United States Patent 11,369,692 (MATERIALS AND METHODS FOR TREATMENT OF DUCHENNE MUSCULAR DYSTROPHY) - sequence listing, part 12

SEQ ID NO: 376276 - DNA, 20 bp, Artificial Sequence
  chemically synthesized
ataatacaagtcgaaaaagt

SEQ ID NO: 376277 - DNA, 20 bp, Artificial Sequence
  chemically synthesized
cgaaaaagttggtatgccca

SEQ ID NO: 376278 - DNA, 20 bp, Artificial Sequence
  chemically synthesized
gaaaaagttggtatgcccaa

SEQ ID NO: 376279 - DNA, 20 bp, Artificial Sequence
  chemically synthesized
caaaatccagataagccttt

SEQ ID NO: 376280 - DNA, 20 bp, Artificial Sequence
  chemically synthesized
acaaaatccagataagcctt

SEQ ID NO: 376281 - DNA, 20 bp, Artificial Sequence
  chemically synthesized
ggtatgcccaaaggcttatc

SEQ ID NO: 376282 - DNA, 20 bp, Artificial Sequence
  chemically synthesized
aatgaatacaaaatccagat

SEQ ID NO: 376283 - DNA, 20 bp, Artificial Sequence
  chemically synthesized
gaaaaaatgaatacaaaatc

SEQ ID NO: 376284 - DNA, 20 bp, Artificial Sequence
  chemically synthesized
tattcattttttccattttg

SEQ ID NO: 376285 - DNA, 20 bp, Artificial Sequence
  chemically synthesized
acttgttttgaacttcaaaa

SEQ ID NO: 376286 - DNA, 20 bp, Artificial Sequence
  chemically synthesized
tccattttgaagttcaaaac

SEQ ID NO: 376287 - DNA, 20 bp, Artificial Sequence
  chemically synthesized
gattgcagagaataaagaaa

SEQ ID NO: 376288 - DNA, 20 bp, Artificial Sequence
  chemically synthesized
tgtattgattgcagagaata

SEQ ID NO: 376289 - DNA, 20 bp, Artificial Sequence
  chemically synthesized
cacattttgtattgattgca

SEQ ID NO: 376290 - DNA, 20 bp, Artificial Sequence
  chemically synthesized
cacacattttgtattgattg

SEQ ID NO: 376291 - DNA, 20 bp, Artificial Sequence
  chemically synthesized
aaatgtgtgttcatactatt

SEQ ID NO: 376292 - DNA, 20 bp, Artificial Sequence
  chemically synthesized
tgtgtgttcatactattaag

SEQ ID NO: 376293 - DNA, 20 bp, Artificial Sequence
  chemically synthesized
tgtgttcatactattaagaa

SEQ ID NO: 376294 - DNA, 20 bp, Artificial Sequence
  chemically synthesized
aacagtcatgctcttcttaa

SEQ ID NO: 376295 - DNA, 20 bp, Artificial Sequence
  chemically synthesized
ttaagaagagcatgactgtt

SEQ ID NO: 376296 - DNA, 20 bp, Artificial Sequence
  chemically synthesized
agaagagcatgactgttaag

SEQ ID NO: 376297 - DNA, 20 bp, Artificial Sequence
  chemically synthesized
attgaactaaggcttcttaa

SEQ ID NO: 376298 - DNA, 20 bp, Artificial Sequence
  chemically synthesized
gcatgactgttaagaagcct

SEQ ID NO: 376299 - DNA, 20 bp, Artificial Sequence
  chemically synthesized
tctactaatccattgaacta

SEQ ID NO: 376300 - DNA, 20 bp, Artificial Sequence
  chemically synthesized
gttaagaagccttagttcaa

SEQ ID NO: 376301 - DNA, 20 bp, Artificial Sequence
  chemically synthesized
gtctactaatccattgaact

SEQ ID NO: 376302 - DNA, 20 bp, Artificial Sequence
  chemically synthesized
gaagccttagttcaatggat

SEQ ID NO: 376303 - DNA, 20 bp, Artificial Sequence
  chemically synthesized
gccttagttcaatggattag

SEQ ID NO: 376304 - DNA, 20 bp, Artificial Sequence
  chemically synthesized
gggaagactaattaaaaaaa

SEQ ID NO: 376305 - DNA, 20 bp, Artificial Sequence
  chemically synthesized
tagacaaccatttttttaat

SEQ ID NO: 376306 - DNA, 20 bp, Artificial Sequence
  chemically synthesized
ggagaaaagttcagaggggg

SEQ ID NO: 376307 - DNA, 20 bp, Artificial Sequence
  chemically synthesized
agtggagaaaagttcagagg

SEQ ID NO: 376308 - DNA, 20 bp, Artificial Sequence
  chemically synthesized
aagtggagaaaagttcagag

SEQ ID NO: 376309 - DNA, 20 bp, Artificial Sequence
  chemically synthesized
aaagtggagaaaagttcaga

SEQ ID NO: 376310 - DNA, 20 bp, Artificial Sequence
  chemically synthesized
gaaagtggagaaaagttcag

SEQ ID NO: 376311 - DNA, 20 bp, Artificial Sequence
  chemically synthesized
ggaaagtggagaaaagttca

SEQ ID NO: 376312 - DNA, 20 bp, Artificial Sequence
  chemically synthesized
gcggaaagtggagaaaagtt

SEQ ID NO: 376313 - DNA, 20 bp, Artificial Sequence
  chemically synthesized
ttgctgcggaaagtggagaa

SEQ ID NO: 376314 - DNA, 20 bp, Artificial Sequence
  chemically synthesized
tccatttgctgcggaaagtg

SEQ ID NO: 376315 - DNA, 20 bp, Artificial Sequence
  chemically synthesized
gaacttttctccactttccg

SEQ ID NO: 376316 - DNA, 20 bp, Artificial Sequence
  chemically synthesized
tttccatttgctgcggaaag

SEQ ID NO: 376317 - DNA, 20 bp, Artificial Sequence
  chemically synthesized
acgtttccatttgctgcgga

SEQ ID NO: 376318 - DNA, 20 bp, Artificial Sequence
  chemically synthesized
tctccactttccgcagcaaa

SEQ ID NO: 376319 - DNA, 20 bp, Artificial Sequence
  chemically synthesized
cattacgtttccatttgctg

SEQ ID NO: 376320 - DNA, 20 bp, Artificial Sequence
  chemically synthesized
gcagcaaatggaaacgtaat

SEQ ID NO: 376321 - DNA, 20 bp, Artificial Sequence
  chemically synthesized
gaaacgtaatgagaatctca

SEQ ID NO: 376322 - DNA, 20 bp, Artificial Sequence
  chemically synthesized
ttattttggcagaatactat

SEQ ID NO: 376323 - DNA, 20 bp, Artificial Sequence
  chemically synthesized
tgacatcccctttattttgg

SEQ ID NO: 376324 - DNA, 20 bp, Artificial Sequence
  chemically synthesized
catagtattctgccaaaata

SEQ ID NO: 376325 - DNA, 20 bp, Artificial Sequence
  chemically synthesized
atagtattctgccaaaataa

SEQ ID NO: 376326 - DNA, 20 bp, Artificial Sequence
  chemically synthesized
tagtattctgccaaaataaa

SEQ ID NO: 376327 - DNA, 20 bp, Artificial Sequence
  chemically synthesized
gcctgacatcccctttattt

SEQ ID NO: 376328 - DNA, 20 bp, Artificial Sequence
  chemically synthesized
agtattctgccaaaataaag

SEQ ID NO: 376329 - DNA, 20 bp, Artificial Sequence
  chemically synthesized
tgccaaaataaaggggatgt

SEQ ID NO: 376330 - DNA, 20 bp, Artificial Sequence
  chemically synthesized
gccaaaataaaggggatgtc

SEQ ID NO: 376331 - DNA, 20 bp, Artificial Sequence
  chemically synthesized
aaaggggatgtcaggcaata

SEQ ID NO: 376332 - DNA, 20 bp, Artificial Sequence
  chemically synthesized
taaagcatatccttgctaaa

SEQ ID NO: 376333 - DNA, 20 bp, Artificial Sequence
  chemically synthesized
atttgtgatgctatttagca

SEQ ID NO: 376334 - DNA, 20 bp, Artificial Sequence
  chemically synthesized
gatttgtgatgctatttagc

SEQ ID NO: 376335 - DNA, 20 bp, Artificial Sequence
  chemically synthesized
atgggatttgtgatgctatt

SEQ ID NO: 376336 - DNA, 20 bp, Artificial Sequence
  chemically synthesized
agcatcacaaatcccatatg

SEQ ID NO: 376337 - DNA, 20 bp, Artificial Sequence
  chemically synthesized
aaaatgataattctacatat

SEQ ID NO: 376338 - DNA, 20 bp, Artificial Sequence
  chemically synthesized
taaaatgataattctacata

SEQ ID NO: 376339 - DNA, 20 bp, Artificial Sequence
  chemically synthesized
agaattatcattttattttt

SEQ ID NO: 376340 - DNA, 20 bp, Artificial Sequence
  chemically synthesized
aattatcattttatttttaa

SEQ ID NO: 376341 - DNA, 20 bp, Artificial Sequence
  chemically synthesized
ttaagagttttttccaccaa

SEQ ID NO: 376342 - DNA, 20 bp, Artificial Sequence
  chemically synthesized
attttattcttggcttttgg

SEQ ID NO: 376343 - DNA, 20 bp, Artificial Sequence
  chemically synthesized
agttttttccaccaaaagcc

SEQ ID NO: 376344 - DNA, 20 bp, Artificial Sequence
  chemically synthesized
gcaattttattcttggcttt

SEQ ID NO: 376345 - DNA, 20 bp, Artificial Sequence
  chemically synthesized
cttcaaagcaattttattct

SEQ ID NO: 376346 - DNA, 20 bp, Artificial Sequence
  chemically synthesized
ccaagaataaaattgctttg

SEQ ID NO: 376347 - DNA, 20 bp, Artificial Sequence
  chemically synthesized
caagaataaaattgctttga

SEQ ID NO: 376348 - DNA, 20 bp, Artificial Sequence
  chemically synthesized
catttaacaattatccttca

SEQ ID NO: 376349 - DNA, 20 bp, Artificial Sequence
  chemically synthesized
tttgaaggataattgttaaa

SEQ ID NO: 376350 - DNA, 20 bp, Artificial Sequence
  chemically synthesized
attgttaaatggttatgctt

SEQ ID NO: 376351 - DNA, 20 bp, Artificial Sequence
  chemically synthesized
gaggctcaaatatagagcca

SEQ ID NO: 376352 - DNA, 20 bp, Artificial Sequence
  chemically synthesized
tatgctttggctctatattt

SEQ ID NO: 376353 - DNA, 20 bp, Artificial Sequence
  chemically synthesized
tacgtggaggctcaaatata

SEQ ID NO: 376354 - DNA, 20 bp, Artificial Sequence
  chemically synthesized
cttacgtggaggctcaaata

SEQ ID NO: 376355 - DNA, 20 bp, Artificial Sequence
  chemically synthesized
ctatatttgagcctccacgt

SEQ ID NO: 376356 - DNA, 20 bp, Artificial Sequence
  chemically synthesized
ttaattaaagacttacgtgg

SEQ ID NO: 376357 - DNA, 20 bp, Artificial Sequence
  chemically synthesized
attaattaaagacttacgtg

SEQ ID NO: 376358 - DNA, 20 bp, Artificial Sequence
  chemically synthesized
ttattaattaaagacttacg

SEQ ID NO: 376359 - DNA, 20 bp, Artificial Sequence
  chemically synthesized
atagcacaaattattaatta

SEQ ID NO: 376360 - DNA, 20 bp, Artificial Sequence
  chemically synthesized
ttaattaataatttgtgcta

SEQ ID NO: 376361 - DNA, 20 bp, Artificial Sequence
  chemically synthesized
tctcatcagaacacggtcca

SEQ ID NO: 376362 - DNA, 20 bp, Artificial Sequence
  chemically synthesized
caaaacatctcatcagaaca

SEQ ID NO: 376363 - DNA, 20 bp, Artificial Sequence
  chemically synthesized
gctatggaccgtgttctgat

SEQ ID NO: 376364 - DNA, 20 bp, Artificial Sequence
  chemically synthesized
tccttagcaaaacatctcat

SEQ ID NO: 376365 - DNA, 20 bp, Artificial Sequence
  chemically synthesized
ttctgatgagatgttttgct

SEQ ID NO: 376366 - DNA, 20 bp, Artificial Sequence
  chemically synthesized
tctgatgagatgttttgcta

SEQ ID NO: 376367 - DNA, 20 bp, Artificial Sequence
  chemically synthesized
tgatgagatgttttgctaag

SEQ ID NO: 376368 - DNA, 20 bp, Artificial Sequence
  chemically synthesized
gggaagggagcatatctcct

SEQ ID NO: 376369 - DNA, 20 bp, Artificial Sequence
  chemically synthesized
tgggtggcagtaagggaagg

SEQ ID NO: 376370 - DNA, 20 bp, Artificial Sequence
  chemically synthesized
tgtgggtggcagtaagggaa

SEQ ID NO: 376371 - DNA, 20 bp, Artificial Sequence
  chemically synthesized
ttgtgggtggcagtaaggga

SEQ ID NO: 376372 - DNA, 20 bp, Artificial Sequence
  chemically synthesized
cttgtgggtggcagtaaggg

SEQ ID NO: 376373 - DNA, 20 bp, Artificial Sequence
  chemically synthesized
actcttgtgggtggcagtaa

SEQ ID NO: 376374 - DNA, 20 bp, Artificial Sequence
  chemically synthesized
tactcttgtgggtggcagta

SEQ ID NO: 376375 - DNA, 20 bp, Artificial Sequence
  chemically synthesized
ttactcttgtgggtggcagt

SEQ ID NO: 376376 - DNA, 20 bp, Artificial Sequence
  chemically synthesized
ttatttactcttgtgggtgg

SEQ ID NO: 376377 - DNA, 20 bp, Artificial Sequence
  chemically synthesized
cttcccttactgccacccac

SEQ ID NO: 376378 - DNA, 20 bp, Artificial Sequence
  chemically synthesized
tcccttactgccacccacaa

SEQ ID NO: 376379 - DNA, 20 bp, Artificial Sequence
  chemically synthesized
cttttatttactcttgtggg

SEQ ID NO: 376380 - DNA, 20 bp, Artificial Sequence
  chemically synthesized
ttgcttttatttactcttgt

SEQ ID NO: 376381 - DNA, 20 bp, Artificial Sequence
  chemically synthesized
cttgcttttatttactcttg

SEQ ID NO: 376382 - DNA, 20 bp, Artificial Sequence
  chemically synthesized
ccacccacaagagtaaataa

SEQ ID NO: 376383 - DNA, 20 bp, Artificial Sequence
  chemically synthesized
ccacaagagtaaataaaagc

SEQ ID NO: 376384 - DNA, 20 bp, Artificial Sequence
  chemically synthesized
agtaaataaaagcaagacac

SEQ ID NO: 376385 - DNA, 20 bp, Artificial Sequence
  chemically synthesized
aaagcaagacactggcgttt

SEQ ID NO: 376386 - DNA, 20 bp, Artificial Sequence
  chemically synthesized
cagtttgacttccaaaacgc

SEQ ID NO: 376387 - DNA, 20 bp, Artificial Sequence
  chemically synthesized
gcaagacactggcgttttgg

SEQ ID NO: 376388 - DNA, 20 bp, Artificial Sequence
  chemically synthesized
tggcgttttggaagtcaaac

SEQ ID NO: 376389 - DNA, 20 bp, Artificial Sequence
  chemically synthesized
ggcgttttggaagtcaaact

SEQ ID NO: 376390 - DNA, 20 bp, Artificial Sequence
  chemically synthesized
caggaacttcttcagaatcc

SEQ ID NO: 376391 - DNA, 20 bp, Artificial Sequence
  chemically synthesized
gaagtcaaactgggattctg

SEQ ID NO: 376392 - DNA, 20 bp, Artificial Sequence
  chemically synthesized
gtcaaactgggattctgaag

SEQ ID NO: 376393 - DNA, 20 bp, Artificial Sequence
  chemically synthesized
tcagagcccaggaacttctt

SEQ ID NO: 376394 - DNA, 20 bp, Artificial Sequence
  chemically synthesized
tgggattctgaagaagttcc

SEQ ID NO: 376395 - DNA, 20 bp, Artificial Sequence
  chemically synthesized
gggattctgaagaagttcct

SEQ ID NO: 376396 - DNA, 20 bp, Artificial Sequence
  chemically synthesized
tgaagaagttcctgggctct

SEQ ID NO: 376397 - DNA, 20 bp, Artificial Sequence
  chemically synthesized
tagcatgatactcagagccc

SEQ ID NO: 376398 - DNA, 20 bp, Artificial Sequence
  chemically synthesized
gtagcatgatactcagagcc

SEQ ID NO: 376399 - DNA, 20 bp, Artificial Sequence
  chemically synthesized
actgtgtagcatgatactca

SEQ ID NO: 376400 - DNA, 20 bp, Artificial Sequence
  chemically synthesized
ctactgtgtagcatgatact

SEQ ID NO: 376401 - DNA, 20 bp, Artificial Sequence
  chemically synthesized
gctctgagtatcatgctaca

SEQ ID NO: 376402 - DNA, 20 bp, Artificial Sequence
  chemically synthesized
ctgagtatcatgctacacag

SEQ ID NO: 376403 - DNA, 20 bp, Artificial Sequence
  chemically synthesized
gagtatcatgctacacagta

SEQ ID NO: 376404 - DNA, 20 bp, Artificial Sequence
  chemically synthesized
ggaagtgactctctactgtg

SEQ ID NO: 376405 - DNA, 20 bp, Artificial Sequence
  chemically synthesized
gtatcatgctacacagtaga

SEQ ID NO: 376406 - DNA, 20 bp, Artificial Sequence
  chemically synthesized
ttagatattagagaggcagg

SEQ ID NO: 376407 - DNA, 20 bp, Artificial Sequence
  chemically synthesized
gttttagatattagagaggc

SEQ ID NO: 376408 - DNA, 20 bp, Artificial Sequence
  chemically synthesized
tgttttagatattagagagg

SEQ ID NO: 376409 - DNA, 20 bp, Artificial Sequence
  chemically synthesized
ttttgttttagatattagag

SEQ ID NO: 376410 - DNA, 20 bp, Artificial Sequence
  chemically synthesized
cttttgttttagatattaga

SEQ ID NO: 376411 - DNA, 20 bp, Artificial Sequence
  chemically synthesized
atcttttgttttagatatta

SEQ ID NO: 376412 - DNA, 20 bp, Artificial Sequence
  chemically synthesized
aaatcttttgttttagatat

SEQ ID NO: 376413 - DNA, 20 bp, Artificial Sequence
  chemically synthesized
ctctctaatatctaaaacaa

SEQ ID NO: 376414 - DNA, 20 bp, Artificial Sequence
  chemically synthesized
ccagttcaaatcttttgttt

SEQ ID NO: 376415 - DNA, 20 bp, Artificial Sequence
  chemically synthesized
ctaaaacaaaagatttgaac

SEQ ID NO: 376416 - DNA, 20 bp, Artificial Sequence
  chemically synthesized
aaacaaaagatttgaactgg

SEQ ID NO: 376417 - DNA, 20 bp, Artificial Sequence
  chemically synthesized
tgaattagatcaatggctac

SEQ ID NO: 376418 - DNA, 20 bp, Artificial Sequence
  chemically synthesized
tcaggcctgaattagatcaa

SEQ ID NO: 376419 - DNA, 20 bp, Artificial Sequence
  chemically synthesized
tggtagccattgatctaatt

SEQ ID NO: 376420 - DNA, 20 bp, Artificial Sequence
  chemically synthesized
ggtagccattgatctaattc

SEQ ID NO: 376421 - DNA, 20 bp, Artificial Sequence
  chemically synthesized
aatgtatctcaggcctgaat

SEQ ID NO: 376422 - DNA, 20 bp, Artificial Sequence
  chemically synthesized
cattgatctaattcaggcct

SEQ ID NO: 376423 - DNA, 20 bp, Artificial Sequence
  chemically synthesized
aaactagccaaatgtatctc

SEQ ID NO: 376424 - DNA, 20 bp, Artificial Sequence
  chemically synthesized
caaactagccaaatgtatct

SEQ ID NO: 376425 - DNA, 20 bp, Artificial Sequence
  chemically synthesized
attcaggcctgagatacatt

SEQ ID NO: 376426 - DNA, 20 bp, Artificial Sequence
  chemically synthesized
aggcctgagatacatttggc

SEQ ID NO: 376427 - DNA, 20 bp, Artificial Sequence
  chemically synthesized
taacctgtcctgtatcaaac

SEQ ID NO: 376428 - DNA, 20 bp, Artificial Sequence
  chemically synthesized
tacatttggctagtttgata

SEQ ID NO: 376429 - DNA, 20 bp, Artificial Sequence
  chemically synthesized
acatttggctagtttgatac

SEQ ID NO: 376430 - DNA, 20 bp, Artificial Sequence
  chemically synthesized
ttggctagtttgatacagga

SEQ ID NO: 376431 - DNA, 20 bp, Artificial Sequence
  chemically synthesized
tggctagtttgatacaggac

SEQ ID NO: 376432 - DNA, 20 bp, Artificial Sequence
  chemically synthesized
agtttgatacaggacaggtt

SEQ ID NO: 376433 - DNA, 20 bp, Artificial Sequence
  chemically synthesized
gacaggttaagccccaaaat

SEQ ID NO: 376434 - DNA, 20 bp, Artificial Sequence
  chemically synthesized
acaggttaagccccaaaatc

SEQ ID NO: 376435 - DNA, 20 bp, Artificial Sequence
  chemically synthesized
caggccaagccctgattttg

SEQ ID NO: 376436 - DNA, 20 bp, Artificial Sequence
  chemically synthesized
caggttaagccccaaaatca

SEQ ID NO: 376437 - DNA, 20 bp, Artificial Sequence
  chemically synthesized
ccaggccaagccctgatttt

SEQ ID NO: 376438 - DNA, 20 bp, Artificial Sequence
  chemically synthesized
cccaggccaagccctgattt

SEQ ID NO: 376439 - DNA, 20 bp, Artificial Sequence
  chemically synthesized
taagccccaaaatcagggct

SEQ ID NO: 376440 - DNA, 20 bp, Artificial Sequence
  chemically synthesized
cccaaaatcagggcttggcc

SEQ ID NO: 376441 - DNA, 20 bp, Artificial Sequence
  chemically synthesized
ccaaaatcagggcttggcct

SEQ ID NO: 376442 - DNA, 20 bp, Artificial Sequence
  chemically synthesized
aaaatcagggcttggcctgg

SEQ ID NO: 376443 - DNA, 20 bp, Artificial Sequence
  chemically synthesized
gccaagaatcctcccaggcc

SEQ ID NO: 376444 - DNA, 20 bp, Artificial Sequence
  chemically synthesized
aaatcagggcttggcctggg

SEQ ID NO: 376445 - DNA, 20 bp, Artificial Sequence
  chemically synthesized
gcaaagccaagaatcctccc

SEQ ID NO: 376446 - DNA, 20 bp, Artificial Sequence
  chemically synthesized
ggcaaagccaagaatcctcc

SEQ ID NO: 376447 - DNA, 20 bp, Artificial Sequence
  chemically synthesized
gcttggcctgggaggattct

SEQ ID NO: 376448 - DNA, 20 bp, Artificial Sequence
  chemically synthesized
attctttcctaggcaaagcc

SEQ ID NO: 376449 - DNA, 20 bp, Artificial Sequence
  chemically synthesized
ggaggattcttggctttgcc

SEQ ID NO: 376450 - DNA, 20 bp, Artificial Sequence
  chemically synthesized
gaggattcttggctttgcct

SEQ ID NO: 376451 - DNA, 20 bp, Artificial Sequence
  chemically synthesized
cttgaattctttcctaggca

SEQ ID NO: 376452 - DNA, 20 bp, Artificial Sequence
  chemically synthesized
attcttggctttgcctagga

SEQ ID NO: 376453 - DNA, 20 bp, Artificial Sequence
  chemically synthesized
tcgcccttgaattctttcct

SEQ ID NO: 376454 - DNA, 20 bp, Artificial Sequence
  chemically synthesized
ctcgcccttgaattctttcc

SEQ ID NO: 376455 - DNA, 20 bp, Artificial Sequence
  chemically synthesized
ctttgcctaggaaagaattc

SEQ ID NO: 376456 - DNA, 20 bp, Artificial Sequence
  chemically synthesized
tttgcctaggaaagaattca

SEQ ID NO: 376457 - DNA, 20 bp, Artificial Sequence
  chemically synthesized
ttgcctaggaaagaattcaa

SEQ ID NO: 376458 - DNA, 20 bp, Artificial Sequence
  chemically synthesized
ctaggaaagaattcaagggc

SEQ ID NO: 376459 - DNA, 20 bp, Artificial Sequence
  chemically synthesized
gaaagaattcaagggcgagc

SEQ ID NO: 376460 - DNA, 20 bp, Artificial Sequence
  chemically synthesized
agaattcaagggcgagccag

SEQ ID NO: 376461 - DNA, 20 bp, Artificial Sequence
  chemically synthesized
acatagctgtttaacgccac

SEQ ID NO: 376462 - DNA, 20 bp, Artificial Sequence
  chemically synthesized
ggcgagccagtggcgttaaa

SEQ ID NO: 376463 - DNA, 20 bp, Artificial Sequence
  chemically synthesized
ggcgttaaacagctatgttt

SEQ ID NO: 376464 - DNA, 20 bp, Artificial Sequence
  chemically synthesized
cagtaatgttcactaaaaca

SEQ ID NO: 376465 - DNA, 20 bp, Artificial Sequence
  chemically synthesized
tgtccctatttcacaaagcg

SEQ ID NO: 376466 - DNA, 20 bp, Artificial Sequence
  chemically synthesized
cattactgcgctttgtgaaa

SEQ ID NO: 376467 - DNA, 20 bp, Artificial Sequence
  chemically synthesized
tgagttgtccctatttcaca

SEQ ID NO: 376468 - DNA, 20 bp, Artificial Sequence
  chemically synthesized
attactgcgctttgtgaaat

SEQ ID NO: 376469 - DNA, 20 bp, Artificial Sequence
  chemically synthesized
ttactgcgctttgtgaaata

SEQ ID NO: 376470 - DNA, 20 bp, Artificial Sequence
  chemically synthesized
tgtgaaatagggacaactca

SEQ ID NO: 376471 - DNA, 20 bp, Artificial Sequence
  chemically synthesized
gtgaaatagggacaactcat

SEQ ID NO: 376472 - DNA, 20 bp, Artificial Sequence
  chemically synthesized
aaatagggacaactcatagg

SEQ ID NO: 376473 - DNA, 20 bp, Artificial Sequence
  chemically synthesized
actttggaggcactgcctat

SEQ ID NO: 376474 - DNA, 20 bp, Artificial Sequence
  chemically synthesized
actcataggcagtgcctcca

SEQ ID NO: 376475 - DNA, 20 bp, Artificial Sequence
  chemically synthesized
ataggcagtgcctccaaagt

SEQ ID NO: 376476 - DNA, 20 bp, Artificial Sequence
  chemically synthesized
ccataccctgccaactttgg

SEQ ID NO: 376477 - DNA, 20 bp, Artificial Sequence
  chemically synthesized
cccataccctgccaactttg

SEQ ID NO: 376478 - DNA, 20 bp, Artificial Sequence
  chemically synthesized
ggcagtgcctccaaagttgg

SEQ ID NO: 376479 - DNA, 20 bp, Artificial Sequence
  chemically synthesized
agcccataccctgccaactt

SEQ ID NO: 376480 - DNA, 20 bp, Artificial Sequence
  chemically synthesized
gcagtgcctccaaagttggc

SEQ ID NO: 376481 - DNA, 20 bp, Artificial Sequence
  chemically synthesized
cagtgcctccaaagttggca

SEQ ID NO: 376482 - DNA, 20 bp, Artificial Sequence
  chemically synthesized
cctccaaagttggcagggta

SEQ ID NO: 376483 - DNA, 20 bp, Artificial Sequence
  chemically synthesized
ctccaaagttggcagggtat

SEQ ID NO: 376484 - DNA, 20 bp, Artificial Sequence
  chemically synthesized
gttggcagggtatgggctgc

SEQ ID NO: 376485 - DNA, 20 bp, Artificial Sequence
  chemically synthesized
gatataaatacagtagccag

SEQ ID NO: 376486 - DNA, 20 bp, Artificial Sequence
  chemically synthesized
atggatataaatacagtagc

SEQ ID NO: 376487 - DNA, 20 bp, Artificial Sequence
  chemically synthesized
ataaatggatataaatacag

SEQ ID NO: 376488 - DNA, 20 bp, Artificial Sequence
  chemically synthesized
ggtataaatggatataaata

SEQ ID NO: 376489 - DNA, 20 bp, Artificial Sequence
  chemically synthesized
taattgaaagtgggtataaa

SEQ ID NO: 376490 - DNA, 20 bp, Artificial Sequence
  chemically synthesized
atttacatgtaattgaaagt

SEQ ID NO: 376491 - DNA, 20 bp, Artificial Sequence
  chemically synthesized
aatttacatgtaattgaaag

SEQ ID NO: 376492 - DNA, 20 bp, Artificial Sequence
  chemically synthesized
cttaatttacatgtaattga

SEQ ID NO: 376493 - DNA, 20 bp, Artificial Sequence
  chemically synthesized
ctttcaattacatgtaaatt

SEQ ID NO: 376494 - DNA, 20 bp, Artificial Sequence
  chemically synthesized
tcaattacatgtaaattaag

SEQ ID NO: 376495 - DNA, 20 bp, Artificial Sequence
  chemically synthesized
attacatgtaaattaagtgg

SEQ ID NO: 376496 - DNA, 20 bp, Artificial Sequence
  chemically synthesized
gtggcagattaatgcaaatt

SEQ ID NO: 376497 - DNA, 20 bp, Artificial Sequence
  chemically synthesized
ggcagattaatgcaaattga

SEQ ID NO: 376498 - DNA, 20 bp, Artificial Sequence
  chemically synthesized
gattaatgcaaattgagaga

SEQ ID NO: 376499 - DNA, 20 bp, Artificial Sequence
  chemically synthesized
attaatgcaaattgagagac

SEQ ID NO: 376500 - DNA, 20 bp, Artificial Sequence
  chemically synthesized
aaattgagagacaggttatt

SEQ ID NO: 376501 - DNA, 20 bp, Artificial Sequence
  chemically synthesized
acaggttatttagaactttc

SEQ ID NO: 376502 - DNA, 20 bp, Artificial Sequence
  chemically synthesized
caggttatttagaactttct

SEQ ID NO: 376503 - DNA, 20 bp, Artificial Sequence
  chemically synthesized
ttatttagaactttctagga

SEQ ID NO: 376504 - DNA, 20 bp, Artificial Sequence
  chemically synthesized
gttaccacccctttcctaga

SEQ ID NO: 376505 - DNA, 20 bp, Artificial Sequence
  chemically synthesized
tatttagaactttctaggaa

SEQ ID NO: 376506 - DNA, 20 bp, Artificial Sequence
  chemically synthesized
atttagaactttctaggaaa

SEQ ID NO: 376507 - DNA, 20 bp, Artificial Sequence
  chemically synthesized
tttagaactttctaggaaag

SEQ ID NO: 376508 - DNA, 20 bp, Artificial Sequence
  chemically synthesized
agaagttaccacccctttcc

SEQ ID NO: 376509 - DNA, 20 bp, Artificial Sequence
  chemically synthesized
agaactttctaggaaagggg

SEQ ID NO: 376510 - DNA, 20 bp, Artificial Sequence
  chemically synthesized
aggaaaggggtggtaacttc

SEQ ID NO: 376511 - DNA, 20 bp, Artificial Sequence
  chemically synthesized
ggaaaggggtggtaacttct

SEQ ID NO: 376512 - DNA, 20 bp, Artificial Sequence
  chemically synthesized
aggacatggcaataacccag

SEQ ID NO: 376513 - DNA, 20 bp, Artificial Sequence
  chemically synthesized
caaaggacatggcaataacc

SEQ ID NO: 376514 - DNA, 20 bp, Artificial Sequence
  chemically synthesized
atgacagtttacaaaggaca

SEQ ID NO: 376515 - DNA, 20 bp, Artificial Sequence
  chemically synthesized
agcaccatgacagtttacaa

SEQ ID NO: 376516 - DNA, 20 bp, Artificial Sequence
  chemically synthesized
cagcaccatgacagtttaca

SEQ ID NO: 376517 - DNA, 20 bp, Artificial Sequence
  chemically synthesized
atgtcctttgtaaactgtca

SEQ ID NO: 376518 - DNA, 20 bp, Artificial Sequence
  chemically synthesized
cactcccaccagcaccatga

SEQ ID NO: 376519 - DNA, 20 bp, Artificial Sequence
  chemically synthesized
tttgtaaactgtcatggtgc

SEQ ID NO: 376520 - DNA, 20 bp, Artificial Sequence
  chemically synthesized
gtaaactgtcatggtgctgg

SEQ ID NO: 376521 - DNA, 20 bp, Artificial Sequence
  chemically synthesized
taaactgtcatggtgctggt

SEQ ID NO: 376522 - DNA, 20 bp, Artificial Sequence
  chemically synthesized
aactgtcatggtgctggtgg

SEQ ID NO: 376523 - DNA, 20 bp, Artificial Sequence
  chemically synthesized
tgtcatggtgctggtgggag

SEQ ID NO: 376524 - DNA, 20 bp, Artificial Sequence
  chemically synthesized
ttagcagaagccactcccac

SEQ ID NO: 376525 - DNA, 20 bp, Artificial Sequence
  chemically synthesized
ccctcattgcatattagcag

SEQ ID NO: 376526 - DNA, 20 bp, Artificial Sequence
  chemically synthesized
cagccctcattgcatattag

SEQ ID NO: 376527 - DNA, 20 bp, Artificial Sequence
  chemically synthesized
cagcagccctcattgcatat

SEQ ID NO: 376528 - DNA, 20 bp, Artificial Sequence
  chemically synthesized
ggcttctgctaatatgcaat

SEQ ID NO: 376529 - DNA, 20 bp, Artificial Sequence
  chemically synthesized
gcttctgctaatatgcaatg

SEQ ID NO: 376530 - DNA, 20 bp, Artificial Sequence
  chemically synthesized
cttctgctaatatgcaatga

SEQ ID NO: 376531 - DNA, 20 bp, Artificial Sequence
  chemically synthesized
taatatgcaatgagggctgc

SEQ ID NO: 376532 - DNA, 20 bp, Artificial Sequence
  chemically synthesized
aatatgcaatgagggctgct

SEQ ID NO: 376533 - DNA, 20 bp, Artificial Sequence
  chemically synthesized
atatgcaatgagggctgctg

SEQ ID NO: 376534 - DNA, 20 bp, Artificial Sequence
  chemically synthesized
gcaacaaaagtgatccccag

SEQ ID NO: 376535 - DNA, 20 bp, Artificial Sequence
  chemically synthesized
atggcaacaaaagtgatccc

SEQ ID NO: 376536 - DNA, 20 bp, Artificial Sequence
  chemically synthesized
aaaccagcagatggcaacaa

SEQ ID NO: 376537 - DNA, 20 bp, Artificial Sequence
  chemically synthesized
tcacttttgttgccatctgc

SEQ ID NO: 376538 - DNA, 20 bp, Artificial Sequence
  chemically synthesized
aaacagcagaaaccagcaga

SEQ ID NO: 376539 - DNA, 20 bp, Artificial Sequence
  chemically synthesized
agaaaaacagcagaaaccag

SEQ ID NO: 376540 - DNA, 20 bp, Artificial Sequence
  chemically synthesized
gtgagaaaaacagcagaaac

SEQ ID NO: 376541 - DNA, 20 bp, Artificial Sequence
  chemically synthesized
aacggaagtgagaaaaacag

SEQ ID NO: 376542 - DNA, 20 bp, Artificial Sequence
  chemically synthesized
accaacggaagtgagaaaaa

SEQ ID NO: 376543 - DNA, 20 bp, Artificial Sequence
  chemically synthesized
aggcagcgaccaacggaagt

SEQ ID NO: 376544 - DNA, 20 bp, Artificial Sequence
  chemically synthesized
gctgtttttctcacttccgt

SEQ ID NO: 376545 - DNA, 20 bp, Artificial Sequence
  chemically synthesized
cagcaggcagcgaccaacgg

SEQ ID NO: 376546 - DNA, 20 bp, Artificial Sequence
  chemically synthesized
taccagcaggcagcgaccaa

SEQ ID NO: 376547 - DNA, 20 bp, Artificial Sequence
  chemically synthesized
ttccgttggtcgctgcctgc

SEQ ID NO: 376548 - DNA, 20 bp, Artificial Sequence
  chemically synthesized
aactggcaggtaccagcagg

SEQ ID NO: 376549 - DNA, 20 bp, Artificial Sequence
  chemically synthesized
agaaactggcaggtaccagc

SEQ ID NO: 376550 - DNA, 20 bp, Artificial Sequence
  chemically synthesized
aagaaactggcaggtaccag

SEQ ID NO: 376551 - DNA, 20 bp, Artificial Sequence
  chemically synthesized
gtgaagaaactggcaggtac

SEQ ID NO: 376552 - DNA, 20 bp, Artificial Sequence
  chemically synthesized
cgctgcctgctggtacctgc

SEQ ID NO: 376553 - DNA, 20 bp, Artificial Sequence
  chemically synthesized
gataaagtgaagaaactggc

SEQ ID NO: 376554 - DNA, 20 bp, Artificial Sequence
  chemically synthesized
ggataaagtgaagaaactgg

SEQ ID NO: 376555 - DNA, 20 bp, Artificial Sequence
  chemically synthesized
agaggataaagtgaagaaac

SEQ ID NO: 376556 - DNA, 20 bp, Artificial Sequence
  chemically synthesized
cattcccagaggataaagtg

SEQ ID NO: 376557 - DNA, 20 bp, Artificial Sequence
  chemically synthesized
agtttcttcactttatcctc

SEQ ID NO: 376558 - DNA, 20 bp, Artificial Sequence
  chemically synthesized
tttcccattcccagaggata

SEQ ID NO: 376559 - DNA, 20 bp, Artificial Sequence
  chemically synthesized
gtttcttcactttatcctct

SEQ ID NO: 376560 - DNA, 20 bp, Artificial Sequence
  chemically synthesized
ttcactttatcctctgggaa

SEQ ID NO: 376561 - DNA, 20 bp, Artificial Sequence
  chemically synthesized
gacttatttcccattcccag

SEQ ID NO: 376562 - DNA, 20 bp, Artificial Sequence
  chemically synthesized
tcactttatcctctgggaat

SEQ ID NO: 376563 - DNA, 20 bp, Artificial Sequence
  chemically synthesized
ggacttatttcccattccca

SEQ ID NO: 376564 - DNA, 20 bp, Artificial Sequence
  chemically synthesized
caggacttatttcccattcc

SEQ ID NO: 376565 - DNA, 20 bp, Artificial Sequence
  chemically synthesized
atcctctgggaatgggaaat

SEQ ID NO: 376566 - DNA, 20 bp, Artificial Sequence
  chemically synthesized
gcctgaggtaggagttgggc

SEQ ID NO: 376567 - DNA, 20 bp, Artificial Sequence
  chemically synthesized
agcctgaggtaggagttggg

SEQ ID NO: 376568 - DNA, 20 bp, Artificial Sequence
  chemically synthesized
gcaagcctgaggtaggagtt

SEQ ID NO: 376569 - DNA, 20 bp, Artificial Sequence
  chemically synthesized
tgcaagcctgaggtaggagt

SEQ ID NO: 376570 - DNA, 20 bp, Artificial Sequence
  chemically synthesized
gtcctgcccaactcctacct

SEQ ID NO: 376571 - DNA, 20 bp, Artificial Sequence
  chemically synthesized
tcctgcccaactcctacctc

SEQ ID NO: 376572 - DNA, 20 bp, Artificial Sequence
  chemically synthesized
tctgtgcaagcctgaggtag

SEQ ID NO: 376573 - DNA, 20 bp, Artificial Sequence
  chemically synthesized
attctgtgcaagcctgaggt

SEQ ID NO: 376574 - DNA, 20 bp, Artificial Sequence
  chemically synthesized
aattctgtgcaagcctgagg

SEQ ID NO: 376575 - DNA, 20 bp, Artificial Sequence
  chemically synthesized
aaaaattctgtgcaagcctg

SEQ ID NO: 376576 - DNA, 20 bp, Artificial Sequence
  chemically synthesized
taaaaattctgtgcaagcct

SEQ ID NO: 376577 - DNA, 20 bp, Artificial Sequence
  chemically synthesized
actcctacctcaggcttgca

SEQ ID NO: 376578 - DNA, 20 bp, Artificial Sequence
  chemically synthesized
tccaattaaaaattctgtgc

SEQ ID NO: 376579 - DNA, 20 bp, Artificial Sequence
  chemically synthesized
gcttgcacagaatttttaat

SEQ ID NO: 376580 - DNA, 20 bp, Artificial Sequence
  chemically synthesized
ttaattggaaaacctttttc

SEQ ID NO: 376581 - DNA, 20 bp, Artificial Sequence
  chemically synthesized
tttggtgggtaactggaaaa

SEQ ID NO: 376582 - DNA, 20 bp, Artificial Sequence
  chemically synthesized
atttggtgggtaactggaaa

SEQ ID NO: 376583 - DNA, 20 bp, Artificial Sequence
  chemically synthesized
atgtatatttggtgggtaac

SEQ ID NO: 376584 - DNA, 20 bp, Artificial Sequence
  chemically synthesized
ggcagtgatgtatatttggt

SEQ ID NO: 376585 - DNA, 20 bp, Artificial Sequence
  chemically synthesized
aggcagtgatgtatatttgg

SEQ ID NO: 376586 - DNA, 20 bp, Artificial Sequence
  chemically synthesized
agtaggcagtgatgtatatt

SEQ ID NO: 376587 - DNA, 20 bp, Artificial Sequence
  chemically synthesized
agtgcctgatatatagtagg

SEQ ID NO: 376588 - DNA, 20 bp, Artificial Sequence
  chemically synthesized
aacagtgcctgatatatagt

SEQ ID NO: 376589 - DNA, 20 bp, Artificial Sequence
  chemically synthesized
gaacagtgcctgatatatag

SEQ ID NO: 376590 - DNA, 20 bp, Artificial Sequence
  chemically synthesized
catcactgcctactatatat

SEQ ID NO: 376591 - DNA, 20 bp, Artificial Sequence
  chemically synthesized
atcactgcctactatatatc

SEQ ID NO: 376592 - DNA, 20 bp, Artificial Sequence
  chemically synthesized
ttggaacagtgcctgatata

SEQ ID NO: 376593 - DNA, 20 bp, Artificial Sequence
  chemically synthesized
tatatatcaggcactgttcc

SEQ ID NO: 376594 - DNA, 20 bp, Artificial Sequence
  chemically synthesized
tgaatcccaagcacttggaa

SEQ ID NO: 376595 - DNA, 20 bp, Artificial Sequence
  chemically synthesized
caggcactgttccaagtgct

SEQ ID NO: 376596 - DNA, 20 bp, Artificial Sequence
  chemically synthesized
aggcactgttccaagtgctt

SEQ ID NO: 376597 - DNA, 20 bp, Artificial Sequence
  chemically synthesized
actggtgaatcccaagcact

SEQ ID NO: 376598 - DNA, 20 bp, Artificial Sequence
  chemically synthesized
gttgtctactggtgaatccc

SEQ ID NO: 376599 - DNA, 20 bp, Artificial Sequence
  chemically synthesized
tccaagtgcttgggattcac

SEQ ID NO: 376600 - DNA, 20 bp, Artificial Sequence
  chemically synthesized
aagtgcttgggattcaccag

SEQ ID NO: 376601 - DNA, 20 bp, Artificial Sequence
  chemically synthesized
tatgtgtgcatgttgtctac

SEQ ID NO: 376602 - DNA, 20 bp, Artificial Sequence
  chemically synthesized
caacatgcacacataaaaaa

SEQ ID NO: 376603 - DNA, 20 bp, Artificial Sequence
  chemically synthesized
aaaaaaagtgctcaacttat

SEQ ID NO: 376604 - DNA, 20 bp, Artificial Sequence
  chemically synthesized
atatatttgcctcataagtt

SEQ ID NO: 376605 - DNA, 20 bp, Artificial Sequence
  chemically synthesized
aaaaaagtgctcaacttatg

SEQ ID NO: 376606 - DNA, 20 bp, Artificial Sequence
  chemically synthesized
gcactatatatttgcctcat

SEQ ID NO: 376607 - DNA, 20 bp, Artificial Sequence
  chemically synthesized
caacttatgaggcaaatata

SEQ ID NO: 376608 - DNA, 20 bp, Artificial Sequence
  chemically synthesized
gaggcaaatatatagtgcac

SEQ ID NO: 376609 - DNA, 20 bp, Artificial Sequence
  chemically synthesized
aggcaaatatatagtgcact

SEQ ID NO: 376610 - DNA, 20 bp, Artificial Sequence
  chemically synthesized
gagttgtatgtaaaacatcc

SEQ ID NO: 376611 - DNA, 20 bp, Artificial Sequence
  chemically synthesized
ggatgttttacatacaactc

SEQ ID NO: 376612 - DNA, 20 bp, Artificial Sequence
  chemically synthesized
aagaggaacttaagaatctg

SEQ ID NO: 376613 - DNA, 20 bp, Artificial Sequence
  chemically synthesized
acatacaactccagattctt

SEQ ID NO: 376614 - DNA, 20 bp, Artificial Sequence
  chemically synthesized
tcaagaggaacttaagaatc

SEQ ID NO: 376615 - DNA, 20 bp, Artificial Sequence
  chemically synthesized
ttatttttcaagaggaactt

SEQ ID NO: 376616 - DNA, 20 bp, Artificial Sequence
  chemically synthesized
catatattttatttttcaag

SEQ ID NO: 376617 - DNA, 20 bp, Artificial Sequence
  chemically synthesized
ccatatattttatttttcaa

SEQ ID NO: 376618 - DNA, 20 bp, Artificial Sequence
  chemically synthesized
ggccatatattttatttttc

SEQ ID NO: 376619 - DNA, 20 bp, Artificial Sequence
  chemically synthesized
ctcttgaaaaataaaatata

SEQ ID NO: 376620 - DNA, 20 bp, Artificial Sequence
  chemically synthesized
ataaaatatatggccaaaaa

SEQ ID NO: 376621 - DNA, 20 bp, Artificial Sequence
  chemically synthesized
tcagaatgtagagctatttt

SEQ ID NO: 376622 - DNA, 20 bp, Artificial Sequence
  chemically synthesized
agtgtccatgtcagaatgta

SEQ ID NO: 376623 - DNA, 20 bp, Artificial Sequence
  chemically synthesized
gcagtgtccatgtcagaatg

SEQ ID NO: 376624 - DNA, 20 bp, Artificial Sequence
  chemically synthesized
aatagctctacattctgaca

SEQ ID NO: 376625 - DNA, 20 bp, Artificial Sequence
  chemically synthesized
cagtctagcagtgtccatgt

SEQ ID NO: 376626 - DNA, 20 bp, Artificial Sequence
  chemically synthesized
cattctgacatggacactgc

SEQ ID NO: 376627 - DNA, 20 bp, Artificial Sequence
  chemically synthesized
tgctaatcaattcagtctag

SEQ ID NO: 376628 - DNA, 20 bp, Artificial Sequence
  chemically synthesized
aactgctaatcaattcagtc

SEQ ID NO: 376629 - DNA, 20 bp, Artificial Sequence
  chemically synthesized
cactgctagactgaattgat

SEQ ID NO: 376630 - DNA, 20 bp, Artificial Sequence
  chemically synthesized
tgggcaactgctaatcaatt

SEQ ID NO: 376631 - DNA, 20 bp, Artificial Sequence
  chemically synthesized
tgctagactgaattgattag

SEQ ID NO: 376632 - DNA, 20 bp, Artificial Sequence
  chemically synthesized
tgattagcagttgcccattt

SEQ ID NO: 376633 - DNA, 20 bp, Artificial Sequence
  chemically synthesized
gcctgtgcccagtctaaaat

SEQ ID NO: 376634 - DNA, 20 bp, Artificial Sequence
  chemically synthesized
cgcctgtgcccagtctaaaa

SEQ ID NO: 376635 - DNA, 20 bp, Artificial Sequence
  chemically synthesized
agcagttgcccattttagac

SEQ ID NO: 376636 - DNA, 20 bp, Artificial Sequence
  chemically synthesized
gcagttgcccattttagact

SEQ ID NO: 376637 - DNA, 20 bp, Artificial Sequence
  chemically synthesized
tgcccattttagactgggca

SEQ ID NO: 376638 - DNA, 20 bp, Artificial Sequence
  chemically synthesized
gcccattttagactgggcac

SEQ ID NO: 376639 - DNA, 20 bp, Artificial Sequence
  chemically synthesized
gcaaatggcacgcctgtgcc

SEQ ID NO: 376640 - DNA, 20 bp, Artificial Sequence
  chemically synthesized
ggcacaggcgtgccatttgc

SEQ ID NO: 376641 - DNA, 20 bp, Artificial Sequence
  chemically synthesized
ttggaaagaatactggcaaa

SEQ ID NO: 376642 - DNA, 20 bp, Artificial Sequence
  chemically synthesized
gtgtaaattggaaagaatac

SEQ ID NO: 376643 - DNA, 20 bp, Artificial Sequence
  chemically synthesized
cggacattgtgtaaattgga

SEQ ID NO: 376644 - DNA, 20 bp, Artificial Sequence
  chemically synthesized
catacggacattgtgtaaat

SEQ ID NO: 376645 - DNA, 20 bp, Artificial Sequence
  chemically synthesized
agcaaagatctaaatgcata

SEQ ID NO: 376646 - DNA, 20 bp, Artificial Sequence
  chemically synthesized
acacaatgtccgtatgcatt

SEQ ID NO: 376647 - DNA, 20 bp, Artificial Sequence
  chemically synthesized
gaatggaaataggtgaagca

SEQ ID NO: 376648 - DNA, 20 bp, Artificial Sequence
  chemically synthesized
aaagggaatggaaataggtg

SEQ ID NO: 376649 - DNA, 20 bp, Artificial Sequence
  chemically synthesized
acctgaaagggaatggaaat

SEQ ID NO: 376650 - DNA, 20 bp, Artificial Sequence
  chemically synthesized
gacctgaaagggaatggaaa

SEQ ID NO: 376651 - DNA, 20 bp, Artificial Sequence
  chemically synthesized
tgcaaggacctgaaagggaa

SEQ ID NO: 376652 - DNA, 20 bp, Artificial Sequence
  chemically synthesized
cacctatttccattcccttt

SEQ ID NO: 376653 - DNA, 20 bp, Artificial Sequence
  chemically synthesized
acctatttccattccctttc

SEQ ID NO: 376654 - DNA, 20 bp, Artificial Sequence
  chemically synthesized
atacctgcaaggacctgaaa

SEQ ID NO: 376655 - DNA, 20 bp, Artificial Sequence
  chemically synthesized
aatacctgcaaggacctgaa

SEQ ID NO: 376656 - DNA, 20 bp, Artificial Sequence
  chemically synthesized
aaatacctgcaaggacctga

SEQ ID NO: 376657 - DNA, 20 bp, Artificial Sequence
  chemically synthesized
cattccctttcaggtccttg

SEQ ID NO: 376658 - DNA, 20 bp, Artificial Sequence
  chemically synthesized
attccctttcaggtccttgc

SEQ ID NO: 376659 - DNA, 20 bp, Artificial Sequence
  chemically synthesized
ccacaattaaaatacctgca

SEQ ID NO: 376660 - DNA, 20 bp, Artificial Sequence
  chemically synthesized
tccacaattaaaatacctgc

SEQ ID NO: 376661 - DNA, 20 bp, Artificial Sequence
  chemically synthesized
ccttgcaggtattttaattg

SEQ ID NO: 376662 - DNA, 20 bp, Artificial Sequence
  chemically synthesized
ataaaataatacagtgaatg

SEQ ID NO: 376663 - DNA, 20 bp, Artificial Sequence
  chemically synthesized
aaataaaataatacagtgaa

SEQ ID NO: 376664 - DNA, 20 bp, Artificial Sequence
  chemically synthesized
tgaaataaaataaaataata

SEQ ID NO: 376665 - DNA, 20 bp, Artificial Sequence
  chemically synthesized
tgtattattttattttattt

SEQ ID NO: 376666 - DNA, 20 bp, Artificial Sequence
  chemically synthesized
tattttattttatttcagtt

SEQ ID NO: 376667 - DNA, 20 bp, Artificial Sequence
  chemically synthesized
agttcagtttgtatcatttt

SEQ ID NO: 376668 - DNA, 20 bp, Artificial Sequence
  chemically synthesized
tattatactaaattaaaaac

SEQ ID NO: 376669 - DNA, 20 bp, Artificial Sequence
  chemically synthesized
atattatactaaattaaaaa

SEQ ID NO: 376670 - DNA, 20 bp, Artificial Sequence
  chemically synthesized
ttgagttcctgtttttaatt

SEQ ID NO: 376671 - DNA, 20 bp, Artificial Sequence
  chemically synthesized
tttaatttagtataatatca

SEQ ID NO: 376672 - DNA, 20 bp, Artificial Sequence
  chemically synthesized
atttagtataatatcataga

SEQ ID NO: 376673 - DNA, 20 bp, Artificial Sequence
  chemically synthesized
agtgtttgtacttaattcta

SEQ ID NO: 376674 - DNA, 20 bp, Artificial Sequence
  chemically synthesized
ccgcacccggccgtagaatt

SEQ ID NO: 376675 - DNA, 20 bp, Artificial Sequence
  chemically synthesized
tttgtacttaattctacggc

SEQ ID NO: 376676 - DNA, 20 bp, Artificial Sequence
  chemically synthesized
ttgtacttaattctacggcc

SEQ ID NO: 376677 - DNA, 20 bp, Artificial Sequence
  chemically synthesized
tgagccaccgcacccggccg

SEQ ID NO: 376678 - DNA, 20 bp, Artificial Sequence
  chemically synthesized
cttaattctacggccgggtg

SEQ ID NO: 376679 - DNA, 20 bp, Artificial Sequence
  chemically synthesized
aattctacggccgggtgcgg

SEQ ID NO: 376680 - DNA, 20 bp, Artificial Sequence
  chemically synthesized
caggcgtgagccaccgcacc

SEQ ID NO: 376681 - DNA, 20 bp, Artificial Sequence
  chemically synthesized
agtgctgtgattgcaggcgt

SEQ ID NO: 376682 - DNA, 20 bp, Artificial Sequence
  chemically synthesized
gtggctcacgcctgcaatca

SEQ ID NO: 376683 - DNA, 20 bp, Artificial Sequence
  chemically synthesized
tcccaaagtgctgtgattgc

SEQ ID NO: 376684 - DNA, 20 bp, Artificial Sequence
  chemically synthesized
ctcccaaagtgctgtgattg

SEQ ID NO: 376685 - DNA, 20 bp, Artificial Sequence
  chemically synthesized
cgcctgcaatcacagcactt

SEQ ID NO: 376686 - DNA, 20 bp, Artificial Sequence
  chemically synthesized
gcctgcaatcacagcacttt

SEQ ID NO: 376687 - DNA, 20 bp, Artificial Sequence
  chemically synthesized
ctgcaatcacagcactttgg

SEQ ID NO: 376688 - DNA, 20 bp, Artificial Sequence
  chemically synthesized
tgcaatcacagcactttggg

SEQ ID NO: 376689 - DNA, 20 bp, Artificial Sequence
  chemically synthesized
ccgcccgcctcagcctccca

SEQ ID NO: 376690 - DNA, 20 bp, Artificial Sequence
  chemically synthesized
tcacagcactttgggaggct

SEQ ID NO: 376691 - DNA, 20 bp, Artificial Sequence
  chemically synthesized
cacagcactttgggaggctg

SEQ ID NO: 376692 - DNA, 20 bp, Artificial Sequence
  chemically synthesized
agcactttgggaggctgagg

SEQ ID NO: 376693 - DNA, 20 bp, Artificial Sequence
  chemically synthesized
gcactttgggaggctgaggc

SEQ ID NO: 376694 - DNA, 20 bp, Artificial Sequence
  chemically synthesized
ctttgggaggctgaggcggg

SEQ ID NO: 376695 - DNA, 20 bp, Artificial Sequence
  chemically synthesized
atctcgtgatccgcccgcct

SEQ ID NO: 376696 - DNA, 20 bp, Artificial Sequence
  chemically synthesized
ggctgaggcgggcggatcac

SEQ ID NO: 376697 - DNA, 20 bp, Artificial Sequence
  chemically synthesized
ggcgggcggatcacgagatc

SEQ ID NO: 376698 - DNA, 20 bp, Artificial Sequence
  chemically synthesized
cgggcggatcacgagatcaa

SEQ ID NO: 376699 - DNA, 20 bp, Artificial Sequence
  chemically synthesized
gatcacgagatcaagagatc

SEQ ID NO: 376700 - DNA, 20 bp, Artificial Sequence
  chemically synthesized
tttcaccatgttggtcagga

SEQ ID NO: 376701 - DNA, 20 bp, Artificial Sequence
  chemically synthesized
ggggtttcaccatgttggtc

SEQ ID NO: 376702 - DNA, 20 bp, Artificial Sequence
  chemically synthesized
cgagaccatcctgaccaaca

SEQ ID NO: 376703 - DNA, 20 bp, Artificial Sequence
  chemically synthesized
cggggtttcaccatgttggt

SEQ ID NO: 376704 - DNA, 20 bp, Artificial Sequence
  chemically synthesized
gcgacggggtttcaccatgt

SEQ ID NO: 376705 - DNA, 20 bp, Artificial Sequence
  chemically synthesized
ttgtatttttagtagcgacg

SEQ ID NO: 376706 - DNA, 20 bp, Artificial Sequence
  chemically synthesized
tttgtatttttagtagcgac

SEQ ID NO: 376707 - DNA, 20 bp, Artificial Sequence
  chemically synthesized
ttttgtatttttagtagcga

SEQ ID NO: 376708 - DNA, 20 bp, Artificial Sequence
  chemically synthesized
gctaatttttgtatttttag

SEQ ID NO: 376709 - DNA, 20 bp, Artificial Sequence
  chemically synthesized
ccagctaatttttgtatttt

SEQ ID NO: 376710 - DNA, 20 bp, Artificial Sequence
  chemically synthesized
gctactaaaaatacaaaaat

SEQ ID NO: 376711 - DNA, 20 bp, Artificial Sequence
  chemically synthesized
ctaaaaatacaaaaattagc

SEQ ID NO: 376712 - DNA, 20 bp, Artificial Sequence
  chemically synthesized
atacaaaaattagctggtcg

SEQ ID NO: 376713 - DNA, 20 bp, Artificial Sequence
  chemically synthesized
caaaaattagctggtcgtgg

SEQ ID NO: 376714 - DNA, 20 bp, Artificial Sequence
  chemically synthesized
caggcacgtgccaccacgac

SEQ ID NO: 376715 - DNA, 20 bp, Artificial Sequence
  chemically synthesized
gtcgtggtggcacgtgcctg

SEQ ID NO: 376716 - DNA, 20 bp, Artificial Sequence
  chemically synthesized
gtggcacgtgcctgtagtcc

SEQ ID NO: 376717 - DNA, 20 bp, Artificial Sequence
  chemically synthesized
tcctgagtagctgggactac

SEQ ID NO: 376718 - DNA, 20 bp, Artificial Sequence
  chemically synthesized
ctcctgagtagctgggacta

SEQ ID NO: 376719 - DNA, 20 bp, Artificial Sequence
  chemically synthesized
tgcctgtagtcccagctact

SEQ ID NO: 376720 - DNA, 20 bp, Artificial Sequence
  chemically synthesized
cctcagcctcctgagtagct

SEQ ID NO: 376721 - DNA, 20 bp, Artificial Sequence
  chemically synthesized
gcctgtagtcccagctactc

SEQ ID NO: 376722 - DNA, 20 bp, Artificial Sequence
  chemically synthesized
gcctcagcctcctgagtagc

SEQ ID NO: 376723 - DNA, 20 bp, Artificial Sequence
  chemically synthesized
ctgtagtcccagctactcag

SEQ ID NO: 376724 - DNA, 20 bp, Artificial Sequence
  chemically synthesized
tgtagtcccagctactcagg

SEQ ID NO: 376725 - DNA, 20 bp, Artificial Sequence
  chemically synthesized
ttctgcctcagcctcctgag

SEQ ID NO: 376726 - DNA, 20 bp, Artificial Sequence
  chemically synthesized
ttcttctgcctcagcctcct

SEQ ID NO: 376727 - DNA, 20 bp, Artificial Sequence
  chemically synthesized
tcccagctactcaggaggct

SEQ ID NO: 376728 - DNA, 20 bp, Artificial Sequence
  chemically synthesized
cccagctactcaggaggctg

SEQ ID NO: 376729 - DNA, 20 bp, Artificial Sequence
  chemically synthesized
agctactcaggaggctgagg

SEQ ID NO: 376730 - DNA, 20 bp, Artificial Sequence
  chemically synthesized
tactcaggaggctgaggcag

SEQ ID NO: 376731 - DNA, 20 bp, Artificial Sequence
  chemically synthesized
ttcaagtgattcttctgcct

SEQ ID NO: 376732 - DNA, 20 bp, Artificial Sequence
  chemically synthesized
gcagaagaatcacttgaacc

SEQ ID NO: 376733 - DNA, 20 bp, Artificial Sequence
  chemically synthesized
cagaagaatcacttgaacct

SEQ ID NO: 376734 - DNA, 20 bp, Artificial Sequence
  chemically synthesized
aacctctgcctcccaggttc

SEQ ID NO: 376735 - DNA, 20 bp, Artificial Sequence
  chemically synthesized
gaagaatcacttgaacctgg

SEQ ID NO: 376736 - DNA, 20 bp, Artificial Sequence
  chemically synthesized
aagaatcacttgaacctggg

SEQ ID NO: 376737 - DNA, 20 bp, Artificial Sequence
  chemically synthesized
aatcacttgaacctgggagg

SEQ ID NO: 376738 - DNA, 20 bp, Artificial Sequence
  chemically synthesized
cactgcaacctctgcctccc

SEQ ID NO: 376739 - DNA, 20 bp, Artificial Sequence
  chemically synthesized
tcacttgaacctgggaggca

SEQ ID NO: 376740 - DNA, 20 bp, Artificial Sequence
  chemically synthesized
tcactgcaacctctgcctcc

SEQ ID NO: 376741 - DNA, 20 bp, Artificial Sequence
  chemically synthesized
cacttgaacctgggaggcag

SEQ ID NO: 376742 - DNA, 20 bp, Artificial Sequence
  chemically synthesized
aacctgggaggcagaggttg

SEQ ID NO: 376743 - DNA, 20 bp, Artificial Sequence
  chemically synthesized
tgggaggcagaggttgcagt

SEQ ID NO: 376744 - DNA, 20 bp, Artificial Sequence
  chemically synthesized
ggcagaggttgcagtgagcc

SEQ ID NO: 376745 - DNA, 20 bp, Artificial Sequence
  chemically synthesized
ggagtgcagtgacgcgatct

SEQ ID NO: 376746 - DNA, 20 bp, Artificial Sequence
  chemically synthesized
gagatcgcgtcactgcactc

SEQ ID NO: 376747 - DNA, 20 bp, Artificial Sequence
  chemically synthesized
ctgttgtccaggctggagtg

SEQ ID NO: 376748 - DNA, 20 bp, Artificial Sequence
  chemically synthesized
cgcgtcactgcactccagcc

SEQ ID NO: 376749 - DNA, 20 bp, Artificial Sequence
  chemically synthesized
ttgctctgttgtccaggctg

SEQ ID NO: 376750 - DNA, 20 bp, Artificial Sequence
  chemically synthesized
tcttgctctgttgtccaggc

SEQ ID NO: 376751 - DNA, 20 bp, Artificial Sequence
  chemically synthesized
ctgcactccagcctggacaa

SEQ ID NO: 376752 - DNA, 20 bp, Artificial Sequence
  chemically synthesized
ggagtcttgctctgttgtcc

SEQ ID NO: 376753 - DNA, 20 bp, Artificial Sequence
  chemically synthesized
gcactccagcctggacaaca

SEQ ID NO: 376754 - DNA, 20 bp, Artificial Sequence
  chemically synthesized
cggagtcttgctctgttgtc

SEQ ID NO: 376755 - DNA, 20 bp, Artificial Sequence
  chemically synthesized
tccagcctggacaacagagc

SEQ ID NO: 376756 - DNA, 20 bp, Artificial Sequence
  chemically synthesized
ttttttttttttttgagacg

SEQ ID NO: 376757 - DNA, 20 bp, Artificial Sequence
  chemically synthesized
ttttttttttttttttgaga

SEQ ID NO: 376758 - DNA, 20 bp, Artificial Sequence
  chemically synthesized
tttctttttttttttttttt

SEQ ID NO: 376759 - DNA, 20 bp, Artificial Sequence
  chemically synthesized
cgtctcaaaaaaaaaaaaaa

SEQ ID NO: 376760 - DNA, 20 bp, Artificial Sequence
  chemically synthesized
tcaaaaaaaaaaaaaaaaga

SEQ ID NO: 376761 - DNA, 20 bp, Artificial Sequence
  chemically synthesized
aaaaaaaaaaaagaaagaaa

SEQ ID NO: 376762 - DNA, 20 bp, Artificial Sequence
  chemically synthesized
aaaaaagaaagaaaaagaaa

SEQ ID NO: 376763 - DNA, 20 bp, Artificial Sequence
  chemically synthesized
aagaaagaaaaagaaaaaga

SEQ ID NO: 376764 - DNA, 20 bp, Artificial Sequence
  chemically synthesized
aagaaaaagaaaaagaaaga

SEQ ID NO: 376765 - DNA, 20 bp, Artificial Sequence
  chemically synthesized
aagaaaaagaaagaaagaaa

SEQ ID NO: 376766 - DNA, 20 bp, Artificial Sequence
  chemically synthesized
taacattctgcattagaatt

SEQ ID NO: 376767 - DNA, 20 bp, Artificial Sequence
  chemically synthesized
gtttgtacttaattctaatg

SEQ ID NO: 376768 - DNA, 20 bp, Artificial Sequence
  chemically synthesized
gaatccataacattctgcat

SEQ ID NO: 376769 - DNA, 20 bp, Artificial Sequence
  chemically synthesized
aattctaatgcagaatgtta

SEQ ID NO: 376770 - DNA, 20 bp, Artificial Sequence
  chemically synthesized
aatgttatggattcttatat

SEQ ID NO: 376771 - DNA, 20 bp, Artificial Sequence
  chemically synthesized
atttataccagaaccaatat

SEQ ID NO: 376772 - DNA, 20 bp, Artificial Sequence
  chemically synthesized
atggattcttatattggttc

SEQ ID NO: 376773 - DNA, 20 bp, Artificial Sequence
  chemically synthesized
tttatttagcttatttatac

SEQ ID NO: 376774 - DNA, 20 bp, Artificial Sequence
  chemically synthesized
atattggttctggtataaat

SEQ ID NO: 376775 - DNA, 20 bp, Artificial Sequence
  chemically synthesized
aaaacatgtttaaatttatt

SEQ ID NO: 376776 - DNA, 20 bp, Artificial Sequence
  chemically synthesized
catgttttttaaactctgtg

SEQ ID NO: 376777 - DNA, 20 bp, Artificial Sequence
  chemically synthesized
gaatatatttggaccacaca

SEQ ID NO: 376778 - DNA, 20 bp, Artificial Sequence
  chemically synthesized
gagaatatatttggaccaca

SEQ ID NO: 376779 - DNA, 20 bp, Artificial Sequence
  chemically synthesized
tactttactgagaatatatt

SEQ ID NO: 376780 - DNA, 20 bp, Artificial Sequence
  chemically synthesized
gtgtggtccaaatatattct

SEQ ID NO: 376781 - DNA, 20 bp, Artificial Sequence
  chemically synthesized
gtccaaatatattctcagta

SEQ ID NO: 376782 - DNA, 20 bp, Artificial Sequence
  chemically synthesized
agtcaaactcttactttact

SEQ ID NO: 376783 - DNA, 20 bp, Artificial Sequence
  chemically synthesized
aaatatattctcagtaaagt

SEQ ID NO: 376784 - DNA, 20 bp, Artificial Sequence
  chemically synthesized
atatattctcagtaaagtaa

SEQ ID NO: 376785 - DNA, 20 bp, Artificial Sequence
  chemically synthesized
gtaagagtttgacttatttg

SEQ ID NO: 376786 - DNA, 20 bp, Artificial Sequence
  chemically synthesized
taagagtttgacttatttgt

SEQ ID NO: 376787 - DNA, 20 bp, Artificial Sequence
  chemically synthesized
tcaatttcaaacccacaaat

SEQ ID NO: 376788 - DNA, 20 bp, Artificial Sequence
  chemically synthesized
ttatttgtgggtttgaaatt

SEQ ID NO: 376789 - DNA, 20 bp, Artificial Sequence
  chemically synthesized
tgtgggtttgaaattgagtt

SEQ ID NO: 376790 - DNA, 20 bp, Artificial Sequence
  chemically synthesized
ttcagttgaaactcacaatt

SEQ ID NO: 376791 - DNA, 20 bp, Artificial Sequence
  chemically synthesized
cagcagctcaactgaattgt

SEQ ID NO: 376792 - DNA, 20 bp, Artificial Sequence
  chemically synthesized
ttgaaactcacaattcagtt

SEQ ID NO: 376793 - DNA, 20 bp, Artificial Sequence
  chemically synthesized
ccataaaactgaaattacag

SEQ ID NO: 376794 - DNA, 20 bp, Artificial Sequence
  chemically synthesized
cagttgagctgctgtaattt

SEQ ID NO: 376795 - DNA, 20 bp, Artificial Sequence
  chemically synthesized
gaaccataaaactgaaatta

SEQ ID NO: 376796 - DNA, 20 bp, Artificial Sequence
  chemically synthesized
ctgctgtaatttcagtttta

SEQ ID NO: 376797 - DNA, 20 bp, Artificial Sequence
  chemically synthesized
aatatatagcataaggaaga

SEQ ID NO: 376798 - DNA, 20 bp, Artificial Sequence
  chemically synthesized
taaaaatatatagcataagg

SEQ ID NO: 376799 - DNA, 20 bp, Artificial Sequence
  chemically synthesized
ttttaaaaatatatagcata

SEQ ID NO: 376800 - DNA, 20 bp, Artificial Sequence
  chemically synthesized
cttttaaaaatatatagcat

SEQ ID NO: 376801 - DNA, 20 bp, Artificial Sequence
  chemically synthesized
aaacctcttttaaaaatata

SEQ ID NO: 376802 - DNA, 20 bp, Artificial Sequence
  chemically synthesized
cttatgctatatatttttaa

SEQ ID NO: 376803 - DNA, 20 bp, Artificial Sequence
  chemically synthesized
tatgctatatatttttaaaa

SEQ ID NO: 376804 - DNA, 20 bp, Artificial Sequence
  chemically synthesized
atgctatatatttttaaaag

SEQ ID NO: 376805 - DNA, 20 bp, Artificial Sequence
  chemically synthesized
gaggttttgttgataaaaaa

SEQ ID NO: 376806 - DNA, 20 bp, Artificial Sequence
  chemically synthesized
ttttgttgataaaaaaaaga

SEQ ID NO: 376807 - DNA, 20 bp, Artificial Sequence
  chemically synthesized
aaagaaagtttgtgaaccac

SEQ ID NO: 376808 - DNA, 20 bp, Artificial Sequence
  chemically synthesized
aagaaagtttgtgaaccact

SEQ ID NO: 376809 - DNA, 20 bp, Artificial Sequence
  chemically synthesized
atagagatcagaaagcccag

SEQ ID NO: 376810 - DNA, 20 bp, Artificial Sequence
  chemically synthesized
atcatagagatcagaaagcc

SEQ ID NO: 376811 - DNA, 20 bp, Artificial Sequence
  chemically synthesized
aggagatcatagagatcaga

SEQ ID NO: 376812 - DNA, 20 bp, Artificial Sequence
  chemically synthesized
ttgtaggagatcatagagat

SEQ ID NO: 376813 - DNA, 20 bp, Artificial Sequence
  chemically synthesized
taaatttgtaggagatcata

SEQ ID NO: 376814 - DNA, 20 bp, Artificial Sequence
  chemically synthesized
tttaaatttgtaggagatca

SEQ ID NO: 376815 - DNA, 20 bp, Artificial Sequence
  chemically synthesized
acataagtttaaatttgtag

SEQ ID NO: 376816 - DNA, 20 bp, Artificial Sequence
  chemically synthesized
tcacataagtttaaatttgt

SEQ ID NO: 376817 - DNA, 20 bp, Artificial Sequence
  chemically synthesized
atcacataagtttaaatttg

SEQ ID NO: 376818 - DNA, 20 bp, Artificial Sequence
  chemically synthesized
tgattagtgttaaatcacat

SEQ ID NO: 376819 - DNA, 20 bp, Artificial Sequence
  chemically synthesized
tgtgatttaacactaatcaa

SEQ ID NO: 376820 - DNA, 20 bp, Artificial Sequence
  chemically synthesized
aataccgatttgcttttgat

SEQ ID NO: 376821 - DNA, 20 bp, Artificial Sequence
  chemically synthesized
aacactaatcaaaagcaaat

SEQ ID NO: 376822 - DNA, 20 bp, Artificial Sequence
  chemically synthesized
ttgtatataaaaagttaaat

SEQ ID NO: 376823 - DNA, 20 bp, Artificial Sequence
  chemically synthesized
tttgtatataaaaagttaaa

SEQ ID NO: 376824 - DNA, 20 bp, Artificial Sequence
  chemically synthesized
ataagacctttgtatataaa

SEQ ID NO: 376825 - DNA, 20 bp, Artificial Sequence
  chemically synthesized
tatttaactttttatataca

SEQ ID NO: 376826 - DNA, 20 bp, Artificial Sequence
  chemically synthesized
atttaactttttatatacaa

SEQ ID NO: 376827 - DNA, 20 bp, Artificial Sequence
  chemically synthesized
ttagggaattttaaggaaat

SEQ ID NO: 376828 - DNA, 20 bp, Artificial Sequence
  chemically synthesized
ttccaacttagggaatttta

SEQ ID NO: 376829 - DNA, 20 bp, Artificial Sequence
  chemically synthesized
attccaacttagggaatttt

SEQ ID NO: 376830 - DNA, 20 bp, Artificial Sequence
  chemically synthesized
ttatttccttaaaattccct

SEQ ID NO: 376831 - DNA, 20 bp, Artificial Sequence
  chemically synthesized
ttccttaaaattccctaagt

SEQ ID NO: 376832 - DNA, 20 bp, Artificial Sequence
  chemically synthesized
taagatattattccaactta

SEQ ID NO: 376833 - DNA, 20 bp, Artificial Sequence
  chemically synthesized
ttaagatattattccaactt

SEQ ID NO: 376834 - DNA, 20 bp, Artificial Sequence
  chemically synthesized
tttaagatattattccaact

SEQ ID NO: 376835 - DNA, 20 bp, Artificial Sequence
  chemically synthesized
aagttggaataatatcttaa

SEQ ID NO: 376836 - DNA, 20 bp, Artificial Sequence
  chemically synthesized
actatggaagaacagctttt

SEQ ID NO: 376837 - DNA, 20 bp, Artificial Sequence
  chemically synthesized
taattgacactatggaagaa

SEQ ID NO: 376838 - DNA, 20 bp, Artificial Sequence
  chemically synthesized
tcttaaaagctgttcttcca

SEQ ID NO: 376839 - DNA, 20 bp, Artificial Sequence
  chemically synthesized
gcacttaattgacactatgg

SEQ ID NO: 376840 - DNA, 20 bp, Artificial Sequence
  chemically synthesized
tatgcacttaattgacacta

SEQ ID NO: 376841 - DNA, 20 bp, Artificial Sequence
  chemically synthesized
gttcttccatagtgtcaatt

SEQ ID NO: 376842 - DNA, 20 bp, Artificial Sequence
  chemically synthesized
gtattttcagcaaatatttt

SEQ ID NO: 376843 - DNA, 20 bp, Artificial Sequence
  chemically synthesized
accagatgtgtatgtatttt

SEQ ID NO: 376844 - DNA, 20 bp, Artificial Sequence
  chemically synthesized
gctgaaaatacatacacatc

SEQ ID NO: 376845 - DNA, 20 bp, Artificial Sequence
  chemically synthesized
tcataccaacacaattttac

SEQ ID NO: 376846 - DNA, 20 bp, Artificial Sequence
  chemically synthesized
cacatctggtaaaattgtgt

SEQ ID NO: 376847 - DNA, 20 bp, Artificial Sequence
  chemically synthesized
taaaattgtgttggtatgaa

SEQ ID NO: 376848 - DNA, 20 bp, Artificial Sequence
  chemically synthesized
aaaattgtgttggtatgaat

SEQ ID NO: 376849 - DNA, 20 bp, Artificial Sequence
  chemically synthesized
ataaatacaaaaatgaaaat

SEQ ID NO: 376850 - DNA, 20 bp, Artificial Sequence
  chemically synthesized
taaatacaaaaatgaaaatt

SEQ ID NO: 376851 - DNA, 20 bp, Artificial Sequence
  chemically synthesized
atacaaaaatgaaaattggg

SEQ ID NO: 376852 - DNA, 20 bp, Artificial Sequence
  chemically synthesized
acaaaaatgaaaattgggaa

SEQ ID NO: 376853 - DNA, 20 bp, Artificial Sequence
  chemically synthesized
aaaaatgaaaattgggaaga

SEQ ID NO: 376854 - DNA, 20 bp, Artificial Sequence
  chemically synthesized
tgaaaattgggaagagagaa

SEQ ID NO: 376855 - DNA, 20 bp, Artificial Sequence
  chemically synthesized
aaattgggaagagagaatag

SEQ ID NO: 376856 - DNA, 20 bp, Artificial Sequence
  chemically synthesized
agagagaatagtggtgcatt

SEQ ID NO: 376857 - DNA, 20 bp, Artificial Sequence
  chemically synthesized
gagagaatagtggtgcattt

SEQ ID NO: 376858 - DNA, 20 bp, Artificial Sequence
  chemically synthesized
agaatagtggtgcatttggg

SEQ ID NO: 376859 - DNA, 20 bp, Artificial Sequence
  chemically synthesized
gaatagtggtgcatttggga

SEQ ID NO: 376860 - DNA, 20 bp, Artificial Sequence
  chemically synthesized
aatagtggtgcatttgggaa

SEQ ID NO: 376861 - DNA, 20 bp, Artificial Sequence
  chemically synthesized
agtggtgcatttgggaaggg

SEQ ID NO: 376862 - DNA, 20 bp, Artificial Sequence
  chemically synthesized
catttgggaagggtggcatg

SEQ ID NO: 376863 - DNA, 20 bp, Artificial Sequence
  chemically synthesized
tttgggaagggtggcatgtg

SEQ ID NO: 376864 - DNA, 20 bp, Artificial Sequence
  chemically synthesized
ttgggaagggtggcatgtgg

SEQ ID NO: 376865 - DNA, 20 bp, Artificial Sequence
  chemically synthesized
gggaagggtggcatgtggag

SEQ ID NO: 376866 - DNA, 20 bp, Artificial Sequence
  chemically synthesized
ggaagggtggcatgtggagg

SEQ ID NO: 376867 - DNA, 20 bp, Artificial Sequence
  chemically synthesized
gaagggtggcatgtggagga

SEQ ID NO: 376868 - DNA, 20 bp, Artificial Sequence
  chemically synthesized
ggcatgtggaggagggcttc

SEQ ID NO: 376869 - DNA, 20 bp, Artificial Sequence
  chemically synthesized
catgtggaggagggcttcta

SEQ ID NO: 376870 - DNA, 20 bp, Artificial Sequence
  chemically synthesized
gaatatgactaatactctag

SEQ ID NO: 376871 - DNA, 20 bp, Artificial Sequence
  chemically synthesized
gaggagggcttctagagtat

SEQ ID NO: 376872 - DNA, 20 bp, Artificial Sequence
  chemically synthesized
ctagaatatgactaatactc

SEQ ID NO: 376873 - DNA, 20 bp, Artificial Sequence
  chemically synthesized
ctagagtattagtcatattc

SEQ ID NO: 376874 - DNA, 20 bp, Artificial Sequence
  chemically synthesized
tctcttaaagaaaaattgac

SEQ ID NO: 376875 - DNA, 20 bp, Artificial Sequence
  chemically synthesized
attctagtcaatttttcttt

SEQ ID NO: 376876 - DNA, 20 bp, Artificial Sequence
  chemically synthesized
tctagtcaatttttctttaa

SEQ ID NO: 376877 - DNA, 20 bp, Artificial Sequence
  chemically synthesized
agtcaatttttctttaagag

SEQ ID NO: 376878 - DNA, 20 bp, Artificial Sequence
  chemically synthesized
gtcaatttttctttaagaga

SEQ ID NO: 376879 - DNA, 20 bp, Artificial Sequence
  chemically synthesized
gagtgagggcccttctctta

SEQ ID NO: 376880 - DNA, 20 bp, Artificial Sequence
  chemically synthesized
tcaatttttctttaagagaa

SEQ ID NO: 376881 - DNA, 20 bp, Artificial Sequence
  chemically synthesized
cagcctgggaaacagagtga

SEQ ID NO: 376882 - DNA, 20 bp, Artificial Sequence
  chemically synthesized
tcagcctgggaaacagagtg

SEQ ID NO: 376883 - DNA, 20 bp, Artificial Sequence
  chemically synthesized
ttcagcctgggaaacagagt

SEQ ID NO: 376884 - DNA, 20 bp, Artificial Sequence
  chemically synthesized
agggccctcactctgtttcc

SEQ ID NO: 376885 - DNA, 20 bp, Artificial Sequence
  chemically synthesized
aaacttcagcctgggaaaca

SEQ ID NO: 376886 - DNA, 20 bp, Artificial Sequence
  chemically synthesized
gggccctcactctgtttccc

SEQ ID NO: 376887 - DNA, 20 bp, Artificial Sequence
  chemically synthesized
ctaaacttcagcctgggaaa

SEQ ID NO: 376888 - DNA, 20 bp, Artificial Sequence
  chemically synthesized
tcactctgtttcccaggctg

SEQ ID NO: 376889 - DNA, 20 bp, Artificial Sequence
  chemically synthesized
gtgccactaaacttcagcct

SEQ ID NO: 376890 - DNA, 20 bp, Artificial Sequence
  chemically synthesized
agtgccactaaacttcagcc

SEQ ID NO: 376891 - DNA, 20 bp, Artificial Sequence
  chemically synthesized
ctgtttcccaggctgaagtt

SEQ ID NO: 376892 - DNA, 20 bp, Artificial Sequence
  chemically synthesized
atgatagtgccactaaactt

SEQ ID NO: 376893 - DNA, 20 bp, Artificial Sequence
  chemically synthesized
tttcccaggctgaagtttag

SEQ ID NO: 376894 - DNA, 20 bp, Artificial Sequence
  chemically synthesized
gaagtttagtggcactatca

SEQ ID NO: 376895 - DNA, 20 bp, Artificial Sequence
  chemically synthesized
ggttagactgagagctatga

SEQ ID NO: 376896 - DNA, 20 bp, Artificial Sequence
  chemically synthesized
agtggcactatcatagctct

SEQ ID NO: 376897 - DNA, 20 bp, Artificial Sequence
  chemically synthesized
gaaattcaaggttagactga

SEQ ID NO: 376898 - DNA, 20 bp, Artificial Sequence
  chemically synthesized
cagaaattcaaggttagact

SEQ ID NO: 376899 - DNA, 20 bp, Artificial Sequence
  chemically synthesized
tgagcccagaaattcaaggt

SEQ ID NO: 376900 - DNA, 20 bp, Artificial Sequence
  chemically synthesized
ggcttgagcccagaaattca

SEQ ID NO: 376901 - DNA, 20 bp, Artificial Sequence
  chemically synthesized
tcagtctaaccttgaatttc

SEQ ID NO: 376902 - DNA, 20 bp, Artificial Sequence
  chemically synthesized
tggcttgagcccagaaattc

SEQ ID NO: 376903 - DNA, 20 bp, Artificial Sequence
  chemically synthesized
cagtctaaccttgaatttct

SEQ ID NO: 376904 - DNA, 20 bp, Artificial Sequence
  chemically synthesized
aaccttgaatttctgggctc

SEQ ID NO: 376905 - DNA, 20 bp, Artificial Sequence
  chemically synthesized
gcagttgaatggcttgagcc

SEQ ID NO: 376906 - DNA, 20 bp, Artificial Sequence
  chemically synthesized
ctgaggcagttgaatggctt

SEQ ID NO: 376907 - DNA, 20 bp, Artificial Sequence
  chemically synthesized
aggaggctgaggcagttgaa

SEQ ID NO: 376908 - DNA, 20 bp, Artificial Sequence
  chemically synthesized
ctcaagccattcaactgcct

SEQ ID NO: 376909 - DNA, 20 bp, Artificial Sequence
  chemically synthesized
agctactcaggaggctgagg

SEQ ID NO: 376910 - DNA, 20 bp, Artificial Sequence
  chemically synthesized
cctagctactcaggaggctg

SEQ ID NO: 376911 - DNA, 20 bp, Artificial Sequence
  chemically synthesized
tcctagctactcaggaggct

SEQ ID NO: 376912 - DNA, 20 bp, Artificial Sequence
  chemically synthesized
ttcaactgcctcagcctcct

SEQ ID NO: 376913 - DNA, 20 bp, Artificial Sequence
  chemically synthesized
aactgcctcagcctcctgag

SEQ ID NO: 376914 - DNA, 20 bp, Artificial Sequence
  chemically synthesized
tatagtcctagctactcagg

SEQ ID NO: 376915 - DNA, 20 bp, Artificial Sequence
  chemically synthesized
ctatagtcctagctactcag

SEQ ID NO: 376916 - DNA, 20 bp, Artificial Sequence
  chemically synthesized
gcctcagcctcctgagtagc

SEQ ID NO: 376917 - DNA, 20 bp, Artificial Sequence
  chemically synthesized
acctatagtcctagctactc

SEQ ID NO: 376918 - DNA, 20 bp, Artificial Sequence
  chemically synthesized
cctcagcctcctgagtagct

SEQ ID NO: 376919 - DNA, 20 bp, Artificial Sequence
  chemically synthesized
cacctatagtcctagctact

SEQ ID NO: 376920 - DNA, 20 bp, Artificial Sequence
  chemically synthesized
ctcctgagtagctaggacta

SEQ ID NO: 376921 - DNA, 20 bp, Artificial Sequence
  chemically synthesized
tcctgagtagctaggactat

SEQ ID NO: 376922 - DNA, 20 bp, Artificial Sequence
  chemically synthesized
gtggcatgcacctatagtcc

SEQ ID NO: 376923 - DNA, 20 bp, Artificial Sequence
  chemically synthesized
ggcatagtggcatgcaccta

SEQ ID NO: 376924 - DNA, 20 bp, Artificial Sequence
  chemically synthesized
taggtgcatgccactatgcc

SEQ ID NO: 376925 - DNA, 20 bp, Artificial Sequence
  chemically synthesized
aaaaaattatctgggcatag

SEQ ID NO: 376926 - DNA, 20 bp, Artificial Sequence
  chemically synthesized
attaaaaaattatctgggca

SEQ ID NO: 376927 - DNA, 20 bp, Artificial Sequence
  chemically synthesized
aaaaaattaaaaaattatct

SEQ ID NO: 376928 - DNA, 20 bp, Artificial Sequence
  chemically synthesized
gaaaaaattaaaaaattatc

SEQ ID NO: 376929 - DNA, 20 bp, Artificial Sequence
  chemically synthesized
ataattttttaattttttca

SEQ ID NO: 376930 - DNA, 20 bp, Artificial Sequence
  chemically synthesized
aaccaacatatcaagacatt

SEQ ID NO: 376931 - DNA, 20 bp, Artificial Sequence
  chemically synthesized
gacttaatgtcttgatatgt

SEQ ID NO: 376932 - DNA, 20 bp, Artificial Sequence
  chemically synthesized
tccagcctaaccaacatatc

SEQ ID NO: 376933 - DNA, 20 bp, Artificial Sequence
  chemically synthesized
taatgtcttgatatgttggt

SEQ ID NO: 376934 - DNA, 20 bp, Artificial Sequence
  chemically synthesized
aatgtcttgatatgttggtt

SEQ ID NO: 376935 - DNA, 20 bp, Artificial Sequence
  chemically synthesized
tcttgatatgttggttaggc

SEQ ID NO: 376936 - DNA, 20 bp, Artificial Sequence
  chemically synthesized
tgtgtccaggagtttgagtc

SEQ ID NO: 376937 - DNA, 20 bp, Artificial Sequence
  chemically synthesized
ttaggctggactcaaactcc

SEQ ID NO: 376938 - DNA, 20 bp, Artificial Sequence
  chemically synthesized
ttgcttgtgtccaggagttt

SEQ ID NO: 376939 - DNA, 20 bp, Artificial Sequence
  chemically synthesized
gtaggattgcttgtgtccag

SEQ ID NO: 376940 - DNA, 20 bp, Artificial Sequence
  chemically synthesized
ggactcaaactcctggacac

SEQ ID NO: 376941 - DNA, 20 bp, Artificial Sequence
  chemically synthesized
tggtaggattgcttgtgtcc

SEQ ID NO: 376942 - DNA, 20 bp, Artificial Sequence
  chemically synthesized
gtggtaggattgcttgtgtc

SEQ ID NO: 376943 - DNA, 20 bp, Artificial Sequence
  chemically synthesized
cacaagcaatcctaccacct

SEQ ID NO: 376944 - DNA, 20 bp, Artificial Sequence
  chemically synthesized
ttttgggaggctgaggtggt

SEQ ID NO: 376945 - DNA, 20 bp, Artificial Sequence
  chemically synthesized
gttttgggaggctgaggtgg

SEQ ID NO: 376946 - DNA, 20 bp, Artificial Sequence
  chemically synthesized
agagttttgggaggctgagg

SEQ ID NO: 376947 - DNA, 20 bp, Artificial Sequence
  chemically synthesized
cccagagttttgggaggctg

SEQ ID NO: 376948 - DNA, 20 bp, Artificial Sequence
  chemically synthesized
tcccagagttttgggaggct

SEQ ID NO: 376949 - DNA, 20 bp, Artificial Sequence
  chemically synthesized
tgtaatcccagagttttggg

SEQ ID NO: 376950 - DNA, 20 bp, Artificial Sequence
  chemically synthesized
ttgtaatcccagagttttgg

SEQ ID NO: 376951 - DNA, 20 bp, Artificial Sequence
  chemically synthesized
acctcagcctcccaaaactc

SEQ ID NO: 376952 - DNA, 20 bp, Artificial Sequence
  chemically synthesized
gcttgtaatcccagagtttt

SEQ ID NO: 376953 - DNA, 20 bp, Artificial Sequence
  chemically synthesized
cctcagcctcccaaaactct

SEQ ID NO: 376954 - DNA, 20 bp, Artificial Sequence
  chemically synthesized
tgcttgtaatcccagagttt

SEQ ID NO: 376955 - DNA, 20 bp, Artificial Sequence
  chemically synthesized
ggcttgtgcttgtaatccca

SEQ ID NO: 376956 - DNA, 20 bp, Artificial Sequence
  chemically synthesized
tcccaaaactctgggattac

SEQ ID NO: 376957 - DNA, 20 bp, Artificial Sequence
  chemically synthesized
gtggcttgtgcttgtaatcc

SEQ ID NO: 376958 - DNA, 20 bp, Artificial Sequence
  chemically synthesized
aactctgggattacaagcac

SEQ ID NO: 376959 - DNA, 20 bp, Artificial Sequence
  chemically synthesized
caagcacaagccaccacacc

SEQ ID NO: 376960 - DNA, 20 bp, Artificial Sequence
  chemically synthesized
aaatagggggctgggtgtgg

SEQ ID NO: 376961 - DNA, 20 bp, Artificial Sequence
  chemically synthesized
aagaaatagggggctgggtg

SEQ ID NO: 376962 - DNA, 20 bp, Artificial Sequence
  chemically synthesized
cacttaagaaatagggggct

SEQ ID NO: 376963 - DNA, 20 bp, Artificial Sequence
  chemically synthesized
tcacttaagaaatagggggc

SEQ ID NO: 376964 - DNA, 20 bp, Artificial Sequence
  chemically synthesized
cacttcacttaagaaatagg

SEQ ID NO: 376965 - DNA, 20 bp, Artificial Sequence
  chemically synthesized
tcacttcacttaagaaatag

SEQ ID NO: 376966 - DNA, 20 bp, Artificial Sequence
  chemically synthesized
atcacttcacttaagaaata

SEQ ID NO: 376967 - DNA, 20 bp, Artificial Sequence
  chemically synthesized
cacccagccccctatttctt

SEQ ID NO: 376968 - DNA, 20 bp, Artificial Sequence
  chemically synthesized
aatcacttcacttaagaaat

SEQ ID NO: 376969 - DNA, 20 bp, Artificial Sequence
  chemically synthesized
taatcacttcacttaagaaa

SEQ ID NO: 376970 - DNA, 20 bp, Artificial Sequence
  chemically synthesized
agccccctatttcttaagtg

SEQ ID NO: 376971 - DNA, 20 bp, Artificial Sequence
  chemically synthesized
tcctcataatcacttcactt

SEQ ID NO: 376972 - DNA, 20 bp, Artificial Sequence
  chemically synthesized
ttcttaagtgaagtgattat

SEQ ID NO: 376973 - DNA, 20 bp, Artificial Sequence
  chemically synthesized
tcttaagtgaagtgattatg

SEQ ID NO: 376974 - DNA, 20 bp, Artificial Sequence
  chemically synthesized
agtgaagtgattatgaggaa

SEQ ID NO: 376975 - DNA, 20 bp, Artificial Sequence
  chemically synthesized
atatagagcaataatgaatt

SEQ ID NO: 376976 - DNA, 20 bp, Artificial Sequence
  chemically synthesized
ttacatgtgtaaggaatata

SEQ ID NO: 376977 - DNA, 20 bp, Artificial Sequence
  chemically synthesized
atttacatgtgtaaggaata

SEQ ID NO: 376978 - DNA, 20 bp, Artificial Sequence
  chemically synthesized
atataagatttacatgtgta

SEQ ID NO: 376979 - DNA, 20 bp, Artificial Sequence
  chemically synthesized
catataagatttacatgtgt

SEQ ID NO: 376980 - DNA, 20 bp, Artificial Sequence
  chemically synthesized
tttgctatagatgtacatat

SEQ ID NO: 376981 - DNA, 20 bp, Artificial Sequence
  chemically synthesized
aaatcttatatgtacatcta

SEQ ID NO: 376982 - DNA, 20 bp, Artificial Sequence
  chemically synthesized
tccttttttttcatttgcta

SEQ ID NO: 376983 - DNA, 20 bp, Artificial Sequence
  chemically synthesized
atctatagcaaatgaaaaaa

SEQ ID NO: 376984 - DNA, 20 bp, Artificial Sequence
  chemically synthesized
tctatagcaaatgaaaaaaa

SEQ ID NO: 376985 - DNA, 20 bp, Artificial Sequence
  chemically synthesized
gttgatatttcctttaaatg

SEQ ID NO: 376986 - DNA, 20 bp, Artificial Sequence
  chemically synthesized
ccaatgtgatcttcatttaa

SEQ ID NO: 376987 - DNA, 20 bp, Artificial Sequence
  chemically synthesized
tccaatgtgatcttcattta

SEQ ID NO: 376988 - DNA, 20 bp, Artificial Sequence
  chemically synthesized
cctttaaatgaagatcacat

SEQ ID NO: 376989 - DNA, 20 bp, Artificial Sequence
  chemically synthesized
tttaaatgaagatcacattg

SEQ ID NO: 376990 - DNA, 20 bp, Artificial Sequence
  chemically synthesized
ttaaatgaagatcacattgg

SEQ ID NO: 376991 - DNA, 20 bp, Artificial Sequence
  chemically synthesized
aggtcaaaatgtcacaccaa

SEQ ID NO: 376992 - DNA, 20 bp, Artificial Sequence
  chemically synthesized
ggtcaaaatgtcacaccaaa

SEQ ID NO: 376993 - DNA, 20 bp, Artificial Sequence
  chemically synthesized
aaaatgtcacaccaaaagga

SEQ ID NO: 376994 - DNA, 20 bp, Artificial Sequence
  chemically synthesized
tgagttttttactttccttt

SEQ ID NO: 376995 - DNA, 20 bp, Artificial Sequence
  chemically synthesized
aaaggaaagtaaaaaactca

SEQ ID NO: 376996 - DNA, 20 bp, Artificial Sequence
  chemically synthesized
aaagtaaaaaactcaaagta

SEQ ID NO: 376997 - DNA, 20 bp, Artificial Sequence
  chemically synthesized
taacaaaatatctttacttt

SEQ ID NO: 376998 - DNA, 20 bp, Artificial Sequence
  chemically synthesized
gatattttgttaaaattatg

SEQ ID NO: 376999 - DNA, 20 bp, Artificial Sequence
  chemically synthesized
ataatacaatatttacaaat

SEQ ID NO: 377000 - DNA, 20 bp, Artificial Sequence
  chemically synthesized
atattgtattattatttatt

SEQ ID NO: 377001 - DNA, 20 bp, Artificial Sequence
  chemically synthesized
ttattaagaattactcgaat

SEQ ID NO: 377002 - DNA, 20 bp, Artificial Sequence
  chemically synthesized
ttcatcattttggcttattc

SEQ ID NO: 377003 - DNA, 20 bp, Artificial Sequence
  chemically synthesized
aacaagcattttcatcattt

SEQ ID NO: 377004 - DNA, 20 bp, Artificial Sequence
  chemically synthesized
tgatgaaaatgcttgttata

SEQ ID NO: 377005 - DNA, 20 bp, Artificial Sequence
  chemically synthesized
tttagatttctctatataac

SEQ ID NO: 377006 - DNA, 20 bp, Artificial Sequence
  chemically synthesized
atgaaaatgcttgttatata

SEQ ID NO: 377007 - DNA, 20 bp, Artificial Sequence
  chemically synthesized
tatagagaaatctaaaatgt

SEQ ID NO: 377008 - DNA, 20 bp, Artificial Sequence
  chemically synthesized
atagagaaatctaaaatgta

SEQ ID NO: 377009 - DNA, 20 bp, Artificial Sequence
  chemically synthesized
ctgcttactgccttacattt

SEQ ID NO: 377010 - DNA, 20 bp, Artificial Sequence
  chemically synthesized
gagaaatctaaaatgtaagg

SEQ ID NO: 377011 - DNA, 20 bp, Artificial Sequence
  chemically synthesized
aatctaaaatgtaaggcagt

SEQ ID NO: 377012 - DNA, 20 bp, Artificial Sequence
  chemically synthesized
ctaaaatgtaaggcagtaag

SEQ ID NO: 377013 - DNA, 20 bp, Artificial Sequence
  chemically synthesized
ttttggagttattggaagag

SEQ ID NO: 377014 - DNA, 20 bp, Artificial Sequence
  chemically synthesized
atcttttggagttattggaa

SEQ ID NO: 377015 - DNA, 20 bp, Artificial Sequence
  chemically synthesized
tcatcttttggagttattgg

SEQ ID NO: 377016 - DNA, 20 bp, Artificial Sequence
  chemically synthesized
ttttcatcttttggagttat

SEQ ID NO: 377017 - DNA, 20 bp, Artificial Sequence
  chemically synthesized
tactcttccaataactccaa

SEQ ID NO: 377018 - DNA, 20 bp, Artificial Sequence
  chemically synthesized
aaacatattttcatcttttg

SEQ ID NO: 377019 - DNA, 20 bp, Artificial Sequence
  chemically synthesized
ccaaacatattttcatcttt

SEQ ID NO: 377020 - DNA, 20 bp, Artificial Sequence
  chemically synthesized
ccaaaagatgaaaatatgtt

SEQ ID NO: 377021 - DNA, 20 bp, Artificial Sequence
  chemically synthesized
attacagattagattttttt

SEQ ID NO: 377022 - DNA, 20 bp, Artificial Sequence
  chemically synthesized
ccactgactacattacagat

SEQ ID NO: 377023 - DNA, 20 bp, Artificial Sequence
  chemically synthesized
aaaaaatctaatctgtaatg

SEQ ID NO: 377024 - DNA, 20 bp, Artificial Sequence
  chemically synthesized
atataccactgactacatta

SEQ ID NO: 377025 - DNA, 20 bp, Artificial Sequence
  chemically synthesized
aatctaatctgtaatgtagt

SEQ ID NO: 377026 - DNA, 20 bp, Artificial Sequence
  chemically synthesized
ctaatctgtaatgtagtcag

SEQ ID NO: 377027 - DNA, 20 bp, Artificial Sequence
  chemically synthesized
tagtcagtggtatattttga

SEQ ID NO: 377028 - DNA, 20 bp, Artificial Sequence
  chemically synthesized
agtggtatattttgaaagaa

SEQ ID NO: 377029 - DNA, 20 bp, Artificial Sequence
  chemically synthesized
ttgaaagaaaagtaaaacta

SEQ ID NO: 377030 - DNA, 20 bp, Artificial Sequence
  chemically synthesized
tttataaataatcaaaacta

SEQ ID NO: 377031 - DNA, 20 bp, Artificial Sequence
  chemically synthesized
atagttttgattatttataa

SEQ ID NO: 377032 - DNA, 20 bp, Artificial Sequence
  chemically synthesized
attttatatttaaaataatt

SEQ ID NO: 377033 - DNA, 20 bp, Artificial Sequence
  chemically synthesized
tatatttaaaataattaagt

SEQ ID NO: 377034 - DNA, 20 bp, Artificial Sequence
  chemically synthesized
tatttaaaataattaagtca

SEQ ID NO: 377035 - DNA, 20 bp, Artificial Sequence
  chemically synthesized
ataattaagtcagagttaaa

SEQ ID NO: 377036 - DNA, 20 bp, Artificial Sequence
  chemically synthesized
attaagtcagagttaaatag

SEQ ID NO: 377037 - DNA, 20 bp, Artificial Sequence
  chemically synthesized
catgtaatttttaaaattga

SEQ ID NO: 377038 - DNA, 20 bp, Artificial Sequence
  chemically synthesized
atgtaatttttaaaattgat

SEQ ID NO: 377039 - DNA, 20 bp, Artificial Sequence
  chemically synthesized
taatttttaaaattgatagg

SEQ ID NO: 377040 - DNA, 20 bp, Artificial Sequence
  chemically synthesized
tattatacaaatgtgataaa

SEQ ID NO: 377041 - DNA, 20 bp, Artificial Sequence
  chemically synthesized
gataaacagcatttatactg

SEQ ID NO: 377042 - DNA, 20 bp, Artificial Sequence
  chemically synthesized
tcattgatacaaattttcca

SEQ ID NO: 377043 - DNA, 20 bp, Artificial Sequence
  chemically synthesized
tggaaaatttgtatcaatga

SEQ ID NO: 377044 - DNA, 20 bp, Artificial Sequence
  chemically synthesized
aaaatttgtatcaatgacag

SEQ ID NO: 377045 - DNA, 20 bp, Artificial Sequence
  chemically synthesized
aaatttgtatcaatgacaga

SEQ ID NO: 377046 - DNA, 20 bp, Artificial Sequence
  chemically synthesized
aaagaattgtagtaagaagg

SEQ ID NO: 377047 - DNA, 20 bp, Artificial Sequence
  chemically synthesized
aaaaagaattgtagtaagaa

SEQ ID NO: 377048 - DNA, 20 bp, Artificial Sequence
  chemically synthesized
aaaaaagaattgtagtaaga

SEQ ID NO: 377049 - DNA, 20 bp, Artificial Sequence
  chemically synthesized
taaaaaagaattgtagtaag

SEQ ID NO: 377050 - DNA, 20 bp, Artificial Sequence
  chemically synthesized
ctttaaaaaagaattgtagt

SEQ ID NO: 377051 - DNA, 20 bp, Artificial Sequence
  chemically synthesized
ttccctttaaaaaagaattg

SEQ ID NO: 377052 - DNA, 20 bp, Artificial Sequence
  chemically synthesized
cttactacaattctttttta

SEQ ID NO: 377053 - DNA, 20 bp, Artificial Sequence
  chemically synthesized
ttactacaattcttttttaa

SEQ ID NO: 377054 - DNA, 20 bp, Artificial Sequence
  chemically synthesized
tactacaattcttttttaaa

SEQ ID NO: 377055 - DNA, 20 bp, Artificial Sequence
  chemically synthesized
atattcttttccctttaaaa

SEQ ID NO: 377056 - DNA, 20 bp, Artificial Sequence
  chemically synthesized
caattcttttttaaagggaa

SEQ ID NO: 377057 - DNA, 20 bp, Artificial Sequence
  chemically synthesized
ttaaagggaaaagaatataa

SEQ ID NO: 377058 - DNA, 20 bp, Artificial Sequence
  chemically synthesized
aaagaatataaaagatgaac

SEQ ID NO: 377059 - DNA, 20 bp, Artificial Sequence
  chemically synthesized
ataaaagatgaacaagtgta

SEQ ID NO: 377060 - DNA, 20 bp, Artificial Sequence
  chemically synthesized
gaacaagtgtacagtctgaa

SEQ ID NO: 377061 - DNA, 20 bp, Artificial Sequence
  chemically synthesized
aacaagtgtacagtctgaaa

SEQ ID NO: 377062 - DNA, 20 bp, Artificial Sequence
  chemically synthesized
aagaagaaaattaacctttt

SEQ ID NO: 377063 - DNA, 20 bp, Artificial Sequence
  chemically synthesized
aagtgttgaaatttttaaag

SEQ ID NO: 377064 - DNA, 20 bp, Artificial Sequence
  chemically synthesized
tcaaagtgttgaaattttta

SEQ ID NO: 377065 - DNA, 20 bp, Artificial Sequence
  chemically synthesized
taaaaatttcaacactttga

SEQ ID NO: 377066 - DNA, 20 bp, Artificial Sequence
  chemically synthesized
gttgaatgcaggtactttca

SEQ ID NO: 377067 - DNA, 20 bp, Artificial Sequence
  chemically synthesized
tttgaagagaagttgaatgc

SEQ ID NO: 377068 - DNA, 20 bp, Artificial Sequence
  chemically synthesized
ttttgaagagaagttgaatg

SEQ ID NO: 377069 - DNA, 20 bp, Artificial Sequence
  chemically synthesized
gaagtaataattttgaagag

SEQ ID NO: 377070 - DNA, 20 bp, Artificial Sequence
  chemically synthesized
taagaagtaataattttgaa

SEQ ID NO: 377071 - DNA, 20 bp, Artificial Sequence
  chemically synthesized
tttaagaagtaataattttg

SEQ ID NO: 377072 - DNA, 20 bp, Artificial Sequence
  chemically synthesized
ttggctgactgtagtttaag

SEQ ID NO: 377073 - DNA, 20 bp, Artificial Sequence
  chemically synthesized
aattattacttcttaaacta

SEQ ID NO: 377074 - DNA, 20 bp, Artificial Sequence
  chemically synthesized
tgcttggctgactgtagttt

SEQ ID NO: 377075 - DNA, 20 bp, Artificial Sequence
  chemically synthesized
attacttcttaaactacagt

SEQ ID NO: 377076 - DNA, 20 bp, Artificial Sequence
  chemically synthesized
gcaaattgcttggctgactg

SEQ ID NO: 377077 - DNA, 20 bp, Artificial Sequence
  chemically synthesized
ttcttaaactacagtcagcc

SEQ ID NO: 377078 - DNA, 20 bp, Artificial Sequence
  chemically synthesized
gttctcaatagcaaattgct

SEQ ID NO: 377079 - DNA, 20 bp, Artificial Sequence
  chemically synthesized
cagccaagcaatttgctatt

SEQ ID NO: 377080 - DNA, 20 bp, Artificial Sequence
  chemically synthesized
tggattttgagagttctcaa

SEQ ID NO: 377081 - DNA, 20 bp, Artificial Sequence
  chemically synthesized
tatttaataatggattttga

SEQ ID NO: 377082 - DNA, 20 bp, Artificial Sequence
  chemically synthesized
tgtatttaataatggatttt

SEQ ID NO: 377083 - DNA, 20 bp, Artificial Sequence
  chemically synthesized
ttgaaaattgtatttaataa

SEQ ID NO: 377084 - DNA, 20 bp, Artificial Sequence
  chemically synthesized
atacaattttcaaacatacc

SEQ ID NO: 377085 - DNA, 20 bp, Artificial Sequence
  chemically synthesized
aatttgtgtttcaaaaaact

SEQ ID NO: 377086 - DNA, 20 bp, Artificial Sequence
  chemically synthesized
aaatttgtgtttcaaaaaac

SEQ ID NO: 377087 - DNA, 20 bp, Artificial Sequence
  chemically synthesized
atcagtcagtttcaaaagca

SEQ ID NO: 377088 - DNA, 20 bp, Artificial Sequence
  chemically synthesized
ttctcatcagtcagtttcaa

SEQ ID NO: 377089 - DNA, 20 bp, Artificial Sequence
  chemically synthesized
tgcttttgaaactgactgat

SEQ ID NO: 377090 - DNA, 20 bp, Artificial Sequence
  chemically synthesized
ttaggtaatttctcatcagt

SEQ ID NO: 377091 - DNA, 20 bp, Artificial Sequence
  chemically synthesized
aaagttaggtaatttctcat

SEQ ID NO: 377092 - DNA, 20 bp, Artificial Sequence
  chemically synthesized
atgaatattttttcaaagtt

SEQ ID NO: 377093 - DNA, 20 bp, Artificial Sequence
  chemically synthesized
aatgaatattttttcaaagt

SEQ ID NO: 377094 - DNA, 20 bp, Artificial Sequence
  chemically synthesized
ttttaatgaatattttttca

SEQ ID NO: 377095 - DNA, 20 bp, Artificial Sequence
  chemically synthesized
ttgaaaaaatattcattaaa

SEQ ID NO: 377096 - DNA, 20 bp, Artificial Sequence
  chemically synthesized
gcacatgactaggtggaata

SEQ ID NO: 377097 - DNA, 20 bp, Artificial Sequence
  chemically synthesized
taaaaagtccatattccacc

SEQ ID NO: 377098 - DNA, 20 bp, Artificial Sequence
  chemically synthesized
atatttagcacatgactagg

SEQ ID NO: 377099 - DNA, 20 bp, Artificial Sequence
  chemically synthesized
ctgatatttagcacatgact

SEQ ID NO: 377100 - DNA, 20 bp, Artificial Sequence
  chemically synthesized
gctgatatttagcacatgac

SEQ ID NO: 377101 - DNA, 20 bp, Artificial Sequence
  chemically synthesized
cctagtcatgtgctaaatat

SEQ ID NO: 377102 - DNA, 20 bp, Artificial Sequence
  chemically synthesized
ctgcttataatgctgatatt

SEQ ID NO: 377103 - DNA, 20 bp, Artificial Sequence
  chemically synthesized
gtgctaaatatcagcattat

SEQ ID NO: 377104 - DNA, 20 bp, Artificial Sequence
  chemically synthesized
ctaaatatcagcattataag

SEQ ID NO: 377105 - DNA, 20 bp, Artificial Sequence
  chemically synthesized
cataaaactaggttttgaaa

SEQ ID NO: 377106 - DNA, 20 bp, Artificial Sequence
  chemically synthesized
taagcagctgtttcaaaacc

SEQ ID NO: 377107 - DNA, 20 bp, Artificial Sequence
  chemically synthesized
ggcacatgttgcataaaact

SEQ ID NO: 377108 - DNA, 20 bp, Artificial Sequence
  chemically synthesized
gggcacatgttgcataaaac

SEQ ID NO: 377109 - DNA, 20 bp, Artificial Sequence
  chemically synthesized
tttatgaaaaattttaaaaa

SEQ ID NO: 377110 - DNA, 20 bp, Artificial Sequence
  chemically synthesized
ttttatgaaaaattttaaaa

SEQ ID NO: 377111 - DNA, 20 bp, Artificial Sequence
  chemically synthesized
attttatgaaaaattttaaa

SEQ ID NO: 377112 - DNA, 20 bp, Artificial Sequence
  chemically synthesized
tcataaaatgtaatatctgt

SEQ ID NO: 377113 - DNA, 20 bp, Artificial Sequence
  chemically synthesized
taaaatgtaatatctgttgg

SEQ ID NO: 377114 - DNA, 20 bp, Artificial Sequence
  chemically synthesized
attattagtagtgctaccaa

SEQ ID NO: 377115 - DNA, 20 bp, Artificial Sequence
  chemically synthesized
ttttcctataatattattag

SEQ ID NO: 377116 - DNA, 20 bp, Artificial Sequence
  chemically synthesized
gcgttttcctataatattat

SEQ ID NO: 377117 - DNA, 20 bp, Artificial Sequence
  chemically synthesized
tagcactactaataatatta

SEQ ID NO: 377118 - DNA, 20 bp, Artificial Sequence
  chemically synthesized
agcactactaataatattat

SEQ ID NO: 377119 - DNA, 20 bp, Artificial Sequence
  chemically synthesized
ttttctatatgatcgtaatt

SEQ ID NO: 377120 - DNA, 20 bp, Artificial Sequence
  chemically synthesized
aacgctgaattacgatcata

SEQ ID NO: 377121 - DNA, 20 bp, Artificial Sequence
  chemically synthesized
tcatatagaaaattataaaa

SEQ ID NO: 377122 - DNA, 20 bp, Artificial Sequence
  chemically synthesized
ttataaaatagaaaaataaa

SEQ ID NO: 377123 - DNA, 20 bp, Artificial Sequence
  chemically synthesized
ataaaatagaaaaataaaca

SEQ ID NO: 377124 - DNA, 20 bp, Artificial Sequence
  chemically synthesized
atagaaaaataaacagagtt

SEQ ID NO: 377125 - DNA, 20 bp, Artificial Sequence
  chemically synthesized
aaaataaacagagtttagta

SEQ ID NO: 377126 - DNA, 20 bp, Artificial Sequence
  chemically synthesized
aataaacagagtttagtata

SEQ ID NO: 377127 - DNA, 20 bp, Artificial Sequence
  chemically synthesized
ccccttgctttacacatgtt

SEQ ID NO: 377128 - DNA, 20 bp, Artificial Sequence
  chemically synthesized
agagtgtctgaacatgtgta

SEQ ID NO: 377129 - DNA, 20 bp, Artificial Sequence
  chemically synthesized
tgtctgaacatgtgtaaagc

SEQ ID NO: 377130 - DNA, 20 bp, Artificial Sequence
  chemically synthesized
gtctgaacatgtgtaaagca

SEQ ID NO: 377131 - DNA, 20 bp, Artificial Sequence
  chemically synthesized
tctgaacatgtgtaaagcaa

SEQ ID NO: 377132 - DNA, 20 bp, Artificial Sequence
  chemically synthesized
ctgaacatgtgtaaagcaag

SEQ ID NO: 377133 - DNA, 20 bp, Artificial Sequence
  chemically synthesized
acatgtgtaaagcaaggggt

SEQ ID NO: 377134 - DNA, 20 bp, Artificial Sequence
  chemically synthesized
gtaaagcaaggggtcagttg

SEQ ID NO: 377135 - DNA, 20 bp, Artificial Sequence
  chemically synthesized
aaagcaaggggtcagttgcg

SEQ ID NO: 377136 - DNA, 20 bp, Artificial Sequence
  chemically synthesized
aagcaaggggtcagttgcgg

SEQ ID NO: 377137 - DNA, 20 bp, Artificial Sequence
  chemically synthesized
gttgcggaggacgacttatt

SEQ ID NO: 377138 - DNA, 20 bp, Artificial Sequence
  chemically synthesized
gatattacaaatatctcaat

SEQ ID NO: 377139 - DNA, 20 bp, Artificial Sequence
  chemically synthesized
aacagataaaagtagatgaa

SEQ ID NO: 377140 - DNA, 20 bp, Artificial Sequence
  chemically synthesized
aaacagataaaagtagatga

SEQ ID NO: 377141 - DNA, 20 bp, Artificial Sequence
  chemically synthesized
aactataaaacagataaaag

SEQ ID NO: 377142 - DNA, 20 bp, Artificial Sequence
  chemically synthesized
ggaaactataaaacagataa

SEQ ID NO: 377143 - DNA, 20 bp, Artificial Sequence
  chemically synthesized
atctacttttatctgtttta

SEQ ID NO: 377144 - DNA, 20 bp, Artificial Sequence
  chemically synthesized
tttactaggaaactataaaa

SEQ ID NO: 377145 - DNA, 20 bp, Artificial Sequence
  chemically synthesized
ttatctgttttatagtttcc

SEQ ID NO: 377146 - DNA, 20 bp, Artificial Sequence
  chemically synthesized
atcactgcttataatttact

SEQ ID NO: 377147 - DNA, 20 bp, Artificial Sequence
  chemically synthesized
aatcactgcttataatttac

SEQ ID NO: 377148 - DNA, 20 bp, Artificial Sequence
  chemically synthesized
atagtttcctagtaaattat

SEQ ID NO: 377149 - DNA, 20 bp, Artificial Sequence
  chemically synthesized
gtttcctagtaaattataag

SEQ ID NO: 377150 - DNA, 20 bp, Artificial Sequence
  chemically synthesized
tccataaagccaaagattaa

SEQ ID NO: 377151 - DNA, 20 bp, Artificial Sequence
  chemically synthesized
gtgattacacccttaatctt

SEQ ID NO: 377152 - DNA, 20 bp, Artificial Sequence
  chemically synthesized
ttccataaagccaaagatta

SEQ ID NO: 377153 - DNA, 20 bp, Artificial Sequence
  chemically synthesized
tttccataaagccaaagatt

SEQ ID NO: 377154 - DNA, 20 bp, Artificial Sequence
  chemically synthesized
tatacttttccataaagcca

SEQ ID NO: 377155 - DNA, 20 bp, Artificial Sequence
  chemically synthesized
acccttaatctttggcttta

SEQ ID NO: 377156 - DNA, 20 bp, Artificial Sequence
  chemically synthesized
taatctttggctttatggaa

SEQ ID NO: 377157 - DNA, 20 bp, Artificial Sequence
  chemically synthesized
cgattttatacttttccata

SEQ ID NO: 377158 - DNA, 20 bp, Artificial Sequence
  chemically synthesized
aaaagtataaaatcgctctt

SEQ ID NO: 377159 - DNA, 20 bp, Artificial Sequence
  chemically synthesized
acagtcataataaaactgaa

SEQ ID NO: 377160 - DNA, 20 bp, Artificial Sequence
  chemically synthesized
atacagtcataataaaactg

SEQ ID NO: 377161 - DNA, 20 bp, Artificial Sequence
  chemically synthesized
agttttattatgactgtata

SEQ ID NO: 377162 - DNA, 20 bp, Artificial Sequence
  chemically synthesized
gtaaatagaatatccatata

SEQ ID NO: 377163 - DNA, 20 bp, Artificial Sequence
  chemically synthesized
atagcatatgtttttgtaaa

SEQ ID NO: 377164 - DNA, 20 bp, Artificial Sequence
  chemically synthesized
aaagattggccaaaatgtaa

SEQ ID NO: 377165 - DNA, 20 bp, Artificial Sequence
  chemically synthesized
aaacatatgctattacattt

SEQ ID NO: 377166 - DNA, 20 bp, Artificial Sequence
  chemically synthesized
acaaaaattaatacaaagat

SEQ ID NO: 377167 - DNA, 20 bp, Artificial Sequence
  chemically synthesized
ttcttacaaaaattaataca

SEQ ID NO: 377168 - DNA, 20 bp, Artificial Sequence
  chemically synthesized
atctttgtattaatttttgt

SEQ ID NO: 377169 - DNA, 20 bp, Artificial Sequence
  chemically synthesized
tttgtaagaatatattgtgt

SEQ ID NO: 377170 - DNA, 20 bp, Artificial Sequence
  chemically synthesized
atatattgtgtaagtattta

SEQ ID NO: 377171 - DNA, 20 bp, Artificial Sequence
  chemically synthesized
tatattgtgtaagtatttat

SEQ ID NO: 377172 - DNA, 20 bp, Artificial Sequence
  chemically synthesized
atattgtgtaagtatttata

SEQ ID NO: 377173 - DNA, 20 bp, Artificial Sequence
  chemically synthesized
atacatatcatacgaatgtt

SEQ ID NO: 377174 - DNA, 20 bp, Artificial Sequence
  chemically synthesized
acatatcatacgaatgttaa

SEQ ID NO: 377175 - DNA, 20 bp, Artificial Sequence
  chemically synthesized
tacgaatgttaagagtgcaa

SEQ ID NO: 377176 - DNA, 20 bp, Artificial Sequence
  chemically synthesized
aagagtgcaatagcaaaata

SEQ ID NO: 377177 - DNA, 20 bp, Artificial Sequence
  chemically synthesized
aatagcaaaataaagaacca

SEQ ID NO: 377178 - DNA, 20 bp, Artificial Sequence
  chemically synthesized
tgaggaatttattttggcta

SEQ ID NO: 377179 - DNA, 20 bp, Artificial Sequence
  chemically synthesized
tgcttatgaggaatttattt

SEQ ID NO: 377180 - DNA, 20 bp, Artificial Sequence
  chemically synthesized
agccaaaataaattcctcat

SEQ ID NO: 377181 - DNA, 20 bp, Artificial Sequence
  chemically synthesized
aaaataaattcctcataagc

SEQ ID NO: 377182 - DNA, 20 bp, Artificial Sequence
  chemically synthesized
gtgtgtgatgcttgcttatg

SEQ ID NO: 377183 - DNA, 20 bp, Artificial Sequence
  chemically synthesized
tgtgtgtgatgcttgcttat

SEQ ID NO: 377184 - DNA, 20 bp, Artificial Sequence
  chemically synthesized
cacacacacacacacacacg

SEQ ID NO: 377185 - DNA, 20 bp, Artificial Sequence
  chemically synthesized
cacacacacacgcagaaaca

SEQ ID NO: 377186 - DNA, 20 bp, Artificial Sequence
  chemically synthesized
aaattttttctgagtcagtg

SEQ ID NO: 377187 - DNA, 20 bp, Artificial Sequence
  chemically synthesized
ggacattttcttcactgact

SEQ ID NO: 377188 - DNA, 20 bp, Artificial Sequence
  chemically synthesized
cctgaaaattttttctgagt

SEQ ID NO: 377189 - DNA, 20 bp, Artificial Sequence
  chemically synthesized
tttacctgaaaattttttct

SEQ ID NO: 377190 - DNA, 20 bp, Artificial Sequence
  chemically synthesized
actgactcagaaaaaatttt

SEQ ID NO: 377191 - DNA, 20 bp, Artificial Sequence
  chemically synthesized
ctgactcagaaaaaattttc

SEQ ID NO: 377192 - DNA, 20 bp, Artificial Sequence
  chemically synthesized
gtgaccactcgaacatttac

SEQ ID NO: 377193 - DNA, 20 bp, Artificial Sequence
  chemically synthesized
tgtgaccactcgaacattta

SEQ ID NO: 377194 - DNA, 20 bp, Artificial Sequence
  chemically synthesized
aaaatgtcctgtaaatgttc

SEQ ID NO: 377195 - DNA, 20 bp, Artificial Sequence
  chemically synthesized
atgtcctgtaaatgttcgag

SEQ ID NO: 377196 - DNA, 20 bp, Artificial Sequence
  chemically synthesized
gtaaatgttcgagtggtcac

SEQ ID NO: 377197 - DNA, 20 bp, Artificial Sequence
  chemically synthesized
gtcacaagtaaaaatttaca

SEQ ID NO: 377198 - DNA, 20 bp, Artificial Sequence
  chemically synthesized
aaatttacaaagtgtttcta

SEQ ID NO: 377199 - DNA, 20 bp, Artificial Sequence
  chemically synthesized
acaaagtgtttctatagttc

SEQ ID NO: 377200 - DNA, 20 bp, Artificial Sequence
  chemically synthesized
ctcgctttctgctggaacta

SEQ ID NO: 377201 - DNA, 20 bp, Artificial Sequence
  chemically synthesized
aagtgtttctatagttccag

SEQ ID NO: 377202 - DNA, 20 bp, Artificial Sequence
  chemically synthesized
gtttctatagttccagcaga

SEQ ID NO: 377203 - DNA, 20 bp, Artificial Sequence
  chemically synthesized
taatgcacctcgctttctgc

SEQ ID NO: 377204 - DNA, 20 bp, Artificial Sequence
  chemically synthesized
ctatagttccagcagaaagc

SEQ ID NO: 377205 - DNA, 20 bp, Artificial Sequence
  chemically synthesized
tatagttccagcagaaagcg

SEQ ID NO: 377206 - DNA, 20 bp, Artificial Sequence
  chemically synthesized
cagcagaaagcgaggtgcat

SEQ ID NO: 377207 - DNA, 20 bp, Artificial Sequence
  chemically synthesized
cagaaagcgaggtgcattag

SEQ ID NO: 377208 - DNA, 20 bp, Artificial Sequence
  chemically synthesized
aaaaatattcatgatatatt

SEQ ID NO: 377209 - DNA, 20 bp, Artificial Sequence
  chemically synthesized
atattcatgatatatttaga

SEQ ID NO: 377210 - DNA, 20 bp, Artificial Sequence
  chemically synthesized
ccacttgttttatcaaaatt

SEQ ID NO: 377211 - DNA, 20 bp, Artificial Sequence
  chemically synthesized
acaccaaattttgataaaac

SEQ ID NO: 377212 - DNA, 20 bp, Artificial Sequence
  chemically synthesized
ccaaattttgataaaacaag

SEQ ID NO: 377213 - DNA, 20 bp, Artificial Sequence
  chemically synthesized
tgataaaacaagtggtaact

SEQ ID NO: 377214 - DNA, 20 bp, Artificial Sequence
  chemically synthesized
tatatttggttaattaaact

SEQ ID NO: 377215 - DNA, 20 bp, Artificial Sequence
  chemically synthesized
ttttgcatgtggtatatatt

SEQ ID NO: 377216 - DNA, 20 bp, Artificial Sequence
  chemically synthesized
tctatgacatattttgcatg

SEQ ID NO: 377217 - DNA, 20 bp, Artificial Sequence
  chemically synthesized
accacatgcaaaatatgtca

SEQ ID NO: 377218 - DNA, 20 bp, Artificial Sequence
  chemically synthesized
gaatacttattttgaattat

SEQ ID NO: 377219 - DNA, 20 bp, Artificial Sequence
  chemically synthesized
agatactgataattcaaaat

SEQ ID NO: 377220 - DNA, 20 bp, Artificial Sequence
  chemically synthesized
aaaataagtattctctaatt

SEQ ID NO: 377221 - DNA, 20 bp, Artificial Sequence
  chemically synthesized
tgttgctaatttccaaatta

SEQ ID NO: 377222 - DNA, 20 bp, Artificial Sequence
  chemically synthesized
tgtgttgctaatttccaaat

SEQ ID NO: 377223 - DNA, 20 bp, Artificial Sequence
  chemically synthesized
gtattctctaatttggaaat

SEQ ID NO: 377224 - DNA, 20 bp, Artificial Sequence
  chemically synthesized
cacatttttgtgtatatatg

SEQ ID NO: 377225 - DNA, 20 bp, Artificial Sequence
  chemically synthesized
tttttgtgtatatatgtgga

SEQ ID NO: 377226 - DNA, 20 bp, Artificial Sequence
  chemically synthesized
cagatatattaatccatccc

SEQ ID NO: 377227 - DNA, 20 bp, Artificial Sequence
  chemically synthesized
ggatactcctatgccaggga

SEQ ID NO: 377228 - DNA, 20 bp, Artificial Sequence
  chemically synthesized
atattaatccatccctggca

SEQ ID NO: 377229 - DNA, 20 bp, Artificial Sequence
  chemically synthesized
tattaatccatccctggcat

SEQ ID NO: 377230 - DNA, 20 bp, Artificial Sequence
  chemically synthesized
attgggatactcctatgcca

SEQ ID NO: 377231 - DNA, 20 bp, Artificial Sequence
  chemically synthesized
ttaatccatccctggcatag

SEQ ID NO: 377232 - DNA, 20 bp, Artificial Sequence
  chemically synthesized
cattgggatactcctatgcc

SEQ ID NO: 377233 - DNA, 20 bp, Artificial Sequence
  chemically synthesized
acattgggatactcctatgc

SEQ ID NO: 377234 - DNA, 20 bp, Artificial Sequence
  chemically synthesized
agagttcaaattagtacatt

SEQ ID NO: 377235 - DNA, 20 bp, Artificial Sequence
  chemically synthesized
aagagttcaaattagtacat

SEQ ID NO: 377236 - DNA, 20 bp, Artificial Sequence
  chemically synthesized
tgctttataagagttcaaat

SEQ ID NO: 377237 - DNA, 20 bp, Artificial Sequence
  chemically synthesized
tactaatttgaactcttata

SEQ ID NO: 377238 - DNA, 20 bp, Artificial Sequence
  chemically synthesized
ttgaactgaatgctttataa

SEQ ID NO: 377239 - DNA, 20 bp, Artificial Sequence
  chemically synthesized
tattgaactgaatgctttat

SEQ ID NO: 377240 - DNA, 20 bp, Artificial Sequence
  chemically synthesized
ttgaactcttataaagcatt

SEQ ID NO: 377241 - DNA, 20 bp, Artificial Sequence
  chemically synthesized
gttcaatataactcattaaa

SEQ ID NO: 377242 - DNA, 20 bp, Artificial Sequence
  chemically synthesized
gggctgtagggccatttaat

SEQ ID NO: 377243 - DNA, 20 bp, Artificial Sequence
  chemically synthesized
taactcattaaatggcccta

SEQ ID NO: 377244 - DNA, 20 bp, Artificial Sequence
  chemically synthesized
ggcttcttctttgggctgta

SEQ ID NO: 377245 - DNA, 20 bp, Artificial Sequence
  chemically synthesized
tggcttcttctttgggctgt

SEQ ID NO: 377246 - DNA, 20 bp, Artificial Sequence
  chemically synthesized
ttaaatggccctacagccca

SEQ ID NO: 377247 - DNA, 20 bp, Artificial Sequence
  chemically synthesized
atggcttcttctttgggctg

SEQ ID NO: 377248 - DNA, 20 bp, Artificial Sequence
  chemically synthesized
aatggccctacagcccaaag

SEQ ID NO: 377249 - DNA, 20 bp, Artificial Sequence
  chemically synthesized
ggccctacagcccaaagaag

SEQ ID NO: 377250 - DNA, 20 bp, Artificial Sequence
  chemically synthesized
ctaaagatggcttcttcttt

SEQ ID NO: 377251 - DNA, 20 bp, Artificial Sequence
  chemically synthesized
actaaagatggcttcttctt

SEQ ID NO: 377252 - DNA, 20 bp, Artificial Sequence
  chemically synthesized
cccaaagaagaagccatctt

SEQ ID NO: 377253 - DNA, 20 bp, Artificial Sequence
  chemically synthesized
tgtatcatgcatactaaaga

SEQ ID NO: 377254 - DNA, 20 bp, Artificial Sequence
  chemically synthesized
agcttgtatcatgcatacta

SEQ ID NO: 377255 - DNA, 20 bp, Artificial Sequence
  chemically synthesized
atctttagtatgcatgatac

SEQ ID NO: 377256 - DNA, 20 bp, Artificial Sequence
  chemically synthesized
atttctttttatagaaatga

SEQ ID NO: 377257 - DNA, 20 bp, Artificial Sequence
  chemically synthesized
caagctttcatttctataaa

SEQ ID NO: 377258 - DNA, 20 bp, Artificial Sequence
  chemically synthesized
tcttttgccatttcttttta

SEQ ID NO: 377259 - DNA, 20 bp, Artificial Sequence
  chemically synthesized
ttcatttctataaaaagaaa

SEQ ID NO: 377260 - DNA, 20 bp, Artificial Sequence
  chemically synthesized
tctataaaaagaaatggcaa

SEQ ID NO: 377261 - DNA, 20 bp, Artificial Sequence
  chemically synthesized
aaaaagaaatggcaaaagat

SEQ ID NO: 377262 - DNA, 20 bp, Artificial Sequence
  chemically synthesized
ggcaaaagattagatttgca

SEQ ID NO: 377263 - DNA, 20 bp, Artificial Sequence
  chemically synthesized
aaagattagatttgcaaagc

SEQ ID NO: 377264 - DNA, 20 bp, Artificial Sequence
  chemically synthesized
gatttgcaaagcaagataaa

SEQ ID NO: 377265 - DNA, 20 bp, Artificial Sequence
  chemically synthesized
caagataaaaagacacttgt

SEQ ID NO: 377266 - DNA, 20 bp, Artificial Sequence
  chemically synthesized
tggaagatctaggagctgac

SEQ ID NO: 377267 - DNA, 20 bp, Artificial Sequence
  chemically synthesized
aaaagacacttgtcagctcc

SEQ ID NO: 377268 - DNA, 20 bp, Artificial Sequence
  chemically synthesized
ctgcttcctggaagatctag

SEQ ID NO: 377269 - DNA, 20 bp, Artificial Sequence
  chemically synthesized
tgctgcttcctggaagatct

SEQ ID NO: 377270 - DNA, 20 bp, Artificial Sequence
  chemically synthesized
ttgtcagctcctagatcttc

SEQ ID NO: 377271 - DNA, 20 bp, Artificial Sequence
  chemically synthesized
atgctgcttcctggaagatc

SEQ ID NO: 377272 - DNA, 20 bp, Artificial Sequence
  chemically synthesized
tgtcagctcctagatcttcc

SEQ ID NO: 377273 - DNA, 20 bp, Artificial Sequence
  chemically synthesized
cagctcctagatcttccagg

SEQ ID NO: 377274 - DNA, 20 bp, Artificial Sequence
  chemically synthesized
ctatatatgctgcttcctgg

SEQ ID NO: 377275 - DNA, 20 bp, Artificial Sequence
  chemically synthesized
ctcctagatcttccaggaag

SEQ ID NO: 377276 - DNA, 20 bp, Artificial Sequence
  chemically synthesized
ctcctatatatgctgcttcc

SEQ ID NO: 377277 - DNA, 20 bp, Artificial Sequence
  chemically synthesized
cttccaggaagcagcatata

SEQ ID NO: 377278 - DNA, 20 bp, Artificial Sequence
  chemically synthesized
ttccaggaagcagcatatat

SEQ ID NO: 377279 - DNA, 20 bp, Artificial Sequence
  chemically synthesized
ccaggaagcagcatatatag

SEQ ID NO: 377280 - DNA, 20 bp, Artificial Sequence
  chemically synthesized
gaagcagcatatataggaga

SEQ ID NO: 377281 - DNA, 20 bp, Artificial Sequence
  chemically synthesized
agcagcatatataggagaaa

SEQ ID NO: 377282 - DNA, 20 bp, Artificial Sequence
  chemically synthesized
tatataggagaaagagaaaa

SEQ ID NO: 377283 - DNA, 20 bp, Artificial Sequence
  chemically synthesized
atataggagaaagagaaaaa

SEQ ID NO: 377284 - DNA, 20 bp, Artificial Sequence
  chemically synthesized
aaggtaaaacatgattgata

SEQ ID NO: 377285 - DNA, 20 bp, Artificial Sequence
  chemically synthesized
aggtaaaacatgattgatat

SEQ ID NO: 377286 - DNA, 20 bp, Artificial Sequence
  chemically synthesized
acatgattgatataggaaaa

SEQ ID NO: 377287 - DNA, 20 bp, Artificial Sequence
  chemically synthesized
accatacaatttataatgta

SEQ ID NO: 377288 - DNA, 20 bp, Artificial Sequence
  chemically synthesized
gctttacattataaattgta

SEQ ID NO: 377289 - DNA, 20 bp, Artificial Sequence
  chemically synthesized
ttgtatggtgtctatatacg

SEQ ID NO: 377290 - DNA, 20 bp, Artificial Sequence
  chemically synthesized
tgtatggtgtctatatacgt

SEQ ID NO: 377291 - DNA, 20 bp, Artificial Sequence
  chemically synthesized
tagaaaatttcccacgtata

SEQ ID NO: 377292 - DNA, 20 bp, Artificial Sequence
  chemically synthesized
ttcttgacttgtttttaatt

SEQ ID NO: 377293 - DNA, 20 bp, Artificial Sequence
  chemically synthesized
aaattttctaaattaaaaac

SEQ ID NO: 377294 - DNA, 20 bp, Artificial Sequence
  chemically synthesized
ttctaaattaaaaacaagtc

SEQ ID NO: 377295 - DNA, 20 bp, Artificial Sequence
  chemically synthesized
aaacaagtcaagaaactata

SEQ ID NO: 377296 - DNA, 20 bp, Artificial Sequence
  chemically synthesized
cacctggccaaatttcttta

SEQ ID NO: 377297 - DNA, 20 bp, Artificial Sequence
  chemically synthesized
caagaaactataaagaaatt

SEQ ID NO: 377298 - DNA, 20 bp, Artificial Sequence
  chemically synthesized
aaactataaagaaatttggc

SEQ ID NO: 377299 - DNA, 20 bp, Artificial Sequence
  chemically synthesized
aactataaagaaatttggcc

SEQ ID NO: 377300 - DNA, 20 bp, Artificial Sequence
  chemically synthesized
taaagaaatttggccaggtg

SEQ ID NO: 377301 - DNA, 20 bp, Artificial Sequence
  chemically synthesized
agaaatttggccaggtgcgg

SEQ ID NO: 377302 - DNA, 20 bp, Artificial Sequence
  chemically synthesized
caggtgtgaaccaccgcacc

SEQ ID NO: 377303 - DNA, 20 bp, Artificial Sequence
  chemically synthesized
gtggttcacacctgtaatcc

SEQ ID NO: 377304 - DNA, 20 bp, Artificial Sequence
  chemically synthesized
tcccaaagtgctgggattac

SEQ ID NO: 377305 - DNA, 20 bp, Artificial Sequence
  chemically synthesized
ctcccaaagtgctgggatta

SEQ ID NO: 377306 - DNA, 20 bp, Artificial Sequence
  chemically synthesized
cacctgtaatcccagcactt

SEQ ID NO: 377307 - DNA, 20 bp, Artificial Sequence
  chemically synthesized
ccttggcctcccaaagtgct

SEQ ID NO: 377308 - DNA, 20 bp, Artificial Sequence
  chemically synthesized
acctgtaatcccagcacttt

SEQ ID NO: 377309 - DNA, 20 bp, Artificial Sequence
  chemically synthesized
gccttggcctcccaaagtgc

SEQ ID NO: 377310 - DNA, 20 bp, Artificial Sequence
  chemically synthesized
ctgtaatcccagcactttgg

SEQ ID NO: 377311 - DNA, 20 bp, Artificial Sequence
  chemically synthesized
tgtaatcccagcactttggg

SEQ ID NO: 377312 - DNA, 20 bp, Artificial Sequence
  chemically synthesized
ccacccgccttggcctccca

SEQ ID NO: 377313 - DNA, 20 bp, Artificial Sequence
  chemically synthesized
tcccagcactttgggaggcc

SEQ ID NO: 377314 - DNA, 20 bp, Artificial Sequence
  chemically synthesized
cccagcactttgggaggcca

SEQ ID NO: 377315 - DNA, 20 bp, Artificial Sequence
  chemically synthesized
agcactttgggaggccaagg

SEQ ID NO: 377316 - DNA, 20 bp, Artificial Sequence
  chemically synthesized
gcactttgggaggccaaggc

SEQ ID NO: 377317 - DNA, 20 bp, Artificial Sequence
  chemically synthesized
ctttgggaggccaaggcggg

SEQ ID NO: 377318 - DNA, 20 bp, Artificial Sequence
  chemically synthesized
ctcgggtgatccacccgcct

SEQ ID NO: 377319 - DNA, 20 bp, Artificial Sequence
  chemically synthesized
ccaaggcgggtggatcaccc

SEQ ID NO: 377320 - DNA, 20 bp, Artificial Sequence
  chemically synthesized
caaggcgggtggatcacccg

SEQ ID NO: 377321 - DNA, 20 bp, Artificial Sequence
  chemically synthesized
gcgggtggatcacccgaggt

SEQ ID NO: 377322 - DNA, 20 bp, Artificial Sequence
  chemically synthesized
cgggtggatcacccgaggtc

SEQ ID NO: 377323 - DNA, 20 bp, Artificial Sequence
  chemically synthesized
ggtctcaaactcctgacctc

SEQ ID NO: 377324 - DNA, 20 bp, Artificial Sequence
  chemically synthesized
ggtggatcacccgaggtcag

SEQ ID NO: 377325 - DNA, 20 bp, Artificial Sequence
  chemically synthesized
tggtctcaaactcctgacct

SEQ ID NO: 377326 - DNA, 20 bp, Artificial Sequence
  chemically synthesized
tcacccgaggtcaggagttt

SEQ ID NO: 377327 - DNA, 20 bp, Artificial Sequence
  chemically synthesized
cgaggtcaggagtttgagac

SEQ ID NO: 377328 - DNA, 20 bp, Artificial Sequence
  chemically synthesized
tcaggagtttgagaccagcc

SEQ ID NO: 377329 - DNA, 20 bp, Artificial Sequence
  chemically synthesized
tttcatcatgttggccaggc

SEQ ID NO: 377330 - DNA, 20 bp, Artificial Sequence
  chemically synthesized
ggggtttcatcatgttggcc

SEQ ID NO: 377331 - DNA, 20 bp, Artificial Sequence
  chemically synthesized
tggggtttcatcatgttggc

SEQ ID NO: 377332 - DNA, 20 bp, Artificial Sequence
  chemically synthesized
gagatggggtttcatcatgt

SEQ ID NO: 377333 - DNA, 20 bp, Artificial Sequence
  chemically synthesized
ttgtatttttagtagagatg

SEQ ID NO: 377334 - DNA, 20 bp, Artificial Sequence
  chemically synthesized
tttgtatttttagtagagat

SEQ ID NO: 377335 - DNA, 20 bp, Artificial Sequence
  chemically synthesized
ttttgtatttttagtagaga

SEQ ID NO: 377336 - DNA, 20 bp, Artificial Sequence
  chemically synthesized
taatttttgtatttttagta

SEQ ID NO: 377337 - DNA, 20 bp, Artificial Sequence
  chemically synthesized
gctaatttttgtatttttag

SEQ ID NO: 377338 - DNA, 20 bp, Artificial Sequence
  chemically synthesized
ccagctaatttttgtatttt

SEQ ID NO: 377339 - DNA, 20 bp, Artificial Sequence
  chemically synthesized
tctactaaaaatacaaaaat

SEQ ID NO: 377340 - DNA, 20 bp, Artificial Sequence
  chemically synthesized
ctaaaaatacaaaaattagc

SEQ ID NO: 377341 - DNA, 20 bp, Artificial Sequence
  chemically synthesized
taaaaatacaaaaattagct

SEQ ID NO: 377342 - DNA, 20 bp, Artificial Sequence
  chemically synthesized
atacaaaaattagctgggct

SEQ ID NO: 377343 - DNA, 20 bp, Artificial Sequence
  chemically synthesized
caaaaattagctgggcttgg

SEQ ID NO: 377344 - DNA, 20 bp, Artificial Sequence
  chemically synthesized
caggcatgagccaccaagcc

SEQ ID NO: 377345 - DNA, 20 bp, Artificial Sequence
  chemically synthesized
gactacaggcatgagccacc

SEQ ID NO: 377346 - DNA, 20 bp, Artificial Sequence
  chemically synthesized
ggcttggtggctcatgcctg

SEQ ID NO: 377347 - DNA, 20 bp, Artificial Sequence
  chemically synthesized
gtagctgggactacaggcat

SEQ ID NO: 377348 - DNA, 20 bp, Artificial Sequence
  chemically synthesized
gtggctcatgcctgtagtcc

SEQ ID NO: 377349 - DNA, 20 bp, Artificial Sequence
  chemically synthesized
tcctgagtagctgggactac

SEQ ID NO: 377350 - DNA, 20 bp, Artificial Sequence
  chemically synthesized
ctcctgagtagctgggacta

SEQ ID NO: 377351 - DNA, 20 bp, Artificial Sequence
  chemically synthesized
tgcctgtagtcccagctact

SEQ ID NO: 377352 - DNA, 20 bp, Artificial Sequence
  chemically synthesized
cctcagcctcctgagtagct

SEQ ID NO: 377353 - DNA, 20 bp, Artificial Sequence
  chemically synthesized
gcctgtagtcccagctactc

SEQ ID NO: 377354 - DNA, 20 bp, Artificial Sequence
  chemically synthesized
gcctcagcctcctgagtagc

SEQ ID NO: 377355 - DNA, 20 bp, Artificial Sequence
  chemically synthesized
ctgtagtcccagctactcag

SEQ ID NO: 377356 - DNA, 20 bp, Artificial Sequence
  chemically synthesized
tgtagtcccagctactcagg

SEQ ID NO: 377357 - DNA, 20 bp, Artificial Sequence
  chemically synthesized
tcttgcctcagcctcctgag

SEQ ID NO: 377358 - DNA, 20 bp, Artificial Sequence
  chemically synthesized
ttctcttgcctcagcctcct

SEQ ID NO: 377359 - DNA, 20 bp, Artificial Sequence
  chemically synthesized
tcccagctactcaggaggct

SEQ ID NO: 377360 - DNA, 20 bp, Artificial Sequence
  chemically synthesized
cccagctactcaggaggctg

SEQ ID NO: 377361 - DNA, 20 bp, Artificial Sequence
  chemically synthesized
gctactcaggaggctgaggc

SEQ ID NO: 377362 - DNA, 20 bp, Artificial Sequence
  chemically synthesized
tactcaggaggctgaggcaa

SEQ ID NO: 377363 - DNA, 20 bp, Artificial Sequence
  chemically synthesized
ttcaagggattctcttgcct

SEQ ID NO: 377364 - DNA, 20 bp, Artificial Sequence
  chemically synthesized
gcaagagaatcccttgaacc

SEQ ID NO: 377365 - DNA, 20 bp, Artificial Sequence
  chemically synthesized
cctccgcctcccgggttcaa

SEQ ID NO: 377366 - DNA, 20 bp, Artificial Sequence
  chemically synthesized
caagagaatcccttgaaccc

SEQ ID NO: 377367 - DNA, 20 bp, Artificial Sequence
  chemically synthesized
acctccgcctcccgggttca

SEQ ID NO: 377368 - DNA, 20 bp, Artificial Sequence
  chemically synthesized
aacctccgcctcccgggttc

SEQ ID NO: 377369 - DNA, 20 bp, Artificial Sequence
  chemically synthesized
agagaatcccttgaacccgg

SEQ ID NO: 377370 - DNA, 20 bp, Artificial Sequence
  chemically synthesized
gagaatcccttgaacccggg

SEQ ID NO: 377371 - DNA, 20 bp, Artificial Sequence
  chemically synthesized
aatcccttgaacccgggagg

SEQ ID NO: 377372 - DNA, 20 bp, Artificial Sequence
  chemically synthesized
ggctgcaacctccgcctccc

SEQ ID NO: 377373 - DNA, 20 bp, Artificial Sequence
  chemically synthesized
tcccttgaacccgggaggcg

SEQ ID NO: 377374 - DNA, 20 bp, Artificial Sequence
  chemically synthesized
gggctgcaacctccgcctcc

SEQ ID NO: 377375 - DNA, 20 bp, Artificial Sequence
  chemically synthesized
cccttgaacccgggaggcgg

SEQ ID NO: 377376 - DNA, 20 bp, Artificial Sequence
  chemically synthesized
aacccgggaggcggaggttg

SEQ ID NO: 377377 - DNA, 20 bp, Artificial Sequence
  chemically synthesized
gggaggcggaggttgcagcc

SEQ ID NO: 377378 - DNA, 20 bp, Artificial Sequence
  chemically synthesized
ggaggcggaggttgcagccc

SEQ ID NO: 377379 - DNA, 20 bp, Artificial Sequence
  chemically synthesized
ggaggttgcagcccaggttg

SEQ ID NO: 377380 - DNA, 20 bp, Artificial Sequence
  chemically synthesized
cccaggctgggctgcaacct

SEQ ID NO: 377381 - DNA, 20 bp, Artificial Sequence
  chemically synthesized
gcccaggctgggctgcaacc

SEQ ID NO: 377382 - DNA, 20 bp, Artificial Sequence
  chemically synthesized
ttgcagcccaggttgcagcc

SEQ ID NO: 377383 - DNA, 20 bp, Artificial Sequence
  chemically synthesized
gcccaggttgcagcccagcc

SEQ ID NO: 377384 - DNA, 20 bp, Artificial Sequence
  chemically synthesized
cccaggttgcagcccagcct

SEQ ID NO: 377385 - DNA, 20 bp, Artificial Sequence
  chemically synthesized
ctcactctgtcgcccaggct

SEQ ID NO: 377386 - DNA, 20 bp, Artificial Sequence
  chemically synthesized
tctcactctgtcgcccaggc

SEQ ID NO: 377387 - DNA, 20 bp, Artificial Sequence
  chemically synthesized
ttgcagcccagcctgggcga

SEQ ID NO: 377388 - DNA, 20 bp, Artificial Sequence
  chemically synthesized
tgagtctcactctgtcgccc

SEQ ID NO: 377389 - DNA, 20 bp, Artificial Sequence
  chemically synthesized
gcagcccagcctgggcgaca

SEQ ID NO: 377390 - DNA, 20 bp, Artificial Sequence
  chemically synthesized
ctgagtctcactctgtcgcc

SEQ ID NO: 377391 - DNA, 20 bp, Artificial Sequence
  chemically synthesized
cccagcctgggcgacagagt

SEQ ID NO: 377392 - DNA, 20 bp, Artificial Sequence
  chemically synthesized
ctgggcgacagagtgagact

SEQ ID NO: 377393 - DNA, 20 bp, Artificial Sequence
  chemically synthesized
ttttttttttttttgagact

SEQ ID NO: 377394 - DNA, 20 bp, Artificial Sequence
  chemically synthesized
tttttttttttttttttttt

SEQ ID NO: 377395 - DNA, 20 bp, Artificial Sequence
  chemically synthesized
caaaaaaaaaaaaaaaaaaa

SEQ ID NO: 377396 - DNA, 20 bp, Artificial Sequence
  chemically synthesized
aaaaaaaaaaagaaactaaa

SEQ ID NO: 377397 - DNA, 20 bp, Artificial Sequence
  chemically synthesized
aataaatgaaaatttctttt

SEQ ID NO: 377398 - DNA, 20 bp, Artificial Sequence
  chemically synthesized
aagaaattttcatttattat

SEQ ID NO: 377399 - DNA, 20 bp, Artificial Sequence
  chemically synthesized
catttattatcagcaactaa

SEQ ID NO: 377400 - DNA, 20 bp, Artificial Sequence
  chemically synthesized
atttattatcagcaactaaa

SEQ ID NO: 377401 - DNA, 20 bp, Artificial Sequence
  chemically synthesized
atctttgtacttaatccttt

SEQ ID NO: 377402 - DNA, 20 bp, Artificial Sequence
  chemically synthesized
tatcagcaactaaaaggatt

SEQ ID NO: 377403 - DNA, 20 bp, Artificial Sequence
  chemically synthesized
aactaaaaggattaagtaca

SEQ ID NO: 377404 - DNA, 20 bp, Artificial Sequence
  chemically synthesized
agtacaaagataatgtaact

SEQ ID NO: 377405 - DNA, 20 bp, Artificial Sequence
  chemically synthesized
agataatgtaactaagcatt

SEQ ID NO: 377406 - DNA, 20 bp, Artificial Sequence
  chemically synthesized
agtcttcccctctaaatgct

SEQ ID NO: 377407 - DNA, 20 bp, Artificial Sequence
  chemically synthesized
ataatgtaactaagcattta

SEQ ID NO: 377408 - DNA, 20 bp, Artificial Sequence
  chemically synthesized
taatgtaactaagcatttag

SEQ ID NO: 377409 - DNA, 20 bp, Artificial Sequence
  chemically synthesized
aatgtaactaagcatttaga

SEQ ID NO: 377410 - DNA, 20 bp, Artificial Sequence
  chemically synthesized
atgtaactaagcatttagag

SEQ ID NO: 377411 - DNA, 20 bp, Artificial Sequence
  chemically synthesized
taactaagcatttagagggg

SEQ ID NO: 377412 - DNA, 20 bp, Artificial Sequence
  chemically synthesized
aagcatttagaggggaagac

SEQ ID NO: 377413 - DNA, 20 bp, Artificial Sequence
  chemically synthesized
taccatacccttacacatac

SEQ ID NO: 377414 - DNA, 20 bp, Artificial Sequence
  chemically synthesized
aggggaagactggtatgtgt

SEQ ID NO: 377415 - DNA, 20 bp, Artificial Sequence
  chemically synthesized
ggggaagactggtatgtgta

SEQ ID NO: 377416 - DNA, 20 bp, Artificial Sequence
  chemically synthesized
gggaagactggtatgtgtaa

SEQ ID NO: 377417 - DNA, 20 bp, Artificial Sequence
  chemically synthesized
gactggtatgtgtaagggta

SEQ ID NO: 377418 - DNA, 20 bp, Artificial Sequence
  chemically synthesized
gtataaaaatcataactctt

SEQ ID NO: 377419 - DNA, 20 bp, Artificial Sequence
  chemically synthesized
taaaaatcataactcttcag

SEQ ID NO: 377420 - DNA, 20 bp, Artificial Sequence
  chemically synthesized
aagtctttgtttcttctgaa

SEQ ID NO: 377421 - DNA, 20 bp, Artificial Sequence
  chemically synthesized
aaaagtctttgtttcttctg

SEQ ID NO: 377422 - DNA, 20 bp, Artificial Sequence
  chemically synthesized
ataactcttcagaagaaaca

SEQ ID NO: 377423 - DNA, 20 bp, Artificial Sequence
  chemically synthesized
atttcattgcaattattcaa

SEQ ID NO: 377424 - DNA, 20 bp, Artificial Sequence
  chemically synthesized
taattgcaatgaaatgtatg

SEQ ID NO: 377425 - DNA, 20 bp, Artificial Sequence
  chemically synthesized
aattgcaatgaaatgtatgt

SEQ ID NO: 377426 - DNA, 20 bp, Artificial Sequence
  chemically synthesized
tgcaatgaaatgtatgtagg

SEQ ID NO: 377427 - DNA, 20 bp, Artificial Sequence
  chemically synthesized
gcaatgaaatgtatgtaggt

SEQ ID NO: 377428 - DNA, 20 bp, Artificial Sequence
  chemically synthesized
caatgaaatgtatgtaggta

SEQ ID NO: 377429 - DNA, 20 bp, Artificial Sequence
  chemically synthesized
tgaaatgtatgtaggtaggg

SEQ ID NO: 377430 - DNA, 20 bp, Artificial Sequence
  chemically synthesized
gaaatgtatgtaggtagggt

SEQ ID NO: 377431 - DNA, 20 bp, Artificial Sequence
  chemically synthesized
aaatgtatgtaggtagggtg

SEQ ID NO: 377432 - DNA, 20 bp, Artificial Sequence
  chemically synthesized
atgtaggtagggtggggaaa

SEQ ID NO: 377433 - DNA, 20 bp, Artificial Sequence
  chemically synthesized
taggtagggtggggaaaaag

SEQ ID NO: 377434 - DNA, 20 bp, Artificial Sequence
  chemically synthesized
aggtagggtggggaaaaagt

SEQ ID NO: 377435 - DNA, 20 bp, Artificial Sequence
  chemically synthesized
gtagggtggggaaaaagtgg

SEQ ID NO: 377436 - DNA, 20 bp, Artificial Sequence
  chemically synthesized
gggtggggaaaaagtgggag

SEQ ID NO: 377437 - DNA, 20 bp, Artificial Sequence
  chemically synthesized
tggggaaaaagtgggagaag

SEQ ID NO: 377438 - DNA, 20 bp, Artificial Sequence
  chemically synthesized
ggggaaaaagtgggagaaga

SEQ ID NO: 377439 - DNA, 20 bp, Artificial Sequence
  chemically synthesized
gggaaaaagtgggagaagaa

SEQ ID NO: 377440 - DNA, 20 bp, Artificial Sequence
  chemically synthesized
gtgggagaagaagggaatta

SEQ ID NO: 377441 - DNA, 20 bp, Artificial Sequence
  chemically synthesized
ggagaagaagggaattacag

SEQ ID NO: 377442 - DNA, 20 bp, Artificial Sequence
  chemically synthesized
agaagaagggaattacagca

SEQ ID NO: 377443 - DNA, 20 bp, Artificial Sequence
  chemically synthesized
gaagaagggaattacagcag

SEQ ID NO: 377444 - DNA, 20 bp, Artificial Sequence
  chemically synthesized
agaagggaattacagcagag

SEQ ID NO: 377445 - DNA, 20 bp, Artificial Sequence
  chemically synthesized
gaagggaattacagcagagg

SEQ ID NO: 377446 - DNA, 20 bp, Artificial Sequence
  chemically synthesized
ggaattacagcagaggaggc

SEQ ID NO: 377447 - DNA, 20 bp, Artificial Sequence
  chemically synthesized
gaattacagcagaggaggcg

SEQ ID NO: 377448 - DNA, 20 bp, Artificial Sequence
  chemically synthesized
ttacagcagaggaggcgagg

SEQ ID NO: 377449 - DNA, 20 bp, Artificial Sequence
  chemically synthesized
acagcagaggaggcgaggta

SEQ ID NO: 377450 - DNA, 20 bp, Artificial Sequence
  chemically synthesized
cagcagaggaggcgaggtag

SEQ ID NO: 377451 - DNA, 20 bp, Artificial Sequence
  chemically synthesized
cagaggaggcgaggtagagg

SEQ ID NO: 377452 - DNA, 20 bp, Artificial Sequence
  chemically synthesized
agaggaggcgaggtagagga

SEQ ID NO: 377453 - DNA, 20 bp, Artificial Sequence
  chemically synthesized
aaggcaaaaaccaaattaca

SEQ ID NO: 377454 - DNA, 20 bp, Artificial Sequence
  chemically synthesized
acaaaatgccctttgtaatt

SEQ ID NO: 377455 - DNA, 20 bp, Artificial Sequence
  chemically synthesized
aggcaaaaaccaaattacaa

SEQ ID NO: 377456 - DNA, 20 bp, Artificial Sequence
  chemically synthesized
ggcaaaaaccaaattacaaa

SEQ ID NO: 377457 - DNA, 20 bp, Artificial Sequence
  chemically synthesized
agggcattttgtgcaatgct

SEQ ID NO: 377458 - DNA, 20 bp, Artificial Sequence
  chemically synthesized
gggcattttgtgcaatgctg

SEQ ID NO: 377459 - DNA, 20 bp, Artificial Sequence
  chemically synthesized
ggcattttgtgcaatgctga

SEQ ID NO: 377460 - DNA, 20 bp, Artificial Sequence
  chemically synthesized
gcattttgtgcaatgctgag

SEQ ID NO: 377461 - DNA, 20 bp, Artificial Sequence
  chemically synthesized
tattataaaaataaacccct

SEQ ID NO: 377462 - DNA, 20 bp, Artificial Sequence
  chemically synthesized
ggggtttatttttataataa

SEQ ID NO: 377463 - DNA, 20 bp, Artificial Sequence
  chemically synthesized
tatttttataataaaagctg

SEQ ID NO: 377464 - DNA, 20 bp, Artificial Sequence
  chemically synthesized
atttttataataaaagctgt

SEQ ID NO: 377465 - DNA, 20 bp, Artificial Sequence
  chemically synthesized
tttttataataaaagctgta

SEQ ID NO: 377466 - DNA, 20 bp, Artificial Sequence
  chemically synthesized
aatgctttaacgtttcccta

SEQ ID NO: 377467 - DNA, 20 bp, Artificial Sequence
  chemically synthesized
aaagctgtagggaaacgtta

SEQ ID NO: 377468 - DNA, 20 bp, Artificial Sequence
  chemically synthesized
gtagggaaacgttaaagcat

SEQ ID NO: 377469 - DNA, 20 bp, Artificial Sequence
  chemically synthesized
acgttaaagcattggtttcc

SEQ ID NO: 377470 - DNA, 20 bp, Artificial Sequence
  chemically synthesized
aaagcattggtttccaagcc

SEQ ID NO: 377471 - DNA, 20 bp, Artificial Sequence
  chemically synthesized
ctgtaatgctcagctaggct

SEQ ID NO: 377472 - DNA, 20 bp, Artificial Sequence
  chemically synthesized
attggtttccaagcctagct

SEQ ID NO: 377473 - DNA, 20 bp, Artificial Sequence
  chemically synthesized
ggtaactgtaatgctcagct

SEQ ID NO: 377474 - DNA, 20 bp, Artificial Sequence
  chemically synthesized
gggtaactgtaatgctcagc

SEQ ID NO: 377475 - DNA, 20 bp, Artificial Sequence
  chemically synthesized
ccaagcctagctgagcatta

SEQ ID NO: 377476 - DNA, 20 bp, Artificial Sequence
  chemically synthesized
ccctgggtaactgtaatgct

SEQ ID NO: 377477 - DNA, 20 bp, Artificial Sequence
  chemically synthesized
agctgagcattacagttacc

SEQ ID NO: 377478 - DNA, 20 bp, Artificial Sequence
  chemically synthesized
gctgagcattacagttaccc

SEQ ID NO: 377479 - DNA, 20 bp, Artificial Sequence
  chemically synthesized
ctgagcattacagttaccca

SEQ ID NO: 377480 - DNA, 20 bp, Artificial Sequence
  chemically synthesized
gagcattacagttacccagg

SEQ ID NO: 377481 - DNA, 20 bp, Artificial Sequence
  chemically synthesized
gcattttaagaaagctccct

SEQ ID NO: 377482 - DNA, 20 bp, Artificial Sequence
  chemically synthesized
agcattttaagaaagctccc

SEQ ID NO: 377483 - DNA, 20 bp, Artificial Sequence
  chemically synthesized
tgggagtgagcattttaaga

SEQ ID NO: 377484 - DNA, 20 bp, Artificial Sequence
  chemically synthesized
ggactgggagtgagcatttt

SEQ ID NO: 377485 - DNA, 20 bp, Artificial Sequence
  chemically synthesized
tttcttaaaatgctcactcc

SEQ ID NO: 377486 - DNA, 20 bp, Artificial Sequence
  chemically synthesized
gggtatgagggactgggagt

SEQ ID NO: 377487 - DNA, 20 bp, Artificial Sequence
  chemically synthesized
ctctgggtatgagggactgg

SEQ ID NO: 377488 - DNA, 20 bp, Artificial Sequence
  chemically synthesized
atctctgggtatgagggact

SEQ ID NO: 377489 - DNA, 20 bp, Artificial Sequence
  chemically synthesized
aatctctgggtatgagggac

SEQ ID NO: 377490 - DNA, 20 bp, Artificial Sequence
  chemically synthesized
cactcccagtccctcatacc

SEQ ID NO: 377491 - DNA, 20 bp, Artificial Sequence
  chemically synthesized
atcagaatctctgggtatga

SEQ ID NO: 377492 - DNA, 20 bp, Artificial Sequence
  chemically synthesized
aatcagaatctctgggtatg

SEQ ID NO: 377493 - DNA, 20 bp, Artificial Sequence
  chemically synthesized
ctcccagtccctcataccca

SEQ ID NO: 377494 - DNA, 20 bp, Artificial Sequence
  chemically synthesized
aaatcagaatctctgggtat

SEQ ID NO: 377495 - DNA, 20 bp, Artificial Sequence
  chemically synthesized
taaattaaatcagaatctct

SEQ ID NO: 377496 - DNA, 20 bp, Artificial Sequence
  chemically synthesized
ataaattaaatcagaatctc

SEQ ID NO: 377497 - DNA, 20 bp, Artificial Sequence
  chemically synthesized
ccacccaagataaattaaat

SEQ ID NO: 377498 - DNA, 20 bp, Artificial Sequence
  chemically synthesized
gattctgatttaatttatct

SEQ ID NO: 377499 - DNA, 20 bp, Artificial Sequence
  chemically synthesized
attctgatttaatttatctt

SEQ ID NO: 377500 - DNA, 20 bp, Artificial Sequence
  chemically synthesized
ctgatttaatttatcttggg

SEQ ID NO: 377501 - DNA, 20 bp, Artificial Sequence
  chemically synthesized
gatttaatttatcttgggtg

SEQ ID NO: 377502 - DNA, 20 bp, Artificial Sequence
  chemically synthesized
aaaatcaccaggctccaccc

SEQ ID NO: 377503 - DNA, 20 bp, Artificial Sequence
  chemically synthesized
aatttatcttgggtggagcc

SEQ ID NO: 377504 - DNA, 20 bp, Artificial Sequence
  chemically synthesized
agctacatgtgaaaatcacc

SEQ ID NO: 377505 - DNA, 20 bp, Artificial Sequence
  chemically synthesized
tagctacatgtgaaaatcac

SEQ ID NO: 377506 - DNA, 20 bp, Artificial Sequence
  chemically synthesized
agcctggtgattttcacatg

SEQ ID NO: 377507 - DNA, 20 bp, Artificial Sequence
  chemically synthesized
ggtgattttcacatgtagct

SEQ ID NO: 377508 - DNA, 20 bp, Artificial Sequence
  chemically synthesized
gtgattttcacatgtagcta

SEQ ID NO: 377509 - DNA, 20 bp, Artificial Sequence
  chemically synthesized
aacacagccgttagcaacct

SEQ ID NO: 377510 - DNA, 20 bp, Artificial Sequence
  chemically synthesized
catgtagctaaggttgctaa

SEQ ID NO: 377511 - DNA, 20 bp, Artificial Sequence
  chemically synthesized
aaatccattaacacagccgt

SEQ ID NO: 377512 - DNA, 20 bp, Artificial Sequence
  chemically synthesized
gttgctaacggctgtgttaa

SEQ ID NO: 377513 - DNA, 20 bp, Artificial Sequence
  chemically synthesized
ttacttaaaatccattaaca

SEQ ID NO: 377514 - DNA, 20 bp, Artificial Sequence
  chemically synthesized
cggctgtgttaatggatttt

SEQ ID NO: 377515 - DNA, 20 bp, Artificial Sequence
  chemically synthesized
ttttaagtaaactacacaat

SEQ ID NO: 377516 - DNA, 20 bp, Artificial Sequence
  chemically synthesized
acaatataaatctgattgtg

SEQ ID NO: 377517 - DNA, 20 bp, Artificial Sequence
  chemically synthesized
acacaatcagatttatattg

SEQ ID NO: 377518 - DNA, 20 bp, Artificial Sequence
  chemically synthesized
tgtggaatgaacactaatcc

SEQ ID NO: 377519 - DNA, 20 bp, Artificial Sequence
  chemically synthesized
ggaatgaacactaatcctgg

SEQ ID NO: 377520 - DNA, 20 bp, Artificial Sequence
  chemically synthesized
agtctaaatactgccaggat

SEQ ID NO: 377521 - DNA, 20 bp, Artificial Sequence
  chemically synthesized
aaatcagtctaaatactgcc

SEQ ID NO: 377522 - DNA, 20 bp, Artificial Sequence
  chemically synthesized
aaaatcagtctaaatactgc

SEQ ID NO: 377523 - DNA, 20 bp, Artificial Sequence
  chemically synthesized
acactaatcctggcagtatt

SEQ ID NO: 377524 - DNA, 20 bp, Artificial Sequence
  chemically synthesized
ggcagtatttagactgattt

SEQ ID NO: 377525 - DNA, 20 bp, Artificial Sequence
  chemically synthesized
agtttagtctattccaaaat

SEQ ID NO: 377526 - DNA, 20 bp, Artificial Sequence
  chemically synthesized
tatttagactgattttggaa

SEQ ID NO: 377527 - DNA, 20 bp, Artificial Sequence
  chemically synthesized
ataagaaatccagtgcagtt

SEQ ID NO: 377528 - DNA, 20 bp, Artificial Sequence
  chemically synthesized
tggaatagactaaactgcac

SEQ ID NO: 377529 - DNA, 20 bp, Artificial Sequence
  chemically synthesized
atatcataagaaatccagtg

SEQ ID NO: 377530 - DNA, 20 bp, Artificial Sequence
  chemically synthesized
tgataatatcataagaaatc

SEQ ID NO: 377531 - DNA, 20 bp, Artificial Sequence
  chemically synthesized
tattataatgataatatcat

SEQ ID NO: 377532 - DNA, 20 bp, Artificial Sequence
  chemically synthesized
atgatattatcattataata

SEQ ID NO: 377533 - DNA, 20 bp, Artificial Sequence
  chemically synthesized
tgatattatcattataatat

SEQ ID NO: 377534 - DNA, 20 bp, Artificial Sequence
  chemically synthesized
attatcattataatatagga

SEQ ID NO: 377535 - DNA, 20 bp, Artificial Sequence
  chemically synthesized
atcattataatataggaaag

SEQ ID NO: 377536 - DNA, 20 bp, Artificial Sequence
  chemically synthesized
aatataggaaagaagacctg

SEQ ID NO: 377537 - DNA, 20 bp, Artificial Sequence
  chemically synthesized
tggcttcactttagatcttc

SEQ ID NO: 377538 - DNA, 20 bp, Artificial Sequence
  chemically synthesized
ctggcttcactttagatctt

SEQ ID NO: 377539 - DNA, 20 bp, Artificial Sequence
  chemically synthesized
aaagaagacctgaagatcta

SEQ ID NO: 377540 - DNA, 20 bp, Artificial Sequence
  chemically synthesized
agacctgaagatctaaagtg

SEQ ID NO: 377541 - DNA, 20 bp, Artificial Sequence
  chemically synthesized
cttactacctggcttcactt

SEQ ID NO: 377542 - DNA, 20 bp, Artificial Sequence
  chemically synthesized
ctgaagatctaaagtgaagc

SEQ ID NO: 377543 - DNA, 20 bp, Artificial Sequence
  chemically synthesized
tgaagatctaaagtgaagcc

SEQ ID NO: 377544 - DNA, 20 bp, Artificial Sequence
  chemically synthesized
agatctaaagtgaagccagg

SEQ ID NO: 377545 - DNA, 20 bp, Artificial Sequence
  chemically synthesized
ctaaagtgaagccaggtagt

SEQ ID NO: 377546 - DNA, 20 bp, Artificial Sequence
  chemically synthesized
taaagtgaagccaggtagta

SEQ ID NO: 377547 - DNA, 20 bp, Artificial Sequence
  chemically synthesized
ccttatccatccttactacc

SEQ ID NO: 377548 - DNA, 20 bp, Artificial Sequence
  chemically synthesized
gtgaagccaggtagtaagga

SEQ ID NO: 377549 - DNA, 20 bp, Artificial Sequence
  chemically synthesized
gccaggtagtaaggatggat

SEQ ID NO: 377550 - DNA, 20 bp, Artificial Sequence
  chemically synthesized
ccaggtagtaaggatggata

SEQ ID NO: 377551 - DNA, 20 bp, Artificial Sequence
  chemically synthesized
aggtagtaaggatggataag

SEQ ID NO: 377552 - DNA, 20 bp, Artificial Sequence
  chemically synthesized
tagtaaggatggataaggag

SEQ ID NO: 377553 - DNA, 20 bp, Artificial Sequence
  chemically synthesized
agtaaggatggataaggagt

SEQ ID NO: 377554 - DNA, 20 bp, Artificial Sequence
  chemically synthesized
taaggatggataaggagtgg

SEQ ID NO: 377555 - DNA, 20 bp, Artificial Sequence
  chemically synthesized
ggatggataaggagtgggag

SEQ ID NO: 377556 - DNA, 20 bp, Artificial Sequence
  chemically synthesized
aggagtgggagtggcattca

SEQ ID NO: 377557 - DNA, 20 bp, Artificial Sequence
  chemically synthesized
attcatagttttaatgcgac

SEQ ID NO: 377558 - DNA, 20 bp, Artificial Sequence
  chemically synthesized
ttttaatgcgactggaacac

SEQ ID NO: 377559 - DNA, 20 bp, Artificial Sequence
  chemically synthesized
atatcttgcttctcgtgttc

SEQ ID NO: 377560 - DNA, 20 bp, Artificial Sequence
  chemically synthesized
taatgcgactggaacacgag

SEQ ID NO: 377561 - DNA, 20 bp, Artificial Sequence
  chemically synthesized
gcgactggaacacgagaagc

SEQ ID NO: 377562 - DNA, 20 bp, Artificial Sequence
  chemically synthesized
acacgagaagcaagatatca

SEQ ID NO: 377563 - DNA, 20 bp, Artificial Sequence
  chemically synthesized
caggagtagagtttgaattc

SEQ ID NO: 377564 - DNA, 20 bp, Artificial Sequence
  chemically synthesized
acaacaaagtggcaggagta

SEQ ID NO: 377565 - DNA, 20 bp, Artificial Sequence
  chemically synthesized
caacaacaaagtggcaggag

SEQ ID NO: 377566 - DNA, 20 bp, Artificial Sequence
  chemically synthesized
acacaacaacaaagtggcag

SEQ ID NO: 377567 - DNA, 20 bp, Artificial Sequence
  chemically synthesized
tcacacaacaacaaagtggc

SEQ ID NO: 377568 - DNA, 20 bp, Artificial Sequence
  chemically synthesized
ttcacacaacaacaaagtgg

SEQ ID NO: 377569 - DNA, 20 bp, Artificial Sequence
  chemically synthesized
aagttcacacaacaacaaag

SEQ ID NO: 377570 - DNA, 20 bp, Artificial Sequence
  chemically synthesized
tctaagttcacacaacaaca

SEQ ID NO: 377571 - DNA, 20 bp, Artificial Sequence
  chemically synthesized
actttgttgttgtgtgaact

SEQ ID NO: 377572 - DNA, 20 bp, Artificial Sequence
  chemically synthesized
gttgttgtgtgaacttagac

SEQ ID NO: 377573 - DNA, 20 bp, Artificial Sequence
  chemically synthesized
agtggttaagtaacttgtct

SEQ ID NO: 377574 - DNA, 20 bp, Artificial Sequence
  chemically synthesized
aaaagagacttagagtggtt

SEQ ID NO: 377575 - DNA, 20 bp, Artificial Sequence
  chemically synthesized
acaagttacttaaccactct

SEQ ID NO: 377576 - DNA, 20 bp, Artificial Sequence
  chemically synthesized
gagcaaaaagagacttagag

SEQ ID NO: 377577 - DNA, 20 bp, Artificial Sequence
  chemically synthesized
tatgagcaaaaagagactta

SEQ ID NO: 377578 - DNA, 20 bp, Artificial Sequence
  chemically synthesized
catatgagcaaaaagagact

SEQ ID NO: 377579 - DNA, 20 bp, Artificial Sequence
  chemically synthesized
atttcacatatgagcaaaaa

SEQ ID NO: 377580 - DNA, 20 bp, Artificial Sequence
  chemically synthesized
ccatttcacatatgagcaaa

SEQ ID NO: 377581 - DNA, 20 bp, Artificial Sequence
  chemically synthesized
attatttccatttcacatat

SEQ ID NO: 377582 - DNA, 20 bp, Artificial Sequence
  chemically synthesized
ctttttgctcatatgtgaaa

SEQ ID NO: 377583 - DNA, 20 bp, Artificial Sequence
  chemically synthesized
atgtgaaatggaaataataa

SEQ ID NO: 377584 - DNA, 20 bp, Artificial Sequence
  chemically synthesized
aaataataatagctgcacca

SEQ ID NO: 377585 - DNA, 20 bp, Artificial Sequence
  chemically synthesized
agttgaaaatttctgtggtg

SEQ ID NO: 377586 - DNA, 20 bp, Artificial Sequence
  chemically synthesized
ttgacagttgaaaatttctg

SEQ ID NO: 377587 - DNA, 20 bp, Artificial Sequence
  chemically synthesized
gaaattttcaactgtcaaac

SEQ ID NO: 377588 - DNA, 20 bp, Artificial Sequence
  chemically synthesized
aaattttcaactgtcaaacc

SEQ ID NO: 377589 - DNA, 20 bp, Artificial Sequence
  chemically synthesized
aacttccttacctggtttga

SEQ ID NO: 377590 - DNA, 20 bp, Artificial Sequence
  chemically synthesized
tttcaactgtcaaaccaggt

SEQ ID NO: 377591 - DNA, 20 bp, Artificial Sequence
  chemically synthesized
ttcaactgtcaaaccaggta

SEQ ID NO: 377592 - DNA, 20 bp, Artificial Sequence
  chemically synthesized
aactgtcaaaccaggtaagg

SEQ ID NO: 377593 - DNA, 20 bp, Artificial Sequence
  chemically synthesized
ccattattaacttccttacc

SEQ ID NO: 377594 - DNA, 20 bp, Artificial Sequence
  chemically synthesized
ccaggtaaggaagttaataa

SEQ ID NO: 377595 - DNA, 20 bp, Artificial Sequence
  chemically synthesized
aataatggataacaatatca

SEQ ID NO: 377596 - DNA, 20 bp, Artificial Sequence
  chemically synthesized
ggataacaatatcaaagata

SEQ ID NO: 377597 - DNA, 20 bp, Artificial Sequence
  chemically synthesized
atatagcaaatattcaacaa

SEQ ID NO: 377598 - DNA, 20 bp, Artificial Sequence
  chemically synthesized
agcaaatattcaacaatgga

SEQ ID NO: 377599 - DNA, 20 bp, Artificial Sequence
  chemically synthesized
ggacagtcattatgaaaatc

SEQ ID NO: 377600 - DNA, 20 bp, Artificial Sequence
  chemically synthesized
ttatgaaaatctagctgtct

SEQ ID NO: 377601 - DNA, 20 bp, Artificial Sequence
  chemically synthesized
agcacatttactgagacagc

SEQ ID NO: 377602 - DNA, 20 bp, Artificial Sequence
  chemically synthesized
atccagcacatttactgaga

SEQ ID NO: 377603 - DNA, 20 bp, Artificial Sequence
  chemically synthesized
attcatccagcacatttact

SEQ ID NO: 377604 - DNA, 20 bp, Artificial Sequence
  chemically synthesized
agctgtctcagtaaatgtgc

SEQ ID NO: 377605 - DNA, 20 bp, Artificial Sequence
  chemically synthesized
agtaaatgtgctggatgaat

SEQ ID NO: 377606 - DNA, 20 bp, Artificial Sequence
  chemically synthesized
acctttccctcttattcatc

SEQ ID NO: 377607 - DNA, 20 bp, Artificial Sequence
  chemically synthesized
taaatgtgctggatgaataa

SEQ ID NO: 377608 - DNA, 20 bp, Artificial Sequence
  chemically synthesized
aaatgtgctggatgaataag

SEQ ID NO: 377609 - DNA, 20 bp, Artificial Sequence
  chemically synthesized
aatgtgctggatgaataaga

SEQ ID NO: 377610 - DNA, 20 bp, Artificial Sequence
  chemically synthesized
tgctggatgaataagaggga

SEQ ID NO: 377611 - DNA, 20 bp, Artificial Sequence
  chemically synthesized
gctggatgaataagagggaa

SEQ ID NO: 377612 - DNA, 20 bp, Artificial Sequence
  chemically synthesized
atgaataagagggaaaggtg

SEQ ID NO: 377613 - DNA, 20 bp, Artificial Sequence
  chemically synthesized
taagagggaaaggtgtagct

SEQ ID NO: 377614 - DNA, 20 bp, Artificial Sequence
  chemically synthesized
gaaaggtgtagcttggcttc

SEQ ID NO: 377615 - DNA, 20 bp, Artificial Sequence
  chemically synthesized
acatataaattctagaagcc

SEQ ID NO: 377616 - DNA, 20 bp, Artificial Sequence
  chemically synthesized
agattacatataaattctag

SEQ ID NO: 377617 - DNA, 20 bp, Artificial Sequence
  chemically synthesized
aaaagattacatataaattc

SEQ ID NO: 377618 - DNA, 20 bp, Artificial Sequence
  chemically synthesized
tattttatattttaagaaaa

SEQ ID NO: 377619 - DNA, 20 bp, Artificial Sequence
  chemically synthesized
ctctatatattttatatttt

SEQ ID NO: 377620 - DNA, 20 bp, Artificial Sequence
  chemically synthesized
ttcttaaaatataaaatata

SEQ ID NO: 377621 - DNA, 20 bp, Artificial Sequence
  chemically synthesized
cttaaaatataaaatatata

SEQ ID NO: 377622 - DNA, 20 bp, Artificial Sequence
  chemically synthesized
aatatatagagaaaatctgt

SEQ ID NO: 377623 - DNA, 20 bp, Artificial Sequence
  chemically synthesized
attgagtcacttatgactta

SEQ ID NO: 377624 - DNA, 20 bp, Artificial Sequence
  chemically synthesized
agagaaaatctgtaagtcat

SEQ ID NO: 377625 - DNA, 20 bp, Artificial Sequence
  chemically synthesized
taagtcataagtgactcaat

SEQ ID NO: 377626 - DNA, 20 bp, Artificial Sequence
  chemically synthesized
tacatttgtgaaaacttatt

SEQ ID NO: 377627 - DNA, 20 bp, Artificial Sequence
  chemically synthesized
atgtaatgcacccatttaac

SEQ ID NO: 377628 - DNA, 20 bp, Artificial Sequence
  chemically synthesized
tgatctgatactggttaaat

SEQ ID NO: 377629 - DNA, 20 bp, Artificial Sequence
  chemically synthesized
ttgatctgatactggttaaa

SEQ ID NO: 377630 - DNA, 20 bp, Artificial Sequence
  chemically synthesized
tgcacccatttaaccagtat

SEQ ID NO: 377631 - DNA, 20 bp, Artificial Sequence
  chemically synthesized
tcggcttcttgatctgatac

SEQ ID NO: 377632 - DNA, 20 bp, Artificial Sequence
  chemically synthesized
catttaaccagtatcagatc

SEQ ID NO: 377633 - DNA, 20 bp, Artificial Sequence
  chemically synthesized
ttaaccagtatcagatcaag

SEQ ID NO: 377634 - DNA, 20 bp, Artificial Sequence
  chemically synthesized
tatgaagtttagataatgtt

SEQ ID NO: 377635 - DNA, 20 bp, Artificial Sequence
  chemically synthesized
cttgaaaggggtatgaagtt

SEQ ID NO: 377636 - DNA, 20 bp, Artificial Sequence
  chemically synthesized
catgacttgaaaggggtatg

SEQ ID NO: 377637 - DNA, 20 bp, Artificial Sequence
  chemically synthesized
ctaaacttcatacccctttc

SEQ ID NO: 377638 - DNA, 20 bp, Artificial Sequence
  chemically synthesized
taggagacatgacttgaaag

SEQ ID NO: 377639 - DNA, 20 bp, Artificial Sequence
  chemically synthesized
ctaggagacatgacttgaaa

SEQ ID NO: 377640 - DNA, 20 bp, Artificial Sequence
  chemically synthesized
cctaggagacatgacttgaa

SEQ ID NO: 377641 - DNA, 20 bp, Artificial Sequence
  chemically synthesized
ccctaggagacatgacttga

SEQ ID NO: 377642 - DNA, 20 bp, Artificial Sequence
  chemically synthesized
ccctttcaagtcatgtctcc

SEQ ID NO: 377643 - DNA, 20 bp, Artificial Sequence
  chemically synthesized
cctttcaagtcatgtctcct

SEQ ID NO: 377644 - DNA, 20 bp, Artificial Sequence
  chemically synthesized
ctttcaagtcatgtctccta

SEQ ID NO: 377645 - DNA, 20 bp, Artificial Sequence
  chemically synthesized
gggccaaataaataccctag

SEQ ID NO: 377646 - DNA, 20 bp, Artificial Sequence
  chemically synthesized
gtgggccaaataaataccct

SEQ ID NO: 377647 - DNA, 20 bp, Artificial Sequence
  chemically synthesized
agtgggccaaataaataccc

SEQ ID NO: 377648 - DNA, 20 bp, Artificial Sequence
  chemically synthesized
tgtctcctagggtatttatt

SEQ ID NO: 377649 - DNA, 20 bp, Artificial Sequence
  chemically synthesized
gctatttctaaacatttagt

SEQ ID NO: 377650 - DNA, 20 bp, Artificial Sequence
  chemically synthesized
tgctatttctaaacatttag

SEQ ID NO: 377651 - DNA, 20 bp, Artificial Sequence
  chemically synthesized
tatttggcccactaaatgtt

SEQ ID NO: 377652 - DNA, 20 bp, Artificial Sequence
  chemically synthesized
tcttgctatttctaaacatt

SEQ ID NO: 377653 - DNA, 20 bp, Artificial Sequence
  chemically synthesized
gcccactaaatgtttagaaa

SEQ ID NO: 377654 - DNA, 20 bp, Artificial Sequence
  chemically synthesized
actaaatgtttagaaatagc

SEQ ID NO: 377655 - DNA, 20 bp, Artificial Sequence
  chemically synthesized
taaatgtttagaaatagcaa

SEQ ID NO: 377656 - DNA, 20 bp, Artificial Sequence
  chemically synthesized
tgtttagaaatagcaagaga

SEQ ID NO: 377657 - DNA, 20 bp, Artificial Sequence
  chemically synthesized
aatagcaagagaaagattat

SEQ ID NO: 377658 - DNA, 20 bp, Artificial Sequence
  chemically synthesized
agcaagagaaagattataag

SEQ ID NO: 377659 - DNA, 20 bp, Artificial Sequence
  chemically synthesized
caagagaaagattataagaa

SEQ ID NO: 377660 - DNA, 20 bp, Artificial Sequence
  chemically synthesized
aagagaaagattataagaag

SEQ ID NO: 377661 - DNA, 20 bp, Artificial Sequence
  chemically synthesized
aaagattataagaagaggtg

SEQ ID NO: 377662 - DNA, 20 bp, Artificial Sequence
  chemically synthesized
gattataagaagaggtgtag

SEQ ID NO: 377663 - DNA, 20 bp, Artificial Sequence
  chemically synthesized
ttataagaagaggtgtagta

SEQ ID NO: 377664 - DNA, 20 bp, Artificial Sequence
  chemically synthesized
ataagaagaggtgtagtaga

SEQ ID NO: 377665 - DNA, 20 bp, Artificial Sequence
  chemically synthesized
taagaagaggtgtagtagag

SEQ ID NO: 377666 - DNA, 20 bp, Artificial Sequence
  chemically synthesized
gaagaggtgtagtagagagg

SEQ ID NO: 377667 - DNA, 20 bp, Artificial Sequence
  chemically synthesized
aggtgtagtagagaggaaga

SEQ ID NO: 377668 - DNA, 20 bp, Artificial Sequence
  chemically synthesized
ggtgtagtagagaggaagat

SEQ ID NO: 377669 - DNA, 20 bp, Artificial Sequence
  chemically synthesized
gaggaagataggtttaattt

SEQ ID NO: 377670 - DNA, 20 bp, Artificial Sequence
  chemically synthesized
agataggtttaattttggat

SEQ ID NO: 377671 - DNA, 20 bp, Artificial Sequence
  chemically synthesized
taggtttaattttggataag

SEQ ID NO: 377672 - DNA, 20 bp, Artificial Sequence
  chemically synthesized
aggtttaattttggataagt

SEQ ID NO: 377673 - DNA, 20 bp, Artificial Sequence
  chemically synthesized
ggtttaattttggataagtg

SEQ ID NO: 377674 - DNA, 20 bp, Artificial Sequence
  chemically synthesized
aattttggataagtggggtc

SEQ ID NO: 377675 - DNA, 20 bp, Artificial Sequence
  chemically synthesized
ttttggataagtggggtcaa

SEQ ID NO: 377676 - DNA, 20 bp, Artificial Sequence
  chemically synthesized
taagtggggtcaagagcctg

SEQ ID NO: 377677 - DNA, 20 bp, Artificial Sequence
  chemically synthesized
aagtggggtcaagagcctgt

SEQ ID NO: 377678 - DNA, 20 bp, Artificial Sequence
  chemically synthesized
tttccatttgaatatcccac

SEQ ID NO: 377679 - DNA, 20 bp, Artificial Sequence
  chemically synthesized
ttttccatttgaatatccca

SEQ ID NO: 377680 - DNA, 20 bp, Artificial Sequence
  chemically synthesized
gagcctgtgggatattcaaa

SEQ ID NO: 377681 - DNA, 20 bp, Artificial Sequence
  chemically synthesized
gatattcaaatggaaaattc

SEQ ID NO: 377682 - DNA, 20 bp, Artificial Sequence
  chemically synthesized
attcaaatggaaaattcaag

SEQ ID NO: 377683 - DNA, 20 bp, Artificial Sequence
  chemically synthesized
ttcaaatggaaaattcaaga

SEQ ID NO: 377684 - DNA, 20 bp, Artificial Sequence
  chemically synthesized
ggaaaattcaagaaggtttt

SEQ ID NO: 377685 - DNA, 20 bp, Artificial Sequence
  chemically synthesized
aaattcaagaaggttttgag

SEQ ID NO: 377686 - DNA, 20 bp, Artificial Sequence
  chemically synthesized
agaaggttttgagcagaata

SEQ ID NO: 377687 - DNA, 20 bp, Artificial Sequence
  chemically synthesized
gaaggttttgagcagaataa

SEQ ID NO: 377688 - DNA, 20 bp, Artificial Sequence
  chemically synthesized
aaggttttgagcagaataaa

SEQ ID NO: 377689 - DNA, 20 bp, Artificial Sequence
  chemically synthesized
ttttgagcagaataaagggt

SEQ ID NO: 377690 - DNA, 20 bp, Artificial Sequence
  chemically synthesized
gcagaataaagggtaagtca

SEQ ID NO: 377691 - DNA, 20 bp, Artificial Sequence
  chemically synthesized
agtcatagacactgaactga

SEQ ID NO: 377692 - DNA, 20 bp, Artificial Sequence
  chemically synthesized
gatgctaatgtctgtcagtt

SEQ ID NO: 377693 - DNA, 20 bp, Artificial Sequence
  chemically synthesized
gctttgatgctaatgtctgt

SEQ ID NO: 377694 - DNA, 20 bp, Artificial Sequence
  chemically synthesized
gacactgaactgacagacat

SEQ ID NO: 377695 - DNA, 20 bp, Artificial Sequence
  chemically synthesized
actgacagacattagcatca

SEQ ID NO: 377696 - DNA, 20 bp, Artificial Sequence
  chemically synthesized
gacagacattagcatcaaag

SEQ ID NO: 377697 - DNA, 20 bp, Artificial Sequence
  chemically synthesized
agacattagcatcaaagcag

SEQ ID NO: 377698 - DNA, 20 bp, Artificial Sequence
  chemically synthesized
gcagtagttgacattaaaaa

SEQ ID NO: 377699 - DNA, 20 bp, Artificial Sequence
  chemically synthesized
aaaagaaaagaaaatatgaa

SEQ ID NO: 377700 - DNA, 20 bp, Artificial Sequence
  chemically synthesized
ctccatctccaaaaaaagaa

SEQ ID NO: 377701 - DNA, 20 bp, Artificial Sequence
  chemically synthesized
catattttcttttctttttt

SEQ ID NO: 377702 - DNA, 20 bp, Artificial Sequence
  chemically synthesized
tattttcttttctttttttg

SEQ ID NO: 377703 - DNA, 20 bp, Artificial Sequence
  chemically synthesized
cgagactccatctccaaaaa

SEQ ID NO: 377704 - DNA, 20 bp, Artificial Sequence
  chemically synthesized
ttcttttctttttttggaga

SEQ ID NO: 377705 - DNA, 20 bp, Artificial Sequence
  chemically synthesized
cttttctttttttggagatg

SEQ ID NO: 377706 - DNA, 20 bp, Artificial Sequence
  chemically synthesized
tccagcctgggtgacagagc

SEQ ID NO: 377707 - DNA, 20 bp, Artificial Sequence
  chemically synthesized
tggagtctcgctctgtcacc

SEQ ID NO: 377708 - DNA, 20 bp, Artificial Sequence
  chemically synthesized
gcactccagcctgggtgaca

SEQ ID NO: 377709 - DNA, 20 bp, Artificial Sequence
  chemically synthesized
ggagtctcgctctgtcaccc

SEQ ID NO: 377710 - DNA, 20 bp, Artificial Sequence
  chemically synthesized
ttgcactccagcctgggtga

SEQ ID NO: 377711 - DNA, 20 bp, Artificial Sequence
  chemically synthesized
tctcgctctgtcacccaggc

SEQ ID NO: 377712 - DNA, 20 bp, Artificial Sequence
  chemically synthesized
tcgctctgtcacccaggctg

SEQ ID NO: 377713 - DNA, 20 bp, Artificial Sequence
  chemically synthesized
ccgccattgcactccagcct

SEQ ID NO: 377714 - DNA, 20 bp, Artificial Sequence
  chemically synthesized
tccgccattgcactccagcc

SEQ ID NO: 377715 - DNA, 20 bp, Artificial Sequence
  chemically synthesized
agagatccgccattgcactc

SEQ ID NO: 377716 - DNA, 20 bp, Artificial Sequence
  chemically synthesized
tcacccaggctggagtgcaa

SEQ ID NO: 377717 - DNA, 20 bp, Artificial Sequence
  chemically synthesized
cccaggctggagtgcaatgg

SEQ ID NO: 377718 - DNA, 20 bp, Artificial Sequence
  chemically synthesized
ggcggaggttgcagtgagca

SEQ ID NO: 377719 - DNA, 20 bp, Artificial Sequence
  chemically synthesized
gaggcggaggttgcagtgag

SEQ ID NO: 377720 - DNA, 20 bp, Artificial Sequence
  chemically synthesized
cgggaggcggaggttgcagt

SEQ ID NO: 377721 - DNA, 20 bp, Artificial Sequence
  chemically synthesized
agcccgggaggcggaggttg

SEQ ID NO: 377722 - DNA, 20 bp, Artificial Sequence
  chemically synthesized
tgcttgagcccgggaggcgg

SEQ ID NO: 377723 - DNA, 20 bp, Artificial Sequence
  chemically synthesized
tcactgcaacctccgcctcc

SEQ ID NO: 377724 - DNA, 20 bp, Artificial Sequence
  chemically synthesized
ttgcttgagcccgggaggcg

SEQ ID NO: 377725 - DNA, 20 bp, Artificial Sequence
  chemically synthesized
cactgcaacctccgcctccc

SEQ ID NO: 377726 - DNA, 20 bp, Artificial Sequence
  chemically synthesized
aattgcttgagcccgggagg

SEQ ID NO: 377727 - DNA, 20 bp, Artificial Sequence
  chemically synthesized
gagaattgcttgagcccggg

SEQ ID NO: 377728 - DNA, 20 bp, Artificial Sequence
  chemically synthesized
ggagaattgcttgagcccgg

SEQ ID NO: 377729 - DNA, 20 bp, Artificial Sequence
  chemically synthesized
aacctccgcctcccgggctc

SEQ ID NO: 377730 - DNA, 20 bp, Artificial Sequence
  chemically synthesized
caggagaattgcttgagccc

SEQ ID NO: 377731 - DNA, 20 bp, Artificial Sequence
  chemically synthesized
gcaggagaattgcttgagcc

SEQ ID NO: 377732 - DNA, 20 bp, Artificial Sequence
  chemically synthesized
ctgaggcaggagaattgctt

SEQ ID NO: 377733 - DNA, 20 bp, Artificial Sequence
  chemically synthesized
ctcaagcaattctcctgcct

SEQ ID NO: 377734 - DNA, 20 bp, Artificial Sequence
  chemically synthesized
tacttgggaggctgaggcag

SEQ ID NO: 377735 - DNA, 20 bp, Artificial Sequence
  chemically synthesized
gctacttgggaggctgaggc

SEQ ID NO: 377736 - DNA, 20 bp, Artificial Sequence
  chemically synthesized
agctacttgggaggctgagg

SEQ ID NO: 377737 - DNA, 20 bp, Artificial Sequence
  chemically synthesized
cccagctacttgggaggctg

SEQ ID NO: 377738 - DNA, 20 bp, Artificial Sequence
  chemically synthesized
tcccagctacttgggaggct

SEQ ID NO: 377739 - DNA, 20 bp, Artificial Sequence
  chemically synthesized
ttctcctgcctcagcctccc

SEQ ID NO: 377740 - DNA, 20 bp, Artificial Sequence
  chemically synthesized
tcctgcctcagcctcccaag

SEQ ID NO: 377741 - DNA, 20 bp, Artificial Sequence
  chemically synthesized
tgtaatcccagctacttggg

SEQ ID NO: 377742 - DNA, 20 bp, Artificial Sequence
  chemically synthesized
ctgtaatcccagctacttgg

SEQ ID NO: 377743 - DNA, 20 bp, Artificial Sequence
  chemically synthesized
gcctcagcctcccaagtagc

SEQ ID NO: 377744 - DNA, 20 bp, Artificial Sequence
  chemically synthesized
gcctgtaatcccagctactt

SEQ ID NO: 377745 - DNA, 20 bp, Artificial Sequence
  chemically synthesized
cctcagcctcccaagtagct

SEQ ID NO: 377746 - DNA, 20 bp, Artificial Sequence
  chemically synthesized
tgcctgtaatcccagctact

SEQ ID NO: 377747 - DNA, 20 bp, Artificial Sequence
  chemically synthesized
ctcccaagtagctgggatta

SEQ ID NO: 377748 - DNA, 20 bp, Artificial Sequence
  chemically synthesized
tcccaagtagctgggattac

SEQ ID NO: 377749 - DNA, 20 bp, Artificial Sequence
  chemically synthesized
gtggtggatgcctgtaatcc

SEQ ID NO: 377750 - DNA, 20 bp, Artificial Sequence
  chemically synthesized
attagccgggcgtgtggtgg

SEQ ID NO: 377751 - DNA, 20 bp, Artificial Sequence
  chemically synthesized
aaaattagccgggcgtgtgg

SEQ ID NO: 377752 - DNA, 20 bp, Artificial Sequence
  chemically synthesized
ggcatccaccaccacacgcc

SEQ ID NO: 377753 - DNA, 20 bp, Artificial Sequence
  chemically synthesized
acaaaaattagccgggcgtg

SEQ ID NO: 377754 - DNA, 20 bp, Artificial Sequence
  chemically synthesized
caaaaatacaaaaattagcc

SEQ ID NO: 377755 - DNA, 20 bp, Artificial Sequence
  chemically synthesized
ccaaaaatacaaaaattagc

SEQ ID NO: 377756 - DNA, 20 bp, Artificial Sequence
  chemically synthesized
tctaccaaaaatacaaaaat

SEQ ID NO: 377757 - DNA, 20 bp, Artificial Sequence
  chemically synthesized
ccggctaatttttgtatttt

SEQ ID NO: 377758 - DNA, 20 bp, Artificial Sequence
  chemically synthesized
gctaatttttgtatttttgg

SEQ ID NO: 377759 - DNA, 20 bp, Artificial Sequence
  chemically synthesized
taatttttgtatttttggta

SEQ ID NO: 377760 - DNA, 20 bp, Artificial Sequence
  chemically synthesized
ttttgtatttttggtagaga

SEQ ID NO: 377761 - DNA, 20 bp, Artificial Sequence
  chemically synthesized
tttgtatttttggtagagac

SEQ ID NO: 377762 - DNA, 20 bp, Artificial Sequence
  chemically synthesized
ttgtatttttggtagagaca

SEQ ID NO: 377763 - DNA, 20 bp, Artificial Sequence
  chemically synthesized
gagacagggtttcaccatgt

SEQ ID NO: 377764 - DNA, 20 bp, Artificial Sequence
  chemically synthesized
cagggtttcaccatgttggc

SEQ ID NO: 377765 - DNA, 20 bp, Artificial Sequence
  chemically synthesized
caagaccagcctggccaaca

SEQ ID NO: 377766 - DNA, 20 bp, Artificial Sequence
  chemically synthesized
agggtttcaccatgttggcc

SEQ ID NO: 377767 - DNA, 20 bp, Artificial Sequence
  chemically synthesized
tttcaccatgttggccaggc

SEQ ID NO: 377768 - DNA, 20 bp, Artificial Sequence
  chemically synthesized
tcaggagttcaagaccagcc

SEQ ID NO: 377769 - DNA, 20 bp, Artificial Sequence
  chemically synthesized
tgaggtcaggagttcaagac

SEQ ID NO: 377770 - DNA, 20 bp, Artificial Sequence
  chemically synthesized
ttacctgaggtcaggagttc

SEQ ID NO: 377771 - DNA, 20 bp, Artificial Sequence
  chemically synthesized
tggtcttgaactcctgacct

SEQ ID NO: 377772 - DNA, 20 bp, Artificial Sequence
  chemically synthesized
ggtggattacctgaggtcag

SEQ ID NO: 377773 - DNA, 20 bp, Artificial Sequence
  chemically synthesized
ggtcttgaactcctgacctc

SEQ ID NO: 377774 - DNA, 20 bp, Artificial Sequence
  chemically synthesized
caggtggattacctgaggtc

SEQ ID NO: 377775 - DNA, 20 bp, Artificial Sequence
  chemically synthesized
gcaggtggattacctgaggt

SEQ ID NO: 377776 - DNA, 20 bp, Artificial Sequence
  chemically synthesized
caaggcaggtggattacctg

SEQ ID NO: 377777 - DNA, 20 bp, Artificial Sequence
  chemically synthesized
ccaaggcaggtggattacct

SEQ ID NO: 377778 - DNA, 20 bp, Artificial Sequence
  chemically synthesized
ctcaggtaatccacctgcct

SEQ ID NO: 377779 - DNA, 20 bp, Artificial Sequence
  chemically synthesized
ctttggaaggccaaggcagg

SEQ ID NO: 377780 - DNA, 20 bp, Artificial Sequence
  chemically synthesized
gcactttggaaggccaaggc

SEQ ID NO: 377781 - DNA, 20 bp, Artificial Sequence
  chemically synthesized
agcactttggaaggccaagg

SEQ ID NO: 377782 - DNA, 20 bp, Artificial Sequence
  chemically synthesized
cccagcactttggaaggcca

SEQ ID NO: 377783 - DNA, 20 bp, Artificial Sequence
  chemically synthesized
tcccagcactttggaaggcc

SEQ ID NO: 377784 - DNA, 20 bp, Artificial Sequence
  chemically synthesized
ccacctgccttggccttcca

SEQ ID NO: 377785 - DNA, 20 bp, Artificial Sequence
  chemically synthesized
tgtaatcccagcactttgga

SEQ ID NO: 377786 - DNA, 20 bp, Artificial Sequence
  chemically synthesized
ctgtaatcccagcactttgg

SEQ ID NO: 377787 - DNA, 20 bp, Artificial Sequence
  chemically synthesized
gccttggccttccaaagtgc

SEQ ID NO: 377788 - DNA, 20 bp, Artificial Sequence
  chemically synthesized
ccttggccttccaaagtgct

SEQ ID NO: 377789 - DNA, 20 bp, Artificial Sequence
  chemically synthesized
tgcctgtaatcccagcactt

SEQ ID NO: 377790 - DNA, 20 bp, Artificial Sequence
  chemically synthesized
cttccaaagtgctgggatta

SEQ ID NO: 377791 - DNA, 20 bp, Artificial Sequence
  chemically synthesized
ttccaaagtgctgggattac

SEQ ID NO: 377792 - DNA, 20 bp, Artificial Sequence
  chemically synthesized
gtggctcatgcctgtaatcc

SEQ ID NO: 377793 - DNA, 20 bp, Artificial Sequence
  chemically synthesized
agtgctgggattacaggcat

SEQ ID NO: 377794 - DNA, 20 bp, Artificial Sequence
  chemically synthesized
caggcatgagccactgcact

SEQ ID NO: 377795 - DNA, 20 bp, Artificial Sequence
  chemically synthesized
acattatgggctgagtgcag

SEQ ID NO: 377796 - DNA, 20 bp, Artificial Sequence
  chemically synthesized
aaaacattatgggctgagtg

SEQ ID NO: 377797 - DNA, 20 bp, Artificial Sequence
  chemically synthesized
ccattaaaacattatgggct

SEQ ID NO: 377798 - DNA, 20 bp, Artificial Sequence
  chemically synthesized
atacaccattaaaacattat

SEQ ID NO: 377799 - DNA, 20 bp, Artificial Sequence
  chemically synthesized
catacaccattaaaacatta

SEQ ID NO: 377800 - DNA, 20 bp, Artificial Sequence
  chemically synthesized
ctcagcccataatgttttaa

SEQ ID NO: 377801 - DNA, 20 bp, Artificial Sequence
  chemically synthesized
gttttaatggtgtatgattc

SEQ ID NO: 377802 - DNA, 20 bp, Artificial Sequence
  chemically synthesized
tggtgtatgattcaagtgac

SEQ ID NO: 377803 - DNA, 20 bp, Artificial Sequence
  chemically synthesized
ggtgtatgattcaagtgact

SEQ ID NO: 377804 - DNA, 20 bp, Artificial Sequence
  chemically synthesized
gacaagcaacatattatgcc

SEQ ID NO: 377805 - DNA, 20 bp, Artificial Sequence
  chemically synthesized
tactttttgagcaacgagac

SEQ ID NO: 377806 - DNA, 20 bp, Artificial Sequence
  chemically synthesized
tttcttactttttgagcaac

SEQ ID NO: 377807 - DNA, 20 bp, Artificial Sequence
  chemically synthesized
tgcttgtctcgttgctcaaa

SEQ ID NO: 377808 - DNA, 20 bp, Artificial Sequence
  chemically synthesized
tgtctcgttgctcaaaaagt

SEQ ID NO: 377809 - DNA, 20 bp, Artificial Sequence
  chemically synthesized
ttttatttttcttacttttt

SEQ ID NO: 377810 - DNA, 20 bp, Artificial Sequence
  chemically synthesized
tcaaaaagtaagaaaaataa

SEQ ID NO: 377811 - DNA, 20 bp, Artificial Sequence
  chemically synthesized
aaagtaagaaaaataaaaga

SEQ ID NO: 377812 - DNA, 20 bp, Artificial Sequence
  chemically synthesized
agtaagaaaaataaaagaaa

SEQ ID NO: 377813 - DNA, 20 bp, Artificial Sequence
  chemically synthesized
ttaaacctagcaaaagagtg

SEQ ID NO: 377814 - DNA, 20 bp, Artificial Sequence
  chemically synthesized
tgttaaacctagcaaaagag

SEQ ID NO: 377815 - DNA, 20 bp, Artificial Sequence
  chemically synthesized
aagagactccactcttttgc

SEQ ID NO: 377816 - DNA, 20 bp, Artificial Sequence
  chemically synthesized
agagactccactcttttgct

SEQ ID NO: 377817 - DNA, 20 bp, Artificial Sequence
  chemically synthesized
caatgttaaacctagcaaaa

SEQ ID NO: 377818 - DNA, 20 bp, Artificial Sequence
  chemically synthesized
cacaatgttaaacctagcaa

SEQ ID NO: 377819 - DNA, 20 bp, Artificial Sequence
  chemically synthesized
caacaacacaatgttaaacc

SEQ ID NO: 377820 - DNA, 20 bp, Artificial Sequence
  chemically synthesized
tcccaatatagggatgtgta

SEQ ID NO: 377821 - DNA, 20 bp, Artificial Sequence
  chemically synthesized
ttctgtacacatccctatat

SEQ ID NO: 377822 - DNA, 20 bp, Artificial Sequence
  chemically synthesized
tctgtacacatccctatatt

SEQ ID NO: 377823 - DNA, 20 bp, Artificial Sequence
  chemically synthesized
ggtcatatggtcccaatata

SEQ ID NO: 377824 - DNA, 20 bp, Artificial Sequence
  chemically synthesized
aggtcatatggtcccaatat

SEQ ID NO: 377825 - DNA, 20 bp, Artificial Sequence
  chemically synthesized
aaggtcatatggtcccaata

SEQ ID NO: 377826 - DNA, 20 bp, Artificial Sequence
  chemically synthesized
tttctttgtggaaggtcata

SEQ ID NO: 377827 - DNA, 20 bp, Artificial Sequence
  chemically synthesized
ggaccatatgaccttccaca

SEQ ID NO: 377828 - DNA, 20 bp, Artificial Sequence
  chemically synthesized
taagattgtttctttgtgga

SEQ ID NO: 377829 - DNA, 20 bp, Artificial Sequence
  chemically synthesized
gtaagattgtttctttgtgg

SEQ ID NO: 377830 - DNA, 20 bp, Artificial Sequence
  chemically synthesized
taagtaagattgtttctttg

SEQ ID NO: 377831 - DNA, 20 bp, Artificial Sequence
  chemically synthesized
tatttaaaacaattttaagt

SEQ ID NO: 377832 - DNA, 20 bp, Artificial Sequence
  chemically synthesized
tatttatttaaaacaatttt

SEQ ID NO: 377833 - DNA, 20 bp, Artificial Sequence
  chemically synthesized
gttttaaataaatatgtaaa

SEQ ID NO: 377834 - DNA, 20 bp, Artificial Sequence
  chemically synthesized
caaaataatgtaaaatttta

SEQ ID NO: 377835 - DNA, 20 bp, Artificial Sequence
  chemically synthesized
aattttacattattttgcga

SEQ ID NO: 377836 - DNA, 20 bp, Artificial Sequence
  chemically synthesized
ttattttgcgacagaaatac

SEQ ID NO: 377837 - DNA, 20 bp, Artificial Sequence
  chemically synthesized
atacaagttttgttactgat

SEQ ID NO: 377838 - DNA, 20 bp, Artificial Sequence
  chemically synthesized
acaagttttgttactgatta

SEQ ID NO: 377839 - DNA, 20 bp, Artificial Sequence
  chemically synthesized
actgttgctgcatctctaat

SEQ ID NO: 377840 - DNA, 20 bp, Artificial Sequence
  chemically synthesized
tttgttactgattagagatg

SEQ ID NO: 377841 - DNA, 20 bp, Artificial Sequence
  chemically synthesized
actgattagagatgcagcaa

SEQ ID NO: 377842 - DNA, 20 bp, Artificial Sequence
  chemically synthesized
gggttcctaatgtagttgaa

SEQ ID NO: 377843 - DNA, 20 bp, Artificial Sequence
  chemically synthesized
agtttgcttttcaactacat

SEQ ID NO: 377844 - DNA, 20 bp, Artificial Sequence
  chemically synthesized
gtttgcttttcaactacatt

SEQ ID NO: 377845 - DNA, 20 bp, Artificial Sequence
  chemically synthesized
tgctcatagggttcctaatg

SEQ ID NO: 377846 - DNA, 20 bp, Artificial Sequence
  chemically synthesized
aactacattaggaaccctat

SEQ ID NO: 377847 - DNA, 20 bp, Artificial Sequence
  chemically synthesized
ttatctaaaaaatgctcata

SEQ ID NO: 377848 - DNA, 20 bp, Artificial Sequence
  chemically synthesized
attatctaaaaaatgctcat

SEQ ID NO: 377849 - DNA, 20 bp, Artificial Sequence
  chemically synthesized
aattatctaaaaaatgctca

SEQ ID NO: 377850 - DNA, 20 bp, Artificial Sequence
  chemically synthesized
ggaaccctatgagcattttt

SEQ ID NO: 377851 - DNA, 20 bp, Artificial Sequence
  chemically synthesized
gcattttttagataatttca

SEQ ID NO: 377852 - DNA, 20 bp, Artificial Sequence
  chemically synthesized
ttagataatttcatagtaat

SEQ ID NO: 377853 - DNA, 20 bp, Artificial Sequence
  chemically synthesized
gataatttcatagtaataag

SEQ ID NO: 377854 - DNA, 20 bp, Artificial Sequence
  chemically synthesized
ataatttcatagtaataagt

SEQ ID NO: 377855 - DNA, 20 bp, Artificial Sequence
  chemically synthesized
atttcatagtaataagtagg

SEQ ID NO: 377856 - DNA, 20 bp, Artificial Sequence
  chemically synthesized
gtaataagtaggaagtacat

SEQ ID NO: 377857 - DNA, 20 bp, Artificial Sequence
  chemically synthesized
agtaggaagtacataagaca

SEQ ID NO: 377858 - DNA, 20 bp, Artificial Sequence
  chemically synthesized
gtaggaagtacataagacat

SEQ ID NO: 377859 - DNA, 20 bp, Artificial Sequence
  chemically synthesized
agacataggattcactaact

SEQ ID NO: 377860 - DNA, 20 bp, Artificial Sequence
  chemically synthesized
ataggattcactaacttggt

SEQ ID NO: 377861 - DNA, 20 bp, Artificial Sequence
  chemically synthesized
caattaagttctcaccaagt

SEQ ID NO: 377862 - DNA, 20 bp, Artificial Sequence
  chemically synthesized
tgagcaattaagttctcacc

SEQ ID NO: 377863 - DNA, 20 bp, Artificial Sequence
  chemically synthesized
tttttctcttgtgagcaatt

SEQ ID NO: 377864 - DNA, 20 bp, Artificial Sequence
  chemically synthesized
gtgagaacttaattgctcac

SEQ ID NO: 377865 - DNA, 20 bp, Artificial Sequence
  chemically synthesized
gagaacttaattgctcacaa

SEQ ID NO: 377866 - DNA, 20 bp, Artificial Sequence
  chemically synthesized
gtctagcatttttctcttgt

SEQ ID NO: 377867 - DNA, 20 bp, Artificial Sequence
  chemically synthesized
tgctcacaagagaaaaatgc

SEQ ID NO: 377868 - DNA, 20 bp, Artificial Sequence
  chemically synthesized
ctttgctaaggggattagtc

SEQ ID NO: 377869 - DNA, 20 bp, Artificial Sequence
  chemically synthesized
aaatgctagactaatcccct

SEQ ID NO: 377870 - DNA, 20 bp, Artificial Sequence
  chemically synthesized
agattctttgctaaggggat

SEQ ID NO: 377871 - DNA, 20 bp, Artificial Sequence
  chemically synthesized
ctagactaatccccttagca

SEQ ID NO: 377872 - DNA, 20 bp, Artificial Sequence
  chemically synthesized
atcatagattctttgctaag

SEQ ID NO: 377873 - DNA, 20 bp, Artificial Sequence
  chemically synthesized
aatcatagattctttgctaa

SEQ ID NO: 377874 - DNA, 20 bp, Artificial Sequence
  chemically synthesized
taatcatagattctttgcta

SEQ ID NO: 377875 - DNA, 20 bp, Artificial Sequence
  chemically synthesized
ttaatcatagattctttgct

SEQ ID NO: 377876 - DNA, 20 bp, Artificial Sequence
  chemically synthesized
agcaaagaatctatgattaa

SEQ ID NO: 377877 - DNA, 20 bp, Artificial Sequence
  chemically synthesized
tttttagaatcttttaatca

SEQ ID NO: 377878 - DNA, 20 bp, Artificial Sequence
  chemically synthesized
aaattgttcaaattattttt

SEQ ID NO: 377879 - DNA, 20 bp, Artificial Sequence
  chemically synthesized
aaaataatttgaacaatttc

SEQ ID NO: 377880 - DNA, 20 bp, Artificial Sequence
  chemically synthesized
ccatgtctttttatggtaac

SEQ ID NO: 377881 - DNA, 20 bp, Artificial Sequence
  chemically synthesized
caatttccagttaccataaa

SEQ ID NO: 377882 - DNA, 20 bp, Artificial Sequence
  chemically synthesized
ttctcaaccatgtcttttta

SEQ ID NO: 377883 - DNA, 20 bp, Artificial Sequence
  chemically synthesized
ccagttaccataaaaagaca

SEQ ID NO: 377884 - DNA, 20 bp, Artificial Sequence
  chemically synthesized
taccataaaaagacatggtt

SEQ ID NO: 377885 - DNA, 20 bp, Artificial Sequence
  chemically synthesized
tattgaatatcaatagcaaa

SEQ ID NO: 377886 - DNA, 20 bp, Artificial Sequence
  chemically synthesized
aaacatttattgaatatcaa

SEQ ID NO: 377887 - DNA, 20 bp, Artificial Sequence
  chemically synthesized
taaatgtttactatatatat

SEQ ID NO: 377888 - DNA, 20 bp, Artificial Sequence
  chemically synthesized
tcagccccaacttatatata

SEQ ID NO: 377889 - DNA, 20 bp, Artificial Sequence
  chemically synthesized
tgtttactatatatataagt

SEQ ID NO: 377890 - DNA, 20 bp, Artificial Sequence
  chemically synthesized
gtttactatatatataagtt

SEQ ID NO: 377891 - DNA, 20 bp, Artificial Sequence
  chemically synthesized
tttactatatatataagttg

SEQ ID NO: 377892 - DNA, 20 bp, Artificial Sequence
  chemically synthesized
tatatatataagttggggct

SEQ ID NO: 377893 - DNA, 20 bp, Artificial Sequence
  chemically synthesized
caaagaatgaaagaaagact

SEQ ID NO: 377894 - DNA, 20 bp, Artificial Sequence
  chemically synthesized
aagacccaaagaatgaaaga

SEQ ID NO: 377895 - DNA, 20 bp, Artificial Sequence
  chemically synthesized
tgctaagacccaaagaatga

SEQ ID NO: 377896 - DNA, 20 bp, Artificial Sequence
  chemically synthesized
tgagtctttctttcattctt

SEQ ID NO: 377897 - DNA, 20 bp, Artificial Sequence
  chemically synthesized
gagtctttctttcattcttt

SEQ ID NO: 377898 - DNA, 20 bp, Artificial Sequence
  chemically synthesized
ttctttcattctttgggtct

SEQ ID NO: 377899 - DNA, 20 bp, Artificial Sequence
  chemically synthesized
ggtgtttatgctaagaccca

SEQ ID NO: 377900 - DNA, 20 bp, Artificial Sequence
  chemically synthesized
ggggaggtggtgtttatgct

SEQ ID NO: 377901 - DNA, 20 bp, Artificial Sequence
  chemically synthesized
gcaggtggtgttgggggagg

SEQ ID NO: 377902 - DNA, 20 bp, Artificial Sequence
  chemically synthesized
agagcaggtggtgttggggg

SEQ ID NO: 377903 - DNA, 20 bp, Artificial Sequence
  chemically synthesized
tagagcaggtggtgttgggg

SEQ ID NO: 377904 - DNA, 20 bp, Artificial Sequence
  chemically synthesized
tttagagcaggtggtgttgg

SEQ ID NO: 377905 - DNA, 20 bp, Artificial Sequence
  chemically synthesized
atttagagcaggtggtgttg

SEQ ID NO: 377906 - DNA, 20 bp, Artificial Sequence
  chemically synthesized
aatttagagcaggtggtgtt

SEQ ID NO: 377907 - DNA, 20 bp, Artificial Sequence
  chemically synthesized
taatttagagcaggtggtgt

SEQ ID NO: 377908 - DNA, 20 bp, Artificial Sequence
  chemically synthesized
gaaacctaatttagagcagg

SEQ ID NO: 377909 - DNA, 20 bp, Artificial Sequence
  chemically synthesized
agtgaaacctaatttagagc

SEQ ID NO: 377910 - DNA, 20 bp, Artificial Sequence
  chemically synthesized
cagtgaaacctaatttagag

SEQ ID NO: 377911 - DNA, 20 bp, Artificial Sequence
  chemically synthesized
caacaccacctgctctaaat

SEQ ID NO: 377912 - DNA, 20 bp, Artificial Sequence
  chemically synthesized
aacaccacctgctctaaatt

SEQ ID NO: 377913 - DNA, 20 bp, Artificial Sequence
  chemically synthesized
ggccagtgaaacctaattta

SEQ ID NO: 377914 - DNA, 20 bp, Artificial Sequence
  chemically synthesized
gtggccagtgaaacctaatt

SEQ ID NO: 377915 - DNA, 20 bp, Artificial Sequence
  chemically synthesized
tgctctaaattaggtttcac

SEQ ID NO: 377916 - DNA, 20 bp, Artificial Sequence
  chemically synthesized
caaggggacaagagagtggc

SEQ ID NO: 377917 - DNA, 20 bp, Artificial Sequence
  chemically synthesized
tggacaaggggacaagagag

SEQ ID NO: 377918 - DNA, 20 bp, Artificial Sequence
  chemically synthesized
tcatggacaaggggacaaga

SEQ ID NO: 377919 - DNA, 20 bp, Artificial Sequence
  chemically synthesized
tctcatggacaaggggacaa

SEQ ID NO: 377920 - DNA, 20 bp, Artificial Sequence
  chemically synthesized
gctctcatggacaaggggac

SEQ ID NO: 377921 - DNA, 20 bp, Artificial Sequence
  chemically synthesized
tgggtgctctcatggacaag

SEQ ID NO: 377922 - DNA, 20 bp, Artificial Sequence
  chemically synthesized
ttgggtgctctcatggacaa

SEQ ID NO: 377923 - DNA, 20 bp, Artificial Sequence
  chemically synthesized
tctcttgtccccttgtccat

SEQ ID NO: 377924 - DNA, 20 bp, Artificial Sequence
  chemically synthesized
gttgggtgctctcatggaca

SEQ ID NO: 377925 - DNA, 20 bp, Artificial Sequence
  chemically synthesized
tgttgggtgctctcatggac

SEQ ID NO: 377926 - DNA, 20 bp, Artificial Sequence
  chemically synthesized
tcttgtccccttgtccatga

SEQ ID NO: 377927 - DNA, 20 bp, Artificial Sequence
  chemically synthesized
aattatgttgggtgctctca

SEQ ID NO: 377928 - DNA, 20 bp, Artificial Sequence
  chemically synthesized
gtatactttcaaattatgtt

SEQ ID NO: 377929 - DNA, 20 bp, Artificial Sequence
  chemically synthesized
tgtatactttcaaattatgt

SEQ ID NO: 377930 - DNA, 20 bp, Artificial Sequence
  chemically synthesized
gagcacccaacataatttga

SEQ ID NO: 377931 - DNA, 20 bp, Artificial Sequence
  chemically synthesized
gtatacatttaattgtttgt

SEQ ID NO: 377932 - DNA, 20 bp, Artificial Sequence
  chemically synthesized
acatttaattgtttgttagc

SEQ ID NO: 377933 - DNA, 20 bp, Artificial Sequence
  chemically synthesized
ggagaagatagtcaataagc

SEQ ID NO: 377934 - DNA, 20 bp, Artificial Sequence
  chemically synthesized
ttaaggagaagatagtcaat

SEQ ID NO: 377935 - DNA, 20 bp, Artificial Sequence
  chemically synthesized
ctaatccattaaggagaaga

SEQ ID NO: 377936 - DNA, 20 bp, Artificial Sequence
  chemically synthesized
caaactaatccattaaggag

SEQ ID NO: 377937 - DNA, 20 bp, Artificial Sequence
  chemically synthesized
attgactatcttctccttaa

SEQ ID NO: 377938 - DNA, 20 bp, Artificial Sequence
  chemically synthesized
tcacaaactaatccattaag

SEQ ID NO: 377939 - DNA, 20 bp, Artificial Sequence
  chemically synthesized
tttcacaaactaatccatta

SEQ ID NO: 377940 - DNA, 20 bp, Artificial Sequence
  chemically synthesized
ctatcttctccttaatggat

SEQ ID NO: 377941 - DNA, 20 bp, Artificial Sequence
  chemically synthesized
ctttcacaaactaatccatt

SEQ ID NO: 377942 - DNA, 20 bp, Artificial Sequence
  chemically synthesized
cttaatggattagtttgtga

SEQ ID NO: 377943 - DNA, 20 bp, Artificial Sequence
  chemically synthesized
tggattagtttgtgaaagtt

SEQ ID NO: 377944 - DNA, 20 bp, Artificial Sequence
  chemically synthesized
gacagtgaaccaaatgaata

SEQ ID NO: 377945 - DNA, 20 bp, Artificial Sequence
  chemically synthesized
aagtttagaccatattcatt

SEQ ID NO: 377946 - DNA, 20 bp, Artificial Sequence
  chemically synthesized
tctaggtgccaggaatatga

SEQ ID NO: 377947 - DNA, 20 bp, Artificial Sequence
  chemically synthesized
ttggttcactgtcatattcc

SEQ ID NO: 377948 - DNA, 20 bp, Artificial Sequence
  chemically synthesized
actgtcatattcctggcacc

SEQ ID NO: 377949 - DNA, 20 bp, Artificial Sequence
  chemically synthesized
caacaacccttctaggtgcc

SEQ ID NO: 377950 - DNA, 20 bp, Artificial Sequence
  chemically synthesized
tcaacaacccttctaggtgc

SEQ ID NO: 377951 - DNA, 20 bp, Artificial Sequence
  chemically synthesized
gtcatattcctggcacctag

SEQ ID NO: 377952 - DNA, 20 bp, Artificial Sequence
  chemically synthesized
tcatattcctggcacctaga

SEQ ID NO: 377953 - DNA, 20 bp, Artificial Sequence
  chemically synthesized
catattcctggcacctagaa

SEQ ID NO: 377954 - DNA, 20 bp, Artificial Sequence
  chemically synthesized
aatacgtcaacaacccttct

SEQ ID NO: 377955 - DNA, 20 bp, Artificial Sequence
  chemically synthesized
caatacgtcaacaacccttc

SEQ ID NO: 377956 - DNA, 20 bp, Artificial Sequence
  chemically synthesized
gaagggttgttgacgtattg

SEQ ID NO: 377957 - DNA, 20 bp, Artificial Sequence
  chemically synthesized
agggttgttgacgtattgca

SEQ ID NO: 377958 - DNA, 20 bp, Artificial Sequence
  chemically synthesized
attgcagagattctcaatct

SEQ ID NO: 377959 - DNA, 20 bp, Artificial Sequence
  chemically synthesized
atctcagtagcaccaagatt

SEQ ID NO: 377960 - DNA, 20 bp, Artificial Sequence
  chemically synthesized
tgcaaaatctcagtagcacc

SEQ ID NO: 377961 - DNA, 20 bp, Artificial Sequence
  chemically synthesized
ttctcaatcttggtgctact

SEQ ID NO: 377962 - DNA, 20 bp, Artificial Sequence
  chemically synthesized
catcttgtgcaaaatctcag

SEQ ID NO: 377963 - DNA, 20 bp, Artificial Sequence
  chemically synthesized
aatcatcttgtgcaaaatct

SEQ ID NO: 377964 - DNA, 20 bp, Artificial Sequence
  chemically synthesized
gtgctactgagattttgcac

SEQ ID NO: 377965 - DNA, 20 bp, Artificial Sequence
  chemically synthesized
cacaagatgattctttatta

SEQ ID NO: 377966 - DNA, 20 bp, Artificial Sequence
  chemically synthesized
caggtcaacccaccataata

SEQ ID NO: 377967 - DNA, 20 bp, Artificial Sequence
  chemically synthesized
aagatgattctttattatgg

SEQ ID NO: 377968 - DNA, 20 bp, Artificial Sequence
  chemically synthesized
agatgattctttattatggt

SEQ ID NO: 377969 - DNA, 20 bp, Artificial Sequence
  chemically synthesized
ctaaacatgtaataatgttc

SEQ ID NO: 377970 - DNA, 20 bp, Artificial Sequence
  chemically synthesized
gctaaacatgtaataatgtt

SEQ ID NO: 377971 - DNA, 20 bp, Artificial Sequence
  chemically synthesized
cctgaacattattacatgtt

SEQ ID NO: 377972 - DNA, 20 bp, Artificial Sequence
  chemically synthesized
tacatgtttagcaacatccc

SEQ ID NO: 377973 - DNA, 20 bp, Artificial Sequence
  chemically synthesized
tgtctagtgggtagagacca

SEQ ID NO: 377974 - DNA, 20 bp, Artificial Sequence
  chemically synthesized
gtgtctagtgggtagagacc

SEQ ID NO: 377975 - DNA, 20 bp, Artificial Sequence
  chemically synthesized
ggtgtctagtgggtagagac

SEQ ID NO: 377976 - DNA, 20 bp, Artificial Sequence
  chemically synthesized
catccctggtctctacccac

SEQ ID NO: 377977 - DNA, 20 bp, Artificial Sequence
  chemically synthesized
ctactggtgtctagtgggta

SEQ ID NO: 377978 - DNA, 20 bp, Artificial Sequence
  chemically synthesized
tgctactggtgtctagtggg

SEQ ID NO: 377979 - DNA, 20 bp, Artificial Sequence
  chemically synthesized
gtttgctactggtgtctagt

SEQ ID NO: 377980 - DNA, 20 bp, Artificial Sequence
  chemically synthesized
tgtttgctactggtgtctag

SEQ ID NO: 377981 - DNA, 20 bp, Artificial Sequence
  chemically synthesized
ggtctctacccactagacac

SEQ ID NO: 377982 - DNA, 20 bp, Artificial Sequence
  chemically synthesized
agatgtttgctactggtgtc

SEQ ID NO: 377983 - DNA, 20 bp, Artificial Sequence
  chemically synthesized
ctctacccactagacaccag

SEQ ID NO: 377984 - DNA, 20 bp, Artificial Sequence
  chemically synthesized
aaagaagagatgtttgctac

SEQ ID NO: 377985 - DNA, 20 bp, Artificial Sequence
  chemically synthesized
gtagcaaacatctcttcttt

SEQ ID NO: 377986 - DNA, 20 bp, Artificial Sequence
  chemically synthesized
tagtggcataactaaaagaa

SEQ ID NO: 377987 - DNA, 20 bp, Artificial Sequence
  chemically synthesized
cctagtggcataactaaaag

SEQ ID NO: 377988 - DNA, 20 bp, Artificial Sequence
  chemically synthesized
attcctagtggcataactaa

SEQ ID NO: 377989 - DNA, 20 bp, Artificial Sequence
  chemically synthesized
tcttcttttagttatgccac

SEQ ID NO: 377990 - DNA, 20 bp, Artificial Sequence
  chemically synthesized
cttcttttagttatgccact

SEQ ID NO: 377991 - DNA, 20 bp, Artificial Sequence
  chemically synthesized
atgtccggagagattcctag

SEQ ID NO: 377992 - DNA, 20 bp, Artificial Sequence
  chemically synthesized
accatgtccggagagattcc

SEQ ID NO: 377993 - DNA, 20 bp, Artificial Sequence
  chemically synthesized
tatgccactaggaatctctc

SEQ ID NO: 377994 - DNA, 20 bp, Artificial Sequence
  chemically synthesized
gttatttcaccatgtccgga

SEQ ID NO: 377995 - DNA, 20 bp, Artificial Sequence
  chemically synthesized
actaggaatctctccggaca

SEQ ID NO: 377996 - DNA, 20 bp, Artificial Sequence
  chemically synthesized
gggttatttcaccatgtccg

SEQ ID NO: 377997 - DNA, 20 bp, Artificial Sequence
  chemically synthesized
aggggttatttcaccatgtc

SEQ ID NO: 377998 - DNA, 20 bp, Artificial Sequence
  chemically synthesized
ggacatggtgaaataacccc

SEQ ID NO: 377999 - DNA, 20 bp, Artificial Sequence
  chemically synthesized
atggtgaaataacccctgga

SEQ ID NO: 378000 - DNA, 20 bp, Artificial Sequence
  chemically synthesized
tgggtggttttgccgtccag

SEQ ID NO: 378001 - DNA, 20 bp, Artificial Sequence
  chemically synthesized
ctgggtggttttgccgtcca

SEQ ID NO: 378002 - DNA, 20 bp, Artificial Sequence
  chemically synthesized
tctgggtggttttgccgtcc

SEQ ID NO: 378003 - DNA, 20 bp, Artificial Sequence
  chemically synthesized
ctctgggtggttttgccgtc

SEQ ID NO: 378004 - DNA, 20 bp, Artificial Sequence
  chemically synthesized
ccctggacggcaaaaccacc

SEQ ID NO: 378005 - DNA, 20 bp, Artificial Sequence
  chemically synthesized
ctggacggcaaaaccaccca

SEQ ID NO: 378006 - DNA, 20 bp, Artificial Sequence
  chemically synthesized
cagtgattctcaactctggg

SEQ ID NO: 378007 - DNA, 20 bp, Artificial Sequence
  chemically synthesized
cggcaaaaccacccagagtt

SEQ ID NO: 378008 - DNA, 20 bp, Artificial Sequence
  chemically synthesized
attcagtgattctcaactct

SEQ ID NO: 378009 - DNA, 20 bp, Artificial Sequence
  chemically synthesized
tattcagtgattctcaactc

SEQ ID NO: 378010 - DNA, 20 bp, Artificial Sequence
  chemically synthesized
catttatgtattaaattatt

SEQ ID NO: 378011 - DNA, 20 bp, Artificial Sequence
  chemically synthesized
taatacataaatgaacaaat

SEQ ID NO: 378012 - DNA, 20 bp, Artificial Sequence
  chemically synthesized
acataaatgaacaaatgagt

SEQ ID NO: 378013 - DNA, 20 bp, Artificial Sequence
  chemically synthesized
gagtgagtgaatgaatgaat

SEQ ID NO: 378014 - DNA, 20 bp, Artificial Sequence
  chemically synthesized
ccgttttctgagcaatcaga

SEQ ID NO: 378015 - DNA, 20 bp, Artificial Sequence
  chemically synthesized
tgaataactgtctgattgct

SEQ ID NO: 378016 - DNA, 20 bp, Artificial Sequence
  chemically synthesized
acttccgttttctgagcaat

SEQ ID NO: 378017 - DNA, 20 bp, Artificial Sequence
  chemically synthesized
ctgtctgattgctcagaaaa

SEQ ID NO: 378018 - DNA, 20 bp, Artificial Sequence
  chemically synthesized
tgcttctacttccgttttct

SEQ ID NO: 378019 - DNA, 20 bp, Artificial Sequence
  chemically synthesized
tctgattgctcagaaaacgg

SEQ ID NO: 378020 - DNA, 20 bp, Artificial Sequence
  chemically synthesized
gattgctcagaaaacggaag

SEQ ID NO: 378021 - DNA, 20 bp, Artificial Sequence
  chemically synthesized
tgctcagaaaacggaagtag

SEQ ID NO: 378022 - DNA, 20 bp, Artificial Sequence
  chemically synthesized
tcagaaaacggaagtagaag

SEQ ID NO: 378023 - DNA, 20 bp, Artificial Sequence
  chemically synthesized
cagaaaacggaagtagaagc

SEQ ID NO: 378024 - DNA, 20 bp, Artificial Sequence
  chemically synthesized
gaaaacggaagtagaagcag

SEQ ID NO: 378025 - DNA, 20 bp, Artificial Sequence
  chemically synthesized
cggaagtagaagcaggagca

SEQ ID NO: 378026 - DNA, 20 bp, Artificial Sequence
  chemically synthesized
agcaggagcaaagcacattc

SEQ ID NO: 378027 - DNA, 20 bp, Artificial Sequence
  chemically synthesized
ggagcaaagcacattccagt

SEQ ID NO: 378028 - DNA, 20 bp, Artificial Sequence
  chemically synthesized
caaagcacattccagtcaga

SEQ ID NO: 378029 - DNA, 20 bp, Artificial Sequence
  chemically synthesized
aaaccatatcactatctgac

SEQ ID NO: 378030 - DNA, 20 bp, Artificial Sequence
  chemically synthesized
attccagtcagatagtgata

SEQ ID NO: 378031 - DNA, 20 bp, Artificial Sequence
  chemically synthesized
attcaacatgagatttcgtg

SEQ ID NO: 378032 - DNA, 20 bp, Artificial Sequence
  chemically synthesized
aattcaacatgagatttcgt

SEQ ID NO: 378033 - DNA, 20 bp, Artificial Sequence
  chemically synthesized
caattcaacatgagatttcg

SEQ ID NO: 378034 - DNA, 20 bp, Artificial Sequence
  chemically synthesized
tagggattacaattcaacat

SEQ ID NO: 378035 - DNA, 20 bp, Artificial Sequence
  chemically synthesized
tgaattgtaatccctaatgt

SEQ ID NO: 378036 - DNA, 20 bp, Artificial Sequence
  chemically synthesized
aggccccacctctaacatta

SEQ ID NO: 378037 - DNA, 20 bp, Artificial Sequence
  chemically synthesized
aattgtaatccctaatgtta

SEQ ID NO: 378038 - DNA, 20 bp, Artificial Sequence
  chemically synthesized
caggccccacctctaacatt

SEQ ID NO: 378039 - DNA, 20 bp, Artificial Sequence
  chemically synthesized
attgtaatccctaatgttag

SEQ ID NO: 378040 - DNA, 20 bp, Artificial Sequence
  chemically synthesized
ccaggccccacctctaacat

SEQ ID NO: 378041 - DNA, 20 bp, Artificial Sequence
  chemically synthesized
gtaatccctaatgttagagg

SEQ ID NO: 378042 - DNA, 20 bp, Artificial Sequence
  chemically synthesized
taatccctaatgttagaggt

SEQ ID NO: 378043 - DNA, 20 bp, Artificial Sequence
  chemically synthesized
aatccctaatgttagaggtg

SEQ ID NO: 378044 - DNA, 20 bp, Artificial Sequence
  chemically synthesized
ctaatgttagaggtggggcc

SEQ ID NO: 378045 - DNA, 20 bp, Artificial Sequence
  chemically synthesized
atgttagaggtggggcctgg

SEQ ID NO: 378046 - DNA, 20 bp, Artificial Sequence
  chemically synthesized
ttagaggtggggcctggtgg

SEQ ID NO: 378047 - DNA, 20 bp, Artificial Sequence
  chemically synthesized
tagaggtggggcctggtggc

SEQ ID NO: 378048 - DNA, 20 bp, Artificial Sequence
  chemically synthesized
tgatccaatcacctgccacc

SEQ ID NO: 378049 - DNA, 20 bp, Artificial Sequence
  chemically synthesized
gtgatccaatcacctgccac

SEQ ID NO: 378050 - DNA, 20 bp, Artificial Sequence
  chemically synthesized
ggggcctggtggcaggtgat

SEQ ID NO: 378051 - DNA, 20 bp, Artificial Sequence
  chemically synthesized
ggtggcaggtgattggatca

SEQ ID NO: 378052 - DNA, 20 bp, Artificial Sequence
  chemically synthesized
atcacggtgtttctcattaa

SEQ ID NO: 378053 - DNA, 20 bp, Artificial Sequence
  chemically synthesized
gatggtgctacaccattaat

SEQ ID NO: 378054 - DNA, 20 bp, Artificial Sequence
  chemically synthesized
ggtgtttctcattaatggtg

SEQ ID NO: 378055 - DNA, 20 bp, Artificial Sequence
  chemically synthesized
cgagaacagcatcaagggga

SEQ ID NO: 378056 - DNA, 20 bp, Artificial Sequence
  chemically synthesized
atcgcgagaacagcatcaag

SEQ ID NO: 378057 - DNA, 20 bp, Artificial Sequence
  chemically synthesized
tatcgcgagaacagcatcaa

SEQ ID NO: 378058 - DNA, 20 bp, Artificial Sequence
  chemically synthesized
ctatcgcgagaacagcatca

SEQ ID NO: 378059 - DNA, 20 bp, Artificial Sequence
  chemically synthesized
actatcgcgagaacagcatc

SEQ ID NO: 378060 - DNA, 20 bp, Artificial Sequence
  chemically synthesized
agagcccactatcgcgagaa

SEQ ID NO: 378061 - DNA, 20 bp, Artificial Sequence
  chemically synthesized
ccttgatgctgttctcgcga

SEQ ID NO: 378062 - DNA, 20 bp, Artificial Sequence
  chemically synthesized
tgatgctgttctcgcgatag

SEQ ID NO: 378063 - DNA, 20 bp, Artificial Sequence
  chemically synthesized
tcgtgagagcccactatcgc

SEQ ID NO: 378064 - DNA, 20 bp, Artificial Sequence
  chemically synthesized
gatgctgttctcgcgatagt

SEQ ID NO: 378065 - DNA, 20 bp, Artificial Sequence
  chemically synthesized
tcgcgatagtgggctctcac

SEQ ID NO: 378066 - DNA, 20 bp, Artificial Sequence
  chemically synthesized
taaacaaccagatctcgtga

SEQ ID NO: 378067 - DNA, 20 bp, Artificial Sequence
  chemically synthesized
tttaaacaaccagatctcgt

SEQ ID NO: 378068 - DNA, 20 bp, Artificial Sequence
  chemically synthesized
tagtgggctctcacgagatc

SEQ ID NO: 378069 - DNA, 20 bp, Artificial Sequence
  chemically synthesized
gctgcacacttttaaacaac

SEQ ID NO: 378070 - DNA, 20 bp, Artificial Sequence
  chemically synthesized
cacgagatctggttgtttaa

SEQ ID NO: 378071 - DNA, 20 bp, Artificial Sequence
  chemically synthesized
tctggttgtttaaaagtgtg

SEQ ID NO: 378072 - DNA, 20 bp, Artificial Sequence
  chemically synthesized
aagagagacagcaagtgggg

SEQ ID NO: 378073 - DNA, 20 bp, Artificial Sequence
  chemically synthesized
caagagagacagcaagtggg

SEQ ID NO: 378074 - DNA, 20 bp, Artificial Sequence
  chemically synthesized
ggcaagagagacagcaagtg

SEQ ID NO: 378075 - DNA, 20 bp, Artificial Sequence
  chemically synthesized
gggcaagagagacagcaagt

SEQ ID NO: 378076 - DNA, 20 bp, Artificial Sequence
  chemically synthesized
agggcaagagagacagcaag

SEQ ID NO: 378077 - DNA, 20 bp, Artificial Sequence
  chemically synthesized
gcaagggcaagagagacagc

SEQ ID NO: 378078 - DNA, 20 bp, Artificial Sequence
  chemically synthesized
gggagcaagggcaagagaga

SEQ ID NO: 378079 - DNA, 20 bp, Artificial Sequence
  chemically synthesized
cggtgggagcaagggcaaga

SEQ ID NO: 378080 - DNA, 20 bp, Artificial Sequence
  chemically synthesized
gacggtgggagcaagggcaa

SEQ ID NO: 378081 - DNA, 20 bp, Artificial Sequence
  chemically synthesized
cagacggtgggagcaagggc

SEQ ID NO: 378082 - DNA, 20 bp, Artificial Sequence
  chemically synthesized
gactcagacggtgggagcaa

SEQ ID NO: 378083 - DNA, 20 bp, Artificial Sequence
  chemically synthesized
tgactcagacggtgggagca

SEQ ID NO: 378084 - DNA, 20 bp, Artificial Sequence
  chemically synthesized
gtgactcagacggtgggagc

SEQ ID NO: 378085 - DNA, 20 bp, Artificial Sequence
  chemically synthesized
cgaggtgactcagacggtgg

SEQ ID NO: 378086 - DNA, 20 bp, Artificial Sequence
  chemically synthesized
tgcccttgctcccaccgtct

SEQ ID NO: 378087 - DNA, 20 bp, Artificial Sequence
  chemically synthesized
agcgaggtgactcagacggt

SEQ ID NO: 378088 - DNA, 20 bp, Artificial Sequence
  chemically synthesized
gagcgaggtgactcagacgg

SEQ ID NO: 378089 - DNA, 20 bp, Artificial Sequence
  chemically synthesized
ggggagcgaggtgactcaga

SEQ ID NO: 378090 - DNA, 20 bp, Artificial Sequence
  chemically synthesized
agacggggagcgaggtgact

SEQ ID NO: 378091 - DNA, 20 bp, Artificial Sequence
  chemically synthesized
cagaaggcagacggggagcg

SEQ ID NO: 378092 - DNA, 20 bp, Artificial Sequence
  chemically synthesized
gcagaaggcagacggggagc

SEQ ID NO: 378093 - DNA, 20 bp, Artificial Sequence
  chemically synthesized
catggcagaaggcagacggg

SEQ ID NO: 378094 - DNA, 20 bp, Artificial Sequence
  chemically synthesized
atcatggcagaaggcagacg

SEQ ID NO: 378095 - DNA, 20 bp, Artificial Sequence
  chemically synthesized
aatcatggcagaaggcagac

SEQ ID NO: 378096 - DNA, 20 bp, Artificial Sequence
  chemically synthesized
taatcatggcagaaggcaga

SEQ ID NO: 378097 - DNA, 20 bp, Artificial Sequence
  chemically synthesized
cttctaatcatggcagaagg

SEQ ID NO: 378098 - DNA, 20 bp, Artificial Sequence
  chemically synthesized
aagcttctaatcatggcaga

SEQ ID NO: 378099 - DNA, 20 bp, Artificial Sequence
  chemically synthesized
gaagcttctaatcatggcag

SEQ ID NO: 378100 - DNA, 20 bp, Artificial Sequence
  chemically synthesized
cgtctgccttctgccatgat

SEQ ID NO: 378101 - DNA, 20 bp, Artificial Sequence
  chemically synthesized
caggaagcttctaatcatgg

SEQ ID NO: 378102 - DNA, 20 bp, Artificial Sequence
  chemically synthesized
ctgccttctgccatgattag

SEQ ID NO: 378103 - DNA, 20 bp, Artificial Sequence
  chemically synthesized
cctcaggaagcttctaatca

SEQ ID NO: 378104 - DNA, 20 bp, Artificial Sequence
  chemically synthesized
gccatgattagaagcttcct

SEQ ID NO: 378105 - DNA, 20 bp, Artificial Sequence
  chemically synthesized
ccatgattagaagcttcctg

SEQ ID NO: 378106 - DNA, 20 bp, Artificial Sequence
  chemically synthesized
gcttctggggcggcctcagg

SEQ ID NO: 378107 - DNA, 20 bp, Artificial Sequence
  chemically synthesized
tctgcttctggggcggcctc

SEQ ID NO: 378108 - DNA, 20 bp, Artificial Sequence
  chemically synthesized
ttctgcttctggggcggcct

SEQ ID NO: 378109 - DNA, 20 bp, Artificial Sequence
  chemically synthesized
gaagcttcctgaggccgccc

SEQ ID NO: 378110 - DNA, 20 bp, Artificial Sequence
  chemically synthesized
gcttcctgaggccgccccag

SEQ ID NO: 378111 - DNA, 20 bp, Artificial Sequence
  chemically synthesized
agcagcttctgcttctgggg

SEQ ID NO: 378112 - DNA, 20 bp, Artificial Sequence
  chemically synthesized
tcctgaggccgccccagaag

SEQ ID NO: 378113 - DNA, 20 bp, Artificial Sequence
  chemically synthesized
catagcagcttctgcttctg

SEQ ID NO: 378114 - DNA, 20 bp, Artificial Sequence
  chemically synthesized
gcatagcagcttctgcttct

SEQ ID NO: 378115 - DNA, 20 bp, Artificial Sequence
  chemically synthesized
tgaggccgccccagaagcag

SEQ ID NO: 378116 - DNA, 20 bp, Artificial Sequence
  chemically synthesized
agcatagcagcttctgcttc

SEQ ID NO: 378117 - DNA, 20 bp, Artificial Sequence
  chemically synthesized
aggctgttcaggaagcatag

SEQ ID NO: 378118 - DNA, 20 bp, Artificial Sequence
  chemically synthesized
tgcaggctgttcaggaagca

SEQ ID NO: 378119 - DNA, 20 bp, Artificial Sequence
  chemically synthesized
aagctgctatgcttcctgaa

SEQ ID NO: 378120 - DNA, 20 bp, Artificial Sequence
  chemically synthesized
ggttctgcaggctgttcagg

SEQ ID NO: 378121 - DNA, 20 bp, Artificial Sequence
  chemically synthesized
cacggttctgcaggctgttc

SEQ ID NO: 378122 - DNA, 20 bp, Artificial Sequence
  chemically synthesized
tcacggttctgcaggctgtt

SEQ ID NO: 378123 - DNA, 20 bp, Artificial Sequence
  chemically synthesized
tatgcttcctgaacagcctg

SEQ ID NO: 378124 - DNA, 20 bp, Artificial Sequence
  chemically synthesized
tagttggttcacggttctgc

SEQ ID NO: 378125 - DNA, 20 bp, Artificial Sequence
  chemically synthesized
ttagttggttcacggttctg

SEQ ID NO: 378126 - DNA, 20 bp, Artificial Sequence
  chemically synthesized
aaagacgtttagttggttca

SEQ ID NO: 378127 - DNA, 20 bp, Artificial Sequence
  chemically synthesized
ataaagaaaagacgtttagt

SEQ ID NO: 378128 - DNA, 20 bp, Artificial Sequence
  chemically synthesized
atttataaagaaaagacgtt

SEQ ID NO: 378129 - DNA, 20 bp, Artificial Sequence
  chemically synthesized
actggataatttataaagaa

SEQ ID NO: 378130 - DNA, 20 bp, Artificial Sequence
  chemically synthesized
ctgacactggataatttata

SEQ ID NO: 378131 - DNA, 20 bp, Artificial Sequence
  chemically synthesized
tcttttctttataaattatc

SEQ ID NO: 378132 - DNA, 20 bp, Artificial Sequence
  chemically synthesized
ctttataaattatccagtgt

SEQ ID NO: 378133 - DNA, 20 bp, Artificial Sequence
  chemically synthesized
tttataaattatccagtgtc

SEQ ID NO: 378134 - DNA, 20 bp, Artificial Sequence
  chemically synthesized
tgtaaagaaatacctgacac

SEQ ID NO: 378135 - DNA, 20 bp, Artificial Sequence
  chemically synthesized
cagtgtcaggtatttcttta

SEQ ID NO: 378136 - DNA, 20 bp, Artificial Sequence
  chemically synthesized
tccattctggcattgctgta

SEQ ID NO: 378137 - DNA, 20 bp, Artificial Sequence
  chemically synthesized
gtatttctttacagcaatgc

SEQ ID NO: 378138 - DNA, 20 bp, Artificial Sequence
  chemically synthesized
tctttacagcaatgccagaa

SEQ ID NO: 378139 - DNA, 20 bp, Artificial Sequence
  chemically synthesized
ccctctgtattagtccattc

SEQ ID NO: 378140 - DNA, 20 bp, Artificial Sequence
  chemically synthesized
aatgccagaatggactaata

SEQ ID NO: 378141 - DNA, 20 bp, Artificial Sequence
  chemically synthesized
tgccagaatggactaataca

SEQ ID NO: 378142 - DNA, 20 bp, Artificial Sequence
  chemically synthesized
gccagaatggactaatacag

SEQ ID NO: 378143 - DNA, 20 bp, Artificial Sequence
  chemically synthesized
ccagaatggactaatacaga

SEQ ID NO: 378144 - DNA, 20 bp, Artificial Sequence
  chemically synthesized
atttactgttccctctgtat

SEQ ID NO: 378145 - DNA, 20 bp, Artificial Sequence
  chemically synthesized
atggactaatacagagggaa

SEQ ID NO: 378146 - DNA, 20 bp, Artificial Sequence
  chemically synthesized
atacagagggaacagtaaat

SEQ ID NO: 378147 - DNA, 20 bp, Artificial Sequence
  chemically synthesized
cagagggaacagtaaataag

SEQ ID NO: 378148 - DNA, 20 bp, Artificial Sequence
  chemically synthesized
acagtaaataagtagacacc

SEQ ID NO: 378149 - DNA, 20 bp, Artificial Sequence
  chemically synthesized
cagtaaataagtagacaccg

SEQ ID NO: 378150 - DNA, 20 bp, Artificial Sequence
  chemically synthesized
agtaaataagtagacaccga

SEQ ID NO: 378151 - DNA, 20 bp, Artificial Sequence
  chemically synthesized
taataagctttcaagtccct

SEQ ID NO: 378152 - DNA, 20 bp, Artificial Sequence
  chemically synthesized
gtagacaccgagggacttga

SEQ ID NO: 378153 - DNA, 20 bp, Artificial Sequence
  chemically synthesized
cttgcatgtaataagctttc

SEQ ID NO: 378154 - DNA, 20 bp, Artificial Sequence
  chemically synthesized
tcttagttcttgcatgtaat

SEQ ID NO: 378155 - DNA, 20 bp, Artificial Sequence
  chemically synthesized
cttgaaagcttattacatgc

SEQ ID NO: 378156 - DNA, 20 bp, Artificial Sequence
  chemically synthesized
gcttattacatgcaagaact

SEQ ID NO: 378157 - DNA, 20 bp, Artificial Sequence
  chemically synthesized
attacatgcaagaactaaga

SEQ ID NO: 378158 - DNA, 20 bp, Artificial Sequence
  chemically synthesized
tacatgcaagaactaagaca

SEQ ID NO: 378159 - DNA, 20 bp, Artificial Sequence
  chemically synthesized
caggcaagctagctctgtct

SEQ ID NO: 378160 - DNA, 20 bp, Artificial Sequence
  chemically synthesized
tgcaagaactaagacagagc

SEQ ID NO: 378161 - DNA, 20 bp, Artificial Sequence
  chemically synthesized
taagacagagctagcttgcc

SEQ ID NO: 378162 - DNA, 20 bp, Artificial Sequence
  chemically synthesized
tcttgtagctccaggcaagc

SEQ ID NO: 378163 - DNA, 20 bp, Artificial Sequence
  chemically synthesized
agacagagctagcttgcctg

SEQ ID NO: 378164 - DNA, 20 bp, Artificial Sequence
  chemically synthesized
ttgctcttgtagctccaggc

SEQ ID NO: 378165 - DNA, 20 bp, Artificial Sequence
  chemically synthesized
agctttgctcttgtagctcc

SEQ ID NO: 378166 - DNA, 20 bp, Artificial Sequence
  chemically synthesized
gctagcttgcctggagctac

SEQ ID NO: 378167 - DNA, 20 bp, Artificial Sequence
  chemically synthesized
cagctttgctcttgtagctc

SEQ ID NO: 378168 - DNA, 20 bp, Artificial Sequence
  chemically synthesized
tagcttgcctggagctacaa

SEQ ID NO: 378169 - DNA, 20 bp, Artificial Sequence
  chemically synthesized
tcaattcagctttgctcttg

SEQ ID NO: 378170 - DNA, 20 bp, Artificial Sequence
  chemically synthesized
tgcctggagctacaagagca

SEQ ID NO: 378171 - DNA, 20 bp, Artificial Sequence
  chemically synthesized
ctccctcgcccatttcaatt

SEQ ID NO: 378172 - DNA, 20 bp, Artificial Sequence
  chemically synthesized
agagcaaagctgaattgaaa

SEQ ID NO: 378173 - DNA, 20 bp, Artificial Sequence
  chemically synthesized
gagcaaagctgaattgaaat

SEQ ID NO: 378174 - DNA, 20 bp, Artificial Sequence
  chemically synthesized
aaagctgaattgaaatgggc

SEQ ID NO: 378175 - DNA, 20 bp, Artificial Sequence
  chemically synthesized
aagctgaattgaaatgggcg

SEQ ID NO: 378176 - DNA, 20 bp, Artificial Sequence
  chemically synthesized
agctgaattgaaatgggcga

SEQ ID NO: 378177 - DNA, 20 bp, Artificial Sequence
  chemically synthesized
ctgaattgaaatgggcgagg

SEQ ID NO: 378178 - DNA, 20 bp, Artificial Sequence
  chemically synthesized
tgaattgaaatgggcgaggg

SEQ ID NO: 378179 - DNA, 20 bp, Artificial Sequence
  chemically synthesized
tgaaatgggcgagggaggca

SEQ ID NO: 378180 - DNA, 20 bp, Artificial Sequence
  chemically synthesized
tgggcgagggaggcatggtc

SEQ ID NO: 378181 - DNA, 20 bp, Artificial Sequence
  chemically synthesized
ggaggcatggtccagttatg

SEQ ID NO: 378182 - DNA, 20 bp, Artificial Sequence
  chemically synthesized
gaggcatggtccagttatgt

SEQ ID NO: 378183 - DNA, 20 bp, Artificial Sequence
  chemically synthesized
ttaaccttgacctacataac

SEQ ID NO: 378184 - DNA, 20 bp, Artificial Sequence
  chemically synthesized
atggtccagttatgtaggtc

SEQ ID NO: 378185 - DNA, 20 bp, Artificial Sequence
  chemically synthesized
tggtccagttatgtaggtca

SEQ ID NO: 378186 - DNA, 20 bp, Artificial Sequence
  chemically synthesized
gttatgtaggtcaaggttaa

SEQ ID NO: 378187 - DNA, 20 bp, Artificial Sequence
  chemically synthesized
ttatgtaggtcaaggttaaa

SEQ ID NO: 378188 - DNA, 20 bp, Artificial Sequence
  chemically synthesized
taggtcaaggttaaaaggtt

SEQ ID NO: 378189 - DNA, 20 bp, Artificial Sequence
  chemically synthesized
aaaggtttggaatttactct

SEQ ID NO: 378190 - DNA, 20 bp, Artificial Sequence
  chemically synthesized
ggtttggaatttactcttgg

SEQ ID NO: 378191 - DNA, 20 bp, Artificial Sequence
  chemically synthesized
aacgcctctcattctaccaa

SEQ ID NO: 378192 - DNA, 20 bp, Artificial Sequence
  chemically synthesized
aaaacgcctctcattctacc

SEQ ID NO: 378193 - DNA, 20 bp, Artificial Sequence
  chemically synthesized
gaatttactcttggtagaat

SEQ ID NO: 378194 - DNA, 20 bp, Artificial Sequence
  chemically synthesized
atttactcttggtagaatga

SEQ ID NO: 378195 - DNA, 20 bp, Artificial Sequence
  chemically synthesized
tttactcttggtagaatgag

SEQ ID NO: 378196 - DNA, 20 bp, Artificial Sequence
  chemically synthesized
gaatgagaggcgttttaatg

SEQ ID NO: 378197 - DNA, 20 bp, Artificial Sequence
  chemically synthesized
atgagaggcgttttaatgaa

SEQ ID NO: 378198 - DNA, 20 bp, Artificial Sequence
  chemically synthesized
tgagaggcgttttaatgaag

SEQ ID NO: 378199 - DNA, 20 bp, Artificial Sequence
  chemically synthesized
aggcgttttaatgaagaggt

SEQ ID NO: 378200 - DNA, 20 bp, Artificial Sequence
  chemically synthesized
gatttaattgatctttctaa

SEQ ID NO: 378201 - DNA, 20 bp, Artificial Sequence
  chemically synthesized
atttaattgatctttctaaa

SEQ ID NO: 378202 - DNA, 20 bp, Artificial Sequence
  chemically synthesized
atttggagcaaccttttaga

SEQ ID NO: 378203 - DNA, 20 bp, Artificial Sequence
  chemically synthesized
cagcatttggagcaaccttt

SEQ ID NO: 378204 - DNA, 20 bp, Artificial Sequence
  chemically synthesized
aatcctaatttcagcatttg

SEQ ID NO: 378205 - DNA, 20 bp, Artificial Sequence
  chemically synthesized
taaatcctaatttcagcatt

SEQ ID NO: 378206 - DNA, 20 bp, Artificial Sequence
  chemically synthesized
gttgctccaaatgctgaaat

SEQ ID NO: 378207 - DNA, 20 bp, Artificial Sequence
  chemically synthesized
ttgctccaaatgctgaaatt

SEQ ID NO: 378208 - DNA, 20 bp, Artificial Sequence
  chemically synthesized
ccatctataaatcctaattt

SEQ ID NO: 378209 - DNA, 20 bp, Artificial Sequence
  chemically synthesized
aatgctgaaattaggattta

SEQ ID NO: 378210 - DNA, 20 bp, Artificial Sequence
  chemically synthesized
ctgaaattaggatttataga

SEQ ID NO: 378211 - DNA, 20 bp, Artificial Sequence
  chemically synthesized
tgaaattaggatttatagat

SEQ ID NO: 378212 - DNA, 20 bp, Artificial Sequence
  chemically synthesized
gaaattaggatttatagatg

SEQ ID NO: 378213 - DNA, 20 bp, Artificial Sequence
  chemically synthesized
taggatttatagatggggtc

SEQ ID NO: 378214 - DNA, 20 bp, Artificial Sequence
  chemically synthesized
agatggggtcaagactacat

SEQ ID NO: 378215 - DNA, 20 bp, Artificial Sequence
  chemically synthesized
atggggtcaagactacatga

SEQ ID NO: 378216 - DNA, 20 bp, Artificial Sequence
  chemically synthesized
ggggtcaagactacatgaga

SEQ ID NO: 378217 - DNA, 20 bp, Artificial Sequence
  chemically synthesized
cctaactgctctctctcatg

SEQ ID NO: 378218 - DNA, 20 bp, Artificial Sequence
  chemically synthesized
ggtcaagactacatgagaga

SEQ ID NO: 378219 - DNA, 20 bp, Artificial Sequence
  chemically synthesized
caagactacatgagagagag

SEQ ID NO: 378220 - DNA, 20 bp, Artificial Sequence
  chemically synthesized
actacatgagagagagcagt

SEQ ID NO: 378221 - DNA, 20 bp, Artificial Sequence
  chemically synthesized
ctacatgagagagagcagtt

SEQ ID NO: 378222 - DNA, 20 bp, Artificial Sequence
  chemically synthesized
gagcagttaggatgctattt

SEQ ID NO: 378223 - DNA, 20 bp, Artificial Sequence
  chemically synthesized
tccttcctggagtactgaaa

SEQ ID NO: 378224 - DNA, 20 bp, Artificial Sequence
  chemically synthesized
aggatgctatttcagtactc

SEQ ID NO: 378225 - DNA, 20 bp, Artificial Sequence
  chemically synthesized
ggatgctatttcagtactcc

SEQ ID NO: 378226 - DNA, 20 bp, Artificial Sequence
  chemically synthesized
tgctatttcagtactccagg

SEQ ID NO: 378227 - DNA, 20 bp, Artificial Sequence
  chemically synthesized
gctatttcagtactccagga

SEQ ID NO: 378228 - DNA, 20 bp, Artificial Sequence
  chemically synthesized
tatttcagtactccaggaag

SEQ ID NO: 378229 - DNA, 20 bp, Artificial Sequence
  chemically synthesized
gtaccatcagctccttcctg

SEQ ID NO: 378230 - DNA, 20 bp, Artificial Sequence
  chemically synthesized
gtgtaccatcagctccttcc

SEQ ID NO: 378231 - DNA, 20 bp, Artificial Sequence
  chemically synthesized
gtactccaggaaggagctga

SEQ ID NO: 378232 - DNA, 20 bp, Artificial Sequence
  chemically synthesized
ttgacacttctgtgtaccat

SEQ ID NO: 378233 - DNA, 20 bp, Artificial Sequence
  chemically synthesized
aggaaggagctgatggtaca

SEQ ID NO: 378234 - DNA, 20 bp, Artificial Sequence
  chemically synthesized
aaggagctgatggtacacag

SEQ ID NO: 378235 - DNA, 20 bp, Artificial Sequence
  chemically synthesized
gatggtacacagaagtgtca

SEQ ID NO: 378236 - DNA, 20 bp, Artificial Sequence
  chemically synthesized
tacacagaagtgtcaaagtt

SEQ ID NO: 378237 - DNA, 20 bp, Artificial Sequence
  chemically synthesized
cacagaagtgtcaaagttga

SEQ ID NO: 378238 - DNA, 20 bp, Artificial Sequence
  chemically synthesized
acagaagtgtcaaagttgag

SEQ ID NO: 378239 - DNA, 20 bp, Artificial Sequence
  chemically synthesized
cagaagtgtcaaagttgaga

SEQ ID NO: 378240 - DNA, 20 bp, Artificial Sequence
  chemically synthesized
gcttggcctacaaattagta

SEQ ID NO: 378241 - DNA, 20 bp, Artificial Sequence
  chemically synthesized
agagggactgtactaatttg

SEQ ID NO: 378242 - DNA, 20 bp, Artificial Sequence
  chemically synthesized
gagggactgtactaatttgt

SEQ ID NO: 378243 - DNA, 20 bp, Artificial Sequence
  chemically synthesized
atttggcttggcctacaaat

SEQ ID NO: 378244 - DNA, 20 bp, Artificial Sequence
  chemically synthesized
actgtactaatttgtaggcc

SEQ ID NO: 378245 - DNA, 20 bp, Artificial Sequence
  chemically synthesized
cttggccgattgatttggct

SEQ ID NO: 378246 - DNA, 20 bp, Artificial Sequence
  chemically synthesized
gtaggccaagccaaatcaat

SEQ ID NO: 378247 - DNA, 20 bp, Artificial Sequence
  chemically synthesized
ttttgcttggccgattgatt

SEQ ID NO: 378248 - DNA, 20 bp, Artificial Sequence
  chemically synthesized
ccaagccaaatcaatcggcc

SEQ ID NO: 378249 - DNA, 20 bp, Artificial Sequence
  chemically synthesized
aatcaatcggccaagcaaaa

SEQ ID NO: 378250 - DNA, 20 bp, Artificial Sequence
  chemically synthesized
tatatagaatccattttgct

SEQ ID NO: 378251 - DNA, 20 bp, Artificial Sequence
  chemically synthesized
tcatgatcataatatttata

SEQ ID NO: 378252 - DNA, 20 bp, Artificial Sequence
  chemically synthesized
tatgatcatgaacaatatat

SEQ ID NO: 378253 - DNA, 20 bp, Artificial Sequence
  chemically synthesized
tagaatgacattatatgcat

SEQ ID NO: 378254 - DNA, 20 bp, Artificial Sequence
  chemically synthesized
gacattatatgcataagaca

SEQ ID NO: 378255 - DNA, 20 bp, Artificial Sequence
  chemically synthesized
acattatatgcataagacat

SEQ ID NO: 378256 - DNA, 20 bp, Artificial Sequence
  chemically synthesized
atatgcataagacataggtt

SEQ ID NO: 378257 - DNA, 20 bp, Artificial Sequence
  chemically synthesized
ttggttattttacatacatg

SEQ ID NO: 378258 - DNA, 20 bp, Artificial Sequence
  chemically synthesized
catacatgtagatgaaatta

SEQ ID NO: 378259 - DNA, 20 bp, Artificial Sequence
  chemically synthesized
tttaaaatctttcaggaaat

SEQ ID NO: 378260 - DNA, 20 bp, Artificial Sequence
  chemically synthesized
ttaaagaactaatttcctga

SEQ ID NO: 378261 - DNA, 20 bp, Artificial Sequence
  chemically synthesized
agtgatttttaaaatctttc

SEQ ID NO: 378262 - DNA, 20 bp, Artificial Sequence
  chemically synthesized
aagtgatttttaaaatcttt

SEQ ID NO: 378263 - DNA, 20 bp, Artificial Sequence
  chemically synthesized
gaaagattttaaaaatcact

SEQ ID NO: 378264 - DNA, 20 bp, Artificial Sequence
  chemically synthesized
attcaacaaatacagagact

SEQ ID NO: 378265 - DNA, 20 bp, Artificial Sequence
  chemically synthesized
atagtcattcaacaaataca

SEQ ID NO: 378266 - DNA, 20 bp, Artificial Sequence
  chemically synthesized
tcatagtcattcaacaaata

SEQ ID NO: 378267 - DNA, 20 bp, Artificial Sequence
  chemically synthesized
ctggaatttggatgatatca

SEQ ID NO: 378268 - DNA, 20 bp, Artificial Sequence
  chemically synthesized
ctatgatatcatccaaattc

SEQ ID NO: 378269 - DNA, 20 bp, Artificial Sequence
  chemically synthesized
aatgtttttattctggaatt

SEQ ID NO: 378270 - DNA, 20 bp, Artificial Sequence
  chemically synthesized
actatagaatgtttttattc

SEQ ID NO: 378271 - DNA, 20 bp, Artificial Sequence
  chemically synthesized
tccagaataaaaacattcta

SEQ ID NO: 378272 - DNA, 20 bp, Artificial Sequence
  chemically synthesized
tttctcatgaatttacacta

SEQ ID NO: 378273 - DNA, 20 bp, Artificial Sequence
  chemically synthesized
attctatagtgtaaattcat

SEQ ID NO: 378274 - DNA, 20 bp, Artificial Sequence
  chemically synthesized
tcatgagaaaataccctatt

SEQ ID NO: 378275 - DNA, 20 bp, Artificial Sequence
  chemically synthesized
aaggccaataatactcaata

SEQ ID NO: 378276 - DNA, 20 bp, Artificial Sequence
  chemically synthesized
taaggccaataatactcaat

SEQ ID NO: 378277 - DNA, 20 bp, Artificial Sequence
  chemically synthesized
ataaggccaataatactcaa

SEQ ID NO: 378278 - DNA, 20 bp, Artificial Sequence
  chemically synthesized
aataccctattgagtattat

SEQ ID NO: 378279 - DNA, 20 bp, Artificial Sequence
  chemically synthesized
taagtgaagcttgcattata

SEQ ID NO: 378280 - DNA, 20 bp, Artificial Sequence
  chemically synthesized
tattattggccttataatgc

SEQ ID NO: 378281 - DNA, 20 bp, Artificial Sequence
  chemically synthesized
ttaagtgaagcttgcattat

SEQ ID NO: 378282 - DNA, 20 bp, Artificial Sequence
  chemically synthesized
cacaattgtaaagttaagtg

SEQ ID NO: 378283 - DNA, 20 bp, Artificial Sequence
  chemically synthesized
tattccacaattgtaaagtt

SEQ ID NO: 378284 - DNA, 20 bp, Artificial Sequence
  chemically synthesized
aaaattattccacaattgta

SEQ ID NO: 378285 - DNA, 20 bp, Artificial Sequence
  chemically synthesized
ttcacttaactttacaattg

SEQ ID NO: 378286 - DNA, 20 bp, Artificial Sequence
  chemically synthesized
aatgaaatgaacatcacagt

SEQ ID NO: 378287 - DNA, 20 bp, Artificial Sequence
  chemically synthesized
acgcaatgaaatgaacatca

SEQ ID NO: 378288 - DNA, 20 bp, Artificial Sequence
  chemically synthesized
gttcatttcattgcgtgaaa

SEQ ID NO: 378289 - DNA, 20 bp, Artificial Sequence
  chemically synthesized
ttcatttcattgcgtgaaac

SEQ ID NO: 378290 - DNA, 20 bp, Artificial Sequence
  chemically synthesized
ttcattgcgtgaaacaggtt

SEQ ID NO: 378291 - DNA, 20 bp, Artificial Sequence
  chemically synthesized
taaaacaaagcattttgaag

SEQ ID NO: 378292 - DNA, 20 bp, Artificial Sequence
  chemically synthesized
atctaaaacaaagcattttg

SEQ ID NO: 378293 - DNA, 20 bp, Artificial Sequence
  chemically synthesized
tacttcaaaatgctttgttt

SEQ ID NO: 378294 - DNA, 20 bp, Artificial Sequence
  chemically synthesized
tattttttaaatctaaaaca

SEQ ID NO: 378295 - DNA, 20 bp, Artificial Sequence
  chemically synthesized
gttttagatttaaaaaatat

SEQ ID NO: 378296 - DNA, 20 bp, Artificial Sequence
  chemically synthesized
gaaacctcacattggcaaag

SEQ ID NO: 378297 - DNA, 20 bp, Artificial Sequence
  chemically synthesized
tatgaaacctcacattggca

SEQ ID NO: 378298 - DNA, 20 bp, Artificial Sequence
  chemically synthesized
cataactgctttgccaatgt

SEQ ID NO: 378299 - DNA, 20 bp, Artificial Sequence
  chemically synthesized
ataactgctttgccaatgtg

SEQ ID NO: 378300 - DNA, 20 bp, Artificial Sequence
  chemically synthesized
tttcgtatgaaacctcacat

SEQ ID NO: 378301 - DNA, 20 bp, Artificial Sequence
  chemically synthesized
aaatcaatatgataagtttt

SEQ ID NO: 378302 - DNA, 20 bp, Artificial Sequence
  chemically synthesized
tgacacaaaatcaatatgat

SEQ ID NO: 378303 - DNA, 20 bp, Artificial Sequence
  chemically synthesized
tgtgtcaaatctttatgaac

SEQ ID NO: 378304 - DNA, 20 bp, Artificial Sequence
  chemically synthesized
tataaaaatgcttgttcata

SEQ ID NO: 378305 - DNA, 20 bp, Artificial Sequence
  chemically synthesized
gaacaagcatttttataata

SEQ ID NO: 378306 - DNA, 20 bp, Artificial Sequence
  chemically synthesized
agggaaggagattatgagaa

SEQ ID NO: 378307 - DNA, 20 bp, Artificial Sequence
  chemically synthesized
tatgaagggaaggagattat

SEQ ID NO: 378308 - DNA, 20 bp, Artificial Sequence
  chemically synthesized
tagtgagatatgaagggaag

SEQ ID NO: 378309 - DNA, 20 bp, Artificial Sequence
  chemically synthesized
tatagtgagatatgaaggga

SEQ ID NO: 378310 - DNA, 20 bp, Artificial Sequence
  chemically synthesized
ctatagtgagatatgaaggg

SEQ ID NO: 378311 - DNA, 20 bp, Artificial Sequence
  chemically synthesized
aatctatagtgagatatgaa

SEQ ID NO: 378312 - DNA, 20 bp, Artificial Sequence
  chemically synthesized
caatctatagtgagatatga

SEQ ID NO: 378313 - DNA, 20 bp, Artificial Sequence
  chemically synthesized
acaatctatagtgagatatg

SEQ ID NO: 378314 - DNA, 20 bp, Artificial Sequence
  chemically synthesized
cttcccttcatatctcacta

SEQ ID NO: 378315 - DNA, 20 bp, Artificial Sequence
  chemically synthesized
tatttagtacaatctatagt

SEQ ID NO: 378316 - DNA, 20 bp, Artificial Sequence
  chemically synthesized
acaatatttagtacaatcta

SEQ ID NO: 378317 - DNA, 20 bp, Artificial Sequence
  chemically synthesized
tgaaggatagatacaatatt

SEQ ID NO: 378318 - DNA, 20 bp, Artificial Sequence
  chemically synthesized
aactgtatgtacatgaagga

SEQ ID NO: 378319 - DNA, 20 bp, Artificial Sequence
  chemically synthesized
gtagaactgtatgtacatga

SEQ ID NO: 378320 - DNA, 20 bp, Artificial Sequence
  chemically synthesized
cgtagaactgtatgtacatg

SEQ ID NO: 378321 - DNA, 20 bp, Artificial Sequence
  chemically synthesized
atctatccttcatgtacata

SEQ ID NO: 378322 - DNA, 20 bp, Artificial Sequence
  chemically synthesized
tcatgtacatacagttctac

SEQ ID NO: 378323 - DNA, 20 bp, Artificial Sequence
  chemically synthesized
catgtacatacagttctacg

SEQ ID NO: 378324 - DNA, 20 bp, Artificial Sequence
  chemically synthesized
ttgaatttcttatttcctcg

SEQ ID NO: 378325 - DNA, 20 bp, Artificial Sequence
  chemically synthesized
atacagttctacgaggaaat

SEQ ID NO: 378326 - DNA, 20 bp, Artificial Sequence
  chemically synthesized
tacgaggaaataagaaattc

SEQ ID NO: 378327 - DNA, 20 bp, Artificial Sequence
  chemically synthesized
gaggaaataagaaattcaag

SEQ ID NO: 378328 - DNA, 20 bp, Artificial Sequence
  chemically synthesized
ttcattgaattaatcactaa

SEQ ID NO: 378329 - DNA, 20 bp, Artificial Sequence
  chemically synthesized
tcattgaattaatcactaat

SEQ ID NO: 378330 - DNA, 20 bp, Artificial Sequence
  chemically synthesized
attgaattaatcactaatag

SEQ ID NO: 378331 - DNA, 20 bp, Artificial Sequence
  chemically synthesized
tgaattaatcactaatagga

SEQ ID NO: 378332 - DNA, 20 bp, Artificial Sequence
  chemically synthesized
tttgatcaattctctcctat

SEQ ID NO: 378333 - DNA, 20 bp, Artificial Sequence
  chemically synthesized
attttgaaggaagaaaatta

SEQ ID NO: 378334 - DNA, 20 bp, Artificial Sequence
  chemically synthesized
aattctgatgattttgaagg

SEQ ID NO: 378335 - DNA, 20 bp, Artificial Sequence
  chemically synthesized
cagaattctgatgattttga

SEQ ID NO: 378336 - DNA, 20 bp, Artificial Sequence
  chemically synthesized
ccagaattctgatgattttg

SEQ ID NO: 378337 - DNA, 20 bp, Artificial Sequence
  chemically synthesized
ttttcttccttcaaaatcat

SEQ ID NO: 378338 - DNA, 20 bp, Artificial Sequence
  chemically synthesized
cttcaaaatcatcagaattc

SEQ ID NO: 378339 - DNA, 20 bp, Artificial Sequence
  chemically synthesized
aaatcatcagaattctggta

SEQ ID NO: 378340 - DNA, 20 bp, Artificial Sequence
  chemically synthesized
tatgaaatacaaagctttac

SEQ ID NO: 378341 - DNA, 20 bp, Artificial Sequence
  chemically synthesized
agtccaaattatgaaataca

SEQ ID NO: 378342 - DNA, 20 bp, Artificial Sequence
  chemically synthesized
aagctttgtatttcataatt

SEQ ID NO: 378343 - DNA, 20 bp, Artificial Sequence
  chemically synthesized
ataatttggactccacatat

SEQ ID NO: 378344 - DNA, 20 bp, Artificial Sequence
  chemically synthesized
tgaattgtcaccaatatgtg

SEQ ID NO: 378345 - DNA, 20 bp, Artificial Sequence
  chemically synthesized
tctgaattgtcaccaatatg

SEQ ID NO: 378346 - DNA, 20 bp, Artificial Sequence
  chemically synthesized
tccacatattggtgacaatt

SEQ ID NO: 378347 - DNA, 20 bp, Artificial Sequence
  chemically synthesized
ttggtgacaattcagacact

SEQ ID NO: 378348 - DNA, 20 bp, Artificial Sequence
  chemically synthesized
ggtgacaattcagacactga

SEQ ID NO: 378349 - DNA, 20 bp, Artificial Sequence
  chemically synthesized
gacaattcagacactgagag

SEQ ID NO: 378350 - DNA, 20 bp, Artificial Sequence
  chemically synthesized
attcctttgtgttccactct

SEQ ID NO: 378351 - DNA, 20 bp, Artificial Sequence
  chemically synthesized
gacactgagagtggaacaca

SEQ ID NO: 378352 - DNA, 20 bp, Artificial Sequence
  chemically synthesized
acactgagagtggaacacaa

SEQ ID NO: 378353 - DNA, 20 bp, Artificial Sequence
  chemically synthesized
agagtggaacacaaaggaat

SEQ ID NO: 378354 - DNA, 20 bp, Artificial Sequence
  chemically synthesized
gagtggaacacaaaggaatt

SEQ ID NO: 378355 - DNA, 20 bp, Artificial Sequence
  chemically synthesized
acacaaaggaattgggtaac

SEQ ID NO: 378356 - DNA, 20 bp, Artificial Sequence
  chemically synthesized
aattgggtaacgagatcact

SEQ ID NO: 378357 - DNA, 20 bp, Artificial Sequence
  chemically synthesized
attgggtaacgagatcacta

SEQ ID NO: 378358 - DNA, 20 bp, Artificial Sequence
  chemically synthesized
ttgggtaacgagatcactaa

SEQ ID NO: 378359 - DNA, 20 bp, Artificial Sequence
  chemically synthesized
tactaggctaaaaattccct

SEQ ID NO: 378360 - DNA, 20 bp, Artificial Sequence
  chemically synthesized
gagatcactaagggaatttt

SEQ ID NO: 378361 - DNA, 20 bp, Artificial Sequence
  chemically synthesized
cactaagggaatttttagcc

SEQ ID NO: 378362 - DNA, 20 bp, Artificial Sequence
  chemically synthesized
agggaatttttagcctagta

SEQ ID NO: 378363 - DNA, 20 bp, Artificial Sequence
  chemically synthesized
gttgagaaactgtctttact

SEQ ID NO: 378364 - DNA, 20 bp, Artificial Sequence
  chemically synthesized
aatttttagcctagtaaaga

SEQ ID NO: 378365 - DNA, 20 bp, Artificial Sequence
  chemically synthesized
tgttgagaaactgtctttac

SEQ ID NO: 378366 - DNA, 20 bp, Artificial Sequence
  chemically synthesized
aagacagtttctcaacattc

SEQ ID NO: 378367 - DNA, 20 bp, Artificial Sequence
  chemically synthesized
ttgaattattcttgaatgtt

SEQ ID NO: 378368 - DNA, 20 bp, Artificial Sequence
  chemically synthesized
ttacataaaaattcatataa

SEQ ID NO: 378369 - DNA, 20 bp, Artificial Sequence
  chemically synthesized
gtgcattaataagtattcaa

SEQ ID NO: 378370 - DNA, 20 bp, Artificial Sequence
  chemically synthesized
tctgaggggtgtgcattaat

SEQ ID NO: 378371 - DNA, 20 bp, Artificial Sequence
  chemically synthesized
acttattaatgcacacccct

SEQ ID NO: 378372 - DNA, 20 bp, Artificial Sequence
  chemically synthesized
ttattaatgcacacccctca

SEQ ID NO: 378373 - DNA, 20 bp, Artificial Sequence
  chemically synthesized
gcaaatttcaggtctctgag

SEQ ID NO: 378374 - DNA, 20 bp, Artificial Sequence
  chemically synthesized
tgcaaatttcaggtctctga

SEQ ID NO: 378375 - DNA, 20 bp, Artificial Sequence
  chemically synthesized
ttgcaaatttcaggtctctg

SEQ ID NO: 378376 - DNA, 20 bp, Artificial Sequence
  chemically synthesized
cttgcaaatttcaggtctct

SEQ ID NO: 378377 - DNA, 20 bp, Artificial Sequence
  chemically synthesized
tatatagtcttgcaaatttc

SEQ ID NO: 378378 - DNA, 20 bp, Artificial Sequence
  chemically synthesized
ctatatagtcttgcaaattt

SEQ ID NO: 378379 - DNA, 20 bp, Artificial Sequence
  chemically synthesized
ctcagagacctgaaatttgc

SEQ ID NO: 378380 - DNA, 20 bp, Artificial Sequence
  chemically synthesized
ctgaaatttgcaagactata

SEQ ID NO: 378381 - DNA, 20 bp, Artificial Sequence
  chemically synthesized
caaattcaaattaagctata

SEQ ID NO: 378382 - DNA, 20 bp, Artificial Sequence
  chemically synthesized
agaaaattcaaattcaaatt

SEQ ID NO: 378383 - DNA, 20 bp, Artificial Sequence
  chemically synthesized
tttattttgctaaaataagt

SEQ ID NO: 378384 - DNA, 20 bp, Artificial Sequence
  chemically synthesized
ttgaattttcttacttattt

SEQ ID NO: 378385 - DNA, 20 bp, Artificial Sequence
  chemically synthesized
taagtttattttgctaaaat

SEQ ID NO: 378386 - DNA, 20 bp, Artificial Sequence
  chemically synthesized
tattttagcaaaataaactt

SEQ ID NO: 378387 - DNA, 20 bp, Artificial Sequence
  chemically synthesized
attttagcaaaataaactta

SEQ ID NO: 378388 - DNA, 20 bp, Artificial Sequence
  chemically synthesized
gctatgttcttatgaacctt

SEQ ID NO: 378389 - DNA, 20 bp, Artificial Sequence
  chemically synthesized
aaaataaacttaaggttcat

SEQ ID NO: 378390 - DNA, 20 bp, Artificial Sequence
  chemically synthesized
acttaaggttcataagaaca

SEQ ID NO: 378391 - DNA, 20 bp, Artificial Sequence
  chemically synthesized
gaccaagataagtgaatgaa

SEQ ID NO: 378392 - DNA, 20 bp, Artificial Sequence
  chemically synthesized
acgaccaagataagtgaatg

SEQ ID NO: 378393 - DNA, 20 bp, Artificial Sequence
  chemically synthesized
agctcttcattcacttatct

SEQ ID NO: 378394 - DNA, 20 bp, Artificial Sequence
  chemically synthesized
acagtatttacgaccaagat

SEQ ID NO: 378395 - DNA, 20 bp, Artificial Sequence
  chemically synthesized
gtttaacagtatttacgacc

SEQ ID NO: 378396 - DNA, 20 bp, Artificial Sequence
  chemically synthesized
gcacctgattttgtgtttaa

SEQ ID NO: 378397 - DNA, 20 bp, Artificial Sequence
  chemically synthesized
aatactgttaaacacaaaat

SEQ ID NO: 378398 - DNA, 20 bp, Artificial Sequence
  chemically synthesized
atactgttaaacacaaaatc

SEQ ID NO: 378399 - DNA, 20 bp, Artificial Sequence
  chemically synthesized
aacacaaaatcaggtgccca

SEQ ID NO: 378400 - DNA, 20 bp, Artificial Sequence
  chemically synthesized
tgtgtagatttgtgagctgt

SEQ ID NO: 378401 - DNA, 20 bp, Artificial Sequence
  chemically synthesized
atgtgtagatttgtgagctg

SEQ ID NO: 378402 - DNA, 20 bp, Artificial Sequence
  chemically synthesized
tgtgtcatgtgtagatttgt

SEQ ID NO: 378403 - DNA, 20 bp, Artificial Sequence
  chemically synthesized
gtaaagagatgtgtcatgtg

SEQ ID NO: 378404 - DNA, 20 bp, Artificial Sequence
  chemically synthesized
taggtcaggaggaacgtaaa

SEQ ID NO: 378405 - DNA, 20 bp, Artificial Sequence
  chemically synthesized
ggtaggtcaggaggaacgta

SEQ ID NO: 378406 - DNA, 20 bp, Artificial Sequence
  chemically synthesized
ttgggctgaggtaggtcagg

SEQ ID NO: 378407 - DNA, 20 bp, Artificial Sequence
  chemically synthesized
tttgggctgaggtaggtcag

SEQ ID NO: 378408 - DNA, 20 bp, Artificial Sequence
  chemically synthesized
gatttgggctgaggtaggtc

SEQ ID NO: 378409 - DNA, 20 bp, Artificial Sequence
  chemically synthesized
ggatttgggctgaggtaggt

SEQ ID NO: 378410 - DNA, 20 bp, Artificial Sequence
  chemically synthesized
acgttcctcctgacctacct

SEQ ID NO: 378411 - DNA, 20 bp, Artificial Sequence
  chemically synthesized
agagggatttgggctgaggt

SEQ ID NO: 378412 - DNA, 20 bp, Artificial Sequence
  chemically synthesized
gagagggatttgggctgagg

SEQ ID NO: 378413 - DNA, 20 bp, Artificial Sequence
  chemically synthesized
gtagagagggatttgggctg

SEQ ID NO: 378414 - DNA, 20 bp, Artificial Sequence
  chemically synthesized
ggtagagagggatttgggct

SEQ ID NO: 378415 - DNA, 20 bp, Artificial Sequence
  chemically synthesized
tatgaggtagagagggattt

SEQ ID NO: 378416 - DNA, 20 bp, Artificial Sequence
  chemically synthesized
ctatgaggtagagagggatt

SEQ ID NO: 378417 - DNA, 20 bp, Artificial Sequence
  chemically synthesized
caaattctatgaggtagaga

SEQ ID NO: 378418 - DNA, 20 bp, Artificial Sequence
  chemically synthesized
tcaaattctatgaggtagag

SEQ ID NO: 378419 - DNA, 20 bp, Artificial Sequence
  chemically synthesized
atcaaattctatgaggtaga

SEQ ID NO: 378420 - DNA, 20 bp, Artificial Sequence
  chemically synthesized
ccaaatccctctctacctca

SEQ ID NO: 378421 - DNA, 20 bp, Artificial Sequence
  chemically synthesized
atatcaaattctatgaggta

SEQ ID NO: 378422 - DNA, 20 bp, Artificial Sequence
  chemically synthesized
taatatcaaattctatgagg

SEQ ID NO: 378423 - DNA, 20 bp, Artificial Sequence
  chemically synthesized
agttaatatcaaattctatg

SEQ ID NO: 378424 - DNA, 20 bp, Artificial Sequence
  chemically synthesized
aagttaatatcaaattctat

SEQ ID NO: 378425 - DNA, 20 bp, Artificial Sequence
  chemically synthesized
cctttcaaaaagttagcaga

SEQ ID NO: 378426 - DNA, 20 bp, Artificial Sequence
  chemically synthesized
ttctcctttcaaaaagttag

SEQ ID NO: 378427 - DNA, 20 bp, Artificial Sequence
  chemically synthesized
ctattctcctttcaaaaagt

SEQ ID NO: 378428 - DNA, 20 bp, Artificial Sequence
  chemically synthesized
actttctgctaactttttga

SEQ ID NO: 378429 - DNA, 20 bp, Artificial Sequence
  chemically synthesized
ctttctgctaactttttgaa

SEQ ID NO: 378430 - DNA, 20 bp, Artificial Sequence
  chemically synthesized
agaactattctcctttcaaa

SEQ ID NO: 378431 - DNA, 20 bp, Artificial Sequence
  chemically synthesized
ttctgctaactttttgaaag

SEQ ID NO: 378432 - DNA, 20 bp, Artificial Sequence
  chemically synthesized
ctaactttttgaaaggagaa

SEQ ID NO: 378433 - DNA, 20 bp, Artificial Sequence
  chemically synthesized
gagaatagttctgttgctac

SEQ ID NO: 378434 - DNA, 20 bp, Artificial Sequence
  chemically synthesized
tcaagggtgactcgtagcaa

SEQ ID NO: 378435 - DNA, 20 bp, Artificial Sequence
  chemically synthesized
aaagggtcaagggtgactcg

SEQ ID NO: 378436 - DNA, 20 bp, Artificial Sequence
  chemically synthesized
ttggtcttgcaaagggtcaa

SEQ ID NO: 378437 - DNA, 20 bp, Artificial Sequence
  chemically synthesized
tttggtcttgcaaagggtca

SEQ ID NO: 378438 - DNA, 20 bp, Artificial Sequence
  chemically synthesized
gtttggtcttgcaaagggtc

SEQ ID NO: 378439 - DNA, 20 bp, Artificial Sequence
  chemically synthesized
agtcacccttgaccctttgc

SEQ ID NO: 378440 - DNA, 20 bp, Artificial Sequence
  chemically synthesized
ggcatgtttggtcttgcaaa

SEQ ID NO: 378441 - DNA, 20 bp, Artificial Sequence
  chemically synthesized
cggcatgtttggtcttgcaa

SEQ ID NO: 378442 - DNA, 20 bp, Artificial Sequence
  chemically synthesized
tcggcatgtttggtcttgca

SEQ ID NO: 378443 - DNA, 20 bp, Artificial Sequence
  chemically synthesized
ttttaaattatcggcatgtt

SEQ ID NO: 378444 - DNA, 20 bp, Artificial Sequence
  chemically synthesized
tacatcacattttaaattat

SEQ ID NO: 378445 - DNA, 20 bp, Artificial Sequence
  chemically synthesized
cgataatttaaaatgtgatg

SEQ ID NO: 378446 - DNA, 20 bp, Artificial Sequence
  chemically synthesized
gataatttaaaatgtgatgt

SEQ ID NO: 378447 - DNA, 20 bp, Artificial Sequence
  chemically synthesized
caacacttaattattgatta

SEQ ID NO: 378448 - DNA, 20 bp, Artificial Sequence
  chemically synthesized
aacaacacttaattattgat

SEQ ID NO: 378449 - DNA, 20 bp, Artificial Sequence
  chemically synthesized
gtaggctctaatcaataatt

SEQ ID NO: 378450 - DNA, 20 bp, Artificial Sequence
  chemically synthesized
tgtgatatatcataagttaa

SEQ ID NO: 378451 - DNA, 20 bp, Artificial Sequence
  chemically synthesized
taaagtatgtgatatatcat

SEQ ID NO: 378452 - DNA, 20 bp, Artificial Sequence
  chemically synthesized
taatgtcactgaatcaaata

SEQ ID NO: 378453 - DNA, 20 bp, Artificial Sequence
  chemically synthesized
atcacatactttatttgatt

SEQ ID NO: 378454 - DNA, 20 bp, Artificial Sequence
  chemically synthesized
acattaatatcatcatcaaa

SEQ ID NO: 378455 - DNA, 20 bp, Artificial Sequence
  chemically synthesized
agaacaggagattaaaatat

SEQ ID NO: 378456 - DNA, 20 bp, Artificial Sequence
  chemically synthesized
tctgctgcatggtagaacag

SEQ ID NO: 378457 - DNA, 20 bp, Artificial Sequence
  chemically synthesized
gctctgctgcatggtagaac

SEQ ID NO: 378458 - DNA, 20 bp, Artificial Sequence
  chemically synthesized
tgctctgctgcatggtagaa

SEQ ID NO: 378459 - DNA, 20 bp, Artificial Sequence
  chemically synthesized
taatctcctgttctaccatg

SEQ ID NO: 378460 - DNA, 20 bp, Artificial Sequence
  chemically synthesized
agctgtgctctgctgcatgg

SEQ ID NO: 378461 - DNA, 20 bp, Artificial Sequence
  chemically synthesized
tctcctgttctaccatgcag

SEQ ID NO: 378462 - DNA, 20 bp, Artificial Sequence
  chemically synthesized
tcctgttctaccatgcagca

SEQ ID NO: 378463 - DNA, 20 bp, Artificial Sequence
  chemically synthesized
tgcagctgtgctctgctgca

SEQ ID NO: 378464 - DNA, 20 bp, Artificial Sequence
  chemically synthesized
ttctaccatgcagcagagca

SEQ ID NO: 378465 - DNA, 20 bp, Artificial Sequence
  chemically synthesized
cccatggaaaatataatatg

SEQ ID NO: 378466 - DNA, 20 bp, Artificial Sequence
  chemically synthesized
gctgcatattatattttcca

SEQ ID NO: 378467 - DNA, 20 bp, Artificial Sequence
  chemically synthesized
ctgcatattatattttccat

SEQ ID NO: 378468 - DNA, 20 bp, Artificial Sequence
  chemically synthesized
atgatggctgatatttccca

SEQ ID NO: 378469 - DNA, 20 bp, Artificial Sequence
  chemically synthesized
atattttccatgggaaatat

SEQ ID NO: 378470 - DNA, 20 bp, Artificial Sequence
  chemically synthesized
gggaaatatcagccatcata

SEQ ID NO: 378471 - DNA, 20 bp, Artificial Sequence
  chemically synthesized
gaagactacaagccatatga

SEQ ID NO: 378472 - DNA, 20 bp, Artificial Sequence
  chemically synthesized
atcagccatcatatggcttg

SEQ ID NO: 378473 - DNA, 20 bp, Artificial Sequence
  chemically synthesized
ccagaaatttggaagactac

SEQ ID NO: 378474 - DNA, 20 bp, Artificial Sequence
  chemically synthesized
aaagtaggccagaaatttgg

SEQ ID NO: 378475 - DNA, 20 bp, Artificial Sequence
  chemically synthesized
cttgtagtcttccaaatttc

SEQ ID NO: 378476 - DNA, 20 bp, Artificial Sequence
  chemically synthesized
tgaaaagtaggccagaaatt

SEQ ID NO: 378477 - DNA, 20 bp, Artificial Sequence
  chemically synthesized
tttgattttgaaaagtaggc

SEQ ID NO: 378478 - DNA, 20 bp, Artificial Sequence
  chemically synthesized
gacatttgattttgaaaagt

SEQ ID NO: 378479 - DNA, 20 bp, Artificial Sequence
  chemically synthesized
agacatttgattttgaaaag

SEQ ID NO: 378480 - DNA, 20 bp, Artificial Sequence
  chemically synthesized
tgtagacatttgattttgaa

SEQ ID NO: 378481 - DNA, 20 bp, Artificial Sequence
  chemically synthesized
tcagtgttttttggaaattg

SEQ ID NO: 378482 - DNA, 20 bp, Artificial Sequence
  chemically synthesized
aaaatattttcagtgttttt

SEQ ID NO: 378483 - DNA, 20 bp, Artificial Sequence
  chemically synthesized
atgtactttaaaaatatttt

SEQ ID NO: 378484 - DNA, 20 bp, Artificial Sequence
  chemically synthesized
aaacactgaaaatattttta

SEQ ID NO: 378485 - DNA, 20 bp, Artificial Sequence
  chemically synthesized
tactcataagttaaaatgtt

SEQ ID NO: 378486 - DNA, 20 bp, Artificial Sequence
  chemically synthesized
caccaaacattttaacttat

SEQ ID NO: 378487 - DNA, 20 bp, Artificial Sequence
  chemically synthesized
tgtaaaggttgattactcat

SEQ ID NO: 378488 - DNA, 20 bp, Artificial Sequence
  chemically synthesized
tttacgttcaaatgttgtaa

SEQ ID NO: 378489 - DNA, 20 bp, Artificial Sequence
  chemically synthesized
ttttacgttcaaatgttgta

SEQ ID NO: 378490 - DNA, 20 bp, Artificial Sequence
  chemically synthesized
tacaacatttgaacgtaaaa

SEQ ID NO: 378491 - DNA, 20 bp, Artificial Sequence
  chemically synthesized
aacatttgaacgtaaaacgg

SEQ ID NO: 378492 - DNA, 20 bp, Artificial Sequence
  chemically synthesized
acgtaaaacggaagtgctaa

SEQ ID NO: 378493 - DNA, 20 bp, Artificial Sequence
  chemically synthesized
aaacggaagtgctaaaagtc

SEQ ID NO: 378494 - DNA, 20 bp, Artificial Sequence
  chemically synthesized
tgtttttgctgccagacttt

SEQ ID NO: 378495 - DNA, 20 bp, Artificial Sequence
  chemically synthesized
cggaagtgctaaaagtctgg

SEQ ID NO: 378496 - DNA, 20 bp, Artificial Sequence
  chemically synthesized
tgaaaggttgtttttgctgc

SEQ ID NO: 378497 - DNA, 20 bp, Artificial Sequence
  chemically synthesized
tggcagcaaaaacaaccttt

SEQ ID NO: 378498 - DNA, 20 bp, Artificial Sequence
  chemically synthesized
atctctcataaaatgctgaa

SEQ ID NO: 378499 - DNA, 20 bp, Artificial Sequence
  chemically synthesized
gatctctcataaaatgctga

SEQ ID NO: 378500 - DNA, 20 bp, Artificial Sequence
  chemically synthesized
acaacctttcagcattttat

SEQ ID NO: 378501 - DNA, 20 bp, Artificial Sequence
  chemically synthesized
aacctttcagcattttatga

SEQ ID NO: 378502 - DNA, 20 bp, Artificial Sequence
  chemically synthesized
attcaccaatatgacgatac

SEQ ID NO: 378503 - DNA, 20 bp, Artificial Sequence
  chemically synthesized
aattcaccaatatgacgata

SEQ ID NO: 378504 - DNA, 20 bp, Artificial Sequence
  chemically synthesized
gagatcctgtatcgtcatat

SEQ ID NO: 378505 - DNA, 20 bp, Artificial Sequence
  chemically synthesized
ggtgaatttaaaatgatttt

SEQ ID NO: 378506 - DNA, 20 bp, Artificial Sequence
  chemically synthesized
aagtctcatgagaagaaaga

SEQ ID NO: 378507 - DNA, 20 bp, Artificial Sequence
  chemically synthesized
tctaaagtctcatgagaaga

SEQ ID NO: 378508 - DNA, 20 bp, Artificial Sequence
  chemically synthesized
agttctttctttcttctcat

SEQ ID NO: 378509 - DNA, 20 bp, Artificial Sequence
  chemically synthesized
tagatctaaagtctcatgag

SEQ ID NO: 378510 - DNA, 20 bp, Artificial Sequence
  chemically synthesized
gcttagatctaaagtctcat

SEQ ID NO: 378511 - DNA, 20 bp, Artificial Sequence
  chemically synthesized
tctttcttctcatgagactt

SEQ ID NO: 378512 - DNA, 20 bp, Artificial Sequence
  chemically synthesized
tctcatgagactttagatct

SEQ ID NO: 378513 - DNA, 20 bp, Artificial Sequence
  chemically synthesized
agacagactgcttagatcta

SEQ ID NO: 378514 - DNA, 20 bp, Artificial Sequence
  chemically synthesized
catgagactttagatctaag

SEQ ID NO: 378515 - DNA, 20 bp, Artificial Sequence
  chemically synthesized
agtgctaaagacagactgct

SEQ ID NO: 378516 - DNA, 20 bp, Artificial Sequence
  chemically synthesized
agatctaagcagtctgtctt

SEQ ID NO: 378517 - DNA, 20 bp, Artificial Sequence
  chemically synthesized
atcccggttagtgctaaaga

SEQ ID NO: 378518 - DNA, 20 bp, Artificial Sequence
  chemically synthesized
agtgatcccggttagtgcta

SEQ ID NO: 378519 - DNA, 20 bp, Artificial Sequence
  chemically synthesized
agtctgtctttagcactaac

SEQ ID NO: 378520 - DNA, 20 bp, Artificial Sequence
  chemically synthesized
gtctgtctttagcactaacc

SEQ ID NO: 378521 - DNA, 20 bp, Artificial Sequence
  chemically synthesized
tgcattgaagtgatcccggt

SEQ ID NO: 378522 - DNA, 20 bp, Artificial Sequence
  chemically synthesized
atgttgcattgaagtgatcc

SEQ ID NO: 378523 - DNA, 20 bp, Artificial Sequence
  chemically synthesized
tccatgaaaatgttgcattg

SEQ ID NO: 378524 - DNA, 20 bp, Artificial Sequence
  chemically synthesized
acttcaatgcaacattttca

SEQ ID NO: 378525 - DNA, 20 bp, Artificial Sequence
  chemically synthesized
tgcaacattttcatggaaca

SEQ ID NO: 378526 - DNA, 20 bp, Artificial Sequence
  chemically synthesized
attataatcttattgattga

SEQ ID NO: 378527 - DNA, 20 bp, Artificial Sequence
  chemically synthesized
agcatttgctgtcaatcaat

SEQ ID NO: 378528 - DNA, 20 bp, Artificial Sequence
  chemically synthesized
tacaaaataatgatgcctta

SEQ ID NO: 378529 - DNA, 20 bp, Artificial Sequence
  chemically synthesized
atttttagaatgggtctgta

SEQ ID NO: 378530 - DNA, 20 bp, Artificial Sequence
  chemically synthesized
tatttttagaatgggtctgt

SEQ ID NO: 378531 - DNA, 20 bp, Artificial Sequence
  chemically synthesized
tgtcaaagtatttttagaat

SEQ ID NO: 378532 - DNA, 20 bp, Artificial Sequence
  chemically synthesized
atgtcaaagtatttttagaa

SEQ ID NO: 378533 - DNA, 20 bp, Artificial Sequence
  chemically synthesized
ttcagatgtcaaagtatttt

SEQ ID NO: 378534 - DNA, 20 bp, Artificial Sequence
  chemically synthesized
tttcatagattcagatgtca

SEQ ID NO: 378535 - DNA, 20 bp, Artificial Sequence
  chemically synthesized
tttgagccctttcatagatt

SEQ ID NO: 378536 - DNA, 20 bp, Artificial Sequence
  chemically synthesized
tttgacatctgaatctatga

SEQ ID NO: 378537 - DNA, 20 bp, Artificial Sequence
  chemically synthesized
ttgacatctgaatctatgaa

SEQ ID NO: 378538 - DNA, 20 bp, Artificial Sequence
  chemically synthesized
tgacatctgaatctatgaaa

SEQ ID NO: 378539 - DNA, 20 bp, Artificial Sequence
  chemically synthesized
ttggtatttgagccctttca

SEQ ID NO: 378540 - DNA, 20 bp, Artificial Sequence
  chemically synthesized
gaagatcctttttggtattt

SEQ ID NO: 378541 - DNA, 20 bp, Artificial Sequence
  chemically synthesized
gaaagggctcaaataccaaa

SEQ ID NO: 378542 - DNA, 20 bp, Artificial Sequence
  chemically synthesized
aaagggctcaaataccaaaa

SEQ ID NO: 378543 - DNA, 20 bp, Artificial Sequence
  chemically synthesized
tgaatctggaagatcctttt

SEQ ID NO: 378544 - DNA, 20 bp, Artificial Sequence
  chemically synthesized
aaataccaaaaaggatcttc

SEQ ID NO: 378545 - DNA, 20 bp, Artificial Sequence
  chemically synthesized
ctttattcatgtgaatctgg

SEQ ID NO: 378546 - DNA, 20 bp, Artificial Sequence
  chemically synthesized
gaactttattcatgtgaatc

SEQ ID NO: 378547 - DNA, 20 bp, Artificial Sequence
  chemically synthesized
cttccagattcacatgaata

SEQ ID NO: 378548 - DNA, 20 bp, Artificial Sequence
  chemically synthesized
ttcacatgaataaagttcct

SEQ ID NO: 378549 - DNA, 20 bp, Artificial Sequence
  chemically synthesized
tcacatgaataaagttcctg

SEQ ID NO: 378550 - DNA, 20 bp, Artificial Sequence
  chemically synthesized
catgaataaagttcctgagg

SEQ ID NO: 378551 - DNA, 20 bp, Artificial Sequence
  chemically synthesized
tttaaaatatcaactacctc

SEQ ID NO: 378552 - DNA, 20 bp, Artificial Sequence
  chemically synthesized
ttttaaaatatcaactacct

SEQ ID NO: 378553 - DNA, 20 bp, Artificial Sequence
  chemically synthesized
ttcacataattggcatgaca

SEQ ID NO: 378554 - DNA, 20 bp, Artificial Sequence
  chemically synthesized
ccagcataggttcacataat

SEQ ID NO: 378555 - DNA, 20 bp, Artificial Sequence
  chemically synthesized
ccaattatgtgaacctatgc

SEQ ID NO: 378556 - DNA, 20 bp, Artificial Sequence
  chemically synthesized
aggtgtgatctaaccagcat

SEQ ID NO: 378557 - DNA, 20 bp, Artificial Sequence
  chemically synthesized
ttatgtgaacctatgctggt

SEQ ID NO: 378558 - DNA, 20 bp, Artificial Sequence
  chemically synthesized
caggtgtgatctaaccagca

SEQ ID NO: 378559 - DNA, 20 bp, Artificial Sequence
  chemically synthesized
attttcaggtgtgatctaac

SEQ ID NO: 378560 - DNA, 20 bp, Artificial Sequence
  chemically synthesized
ttagatcacacctgaaaatt

SEQ ID NO: 378561 - DNA, 20 bp, Artificial Sequence
  chemically synthesized
acaatacatcctaaattttc

SEQ ID NO: 378562 - DNA, 20 bp, Artificial Sequence
  chemically synthesized
tagatcacacctgaaaattt

SEQ ID NO: 378563 - DNA, 20 bp, Artificial Sequence
  chemically synthesized
gacaatacatcctaaatttt

SEQ ID NO: 378564 - DNA, 20 bp, Artificial Sequence
  chemically synthesized
aaatttaggatgtattgtca

SEQ ID NO: 378565 - DNA, 20 bp, Artificial Sequence
  chemically synthesized
ggtatgtgaactgactacaa

SEQ ID NO: 378566 - DNA, 20 bp, Artificial Sequence
  chemically synthesized
ctcctgataccttttgtagt

SEQ ID NO: 378567 - DNA, 20 bp, Artificial Sequence
  chemically synthesized
gtatgtgaactgactacaaa

SEQ ID NO: 378568 - DNA, 20 bp, Artificial Sequence
  chemically synthesized
caacctcctgataccttttg

SEQ ID NO: 378569 - DNA, 20 bp, Artificial Sequence
  chemically synthesized
gaactgactacaaaaggtat

SEQ ID NO: 378570 - DNA, 20 bp, Artificial Sequence
  chemically synthesized
aactgactacaaaaggtatc

SEQ ID NO: 378571 - DNA, 20 bp, Artificial Sequence
  chemically synthesized
ctgactacaaaaggtatcag

SEQ ID NO: 378572 - DNA, 20 bp, Artificial Sequence
  chemically synthesized
tgactacaaaaggtatcagg

SEQ ID NO: 378573 - DNA, 20 bp, Artificial Sequence
  chemically synthesized
gaggttgatatttgctacat

SEQ ID NO: 378574 - DNA, 20 bp, Artificial Sequence
  chemically synthesized
ggttgatatttgctacataa

SEQ ID NO: 378575 - DNA, 20 bp, Artificial Sequence
  chemically synthesized
gaacacatctttctcttatg

SEQ ID NO: 378576 - DNA, 20 bp, Artificial Sequence
  chemically synthesized
gatatttgctacataagaga

SEQ ID NO: 378577 - DNA, 20 bp, Artificial Sequence
  chemically synthesized
cataagagaaagatgtgttc

SEQ ID NO: 378578 - DNA, 20 bp, Artificial Sequence
  chemically synthesized
tagtgagatgcaaaggtgtg

SEQ ID NO: 378579 - DNA, 20 bp, Artificial Sequence
  chemically synthesized
ctagtgagatgcaaaggtgt

SEQ ID NO: 378580 - DNA, 20 bp, Artificial Sequence
  chemically synthesized
atttgcctagtgagatgcaa

SEQ ID NO: 378581 - DNA, 20 bp, Artificial Sequence
  chemically synthesized
catttgcctagtgagatgca

SEQ ID NO: 378582 - DNA, 20 bp, Artificial Sequence
  chemically synthesized
ctcacacctttgcatctcac

SEQ ID NO: 378583 - DNA, 20 bp, Artificial Sequence
  chemically synthesized
tcacacctttgcatctcact

SEQ ID NO: 378584 - DNA, 20 bp, Artificial Sequence
  chemically synthesized
aattaacccatttgcctagt

SEQ ID NO: 378585 - DNA, 20 bp, Artificial Sequence
  chemically synthesized
tttgcatctcactaggcaaa

SEQ ID NO: 378586 - DNA, 20 bp, Artificial Sequence
  chemically synthesized
ttgcatctcactaggcaaat

SEQ ID NO: 378587 - DNA, 20 bp, Artificial Sequence
  chemically synthesized
atgtaattaacccatttgcc

SEQ ID NO: 378588 - DNA, 20 bp, Artificial Sequence
  chemically synthesized
accaaatcgaaatatgattt

SEQ ID NO: 378589 - DNA, 20 bp, Artificial Sequence
  chemically synthesized
tctgaaatcatatttcgatt

SEQ ID NO: 378590 - DNA, 20 bp, Artificial Sequence
  chemically synthesized
tcatatttcgatttggttga

SEQ ID NO: 378591 - DNA, 20 bp, Artificial Sequence
  chemically synthesized
gatttggttgatagtctgat

SEQ ID NO: 378592 - DNA, 20 bp, Artificial Sequence
  chemically synthesized
gtcaccttaaattaacttat

SEQ ID NO: 378593 - DNA, 20 bp, Artificial Sequence
  chemically synthesized
atagtctgataagttaattt

SEQ ID NO: 378594 - DNA, 20 bp, Artificial Sequence
  chemically synthesized
tagtctgataagttaattta

SEQ ID NO: 378595 - DNA, 20 bp, Artificial Sequence
  chemically synthesized
aagttaatttaaggtgaccc

SEQ ID NO: 378596 - DNA, 20 bp, Artificial Sequence
  chemically synthesized
aaaacagttagatggtacca

SEQ ID NO: 378597 - DNA, 20 bp, Artificial Sequence
  chemically synthesized
caaaacagttagatggtacc

SEQ ID NO: 378598 - DNA, 20 bp, Artificial Sequence
  chemically synthesized
acaaaacagttagatggtac

SEQ ID NO: 378599 - DNA, 20 bp, Artificial Sequence
  chemically synthesized
ataaaaacaaaacagttaga

SEQ ID NO: 378600 - DNA, 20 bp, Artificial Sequence
  chemically synthesized
tggaataaaaacaaaacagt

SEQ ID NO: 378601 - DNA, 20 bp, Artificial Sequence
  chemically synthesized
tatttggaataaaaacaaaa

SEQ ID NO: 378602 - DNA, 20 bp, Artificial Sequence
  chemically synthesized
tgttttgtttttattccaaa

SEQ ID NO: 378603 - DNA, 20 bp, Artificial Sequence
  chemically synthesized
gttttgtttttattccaaat

SEQ ID NO: 378604 - DNA, 20 bp, Artificial Sequence
  chemically synthesized
gaaagggccaatatcctatt

SEQ ID NO: 378605 - DNA, 20 bp, Artificial Sequence
  chemically synthesized
ttttattccaaataggatat

SEQ ID NO: 378606 - DNA, 20 bp, Artificial Sequence
  chemically synthesized
tacataatcctttttagaaa

SEQ ID NO: 378607 - DNA, 20 bp, Artificial Sequence
  chemically synthesized
ggatattggccctttctaaa

SEQ ID NO: 378608 - DNA, 20 bp, Artificial Sequence
  chemically synthesized
ctacataatcctttttagaa

SEQ ID NO: 378609 - DNA, 20 bp, Artificial Sequence
  chemically synthesized
gatattggccctttctaaaa

SEQ ID NO: 378610 - DNA, 20 bp, Artificial Sequence
  chemically synthesized
actacataatcctttttaga

SEQ ID NO: 378611 - DNA, 20 bp, Artificial Sequence
  chemically synthesized
caagactacataatcctttt

SEQ ID NO: 378612 - DNA, 20 bp, Artificial Sequence
  chemically synthesized
cctttctaaaaaggattatg

SEQ ID NO: 378613 - DNA, 20 bp, Artificial Sequence
  chemically synthesized
ttttttttgctcatatagac

SEQ ID NO: 378614 - DNA, 20 bp, Artificial Sequence
  chemically synthesized
ttatgtagtcttgtctatat

SEQ ID NO: 378615 - DNA, 20 bp, Artificial Sequence
  chemically synthesized
tttttttttttttgctcata

SEQ ID NO: 378616 - DNA, 20 bp, Artificial Sequence
  chemically synthesized
aaaaaaaaaaaaaaaaaaaa

SEQ ID NO: 378617 - DNA, 20 bp, Artificial Sequence
  chemically synthesized
aaaaaaaaaaaaagtaacct

SEQ ID NO: 378618 - DNA, 20 bp, Artificial Sequence
  chemically synthesized
ttagtaccatagttatactc

SEQ ID NO: 378619 - DNA, 20 bp, Artificial Sequence
  chemically synthesized
cttagtaccatagttatact

SEQ ID NO: 378620 - DNA, 20 bp, Artificial Sequence
  chemically synthesized
aagtaacctgagtataacta

SEQ ID NO: 378621 - DNA, 20 bp, Artificial Sequence
  chemically synthesized
ctgagtataactatggtact

SEQ ID NO: 378622 - DNA, 20 bp, Artificial Sequence
  chemically synthesized
gattttctttcttagtacca

SEQ ID NO: 378623 - DNA, 20 bp, Artificial Sequence
  chemically synthesized
gtataactatggtactaaga

SEQ ID NO: 378624 - DNA, 20 bp, Artificial Sequence
  chemically synthesized
tgtatactgattttctttct

SEQ ID NO: 378625 - DNA, 20 bp, Artificial Sequence
  chemically synthesized
atggtactaagaaagaaaat

SEQ ID NO: 378626 - DNA, 20 bp, Artificial Sequence
  chemically synthesized
agaaagaaaatcagtataca

SEQ ID NO: 378627 - DNA, 20 bp, Artificial Sequence
  chemically synthesized
gaaagaaaatcagtatacac

SEQ ID NO: 378628 - DNA, 20 bp, Artificial Sequence
  chemically synthesized
agaaaatcagtatacacagg

SEQ ID NO: 378629 - DNA, 20 bp, Artificial Sequence
  chemically synthesized
gaaaatcagtatacacaggt

SEQ ID NO: 378630 - DNA, 20 bp, Artificial Sequence
  chemically synthesized
ggtaggatttatctgccata

SEQ ID NO: 378631 - DNA, 20 bp, Artificial Sequence
  chemically synthesized
cagtgaactattctttatgg

SEQ ID NO: 378632 - DNA, 20 bp, Artificial Sequence
  chemically synthesized
gatttatctgccataaagaa

SEQ ID NO: 378633 - DNA, 20 bp, Artificial Sequence
  chemically synthesized
tagcagtgaactattcttta

SEQ ID NO: 378634 - DNA, 20 bp, Artificial Sequence
  chemically synthesized
aaagaatagttcactgctat

SEQ ID NO: 378635 - DNA, 20 bp, Artificial Sequence
  chemically synthesized
cttgtaagaaattcttatag

SEQ ID NO: 378636 - DNA, 20 bp, Artificial Sequence
  chemically synthesized
tttcttgtaagaaattctta

SEQ ID NO: 378637 - DNA, 20 bp, Artificial Sequence
  chemically synthesized
ctgctataagaatttcttac

SEQ ID NO: 378638 - DNA, 20 bp, Artificial Sequence
  chemically synthesized
tatccagtagagtttcttgt

SEQ ID NO: 378639 - DNA, 20 bp, Artificial Sequence
  chemically synthesized
tttcttacaagaaactctac

SEQ ID NO: 378640 - DNA, 20 bp, Artificial Sequence
  chemically synthesized
agaaggttgattatccagta

SEQ ID NO: 378641 - DNA, 20 bp, Artificial Sequence
  chemically synthesized
ctagaaggttgattatccag

SEQ ID NO: 378642 - DNA, 20 bp, Artificial Sequence
  chemically synthesized
tgactagaaggttgattatc

SEQ ID NO: 378643 - DNA, 20 bp, Artificial Sequence
  chemically synthesized
ctactggataatcaaccttc

SEQ ID NO: 378644 - DNA, 20 bp, Artificial Sequence
  chemically synthesized
ttccctggagtttgactaga

SEQ ID NO: 378645 - DNA, 20 bp, Artificial Sequence
  chemically synthesized
attccctggagtttgactag

SEQ ID NO: 378646 - DNA, 20 bp, Artificial Sequence
  chemically synthesized
tgaattccctggagtttgac

SEQ ID NO: 378647 - DNA, 20 bp, Artificial Sequence
  chemically synthesized
tcaaccttctagtcaaactc

SEQ ID NO: 378648 - DNA, 20 bp, Artificial Sequence
  chemically synthesized
caaccttctagtcaaactcc

SEQ ID NO: 378649 - DNA, 20 bp, Artificial Sequence
  chemically synthesized
aaccttctagtcaaactcca

SEQ ID NO: 378650 - DNA, 20 bp, Artificial Sequence
  chemically synthesized
aaactacattgaattccctg

SEQ ID NO: 378651 - DNA, 20 bp, Artificial Sequence
  chemically synthesized
ttaaactacattgaattccc

SEQ ID NO: 378652 - DNA, 20 bp, Artificial Sequence
  chemically synthesized
aaactccagggaattcaatg

SEQ ID NO: 378653 - DNA, 20 bp, Artificial Sequence
  chemically synthesized
tgatttccctaatatgtatt

SEQ ID NO: 378654 - DNA, 20 bp, Artificial Sequence
  chemically synthesized
agtttaaactcaatacatat

SEQ ID NO: 378655 - DNA, 20 bp, Artificial Sequence
  chemically synthesized
gtttaaactcaatacatatt

SEQ ID NO: 378656 - DNA, 20 bp, Artificial Sequence
  chemically synthesized
tttaaactcaatacatatta

SEQ ID NO: 378657 - DNA, 20 bp, Artificial Sequence
  chemically synthesized
atcacaaaatgaatcatatg

SEQ ID NO: 378658 - DNA, 20 bp, Artificial Sequence
  chemically synthesized
aatcatatgtagtcattcta

SEQ ID NO: 378659 - DNA, 20 bp, Artificial Sequence
  chemically synthesized
tatgtagtcattctatggat

SEQ ID NO: 378660 - DNA, 20 bp, Artificial Sequence
  chemically synthesized
ctagattgtgaactcatcca

SEQ ID NO: 378661 - DNA, 20 bp, Artificial Sequence
  chemically synthesized
ctatggatgagttcacaatc

SEQ ID NO: 378662 - DNA, 20 bp, Artificial Sequence
  chemically synthesized
ggatgagttcacaatctaga

SEQ ID NO: 378663 - DNA, 20 bp, Artificial Sequence
  chemically synthesized
acccccacggaaatactatc

SEQ ID NO: 378664 - DNA, 20 bp, Artificial Sequence
  chemically synthesized
caatctagatagtatttccg

SEQ ID NO: 378665 - DNA, 20 bp, Artificial Sequence
  chemically synthesized
aatctagatagtatttccgt

SEQ ID NO: 378666 - DNA, 20 bp, Artificial Sequence
  chemically synthesized
atctagatagtatttccgtg

SEQ ID NO: 378667 - DNA, 20 bp, Artificial Sequence
  chemically synthesized
tctagatagtatttccgtgg

SEQ ID NO: 378668 - DNA, 20 bp, Artificial Sequence
  chemically synthesized
gatactcctcattaccccca

SEQ ID NO: 378669 - DNA, 20 bp, Artificial Sequence
  chemically synthesized
agtatttccgtgggggtaat

SEQ ID NO: 378670 - DNA, 20 bp, Artificial Sequence
  chemically synthesized
gtatttccgtgggggtaatg

SEQ ID NO: 378671 - DNA, 20 bp, Artificial Sequence
  chemically synthesized
atttccgtgggggtaatgag

SEQ ID NO: 378672 - DNA, 20 bp, Artificial Sequence
  chemically synthesized
tgaggagtatctcgccacgt

SEQ ID NO: 378673 - DNA, 20 bp, Artificial Sequence
  chemically synthesized
actcactcctctgacgtggc

SEQ ID NO: 378674 - DNA, 20 bp, Artificial Sequence
  chemically synthesized
aggagtatctcgccacgtca

SEQ ID NO: 378675 - DNA, 20 bp, Artificial Sequence
  chemically synthesized
ggagtatctcgccacgtcag

SEQ ID NO: 378676 - DNA, 20 bp, Artificial Sequence
  chemically synthesized
ggatactcactcctctgacg

SEQ ID NO: 378677 - DNA, 20 bp, Artificial Sequence
  chemically synthesized
agtatctcgccacgtcagag

SEQ ID NO: 378678 - DNA, 20 bp, Artificial Sequence
  chemically synthesized
tctcgccacgtcagaggagt

SEQ ID NO: 378679 - DNA, 20 bp, Artificial Sequence
  chemically synthesized
gttatacttaagaaggcaga

SEQ ID NO: 378680 - DNA, 20 bp, Artificial Sequence
  chemically synthesized
tgttatacttaagaaggcag

SEQ ID NO: 378681 - DNA, 20 bp, Artificial Sequence
  chemically synthesized
gagtatccttctgccttctt

SEQ ID NO: 378682 - DNA, 20 bp, Artificial Sequence
  chemically synthesized
atgtgttatacttaagaagg

SEQ ID NO: 378683 - DNA, 20 bp, Artificial Sequence
  chemically synthesized
tatatgtgttatacttaaga

SEQ ID NO: 378684 - DNA, 20 bp, Artificial Sequence
  chemically synthesized
ctatatgtgttatacttaag

SEQ ID NO: 378685 - DNA, 20 bp, Artificial Sequence
  chemically synthesized
taactatatgtgttatactt

SEQ ID NO: 378686 - DNA, 20 bp, Artificial Sequence
  chemically synthesized
cttcttaagtataacacata

SEQ ID NO: 378687 - DNA, 20 bp, Artificial Sequence
  chemically synthesized
gttaacataatattttcttg

SEQ ID NO: 378688 - DNA, 20 bp, Artificial Sequence
  chemically synthesized
ataatattttcttgaagtaa

SEQ ID NO: 378689 - DNA, 20 bp, Artificial Sequence
  chemically synthesized
tgactctctactgttacttc

SEQ ID NO: 378690 - DNA, 20 bp, Artificial Sequence
  chemically synthesized
atattttcttgaagtaacag

SEQ ID NO: 378691 - DNA, 20 bp, Artificial Sequence
  chemically synthesized
attttcttgaagtaacagta

SEQ ID NO: 378692 - DNA, 20 bp, Artificial Sequence
  chemically synthesized
tttcttgaagtaacagtaga

SEQ ID NO: 378693 - DNA, 20 bp, Artificial Sequence
  chemically synthesized
tgaagtaacagtagagagtc

SEQ ID NO: 378694 - DNA, 20 bp, Artificial Sequence
  chemically synthesized
cagtagagagtcaagccttg

SEQ ID NO: 378695 - DNA, 20 bp, Artificial Sequence
  chemically synthesized
agtagagagtcaagccttgt

SEQ ID NO: 378696 - DNA, 20 bp, Artificial Sequence
  chemically synthesized
tagagagtcaagccttgtag

SEQ ID NO: 378697 - DNA, 20 bp, Artificial Sequence
  chemically synthesized
aaaatatctgttctcctaca

SEQ ID NO: 378698 - DNA, 20 bp, Artificial Sequence
  chemically synthesized
gaaaatatctgttctcctac

SEQ ID NO: 378699 - DNA, 20 bp, Artificial Sequence
  chemically synthesized
agtcaagccttgtaggagaa

SEQ ID NO: 378700 - DNA, 20 bp, Artificial Sequence
  chemically synthesized
gagaacagatattttctacc

SEQ ID NO: 378701 - DNA, 20 bp, Artificial Sequence
  chemically synthesized
cagactaagctgagacttgg

SEQ ID NO: 378702 - DNA, 20 bp, Artificial Sequence
  chemically synthesized
agatattttctaccaagtct

SEQ ID NO: 378703 - DNA, 20 bp, Artificial Sequence
  chemically synthesized
taacagactaagctgagact

SEQ ID NO: 378704 - DNA, 20 bp, Artificial Sequence
  chemically synthesized
ttttctaccaagtctcagct

SEQ ID NO: 378705 - DNA, 20 bp, Artificial Sequence
  chemically synthesized
actgagtaacagactaagct

SEQ ID NO: 378706 - DNA, 20 bp, Artificial Sequence
  chemically synthesized
agaaaactgagtaacagact

SEQ ID NO: 378707 - DNA, 20 bp, Artificial Sequence
  chemically synthesized
tctcagcttagtctgttact

SEQ ID NO: 378708 - DNA, 20 bp, Artificial Sequence
  chemically synthesized
atggcaagaaaactgagtaa

SEQ ID NO: 378709 - DNA, 20 bp, Artificial Sequence
  chemically synthesized
agtactatggcaagaaaact

SEQ ID NO: 378710 - DNA, 20 bp, Artificial Sequence
  chemically synthesized
gttactcagttttcttgcca

SEQ ID NO: 378711 - DNA, 20 bp, Artificial Sequence
  chemically synthesized
atgttgcagagtactatggc

SEQ ID NO: 378712 - DNA, 20 bp, Artificial Sequence
  chemically synthesized
cagcatgttgcagagtacta

SEQ ID NO: 378713 - DNA, 20 bp, Artificial Sequence
  chemically synthesized
cgtggattcagcatgttgca

SEQ ID NO: 378714 - DNA, 20 bp, Artificial Sequence
  chemically synthesized
accgtggattcagcatgttg

SEQ ID NO: 378715 - DNA, 20 bp, Artificial Sequence
  chemically synthesized
tctgcaacatgctgaatcca

SEQ ID NO: 378716 - DNA, 20 bp, Artificial Sequence
  chemically synthesized
ttctacaaaaaccgtggatt

SEQ ID NO: 378717 - DNA, 20 bp, Artificial Sequence
  chemically synthesized
acgcatttctacaaaaaccg

SEQ ID NO: 378718 - DNA, 20 bp, Artificial Sequence
  chemically synthesized
tgctgaatccacggtttttg

SEQ ID NO: 378719 - DNA, 20 bp, Artificial Sequence
  chemically synthesized
cattcatggcataaattttg

SEQ ID NO: 378720 - DNA, 20 bp, Artificial Sequence
  chemically synthesized
ctgcttttttgttgcattca

SEQ ID NO: 378721 - DNA, 20 bp, Artificial Sequence
  chemically synthesized
atgccatgaatgcaacaaaa

SEQ ID NO: 378722 - DNA, 20 bp, Artificial Sequence
  chemically synthesized
ccatgaatgcaacaaaaaag

SEQ ID NO: 378723 - DNA, 20 bp, Artificial Sequence
  chemically synthesized
aaaaaagcagtacacacatc

SEQ ID NO: 378724 - DNA, 20 bp, Artificial Sequence
  chemically synthesized
aagcagtacacacatccagt

SEQ ID NO: 378725 - DNA, 20 bp, Artificial Sequence
  chemically synthesized
gattgaattcaatttcttac

SEQ ID NO: 378726 - DNA, 20 bp, Artificial Sequence
  chemically synthesized
agtaagaaattgaattcaat

SEQ ID NO: 378727 - DNA, 20 bp, Artificial Sequence
  chemically synthesized
aagaaattgaattcaatcag

SEQ ID NO: 378728 - DNA, 20 bp, Artificial Sequence
  chemically synthesized
attgaattcaatcagtagat

SEQ ID NO: 378729 - DNA, 20 bp, Artificial Sequence
  chemically synthesized
attcaatcagtagataagct

SEQ ID NO: 378730 - DNA, 20 bp, Artificial Sequence
  chemically synthesized
tgagtttcaaatatttggcc

SEQ ID NO: 378731 - DNA, 20 bp, Artificial Sequence
  chemically synthesized
gtttttgagtttcaaatatt

SEQ ID NO: 378732 - DNA, 20 bp, Artificial Sequence
  chemically synthesized
caattaatgatttagttttt

SEQ ID NO: 378733 - DNA, 20 bp, Artificial Sequence
  chemically synthesized
cttttgcacaattaatgatt

SEQ ID NO: 378734 - DNA, 20 bp, Artificial Sequence
  chemically synthesized
ctaaatcattaattgtgcaa

SEQ ID NO: 378735 - DNA, 20 bp, Artificial Sequence
  chemically synthesized
tcattaattgtgcaaaagta

SEQ ID NO: 378736 - DNA, 20 bp, Artificial Sequence
  chemically synthesized
attgtgcaaaagtaaagaaa

SEQ ID NO: 378737 - DNA, 20 bp, Artificial Sequence
  chemically synthesized
gtgcaaaagtaaagaaaaag

SEQ ID NO: 378738 - DNA, 20 bp, Artificial Sequence
  chemically synthesized
tgcaaaagtaaagaaaaagt

SEQ ID NO: 378739 - DNA, 20 bp, Artificial Sequence
  chemically synthesized
taaaaatagtaagaatgttt

SEQ ID NO: 378740 - DNA, 20 bp, Artificial Sequence
  chemically synthesized
ctttcttagttaaaaatagt

SEQ ID NO: 378741 - DNA, 20 bp, Artificial Sequence
  chemically synthesized
tatgctttcttagttaaaaa

SEQ ID NO: 378742 - DNA, 20 bp, Artificial Sequence
  chemically synthesized
cattcttactatttttaact

SEQ ID NO: 378743 - DNA, 20 bp, Artificial Sequence
  chemically synthesized
cttactatttttaactaaga

SEQ ID NO: 378744 - DNA, 20 bp, Artificial Sequence
  chemically synthesized
atcagtaaaatatgctttct

SEQ ID NO: 378745 - DNA, 20 bp, Artificial Sequence
  chemically synthesized
aacaaaaggcttgcagacat

SEQ ID NO: 378746 - DNA, 20 bp, Artificial Sequence
  chemically synthesized
catattttactgatgtctgc

SEQ ID NO: 378747 - DNA, 20 bp, Artificial Sequence
  chemically synthesized
agtgaagaacaaaaggcttg

SEQ ID NO: 378748 - DNA, 20 bp, Artificial Sequence
  chemically synthesized
ttgaaagagtgaagaacaaa

SEQ ID NO: 378749 - DNA, 20 bp, Artificial Sequence
  chemically synthesized
attgaaagagtgaagaacaa

SEQ ID NO: 378750 - DNA, 20 bp, Artificial Sequence
  chemically synthesized
attagagaattgaaagagtg

SEQ ID NO: 378751 - DNA, 20 bp, Artificial Sequence
  chemically synthesized
gcaggattagagaattgaaa

SEQ ID NO: 378752 - DNA, 20 bp, Artificial Sequence
  chemically synthesized
tggcaggattagagaattga

SEQ ID NO: 378753 - DNA, 20 bp, Artificial Sequence
  chemically synthesized
tggggtggatggcaggatta

SEQ ID NO: 378754 - DNA, 20 bp, Artificial Sequence
  chemically synthesized
tatggggtggatggcaggat

SEQ ID NO: 378755 - DNA, 20 bp, Artificial Sequence
  chemically synthesized
aaagatatggggtggatggc

SEQ ID NO: 378756 - DNA, 20 bp, Artificial Sequence
  chemically synthesized
gaaagatatggggtggatgg

SEQ ID NO: 378757 - DNA, 20 bp, Artificial Sequence
  chemically synthesized
aaagaaagatatggggtgga

SEQ ID NO: 378758 - DNA, 20 bp, Artificial Sequence
  chemically synthesized
aatgaaagaaagatatgggg

SEQ ID NO: 378759 - DNA, 20 bp, Artificial Sequence
  chemically synthesized
ccaaatgaaagaaagatatg

SEQ ID NO: 378760 - DNA, 20 bp, Artificial Sequence
  chemically synthesized
tccaaatgaaagaaagatat

SEQ ID NO: 378761 - DNA, 20 bp, Artificial Sequence
  chemically synthesized
ttccaaatgaaagaaagata

SEQ ID NO: 378762 - DNA, 20 bp, Artificial Sequence
  chemically synthesized
ccaaaattccaaatgaaaga

SEQ ID NO: 378763 - DNA, 20 bp, Artificial Sequence
  chemically synthesized
ccccatatctttctttcatt

SEQ ID NO: 378764 - DNA, 20 bp, Artificial Sequence
  chemically synthesized
taaaccaaaattccaaatga

SEQ ID NO: 378765 - DNA, 20 bp, Artificial Sequence
  chemically synthesized
ctttctttcatttggaattt

SEQ ID NO: 378766 - DNA, 20 bp, Artificial Sequence
  chemically synthesized
gaattttggtttacaacact

SEQ ID NO: 378767 - DNA, 20 bp, Artificial Sequence
  chemically synthesized
tggtttacaacactcagttg

SEQ ID NO: 378768 - DNA, 20 bp, Artificial Sequence
  chemically synthesized
atatgcctgagtctacaact

SEQ ID NO: 378769 - DNA, 20 bp, Artificial Sequence
  chemically synthesized
acaacactcagttgtagact

SEQ ID NO: 378770 - DNA, 20 bp, Artificial Sequence
  chemically synthesized
caacactcagttgtagactc

SEQ ID NO: 378771 - DNA, 20 bp, Artificial Sequence
  chemically synthesized
aaaacacaagttatatgcct

SEQ ID NO: 378772 - DNA, 20 bp, Artificial Sequence
  chemically synthesized
caggcatataacttgtgttt

SEQ ID NO: 378773 - DNA, 20 bp, Artificial Sequence
  chemically synthesized
aaggaataagactaaaacac

SEQ ID NO: 378774 - DNA, 20 bp, Artificial Sequence
  chemically synthesized
ttgtctttgtgcaaaggaat

SEQ ID NO: 378775 - DNA, 20 bp, Artificial Sequence
  chemically synthesized
tagtcttattcctttgcaca

SEQ ID NO: 378776 - DNA, 20 bp, Artificial Sequence
  chemically synthesized
tgtattttgtctttgtgcaa

SEQ ID NO: 378777 - DNA, 20 bp, Artificial Sequence
  chemically synthesized
atgtattttgtctttgtgca

SEQ ID NO: 378778 - DNA, 20 bp, Artificial Sequence
  chemically synthesized
ttgcacaaagacaaaataca

SEQ ID NO: 378779 - DNA, 20 bp, Artificial Sequence
  chemically synthesized
acaaagacaaaatacataga

SEQ ID NO: 378780 - DNA, 20 bp, Artificial Sequence
  chemically synthesized
caaagacaaaatacatagac

SEQ ID NO: 378781 - DNA, 20 bp, Artificial Sequence
  chemically synthesized
catagacaggacacattgat

SEQ ID NO: 378782 - DNA, 20 bp, Artificial Sequence
  chemically synthesized
ggacacattgatcagaaaac

SEQ ID NO: 378783 - DNA, 20 bp, Artificial Sequence
  chemically synthesized
ttttagaaatagattatttc

SEQ ID NO: 378784 - DNA, 20 bp, Artificial Sequence
  chemically synthesized
gggattagaaattttagaaa

SEQ ID NO: 378785 - DNA, 20 bp, Artificial Sequence
  chemically synthesized
atgtcagggattagaaattt

SEQ ID NO: 378786 - DNA, 20 bp, Artificial Sequence
  chemically synthesized
gatacatttatgtcagggat

SEQ ID NO: 378787 - DNA, 20 bp, Artificial Sequence
  chemically synthesized
attttgatacatttatgtca

SEQ ID NO: 378788 - DNA, 20 bp, Artificial Sequence
  chemically synthesized
gattttgatacatttatgtc

SEQ ID NO: 378789 - DNA, 20 bp, Artificial Sequence
  chemically synthesized
tgattttgatacatttatgt

SEQ ID NO: 378790 - DNA, 20 bp, Artificial Sequence
  chemically synthesized
aaaatcacacaataatttaa

SEQ ID NO: 378791 - DNA, 20 bp, Artificial Sequence
  chemically synthesized
acacaataatttaatagaat

SEQ ID NO: 378792 - DNA, 20 bp, Artificial Sequence
  chemically synthesized
gaattgcacacacacacacg

SEQ ID NO: 378793 - DNA, 20 bp, Artificial Sequence
  chemically synthesized
cacgcggcacaataaaaccc

SEQ ID NO: 378794 - DNA, 20 bp, Artificial Sequence
  chemically synthesized
acgcggcacaataaaaccca

SEQ ID NO: 378795 - DNA, 20 bp, Artificial Sequence
  chemically synthesized
gttgtgctttggtttacctt

SEQ ID NO: 378796 - DNA, 20 bp, Artificial Sequence
  chemically synthesized
tgttgtgctttggtttacct

SEQ ID NO: 378797 - DNA, 20 bp, Artificial Sequence
  chemically synthesized
ataaaacccaaggtaaacca

SEQ ID NO: 378798 - DNA, 20 bp, Artificial Sequence
  chemically synthesized
gaaggacatttgttgtgctt

SEQ ID NO: 378799 - DNA, 20 bp, Artificial Sequence
  chemically synthesized
ggaaaacctttttgttcaga

SEQ ID NO: 378800 - DNA, 20 bp, Artificial Sequence
  chemically synthesized
tggaaaacctttttgttcag

SEQ ID NO: 378801 - DNA, 20 bp, Artificial Sequence
  chemically synthesized
caaatgtccttctgaacaaa

SEQ ID NO: 378802 - DNA, 20 bp, Artificial Sequence
  chemically synthesized
aaatgtccttctgaacaaaa

SEQ ID NO: 378803 - DNA, 20 bp, Artificial Sequence
  chemically synthesized
gtctggaaaacctttttgtt

SEQ ID NO: 378804 - DNA, 20 bp, Artificial Sequence
  chemically synthesized
ttctgaacaaaaaggttttc

SEQ ID NO: 378805 - DNA, 20 bp, Artificial Sequence
  chemically synthesized
gaacaaaaaggttttccaga

SEQ ID NO: 378806 - DNA, 20 bp, Artificial Sequence
  chemically synthesized
aaaaggttttccagacagct

SEQ ID NO: 378807 - DNA, 20 bp, Artificial Sequence
  chemically synthesized
aggagtagctctcagctgtc

SEQ ID NO: 378808 - DNA, 20 bp, Artificial Sequence
  chemically synthesized
aaggttttccagacagctga

SEQ ID NO: 378809 - DNA, 20 bp, Artificial Sequence
  chemically synthesized
tcatccaaaggagtagctct

SEQ ID NO: 378810 - DNA, 20 bp, Artificial Sequence
  chemically synthesized
acagctgagagctactcctt

SEQ ID NO: 378811 - DNA, 20 bp, Artificial Sequence
  chemically synthesized
tgttctgtcatccaaaggag

SEQ ID NO: 378812 - DNA, 20 bp, Artificial Sequence
  chemically synthesized
aggtgttctgtcatccaaag

SEQ ID NO: 378813 - DNA, 20 bp, Artificial Sequence
  chemically synthesized
tgaggtgttctgtcatccaa

SEQ ID NO: 378814 - DNA, 20 bp, Artificial Sequence
  chemically synthesized
agagctactcctttggatga

SEQ ID NO: 378815 - DNA, 20 bp, Artificial Sequence
  chemically synthesized
ttgaggtgttctgtcatcca

SEQ ID NO: 378816 - DNA, 20 bp, Artificial Sequence
  chemically synthesized
tgacagaacacctcaacttc

SEQ ID NO: 378817 - DNA, 20 bp, Artificial Sequence
  chemically synthesized
aacctttcatccagaagttg

SEQ ID NO: 378818 - DNA, 20 bp, Artificial Sequence
  chemically synthesized
aaacctttcatccagaagtt

SEQ ID NO: 378819 - DNA, 20 bp, Artificial Sequence
  chemically synthesized
catgtaaacctttcatccag

SEQ ID NO: 378820 - DNA, 20 bp, Artificial Sequence
  chemically synthesized
acacctcaacttctggatga

SEQ ID NO: 378821 - DNA, 20 bp, Artificial Sequence
  chemically synthesized
cacctcaacttctggatgaa

SEQ ID NO: 378822 - DNA, 20 bp, Artificial Sequence
  chemically synthesized
tttcatgtaaacctttcatc

SEQ ID NO: 378823 - DNA, 20 bp, Artificial Sequence
  chemically synthesized
tttacatgaaaatgattatg

SEQ ID NO: 378824 - DNA, 20 bp, Artificial Sequence
  chemically synthesized
ttacatgaaaatgattatgt

SEQ ID NO: 378825 - DNA, 20 bp, Artificial Sequence
  chemically synthesized
atgaaaatgattatgtagga

SEQ ID NO: 378826 - DNA, 20 bp, Artificial Sequence
  chemically synthesized
catacataagaagggaaaga

SEQ ID NO: 378827 - DNA, 20 bp, Artificial Sequence
  chemically synthesized
accatacataagaagggaaa

SEQ ID NO: 378828 - DNA, 20 bp, Artificial Sequence
  chemically synthesized
ataccatacataagaaggga

SEQ ID NO: 378829 - DNA, 20 bp, Artificial Sequence
  chemically synthesized
agacataccatacataagaa

SEQ ID NO: 378830 - DNA, 20 bp, Artificial Sequence
  chemically synthesized
tagacataccatacataaga

SEQ ID NO: 378831 - DNA, 20 bp, Artificial Sequence
  chemically synthesized
ttagacataccatacataag

SEQ ID NO: 378832 - DNA, 20 bp, Artificial Sequence
  chemically synthesized
tctctttcccttcttatgta

SEQ ID NO: 378833 - DNA, 20 bp, Artificial Sequence
  chemically synthesized
atgttagacataccatacat

SEQ ID NO: 378834 - DNA, 20 bp, Artificial Sequence
  chemically synthesized
tcatcaagaaaatattatgt

SEQ ID NO: 378835 - DNA, 20 bp, Artificial Sequence
  chemically synthesized
ataatattttcttgatgatt

SEQ ID NO: 378836 - DNA, 20 bp, Artificial Sequence
  chemically synthesized
aattctaaccctaaatcatc

SEQ ID NO: 378837 - DNA, 20 bp, Artificial Sequence
  chemically synthesized
taatattttcttgatgattt

SEQ ID NO: 378838 - DNA, 20 bp, Artificial Sequence
  chemically synthesized
aatattttcttgatgattta

SEQ ID NO: 378839 - DNA, 20 bp, Artificial Sequence
  chemically synthesized
ttttcttgatgatttagggt

SEQ ID NO: 378840 - DNA, 20 bp, Artificial Sequence
  chemically synthesized
agggttagaattatgatgtg

SEQ ID NO: 378841 - DNA, 20 bp, Artificial Sequence
  chemically synthesized
atgatgtgaagatatgactg

SEQ ID NO: 378842 - DNA, 20 bp, Artificial Sequence
  chemically synthesized
atgtgaagatatgactgtgg

SEQ ID NO: 378843 - DNA, 20 bp, Artificial Sequence
  chemically synthesized
tgtgaagatatgactgtgga

SEQ ID NO: 378844 - DNA, 20 bp, Artificial Sequence
  chemically synthesized
acctgggatcaatccttcca

SEQ ID NO: 378845 - DNA, 20 bp, Artificial Sequence
  chemically synthesized
gactgtggaaggattgatcc

SEQ ID NO: 378846 - DNA, 20 bp, Artificial Sequence
  chemically synthesized
actgtggaaggattgatccc

SEQ ID NO: 378847 - DNA, 20 bp, Artificial Sequence
  chemically synthesized
gtgaacatccacatgtacct

SEQ ID NO: 378848 - DNA, 20 bp, Artificial Sequence
  chemically synthesized
ggtgaacatccacatgtacc

SEQ ID NO: 378849 - DNA, 20 bp, Artificial Sequence
  chemically synthesized
ggattgatcccaggtacatg

SEQ ID NO: 378850 - DNA, 20 bp, Artificial Sequence
  chemically synthesized
tacatgtggatgttcacccc

SEQ ID NO: 378851 - DNA, 20 bp, Artificial Sequence
  chemically synthesized
aaaaagaaattgcattctag

SEQ ID NO: 378852 - DNA, 20 bp, Artificial Sequence
  chemically synthesized
gaaaaagaaattgcattcta

SEQ ID NO: 378853 - DNA, 20 bp, Artificial Sequence
  chemically synthesized
agaaaaagaaattgcattct

SEQ ID NO: 378854 - DNA, 20 bp, Artificial Sequence
  chemically synthesized
aagaaaaagaaattgcattc

SEQ ID NO: 378855 - DNA, 20 bp, Artificial Sequence
  chemically synthesized
tctaaaaaaaataaaagaaa

SEQ ID NO: 378856 - DNA, 20 bp, Artificial Sequence
  chemically synthesized
actctatctaaaaaaaataa

SEQ ID NO: 378857 - DNA, 20 bp, Artificial Sequence
  chemically synthesized
tctttttcttttattttttt

SEQ ID NO: 378858 - DNA, 20 bp, Artificial Sequence
  chemically synthesized
tttcttttattttttttaga

SEQ ID NO: 378859 - DNA, 20 bp, Artificial Sequence
  chemically synthesized
tcttttattttttttagata

SEQ ID NO: 378860 - DNA, 20 bp, Artificial Sequence
  chemically synthesized
tccagcccgggtgacagtgt

SEQ ID NO: 378861 - DNA, 20 bp, Artificial Sequence
  chemically synthesized
tagagtctcacactgtcacc

SEQ ID NO: 378862 - DNA, 20 bp, Artificial Sequence
  chemically synthesized
agagtctcacactgtcaccc

SEQ ID NO: 378863 - DNA, 20 bp, Artificial Sequence
  chemically synthesized
ttgcactccagcccgggtga

SEQ ID NO: 378864 - DNA, 20 bp, Artificial Sequence
  chemically synthesized
tctcacactgtcacccgggc

SEQ ID NO: 378865 - DNA, 20 bp, Artificial Sequence
  chemically synthesized
tcacactgtcacccgggctg

SEQ ID NO: 378866 - DNA, 20 bp, Artificial Sequence
  chemically synthesized
acaccattgcactccagccc

SEQ ID NO: 378867 - DNA, 20 bp, Artificial Sequence
  chemically synthesized
cacaccattgcactccagcc

SEQ ID NO: 378868 - DNA, 20 bp, Artificial Sequence
  chemically synthesized
cagatcacaccattgcactc

SEQ ID NO: 378869 - DNA, 20 bp, Artificial Sequence
  chemically synthesized
tcacccgggctggagtgcaa

SEQ ID NO: 378870 - DNA, 20 bp, Artificial Sequence
  chemically synthesized
tggagtgcaatggtgtgatc

SEQ ID NO: 378871 - DNA, 20 bp, Artificial Sequence
  chemically synthesized
ggagtgcaatggtgtgatct

SEQ ID NO: 378872 - DNA, 20 bp, Artificial Sequence
  chemically synthesized
ggcggaggttgcagtgagcc

SEQ ID NO: 378873 - DNA, 20 bp, Artificial Sequence
  chemically synthesized
tgggaggcggaggttgcagt

SEQ ID NO: 378874 - DNA, 20 bp, Artificial Sequence
  chemically synthesized
gaattgggaggcggaggttg

SEQ ID NO: 378875 - DNA, 20 bp, Artificial Sequence
  chemically synthesized
gcaggagaattgggaggcgg

SEQ ID NO: 378876 - DNA, 20 bp, Artificial Sequence
  chemically synthesized
ggcaggagaattgggaggcg

SEQ ID NO: 378877 - DNA, 20 bp, Artificial Sequence
  chemically synthesized
ttggcaggagaattgggagg

SEQ ID NO: 378878 - DNA, 20 bp, Artificial Sequence
  chemically synthesized
cgcttggcaggagaattggg

SEQ ID NO: 378879 - DNA, 20 bp, Artificial Sequence
  chemically synthesized
tcgcttggcaggagaattgg

SEQ ID NO: 378880 - DNA, 20 bp, Artificial Sequence
  chemically synthesized
aatcgcttggcaggagaatt

SEQ ID NO: 378881 - DNA, 20 bp, Artificial Sequence
  chemically synthesized
gaatcgcttggcaggagaat

SEQ ID NO: 378882 - DNA, 20 bp, Artificial Sequence
  chemically synthesized
cgcctcccaattctcctgcc

SEQ ID NO: 378883 - DNA, 20 bp, Artificial Sequence
  chemically synthesized
gcaggagaatcgcttggcag

SEQ ID NO: 378884 - DNA, 20 bp, Artificial Sequence
  chemically synthesized
aggcaggagaatcgcttggc

SEQ ID NO: 378885 - DNA, 20 bp, Artificial Sequence
  chemically synthesized
gaggcaggagaatcgcttgg

SEQ ID NO: 378886 - DNA, 20 bp, Artificial Sequence
  chemically synthesized
gctgaggcaggagaatcgct

SEQ ID NO: 378887 - DNA, 20 bp, Artificial Sequence
  chemically synthesized
gccaagcgattctcctgcct

SEQ ID NO: 378888 - DNA, 20 bp, Artificial Sequence
  chemically synthesized
tactcaggaggctgaggcag

SEQ ID NO: 378889 - DNA, 20 bp, Artificial Sequence
  chemically synthesized
gctactcaggaggctgaggc

SEQ ID NO: 378890 - DNA, 20 bp, Artificial Sequence
  chemically synthesized
agctactcaggaggctgagg

SEQ ID NO: 378891 - DNA, 20 bp, Artificial Sequence
  chemically synthesized
cccagctactcaggaggctg

SEQ ID NO: 378892 - DNA, 20 bp, Artificial Sequence
  chemically synthesized
tcccagctactcaggaggct

SEQ ID NO: 378893 - DNA, 20 bp, Artificial Sequence
  chemically synthesized
ttctcctgcctcagcctcct

SEQ ID NO: 378894 - DNA, 20 bp, Artificial Sequence
  chemically synthesized
tcctgcctcagcctcctgag

SEQ ID NO: 378895 - DNA, 20 bp, Artificial Sequence
  chemically synthesized
tggaatcccagctactcagg

SEQ ID NO: 378896 - DNA, 20 bp, Artificial Sequence
  chemically synthesized
ctggaatcccagctactcag

SEQ ID NO: 378897 - DNA, 20 bp, Artificial Sequence
  chemically synthesized
gcctcagcctcctgagtagc

SEQ ID NO: 378898 - DNA, 20 bp, Artificial Sequence
  chemically synthesized
acctggaatcccagctactc

SEQ ID NO: 378899 - DNA, 20 bp, Artificial Sequence
  chemically synthesized
cctcagcctcctgagtagct

SEQ ID NO: 378900 - DNA, 20 bp, Artificial Sequence
  chemically synthesized
cacctggaatcccagctact

SEQ ID NO: 378901 - DNA, 20 bp, Artificial Sequence
  chemically synthesized
ctcctgagtagctgggattc

SEQ ID NO: 378902 - DNA, 20 bp, Artificial Sequence
  chemically synthesized
tcctgagtagctgggattcc

SEQ ID NO: 378903 - DNA, 20 bp, Artificial Sequence
  chemically synthesized
gcggcgggcacctggaatcc

SEQ ID NO: 378904 - DNA, 20 bp, Artificial Sequence
  chemically synthesized
caggcatggcggcgggcacc

SEQ ID NO: 378905 - DNA, 20 bp, Artificial Sequence
  chemically synthesized
aattagccaggcatggcggc

SEQ ID NO: 378906 - DNA, 20 bp, Artificial Sequence
  chemically synthesized
aaattagccaggcatggcgg

SEQ ID NO: 378907 - DNA, 20 bp, Artificial Sequence
  chemically synthesized
caggtgcccgccgccatgcc

SEQ ID NO: 378908 - DNA, 20 bp, Artificial Sequence
  chemically synthesized
gaaaaattagccaggcatgg

SEQ ID NO: 378909 - DNA, 20 bp, Artificial Sequence
  chemically synthesized
acagaaaaattagccaggca

SEQ ID NO: 378910 - DNA, 20 bp, Artificial Sequence
  chemically synthesized
cacacacagaaaaattagcc

SEQ ID NO: 378911 - DNA, 20 bp, Artificial Sequence
  chemically synthesized
gcacacacagaaaaattagc

SEQ ID NO: 378912 - DNA, 20 bp, Artificial Sequence
  chemically synthesized
aaatgcacacacagaaaaat

SEQ ID NO: 378913 - DNA, 20 bp, Artificial Sequence
  chemically synthesized
ctctactaaaaatgcacaca

SEQ ID NO: 378914 - DNA, 20 bp, Artificial Sequence
  chemically synthesized
tttttctgtgtgtgcatttt

SEQ ID NO: 378915 - DNA, 20 bp, Artificial Sequence
  chemically synthesized
ttctgtgtgtgcatttttag

SEQ ID NO: 378916 - DNA, 20 bp, Artificial Sequence
  chemically synthesized
ctgtgtgtgcatttttagta

SEQ ID NO: 378917 - DNA, 20 bp, Artificial Sequence
  chemically synthesized
gtgtgcatttttagtagaga

SEQ ID NO: 378918 - DNA, 20 bp, Artificial Sequence
  chemically synthesized
tgtgcatttttagtagagac

SEQ ID NO: 378919 - DNA, 20 bp, Artificial Sequence
  chemically synthesized
gtgcatttttagtagagacg

SEQ ID NO: 378920 - DNA, 20 bp, Artificial Sequence
  chemically synthesized
gagacggggtttcactatgt

SEQ ID NO: 378921 - DNA, 20 bp, Artificial Sequence
  chemically synthesized
cggggtttcactatgttggc

SEQ ID NO: 378922 - DNA, 20 bp, Artificial Sequence
  chemically synthesized
cgagaccagcctggccaaca

SEQ ID NO: 378923 - DNA, 20 bp, Artificial Sequence
  chemically synthesized
ggggtttcactatgttggcc

SEQ ID NO: 378924 - DNA, 20 bp, Artificial Sequence
  chemically synthesized
tttcactatgttggccaggc

SEQ ID NO: 378925 - DNA, 20 bp, Artificial Sequence
  chemically synthesized
tcaggatttcgagaccagcc

SEQ ID NO: 378926 - DNA, 20 bp, Artificial Sequence
  chemically synthesized
cgaggtcaggatttcgagac

SEQ ID NO: 378927 - DNA, 20 bp, Artificial Sequence
  chemically synthesized
gatcacgaggtcaggatttc

SEQ ID NO: 378928 - DNA, 20 bp, Artificial Sequence
  chemically synthesized
ggcaggcggatcacgaggtc

SEQ ID NO: 378929 - DNA, 20 bp, Artificial Sequence
  chemically synthesized
aggcaggcggatcacgaggt

SEQ ID NO: 378930 - DNA, 20 bp, Artificial Sequence
  chemically synthesized
gccgaggcaggcggatcacg

SEQ ID NO: 378931 - DNA, 20 bp, Artificial Sequence
  chemically synthesized
ggccgaggcaggcggatcac

SEQ ID NO: 378932 - DNA, 20 bp, Artificial Sequence
  chemically synthesized
acctcgtgatccgcctgcct

SEQ ID NO: 378933 - DNA, 20 bp, Artificial Sequence
  chemically synthesized
ctttggggggccgaggcagg

SEQ ID NO: 378934 - DNA, 20 bp, Artificial Sequence
  chemically synthesized
gcactttggggggccgaggc

SEQ ID NO: 378935 - DNA, 20 bp, Artificial Sequence
  chemically synthesized
agcactttggggggccgagg

SEQ ID NO: 378936 - DNA, 20 bp, Artificial Sequence
  chemically synthesized
cccagcactttggggggccg

SEQ ID NO: 378937 - DNA, 20 bp, Artificial Sequence
  chemically synthesized
tcccagcactttggggggcc

SEQ ID NO: 378938 - DNA, 20 bp, Artificial Sequence
  chemically synthesized
ccgcctgcctcggcccccca

SEQ ID NO: 378939 - DNA, 20 bp, Artificial Sequence
  chemically synthesized
tgtaatcccagcactttggg

SEQ ID NO: 378940 - DNA, 20 bp, Artificial Sequence
  chemically synthesized
ctgtaatcccagcactttgg

SEQ ID NO: 378941 - DNA, 20 bp, Artificial Sequence
  chemically synthesized
cctgtaatcccagcactttg

SEQ ID NO: 378942 - DNA, 20 bp, Artificial Sequence
  chemically synthesized
gcctcggccccccaaagtgc

SEQ ID NO: 378943 - DNA, 20 bp, Artificial Sequence
  chemically synthesized
tcctgtaatcccagcacttt

SEQ ID NO: 378944 - DNA, 20 bp, Artificial Sequence
  chemically synthesized
cctcggccccccaaagtgct

SEQ ID NO: 378945 - DNA, 20 bp, Artificial Sequence
  chemically synthesized
ctcctgtaatcccagcactt

SEQ ID NO: 378946 - DNA, 20 bp, Artificial Sequence
  chemically synthesized
cccccaaagtgctgggatta

SEQ ID NO: 378947 - DNA, 20 bp, Artificial Sequence
  chemically synthesized
ccccaaagtgctgggattac

SEQ ID NO: 378948 - DNA, 20 bp, Artificial Sequence
  chemically synthesized
gtggctcactcctgtaatcc

SEQ ID NO: 378949 - DNA, 20 bp, Artificial Sequence
  chemically synthesized
ccaaagtgctgggattacag

SEQ ID NO: 378950 - DNA, 20 bp, Artificial Sequence
  chemically synthesized
agtgctgggattacaggagt

SEQ ID NO: 378951 - DNA, 20 bp, Artificial Sequence
  chemically synthesized
tgttctagggcggggcgcgg

SEQ ID NO: 378952 - DNA, 20 bp, Artificial Sequence
  chemically synthesized
gtgtgttctagggcggggcg

SEQ ID NO: 378953 - DNA, 20 bp, Artificial Sequence
  chemically synthesized
tgagccaccgcgccccgccc

SEQ ID NO: 378954 - DNA, 20 bp, Artificial Sequence
  chemically synthesized
agaaagtgtgttctagggcg

SEQ ID NO: 378955 - DNA, 20 bp, Artificial Sequence
  chemically synthesized
aagaaagtgtgttctagggc

SEQ ID NO: 378956 - DNA, 20 bp, Artificial Sequence
  chemically synthesized
taagaaagtgtgttctaggg

SEQ ID NO: 378957 - DNA, 20 bp, Artificial Sequence
  chemically synthesized
ttctaagaaagtgtgttcta

SEQ ID NO: 378958 - DNA, 20 bp, Artificial Sequence
  chemically synthesized
tttctaagaaagtgtgttct

SEQ ID NO: 378959 - DNA, 20 bp, Artificial Sequence
  chemically synthesized
ctttctaagaaagtgtgttc

SEQ ID NO: 378960 - DNA, 20 bp, Artificial Sequence
  chemically synthesized
cgccctagaacacactttct

SEQ ID NO: 378961 - DNA, 20 bp, Artificial Sequence
  chemically synthesized
ctagaacacactttcttaga

SEQ ID NO: 378962 - DNA, 20 bp, Artificial Sequence
  chemically synthesized
tattttgaaactttctaaga

SEQ ID NO: 378963 - DNA, 20 bp, Artificial Sequence
  chemically synthesized
aagatattttgaaactttct

SEQ ID NO: 378964 - DNA, 20 bp, Artificial Sequence
  chemically synthesized
taaaatactgtaacagtaaa

SEQ ID NO: 378965 - DNA, 20 bp, Artificial Sequence
  chemically synthesized
aaaatatctttttactgtta

SEQ ID NO: 378966 - DNA, 20 bp, Artificial Sequence
  chemically synthesized
agattcctaaaatactgtaa

SEQ ID NO: 378967 - DNA, 20 bp, Artificial Sequence
  chemically synthesized
tttttactgttacagtattt

SEQ ID NO: 378968 - DNA, 20 bp, Artificial Sequence
  chemically synthesized
ttttactgttacagtatttt

SEQ ID NO: 378969 - DNA, 20 bp, Artificial Sequence
  chemically synthesized
tccttttactaataagtgtt

SEQ ID NO: 378970 - DNA, 20 bp, Artificial Sequence
  chemically synthesized
ttaggaatctgaacacttat

SEQ ID NO: 378971 - DNA, 20 bp, Artificial Sequence
  chemically synthesized
tcatatttccttttactaat

SEQ ID NO: 378972 - DNA, 20 bp, Artificial Sequence
  chemically synthesized
atctgaacacttattagtaa

SEQ ID NO: 378973 - DNA, 20 bp, Artificial Sequence
  chemically synthesized
tctgaacacttattagtaaa

SEQ ID NO: 378974 - DNA, 20 bp, Artificial Sequence
  chemically synthesized
gatactacttgagagaaagc

SEQ ID NO: 378975 - DNA, 20 bp, Artificial Sequence
  chemically synthesized
atatgaacttgctttctctc

SEQ ID NO: 378976 - DNA, 20 bp, Artificial Sequence
  chemically synthesized
gaaagatactacttgagaga

SEQ ID NO: 378977 - DNA, 20 bp, Artificial Sequence
  chemically synthesized
tgaacttgctttctctcaag

SEQ ID NO: 378978 - DNA, 20 bp, Artificial Sequence
  chemically synthesized
gaaagaaagatactacttga

SEQ ID NO: 378979 - DNA, 20 bp, Artificial Sequence
  chemically synthesized
gagaaagaaagatactactt

SEQ ID NO: 378980 - DNA, 20 bp, Artificial Sequence
  chemically synthesized
catggctttgtggagaaaga

SEQ ID NO: 378981 - DNA, 20 bp, Artificial Sequence
  chemically synthesized
aagacatggctttgtggaga

SEQ ID NO: 378982 - DNA, 20 bp, Artificial Sequence
  chemically synthesized
agtatctttctttctccaca

SEQ ID NO: 378983 - DNA, 20 bp, Artificial Sequence
  chemically synthesized
ctctaagacatggctttgtg

SEQ ID NO: 378984 - DNA, 20 bp, Artificial Sequence
  chemically synthesized
agctctaagacatggctttg

SEQ ID NO: 378985 - DNA, 20 bp, Artificial Sequence
  chemically synthesized
ttctccacaaagccatgtct

SEQ ID NO: 378986 - DNA, 20 bp, Artificial Sequence
  chemically synthesized
ctccacaaagccatgtctta

SEQ ID NO: 378987 - DNA, 20 bp, Artificial Sequence
  chemically synthesized
attgaaagagctctaagaca

SEQ ID NO: 378988 - DNA, 20 bp, Artificial Sequence
  chemically synthesized
cccataattgaaagagctct

SEQ ID NO: 378989 - DNA, 20 bp, Artificial Sequence
  chemically synthesized
tttaatacccataattgaaa

SEQ ID NO: 378990 - DNA, 20 bp, Artificial Sequence
  chemically synthesized
tcttagagctctttcaatta

SEQ ID NO: 378991 - DNA, 20 bp, Artificial Sequence
  chemically synthesized
ggtttaatacccataattga

SEQ ID NO: 378992 - DNA, 20 bp, Artificial Sequence
  chemically synthesized
cttagagctctttcaattat

SEQ ID NO: 378993 - DNA, 20 bp, Artificial Sequence
  chemically synthesized
ttcaattatgggtattaaac

SEQ ID NO: 378994 - DNA, 20 bp, Artificial Sequence
  chemically synthesized
gggtattaaaccagtatgac

SEQ ID NO: 378995 - DNA, 20 bp, Artificial Sequence
  chemically synthesized
gtctgagattctggtcatac

SEQ ID NO: 378996 - DNA, 20 bp, Artificial Sequence
  chemically synthesized
aaccagtatgaccagaatct

SEQ ID NO: 378997 - DNA, 20 bp, Artificial Sequence
  chemically synthesized
gtgtctgttgtctgagattc

SEQ ID NO: 378998 - DNA, 20 bp, Artificial Sequence
  chemically synthesized
atgaccagaatctcagacaa

SEQ ID NO: 378999 - DNA, 20 bp, Artificial Sequence
  chemically synthesized
caggatagtgtctgttgtct

SEQ ID NO: 379000 - DNA, 20 bp, Artificial Sequence
  chemically synthesized
ttagctctgtgtggacagga

SEQ ID NO: 379001 - DNA, 20 bp, Artificial Sequence
  chemically synthesized
cagacactatcctgtccaca

SEQ ID NO: 379002 - DNA, 20 bp, Artificial Sequence
  chemically synthesized
aacattagctctgtgtggac

SEQ ID NO: 379003 - DNA, 20 bp, Artificial Sequence
  chemically synthesized
aaacattagctctgtgtgga

SEQ ID NO: 379004 - DNA, 20 bp, Artificial Sequence
  chemically synthesized
gacactatcctgtccacaca

SEQ ID NO: 379005 - DNA, 20 bp, Artificial Sequence
  chemically synthesized
ggataaacattagctctgtg

SEQ ID NO: 379006 - DNA, 20 bp, Artificial Sequence
  chemically synthesized
ctgcagacagggataaacat

SEQ ID NO: 379007 - DNA, 20 bp, Artificial Sequence
  chemically synthesized
ctaatgtttatccctgtctg

SEQ ID NO: 379008 - DNA, 20 bp, Artificial Sequence
  chemically synthesized
gttgatgaagactgcagaca

SEQ ID NO: 379009 - DNA, 20 bp, Artificial Sequence
  chemically synthesized
tgttgatgaagactgcagac

SEQ ID NO: 379010 - DNA, 20 bp, Artificial Sequence
  chemically synthesized
ctgttgatgaagactgcaga

SEQ ID NO: 379011 - DNA, 20 bp, Artificial Sequence
  chemically synthesized
caaactgttgatgaagactg

SEQ ID NO: 379012 - DNA, 20 bp, Artificial Sequence
  chemically synthesized
ctgtctgcagtcttcatcaa

SEQ ID NO: 379013 - DNA, 20 bp, Artificial Sequence
  chemically synthesized
tcctttccaaactgttgatg

SEQ ID NO: 379014 - DNA, 20 bp, Artificial Sequence
  chemically synthesized
tgcagtcttcatcaacagtt

SEQ ID NO: 379015 - DNA, 20 bp, Artificial Sequence
  chemically synthesized
gtcttcatcaacagtttgga

SEQ ID NO: 379016 - DNA, 20 bp, Artificial Sequence
  chemically synthesized
tcttcatcaacagtttggaa

SEQ ID NO: 379017 - DNA, 20 bp, Artificial Sequence
  chemically synthesized
atcaacagtttggaaaggaa

SEQ ID NO: 379018 - DNA, 20 bp, Artificial Sequence
  chemically synthesized
ttaaaatattgaaatagcga

SEQ ID NO: 379019 - DNA, 20 bp, Artificial Sequence
  chemically synthesized
cttaaaatattgaaatagcg

SEQ ID NO: 379020 - DNA, 20 bp, Artificial Sequence
  chemically synthesized
gcttaaaatattgaaatagc

SEQ ID NO: 379021 - DNA, 20 bp, Artificial Sequence
  chemically synthesized
gtcagcttaaaatattgaaa

SEQ ID NO: 379022 - DNA, 20 bp, Artificial Sequence
  chemically synthesized
cctcgctatttcaatatttt

SEQ ID NO: 379023 - DNA, 20 bp, Artificial Sequence
  chemically synthesized
aaggaattcgtaaaatgtgt

SEQ ID NO: 379024 - DNA, 20 bp, Artificial Sequence
  chemically synthesized
agaccacttttagagtgtaa

SEQ ID NO: 379025 - DNA, 20 bp, Artificial Sequence
  chemically synthesized
tagaccacttttagagtgta

SEQ ID NO: 379026 - DNA, 20 bp, Artificial Sequence
  chemically synthesized
cgaattcctttacactctaa

SEQ ID NO: 379027 - DNA, 20 bp, Artificial Sequence
  chemically synthesized
attcctttacactctaaaag

SEQ ID NO: 379028 - DNA, 20 bp, Artificial Sequence
  chemically synthesized
aaatatatagaccactttta

SEQ ID NO: 379029 - DNA, 20 bp, Artificial Sequence
  chemically synthesized
ataaatatatagaccacttt

SEQ ID NO: 379030 - DNA, 20 bp, Artificial Sequence
  chemically synthesized
agtcctatctaataaatata

SEQ ID NO: 379031 - DNA, 20 bp, Artificial Sequence
  chemically synthesized
aaagtggtctatatatttat

SEQ ID NO: 379032 - DNA, 20 bp, Artificial Sequence
  chemically synthesized
tggtctatatatttattaga

SEQ ID NO: 379033 - DNA, 20 bp, Artificial Sequence
  chemically synthesized
ggtctatatatttattagat

SEQ ID NO: 379034 - DNA, 20 bp, Artificial Sequence
  chemically synthesized
tttattagataggacttctc

SEQ ID NO: 379035 - DNA, 20 bp, Artificial Sequence
  chemically synthesized
ttattagataggacttctca

SEQ ID NO: 379036 - DNA, 20 bp, Artificial Sequence
  chemically synthesized
aggctatatcatgccttgag

SEQ ID NO: 379037 - DNA, 20 bp, Artificial Sequence
  chemically synthesized
tctaggctatatcatgcctt

SEQ ID NO: 379038 - DNA, 20 bp, Artificial Sequence
  chemically synthesized
ggacttctcaaggcatgata

SEQ ID NO: 379039 - DNA, 20 bp, Artificial Sequence
  chemically synthesized
tctcaaggcatgatatagcc

SEQ ID NO: 379040 - DNA, 20 bp, Artificial Sequence
  chemically synthesized
cagaggttccagaaaattct

SEQ ID NO: 379041 - DNA, 20 bp, Artificial Sequence
  chemically synthesized
tcagaggttccagaaaattc

SEQ ID NO: 379042 - DNA, 20 bp, Artificial Sequence
  chemically synthesized
tgatatagcctagaattttc

SEQ ID NO: 379043 - DNA, 20 bp, Artificial Sequence
  chemically synthesized
aataaaggattcagaggttc

SEQ ID NO: 379044 - DNA, 20 bp, Artificial Sequence
  chemically synthesized
agtgtcaataaaggattcag

SEQ ID NO: 379045 - DNA, 20 bp, Artificial Sequence
  chemically synthesized
cagtgtcaataaaggattca

SEQ ID NO: 379046 - DNA, 20 bp, Artificial Sequence
  chemically synthesized
ttcagtgtcaataaaggatt

SEQ ID NO: 379047 - DNA, 20 bp, Artificial Sequence
  chemically synthesized
tggaccttcagtgtcaataa

SEQ ID NO: 379048 - DNA, 20 bp, Artificial Sequence
  chemically synthesized
atggaccttcagtgtcaata

SEQ ID NO: 379049 - DNA, 20 bp, Artificial Sequence
  chemically synthesized
tgaatcctttattgacactg

SEQ ID NO: 379050 - DNA, 20 bp, Artificial Sequence
  chemically synthesized
gaatcctttattgacactga

SEQ ID NO: 379051 - DNA, 20 bp, Artificial Sequence
  chemically synthesized
caggcactatcatggacctt

SEQ ID NO: 379052 - DNA, 20 bp, Artificial Sequence
  chemically synthesized
ttgacactgaaggtccatga

SEQ ID NO: 379053 - DNA, 20 bp, Artificial Sequence
  chemically synthesized
tcattttgcaggcactatca

SEQ ID NO: 379054 - DNA, 20 bp, Artificial Sequence
  chemically synthesized
gtattgttcaatcattttgc

SEQ ID NO: 379055 - DNA, 20 bp, Artificial Sequence
  chemically synthesized
agtattgttcaatcattttg

SEQ ID NO: 379056 - DNA, 20 bp, Artificial Sequence
  chemically synthesized
gtgaaattgtttacaagatt

SEQ ID NO: 379057 - DNA, 20 bp, Artificial Sequence
  chemically synthesized
tataatgtgaaattgtttac

SEQ ID NO: 379058 - DNA, 20 bp, Artificial Sequence
  chemically synthesized
attatatttgtaatgtacca

SEQ ID NO: 379059 - DNA, 20 bp, Artificial Sequence
  chemically synthesized
attcataagatcaatgactg

SEQ ID NO: 379060 - DNA, 20 bp, Artificial Sequence
  chemically synthesized
ccagtttcaccatcattcat

SEQ ID NO: 379061 - DNA, 20 bp, Artificial Sequence
  chemically synthesized
gtcattgatcttatgaatga

SEQ ID NO: 379062 - DNA, 20 bp, Artificial Sequence
  chemically synthesized
cttatgaatgatggtgaaac

SEQ ID NO: 379063 - DNA, 20 bp, Artificial Sequence
  chemically synthesized
atgaatgatggtgaaactgg

SEQ ID NO: 379064 - DNA, 20 bp, Artificial Sequence
  chemically synthesized
aatgatggtgaaactggcgg

SEQ ID NO: 379065 - DNA, 20 bp, Artificial Sequence
  chemically synthesized
atgatggtgaaactggcggt

SEQ ID NO: 379066 - DNA, 20 bp, Artificial Sequence
  chemically synthesized
ttacctctctttcccaccgc

SEQ ID NO: 379067 - DNA, 20 bp, Artificial Sequence
  chemically synthesized
tggtgaaactggcggtggga

SEQ ID NO: 379068 - DNA, 20 bp, Artificial Sequence
  chemically synthesized
gtgaaactggcggtgggaaa

SEQ ID NO: 379069 - DNA, 20 bp, Artificial Sequence
  chemically synthesized
gaaactggcggtgggaaaga

SEQ ID NO: 379070 - DNA, 20 bp, Artificial Sequence
  chemically synthesized
aaactggcggtgggaaagag

SEQ ID NO: 379071 - DNA, 20 bp, Artificial Sequence
  chemically synthesized
tttgaaactggtttagtgtt

SEQ ID NO: 379072 - DNA, 20 bp, Artificial Sequence
  chemically synthesized
ttttgaaactggtttagtgt

SEQ ID NO: 379073 - DNA, 20 bp, Artificial Sequence
  chemically synthesized
tgtgtatcctaacactaaac

SEQ ID NO: 379074 - DNA, 20 bp, Artificial Sequence
  chemically synthesized
acagccttttgaaactggtt

SEQ ID NO: 379075 - DNA, 20 bp, Artificial Sequence
  chemically synthesized
taacactaaaccagtttcaa

SEQ ID NO: 379076 - DNA, 20 bp, Artificial Sequence
  chemically synthesized
ggagcacagccttttgaaac

SEQ ID NO: 379077 - DNA, 20 bp, Artificial Sequence
  chemically synthesized
aacactaaaccagtttcaaa

SEQ ID NO: 379078 - DNA, 20 bp, Artificial Sequence
  chemically synthesized
tttcaaaaggctgtgctccc

SEQ ID NO: 379079 - DNA, 20 bp, Artificial Sequence
  chemically synthesized
gctaggataacttgggagca

SEQ ID NO: 379080 - DNA, 20 bp, Artificial Sequence
  chemically synthesized
ttatggctaggataacttgg

SEQ ID NO: 379081 - DNA, 20 bp, Artificial Sequence
  chemically synthesized
tgttatggctaggataactt

SEQ ID NO: 379082 - DNA, 20 bp, Artificial Sequence
  chemically synthesized
atgttatggctaggataact

SEQ ID NO: 379083 - DNA, 20 bp, Artificial Sequence
  chemically synthesized
gctgtgctcccaagttatcc

SEQ ID NO: 379084 - DNA, 20 bp, Artificial Sequence
  chemically synthesized
aatcagaacatgttatggct

SEQ ID NO: 379085 - DNA, 20 bp, Artificial Sequence
  chemically synthesized
aaatcagaacatgttatggc

SEQ ID NO: 379086 - DNA, 20 bp, Artificial Sequence
  chemically synthesized
taagaaatcagaacatgtta

SEQ ID NO: 379087 - DNA, 20 bp, Artificial Sequence
  chemically synthesized
ttaatgtgaaagtaagaaat

SEQ ID NO: 379088 - DNA, 20 bp, Artificial Sequence
  chemically synthesized
acagagtttaatgtgaaagt

SEQ ID NO: 379089 - DNA, 20 bp, Artificial Sequence
  chemically synthesized
ctatacagagtttaatgtga

SEQ ID NO: 379090 - DNA, 20 bp, Artificial Sequence
  chemically synthesized
ctttcacattaaactctgta

SEQ ID NO: 379091 - DNA, 20 bp, Artificial Sequence
  chemically synthesized
gttctacaatatactataca

SEQ ID NO: 379092 - DNA, 20 bp, Artificial Sequence
  chemically synthesized
aagttctacaatatactata

SEQ ID NO: 379093 - DNA, 20 bp, Artificial Sequence
  chemically synthesized
aaactctgtatagtatattg

SEQ ID NO: 379094 - DNA, 20 bp, Artificial Sequence
  chemically synthesized
taatttagcagatatgaatt

SEQ ID NO: 379095 - DNA, 20 bp, Artificial Sequence
  chemically synthesized
tattcactcatttaatttag

SEQ ID NO: 379096 - DNA, 20 bp, Artificial Sequence
  chemically synthesized
atgtattcactcatttaatt

SEQ ID NO: 379097 - DNA, 20 bp, Artificial Sequence
  chemically synthesized
tcatatctgctaaattaaat

SEQ ID NO: 379098 - DNA, 20 bp, Artificial Sequence
  chemically synthesized
aaatgagtgaatacataaaa

SEQ ID NO: 379099 - DNA, 20 bp, Artificial Sequence
  chemically synthesized
aatacataaaacggaaaact

SEQ ID NO: 379100 - DNA, 20 bp, Artificial Sequence
  chemically synthesized
atacataaaacggaaaactg

SEQ ID NO: 379101 - DNA, 20 bp, Artificial Sequence
  chemically synthesized
aagtagtacacaatttacct

SEQ ID NO: 379102 - DNA, 20 bp, Artificial Sequence
  chemically synthesized
gtactttgatttagtgtaag

SEQ ID NO: 379103 - DNA, 20 bp, Artificial Sequence
  chemically synthesized
gctgtactttgatttagtgt

SEQ ID NO: 379104 - DNA, 20 bp, Artificial Sequence
  chemically synthesized
gtactacttacactaaatca

SEQ ID NO: 379105 - DNA, 20 bp, Artificial Sequence
  chemically synthesized
tttaaggctgtactttgatt

SEQ ID NO: 379106 - DNA, 20 bp, Artificial Sequence
  chemically synthesized
acttacactaaatcaaagta

SEQ ID NO: 379107 - DNA, 20 bp, Artificial Sequence
  chemically synthesized
taaatcaaagtacagcctta

SEQ ID NO: 379108 - DNA, 20 bp, Artificial Sequence
  chemically synthesized
aaatcaaagtacagccttaa

SEQ ID NO: 379109 - DNA, 20 bp, Artificial Sequence
  chemically synthesized
attaaatgtatattccttta

SEQ ID NO: 379110 - DNA, 20 bp, Artificial Sequence
  chemically synthesized
tattaaatgtatattccttt

SEQ ID NO: 379111 - DNA, 20 bp, Artificial Sequence
  chemically synthesized
aggaatatacatttaataat

SEQ ID NO: 379112 - DNA, 20 bp, Artificial Sequence
  chemically synthesized
tttaaatgcagacaattgtt

SEQ ID NO: 379113 - DNA, 20 bp, Artificial Sequence
  chemically synthesized
ccattggcaagttttaaatg

SEQ ID NO: 379114 - DNA, 20 bp, Artificial Sequence
  chemically synthesized
ctgcatttaaaacttgccaa

SEQ ID NO: 379115 - DNA, 20 bp, Artificial Sequence
  chemically synthesized
tttttcatggttccattggc

SEQ ID NO: 379116 - DNA, 20 bp, Artificial Sequence
  chemically synthesized
gcattttttcatggttccat

SEQ ID NO: 379117 - DNA, 20 bp, Artificial Sequence
  chemically synthesized
tgagtttgggcattttttca

SEQ ID NO: 379118 - DNA, 20 bp, Artificial Sequence
  chemically synthesized
cattaatgaaaaatgagttt

SEQ ID NO: 379119 - DNA, 20 bp, Artificial Sequence
  chemically synthesized
gcattaatgaaaaatgagtt

SEQ ID NO: 379120 - DNA, 20 bp, Artificial Sequence
  chemically synthesized
gaattgcattaatgaaaaat

SEQ ID NO: 379121 - DNA, 20 bp, Artificial Sequence
  chemically synthesized
tttttcattaatgcaattca

SEQ ID NO: 379122 - DNA, 20 bp, Artificial Sequence
  chemically synthesized
tgcaattcaaagtaaatcca

SEQ ID NO: 379123 - DNA, 20 bp, Artificial Sequence
  chemically synthesized
attcaaagtaaatccacagc

SEQ ID NO: 379124 - DNA, 20 bp, Artificial Sequence
  chemically synthesized
tataaaattgtttctagctg

SEQ ID NO: 379125 - DNA, 20 bp, Artificial Sequence
  chemically synthesized
gttgagtataaaattgtttc

SEQ ID NO: 379126 - DNA, 20 bp, Artificial Sequence
  chemically synthesized
agaaacaattttatactcaa

SEQ ID NO: 379127 - DNA, 20 bp, Artificial Sequence
  chemically synthesized
aaacaattttatactcaaca

SEQ ID NO: 379128 - DNA, 20 bp, Artificial Sequence
  chemically synthesized
caattttatactcaacagag

SEQ ID NO: 379129 - DNA, 20 bp, Artificial Sequence
  chemically synthesized
taacttttggctactctgtt

SEQ ID NO: 379130 - DNA, 20 bp, Artificial Sequence
  chemically synthesized
atactcaacagagtagccaa

SEQ ID NO: 379131 - DNA, 20 bp, Artificial Sequence
  chemically synthesized
caacagagtagccaaaagtt

SEQ ID NO: 379132 - DNA, 20 bp, Artificial Sequence
  chemically synthesized
acaatgtcaaacttaacttt

SEQ ID NO: 379133 - DNA, 20 bp, Artificial Sequence
  chemically synthesized
aagttaagtttgacattgtc

SEQ ID NO: 379134 - DNA, 20 bp, Artificial Sequence
  chemically synthesized
agtttgacattgtcaagtgt

SEQ ID NO: 379135 - DNA, 20 bp, Artificial Sequence
  chemically synthesized
cattgtcaagtgttagaatt

SEQ ID NO: 379136 - DNA, 20 bp, Artificial Sequence
  chemically synthesized
attgtcaagtgttagaattt

SEQ ID NO: 379137 - DNA, 20 bp, Artificial Sequence
  chemically synthesized
tgtcaagtgttagaatttgg

SEQ ID NO: 379138 - DNA, 20 bp, Artificial Sequence
  chemically synthesized
aagtgttagaatttgggagc

SEQ ID NO: 379139 - DNA, 20 bp, Artificial Sequence
  chemically synthesized
tgttagaatttgggagcaag

SEQ ID NO: 379140 - DNA, 20 bp, Artificial Sequence
  chemically synthesized
tgggagcaagcagaattttt

SEQ ID NO: 379141 - DNA, 20 bp, Artificial Sequence
  chemically synthesized
agcagaatttttaagttcgt

SEQ ID NO: 379142 - DNA, 20 bp, Artificial Sequence
  chemically synthesized
aagttcgtgagaatttaaat

SEQ ID NO: 379143 - DNA, 20 bp, Artificial Sequence
  chemically synthesized
tgccaaattatttttaaaat

SEQ ID NO: 379144 - DNA, 20 bp, Artificial Sequence
  chemically synthesized
aaccaattttaaaaataatt

SEQ ID NO: 379145 - DNA, 20 bp, Artificial Sequence
  chemically synthesized
aaaataatttggcataatct

SEQ ID NO: 379146 - DNA, 20 bp, Artificial Sequence
  chemically synthesized
ttggcataatcttggaaact

SEQ ID NO: 379147 - DNA, 20 bp, Artificial Sequence
  chemically synthesized
tgatgtatttctaagtttcc

SEQ ID NO: 379148 - DNA, 20 bp, Artificial Sequence
  chemically synthesized
gactgacatgatgtatttct

SEQ ID NO: 379149 - DNA, 20 bp, Artificial Sequence
  chemically synthesized
aacttagaaatacatcatgt

SEQ ID NO: 379150 - DNA, 20 bp, Artificial Sequence
  chemically synthesized
tagaaatacatcatgtcagt

SEQ ID NO: 379151 - DNA, 20 bp, Artificial Sequence
  chemically synthesized
catcatgtcagtcagaatct

SEQ ID NO: 379152 - DNA, 20 bp, Artificial Sequence
  chemically synthesized
catgtcagtcagaatctaag

SEQ ID NO: 379153 - DNA, 20 bp, Artificial Sequence
  chemically synthesized
aatgactttttgtgtctgct

SEQ ID NO: 379154 - DNA, 20 bp, Artificial Sequence
  chemically synthesized
agaatctaagcagacacaaa

SEQ ID NO: 379155 - DNA, 20 bp, Artificial Sequence
  chemically synthesized
aagtcatttgatatttaaat

SEQ ID NO: 379156 - DNA, 20 bp, Artificial Sequence
  chemically synthesized
catttgatatttaaatcaga

SEQ ID NO: 379157 - DNA, 20 bp, Artificial Sequence
  chemically synthesized
aaatcagaaagcttaaatta

SEQ ID NO: 379158 - DNA, 20 bp, Artificial Sequence
  chemically synthesized
ttgtttcaattctataattt

SEQ ID NO: 379159 - DNA, 20 bp, Artificial Sequence
  chemically synthesized
attatagaattgaaacaaat

SEQ ID NO: 379160 - DNA, 20 bp, Artificial Sequence
  chemically synthesized
tatagaattgaaacaaatga

SEQ ID NO: 379161 - DNA, 20 bp, Artificial Sequence
  chemically synthesized
agaattgaaacaaatgagag

SEQ ID NO: 379162 - DNA, 20 bp, Artificial Sequence
  chemically synthesized
tgaaacaaatgagagaagaa

SEQ ID NO: 379163 - DNA, 20 bp, Artificial Sequence
  chemically synthesized
aaacaaatgagagaagaaca

SEQ ID NO: 379164 - DNA, 20 bp, Artificial Sequence
  chemically synthesized
gagagaagaacagagttgac

SEQ ID NO: 379165 - DNA, 20 bp, Artificial Sequence
  chemically synthesized
agaacagagttgacaagctg

SEQ ID NO: 379166 - DNA, 20 bp, Artificial Sequence
  chemically synthesized
aacagagttgacaagctgtg

SEQ ID NO: 379167 - DNA, 20 bp, Artificial Sequence
  chemically synthesized
acagagttgacaagctgtgg

SEQ ID NO: 379168 - DNA, 20 bp, Artificial Sequence
  chemically synthesized
ctgagtcactttgtcctcca

SEQ ID NO: 379169 - DNA, 20 bp, Artificial Sequence
  chemically synthesized
ttgacaagctgtggaggaca

SEQ ID NO: 379170 - DNA, 20 bp, Artificial Sequence
  chemically synthesized
ctgtggaggacaaagtgact

SEQ ID NO: 379171 - DNA, 20 bp, Artificial Sequence
  chemically synthesized
gtggaggacaaagtgactca

SEQ ID NO: 379172 - DNA, 20 bp, Artificial Sequence
  chemically synthesized
ggacaaagtgactcagagtt

SEQ ID NO: 379173 - DNA, 20 bp, Artificial Sequence
  chemically synthesized
tcctgtggttgctaaactct

SEQ ID NO: 379174 - DNA, 20 bp, Artificial Sequence
  chemically synthesized
gactcagagtttagcaacca

SEQ ID NO: 379175 - DNA, 20 bp, Artificial Sequence
  chemically synthesized
actcagagtttagcaaccac

SEQ ID NO: 379176 - DNA, 20 bp, Artificial Sequence
  chemically synthesized
cagagtttagcaaccacagg

SEQ ID NO: 379177 - DNA, 20 bp, Artificial Sequence
  chemically synthesized
agggtaatagtggcttcctg

SEQ ID NO: 379178 - DNA, 20 bp, Artificial Sequence
  chemically synthesized
ctgtactttaagggtaatag

SEQ ID NO: 379179 - DNA, 20 bp, Artificial Sequence
  chemically synthesized
tccctgtactttaagggtaa

SEQ ID NO: 379180 - DNA, 20 bp, Artificial Sequence
  chemically synthesized
ggaagccactattaccctta

SEQ ID NO: 379181 - DNA, 20 bp, Artificial Sequence
  chemically synthesized
ttcctctccctgtactttaa

SEQ ID NO: 379182 - DNA, 20 bp, Artificial Sequence
  chemically synthesized
ccactattacccttaaagta

SEQ ID NO: 379183 - DNA, 20 bp, Artificial Sequence
  chemically synthesized
cttcctctccctgtacttta

SEQ ID NO: 379184 - DNA, 20 bp, Artificial Sequence
  chemically synthesized
cactattacccttaaagtac

SEQ ID NO: 379185 - DNA, 20 bp, Artificial Sequence
  chemically synthesized
ccttcctctccctgtacttt

SEQ ID NO: 379186 - DNA, 20 bp, Artificial Sequence
  chemically synthesized
actattacccttaaagtaca

SEQ ID NO: 379187 - DNA, 20 bp, Artificial Sequence
  chemically synthesized
tattacccttaaagtacagg

SEQ ID NO: 379188 - DNA, 20 bp, Artificial Sequence
  chemically synthesized
ttacccttaaagtacaggga

SEQ ID NO: 379189 - DNA, 20 bp, Artificial Sequence
  chemically synthesized
tacccttaaagtacagggag

SEQ ID NO: 379190 - DNA, 20 bp, Artificial Sequence
  chemically synthesized
ccttaaagtacagggagagg

SEQ ID NO: 379191 - DNA, 20 bp, Artificial Sequence
  chemically synthesized
cttaaagtacagggagagga

SEQ ID NO: 379192 - DNA, 20 bp, Artificial Sequence
  chemically synthesized
ttaaagtacagggagaggaa

SEQ ID NO: 379193 - DNA, 20 bp, Artificial Sequence
  chemically synthesized
aaagtacagggagaggaagg

SEQ ID NO: 379194 - DNA, 20 bp, Artificial Sequence
  chemically synthesized
agtacagggagaggaaggga

SEQ ID NO: 379195 - DNA, 20 bp, Artificial Sequence
  chemically synthesized
gtacagggagaggaagggag

SEQ ID NO: 379196 - DNA, 20 bp, Artificial Sequence
  chemically synthesized
acagggagaggaagggagag

SEQ ID NO: 379197 - DNA, 20 bp, Artificial Sequence
  chemically synthesized
agggagaggaagggagagga

SEQ ID NO: 379198 - DNA, 20 bp, Artificial Sequence
  chemically synthesized
gagaggaagggagaggagag

SEQ ID NO: 379199 - DNA, 20 bp, Artificial Sequence
  chemically synthesized
aggaagggagaggagagaag

SEQ ID NO: 379200 - DNA, 20 bp, Artificial Sequence
  chemically synthesized
gaagggagaggagagaagaa

SEQ ID NO: 379201 - DNA, 20 bp, Artificial Sequence
  chemically synthesized
gggagaggagagaagaagag

SEQ ID NO: 379202 - DNA, 20 bp, Artificial Sequence
  chemically synthesized
ggagaggagagaagaagagt

SEQ ID NO: 379203 - DNA, 20 bp, Artificial Sequence
  chemically synthesized
agaggagagaagaagagtgg

SEQ ID NO: 379204 - DNA, 20 bp, Artificial Sequence
  chemically synthesized
aggagagaagaagagtggga

SEQ ID NO: 379205 - DNA, 20 bp, Artificial Sequence
  chemically synthesized
agagaagaagagtgggagag

SEQ ID NO: 379206 - DNA, 20 bp, Artificial Sequence
  chemically synthesized
gagaagaagagtgggagaga

SEQ ID NO: 379207 - DNA, 20 bp, Artificial Sequence
  chemically synthesized
agaagaagagtgggagagaa

SEQ ID NO: 379208 - DNA, 20 bp, Artificial Sequence
  chemically synthesized
gaagaagagtgggagagaag

SEQ ID NO: 379209 - DNA, 20 bp, Artificial Sequence
  chemically synthesized
agaagagtgggagagaaggg

SEQ ID NO: 379210 - DNA, 20 bp, Artificial Sequence
  chemically synthesized
aagagtgggagagaagggga

SEQ ID NO: 379211 - DNA, 20 bp, Artificial Sequence
  chemically synthesized
gagtgggagagaaggggaga

SEQ ID NO: 379212 - DNA, 20 bp, Artificial Sequence
  chemically synthesized
gtgggagagaaggggagaga

SEQ ID NO: 379213 - DNA, 20 bp, Artificial Sequence
  chemically synthesized
gggagagaaggggagagaga

SEQ ID NO: 379214 - DNA, 20 bp, Artificial Sequence
  chemically synthesized
gagagaaggggagagagaga

SEQ ID NO: 379215 - DNA, 20 bp, Artificial Sequence
  chemically synthesized
gagaaggggagagagagaga

SEQ ID NO: 379216 - DNA, 20 bp, Artificial Sequence
  chemically synthesized
gaaggggagagagagagaga

SEQ ID NO: 379217 - DNA, 20 bp, Artificial Sequence
  chemically synthesized
aggggagagagagagagaga

SEQ ID NO: 379218 - DNA, 20 bp, Artificial Sequence
  chemically synthesized
gggagagagagagagagaga

SEQ ID NO: 379219 - DNA, 20 bp, Artificial Sequence
  chemically synthesized
gagagagagagagagagaga

SEQ ID NO: 379220 - DNA, 20 bp, Artificial Sequence
  chemically synthesized
gagagagagagagagagaga

SEQ ID NO: 379221 - DNA, 20 bp, Artificial Sequence
  chemically synthesized
gagagagagagagagagaga

SEQ ID NO: 379222 - DNA, 20 bp, Artificial Sequence
  chemically synthesized
agagagagagagagagagag

SEQ ID NO: 379223 - DNA, 20 bp, Artificial Sequence
  chemically synthesized
gagagagagagagagagaga

SEQ ID NO: 379224 - DNA, 20 bp, Artificial Sequence
  chemically synthesized
gagagagagagagagagaag

SEQ ID NO: 379225 - DNA, 20 bp, Artificial Sequence
  chemically synthesized
agagagagagagagagaagg

SEQ ID NO: 379226 - DNA, 20 bp, Artificial Sequence
  chemically synthesized
agagagagagagagaaggag

SEQ ID NO: 379227 - DNA, 20 bp, Artificial Sequence
  chemically synthesized
gagagagagagagaaggagg

SEQ ID NO: 379228 - DNA, 20 bp, Artificial Sequence
  chemically synthesized
gagagagagaaggaggagga

SEQ ID NO: 379229 - DNA, 20 bp, Artificial Sequence
  chemically synthesized
agagagagaaggaggaggat

SEQ ID NO: 379230 - DNA, 20 bp, Artificial Sequence
  chemically synthesized
gagagagaaggaggaggatg

SEQ ID NO: 379231 - DNA, 20 bp, Artificial Sequence
  chemically synthesized
gagagaaggaggaggatggg

SEQ ID NO: 379232 - DNA, 20 bp, Artificial Sequence
  chemically synthesized
agagaaggaggaggatgggg

SEQ ID NO: 379233 - DNA, 20 bp, Artificial Sequence
  chemically synthesized
agaaggaggaggatggggag

SEQ ID NO: 379234 - DNA, 20 bp, Artificial Sequence
  chemically synthesized
gaaggaggaggatggggagg

SEQ ID NO: 379235 - DNA, 20 bp, Artificial Sequence
  chemically synthesized
ggaggaggatggggaggagg

SEQ ID NO: 379236 - DNA, 20 bp, Artificial Sequence
  chemically synthesized
aggaggatggggaggaggaa

SEQ ID NO: 379237 - DNA, 20 bp, Artificial Sequence
  chemically synthesized
ggaggatggggaggaggaag

SEQ ID NO: 379238 - DNA, 20 bp, Artificial Sequence
  chemically synthesized
aggatggggaggaggaagag

SEQ ID NO: 379239 - DNA, 20 bp, Artificial Sequence
  chemically synthesized
atggggaggaggaagaggag

SEQ ID NO: 379240 - DNA, 20 bp, Artificial Sequence
  chemically synthesized
tggggaggaggaagaggaga

SEQ ID NO: 379241 - DNA, 20 bp, Artificial Sequence
  chemically synthesized
aggaggaagaggagaaggaa

SEQ ID NO: 379242 - DNA, 20 bp, Artificial Sequence
  chemically synthesized
ggaggaagaggagaaggaat

SEQ ID NO: 379243 - DNA, 20 bp, Artificial Sequence
  chemically synthesized
gaggaagaggagaaggaatg

SEQ ID NO: 379244 - DNA, 20 bp, Artificial Sequence
  chemically synthesized
ggaagaggagaaggaatggg

SEQ ID NO: 379245 - DNA, 20 bp, Artificial Sequence
  chemically synthesized
gaagaggagaaggaatgggg

SEQ ID NO: 379246 - DNA, 20 bp, Artificial Sequence
  chemically synthesized
agaggagaaggaatggggag

SEQ ID NO: 379247 - DNA, 20 bp, Artificial Sequence
  chemically synthesized
gaggagaaggaatggggagg

SEQ ID NO: 379248 - DNA, 20 bp, Artificial Sequence
  chemically synthesized
ggagaaggaatggggaggag

SEQ ID NO: 379249 - DNA, 20 bp, Artificial Sequence
  chemically synthesized
gagaaggaatggggaggagg

SEQ ID NO: 379250 - DNA, 20 bp, Artificial Sequence
  chemically synthesized
aggaatggggaggaggagga

SEQ ID NO: 379251 - DNA, 20 bp, Artificial Sequence
  chemically synthesized
aatggggaggaggaggaaag

SEQ ID NO: 379252 - DNA, 20 bp, Artificial Sequence
  chemically synthesized
ggggaggaggaggaaagaag

SEQ ID NO: 379253 - DNA, 20 bp, Artificial Sequence
  chemically synthesized
gggaggaggaggaaagaaga

SEQ ID NO: 379254 - DNA, 20 bp, Artificial Sequence
  chemically synthesized
aggaggaggaaagaagaagg

SEQ ID NO: 379255 - DNA, 20 bp, Artificial Sequence
  chemically synthesized
ggaggaggaaagaagaaggc

SEQ ID NO: 379256 - DNA, 20 bp, Artificial Sequence
  chemically synthesized
gaggaggaaagaagaaggca

SEQ ID NO: 379257 - DNA, 20 bp, Artificial Sequence
  chemically synthesized
gaaggcagggtgcatgaatt

SEQ ID NO: 379258 - DNA, 20 bp, Artificial Sequence
  chemically synthesized
ggtgcatgaattcagtgaat

SEQ ID NO: 379259 - DNA, 20 bp, Artificial Sequence
  chemically synthesized
gtgcatgaattcagtgaatg

SEQ ID NO: 379260 - DNA, 20 bp, Artificial Sequence
  chemically synthesized
aattcagtgaatgaggttat

SEQ ID NO: 379261 - DNA, 20 bp, Artificial Sequence
  chemically synthesized
gaggttatgagatcattcat

SEQ ID NO: 379262 - DNA, 20 bp, Artificial Sequence
  chemically synthesized
gttatgagatcattcattgg

SEQ ID NO: 379263 - DNA, 20 bp, Artificial Sequence
  chemically synthesized
agatcattcattggaagctg

SEQ ID NO: 379264 - DNA, 20 bp, Artificial Sequence
  chemically synthesized
ttcattggaagctgcagcta

SEQ ID NO: 379265 - DNA, 20 bp, Artificial Sequence
  chemically synthesized
agataggcccactatagctg

SEQ ID NO: 379266 - DNA, 20 bp, Artificial Sequence
  chemically synthesized
attggaagctgcagctatag

SEQ ID NO: 379267 - DNA, 20 bp, Artificial Sequence
  chemically synthesized
ttggaagctgcagctatagt

SEQ ID NO: 379268 - DNA, 20 bp, Artificial Sequence
  chemically synthesized
ccaaccagataggcccacta

SEQ ID NO: 379269 - DNA, 20 bp, Artificial Sequence
  chemically synthesized
gcagctatagtgggcctatc

SEQ ID NO: 379270 - DNA, 20 bp, Artificial Sequence
  chemically synthesized
ctatagtgggcctatctggt

SEQ ID NO: 379271 - DNA, 20 bp, Artificial Sequence
  chemically synthesized
tgtcccccctccaaccagat

SEQ ID NO: 379272 - DNA, 20 bp, Artificial Sequence
  chemically synthesized
atgtcccccctccaaccaga

SEQ ID NO: 379273 - DNA, 20 bp, Artificial Sequence
  chemically synthesized
atagtgggcctatctggttg

SEQ ID NO: 379274 - DNA, 20 bp, Artificial Sequence
  chemically synthesized
tagtgggcctatctggttgg

SEQ ID NO: 379275 - DNA, 20 bp, Artificial Sequence
  chemically synthesized
agtgggcctatctggttgga

SEQ ID NO: 379276 - DNA, 20 bp, Artificial Sequence
  chemically synthesized
gtgggcctatctggttggag

SEQ ID NO: 379277 - DNA, 20 bp, Artificial Sequence
  chemically synthesized
tttgatgtcccccctccaac

SEQ ID NO: 379278 - DNA, 20 bp, Artificial Sequence
  chemically synthesized
tgggcctatctggttggagg

SEQ ID NO: 379279 - DNA, 20 bp, Artificial Sequence
  chemically synthesized
gggcctatctggttggaggg

SEQ ID NO: 379280 - DNA, 20 bp, Artificial Sequence
  chemically synthesized
tggttggaggggggacatca

SEQ ID NO: 379281 - DNA, 20 bp, Artificial Sequence
  chemically synthesized
gggggacatcaaagcatatg

SEQ ID NO: 379282 - DNA, 20 bp, Artificial Sequence
  chemically synthesized
agcatatgcagctgttgcca

SEQ ID NO: 379283 - DNA, 20 bp, Artificial Sequence
  chemically synthesized
tcaggcagtatctttggcaa

SEQ ID NO: 379284 - DNA, 20 bp, Artificial Sequence
  chemically synthesized
tgtgtttcaggcagtatctt

SEQ ID NO: 379285 - DNA, 20 bp, Artificial Sequence
  chemically synthesized
tcctctctttgtgtttcagg

SEQ ID NO: 379286 - DNA, 20 bp, Artificial Sequence
  chemically synthesized
tcttcctctctttgtgtttc

SEQ ID NO: 379287 - DNA, 20 bp, Artificial Sequence
  chemically synthesized
aagatactgcctgaaacaca

SEQ ID NO: 379288 - DNA, 20 bp, Artificial Sequence
  chemically synthesized
ctcttcctctctttgtgttt

SEQ ID NO: 379289 - DNA, 20 bp, Artificial Sequence
  chemically synthesized
gatactgcctgaaacacaaa

SEQ ID NO: 379290 - DNA, 20 bp, Artificial Sequence
  chemically synthesized
tactgcctgaaacacaaaga

SEQ ID NO: 379291 - DNA, 20 bp, Artificial Sequence
  chemically synthesized
actgcctgaaacacaaagag

SEQ ID NO: 379292 - DNA, 20 bp, Artificial Sequence
  chemically synthesized
gcctgaaacacaaagagagg

SEQ ID NO: 379293 - DNA, 20 bp, Artificial Sequence
  chemically synthesized
ctgaaacacaaagagaggaa

SEQ ID NO: 379294 - DNA, 20 bp, Artificial Sequence
  chemically synthesized
aaacacaaagagaggaagag

SEQ ID NO: 379295 - DNA, 20 bp, Artificial Sequence
  chemically synthesized
gaaactcagggaagacacaa

SEQ ID NO: 379296 - DNA, 20 bp, Artificial Sequence
  chemically synthesized
tggaaactcagggaagacac

SEQ ID NO: 379297 - DNA, 20 bp, Artificial Sequence
  chemically synthesized
agcactcttgtgtcttccct

SEQ ID NO: 379298 - DNA, 20 bp, Artificial Sequence
  chemically synthesized
gaaggattggaaactcaggg

SEQ ID NO: 379299 - DNA, 20 bp, Artificial Sequence
  chemically synthesized
ggtgaaggattggaaactca

SEQ ID NO: 379300 - DNA, 20 bp, Artificial Sequence
  chemically synthesized
tggtgaaggattggaaactc

SEQ ID NO: 379301 - DNA, 20 bp, Artificial Sequence
  chemically synthesized
atggtgaaggattggaaact

SEQ ID NO: 379302 - DNA, 20 bp, Artificial Sequence
  chemically synthesized
tttggctgatggtgaaggat

SEQ ID NO: 379303 - DNA, 20 bp, Artificial Sequence
  chemically synthesized
agtttccaatccttcaccat

SEQ ID NO: 379304 - DNA, 20 bp, Artificial Sequence
  chemically synthesized
ctctctttggctgatggtga

SEQ ID NO: 379305 - DNA, 20 bp, Artificial Sequence
  chemically synthesized
gctctctttggctgatggtg

SEQ ID NO: 379306 - DNA, 20 bp, Artificial Sequence
  chemically synthesized
caatccttcaccatcagcca

SEQ ID NO: 379307 - DNA, 20 bp, Artificial Sequence
  chemically synthesized
ttccagctctctttggctga

SEQ ID NO: 379308 - DNA, 20 bp, Artificial Sequence
  chemically synthesized
atccttcaccatcagccaaa

SEQ ID NO: 379309 - DNA, 20 bp, Artificial Sequence
  chemically synthesized
ccttcaccatcagccaaaga

SEQ ID NO: 379310 - DNA, 20 bp, Artificial Sequence
  chemically synthesized
aggtgacttccagctctctt

SEQ ID NO: 379311 - DNA, 20 bp, Artificial Sequence
  chemically synthesized
caccatcagccaaagagagc

SEQ ID NO: 379312 - DNA, 20 bp, Artificial Sequence
  chemically synthesized
catcagccaaagagagctgg

SEQ ID NO: 379313 - DNA, 20 bp, Artificial Sequence
  chemically synthesized
ttccatttccaggtgacttc

SEQ ID NO: 379314 - DNA, 20 bp, Artificial Sequence
  chemically synthesized
aaagagagctggaagtcacc

SEQ ID NO: 379315 - DNA, 20 bp, Artificial Sequence
  chemically synthesized
agctggaagtcacctggaaa

SEQ ID NO: 379316 - DNA, 20 bp, Artificial Sequence
  chemically synthesized
tgtgccaggcttccatttcc

SEQ ID NO: 379317 - DNA, 20 bp, Artificial Sequence
  chemically synthesized
tggaagtcacctggaaatgg

SEQ ID NO: 379318 - DNA, 20 bp, Artificial Sequence
  chemically synthesized
gtgtgccaggcttccatttc

SEQ ID NO: 379319 - DNA, 20 bp, Artificial Sequence
  chemically synthesized
gtcacctggaaatggaagcc

SEQ ID NO: 379320 - DNA, 20 bp, Artificial Sequence
  chemically synthesized
ctttgtagactgtgtgtgcc

SEQ ID NO: 379321 - DNA, 20 bp, Artificial Sequence
  chemically synthesized
aaatggaagcctggcacaca

SEQ ID NO: 379322 - DNA, 20 bp, Artificial Sequence
  chemically synthesized
cctttgtagactgtgtgtgc

SEQ ID NO: 379323 - DNA, 20 bp, Artificial Sequence
  chemically synthesized
cctggcacacacagtctaca

SEQ ID NO: 379324 - DNA, 20 bp, Artificial Sequence
  chemically synthesized
ctggcacacacagtctacaa

SEQ ID NO: 379325 - DNA, 20 bp, Artificial Sequence
  chemically synthesized
cacacacagtctacaaaggt

SEQ ID NO: 379326 - DNA, 20 bp, Artificial Sequence
  chemically synthesized
cactgggagactgacctttg

SEQ ID NO: 379327 - DNA, 20 bp, Artificial Sequence
  chemically synthesized
gtctacaaaggtcagtctcc

SEQ ID NO: 379328 - DNA, 20 bp, Artificial Sequence
  chemically synthesized
tacaaaggtcagtctcccag

SEQ ID NO: 379329 - DNA, 20 bp, Artificial Sequence
  chemically synthesized
gctctactgtgtaccactgg

SEQ ID NO: 379330 - DNA, 20 bp, Artificial Sequence
  chemically synthesized
ctgctctactgtgtaccact

SEQ ID NO: 379331 - DNA, 20 bp, Artificial Sequence
  chemically synthesized
actgctctactgtgtaccac

SEQ ID NO: 379332 - DNA, 20 bp, Artificial Sequence
  chemically synthesized
gtcagtctcccagtggtaca

SEQ ID NO: 379333 - DNA, 20 bp, Artificial Sequence
  chemically synthesized
agtctcccagtggtacacag

SEQ ID NO: 379334 - DNA, 20 bp, Artificial Sequence
  chemically synthesized
tctcccagtggtacacagta

SEQ ID NO: 379335 - DNA, 20 bp, Artificial Sequence
  chemically synthesized
cccagtggtacacagtagag

SEQ ID NO: 379336 - DNA, 20 bp, Artificial Sequence
  chemically synthesized
gtacacagtagagcagtgta

SEQ ID NO: 379337 - DNA, 20 bp, Artificial Sequence
  chemically synthesized
tacacagtagagcagtgtaa

SEQ ID NO: 379338 - DNA, 20 bp, Artificial Sequence
  chemically synthesized
cacagtagagcagtgtaaag

SEQ ID NO: 379339 - DNA, 20 bp, Artificial Sequence
  chemically synthesized
agagcagtgtaaaggagcca

SEQ ID NO: 379340 - DNA, 20 bp, Artificial Sequence
  chemically synthesized
agcagtgtaaaggagccaaa

SEQ ID NO: 379341 - DNA, 20 bp, Artificial Sequence
  chemically synthesized
gtgccctctggtatactctt

SEQ ID NO: 379342 - DNA, 20 bp, Artificial Sequence
  chemically synthesized
aaaggagccaaagagtatac

SEQ ID NO: 379343 - DNA, 20 bp, Artificial Sequence
  chemically synthesized
aggagccaaagagtatacca

SEQ ID NO: 379344 - DNA, 20 bp, Artificial Sequence
  chemically synthesized
ggagccaaagagtataccag

SEQ ID NO: 379345 - DNA, 20 bp, Artificial Sequence
  chemically synthesized
gagccaaagagtataccaga

SEQ ID NO: 379346 - DNA, 20 bp, Artificial Sequence
  chemically synthesized
gggcccatgtatgtgccctc

SEQ ID NO: 379347 - DNA, 20 bp, Artificial Sequence
  chemically synthesized
tataccagagggcacataca

SEQ ID NO: 379348 - DNA, 20 bp, Artificial Sequence
  chemically synthesized
ataccagagggcacatacat

SEQ ID NO: 379349 - DNA, 20 bp, Artificial Sequence
  chemically synthesized
catacatgggccctgtgacc

SEQ ID NO: 379350 - DNA, 20 bp, Artificial Sequence
  chemically synthesized
agtgggattgctgggtcaca

SEQ ID NO: 379351 - DNA, 20 bp, Artificial Sequence
  chemically synthesized
gagtgggattgctgggtcac

SEQ ID NO: 379352 - DNA, 20 bp, Artificial Sequence
  chemically synthesized
ggagtgggattgctgggtca

SEQ ID NO: 379353 - DNA, 20 bp, Artificial Sequence
  chemically synthesized
catgtaggagtgggattgct

SEQ ID NO: 379354 - DNA, 20 bp, Artificial Sequence
  chemically synthesized
acatgtaggagtgggattgc

SEQ ID NO: 379355 - DNA, 20 bp, Artificial Sequence
  chemically synthesized
ccttgtatacatgtaggagt

SEQ ID NO: 379356 - DNA, 20 bp, Artificial Sequence
  chemically synthesized
tccttgtatacatgtaggag

SEQ ID NO: 379357 - DNA, 20 bp, Artificial Sequence
  chemically synthesized
ggttccttgtatacatgtag

SEQ ID NO: 379358 - DNA, 20 bp, Artificial Sequence
  chemically synthesized
aaggttccttgtatacatgt

SEQ ID NO: 379359 - DNA, 20 bp, Artificial Sequence
  chemically synthesized
caaggttccttgtatacatg

SEQ ID NO: 379360 - DNA, 20 bp, Artificial Sequence
  chemically synthesized
tcccactcctacatgtatac

SEQ ID NO: 379361 - DNA, 20 bp, Artificial Sequence
  chemically synthesized
cccactcctacatgtataca

SEQ ID NO: 379362 - DNA, 20 bp, Artificial Sequence
  chemically synthesized
ttcttttcctattacaaaca

SEQ ID NO: 379363 - DNA, 20 bp, Artificial Sequence
  chemically synthesized
attcttttcctattacaaac

SEQ ID NO: 379364 - DNA, 20 bp, Artificial Sequence
  chemically synthesized
acaaggaaccttgtttgtaa

SEQ ID NO: 379365 - DNA, 20 bp, Artificial Sequence
  chemically synthesized
caaggaaccttgtttgtaat

SEQ ID NO: 379366 - DNA, 20 bp, Artificial Sequence
  chemically synthesized
aaccttgtttgtaataggaa

SEQ ID NO: 379367 - DNA, 20 bp, Artificial Sequence
  chemically synthesized
aataggaaaagaattaaaac

SEQ ID NO: 379368 - DNA, 20 bp, Artificial Sequence
  chemically synthesized
atggatactagggtcgtttc

SEQ ID NO: 379369 - DNA, 20 bp, Artificial Sequence
  chemically synthesized
attaaaactggaaacgaccc

SEQ ID NO: 379370 - DNA, 20 bp, Artificial Sequence
  chemically synthesized
actactgttgatggatacta

SEQ ID NO: 379371 - DNA, 20 bp, Artificial Sequence
  chemically synthesized
tactactgttgatggatact

SEQ ID NO: 379372 - DNA, 20 bp, Artificial Sequence
  chemically synthesized
atactactgttgatggatac

SEQ ID NO: 379373 - DNA, 20 bp, Artificial Sequence
  chemically synthesized
acgaccctagtatccatcaa

SEQ ID NO: 379374 - DNA, 20 bp, Artificial Sequence
  chemically synthesized
accctagtatccatcaacag

SEQ ID NO: 379375 - DNA, 20 bp, Artificial Sequence
  chemically synthesized
tttatgcatactactgttga

SEQ ID NO: 379376 - DNA, 20 bp, Artificial Sequence
  chemically synthesized
tagtatgcataaataaattg

SEQ ID NO: 379377 - DNA, 20 bp, Artificial Sequence
  chemically synthesized
agtatgcataaataaattgt

SEQ ID NO: 379378 - DNA, 20 bp, Artificial Sequence
  chemically synthesized
attgtgggttatttctatga

SEQ ID NO: 379379 - DNA, 20 bp, Artificial Sequence
  chemically synthesized
cattatgtcatattccgtca

SEQ ID NO: 379380 - DNA, 20 bp, Artificial Sequence
  chemically synthesized
cggaatatgacataatgctg

SEQ ID NO: 379381 - DNA, 20 bp, Artificial Sequence
  chemically synthesized
atgacataatgctgcagtca

SEQ ID NO: 379382 - DNA, 20 bp, Artificial Sequence
  chemically synthesized
ttcatccatgtctgtgactg

SEQ ID NO: 379383 - DNA, 20 bp, Artificial Sequence
  chemically synthesized
taatgctgcagtcacagaca

SEQ ID NO: 379384 - DNA, 20 bp, Artificial Sequence
  chemically synthesized
tcacagacatggatgaatct

SEQ ID NO: 379385 - DNA, 20 bp, Artificial Sequence
  chemically synthesized
tcaatcagcattatgttgct

SEQ ID NO: 379386 - DNA, 20 bp, Artificial Sequence
  chemically synthesized
agcaacataatgctgattga

SEQ ID NO: 379387 - DNA, 20 bp, Artificial Sequence
  chemically synthesized
ctgtgactgtttctttcaat

SEQ ID NO: 379388 - DNA, 20 bp, Artificial Sequence
  chemically synthesized
ataatgctgattgaaagaaa

SEQ ID NO: 379389 - DNA, 20 bp, Artificial Sequence
  chemically synthesized
ctgattgaaagaaacagtca

SEQ ID NO: 379390 - DNA, 20 bp, Artificial Sequence
  chemically synthesized
attgaaagaaacagtcacag

SEQ ID NO: 379391 - DNA, 20 bp, Artificial Sequence
  chemically synthesized
gcttttgaacttcgtatagt

SEQ ID NO: 379392 - DNA, 20 bp, Artificial Sequence
  chemically synthesized
aatatgattccaactatacg

SEQ ID NO: 379393 - DNA, 20 bp, Artificial Sequence
  chemically synthesized
gcatgcttttgaacttcgta

SEQ ID NO: 379394 - DNA, 20 bp, Artificial Sequence
  chemically synthesized
tccaactatacgaagttcaa

SEQ ID NO: 379395 - DNA, 20 bp, Artificial Sequence
  chemically synthesized
atacgaagttcaaaagcatg

SEQ ID NO: 379396 - DNA, 20 bp, Artificial Sequence
  chemically synthesized
acgaagttcaaaagcatgca

SEQ ID NO: 379397 - DNA, 20 bp, Artificial Sequence
  chemically synthesized
agttcaaaagcatgcagagc

SEQ ID NO: 379398 - DNA, 20 bp, Artificial Sequence
  chemically synthesized
atgtattactaaaagagaaa

SEQ ID NO: 379399 - DNA, 20 bp, Artificial Sequence
  chemically synthesized
gagcaagactatttctcttt

SEQ ID NO: 379400 - DNA, 20 bp, Artificial Sequence
  chemically synthesized
atatatatgtattactaaaa

SEQ ID NO: 379401 - DNA, 20 bp, Artificial Sequence
  chemically synthesized
acatatatatgtattactaa

SEQ ID NO: 379402 - DNA, 20 bp, Artificial Sequence
  chemically synthesized
tttagtaatacatatatatg

SEQ ID NO: 379403 - DNA, 20 bp, Artificial Sequence
  chemically synthesized
gtaatacatatatatgtagc

SEQ ID NO: 379404 - DNA, 20 bp, Artificial Sequence
  chemically synthesized
tgtagcaagactataaaaca

SEQ ID NO: 379405 - DNA, 20 bp, Artificial Sequence
  chemically synthesized
gtgaaatttgctttgtttta

SEQ ID NO: 379406 - DNA, 20 bp, Artificial Sequence
  chemically synthesized
actaccaccagagataacgg

SEQ ID NO: 379407 - DNA, 20 bp, Artificial Sequence
  chemically synthesized
ttcacgaccaccgttatctc

SEQ ID NO: 379408 - DNA, 20 bp, Artificial Sequence
  chemically synthesized
cccactaccaccagagataa

SEQ ID NO: 379409 - DNA, 20 bp, Artificial Sequence
  chemically synthesized
acgaccaccgttatctctgg

SEQ ID NO: 379410 - DNA, 20 bp, Artificial Sequence
  chemically synthesized
accaccgttatctctggtgg

SEQ ID NO: 379411 - DNA, 20 bp, Artificial Sequence
  chemically synthesized
tcgcttccccactaccacca

SEQ ID NO: 379412 - DNA, 20 bp, Artificial Sequence
  chemically synthesized
accgttatctctggtggtag

SEQ ID NO: 379413 - DNA, 20 bp, Artificial Sequence
  chemically synthesized
catcgcttccccactaccac

SEQ ID NO: 379414 - DNA, 20 bp, Artificial Sequence
  chemically synthesized
ccgttatctctggtggtagt

SEQ ID NO: 379415 - DNA, 20 bp, Artificial Sequence
  chemically synthesized
cgttatctctggtggtagtg

SEQ ID NO: 379416 - DNA, 20 bp, Artificial Sequence
  chemically synthesized
tatctctggtggtagtgggg

SEQ ID NO: 379417 - DNA, 20 bp, Artificial Sequence
  chemically synthesized
tggtggtagtggggaagcga

SEQ ID NO: 379418 - DNA, 20 bp, Artificial Sequence
  chemically synthesized
tagtggggaagcgatggaat

SEQ ID NO: 379419 - DNA, 20 bp, Artificial Sequence
  chemically synthesized
gtggggaagcgatggaattg

SEQ ID NO: 379420 - DNA, 20 bp, Artificial Sequence
  chemically synthesized
ggaagcgatggaattggaga

SEQ ID NO: 379421 - DNA, 20 bp, Artificial Sequence
  chemically synthesized
gaagcgatggaattggagat

SEQ ID NO: 379422 - DNA, 20 bp, Artificial Sequence
  chemically synthesized
tggaattggagatgggtaca

SEQ ID NO: 379423 - DNA, 20 bp, Artificial Sequence
  chemically synthesized
attggagatgggtacataga

SEQ ID NO: 379424 - DNA, 20 bp, Artificial Sequence
  chemically synthesized
atgggtacatagatggcttc

SEQ ID NO: 379425 - DNA, 20 bp, Artificial Sequence
  chemically synthesized
gaattttccacagtaacttg

SEQ ID NO: 379426 - DNA, 20 bp, Artificial Sequence
  chemically synthesized
tagatggcttcaagttactg

SEQ ID NO: 379427 - DNA, 20 bp, Artificial Sequence
  chemically synthesized
ttattacttcgaattttcca

SEQ ID NO: 379428 - DNA, 20 bp, Artificial Sequence
  chemically synthesized
aagttactgtggaaaattcg

SEQ ID NO: 379429 - DNA, 20 bp, Artificial Sequence
  chemically synthesized
ttcgaagtaataaacacatt

SEQ ID NO: 379430 - DNA, 20 bp, Artificial Sequence
  chemically synthesized
acaaaagattttaagacata

SEQ ID NO: 379431 - DNA, 20 bp, Artificial Sequence
  chemically synthesized
acataagaacaaaagatttt

SEQ ID NO: 379432 - DNA, 20 bp, Artificial Sequence
  chemically synthesized
atcttattacataagaacaa

SEQ ID NO: 379433 - DNA, 20 bp, Artificial Sequence
  chemically synthesized
atcttttgttcttatgtaat

SEQ ID NO: 379434 - DNA, 20 bp, Artificial Sequence
  chemically synthesized
ttaaaaatatcttattacat

SEQ ID NO: 379435 - DNA, 20 bp, Artificial Sequence
  chemically synthesized
atgtaataagatatttttaa

SEQ ID NO: 379436 - DNA, 20 bp, Artificial Sequence
  chemically synthesized
aataagatatttttaaaaga

SEQ ID NO: 379437 - DNA, 20 bp, Artificial Sequence
  chemically synthesized
cagatacatgtttaactgat

SEQ ID NO: 379438 - DNA, 20 bp, Artificial Sequence
  chemically synthesized
tacatgtttaactgattggc

SEQ ID NO: 379439 - DNA, 20 bp, Artificial Sequence
  chemically synthesized
tgttatactaacttgccaat

SEQ ID NO: 379440 - DNA, 20 bp, Artificial Sequence
  chemically synthesized
tgtttaactgattggcaagt

SEQ ID NO: 379441 - DNA, 20 bp, Artificial Sequence
  chemically synthesized
gtataacaacatcaacctaa

SEQ ID NO: 379442 - DNA, 20 bp, Artificial Sequence
  chemically synthesized
aaataaacttaatttctttt

SEQ ID NO: 379443 - DNA, 20 bp, Artificial Sequence
  chemically synthesized
aaaataaacttaatttcttt

SEQ ID NO: 379444 - DNA, 20 bp, Artificial Sequence
  chemically synthesized
acatcaacctaaaagaaatt

SEQ ID NO: 379445 - DNA, 20 bp, Artificial Sequence
  chemically synthesized
ttttgttttttaaatctgaa

SEQ ID NO: 379446 - DNA, 20 bp, Artificial Sequence
  chemically synthesized
gctgaaagggaaatgctttt

SEQ ID NO: 379447 - DNA, 20 bp, Artificial Sequence
  chemically synthesized
tctgaaaagcatttcccttt

SEQ ID NO: 379448 - DNA, 20 bp, Artificial Sequence
  chemically synthesized
agaaacccagcaagctgaaa

SEQ ID NO: 379449 - DNA, 20 bp, Artificial Sequence
  chemically synthesized
aagaaacccagcaagctgaa

SEQ ID NO: 379450 - DNA, 20 bp, Artificial Sequence
  chemically synthesized
caagaaacccagcaagctga

SEQ ID NO: 379451 - DNA, 20 bp, Artificial Sequence
  chemically synthesized
gcatttccctttcagcttgc

SEQ ID NO: 379452 - DNA, 20 bp, Artificial Sequence
  chemically synthesized
catttccctttcagcttgct

SEQ ID NO: 379453 - DNA, 20 bp, Artificial Sequence
  chemically synthesized
tttagtgcaagaaacccagc

SEQ ID NO: 379454 - DNA, 20 bp, Artificial Sequence
  chemically synthesized
atcttttagtgcaagaaacc

SEQ ID NO: 379455 - DNA, 20 bp, Artificial Sequence
  chemically synthesized
tgctgggtttcttgcactaa

SEQ ID NO: 379456 - DNA, 20 bp, Artificial Sequence
  chemically synthesized
aaaccctcatcttttagtgc

SEQ ID NO: 379457 - DNA, 20 bp, Artificial Sequence
  chemically synthesized
ggtttcttgcactaaaagat

SEQ ID NO: 379458 - DNA, 20 bp, Artificial Sequence
  chemically synthesized
gtttcttgcactaaaagatg

SEQ ID NO: 379459 - DNA, 20 bp, Artificial Sequence
  chemically synthesized
attattaaaccctcatcttt

SEQ ID NO: 379460 - DNA, 20 bp, Artificial Sequence
  chemically synthesized
tttcttgcactaaaagatga

SEQ ID NO: 379461 - DNA, 20 bp, Artificial Sequence
  chemically synthesized
agatgagggtttaataatca

SEQ ID NO: 379462 - DNA, 20 bp, Artificial Sequence
  chemically synthesized
tgagggtttaataatcatag

SEQ ID NO: 379463 - DNA, 20 bp, Artificial Sequence
  chemically synthesized
gtttaataatcatagcagat

SEQ ID NO: 379464 - DNA, 20 bp, Artificial Sequence
  chemically synthesized
ttaataatcatagcagatca

SEQ ID NO: 379465 - DNA, 20 bp, Artificial Sequence
  chemically synthesized
taataatcatagcagatcag

SEQ ID NO: 379466 - DNA, 20 bp, Artificial Sequence
  chemically synthesized
tcatagcagatcagaggctt

SEQ ID NO: 379467 - DNA, 20 bp, Artificial Sequence
  chemically synthesized
tagcagatcagaggcttcag

SEQ ID NO: 379468 - DNA, 20 bp, Artificial Sequence
  chemically synthesized
agcagatcagaggcttcagt

SEQ ID NO: 379469 - DNA, 20 bp, Artificial Sequence
  chemically synthesized
gcagatcagaggcttcagta

SEQ ID NO: 379470 - DNA, 20 bp, Artificial Sequence
  chemically synthesized
agatcagaggcttcagtagg

SEQ ID NO: 379471 - DNA, 20 bp, Artificial Sequence
  chemically synthesized
atcccatctcctccctactg

SEQ ID NO: 379472 - DNA, 20 bp, Artificial Sequence
  chemically synthesized
gatcagaggcttcagtaggg

SEQ ID NO: 379473 - DNA, 20 bp, Artificial Sequence
  chemically synthesized
tcagaggcttcagtagggag

SEQ ID NO: 379474 - DNA, 20 bp, Artificial Sequence
  chemically synthesized
aggcttcagtagggaggaga

SEQ ID NO: 379475 - DNA, 20 bp, Artificial Sequence
  chemically synthesized
ggcttcagtagggaggagat

SEQ ID NO: 379476 - DNA, 20 bp, Artificial Sequence
  chemically synthesized
tcagtagggaggagatggga

SEQ ID NO: 379477 - DNA, 20 bp, Artificial Sequence
  chemically synthesized
ggaaaatcgtttttcacaat

SEQ ID NO: 379478 - DNA, 20 bp, Artificial Sequence
  chemically synthesized
gtgaaaaacgattttccccc

SEQ ID NO: 379479 - DNA, 20 bp, Artificial Sequence
  chemically synthesized
ggggccacttttaaactagg

SEQ ID NO: 379480 - DNA, 20 bp, Artificial Sequence
  chemically synthesized
aggggccacttttaaactag

SEQ ID NO: 379481 - DNA, 20 bp, Artificial Sequence
  chemically synthesized
caggggccacttttaaacta

SEQ ID NO: 379482 - DNA, 20 bp, Artificial Sequence
  chemically synthesized
cgattttccccctagtttaa

SEQ ID NO: 379483 - DNA, 20 bp, Artificial Sequence
  chemically synthesized
ccaggggccacttttaaact

SEQ ID NO: 379484 - DNA, 20 bp, Artificial Sequence
  chemically synthesized
accaggggccacttttaaac

SEQ ID NO: 379485 - DNA, 20 bp, Artificial Sequence
  chemically synthesized
ttttccccctagtttaaaag

SEQ ID NO: 379486 - DNA, 20 bp, Artificial Sequence
  chemically synthesized
cctagtttaaaagtggcccc

SEQ ID NO: 379487 - DNA, 20 bp, Artificial Sequence
  chemically synthesized
ttcaagaaaaatgttaccag

SEQ ID NO: 379488 - DNA, 20 bp, Artificial Sequence
  chemically synthesized
cttcaagaaaaatgttacca

SEQ ID NO: 379489 - DNA, 20 bp, Artificial Sequence
  chemically synthesized
gcttcaagaaaaatgttacc

SEQ ID NO: 379490 - DNA, 20 bp, Artificial Sequence
  chemically synthesized
agcttcaagaaaaatgttac

SEQ ID NO: 379491 - DNA, 20 bp, Artificial Sequence
  chemically synthesized
ccctggtaacatttttcttg

SEQ ID NO: 379492 - DNA, 20 bp, Artificial Sequence
  chemically synthesized
tatatataactagaagcttc

SEQ ID NO: 379493 - DNA, 20 bp, Artificial Sequence
  chemically synthesized
aacatttttcttgaagcttc

SEQ ID NO: 379494 - DNA, 20 bp, Artificial Sequence
  chemically synthesized
acaacgatatatataactag

SEQ ID NO: 379495 - DNA, 20 bp, Artificial Sequence
  chemically synthesized
ctgacaacgatatatataac

SEQ ID NO: 379496 - DNA, 20 bp, Artificial Sequence
  chemically synthesized
ctagttatatatatcgttgt

SEQ ID NO: 379497 - DNA, 20 bp, Artificial Sequence
  chemically synthesized
actgtttcttcaaagttgca

SEQ ID NO: 379498 - DNA, 20 bp, Artificial Sequence
  chemically synthesized
tcagtcactttgcaactttg

SEQ ID NO: 379499 - DNA, 20 bp, Artificial Sequence
  chemically synthesized
gcaggaaaactgtttcttca

SEQ ID NO: 379500 - DNA, 20 bp, Artificial Sequence
  chemically synthesized
actttgcaactttgaagaaa

SEQ ID NO: 379501 - DNA, 20 bp, Artificial Sequence
  chemically synthesized
aagaaacagttttcctgccg

SEQ ID NO: 379502 - DNA, 20 bp, Artificial Sequence
  chemically synthesized
agaaacagttttcctgccga

SEQ ID NO: 379503 - DNA, 20 bp, Artificial Sequence
  chemically synthesized
gaaacagttttcctgccgaa

SEQ ID NO: 379504 - DNA, 20 bp, Artificial Sequence
  chemically synthesized
ctataatagagcccttcggc

SEQ ID NO: 379505 - DNA, 20 bp, Artificial Sequence
  chemically synthesized
actataatagagcccttcgg

SEQ ID NO: 379506 - DNA, 20 bp, Artificial Sequence
  chemically synthesized
ttaactataatagagccctt

SEQ ID NO: 379507 - DNA, 20 bp, Artificial Sequence
  chemically synthesized
cctgccgaagggctctatta

SEQ ID NO: 379508 - DNA, 20 bp, Artificial Sequence
  chemically synthesized
gacacatattaactataata

SEQ ID NO: 379509 - DNA, 20 bp, Artificial Sequence
  chemically synthesized
tagacacatattaactataa

SEQ ID NO: 379510 - DNA, 20 bp, Artificial Sequence
  chemically synthesized
aaatgactttttgtattatg

SEQ ID NO: 379511 - DNA, 20 bp, Artificial Sequence
  chemically synthesized
atgtgtctacataatacaaa

SEQ ID NO: 379512 - DNA, 20 bp, Artificial Sequence
  chemically synthesized
catttaaaaattattgcttt

SEQ ID NO: 379513 - DNA, 20 bp, Artificial Sequence
  chemically synthesized
cactcaataaatagttctta

SEQ ID NO: 379514 - DNA, 20 bp, Artificial Sequence
  chemically synthesized
tgctttaagaactatttatt

SEQ ID NO: 379515 - DNA, 20 bp, Artificial Sequence
  chemically synthesized
cttaggaggcactcaataaa

SEQ ID NO: 379516 - DNA, 20 bp, Artificial Sequence
  chemically synthesized
ctatttattgagtgcctcct

SEQ ID NO: 379517 - DNA, 20 bp, Artificial Sequence
  chemically synthesized
tttgatgttatgtacttagg

SEQ ID NO: 379518 - DNA, 20 bp, Artificial Sequence
  chemically synthesized
gtttgatgttatgtacttag

SEQ ID NO: 379519 - DNA, 20 bp, Artificial Sequence
  chemically synthesized
cagtttgatgttatgtactt

SEQ ID NO: 379520 - DNA, 20 bp, Artificial Sequence
  chemically synthesized
acagtttgatgttatgtact

SEQ ID NO: 379521 - DNA, 20 bp, Artificial Sequence
  chemically synthesized
gcaagtccactttaaattca

SEQ ID NO: 379522 - DNA, 20 bp, Artificial Sequence
  chemically synthesized
aacatcaaactgtgaattta

SEQ ID NO: 379523 - DNA, 20 bp, Artificial Sequence
  chemically synthesized
atcaaactgtgaatttaaag

SEQ ID NO: 379524 - DNA, 20 bp, Artificial Sequence
  chemically synthesized
aaattttgattaaattatgc

SEQ ID NO: 379525 - DNA, 20 bp, Artificial Sequence
  chemically synthesized
atttaatcaaaatttatact

SEQ ID NO: 379526 - DNA, 20 bp, Artificial Sequence
  chemically synthesized
tttaatcaaaatttatacta

SEQ ID NO: 379527 - DNA, 20 bp, Artificial Sequence
  chemically synthesized
aaaatttatactaaggaaaa

SEQ ID NO: 379528 - DNA, 20 bp, Artificial Sequence
  chemically synthesized
gccctatagcctgttttcct

SEQ ID NO: 379529 - DNA, 20 bp, Artificial Sequence
  chemically synthesized
aaatttatactaaggaaaac

SEQ ID NO: 379530 - DNA, 20 bp, Artificial Sequence
  chemically synthesized
atactaaggaaaacaggcta

SEQ ID NO: 379531 - DNA, 20 bp, Artificial Sequence
  chemically synthesized
tactaaggaaaacaggctat

SEQ ID NO: 379532 - DNA, 20 bp, Artificial Sequence
  chemically synthesized
actaaggaaaacaggctata

SEQ ID NO: 379533 - DNA, 20 bp, Artificial Sequence
  chemically synthesized
tgtagtatcgaaaagcccta

SEQ ID NO: 379534 - DNA, 20 bp, Artificial Sequence
  chemically synthesized
tcaggtattgtagtatcgaa

SEQ ID NO: 379535 - DNA, 20 bp, Artificial Sequence
  chemically synthesized
atttcatttttcaggtattg

SEQ ID NO: 379536 - DNA, 20 bp, Artificial Sequence
  chemically synthesized
actgtagtatttcatttttc

SEQ ID NO: 379537 - DNA, 20 bp, Artificial Sequence
  chemically synthesized
aactgtagtatttcattttt

SEQ ID NO: 379538 - DNA, 20 bp, Artificial Sequence
  chemically synthesized
acctgaaaaatgaaatacta

SEQ ID NO: 379539 - DNA, 20 bp, Artificial Sequence
  chemically synthesized
tatcatgtggattataactg

SEQ ID NO: 379540 - DNA, 20 bp, Artificial Sequence
  chemically synthesized
gtttcatacctggtatcatg

SEQ ID NO: 379541 - DNA, 20 bp, Artificial Sequence
  chemically synthesized
agttataatccacatgatac

SEQ ID NO: 379542 - DNA, 20 bp, Artificial Sequence
  chemically synthesized
gttataatccacatgatacc

SEQ ID NO: 379543 - DNA, 20 bp, Artificial Sequence
  chemically synthesized
gctactgaatgtttcatacc

SEQ ID NO: 379544 - DNA, 20 bp, Artificial Sequence
  chemically synthesized
gataccaggtatgaaacatt

SEQ ID NO: 379545 - DNA, 20 bp, Artificial Sequence
  chemically synthesized
accaggtatgaaacattcag

SEQ ID NO: 379546 - DNA, 20 bp, Artificial Sequence
  chemically synthesized
aggtatgaaacattcagtag

SEQ ID NO: 379547 - DNA, 20 bp, Artificial Sequence
  chemically synthesized
tatgaaacattcagtagcag

SEQ ID NO: 379548 - DNA, 20 bp, Artificial Sequence
  chemically synthesized
atgaaacattcagtagcagt

SEQ ID NO: 379549 - DNA, 20 bp, Artificial Sequence
  chemically synthesized
aacattcagtagcagtgggc

SEQ ID NO: 379550 - DNA, 20 bp, Artificial Sequence
  chemically synthesized
cattcagtagcagtgggcta

SEQ ID NO: 379551 - DNA, 20 bp, Artificial Sequence
  chemically synthesized
gtagcagtgggctagagcta

SEQ ID NO: 379552 - DNA, 20 bp, Artificial Sequence
  chemically synthesized
tagcagtgggctagagctac

SEQ ID NO: 379553 - DNA, 20 bp, Artificial Sequence
  chemically synthesized
aagaaggtaacctgtagctc

SEQ ID NO: 379554 - DNA, 20 bp, Artificial Sequence
  chemically synthesized
tgtctcaagaaggtaacctg

SEQ ID NO: 379555 - DNA, 20 bp, Artificial Sequence
  chemically synthesized
gagctacaggttaccttctt

SEQ ID NO: 379556 - DNA, 20 bp, Artificial Sequence
  chemically synthesized
tttgacaacgtgtctcaaga

SEQ ID NO: 379557 - DNA, 20 bp, Artificial Sequence
  chemically synthesized
ctttgacaacgtgtctcaag

SEQ ID NO: 379558 - DNA, 20 bp, Artificial Sequence
  chemically synthesized
cttctttgacaacgtgtctc

SEQ ID NO: 379559 - DNA, 20 bp, Artificial Sequence
  chemically synthesized
cttcttgagacacgttgtca

SEQ ID NO: 379560 - DNA, 20 bp, Artificial Sequence
  chemically synthesized
cttgagacacgttgtcaaag

SEQ ID NO: 379561 - DNA, 20 bp, Artificial Sequence
  chemically synthesized
cacgttgtcaaagaagacca

SEQ ID NO: 379562 - DNA, 20 bp, Artificial Sequence
  chemically synthesized
gtcaaagaagaccatagcac

SEQ ID NO: 379563 - DNA, 20 bp, Artificial Sequence
  chemically synthesized
tcaaagaagaccatagcact

SEQ ID NO: 379564 - DNA, 20 bp, Artificial Sequence
  chemically synthesized
ttcccaattacctagtgcta

SEQ ID NO: 379565 - DNA, 20 bp, Artificial Sequence
  chemically synthesized
agaccatagcactaggtaat

SEQ ID NO: 379566 - DNA, 20 bp, Artificial Sequence
  chemically synthesized
gaccatagcactaggtaatt

SEQ ID NO: 379567 - DNA, 20 bp, Artificial Sequence
  chemically synthesized
aactggatttcccaattacc

SEQ ID NO: 379568 - DNA, 20 bp, Artificial Sequence
  chemically synthesized
cactaggtaattgggaaatc

SEQ ID NO: 379569 - DNA, 20 bp, Artificial Sequence
  chemically synthesized
aggtaattgggaaatccagt

SEQ ID NO: 379570 - DNA, 20 bp, Artificial Sequence
  chemically synthesized
gtctgctacacagttccaac

SEQ ID NO: 379571 - DNA, 20 bp, Artificial Sequence
  chemically synthesized
gaaatccagttggaactgtg

SEQ ID NO: 379572 - DNA, 20 bp, Artificial Sequence
  chemically synthesized
atccagttggaactgtgtag

SEQ ID NO: 379573 - DNA, 20 bp, Artificial Sequence
  chemically synthesized
agtgggcagtgtctgctaca

SEQ ID NO: 379574 - DNA, 20 bp, Artificial Sequence
  chemically synthesized
aggtaaaccaacagagtggg

SEQ ID NO: 379575 - DNA, 20 bp, Artificial Sequence
  chemically synthesized
gcagacactgcccactctgt

SEQ ID NO: 379576 - DNA, 20 bp, Artificial Sequence
  chemically synthesized
cagaggtaaaccaacagagt

SEQ ID NO: 379577 - DNA, 20 bp, Artificial Sequence
  chemically synthesized
ccagaggtaaaccaacagag

SEQ ID NO: 379578 - DNA, 20 bp, Artificial Sequence
  chemically synthesized
aagccagaggtaaaccaaca

SEQ ID NO: 379579 - DNA, 20 bp, Artificial Sequence
  chemically synthesized
tcaagccagaggtaaaccaa

SEQ ID NO: 379580 - DNA, 20 bp, Artificial Sequence
  chemically synthesized
ccactctgttggtttacctc

SEQ ID NO: 379581 - DNA, 20 bp, Artificial Sequence
  chemically synthesized
tacagggctgatcaagccag

SEQ ID NO: 379582 - DNA, 20 bp, Artificial Sequence
  chemically synthesized
ttacagggctgatcaagcca

SEQ ID NO: 379583 - DNA, 20 bp, Artificial Sequence
  chemically synthesized
tggtttacctctggcttgat

SEQ ID NO: 379584 - DNA, 20 bp, Artificial Sequence
  chemically synthesized
cattacagggctgatcaagc

SEQ ID NO: 379585 - DNA, 20 bp, Artificial Sequence
  chemically synthesized
tctccattacagggctgatc

SEQ ID NO: 379586 - DNA, 20 bp, Artificial Sequence
  chemically synthesized
tggcttgatcagccctgtaa

SEQ ID NO: 379587 - DNA, 20 bp, Artificial Sequence
  chemically synthesized
gcttgatcagccctgtaatg

SEQ ID NO: 379588 - DNA, 20 bp, Artificial Sequence
  chemically synthesized
gcccgagactctccattaca

SEQ ID NO: 379589 - DNA, 20 bp, Artificial Sequence
  chemically synthesized
tgcccgagactctccattac

SEQ ID NO: 379590 - DNA, 20 bp, Artificial Sequence
  chemically synthesized
ttgatcagccctgtaatgga

SEQ ID NO: 379591 - DNA, 20 bp, Artificial Sequence
  chemically synthesized
atgcccgagactctccatta

SEQ ID NO: 379592 - DNA, 20 bp, Artificial Sequence
  chemically synthesized
agccctgtaatggagagtct

SEQ ID NO: 379593 - DNA, 20 bp, Artificial Sequence
  chemically synthesized
gccctgtaatggagagtctc

SEQ ID NO: 379594 - DNA, 20 bp, Artificial Sequence
  chemically synthesized
ggtgggctgttagcatgccc

SEQ ID NO: 379595 - DNA, 20 bp, Artificial Sequence
  chemically synthesized
gagagtctcgggcatgctaa

SEQ ID NO: 379596 - DNA, 20 bp, Artificial Sequence
  chemically synthesized
tgcttgacctggtgggctgt

SEQ ID NO: 379597 - DNA, 20 bp, Artificial Sequence
  chemically synthesized
cgggcatgctaacagcccac

SEQ ID NO: 379598 - DNA, 20 bp, Artificial Sequence
  chemically synthesized
gggcatgctaacagcccacc

SEQ ID NO: 379599 - DNA, 20 bp, Artificial Sequence
  chemically synthesized
cagtgggtgcttgacctggt

SEQ ID NO: 379600 - DNA, 20 bp, Artificial Sequence
  chemically synthesized
tgctaacagcccaccaggtc

SEQ ID NO: 379601 - DNA, 20 bp, Artificial Sequence
  chemically synthesized
gcagtgggtgcttgacctgg

SEQ ID NO: 379602 - DNA, 20 bp, Artificial Sequence
  chemically synthesized
gaagcagtgggtgcttgacc

SEQ ID NO: 379603 - DNA, 20 bp, Artificial Sequence
  chemically synthesized
ctgaaacacagagaagcagt

SEQ ID NO: 379604 - DNA, 20 bp, Artificial Sequence
  chemically synthesized
gctgaaacacagagaagcag

SEQ ID NO: 379605 - DNA, 20 bp, Artificial Sequence
  chemically synthesized
gaggctgaaacacagagaag

SEQ ID NO: 379606 - DNA, 20 bp, Artificial Sequence
  chemically synthesized
cgtgaggctgaaacacagag

SEQ ID NO: 379607 - DNA, 20 bp, Artificial Sequence
  chemically synthesized
cccactgcttctctgtgttt

SEQ ID NO: 379608 - DNA, 20 bp, Artificial Sequence
  chemically synthesized
agtcgtgaggctgaaacaca

SEQ ID NO: 379609 - DNA, 20 bp, Artificial Sequence
  chemically synthesized
aaagtcgtgaggctgaaaca

SEQ ID NO: 379610 - DNA, 20 bp, Artificial Sequence
  chemically synthesized
taactttggacaaagtcgtg

SEQ ID NO: 379611 - DNA, 20 bp, Artificial Sequence
  chemically synthesized
ataactttggacaaagtcgt

SEQ ID NO: 379612 - DNA, 20 bp, Artificial Sequence
  chemically synthesized
cagcctcacgactttgtcca

SEQ ID NO: 379613 - DNA, 20 bp, Artificial Sequence
  chemically synthesized
agtttctataactttggaca

SEQ ID NO: 379614 - DNA, 20 bp, Artificial Sequence
  chemically synthesized
cacgactttgtccaaagtta

SEQ ID NO: 379615 - DNA, 20 bp, Artificial Sequence
  chemically synthesized
tgagtgagtttctataactt

SEQ ID NO: 379616 - DNA, 20 bp, Artificial Sequence
  chemically synthesized
ctcctgtgtgttggatgagt

SEQ ID NO: 379617 - DNA, 20 bp, Artificial Sequence
  chemically synthesized
tcccctcctgtgtgttggat

SEQ ID NO: 379618 - DNA, 20 bp, Artificial Sequence
  chemically synthesized
aaactcactcatccaacaca

SEQ ID NO: 379619 - DNA, 20 bp, Artificial Sequence
  chemically synthesized
aactcactcatccaacacac

SEQ ID NO: 379620 - DNA, 20 bp, Artificial Sequence
  chemically synthesized
tcaggtcccctcctgtgtgt

SEQ ID NO: 379621 - DNA, 20 bp, Artificial Sequence
  chemically synthesized
ctcactcatccaacacacag

SEQ ID NO: 379622 - DNA, 20 bp, Artificial Sequence
  chemically synthesized
tcactcatccaacacacagg

SEQ ID NO: 379623 - DNA, 20 bp, Artificial Sequence
  chemically synthesized
cactcatccaacacacagga

SEQ ID NO: 379624 - DNA, 20 bp, Artificial Sequence
  chemically synthesized
actcatccaacacacaggag

SEQ ID NO: 379625 - DNA, 20 bp, Artificial Sequence
  chemically synthesized
aattatttctcagggacatc

SEQ ID NO: 379626 - DNA, 20 bp, Artificial Sequence
  chemically synthesized
taattatttctcagggacat

SEQ ID NO: 379627 - DNA, 20 bp, Artificial Sequence
  chemically synthesized
ggaggggacctgatgtccct

SEQ ID NO: 379628 - DNA, 20 bp, Artificial Sequence
  chemically synthesized
gcctcattaattatttctca

SEQ ID NO: 379629 - DNA, 20 bp, Artificial Sequence
  chemically synthesized
tgcctcattaattatttctc

SEQ ID NO: 379630 - DNA, 20 bp, Artificial Sequence
  chemically synthesized
gtgcctcattaattatttct

SEQ ID NO: 379631 - DNA, 20 bp, Artificial Sequence
  chemically synthesized
gtccctgagaaataattaat

SEQ ID NO: 379632 - DNA, 20 bp, Artificial Sequence
  chemically synthesized
tccctgagaaataattaatg

SEQ ID NO: 379633 - DNA, 20 bp, Artificial Sequence
  chemically synthesized
gagaaataattaatgaggca

SEQ ID NO: 379634 - DNA, 20 bp, Artificial Sequence
  chemically synthesized
agaaataattaatgaggcac

SEQ ID NO: 379635 - DNA, 20 bp, Artificial Sequence
  chemically synthesized
aattaatgaggcacaggaac

SEQ ID NO: 379636 - DNA, 20 bp, Artificial Sequence
  chemically synthesized
ttaatgaggcacaggaacca

SEQ ID NO: 379637 - DNA, 20 bp, Artificial Sequence
  chemically synthesized
gaggctggggaatatgtctc

SEQ ID NO: 379638 - DNA, 20 bp, Artificial Sequence
  chemically synthesized
ggaaccagagacatattccc

SEQ ID NO: 379639 - DNA, 20 bp, Artificial Sequence
  chemically synthesized
ctctgaagaataagaggctg

SEQ ID NO: 379640 - DNA, 20 bp, Artificial Sequence
  chemically synthesized
cctctgaagaataagaggct

SEQ ID NO: 379641 - DNA, 20 bp, Artificial Sequence
  chemically synthesized
ccctctgaagaataagaggc

SEQ ID NO: 379642 - DNA, 20 bp, Artificial Sequence
  chemically synthesized
ttgtccctctgaagaataag

SEQ ID NO: 379643 - DNA, 20 bp, Artificial Sequence
  chemically synthesized
attgtccctctgaagaataa

SEQ ID NO: 379644 - DNA, 20 bp, Artificial Sequence
  chemically synthesized
ttccccagcctcttattctt

SEQ ID NO: 379645 - DNA, 20 bp, Artificial Sequence
  chemically synthesized
taattgtccctctgaagaat

SEQ ID NO: 379646 - DNA, 20 bp, Artificial Sequence
  chemically synthesized
ccccagcctcttattcttca

SEQ ID NO: 379647 - DNA, 20 bp, Artificial Sequence
  chemically synthesized
cccagcctcttattcttcag

SEQ ID NO: 379648 - DNA, 20 bp, Artificial Sequence
  chemically synthesized
ccagcctcttattcttcaga

SEQ ID NO: 379649 - DNA, 20 bp, Artificial Sequence
  chemically synthesized
tactcataattgtccctctg

SEQ ID NO: 379650 - DNA, 20 bp, Artificial Sequence
  chemically synthesized
ttcttcagagggacaattat

SEQ ID NO: 379651 - DNA, 20 bp, Artificial Sequence
  chemically synthesized
acaattatgagtacattcta

SEQ ID NO: 379652 - DNA, 20 bp, Artificial Sequence
  chemically synthesized
gacccctctgaggaatgctg

SEQ ID NO: 379653 - DNA, 20 bp, Artificial Sequence
  chemically synthesized
gtacattctacagcattcct

SEQ ID NO: 379654 - DNA, 20 bp, Artificial Sequence
  chemically synthesized
acattctacagcattcctca

SEQ ID NO: 379655 - DNA, 20 bp, Artificial Sequence
  chemically synthesized
cattctacagcattcctcag

SEQ ID NO: 379656 - DNA, 20 bp, Artificial Sequence
  chemically synthesized
attctacagcattcctcaga

SEQ ID NO: 379657 - DNA, 20 bp, Artificial Sequence
  chemically synthesized
ttctacagcattcctcagag

SEQ ID NO: 379658 - DNA, 20 bp, Artificial Sequence
  chemically synthesized
atcctgtgaagacccctctg

SEQ ID NO: 379659 - DNA, 20 bp, Artificial Sequence
  chemically synthesized
aatcctgtgaagacccctct

SEQ ID NO: 379660 - DNA, 20 bp, Artificial Sequence
  chemically synthesized
attcctcagaggggtcttca

SEQ ID NO: 379661 - DNA, 20 bp, Artificial Sequence
  chemically synthesized
ttcctcagaggggtcttcac

SEQ ID NO: 379662 - DNA, 20 bp, Artificial Sequence
  chemically synthesized
aactgttgttcaatcctgtg

SEQ ID NO: 379663 - DNA, 20 bp, Artificial Sequence
  chemically synthesized
gtcttcacaggattgaacaa

SEQ ID NO: 379664 - DNA, 20 bp, Artificial Sequence
  chemically synthesized
tgaacaacagtttcccactg

SEQ ID NO: 379665 - DNA, 20 bp, Artificial Sequence
  chemically synthesized
acaacagtttcccactgcag

SEQ ID NO: 379666 - DNA, 20 bp, Artificial Sequence
  chemically synthesized
attcagctggctactgcagt

SEQ ID NO: 379667 - DNA, 20 bp, Artificial Sequence
  chemically synthesized
tattcagctggctactgcag

SEQ ID NO: 379668 - DNA, 20 bp, Artificial Sequence
  chemically synthesized
cagtttcccactgcagtagc

SEQ ID NO: 379669 - DNA, 20 bp, Artificial Sequence
  chemically synthesized
tattattcagctggctactg

SEQ ID NO: 379670 - DNA, 20 bp, Artificial Sequence
  chemically synthesized
tagtgagtgtattattcagc

SEQ ID NO: 379671 - DNA, 20 bp, Artificial Sequence
  chemically synthesized
acaatagtgagtgtattatt

SEQ ID NO: 379672 - DNA, 20 bp, Artificial Sequence
  chemically synthesized
aaacgggggaaaacaatagt

SEQ ID NO: 379673 - DNA, 20 bp, Artificial Sequence
  chemically synthesized
ggaaaaacgggggaaaacaa

SEQ ID NO: 379674 - DNA, 20 bp, Artificial Sequence
  chemically synthesized
ggggaagtaaggaaaaacgg

SEQ ID NO: 379675 - DNA, 20 bp, Artificial Sequence
  chemically synthesized
aggggaagtaaggaaaaacg

SEQ ID NO: 379676 - DNA, 20 bp, Artificial Sequence
  chemically synthesized
caggggaagtaaggaaaaac

SEQ ID NO: 379677 - DNA, 20 bp, Artificial Sequence
  chemically synthesized
gcaggggaagtaaggaaaaa

SEQ ID NO: 379678 - DNA, 20 bp, Artificial Sequence
  chemically synthesized
agtgggaggcaggggaagta

SEQ ID NO: 379679 - DNA, 20 bp, Artificial Sequence
  chemically synthesized
aagtgggaggcaggggaagt

SEQ ID NO: 379680 - DNA, 20 bp, Artificial Sequence
  chemically synthesized
gcacaagtgggaggcagggg

SEQ ID NO: 379681 - DNA, 20 bp, Artificial Sequence
  chemically synthesized
ggagcacaagtgggaggcag

SEQ ID NO: 379682 - DNA, 20 bp, Artificial Sequence
  chemically synthesized
gggagcacaagtgggaggca

SEQ ID NO: 379683 - DNA, 20 bp, Artificial Sequence
  chemically synthesized
agggagcacaagtgggaggc

SEQ ID NO: 379684 - DNA, 20 bp, Artificial Sequence
  chemically synthesized
cagggagcacaagtgggagg

SEQ ID NO: 379685 - DNA, 20 bp, Artificial Sequence
  chemically synthesized
tcacagggagcacaagtggg

SEQ ID NO: 379686 - DNA, 20 bp, Artificial Sequence
  chemically synthesized
atcacagggagcacaagtgg

SEQ ID NO: 379687 - DNA, 20 bp, Artificial Sequence
  chemically synthesized
tgatcacagggagcacaagt

SEQ ID NO: 379688 - DNA, 20 bp, Artificial Sequence
  chemically synthesized
ctgatcacagggagcacaag

SEQ ID NO: 379689 - DNA, 20 bp, Artificial Sequence
  chemically synthesized
tagctgatcacagggagcac

SEQ ID NO: 379690 - DNA, 20 bp, Artificial Sequence
  chemically synthesized
atttggtagctgatcacagg

SEQ ID NO: 379691 - DNA, 20 bp, Artificial Sequence
  chemically synthesized
ccacttgtgctccctgtgat

SEQ ID NO: 379692 - DNA, 20 bp, Artificial Sequence
  chemically synthesized
tcatttggtagctgatcaca

SEQ ID NO: 379693 - DNA, 20 bp, Artificial Sequence
  chemically synthesized
ctcatttggtagctgatcac

SEQ ID NO: 379694 - DNA, 20 bp, Artificial Sequence
  chemically synthesized
gctcatttggtagctgatca

SEQ ID NO: 379695 - DNA, 20 bp, Artificial Sequence
  chemically synthesized
cctgtgatcagctaccaaat

SEQ ID NO: 379696 - DNA, 20 bp, Artificial Sequence
  chemically synthesized
agagcaactagctcatttgg

SEQ ID NO: 379697 - DNA, 20 bp, Artificial Sequence
  chemically synthesized
tgatcagctaccaaatgagc

SEQ ID NO: 379698 - DNA, 20 bp, Artificial Sequence
  chemically synthesized
tagagagcaactagctcatt

SEQ ID NO: 379699 - DNA, 20 bp, Artificial Sequence
  chemically synthesized
ggcgaggactagagagcaac

SEQ ID NO: 379700 - DNA, 20 bp, Artificial Sequence
  chemically synthesized
caaatgagctagttgctctc

SEQ ID NO: 379701 - DNA, 20 bp, Artificial Sequence
  chemically synthesized
agcctgaggcgaggactaga

SEQ ID NO: 379702 - DNA, 20 bp, Artificial Sequence
  chemically synthesized
taagcctgaggcgaggacta

SEQ ID NO: 379703 - DNA, 20 bp, Artificial Sequence
  chemically synthesized
gctaagcctgaggcgaggac

SEQ ID NO: 379704 - DNA, 20 bp, Artificial Sequence
  chemically synthesized
ttgctctctagtcctcgcct

SEQ ID NO: 379705 - DNA, 20 bp, Artificial Sequence
  chemically synthesized
tgctctctagtcctcgcctc

SEQ ID NO: 379706 - DNA, 20 bp, Artificial Sequence
  chemically synthesized
taaaagctaagcctgaggcg

SEQ ID NO: 379707 - DNA, 20 bp, Artificial Sequence
  chemically synthesized
ttaaaagctaagcctgaggc

SEQ ID NO: 379708 - DNA, 20 bp, Artificial Sequence
  chemically synthesized
tctagtcctcgcctcaggct

SEQ ID NO: 379709 - DNA, 20 bp, Artificial Sequence
  chemically synthesized
ttctttaaaagctaagcctg

SEQ ID NO: 379710 - DNA, 20 bp, Artificial Sequence
  chemically synthesized
tttctttaaaagctaagcct

SEQ ID NO: 379711 - DNA, 20 bp, Artificial Sequence
  chemically synthesized
tttggatttctttaaaagct

SEQ ID NO: 379712 - DNA, 20 bp, Artificial Sequence
  chemically synthesized
cgcctcaggcttagctttta

SEQ ID NO: 379713 - DNA, 20 bp, Artificial Sequence
  chemically synthesized
cttagtttggatttctttaa

SEQ ID NO: 379714 - DNA, 20 bp, Artificial Sequence
  chemically synthesized
cttttaaagaaatccaaact

SEQ ID NO: 379715 - DNA, 20 bp, Artificial Sequence
  chemically synthesized
tgtcacagtttgtcttagtt

SEQ ID NO: 379716 - DNA, 20 bp, Artificial Sequence
  chemically synthesized
taatttgtcacagtttgtct

SEQ ID NO: 379717 - DNA, 20 bp, Artificial Sequence
  chemically synthesized
gtttggattgtaatttgtca

SEQ ID NO: 379718 - DNA, 20 bp, Artificial Sequence
  chemically synthesized
tgacaaattacaatccaaac

SEQ ID NO: 379719 - DNA, 20 bp, Artificial Sequence
  chemically synthesized
tgagaggaaagaatctcgtt

SEQ ID NO: 379720 - DNA, 20 bp, Artificial Sequence
  chemically synthesized
caaacgagattctttcctct

SEQ ID NO: 379721 - DNA, 20 bp, Artificial Sequence
  chemically synthesized
aaacgagattctttcctctc

SEQ ID NO: 379722 - DNA, 20 bp, Artificial Sequence
  chemically synthesized
taagcatccccctgagagga

SEQ ID NO: 379723 - DNA, 20 bp, Artificial Sequence
  chemically synthesized
aacgagattctttcctctca

SEQ ID NO: 379724 - DNA, 20 bp, Artificial Sequence
  chemically synthesized
acgagattctttcctctcag

SEQ ID NO: 379725 - DNA, 20 bp, Artificial Sequence
  chemically synthesized
cgagattctttcctctcagg

SEQ ID NO: 379726 - DNA, 20 bp, Artificial Sequence
  chemically synthesized
ggactaagcatccccctgag

SEQ ID NO: 379727 - DNA, 20 bp, Artificial Sequence
  chemically synthesized
gggactaagcatccccctga

SEQ ID NO: 379728 - DNA, 20 bp, Artificial Sequence
  chemically synthesized
gggggactaagcatccccct

SEQ ID NO: 379729 - DNA, 20 bp, Artificial Sequence
  chemically synthesized
tttcctctcagggggatgct

SEQ ID NO: 379730 - DNA, 20 bp, Artificial Sequence
  chemically synthesized
tgatgcttgatggggggact

SEQ ID NO: 379731 - DNA, 20 bp, Artificial Sequence
  chemically synthesized
ggatgcttagtccccccatc

SEQ ID NO: 379732 - DNA, 20 bp, Artificial Sequence
  chemically synthesized
tgataatgatgcttgatggg

SEQ ID NO: 379733 - DNA, 20 bp, Artificial Sequence
  chemically synthesized
ttgataatgatgcttgatgg

SEQ ID NO: 379734 - DNA, 20 bp, Artificial Sequence
  chemically synthesized
tttgataatgatgcttgatg

SEQ ID NO: 379735 - DNA, 20 bp, Artificial Sequence
  chemically synthesized
ttttgataatgatgcttgat

SEQ ID NO: 379736 - DNA, 20 bp, Artificial Sequence
  chemically synthesized
attttgataatgatgcttga

SEQ ID NO: 379737 - DNA, 20 bp, Artificial Sequence
  chemically synthesized
catcattatcaaaatgaaca

SEQ ID NO: 379738 - DNA, 20 bp, Artificial Sequence
  chemically synthesized
atcaaaatgaacacagactg

SEQ ID NO: 379739 - DNA, 20 bp, Artificial Sequence
  chemically synthesized
caaaatgaacacagactgca

SEQ ID NO: 379740 - DNA, 20 bp, Artificial Sequence
  chemically synthesized
aaaatgaacacagactgcag

SEQ ID NO: 379741 - DNA, 20 bp, Artificial Sequence
  chemically synthesized
atgaacacagactgcagagg

SEQ ID NO: 379742 - DNA, 20 bp, Artificial Sequence
  chemically synthesized
gcaaatattttcttcctctg

SEQ ID NO: 379743 - DNA, 20 bp, Artificial Sequence
  chemically synthesized
agaaaatatttgccttcact

SEQ ID NO: 379744 - DNA, 20 bp, Artificial Sequence
  chemically synthesized
agtctgactttgctcagtga

SEQ ID NO: 379745 - DNA, 20 bp, Artificial Sequence
  chemically synthesized
gagtctgactttgctcagtg

SEQ ID NO: 379746 - DNA, 20 bp, Artificial Sequence
  chemically synthesized
atatttgccttcactgagca

SEQ ID NO: 379747 - DNA, 20 bp, Artificial Sequence
  chemically synthesized
gtcatgagtctgactttgct

SEQ ID NO: 379748 - DNA, 20 bp, Artificial Sequence
  chemically synthesized
ttgccttcactgagcaaagt

SEQ ID NO: 379749 - DNA, 20 bp, Artificial Sequence
  chemically synthesized
gtctctaacctgagggtcat

SEQ ID NO: 379750 - DNA, 20 bp, Artificial Sequence
  chemically synthesized
aaagtcagactcatgaccct

SEQ ID NO: 379751 - DNA, 20 bp, Artificial Sequence
  chemically synthesized
aagtcagactcatgaccctc

SEQ ID NO: 379752 - DNA, 20 bp, Artificial Sequence
  chemically synthesized
cagactcatgaccctcaggt

SEQ ID NO: 379753 - DNA, 20 bp, Artificial Sequence
  chemically synthesized
tctctgtgtctctaacctga

SEQ ID NO: 379754 - DNA, 20 bp, Artificial Sequence
  chemically synthesized
gactcatgaccctcaggtta

SEQ ID NO: 379755 - DNA, 20 bp, Artificial Sequence
  chemically synthesized
ttctctgtgtctctaacctg

SEQ ID NO: 379756 - DNA, 20 bp, Artificial Sequence
  chemically synthesized
tttctctgtgtctctaacct

SEQ ID NO: 379757 - DNA, 20 bp, Artificial Sequence
  chemically synthesized
tgaccctcaggttagagaca

SEQ ID NO: 379758 - DNA, 20 bp, Artificial Sequence
  chemically synthesized
accctcaggttagagacaca

SEQ ID NO: 379759 - DNA, 20 bp, Artificial Sequence
  chemically synthesized
cagagaaatgcaactaactc

SEQ ID NO: 379760 - DNA, 20 bp, Artificial Sequence
  chemically synthesized
agagaaatgcaactaactct

SEQ ID NO: 379761 - DNA, 20 bp, Artificial Sequence
  chemically synthesized
gagaaatgcaactaactctg

SEQ ID NO: 379762 - DNA, 20 bp, Artificial Sequence
  chemically synthesized
gtacctattcaccccagagt

SEQ ID NO: 379763 - DNA, 20 bp, Artificial Sequence
  chemically synthesized
atctgtacctattcacccca

SEQ ID NO: 379764 - DNA, 20 bp, Artificial Sequence
  chemically synthesized
gcaactaactctggggtgaa

SEQ ID NO: 379765 - DNA, 20 bp, Artificial Sequence
  chemically synthesized
gaatctgtacctattcaccc

SEQ ID NO: 379766 - DNA, 20 bp, Artificial Sequence
  chemically synthesized
caactaactctggggtgaat

SEQ ID NO: 379767 - DNA, 20 bp, Artificial Sequence
  chemically synthesized
aactctggggtgaataggta

SEQ ID NO: 379768 - DNA, 20 bp, Artificial Sequence
  chemically synthesized
ggggtgaataggtacagatt

SEQ ID NO: 379769 - DNA, 20 bp, Artificial Sequence
  chemically synthesized
ggtgaataggtacagattca

SEQ ID NO: 379770 - DNA, 20 bp, Artificial Sequence
  chemically synthesized
gaataggtacagattcagag

SEQ ID NO: 379771 - DNA, 20 bp, Artificial Sequence
  chemically synthesized
aggtacagattcagagtgga

SEQ ID NO: 379772 - DNA, 20 bp, Artificial Sequence
  chemically synthesized
agagtggaaagactttaaaa

SEQ ID NO: 379773 - DNA, 20 bp, Artificial Sequence
  chemically synthesized
aggactttattgctgtttta

SEQ ID NO: 379774 - DNA, 20 bp, Artificial Sequence
  chemically synthesized
aagactttaaaacagcaata

SEQ ID NO: 379775 - DNA, 20 bp, Artificial Sequence
  chemically synthesized
ttaaaacagcaataaagtcc

SEQ ID NO: 379776 - DNA, 20 bp, Artificial Sequence
  chemically synthesized
tgacagctttttttatttct

SEQ ID NO: 379777 - DNA, 20 bp, Artificial Sequence
  chemically synthesized
ctgacagctttttttatttc

SEQ ID NO: 379778 - DNA, 20 bp, Artificial Sequence
  chemically synthesized
taaagtcctagaaataaaaa

SEQ ID NO: 379779 - DNA, 20 bp, Artificial Sequence
  chemically synthesized
ctagaaataaaaaaagctgt

SEQ ID NO: 379780 - DNA, 20 bp, Artificial Sequence
  chemically synthesized
aataaaaaaagctgtcagct

SEQ ID NO: 379781 - DNA, 20 bp, Artificial Sequence
  chemically synthesized
tctggtctgtaccgagctga

SEQ ID NO: 379782 - DNA, 20 bp, Artificial Sequence
  chemically synthesized
aaaaagctgtcagctcggta

SEQ ID NO: 379783 - DNA, 20 bp, Artificial Sequence
  chemically synthesized
ctcaagctctggtctgtacc

SEQ ID NO: 379784 - DNA, 20 bp, Artificial Sequence
  chemically synthesized
gctgtcagctcggtacagac

SEQ ID NO: 379785 - DNA, 20 bp, Artificial Sequence
  chemically synthesized
tgtcagctcggtacagacca

SEQ ID NO: 379786 - DNA, 20 bp, Artificial Sequence
  chemically synthesized
ctcggtacagaccagagctt

SEQ ID NO: 379787 - DNA, 20 bp, Artificial Sequence
  chemically synthesized
gtactcttgctctcaagctc

SEQ ID NO: 379788 - DNA, 20 bp, Artificial Sequence
  chemically synthesized
cggtacagaccagagcttga

SEQ ID NO: 379789 - DNA, 20 bp, Artificial Sequence
  chemically synthesized
acagaccagagcttgagagc

SEQ ID NO: 379790 - DNA, 20 bp, Artificial Sequence
  chemically synthesized
cgcttagtactcttgctctc

SEQ ID NO: 379791 - DNA, 20 bp, Artificial Sequence
  chemically synthesized
agaccagagcttgagagcaa

SEQ ID NO: 379792 - DNA, 20 bp, Artificial Sequence
  chemically synthesized
agcttgagagcaagagtact

SEQ ID NO: 379793 - DNA, 20 bp, Artificial Sequence
  chemically synthesized
atccttttctatgagtcgct

SEQ ID NO: 379794 - DNA, 20 bp, Artificial Sequence
  chemically synthesized
caagagtactaagcgactca

SEQ ID NO: 379795 - DNA, 20 bp, Artificial Sequence
  chemically synthesized
gtactaagcgactcatagaa

SEQ ID NO: 379796 - DNA, 20 bp, Artificial Sequence
  chemically synthesized
tactaagcgactcatagaaa

SEQ ID NO: 379797 - DNA, 20 bp, Artificial Sequence
  chemically synthesized
cctcctgaatccttttctat

SEQ ID NO: 379798 - DNA, 20 bp, Artificial Sequence
  chemically synthesized
gcgactcatagaaaaggatt

SEQ ID NO: 379799 - DNA, 20 bp, Artificial Sequence
  chemically synthesized
cgactcatagaaaaggattc

SEQ ID NO: 379800 - DNA, 20 bp, Artificial Sequence
  chemically synthesized
actcatagaaaaggattcag

SEQ ID NO: 379801 - DNA, 20 bp, Artificial Sequence
  chemically synthesized
ctcatagaaaaggattcagg

SEQ ID NO: 379802 - DNA, 20 bp, Artificial Sequence
  chemically synthesized
tcatagaaaaggattcagga

SEQ ID NO: 379803 - DNA, 20 bp, Artificial Sequence
  chemically synthesized
gaaaaggattcaggagggac

SEQ ID NO: 379804 - DNA, 20 bp, Artificial Sequence
  chemically synthesized
ggattcaggagggaccagca

SEQ ID NO: 379805 - DNA, 20 bp, Artificial Sequence
  chemically synthesized
tgagcctaaagtcgctgtgc

SEQ ID NO: 379806 - DNA, 20 bp, Artificial Sequence
  chemically synthesized
agggaccagcacagcgactt

SEQ ID NO: 379807 - DNA, 20 bp, Artificial Sequence
  chemically synthesized
gggaccagcacagcgacttt

SEQ ID NO: 379808 - DNA, 20 bp, Artificial Sequence
  chemically synthesized
tgcttgttactatgagccta

SEQ ID NO: 379809 - DNA, 20 bp, Artificial Sequence
  chemically synthesized
gcacagcgactttaggctca

SEQ ID NO: 379810 - DNA, 20 bp, Artificial Sequence
  chemically synthesized
aaactgttgcttgttactat

SEQ ID NO: 379811 - DNA, 20 bp, Artificial Sequence
  chemically synthesized
gactttaggctcatagtaac

SEQ ID NO: 379812 - DNA, 20 bp, Artificial Sequence
  chemically synthesized
aggctcatagtaacaagcaa

SEQ ID NO: 379813 - DNA, 20 bp, Artificial Sequence
  chemically synthesized
taacaagcaacagtttgctt

SEQ ID NO: 379814 - DNA, 20 bp, Artificial Sequence
  chemically synthesized
gcaacagtttgctttggcta

SEQ ID NO: 379815 - DNA, 20 bp, Artificial Sequence
  chemically synthesized
ctagtaataaactttagcca

SEQ ID NO: 379816 - DNA, 20 bp, Artificial Sequence
  chemically synthesized
ccacacctagtaataaactt

SEQ ID NO: 379817 - DNA, 20 bp, Artificial Sequence
  chemically synthesized
ctttggctaaagtttattac

SEQ ID NO: 379818 - DNA, 20 bp, Artificial Sequence
  chemically synthesized
tttggctaaagtttattact

SEQ ID NO: 379819 - DNA, 20 bp, Artificial Sequence
  chemically synthesized
ctaaagtttattactaggtg

SEQ ID NO: 379820 - DNA, 20 bp, Artificial Sequence
  chemically synthesized
atctcttgcttgtccacacc

SEQ ID NO: 379821 - DNA, 20 bp, Artificial Sequence
  chemically synthesized
gtttattactaggtgtggac

SEQ ID NO: 379822 - DNA, 20 bp, Artificial Sequence
  chemically synthesized
attactaggtgtggacaagc

SEQ ID NO: 379823 - DNA, 20 bp, Artificial Sequence
  chemically synthesized
tactaggtgtggacaagcaa

SEQ ID NO: 379824 - DNA, 20 bp, Artificial Sequence
  chemically synthesized
gacaagcaagagataaatat

SEQ ID NO: 379825 - DNA, 20 bp, Artificial Sequence
  chemically synthesized
gagataaatatcggaatctg

SEQ ID NO: 379826 - DNA, 20 bp, Artificial Sequence
  chemically synthesized
agataaatatcggaatctgt

SEQ ID NO: 379827 - DNA, 20 bp, Artificial Sequence
  chemically synthesized
aatatcggaatctgtgggta

SEQ ID NO: 379828 - DNA, 20 bp, Artificial Sequence
  chemically synthesized
aaatccaaaggctgtaccca

SEQ ID NO: 379829 - DNA, 20 bp, Artificial Sequence
  chemically synthesized
gaatctgtgggtacagcctt

SEQ ID NO: 379830 - DNA, 20 bp, Artificial Sequence
  chemically synthesized
tgccatggcatgaaatccaa

SEQ ID NO: 379831 - DNA, 20 bp, Artificial Sequence
  chemically synthesized
ttgccatggcatgaaatcca

SEQ ID NO: 379832 - DNA, 20 bp, Artificial Sequence
  chemically synthesized
agcctttggatttcatgcca

SEQ ID NO: 379833 - DNA, 20 bp, Artificial Sequence
  chemically synthesized
tttggatttcatgccatggc

SEQ ID NO: 379834 - DNA, 20 bp, Artificial Sequence
  chemically synthesized
ttggatttcatgccatggca

SEQ ID NO: 379835 - DNA, 20 bp, Artificial Sequence
  chemically synthesized
agatggattttaccttgcca

SEQ ID NO: 379836 - DNA, 20 bp, Artificial Sequence
  chemically synthesized
tctgtttttgatgttgcaga

SEQ ID NO: 379837 - DNA, 20 bp, Artificial Sequence
  chemically synthesized
cctctctgtttttgatgttg

SEQ ID NO: 379838 - DNA, 20 bp, Artificial Sequence
  chemically synthesized
tccatctgcaacatcaaaaa

SEQ ID NO: 379839 - DNA, 20 bp, Artificial Sequence
  chemically synthesized
catctgcaacatcaaaaaca

SEQ ID NO: 379840 - DNA, 20 bp, Artificial Sequence
  chemically synthesized
tctgcaacatcaaaaacaga

SEQ ID NO: 379841 - DNA, 20 bp, Artificial Sequence
  chemically synthesized
ctgcaacatcaaaaacagag

SEQ ID NO: 379842 - DNA, 20 bp, Artificial Sequence
  chemically synthesized
aaacagagaggcatttgcaa

SEQ ID NO: 379843 - DNA, 20 bp, Artificial Sequence
  chemically synthesized
aacagagaggcatttgcaaa

SEQ ID NO: 379844 - DNA, 20 bp, Artificial Sequence
  chemically synthesized
gcatttgcaaaaggaaacat

SEQ ID NO: 379845 - DNA, 20 bp, Artificial Sequence
  chemically synthesized
catttgcaaaaggaaacatg

SEQ ID NO: 379846 - DNA, 20 bp, Artificial Sequence
  chemically synthesized
tttgcaaaaggaaacatgag

SEQ ID NO: 379847 - DNA, 20 bp, Artificial Sequence
  chemically synthesized
aaacatgaggagaatgttcc

SEQ ID NO: 379848 - DNA, 20 bp, Artificial Sequence
  chemically synthesized
catgaggagaatgttcctag

SEQ ID NO: 379849 - DNA, 20 bp, Artificial Sequence
  chemically synthesized
ttattttgggcagtgctgct

SEQ ID NO: 379850 - DNA, 20 bp, Artificial Sequence
  chemically synthesized
gttattttgggcagtgctgc

SEQ ID NO: 379851 - DNA, 20 bp, Artificial Sequence
  chemically synthesized
gtttattgtgttattttggg

SEQ ID NO: 379852 - DNA, 20 bp, Artificial Sequence
  chemically synthesized
ttcgtttattgtgttatttt

SEQ ID NO: 379853 - DNA, 20 bp, Artificial Sequence
  chemically synthesized
tttcgtttattgtgttattt

SEQ ID NO: 379854 - DNA, 20 bp, Artificial Sequence
  chemically synthesized
acaataaacgaaaaatcttc

SEQ ID NO: 379855 - DNA, 20 bp, Artificial Sequence
  chemically synthesized
ataaacgaaaaatcttcgag

SEQ ID NO: 379856 - DNA, 20 bp, Artificial Sequence
  chemically synthesized
gagggcatttgggctgctcg

SEQ ID NO: 379857 - DNA, 20 bp, Artificial Sequence
  chemically synthesized
tttcctgccagagggcattt

SEQ ID NO: 379858 - DNA, 20 bp, Artificial Sequence
  chemically synthesized
ttttcctgccagagggcatt

SEQ ID NO: 379859 - DNA, 20 bp, Artificial Sequence
  chemically synthesized
cgagcagcccaaatgccctc

SEQ ID NO: 379860 - DNA, 20 bp, Artificial Sequence
  chemically synthesized
gcagcccaaatgccctctgg

SEQ ID NO: 379861 - DNA, 20 bp, Artificial Sequence
  chemically synthesized
cagcccaaatgccctctggc

SEQ ID NO: 379862 - DNA, 20 bp, Artificial Sequence
  chemically synthesized
ctgtccattttcctgccaga

SEQ ID NO: 379863 - DNA, 20 bp, Artificial Sequence
  chemically synthesized
actgtccattttcctgccag

SEQ ID NO: 379864 - DNA, 20 bp, Artificial Sequence
  chemically synthesized
aactgtccattttcctgcca

SEQ ID NO: 379865 - DNA, 20 bp, Artificial Sequence
  chemically synthesized
ttaactgtccattttcctgc

SEQ ID NO: 379866 - DNA, 20 bp, Artificial Sequence
  chemically synthesized
aatgccctctggcaggaaaa

SEQ ID NO: 379867 - DNA, 20 bp, Artificial Sequence
  chemically synthesized
ccctctggcaggaaaatgga

SEQ ID NO: 379868 - DNA, 20 bp, Artificial Sequence
  chemically synthesized
ggacagttaacctgattaca

SEQ ID NO: 379869 - DNA, 20 bp, Artificial Sequence
  chemically synthesized
tctttgactactatgtaatc

SEQ ID NO: 379870 - DNA, 20 bp, Artificial Sequence
  chemically synthesized
ttctttgactactatgtaat

SEQ ID NO: 379871 - DNA, 20 bp, Artificial Sequence
  chemically synthesized
cagttaacctgattacatag

SEQ ID NO: 379872 - DNA, 20 bp, Artificial Sequence
  chemically synthesized
acctgattacatagtagtca

SEQ ID NO: 379873 - DNA, 20 bp, Artificial Sequence
  chemically synthesized
atcttgattgttttgtgtag

SEQ ID NO: 379874 - DNA, 20 bp, Artificial Sequence
  chemically synthesized
tttatcttgattgttttgtg

SEQ ID NO: 379875 - DNA, 20 bp, Artificial Sequence
  chemically synthesized
gactgctacacaaaacaatc

SEQ ID NO: 379876 - DNA, 20 bp, Artificial Sequence
  chemically synthesized
aaaacaatcaagataaattc

SEQ ID NO: 379877 - DNA, 20 bp, Artificial Sequence
  chemically synthesized
aaacaatcaagataaattct

SEQ ID NO: 379878 - DNA, 20 bp, Artificial Sequence
  chemically synthesized
aacaatcaagataaattcta

SEQ ID NO: 379879 - DNA, 20 bp, Artificial Sequence
  chemically synthesized
atcaagataaattctaggga

SEQ ID NO: 379880 - DNA, 20 bp, Artificial Sequence
  chemically synthesized
tcaagataaattctagggat

SEQ ID NO: 379881 - DNA, 20 bp, Artificial Sequence
  chemically synthesized
ctcatgcatcatcccatccc

SEQ ID NO: 379882 - DNA, 20 bp, Artificial Sequence
  chemically synthesized
ctagggatgggatgatgcat

SEQ ID NO: 379883 - DNA, 20 bp, Artificial Sequence
  chemically synthesized
tagggatgggatgatgcatg

SEQ ID NO: 379884 - DNA, 20 bp, Artificial Sequence
  chemically synthesized
atgatgcatgaggaaaatat

SEQ ID NO: 379885 - DNA, 20 bp, Artificial Sequence
  chemically synthesized
atgttattaaaaagatattt

SEQ ID NO: 379886 - DNA, 20 bp, Artificial Sequence
  chemically synthesized
aatgttattaaaaagatatt

SEQ ID NO: 379887 - DNA, 20 bp, Artificial Sequence
  chemically synthesized
tatatttaaatgttattaaa

SEQ ID NO: 379888 - DNA, 20 bp, Artificial Sequence
  chemically synthesized
ctgtatgacacaaaatgttt

SEQ ID NO: 379889 - DNA, 20 bp, Artificial Sequence
  chemically synthesized
ctaaaacattttgtgtcata

SEQ ID NO: 379890 - DNA, 20 bp, Artificial Sequence
  chemically synthesized
gggctattgtgaacatatgt

SEQ ID NO: 379891 - DNA, 20 bp, Artificial Sequence
  chemically synthesized
gttctcacatatgttcacaa

SEQ ID NO: 379892 - DNA, 20 bp, Artificial Sequence
  chemically synthesized
ataatagtaaatatgtcata

SEQ ID NO: 379893 - DNA, 20 bp, Artificial Sequence
  chemically synthesized
aataatagtaaatatgtcat

SEQ ID NO: 379894 - DNA, 20 bp, Artificial Sequence
  chemically synthesized
caataatagtaaatatgtca

SEQ ID NO: 379895 - DNA, 20 bp, Artificial Sequence
  chemically synthesized
aaaaaaaatggggacaataa

SEQ ID NO: 379896 - DNA, 20 bp, Artificial Sequence
  chemically synthesized
tctcatccaaaaaaaaaatg

SEQ ID NO: 379897 - DNA, 20 bp, Artificial Sequence
  chemically synthesized
ttctcatccaaaaaaaaaat

SEQ ID NO: 379898 - DNA, 20 bp, Artificial Sequence
  chemically synthesized
tttctcatccaaaaaaaaaa

SEQ ID NO: 379899 - DNA, 20 bp, Artificial Sequence
  chemically synthesized
tattgtccccattttttttt

SEQ ID NO: 379900 - DNA, 20 bp, Artificial Sequence
  chemically synthesized
tccccattttttttttggat

SEQ ID NO: 379901 - DNA, 20 bp, Artificial Sequence
  chemically synthesized
tttttttggatgagaaaact

SEQ ID NO: 379902 - DNA, 20 bp, Artificial Sequence
  chemically synthesized
ttttttggatgagaaaactg

SEQ ID NO: 379903 - DNA, 20 bp, Artificial Sequence
  chemically synthesized
tggatgagaaaactgaggct

SEQ ID NO: 379904 - DNA, 20 bp, Artificial Sequence
  chemically synthesized
gatgagaaaactgaggctca

SEQ ID NO: 379905 - DNA, 20 bp, Artificial Sequence
  chemically synthesized
tactgaagttctctgagcct

SEQ ID NO: 379906 - DNA, 20 bp, Artificial Sequence
  chemically synthesized
gaatgttactgaagttctct

SEQ ID NO: 379907 - DNA, 20 bp, Artificial Sequence
  chemically synthesized
aactgaggctcagagaactt

SEQ ID NO: 379908 - DNA, 20 bp, Artificial Sequence
  chemically synthesized
tgaccttgggaatgttactg

SEQ ID NO: 379909 - DNA, 20 bp, Artificial Sequence
  chemically synthesized
agaacttcagtaacattccc

SEQ ID NO: 379910 - DNA, 20 bp, Artificial Sequence
  chemically synthesized
gaacttcagtaacattccca

SEQ ID NO: 379911 - DNA, 20 bp, Artificial Sequence
  chemically synthesized
ttcagtaacattcccaaggt

SEQ ID NO: 379912 - DNA, 20 bp, Artificial Sequence
  chemically synthesized
attactggatatctgacctt

SEQ ID NO: 379913 - DNA, 20 bp, Artificial Sequence
  chemically synthesized
aattactggatatctgacct

SEQ ID NO: 379914 - DNA, 20 bp, Artificial Sequence
  chemically synthesized
cattcccaaggtcagatatc

SEQ ID NO: 379915 - DNA, 20 bp, Artificial Sequence
  chemically synthesized
aaggtcagatatccagtaat

SEQ ID NO: 379916 - DNA, 20 bp, Artificial Sequence
  chemically synthesized
attctgtctacactaattac

SEQ ID NO: 379917 - DNA, 20 bp, Artificial Sequence
  chemically synthesized
cagatatccagtaattagtg

SEQ ID NO: 379918 - DNA, 20 bp, Artificial Sequence
  chemically synthesized
tatccagtaattagtgtaga

SEQ ID NO: 379919 - DNA, 20 bp, Artificial Sequence
  chemically synthesized
gtgtagacagaattcaaatc

SEQ ID NO: 379920 - DNA, 20 bp, Artificial Sequence
  chemically synthesized
tgtagacagaattcaaatcc

SEQ ID NO: 379921 - DNA, 20 bp, Artificial Sequence
  chemically synthesized
agacagaattcaaatccagg

SEQ ID NO: 379922 - DNA, 20 bp, Artificial Sequence
  chemically synthesized
ggtttcagagcatttccacc

SEQ ID NO: 379923 - DNA, 20 bp, Artificial Sequence
  chemically synthesized
aggtaagactgtgggtttca

SEQ ID NO: 379924 - DNA, 20 bp, Artificial Sequence
  chemically synthesized
tggaaatgctctgaaaccca

SEQ ID NO: 379925 - DNA, 20 bp, Artificial Sequence
  chemically synthesized
gcaggtaagactgtgggttt

SEQ ID NO: 379926 - DNA, 20 bp, Artificial Sequence
  chemically synthesized
agtgtagcaggtaagactgt

SEQ ID NO: 379927 - DNA, 20 bp, Artificial Sequence
  chemically synthesized
tagtgtagcaggtaagactg

SEQ ID NO: 379928 - DNA, 20 bp, Artificial Sequence
  chemically synthesized
tccagtttagtgtagcaggt

SEQ ID NO: 379929 - DNA, 20 bp, Artificial Sequence
  chemically synthesized
ttgttccagtttagtgtagc

SEQ ID NO: 379930 - DNA, 20 bp, Artificial Sequence
  chemically synthesized
tttgttccagtttagtgtag

SEQ ID NO: 379931 - DNA, 20 bp, Artificial Sequence
  chemically synthesized
atatttgttccagtttagtg

SEQ ID NO: 379932 - DNA, 20 bp, Artificial Sequence
  chemically synthesized
tcttacctgctacactaaac

SEQ ID NO: 379933 - DNA, 20 bp, Artificial Sequence
  chemically synthesized
caacaatatttgttccagtt

SEQ ID NO: 379934 - DNA, 20 bp, Artificial Sequence
  chemically synthesized
tgtttcaacaatatttgttc

SEQ ID NO: 379935 - DNA, 20 bp, Artificial Sequence
  chemically synthesized
aatatttttaaatgttttat

SEQ ID NO: 379936 - DNA, 20 bp, Artificial Sequence
  chemically synthesized
taaaacatttaaaaatatta

SEQ ID NO: 379937 - DNA, 20 bp, Artificial Sequence
  chemically synthesized
aaaacatttaaaaatattac

SEQ ID NO: 379938 - DNA, 20 bp, Artificial Sequence
  chemically synthesized
atattacaggattataaatt

SEQ ID NO: 379939 - DNA, 20 bp, Artificial Sequence
  chemically synthesized
tattacaggattataaattc

SEQ ID NO: 379940 - DNA, 20 bp, Artificial Sequence
  chemically synthesized
aggcaatgtttactatccca

SEQ ID NO: 379941 - DNA, 20 bp, Artificial Sequence
  chemically synthesized
atgtccccccaactttggga

SEQ ID NO: 379942 - DNA, 20 bp, Artificial Sequence
  chemically synthesized
aatgtttactatcccaaagt

SEQ ID NO: 379943 - DNA, 20 bp, Artificial Sequence
  chemically synthesized
atgtttactatcccaaagtt

SEQ ID NO: 379944 - DNA, 20 bp, Artificial Sequence
  chemically synthesized
tgtttactatcccaaagttg

SEQ ID NO: 379945 - DNA, 20 bp, Artificial Sequence
  chemically synthesized
tcccatgtccccccaacttt

SEQ ID NO: 379946 - DNA, 20 bp, Artificial Sequence
  chemically synthesized
gtttactatcccaaagttgg

SEQ ID NO: 379947 - DNA, 20 bp, Artificial Sequence
  chemically synthesized
ttcccatgtccccccaactt

SEQ ID NO: 379948 - DNA, 20 bp, Artificial Sequence
  chemically synthesized
tttactatcccaaagttggg

SEQ ID NO: 379949 - DNA, 20 bp, Artificial Sequence
  chemically synthesized
atcccaaagttggggggaca

SEQ ID NO: 379950 - DNA, 20 bp, Artificial Sequence
  chemically synthesized
tcccaaagttggggggacat

SEQ ID NO: 379951 - DNA, 20 bp, Artificial Sequence
  chemically synthesized
caaagttggggggacatggg

SEQ ID NO: 379952 - DNA, 20 bp, Artificial Sequence
  chemically synthesized
gttggggggacatgggaaga

SEQ ID NO: 379953 - DNA, 20 bp, Artificial Sequence
  chemically synthesized
gggacatgggaagatggcat

SEQ ID NO: 379954 - DNA, 20 bp, Artificial Sequence
  chemically synthesized
ggacatgggaagatggcatg

SEQ ID NO: 379955 - DNA, 20 bp, Artificial Sequence
  chemically synthesized
catgggaagatggcatgagg

SEQ ID NO: 379956 - DNA, 20 bp, Artificial Sequence
  chemically synthesized
gttggcaatgacataaagca

SEQ ID NO: 379957 - DNA, 20 bp, Artificial Sequence
  chemically synthesized
agaaagttggcaatgacata

SEQ ID NO: 379958 - DNA, 20 bp, Artificial Sequence
  chemically synthesized
ttatgtcattgccaactttc

SEQ ID NO: 379959 - DNA, 20 bp, Artificial Sequence
  chemically synthesized
caactgaaggactagaaagt

SEQ ID NO: 379960 - DNA, 20 bp, Artificial Sequence
  chemically synthesized
ccaccaactgaaggactaga

SEQ ID NO: 379961 - DNA, 20 bp, Artificial Sequence
  chemically synthesized
ttgccaactttctagtcctt

SEQ ID NO: 379962 - DNA, 20 bp, Artificial Sequence
  chemically synthesized
ttaaccaccaactgaaggac

SEQ ID NO: 379963 - DNA, 20 bp, Artificial Sequence
  chemically synthesized
caactttctagtccttcagt

SEQ ID NO: 379964 - DNA, 20 bp, Artificial Sequence
  chemically synthesized
tccacttaaccaccaactga

SEQ ID NO: 379965 - DNA, 20 bp, Artificial Sequence
  chemically synthesized
ctttctagtccttcagttgg

SEQ ID NO: 379966 - DNA, 20 bp, Artificial Sequence
  chemically synthesized
ctccacttaaccaccaactg

SEQ ID NO: 379967 - DNA, 20 bp, Artificial Sequence
  chemically synthesized
tagtccttcagttggtggtt

SEQ ID NO: 379968 - DNA, 20 bp, Artificial Sequence
  chemically synthesized
tccttcagttggtggttaag

SEQ ID NO: 379969 - DNA, 20 bp, Artificial Sequence
  chemically synthesized
cttcagttggtggttaagtg

SEQ ID NO: 379970 - DNA, 20 bp, Artificial Sequence
  chemically synthesized
gttggtggttaagtggagat

SEQ ID NO: 379971 - DNA, 20 bp, Artificial Sequence
  chemically synthesized
ttggtggttaagtggagata

SEQ ID NO: 379972 - DNA, 20 bp, Artificial Sequence
  chemically synthesized
ggttaagtggagataaggat

SEQ ID NO: 379973 - DNA, 20 bp, Artificial Sequence
  chemically synthesized
gttaagtggagataaggatg

SEQ ID NO: 379974 - DNA, 20 bp, Artificial Sequence
  chemically synthesized
agtggagataaggatgaggc

SEQ ID NO: 379975 - DNA, 20 bp, Artificial Sequence
  chemically synthesized
tggagataaggatgaggcca

SEQ ID NO: 379976 - DNA, 20 bp, Artificial Sequence
  chemically synthesized
ttcgtgccactcatgttctc

SEQ ID NO: 379977 - DNA, 20 bp, Artificial Sequence
  chemically synthesized
aggatgaggccagagaacat

SEQ ID NO: 379978 - DNA, 20 bp, Artificial Sequence
  chemically synthesized
atgaggccagagaacatgag

SEQ ID NO: 379979 - DNA, 20 bp, Artificial Sequence
  chemically synthesized
aacatgagtggcacgaatgc

SEQ ID NO: 379980 - DNA, 20 bp, Artificial Sequence
  chemically synthesized
ttaaaattttaagagaatac

SEQ ID NO: 379981 - DNA, 20 bp, Artificial Sequence
  chemically synthesized
gcaaaatattaaaattttaa

SEQ ID NO: 379982 - DNA, 20 bp, Artificial Sequence
  chemically synthesized
gagcaaaatattaaaatttt

SEQ ID NO: 379983 - DNA, 20 bp, Artificial Sequence
  chemically synthesized
caatgcaaaataattcatat

SEQ ID NO: 379984 - DNA, 20 bp, Artificial Sequence
  chemically synthesized
ttgattttaattgttaaaat

SEQ ID NO: 379985 - DNA, 20 bp, Artificial Sequence
  chemically synthesized
tgattttaattgttaaaatg

SEQ ID NO: 379986 - DNA, 20 bp, Artificial Sequence
  chemically synthesized
cgcctaaaaattcagaaatc

SEQ ID NO: 379987 - DNA, 20 bp, Artificial Sequence
  chemically synthesized
tcgcctaaaaattcagaaat

SEQ ID NO: 379988 - DNA, 20 bp, Artificial Sequence
  chemically synthesized
tatcctgatttctgaatttt

SEQ ID NO: 379989 - DNA, 20 bp, Artificial Sequence
  chemically synthesized
atcctgatttctgaattttt

SEQ ID NO: 379990 - DNA, 20 bp, Artificial Sequence
  chemically synthesized
taagcggtcgcctaaaaatt

SEQ ID NO: 379991 - DNA, 20 bp, Artificial Sequence
  chemically synthesized
tctgaatcacaaaatgtaag

SEQ ID NO: 379992 - DNA, 20 bp, Artificial Sequence
  chemically synthesized
atgtctgaatcacaaaatgt

SEQ ID NO: 379993 - DNA, 20 bp, Artificial Sequence
  chemically synthesized
accgcttacattttgtgatt

SEQ ID NO: 379994 - DNA, 20 bp, Artificial Sequence
  chemically synthesized
tacattttgtgattcagaca

SEQ ID NO: 379995 - DNA, 20 bp, Artificial Sequence
  chemically synthesized
tcagacatagccatcttttc

SEQ ID NO: 379996 - DNA, 20 bp, Artificial Sequence
  chemically synthesized
ccttcctctcccagaaaaga

SEQ ID NO: 379997 - DNA, 20 bp, Artificial Sequence
  chemically synthesized
cagacatagccatcttttct

SEQ ID NO: 379998 - DNA, 20 bp, Artificial Sequence
  chemically synthesized
gacatagccatcttttctgg

SEQ ID NO: 379999 - DNA, 20 bp, Artificial Sequence
  chemically synthesized
ctccccttcctctcccagaa

SEQ ID NO: 380000 - DNA, 20 bp, Artificial Sequence
  chemically synthesized
catagccatcttttctggga

SEQ ID NO: 380001 - DNA, 20 bp, Artificial Sequence
  chemically synthesized
atagccatcttttctgggag

SEQ ID NO: 380002 - DNA, 20 bp, Artificial Sequence
  chemically synthesized
gccatcttttctgggagagg

SEQ ID NO: 380003 - DNA, 20 bp, Artificial Sequence
  chemically synthesized
acctcctccccttcctctcc

SEQ ID NO: 380004 - DNA, 20 bp, Artificial Sequence
  chemically synthesized
ccatcttttctgggagagga

SEQ ID NO: 380005 - DNA, 20 bp, Artificial Sequence
  chemically synthesized
catcttttctgggagaggaa

SEQ ID NO: 380006 - DNA, 20 bp, Artificial Sequence
  chemically synthesized
atcttttctgggagaggaag

SEQ ID NO: 380007 - DNA, 20 bp, Artificial Sequence
  chemically synthesized
cttttctgggagaggaaggg

SEQ ID NO: 380008 - DNA, 20 bp, Artificial Sequence
  chemically synthesized
ttttctgggagaggaagggg

SEQ ID NO: 380009 - DNA, 20 bp, Artificial Sequence
  chemically synthesized
ttctgggagaggaaggggag

SEQ ID NO: 380010 - DNA, 20 bp, Artificial Sequence
  chemically synthesized
tctgggagaggaaggggagg

SEQ ID NO: 380011 - DNA, 20 bp, Artificial Sequence
  chemically synthesized
ggaaggggaggaggtacaca

SEQ ID NO: 380012 - DNA, 20 bp, Artificial Sequence
  chemically synthesized
gaaggggaggaggtacacac

SEQ ID NO: 380013 - DNA, 20 bp, Artificial Sequence
  chemically synthesized
cacaggatttgtcttgaatg

SEQ ID NO: 380014 - DNA, 20 bp, Artificial Sequence
  chemically synthesized
acaggatttgtcttgaatgt

SEQ ID NO: 380015 - DNA, 20 bp, Artificial Sequence
  chemically synthesized
aaatagggaaacctacattc

SEQ ID NO: 380016 - DNA, 20 bp, Artificial Sequence
  chemically synthesized
aatgtaggtttccctatttt

SEQ ID NO: 380017 - DNA, 20 bp, Artificial Sequence
  chemically synthesized
atatacaatctctgaaaata

SEQ ID NO: 380018 - DNA, 20 bp, Artificial Sequence
  chemically synthesized
tgtaggtttccctattttca

SEQ ID NO: 380019 - DNA, 20 bp, Artificial Sequence
  chemically synthesized
aatatacaatctctgaaaat

SEQ ID NO: 380020 - DNA, 20 bp, Artificial Sequence
  chemically synthesized
aaatatacaatctctgaaaa

SEQ ID NO: 380021 - DNA, 20 bp, Artificial Sequence
  chemically synthesized
gattgtatatttgcttcctg

SEQ ID NO: 380022 - DNA, 20 bp, Artificial Sequence
  chemically synthesized
acctcacaccaagccacagg

SEQ ID NO: 380023 - DNA, 20 bp, Artificial Sequence
  chemically synthesized
tatatttgcttcctgtggct

SEQ ID NO: 380024 - DNA, 20 bp, Artificial Sequence
  chemically synthesized
cagacctcacaccaagccac

SEQ ID NO: 380025 - DNA, 20 bp, Artificial Sequence
  chemically synthesized
tcagacctcacaccaagcca

SEQ ID NO: 380026 - DNA, 20 bp, Artificial Sequence
  chemically synthesized
tgcttcctgtggcttggtgt

SEQ ID NO: 380027 - DNA, 20 bp, Artificial Sequence
  chemically synthesized
gcttcctgtggcttggtgtg

SEQ ID NO: 380028 - DNA, 20 bp, Artificial Sequence
  chemically synthesized
cattcatcagacctcacacc

SEQ ID NO: 380029 - DNA, 20 bp, Artificial Sequence
  chemically synthesized
agccttcgcttaacattcat

SEQ ID NO: 380030 - DNA, 20 bp, Artificial Sequence
  chemically synthesized
tgtgaggtctgatgaatgtt

SEQ ID NO: 380031 - DNA, 20 bp, Artificial Sequence
  chemically synthesized
ggtctgatgaatgttaagcg

SEQ ID NO: 380032 - DNA, 20 bp, Artificial Sequence
  chemically synthesized
gtctgatgaatgttaagcga

SEQ ID NO: 380033 - DNA, 20 bp, Artificial Sequence
  chemically synthesized
taaggagagagggggtgatt

SEQ ID NO: 380034 - DNA, 20 bp, Artificial Sequence
  chemically synthesized
ggtggtactaaggagagagg

SEQ ID NO: 380035 - DNA, 20 bp, Artificial Sequence
  chemically synthesized
tggtggtactaaggagagag

SEQ ID NO: 380036 - DNA, 20 bp, Artificial Sequence
  chemically synthesized
gtggtggtactaaggagaga

SEQ ID NO: 380037 - DNA, 20 bp, Artificial Sequence
  chemically synthesized
taaatcaccccctctctcct

SEQ ID NO: 380038 - DNA, 20 bp, Artificial Sequence
  chemically synthesized
agtggtggtactaaggagag

SEQ ID NO: 380039 - DNA, 20 bp, Artificial Sequence
  chemically synthesized
cagtggtggtactaaggaga

SEQ ID NO: 380040 - DNA, 20 bp, Artificial Sequence
  chemically synthesized
ttcagtggtggtactaagga

SEQ ID NO: 380041 - DNA, 20 bp, Artificial Sequence
  chemically synthesized
acttcagtggtggtactaag

SEQ ID NO: 380042 - DNA, 20 bp, Artificial Sequence
  chemically synthesized
tgacttcagtggtggtacta

SEQ ID NO: 380043 - DNA, 20 bp, Artificial Sequence
  chemically synthesized
gtgacttcagtggtggtact

SEQ ID NO: 380044 - DNA, 20 bp, Artificial Sequence
  chemically synthesized
tctccttagtaccaccactg

SEQ ID NO: 380045 - DNA, 20 bp, Artificial Sequence
  chemically synthesized
gaaagaagtgacttcagtgg

SEQ ID NO: 380046 - DNA, 20 bp, Artificial Sequence
  chemically synthesized
ccagaaagaagtgacttcag

SEQ ID NO: 380047 - DNA, 20 bp, Artificial Sequence
  chemically synthesized
aggccagaaagaagtgactt

SEQ ID NO: 380048 - DNA, 20 bp, Artificial Sequence
  chemically synthesized
ccactgaagtcacttctttc

SEQ ID NO: 380049 - DNA, 20 bp, Artificial Sequence
  chemically synthesized
ttgaacttaaggccagaaag

SEQ ID NO: 380050 - DNA, 20 bp, Artificial Sequence
  chemically synthesized
cttttgaacttaaggccaga

SEQ ID NO: 380051 - DNA, 20 bp, Artificial Sequence
  chemically synthesized
agtcacttctttctggcctt

SEQ ID NO: 380052 - DNA, 20 bp, Artificial Sequence
  chemically synthesized
tccccttttgaacttaaggc

SEQ ID NO: 380053 - DNA, 20 bp, Artificial Sequence
  chemically synthesized
agtttccccttttgaactta

SEQ ID NO: 380054 - DNA, 20 bp, Artificial Sequence
  chemically synthesized
cagtttccccttttgaactt

SEQ ID NO: 380055 - DNA, 20 bp, Artificial Sequence
  chemically synthesized
ctttctggccttaagttcaa

SEQ ID NO: 380056 - DNA, 20 bp, Artificial Sequence
  chemically synthesized
tttctggccttaagttcaaa

SEQ ID NO: 380057 - DNA, 20 bp, Artificial Sequence
  chemically synthesized
ttctggccttaagttcaaaa

SEQ ID NO: 380058 - DNA, 20 bp, Artificial Sequence
  chemically synthesized
tctggccttaagttcaaaag

SEQ ID NO: 380059 - DNA, 20 bp, Artificial Sequence
  chemically synthesized
aaaaggggaaactgaatgat

SEQ ID NO: 380060 - DNA, 20 bp, Artificial Sequence
  chemically synthesized
gatgctcaatactcatcatt

SEQ ID NO: 380061 - DNA, 20 bp, Artificial Sequence
  chemically synthesized
gaaactgaatgatgagtatt

SEQ ID NO: 380062 - DNA, 20 bp, Artificial Sequence
  chemically synthesized
actaatgccatgacacagtg

SEQ ID NO: 380063 - DNA, 20 bp, Artificial Sequence
  chemically synthesized
tgagcatctacactgtgtca

SEQ ID NO: 380064 - DNA, 20 bp, Artificial Sequence
  chemically synthesized
caattactaatgccatgaca

SEQ ID NO: 380065 - DNA, 20 bp, Artificial Sequence
  chemically synthesized
tctacactgtgtcatggcat

SEQ ID NO: 380066 - DNA, 20 bp, Artificial Sequence
  chemically synthesized
gctactgagggagtcaagtg

SEQ ID NO: 380067 - DNA, 20 bp, Artificial Sequence
  chemically synthesized
agctactgagggagtcaagt

SEQ ID NO: 380068 - DNA, 20 bp, Artificial Sequence
  chemically synthesized
atgtagctactgagggagtc

SEQ ID NO: 380069 - DNA, 20 bp, Artificial Sequence
  chemically synthesized
tgttcctcacttgactccct

SEQ ID NO: 380070 - DNA, 20 bp, Artificial Sequence
  chemically synthesized
tcctcacttgactccctcag

SEQ ID NO: 380071 - DNA, 20 bp, Artificial Sequence
  chemically synthesized
actttatgtagctactgagg

SEQ ID NO: 380072 - DNA, 20 bp, Artificial Sequence
  chemically synthesized
ttactttatgtagctactga

SEQ ID NO: 380073 - DNA, 20 bp, Artificial Sequence
  chemically synthesized
cttactttatgtagctactg

SEQ ID NO: 380074 - DNA, 20 bp, Artificial Sequence
  chemically synthesized
acttactttatgtagctact

SEQ ID NO: 380075 - DNA, 20 bp, Artificial Sequence
  chemically synthesized
actccctcagtagctacata

SEQ ID NO: 380076 - DNA, 20 bp, Artificial Sequence
  chemically synthesized
ataagaagacttactttatg

SEQ ID NO: 380077 - DNA, 20 bp, Artificial Sequence
  chemically synthesized
cctcagtagctacataaagt

SEQ ID NO: 380078 - DNA, 20 bp, Artificial Sequence
  chemically synthesized
ctccatgaaatgagaataag

SEQ ID NO: 380079 - DNA, 20 bp, Artificial Sequence
  chemically synthesized
ttactccatgaaatgagaat

SEQ ID NO: 380080 - DNA, 20 bp, Artificial Sequence
  chemically synthesized
gtcttcttattctcatttca

SEQ ID NO: 380081 - DNA, 20 bp, Artificial Sequence
  chemically synthesized
gaatacttactccatgaaat

SEQ ID NO: 380082 - DNA, 20 bp, Artificial Sequence
  chemically synthesized
cttcttattctcatttcatg

SEQ ID NO: 380083 - DNA, 20 bp, Artificial Sequence
  chemically synthesized
ttattctcatttcatggagt

SEQ ID NO: 380084 - DNA, 20 bp, Artificial Sequence
  chemically synthesized
ttcttccacataatgggaat

SEQ ID NO: 380085 - DNA, 20 bp, Artificial Sequence
  chemically synthesized
gtattcttattcccattatg

SEQ ID NO: 380086 - DNA, 20 bp, Artificial Sequence
  chemically synthesized
gtattattcttccacataat

SEQ ID NO: 380087 - DNA, 20 bp, Artificial Sequence
  chemically synthesized
agtattattcttccacataa

SEQ ID NO: 380088 - DNA, 20 bp, Artificial Sequence
  chemically synthesized
ttcttattcccattatgtgg

SEQ ID NO: 380089 - DNA, 20 bp, Artificial Sequence
  chemically synthesized
atgtggaagaataatactta

SEQ ID NO: 380090 - DNA, 20 bp, Artificial Sequence
  chemically synthesized
tacatgaataagaatacttt

SEQ ID NO: 380091 - DNA, 20 bp, Artificial Sequence
  chemically synthesized
tcagtttttaatacatgaat

SEQ ID NO: 380092 - DNA, 20 bp, Artificial Sequence
  chemically synthesized
ttattcatgtattaaaaact

SEQ ID NO: 380093 - DNA, 20 bp, Artificial Sequence
  chemically synthesized
tattcatgtattaaaaactg

SEQ ID NO: 380094 - DNA, 20 bp, Artificial Sequence
  chemically synthesized
atgtattaaaaactgaggct

SEQ ID NO: 380095 - DNA, 20 bp, Artificial Sequence
  chemically synthesized
ttcttagtatttctgagcct

SEQ ID NO: 380096 - DNA, 20 bp, Artificial Sequence
  chemically synthesized
acaatgttcttagtatttct

SEQ ID NO: 380097 - DNA, 20 bp, Artificial Sequence
  chemically synthesized
aactgaggctcagaaatact

SEQ ID NO: 380098 - DNA, 20 bp, Artificial Sequence
  chemically synthesized
ttgcccttagacaatgttct

SEQ ID NO: 380099 - DNA, 20 bp, Artificial Sequence
  chemically synthesized
aaatactaagaacattgtct

SEQ ID NO: 380100 - DNA, 20 bp, Artificial Sequence
  chemically synthesized
aatactaagaacattgtcta

SEQ ID NO: 380101 - DNA, 20 bp, Artificial Sequence
  chemically synthesized
atactaagaacattgtctaa

SEQ ID NO: 380102 - DNA, 20 bp, Artificial Sequence
  chemically synthesized
gcacttgaaatatttgccct

SEQ ID NO: 380103 - DNA, 20 bp, Artificial Sequence
  chemically synthesized
tgtctaagggcaaatatttc

SEQ ID NO: 380104 - DNA, 20 bp, Artificial Sequence
  chemically synthesized
ccatgaagtttaagaattta

SEQ ID NO: 380105 - DNA, 20 bp, Artificial Sequence
  chemically synthesized
acaaaatacccatgaagttt

SEQ ID NO: 380106 - DNA, 20 bp, Artificial Sequence
  chemically synthesized
ccataaattcttaaacttca

SEQ ID NO: 380107 - DNA, 20 bp, Artificial Sequence
  chemically synthesized
cataaattcttaaacttcat

SEQ ID NO: 380108 - DNA, 20 bp, Artificial Sequence
  chemically synthesized
aatcatacaaaatacccatg

SEQ ID NO: 380109 - DNA, 20 bp, Artificial Sequence
  chemically synthesized
cccagtcaaaagaggttgaa

SEQ ID NO: 380110 - DNA, 20 bp, Artificial Sequence
  chemically synthesized
cagaatagcccagtcaaaag

SEQ ID NO: 380111 - DNA, 20 bp, Artificial Sequence
  chemically synthesized
tcttttcaacctcttttgac

SEQ ID NO: 380112 - DNA, 20 bp, Artificial Sequence
  chemically synthesized
ccagaatagcccagtcaaaa

SEQ ID NO: 380113 - DNA, 20 bp, Artificial Sequence
  chemically synthesized
cttttcaacctcttttgact

SEQ ID NO: 380114 - DNA, 20 bp, Artificial Sequence
  chemically synthesized
tcccagaatagcccagtcaa

SEQ ID NO: 380115 - DNA, 20 bp, Artificial Sequence
  chemically synthesized
gaccacctcccagaatagcc

SEQ ID NO: 380116 - DNA, 20 bp, Artificial Sequence
  chemically synthesized
ctcttttgactgggctattc

SEQ ID NO: 380117 - DNA, 20 bp, Artificial Sequence
  chemically synthesized
tcttttgactgggctattct

SEQ ID NO: 380118 - DNA, 20 bp, Artificial Sequence
  chemically synthesized
ttttgactgggctattctgg

SEQ ID NO: 380119 - DNA, 20 bp, Artificial Sequence
  chemically synthesized
tttgactgggctattctggg

SEQ ID NO: 380120 - DNA, 20 bp, Artificial Sequence
  chemically synthesized
gctgtgaccacctcccagaa

SEQ ID NO: 380121 - DNA, 20 bp, Artificial Sequence
  chemically synthesized
gactgggctattctgggagg

SEQ ID NO: 380122 - DNA, 20 bp, Artificial Sequence
  chemically synthesized
taatagctgtgaccacctcc

SEQ ID NO: 380123 - DNA, 20 bp, Artificial Sequence
  chemically synthesized
gctattctgggaggtggtca

SEQ ID NO: 380124 - DNA, 20 bp, Artificial Sequence
  chemically synthesized
tgggaggtggtcacagctat

SEQ ID NO: 380125 - DNA, 20 bp, Artificial Sequence
  chemically synthesized
gggaggtggtcacagctatt

SEQ ID NO: 380126 - DNA, 20 bp, Artificial Sequence
  chemically synthesized
ggaggtggtcacagctatta

SEQ ID NO: 380127 - DNA, 20 bp, Artificial Sequence
  chemically synthesized
tttaattcatttggccctaa

SEQ ID NO: 380128 - DNA, 20 bp, Artificial Sequence
  chemically synthesized
ttcatatattttaattcatt

SEQ ID NO: 380129 - DNA, 20 bp, Artificial Sequence
  chemically synthesized
gaaaatgattgatgaactgt

SEQ ID NO: 380130 - DNA, 20 bp, Artificial Sequence
  chemically synthesized
aaaatgattgatgaactgta

SEQ ID NO: 380131 - DNA, 20 bp, Artificial Sequence
  chemically synthesized
tatgttgatatgatgcctta

SEQ ID NO: 380132 - DNA, 20 bp, Artificial Sequence
  chemically synthesized
gcatcatatcaacataaata

SEQ ID NO: 380133 - DNA, 20 bp, Artificial Sequence
  chemically synthesized
aaatcatttacttctacttc

SEQ ID NO: 380134 - DNA, 20 bp, Artificial Sequence
  chemically synthesized
cttctgaatactagaagtag

SEQ ID NO: 380135 - DNA, 20 bp, Artificial Sequence
  chemically synthesized
tctcttctgaatactagaag

SEQ ID NO: 380136 - DNA, 20 bp, Artificial Sequence
  chemically synthesized
acctctcttctgaatactag

SEQ ID NO: 380137 - DNA, 20 bp, Artificial Sequence
  chemically synthesized
ttacttctacttctagtatt

SEQ ID NO: 380138 - DNA, 20 bp, Artificial Sequence
  chemically synthesized
tttacctctcttctgaatac

SEQ ID NO: 380139 - DNA, 20 bp, Artificial Sequence
  chemically synthesized
cttctacttctagtattcag

SEQ ID NO: 380140 - DNA, 20 bp, Artificial Sequence
  chemically synthesized
tctacttctagtattcagaa

SEQ ID NO: 380141 - DNA, 20 bp, Artificial Sequence
  chemically synthesized
tacttctagtattcagaaga

SEQ ID NO: 380142 - DNA, 20 bp, Artificial Sequence
  chemically synthesized
acttctagtattcagaagag

SEQ ID NO: 380143 - DNA, 20 bp, Artificial Sequence
  chemically synthesized
tagtattcagaagagaggta

SEQ ID NO: 380144 - DNA, 20 bp, Artificial Sequence
  chemically synthesized
agtattcagaagagaggtaa

SEQ ID NO: 380145 - DNA, 20 bp, Artificial Sequence
  chemically synthesized
aaggtatattttgcctattt

SEQ ID NO: 380146 - DNA, 20 bp, Artificial Sequence
  chemically synthesized
ggtatattttgcctatttta

SEQ ID NO: 380147 - DNA, 20 bp, Artificial Sequence
  chemically synthesized
ttcatatggtactctaaaat

SEQ ID NO: 380148 - DNA, 20 bp, Artificial Sequence
  chemically synthesized
tttcatatggtactctaaaa

SEQ ID NO: 380149 - DNA, 20 bp, Artificial Sequence
  chemically synthesized
atattttatttcatttcata

SEQ ID NO: 380150 - DNA, 20 bp, Artificial Sequence
  chemically synthesized
tgaaataaaatattattatg

SEQ ID NO: 380151 - DNA, 20 bp, Artificial Sequence
  chemically synthesized
atagtttcccaatgtgaaaa

SEQ ID NO: 380152 - DNA, 20 bp, Artificial Sequence
  chemically synthesized
aaaatttactcttttcacat

SEQ ID NO: 380153 - DNA, 20 bp, Artificial Sequence
  chemically synthesized
ggatagtttcccaatgtgaa

SEQ ID NO: 380154 - DNA, 20 bp, Artificial Sequence
  chemically synthesized
aaatttactcttttcacatt

SEQ ID NO: 380155 - DNA, 20 bp, Artificial Sequence
  chemically synthesized
cacattgggaaactatccat

SEQ ID NO: 380156 - DNA, 20 bp, Artificial Sequence
  chemically synthesized
cattgggaaactatccatca

SEQ ID NO: 380157 - DNA, 20 bp, Artificial Sequence
  chemically synthesized
tgattgttgactctgatgga

SEQ ID NO: 380158 - DNA, 20 bp, Artificial Sequence
  chemically synthesized
acaatgattgttgactctga

SEQ ID NO: 380159 - DNA, 20 bp, Artificial Sequence
  chemically synthesized
gttctattttggagagaagg

SEQ ID NO: 380160 - DNA, 20 bp, Artificial Sequence
  chemically synthesized
tgttctattttggagagaag

SEQ ID NO: 380161 - DNA, 20 bp, Artificial Sequence
  chemically synthesized
catgttctattttggagaga

SEQ ID NO: 380162 - DNA, 20 bp, Artificial Sequence
  chemically synthesized
gcatgttctattttggagag

SEQ ID NO: 380163 - DNA, 20 bp, Artificial Sequence
  chemically synthesized
tgtcctccttctctccaaaa

SEQ ID NO: 380164 - DNA, 20 bp, Artificial Sequence
  chemically synthesized
tcagcatgttctattttgga

SEQ ID NO: 380165 - DNA, 20 bp, Artificial Sequence
  chemically synthesized
cctcagcatgttctattttg

SEQ ID NO: 380166 - DNA, 20 bp, Artificial Sequence
  chemically synthesized
aacctcagcatgttctattt

SEQ ID NO: 380167 - DNA, 20 bp, Artificial Sequence
  chemically synthesized
tctccaaaatagaacatgct

SEQ ID NO: 380168 - DNA, 20 bp, Artificial Sequence
  chemically synthesized
ctccaaaatagaacatgctg

SEQ ID NO: 380169 - DNA, 20 bp, Artificial Sequence
  chemically synthesized
caaaaatatagcataaacct

SEQ ID NO: 380170 - DNA, 20 bp, Artificial Sequence
  chemically synthesized
atagaaatagttcaaaaata

SEQ ID NO: 380171 - DNA, 20 bp, Artificial Sequence
  chemically synthesized
tttaattgtgttaatagaaa

SEQ ID NO: 380172 - DNA, 20 bp, Artificial Sequence
  chemically synthesized
cagcattttaattgtgttaa

SEQ ID NO: 380173 - DNA, 20 bp, Artificial Sequence
  chemically synthesized
acatcttttcaaattcattt

SEQ ID NO: 380174 - DNA, 20 bp, Artificial Sequence
  chemically synthesized
aatgctgaaatgaatttgaa

SEQ ID NO: 380175 - DNA, 20 bp, Artificial Sequence
  chemically synthesized
aagatgtttatattctgacg

SEQ ID NO: 380176 - DNA, 20 bp, Artificial Sequence
  chemically synthesized
agatgtttatattctgacga

SEQ ID NO: 380177 - DNA, 20 bp, Artificial Sequence
  chemically synthesized
gatgtttatattctgacgaa

SEQ ID NO: 380178 - DNA, 20 bp, Artificial Sequence
  chemically synthesized
tatttctagttacccttcgt

SEQ ID NO: 380179 - DNA, 20 bp, Artificial Sequence
  chemically synthesized
atattctgacgaagggtaac

SEQ ID NO: 380180 - DNA, 20 bp, Artificial Sequence
  chemically synthesized
tttagagtagaaaatatttc

SEQ ID NO: 380181 - DNA, 20 bp, Artificial Sequence
  chemically synthesized
acacctgactcaatttagag

SEQ ID NO: 380182 - DNA, 20 bp, Artificial Sequence
  chemically synthesized
aatattttctactctaaatt

SEQ ID NO: 380183 - DNA, 20 bp, Artificial Sequence
  chemically synthesized
atcacacctgactcaattta

SEQ ID NO: 380184 - DNA, 20 bp, Artificial Sequence
  chemically synthesized
gtatcacacctgactcaatt

SEQ ID NO: 380185 - DNA, 20 bp, Artificial Sequence
  chemically synthesized
ttttctactctaaattgagt

SEQ ID NO: 380186 - DNA, 20 bp, Artificial Sequence
  chemically synthesized
tttctactctaaattgagtc

SEQ ID NO: 380187 - DNA, 20 bp, Artificial Sequence
  chemically synthesized
gtcaggtgtgatactgtaaa

SEQ ID NO: 380188 - DNA, 20 bp, Artificial Sequence
  chemically synthesized
tcaggtgtgatactgtaaac

SEQ ID NO: 380189 - DNA, 20 bp, Artificial Sequence
  chemically synthesized
atttttacttatcctgttta

SEQ ID NO: 380190 - DNA, 20 bp, Artificial Sequence
  chemically synthesized
tgtgatactgtaaacaggat

SEQ ID NO: 380191 - DNA, 20 bp, Artificial Sequence
  chemically synthesized
ttctggacattggaatcaag

SEQ ID NO: 380192 - DNA, 20 bp, Artificial Sequence
  chemically synthesized
cttttctggacattggaatc

SEQ ID NO: 380193 - DNA, 20 bp, Artificial Sequence
  chemically synthesized
tactacttgattccaatgtc

SEQ ID NO: 380194 - DNA, 20 bp, Artificial Sequence
  chemically synthesized
tttcattcttttctggacat

SEQ ID NO: 380195 - DNA, 20 bp, Artificial Sequence
  chemically synthesized
cttgattccaatgtccagaa

SEQ ID NO: 380196 - DNA, 20 bp, Artificial Sequence
  chemically synthesized
tttatattttcattcttttc

SEQ ID NO: 380197 - DNA, 20 bp, Artificial Sequence
  chemically synthesized
atataaatcatataaaactc

SEQ ID NO: 380198 - DNA, 20 bp, Artificial Sequence
  chemically synthesized
acagttgcttaaattggcta

SEQ ID NO: 380199 - DNA, 20 bp, Artificial Sequence
  chemically synthesized
ttacagttgcttaaattggc

SEQ ID NO: 380200 - DNA, 20 bp, Artificial Sequence
  chemically synthesized
tataaaactctagccaattt

SEQ ID NO: 380201 - DNA, 20 bp, Artificial Sequence
  chemically synthesized
gggattacagttgcttaaat

SEQ ID NO: 380202 - DNA, 20 bp, Artificial Sequence
  chemically synthesized
aatgatgtctaaagggatta

SEQ ID NO: 380203 - DNA, 20 bp, Artificial Sequence
  chemically synthesized
ttaagcaactgtaatccctt

SEQ ID NO: 380204 - DNA, 20 bp, Artificial Sequence
  chemically synthesized
taaatttaatgatgtctaaa

SEQ ID NO: 380205 - DNA, 20 bp, Artificial Sequence
  chemically synthesized
gtaaatttaatgatgtctaa

SEQ ID NO: 380206 - DNA, 20 bp, Artificial Sequence
  chemically synthesized
agtaaatttaatgatgtcta

SEQ ID NO: 380207 - DNA, 20 bp, Artificial Sequence
  chemically synthesized
atcacctactgtcagaggta

SEQ ID NO: 380208 - DNA, 20 bp, Artificial Sequence
  chemically synthesized
taaatttactttacctctga

SEQ ID NO: 380209 - DNA, 20 bp, Artificial Sequence
  chemically synthesized
atttactttacctctgacag

SEQ ID NO: 380210 - DNA, 20 bp, Artificial Sequence
  chemically synthesized
atggtatcacctactgtcag

SEQ ID NO: 380211 - DNA, 20 bp, Artificial Sequence
  chemically synthesized
tttactttacctctgacagt

SEQ ID NO: 380212 - DNA, 20 bp, Artificial Sequence
  chemically synthesized
tatggtatcacctactgtca

SEQ ID NO: 380213 - DNA, 20 bp, Artificial Sequence
  chemically synthesized
tttatggtatcacctactgt

SEQ ID NO: 380214 - DNA, 20 bp, Artificial Sequence
  chemically synthesized
cagtaggtgataccataaat

SEQ ID NO: 380215 - DNA, 20 bp, Artificial Sequence
  chemically synthesized
aatatgttcttactcattta

SEQ ID NO: 380216 - DNA, 20 bp, Artificial Sequence
  chemically synthesized
aggtgataccataaatgagt

SEQ ID NO: 380217 - DNA, 20 bp, Artificial Sequence
  chemically synthesized
atgtcaatatattgtctctc

SEQ ID NO: 380218 - DNA, 20 bp, Artificial Sequence
  chemically synthesized
catcaaatatattatccaga

SEQ ID NO: 380219 - DNA, 20 bp, Artificial Sequence
  chemically synthesized
accatcaaatatattatcca

SEQ ID NO: 380220 - DNA, 20 bp, Artificial Sequence
  chemically synthesized
aaaccatcaaatatattatc

SEQ ID NO: 380221 - DNA, 20 bp, Artificial Sequence
  chemically synthesized
tctctggataatatatttga

SEQ ID NO: 380222 - DNA, 20 bp, Artificial Sequence
  chemically synthesized
agtttctatgggttttagta

SEQ ID NO: 380223 - DNA, 20 bp, Artificial Sequence
  chemically synthesized
aagtttctatgggttttagt

SEQ ID NO: 380224 - DNA, 20 bp, Artificial Sequence
  chemically synthesized
atataccttactaaaaccca

SEQ ID NO: 380225 - DNA, 20 bp, Artificial Sequence
  chemically synthesized
taaaaagtttctatgggttt

SEQ ID NO: 380226 - DNA, 20 bp, Artificial Sequence
  chemically synthesized
catctttaaaaagtttctat

SEQ ID NO: 380227 - DNA, 20 bp, Artificial Sequence
  chemically synthesized
acatctttaaaaagtttcta

SEQ ID NO: 380228 - DNA, 20 bp, Artificial Sequence
  chemically synthesized
aaacccatagaaacttttta

SEQ ID NO: 380229 - DNA, 20 bp, Artificial Sequence
  chemically synthesized
actaatatcacatctttaaa

SEQ ID NO: 380230 - DNA, 20 bp, Artificial Sequence
  chemically synthesized
actttttaaagatgtgatat

SEQ ID NO: 380231 - DNA, 20 bp, Artificial Sequence
  chemically synthesized
attagtgttgatatctattg

SEQ ID NO: 380232 - DNA, 20 bp, Artificial Sequence
  chemically synthesized
ttagccaattatatcttcaa

SEQ ID NO: 380233 - DNA, 20 bp, Artificial Sequence
  chemically synthesized
atatctattgaagatataat

SEQ ID NO: 380234 - DNA, 20 bp, Artificial Sequence
  chemically synthesized
attgaagatataattggcta

SEQ ID NO: 380235 - DNA, 20 bp, Artificial Sequence
  chemically synthesized
ttttactcttttttaaactt

SEQ ID NO: 380236 - DNA, 20 bp, Artificial Sequence
  chemically synthesized
taattggctaaagtttaaaa

SEQ ID NO: 380237 - DNA, 20 bp, Artificial Sequence
  chemically synthesized
attggctaaagtttaaaaaa

SEQ ID NO: 380238 - DNA, 20 bp, Artificial Sequence
  chemically synthesized
agagtaaaatatttttttcc

SEQ ID NO: 380239 - DNA, 20 bp, Artificial Sequence
  chemically synthesized
aaaatatttttttccaagca

SEQ ID NO: 380240 - DNA, 20 bp, Artificial Sequence
  chemically synthesized
caatattactgggctgtgct

SEQ ID NO: 380241 - DNA, 20 bp, Artificial Sequence
  chemically synthesized
atttttttccaagcacagcc

SEQ ID NO: 380242 - DNA, 20 bp, Artificial Sequence
  chemically synthesized
atcacatgtccaatattact

SEQ ID NO: 380243 - DNA, 20 bp, Artificial Sequence
  chemically synthesized
caagcacagcccagtaatat

SEQ ID NO: 380244 - DNA, 20 bp, Artificial Sequence
  chemically synthesized
gatcacatgtccaatattac

SEQ ID NO: 380245 - DNA, 20 bp, Artificial Sequence
  chemically synthesized
tatgacaacagtaaaaaaca

SEQ ID NO: 380246 - DNA, 20 bp, Artificial Sequence
  chemically synthesized
ttgttttttactgttgtcat

SEQ ID NO: 380247 - DNA, 20 bp, Artificial Sequence
  chemically synthesized
tttctatatgcttatgacaa

SEQ ID NO: 380248 - DNA, 20 bp, Artificial Sequence
  chemically synthesized
ttactgttgtcataagcata

SEQ ID NO: 380249 - DNA, 20 bp, Artificial Sequence
  chemically synthesized
tgttgtcataagcatataga

SEQ ID NO: 380250 - DNA, 20 bp, Artificial Sequence
  chemically synthesized
aagcatatagaaagacaatt

SEQ ID NO: 380251 - DNA, 20 bp, Artificial Sequence
  chemically synthesized
atatagaaagacaatttagc

SEQ ID NO: 380252 - DNA, 20 bp, Artificial Sequence
  chemically synthesized
aatttagcaagtgttctgat

SEQ ID NO: 380253 - DNA, 20 bp, Artificial Sequence
  chemically synthesized
atttagcaagtgttctgatg

SEQ ID NO: 380254 - DNA, 20 bp, Artificial Sequence
  chemically synthesized
aaatgctctttaaacctcat

SEQ ID NO: 380255 - DNA, 20 bp, Artificial Sequence
  chemically synthesized
aagtgttctgatgaggttta

SEQ ID NO: 380256 - DNA, 20 bp, Artificial Sequence
  chemically synthesized
gtgttctgatgaggtttaaa

SEQ ID NO: 380257 - DNA, 20 bp, Artificial Sequence
  chemically synthesized
ggtttaaagagcattttttc

SEQ ID NO: 380258 - DNA, 20 bp, Artificial Sequence
  chemically synthesized
agagcattttttctagtata

SEQ ID NO: 380259 - DNA, 20 bp, Artificial Sequence
  chemically synthesized
tttattatactaccatatac

SEQ ID NO: 380260 - DNA, 20 bp, Artificial Sequence
  chemically synthesized
gcattttttctagtatatgg

SEQ ID NO: 380261 - DNA, 20 bp, Artificial Sequence
  chemically synthesized
attcattgtatatttcaaaa

SEQ ID NO: 380262 - DNA, 20 bp, Artificial Sequence
  chemically synthesized
attgtatatttcaaaatagc

SEQ ID NO: 380263 - DNA, 20 bp, Artificial Sequence
  chemically synthesized
gtatatttcaaaatagctag

SEQ ID NO: 380264 - DNA, 20 bp, Artificial Sequence
  chemically synthesized
atatttcaaaatagctagaa

SEQ ID NO: 380265 - DNA, 20 bp, Artificial Sequence
  chemically synthesized
tcattataattattctcttc

SEQ ID NO: 380266 - DNA, 20 bp, Artificial Sequence
  chemically synthesized
attataatgatcccatcaca

SEQ ID NO: 380267 - DNA, 20 bp, Artificial Sequence
  chemically synthesized
atccttcctttctttgtgat

SEQ ID NO: 380268 - DNA, 20 bp, Artificial Sequence
  chemically synthesized
aatccttcctttctttgtga

SEQ ID NO: 380269 - DNA, 20 bp, Artificial Sequence
  chemically synthesized
taatgatcccatcacaaaga

SEQ ID NO: 380270 - DNA, 20 bp, Artificial Sequence
  chemically synthesized
aatgatcccatcacaaagaa

SEQ ID NO: 380271 - DNA, 20 bp, Artificial Sequence
  chemically synthesized
gatcccatcacaaagaaagg

SEQ ID NO: 380272 - DNA, 20 bp, Artificial Sequence
  chemically synthesized
atcccatcacaaagaaagga

SEQ ID NO: 380273 - DNA, 20 bp, Artificial Sequence
  chemically synthesized
tcacaaagaaaggaaggatt

SEQ ID NO: 380274 - DNA, 20 bp, Artificial Sequence
  chemically synthesized
gaaaggaaggattgagatga

SEQ ID NO: 380275 - DNA, 20 bp, Artificial Sequence
  chemically synthesized
atgatcaaatcagagtaatt

SEQ ID NO: 380276 - DNA, 20 bp, Artificial Sequence
  chemically synthesized
aatgatcaaatcagagtaat

SEQ ID NO: 380277 - DNA, 20 bp, Artificial Sequence
  chemically synthesized
ctgtataaatgatcaaatca

SEQ ID NO: 380278 - DNA, 20 bp, Artificial Sequence
  chemically synthesized
tactgtataaatgatcaaat

SEQ ID NO: 380279 - DNA, 20 bp, Artificial Sequence
  chemically synthesized
ctctgatttgatcatttata

SEQ ID NO: 380280 - DNA, 20 bp, Artificial Sequence
  chemically synthesized
atattacatgtgatatactt

SEQ ID NO: 380281 - DNA, 20 bp, Artificial Sequence
  chemically synthesized
tgggtggggacacagagcca

SEQ ID NO: 380282 - DNA, 20 bp, Artificial Sequence
  chemically synthesized
tagatttgggtggggacaca

SEQ ID NO: 380283 - DNA, 20 bp, Artificial Sequence
  chemically synthesized
attagatttgggtggggaca

SEQ ID NO: 380284 - DNA, 20 bp, Artificial Sequence
  chemically synthesized
tttggcattagatttgggtg

SEQ ID NO: 380285 - DNA, 20 bp, Artificial Sequence
  chemically synthesized
atttggcattagatttgggt

SEQ ID NO: 380286 - DNA, 20 bp, Artificial Sequence
  chemically synthesized
tatttggcattagatttggg

SEQ ID NO: 380287 - DNA, 20 bp, Artificial Sequence
  chemically synthesized
tactatttggcattagattt

SEQ ID NO: 380288 - DNA, 20 bp, Artificial Sequence
  chemically synthesized
ttactatttggcattagatt

SEQ ID NO: 380289 - DNA, 20 bp, Artificial Sequence
  chemically synthesized
aggagattactatttggcat

SEQ ID NO: 380290 - DNA, 20 bp, Artificial Sequence
  chemically synthesized
cacccaaatctaatgccaaa

SEQ ID NO: 380291 - DNA, 20 bp, Artificial Sequence
  chemically synthesized
gacacaaggagattactatt

SEQ ID NO: 380292 - DNA, 20 bp, Artificial Sequence
  chemically synthesized
aaatagtaatctccttgtgt

SEQ ID NO: 380293 - DNA, 20 bp, Artificial Sequence
  chemically synthesized
ggtccctcccctgacacaag

SEQ ID NO: 380294 - DNA, 20 bp, Artificial Sequence
  chemically synthesized
aatagtaatctccttgtgtc

SEQ ID NO: 380295 - DNA, 20 bp, Artificial Sequence
  chemically synthesized
atagtaatctccttgtgtca

SEQ ID NO: 380296 - DNA, 20 bp, Artificial Sequence
  chemically synthesized
caggtccctcccctgacaca

SEQ ID NO: 380297 - DNA, 20 bp, Artificial Sequence
  chemically synthesized
tagtaatctccttgtgtcag

SEQ ID NO: 380298 - DNA, 20 bp, Artificial Sequence
  chemically synthesized
ccaggtccctcccctgacac

SEQ ID NO: 380299 - DNA, 20 bp, Artificial Sequence
  chemically synthesized
gtaatctccttgtgtcaggg

SEQ ID NO: 380300 - DNA, 20 bp, Artificial Sequence
  chemically synthesized
taatctccttgtgtcagggg

SEQ ID NO: 380301 - DNA, 20 bp, Artificial Sequence
  chemically synthesized
aatctccttgtgtcagggga

SEQ ID NO: 380302 - DNA, 20 bp, Artificial Sequence
  chemically synthesized
cttgtgtcaggggagggacc

SEQ ID NO: 380303 - DNA, 20 bp, Artificial Sequence
  chemically synthesized
gtgtcaggggagggacctgg

SEQ ID NO: 380304 - DNA, 20 bp, Artificial Sequence
  chemically synthesized
tgtcaggggagggacctggt

SEQ ID NO: 380305 - DNA, 20 bp, Artificial Sequence
  chemically synthesized
tcaggggagggacctggtgg

SEQ ID NO: 380306 - DNA, 20 bp, Artificial Sequence
  chemically synthesized
tgatccagtcatctcccacc

SEQ ID NO: 380307 - DNA, 20 bp, Artificial Sequence
  chemically synthesized
atgatccagtcatctcccac

SEQ ID NO: 380308 - DNA, 20 bp, Artificial Sequence
  chemically synthesized
gggacctggtgggagatgac

SEQ ID NO: 380309 - DNA, 20 bp, Artificial Sequence
  chemically synthesized
ggtgggagatgactggatca

SEQ ID NO: 380310 - DNA, 20 bp, Artificial Sequence
  chemically synthesized
gtgggagatgactggatcat

SEQ ID NO: 380311 - DNA, 20 bp, Artificial Sequence
  chemically synthesized
ggaaatctgctcccatgatc

SEQ ID NO: 380312 - DNA, 20 bp, Artificial Sequence
  chemically synthesized
gggagatgactggatcatgg

SEQ ID NO: 380313 - DNA, 20 bp, Artificial Sequence
  chemically synthesized
agatgactggatcatgggag

SEQ ID NO: 380314 - DNA, 20 bp, Artificial Sequence
  chemically synthesized
tcatgggagcagatttccct

SEQ ID NO: 380315 - DNA, 20 bp, Artificial Sequence
  chemically synthesized
ctatcacaagaaaagtctga

SEQ ID NO: 380316 - DNA, 20 bp, Artificial Sequence
  chemically synthesized
actatcacaagaaaagtctg

SEQ ID NO: 380317 - DNA, 20 bp, Artificial Sequence
  chemically synthesized
cactatcacaagaaaagtct

SEQ ID NO: 380318 - DNA, 20 bp, Artificial Sequence
  chemically synthesized
ctcactcactatcacaagaa

SEQ ID NO: 380319 - DNA, 20 bp, Artificial Sequence
  chemically synthesized
ccctcagacttttcttgtga

SEQ ID NO: 380320 - DNA, 20 bp, Artificial Sequence
  chemically synthesized
gagaactcactcactatcac

SEQ ID NO: 380321 - DNA, 20 bp, Artificial Sequence
  chemically synthesized
cagacttttcttgtgatagt

SEQ ID NO: 380322 - DNA, 20 bp, Artificial Sequence
  chemically synthesized
cttttcttgtgatagtgagt

SEQ ID NO: 380323 - DNA, 20 bp, Artificial Sequence
  chemically synthesized
gatagtgagtgagttctcac

SEQ ID NO: 380324 - DNA, 20 bp, Artificial Sequence
  chemically synthesized
tttaaaccatcagatctcgt

SEQ ID NO: 380325 - DNA, 20 bp, Artificial Sequence
  chemically synthesized
tgagttctcacgagatctga

SEQ ID NO: 380326 - DNA, 20 bp, Artificial Sequence
  chemically synthesized
gtgccacacttttaaaccat

SEQ ID NO: 380327 - DNA, 20 bp, Artificial Sequence
  chemically synthesized
cacgagatctgatggtttaa

SEQ ID NO: 380328 - DNA, 20 bp, Artificial Sequence
  chemically synthesized
gatctgatggtttaaaagtg

SEQ ID NO: 380329 - DNA, 20 bp, Artificial Sequence
  chemically synthesized
gggggatgtggggggggggg

SEQ ID NO: 380330 - DNA, 20 bp, Artificial Sequence
  chemically synthesized
gctgggggatgtgggggggg

SEQ ID NO: 380331 - DNA, 20 bp, Artificial Sequence
  chemically synthesized
agctgggggatgtggggggg

SEQ ID NO: 380332 - DNA, 20 bp, Artificial Sequence
  chemically synthesized
gagctgggggatgtgggggg

SEQ ID NO: 380333 - DNA, 20 bp, Artificial Sequence
  chemically synthesized
ggagctgggggatgtggggg

SEQ ID NO: 380334 - DNA, 20 bp, Artificial Sequence
  chemically synthesized
aggagctgggggatgtgggg

SEQ ID NO: 380335 - DNA, 20 bp, Artificial Sequence
  chemically synthesized
caggagctgggggatgtggg

SEQ ID NO: 380336 - DNA, 20 bp, Artificial Sequence
  chemically synthesized
gcaggagctgggggatgtgg

SEQ ID NO: 380337 - DNA, 20 bp, Artificial Sequence
  chemically synthesized
ggcaggagctgggggatgtg

SEQ ID NO: 380338 - DNA, 20 bp, Artificial Sequence
  chemically synthesized
tggcaggagctgggggatgt

SEQ ID NO: 380339 - DNA, 20 bp, Artificial Sequence
  chemically synthesized
tcccccccccccacatcccc

SEQ ID NO: 380340 - DNA, 20 bp, Artificial Sequence
  chemically synthesized
gtggcaggagctgggggatg

SEQ ID NO: 380341 - DNA, 20 bp, Artificial Sequence
  chemically synthesized
tacatggtggcaggagctgg

SEQ ID NO: 380342 - DNA, 20 bp, Artificial Sequence
  chemically synthesized
ttacatggtggcaggagctg

SEQ ID NO: 380343 - DNA, 20 bp, Artificial Sequence
  chemically synthesized
cttacatggtggcaggagct

SEQ ID NO: 380344 - DNA, 20 bp, Artificial Sequence
  chemically synthesized
tcttacatggtggcaggagc

SEQ ID NO: 380345 - DNA, 20 bp, Artificial Sequence
  chemically synthesized
cacatcttacatggtggcag

SEQ ID NO: 380346 - DNA, 20 bp, Artificial Sequence
  chemically synthesized
ggcacatcttacatggtggc

SEQ ID NO: 380347 - DNA, 20 bp, Artificial Sequence
  chemically synthesized
aggcacatcttacatggtgg

SEQ ID NO: 380348 - DNA, 20 bp, Artificial Sequence
  chemically synthesized
cccagctcctgccaccatgt

SEQ ID NO: 380349 - DNA, 20 bp, Artificial Sequence
  chemically synthesized
gcaaggcacatcttacatgg

SEQ ID NO: 380350 - DNA, 20 bp, Artificial Sequence
  chemically synthesized
gaggcaaggcacatcttaca

SEQ ID NO: 380351 - DNA, 20 bp, Artificial Sequence
  chemically synthesized
cagaaggtgaaggggaggca

SEQ ID NO: 380352 - DNA, 20 bp, Artificial Sequence
  chemically synthesized
gcagaaggtgaaggggaggc

SEQ ID NO: 380353 - DNA, 20 bp, Artificial Sequence
  chemically synthesized
cttggcagaaggtgaagggg

SEQ ID NO: 380354 - DNA, 20 bp, Artificial Sequence
  chemically synthesized
tcttggcagaaggtgaaggg

SEQ ID NO: 380355 - DNA, 20 bp, Artificial Sequence
  chemically synthesized
aatcttggcagaaggtgaag

SEQ ID NO: 380356 - DNA, 20 bp, Artificial Sequence
  chemically synthesized
caatcttggcagaaggtgaa

SEQ ID NO: 380357 - DNA, 20 bp, Artificial Sequence
  chemically synthesized
acaatcttggcagaaggtga

SEQ ID NO: 380358 - DNA, 20 bp, Artificial Sequence
  chemically synthesized
gacaatcttggcagaaggtg

SEQ ID NO: 380359 - DNA, 20 bp, Artificial Sequence
  chemically synthesized
cctccccttcaccttctgcc

SEQ ID NO: 380360 - DNA, 20 bp, Artificial Sequence
  chemically synthesized
acgctgacaatcttggcaga

SEQ ID NO: 380361 - DNA, 20 bp, Artificial Sequence
  chemically synthesized
gacgctgacaatcttggcag

SEQ ID NO: 380362 - DNA, 20 bp, Artificial Sequence
  chemically synthesized
caggacgctgacaatcttgg

SEQ ID NO: 380363 - DNA, 20 bp, Artificial Sequence
  chemically synthesized
tcaccttctgccaagattgt

SEQ ID NO: 380364 - DNA, 20 bp, Artificial Sequence
  chemically synthesized
cctcaggacgctgacaatct

SEQ ID NO: 380365 - DNA, 20 bp, Artificial Sequence
  chemically synthesized
gccaagattgtcagcgtcct

SEQ ID NO: 380366 - DNA, 20 bp, Artificial Sequence
  chemically synthesized
ccaagattgtcagcgtcctg

SEQ ID NO: 380367 - DNA, 20 bp, Artificial Sequence
  chemically synthesized
cacatgactggggaggcctc

SEQ ID NO: 380368 - DNA, 20 bp, Artificial Sequence
  chemically synthesized
ccacatgactggggaggcct

SEQ ID NO: 380369 - DNA, 20 bp, Artificial Sequence
  chemically synthesized
tcagcgtcctgaggcctccc

SEQ ID NO: 380370 - DNA, 20 bp, Artificial Sequence
  chemically synthesized
aaagttccacatgactgggg

SEQ ID NO: 380371 - DNA, 20 bp, Artificial Sequence
  chemically synthesized
caaagttccacatgactggg

SEQ ID NO: 380372 - DNA, 20 bp, Artificial Sequence
  chemically synthesized
ctcaaagttccacatgactg

SEQ ID NO: 380373 - DNA, 20 bp, Artificial Sequence
  chemically synthesized
ctgaggcctccccagtcatg

SEQ ID NO: 380374 - DNA, 20 bp, Artificial Sequence
  chemically synthesized
actcaaagttccacatgact

SEQ ID NO: 380375 - DNA, 20 bp, Artificial Sequence
  chemically synthesized
gactcaaagttccacatgac

SEQ ID NO: 380376 - DNA, 20 bp, Artificial Sequence
  chemically synthesized
ccccagtcatgtggaacttt

SEQ ID NO: 380377 - DNA, 20 bp, Artificial Sequence
  chemically synthesized
aaagaggtttaattgactca

SEQ ID NO: 380378 - DNA, 20 bp, Artificial Sequence
  chemically synthesized
gggtgatttataaagaaaag

SEQ ID NO: 380379 - DNA, 20 bp, Artificial Sequence
  chemically synthesized
tgggtgatttataaagaaaa

SEQ ID NO: 380380 - DNA, 20 bp, Artificial Sequence
  chemically synthesized
actgggtgatttataaagaa

SEQ ID NO: 380381 - DNA, 20 bp, Artificial Sequence
  chemically synthesized
ctgagactgggtgatttata

SEQ ID NO: 380382 - DNA, 20 bp, Artificial Sequence
  chemically synthesized
tcttttctttataaatcacc

SEQ ID NO: 380383 - DNA, 20 bp, Artificial Sequence
  chemically synthesized
ctttataaatcacccagtct

SEQ ID NO: 380384 - DNA, 20 bp, Artificial Sequence
  chemically synthesized
tttataaatcacccagtctc

SEQ ID NO: 380385 - DNA, 20 bp, Artificial Sequence
  chemically synthesized
ataaagaactacctgagact

SEQ ID NO: 380386 - DNA, 20 bp, Artificial Sequence
  chemically synthesized
tataaagaactacctgagac

SEQ ID NO: 380387 - DNA, 20 bp, Artificial Sequence
  chemically synthesized
ataaatcacccagtctcagg

SEQ ID NO: 380388 - DNA, 20 bp, Artificial Sequence
  chemically synthesized
acagctataaagaactacct

SEQ ID NO: 380389 - DNA, 20 bp, Artificial Sequence
  chemically synthesized
cagtctcaggtagttcttta

SEQ ID NO: 380390 - DNA, 20 bp, Artificial Sequence
  chemically synthesized
ttcatttttacacagctata

SEQ ID NO: 380391 - DNA, 20 bp, Artificial Sequence
  chemically synthesized
tgtattagttcatttttaca

SEQ ID NO: 380392 - DNA, 20 bp, Artificial Sequence
  chemically synthesized
tttcgtgttacatgttgtat

SEQ ID NO: 380393 - DNA, 20 bp, Artificial Sequence
  chemically synthesized
ttgtagcttttgatatatca

SEQ ID NO: 380394 - DNA, 20 bp, Artificial Sequence
  chemically synthesized
gtacaactatgatatatcaa

SEQ ID NO: 380395 - DNA, 20 bp, Artificial Sequence
  chemically synthesized
gagcaaacaaaaatagtttg

SEQ ID NO: 380396 - DNA, 20 bp, Artificial Sequence
  chemically synthesized
agtaaatgagcaaacaaaaa

SEQ ID NO: 380397 - DNA, 20 bp, Artificial Sequence
  chemically synthesized
atctaagatatatagtaaat

SEQ ID NO: 380398 - DNA, 20 bp, Artificial Sequence
  chemically synthesized
tgctcatttactatatatct

SEQ ID NO: 380399 - DNA, 20 bp, Artificial Sequence
  chemically synthesized
tccaaaatatctaagatata

SEQ ID NO: 380400 - DNA, 20 bp, Artificial Sequence
  chemically synthesized
gtggtggttccaaaatatct

SEQ ID NO: 380401 - DNA, 20 bp, Artificial Sequence
  chemically synthesized
actatatatcttagatattt

SEQ ID NO: 380402 - DNA, 20 bp, Artificial Sequence
  chemically synthesized
tgtgtgatgtgtggtggtgg

SEQ ID NO: 380403 - DNA, 20 bp, Artificial Sequence
  chemically synthesized
ttgtgtgtgatgtgtggtgg

SEQ ID NO: 380404 - DNA, 20 bp, Artificial Sequence
  chemically synthesized
aatttgtgtgtgatgtgtgg

SEQ ID NO: 380405 - DNA, 20 bp, Artificial Sequence
  chemically synthesized
gtgaatttgtgtgtgatgtg

SEQ ID NO: 380406 - DNA, 20 bp, Artificial Sequence
  chemically synthesized
acataacatgttataaaaca

SEQ ID NO: 380407 - DNA, 20 bp, Artificial Sequence
  chemically synthesized
cataacatgttataaaacat

SEQ ID NO: 380408 - DNA, 20 bp, Artificial Sequence
  chemically synthesized
taaaacataggaaatcaaat

SEQ ID NO: 380409 - DNA, 20 bp, Artificial Sequence
  chemically synthesized
atcaaatgagaacatttcct

SEQ ID NO: 380410 - DNA, 20 bp, Artificial Sequence
  chemically synthesized
tcaaatgagaacatttccta

SEQ ID NO: 380411 - DNA, 20 bp, Artificial Sequence
  chemically synthesized
agttgaaaaagcatagcctt

SEQ ID NO: 380412 - DNA, 20 bp, Artificial Sequence
  chemically synthesized
cagttgaaaaagcatagcct

SEQ ID NO: 380413 - DNA, 20 bp, Artificial Sequence
  chemically synthesized
aactaccagttgaaaaagca

SEQ ID NO: 380414 - DNA, 20 bp, Artificial Sequence
  chemically synthesized
taaggctatgctttttcaac

SEQ ID NO: 380415 - DNA, 20 bp, Artificial Sequence
  chemically synthesized
tccccaactaccagttgaaa

SEQ ID NO: 380416 - DNA, 20 bp, Artificial Sequence
  chemically synthesized
ggctatgctttttcaactgg

SEQ ID NO: 380417 - DNA, 20 bp, Artificial Sequence
  chemically synthesized
atgctttttcaactggtagt

SEQ ID NO: 380418 - DNA, 20 bp, Artificial Sequence
  chemically synthesized
tgctttttcaactggtagtt

SEQ ID NO: 380419 - DNA, 20 bp, Artificial Sequence
  chemically synthesized
gctttttcaactggtagttg

SEQ ID NO: 380420 - DNA, 20 bp, Artificial Sequence
  chemically synthesized
tcagtttcctccccaactac

SEQ ID NO: 380421 - DNA, 20 bp, Artificial Sequence
  chemically synthesized
tttttcaactggtagttggg

SEQ ID NO: 380422 - DNA, 20 bp, Artificial Sequence
  chemically synthesized
ttttcaactggtagttgggg

SEQ ID NO: 380423 - DNA, 20 bp, Artificial Sequence
  chemically synthesized
agagcggagattttgaaatt

SEQ ID NO: 380424 - DNA, 20 bp, Artificial Sequence
  chemically synthesized
tagagagaaattatagagcg

SEQ ID NO: 380425 - DNA, 20 bp, Artificial Sequence
  chemically synthesized
gttagagagaaattatagag

SEQ ID NO: 380426 - DNA, 20 bp, Artificial Sequence
  chemically synthesized
agagttagagagaaattata

SEQ ID NO: 380427 - DNA, 20 bp, Artificial Sequence
  chemically synthesized
atagagttagagagaaatta

SEQ ID NO: 380428 - DNA, 20 bp, Artificial Sequence
  chemically synthesized
agtgacaatatagagttaga

SEQ ID NO: 380429 - DNA, 20 bp, Artificial Sequence
  chemically synthesized
gaagtgacaatatagagtta

SEQ ID NO: 380430 - DNA, 20 bp, Artificial Sequence
  chemically synthesized
cagaagtgacaatatagagt

SEQ ID NO: 380431 - DNA, 20 bp, Artificial Sequence
  chemically synthesized
tccccagaagtgacaatata

SEQ ID NO: 380432 - DNA, 20 bp, Artificial Sequence
  chemically synthesized
tttccccagaagtgacaata

SEQ ID NO: 380433 - DNA, 20 bp, Artificial Sequence
  chemically synthesized
taactctatattgtcacttc

SEQ ID NO: 380434 - DNA, 20 bp, Artificial Sequence
  chemically synthesized
aactctatattgtcacttct

SEQ ID NO: 380435 - DNA, 20 bp, Artificial Sequence
  chemically synthesized
actctatattgtcacttctg

SEQ ID NO: 380436 - DNA, 20 bp, Artificial Sequence
  chemically synthesized
tcttctctttttttccccag

SEQ ID NO: 380437 - DNA, 20 bp, Artificial Sequence
  chemically synthesized
ccttcttctctttttttccc

SEQ ID NO: 380438 - DNA, 20 bp, Artificial Sequence
  chemically synthesized
ttgtcacttctggggaaaaa

SEQ ID NO: 380439 - DNA, 20 bp, Artificial Sequence
  chemically synthesized
gtcacttctggggaaaaaaa

SEQ ID NO: 380440 - DNA, 20 bp, Artificial Sequence
  chemically synthesized
acttctggggaaaaaaagag

SEQ ID NO: 380441 - DNA, 20 bp, Artificial Sequence
  chemically synthesized
tctggggaaaaaaagagaag

SEQ ID NO: 380442 - DNA, 20 bp, Artificial Sequence
  chemically synthesized
ctggggaaaaaaagagaaga

SEQ ID NO: 380443 - DNA, 20 bp, Artificial Sequence
  chemically synthesized
agaaggtaaattgcatcttc

SEQ ID NO: 380444 - DNA, 20 bp, Artificial Sequence
  chemically synthesized
cttcttctgaatagagccag

SEQ ID NO: 380445 - DNA, 20 bp, Artificial Sequence
  chemically synthesized
tttcttcttctgaatagagc

SEQ ID NO: 380446 - DNA, 20 bp, Artificial Sequence
  chemically synthesized
ttgcatcttctggctctatt

SEQ ID NO: 380447 - DNA, 20 bp, Artificial Sequence
  chemically synthesized
catcttctggctctattcag

SEQ ID NO: 380448 - DNA, 20 bp, Artificial Sequence
  chemically synthesized
attttttcttcttctgaata

SEQ ID NO: 380449 - DNA, 20 bp, Artificial Sequence
  chemically synthesized
ccattttttcttcttctgaa

SEQ ID NO: 380450 - DNA, 20 bp, Artificial Sequence
  chemically synthesized
cttctggctctattcagaag

SEQ ID NO: 380451 - DNA, 20 bp, Artificial Sequence
  chemically synthesized
ctattcagaagaagaaaaaa

SEQ ID NO: 380452 - DNA, 20 bp, Artificial Sequence
  chemically synthesized
tcagaagaagaaaaaatggt

SEQ ID NO: 380453 - DNA, 20 bp, Artificial Sequence
  chemically synthesized
ggttggtgatctttgttgta

SEQ ID NO: 380454 - DNA, 20 bp, Artificial Sequence
  chemically synthesized
cagataaaatccatacaaca

SEQ ID NO: 380455 - DNA, 20 bp, Artificial Sequence
  chemically synthesized
gttgtatggattttatctga

SEQ ID NO: 380456 - DNA, 20 bp, Artificial Sequence
  chemically synthesized
ttgtatggattttatctgat

SEQ ID NO: 380457 - DNA, 20 bp, Artificial Sequence
  chemically synthesized
gtgtaaactaggagacccat

SEQ ID NO: 380458 - DNA, 20 bp, Artificial Sequence
  chemically synthesized
attttatctgatgggtctcc

SEQ ID NO: 380459 - DNA, 20 bp, Artificial Sequence
  chemically synthesized
caaatctaagtgtaaactag

SEQ ID NO: 380460 - DNA, 20 bp, Artificial Sequence
  chemically synthesized
agcaaatctaagtgtaaact

SEQ ID NO: 380461 - DNA, 20 bp, Artificial Sequence
  chemically synthesized
cagcaaatctaagtgtaaac

SEQ ID NO: 380462 - DNA, 20 bp, Artificial Sequence
  chemically synthesized
tgggtctcctagtttacact

SEQ ID NO: 380463 - DNA, 20 bp, Artificial Sequence
  chemically synthesized
aggatttattcagcaaatct

SEQ ID NO: 380464 - DNA, 20 bp, Artificial Sequence
  chemically synthesized
ggaaatgaggaggatttatt

SEQ ID NO: 380465 - DNA, 20 bp, Artificial Sequence
  chemically synthesized
ttgtctttctggaaatgagg

SEQ ID NO: 380466 - DNA, 20 bp, Artificial Sequence
  chemically synthesized
attgtctttctggaaatgag

SEQ ID NO: 380467 - DNA, 20 bp, Artificial Sequence
  chemically synthesized
gaataaatcctcctcatttc

SEQ ID NO: 380468 - DNA, 20 bp, Artificial Sequence
  chemically synthesized
atattgtctttctggaaatg

SEQ ID NO: 380469 - DNA, 20 bp, Artificial Sequence
  chemically synthesized
catattgtctttctggaaat

SEQ ID NO: 380470 - DNA, 20 bp, Artificial Sequence
  chemically synthesized
aaatcctcctcatttccaga

SEQ ID NO: 380471 - DNA, 20 bp, Artificial Sequence
  chemically synthesized
acaaagccatattgtctttc

SEQ ID NO: 380472 - DNA, 20 bp, Artificial Sequence
  chemically synthesized
tcatttccagaaagacaata

SEQ ID NO: 380473 - DNA, 20 bp, Artificial Sequence
  chemically synthesized
agaaagacaatatggctttg

SEQ ID NO: 380474 - DNA, 20 bp, Artificial Sequence
  chemically synthesized
gaaagacaatatggctttgt

SEQ ID NO: 380475 - DNA, 20 bp, Artificial Sequence
  chemically synthesized
aagacaatatggctttgtgg

SEQ ID NO: 380476 - DNA, 20 bp, Artificial Sequence
  chemically synthesized
gtgccttcagcactcccaca

SEQ ID NO: 380477 - DNA, 20 bp, Artificial Sequence
  chemically synthesized
atggctttgtgggagtgctg

SEQ ID NO: 380478 - DNA, 20 bp, Artificial Sequence
  chemically synthesized
tggctttgtgggagtgctga

SEQ ID NO: 380479 - DNA, 20 bp, Artificial Sequence
  chemically synthesized
aactgacaaagatgtgcctt

SEQ ID NO: 380480 - DNA, 20 bp, Artificial Sequence
  chemically synthesized
tgctgaaggcacatctttgt

SEQ ID NO: 380481 - DNA, 20 bp, Artificial Sequence
  chemically synthesized
tccgatagtgggaactgaca

SEQ ID NO: 380482 - DNA, 20 bp, Artificial Sequence
  chemically synthesized
tctttgtcagttcccactat

SEQ ID NO: 380483 - DNA, 20 bp, Artificial Sequence
  chemically synthesized
tttgtcagttcccactatcg

SEQ ID NO: 380484 - DNA, 20 bp, Artificial Sequence
  chemically synthesized
tactgggagtctccgatagt

SEQ ID NO: 380485 - DNA, 20 bp, Artificial Sequence
  chemically synthesized
gtactgggagtctccgatag

SEQ ID NO: 380486 - DNA, 20 bp, Artificial Sequence
  chemically synthesized
gatgtactgggagtctccga

SEQ ID NO: 380487 - DNA, 20 bp, Artificial Sequence
  chemically synthesized
ttcccactatcggagactcc

SEQ ID NO: 380488 - DNA, 20 bp, Artificial Sequence
  chemically synthesized
ggcatgacaggatgtactgg

SEQ ID NO: 380489 - DNA, 20 bp, Artificial Sequence
  chemically synthesized
ctggcatgacaggatgtact

SEQ ID NO: 380490 - DNA, 20 bp, Artificial Sequence
  chemically synthesized
cctggcatgacaggatgtac

SEQ ID NO: 380491 - DNA, 20 bp, Artificial Sequence
  chemically synthesized
cccagtacatcctgtcatgc

SEQ ID NO: 380492 - DNA, 20 bp, Artificial Sequence
  chemically synthesized
agagcaaatcctggcatgac

SEQ ID NO: 380493 - DNA, 20 bp, Artificial Sequence
  chemically synthesized
ccagtacatcctgtcatgcc

SEQ ID NO: 380494 - DNA, 20 bp, Artificial Sequence
  chemically synthesized
cagagcaaatcctggcatga

SEQ ID NO: 380495 - DNA, 20 bp, Artificial Sequence
  chemically synthesized
ttgtcaggcagagcaaatcc

SEQ ID NO: 380496 - DNA, 20 bp, Artificial Sequence
  chemically synthesized
ttcttccttcttgtcaggca

SEQ ID NO: 380497 - DNA, 20 bp, Artificial Sequence
  chemically synthesized
caggatttgctctgcctgac

SEQ ID NO: 380498 - DNA, 20 bp, Artificial Sequence
  chemically synthesized
gcttcttccttcttgtcagg

SEQ ID NO: 380499 - DNA, 20 bp, Artificial Sequence
  chemically synthesized
gatttgctctgcctgacaag

SEQ ID NO: 380500 - DNA, 20 bp, Artificial Sequence
  chemically synthesized
atttgctctgcctgacaaga

SEQ ID NO: 380501 - DNA, 20 bp, Artificial Sequence
  chemically synthesized
taagcttcttccttcttgtc

SEQ ID NO: 380502 - DNA, 20 bp, Artificial Sequence
  chemically synthesized
ataagcttcttccttcttgt

SEQ ID NO: 380503 - DNA, 20 bp, Artificial Sequence
  chemically synthesized
tgctctgcctgacaagaagg

SEQ ID NO: 380504 - DNA, 20 bp, Artificial Sequence
  chemically synthesized
tctgcctgacaagaaggaag

SEQ ID NO: 380505 - DNA, 20 bp, Artificial Sequence
  chemically synthesized
aagaaggaagaagcttatga

SEQ ID NO: 380506 - DNA, 20 bp, Artificial Sequence
  chemically synthesized
gtcattcagaaagctatcat

SEQ ID NO: 380507 - DNA, 20 bp, Artificial Sequence
  chemically synthesized
atttttcagagtcattcaga

SEQ ID NO: 380508 - DNA, 20 bp, Artificial Sequence
  chemically synthesized
cttcatttttcagagtcatt

SEQ ID NO: 380509 - DNA, 20 bp, Artificial Sequence
  chemically synthesized
cagagcagcttcatttttca

SEQ ID NO: 380510 - DNA, 20 bp, Artificial Sequence
  chemically synthesized
ctgaatgactctgaaaaatg

SEQ ID NO: 380511 - DNA, 20 bp, Artificial Sequence
  chemically synthesized
tgcagagcagcttcattttt

SEQ ID NO: 380512 - DNA, 20 bp, Artificial Sequence
  chemically synthesized
tgaaaaatgaagctgctctg

SEQ ID NO: 380513 - DNA, 20 bp, Artificial Sequence
  chemically synthesized
gaaaaatgaagctgctctgc

SEQ ID NO: 380514 - DNA, 20 bp, Artificial Sequence
  chemically synthesized
tagtgatgatacctgcagag

SEQ ID NO: 380515 - DNA, 20 bp, Artificial Sequence
  chemically synthesized
gtctagtgatgatacctgca

SEQ ID NO: 380516 - DNA, 20 bp, Artificial Sequence
  chemically synthesized
tggtctagtgatgatacctg

SEQ ID NO: 380517 - DNA, 20 bp, Artificial Sequence
  chemically synthesized
tgctctgcaggtatcatcac

SEQ ID NO: 380518 - DNA, 20 bp, Artificial Sequence
  chemically synthesized
caggtatcatcactagacca

SEQ ID NO: 380519 - DNA, 20 bp, Artificial Sequence
  chemically synthesized
tattgagtttatctgtggtc

SEQ ID NO: 380520 - DNA, 20 bp, Artificial Sequence
  chemically synthesized
aatgttattgagtttatctg

SEQ ID NO: 380521 - DNA, 20 bp, Artificial Sequence
  chemically synthesized
tctagcagatgaatgttatt

SEQ ID NO: 380522 - DNA, 20 bp, Artificial Sequence
  chemically synthesized
actcaataacattcatctgc

SEQ ID NO: 380523 - DNA, 20 bp, Artificial Sequence
  chemically synthesized
ctttttttttttttttctag

SEQ ID NO: 380524 - DNA, 20 bp, Artificial Sequence
  chemically synthesized
tttctttttttttttttttc

SEQ ID NO: 380525 - DNA, 20 bp, Artificial Sequence
  chemically synthesized
ctgctagaaaaaaaaaaaaa

SEQ ID NO: 380526 - DNA, 20 bp, Artificial Sequence
  chemically synthesized
tagaaaaaaaaaaaaaaaga

SEQ ID NO: 380527 - DNA, 20 bp, Artificial Sequence
  chemically synthesized
aaaaaaaaaaaaagaaagaa

SEQ ID NO: 380528 - DNA, 20 bp, Artificial Sequence
  chemically synthesized
aaaaaaaaaaaagaaagaaa

SEQ ID NO: 380529 - DNA, 20 bp, Artificial Sequence
  chemically synthesized
aaaaaaaaaaagaaagaaaa

SEQ ID NO: 380530 - DNA, 20 bp, Artificial Sequence
  chemically synthesized
gaaagaaaagggttcacttc

SEQ ID NO: 380531 - DNA, 20 bp, Artificial Sequence
  chemically synthesized
aaaagggttcacttccagat

SEQ ID NO: 380532 - DNA, 20 bp, Artificial Sequence
  chemically synthesized
tctaccaaaggctgatctgg

SEQ ID NO: 380533 - DNA, 20 bp, Artificial Sequence
  chemically synthesized
atctctaccaaaggctgatc

SEQ ID NO: 380534 - DNA, 20 bp, Artificial Sequence
  chemically synthesized
ttcacttccagatcagcctt

SEQ ID NO: 380535 - DNA, 20 bp, Artificial Sequence
  chemically synthesized
acttccagatcagcctttgg

SEQ ID NO: 380536 - DNA, 20 bp, Artificial Sequence
  chemically synthesized
ttccagatcagcctttggta

SEQ ID NO: 380537 - DNA, 20 bp, Artificial Sequence
  chemically synthesized
ctactgcctatctctaccaa

SEQ ID NO: 380538 - DNA, 20 bp, Artificial Sequence
  chemically synthesized
cctactgcctatctctacca

SEQ ID NO: 380539 - DNA, 20 bp, Artificial Sequence
  chemically synthesized
agatcagcctttggtagaga

SEQ ID NO: 380540 - DNA, 20 bp, Artificial Sequence
  chemically synthesized
gatcagcctttggtagagat

SEQ ID NO: 380541 - DNA, 20 bp, Artificial Sequence
  chemically synthesized
cagcctttggtagagatagg

SEQ ID NO: 380542 - DNA, 20 bp, Artificial Sequence
  chemically synthesized
cctttggtagagataggcag

SEQ ID NO: 380543 - DNA, 20 bp, Artificial Sequence
  chemically synthesized
ctttggtagagataggcagt

SEQ ID NO: 380544 - DNA, 20 bp, Artificial Sequence
  chemically synthesized
tttggtagagataggcagta

SEQ ID NO: 380545 - DNA, 20 bp, Artificial Sequence
  chemically synthesized
agagataggcagtagggact

SEQ ID NO: 380546 - DNA, 20 bp, Artificial Sequence
  chemically synthesized
gataggcagtagggacttgg

SEQ ID NO: 380547 - DNA, 20 bp, Artificial Sequence
  chemically synthesized
gaatgtgactagggactgcc

SEQ ID NO: 380548 - DNA, 20 bp, Artificial Sequence
  chemically synthesized
agtagggacttggcagtccc

SEQ ID NO: 380549 - DNA, 20 bp, Artificial Sequence
  chemically synthesized
ccttcatttgaatgtgacta

SEQ ID NO: 380550 - DNA, 20 bp, Artificial Sequence
  chemically synthesized
accttcatttgaatgtgact

SEQ ID NO: 380551 - DNA, 20 bp, Artificial Sequence
  chemically synthesized
aaccttcatttgaatgtgac

SEQ ID NO: 380552 - DNA, 20 bp, Artificial Sequence
  chemically synthesized
tccctagtcacattcaaatg

SEQ ID NO: 380553 - DNA, 20 bp, Artificial Sequence
  chemically synthesized
ccctagtcacattcaaatga

SEQ ID NO: 380554 - DNA, 20 bp, Artificial Sequence
  chemically synthesized
gtcttagacttcagcacaat

SEQ ID NO: 380555 - DNA, 20 bp, Artificial Sequence
  chemically synthesized
tgtcttagacttcagcacaa

SEQ ID NO: 380556 - DNA, 20 bp, Artificial Sequence
  chemically synthesized
aggttcgacctattgtgctg

SEQ ID NO: 380557 - DNA, 20 bp, Artificial Sequence
  chemically synthesized
gacctattgtgctgaagtct

SEQ ID NO: 380558 - DNA, 20 bp, Artificial Sequence
  chemically synthesized
agcacctttgtcttagactt

SEQ ID NO: 380559 - DNA, 20 bp, Artificial Sequence
  chemically synthesized
ttgtgctgaagtctaagaca

SEQ ID NO: 380560 - DNA, 20 bp, Artificial Sequence
  chemically synthesized
tgtgctgaagtctaagacaa

SEQ ID NO: 380561 - DNA, 20 bp, Artificial Sequence
  chemically synthesized
ctaaataagcacctttgtct

SEQ ID NO: 380562 - DNA, 20 bp, Artificial Sequence
  chemically synthesized
ctaagacaaaggtgcttatt

SEQ ID NO: 380563 - DNA, 20 bp, Artificial Sequence
  chemically synthesized
ataaaataggaaatctaaat

SEQ ID NO: 380564 - DNA, 20 bp, Artificial Sequence
  chemically synthesized
tatttagatttcctatttta

SEQ ID NO: 380565 - DNA, 20 bp, Artificial Sequence
  chemically synthesized
atatattttagccataaaat

SEQ ID NO: 380566 - DNA, 20 bp, Artificial Sequence
  chemically synthesized
catatattttagccataaaa

SEQ ID NO: 380567 - DNA, 20 bp, Artificial Sequence
  chemically synthesized
tcctacagtcacatatattt

SEQ ID NO: 380568 - DNA, 20 bp, Artificial Sequence
  chemically synthesized
ggctaaaatatatgtgactg

SEQ ID NO: 380569 - DNA, 20 bp, Artificial Sequence
  chemically synthesized
gctaaaatatatgtgactgt

SEQ ID NO: 380570 - DNA, 20 bp, Artificial Sequence
  chemically synthesized
tgtccaacagaggattccta

SEQ ID NO: 380571 - DNA, 20 bp, Artificial Sequence
  chemically synthesized
tgactgtaggaatcctctgt

SEQ ID NO: 380572 - DNA, 20 bp, Artificial Sequence
  chemically synthesized
tgtatgcgtatgtccaacag

SEQ ID NO: 380573 - DNA, 20 bp, Artificial Sequence
  chemically synthesized
gtgtatgcgtatgtccaaca

SEQ ID NO: 380574 - DNA, 20 bp, Artificial Sequence
  chemically synthesized
gtgtgtatgcgtatgtccaa

SEQ ID NO: 380575 - DNA, 20 bp, Artificial Sequence
  chemically synthesized
gacccttgcaatagataagt

SEQ ID NO: 380576 - DNA, 20 bp, Artificial Sequence
  chemically synthesized
tatagacccttgcaatagat

SEQ ID NO: 380577 - DNA, 20 bp, Artificial Sequence
  chemically synthesized
cacaccaacttatctattgc

SEQ ID NO: 380578 - DNA, 20 bp, Artificial Sequence
  chemically synthesized
acaccaacttatctattgca

SEQ ID NO: 380579 - DNA, 20 bp, Artificial Sequence
  chemically synthesized
caccaacttatctattgcaa

SEQ ID NO: 380580 - DNA, 20 bp, Artificial Sequence
  chemically synthesized
aataatatagacccttgcaa

SEQ ID NO: 380581 - DNA, 20 bp, Artificial Sequence
  chemically synthesized
attgcaagggtctatattat

SEQ ID NO: 380582 - DNA, 20 bp, Artificial Sequence
  chemically synthesized
atacagtcatactaataata

SEQ ID NO: 380583 - DNA, 20 bp, Artificial Sequence
  chemically synthesized
taataaaattatttaatata

SEQ ID NO: 380584 - DNA, 20 bp, Artificial Sequence
  chemically synthesized
ttcaatgcactcaaattttt

SEQ ID NO: 380585 - DNA, 20 bp, Artificial Sequence
  chemically synthesized
ttttattatctgaaaaattt

SEQ ID NO: 380586 - DNA, 20 bp, Artificial Sequence
  chemically synthesized
tgaaaaatttgagtgcattg

SEQ ID NO: 380587 - DNA, 20 bp, Artificial Sequence
  chemically synthesized
aggacttagatttcaggagt

SEQ ID NO: 380588 - DNA, 20 bp, Artificial Sequence
  chemically synthesized
aaataggacttagatttcag

SEQ ID NO: 380589 - DNA, 20 bp, Artificial Sequence
  chemically synthesized
aaaactgactcctgaaatct

SEQ ID NO: 380590 - DNA, 20 bp, Artificial Sequence
  chemically synthesized
ttaaataggacttagatttc

SEQ ID NO: 380591 - DNA, 20 bp, Artificial Sequence
  chemically synthesized
attaaataggacttagattt

SEQ ID NO: 380592 - DNA, 20 bp, Artificial Sequence
  chemically synthesized
agttttgattaaataggact

SEQ ID NO: 380593 - DNA, 20 bp, Artificial Sequence
  chemically synthesized
gaagcaagttttgattaaat

SEQ ID NO: 380594 - DNA, 20 bp, Artificial Sequence
  chemically synthesized
tgaagcaagttttgattaaa

SEQ ID NO: 380595 - DNA, 20 bp, Artificial Sequence
  chemically synthesized
ctttgggaaggttttgaagc

SEQ ID NO: 380596 - DNA, 20 bp, Artificial Sequence
  chemically synthesized
gaaactttgggaaggttttg

SEQ ID NO: 380597 - DNA, 20 bp, Artificial Sequence
  chemically synthesized
cttgcttcaaaaccttccca

SEQ ID NO: 380598 - DNA, 20 bp, Artificial Sequence
  chemically synthesized
tacatgttgaaactttggga

SEQ ID NO: 380599 - DNA, 20 bp, Artificial Sequence
  chemically synthesized
atacatgttgaaactttggg

SEQ ID NO: 380600 - DNA, 20 bp, Artificial Sequence
  chemically synthesized
ataatacatgttgaaacttt

SEQ ID NO: 380601 - DNA, 20 bp, Artificial Sequence
  chemically synthesized
aataatacatgttgaaactt

SEQ ID NO: 380602 - DNA, 20 bp, Artificial Sequence
  chemically synthesized
tattttttcgtgtgtgtgac

SEQ ID NO: 380603 - DNA, 20 bp, Artificial Sequence
  chemically synthesized
attttttcgtgtgtgtgaca

SEQ ID NO: 380604 - DNA, 20 bp, Artificial Sequence
  chemically synthesized
caaggtcgcactctgtcgcc

SEQ ID NO: 380605 - DNA, 20 bp, Artificial Sequence
  chemically synthesized
actgcaccatctgggcgaca

SEQ ID NO: 380606 - DNA, 20 bp, Artificial Sequence
  chemically synthesized
ccactgcaccatctgggcga

SEQ ID NO: 380607 - DNA, 20 bp, Artificial Sequence
  chemically synthesized
gtcgcactctgtcgcccaga

SEQ ID NO: 380608 - DNA, 20 bp, Artificial Sequence
  chemically synthesized
atcacaccactgcaccatct

SEQ ID NO: 380609 - DNA, 20 bp, Artificial Sequence
  chemically synthesized
actctgtcgcccagatggtg

SEQ ID NO: 380610 - DNA, 20 bp, Artificial Sequence
  chemically synthesized
gatcacaccactgcaccatc

SEQ ID NO: 380611 - DNA, 20 bp, Artificial Sequence
  chemically synthesized
ctgtcgcccagatggtgcag

SEQ ID NO: 380612 - DNA, 20 bp, Artificial Sequence
  chemically synthesized
atggtgcagtggtgtgatct

SEQ ID NO: 380613 - DNA, 20 bp, Artificial Sequence
  chemically synthesized
ggcagaggttgcagtgaact

SEQ ID NO: 380614 - DNA, 20 bp, Artificial Sequence
  chemically synthesized
gaggcgggaggcagaggttg

SEQ ID NO: 380615 - DNA, 20 bp, Artificial Sequence
  chemically synthesized
tcacttgaggcgggaggcag

SEQ ID NO: 380616 - DNA, 20 bp, Artificial Sequence
  chemically synthesized
ttcacttgaggcgggaggca

SEQ ID NO: 380617 - DNA, 20 bp, Artificial Sequence
  chemically synthesized
gtttcacttgaggcgggagg

SEQ ID NO: 380618 - DNA, 20 bp, Artificial Sequence
  chemically synthesized
gaggtttcacttgaggcggg

SEQ ID NO: 380619 - DNA, 20 bp, Artificial Sequence
  chemically synthesized
caacctctgcctcccgcctc

SEQ ID NO: 380620 - DNA, 20 bp, Artificial Sequence
  chemically synthesized
ggaggtttcacttgaggcgg

SEQ ID NO: 380621 - DNA, 20 bp, Artificial Sequence
  chemically synthesized
tgggaggtttcacttgaggc

SEQ ID NO: 380622 - DNA, 20 bp, Artificial Sequence
  chemically synthesized
gtgggaggtttcacttgagg

SEQ ID NO: 380623 - DNA, 20 bp, Artificial Sequence
  chemically synthesized
gaggtgggaggtttcacttg

SEQ ID NO: 380624 - DNA, 20 bp, Artificial Sequence
  chemically synthesized
tgaggtgggaggtttcactt

SEQ ID NO: 380625 - DNA, 20 bp, Artificial Sequence
  chemically synthesized
tcaagtgaaacctcccacct

SEQ ID NO: 380626 - DNA, 20 bp, Artificial Sequence
  chemically synthesized
acttgggaggctgaggtggg

SEQ ID NO: 380627 - DNA, 20 bp, Artificial Sequence
  chemically synthesized
tacttgggaggctgaggtgg

SEQ ID NO: 380628 - DNA, 20 bp, Artificial Sequence
  chemically synthesized
gctacttgggaggctgaggt

SEQ ID NO: 380629 - DNA, 20 bp, Artificial Sequence
  chemically synthesized
agctacttgggaggctgagg

SEQ ID NO: 380630 - DNA, 20 bp, Artificial Sequence
  chemically synthesized
tccagctacttgggaggctg

SEQ ID NO: 380631 - DNA, 20 bp, Artificial Sequence
  chemically synthesized
ttccagctacttgggaggct

SEQ ID NO: 380632 - DNA, 20 bp, Artificial Sequence
  chemically synthesized
acctcccacctcagcctccc

SEQ ID NO: 380633 - DNA, 20 bp, Artificial Sequence
  chemically synthesized
tcccacctcagcctcccaag

SEQ ID NO: 380634 - DNA, 20 bp, Artificial Sequence
  chemically synthesized
tgtaattccagctacttggg

SEQ ID NO: 380635 - DNA, 20 bp, Artificial Sequence
  chemically synthesized
ctgtaattccagctacttgg

SEQ ID NO: 380636 - DNA, 20 bp, Artificial Sequence
  chemically synthesized
acctcagcctcccaagtagc

SEQ ID NO: 380637 - DNA, 20 bp, Artificial Sequence
  chemically synthesized
acctgtaattccagctactt

SEQ ID NO: 380638 - DNA, 20 bp, Artificial Sequence
  chemically synthesized
cacctgtaattccagctact

SEQ ID NO: 380639 - DNA, 20 bp, Artificial Sequence
  chemically synthesized
ctcccaagtagctggaatta

SEQ ID NO: 380640 - DNA, 20 bp, Artificial Sequence
  chemically synthesized
tcccaagtagctggaattac

SEQ ID NO: 380641 - DNA, 20 bp, Artificial Sequence
  chemically synthesized
gtggtgggcacctgtaattc

SEQ ID NO: 380642 - DNA, 20 bp, Artificial Sequence
  chemically synthesized
aattagctgtgtgtggtggt

SEQ ID NO: 380643 - DNA, 20 bp, Artificial Sequence
  chemically synthesized
aaattagctgtgtgtggtgg

SEQ ID NO: 380644 - DNA, 20 bp, Artificial Sequence
  chemically synthesized
caggtgcccaccaccacaca

SEQ ID NO: 380645 - DNA, 20 bp, Artificial Sequence
  chemically synthesized
caaaaattagctgtgtgtgg

SEQ ID NO: 380646 - DNA, 20 bp, Artificial Sequence
  chemically synthesized
ccacaaaaattagctgtgtg

SEQ ID NO: 380647 - DNA, 20 bp, Artificial Sequence
  chemically synthesized
ccacacacagctaatttttg

SEQ ID NO: 380648 - DNA, 20 bp, Artificial Sequence
  chemically synthesized
tctgcaaaacccacaaaaat

SEQ ID NO: 380649 - DNA, 20 bp, Artificial Sequence
  chemically synthesized
cacacacagctaatttttgt

SEQ ID NO: 380650 - DNA, 20 bp, Artificial Sequence
  chemically synthesized
gctaatttttgtgggttttg

SEQ ID NO: 380651 - DNA, 20 bp, Artificial Sequence
  chemically synthesized
taatttttgtgggttttgca

SEQ ID NO: 380652 - DNA, 20 bp, Artificial Sequence
  chemically synthesized
tttgtgggttttgcagagat

SEQ ID NO: 380653 - DNA, 20 bp, Artificial Sequence
  chemically synthesized
ttgtgggttttgcagagatg

SEQ ID NO: 380654 - DNA, 20 bp, Artificial Sequence
  chemically synthesized
tgaggtttcaccatgttgtc

SEQ ID NO: 380655 - DNA, 20 bp, Artificial Sequence
  chemically synthesized
cgagaccagcctggacaaca

SEQ ID NO: 380656 - DNA, 20 bp, Artificial Sequence
  chemically synthesized
gaggtttcaccatgttgtcc

SEQ ID NO: 380657 - DNA, 20 bp, Artificial Sequence
  chemically synthesized
tttcaccatgttgtccaggc

SEQ ID NO: 380658 - DNA, 20 bp, Artificial Sequence
  chemically synthesized
ccaggagttcgagaccagcc

SEQ ID NO: 380659 - DNA, 20 bp, Artificial Sequence
  chemically synthesized
tgagcccaggagttcgagac

SEQ ID NO: 380660 - DNA, 20 bp, Artificial Sequence
  chemically synthesized
ccaggctggtctcgaactcc

SEQ ID NO: 380661 - DNA, 20 bp, Artificial Sequence
  chemically synthesized
tcgcttgagcccaggagttc

SEQ ID NO: 380662 - DNA, 20 bp, Artificial Sequence
  chemically synthesized
caggctggtctcgaactcct

SEQ ID NO: 380663 - DNA, 20 bp, Artificial Sequence
  chemically synthesized
ggcagatcgcttgagcccag

SEQ ID NO: 380664 - DNA, 20 bp, Artificial Sequence
  chemically synthesized
ggtctcgaactcctgggctc

SEQ ID NO: 380665 - DNA, 20 bp, Artificial Sequence
  chemically synthesized
caggcagatcgcttgagccc

SEQ ID NO: 380666 - DNA, 20 bp, Artificial Sequence
  chemically synthesized
gcaggcagatcgcttgagcc

SEQ ID NO: 380667 - DNA, 20 bp, Artificial Sequence
  chemically synthesized
ccaaggcaggcagatcgctt

SEQ ID NO: 380668 - DNA, 20 bp, Artificial Sequence
  chemically synthesized
ctcaagcgatctgcctgcct

SEQ ID NO: 380669 - DNA, 20 bp, Artificial Sequence
  chemically synthesized
ctttgggaggccaaggcagg

SEQ ID NO: 380670 - DNA, 20 bp, Artificial Sequence
  chemically synthesized
gcactttgggaggccaaggc

SEQ ID NO: 380671 - DNA, 20 bp, Artificial Sequence
  chemically synthesized
agcactttgggaggccaagg

SEQ ID NO: 380672 - DNA, 20 bp, Artificial Sequence
  chemically synthesized
gccagcactttgggaggcca

SEQ ID NO: 380673 - DNA, 20 bp, Artificial Sequence
  chemically synthesized
tgccagcactttgggaggcc

SEQ ID NO: 380674 - DNA, 20 bp, Artificial Sequence
  chemically synthesized
ctgcctgccttggcctccca

SEQ ID NO: 380675 - DNA, 20 bp, Artificial Sequence
  chemically synthesized
tgtaatgccagcactttggg

SEQ ID NO: 380676 - DNA, 20 bp, Artificial Sequence
  chemically synthesized
ctgtaatgccagcactttgg

SEQ ID NO: 380677 - DNA, 20 bp, Artificial Sequence
  chemically synthesized
gccttggcctcccaaagtgc

SEQ ID NO: 380678 - DNA, 20 bp, Artificial Sequence
  chemically synthesized
gcctgtaatgccagcacttt

SEQ ID NO: 380679 - DNA, 20 bp, Artificial Sequence
  chemically synthesized
tgcctgtaatgccagcactt

SEQ ID NO: 380680 - DNA, 20 bp, Artificial Sequence
  chemically synthesized
ctcccaaagtgctggcatta

SEQ ID NO: 380681 - DNA, 20 bp, Artificial Sequence
  chemically synthesized
tcccaaagtgctggcattac

SEQ ID NO: 380682 - DNA, 20 bp, Artificial Sequence
  chemically synthesized
gtggctcatgcctgtaatgc

SEQ ID NO: 380683 - DNA, 20 bp, Artificial Sequence
  chemically synthesized
agtgctggcattacaggcat

SEQ ID NO: 380684 - DNA, 20 bp, Artificial Sequence
  chemically synthesized
caggcatgagccactgcacc

SEQ ID NO: 380685 - DNA, 20 bp, Artificial Sequence
  chemically synthesized
tacatgttgaccgggtgcag

SEQ ID NO: 380686 - DNA, 20 bp, Artificial Sequence
  chemically synthesized
gaatacatgttgaccgggtg

SEQ ID NO: 380687 - DNA, 20 bp, Artificial Sequence
  chemically synthesized
tttaagaatacatgttgacc

SEQ ID NO: 380688 - DNA, 20 bp, Artificial Sequence
  chemically synthesized
gtttaagaatacatgttgac

SEQ ID NO: 380689 - DNA, 20 bp, Artificial Sequence
  chemically synthesized
ggtcaacatgtattcttaaa

SEQ ID NO: 380690 - DNA, 20 bp, Artificial Sequence
  chemically synthesized
aaagcattttaaatctgttt

SEQ ID NO: 380691 - DNA, 20 bp, Artificial Sequence
  chemically synthesized
gatttaaaatgctttcttca

SEQ ID NO: 380692 - DNA, 20 bp, Artificial Sequence
  chemically synthesized
catttttaatgctatgaaga

SEQ ID NO: 380693 - DNA, 20 bp, Artificial Sequence
  chemically synthesized
gaaacatttttaatgctatg

SEQ ID NO: 380694 - DNA, 20 bp, Artificial Sequence
  chemically synthesized
tgtttcacaataatttacat

SEQ ID NO: 380695 - DNA, 20 bp, Artificial Sequence
  chemically synthesized
taatttacatgagaactcta

SEQ ID NO: 380696 - DNA, 20 bp, Artificial Sequence
  chemically synthesized
tttacatgagaactctatgg

SEQ ID NO: 380697 - DNA, 20 bp, Artificial Sequence
  chemically synthesized
aaatatattaagcttccata

SEQ ID NO: 380698 - DNA, 20 bp, Artificial Sequence
  chemically synthesized
ggaaatatattaagcttcca

SEQ ID NO: 380699 - DNA, 20 bp, Artificial Sequence
  chemically synthesized
tcctatgctggaaatatatt

SEQ ID NO: 380700 - DNA, 20 bp, Artificial Sequence
  chemically synthesized
atggaagcttaatatatttc

SEQ ID NO: 380701 - DNA, 20 bp, Artificial Sequence
  chemically synthesized
agcttaatatatttccagca

SEQ ID NO: 380702 - DNA, 20 bp, Artificial Sequence
  chemically synthesized
gcttaatatatttccagcat

SEQ ID NO: 380703 - DNA, 20 bp, Artificial Sequence
  chemically synthesized
tcattgtgtgtatcctatgc

SEQ ID NO: 380704 - DNA, 20 bp, Artificial Sequence
  chemically synthesized
cacacaatgattcaatgtcc

SEQ ID NO: 380705 - DNA, 20 bp, Artificial Sequence
  chemically synthesized
ttatgtgtacttcaagggcc

SEQ ID NO: 380706 - DNA, 20 bp, Artificial Sequence
  chemically synthesized
attcaatgtcctggcccttg

SEQ ID NO: 380707 - DNA, 20 bp, Artificial Sequence
  chemically synthesized
attatgtgtacttcaagggc

SEQ ID NO: 380708 - DNA, 20 bp, Artificial Sequence
  chemically synthesized
tccaattatgtgtacttcaa

SEQ ID NO: 380709 - DNA, 20 bp, Artificial Sequence
  chemically synthesized
ttccaattatgtgtacttca

SEQ ID NO: 380710 - DNA, 20 bp, Artificial Sequence
  chemically synthesized
attccaattatgtgtacttc

SEQ ID NO: 380711 - DNA, 20 bp, Artificial Sequence
  chemically synthesized
gcccttgaagtacacataat

SEQ ID NO: 380712 - DNA, 20 bp, Artificial Sequence
  chemically synthesized
gaagtacacataattggaat

SEQ ID NO: 380713 - DNA, 20 bp, Artificial Sequence
  chemically synthesized
aagtacacataattggaatg

SEQ ID NO: 380714 - DNA, 20 bp, Artificial Sequence
  chemically synthesized
gtacacataattggaatgag

SEQ ID NO: 380715 - DNA, 20 bp, Artificial Sequence
  chemically synthesized
cacataattggaatgaggag

SEQ ID NO: 380716 - DNA, 20 bp, Artificial Sequence
  chemically synthesized
acataattggaatgaggaga

SEQ ID NO: 380717 - DNA, 20 bp, Artificial Sequence
  chemically synthesized
ggaatgaggagaaggacatt

SEQ ID NO: 380718 - DNA, 20 bp, Artificial Sequence
  chemically synthesized
atagcaggtatcatattgca

SEQ ID NO: 380719 - DNA, 20 bp, Artificial Sequence
  chemically synthesized
gtaagaacctgtacaatagc

SEQ ID NO: 380720 - DNA, 20 bp, Artificial Sequence
  chemically synthesized
tgtaagaacctgtacaatag

SEQ ID NO: 380721 - DNA, 20 bp, Artificial Sequence
  chemically synthesized
atatgatacctgctattgta

SEQ ID NO: 380722 - DNA, 20 bp, Artificial Sequence
  chemically synthesized
tatgatacctgctattgtac

SEQ ID NO: 380723 - DNA, 20 bp, Artificial Sequence
  chemically synthesized
acctgtaagaacctgtacaa

SEQ ID NO: 380724 - DNA, 20 bp, Artificial Sequence
  chemically synthesized
tgctattgtacaggttctta

SEQ ID NO: 380725 - DNA, 20 bp, Artificial Sequence
  chemically synthesized
gctattgtacaggttcttac

SEQ ID NO: 380726 - DNA, 20 bp, Artificial Sequence
  chemically synthesized
gattcttctgtagcacctgt

SEQ ID NO: 380727 - DNA, 20 bp, Artificial Sequence
  chemically synthesized
acaggttcttacaggtgcta

SEQ ID NO: 380728 - DNA, 20 bp, Artificial Sequence
  chemically synthesized
ggttcttacaggtgctacag

SEQ ID NO: 380729 - DNA, 20 bp, Artificial Sequence
  chemically synthesized
cctttcctttgattcttctg

SEQ ID NO: 380730 - DNA, 20 bp, Artificial Sequence
  chemically synthesized
caggtgctacagaagaatca

SEQ ID NO: 380731 - DNA, 20 bp, Artificial Sequence
  chemically synthesized
aggtgctacagaagaatcaa

SEQ ID NO: 380732 - DNA, 20 bp, Artificial Sequence
  chemically synthesized
gctacagaagaatcaaagga

SEQ ID NO: 380733 - DNA, 20 bp, Artificial Sequence
  chemically synthesized
ctacagaagaatcaaaggaa

SEQ ID NO: 380734 - DNA, 20 bp, Artificial Sequence
  chemically synthesized
tacagaagaatcaaaggaaa

SEQ ID NO: 380735 - DNA, 20 bp, Artificial Sequence
  chemically synthesized
cagaagaatcaaaggaaagg

SEQ ID NO: 380736 - DNA, 20 bp, Artificial Sequence
  chemically synthesized
ttaattctctgaggtggaat

SEQ ID NO: 380737 - DNA, 20 bp, Artificial Sequence
  chemically synthesized
aagggagactaattccacct

SEQ ID NO: 380738 - DNA, 20 bp, Artificial Sequence
  chemically synthesized
gggagactaattccacctca

SEQ ID NO: 380739 - DNA, 20 bp, Artificial Sequence
  chemically synthesized
atttcattaattctctgagg

SEQ ID NO: 380740 - DNA, 20 bp, Artificial Sequence
  chemically synthesized
tacatttcattaattctctg

SEQ ID NO: 380741 - DNA, 20 bp, Artificial Sequence
  chemically synthesized
atacatttcattaattctct

SEQ ID NO: 380742 - DNA, 20 bp, Artificial Sequence
  chemically synthesized
agaattaatgaaatgtatca

SEQ ID NO: 380743 - DNA, 20 bp, Artificial Sequence
  chemically synthesized
taatgaaatgtatcacggca

SEQ ID NO: 380744 - DNA, 20 bp, Artificial Sequence
  chemically synthesized
aaatgtatcacggcaaagat

SEQ ID NO: 380745 - DNA, 20 bp, Artificial Sequence
  chemically synthesized
ggcaaagatcagattttgtc

SEQ ID NO: 380746 - DNA, 20 bp, Artificial Sequence
  chemically synthesized
gcaaagatcagattttgtct

SEQ ID NO: 380747 - DNA, 20 bp, Artificial Sequence
  chemically synthesized
cagattttgtctgggtccca

SEQ ID NO: 380748 - DNA, 20 bp, Artificial Sequence
  chemically synthesized
tttgaacgtcctttgggacc

SEQ ID NO: 380749 - DNA, 20 bp, Artificial Sequence
  chemically synthesized
agattttgtctgggtcccaa

SEQ ID NO: 380750 - DNA, 20 bp, Artificial Sequence
  chemically synthesized
caagcttttgaacgtccttt

SEQ ID NO: 380751 - DNA, 20 bp, Artificial Sequence
  chemically synthesized
ccaagcttttgaacgtcctt

SEQ ID NO: 380752 - DNA, 20 bp, Artificial Sequence
  chemically synthesized
gggtcccaaaggacgttcaa

SEQ ID NO: 380753 - DNA, 20 bp, Artificial Sequence
  chemically synthesized
ccaaaggacgttcaaaagct

SEQ ID NO: 380754 - DNA, 20 bp, Artificial Sequence
  chemically synthesized
aaggacgttcaaaagcttgg

SEQ ID NO: 380755 - DNA, 20 bp, Artificial Sequence
  chemically synthesized
aggacgttcaaaagcttggt

SEQ ID NO: 380756 - DNA, 20 bp, Artificial Sequence
  chemically synthesized
tcccactttctcaacctacc

SEQ ID NO: 380757 - DNA, 20 bp, Artificial Sequence
  chemically synthesized
gttcaaaagcttggtaggtt

SEQ ID NO: 380758 - DNA, 20 bp, Artificial Sequence
  chemically synthesized
aaaagcttggtaggttgaga

SEQ ID NO: 380759 - DNA, 20 bp, Artificial Sequence
  chemically synthesized
agcttggtaggttgagaaag

SEQ ID NO: 380760 - DNA, 20 bp, Artificial Sequence
  chemically synthesized
gcttggtaggttgagaaagt

SEQ ID NO: 380761 - DNA, 20 bp, Artificial Sequence
  chemically synthesized
taggttgagaaagtgggaaa

SEQ ID NO: 380762 - DNA, 20 bp, Artificial Sequence
  chemically synthesized
gaaagtgggaaacagcattc

SEQ ID NO: 380763 - DNA, 20 bp, Artificial Sequence
  chemically synthesized
aaagtgggaaacagcattcc

SEQ ID NO: 380764 - DNA, 20 bp, Artificial Sequence
  chemically synthesized
ggaaacagcattccaggtct

SEQ ID NO: 380765 - DNA, 20 bp, Artificial Sequence
  chemically synthesized
gaaacagcattccaggtcta

SEQ ID NO: 380766 - DNA, 20 bp, Artificial Sequence
  chemically synthesized
taaggcagtctccttagacc

SEQ ID NO: 380767 - DNA, 20 bp, Artificial Sequence
  chemically synthesized
aacagcattccaggtctaag

SEQ ID NO: 380768 - DNA, 20 bp, Artificial Sequence
  chemically synthesized
aaactttaaggcagtctcct

SEQ ID NO: 380769 - DNA, 20 bp, Artificial Sequence
  chemically synthesized
ggtctaaggagactgcctta

SEQ ID NO: 380770 - DNA, 20 bp, Artificial Sequence
  chemically synthesized
gtcctacttaaactttaagg

SEQ ID NO: 380771 - DNA, 20 bp, Artificial Sequence
  chemically synthesized
actgtcctacttaaacttta

SEQ ID NO: 380772 - DNA, 20 bp, Artificial Sequence
  chemically synthesized
aggagactgccttaaagttt

SEQ ID NO: 380773 - DNA, 20 bp, Artificial Sequence
  chemically synthesized
gactgtcctacttaaacttt

SEQ ID NO: 380774 - DNA, 20 bp, Artificial Sequence
  chemically synthesized
agactgccttaaagtttaag

SEQ ID NO: 380775 - DNA, 20 bp, Artificial Sequence
  chemically synthesized
gactgccttaaagtttaagt

SEQ ID NO: 380776 - DNA, 20 bp, Artificial Sequence
  chemically synthesized
gccttaaagtttaagtagga

SEQ ID NO: 380777 - DNA, 20 bp, Artificial Sequence
  chemically synthesized
aagtttaagtaggacagtca

SEQ ID NO: 380778 - DNA, 20 bp, Artificial Sequence
  chemically synthesized
gtttaagtaggacagtcaaa

SEQ ID NO: 380779 - DNA, 20 bp, Artificial Sequence
  chemically synthesized
taagtaggacagtcaaagag

SEQ ID NO: 380780 - DNA, 20 bp, Artificial Sequence
  chemically synthesized
agtaggacagtcaaagagtg

SEQ ID NO: 380781 - DNA, 20 bp, Artificial Sequence
  chemically synthesized
gtaggacagtcaaagagtgg

SEQ ID NO: 380782 - DNA, 20 bp, Artificial Sequence
  chemically synthesized
agtcaaagagtggaggaaat

SEQ ID NO: 380783 - DNA, 20 bp, Artificial Sequence
  chemically synthesized
gtggaggaaataagtcaaaa

SEQ ID NO: 380784 - DNA, 20 bp, Artificial Sequence
  chemically synthesized
tggaggaaataagtcaaaat

SEQ ID NO: 380785 - DNA, 20 bp, Artificial Sequence
  chemically synthesized
aataggaaaatgacaaaaaa

SEQ ID NO: 380786 - DNA, 20 bp, Artificial Sequence
  chemically synthesized
taggaaaatgacaaaaaata

SEQ ID NO: 380787 - DNA, 20 bp, Artificial Sequence
  chemically synthesized
acaaaaaatagagaaccttg

SEQ ID NO: 380788 - DNA, 20 bp, Artificial Sequence
  chemically synthesized
caaaaaatagagaaccttgt

SEQ ID NO: 380789 - DNA, 20 bp, Artificial Sequence
  chemically synthesized
aaatagagaaccttgtaggc

SEQ ID NO: 380790 - DNA, 20 bp, Artificial Sequence
  chemically synthesized
agtcctaagcctggcctaca

SEQ ID NO: 380791 - DNA, 20 bp, Artificial Sequence
  chemically synthesized
aatagagaaccttgtaggcc

SEQ ID NO: 380792 - DNA, 20 bp, Artificial Sequence
  chemically synthesized
aagtcctaagcctggcctac

SEQ ID NO: 380793 - DNA, 20 bp, Artificial Sequence
  chemically synthesized
agaaccttgtaggccaggct

SEQ ID NO: 380794 - DNA, 20 bp, Artificial Sequence
  chemically synthesized
gaaccttgtaggccaggctt

SEQ ID NO: 380795 - DNA, 20 bp, Artificial Sequence
  chemically synthesized
taagttagaagtcctaagcc

SEQ ID NO: 380796 - DNA, 20 bp, Artificial Sequence
  chemically synthesized
tgtcttaagttagaagtcct

SEQ ID NO: 380797 - DNA, 20 bp, Artificial Sequence
  chemically synthesized
aggcttaggacttctaactt

SEQ ID NO: 380798 - DNA, 20 bp, Artificial Sequence
  chemically synthesized
tctccattgtcttaagttag

SEQ ID NO: 380799 - DNA, 20 bp, Artificial Sequence
  chemically synthesized
tgatctccattgtcttaagt

SEQ ID NO: 380800 - DNA, 20 bp, Artificial Sequence
  chemically synthesized
ggacttctaacttaagacaa

SEQ ID NO: 380801 - DNA, 20 bp, Artificial Sequence
  chemically synthesized
ttgatgatctccattgtctt

SEQ ID NO: 380802 - DNA, 20 bp, Artificial Sequence
  chemically synthesized
acttctaacttaagacaatg

SEQ ID NO: 380803 - DNA, 20 bp, Artificial Sequence
  chemically synthesized
taagacaatggagatcatca

SEQ ID NO: 380804 - DNA, 20 bp, Artificial Sequence
  chemically synthesized
ggagatcatcaaagaccctt

SEQ ID NO: 380805 - DNA, 20 bp, Artificial Sequence
  chemically synthesized
ctcagacttagtcatctaaa

SEQ ID NO: 380806 - DNA, 20 bp, Artificial Sequence
  chemically synthesized
tctcagacttagtcatctaa

SEQ ID NO: 380807 - DNA, 20 bp, Artificial Sequence
  chemically synthesized
ctctcagacttagtcatcta

SEQ ID NO: 380808 - DNA, 20 bp, Artificial Sequence
  chemically synthesized
caaagaccctttagatgact

SEQ ID NO: 380809 - DNA, 20 bp, Artificial Sequence
  chemically synthesized
ccctttagatgactaagtct

SEQ ID NO: 380810 - DNA, 20 bp, Artificial Sequence
  chemically synthesized
ctttagatgactaagtctga

SEQ ID NO: 380811 - DNA, 20 bp, Artificial Sequence
  chemically synthesized
ttacacactgctctcagact

SEQ ID NO: 380812 - DNA, 20 bp, Artificial Sequence
  chemically synthesized
tagatgactaagtctgagag

SEQ ID NO: 380813 - DNA, 20 bp, Artificial Sequence
  chemically synthesized
atccttttacacactgctct

SEQ ID NO: 380814 - DNA, 20 bp, Artificial Sequence
  chemically synthesized
agtctgagagcagtgtgtaa

SEQ ID NO: 380815 - DNA, 20 bp, Artificial Sequence
  chemically synthesized
gtctgagagcagtgtgtaaa

SEQ ID NO: 380816 - DNA, 20 bp, Artificial Sequence
  chemically synthesized
agagcagtgtgtaaaaggat

SEQ ID NO: 380817 - DNA, 20 bp, Artificial Sequence
  chemically synthesized
tgtaaaaggattggcttgaa

SEQ ID NO: 380818 - DNA, 20 bp, Artificial Sequence
  chemically synthesized
ttcctgattttgatcttttc

SEQ ID NO: 380819 - DNA, 20 bp, Artificial Sequence
  chemically synthesized
tggcttgaaaagatcaaaat

SEQ ID NO: 380820 - DNA, 20 bp, Artificial Sequence
  chemically synthesized
ggcttgaaaagatcaaaatc

SEQ ID NO: 380821 - DNA, 20 bp, Artificial Sequence
  chemically synthesized
ttgaaaagatcaaaatcagg

SEQ ID NO: 380822 - DNA, 20 bp, Artificial Sequence
  chemically synthesized
aagatcaaaatcaggaagtc

SEQ ID NO: 380823 - DNA, 20 bp, Artificial Sequence
  chemically synthesized
tcaaaatcaggaagtccaga

SEQ ID NO: 380824 - DNA, 20 bp, Artificial Sequence
  chemically synthesized
atagtcttctcaattctatc

SEQ ID NO: 380825 - DNA, 20 bp, Artificial Sequence
  chemically synthesized
caggaagtccagatagaatt

SEQ ID NO: 380826 - DNA, 20 bp, Artificial Sequence
  chemically synthesized
gaagtccagatagaattgag

SEQ ID NO: 380827 - DNA, 20 bp, Artificial Sequence
  chemically synthesized
agatagaattgagaagacta

SEQ ID NO: 380828 - DNA, 20 bp, Artificial Sequence
  chemically synthesized
attgagaagactatggcaaa

SEQ ID NO: 380829 - DNA, 20 bp, Artificial Sequence
  chemically synthesized
tcaaccaacactatttgcca

SEQ ID NO: 380830 - DNA, 20 bp, Artificial Sequence
  chemically synthesized
aagactatggcaaatagtgt

SEQ ID NO: 380831 - DNA, 20 bp, Artificial Sequence
  chemically synthesized
aaatagtgttggttgatgaa

SEQ ID NO: 380832 - DNA, 20 bp, Artificial Sequence
  chemically synthesized
aatagtgttggttgatgaaa

SEQ ID NO: 380833 - DNA, 20 bp, Artificial Sequence
  chemically synthesized
ggttgatgaaaaggcattgt

SEQ ID NO: 380834 - DNA, 20 bp, Artificial Sequence
  chemically synthesized
aaaggcattgttggtattaa

SEQ ID NO: 380835 - DNA, 20 bp, Artificial Sequence
  chemically synthesized
aaggcattgttggtattaat

SEQ ID NO: 380836 - DNA, 20 bp, Artificial Sequence
  chemically synthesized
ggcattgttggtattaatgg

SEQ ID NO: 380837 - DNA, 20 bp, Artificial Sequence
  chemically synthesized
ttggtattaatgggagattc

SEQ ID NO: 380838 - DNA, 20 bp, Artificial Sequence
  chemically synthesized
ggtattaatgggagattcca

SEQ ID NO: 380839 - DNA, 20 bp, Artificial Sequence
  chemically synthesized
aacaggttggatagtatctc

SEQ ID NO: 380840 - DNA, 20 bp, Artificial Sequence
  chemically synthesized
aaagtataaaacaggttgga

SEQ ID NO: 380841 - DNA, 20 bp, Artificial Sequence
  chemically synthesized
caaaaaagtataaaacaggt

SEQ ID NO: 380842 - DNA, 20 bp, Artificial Sequence
  chemically synthesized
tgatcaaaaaagtataaaac

SEQ ID NO: 380843 - DNA, 20 bp, Artificial Sequence
  chemically synthesized
ctgatcaaaaaagtataaaa

SEQ ID NO: 380844 - DNA, 20 bp, Artificial Sequence
  chemically synthesized
ctgttttatacttttttgat

SEQ ID NO: 380845 - DNA, 20 bp, Artificial Sequence
  chemically synthesized
gacatgcaacctgatcaaaa

SEQ ID NO: 380846 - DNA, 20 bp, Artificial Sequence
  chemically synthesized
tgttttatacttttttgatc

SEQ ID NO: 380847 - DNA, 20 bp, Artificial Sequence
  chemically synthesized
tttgatcaggttgcatgtct

SEQ ID NO: 380848 - DNA, 20 bp, Artificial Sequence
  chemically synthesized
atacttcctagggatgttct

SEQ ID NO: 380849 - DNA, 20 bp, Artificial Sequence
  chemically synthesized
tgcatgtctaagaacatccc

SEQ ID NO: 380850 - DNA, 20 bp, Artificial Sequence
  chemically synthesized
gcatgtctaagaacatccct

SEQ ID NO: 380851 - DNA, 20 bp, Artificial Sequence
  chemically synthesized
tgtctaagaacatccctagg

SEQ ID NO: 380852 - DNA, 20 bp, Artificial Sequence
  chemically synthesized
gtgaaaagtaatacttccta

SEQ ID NO: 380853 - DNA, 20 bp, Artificial Sequence
  chemically synthesized
agtgaaaagtaatacttcct

SEQ ID NO: 380854 - DNA, 20 bp, Artificial Sequence
  chemically synthesized
cagtgaaaagtaatacttcc

SEQ ID NO: 380855 - DNA, 20 bp, Artificial Sequence
  chemically synthesized
gtaaaaaataatgcagtgaa

SEQ ID NO: 380856 - DNA, 20 bp, Artificial Sequence
  chemically synthesized
ttgaatagtaaaaaataatg

SEQ ID NO: 380857 - DNA, 20 bp, Artificial Sequence
  chemically synthesized
ccatttactttatagttgaa

SEQ ID NO: 380858 - DNA, 20 bp, Artificial Sequence
  chemically synthesized
ttttttactattcaactata

SEQ ID NO: 380859 - DNA, 20 bp, Artificial Sequence
  chemically synthesized
acatgcatccatttacttta

SEQ ID NO: 380860 - DNA, 20 bp, Artificial Sequence
  chemically synthesized
ctattcaactataaagtaaa

SEQ ID NO: 380861 - DNA, 20 bp, Artificial Sequence
  chemically synthesized
aatggatgcatgtaactgtt

SEQ ID NO: 380862 - DNA, 20 bp, Artificial Sequence
  chemically synthesized
gagtgcaaggaaaggctcaa

SEQ ID NO: 380863 - DNA, 20 bp, Artificial Sequence
  chemically synthesized
tatggcatgagtgcaaggaa

SEQ ID NO: 380864 - DNA, 20 bp, Artificial Sequence
  chemically synthesized
ttatggcatgagtgcaagga

SEQ ID NO: 380865 - DNA, 20 bp, Artificial Sequence
  chemically synthesized
acatttatggcatgagtgca

SEQ ID NO: 380866 - DNA, 20 bp, Artificial Sequence
  chemically synthesized
tacatttatggcatgagtgc

SEQ ID NO: 380867 - DNA, 20 bp, Artificial Sequence
  chemically synthesized
tgttcttacatttatggcat

SEQ ID NO: 380868 - DNA, 20 bp, Artificial Sequence
  chemically synthesized
tgcactcatgccataaatgt

SEQ ID NO: 380869 - DNA, 20 bp, Artificial Sequence
  chemically synthesized
gctttatgttcttacattta

SEQ ID NO: 380870 - DNA, 20 bp, Artificial Sequence
  chemically synthesized
gccataaatgtaagaacata

SEQ ID NO: 380871 - DNA, 20 bp, Artificial Sequence
  chemically synthesized
gaacataaagctacacctta

SEQ ID NO: 380872 - DNA, 20 bp, Artificial Sequence
  chemically synthesized
taaaaggtaactttaaggtg

SEQ ID NO: 380873 - DNA, 20 bp, Artificial Sequence
  chemically synthesized
agagctaaaaggtaacttta

SEQ ID NO: 380874 - DNA, 20 bp, Artificial Sequence
  chemically synthesized
aagagctaaaaggtaacttt

SEQ ID NO: 380875 - DNA, 20 bp, Artificial Sequence
  chemically synthesized
tacaccttaaagttaccttt

SEQ ID NO: 380876 - DNA, 20 bp, Artificial Sequence
  chemically synthesized
taaaaaataaaagagctaaa

SEQ ID NO: 380877 - DNA, 20 bp, Artificial Sequence
  chemically synthesized
ataaaaaataaaagagctaa

SEQ ID NO: 380878 - DNA, 20 bp, Artificial Sequence
  chemically synthesized
ctaaaacataaaaaataaaa

SEQ ID NO: 380879 - DNA, 20 bp, Artificial Sequence
  chemically synthesized
tactaaaacataaaaaataa

SEQ ID NO: 380880 - DNA, 20 bp, Artificial Sequence
  chemically synthesized
ctcttttattttttatgttt

SEQ ID NO: 380881 - DNA, 20 bp, Artificial Sequence
  chemically synthesized
ttttattttttatgttttag

SEQ ID NO: 380882 - DNA, 20 bp, Artificial Sequence
  chemically synthesized
ttttatgttttagtagtatt

SEQ ID NO: 380883 - DNA, 20 bp, Artificial Sequence
  chemically synthesized
cgggactgaattcagtagaa

SEQ ID NO: 380884 - DNA, 20 bp, Artificial Sequence
  chemically synthesized
tcagtctattctactgaatt

SEQ ID NO: 380885 - DNA, 20 bp, Artificial Sequence
  chemically synthesized
caaatcgggactgaattcag

SEQ ID NO: 380886 - DNA, 20 bp, Artificial Sequence
  chemically synthesized
taacaaatcgggactgaatt

SEQ ID NO: 380887 - DNA, 20 bp, Artificial Sequence
  chemically synthesized
taaataaaatataacaaatc

SEQ ID NO: 380888 - DNA, 20 bp, Artificial Sequence
  chemically synthesized
gtaaataaaatataacaaat

SEQ ID NO: 380889 - DNA, 20 bp, Artificial Sequence
  chemically synthesized
tatattttatttactcttca

SEQ ID NO: 380890 - DNA, 20 bp, Artificial Sequence
  chemically synthesized
tttgaaaaactttctttgaa

SEQ ID NO: 380891 - DNA, 20 bp, Artificial Sequence
  chemically synthesized
ttttatttactcttcaaaga

SEQ ID NO: 380892 - DNA, 20 bp, Artificial Sequence
  chemically synthesized
catttgaaaaactttctttg

SEQ ID NO: 380893 - DNA, 20 bp, Artificial Sequence
  chemically synthesized
tcaaatgacaattgaaataa

SEQ ID NO: 380894 - DNA, 20 bp, Artificial Sequence
  chemically synthesized
aatgacaattgaaataaaag

SEQ ID NO: 380895 - DNA, 20 bp, Artificial Sequence
  chemically synthesized
tagataatctacagaacaaa

SEQ ID NO: 380896 - DNA, 20 bp, Artificial Sequence
  chemically synthesized
agaagataccatttgttctg

SEQ ID NO: 380897 - DNA, 20 bp, Artificial Sequence
  chemically synthesized
attggaatgtagataatcta

SEQ ID NO: 380898 - DNA, 20 bp, Artificial Sequence
  chemically synthesized
aggaaataggaattggaatg

SEQ ID NO: 380899 - DNA, 20 bp, Artificial Sequence
  chemically synthesized
ggaacctaggaaataggaat

SEQ ID NO: 380900 - DNA, 20 bp, Artificial Sequence
  chemically synthesized
acattccaattcctatttcc

SEQ ID NO: 380901 - DNA, 20 bp, Artificial Sequence
  chemically synthesized
cattccaattcctatttcct

SEQ ID NO: 380902 - DNA, 20 bp, Artificial Sequence
  chemically synthesized
gaatagggaacctaggaaat

SEQ ID NO: 380903 - DNA, 20 bp, Artificial Sequence
  chemically synthesized
agaatagggaacctaggaaa

SEQ ID NO: 380904 - DNA, 20 bp, Artificial Sequence
  chemically synthesized
atgattagaatagggaacct

SEQ ID NO: 380905 - DNA, 20 bp, Artificial Sequence
  chemically synthesized
gatgattagaatagggaacc

SEQ ID NO: 380906 - DNA, 20 bp, Artificial Sequence
  chemically synthesized
aaaagtagatgattagaata

SEQ ID NO: 380907 - DNA, 20 bp, Artificial Sequence
  chemically synthesized
gaaaagtagatgattagaat

SEQ ID NO: 380908 - DNA, 20 bp, Artificial Sequence
  chemically synthesized
agaaaagtagatgattagaa

SEQ ID NO: 380909 - DNA, 20 bp, Artificial Sequence
  chemically synthesized
aatatagaaaagtagatgat

SEQ ID NO: 380910 - DNA, 20 bp, Artificial Sequence
  chemically synthesized
atgaagaaaatatagaaaag

SEQ ID NO: 380911 - DNA, 20 bp, Artificial Sequence
  chemically synthesized
gtgatgaagaaaatatagaa

SEQ ID NO: 380912 - DNA, 20 bp, Artificial Sequence
  chemically synthesized
atttggtgatgaagaaaata

SEQ ID NO: 380913 - DNA, 20 bp, Artificial Sequence
  chemically synthesized
actgcctgtatttggtgatg

SEQ ID NO: 380914 - DNA, 20 bp, Artificial Sequence
  chemically synthesized
attttcttcatcaccaaata

SEQ ID NO: 380915 - DNA, 20 bp, Artificial Sequence
  chemically synthesized
ttttcttcatcaccaaatac

SEQ ID NO: 380916 - DNA, 20 bp, Artificial Sequence
  chemically synthesized
tgcctgtgactgcctgtatt

SEQ ID NO: 380917 - DNA, 20 bp, Artificial Sequence
  chemically synthesized
tcttcatcaccaaatacagg

SEQ ID NO: 380918 - DNA, 20 bp, Artificial Sequence
  chemically synthesized
tcaccaaatacaggcagtca

SEQ ID NO: 380919 - DNA, 20 bp, Artificial Sequence
  chemically synthesized
caccaaatacaggcagtcac

SEQ ID NO: 380920 - DNA, 20 bp, Artificial Sequence
  chemically synthesized
aaatacaggcagtcacaggc

SEQ ID NO: 380921 - DNA, 20 bp, Artificial Sequence
  chemically synthesized
caggcagtcacaggcaagtg

SEQ ID NO: 380922 - DNA, 20 bp, Artificial Sequence
  chemically synthesized
aggcagtcacaggcaagtgc

SEQ ID NO: 380923 - DNA, 20 bp, Artificial Sequence
  chemically synthesized
gcagtcacaggcaagtgcag

SEQ ID NO: 380924 - DNA, 20 bp, Artificial Sequence
  chemically synthesized
ttgataaattacatgttata

SEQ ID NO: 380925 - DNA, 20 bp, Artificial Sequence
  chemically synthesized
tccagagaaattgaatatca

SEQ ID NO: 380926 - DNA, 20 bp, Artificial Sequence
  chemically synthesized
actttgatattcaatttctc

SEQ ID NO: 380927 - DNA, 20 bp, Artificial Sequence
  chemically synthesized
tttgatattcaatttctctg

SEQ ID NO: 380928 - DNA, 20 bp, Artificial Sequence
  chemically synthesized
tatatagttatatatctcca

SEQ ID NO: 380929 - DNA, 20 bp, Artificial Sequence
  chemically synthesized
tatatatagttatatatctc

SEQ ID NO: 380930 - DNA, 20 bp, Artificial Sequence
  chemically synthesized
gagggaaagaagggtatata

SEQ ID NO: 380931 - DNA, 20 bp, Artificial Sequence
  chemically synthesized
aagccctctgagggaaagaa

SEQ ID NO: 380932 - DNA, 20 bp, Artificial Sequence
  chemically synthesized
aaagccctctgagggaaaga

SEQ ID NO: 380933 - DNA, 20 bp, Artificial Sequence
  chemically synthesized
taaagccctctgagggaaag

SEQ ID NO: 380934 - DNA, 20 bp, Artificial Sequence
  chemically synthesized
atatatacccttctttccct

SEQ ID NO: 380935 - DNA, 20 bp, Artificial Sequence
  chemically synthesized
atatacccttctttccctca

SEQ ID NO: 380936 - DNA, 20 bp, Artificial Sequence
  chemically synthesized
ccttaaagccctctgaggga

SEQ ID NO: 380937 - DNA, 20 bp, Artificial Sequence
  chemically synthesized
tatacccttctttccctcag

SEQ ID NO: 380938 - DNA, 20 bp, Artificial Sequence
  chemically synthesized
atacccttctttccctcaga

SEQ ID NO: 380939 - DNA, 20 bp, Artificial Sequence
  chemically synthesized
gtttccttaaagccctctga

SEQ ID NO: 380940 - DNA, 20 bp, Artificial Sequence
  chemically synthesized
agtttccttaaagccctctg

SEQ ID NO: 380941 - DNA, 20 bp, Artificial Sequence
  chemically synthesized
tagtttccttaaagccctct

SEQ ID NO: 380942 - DNA, 20 bp, Artificial Sequence
  chemically synthesized
tctttccctcagagggcttt

SEQ ID NO: 380943 - DNA, 20 bp, Artificial Sequence
  chemically synthesized
ctttccctcagagggcttta

SEQ ID NO: 380944 - DNA, 20 bp, Artificial Sequence
  chemically synthesized
ttggggatttagtttcctta

SEQ ID NO: 380945 - DNA, 20 bp, Artificial Sequence
  chemically synthesized
tgcttttagttttggggatt

SEQ ID NO: 380946 - DNA, 20 bp, Artificial Sequence
  chemically synthesized
agtcagtgcttttagttttg

SEQ ID NO: 380947 - DNA, 20 bp, Artificial Sequence
  chemically synthesized
gagtcagtgcttttagtttt

SEQ ID NO: 380948 - DNA, 20 bp, Artificial Sequence
  chemically synthesized
aactaaatccccaaaactaa

SEQ ID NO: 380949 - DNA, 20 bp, Artificial Sequence
  chemically synthesized
tgagtcagtgcttttagttt

SEQ ID NO: 380950 - DNA, 20 bp, Artificial Sequence
  chemically synthesized
aaaccatgagtcagtgcttt

SEQ ID NO: 380951 - DNA, 20 bp, Artificial Sequence
  chemically synthesized
aaactaaaagcactgactca

SEQ ID NO: 380952 - DNA, 20 bp, Artificial Sequence
  chemically synthesized
ttaccctttaaaccatgagt

SEQ ID NO: 380953 - DNA, 20 bp, Artificial Sequence
  chemically synthesized
taacttaccctttaaaccat

SEQ ID NO: 380954 - DNA, 20 bp, Artificial Sequence
  chemically synthesized
aagcactgactcatggttta

SEQ ID NO: 380955 - DNA, 20 bp, Artificial Sequence
  chemically synthesized
agcactgactcatggtttaa

SEQ ID NO: 380956 - DNA, 20 bp, Artificial Sequence
  chemically synthesized
gcactgactcatggtttaaa

SEQ ID NO: 380957 - DNA, 20 bp, Artificial Sequence
  chemically synthesized
tgactcatggtttaaagggt

SEQ ID NO: 380958 - DNA, 20 bp, Artificial Sequence
  chemically synthesized
gtaagttaaatctctctgta

SEQ ID NO: 380959 - DNA, 20 bp, Artificial Sequence
  chemically synthesized
taagttaaatctctctgtaa

SEQ ID NO: 380960 - DNA, 20 bp, Artificial Sequence
  chemically synthesized
tttaggctttcctttacaga

SEQ ID NO: 380961 - DNA, 20 bp, Artificial Sequence
  chemically synthesized
catttaggctttcctttaca

SEQ ID NO: 380962 - DNA, 20 bp, Artificial Sequence
  chemically synthesized
ttaaatctctctgtaaagga

SEQ ID NO: 380963 - DNA, 20 bp, Artificial Sequence
  chemically synthesized
cacatttaggctttccttta

SEQ ID NO: 380964 - DNA, 20 bp, Artificial Sequence
  chemically synthesized
tgtttgcaaagatcacattt

SEQ ID NO: 380965 - DNA, 20 bp, Artificial Sequence
  chemically synthesized
atgtttgcaaagatcacatt

SEQ ID NO: 380966 - DNA, 20 bp, Artificial Sequence
  chemically synthesized
gatcaccagttatgtttgca

SEQ ID NO: 380967 - DNA, 20 bp, Artificial Sequence
  chemically synthesized
gtgatctttgcaaacataac

SEQ ID NO: 380968 - DNA, 20 bp, Artificial Sequence
  chemically synthesized
atctttcggctattgatcac

SEQ ID NO: 380969 - DNA, 20 bp, Artificial Sequence
  chemically synthesized
caaacataactggtgatcaa

SEQ ID NO: 380970 - DNA, 20 bp, Artificial Sequence
  chemically synthesized
aactggtgatcaatagccga

SEQ ID NO: 380971 - DNA, 20 bp, Artificial Sequence
  chemically synthesized
tatgtactgctttaatcttt

SEQ ID NO: 380972 - DNA, 20 bp, Artificial Sequence
  chemically synthesized
gatcaatagccgaaagatta

SEQ ID NO: 380973 - DNA, 20 bp, Artificial Sequence
  chemically synthesized
caatagccgaaagattaaag

SEQ ID NO: 380974 - DNA, 20 bp, Artificial Sequence
  chemically synthesized
taaagcagtacatatgcaaa

SEQ ID NO: 380975 - DNA, 20 bp, Artificial Sequence
  chemically synthesized
aaagcagtacatatgcaaaa

SEQ ID NO: 380976 - DNA, 20 bp, Artificial Sequence
  chemically synthesized
gcagtacatatgcaaaaagg

SEQ ID NO: 380977 - DNA, 20 bp, Artificial Sequence
  chemically synthesized
acatcaataaacaaaatgtt

SEQ ID NO: 380978 - DNA, 20 bp, Artificial Sequence
  chemically synthesized
ttgtttattgatgtcattct

SEQ ID NO: 380979 - DNA, 20 bp, Artificial Sequence
  chemically synthesized
aattaaattaattgagatct

SEQ ID NO: 380980 - DNA, 20 bp, Artificial Sequence
  chemically synthesized
tgtatcaaattaaattaatt

SEQ ID NO: 380981 - DNA, 20 bp, Artificial Sequence
  chemically synthesized
tagtgtttgattgaggacgg

SEQ ID NO: 380982 - DNA, 20 bp, Artificial Sequence
  chemically synthesized
ctagtgtttgattgaggacg

SEQ ID NO: 380983 - DNA, 20 bp, Artificial Sequence
  chemically synthesized
atctagtgtttgattgagga

SEQ ID NO: 380984 - DNA, 20 bp, Artificial Sequence
  chemically synthesized
atccatctagtgtttgattg

SEQ ID NO: 380985 - DNA, 20 bp, Artificial Sequence
  chemically synthesized
tatccatctagtgtttgatt

SEQ ID NO: 380986 - DNA, 20 bp, Artificial Sequence
  chemically synthesized
ctccgtcctcaatcaaacac

SEQ ID NO: 380987 - DNA, 20 bp, Artificial Sequence
  chemically synthesized
gtcctcaatcaaacactaga

SEQ ID NO: 380988 - DNA, 20 bp, Artificial Sequence
  chemically synthesized
agtgattatctttatccatc

SEQ ID NO: 380989 - DNA, 20 bp, Artificial Sequence
  chemically synthesized
aatcaaacactagatggata

SEQ ID NO: 380990 - DNA, 20 bp, Artificial Sequence
  chemically synthesized
gcgtattgactattacataa

SEQ ID NO: 380991 - DNA, 20 bp, Artificial Sequence
  chemically synthesized
agataatcactattatgtaa

SEQ ID NO: 380992 - DNA, 20 bp, Artificial Sequence
  chemically synthesized
tatgtaatagtcaatacgcc

SEQ ID NO: 380993 - DNA, 20 bp, Artificial Sequence
  chemically synthesized
atgtaatagtcaatacgccc

SEQ ID NO: 380994 - DNA, 20 bp, Artificial Sequence
  chemically synthesized
atatatgccaggagacacct

SEQ ID NO: 380995 - DNA, 20 bp, Artificial Sequence
  chemically synthesized
catatatgccaggagacacc

SEQ ID NO: 380996 - DNA, 20 bp, Artificial Sequence
  chemically synthesized
caatacgcccaggtgtctcc

SEQ ID NO: 380997 - DNA, 20 bp, Artificial Sequence
  chemically synthesized
caatagatcatatatgccag

SEQ ID NO: 380998 - DNA, 20 bp, Artificial Sequence
  chemically synthesized
ttcaatagatcatatatgcc

SEQ ID NO: 380999 - DNA, 20 bp, Artificial Sequence
  chemically synthesized
tttcaatagatcatatatgc

SEQ ID NO: 381000 - DNA, 20 bp, Artificial Sequence
  chemically synthesized
taataatatatgtatttcaa

SEQ ID NO: 381001 - DNA, 20 bp, Artificial Sequence
  chemically synthesized
tatattattatattttaact

SEQ ID NO: 381002 - DNA, 20 bp, Artificial Sequence
  chemically synthesized
tatattttaactaagaaaca

SEQ ID NO: 381003 - DNA, 20 bp, Artificial Sequence
  chemically synthesized
gggttagatactgtgtttct

SEQ ID NO: 381004 - DNA, 20 bp, Artificial Sequence
  chemically synthesized
agaaacacagtatctaaccc

SEQ ID NO: 381005 - DNA, 20 bp, Artificial Sequence
  chemically synthesized
aatgtacataatacttgggt

SEQ ID NO: 381006 - DNA, 20 bp, Artificial Sequence
  chemically synthesized
aaaaaatgtacataatactt

SEQ ID NO: 381007 - DNA, 20 bp, Artificial Sequence
  chemically synthesized
taaaaaatgtacataatact

SEQ ID NO: 381008 - DNA, 20 bp, Artificial Sequence
  chemically synthesized
taaacaattcacttccttga

SEQ ID NO: 381009 - DNA, 20 bp, Artificial Sequence
  chemically synthesized
gtaactcataactttcaagg

SEQ ID NO: 381010 - DNA, 20 bp, Artificial Sequence
  chemically synthesized
ttggtaactcataactttca

SEQ ID NO: 381011 - DNA, 20 bp, Artificial Sequence
  chemically synthesized
attggtaactcataactttc

SEQ ID NO: 381012 - DNA, 20 bp, Artificial Sequence
  chemically synthesized
ttcacttccttgaaagttat

SEQ ID NO: 381013 - DNA, 20 bp, Artificial Sequence
  chemically synthesized
agaaatttattaaaaatgat

SEQ ID NO: 381014 - DNA, 20 bp, Artificial Sequence
  chemically synthesized
catttttaataaatttctcc

SEQ ID NO: 381015 - DNA, 20 bp, Artificial Sequence
  chemically synthesized
atagataaatgtaaagctgg

SEQ ID NO: 381016 - DNA, 20 bp, Artificial Sequence
  chemically synthesized
tgatagataaatgtaaagct

SEQ ID NO: 381017 - DNA, 20 bp, Artificial Sequence
  chemically synthesized
ttgatagataaatgtaaagc

SEQ ID NO: 381018 - DNA, 20 bp, Artificial Sequence
  chemically synthesized
ataattgatagataaatgta

SEQ ID NO: 381019 - DNA, 20 bp, Artificial Sequence
  chemically synthesized
tgaagttcagatataattga

SEQ ID NO: 381020 - DNA, 20 bp, Artificial Sequence
  chemically synthesized
tccagagtgtatttgaagtt

SEQ ID NO: 381021 - DNA, 20 bp, Artificial Sequence
  chemically synthesized
atgcatccagagtgtatttg

SEQ ID NO: 381022 - DNA, 20 bp, Artificial Sequence
  chemically synthesized
tctgaacttcaaatacactc

SEQ ID NO: 381023 - DNA, 20 bp, Artificial Sequence
  chemically synthesized
ctctgagacaaatgcatcca

SEQ ID NO: 381024 - DNA, 20 bp, Artificial Sequence
  chemically synthesized
tgctctgagacaaatgcatc

SEQ ID NO: 381025 - DNA, 20 bp, Artificial Sequence
  chemically synthesized
cactctggatgcatttgtct

SEQ ID NO: 381026 - DNA, 20 bp, Artificial Sequence
  chemically synthesized
ctctggatgcatttgtctca

SEQ ID NO: 381027 - DNA, 20 bp, Artificial Sequence
  chemically synthesized
ttagacaccatcattgctct

SEQ ID NO: 381028 - DNA, 20 bp, Artificial Sequence
  chemically synthesized
catttgtctcagagcaatga

SEQ ID NO: 381029 - DNA, 20 bp, Artificial Sequence
  chemically synthesized
tcagagcaatgatggtgtct

SEQ ID NO: 381030 - DNA, 20 bp, Artificial Sequence
  chemically synthesized
aatgatggtgtctaagcttg

SEQ ID NO: 381031 - DNA, 20 bp, Artificial Sequence
  chemically synthesized
agacacagaaactgcaagct

SEQ ID NO: 381032 - DNA, 20 bp, Artificial Sequence
  chemically synthesized
ttcacagacacagaaactgc

SEQ ID NO: 381033 - DNA, 20 bp, Artificial Sequence
  chemically synthesized
gcaaatgaatttcacagaca

SEQ ID NO: 381034 - DNA, 20 bp, Artificial Sequence
  chemically synthesized
tttactgcaaatgaatttca

SEQ ID NO: 381035 - DNA, 20 bp, Artificial Sequence
  chemically synthesized
gtgtctgtgaaattcatttg

SEQ ID NO: 381036 - DNA, 20 bp, Artificial Sequence
  chemically synthesized
aaattgtgaataaataaatg

SEQ ID NO: 381037 - DNA, 20 bp, Artificial Sequence
  chemically synthesized
gaataaataaatgcagtaaa

SEQ ID NO: 381038 - DNA, 20 bp, Artificial Sequence
  chemically synthesized
aataaatgcagtaaaaagcc

SEQ ID NO: 381039 - DNA, 20 bp, Artificial Sequence
  chemically synthesized
ataaatgcagtaaaaagcct

SEQ ID NO: 381040 - DNA, 20 bp, Artificial Sequence
  chemically synthesized
gtagactctccaaggagcct

SEQ ID NO: 381041 - DNA, 20 bp, Artificial Sequence
  chemically synthesized
agtaaaaagcctaggctcct

SEQ ID NO: 381042 - DNA, 20 bp, Artificial Sequence
  chemically synthesized
tgtagactctccaaggagcc

SEQ ID NO: 381043 - DNA, 20 bp, Artificial Sequence
  chemically synthesized
taaaaagcctaggctccttg

SEQ ID NO: 381044 - DNA, 20 bp, Artificial Sequence
  chemically synthesized
aaaagcctaggctccttgga

SEQ ID NO: 381045 - DNA, 20 bp, Artificial Sequence
  chemically synthesized
gagaatgtagactctccaag

SEQ ID NO: 381046 - DNA, 20 bp, Artificial Sequence
  chemically synthesized
aggagaatgtagactctcca

SEQ ID NO: 381047 - DNA, 20 bp, Artificial Sequence
  chemically synthesized
gaggagaatgtagactctcc

SEQ ID NO: 381048 - DNA, 20 bp, Artificial Sequence
  chemically synthesized
agatgggagggaggagaatg

SEQ ID NO: 381049 - DNA, 20 bp, Artificial Sequence
  chemically synthesized
gagaaagagatgggagggag

SEQ ID NO: 381050 - DNA, 20 bp, Artificial Sequence
  chemically synthesized
gagagaaagagatgggaggg

SEQ ID NO: 381051 - DNA, 20 bp, Artificial Sequence
  chemically synthesized
agagagaaagagatgggagg

SEQ ID NO: 381052 - DNA, 20 bp, Artificial Sequence
  chemically synthesized
gaagagagaaagagatggga

SEQ ID NO: 381053 - DNA, 20 bp, Artificial Sequence
  chemically synthesized
agaagagagaaagagatggg

SEQ ID NO: 381054 - DNA, 20 bp, Artificial Sequence
  chemically synthesized
aagaagagagaaagagatgg

SEQ ID NO: 381055 - DNA, 20 bp, Artificial Sequence
  chemically synthesized
agaagaagagagaaagagat

SEQ ID NO: 381056 - DNA, 20 bp, Artificial Sequence
  chemically synthesized
gagaagaagagagaaagaga

SEQ ID NO: 381057 - DNA, 20 bp, Artificial Sequence
  chemically synthesized
aggagagaagaagagagaaa

SEQ ID NO: 381058 - DNA, 20 bp, Artificial Sequence
  chemically synthesized
gtaggagagaagaagagaga

SEQ ID NO: 381059 - DNA, 20 bp, Artificial Sequence
  chemically synthesized
gagggtaggagagaagaaga

SEQ ID NO: 381060 - DNA, 20 bp, Artificial Sequence
  chemically synthesized
gagagggtaggagagaagaa

SEQ ID NO: 381061 - DNA, 20 bp, Artificial Sequence
  chemically synthesized
atgagagggtaggagagaag

SEQ ID NO: 381062 - DNA, 20 bp, Artificial Sequence
  chemically synthesized
aggatgagagggtaggagag

SEQ ID NO: 381063 - DNA, 20 bp, Artificial Sequence
  chemically synthesized
tggaggatgagagggtagga

SEQ ID NO: 381064 - DNA, 20 bp, Artificial Sequence
  chemically synthesized
gatggaggatgagagggtag

SEQ ID NO: 381065 - DNA, 20 bp, Artificial Sequence
  chemically synthesized
cagatggaggatgagagggt

SEQ ID NO: 381066 - DNA, 20 bp, Artificial Sequence
  chemically synthesized
acagatggaggatgagaggg

SEQ ID NO: 381067 - DNA, 20 bp, Artificial Sequence
  chemically synthesized
gggacagatggaggatgaga

SEQ ID NO: 381068 - DNA, 20 bp, Artificial Sequence
  chemically synthesized
agggacagatggaggatgag

SEQ ID NO: 381069 - DNA, 20 bp, Artificial Sequence
  chemically synthesized
aagggacagatggaggatga

SEQ ID NO: 381070 - DNA, 20 bp, Artificial Sequence
  chemically synthesized
gaaagggacagatggaggat

SEQ ID NO: 381071 - DNA, 20 bp, Artificial Sequence
  chemically synthesized
atagggaaagggacagatgg

SEQ ID NO: 381072 - DNA, 20 bp, Artificial Sequence
  chemically synthesized
gatagggaaagggacagatg

SEQ ID NO: 381073 - DNA, 20 bp, Artificial Sequence
  chemically synthesized
aggatagggaaagggacaga

SEQ ID NO: 381074 - DNA, 20 bp, Artificial Sequence
  chemically synthesized
aagaaggatagggaaaggga

SEQ ID NO: 381075 - DNA, 20 bp, Artificial Sequence
  chemically synthesized
tgataagaaggatagggaaa

SEQ ID NO: 381076 - DNA, 20 bp, Artificial Sequence
  chemically synthesized
gtgataagaaggatagggaa

SEQ ID NO: 381077 - DNA, 20 bp, Artificial Sequence
  chemically synthesized
tgtgataagaaggataggga

SEQ ID NO: 381078 - DNA, 20 bp, Artificial Sequence
  chemically synthesized
catgtgtgataagaaggata

SEQ ID NO: 381079 - DNA, 20 bp, Artificial Sequence
  chemically synthesized
ccatgtgtgataagaaggat

SEQ ID NO: 381080 - DNA, 20 bp, Artificial Sequence
  chemically synthesized
cccatgtgtgataagaagga

SEQ ID NO: 381081 - DNA, 20 bp, Artificial Sequence
  chemically synthesized
ttttcccatgtgtgataaga

SEQ ID NO: 381082 - DNA, 20 bp, Artificial Sequence
  chemically synthesized
tttttcccatgtgtgataag

SEQ ID NO: 381083 - DNA, 20 bp, Artificial Sequence
  chemically synthesized
gagtttttcccatgtgtgat

SEQ ID NO: 381084 - DNA, 20 bp, Artificial Sequence
  chemically synthesized
cctatccttcttatcacaca

SEQ ID NO: 381085 - DNA, 20 bp, Artificial Sequence
  chemically synthesized
ctatccttcttatcacacat

SEQ ID NO: 381086 - DNA, 20 bp, Artificial Sequence
  chemically synthesized
agactgaatttaattcaatt

SEQ ID NO: 381087 - DNA, 20 bp, Artificial Sequence
  chemically synthesized
aaactcaattgaattaaatt

SEQ ID NO: 381088 - DNA, 20 bp, Artificial Sequence
  chemically synthesized
ttgaattaaattcagtctac

SEQ ID NO: 381089 - DNA, 20 bp, Artificial Sequence
  chemically synthesized
aattaaattcagtctaccag

SEQ ID NO: 381090 - DNA, 20 bp, Artificial Sequence
  chemically synthesized
attcaattgtatacttctgg

SEQ ID NO: 381091 - DNA, 20 bp, Artificial Sequence
  chemically synthesized
aaaattcaattgtatacttc

SEQ ID NO: 381092 - DNA, 20 bp, Artificial Sequence
  chemically synthesized
tgaatttttgataaacacac

SEQ ID NO: 381093 - DNA, 20 bp, Artificial Sequence
  chemically synthesized
ttgataaacacaccagaaat

SEQ ID NO: 381094 - DNA, 20 bp, Artificial Sequence
  chemically synthesized
gaacatacacatctaatttc

SEQ ID NO: 381095 - DNA, 20 bp, Artificial Sequence
  chemically synthesized
attcaacaaatatgtgcgga

SEQ ID NO: 381096 - DNA, 20 bp, Artificial Sequence
  chemically synthesized
cattcaacaaatatgtgcgg

SEQ ID NO: 381097 - DNA, 20 bp, Artificial Sequence
  chemically synthesized
aaacattcaacaaatatgtg

SEQ ID NO: 381098 - DNA, 20 bp, Artificial Sequence
  chemically synthesized
ttgatccatagtgtggcatg

SEQ ID NO: 381099 - DNA, 20 bp, Artificial Sequence
  chemically synthesized
gtttacttcatgccacacta

SEQ ID NO: 381100 - DNA, 20 bp, Artificial Sequence
  chemically synthesized
tcactgcttgatccatagtg

SEQ ID NO: 381101 - DNA, 20 bp, Artificial Sequence
  chemically synthesized
ttcatgccacactatggatc

SEQ ID NO: 381102 - DNA, 20 bp, Artificial Sequence
  chemically synthesized
tatcttcactgcttgatcca

SEQ ID NO: 381103 - DNA, 20 bp, Artificial Sequence
  chemically synthesized
atgccacactatggatcaag

SEQ ID NO: 381104 - DNA, 20 bp, Artificial Sequence
  chemically synthesized
acactatggatcaagcagtg

SEQ ID NO: 381105 - DNA, 20 bp, Artificial Sequence
  chemically synthesized
atcaagcagtgaagataaaa

SEQ ID NO: 381106 - DNA, 20 bp, Artificial Sequence
  chemically synthesized
gtgaagataaaacagtaaac

SEQ ID NO: 381107 - DNA, 20 bp, Artificial Sequence
  chemically synthesized
aaacagtaaacaagacatgc

SEQ ID NO: 381108 - DNA, 20 bp, Artificial Sequence
  chemically synthesized
aacagtaaacaagacatgca

SEQ ID NO: 381109 - DNA, 20 bp, Artificial Sequence
  chemically synthesized
atgcaaggaaactactctca

SEQ ID NO: 381110 - DNA, 20 bp, Artificial Sequence
  chemically synthesized
gattggaagttccatgagag

SEQ ID NO: 381111 - DNA, 20 bp, Artificial Sequence
  chemically synthesized
atagattggaagttccatga

SEQ ID NO: 381112 - DNA, 20 bp, Artificial Sequence
  chemically synthesized
caatagattggaagttccat

SEQ ID NO: 381113 - DNA, 20 bp, Artificial Sequence
  chemically synthesized
tattccctacaatagattgg

SEQ ID NO: 381114 - DNA, 20 bp, Artificial Sequence
  chemically synthesized
tgctattccctacaatagat

SEQ ID NO: 381115 - DNA, 20 bp, Artificial Sequence
  chemically synthesized
atggaacttccaatctattg

SEQ ID NO: 381116 - DNA, 20 bp, Artificial Sequence
  chemically synthesized
tggaacttccaatctattgt

SEQ ID NO: 381117 - DNA, 20 bp, Artificial Sequence
  chemically synthesized
ggaacttccaatctattgta

SEQ ID NO: 381118 - DNA, 20 bp, Artificial Sequence
  chemically synthesized
ttatttgctattccctacaa

SEQ ID NO: 381119 - DNA, 20 bp, Artificial Sequence
  chemically synthesized
ttccaatctattgtagggaa

SEQ ID NO: 381120 - DNA, 20 bp, Artificial Sequence
  chemically synthesized
tcaataacacttattatatt

SEQ ID NO: 381121 - DNA, 20 bp, Artificial Sequence
  chemically synthesized
acataatcacccaatataat

SEQ ID NO: 381122 - DNA, 20 bp, Artificial Sequence
  chemically synthesized
ttcaataacacttattatat

SEQ ID NO: 381123 - DNA, 20 bp, Artificial Sequence
  chemically synthesized
caatataataagtgttattg

SEQ ID NO: 381124 - DNA, 20 bp, Artificial Sequence
  chemically synthesized
gtgttattgaagaaataaac

SEQ ID NO: 381125 - DNA, 20 bp, Artificial Sequence
  chemically synthesized
gaagaaataaacaagatgtt

SEQ ID NO: 381126 - DNA, 20 bp, Artificial Sequence
  chemically synthesized
aaataaacaagatgttcaga

SEQ ID NO: 381127 - DNA, 20 bp, Artificial Sequence
  chemically synthesized
aaacaagatgttcagataga

SEQ ID NO: 381128 - DNA, 20 bp, Artificial Sequence
  chemically synthesized
cagatagaaagtacctaaaa

SEQ ID NO: 381129 - DNA, 20 bp, Artificial Sequence
  chemically synthesized
gatagaaagtacctaaaata

SEQ ID NO: 381130 - DNA, 20 bp, Artificial Sequence
  chemically synthesized
ttccctggactctctatttt

SEQ ID NO: 381131 - DNA, 20 bp, Artificial Sequence
  chemically synthesized
tagaaagtacctaaaataga

SEQ ID NO: 381132 - DNA, 20 bp, Artificial Sequence
  chemically synthesized
cttccctggactctctattt

SEQ ID NO: 381133 - DNA, 20 bp, Artificial Sequence
  chemically synthesized
agtacctaaaatagagagtc

SEQ ID NO: 381134 - DNA, 20 bp, Artificial Sequence
  chemically synthesized
gtacctaaaatagagagtcc

SEQ ID NO: 381135 - DNA, 20 bp, Artificial Sequence
  chemically synthesized
tacctaaaatagagagtcca

SEQ ID NO: 381136 - DNA, 20 bp, Artificial Sequence
  chemically synthesized
ctaaaatagagagtccaggg

SEQ ID NO: 381137 - DNA, 20 bp, Artificial Sequence
  chemically synthesized
taaaatagagagtccaggga

SEQ ID NO: 381138 - DNA, 20 bp, Artificial Sequence
  chemically synthesized
aaatagagagtccagggaag

SEQ ID NO: 381139 - DNA, 20 bp, Artificial Sequence
  chemically synthesized
actagttctctctccttccc

SEQ ID NO: 381140 - DNA, 20 bp, Artificial Sequence
  chemically synthesized
atagagagtccagggaagga

SEQ ID NO: 381141 - DNA, 20 bp, Artificial Sequence
  chemically synthesized
agagagtccagggaaggaga

SEQ ID NO: 381142 - DNA, 20 bp, Artificial Sequence
  chemically synthesized
tccagggaaggagagagaac

SEQ ID NO: 381143 - DNA, 20 bp, Artificial Sequence
  chemically synthesized
ggaaggagagagaactagtc

SEQ ID NO: 381144 - DNA, 20 bp, Artificial Sequence
  chemically synthesized
tttgactatgaaatccagac

SEQ ID NO: 381145 - DNA, 20 bp, Artificial Sequence
  chemically synthesized
gagaactagtctggatttca

SEQ ID NO: 381146 - DNA, 20 bp, Artificial Sequence
  chemically synthesized
ccttctttgactatgaaatc

SEQ ID NO: 381147 - DNA, 20 bp, Artificial Sequence
  chemically synthesized
tagtctggatttcatagtca

SEQ ID NO: 381148 - DNA, 20 bp, Artificial Sequence
  chemically synthesized
tctggatttcatagtcaaag

SEQ ID NO: 381149 - DNA, 20 bp, Artificial Sequence
  chemically synthesized
ctggatttcatagtcaaaga

SEQ ID NO: 381150 - DNA, 20 bp, Artificial Sequence
  chemically synthesized
agtcaaagaaggtgtttttt

SEQ ID NO: 381151 - DNA, 20 bp, Artificial Sequence
  chemically synthesized
tttttggatgtgcaattaaa

SEQ ID NO: 381152 - DNA, 20 bp, Artificial Sequence
  chemically synthesized
tgtgcaattaaacagatttg

SEQ ID NO: 381153 - DNA, 20 bp, Artificial Sequence
  chemically synthesized
gtgcaattaaacagatttga

SEQ ID NO: 381154 - DNA, 20 bp, Artificial Sequence
  chemically synthesized
tgtgctattattttgcatga

SEQ ID NO: 381155 - DNA, 20 bp, Artificial Sequence
  chemically synthesized
tattccatcatgcaaaataa

SEQ ID NO: 381156 - DNA, 20 bp, Artificial Sequence
  chemically synthesized
atcatgcaaaataatagcac

SEQ ID NO: 381157 - DNA, 20 bp, Artificial Sequence
  chemically synthesized
aataatagcacaagtttgtc

SEQ ID NO: 381158 - DNA, 20 bp, Artificial Sequence
  chemically synthesized
ataatagcacaagtttgtcc

SEQ ID NO: 381159 - DNA, 20 bp, Artificial Sequence
  chemically synthesized
tagcacaagtttgtccagga

SEQ ID NO: 381160 - DNA, 20 bp, Artificial Sequence
  chemically synthesized
gcacaagtttgtccaggaaa

SEQ ID NO: 381161 - DNA, 20 bp, Artificial Sequence
  chemically synthesized
aatttgcaaaggctctttcc

SEQ ID NO: 381162 - DNA, 20 bp, Artificial Sequence
  chemically synthesized
ccatcccagggaatttgcaa

SEQ ID NO: 381163 - DNA, 20 bp, Artificial Sequence
  chemically synthesized
tccatcccagggaatttgca

SEQ ID NO: 381164 - DNA, 20 bp, Artificial Sequence
  chemically synthesized
aagagcctttgcaaattccc

SEQ ID NO: 381165 - DNA, 20 bp, Artificial Sequence
  chemically synthesized
agagcctttgcaaattccct

SEQ ID NO: 381166 - DNA, 20 bp, Artificial Sequence
  chemically synthesized
cctttgcaaattccctggga

SEQ ID NO: 381167 - DNA, 20 bp, Artificial Sequence
  chemically synthesized
aaggcctctattccatccca

SEQ ID NO: 381168 - DNA, 20 bp, Artificial Sequence
  chemically synthesized
gaaggcctctattccatccc

SEQ ID NO: 381169 - DNA, 20 bp, Artificial Sequence
  chemically synthesized
tgaaggcctctattccatcc

SEQ ID NO: 381170 - DNA, 20 bp, Artificial Sequence
  chemically synthesized
gcaaattccctgggatggaa

SEQ ID NO: 381171 - DNA, 20 bp, Artificial Sequence
  chemically synthesized
aaattccctgggatggaata

SEQ ID NO: 381172 - DNA, 20 bp, Artificial Sequence
  chemically synthesized
aattccctgggatggaatag

SEQ ID NO: 381173 - DNA, 20 bp, Artificial Sequence
  chemically synthesized
gaagttccaaacagtaatga

SEQ ID NO: 381174 - DNA, 20 bp, Artificial Sequence
  chemically synthesized
agaagttccaaacagtaatg

SEQ ID NO: 381175 - DNA, 20 bp, Artificial Sequence
  chemically synthesized
tagaggccttcattactgtt

SEQ ID NO: 381176 - DNA, 20 bp, Artificial Sequence
  chemically synthesized
ttgaagagagaagttccaaa

SEQ ID NO: 381177 - DNA, 20 bp, Artificial Sequence
  chemically synthesized
caaaggtagattgaagagag

SEQ ID NO: 381178 - DNA, 20 bp, Artificial Sequence
  chemically synthesized
ctacaaaggtagattgaaga

SEQ ID NO: 381179 - DNA, 20 bp, Artificial Sequence
  chemically synthesized
ggctacaaaggtagattgaa

SEQ ID NO: 381180 - DNA, 20 bp, Artificial Sequence
  chemically synthesized
taggctacaaaggtagattg

SEQ ID NO: 381181 - DNA, 20 bp, Artificial Sequence
  chemically synthesized
ctctcttcaatctacctttg

SEQ ID NO: 381182 - DNA, 20 bp, Artificial Sequence
  chemically synthesized
tgccttttaggctacaaagg

SEQ ID NO: 381183 - DNA, 20 bp, Artificial Sequence
  chemically synthesized
aaatgccttttaggctacaa

SEQ ID NO: 381184 - DNA, 20 bp, Artificial Sequence
  chemically synthesized
aaaatgccttttaggctaca

SEQ ID NO: 381185 - DNA, 20 bp, Artificial Sequence
  chemically synthesized
aatctacctttgtagcctaa

SEQ ID NO: 381186 - DNA, 20 bp, Artificial Sequence
  chemically synthesized
atctacctttgtagcctaaa

SEQ ID NO: 381187 - DNA, 20 bp, Artificial Sequence
  chemically synthesized
catatttaaaaatgcctttt

SEQ ID NO: 381188 - DNA, 20 bp, Artificial Sequence
  chemically synthesized
ccatatttaaaaatgccttt

SEQ ID NO: 381189 - DNA, 20 bp, Artificial Sequence
  chemically synthesized
ctaaaaggcatttttaaata

SEQ ID NO: 381190 - DNA, 20 bp, Artificial Sequence
  chemically synthesized
aggcatttttaaatatggtc

SEQ ID NO: 381191 - DNA, 20 bp, Artificial Sequence
  chemically synthesized
atttacactatcaagaaaaa

SEQ ID NO: 381192 - DNA, 20 bp, Artificial Sequence
  chemically synthesized
gttgaaactgtttttcttga

SEQ ID NO: 381193 - DNA, 20 bp, Artificial Sequence
  chemically synthesized
atacatttatttacactatc

SEQ ID NO: 381194 - DNA, 20 bp, Artificial Sequence
  chemically synthesized
actatagctaattgtttgag

SEQ ID NO: 381195 - DNA, 20 bp, Artificial Sequence
  chemically synthesized
gtatgaactactcaaacaat

SEQ ID NO: 381196 - DNA, 20 bp, Artificial Sequence
  chemically synthesized
atcactatagctaattgttt

SEQ ID NO: 381197 - DNA, 20 bp, Artificial Sequence
  chemically synthesized
actactcaaacaattagcta

SEQ ID NO: 381198 - DNA, 20 bp, Artificial Sequence
  chemically synthesized
acttattcgatttatcacta

SEQ ID NO: 381199 - DNA, 20 bp, Artificial Sequence
  chemically synthesized
gctatagtgataaatcgaat

SEQ ID NO: 381200 - DNA, 20 bp, Artificial Sequence
  chemically synthesized
tagtgataaatcgaataagt

SEQ ID NO: 381201 - DNA, 20 bp, Artificial Sequence
  chemically synthesized
tgataaatcgaataagttgg

SEQ ID NO: 381202 - DNA, 20 bp, Artificial Sequence
  chemically synthesized
gataaatcgaataagttggt

SEQ ID NO: 381203 - DNA, 20 bp, Artificial Sequence
  chemically synthesized
gttggtaggtttgaatatgc

SEQ ID NO: 381204 - DNA, 20 bp, Artificial Sequence
  chemically synthesized
gtatcagaaacagtgttatc

SEQ ID NO: 381205 - DNA, 20 bp, Artificial Sequence
  chemically synthesized
tctctaggtggtatcagaaa

SEQ ID NO: 381206 - DNA, 20 bp, Artificial Sequence
  chemically synthesized
aaccagtctctaggtggtat

SEQ ID NO: 381207 - DNA, 20 bp, Artificial Sequence
  chemically synthesized
acactgtttctgataccacc

SEQ ID NO: 381208 - DNA, 20 bp, Artificial Sequence
  chemically synthesized
actgtttctgataccaccta

SEQ ID NO: 381209 - DNA, 20 bp, Artificial Sequence
  chemically synthesized
gatgggaaccagtctctagg

SEQ ID NO: 381210 - DNA, 20 bp, Artificial Sequence
  chemically synthesized
ttctgataccacctagagac

SEQ ID NO: 381211 - DNA, 20 bp, Artificial Sequence
  chemically synthesized
acagatgggaaccagtctct

SEQ ID NO: 381212 - DNA, 20 bp, Artificial Sequence
  chemically synthesized
gacagatgggaaccagtctc

SEQ ID NO: 381213 - DNA, 20 bp, Artificial Sequence
  chemically synthesized
accagttgacagatgggaac

SEQ ID NO: 381214 - DNA, 20 bp, Artificial Sequence
  chemically synthesized
tttataaccagttgacagat

SEQ ID NO: 381215 - DNA, 20 bp, Artificial Sequence
  chemically synthesized
ttttataaccagttgacaga

SEQ ID NO: 381216 - DNA, 20 bp, Artificial Sequence
  chemically synthesized
actggttcccatctgtcaac

SEQ ID NO: 381217 - DNA, 20 bp, Artificial Sequence
  chemically synthesized
attgttttataaccagttga

SEQ ID NO: 381218 - DNA, 20 bp, Artificial Sequence
  chemically synthesized
ttccaaaattgttttataac

SEQ ID NO: 381219 - DNA, 20 bp, Artificial Sequence
  chemically synthesized
aactggttataaaacaattt

SEQ ID NO: 381220 - DNA, 20 bp, Artificial Sequence
  chemically synthesized
tggttataaaacaattttgg

SEQ ID NO: 381221 - DNA, 20 bp, Artificial Sequence
  chemically synthesized
ggttataaaacaattttgga

SEQ ID NO: 381222 - DNA, 20 bp, Artificial Sequence
  chemically synthesized
aaggaatattataacttgca

SEQ ID NO: 381223 - DNA, 20 bp, Artificial Sequence
  chemically synthesized
attctgttcgttttctttgc

SEQ ID NO: 381224 - DNA, 20 bp, Artificial Sequence
  chemically synthesized
taacttgcaaagaaaacgaa

SEQ ID NO: 381225 - DNA, 20 bp, Artificial Sequence
  chemically synthesized
caaagaaaacgaacagaatt

SEQ ID NO: 381226 - DNA, 20 bp, Artificial Sequence
  chemically synthesized
aagaaaacgaacagaattca

SEQ ID NO: 381227 - DNA, 20 bp, Artificial Sequence
  chemically synthesized
acgaacagaattcagagaaa

SEQ ID NO: 381228 - DNA, 20 bp, Artificial Sequence
  chemically synthesized
acatattttcaaatatttaa

SEQ ID NO: 381229 - DNA, 20 bp, Artificial Sequence
  chemically synthesized
gaacatattttcaaatattt

SEQ ID NO: 381230 - DNA, 20 bp, Artificial Sequence
  chemically synthesized
atatgttcatcctcattcct

SEQ ID NO: 381231 - DNA, 20 bp, Artificial Sequence
  chemically synthesized
cacttatctactcaggaatg

SEQ ID NO: 381232 - DNA, 20 bp, Artificial Sequence
  chemically synthesized
gcacttatctactcaggaat

SEQ ID NO: 381233 - DNA, 20 bp, Artificial Sequence
  chemically synthesized
tgttcatcctcattcctgag

SEQ ID NO: 381234 - DNA, 20 bp, Artificial Sequence
  chemically synthesized
tagtttgcacttatctactc

SEQ ID NO: 381235 - DNA, 20 bp, Artificial Sequence
  chemically synthesized
atcctcattcctgagtagat

SEQ ID NO: 381236 - DNA, 20 bp, Artificial Sequence
  chemically synthesized
ttagtttgcacttatctact

SEQ ID NO: 381237 - DNA, 20 bp, Artificial Sequence
  chemically synthesized
agtagataagtgcaaactaa

SEQ ID NO: 381238 - DNA, 20 bp, Artificial Sequence
  chemically synthesized
taagtgcaaactaaaagaca

SEQ ID NO: 381239 - DNA, 20 bp, Artificial Sequence
  chemically synthesized
aactatgaaactatgtcttt

SEQ ID NO: 381240 - DNA, 20 bp, Artificial Sequence
  chemically synthesized
aactaaaagacatagtttca

SEQ ID NO: 381241 - DNA, 20 bp, Artificial Sequence
  chemically synthesized
tagtttttcaccaatcatat

SEQ ID NO: 381242 - DNA, 20 bp, Artificial Sequence
  chemically synthesized
ttgatctttgccaatatgat

SEQ ID NO: 381243 - DNA, 20 bp, Artificial Sequence
  chemically synthesized
tttcaccaatcatattggca

SEQ ID NO: 381244 - DNA, 20 bp, Artificial Sequence
  chemically synthesized
atcatattggcaaagatcaa

SEQ ID NO: 381245 - DNA, 20 bp, Artificial Sequence
  chemically synthesized
attggcaaagatcaaaagtt

SEQ ID NO: 381246 - DNA, 20 bp, Artificial Sequence
  chemically synthesized
ggcaaagatcaaaagtttgg

SEQ ID NO: 381247 - DNA, 20 bp, Artificial Sequence
  chemically synthesized
tcctcataccataaaaaacg

SEQ ID NO: 381248 - DNA, 20 bp, Artificial Sequence
  chemically synthesized
gtagtatactgcgtttttta

SEQ ID NO: 381249 - DNA, 20 bp, Artificial Sequence
  chemically synthesized
tactgcgttttttatggtat

SEQ ID NO: 381250 - DNA, 20 bp, Artificial Sequence
  chemically synthesized
actgcgttttttatggtatg

SEQ ID NO: 381251 - DNA, 20 bp, Artificial Sequence
  chemically synthesized
caaatctgtcaggaaggtat

SEQ ID NO: 381252 - DNA, 20 bp, Artificial Sequence
  chemically synthesized
atgttctcataccttcctga

SEQ ID NO: 381253 - DNA, 20 bp, Artificial Sequence
  chemically synthesized
tcagttcaaatctgtcagga

SEQ ID NO: 381254 - DNA, 20 bp, Artificial Sequence
  chemically synthesized
atcagttcaaatctgtcagg

SEQ ID NO: 381255 - DNA, 20 bp, Artificial Sequence
  chemically synthesized
tatatcagttcaaatctgtc

SEQ ID NO: 381256 - DNA, 20 bp, Artificial Sequence
  chemically synthesized
gtatatcagttcaaatctgt

SEQ ID NO: 381257 - DNA, 20 bp, Artificial Sequence
  chemically synthesized
cagatttgaactgatatacg

SEQ ID NO: 381258 - DNA, 20 bp, Artificial Sequence
  chemically synthesized
atacacatggccacgtatat

SEQ ID NO: 381259 - DNA, 20 bp, Artificial Sequence
  chemically synthesized
catgcgcatagtcatacaca

SEQ ID NO: 381260 - DNA, 20 bp, Artificial Sequence
  chemically synthesized
ctgctgtacatacatgcgca

SEQ ID NO: 381261 - DNA, 20 bp, Artificial Sequence
  chemically synthesized
tgactatgcgcatgtatgta

SEQ ID NO: 381262 - DNA, 20 bp, Artificial Sequence
  chemically synthesized
ctatgcgcatgtatgtacag

SEQ ID NO: 381263 - DNA, 20 bp, Artificial Sequence
  chemically synthesized
tatgtacagcagatatctga

SEQ ID NO: 381264 - DNA, 20 bp, Artificial Sequence
  chemically synthesized
cggttttctgtgtattcttt

SEQ ID NO: 381265 - DNA, 20 bp, Artificial Sequence
  chemically synthesized
cagatatctgaaagaataca

SEQ ID NO: 381266 - DNA, 20 bp, Artificial Sequence
  chemically synthesized
tacacagaaaaccgcaatgc

SEQ ID NO: 381267 - DNA, 20 bp, Artificial Sequence
  chemically synthesized
tactgggggtgctggcattg

SEQ ID NO: 381268 - DNA, 20 bp, Artificial Sequence
  chemically synthesized
aaccgcaatgccagcacccc

SEQ ID NO: 381269 - DNA, 20 bp, Artificial Sequence
  chemically synthesized
ttctctcttactgggggtgc

SEQ ID NO: 381270 - DNA, 20 bp, Artificial Sequence
  chemically synthesized
gcaatgccagcacccccagt

SEQ ID NO: 381271 - DNA, 20 bp, Artificial Sequence
  chemically synthesized
aatgccagcacccccagtaa

SEQ ID NO: 381272 - DNA, 20 bp, Artificial Sequence
  chemically synthesized
tcctccttctctcttactgg

SEQ ID NO: 381273 - DNA, 20 bp, Artificial Sequence
  chemically synthesized
atcctccttctctcttactg

SEQ ID NO: 381274 - DNA, 20 bp, Artificial Sequence
  chemically synthesized
tgccagcacccccagtaaga

SEQ ID NO: 381275 - DNA, 20 bp, Artificial Sequence
  chemically synthesized
tatcctccttctctcttact

SEQ ID NO: 381276 - DNA, 20 bp, Artificial Sequence
  chemically synthesized
ttatcctccttctctcttac

SEQ ID NO: 381277 - DNA, 20 bp, Artificial Sequence
  chemically synthesized
cagcacccccagtaagagag

SEQ ID NO: 381278 - DNA, 20 bp, Artificial Sequence
  chemically synthesized
agcacccccagtaagagaga

SEQ ID NO: 381279 - DNA, 20 bp, Artificial Sequence
  chemically synthesized
cacccccagtaagagagaag

SEQ ID NO: 381280 - DNA, 20 bp, Artificial Sequence
  chemically synthesized
acccccagtaagagagaagg

SEQ ID NO: 381281 - DNA, 20 bp, Artificial Sequence
  chemically synthesized
taagagagaaggaggataac

SEQ ID NO: 381282 - DNA, 20 bp, Artificial Sequence
  chemically synthesized
aagagagaaggaggataact

SEQ ID NO: 381283 - DNA, 20 bp, Artificial Sequence
  chemically synthesized
gagagaaggaggataactag

SEQ ID NO: 381284 - DNA, 20 bp, Artificial Sequence
  chemically synthesized
agagaaggaggataactagg

SEQ ID NO: 381285 - DNA, 20 bp, Artificial Sequence
  chemically synthesized
aaggaggataactaggaggc

SEQ ID NO: 381286 - DNA, 20 bp, Artificial Sequence
  chemically synthesized
tattatgttagctagcctcc

SEQ ID NO: 381287 - DNA, 20 bp, Artificial Sequence
  chemically synthesized
gtttctcctattatgttagc

SEQ ID NO: 381288 - DNA, 20 bp, Artificial Sequence
  chemically synthesized
taggaggctagctaacataa

SEQ ID NO: 381289 - DNA, 20 bp, Artificial Sequence
  chemically synthesized
aggaggctagctaacataat

SEQ ID NO: 381290 - DNA, 20 bp, Artificial Sequence
  chemically synthesized
aattgtttctcctattatgt

SEQ ID NO: 381291 - DNA, 20 bp, Artificial Sequence
  chemically synthesized
gaggctagctaacataatag

SEQ ID NO: 381292 - DNA, 20 bp, Artificial Sequence
  chemically synthesized
taaacaaaaaagaacgcata

SEQ ID NO: 381293 - DNA, 20 bp, Artificial Sequence
  chemically synthesized
attcatagaggtaaacaaaa

SEQ ID NO: 381294 - DNA, 20 bp, Artificial Sequence
  chemically synthesized
acatagtacaaaattcatag

SEQ ID NO: 381295 - DNA, 20 bp, Artificial Sequence
  chemically synthesized
cacatagtacaaaattcata

SEQ ID NO: 381296 - DNA, 20 bp, Artificial Sequence
  chemically synthesized
tgcacatagtacaaaattca

SEQ ID NO: 381297 - DNA, 20 bp, Artificial Sequence
  chemically synthesized
attacctagttaattgcaca

SEQ ID NO: 381298 - DNA, 20 bp, Artificial Sequence
  chemically synthesized
ttgtactatgtgcaattaac

SEQ ID NO: 381299 - DNA, 20 bp, Artificial Sequence
  chemically synthesized
tgtactatgtgcaattaact

SEQ ID NO: 381300 - DNA, 20 bp, Artificial Sequence
  chemically synthesized
tgtgcaattaactaggtaat

SEQ ID NO: 381301 - DNA, 20 bp, Artificial Sequence
  chemically synthesized
ctcttaaagctccaattacc

SEQ ID NO: 381302 - DNA, 20 bp, Artificial Sequence
  chemically synthesized
tgcaattaactaggtaattg

SEQ ID NO: 381303 - DNA, 20 bp, Artificial Sequence
  chemically synthesized
aactaggtaattggagcttt

SEQ ID NO: 381304 - DNA, 20 bp, Artificial Sequence
  chemically synthesized
ctaggtaattggagctttaa

SEQ ID NO: 381305 - DNA, 20 bp, Artificial Sequence
  chemically synthesized
tgacccccaaagtgctctta

SEQ ID NO: 381306 - DNA, 20 bp, Artificial Sequence
  chemically synthesized
ttggagctttaagagcactt

SEQ ID NO: 381307 - DNA, 20 bp, Artificial Sequence
  chemically synthesized
tggagctttaagagcacttt

SEQ ID NO: 381308 - DNA, 20 bp, Artificial Sequence
  chemically synthesized
ggagctttaagagcactttg

SEQ ID NO: 381309 - DNA, 20 bp, Artificial Sequence
  chemically synthesized
gagctttaagagcactttgg

SEQ ID NO: 381310 - DNA, 20 bp, Artificial Sequence
  chemically synthesized
tttagtgttaatgaccccca

SEQ ID NO: 381311 - DNA, 20 bp, Artificial Sequence
  chemically synthesized
atttctatgtaaaatatttt

SEQ ID NO: 381312 - DNA, 20 bp, Artificial Sequence
  chemically synthesized
aacactaaaaatattttaca

SEQ ID NO: 381313 - DNA, 20 bp, Artificial Sequence
  chemically synthesized
ttttacatagaaataattat

SEQ ID NO: 381314 - DNA, 20 bp, Artificial Sequence
  chemically synthesized
tggataaataaataaatggt

SEQ ID NO: 381315 - DNA, 20 bp, Artificial Sequence
  chemically synthesized
tgcatggataaataaataaa

SEQ ID NO: 381316 - DNA, 20 bp, Artificial Sequence
  chemically synthesized
tgaatggatggatgggtgca

SEQ ID NO: 381317 - DNA, 20 bp, Artificial Sequence
  chemically synthesized
ggatggatgaatggatggat

SEQ ID NO: 381318 - DNA, 20 bp, Artificial Sequence
  chemically synthesized
tggatggatgaatggatgga

SEQ ID NO: 381319 - DNA, 20 bp, Artificial Sequence
  chemically synthesized
cggatggatggatgaatgga

SEQ ID NO: 381320 - DNA, 20 bp, Artificial Sequence
  chemically synthesized
taaacggatggatggatgaa

SEQ ID NO: 381321 - DNA, 20 bp, Artificial Sequence
  chemically synthesized
tgaagagataaacggatgga

SEQ ID NO: 381322 - DNA, 20 bp, Artificial Sequence
  chemically synthesized
tggatgaagagataaacgga

SEQ ID NO: 381323 - DNA, 20 bp, Artificial Sequence
  chemically synthesized
gagatggatgaagagataaa

SEQ ID NO: 381324 - DNA, 20 bp, Artificial Sequence
  chemically synthesized
ttaaacatgagatggatgaa

SEQ ID NO: 381325 - DNA, 20 bp, Artificial Sequence
  chemically synthesized
aattaaacatgagatggatg

SEQ ID NO: 381326 - DNA, 20 bp, Artificial Sequence
  chemically synthesized
tatacaaattaaacatgaga

SEQ ID NO: 381327 - DNA, 20 bp, Artificial Sequence
  chemically synthesized
cgtttatacaaattaaacat

SEQ ID NO: 381328 - DNA, 20 bp, Artificial Sequence
  chemically synthesized
ataaacgtttatttatccca

SEQ ID NO: 381329 - DNA, 20 bp, Artificial Sequence
  chemically synthesized
catacatacatagagtctat

SEQ ID NO: 381330 - DNA, 20 bp, Artificial Sequence
  chemically synthesized
ccatacatacatagagtcta

SEQ ID NO: 381331 - DNA, 20 bp, Artificial Sequence
  chemically synthesized
acatgtaccatacatacata

SEQ ID NO: 381332 - DNA, 20 bp, Artificial Sequence
  chemically synthesized
ttacatgtaccatacataca

SEQ ID NO: 381333 - DNA, 20 bp, Artificial Sequence
  chemically synthesized
ccatagactctatgtatgta

SEQ ID NO: 381334 - DNA, 20 bp, Artificial Sequence
  chemically synthesized
tatgtatgtatggtacatgt

SEQ ID NO: 381335 - DNA, 20 bp, Artificial Sequence
  chemically synthesized
atgtatgtatggtacatgta

SEQ ID NO: 381336 - DNA, 20 bp, Artificial Sequence
  chemically synthesized
tggtacatgtaaggttatat

SEQ ID NO: 381337 - DNA, 20 bp, Artificial Sequence
  chemically synthesized
gtacatgtaaggttatataa

SEQ ID NO: 381338 - DNA, 20 bp, Artificial Sequence
  chemically synthesized
taagagatacaatgttaaat

SEQ ID NO: 381339 - DNA, 20 bp, Artificial Sequence
  chemically synthesized
aagagatacaatgttaaata

SEQ ID NO: 381340 - DNA, 20 bp, Artificial Sequence
  chemically synthesized
agatacaatgttaaataagg

SEQ ID NO: 381341 - DNA, 20 bp, Artificial Sequence
  chemically synthesized
cattgtaaatttagggatag

SEQ ID NO: 381342 - DNA, 20 bp, Artificial Sequence
  chemically synthesized
cttcattgtaaatttaggga

SEQ ID NO: 381343 - DNA, 20 bp, Artificial Sequence
  chemically synthesized
tctccttcattgtaaattta

SEQ ID NO: 381344 - DNA, 20 bp, Artificial Sequence
  chemically synthesized
ttctccttcattgtaaattt

SEQ ID NO: 381345 - DNA, 20 bp, Artificial Sequence
  chemically synthesized
tttctccttcattgtaaatt

SEQ ID NO: 381346 - DNA, 20 bp, Artificial Sequence
  chemically synthesized
ctatccctaaatttacaatg

SEQ ID NO: 381347 - DNA, 20 bp, Artificial Sequence
  chemically synthesized
tatccctaaatttacaatga

SEQ ID NO: 381348 - DNA, 20 bp, Artificial Sequence
  chemically synthesized
tccctaaatttacaatgaag

SEQ ID NO: 381349 - DNA, 20 bp, Artificial Sequence
  chemically synthesized
aaatttacaatgaaggagaa

SEQ ID NO: 381350 - DNA, 20 bp, Artificial Sequence
  chemically synthesized
tcatatctgtaatcatgagg

SEQ ID NO: 381351 - DNA, 20 bp, Artificial Sequence
  chemically synthesized
ccttcatatctgtaatcatg

SEQ ID NO: 381352 - DNA, 20 bp, Artificial Sequence
  chemically synthesized
gaaaagctacctcatgatta

SEQ ID NO: 381353 - DNA, 20 bp, Artificial Sequence
  chemically synthesized
cccttcatatctgtaatcat

SEQ ID NO: 381354 - DNA, 20 bp, Artificial Sequence
  chemically synthesized
acctcatgattacagatatg

SEQ ID NO: 381355 - DNA, 20 bp, Artificial Sequence
  chemically synthesized
cctcatgattacagatatga

SEQ ID NO: 381356 - DNA, 20 bp, Artificial Sequence
  chemically synthesized
ctcatgattacagatatgaa

SEQ ID NO: 381357 - DNA, 20 bp, Artificial Sequence
  chemically synthesized
gattacagatatgaagggtt

SEQ ID NO: 381358 - DNA, 20 bp, Artificial Sequence
  chemically synthesized
ggtttggtaaatgcatcacc

SEQ ID NO: 381359 - DNA, 20 bp, Artificial Sequence
  chemically synthesized
gtttggtaaatgcatcacca

SEQ ID NO: 381360 - DNA, 20 bp, Artificial Sequence
  chemically synthesized
ttctgcttatgtgtaagcct

SEQ ID NO: 381361 - DNA, 20 bp, Artificial Sequence
  chemically synthesized
catcaccaaggcttacacat

SEQ ID NO: 381362 - DNA, 20 bp, Artificial Sequence
  chemically synthesized
ctctccttctgcttatgtgt

SEQ ID NO: 381363 - DNA, 20 bp, Artificial Sequence
  chemically synthesized
caccaaggcttacacataag

SEQ ID NO: 381364 - DNA, 20 bp, Artificial Sequence
  chemically synthesized
caaggcttacacataagcag

SEQ ID NO: 381365 - DNA, 20 bp, Artificial Sequence
  chemically synthesized
aaggcttacacataagcaga

SEQ ID NO: 381366 - DNA, 20 bp, Artificial Sequence
  chemically synthesized
ggcttacacataagcagaag

SEQ ID NO: 381367 - DNA, 20 bp, Artificial Sequence
  chemically synthesized
cttacacataagcagaagga

SEQ ID NO: 381368 - DNA, 20 bp, Artificial Sequence
  chemically synthesized
ttacacataagcagaaggag

SEQ ID NO: 381369 - DNA, 20 bp, Artificial Sequence
  chemically synthesized
tacacataagcagaaggaga

SEQ ID NO: 381370 - DNA, 20 bp, Artificial Sequence
  chemically synthesized
ataagcagaaggagagggtg

SEQ ID NO: 381371 - DNA, 20 bp, Artificial Sequence
  chemically synthesized
aagcagaaggagagggtgca

SEQ ID NO: 381372 - DNA, 20 bp, Artificial Sequence
  chemically synthesized
gcagaaggagagggtgcaga

SEQ ID NO: 381373 - DNA, 20 bp, Artificial Sequence
  chemically synthesized
gagagggtgcagagagctaa

SEQ ID NO: 381374 - DNA, 20 bp, Artificial Sequence
  chemically synthesized
agagggtgcagagagctaaa

SEQ ID NO: 381375 - DNA, 20 bp, Artificial Sequence
  chemically synthesized
agtcctttgggggagccttt

SEQ ID NO: 381376 - DNA, 20 bp, Artificial Sequence
  chemically synthesized
agagctaaaaggctccccca

SEQ ID NO: 381377 - DNA, 20 bp, Artificial Sequence
  chemically synthesized
gagctaaaaggctcccccaa

SEQ ID NO: 381378 - DNA, 20 bp, Artificial Sequence
  chemically synthesized
caagtttcagtcctttgggg

SEQ ID NO: 381379 - DNA, 20 bp, Artificial Sequence
  chemically synthesized
ttcaagtttcagtcctttgg

SEQ ID NO: 381380 - DNA, 20 bp, Artificial Sequence
  chemically synthesized
tttcaagtttcagtcctttg

SEQ ID NO: 381381 - DNA, 20 bp, Artificial Sequence
  chemically synthesized
ctttcaagtttcagtccttt

SEQ ID NO: 381382 - DNA, 20 bp, Artificial Sequence
  chemically synthesized
cctttcaagtttcagtcctt

SEQ ID NO: 381383 - DNA, 20 bp, Artificial Sequence
  chemically synthesized
gcagaattcctttcaagttt

SEQ ID NO: 381384 - DNA, 20 bp, Artificial Sequence
  chemically synthesized
cccaaaggactgaaacttga

SEQ ID NO: 381385 - DNA, 20 bp, Artificial Sequence
  chemically synthesized
ccaaaggactgaaacttgaa

SEQ ID NO: 381386 - DNA, 20 bp, Artificial Sequence
  chemically synthesized
ctatctgcagaattcctttc

SEQ ID NO: 381387 - DNA, 20 bp, Artificial Sequence
  chemically synthesized
gaaacttgaaaggaattctg

SEQ ID NO: 381388 - DNA, 20 bp, Artificial Sequence
  chemically synthesized
cttgaaaggaattctgcaga

SEQ ID NO: 381389 - DNA, 20 bp, Artificial Sequence
  chemically synthesized
ttgaaaggaattctgcagat

SEQ ID NO: 381390 - DNA, 20 bp, Artificial Sequence
  chemically synthesized
agggctttcaaacctatctg

SEQ ID NO: 381391 - DNA, 20 bp, Artificial Sequence
  chemically synthesized
aattctgcagataggtttga

SEQ ID NO: 381392 - DNA, 20 bp, Artificial Sequence
  chemically synthesized
aaaaaaaaaaaatcatgtca

SEQ ID NO: 381393 - DNA, 20 bp, Artificial Sequence
  chemically synthesized
aaaaaaaaaaaaatcatgtc

SEQ ID NO: 381394 - DNA, 20 bp, Artificial Sequence
  chemically synthesized
aaaaaaaaaaaaaatcatgt

SEQ ID NO: 381395 - DNA, 20 bp, Artificial Sequence
  chemically synthesized
aaagaatatgcaataggaaa

SEQ ID NO: 381396 - DNA, 20 bp, Artificial Sequence
  chemically synthesized
gggacaaaagaatatgcaat

SEQ ID NO: 381397 - DNA, 20 bp, Artificial Sequence
  chemically synthesized
agggacaaaagaatatgcaa

SEQ ID NO: 381398 - DNA, 20 bp, Artificial Sequence
  chemically synthesized
ttcatacttgaaagggacaa

SEQ ID NO: 381399 - DNA, 20 bp, Artificial Sequence
  chemically synthesized
catattcttttgtccctttc

SEQ ID NO: 381400 - DNA, 20 bp, Artificial Sequence
  chemically synthesized
aagaattttcatacttgaaa

SEQ ID NO: 381401 - DNA, 20 bp, Artificial Sequence
  chemically synthesized
taagaattttcatacttgaa

SEQ ID NO: 381402 - DNA, 20 bp, Artificial Sequence
  chemically synthesized
ataagaattttcatacttga

SEQ ID NO: 381403 - DNA, 20 bp, Artificial Sequence
  chemically synthesized
tatacattgaaggaaattat

SEQ ID NO: 381404 - DNA, 20 bp, Artificial Sequence
  chemically synthesized
acttagagagtatacattga

SEQ ID NO: 381405 - DNA, 20 bp, Artificial Sequence
  chemically synthesized
tacttagagagtatacattg

SEQ ID NO: 381406 - DNA, 20 bp, Artificial Sequence
  chemically synthesized
tccttcaatgtatactctct

SEQ ID NO: 381407 - DNA, 20 bp, Artificial Sequence
  chemically synthesized
aattgtttttattacttaga

SEQ ID NO: 381408 - DNA, 20 bp, Artificial Sequence
  chemically synthesized
acaattgtttttattactta

SEQ ID NO: 381409 - DNA, 20 bp, Artificial Sequence
  chemically synthesized
atacaattgtttttattact

SEQ ID NO: 381410 - DNA, 20 bp, Artificial Sequence
  chemically synthesized
aaaaacaattgtattctcaa

SEQ ID NO: 381411 - DNA, 20 bp, Artificial Sequence
  chemically synthesized
tttcttgtttgttagctttt

SEQ ID NO: 381412 - DNA, 20 bp, Artificial Sequence
  chemically synthesized
attctcaaaagctaacaaac

SEQ ID NO: 381413 - DNA, 20 bp, Artificial Sequence
  chemically synthesized
ttgcttgctttcttgtttgt

SEQ ID NO: 381414 - DNA, 20 bp, Artificial Sequence
  chemically synthesized
tcaaaagctaacaaacaaga

SEQ ID NO: 381415 - DNA, 20 bp, Artificial Sequence
  chemically synthesized
aagctaacaaacaagaaagc

SEQ ID NO: 381416 - DNA, 20 bp, Artificial Sequence
  chemically synthesized
acaagaaagcaagcaaacaa

SEQ ID NO: 381417 - DNA, 20 bp, Artificial Sequence
  chemically synthesized
aaagcaagcaaacaaaagtt

SEQ ID NO: 381418 - DNA, 20 bp, Artificial Sequence
  chemically synthesized
aagcaagcaaacaaaagttc

SEQ ID NO: 381419 - DNA, 20 bp, Artificial Sequence
  chemically synthesized
aagttcaggtatcacatttg

SEQ ID NO: 381420 - DNA, 20 bp, Artificial Sequence
  chemically synthesized
tcacatttgcagtaatatac

SEQ ID NO: 381421 - DNA, 20 bp, Artificial Sequence
  chemically synthesized
taaaagcataattttaatga

SEQ ID NO: 381422 - DNA, 20 bp, Artificial Sequence
  chemically synthesized
tcctctaagtaaacacataa

SEQ ID NO: 381423 - DNA, 20 bp, Artificial Sequence
  chemically synthesized
tatgcttttatgtgtttact

SEQ ID NO: 381424 - DNA, 20 bp, Artificial Sequence
  chemically synthesized
tgcttttatgtgtttactta

SEQ ID NO: 381425 - DNA, 20 bp, Artificial Sequence
  chemically synthesized
gcttttatgtgtttacttag

SEQ ID NO: 381426 - DNA, 20 bp, Artificial Sequence
  chemically synthesized
ttttatgtgtttacttagag

SEQ ID NO: 381427 - DNA, 20 bp, Artificial Sequence
  chemically synthesized
tattttctcaagactcctct

SEQ ID NO: 381428 - DNA, 20 bp, Artificial Sequence
  chemically synthesized
tgtttacttagaggagtctt

SEQ ID NO: 381429 - DNA, 20 bp, Artificial Sequence
  chemically synthesized
gtaggtctaaatattttctc

SEQ ID NO: 381430 - DNA, 20 bp, Artificial Sequence
  chemically synthesized
aggagtcttgagaaaatatt

SEQ ID NO: 381431 - DNA, 20 bp, Artificial Sequence
  chemically synthesized
aatatttagacctaccccct

SEQ ID NO: 381432 - DNA, 20 bp, Artificial Sequence
  chemically synthesized
ttccctaaagcttagggggt

SEQ ID NO: 381433 - DNA, 20 bp, Artificial Sequence
  chemically synthesized
cttccctaaagcttaggggg

SEQ ID NO: 381434 - DNA, 20 bp, Artificial Sequence
  chemically synthesized
ccacttccctaaagcttagg

SEQ ID NO: 381435 - DNA, 20 bp, Artificial Sequence
  chemically synthesized
accacttccctaaagcttag

SEQ ID NO: 381436 - DNA, 20 bp, Artificial Sequence
  chemically synthesized
tagacctaccccctaagctt

SEQ ID NO: 381437 - DNA, 20 bp, Artificial Sequence
  chemically synthesized
gaccacttccctaaagctta

SEQ ID NO: 381438 - DNA, 20 bp, Artificial Sequence
  chemically synthesized
agacctaccccctaagcttt

SEQ ID NO: 381439 - DNA, 20 bp, Artificial Sequence
  chemically synthesized
ggaccacttccctaaagctt

SEQ ID NO: 381440 - DNA, 20 bp, Artificial Sequence
  chemically synthesized
gacctaccccctaagcttta

SEQ ID NO: 381441 - DNA, 20 bp, Artificial Sequence
  chemically synthesized
gggaccacttccctaaagct

SEQ ID NO: 381442 - DNA, 20 bp, Artificial Sequence
  chemically synthesized
ctaccccctaagctttaggg

SEQ ID NO: 381443 - DNA, 20 bp, Artificial Sequence
  chemically synthesized
ggttggggaccacttcccta

SEQ ID NO: 381444 - DNA, 20 bp, Artificial Sequence
  chemically synthesized
ccccctaagctttagggaag

SEQ ID NO: 381445 - DNA, 20 bp, Artificial Sequence
  chemically synthesized
ccctggtgctaaaaaggttg

SEQ ID NO: 381446 - DNA, 20 bp, Artificial Sequence
  chemically synthesized
tccctggtgctaaaaaggtt

SEQ ID NO: 381447 - DNA, 20 bp, Artificial Sequence
  chemically synthesized
gaagtggtccccaacctttt

SEQ ID NO: 381448 - DNA, 20 bp, Artificial Sequence
  chemically synthesized
gtccctggtgctaaaaaggt

SEQ ID NO: 381449 - DNA, 20 bp, Artificial Sequence
  chemically synthesized
accagtccctggtgctaaaa

SEQ ID NO: 381450 - DNA, 20 bp, Artificial Sequence
  chemically synthesized
aaccagtccctggtgctaaa

SEQ ID NO: 381451 - DNA, 20 bp, Artificial Sequence
  chemically synthesized
gtccccaacctttttagcac

SEQ ID NO: 381452 - DNA, 20 bp, Artificial Sequence
  chemically synthesized
tccccaacctttttagcacc

SEQ ID NO: 381453 - DNA, 20 bp, Artificial Sequence
  chemically synthesized
ccccaacctttttagcacca

SEQ ID NO: 381454 - DNA, 20 bp, Artificial Sequence
  chemically synthesized
acctttttagcaccagggac

SEQ ID NO: 381455 - DNA, 20 bp, Artificial Sequence
  chemically synthesized
tcttccacgaaaccagtccc

SEQ ID NO: 381456 - DNA, 20 bp, Artificial Sequence
  chemically synthesized
agcaccagggactggtttcg

SEQ ID NO: 381457 - DNA, 20 bp, Artificial Sequence
  chemically synthesized
aaaattgtcttccacgaaac

SEQ ID NO: 381458 - DNA, 20 bp, Artificial Sequence
  chemically synthesized
accagggactggtttcgtgg

SEQ ID NO: 381459 - DNA, 20 bp, Artificial Sequence
  chemically synthesized
cgtggaagacaattttttca

SEQ ID NO: 381460 - DNA, 20 bp, Artificial Sequence
  chemically synthesized
agacaattttttcacagact

SEQ ID NO: 381461 - DNA, 20 bp, Artificial Sequence
  chemically synthesized
gacaattttttcacagactt

SEQ ID NO: 381462 - DNA, 20 bp, Artificial Sequence
  chemically synthesized
attttttcacagacttgggc

SEQ ID NO: 381463 - DNA, 20 bp, Artificial Sequence
  chemically synthesized
ttttttcacagacttgggct

SEQ ID NO: 381464 - DNA, 20 bp, Artificial Sequence
  chemically synthesized
tttttcacagacttgggctg

SEQ ID NO: 381465 - DNA, 20 bp, Artificial Sequence
  chemically synthesized
ccaaaccatctccccagccc

SEQ ID NO: 381466 - DNA, 20 bp, Artificial Sequence
  chemically synthesized
tttcacagacttgggctggg

SEQ ID NO: 381467 - DNA, 20 bp, Artificial Sequence
  chemically synthesized
acagacttgggctggggaga

SEQ ID NO: 381468 - DNA, 20 bp, Artificial Sequence
  chemically synthesized
tcattcccaaaccatctccc

SEQ ID NO: 381469 - DNA, 20 bp, Artificial Sequence
  chemically synthesized
cttgggctggggagatggtt

SEQ ID NO: 381470 - DNA, 20 bp, Artificial Sequence
  chemically synthesized
ttgggctggggagatggttt

SEQ ID NO: 381471 - DNA, 20 bp, Artificial Sequence
  chemically synthesized
agatggtttgggaatgattc

SEQ ID NO: 381472 - DNA, 20 bp, Artificial Sequence
  chemically synthesized
atttatcattaaattctcat

SEQ ID NO: 381473 - DNA, 20 bp, Artificial Sequence
  chemically synthesized
tttatcattaaattctcata

SEQ ID NO: 381474 - DNA, 20 bp, Artificial Sequence
  chemically synthesized
tatcattaaattctcataag

SEQ ID NO: 381475 - DNA, 20 bp, Artificial Sequence
  chemically synthesized
ctaggttgtgtgctccttat

SEQ ID NO: 381476 - DNA, 20 bp, Artificial Sequence
  chemically synthesized
ctcataaggagcacacaacc

SEQ ID NO: 381477 - DNA, 20 bp, Artificial Sequence
  chemically synthesized
cctgcgcatgcgagggatct

SEQ ID NO: 381478 - DNA, 20 bp, Artificial Sequence
  chemically synthesized
acctgcgcatgcgagggatc

SEQ ID NO: 381479 - DNA, 20 bp, Artificial Sequence
  chemically synthesized
attgtgacctgcgcatgcga

SEQ ID NO: 381480 - DNA, 20 bp, Artificial Sequence
  chemically synthesized
tattgtgacctgcgcatgcg

SEQ ID NO: 381481 - DNA, 20 bp, Artificial Sequence
  chemically synthesized
acctagatccctcgcatgcg

SEQ ID NO: 381482 - DNA, 20 bp, Artificial Sequence
  chemically synthesized
ctattgtgacctgcgcatgc

SEQ ID NO: 381483 - DNA, 20 bp, Artificial Sequence
  chemically synthesized
cctagatccctcgcatgcgc

SEQ ID NO: 381484 - DNA, 20 bp, Artificial Sequence
  chemically synthesized
ctcgcatgcgcaggtcacaa

SEQ ID NO: 381485 - DNA, 20 bp, Artificial Sequence
  chemically synthesized
tcgcatgcgcaggtcacaat

SEQ ID NO: 381486 - DNA, 20 bp, Artificial Sequence
  chemically synthesized
cgcatgcgcaggtcacaata

SEQ ID NO: 381487 - DNA, 20 bp, Artificial Sequence
  chemically synthesized
cattacattctcataggagc

SEQ ID NO: 381488 - DNA, 20 bp, Artificial Sequence
  chemically synthesized
aatagggttctcgctcctat

SEQ ID NO: 381489 - DNA, 20 bp, Artificial Sequence
  chemically synthesized
gcagcattacattctcatag

SEQ ID NO: 381490 - DNA, 20 bp, Artificial Sequence
  chemically synthesized
cagcagcattacattctcat

SEQ ID NO: 381491 - DNA, 20 bp, Artificial Sequence
  chemically synthesized
gcagcagcattacattctca

SEQ ID NO: 381492 - DNA, 20 bp, Artificial Sequence
  chemically synthesized
gcctcctgtcagataagcag

SEQ ID NO: 381493 - DNA, 20 bp, Artificial Sequence
  chemically synthesized
tctgcctcctgtcagataag

SEQ ID NO: 381494 - DNA, 20 bp, Artificial Sequence
  chemically synthesized
taatgctgctgcttatctga

SEQ ID NO: 381495 - DNA, 20 bp, Artificial Sequence
  chemically synthesized
aatgctgctgcttatctgac

SEQ ID NO: 381496 - DNA, 20 bp, Artificial Sequence
  chemically synthesized
agctctgcctcctgtcagat

SEQ ID NO: 381497 - DNA, 20 bp, Artificial Sequence
  chemically synthesized
tgctgctgcttatctgacag

SEQ ID NO: 381498 - DNA, 20 bp, Artificial Sequence
  chemically synthesized
gctgctgcttatctgacagg

SEQ ID NO: 381499 - DNA, 20 bp, Artificial Sequence
  chemically synthesized
gcctgagctctgcctcctgt

SEQ ID NO: 381500 - DNA, 20 bp, Artificial Sequence
  chemically synthesized
gctgcttatctgacaggagg

SEQ ID NO: 381501 - DNA, 20 bp, Artificial Sequence
  chemically synthesized
tgcttatctgacaggaggca

SEQ ID NO: 381502 - DNA, 20 bp, Artificial Sequence
  chemically synthesized
atctgacaggaggcagagct

SEQ ID NO: 381503 - DNA, 20 bp, Artificial Sequence
  chemically synthesized
tctgacaggaggcagagctc

SEQ ID NO: 381504 - DNA, 20 bp, Artificial Sequence
  chemically synthesized
agtgagccccgggcaagcct

SEQ ID NO: 381505 - DNA, 20 bp, Artificial Sequence
  chemically synthesized
aggcagagctcaggcttgcc

SEQ ID NO: 381506 - DNA, 20 bp, Artificial Sequence
  chemically synthesized
ggcagagctcaggcttgccc

SEQ ID NO: 381507 - DNA, 20 bp, Artificial Sequence
  chemically synthesized
gcagagctcaggcttgcccg

SEQ ID NO: 381508 - DNA, 20 bp, Artificial Sequence
  chemically synthesized
gcaggaagtgagccccgggc

SEQ ID NO: 381509 - DNA, 20 bp, Artificial Sequence
  chemically synthesized
aacagcaggaagtgagcccc

SEQ ID NO: 381510 - DNA, 20 bp, Artificial Sequence
  chemically synthesized
gaacagcaggaagtgagccc

SEQ ID NO: 381511 - DNA, 20 bp, Artificial Sequence
  chemically synthesized
cagggggaacagcaggaagt

SEQ ID NO: 381512 - DNA, 20 bp, Artificial Sequence
  chemically synthesized
aaaccagggggaacagcagg

SEQ ID NO: 381513 - DNA, 20 bp, Artificial Sequence
  chemically synthesized
tagaaaccagggggaacagc

SEQ ID NO: 381514 - DNA, 20 bp, Artificial Sequence
  chemically synthesized
ttagaaaccagggggaacag

SEQ ID NO: 381515 - DNA, 20 bp, Artificial Sequence
  chemically synthesized
tcacttcctgctgttccccc

SEQ ID NO: 381516 - DNA, 20 bp, Artificial Sequence
  chemically synthesized
ctgttagaaaccagggggaa

SEQ ID NO: 381517 - DNA, 20 bp, Artificial Sequence
  chemically synthesized
gtgacctgttagaaaccagg

SEQ ID NO: 381518 - DNA, 20 bp, Artificial Sequence
  chemically synthesized
cgtgacctgttagaaaccag

SEQ ID NO: 381519 - DNA, 20 bp, Artificial Sequence
  chemically synthesized
ccgtgacctgttagaaacca

SEQ ID NO: 381520 - DNA, 20 bp, Artificial Sequence
  chemically synthesized
tccgtgacctgttagaaacc

SEQ ID NO: 381521 - DNA, 20 bp, Artificial Sequence
  chemically synthesized
gtccgtgacctgttagaaac

SEQ ID NO: 381522 - DNA, 20 bp, Artificial Sequence
  chemically synthesized
ctgttccccctggtttctaa

SEQ ID NO: 381523 - DNA, 20 bp, Artificial Sequence
  chemically synthesized
tgttccccctggtttctaac

SEQ ID NO: 381524 - DNA, 20 bp, Artificial Sequence
  chemically synthesized
ccaatcggtccgtgacctgt

SEQ ID NO: 381525 - DNA, 20 bp, Artificial Sequence
  chemically synthesized
ccctggtttctaacaggtca

SEQ ID NO: 381526 - DNA, 20 bp, Artificial Sequence
  chemically synthesized
ctaacaggtcacggaccgat

SEQ ID NO: 381527 - DNA, 20 bp, Artificial Sequence
  chemically synthesized
aggtcacggaccgattggtc

SEQ ID NO: 381528 - DNA, 20 bp, Artificial Sequence
  chemically synthesized
accctgggccccagaccaat

SEQ ID NO: 381529 - DNA, 20 bp, Artificial Sequence
  chemically synthesized
ggtcacggaccgattggtct

SEQ ID NO: 381530 - DNA, 20 bp, Artificial Sequence
  chemically synthesized
gtcacggaccgattggtctg

SEQ ID NO: 381531 - DNA, 20 bp, Artificial Sequence
  chemically synthesized
ggaccgattggtctggggcc

SEQ ID NO: 381532 - DNA, 20 bp, Artificial Sequence
  chemically synthesized
gaccgattggtctggggccc

SEQ ID NO: 381533 - DNA, 20 bp, Artificial Sequence
  chemically synthesized
accgattggtctggggccca

SEQ ID NO: 381534 - DNA, 20 bp, Artificial Sequence
  chemically synthesized
ggtccccaaaccctgggccc

SEQ ID NO: 381535 - DNA, 20 bp, Artificial Sequence
  chemically synthesized
ttggtctggggcccagggtt

SEQ ID NO: 381536 - DNA, 20 bp, Artificial Sequence
  chemically synthesized
tggtctggggcccagggttt

SEQ ID NO: 381537 - DNA, 20 bp, Artificial Sequence
  chemically synthesized
agcaggggtccccaaaccct

SEQ ID NO: 381538 - DNA, 20 bp, Artificial Sequence
  chemically synthesized
ggtctggggcccagggtttg

SEQ ID NO: 381539 - DNA, 20 bp, Artificial Sequence
  chemically synthesized
aagcaggggtccccaaaccc

SEQ ID NO: 381540 - DNA, 20 bp, Artificial Sequence
  chemically synthesized
gggtttggggacccctgctt

SEQ ID NO: 381541 - DNA, 20 bp, Artificial Sequence
  chemically synthesized
ggtttggggacccctgcttt

SEQ ID NO: 381542 - DNA, 20 bp, Artificial Sequence
  chemically synthesized
agcaggggtccccaaagcag

SEQ ID NO: 381543 - DNA, 20 bp, Artificial Sequence
  chemically synthesized
gtttggggacccctgctttg

SEQ ID NO: 381544 - DNA, 20 bp, Artificial Sequence
  chemically synthesized
aagcaggggtccccaaagca

SEQ ID NO: 381545 - DNA, 20 bp, Artificial Sequence
  chemically synthesized
aaagcaggggtccccaaagc

SEQ ID NO: 381546 - DNA, 20 bp, Artificial Sequence
  chemically synthesized
caaagcaggggtccccaaag

SEQ ID NO: 381547 - DNA, 20 bp, Artificial Sequence
  chemically synthesized
ccccaaagcaggggtcccca

SEQ ID NO: 381548 - DNA, 20 bp, Artificial Sequence
  chemically synthesized
tgctttggggacccctgctt

SEQ ID NO: 381549 - DNA, 20 bp, Artificial Sequence
  chemically synthesized
gctttggggacccctgcttt

SEQ ID NO: 381550 - DNA, 20 bp, Artificial Sequence
  chemically synthesized
tgctgttctccccaaagcag

SEQ ID NO: 381551 - DNA, 20 bp, Artificial Sequence
  chemically synthesized
ctttggggacccctgctttg

SEQ ID NO: 381552 - DNA, 20 bp, Artificial Sequence
  chemically synthesized
atgctgttctccccaaagca

SEQ ID NO: 381553 - DNA, 20 bp, Artificial Sequence
  chemically synthesized
tatgctgttctccccaaagc

SEQ ID NO: 381554 - DNA, 20 bp, Artificial Sequence
  chemically synthesized
ttggggacccctgctttggg

SEQ ID NO: 381555 - DNA, 20 bp, Artificial Sequence
  chemically synthesized
ttatgctgttctccccaaag

SEQ ID NO: 381556 - DNA, 20 bp, Artificial Sequence
  chemically synthesized
tttttatgctgttctcccca

SEQ ID NO: 381557 - DNA, 20 bp, Artificial Sequence
  chemically synthesized
gacccctgctttggggagaa

SEQ ID NO: 381558 - DNA, 20 bp, Artificial Sequence
  chemically synthesized
tttggggagaacagcataaa

SEQ ID NO: 381559 - DNA, 20 bp, Artificial Sequence
  chemically synthesized
ttggggagaacagcataaaa

SEQ ID NO: 381560 - DNA, 20 bp, Artificial Sequence
  chemically synthesized
gggagaacagcataaaaagg

SEQ ID NO: 381561 - DNA, 20 bp, Artificial Sequence
  chemically synthesized
ataaaaatctagaacagttt

SEQ ID NO: 381562 - DNA, 20 bp, Artificial Sequence
  chemically synthesized
cagcatttctgaaactgttc

SEQ ID NO: 381563 - DNA, 20 bp, Artificial Sequence
  chemically synthesized
agaaaaataaaaatctagaa

SEQ ID NO: 381564 - DNA, 20 bp, Artificial Sequence
  chemically synthesized
ctgacagaaaaataaaaatc

SEQ ID NO: 381565 - DNA, 20 bp, Artificial Sequence
  chemically synthesized
ctagatttttatttttctgt

SEQ ID NO: 381566 - DNA, 20 bp, Artificial Sequence
  chemically synthesized
tactacaaccattttactga

SEQ ID NO: 381567 - DNA, 20 bp, Artificial Sequence
  chemically synthesized
ttatttttctgtcagtaaaa

SEQ ID NO: 381568 - DNA, 20 bp, Artificial Sequence
  chemically synthesized
ttctgtcagtaaaatggttg

SEQ ID NO: 381569 - DNA, 20 bp, Artificial Sequence
  chemically synthesized
cagtaaaatggttgtagtat

SEQ ID NO: 381570 - DNA, 20 bp, Artificial Sequence
  chemically synthesized
gagactctacaatacagtgt

SEQ ID NO: 381571 - DNA, 20 bp, Artificial Sequence
  chemically synthesized
ataaatcttacactgtattg

SEQ ID NO: 381572 - DNA, 20 bp, Artificial Sequence
  chemically synthesized
aaatcttacactgtattgta

SEQ ID NO: 381573 - DNA, 20 bp, Artificial Sequence
  chemically synthesized
tttattgagactctacaata

SEQ ID NO: 381574 - DNA, 20 bp, Artificial Sequence
  chemically synthesized
tgtattgtagagtctcaata

SEQ ID NO: 381575 - DNA, 20 bp, Artificial Sequence
  chemically synthesized
attcagtgagtaactttatt

SEQ ID NO: 381576 - DNA, 20 bp, Artificial Sequence
  chemically synthesized
ttttaaaatattcattcagt

SEQ ID NO: 381577 - DNA, 20 bp, Artificial Sequence
  chemically synthesized
aactttttaaaatattcatt

SEQ ID NO: 381578 - DNA, 20 bp, Artificial Sequence
  chemically synthesized
cactgaatgaatattttaaa

SEQ ID NO: 381579 - DNA, 20 bp, Artificial Sequence
  chemically synthesized
ttacttttgtaatttaataa

SEQ ID NO: 381580 - DNA, 20 bp, Artificial Sequence
  chemically synthesized
tttacttttgtaatttaata

SEQ ID NO: 381581 - DNA, 20 bp, Artificial Sequence
  chemically synthesized
ttttacttttgtaatttaat

SEQ ID NO: 381582 - DNA, 20 bp, Artificial Sequence
  chemically synthesized
tttcccttattaaattacaa

SEQ ID NO: 381583 - DNA, 20 bp, Artificial Sequence
  chemically synthesized
attaaattacaaaagtaaaa

SEQ ID NO: 381584 - DNA, 20 bp, Artificial Sequence
  chemically synthesized
ttaaattacaaaagtaaaat

SEQ ID NO: 381585 - DNA, 20 bp, Artificial Sequence
  chemically synthesized
aaattacaaaagtaaaatag

SEQ ID NO: 381586 - DNA, 20 bp, Artificial Sequence
  chemically synthesized
tatttatgtagattatgtta

SEQ ID NO: 381587 - DNA, 20 bp, Artificial Sequence
  chemically synthesized
attcatatttggtatttatg

SEQ ID NO: 381588 - DNA, 20 bp, Artificial Sequence
  chemically synthesized
aaaatatatcaattcatatt

SEQ ID NO: 381589 - DNA, 20 bp, Artificial Sequence
  chemically synthesized
aagaatttctgttaaaatat

SEQ ID NO: 381590 - DNA, 20 bp, Artificial Sequence
  chemically synthesized
gaagaatttctgttaaaata

SEQ ID NO: 381591 - DNA, 20 bp, Artificial Sequence
  chemically synthesized
atatttttcctatattttaa

SEQ ID NO: 381592 - DNA, 20 bp, Artificial Sequence
  chemically synthesized
ttttaacagaaattcttctt

SEQ ID NO: 381593 - DNA, 20 bp, Artificial Sequence
  chemically synthesized
ttaacagaaattcttcttga

SEQ ID NO: 381594 - DNA, 20 bp, Artificial Sequence
  chemically synthesized
aattctatgtttctctcaag

SEQ ID NO: 381595 - DNA, 20 bp, Artificial Sequence
  chemically synthesized
tagaattctatgtttctctc

SEQ ID NO: 381596 - DNA, 20 bp, Artificial Sequence
  chemically synthesized
aattcttcttgagagaaaca

SEQ ID NO: 381597 - DNA, 20 bp, Artificial Sequence
  chemically synthesized
atgtctataaataggagaca

SEQ ID NO: 381598 - DNA, 20 bp, Artificial Sequence
  chemically synthesized
aattctatgtctcctattta

SEQ ID NO: 381599 - DNA, 20 bp, Artificial Sequence
  chemically synthesized
cagttaatgtctataaatag

SEQ ID NO: 381600 - DNA, 20 bp, Artificial Sequence
  chemically synthesized
agcagttaatgtctataaat

SEQ ID NO: 381601 - DNA, 20 bp, Artificial Sequence
  chemically synthesized
tagcagttaatgtctataaa

SEQ ID NO: 381602 - DNA, 20 bp, Artificial Sequence
  chemically synthesized
agtggttgtgcaaaatgtag

SEQ ID NO: 381603 - DNA, 20 bp, Artificial Sequence
  chemically synthesized
aaaagtggttgtgcaaaatg

SEQ ID NO: 381604 - DNA, 20 bp, Artificial Sequence
  chemically synthesized
tctctttctaacggtaaaag

SEQ ID NO: 381605 - DNA, 20 bp, Artificial Sequence
  chemically synthesized
tgcacaaccacttttaccgt

SEQ ID NO: 381606 - DNA, 20 bp, Artificial Sequence
  chemically synthesized
agttctctttctaacggtaa

SEQ ID NO: 381607 - DNA, 20 bp, Artificial Sequence
  chemically synthesized
caaccacttttaccgttaga

SEQ ID NO: 381608 - DNA, 20 bp, Artificial Sequence
  chemically synthesized
accacttttaccgttagaaa

SEQ ID NO: 381609 - DNA, 20 bp, Artificial Sequence
  chemically synthesized
aagtacagttctctttctaa

SEQ ID NO: 381610 - DNA, 20 bp, Artificial Sequence
  chemically synthesized
gctatgtaaccatcaaagta

SEQ ID NO: 381611 - DNA, 20 bp, Artificial Sequence
  chemically synthesized
gaaagagaactgtactttga

SEQ ID NO: 381612 - DNA, 20 bp, Artificial Sequence
  chemically synthesized
aaggtgctatgtaaccatca

SEQ ID NO: 381613 - DNA, 20 bp, Artificial Sequence
  chemically synthesized
actgtactttgatggttaca

SEQ ID NO: 381614 - DNA, 20 bp, Artificial Sequence
  chemically synthesized
gtattttgtacatgaggaaa

SEQ ID NO: 381615 - DNA, 20 bp, Artificial Sequence
  chemically synthesized
agtattttgtacatgaggaa

SEQ ID NO: 381616 - DNA, 20 bp, Artificial Sequence
  chemically synthesized
gcattagtattttgtacatg

SEQ ID NO: 381617 - DNA, 20 bp, Artificial Sequence
  chemically synthesized
agcattagtattttgtacat

SEQ ID NO: 381618 - DNA, 20 bp, Artificial Sequence
  chemically synthesized
attatttttgttagtagcat

SEQ ID NO: 381619 - DNA, 20 bp, Artificial Sequence
  chemically synthesized
cttaaaattatttttgttag

SEQ ID NO: 381620 - DNA, 20 bp, Artificial Sequence
  chemically synthesized
tcacttaaaattatttttgt

SEQ ID NO: 381621 - DNA, 20 bp, Artificial Sequence
  chemically synthesized
ctactaacaaaaataatttt

SEQ ID NO: 381622 - DNA, 20 bp, Artificial Sequence
  chemically synthesized
taattatcaaaccccattat

SEQ ID NO: 381623 - DNA, 20 bp, Artificial Sequence
  chemically synthesized
aattatcaaaccccattatg

SEQ ID NO: 381624 - DNA, 20 bp, Artificial Sequence
  chemically synthesized
ttaacctcatcctcataatg

SEQ ID NO: 381625 - DNA, 20 bp, Artificial Sequence
  chemically synthesized
cttaacctcatcctcataat

SEQ ID NO: 381626 - DNA, 20 bp, Artificial Sequence
  chemically synthesized
tcttaacctcatcctcataa

SEQ ID NO: 381627 - DNA, 20 bp, Artificial Sequence
  chemically synthesized
tcaaaccccattatgaggat

SEQ ID NO: 381628 - DNA, 20 bp, Artificial Sequence
  chemically synthesized
caaaccccattatgaggatg

SEQ ID NO: 381629 - DNA, 20 bp, Artificial Sequence
  chemically synthesized
cccattatgaggatgaggtt

SEQ ID NO: 381630 - DNA, 20 bp, Artificial Sequence
  chemically synthesized
atgaggatgaggttaagata

SEQ ID NO: 381631 - DNA, 20 bp, Artificial Sequence
  chemically synthesized
taaagtaaaatcatctttgt

SEQ ID NO: 381632 - DNA, 20 bp, Artificial Sequence
  chemically synthesized
aaagtaaaatcatctttgtc

SEQ ID NO: 381633 - DNA, 20 bp, Artificial Sequence
  chemically synthesized
aagtaaaatcatctttgtca

SEQ ID NO: 381634 - DNA, 20 bp, Artificial Sequence
  chemically synthesized
cactgcgccccaccctgaca

SEQ ID NO: 381635 - DNA, 20 bp, Artificial Sequence
  chemically synthesized
taaaatcatctttgtcaggg

SEQ ID NO: 381636 - DNA, 20 bp, Artificial Sequence
  chemically synthesized
aaaatcatctttgtcagggt

SEQ ID NO: 381637 - DNA, 20 bp, Artificial Sequence
  chemically synthesized
aaatcatctttgtcagggtg

SEQ ID NO: 381638 - DNA, 20 bp, Artificial Sequence
  chemically synthesized
atctttgtcagggtggggcg

SEQ ID NO: 381639 - DNA, 20 bp, Artificial Sequence
  chemically synthesized
tttgtcagggtggggcgcag

SEQ ID NO: 381640 - DNA, 20 bp, Artificial Sequence
  chemically synthesized
agtattgagattacaggtgt

SEQ ID NO: 381641 - DNA, 20 bp, Artificial Sequence
  chemically synthesized
tcccaaagtattgagattac

SEQ ID NO: 381642 - DNA, 20 bp, Artificial Sequence
  chemically synthesized
ctcccaaagtattgagatta

SEQ ID NO: 381643 - DNA, 20 bp, Artificial Sequence
  chemically synthesized
cacctgtaatctcaatactt

SEQ ID NO: 381644 - DNA, 20 bp, Artificial Sequence
  chemically synthesized
ccttggcctcccaaagtatt

SEQ ID NO: 381645 - DNA, 20 bp, Artificial Sequence
  chemically synthesized
acctgtaatctcaatacttt

SEQ ID NO: 381646 - DNA, 20 bp, Artificial Sequence
  chemically synthesized
ctgtaatctcaatactttgg

SEQ ID NO: 381647 - DNA, 20 bp, Artificial Sequence
  chemically synthesized
tgtaatctcaatactttggg

SEQ ID NO: 381648 - DNA, 20 bp, Artificial Sequence
  chemically synthesized
ccccctgccttggcctccca

SEQ ID NO: 381649 - DNA, 20 bp, Artificial Sequence
  chemically synthesized
tctcaatactttgggaggcc

SEQ ID NO: 381650 - DNA, 20 bp, Artificial Sequence
  chemically synthesized
ctcaatactttgggaggcca

SEQ ID NO: 381651 - DNA, 20 bp, Artificial Sequence
  chemically synthesized
aatactttgggaggccaagg

SEQ ID NO: 381652 - DNA, 20 bp, Artificial Sequence
  chemically synthesized
atactttgggaggccaaggc

SEQ ID NO: 381653 - DNA, 20 bp, Artificial Sequence
  chemically synthesized
tactttgggaggccaaggca

SEQ ID NO: 381654 - DNA, 20 bp, Artificial Sequence
  chemically synthesized
actttgggaggccaaggcag

SEQ ID NO: 381655 - DNA, 20 bp, Artificial Sequence
  chemically synthesized
ctttgggaggccaaggcagg

SEQ ID NO: 381656 - DNA, 20 bp, Artificial Sequence
  chemically synthesized
ctcaagtgatccccctgcct

SEQ ID NO: 381657 - DNA, 20 bp, Artificial Sequence
  chemically synthesized
ccaaggcagggggatcactt

SEQ ID NO: 381658 - DNA, 20 bp, Artificial Sequence
  chemically synthesized
caaggcagggggatcacttg

SEQ ID NO: 381659 - DNA, 20 bp, Artificial Sequence
  chemically synthesized
gcagggggatcacttgaggc

SEQ ID NO: 381660 - DNA, 20 bp, Artificial Sequence
  chemically synthesized
cagggggatcacttgaggcc

SEQ ID NO: 381661 - DNA, 20 bp, Artificial Sequence
  chemically synthesized
ggtctcgaactcctggcctc

SEQ ID NO: 381662 - DNA, 20 bp, Artificial Sequence
  chemically synthesized
gggggatcacttgaggccag

SEQ ID NO: 381663 - DNA, 20 bp, Artificial Sequence
  chemically synthesized
tcacttgaggccaggagttc

SEQ ID NO: 381664 - DNA, 20 bp, Artificial Sequence
  chemically synthesized
ccaggctggtctcgaactcc

SEQ ID NO: 381665 - DNA, 20 bp, Artificial Sequence
  chemically synthesized
tgaggccaggagttcgagac

SEQ ID NO: 381666 - DNA, 20 bp, Artificial Sequence
  chemically synthesized
ccaggagttcgagaccagcc

SEQ ID NO: 381667 - DNA, 20 bp, Artificial Sequence
  chemically synthesized
tttcgctataatggccaggc

SEQ ID NO: 381668 - DNA, 20 bp, Artificial Sequence
  chemically synthesized
ggggtttcgctataatggcc

SEQ ID NO: 381669 - DNA, 20 bp, Artificial Sequence
  chemically synthesized
cgagaccagcctggccatta

SEQ ID NO: 381670 - DNA, 20 bp, Artificial Sequence
  chemically synthesized
tggggtttcgctataatggc

SEQ ID NO: 381671 - DNA, 20 bp, Artificial Sequence
  chemically synthesized
gagatggggtttcgctataa

SEQ ID NO: 381672 - DNA, 20 bp, Artificial Sequence
  chemically synthesized
ttgtatttttagtagagatg

SEQ ID NO: 381673 - DNA, 20 bp, Artificial Sequence
  chemically synthesized
tttgtatttttagtagagat

SEQ ID NO: 381674 - DNA, 20 bp, Artificial Sequence
  chemically synthesized
ttttgtatttttagtagaga

SEQ ID NO: 381675 - DNA, 20 bp, Artificial Sequence
  chemically synthesized
taatttttgtatttttagta

SEQ ID NO: 381676 - DNA, 20 bp, Artificial Sequence
  chemically synthesized
tctaatttttgtatttttag

SEQ ID NO: 381677 - DNA, 20 bp, Artificial Sequence
  chemically synthesized
ccatctaatttttgtatttt

SEQ ID NO: 381678 - DNA, 20 bp, Artificial Sequence
  chemically synthesized
tctactaaaaatacaaaaat

SEQ ID NO: 381679 - DNA, 20 bp, Artificial Sequence
  chemically synthesized
ctaaaaatacaaaaattaga

SEQ ID NO: 381680 - DNA, 20 bp, Artificial Sequence
  chemically synthesized
taaaaatacaaaaattagat

SEQ ID NO: 381681 - DNA, 20 bp, Artificial Sequence
  chemically synthesized
atacaaaaattagatgggtg

SEQ ID NO: 381682 - DNA, 20 bp, Artificial Sequence
  chemically synthesized
caaaaattagatgggtgtgg

SEQ ID NO: 381683 - DNA, 20 bp, Artificial Sequence
  chemically synthesized
ccgagtagctgggattacag

SEQ ID NO: 381684 - DNA, 20 bp, Artificial Sequence
  chemically synthesized
accgagtagctgggattaca

SEQ ID NO: 381685 - DNA, 20 bp, Artificial Sequence
  chemically synthesized
gtggcacacccctgtaatcc

SEQ ID NO: 381686 - DNA, 20 bp, Artificial Sequence
  chemically synthesized
taccgagtagctgggattac

SEQ ID NO: 381687 - DNA, 20 bp, Artificial Sequence
  chemically synthesized
ctaccgagtagctgggatta

SEQ ID NO: 381688 - DNA, 20 bp, Artificial Sequence
  chemically synthesized
cccctgtaatcccagctact

SEQ ID NO: 381689 - DNA, 20 bp, Artificial Sequence
  chemically synthesized
cctcagcctaccgagtagct

SEQ ID NO: 381690 - DNA, 20 bp, Artificial Sequence
  chemically synthesized
acctcagcctaccgagtagc

SEQ ID NO: 381691 - DNA, 20 bp, Artificial Sequence
  chemically synthesized
ctgtaatcccagctactcgg

SEQ ID NO: 381692 - DNA, 20 bp, Artificial Sequence
  chemically synthesized
tgtaatcccagctactcggt

SEQ ID NO: 381693 - DNA, 20 bp, Artificial Sequence
  chemically synthesized
tcccacctcagcctaccgag

SEQ ID NO: 381694 - DNA, 20 bp, Artificial Sequence
  chemically synthesized
ttctcccacctcagcctacc

SEQ ID NO: 381695 - DNA, 20 bp, Artificial Sequence
  chemically synthesized
tcccagctactcggtaggct

SEQ ID NO: 381696 - DNA, 20 bp, Artificial Sequence
  chemically synthesized
cccagctactcggtaggctg

SEQ ID NO: 381697 - DNA, 20 bp, Artificial Sequence
  chemically synthesized
agctactcggtaggctgagg

SEQ ID NO: 381698 - DNA, 20 bp, Artificial Sequence
  chemically synthesized
gctactcggtaggctgaggt

SEQ ID NO: 381699 - DNA, 20 bp, Artificial Sequence
  chemically synthesized
tactcggtaggctgaggtgg

SEQ ID NO: 381700 - DNA, 20 bp, Artificial Sequence
  chemically synthesized
gttaagcgattctcccacct

SEQ ID NO: 381701 - DNA, 20 bp, Artificial Sequence
  chemically synthesized
gtgggagaatcgcttaaccc

SEQ ID NO: 381702 - DNA, 20 bp, Artificial Sequence
  chemically synthesized
tgggagaatcgcttaacccc

SEQ ID NO: 381703 - DNA, 20 bp, Artificial Sequence
  chemically synthesized
aacctctggctcccggggtt

SEQ ID NO: 381704 - DNA, 20 bp, Artificial Sequence
  chemically synthesized
ggagaatcgcttaaccccgg

SEQ ID NO: 381705 - DNA, 20 bp, Artificial Sequence
  chemically synthesized
aatcgcttaaccccgggagc

SEQ ID NO: 381706 - DNA, 20 bp, Artificial Sequence
  chemically synthesized
actgcaacctctggctcccg

SEQ ID NO: 381707 - DNA, 20 bp, Artificial Sequence
  chemically synthesized
cactgcaacctctggctccc

SEQ ID NO: 381708 - DNA, 20 bp, Artificial Sequence
  chemically synthesized
tcgcttaaccccgggagcca

SEQ ID NO: 381709 - DNA, 20 bp, Artificial Sequence
  chemically synthesized
tcactgcaacctctggctcc

SEQ ID NO: 381710 - DNA, 20 bp, Artificial Sequence
  chemically synthesized
cgcttaaccccgggagccag

SEQ ID NO: 381711 - DNA, 20 bp, Artificial Sequence
  chemically synthesized
accccgggagccagaggttg

SEQ ID NO: 381712 - DNA, 20 bp, Artificial Sequence
  chemically synthesized
tcttggctcactgcaacctc

SEQ ID NO: 381713 - DNA, 20 bp, Artificial Sequence
  chemically synthesized
cgggagccagaggttgcagt

SEQ ID NO: 381714 - DNA, 20 bp, Artificial Sequence
  chemically synthesized
gccagaggttgcagtgagcc

SEQ ID NO: 381715 - DNA, 20 bp, Artificial Sequence
  chemically synthesized
ggagtgaagtggtgcgatct

SEQ ID NO: 381716 - DNA, 20 bp, Artificial Sequence
  chemically synthesized
ttgcccaggctggagtgaag

SEQ ID NO: 381717 - DNA, 20 bp, Artificial Sequence
  chemically synthesized
aagatcgcaccacttcactc

SEQ ID NO: 381718 - DNA, 20 bp, Artificial Sequence
  chemically synthesized
ctgttgcccaggctggagtg

SEQ ID NO: 381719 - DNA, 20 bp, Artificial Sequence
  chemically synthesized
cgcaccacttcactccagcc

SEQ ID NO: 381720 - DNA, 20 bp, Artificial Sequence
  chemically synthesized
gcaccacttcactccagcct

SEQ ID NO: 381721 - DNA, 20 bp, Artificial Sequence
  chemically synthesized
cacttctgttgcccaggctg

SEQ ID NO: 381722 - DNA, 20 bp, Artificial Sequence
  chemically synthesized
ctcacttctgttgcccaggc

SEQ ID NO: 381723 - DNA, 20 bp, Artificial Sequence
  chemically synthesized
cttcactccagcctgggcaa

SEQ ID NO: 381724 - DNA, 20 bp, Artificial Sequence
  chemically synthesized
agatctcacttctgttgccc

SEQ ID NO: 381725 - DNA, 20 bp, Artificial Sequence
  chemically synthesized
aagatctcacttctgttgcc

SEQ ID NO: 381726 - DNA, 20 bp, Artificial Sequence
  chemically synthesized
cactccagcctgggcaacag

SEQ ID NO: 381727 - DNA, 20 bp, Artificial Sequence
  chemically synthesized
ccagcctgggcaacagaagt

SEQ ID NO: 381728 - DNA, 20 bp, Artificial Sequence
  chemically synthesized
tttgtttttgtttttttttt

SEQ ID NO: 381729 - DNA, 20 bp, Artificial Sequence
  chemically synthesized
cctatagcaaagcatagata

SEQ ID NO: 381730 - DNA, 20 bp, Artificial Sequence
  chemically synthesized
ttaacacctatagcaaagca

SEQ ID NO: 381731 - DNA, 20 bp, Artificial Sequence
  chemically synthesized
actttatctatgctttgcta

SEQ ID NO: 381732 - DNA, 20 bp, Artificial Sequence
  chemically synthesized
ctttatctatgctttgctat

SEQ ID NO: 381733 - DNA, 20 bp, Artificial Sequence
  chemically synthesized
tatcgttaacacctatagca

SEQ ID NO: 381734 - DNA, 20 bp, Artificial Sequence
  chemically synthesized
gcaattatcgttaacaccta

SEQ ID NO: 381735 - DNA, 20 bp, Artificial Sequence
  chemically synthesized
aatcatccatgtaggacaat

SEQ ID NO: 381736 - DNA, 20 bp, Artificial Sequence
  chemically synthesized
aaatcatccatgtaggacaa

SEQ ID NO: 381737 - DNA, 20 bp, Artificial Sequence
  chemically synthesized
taattgcctattgtcctaca

SEQ ID NO: 381738 - DNA, 20 bp, Artificial Sequence
  chemically synthesized
attaataaaatcatccatgt

SEQ ID NO: 381739 - DNA, 20 bp, Artificial Sequence
  chemically synthesized
tattaataaaatcatccatg

SEQ ID NO: 381740 - DNA, 20 bp, Artificial Sequence
  chemically synthesized
tacatggatgattttattaa

SEQ ID NO: 381741 - DNA, 20 bp, Artificial Sequence
  chemically synthesized
aaaatgaaaaactttctgtg

SEQ ID NO: 381742 - DNA, 20 bp, Artificial Sequence
  chemically synthesized
ttacatcaccactacacaga

SEQ ID NO: 381743 - DNA, 20 bp, Artificial Sequence
  chemically synthesized
atgaaaaactttctgtgtag

SEQ ID NO: 381744 - DNA, 20 bp, Artificial Sequence
  chemically synthesized
ctttttacatcaccactaca

SEQ ID NO: 381745 - DNA, 20 bp, Artificial Sequence
  chemically synthesized
ctgtgtagtggtgatgtaaa

SEQ ID NO: 381746 - DNA, 20 bp, Artificial Sequence
  chemically synthesized
gtagtggtgatgtaaaaaga

SEQ ID NO: 381747 - DNA, 20 bp, Artificial Sequence
  chemically synthesized
aaaagatagttttcatcaca

SEQ ID NO: 381748 - DNA, 20 bp, Artificial Sequence
  chemically synthesized
ggatttgttatatttttaaa

SEQ ID NO: 381749 - DNA, 20 bp, Artificial Sequence
  chemically synthesized
tttaaaaagataattcttca

SEQ ID NO: 381750 - DNA, 20 bp, Artificial Sequence
  chemically synthesized
ttaaaaagataattcttcat

SEQ ID NO: 381751 - DNA, 20 bp, Artificial Sequence
  chemically synthesized
caatccctgaaaaacctatg

SEQ ID NO: 381752 - DNA, 20 bp, Artificial Sequence
  chemically synthesized
ataattcttcataggttttt

SEQ ID NO: 381753 - DNA, 20 bp, Artificial Sequence
  chemically synthesized
taattcttcataggtttttc

SEQ ID NO: 381754 - DNA, 20 bp, Artificial Sequence
  chemically synthesized
aattcttcataggtttttca

SEQ ID NO: 381755 - DNA, 20 bp, Artificial Sequence
  chemically synthesized
taggtttttcagggattgtc

SEQ ID NO: 381756 - DNA, 20 bp, Artificial Sequence
  chemically synthesized
tttcattaaacaaataaaac

SEQ ID NO: 381757 - DNA, 20 bp, Artificial Sequence
  chemically synthesized
ttgtttaatgaaaaataaat

SEQ ID NO: 381758 - DNA, 20 bp, Artificial Sequence
  chemically synthesized
tgtttaatgaaaaataaatg

SEQ ID NO: 381759 - DNA, 20 bp, Artificial Sequence
  chemically synthesized
ttaaactcttattttacaat

SEQ ID NO: 381760 - DNA, 20 bp, Artificial Sequence
  chemically synthesized
gtaacgtctcattgtaaaat

SEQ ID NO: 381761 - DNA, 20 bp, Artificial Sequence
  chemically synthesized
aacgtctcattgtaaaataa

SEQ ID NO: 381762 - DNA, 20 bp, Artificial Sequence
  chemically synthesized
ataagagtttaaattttaat

SEQ ID NO: 381763 - DNA, 20 bp, Artificial Sequence
  chemically synthesized
taagagtttaaattttaatt

SEQ ID NO: 381764 - DNA, 20 bp, Artificial Sequence
  chemically synthesized
gtttaaattttaattaggaa

SEQ ID NO: 381765 - DNA, 20 bp, Artificial Sequence
  chemically synthesized
ttaattaggaaaagataccc

SEQ ID NO: 381766 - DNA, 20 bp, Artificial Sequence
  chemically synthesized
ttaggaaaagatacccaaga

SEQ ID NO: 381767 - DNA, 20 bp, Artificial Sequence
  chemically synthesized
tttaaatgtatttctgtctt

SEQ ID NO: 381768 - DNA, 20 bp, Artificial Sequence
  chemically synthesized
ttttaaatgtatttctgtct

SEQ ID NO: 381769 - DNA, 20 bp, Artificial Sequence
  chemically synthesized
gacagaaatacatttaaaat

SEQ ID NO: 381770 - DNA, 20 bp, Artificial Sequence
  chemically synthesized
gaaatacatttaaaataaga

SEQ ID NO: 381771 - DNA, 20 bp, Artificial Sequence
  chemically synthesized
tagattatcacttttaatta

SEQ ID NO: 381772 - DNA, 20 bp, Artificial Sequence
  chemically synthesized
gcttcattttctataattaa

SEQ ID NO: 381773 - DNA, 20 bp, Artificial Sequence
  chemically synthesized
acttttaattatagaaaatg

SEQ ID NO: 381774 - DNA, 20 bp, Artificial Sequence
  chemically synthesized
ttatagaaaatgaagctttc

SEQ ID NO: 381775 - DNA, 20 bp, Artificial Sequence
  chemically synthesized
aatttaaacataattctgga

SEQ ID NO: 381776 - DNA, 20 bp, Artificial Sequence
  chemically synthesized
tataaatttaaacataattc

SEQ ID NO: 381777 - DNA, 20 bp, Artificial Sequence
  chemically synthesized
cagaattatgtttaaattta

SEQ ID NO: 381778 - DNA, 20 bp, Artificial Sequence
  chemically synthesized
tagatgcattaaaaactatc

SEQ ID NO: 381779 - DNA, 20 bp, Artificial Sequence
  chemically synthesized
acttaaatgtttaaacttga

SEQ ID NO: 381780 - DNA, 20 bp, Artificial Sequence
  chemically synthesized
actatcaagtttaaacattt

SEQ ID NO: 381781 - DNA, 20 bp, Artificial Sequence
  chemically synthesized
ctatttgctcaacattattc

SEQ ID NO: 381782 - DNA, 20 bp, Artificial Sequence
  chemically synthesized
gctatttgctcaacattatt

SEQ ID NO: 381783 - DNA, 20 bp, Artificial Sequence
  chemically synthesized
ttaagtacctgaataatgtt

SEQ ID NO: 381784 - DNA, 20 bp, Artificial Sequence
  chemically synthesized
cctgaataatgttgagcaaa

SEQ ID NO: 381785 - DNA, 20 bp, Artificial Sequence
  chemically synthesized
tgttgagcaaatagcaactt

SEQ ID NO: 381786 - DNA, 20 bp, Artificial Sequence
  chemically synthesized
cctcatgccagcatagtcca

SEQ ID NO: 381787 - DNA, 20 bp, Artificial Sequence
  chemically synthesized
atagcaactttggactatgc

SEQ ID NO: 381788 - DNA, 20 bp, Artificial Sequence
  chemically synthesized
tcactctcctcatgccagca

SEQ ID NO: 381789 - DNA, 20 bp, Artificial Sequence
  chemically synthesized
actttggactatgctggcat

SEQ ID NO: 381790 - DNA, 20 bp, Artificial Sequence
  chemically synthesized
ctttggactatgctggcatg

SEQ ID NO: 381791 - DNA, 20 bp, Artificial Sequence
  chemically synthesized
ttggactatgctggcatgag

SEQ ID NO: 381792 - DNA, 20 bp, Artificial Sequence
  chemically synthesized
tttcctcactctcctcatgc

SEQ ID NO: 381793 - DNA, 20 bp, Artificial Sequence
  chemically synthesized
ggactatgctggcatgagga

SEQ ID NO: 381794 - DNA, 20 bp, Artificial Sequence
  chemically synthesized
tatgctggcatgaggagagt

SEQ ID NO: 381795 - DNA, 20 bp, Artificial Sequence
  chemically synthesized
atgctggcatgaggagagtg

SEQ ID NO: 381796 - DNA, 20 bp, Artificial Sequence
  chemically synthesized
ataatttctgatttttatcg

SEQ ID NO: 381797 - DNA, 20 bp, Artificial Sequence
  chemically synthesized
ggaaatgccacgataaaaat

SEQ ID NO: 381798 - DNA, 20 bp, Artificial Sequence
  chemically synthesized
ataaaaatcagaaattatta

SEQ ID NO: 381799 - DNA, 20 bp, Artificial Sequence
  chemically synthesized
aaaatcagaaattattaaag

SEQ ID NO: 381800 - DNA, 20 bp, Artificial Sequence
  chemically synthesized
tttgtaagcaaaagaaagca

SEQ ID NO: 381801 - DNA, 20 bp, Artificial Sequence
  chemically synthesized
ttttgtaagcaaaagaaagc

SEQ ID NO: 381802 - DNA, 20 bp, Artificial Sequence
  chemically synthesized
aatcttttgtaagcaaaaga

SEQ ID NO: 381803 - DNA, 20 bp, Artificial Sequence
  chemically synthesized
atagaatcttttgtaagcaa

SEQ ID NO: 381804 - DNA, 20 bp, Artificial Sequence
  chemically synthesized
ttgctttcttttgcttacaa

SEQ ID NO: 381805 - DNA, 20 bp, Artificial Sequence
  chemically synthesized
atatcaatagaatcttttgt

SEQ ID NO: 381806 - DNA, 20 bp, Artificial Sequence
  chemically synthesized
ggtttgtttttcaatatcaa

SEQ ID NO: 381807 - DNA, 20 bp, Artificial Sequence
  chemically synthesized
agccatttttttgtttgttt

SEQ ID NO: 381808 - DNA, 20 bp, Artificial Sequence
  chemically synthesized
aaccaaaacaaacaaaaaaa

SEQ ID NO: 381809 - DNA, 20 bp, Artificial Sequence
  chemically synthesized
aacaaacaaaaaaatggcta

SEQ ID NO: 381810 - DNA, 20 bp, Artificial Sequence
  chemically synthesized
aaaaaaatggctacggcatc

SEQ ID NO: 381811 - DNA, 20 bp, Artificial Sequence
  chemically synthesized
cattttgaatccagatgccg

SEQ ID NO: 381812 - DNA, 20 bp, Artificial Sequence
  chemically synthesized
ttatggaaacattttgaatc

SEQ ID NO: 381813 - DNA, 20 bp, Artificial Sequence
  chemically synthesized
tggattcaaaatgtttccat

SEQ ID NO: 381814 - DNA, 20 bp, Artificial Sequence
  chemically synthesized
actttgcatccatagactta

SEQ ID NO: 381815 - DNA, 20 bp, Artificial Sequence
  chemically synthesized
aaaatgtttccataagtcta

SEQ ID NO: 381816 - DNA, 20 bp, Artificial Sequence
  chemically synthesized
tgagactcactttgcatcca

SEQ ID NO: 381817 - DNA, 20 bp, Artificial Sequence
  chemically synthesized
tccataagtctatggatgca

SEQ ID NO: 381818 - DNA, 20 bp, Artificial Sequence
  chemically synthesized
taagtctatggatgcaaagt

SEQ ID NO: 381819 - DNA, 20 bp, Artificial Sequence
  chemically synthesized
ttttcttatttcataaaatt

SEQ ID NO: 381820 - DNA, 20 bp, Artificial Sequence
  chemically synthesized
gagtctcaattttatgaaat

SEQ ID NO: 381821 - DNA, 20 bp, Artificial Sequence
  chemically synthesized
aattttatgaaataagaaaa

SEQ ID NO: 381822 - DNA, 20 bp, Artificial Sequence
  chemically synthesized
ataagaaaaaagaaaaatgt

SEQ ID NO: 381823 - DNA, 20 bp, Artificial Sequence
  chemically synthesized
gaaaaaagaaaaatgttagc

SEQ ID NO: 381824 - DNA, 20 bp, Artificial Sequence
  chemically synthesized
aagaaaaatgttagctagac

SEQ ID NO: 381825 - DNA, 20 bp, Artificial Sequence
  chemically synthesized
agaaaaatgttagctagacc

SEQ ID NO: 381826 - DNA, 20 bp, Artificial Sequence
  chemically synthesized
gtgatccatcatgcctggtc

SEQ ID NO: 381827 - DNA, 20 bp, Artificial Sequence
  chemically synthesized
gttagctagaccaggcatga

SEQ ID NO: 381828 - DNA, 20 bp, Artificial Sequence
  chemically synthesized
caagtgtgatccatcatgcc

SEQ ID NO: 381829 - DNA, 20 bp, Artificial Sequence
  chemically synthesized
atggatcacacttgtaatcc

SEQ ID NO: 381830 - DNA, 20 bp, Artificial Sequence
  chemically synthesized
tcccaaagtgctgggattac

SEQ ID NO: 381831 - DNA, 20 bp, Artificial Sequence
  chemically synthesized
cacttgtaatcccagcactt

SEQ ID NO: 381832 - DNA, 20 bp, Artificial Sequence
  chemically synthesized
cctcagcctcccaaagtgct

SEQ ID NO: 381833 - DNA, 20 bp, Artificial Sequence
  chemically synthesized
acttgtaatcccagcacttt

SEQ ID NO: 381834 - DNA, 20 bp, Artificial Sequence
  chemically synthesized
gcctcagcctcccaaagtgc

SEQ ID NO: 381835 - DNA, 20 bp, Artificial Sequence
  chemically synthesized
ttgtaatcccagcactttgg

SEQ ID NO: 381836 - DNA, 20 bp, Artificial Sequence
  chemically synthesized
tgtaatcccagcactttggg

SEQ ID NO: 381837 - DNA, 20 bp, Artificial Sequence
  chemically synthesized
cctcccgcctcagcctccca

SEQ ID NO: 381838 - DNA, 20 bp, Artificial Sequence
  chemically synthesized
tcccagcactttgggaggct

SEQ ID NO: 381839 - DNA, 20 bp, Artificial Sequence
  chemically synthesized
cccagcactttgggaggctg

SEQ ID NO: 381840 - DNA, 20 bp, Artificial Sequence
  chemically synthesized
agcactttgggaggctgagg

SEQ ID NO: 381841 - DNA, 20 bp, Artificial Sequence
  chemically synthesized
gcactttgggaggctgaggc

SEQ ID NO: 381842 - DNA, 20 bp, Artificial Sequence
  chemically synthesized
actttgggaggctgaggcgg

SEQ ID NO: 381843 - DNA, 20 bp, Artificial Sequence
  chemically synthesized
ctttgggaggctgaggcggg

SEQ ID NO: 381844 - DNA, 20 bp, Artificial Sequence
  chemically synthesized
ctcaagcaatcctcccgcct

SEQ ID NO: 381845 - DNA, 20 bp, Artificial Sequence
  chemically synthesized
ctgaggcgggaggattgctt

SEQ ID NO: 381846 - DNA, 20 bp, Artificial Sequence
  chemically synthesized
tgaggcgggaggattgcttg

SEQ ID NO: 381847 - DNA, 20 bp, Artificial Sequence
  chemically synthesized
gcgggaggattgcttgaggc

SEQ ID NO: 381848 - DNA, 20 bp, Artificial Sequence
  chemically synthesized
cgggaggattgcttgaggcc

SEQ ID NO: 381849 - DNA, 20 bp, Artificial Sequence
  chemically synthesized
ggtctagaactcctggcctc

SEQ ID NO: 381850 - DNA, 20 bp, Artificial Sequence
  chemically synthesized
ggaggattgcttgaggccag

SEQ ID NO: 381851 - DNA, 20 bp, Artificial Sequence
  chemically synthesized
ttgcttgaggccaggagttc

SEQ ID NO: 381852 - DNA, 20 bp, Artificial Sequence
  chemically synthesized
ccaagctggtctagaactcc

SEQ ID NO: 381853 - DNA, 20 bp, Artificial Sequence
  chemically synthesized
tgaggccaggagttctagac

SEQ ID NO: 381854 - DNA, 20 bp, Artificial Sequence
  chemically synthesized
ctatgtttcccaagctggtc

SEQ ID NO: 381855 - DNA, 20 bp, Artificial Sequence
  chemically synthesized
ccaggagttctagaccagct

SEQ ID NO: 381856 - DNA, 20 bp, Artificial Sequence
  chemically synthesized
caggagttctagaccagctt

SEQ ID NO: 381857 - DNA, 20 bp, Artificial Sequence
  chemically synthesized
tcttgctatgtttcccaagc

SEQ ID NO: 381858 - DNA, 20 bp, Artificial Sequence
  chemically synthesized
agggtcttgctatgtttccc

SEQ ID NO: 381859 - DNA, 20 bp, Artificial Sequence
  chemically synthesized
ctagaccagcttgggaaaca

SEQ ID NO: 381860 - DNA, 20 bp, Artificial Sequence
  chemically synthesized
accagcttgggaaacatagc

SEQ ID NO: 381861 - DNA, 20 bp, Artificial Sequence
  chemically synthesized
ttttatttttcgtggagaca

SEQ ID NO: 381862 - DNA, 20 bp, Artificial Sequence
  chemically synthesized
tttttatttttcgtggagac

SEQ ID NO: 381863 - DNA, 20 bp, Artificial Sequence
  chemically synthesized
ctttttatttttcgtggaga

SEQ ID NO: 381864 - DNA, 20 bp, Artificial Sequence
  chemically synthesized
ttttctttttatttttcgtg

SEQ ID NO: 381865 - DNA, 20 bp, Artificial Sequence
  chemically synthesized
aattttctttttatttttcg

SEQ ID NO: 381866 - DNA, 20 bp, Artificial Sequence
  chemically synthesized
ctgtctccacgaaaaataaa

SEQ ID NO: 381867 - DNA, 20 bp, Artificial Sequence
  chemically synthesized
acgaaaaataaaaagaaaat

SEQ ID NO: 381868 - DNA, 20 bp, Artificial Sequence
  chemically synthesized
aaaaataaaaagaaaattag

SEQ ID NO: 381869 - DNA, 20 bp, Artificial Sequence
  chemically synthesized
aaaataaaaagaaaattagc

SEQ ID NO: 381870 - DNA, 20 bp, Artificial Sequence
  chemically synthesized
aaataaaaagaaaattagca

SEQ ID NO: 381871 - DNA, 20 bp, Artificial Sequence
  chemically synthesized
aaaagaaaattagcagggcg

SEQ ID NO: 381872 - DNA, 20 bp, Artificial Sequence
  chemically synthesized
ggcgtggtgtgcacttgtcc

SEQ ID NO: 381873 - DNA, 20 bp, Artificial Sequence
  chemically synthesized
acctcctgagtagctgggac

SEQ ID NO: 381874 - DNA, 20 bp, Artificial Sequence
  chemically synthesized
gtgcacttgtcccagctact

SEQ ID NO: 381875 - DNA, 20 bp, Artificial Sequence
  chemically synthesized
cctgcacctcctgagtagct

SEQ ID NO: 381876 - DNA, 20 bp, Artificial Sequence
  chemically synthesized
tgcacttgtcccagctactc

SEQ ID NO: 381877 - DNA, 20 bp, Artificial Sequence
  chemically synthesized
acctgcacctcctgagtagc

SEQ ID NO: 381878 - DNA, 20 bp, Artificial Sequence
  chemically synthesized
cacttgtcccagctactcag

SEQ ID NO: 381879 - DNA, 20 bp, Artificial Sequence
  chemically synthesized
acttgtcccagctactcagg

SEQ ID NO: 381880 - DNA, 20 bp, Artificial Sequence
  chemically synthesized
tcccacctgcacctcctgag

SEQ ID NO: 381881 - DNA, 20 bp, Artificial Sequence
  chemically synthesized
ttctcccacctgcacctcct

SEQ ID NO: 381882 - DNA, 20 bp, Artificial Sequence
  chemically synthesized
tcccagctactcaggaggtg

SEQ ID NO: 381883 - DNA, 20 bp, Artificial Sequence
  chemically synthesized
cccagctactcaggaggtgc

SEQ ID NO: 381884 - DNA, 20 bp, Artificial Sequence
  chemically synthesized
agctactcaggaggtgcagg

SEQ ID NO: 381885 - DNA, 20 bp, Artificial Sequence
  chemically synthesized
gctactcaggaggtgcaggt

SEQ ID NO: 381886 - DNA, 20 bp, Artificial Sequence
  chemically synthesized
tactcaggaggtgcaggtgg

SEQ ID NO: 381887 - DNA, 20 bp, Artificial Sequence
  chemically synthesized
tgcaggtgggagaatcatct

SEQ ID NO: 381888 - DNA, 20 bp, Artificial Sequence
  chemically synthesized
gtgggagaatcatctgagcc

SEQ ID NO: 381889 - DNA, 20 bp, Artificial Sequence
  chemically synthesized
tgggagaatcatctgagccc

SEQ ID NO: 381890 - DNA, 20 bp, Artificial Sequence
  chemically synthesized
taaccttgaattcctgggct

SEQ ID NO: 381891 - DNA, 20 bp, Artificial Sequence
  chemically synthesized
cactctaaccttgaattcct

SEQ ID NO: 381892 - DNA, 20 bp, Artificial Sequence
  chemically synthesized
tcatctgagcccaggaattc

SEQ ID NO: 381893 - DNA, 20 bp, Artificial Sequence
  chemically synthesized
tcactctaaccttgaattcc

SEQ ID NO: 381894 - DNA, 20 bp, Artificial Sequence
  chemically synthesized
catctgagcccaggaattca

SEQ ID NO: 381895 - DNA, 20 bp, Artificial Sequence
  chemically synthesized
tgagcccaggaattcaaggt

SEQ ID NO: 381896 - DNA, 20 bp, Artificial Sequence
  chemically synthesized
agcccaggaattcaaggtta

SEQ ID NO: 381897 - DNA, 20 bp, Artificial Sequence
  chemically synthesized
caggaattcaaggttagagt

SEQ ID NO: 381898 - DNA, 20 bp, Artificial Sequence
  chemically synthesized
gaagtgcagtggcatgatca

SEQ ID NO: 381899 - DNA, 20 bp, Artificial Sequence
  chemically synthesized
gcacccaggctgaagtgcag

SEQ ID NO: 381900 - DNA, 20 bp, Artificial Sequence
  chemically synthesized
atgatcatgccactgcactt

SEQ ID NO: 381901 - DNA, 20 bp, Artificial Sequence
  chemically synthesized
ctggcacccaggctgaagtg

SEQ ID NO: 381902 - DNA, 20 bp, Artificial Sequence
  chemically synthesized
catgccactgcacttcagcc

SEQ ID NO: 381903 - DNA, 20 bp, Artificial Sequence
  chemically synthesized
atgccactgcacttcagcct

SEQ ID NO: 381904 - DNA, 20 bp, Artificial Sequence
  chemically synthesized
tctctctggcacccaggctg

SEQ ID NO: 381905 - DNA, 20 bp, Artificial Sequence
  chemically synthesized
ctgcacttcagcctgggtgc

SEQ ID NO: 381906 - DNA, 20 bp, Artificial Sequence
  chemically synthesized
aagatctctctctggcaccc

SEQ ID NO: 381907 - DNA, 20 bp, Artificial Sequence
  chemically synthesized
gcacttcagcctgggtgcca

SEQ ID NO: 381908 - DNA, 20 bp, Artificial Sequence
  chemically synthesized
caagatctctctctggcacc

SEQ ID NO: 381909 - DNA, 20 bp, Artificial Sequence
  chemically synthesized
acttcagcctgggtgccaga

SEQ ID NO: 381910 - DNA, 20 bp, Artificial Sequence
  chemically synthesized
ttcagcctgggtgccagaga

SEQ ID NO: 381911 - DNA, 20 bp, Artificial Sequence
  chemically synthesized
taagggacaagatctctctc

SEQ ID NO: 381912 - DNA, 20 bp, Artificial Sequence
  chemically synthesized
tatttttatctttaagggac

SEQ ID NO: 381913 - DNA, 20 bp, Artificial Sequence
  chemically synthesized
gagagagatcttgtccctta

SEQ ID NO: 381914 - DNA, 20 bp, Artificial Sequence
  chemically synthesized
ttttttatttttatctttaa

SEQ ID NO: 381915 - DNA, 20 bp, Artificial Sequence
  chemically synthesized
attttttatttttatcttta

SEQ ID NO: 381916 - DNA, 20 bp, Artificial Sequence
  chemically synthesized
tattttttatttttatcttt

SEQ ID NO: 381917 - DNA, 20 bp, Artificial Sequence
  chemically synthesized
taaaaataaaaaataaatat

SEQ ID NO: 381918 - DNA, 20 bp, Artificial Sequence
  chemically synthesized
ataaatattagctaacctac

SEQ ID NO: 381919 - DNA, 20 bp, Artificial Sequence
  chemically synthesized
ctcaggtaaaactagtaggt

SEQ ID NO: 381920 - DNA, 20 bp, Artificial Sequence
  chemically synthesized
ggaactcaggtaaaactagt

SEQ ID NO: 381921 - DNA, 20 bp, Artificial Sequence
  chemically synthesized
aggaactcaggtaaaactag

SEQ ID NO: 381922 - DNA, 20 bp, Artificial Sequence
  chemically synthesized
tgaaggaactcaggtaaaac

SEQ ID NO: 381923 - DNA, 20 bp, Artificial Sequence
  chemically synthesized
ctaacctactagttttacct

SEQ ID NO: 381924 - DNA, 20 bp, Artificial Sequence
  chemically synthesized
gtaatccactgaaggaactc

SEQ ID NO: 381925 - DNA, 20 bp, Artificial Sequence
  chemically synthesized
tgtaatccactgaaggaact

SEQ ID NO: 381926 - DNA, 20 bp, Artificial Sequence
  chemically synthesized
tagttttacctgagttcctt

SEQ ID NO: 381927 - DNA, 20 bp, Artificial Sequence
  chemically synthesized
ttttacctgagttccttcag

SEQ ID NO: 381928 - DNA, 20 bp, Artificial Sequence
  chemically synthesized
aatatgttgtaatccactga

SEQ ID NO: 381929 - DNA, 20 bp, Artificial Sequence
  chemically synthesized
aaatatgttgtaatccactg

SEQ ID NO: 381930 - DNA, 20 bp, Artificial Sequence
  chemically synthesized
ttacaacatatttcaaacca

SEQ ID NO: 381931 - DNA, 20 bp, Artificial Sequence
  chemically synthesized
aattaacttcaatagggctg

SEQ ID NO: 381932 - DNA, 20 bp, Artificial Sequence
  chemically synthesized
ttcaaaccacagccctattg

SEQ ID NO: 381933 - DNA, 20 bp, Artificial Sequence
  chemically synthesized
cacagaaattaacttcaata

SEQ ID NO: 381934 - DNA, 20 bp, Artificial Sequence
  chemically synthesized
acacagaaattaacttcaat

SEQ ID NO: 381935 - DNA, 20 bp, Artificial Sequence
  chemically synthesized
cacacagaaattaacttcaa

SEQ ID NO: 381936 - DNA, 20 bp, Artificial Sequence
  chemically synthesized
tgaagttaatttctgtgtga

SEQ ID NO: 381937 - DNA, 20 bp, Artificial Sequence
  chemically synthesized
agctaataaattccatcaca

SEQ ID NO: 381938 - DNA, 20 bp, Artificial Sequence
  chemically synthesized
ttctgtgtgatggaatttat

SEQ ID NO: 381939 - DNA, 20 bp, Artificial Sequence
  chemically synthesized
tcagtgtattttaaaacata

SEQ ID NO: 381940 - DNA, 20 bp, Artificial Sequence
  chemically synthesized
actctttcagaggagaaaat

SEQ ID NO: 381941 - DNA, 20 bp, Artificial Sequence
  chemically synthesized
acactgattttctcctctga

SEQ ID NO: 381942 - DNA, 20 bp, Artificial Sequence
  chemically synthesized
attttctcactctttcagag

SEQ ID NO: 381943 - DNA, 20 bp, Artificial Sequence
  chemically synthesized
actgattttctcctctgaaa

SEQ ID NO: 381944 - DNA, 20 bp, Artificial Sequence
  chemically synthesized
atattttctcactctttcag

SEQ ID NO: 381945 - DNA, 20 bp, Artificial Sequence
  chemically synthesized
aatattttctcactctttca

SEQ ID NO: 381946 - DNA, 20 bp, Artificial Sequence
  chemically synthesized
attttctcctctgaaagagt

SEQ ID NO: 381947 - DNA, 20 bp, Artificial Sequence
  chemically synthesized
agaatattttctcactcttt

SEQ ID NO: 381948 - DNA, 20 bp, Artificial Sequence
  chemically synthesized
aagagtgagaaaatattctt

SEQ ID NO: 381949 - DNA, 20 bp, Artificial Sequence
  chemically synthesized
gagaaaatattctttagaaa

SEQ ID NO: 381950 - DNA, 20 bp, Artificial Sequence
  chemically synthesized
tgtaatgtaaactgtttcta

SEQ ID NO: 381951 - DNA, 20 bp, Artificial Sequence
  chemically synthesized
tttacattacaaactctgat

SEQ ID NO: 381952 - DNA, 20 bp, Artificial Sequence
  chemically synthesized
acattacaaactctgatgag

SEQ ID NO: 381953 - DNA, 20 bp, Artificial Sequence
  chemically synthesized
gtattcatatccactcatca

SEQ ID NO: 381954 - DNA, 20 bp, Artificial Sequence
  chemically synthesized
aagtattcatatccactcat

SEQ ID NO: 381955 - DNA, 20 bp, Artificial Sequence
  chemically synthesized
ccacacacatttcattggca

SEQ ID NO: 381956 - DNA, 20 bp, Artificial Sequence
  chemically synthesized
agtatccacacacatttcat

SEQ ID NO: 381957 - DNA, 20 bp, Artificial Sequence
  chemically synthesized
ctttgccaatgaaatgtgtg

SEQ ID NO: 381958 - DNA, 20 bp, Artificial Sequence
  chemically synthesized
atgaaatgtgtgtggatact

SEQ ID NO: 381959 - DNA, 20 bp, Artificial Sequence
  chemically synthesized
gtgtgtggatacttggaaat

SEQ ID NO: 381960 - DNA, 20 bp, Artificial Sequence
  chemically synthesized
tcatgtcccagccaatttcc

SEQ ID NO: 381961 - DNA, 20 bp, Artificial Sequence
  chemically synthesized
gtggatacttggaaattggc

SEQ ID NO: 381962 - DNA, 20 bp, Artificial Sequence
  chemically synthesized
tggatacttggaaattggct

SEQ ID NO: 381963 - DNA, 20 bp, Artificial Sequence
  chemically synthesized
tgagcaatttattcatgtcc

SEQ ID NO: 381964 - DNA, 20 bp, Artificial Sequence
  chemically synthesized
gtgtgtacagtaatagggtt

SEQ ID NO: 381965 - DNA, 20 bp, Artificial Sequence
  chemically synthesized
cttcagtgtgtacagtaata

SEQ ID NO: 381966 - DNA, 20 bp, Artificial Sequence
  chemically synthesized
acttcagtgtgtacagtaat

SEQ ID NO: 381967 - DNA, 20 bp, Artificial Sequence
  chemically synthesized
tacttcagtgtgtacagtaa

SEQ ID NO: 381968 - DNA, 20 bp, Artificial Sequence
  chemically synthesized
aaatagtacttcagtgtgta

SEQ ID NO: 381969 - DNA, 20 bp, Artificial Sequence
  chemically synthesized
ccctattactgtacacactg

SEQ ID NO: 381970 - DNA, 20 bp, Artificial Sequence
  chemically synthesized
agtactaaaaaatagtactt

SEQ ID NO: 381971 - DNA, 20 bp, Artificial Sequence
  chemically synthesized
cacactgaagtactattttt

SEQ ID NO: 381972 - DNA, 20 bp, Artificial Sequence
  chemically synthesized
actgctgaagtactaaaaaa

SEQ ID NO: 381973 - DNA, 20 bp, Artificial Sequence
  chemically synthesized
agtactattttttagtactt

SEQ ID NO: 381974 - DNA, 20 bp, Artificial Sequence
  chemically synthesized
actattttttagtacttcag

SEQ ID NO: 381975 - DNA, 20 bp, Artificial Sequence
  chemically synthesized
attttttagtacttcagcag

SEQ ID NO: 381976 - DNA, 20 bp, Artificial Sequence
  chemically synthesized
ttttttagtacttcagcagt

SEQ ID NO: 381977 - DNA, 20 bp, Artificial Sequence
  chemically synthesized
ctactgctgacctactgctg

SEQ ID NO: 381978 - DNA, 20 bp, Artificial Sequence
  chemically synthesized
ttagtacttcagcagtaggt

SEQ ID NO: 381979 - DNA, 20 bp, Artificial Sequence
  chemically synthesized
gtacttcagcagtaggtcag

SEQ ID NO: 381980 - DNA, 20 bp, Artificial Sequence
  chemically synthesized
cttcagcagtaggtcagcag

SEQ ID NO: 381981 - DNA, 20 bp, Artificial Sequence
  chemically synthesized
gttctttctttggggatatg

SEQ ID NO: 381982 - DNA, 20 bp, Artificial Sequence
  chemically synthesized
tgttctttctttggggatat

SEQ ID NO: 381983 - DNA, 20 bp, Artificial Sequence
  chemically synthesized
gtagaatcctcatatcccca

SEQ ID NO: 381984 - DNA, 20 bp, Artificial Sequence
  chemically synthesized
aatcctcatatccccaaaga

SEQ ID NO: 381985 - DNA, 20 bp, Artificial Sequence
  chemically synthesized
tttataatgttctttctttg

SEQ ID NO: 381986 - DNA, 20 bp, Artificial Sequence
  chemically synthesized
atttataatgttctttcttt

SEQ ID NO: 381987 - DNA, 20 bp, Artificial Sequence
  chemically synthesized
tatttataatgttctttctt

SEQ ID NO: 381988 - DNA, 20 bp, Artificial Sequence
  chemically synthesized
taaatatatgtgtaaatttt

SEQ ID NO: 381989 - DNA, 20 bp, Artificial Sequence
  chemically synthesized
cgtgtttaaaataaaatatt

SEQ ID NO: 381990 - DNA, 20 bp, Artificial Sequence
  chemically synthesized
tttaaaataaaatattaaga

SEQ ID NO: 381991 - DNA, 20 bp, Artificial Sequence
  chemically synthesized
aaatattaagatggaatatt

SEQ ID NO: 381992 - DNA, 20 bp, Artificial Sequence
  chemically synthesized
ttaagtataacctgaatatt

SEQ ID NO: 381993 - DNA, 20 bp, Artificial Sequence
  chemically synthesized
tgtatctgttcttaatattc

SEQ ID NO: 381994 - DNA, 20 bp, Artificial Sequence
  chemically synthesized
gtgtatctgttcttaatatt

SEQ ID NO: 381995 - DNA, 20 bp, Artificial Sequence
  chemically synthesized
tataacctgaatattaagaa

SEQ ID NO: 381996 - DNA, 20 bp, Artificial Sequence
  chemically synthesized
atattaagaacagatacact

SEQ ID NO: 381997 - DNA, 20 bp, Artificial Sequence
  chemically synthesized
agaacagatacactcggaat

SEQ ID NO: 381998 - DNA, 20 bp, Artificial Sequence
  chemically synthesized
tccccaaccccactaattcc

SEQ ID NO: 381999 - DNA, 20 bp, Artificial Sequence
  chemically synthesized
acagatacactcggaattag

SEQ ID NO: 382000 - DNA, 20 bp, Artificial Sequence
  chemically synthesized
cagatacactcggaattagt

SEQ ID NO: 382001 - DNA, 20 bp, Artificial Sequence
  chemically synthesized
agatacactcggaattagtg

SEQ ID NO: 382002 - DNA, 20 bp, Artificial Sequence
  chemically synthesized
acactcggaattagtggggt

SEQ ID NO: 382003 - DNA, 20 bp, Artificial Sequence
  chemically synthesized
cactcggaattagtggggtt

SEQ ID NO: 382004 - DNA, 20 bp, Artificial Sequence
  chemically synthesized
actcggaattagtggggttg

SEQ ID NO: 382005 - DNA, 20 bp, Artificial Sequence
  chemically synthesized
aattagtggggttggggaaa

SEQ ID NO: 382006 - DNA, 20 bp, Artificial Sequence
  chemically synthesized
tagtggggttggggaaaaag

SEQ ID NO: 382007 - DNA, 20 bp, Artificial Sequence
  chemically synthesized
tggggttggggaaaaagtag

SEQ ID NO: 382008 - DNA, 20 bp, Artificial Sequence
  chemically synthesized
gttggggaaaaagtagaaga

SEQ ID NO: 382009 - DNA, 20 bp, Artificial Sequence
  chemically synthesized
aaaagtagaagacagctctg

SEQ ID NO: 382010 - DNA, 20 bp, Artificial Sequence
  chemically synthesized
taccaaaaccatcggccaca

SEQ ID NO: 382011 - DNA, 20 bp, Artificial Sequence
  chemically synthesized
gaagacagctctgtggccga

SEQ ID NO: 382012 - DNA, 20 bp, Artificial Sequence
  chemically synthesized
attaccaaaaccatcggcca

SEQ ID NO: 382013 - DNA, 20 bp, Artificial Sequence
  chemically synthesized
agctctgtggccgatggttt

SEQ ID NO: 382014 - DNA, 20 bp, Artificial Sequence
  chemically synthesized
aacattattaccaaaaccat

SEQ ID NO: 382015 - DNA, 20 bp, Artificial Sequence
  chemically synthesized
atggttttggtaataatgtt

SEQ ID NO: 382016 - DNA, 20 bp, Artificial Sequence
  chemically synthesized
tggttttggtaataatgttt

SEQ ID NO: 382017 - DNA, 20 bp, Artificial Sequence
  chemically synthesized
ggttttggtaataatgttta

SEQ ID NO: 382018 - DNA, 20 bp, Artificial Sequence
  chemically synthesized
gtaataatgtttagggattc

SEQ ID NO: 382019 - DNA, 20 bp, Artificial Sequence
  chemically synthesized
taataatgtttagggattcc

SEQ ID NO: 382020 - DNA, 20 bp, Artificial Sequence
  chemically synthesized
gacattgaaaatcatattcc

SEQ ID NO: 382021 - DNA, 20 bp, Artificial Sequence
  chemically synthesized
gaatatgattttcaatgtca

SEQ ID NO: 382022 - DNA, 20 bp, Artificial Sequence
  chemically synthesized
tagtatttttccaaatgact

SEQ ID NO: 382023 - DNA, 20 bp, Artificial Sequence
  chemically synthesized
gaaaaacctacttagtcatt

SEQ ID NO: 382024 - DNA, 20 bp, Artificial Sequence
  chemically synthesized
tatttttccaaatgactaag

SEQ ID NO: 382025 - DNA, 20 bp, Artificial Sequence
  chemically synthesized
atttttccaaatgactaagt

SEQ ID NO: 382026 - DNA, 20 bp, Artificial Sequence
  chemically synthesized
gagtttttgaaaaacctact

SEQ ID NO: 382027 - DNA, 20 bp, Artificial Sequence
  chemically synthesized
agtaggtttttcaaaaactc

SEQ ID NO: 382028 - DNA, 20 bp, Artificial Sequence
  chemically synthesized
gtaggtttttcaaaaactct

SEQ ID NO: 382029 - DNA, 20 bp, Artificial Sequence
  chemically synthesized
aaaaaaaaaaaaaaaaccca

SEQ ID NO: 382030 - DNA, 20 bp, Artificial Sequence
  chemically synthesized
aaaaaaaaaaaaaaaaaacc

SEQ ID NO: 382031 - DNA, 20 bp, Artificial Sequence
  chemically synthesized
tttttttttttttttttttt

SEQ ID NO: 382032 - DNA, 20 bp, Artificial Sequence
  chemically synthesized
ttttttagaaaaataattga

SEQ ID NO: 382033 - DNA, 20 bp, Artificial Sequence
  chemically synthesized
aattgatggactcaatctga

SEQ ID NO: 382034 - DNA, 20 bp, Artificial Sequence
  chemically synthesized
gccaaaataactttcagatt

SEQ ID NO: 382035 - DNA, 20 bp, Artificial Sequence
  chemically synthesized
tggtaggccaaaataacttt

SEQ ID NO: 382036 - DNA, 20 bp, Artificial Sequence
  chemically synthesized
actcaatctgaaagttattt

SEQ ID NO: 382037 - DNA, 20 bp, Artificial Sequence
  chemically synthesized
ctgcataggctttgtatggt

SEQ ID NO: 382038 - DNA, 20 bp, Artificial Sequence
  chemically synthesized
ttattttggcctaccataca

SEQ ID NO: 382039 - DNA, 20 bp, Artificial Sequence
  chemically synthesized
actgcataggctttgtatgg

SEQ ID NO: 382040 - DNA, 20 bp, Artificial Sequence
  chemically synthesized
agaactgcataggctttgta

SEQ ID NO: 382041 - DNA, 20 bp, Artificial Sequence
  chemically synthesized
cctaccatacaaagcctatg

SEQ ID NO: 382042 - DNA, 20 bp, Artificial Sequence
  chemically synthesized
tcacatactgagaactgcat

SEQ ID NO: 382043 - DNA, 20 bp, Artificial Sequence
  chemically synthesized
gtcacatactgagaactgca

SEQ ID NO: 382044 - DNA, 20 bp, Artificial Sequence
  chemically synthesized
tacaaagcctatgcagttct

SEQ ID NO: 382045 - DNA, 20 bp, Artificial Sequence
  chemically synthesized
attccagcaggtcacatact

SEQ ID NO: 382046 - DNA, 20 bp, Artificial Sequence
  chemically synthesized
gttctcagtatgtgacctgc

SEQ ID NO: 382047 - DNA, 20 bp, Artificial Sequence
  chemically synthesized
gtggtcacactcattccagc

SEQ ID NO: 382048 - DNA, 20 bp, Artificial Sequence
  chemically synthesized
agtatgtgacctgctggaat

SEQ ID NO: 382049 - DNA, 20 bp, Artificial Sequence
  chemically synthesized
ggtggtcacactcattccag

SEQ ID NO: 382050 - DNA, 20 bp, Artificial Sequence
  chemically synthesized
tgaggtggtcacactcattc

SEQ ID NO: 382051 - DNA, 20 bp, Artificial Sequence
  chemically synthesized
tggaatgagtgtgaccacct

SEQ ID NO: 382052 - DNA, 20 bp, Artificial Sequence
  chemically synthesized
aatgagtgtgaccacctcag

SEQ ID NO: 382053 - DNA, 20 bp, Artificial Sequence
  chemically synthesized
aacgttagtatctactgagg

SEQ ID NO: 382054 - DNA, 20 bp, Artificial Sequence
  chemically synthesized
tacaacgttagtatctactg

SEQ ID NO: 382055 - DNA, 20 bp, Artificial Sequence
  chemically synthesized
gtacaacgttagtatctact

SEQ ID NO: 382056 - DNA, 20 bp, Artificial Sequence
  chemically synthesized
aagtattgccagtacaacgt

SEQ ID NO: 382057 - DNA, 20 bp, Artificial Sequence
  chemically synthesized
agtagatactaacgttgtac

SEQ ID NO: 382058 - DNA, 20 bp, Artificial Sequence
  chemically synthesized
tttaaacttaaaagtattgc

SEQ ID NO: 382059 - DNA, 20 bp, Artificial Sequence
  chemically synthesized
gttgtactggcaatactttt

SEQ ID NO: 382060 - DNA, 20 bp, Artificial Sequence
  chemically synthesized
tgttgtggttttaaacttaa

SEQ ID NO: 382061 - DNA, 20 bp, Artificial Sequence
  chemically synthesized
tcttccggaatacaatgttg

SEQ ID NO: 382062 - DNA, 20 bp, Artificial Sequence
  chemically synthesized
aaaaccacaacattgtattc

SEQ ID NO: 382063 - DNA, 20 bp, Artificial Sequence
  chemically synthesized
accacaacattgtattccgg

SEQ ID NO: 382064 - DNA, 20 bp, Artificial Sequence
  chemically synthesized
gactcaaaatagaagtcttc

SEQ ID NO: 382065 - DNA, 20 bp, Artificial Sequence
  chemically synthesized
ttccggaagacttctatttt

SEQ ID NO: 382066 - DNA, 20 bp, Artificial Sequence
  chemically synthesized
aatgaaaagactcaaaatag

SEQ ID NO: 382067 - DNA, 20 bp, Artificial Sequence
  chemically synthesized
cagaatgaaaagactcaaaa

SEQ ID NO: 382068 - DNA, 20 bp, Artificial Sequence
  chemically synthesized
gaggatactatcagaatgaa

SEQ ID NO: 382069 - DNA, 20 bp, Artificial Sequence
  chemically synthesized
tttgagtcttttcattctga

SEQ ID NO: 382070 - DNA, 20 bp, Artificial Sequence
  chemically synthesized
agttccttggaggatactat

SEQ ID NO: 382071 - DNA, 20 bp, Artificial Sequence
  chemically synthesized
tcattctgatagtatcctcc

SEQ ID NO: 382072 - DNA, 20 bp, Artificial Sequence
  chemically synthesized
cattctgatagtatcctcca

SEQ ID NO: 382073 - DNA, 20 bp, Artificial Sequence
  chemically synthesized
tattctttaaagttccttgg

SEQ ID NO: 382074 - DNA, 20 bp, Artificial Sequence
  chemically synthesized
ctattctttaaagttccttg

SEQ ID NO: 382075 - DNA, 20 bp, Artificial Sequence
  chemically synthesized
ttctattctttaaagttcct

SEQ ID NO: 382076 - DNA, 20 bp, Artificial Sequence
  chemically synthesized
gtatcctccaaggaacttta

SEQ ID NO: 382077 - DNA, 20 bp, Artificial Sequence
  chemically synthesized
ctccaaggaactttaaagaa

SEQ ID NO: 382078 - DNA, 20 bp, Artificial Sequence
  chemically synthesized
atcaggggttctattcttta

SEQ ID NO: 382079 - DNA, 20 bp, Artificial Sequence
  chemically synthesized
aaagaatagaacccctgatt

SEQ ID NO: 382080 - DNA, 20 bp, Artificial Sequence
  chemically synthesized
aagaatagaacccctgattc

SEQ ID NO: 382081 - DNA, 20 bp, Artificial Sequence
  chemically synthesized
gatcttgttacctgaatcag

SEQ ID NO: 382082 - DNA, 20 bp, Artificial Sequence
  chemically synthesized
agatcttgttacctgaatca

SEQ ID NO: 382083 - DNA, 20 bp, Artificial Sequence
  chemically synthesized
cagatcttgttacctgaatc

SEQ ID NO: 382084 - DNA, 20 bp, Artificial Sequence
  chemically synthesized
tcagatcttgttacctgaat

SEQ ID NO: 382085 - DNA, 20 bp, Artificial Sequence
  chemically synthesized
gaacccctgattcaggtaac

SEQ ID NO: 382086 - DNA, 20 bp, Artificial Sequence
  chemically synthesized
ggtaacaagatctgaatgtt

SEQ ID NO: 382087 - DNA, 20 bp, Artificial Sequence
  chemically synthesized
gtaacaagatctgaatgttt

SEQ ID NO: 382088 - DNA, 20 bp, Artificial Sequence
  chemically synthesized
actgatgcatcccaaacatt

SEQ ID NO: 382089 - DNA, 20 bp, Artificial Sequence
  chemically synthesized
tctgaatgtttgggatgcat

SEQ ID NO: 382090 - DNA, 20 bp, Artificial Sequence
  chemically synthesized
aatgtttgggatgcatcagt

SEQ ID NO: 382091 - DNA, 20 bp, Artificial Sequence
  chemically synthesized
gtttgggatgcatcagtgag

SEQ ID NO: 382092 - DNA, 20 bp, Artificial Sequence
  chemically synthesized
tgggatgcatcagtgagtag

SEQ ID NO: 382093 - DNA, 20 bp, Artificial Sequence
  chemically synthesized
agaagcaattcacgcacttt

SEQ ID NO: 382094 - DNA, 20 bp, Artificial Sequence
  chemically synthesized
agcaattcacgcactttcag

SEQ ID NO: 382095 - DNA, 20 bp, Artificial Sequence
  chemically synthesized
caaaagttaaggacttctga

SEQ ID NO: 382096 - DNA, 20 bp, Artificial Sequence
  chemically synthesized
tttcagaagtccttaacttt

SEQ ID NO: 382097 - DNA, 20 bp, Artificial Sequence
  chemically synthesized
cttgaggggcccaaaagtta

SEQ ID NO: 382098 - DNA, 20 bp, Artificial Sequence
  chemically synthesized
ttcagaagtccttaactttt

SEQ ID NO: 382099 - DNA, 20 bp, Artificial Sequence
  chemically synthesized
acttgaggggcccaaaagtt

SEQ ID NO: 382100 - DNA, 20 bp, Artificial Sequence
  chemically synthesized
cagttacttgaggggcccaa

SEQ ID NO: 382101 - DNA, 20 bp, Artificial Sequence
  chemically synthesized
ccttaacttttgggcccctc

SEQ ID NO: 382102 - DNA, 20 bp, Artificial Sequence
  chemically synthesized
ttacagtccagttacttgag

SEQ ID NO: 382103 - DNA, 20 bp, Artificial Sequence
  chemically synthesized
gttacagtccagttacttga

SEQ ID NO: 382104 - DNA, 20 bp, Artificial Sequence
  chemically synthesized
agttacagtccagttacttg

SEQ ID NO: 382105 - DNA, 20 bp, Artificial Sequence
  chemically synthesized
ttttgggcccctcaagtaac

SEQ ID NO: 382106 - DNA, 20 bp, Artificial Sequence
  chemically synthesized
aagttacagtccagttactt

SEQ ID NO: 382107 - DNA, 20 bp, Artificial Sequence
  chemically synthesized
actggattcaagttacagtc

SEQ ID NO: 382108 - DNA, 20 bp, Artificial Sequence
  chemically synthesized
catttactggattcaagtta

SEQ ID NO: 382109 - DNA, 20 bp, Artificial Sequence
  chemically synthesized
actggactgtaacttgaatc

SEQ ID NO: 382110 - DNA, 20 bp, Artificial Sequence
  chemically synthesized
gtagttcatttactggattc

SEQ ID NO: 382111 - DNA, 20 bp, Artificial Sequence
  chemically synthesized
gtttcatgtagttcatttac

SEQ ID NO: 382112 - DNA, 20 bp, Artificial Sequence
  chemically synthesized
agtttggtgacagtttcatg

SEQ ID NO: 382113 - DNA, 20 bp, Artificial Sequence
  chemically synthesized
caattgctttagtttggtga

SEQ ID NO: 382114 - DNA, 20 bp, Artificial Sequence
  chemically synthesized
atgaaactgtcaccaaacta

SEQ ID NO: 382115 - DNA, 20 bp, Artificial Sequence
  chemically synthesized
tttcatcaattgctttagtt

SEQ ID NO: 382116 - DNA, 20 bp, Artificial Sequence
  chemically synthesized
tactgtttcatcaattgctt

SEQ ID NO: 382117 - DNA, 20 bp, Artificial Sequence
  chemically synthesized
aactaaagcaattgatgaaa

SEQ ID NO: 382118 - DNA, 20 bp, Artificial Sequence
  chemically synthesized
agtaacacgaataaatataa

SEQ ID NO: 382119 - DNA, 20 bp, Artificial Sequence
  chemically synthesized
gtaacacgaataaatataaa

SEQ ID NO: 382120 - DNA, 20 bp, Artificial Sequence
  chemically synthesized
atataaaaggcactgctaaa

SEQ ID NO: 382121 - DNA, 20 bp, Artificial Sequence
  chemically synthesized
tataaaaggcactgctaaaa

SEQ ID NO: 382122 - DNA, 20 bp, Artificial Sequence
  chemically synthesized
ctttcttaaagcctttttag

SEQ ID NO: 382123 - DNA, 20 bp, Artificial Sequence
  chemically synthesized
agcctttcttaaagcctttt

SEQ ID NO: 382124 - DNA, 20 bp, Artificial Sequence
  chemically synthesized
ggcactgctaaaaaggcttt

SEQ ID NO: 382125 - DNA, 20 bp, Artificial Sequence
  chemically synthesized
ctgctaaaaaggctttaaga

SEQ ID NO: 382126 - DNA, 20 bp, Artificial Sequence
  chemically synthesized
tgctaaaaaggctttaagaa

SEQ ID NO: 382127 - DNA, 20 bp, Artificial Sequence
  chemically synthesized
atgttaaaaagcctttctta

SEQ ID NO: 382128 - DNA, 20 bp, Artificial Sequence
  chemically synthesized
tttccctcaaaaatgttaaa

SEQ ID NO: 382129 - DNA, 20 bp, Artificial Sequence
  chemically synthesized
aaaggctttttaacattttt

SEQ ID NO: 382130 - DNA, 20 bp, Artificial Sequence
  chemically synthesized
aaggctttttaacatttttg

SEQ ID NO: 382131 - DNA, 20 bp, Artificial Sequence
  chemically synthesized
aggctttttaacatttttga

SEQ ID NO: 382132 - DNA, 20 bp, Artificial Sequence
  chemically synthesized
tttaacatttttgagggaaa

SEQ ID NO: 382133 - DNA, 20 bp, Artificial Sequence
  chemically synthesized
ttgagggaaatagtatgtaa

SEQ ID NO: 382134 - DNA, 20 bp, Artificial Sequence
  chemically synthesized
ggaaatagtatgtaaaagtg

SEQ ID NO: 382135 - DNA, 20 bp, Artificial Sequence
  chemically synthesized
tagtacatgataactaaaat

SEQ ID NO: 382136 - DNA, 20 bp, Artificial Sequence
  chemically synthesized
gcaattaatttaactaattt

SEQ ID NO: 382137 - DNA, 20 bp, Artificial Sequence
  chemically synthesized
aaaattagttaaattaattg

SEQ ID NO: 382138 - DNA, 20 bp, Artificial Sequence
  chemically synthesized
aaattagttaaattaattgc

SEQ ID NO: 382139 - DNA, 20 bp, Artificial Sequence
  chemically synthesized
attagttaaattaattgcag

SEQ ID NO: 382140 - DNA, 20 bp, Artificial Sequence
  chemically synthesized
atgtagacatgtggtgatta

SEQ ID NO: 382141 - DNA, 20 bp, Artificial Sequence
  chemically synthesized
tagattgttatgtagacatg

SEQ ID NO: 382142 - DNA, 20 bp, Artificial Sequence
  chemically synthesized
tagtagtttagattgttatg

SEQ ID NO: 382143 - DNA, 20 bp, Artificial Sequence
  chemically synthesized
gattataacgtttagtagtt

SEQ ID NO: 382144 - DNA, 20 bp, Artificial Sequence
  chemically synthesized
ttgaagattataacgtttag

SEQ ID NO: 382145 - DNA, 20 bp, Artificial Sequence
  chemically synthesized
ttcttgaagattataacgtt

SEQ ID NO: 382146 - DNA, 20 bp, Artificial Sequence
  chemically synthesized
tactaaacgttataatcttc

SEQ ID NO: 382147 - DNA, 20 bp, Artificial Sequence
  chemically synthesized
aacgttataatcttcaagaa

SEQ ID NO: 382148 - DNA, 20 bp, Artificial Sequence
  chemically synthesized
acgttataatcttcaagaaa

SEQ ID NO: 382149 - DNA, 20 bp, Artificial Sequence
  chemically synthesized
atagttgtagccttttcttg

SEQ ID NO: 382150 - DNA, 20 bp, Artificial Sequence
  chemically synthesized
aatgctctttttcatagttg

SEQ ID NO: 382151 - DNA, 20 bp, Artificial Sequence
  chemically synthesized
aaaaggctacaactatgaaa

SEQ ID NO: 382152 - DNA, 20 bp, Artificial Sequence
  chemically synthesized
aaggctacaactatgaaaaa

SEQ ID NO: 382153 - DNA, 20 bp, Artificial Sequence
  chemically synthesized
ttcaccaatgctctttttca

SEQ ID NO: 382154 - DNA, 20 bp, Artificial Sequence
  chemically synthesized
acaactatgaaaaagagcat

SEQ ID NO: 382155 - DNA, 20 bp, Artificial Sequence
  chemically synthesized
agagcattggtgaatgtatt

SEQ ID NO: 382156 - DNA, 20 bp, Artificial Sequence
  chemically synthesized
ggtgaatgtattaagtttga

SEQ ID NO: 382157 - DNA, 20 bp, Artificial Sequence
  chemically synthesized
gtttgatagtaaaaacaaaa

SEQ ID NO: 382158 - DNA, 20 bp, Artificial Sequence
  chemically synthesized
aaaaacaaaacagacaaatt

SEQ ID NO: 382159 - DNA, 20 bp, Artificial Sequence
  chemically synthesized
acagacaaattaagctgatt

SEQ ID NO: 382160 - DNA, 20 bp, Artificial Sequence
  chemically synthesized
aagttaatcaatggccaaat

SEQ ID NO: 382161 - DNA, 20 bp, Artificial Sequence
  chemically synthesized
aatatccaaaagttaatcaa

SEQ ID NO: 382162 - DNA, 20 bp, Artificial Sequence
  chemically synthesized
tttggccattgattaacttt

SEQ ID NO: 382163 - DNA, 20 bp, Artificial Sequence
  chemically synthesized
ttatgtcccccaatatccaa

SEQ ID NO: 382164 - DNA, 20 bp, Artificial Sequence
  chemically synthesized
attgattaacttttggatat

SEQ ID NO: 382165 - DNA, 20 bp, Artificial Sequence
  chemically synthesized
ttgattaacttttggatatt

SEQ ID NO: 382166 - DNA, 20 bp, Artificial Sequence
  chemically synthesized
tgattaacttttggatattg

SEQ ID NO: 382167 - DNA, 20 bp, Artificial Sequence
  chemically synthesized
gattaacttttggatattgg

SEQ ID NO: 382168 - DNA, 20 bp, Artificial Sequence
  chemically synthesized
ttgggggacataaatattta

SEQ ID NO: 382169 - DNA, 20 bp, Artificial Sequence
  chemically synthesized
aatttaaagatatagaaaac

SEQ ID NO: 382170 - DNA, 20 bp, Artificial Sequence
  chemically synthesized
ccatactcaatttaaagata

SEQ ID NO: 382171 - DNA, 20 bp, Artificial Sequence
  chemically synthesized
gttttctatatctttaaatt

SEQ ID NO: 382172 - DNA, 20 bp, Artificial Sequence
  chemically synthesized
ctggatccatactcaattta

SEQ ID NO: 382173 - DNA, 20 bp, Artificial Sequence
  chemically synthesized
ctatatctttaaattgagta

SEQ ID NO: 382174 - DNA, 20 bp, Artificial Sequence
  chemically synthesized
ctttaaattgagtatggatc

SEQ ID NO: 382175 - DNA, 20 bp, Artificial Sequence
  chemically synthesized
atactcagtaatgggattgc

SEQ ID NO: 382176 - DNA, 20 bp, Artificial Sequence
  chemically synthesized
gatccagcaatcccattact

SEQ ID NO: 382177 - DNA, 20 bp, Artificial Sequence
  chemically synthesized
tgggatacatactcagtaat

SEQ ID NO: 382178 - DNA, 20 bp, Artificial Sequence
  chemically synthesized
ttgggatacatactcagtaa

SEQ ID NO: 382179 - DNA, 20 bp, Artificial Sequence
  chemically synthesized
atttctttgggatacatact

SEQ ID NO: 382180 - DNA, 20 bp, Artificial Sequence
  chemically synthesized
attactgagtatgtatccca

SEQ ID NO: 382181 - DNA, 20 bp, Artificial Sequence
  chemically synthesized
tataatgatttcatttcttt

SEQ ID NO: 382182 - DNA, 20 bp, Artificial Sequence
  chemically synthesized
atataatgatttcatttctt

SEQ ID NO: 382183 - DNA, 20 bp, Artificial Sequence
  chemically synthesized
aatgaaatcattatattgaa

SEQ ID NO: 382184 - DNA, 20 bp, Artificial Sequence
  chemically synthesized
caatgctgcaatgaacacgg

SEQ ID NO: 382185 - DNA, 20 bp, Artificial Sequence
  chemically synthesized
aacaatgctgcaatgaacac

SEQ ID NO: 382186 - DNA, 20 bp, Artificial Sequence
  chemically synthesized
gaacaatgctgcaatgaaca

SEQ ID NO: 382187 - DNA, 20 bp, Artificial Sequence
  chemically synthesized
gtgcactcccgtgttcattg

SEQ ID NO: 382188 - DNA, 20 bp, Artificial Sequence
  chemically synthesized
cattgcagcattgttcacaa

SEQ ID NO: 382189 - DNA, 20 bp, Artificial Sequence
  chemically synthesized
cagcattgttcacaatagcc

SEQ ID NO: 382190 - DNA, 20 bp, Artificial Sequence
  chemically synthesized
agcattgttcacaatagcca

SEQ ID NO: 382191 - DNA, 20 bp, Artificial Sequence
  chemically synthesized
tgttcacaatagccaaggta

SEQ ID NO: 382192 - DNA, 20 bp, Artificial Sequence
  chemically synthesized
tttaggttgaatccatacct

SEQ ID NO: 382193 - DNA, 20 bp, Artificial Sequence
  chemically synthesized
tcatttgttgatggacattt

SEQ ID NO: 382194 - DNA, 20 bp, Artificial Sequence
  chemically synthesized
ttcatttgttgatggacatt

SEQ ID NO: 382195 - DNA, 20 bp, Artificial Sequence
  chemically synthesized
attatccattcatttgttga

SEQ ID NO: 382196 - DNA, 20 bp, Artificial Sequence
  chemically synthesized
aatgtccatcaacaaatgaa

SEQ ID NO: 382197 - DNA, 20 bp, Artificial Sequence
  chemically synthesized
atgaatggataatgaaaatg

SEQ ID NO: 382198 - DNA, 20 bp, Artificial Sequence
  chemically synthesized
gtggtcacacacacacacaa

SEQ ID NO: 382199 - DNA, 20 bp, Artificial Sequence
  chemically synthesized
acacacaatggaatataatt

SEQ ID NO: 382200 - DNA, 20 bp, Artificial Sequence
  chemically synthesized
ggaatataattcagacatga

SEQ ID NO: 382201 - DNA, 20 bp, Artificial Sequence
  chemically synthesized
atataattcagacatgaaag

SEQ ID NO: 382202 - DNA, 20 bp, Artificial Sequence
  chemically synthesized
atccatgttgtcacaaatgg

SEQ ID NO: 382203 - DNA, 20 bp, Artificial Sequence
  chemically synthesized
attatccatgttgtcacaaa

SEQ ID NO: 382204 - DNA, 20 bp, Artificial Sequence
  chemically synthesized
atctaccatttgtgacaaca

SEQ ID NO: 382205 - DNA, 20 bp, Artificial Sequence
  chemically synthesized
tgtgacaacatggataatcc

SEQ ID NO: 382206 - DNA, 20 bp, Artificial Sequence
  chemically synthesized
tgacaacatggataatcctg

SEQ ID NO: 382207 - DNA, 20 bp, Artificial Sequence
  chemically synthesized
gacaacatggataatcctgg

SEQ ID NO: 382208 - DNA, 20 bp, Artificial Sequence
  chemically synthesized
aacatggataatcctggagg

SEQ ID NO: 382209 - DNA, 20 bp, Artificial Sequence
  chemically synthesized
cacttagcaaaacttcctcc

SEQ ID NO: 382210 - DNA, 20 bp, Artificial Sequence
  chemically synthesized
gcacttagcaaaacttcctc

SEQ ID NO: 382211 - DNA, 20 bp, Artificial Sequence
  chemically synthesized
atcctggaggaagttttgct

SEQ ID NO: 382212 - DNA, 20 bp, Artificial Sequence
  chemically synthesized
tgtgcctggcttattgcact

SEQ ID NO: 382213 - DNA, 20 bp, Artificial Sequence
  chemically synthesized
gaagttttgctaagtgcaat

SEQ ID NO: 382214 - DNA, 20 bp, Artificial Sequence
  chemically synthesized
ttttgctaagtgcaataagc

SEQ ID NO: 382215 - DNA, 20 bp, Artificial Sequence
  chemically synthesized
tttgctaagtgcaataagcc

SEQ ID NO: 382216 - DNA, 20 bp, Artificial Sequence
  chemically synthesized
taagtgcaataagccaggca

SEQ ID NO: 382217 - DNA, 20 bp, Artificial Sequence
  chemically synthesized
gttatttggctttctgtgcc

SEQ ID NO: 382218 - DNA, 20 bp, Artificial Sequence
  chemically synthesized
tgcaataagccaggcacaga

SEQ ID NO: 382219 - DNA, 20 bp, Artificial Sequence
  chemically synthesized
aagcgagatcatatgttatt

SEQ ID NO: 382220 - DNA, 20 bp, Artificial Sequence
  chemically synthesized
agataccacctataataagc

SEQ ID NO: 382221 - DNA, 20 bp, Artificial Sequence
  chemically synthesized
acatatgatctcgcttatta

SEQ ID NO: 382222 - DNA, 20 bp, Artificial Sequence
  chemically synthesized
catatgatctcgcttattat

SEQ ID NO: 382223 - DNA, 20 bp, Artificial Sequence
  chemically synthesized
ttttagataccacctataat

SEQ ID NO: 382224 - DNA, 20 bp, Artificial Sequence
  chemically synthesized
atgatctcgcttattatagg

SEQ ID NO: 382225 - DNA, 20 bp, Artificial Sequence
  chemically synthesized
tattataggtggtatctaaa

SEQ ID NO: 382226 - DNA, 20 bp, Artificial Sequence
  chemically synthesized
ataggtggtatctaaaaagt

SEQ ID NO: 382227 - DNA, 20 bp, Artificial Sequence
  chemically synthesized
taggtggtatctaaaaagtt

SEQ ID NO: 382228 - DNA, 20 bp, Artificial Sequence
  chemically synthesized
cttctatgagcccaactttt

SEQ ID NO: 382229 - DNA, 20 bp, Artificial Sequence
  chemically synthesized
tatctaaaaagttgggctca

SEQ ID NO: 382230 - DNA, 20 bp, Artificial Sequence
  chemically synthesized
ctaaaaagttgggctcatag

SEQ ID NO: 382231 - DNA, 20 bp, Artificial Sequence
  chemically synthesized
aaaagttgggctcatagaag

SEQ ID NO: 382232 - DNA, 20 bp, Artificial Sequence
  chemically synthesized
attctactctctacttctat

SEQ ID NO: 382233 - DNA, 20 bp, Artificial Sequence
  chemically synthesized
aagttgggctcatagaagta

SEQ ID NO: 382234 - DNA, 20 bp, Artificial Sequence
  chemically synthesized
gttgggctcatagaagtaga

SEQ ID NO: 382235 - DNA, 20 bp, Artificial Sequence
  chemically synthesized
gggctcatagaagtagagag

SEQ ID NO: 382236 - DNA, 20 bp, Artificial Sequence
  chemically synthesized
catagaagtagagagtagaa

SEQ ID NO: 382237 - DNA, 20 bp, Artificial Sequence
  chemically synthesized
agaagtagagagtagaatag

SEQ ID NO: 382238 - DNA, 20 bp, Artificial Sequence
  chemically synthesized
gagagtagaatagtggttac

SEQ ID NO: 382239 - DNA, 20 bp, Artificial Sequence
  chemically synthesized
gagtagaatagtggttacca

SEQ ID NO: 382240 - DNA, 20 bp, Artificial Sequence
  chemically synthesized
gaatagtggttaccagagac

SEQ ID NO: 382241 - DNA, 20 bp, Artificial Sequence
  chemically synthesized
aatagtggttaccagagact

SEQ ID NO: 382242 - DNA, 20 bp, Artificial Sequence
  chemically synthesized
cacaccctcctcccagtctc

SEQ ID NO: 382243 - DNA, 20 bp, Artificial Sequence
  chemically synthesized
tagtggttaccagagactgg

SEQ ID NO: 382244 - DNA, 20 bp, Artificial Sequence
  chemically synthesized
agtggttaccagagactggg

SEQ ID NO: 382245 - DNA, 20 bp, Artificial Sequence
  chemically synthesized
tggttaccagagactgggag

SEQ ID NO: 382246 - DNA, 20 bp, Artificial Sequence
  chemically synthesized
ggttaccagagactgggagg

SEQ ID NO: 382247 - DNA, 20 bp, Artificial Sequence
  chemically synthesized
gttaccagagactgggagga

SEQ ID NO: 382248 - DNA, 20 bp, Artificial Sequence
  chemically synthesized
caagcctcacaccctcctcc

SEQ ID NO: 382249 - DNA, 20 bp, Artificial Sequence
  chemically synthesized
agagactgggaggagggtgt

SEQ ID NO: 382250 - DNA, 20 bp, Artificial Sequence
  chemically synthesized
gagactgggaggagggtgtg

SEQ ID NO: 382251 - DNA, 20 bp, Artificial Sequence
  chemically synthesized
ggaggagggtgtgaggcttg

SEQ ID NO: 382252 - DNA, 20 bp, Artificial Sequence
  chemically synthesized
aggagggtgtgaggcttgca

SEQ ID NO: 382253 - DNA, 20 bp, Artificial Sequence
  chemically synthesized
tctttgatcaatatctctgc

SEQ ID NO: 382254 - DNA, 20 bp, Artificial Sequence
  chemically synthesized
gcttgcagagatattgatca

SEQ ID NO: 382255 - DNA, 20 bp, Artificial Sequence
  chemically synthesized
aaagaatacaaaatttcatt

SEQ ID NO: 382256 - DNA, 20 bp, Artificial Sequence
  chemically synthesized
aatacaaaatttcatttaga

SEQ ID NO: 382257 - DNA, 20 bp, Artificial Sequence
  chemically synthesized
atacaaaatttcatttagac

SEQ ID NO: 382258 - DNA, 20 bp, Artificial Sequence
  chemically synthesized
acaaaatttcatttagacag

SEQ ID NO: 382259 - DNA, 20 bp, Artificial Sequence
  chemically synthesized
ttcatttagacaggagaaat

SEQ ID NO: 382260 - DNA, 20 bp, Artificial Sequence
  chemically synthesized
tagacaggagaaataagttc

SEQ ID NO: 382261 - DNA, 20 bp, Artificial Sequence
  chemically synthesized
gacaggagaaataagttcga

SEQ ID NO: 382262 - DNA, 20 bp, Artificial Sequence
  chemically synthesized
tgtagaatcaacatgtacaa

SEQ ID NO: 382263 - DNA, 20 bp, Artificial Sequence
  chemically synthesized
tattgtacatgttgattcta

SEQ ID NO: 382264 - DNA, 20 bp, Artificial Sequence
  chemically synthesized
attgtacatgttgattctac

SEQ ID NO: 382265 - DNA, 20 bp, Artificial Sequence
  chemically synthesized
gtacatgttgattctacagg

SEQ ID NO: 382266 - DNA, 20 bp, Artificial Sequence
  chemically synthesized
acattgttatgaaccacctg

SEQ ID NO: 382267 - DNA, 20 bp, Artificial Sequence
  chemically synthesized
actctcttagcaattttcaa

SEQ ID NO: 382268 - DNA, 20 bp, Artificial Sequence
  chemically synthesized
ctactctcttagcaattttc

SEQ ID NO: 382269 - DNA, 20 bp, Artificial Sequence
  chemically synthesized
ttatactcttgaaaattgct

SEQ ID NO: 382270 - DNA, 20 bp, Artificial Sequence
  chemically synthesized
atactcttgaaaattgctaa

SEQ ID NO: 382271 - DNA, 20 bp, Artificial Sequence
  chemically synthesized
actcttgaaaattgctaaga

SEQ ID NO: 382272 - DNA, 20 bp, Artificial Sequence
  chemically synthesized
cttgaaaattgctaagagag

SEQ ID NO: 382273 - DNA, 20 bp, Artificial Sequence
  chemically synthesized
acacttaaaatctactctct

SEQ ID NO: 382274 - DNA, 20 bp, Artificial Sequence
  chemically synthesized
ttgctaagagagtagatttt

SEQ ID NO: 382275 - DNA, 20 bp, Artificial Sequence
  chemically synthesized
gattttaagtgtttttcact

SEQ ID NO: 382276 - DNA, 20 bp, Artificial Sequence
  chemically synthesized
ttaagtgtttttcacttggc

SEQ ID NO: 382277 - DNA, 20 bp, Artificial Sequence
  chemically synthesized
taagtgtttttcacttggct

SEQ ID NO: 382278 - DNA, 20 bp, Artificial Sequence
  chemically synthesized
gtgagccactgcacccagcc

SEQ ID NO: 382279 - DNA, 20 bp, Artificial Sequence
  chemically synthesized
gtttttcacttggctgggtg

SEQ ID NO: 382280 - DNA, 20 bp, Artificial Sequence
  chemically synthesized
tttcacttggctgggtgcag

SEQ ID NO: 382281 - DNA, 20 bp, Artificial Sequence
  chemically synthesized
caggcgtgagccactgcacc

SEQ ID NO: 382282 - DNA, 20 bp, Artificial Sequence
  chemically synthesized
agtactgggattacaggcgt

SEQ ID NO: 382283 - DNA, 20 bp, Artificial Sequence
  chemically synthesized
gtggctcacgcctgtaatcc

SEQ ID NO: 382284 - DNA, 20 bp, Artificial Sequence
  chemically synthesized
tcccaaagtactgggattac

SEQ ID NO: 382285 - DNA, 20 bp, Artificial Sequence
  chemically synthesized
ctcccaaagtactgggatta

SEQ ID NO: 382286 - DNA, 20 bp, Artificial Sequence
  chemically synthesized
cgcctgtaatcccagtactt

SEQ ID NO: 382287 - DNA, 20 bp, Artificial Sequence
  chemically synthesized
cttccgcctcccaaagtact

SEQ ID NO: 382288 - DNA, 20 bp, Artificial Sequence
  chemically synthesized
gcctgtaatcccagtacttt

SEQ ID NO: 382289 - DNA, 20 bp, Artificial Sequence
  chemically synthesized
gcttccgcctcccaaagtac

SEQ ID NO: 382290 - DNA, 20 bp, Artificial Sequence
  chemically synthesized
ctgtaatcccagtactttgg

SEQ ID NO: 382291 - DNA, 20 bp, Artificial Sequence
  chemically synthesized
tgtaatcccagtactttggg

SEQ ID NO: 382292 - DNA, 20 bp, Artificial Sequence
  chemically synthesized
aatcccagtactttgggagg

SEQ ID NO: 382293 - DNA, 20 bp, Artificial Sequence
  chemically synthesized
ccgcccgcttccgcctccca

SEQ ID NO: 382294 - DNA, 20 bp, Artificial Sequence
  chemically synthesized
cccagtactttgggaggcgg

SEQ ID NO: 382295 - DNA, 20 bp, Artificial Sequence
  chemically synthesized
agtactttgggaggcggaag

SEQ ID NO: 382296 - DNA, 20 bp, Artificial Sequence
  chemically synthesized
gtactttgggaggcggaagc

SEQ ID NO: 382297 - DNA, 20 bp, Artificial Sequence
  chemically synthesized
ctttgggaggcggaagcggg

SEQ ID NO: 382298 - DNA, 20 bp, Artificial Sequence
  chemically synthesized
cggaagcgggcggattgcct

SEQ ID NO: 382299 - DNA, 20 bp, Artificial Sequence
  chemically synthesized
gcgggcggattgcctgagct

SEQ ID NO: 382300 - DNA, 20 bp, Artificial Sequence
  chemically synthesized
cgggcggattgcctgagctc

SEQ ID NO: 382301 - DNA, 20 bp, Artificial Sequence
  chemically synthesized
ggtcaggaactcctgagctc

SEQ ID NO: 382302 - DNA, 20 bp, Artificial Sequence
  chemically synthesized
ggcggattgcctgagctcag

SEQ ID NO: 382303 - DNA, 20 bp, Artificial Sequence
  chemically synthesized
tggtcaggaactcctgagct

SEQ ID NO: 382304 - DNA, 20 bp, Artificial Sequence
  chemically synthesized
caggctggtcaggaactcct

SEQ ID NO: 382305 - DNA, 20 bp, Artificial Sequence
  chemically synthesized
tgagctcaggagttcctgac

SEQ ID NO: 382306 - DNA, 20 bp, Artificial Sequence
  chemically synthesized
ctatgttgcccaggctggtc

SEQ ID NO: 382307 - DNA, 20 bp, Artificial Sequence
  chemically synthesized
tcaggagttcctgaccagcc

SEQ ID NO: 382308 - DNA, 20 bp, Artificial Sequence
  chemically synthesized
actatgttgcccaggctggt

SEQ ID NO: 382309 - DNA, 20 bp, Artificial Sequence
  chemically synthesized
caggagttcctgaccagcct

SEQ ID NO: 382310 - DNA, 20 bp, Artificial Sequence
  chemically synthesized
tttcactatgttgcccaggc

SEQ ID NO: 382311 - DNA, 20 bp, Artificial Sequence
  chemically synthesized
ggggtttcactatgttgccc

SEQ ID NO: 382312 - DNA, 20 bp, Artificial Sequence
  chemically synthesized
cctgaccagcctgggcaaca

SEQ ID NO: 382313 - DNA, 20 bp, Artificial Sequence
  chemically synthesized
cggggtttcactatgttgcc

SEQ ID NO: 382314 - DNA, 20 bp, Artificial Sequence
  chemically synthesized
tgtgtgttttagtagagacg

SEQ ID NO: 382315 - DNA, 20 bp, Artificial Sequence
  chemically synthesized
ttgtgtgttttagtagagac

SEQ ID NO: 382316 - DNA, 20 bp, Artificial Sequence
  chemically synthesized
tttgtgtgttttagtagaga

SEQ ID NO: 382317 - DNA, 20 bp, Artificial Sequence
  chemically synthesized
attttttgtgtgttttagta

SEQ ID NO: 382318 - DNA, 20 bp, Artificial Sequence
  chemically synthesized
taattttttgtgtgttttag

SEQ ID NO: 382319 - DNA, 20 bp, Artificial Sequence
  chemically synthesized
tgctaattttttgtgtgttt

SEQ ID NO: 382320 - DNA, 20 bp, Artificial Sequence
  chemically synthesized
tactaaaacacacaaaaaat

SEQ ID NO: 382321 - DNA, 20 bp, Artificial Sequence
  chemically synthesized
taaaacacacaaaaaattag

SEQ ID NO: 382322 - DNA, 20 bp, Artificial Sequence
  chemically synthesized
aaaacacacaaaaaattagc

SEQ ID NO: 382323 - DNA, 20 bp, Artificial Sequence
  chemically synthesized
cacaaaaaattagcaggatg

SEQ ID NO: 382324 - DNA, 20 bp, Artificial Sequence
  chemically synthesized
aaaaaattagcaggatgtgg

SEQ ID NO: 382325 - DNA, 20 bp, Artificial Sequence
  chemically synthesized
ttagcaggatgtggcggcgt

SEQ ID NO: 382326 - DNA, 20 bp, Artificial Sequence
  chemically synthesized
tagcaggatgtggcggcgtg

SEQ ID NO: 382327 - DNA, 20 bp, Artificial Sequence
  chemically synthesized
gatgtggcggcgtgaggctg

SEQ ID NO: 382328 - DNA, 20 bp, Artificial Sequence
  chemically synthesized
gcggcgtgaggctgtagtcc

SEQ ID NO: 382329 - DNA, 20 bp, Artificial Sequence
  chemically synthesized
ctcctgagtagctgggacta

SEQ ID NO: 382330 - DNA, 20 bp, Artificial Sequence
  chemically synthesized
aggctgtagtcccagctact

SEQ ID NO: 382331 - DNA, 20 bp, Artificial Sequence
  chemically synthesized
cctcagcctcctgagtagct

SEQ ID NO: 382332 - DNA, 20 bp, Artificial Sequence
  chemically synthesized
ggctgtagtcccagctactc

SEQ ID NO: 382333 - DNA, 20 bp, Artificial Sequence
  chemically synthesized
gcctcagcctcctgagtagc

SEQ ID NO: 382334 - DNA, 20 bp, Artificial Sequence
  chemically synthesized
ctgtagtcccagctactcag

SEQ ID NO: 382335 - DNA, 20 bp, Artificial Sequence
  chemically synthesized
tgtagtcccagctactcagg

SEQ ID NO: 382336 - DNA, 20 bp, Artificial Sequence
  chemically synthesized
tcctgcctcagcctcctgag

SEQ ID NO: 382337 - DNA, 20 bp, Artificial Sequence
  chemically synthesized
ttctcctgcctcagcctcct

SEQ ID NO: 382338 - DNA, 20 bp, Artificial Sequence
  chemically synthesized
tcccagctactcaggaggct

SEQ ID NO: 382339 - DNA, 20 bp, Artificial Sequence
  chemically synthesized
cccagctactcaggaggctg

SEQ ID NO: 382340 - DNA, 20 bp, Artificial Sequence
  chemically synthesized
agctactcaggaggctgagg

SEQ ID NO: 382341 - DNA, 20 bp, Artificial Sequence
  chemically synthesized
gctactcaggaggctgaggc

SEQ ID NO: 382342 - DNA, 20 bp, Artificial Sequence
  chemically synthesized
tactcaggaggctgaggcag

SEQ ID NO: 382343 - DNA, 20 bp, Artificial Sequence
  chemically synthesized
ttcaagcgattctcctgcct

SEQ ID NO: 382344 - DNA, 20 bp, Artificial Sequence
  chemically synthesized
aacttctgcctcacaggttc

SEQ ID NO: 382345 - DNA, 20 bp, Artificial Sequence
  chemically synthesized
ggagaatcgcttgaacctgt

SEQ ID NO: 382346 - DNA, 20 bp, Artificial Sequence
  chemically synthesized
gagaatcgcttgaacctgtg

SEQ ID NO: 382347 - DNA, 20 bp, Artificial Sequence
  chemically synthesized
aatcgcttgaacctgtgagg

SEQ ID NO: 382348 - DNA, 20 bp, Artificial Sequence
  chemically synthesized
cactgcaacttctgcctcac

SEQ ID NO: 382349 - DNA, 20 bp, Artificial Sequence
  chemically synthesized
tcactgcaacttctgcctca

SEQ ID NO: 382350 - DNA, 20 bp, Artificial Sequence
  chemically synthesized
cgcttgaacctgtgaggcag

SEQ ID NO: 382351 - DNA, 20 bp, Artificial Sequence
  chemically synthesized
aacctgtgaggcagaagttg

SEQ ID NO: 382352 - DNA, 20 bp, Artificial Sequence
  chemically synthesized
ggcagaagttgcagtgaacc

SEQ ID NO: 382353 - DNA, 20 bp, Artificial Sequence
  chemically synthesized
agttgcagtgaaccgagatc

SEQ ID NO: 382354 - DNA, 20 bp, Artificial Sequence
  chemically synthesized
ggagtgcagtggcttgatct

SEQ ID NO: 382355 - DNA, 20 bp, Artificial Sequence
  chemically synthesized
tctcccaggcaggagtgcag

SEQ ID NO: 382356 - DNA, 20 bp, Artificial Sequence
  chemically synthesized
ccgtctcccaggcaggagtg

SEQ ID NO: 382357 - DNA, 20 bp, Artificial Sequence
  chemically synthesized
caagccactgcactcctgcc

SEQ ID NO: 382358 - DNA, 20 bp, Artificial Sequence
  chemically synthesized
aagccactgcactcctgcct

SEQ ID NO: 382359 - DNA, 20 bp, Artificial Sequence
  chemically synthesized
ttgctccgtctcccaggcag

SEQ ID NO: 382360 - DNA, 20 bp, Artificial Sequence
  chemically synthesized
gccactgcactcctgcctgg

SEQ ID NO: 382361 - DNA, 20 bp, Artificial Sequence
  chemically synthesized
tcttgctccgtctcccaggc

SEQ ID NO: 382362 - DNA, 20 bp, Artificial Sequence
  chemically synthesized
gtcttgctccgtctcccagg

SEQ ID NO: 382363 - DNA, 20 bp, Artificial Sequence
  chemically synthesized
ctgcactcctgcctgggaga

SEQ ID NO: 382364 - DNA, 20 bp, Artificial Sequence
  chemically synthesized
ggagtcttgctccgtctccc

SEQ ID NO: 382365 - DNA, 20 bp, Artificial Sequence
  chemically synthesized
gcactcctgcctgggagacg

SEQ ID NO: 382366 - DNA, 20 bp, Artificial Sequence
  chemically synthesized
tggagtcttgctccgtctcc

SEQ ID NO: 382367 - DNA, 20 bp, Artificial Sequence
  chemically synthesized
tcctgcctgggagacggagc

SEQ ID NO: 382368 - DNA, 20 bp, Artificial Sequence
  chemically synthesized
tttttttttttttggagatg

SEQ ID NO: 382369 - DNA, 20 bp, Artificial Sequence
  chemically synthesized
tttttttttttttttggaga

SEQ ID NO: 382370 - DNA, 20 bp, Artificial Sequence
  chemically synthesized
actttttttttttttttttg

SEQ ID NO: 382371 - DNA, 20 bp, Artificial Sequence
  chemically synthesized
acactttttttttttttttt

SEQ ID NO: 382372 - DNA, 20 bp, Artificial Sequence
  chemically synthesized
tctccaaaaaaaaaaaaaaa

SEQ ID NO: 382373 - DNA, 20 bp, Artificial Sequence
  chemically synthesized
catgcttatttttttgtagg

SEQ ID NO: 382374 - DNA, 20 bp, Artificial Sequence
  chemically synthesized
tcacatgcttatttttttgt

SEQ ID NO: 382375 - DNA, 20 bp, Artificial Sequence
  chemically synthesized
ctcacatgcttatttttttg

SEQ ID NO: 382376 - DNA, 20 bp, Artificial Sequence
  chemically synthesized
tgttcttcctacaaaaaaat

SEQ ID NO: 382377 - DNA, 20 bp, Artificial Sequence
  chemically synthesized
ctacaaaaaaataagcatgt

SEQ ID NO: 382378 - DNA, 20 bp, Artificial Sequence
  chemically synthesized
tacaaaaaaataagcatgtg

SEQ ID NO: 382379 - DNA, 20 bp, Artificial Sequence
  chemically synthesized
gaggtaataaatatgttaat

SEQ ID NO: 382380 - DNA, 20 bp, Artificial Sequence
  chemically synthesized
atatgttaattagcttgact

SEQ ID NO: 382381 - DNA, 20 bp, Artificial Sequence
  chemically synthesized
tatatatgaatggctcagtc

SEQ ID NO: 382382 - DNA, 20 bp, Artificial Sequence
  chemically synthesized
atatatatatatgaatggct

SEQ ID NO: 382383 - DNA, 20 bp, Artificial Sequence
  chemically synthesized
tttgaatatatatatatgaa

SEQ ID NO: 382384 - DNA, 20 bp, Artificial Sequence
  chemically synthesized
acaacatgttgaatgaaata

SEQ ID NO: 382385 - DNA, 20 bp, Artificial Sequence
  chemically synthesized
aaatagttaattttaatgga

SEQ ID NO: 382386 - DNA, 20 bp, Artificial Sequence
  chemically synthesized
aattaaatagttaattttaa

SEQ ID NO: 382387 - DNA, 20 bp, Artificial Sequence
  chemically synthesized
tttattttatttaaattaaa

SEQ ID NO: 382388 - DNA, 20 bp, Artificial Sequence
  chemically synthesized
ttaatttaaataaaataaaa

SEQ ID NO: 382389 - DNA, 20 bp, Artificial Sequence
  chemically synthesized
aacaacctagtaaatgtgtt

SEQ ID NO: 382390 - DNA, 20 bp, Artificial Sequence
  chemically synthesized
taacaacctagtaaatgtgt

SEQ ID NO: 382391 - DNA, 20 bp, Artificial Sequence
  chemically synthesized
gatcatcctaacacatttac

SEQ ID NO: 382392 - DNA, 20 bp, Artificial Sequence
  chemically synthesized
atcatcctaacacatttact

SEQ ID NO: 382393 - DNA, 20 bp, Artificial Sequence
  chemically synthesized
gtttagatcttataacaacc

SEQ ID NO: 382394 - DNA, 20 bp, Artificial Sequence
  chemically synthesized
cacatttactaggttgttat

SEQ ID NO: 382395 - DNA, 20 bp, Artificial Sequence
  chemically synthesized
gttgttataagatctaaaca

SEQ ID NO: 382396 - DNA, 20 bp, Artificial Sequence
  chemically synthesized
tctgcagatgatgccatgtt

SEQ ID NO: 382397 - DNA, 20 bp, Artificial Sequence
  chemically synthesized
tctaaacatggcatcatctg

SEQ ID NO: 382398 - DNA, 20 bp, Artificial Sequence
  chemically synthesized
taaacatggcatcatctgca

SEQ ID NO: 382399 - DNA, 20 bp, Artificial Sequence
  chemically synthesized
aaacatggcatcatctgcag

SEQ ID NO: 382400 - DNA, 20 bp, Artificial Sequence
  chemically synthesized
acattaagccaagacctctg

SEQ ID NO: 382401 - DNA, 20 bp, Artificial Sequence
  chemically synthesized
ggcatcatctgcagaggtct

SEQ ID NO: 382402 - DNA, 20 bp, Artificial Sequence
  chemically synthesized
tatatgtcagacattaagcc

SEQ ID NO: 382403 - DNA, 20 bp, Artificial Sequence
  chemically synthesized
attaatatatgtcagacatt

SEQ ID NO: 382404 - DNA, 20 bp, Artificial Sequence
  chemically synthesized
gctaagcaattaatatatgt

SEQ ID NO: 382405 - DNA, 20 bp, Artificial Sequence
  chemically synthesized
tctgacatatattaattgct

SEQ ID NO: 382406 - DNA, 20 bp, Artificial Sequence
  chemically synthesized
gattacagctacgatttgct

SEQ ID NO: 382407 - DNA, 20 bp, Artificial Sequence
  chemically synthesized
attaattgcttagcaaatcg

SEQ ID NO: 382408 - DNA, 20 bp, Artificial Sequence
  chemically synthesized
atttatttatttagtgatta

SEQ ID NO: 382409 - DNA, 20 bp, Artificial Sequence
  chemically synthesized
agtcaataaatttatttatt

SEQ ID NO: 382410 - DNA, 20 bp, Artificial Sequence
  chemically synthesized
aagggtactatggaataaaa

SEQ ID NO: 382411 - DNA, 20 bp, Artificial Sequence
  chemically synthesized
ttattgacttttttattcca

SEQ ID NO: 382412 - DNA, 20 bp, Artificial Sequence
  chemically synthesized
taatgtagcgaagggtacta

SEQ ID NO: 382413 - DNA, 20 bp, Artificial Sequence
  chemically synthesized
gatacaaataatgtagcgaa

SEQ ID NO: 382414 - DNA, 20 bp, Artificial Sequence
  chemically synthesized
agatacaaataatgtagcga

SEQ ID NO: 382415 - DNA, 20 bp, Artificial Sequence
  chemically synthesized
gagatacaaataatgtagcg

SEQ ID NO: 382416 - DNA, 20 bp, Artificial Sequence
  chemically synthesized
aagtagagatacaaataatg

SEQ ID NO: 382417 - DNA, 20 bp, Artificial Sequence
  chemically synthesized
ccttcccagtagacgaagta

SEQ ID NO: 382418 - DNA, 20 bp, Artificial Sequence
  chemically synthesized
taccttcccagtagacgaag

SEQ ID NO: 382419 - DNA, 20 bp, Artificial Sequence
  chemically synthesized
tgtatctctacttcgtctac

SEQ ID NO: 382420 - DNA, 20 bp, Artificial Sequence
  chemically synthesized
gcataccttcccagtagacg

SEQ ID NO: 382421 - DNA, 20 bp, Artificial Sequence
  chemically synthesized
gtatctctacttcgtctact

SEQ ID NO: 382422 - DNA, 20 bp, Artificial Sequence
  chemically synthesized
tctctacttcgtctactggg

SEQ ID NO: 382423 - DNA, 20 bp, Artificial Sequence
  chemically synthesized
ctctacttcgtctactggga

SEQ ID NO: 382424 - DNA, 20 bp, Artificial Sequence
  chemically synthesized
ccacaggcataccttcccag

SEQ ID NO: 382425 - DNA, 20 bp, Artificial Sequence
  chemically synthesized
ctgccacaggcataccttcc

SEQ ID NO: 382426 - DNA, 20 bp, Artificial Sequence
  chemically synthesized
ctactgggaaggtatgcctg

SEQ ID NO: 382427 - DNA, 20 bp, Artificial Sequence
  chemically synthesized
ctgggaaggtatgcctgtgg

SEQ ID NO: 382428 - DNA, 20 bp, Artificial Sequence
  chemically synthesized
gatggaaacttttctgccac

SEQ ID NO: 382429 - DNA, 20 bp, Artificial Sequence
  chemically synthesized
agatggaaacttttctgcca

SEQ ID NO: 382430 - DNA, 20 bp, Artificial Sequence
  chemically synthesized
aaggtatgcctgtggcagaa

SEQ ID NO: 382431 - DNA, 20 bp, Artificial Sequence
  chemically synthesized
agaaaagtttccatcttatc

SEQ ID NO: 382432 - DNA, 20 bp, Artificial Sequence
  chemically synthesized
gtgagaaaggctagataaga

SEQ ID NO: 382433 - DNA, 20 bp, Artificial Sequence
  chemically synthesized
gaatgtgagaaaggctagat

SEQ ID NO: 382434 - DNA, 20 bp, Artificial Sequence
  chemically synthesized
gaagggaatgtgagaaaggc

SEQ ID NO: 382435 - DNA, 20 bp, Artificial Sequence
  chemically synthesized
gacagaagggaatgtgagaa

SEQ ID NO: 382436 - DNA, 20 bp, Artificial Sequence
  chemically synthesized
ggacagaagggaatgtgaga

SEQ ID NO: 382437 - DNA, 20 bp, Artificial Sequence
  chemically synthesized
atttggacagaagggaatgt

SEQ ID NO: 382438 - DNA, 20 bp, Artificial Sequence
  chemically synthesized
ctggaatgatttggacagaa

SEQ ID NO: 382439 - DNA, 20 bp, Artificial Sequence
  chemically synthesized
gctggaatgatttggacaga

SEQ ID NO: 382440 - DNA, 20 bp, Artificial Sequence
  chemically synthesized
ggctggaatgatttggacag

SEQ ID NO: 382441 - DNA, 20 bp, Artificial Sequence
  chemically synthesized
gtgggctggaatgatttgga

SEQ ID NO: 382442 - DNA, 20 bp, Artificial Sequence
  chemically synthesized
cagagtgggctggaatgatt

SEQ ID NO: 382443 - DNA, 20 bp, Artificial Sequence
  chemically synthesized
cccttctgtccaaatcattc

SEQ ID NO: 382444 - DNA, 20 bp, Artificial Sequence
  chemically synthesized
aagttagattcagagtgggc

SEQ ID NO: 382445 - DNA, 20 bp, Artificial Sequence
  chemically synthesized
aaacaagttagattcagagt

SEQ ID NO: 382446 - DNA, 20 bp, Artificial Sequence
  chemically synthesized
aaaacaagttagattcagag

SEQ ID NO: 382447 - DNA, 20 bp, Artificial Sequence
  chemically synthesized
gtcaaaacaagttagattca

SEQ ID NO: 382448 - DNA, 20 bp, Artificial Sequence
  chemically synthesized
ctgtcaaaacaagttagatt

SEQ ID NO: 382449 - DNA, 20 bp, Artificial Sequence
  chemically synthesized
agtactctgtcaaaacaagt

SEQ ID NO: 382450 - DNA, 20 bp, Artificial Sequence
  chemically synthesized
ctgaatctaacttgttttga

SEQ ID NO: 382451 - DNA, 20 bp, Artificial Sequence
  chemically synthesized
aataagtactctgtcaaaac

SEQ ID NO: 382452 - DNA, 20 bp, Artificial Sequence
  chemically synthesized
gaatctaacttgttttgaca

SEQ ID NO: 382453 - DNA, 20 bp, Artificial Sequence
  chemically synthesized
tgacagagtacttatttact

SEQ ID NO: 382454 - DNA, 20 bp, Artificial Sequence
  chemically synthesized
ctatcatgtgccaagtaaat

SEQ ID NO: 382455 - DNA, 20 bp, Artificial Sequence
  chemically synthesized
ttaagaacctatcatgtgcc

SEQ ID NO: 382456 - DNA, 20 bp, Artificial Sequence
  chemically synthesized
cttatttacttggcacatga

SEQ ID NO: 382457 - DNA, 20 bp, Artificial Sequence
  chemically synthesized
ttatttacttggcacatgat

SEQ ID NO: 382458 - DNA, 20 bp, Artificial Sequence
  chemically synthesized
gcaataaacaaatatttatt

SEQ ID NO: 382459 - DNA, 20 bp, Artificial Sequence
  chemically synthesized
aatatttgtttattgcctta

SEQ ID NO: 382460 - DNA, 20 bp, Artificial Sequence
  chemically synthesized
atatttgtttattgccttat

SEQ ID NO: 382461 - DNA, 20 bp, Artificial Sequence
  chemically synthesized
tttgtttattgccttatagg

SEQ ID NO: 382462 - DNA, 20 bp, Artificial Sequence
  chemically synthesized
ttcataactttcttcctata

SEQ ID NO: 382463 - DNA, 20 bp, Artificial Sequence
  chemically synthesized
cttcataactttcttcctat

SEQ ID NO: 382464 - DNA, 20 bp, Artificial Sequence
  chemically synthesized
tttattgccttataggaaga

SEQ ID NO: 382465 - DNA, 20 bp, Artificial Sequence
  chemically synthesized
cttataggaagaaagttatg

SEQ ID NO: 382466 - DNA, 20 bp, Artificial Sequence
  chemically synthesized
ttataggaagaaagttatga

SEQ ID NO: 382467 - DNA, 20 bp, Artificial Sequence
  chemically synthesized
ggaaatataacttgtttact

SEQ ID NO: 382468 - DNA, 20 bp, Artificial Sequence
  chemically synthesized
cttgctacccctcagtaaac

SEQ ID NO: 382469 - DNA, 20 bp, Artificial Sequence
  chemically synthesized
gaaatataacttgtttactg

SEQ ID NO: 382470 - DNA, 20 bp, Artificial Sequence
  chemically synthesized
aaatataacttgtttactga

SEQ ID NO: 382471 - DNA, 20 bp, Artificial Sequence
  chemically synthesized
aatataacttgtttactgag

SEQ ID NO: 382472 - DNA, 20 bp, Artificial Sequence
  chemically synthesized
ataacttgtttactgagggg

SEQ ID NO: 382473 - DNA, 20 bp, Artificial Sequence
  chemically synthesized
gaaggaaacttgctacccct

SEQ ID NO: 382474 - DNA, 20 bp, Artificial Sequence
  chemically synthesized
cttgtttactgaggggtagc

SEQ ID NO: 382475 - DNA, 20 bp, Artificial Sequence
  chemically synthesized
aaaaaaaaaagaaagaaaga

SEQ ID NO: 382476 - DNA, 20 bp, Artificial Sequence
  chemically synthesized
aaaaaaaaaaagaaagaaag

SEQ ID NO: 382477 - DNA, 20 bp, Artificial Sequence
  chemically synthesized
aaaaaaaaaaaaaagaaaga

SEQ ID NO: 382478 - DNA, 20 bp, Artificial Sequence
  chemically synthesized
aaaaaaaaaaaaaaaaaaga

SEQ ID NO: 382479 - DNA, 20 bp, Artificial Sequence
  chemically synthesized
aaaaaaaaaaaaaaaaaaaa

SEQ ID NO: 382480 - DNA, 20 bp, Artificial Sequence
  chemically synthesized
ttttttttttttttttttga

SEQ ID NO: 382481 - DNA, 20 bp, Artificial Sequence
  chemically synthesized
tactccagcctgggcaacaa

SEQ ID NO: 382482 - DNA, 20 bp, Artificial Sequence
  chemically synthesized
ggaatttcactcttgttgcc

SEQ ID NO: 382483 - DNA, 20 bp, Artificial Sequence
  chemically synthesized
gaatttcactcttgttgccc

SEQ ID NO: 382484 - DNA, 20 bp, Artificial Sequence
  chemically synthesized
catactccagcctgggcaac

SEQ ID NO: 382485 - DNA, 20 bp, Artificial Sequence
  chemically synthesized
ttcactcttgttgcccaggc

SEQ ID NO: 382486 - DNA, 20 bp, Artificial Sequence
  chemically synthesized
cactcttgttgcccaggctg

SEQ ID NO: 382487 - DNA, 20 bp, Artificial Sequence
  chemically synthesized
tggccatcatactccagcct

SEQ ID NO: 382488 - DNA, 20 bp, Artificial Sequence
  chemically synthesized
ctggccatcatactccagcc

SEQ ID NO: 382489 - DNA, 20 bp, Artificial Sequence
  chemically synthesized
gagatctggccatcatactc

SEQ ID NO: 382490 - DNA, 20 bp, Artificial Sequence
  chemically synthesized
ttgcccaggctggagtatga

SEQ ID NO: 382491 - DNA, 20 bp, Artificial Sequence
  chemically synthesized
ccaggctggagtatgatggc

SEQ ID NO: 382492 - DNA, 20 bp, Artificial Sequence
  chemically synthesized
ggagtatgatggccagatct

SEQ ID NO: 382493 - DNA, 20 bp, Artificial Sequence
  chemically synthesized
ggttgtggtgagctgagatc

SEQ ID NO: 382494 - DNA, 20 bp, Artificial Sequence
  chemically synthesized
ggcggaggttgtggtgagct

SEQ ID NO: 382495 - DNA, 20 bp, Artificial Sequence
  chemically synthesized
taaaaggcggaggttgtggt

SEQ ID NO: 382496 - DNA, 20 bp, Artificial Sequence
  chemically synthesized
ccactaaaaggcggaggttg

SEQ ID NO: 382497 - DNA, 20 bp, Artificial Sequence
  chemically synthesized
tcatctccactaaaaggcgg

SEQ ID NO: 382498 - DNA, 20 bp, Artificial Sequence
  chemically synthesized
tcaccacaacctccgccttt

SEQ ID NO: 382499 - DNA, 20 bp, Artificial Sequence
  chemically synthesized
atcatctccactaaaaggcg

SEQ ID NO: 382500 - DNA, 20 bp, Artificial Sequence
  chemically synthesized
acatcatctccactaaaagg

SEQ ID NO: 382501 - DNA, 20 bp, Artificial Sequence
  chemically synthesized
ccacaacctccgccttttag

SEQ ID NO: 382502 - DNA, 20 bp, Artificial Sequence
  chemically synthesized
acaacctccgccttttagtg

SEQ ID NO: 382503 - DNA, 20 bp, Artificial Sequence
  chemically synthesized
gaaacatcatctccactaaa

SEQ ID NO: 382504 - DNA, 20 bp, Artificial Sequence
  chemically synthesized
agaaacatcatctccactaa

SEQ ID NO: 382505 - DNA, 20 bp, Artificial Sequence
  chemically synthesized
gagatgatgtttctccatgt

SEQ ID NO: 382506 - DNA, 20 bp, Artificial Sequence
  chemically synthesized
agaccagcctgaccaacatg

SEQ ID NO: 382507 - DNA, 20 bp, Artificial Sequence
  chemically synthesized
tgatgtttctccatgttggt

SEQ ID NO: 382508 - DNA, 20 bp, Artificial Sequence
  chemically synthesized
caagaccagcctgaccaaca

SEQ ID NO: 382509 - DNA, 20 bp, Artificial Sequence
  chemically synthesized
gatgtttctccatgttggtc

SEQ ID NO: 382510 - DNA, 20 bp, Artificial Sequence
  chemically synthesized
tttctccatgttggtcaggc

SEQ ID NO: 382511 - DNA, 20 bp, Artificial Sequence
  chemically synthesized
tgaggccgggagttcaagac

SEQ ID NO: 382512 - DNA, 20 bp, Artificial Sequence
  chemically synthesized
tcaggctggtcttgaactcc

SEQ ID NO: 382513 - DNA, 20 bp, Artificial Sequence
  chemically synthesized
tcacctgaggccgggagttc

SEQ ID NO: 382514 - DNA, 20 bp, Artificial Sequence
  chemically synthesized
tggtcttgaactcccggcct

SEQ ID NO: 382515 - DNA, 20 bp, Artificial Sequence
  chemically synthesized
agcgggtcacctgaggccgg

SEQ ID NO: 382516 - DNA, 20 bp, Artificial Sequence
  chemically synthesized
ggtcttgaactcccggcctc

SEQ ID NO: 382517 - DNA, 20 bp, Artificial Sequence
  chemically synthesized
gcagcgggtcacctgaggcc

SEQ ID NO: 382518 - DNA, 20 bp, Artificial Sequence
  chemically synthesized
ggcagcgggtcacctgaggc

SEQ ID NO: 382519 - DNA, 20 bp, Artificial Sequence
  chemically synthesized
ccgaggcagcgggtcacctg

SEQ ID NO: 382520 - DNA, 20 bp, Artificial Sequence
  chemically synthesized
tccgaggcagcgggtcacct

SEQ ID NO: 382521 - DNA, 20 bp, Artificial Sequence
  chemically synthesized
cctcaggtgacccgctgcct

SEQ ID NO: 382522 - DNA, 20 bp, Artificial Sequence
  chemically synthesized
ggccgggcgtccgaggcagc

SEQ ID NO: 382523 - DNA, 20 bp, Artificial Sequence
  chemically synthesized
cggccgggcgtccgaggcag

SEQ ID NO: 382524 - DNA, 20 bp, Artificial Sequence
  chemically synthesized
ttgcggccgggcgtccgagg

SEQ ID NO: 382525 - DNA, 20 bp, Artificial Sequence
  chemically synthesized
gacttgcggccgggcgtccg

SEQ ID NO: 382526 - DNA, 20 bp, Artificial Sequence
  chemically synthesized
gacccgctgcctcggacgcc

SEQ ID NO: 382527 - DNA, 20 bp, Artificial Sequence
  chemically synthesized
agacttgcggccgggcgtcc

SEQ ID NO: 382528 - DNA, 20 bp, Artificial Sequence
  chemically synthesized
tgcctcggacgcccggccgc

SEQ ID NO: 382529 - DNA, 20 bp, Artificial Sequence
  chemically synthesized
taaaagaaagacttgcggcc

SEQ ID NO: 382530 - DNA, 20 bp, Artificial Sequence
  chemically synthesized
ataaaagaaagacttgcggc

SEQ ID NO: 382531 - DNA, 20 bp, Artificial Sequence
  chemically synthesized
taagataaaagaaagacttg

SEQ ID NO: 382532 - DNA, 20 bp, Artificial Sequence
  chemically synthesized
gtgtttagtaagataaaaga

SEQ ID NO: 382533 - DNA, 20 bp, Artificial Sequence
  chemically synthesized
gtctgtgtttagtaagataa

SEQ ID NO: 382534 - DNA, 20 bp, Artificial Sequence
  chemically synthesized
atcatttgtctgtgtttagt

SEQ ID NO: 382535 - DNA, 20 bp, Artificial Sequence
  chemically synthesized
ttcttttatcttactaaaca

SEQ ID NO: 382536 - DNA, 20 bp, Artificial Sequence
  chemically synthesized
ctccatcatttgtctgtgtt

SEQ ID NO: 382537 - DNA, 20 bp, Artificial Sequence
  chemically synthesized
tactaaacacagacaaatga

SEQ ID NO: 382538 - DNA, 20 bp, Artificial Sequence
  chemically synthesized
ctaaacacagacaaatgatg

SEQ ID NO: 382539 - DNA, 20 bp, Artificial Sequence
  chemically synthesized
acagacaaatgatggagaaa

SEQ ID NO: 382540 - DNA, 20 bp, Artificial Sequence
  chemically synthesized
tgatggagaaaaagtctgtt

SEQ ID NO: 382541 - DNA, 20 bp, Artificial Sequence
  chemically synthesized
gacagtatgcatttgcttaa

SEQ ID NO: 382542 - DNA, 20 bp, Artificial Sequence
  chemically synthesized
taagcaaatgcatactgtct

SEQ ID NO: 382543 - DNA, 20 bp, Artificial Sequence
  chemically synthesized
aaaacttaaataatccaaga

SEQ ID NO: 382544 - DNA, 20 bp, Artificial Sequence
  chemically synthesized
cccgaaaacttaaataatcc

SEQ ID NO: 382545 - DNA, 20 bp, Artificial Sequence
  chemically synthesized
catactgtcttggattattt

SEQ ID NO: 382546 - DNA, 20 bp, Artificial Sequence
  chemically synthesized
tcttggattatttaagtttt

SEQ ID NO: 382547 - DNA, 20 bp, Artificial Sequence
  chemically synthesized
cttggattatttaagttttc

SEQ ID NO: 382548 - DNA, 20 bp, Artificial Sequence
  chemically synthesized
tatttaagttttcgggtatt

SEQ ID NO: 382549 - DNA, 20 bp, Artificial Sequence
  chemically synthesized
atttaagttttcgggtattt

SEQ ID NO: 382550 - DNA, 20 bp, Artificial Sequence
  chemically synthesized
atttaggttgatttcccaac

SEQ ID NO: 382551 - DNA, 20 bp, Artificial Sequence
  chemically synthesized
tttaggttgatttcccaact

SEQ ID NO: 382552 - DNA, 20 bp, Artificial Sequence
  chemically synthesized
gtttccaggatatcctagtt

SEQ ID NO: 382553 - DNA, 20 bp, Artificial Sequence
  chemically synthesized
tgtttccaggatatcctagt

SEQ ID NO: 382554 - DNA, 20 bp, Artificial Sequence
  chemically synthesized
aatctgtttccaggatatcc

SEQ ID NO: 382555 - DNA, 20 bp, Artificial Sequence
  chemically synthesized
atttcccaactaggatatcc

SEQ ID NO: 382556 - DNA, 20 bp, Artificial Sequence
  chemically synthesized
caactaggatatcctggaaa

SEQ ID NO: 382557 - DNA, 20 bp, Artificial Sequence
  chemically synthesized
tttacattaaatctgtttcc

SEQ ID NO: 382558 - DNA, 20 bp, Artificial Sequence
  chemically synthesized
atttacattaaatctgtttc

SEQ ID NO: 382559 - DNA, 20 bp, Artificial Sequence
  chemically synthesized
aatctaaagattgaagggat

SEQ ID NO: 382560 - DNA, 20 bp, Artificial Sequence
  chemically synthesized
tacagaatctaaagattgaa

SEQ ID NO: 382561 - DNA, 20 bp, Artificial Sequence
  chemically synthesized
atacagaatctaaagattga

SEQ ID NO: 382562 - DNA, 20 bp, Artificial Sequence
  chemically synthesized
catcttatcccttcaatctt

SEQ ID NO: 382563 - DNA, 20 bp, Artificial Sequence
  chemically synthesized
aatacagaatctaaagattg

SEQ ID NO: 382564 - DNA, 20 bp, Artificial Sequence
  chemically synthesized
aaagattaatacagaatcta

SEQ ID NO: 382565 - DNA, 20 bp, Artificial Sequence
  chemically synthesized
aatttttagaaagattaata

SEQ ID NO: 382566 - DNA, 20 bp, Artificial Sequence
  chemically synthesized
cataagagcaaatttttaga

SEQ ID NO: 382567 - DNA, 20 bp, Artificial Sequence
  chemically synthesized
agaacataagagcaaatttt

SEQ ID NO: 382568 - DNA, 20 bp, Artificial Sequence
  chemically synthesized
aatgttccagaagaacataa

SEQ ID NO: 382569 - DNA, 20 bp, Artificial Sequence
  chemically synthesized
taaatgttccagaagaacat

SEQ ID NO: 382570 - DNA, 20 bp, Artificial Sequence
  chemically synthesized
aatttgctcttatgttcttc

SEQ ID NO: 382571 - DNA, 20 bp, Artificial Sequence
  chemically synthesized
tagggatataaatgttccag

SEQ ID NO: 382572 - DNA, 20 bp, Artificial Sequence
  chemically synthesized
tattagggatataaatgttc

SEQ ID NO: 382573 - DNA, 20 bp, Artificial Sequence
  chemically synthesized
tggaacatttatatccctaa

SEQ ID NO: 382574 - DNA, 20 bp, Artificial Sequence
  chemically synthesized
ggaacatttatatccctaat

SEQ ID NO: 382575 - DNA, 20 bp, Artificial Sequence
  chemically synthesized
gaacatttatatccctaata

SEQ ID NO: 382576 - DNA, 20 bp, Artificial Sequence
  chemically synthesized
cagatttaccatccctatta

SEQ ID NO: 382577 - DNA, 20 bp, Artificial Sequence
  chemically synthesized
tcagatttaccatccctatt

SEQ ID NO: 382578 - DNA, 20 bp, Artificial Sequence
  chemically synthesized
atttatatccctaataggga

SEQ ID NO: 382579 - DNA, 20 bp, Artificial Sequence
  chemically synthesized
atcagatttaccatccctat

SEQ ID NO: 382580 - DNA, 20 bp, Artificial Sequence
  chemically synthesized
taccttgaatatcagattat

SEQ ID NO: 382581 - DNA, 20 bp, Artificial Sequence
  chemically synthesized
aatctgataatctgatattc

SEQ ID NO: 382582 - DNA, 20 bp, Artificial Sequence
  chemically synthesized
atctgataatctgatattca

SEQ ID NO: 382583 - DNA, 20 bp, Artificial Sequence
  chemically synthesized
caccatgctaccttgaatat

SEQ ID NO: 382584 - DNA, 20 bp, Artificial Sequence
  chemically synthesized
tgataatctgatattcaagg

SEQ ID NO: 382585 - DNA, 20 bp, Artificial Sequence
  chemically synthesized
atctgatattcaaggtagca

SEQ ID NO: 382586 - DNA, 20 bp, Artificial Sequence
  chemically synthesized
aaggtagcatggtgcacaca

SEQ ID NO: 382587 - DNA, 20 bp, Artificial Sequence
  chemically synthesized
cacacacggattatttgatt

SEQ ID NO: 382588 - DNA, 20 bp, Artificial Sequence
  chemically synthesized
tatttgatttagaaaaaaaa

SEQ ID NO: 382589 - DNA, 20 bp, Artificial Sequence
  chemically synthesized
ctgcattttacaagcggtta

SEQ ID NO: 382590 - DNA, 20 bp, Artificial Sequence
  chemically synthesized
gctgcattttacaagcggtt

SEQ ID NO: 382591 - DNA, 20 bp, Artificial Sequence
  chemically synthesized
tgctgcattttacaagcggt

SEQ ID NO: 382592 - DNA, 20 bp, Artificial Sequence
  chemically synthesized
tacatgctgcattttacaag

SEQ ID NO: 382593 - DNA, 20 bp, Artificial Sequence
  chemically synthesized
atatacatgctgcattttac

SEQ ID NO: 382594 - DNA, 20 bp, Artificial Sequence
  chemically synthesized
ccctaaccgcttgtaaaatg

SEQ ID NO: 382595 - DNA, 20 bp, Artificial Sequence
  chemically synthesized
atataaatcatctcatgtat

SEQ ID NO: 382596 - DNA, 20 bp, Artificial Sequence
  chemically synthesized
tataaatcatctcatgtatt

SEQ ID NO: 382597 - DNA, 20 bp, Artificial Sequence
  chemically synthesized
atggaaactgcctaatacat

SEQ ID NO: 382598 - DNA, 20 bp, Artificial Sequence
  chemically synthesized
aaatcatctcatgtattagg

SEQ ID NO: 382599 - DNA, 20 bp, Artificial Sequence
  chemically synthesized
catattttcttttgggaaaa

SEQ ID NO: 382600 - DNA, 20 bp, Artificial Sequence
  chemically synthesized
ggcagtttccattttcccaa

SEQ ID NO: 382601 - DNA, 20 bp, Artificial Sequence
  chemically synthesized
tcacaggcatattttctttt

SEQ ID NO: 382602 - DNA, 20 bp, Artificial Sequence
  chemically synthesized
ctcacaggcatattttcttt

SEQ ID NO: 382603 - DNA, 20 bp, Artificial Sequence
  chemically synthesized
ccaaaagaaaatatgcctgt

SEQ ID NO: 382604 - DNA, 20 bp, Artificial Sequence
  chemically synthesized
aaatatttttgagggctcac

SEQ ID NO: 382605 - DNA, 20 bp, Artificial Sequence
  chemically synthesized
aaaatatttttgagggctca

SEQ ID NO: 382606 - DNA, 20 bp, Artificial Sequence
  chemically synthesized
ttggcctaaaatatttttga

SEQ ID NO: 382607 - DNA, 20 bp, Artificial Sequence
  chemically synthesized
gttggcctaaaatatttttg

SEQ ID NO: 382608 - DNA, 20 bp, Artificial Sequence
  chemically synthesized
tgttggcctaaaatattttt

SEQ ID NO: 382609 - DNA, 20 bp, Artificial Sequence
  chemically synthesized
gtgagccctcaaaaatattt

SEQ ID NO: 382610 - DNA, 20 bp, Artificial Sequence
  chemically synthesized
tgagccctcaaaaatatttt

SEQ ID NO: 382611 - DNA, 20 bp, Artificial Sequence
  chemically synthesized
aaaattttgtgtatacatgt

SEQ ID NO: 382612 - DNA, 20 bp, Artificial Sequence
  chemically synthesized
aacatgtatacacaaaattt

SEQ ID NO: 382613 - DNA, 20 bp, Artificial Sequence
  chemically synthesized
acatgtatacacaaaatttt

SEQ ID NO: 382614 - DNA, 20 bp, Artificial Sequence
  chemically synthesized
tacacaaaattttaggactt

SEQ ID NO: 382615 - DNA, 20 bp, Artificial Sequence
  chemically synthesized
ttgattatatatatttgcta

SEQ ID NO: 382616 - DNA, 20 bp, Artificial Sequence
  chemically synthesized
attgtatgcatgattttgat

SEQ ID NO: 382617 - DNA, 20 bp, Artificial Sequence
  chemically synthesized
tttttatcatagaaaattaa

SEQ ID NO: 382618 - DNA, 20 bp, Artificial Sequence
  chemically synthesized
aatatttaatatttttatca

SEQ ID NO: 382619 - DNA, 20 bp, Artificial Sequence
  chemically synthesized
atttatatcatataaaacat

SEQ ID NO: 382620 - DNA, 20 bp, Artificial Sequence
  chemically synthesized
atataaaacattagaaatat

SEQ ID NO: 382621 - DNA, 20 bp, Artificial Sequence
  chemically synthesized
attagaaatattagaaatgc

SEQ ID NO: 382622 - DNA, 20 bp, Artificial Sequence
  chemically synthesized
tgcgagactaaaaaacatgc

SEQ ID NO: 382623 - DNA, 20 bp, Artificial Sequence
  chemically synthesized
agaaatgctggcatgttttt

SEQ ID NO: 382624 - DNA, 20 bp, Artificial Sequence
  chemically synthesized
aaagtcatttcatgaaatgc

SEQ ID NO: 382625 - DNA, 20 bp, Artificial Sequence
  chemically synthesized
gctttcaaagagatcgaata

SEQ ID NO: 382626 - DNA, 20 bp, Artificial Sequence
  chemically synthesized
actttattcgatctctttga

SEQ ID NO: 382627 - DNA, 20 bp, Artificial Sequence
  chemically synthesized
acctcaaagtagctttcaaa

SEQ ID NO: 382628 - DNA, 20 bp, Artificial Sequence
  chemically synthesized
ttacctcaaagtagctttca

SEQ ID NO: 382629 - DNA, 20 bp, Artificial Sequence
  chemically synthesized
atctctttgaaagctacttt

SEQ ID NO: 382630 - DNA, 20 bp, Artificial Sequence
  chemically synthesized
tctctttgaaagctactttg

SEQ ID NO: 382631 - DNA, 20 bp, Artificial Sequence
  chemically synthesized
agaaaaaaattacctcaaag

SEQ ID NO: 382632 - DNA, 20 bp, Artificial Sequence
  chemically synthesized
caaagaaaaaaattacctca

SEQ ID NO: 382633 - DNA, 20 bp, Artificial Sequence
  chemically synthesized
gtaatttttttctttgtcat

SEQ ID NO: 382634 - DNA, 20 bp, Artificial Sequence
  chemically synthesized
aaaaaggggttcttatgaca

SEQ ID NO: 382635 - DNA, 20 bp, Artificial Sequence
  chemically synthesized
ctagatgacattaaaaaaag

SEQ ID NO: 382636 - DNA, 20 bp, Artificial Sequence
  chemically synthesized
tctagatgacattaaaaaaa

SEQ ID NO: 382637 - DNA, 20 bp, Artificial Sequence
  chemically synthesized
ttctagatgacattaaaaaa

SEQ ID NO: 382638 - DNA, 20 bp, Artificial Sequence
  chemically synthesized
cttctagatgacattaaaaa

SEQ ID NO: 382639 - DNA, 20 bp, Artificial Sequence
  chemically synthesized
cccctttttttaatgtcatc

SEQ ID NO: 382640 - DNA, 20 bp, Artificial Sequence
  chemically synthesized
ctttttttaatgtcatctag

SEQ ID NO: 382641 - DNA, 20 bp, Artificial Sequence
  chemically synthesized
tgggttctgaaaaaagcttc

SEQ ID NO: 382642 - DNA, 20 bp, Artificial Sequence
  chemically synthesized
tgtcatctagaagctttttt

SEQ ID NO: 382643 - DNA, 20 bp, Artificial Sequence
  chemically synthesized
gagttgatgggttctgaaaa

SEQ ID NO: 382644 - DNA, 20 bp, Artificial Sequence
  chemically synthesized
tagctggaaatggagttgat

SEQ ID NO: 382645 - DNA, 20 bp, Artificial Sequence
  chemically synthesized
gtagctggaaatggagttga

SEQ ID NO: 382646 - DNA, 20 bp, Artificial Sequence
  chemically synthesized
gaacccatcaactccatttc

SEQ ID NO: 382647 - DNA, 20 bp, Artificial Sequence
  chemically synthesized
aacttatgtagctggaaatg

SEQ ID NO: 382648 - DNA, 20 bp, Artificial Sequence
  chemically synthesized
tcaacttatgtagctggaaa

SEQ ID NO: 382649 - DNA, 20 bp, Artificial Sequence
  chemically synthesized
aactccatttccagctacat

SEQ ID NO: 382650 - DNA, 20 bp, Artificial Sequence
  chemically synthesized
tttatctcaacttatgtagc

SEQ ID NO: 382651 - DNA, 20 bp, Artificial Sequence
  chemically synthesized
gtaatttatctcaacttatg

SEQ ID NO: 382652 - DNA, 20 bp, Artificial Sequence
  chemically synthesized
catttccagctacataagtt

SEQ ID NO: 382653 - DNA, 20 bp, Artificial Sequence
  chemically synthesized
gaagagcatacatattcaca

SEQ ID NO: 382654 - DNA, 20 bp, Artificial Sequence
  chemically synthesized
ggtcaaatttttatgacgaa

SEQ ID NO: 382655 - DNA, 20 bp, Artificial Sequence
  chemically synthesized
gaggtcaaatttttatgacg

SEQ ID NO: 382656 - DNA, 20 bp, Artificial Sequence
  chemically synthesized
agcaagcagagtgtggcgtg

SEQ ID NO: 382657 - DNA, 20 bp, Artificial Sequence
  chemically synthesized
tagcaagcagagtgtggcgt

SEQ ID NO: 382658 - DNA, 20 bp, Artificial Sequence
  chemically synthesized
tcttactagcaagcagagtg

SEQ ID NO: 382659 - DNA, 20 bp, Artificial Sequence
  chemically synthesized
tcacgccacactctgcttgc

SEQ ID NO: 382660 - DNA, 20 bp, Artificial Sequence
  chemically synthesized
agctttcttactagcaagca

SEQ ID NO: 382661 - DNA, 20 bp, Artificial Sequence
  chemically synthesized
acagctttcttactagcaag

SEQ ID NO: 382662 - DNA, 20 bp, Artificial Sequence
  chemically synthesized
gccacactctgcttgctagt

SEQ ID NO: 382663 - DNA, 20 bp, Artificial Sequence
  chemically synthesized
acaacagctttcttactagc

SEQ ID NO: 382664 - DNA, 20 bp, Artificial Sequence
  chemically synthesized
cactctgcttgctagtaaga

SEQ ID NO: 382665 - DNA, 20 bp, Artificial Sequence
  chemically synthesized
ataaacaacagctttcttac

SEQ ID NO: 382666 - DNA, 20 bp, Artificial Sequence
  chemically synthesized
aaggggaaaaatataaacaa

SEQ ID NO: 382667 - DNA, 20 bp, Artificial Sequence
  chemically synthesized
aatatacaccaaaagacaag

SEQ ID NO: 382668 - DNA, 20 bp, Artificial Sequence
  chemically synthesized
aaatatacaccaaaagacaa

SEQ ID NO: 382669 - DNA, 20 bp, Artificial Sequence
  chemically synthesized
atatttttccccttgtcttt

SEQ ID NO: 382670 - DNA, 20 bp, Artificial Sequence
  chemically synthesized
caaatatacaccaaaagaca

SEQ ID NO: 382671 - DNA, 20 bp, Artificial Sequence
  chemically synthesized
acaaatatacaccaaaagac

SEQ ID NO: 382672 - DNA, 20 bp, Artificial Sequence
  chemically synthesized
aattcacaaatatacaccaa

SEQ ID NO: 382673 - DNA, 20 bp, Artificial Sequence
  chemically synthesized
gtgtatatttgtgaattcaa

SEQ ID NO: 382674 - DNA, 20 bp, Artificial Sequence
  chemically synthesized
cacatatacaaaacagtaag

SEQ ID NO: 382675 - DNA, 20 bp, Artificial Sequence
  chemically synthesized
atccacatatacaaaacagt

SEQ ID NO: 382676 - DNA, 20 bp, Artificial Sequence
  chemically synthesized
acgtatccacatatacaaaa

SEQ ID NO: 382677 - DNA, 20 bp, Artificial Sequence
  chemically synthesized
tgcttactgttttgtatatg

SEQ ID NO: 382678 - DNA, 20 bp, Artificial Sequence
  chemically synthesized
gttttgtatatgtggatacg

SEQ ID NO: 382679 - DNA, 20 bp, Artificial Sequence
  chemically synthesized
ttttgtatatgtggatacgt

SEQ ID NO: 382680 - DNA, 20 bp, Artificial Sequence
  chemically synthesized
ttatcattaacaatgacacc

SEQ ID NO: 382681 - DNA, 20 bp, Artificial Sequence
  chemically synthesized
cattaacaatgacacctagc

SEQ ID NO: 382682 - DNA, 20 bp, Artificial Sequence
  chemically synthesized
aacaatgacacctagcaagt

SEQ ID NO: 382683 - DNA, 20 bp, Artificial Sequence
  chemically synthesized
acttcatcttcttacttgct

SEQ ID NO: 382684 - DNA, 20 bp, Artificial Sequence
  chemically synthesized
gacttcatcttcttacttgc

SEQ ID NO: 382685 - DNA, 20 bp, Artificial Sequence
  chemically synthesized
aatgacacctagcaagtaag

SEQ ID NO: 382686 - DNA, 20 bp, Artificial Sequence
  chemically synthesized
acctagcaagtaagaagatg

SEQ ID NO: 382687 - DNA, 20 bp, Artificial Sequence
  chemically synthesized
agcaagtaagaagatgaagt

SEQ ID NO: 382688 - DNA, 20 bp, Artificial Sequence
  chemically synthesized
agaagatgaagtcagatacc

SEQ ID NO: 382689 - DNA, 20 bp, Artificial Sequence
  chemically synthesized
gaagatgaagtcagatacct

SEQ ID NO: 382690 - DNA, 20 bp, Artificial Sequence
  chemically synthesized
ttgaatgttagattattccc

SEQ ID NO: 382691 - DNA, 20 bp, Artificial Sequence
  chemically synthesized
attgaatgttagattattcc

SEQ ID NO: 382692 - DNA, 20 bp, Artificial Sequence
  chemically synthesized
tgaaggcaaatattgaatgt

SEQ ID NO: 382693 - DNA, 20 bp, Artificial Sequence
  chemically synthesized
taacattcaatatttgcctt

SEQ ID NO: 382694 - DNA, 20 bp, Artificial Sequence
  chemically synthesized
gaaacggattgaaaaactga

SEQ ID NO: 382695 - DNA, 20 bp, Artificial Sequence
  chemically synthesized
tgaaacggattgaaaaactg

SEQ ID NO: 382696 - DNA, 20 bp, Artificial Sequence
  chemically synthesized
agtttttcaatccgtttcat

SEQ ID NO: 382697 - DNA, 20 bp, Artificial Sequence
  chemically synthesized
gtttttcaatccgtttcatc

SEQ ID NO: 382698 - DNA, 20 bp, Artificial Sequence
  chemically synthesized
aagtaggttacctgatgaaa

SEQ ID NO: 382699 - DNA, 20 bp, Artificial Sequence
  chemically synthesized
ttcatcaggtaacctactta

SEQ ID NO: 382700 - DNA, 20 bp, Artificial Sequence
  chemically synthesized
caagttttacatctgtaagt

SEQ ID NO: 382701 - DNA, 20 bp, Artificial Sequence
  chemically synthesized
gcaagttttacatctgtaag

SEQ ID NO: 382702 - DNA, 20 bp, Artificial Sequence
  chemically synthesized
attgcaagttttacatctgt

SEQ ID NO: 382703 - DNA, 20 bp, Artificial Sequence
  chemically synthesized
tttagaagacaaatcattgc

SEQ ID NO: 382704 - DNA, 20 bp, Artificial Sequence
  chemically synthesized
gcaatgatttgtcttctaaa

SEQ ID NO: 382705 - DNA, 20 bp, Artificial Sequence
  chemically synthesized
aataagataatactgtttag

SEQ ID NO: 382706 - DNA, 20 bp, Artificial Sequence
  chemically synthesized
ctgaataagataatactgtt

SEQ ID NO: 382707 - DNA, 20 bp, Artificial Sequence
  chemically synthesized
ctaaacagtattatcttatt

SEQ ID NO: 382708 - DNA, 20 bp, Artificial Sequence
  chemically synthesized
aaacagtattatcttattca

SEQ ID NO: 382709 - DNA, 20 bp, Artificial Sequence
  chemically synthesized
tcaattgctttactctgaat

SEQ ID NO: 382710 - DNA, 20 bp, Artificial Sequence
  chemically synthesized
gtattatcttattcagagta

SEQ ID NO: 382711 - DNA, 20 bp, Artificial Sequence
  chemically synthesized
ttattcagagtaaagcaatt

SEQ ID NO: 382712 - DNA, 20 bp, Artificial Sequence
  chemically synthesized
attcagagtaaagcaattga

SEQ ID NO: 382713 - DNA, 20 bp, Artificial Sequence
  chemically synthesized
taaaaatctcttattttaga

SEQ ID NO: 382714 - DNA, 20 bp, Artificial Sequence
  chemically synthesized
ttgagagttctttctaaaat

SEQ ID NO: 382715 - DNA, 20 bp, Artificial Sequence
  chemically synthesized
gagagttctttctaaaataa

SEQ ID NO: 382716 - DNA, 20 bp, Artificial Sequence
  chemically synthesized
attttaaaaatctcttattt

SEQ ID NO: 382717 - DNA, 20 bp, Artificial Sequence
  chemically synthesized
gagatttttaaaatataatt

SEQ ID NO: 382718 - DNA, 20 bp, Artificial Sequence
  chemically synthesized
cttataggtgaatttgttca

SEQ ID NO: 382719 - DNA, 20 bp, Artificial Sequence
  chemically synthesized
ctttgaacaaattcacctat

SEQ ID NO: 382720 - DNA, 20 bp, Artificial Sequence
  chemically synthesized
tttgaacaaattcacctata

SEQ ID NO: 382721 - DNA, 20 bp, Artificial Sequence
  chemically synthesized
tgaacaaattcacctataag

SEQ ID NO: 382722 - DNA, 20 bp, Artificial Sequence
  chemically synthesized
taactggtacgtctccttat

SEQ ID NO: 382723 - DNA, 20 bp, Artificial Sequence
  chemically synthesized
ataactggtacgtctcctta

SEQ ID NO: 382724 - DNA, 20 bp, Artificial Sequence
  chemically synthesized
tcacctataaggagacgtac

SEQ ID NO: 382725 - DNA, 20 bp, Artificial Sequence
  chemically synthesized
taagttaacagtgttataac

SEQ ID NO: 382726 - DNA, 20 bp, Artificial Sequence
  chemically synthesized
cccaaccccatgtaagttaa

SEQ ID NO: 382727 - DNA, 20 bp, Artificial Sequence
  chemically synthesized
tataacactgttaacttaca

SEQ ID NO: 382728 - DNA, 20 bp, Artificial Sequence
  chemically synthesized
ataacactgttaacttacat

SEQ ID NO: 382729 - DNA, 20 bp, Artificial Sequence
  chemically synthesized
taacactgttaacttacatg

SEQ ID NO: 382730 - DNA, 20 bp, Artificial Sequence
  chemically synthesized
caattaccccaaccccatgt

SEQ ID NO: 382731 - DNA, 20 bp, Artificial Sequence
  chemically synthesized
actgttaacttacatggggt

SEQ ID NO: 382732 - DNA, 20 bp, Artificial Sequence
  chemically synthesized
ctgttaacttacatggggtt

SEQ ID NO: 382733 - DNA, 20 bp, Artificial Sequence
  chemically synthesized
tgttaacttacatggggttg

SEQ ID NO: 382734 - DNA, 20 bp, Artificial Sequence
  chemically synthesized
ttggggtaattgcttacaat

SEQ ID NO: 382735 - DNA, 20 bp, Artificial Sequence
  chemically synthesized
gtctgagaatatctgattgt

SEQ ID NO: 382736 - DNA, 20 bp, Artificial Sequence
  chemically synthesized
tgcttacaatcagatattct

SEQ ID NO: 382737 - DNA, 20 bp, Artificial Sequence
  chemically synthesized
acctaaagtttgtaatgtct

SEQ ID NO: 382738 - DNA, 20 bp, Artificial Sequence
  chemically synthesized
ttctcagacattacaaactt

SEQ ID NO: 382739 - DNA, 20 bp, Artificial Sequence
  chemically synthesized
tctcagacattacaaacttt

SEQ ID NO: 382740 - DNA, 20 bp, Artificial Sequence
  chemically synthesized
acattacaaactttaggttg

SEQ ID NO: 382741 - DNA, 20 bp, Artificial Sequence
  chemically synthesized
gtttgtagtactgcaaccta

SEQ ID NO: 382742 - DNA, 20 bp, Artificial Sequence
  chemically synthesized
gttttcattatatttgtttg

SEQ ID NO: 382743 - DNA, 20 bp, Artificial Sequence
  chemically synthesized
acaaacaaatataatgaaaa

SEQ ID NO: 382744 - DNA, 20 bp, Artificial Sequence
  chemically synthesized
aataaacatttgtttatgca

SEQ ID NO: 382745 - DNA, 20 bp, Artificial Sequence
  chemically synthesized
aattggtgaacaaaagaata

SEQ ID NO: 382746 - DNA, 20 bp, Artificial Sequence
  chemically synthesized
aacaaggaattggtgaacaa

SEQ ID NO: 382747 - DNA, 20 bp, Artificial Sequence
  chemically synthesized
gtttaaacagaacaaggaat

SEQ ID NO: 382748 - DNA, 20 bp, Artificial Sequence
  chemically synthesized
gaatgtgtttaaacagaaca

SEQ ID NO: 382749 - DNA, 20 bp, Artificial Sequence
  chemically synthesized
ggaatgtgtttaaacagaac

SEQ ID NO: 382750 - DNA, 20 bp, Artificial Sequence
  chemically synthesized
gtttttggaatgtgtttaaa

SEQ ID NO: 382751 - DNA, 20 bp, Artificial Sequence
  chemically synthesized
acgttatgggtaaatgtttt

SEQ ID NO: 382752 - DNA, 20 bp, Artificial Sequence
  chemically synthesized
cataccttcctttacgttat

SEQ ID NO: 382753 - DNA, 20 bp, Artificial Sequence
  chemically synthesized
aaacatttacccataacgta

SEQ ID NO: 382754 - DNA, 20 bp, Artificial Sequence
  chemically synthesized
gcataccttcctttacgtta

SEQ ID NO: 382755 - DNA, 20 bp, Artificial Sequence
  chemically synthesized
aacatttacccataacgtaa

SEQ ID NO: 382756 - DNA, 20 bp, Artificial Sequence
  chemically synthesized
atttacccataacgtaaagg

SEQ ID NO: 382757 - DNA, 20 bp, Artificial Sequence
  chemically synthesized
tttacccataacgtaaagga

SEQ ID NO: 382758 - DNA, 20 bp, Artificial Sequence
  chemically synthesized
aacgtaaaggaaggtatgca

SEQ ID NO: 382759 - DNA, 20 bp, Artificial Sequence
  chemically synthesized
atagatataatttcaaacat

SEQ ID NO: 382760 - DNA, 20 bp, Artificial Sequence
  chemically synthesized
taatttcaaacattagtcaa

SEQ ID NO: 382761 - DNA, 20 bp, Artificial Sequence
  chemically synthesized
aaacattagtcaatagcatt

SEQ ID NO: 382762 - DNA, 20 bp, Artificial Sequence
  chemically synthesized
aatagcattcagtgactgaa

SEQ ID NO: 382763 - DNA, 20 bp, Artificial Sequence
  chemically synthesized
tctccatcccgaaatccatt

SEQ ID NO: 382764 - DNA, 20 bp, Artificial Sequence
  chemically synthesized
ttcagtgactgaatggattt

SEQ ID NO: 382765 - DNA, 20 bp, Artificial Sequence
  chemically synthesized
tcagtgactgaatggatttc

SEQ ID NO: 382766 - DNA, 20 bp, Artificial Sequence
  chemically synthesized
tgactgaatggatttcggga

SEQ ID NO: 382767 - DNA, 20 bp, Artificial Sequence
  chemically synthesized
actgaatggatttcgggatg

SEQ ID NO: 382768 - DNA, 20 bp, Artificial Sequence
  chemically synthesized
aatggatttcgggatggaga

SEQ ID NO: 382769 - DNA, 20 bp, Artificial Sequence
  chemically synthesized
atggatttcgggatggagaa

SEQ ID NO: 382770 - DNA, 20 bp, Artificial Sequence
  chemically synthesized
ggagaaaggaatacaaaaat

SEQ ID NO: 382771 - DNA, 20 bp, Artificial Sequence
  chemically synthesized
aatacaaaaataagcgactt

SEQ ID NO: 382772 - DNA, 20 bp, Artificial Sequence
  chemically synthesized
atacaaaaataagcgacttc

SEQ ID NO: 382773 - DNA, 20 bp, Artificial Sequence
  chemically synthesized
tacaaaaataagcgacttca

SEQ ID NO: 382774 - DNA, 20 bp, Artificial Sequence
  chemically synthesized
tcctatatctgaaatccctg

SEQ ID NO: 382775 - DNA, 20 bp, Artificial Sequence
  chemically synthesized
ataagcgacttcagggattt

SEQ ID NO: 382776 - DNA, 20 bp, Artificial Sequence
  chemically synthesized
gacttcagggatttcagata

SEQ ID NO: 382777 - DNA, 20 bp, Artificial Sequence
  chemically synthesized
acttcagggatttcagatat

SEQ ID NO: 382778 - DNA, 20 bp, Artificial Sequence
  chemically synthesized
ttcagggatttcagatatag

SEQ ID NO: 382779 - DNA, 20 bp, Artificial Sequence
  chemically synthesized
ggatttcagatataggagcc

SEQ ID NO: 382780 - DNA, 20 bp, Artificial Sequence
  chemically synthesized
tttcagatataggagcctgg

SEQ ID NO: 382781 - DNA, 20 bp, Artificial Sequence
  chemically synthesized
cagatataggagcctggaag

SEQ ID NO: 382782 - DNA, 20 bp, Artificial Sequence
  chemically synthesized
tattaagcaccactgcttcc

SEQ ID NO: 382783 - DNA, 20 bp, Artificial Sequence
  chemically synthesized
atataggagcctggaagcag

SEQ ID NO: 382784 - DNA, 20 bp, Artificial Sequence
  chemically synthesized
ctattaagcaccactgcttc

SEQ ID NO: 382785 - DNA, 20 bp, Artificial Sequence
  chemically synthesized
ctggaagcagtggtgcttaa

SEQ ID NO: 382786 - DNA, 20 bp, Artificial Sequence
  chemically synthesized
aagcagtggtgcttaataga

SEQ ID NO: 382787 - DNA, 20 bp, Artificial Sequence
  chemically synthesized
agcagtggtgcttaatagaa

SEQ ID NO: 382788 - DNA, 20 bp, Artificial Sequence
  chemically synthesized
gactctttcccctttctatt

SEQ ID NO: 382789 - DNA, 20 bp, Artificial Sequence
  chemically synthesized
gcagtggtgcttaatagaaa

SEQ ID NO: 382790 - DNA, 20 bp, Artificial Sequence
  chemically synthesized
cagtggtgcttaatagaaag

SEQ ID NO: 382791 - DNA, 20 bp, Artificial Sequence
  chemically synthesized
ggtgcttaatagaaagggga

SEQ ID NO: 382792 - DNA, 20 bp, Artificial Sequence
  chemically synthesized
tgcttaatagaaaggggaaa

SEQ ID NO: 382793 - DNA, 20 bp, Artificial Sequence
  chemically synthesized
agaaaggggaaagagtcatg

SEQ ID NO: 382794 - DNA, 20 bp, Artificial Sequence
  chemically synthesized
aaaggggaaagagtcatgaa

SEQ ID NO: 382795 - DNA, 20 bp, Artificial Sequence
  chemically synthesized
gggaaagagtcatgaagagc

SEQ ID NO: 382796 - DNA, 20 bp, Artificial Sequence
  chemically synthesized
tcatgaagagctggtttatg

SEQ ID NO: 382797 - DNA, 20 bp, Artificial Sequence
  chemically synthesized
ttatctactcccacataaac

SEQ ID NO: 382798 - DNA, 20 bp, Artificial Sequence
  chemically synthesized
catgaagagctggtttatgt

SEQ ID NO: 382799 - DNA, 20 bp, Artificial Sequence
  chemically synthesized
tgaagagctggtttatgtgg

SEQ ID NO: 382800 - DNA, 20 bp, Artificial Sequence
  chemically synthesized
agagctggtttatgtgggag

SEQ ID NO: 382801 - DNA, 20 bp, Artificial Sequence
  chemically synthesized
tttatgtgggagtagataat

SEQ ID NO: 382802 - DNA, 20 bp, Artificial Sequence
  chemically synthesized
agtagataatgagttccatt

SEQ ID NO: 382803 - DNA, 20 bp, Artificial Sequence
  chemically synthesized
tcaaaattaaatataccaaa

SEQ ID NO: 382804 - DNA, 20 bp, Artificial Sequence
  chemically synthesized
catttggtatatttaatttt

SEQ ID NO: 382805 - DNA, 20 bp, Artificial Sequence
  chemically synthesized
atatttaattttgagactga

SEQ ID NO: 382806 - DNA, 20 bp, Artificial Sequence
  chemically synthesized
tatttaattttgagactgat

SEQ ID NO: 382807 - DNA, 20 bp, Artificial Sequence
  chemically synthesized
atttaattttgagactgatg

SEQ ID NO: 382808 - DNA, 20 bp, Artificial Sequence
  chemically synthesized
tttaattttgagactgatgg

SEQ ID NO: 382809 - DNA, 20 bp, Artificial Sequence
  chemically synthesized
ttaattttgagactgatggg

SEQ ID NO: 382810 - DNA, 20 bp, Artificial Sequence
  chemically synthesized
ccaattaagtgtccccccat

SEQ ID NO: 382811 - DNA, 20 bp, Artificial Sequence
  chemically synthesized
ctgatggggggacacttaat

SEQ ID NO: 382812 - DNA, 20 bp, Artificial Sequence
  chemically synthesized
gatggggggacacttaattg

SEQ ID NO: 382813 - DNA, 20 bp, Artificial Sequence
  chemically synthesized
cctacagaacgtctccaatt

SEQ ID NO: 382814 - DNA, 20 bp, Artificial Sequence
  chemically synthesized
acttaattggagacgttctg

SEQ ID NO: 382815 - DNA, 20 bp, Artificial Sequence
  chemically synthesized
cttaattggagacgttctgt

SEQ ID NO: 382816 - DNA, 20 bp, Artificial Sequence
  chemically synthesized
tcttaatataattacaccta

SEQ ID NO: 382817 - DNA, 20 bp, Artificial Sequence
  chemically synthesized
tctgtaggtgtaattatatt

SEQ ID NO: 382818 - DNA, 20 bp, Artificial Sequence
  chemically synthesized
gtaggtgtaattatattaag

SEQ ID NO: 382819 - DNA, 20 bp, Artificial Sequence
  chemically synthesized
taggtgtaattatattaaga

SEQ ID NO: 382820 - DNA, 20 bp, Artificial Sequence
  chemically synthesized
aggtgtaattatattaagaa

SEQ ID NO: 382821 - DNA, 20 bp, Artificial Sequence
  chemically synthesized
ggtgtaattatattaagaag

SEQ ID NO: 382822 - DNA, 20 bp, Artificial Sequence
  chemically synthesized
aagaaggggaaaaattcaat

SEQ ID NO: 382823 - DNA, 20 bp, Artificial Sequence
  chemically synthesized
gaaggggaaaaattcaatta

SEQ ID NO: 382824 - DNA, 20 bp, Artificial Sequence
  chemically synthesized
acagctgatataatttggtg

SEQ ID NO: 382825 - DNA, 20 bp, Artificial Sequence
  chemically synthesized
acacagctgatataatttgg

SEQ ID NO: 382826 - DNA, 20 bp, Artificial Sequence
  chemically synthesized
tggacacagctgatataatt

SEQ ID NO: 382827 - DNA, 20 bp, Artificial Sequence
  chemically synthesized
agagctccaccaaattatat

SEQ ID NO: 382828 - DNA, 20 bp, Artificial Sequence
  chemically synthesized
caatcaatatggtttggaca

SEQ ID NO: 382829 - DNA, 20 bp, Artificial Sequence
  chemically synthesized
cacaggcaatcaatatggtt

SEQ ID NO: 382830 - DNA, 20 bp, Artificial Sequence
  chemically synthesized
atacacacaggcaatcaata

SEQ ID NO: 382831 - DNA, 20 bp, Artificial Sequence
  chemically synthesized
atattgattgcctgtgtgta

SEQ ID NO: 382832 - DNA, 20 bp, Artificial Sequence
  chemically synthesized
tgcacaccagctatacacac

SEQ ID NO: 382833 - DNA, 20 bp, Artificial Sequence
  chemically synthesized
ctgcacaccagctatacaca

SEQ ID NO: 382834 - DNA, 20 bp, Artificial Sequence
  chemically synthesized
tgattgcctgtgtgtatagc

SEQ ID NO: 382835 - DNA, 20 bp, Artificial Sequence
  chemically synthesized
ctgtgtgtatagctggtgtg

SEQ ID NO: 382836 - DNA, 20 bp, Artificial Sequence
  chemically synthesized
agctctgctacactgcacac

SEQ ID NO: 382837 - DNA, 20 bp, Artificial Sequence
  chemically synthesized
tgtatagctggtgtgcagtg

SEQ ID NO: 382838 - DNA, 20 bp, Artificial Sequence
  chemically synthesized
atagctggtgtgcagtgtag

SEQ ID NO: 382839 - DNA, 20 bp, Artificial Sequence
  chemically synthesized
agctggtgtgcagtgtagca

SEQ ID NO: 382840 - DNA, 20 bp, Artificial Sequence
  chemically synthesized
gaagggagcttagtagcatt

SEQ ID NO: 382841 - DNA, 20 bp, Artificial Sequence
  chemically synthesized
tagcagagctgaatgctact

SEQ ID NO: 382842 - DNA, 20 bp, Artificial Sequence
  chemically synthesized
tagaacggaagggagcttag

SEQ ID NO: 382843 - DNA, 20 bp, Artificial Sequence
  chemically synthesized
acgtagaacggaagggagct

SEQ ID NO: 382844 - DNA, 20 bp, Artificial Sequence
  chemically synthesized
aaaaaacgtagaacggaagg

SEQ ID NO: 382845 - DNA, 20 bp, Artificial Sequence
  chemically synthesized
tcaaaaaacgtagaacggaa

SEQ ID NO: 382846 - DNA, 20 bp, Artificial Sequence
  chemically synthesized
atcaaaaaacgtagaacgga

SEQ ID NO: 382847 - DNA, 20 bp, Artificial Sequence
  chemically synthesized
aatcaaaaaacgtagaacgg

SEQ ID NO: 382848 - DNA, 20 bp, Artificial Sequence
  chemically synthesized
tcaaatcaaaaaacgtagaa

SEQ ID NO: 382849 - DNA, 20 bp, Artificial Sequence
  chemically synthesized
cttcttcaaatcaaaaaacg

SEQ ID NO: 382850 - DNA, 20 bp, Artificial Sequence
  chemically synthesized
gttctacgttttttgatttg

SEQ ID NO: 382851 - DNA, 20 bp, Artificial Sequence
  chemically synthesized
ctacgttttttgatttgaag

SEQ ID NO: 382852 - DNA, 20 bp, Artificial Sequence
  chemically synthesized
ttttgatttgaagaagaata

SEQ ID NO: 382853 - DNA, 20 bp, Artificial Sequence
  chemically synthesized
ttgatttgaagaagaatatg

SEQ ID NO: 382854 - DNA, 20 bp, Artificial Sequence
  chemically synthesized
tgatttgaagaagaatatgg

SEQ ID NO: 382855 - DNA, 20 bp, Artificial Sequence
  chemically synthesized
gatttgaagaagaatatgga

SEQ ID NO: 382856 - DNA, 20 bp, Artificial Sequence
  chemically synthesized
gaatatggagggtgacatgc

SEQ ID NO: 382857 - DNA, 20 bp, Artificial Sequence
  chemically synthesized
atggagggtgacatgctgga

SEQ ID NO: 382858 - DNA, 20 bp, Artificial Sequence
  chemically synthesized
ggagggtgacatgctggaaa

SEQ ID NO: 382859 - DNA, 20 bp, Artificial Sequence
  chemically synthesized
gagggtgacatgctggaaag

SEQ ID NO: 382860 - DNA, 20 bp, Artificial Sequence
  chemically synthesized
tgctggtcatgtcctctttc

SEQ ID NO: 382861 - DNA, 20 bp, Artificial Sequence
  chemically synthesized
tgctggaaagaggacatgac

SEQ ID NO: 382862 - DNA, 20 bp, Artificial Sequence
  chemically synthesized
tggaaagaggacatgaccag

SEQ ID NO: 382863 - DNA, 20 bp, Artificial Sequence
  chemically synthesized
agagagagagagaaagctgc

SEQ ID NO: 382864 - DNA, 20 bp, Artificial Sequence
  chemically synthesized
gagagagagagagagagaga

SEQ ID NO: 382865 - DNA, 20 bp, Artificial Sequence
  chemically synthesized
cagtgagagagagagagaga

SEQ ID NO: 382866 - DNA, 20 bp, Artificial Sequence
  chemically synthesized
aacagtgagagagagagaga

SEQ ID NO: 382867 - DNA, 20 bp, Artificial Sequence
  chemically synthesized
ggaacagtgagagagagaga

SEQ ID NO: 382868 - DNA, 20 bp, Artificial Sequence
  chemically synthesized
gaggaacagtgagagagaga

SEQ ID NO: 382869 - DNA, 20 bp, Artificial Sequence
  chemically synthesized
cagaggaacagtgagagaga

SEQ ID NO: 382870 - DNA, 20 bp, Artificial Sequence
  chemically synthesized
accagaggaacagtgagaga

SEQ ID NO: 382871 - DNA, 20 bp, Artificial Sequence
  chemically synthesized
aaaccagaggaacagtgaga

SEQ ID NO: 382872 - DNA, 20 bp, Artificial Sequence
  chemically synthesized
agaaaccagaggaacagtga

SEQ ID NO: 382873 - DNA, 20 bp, Artificial Sequence
  chemically synthesized
ggagaaaccagaggaacagt

SEQ ID NO: 382874 - DNA, 20 bp, Artificial Sequence
  chemically synthesized
tctctctctcactgttcctc

SEQ ID NO: 382875 - DNA, 20 bp, Artificial Sequence
  chemically synthesized
caaaggagaaaccagaggaa

SEQ ID NO: 382876 - DNA, 20 bp, Artificial Sequence
  chemically synthesized
ggaaacaaaggagaaaccag

SEQ ID NO: 382877 - DNA, 20 bp, Artificial Sequence
  chemically synthesized
aggaaacaaaggagaaacca

SEQ ID NO: 382878 - DNA, 20 bp, Artificial Sequence
  chemically synthesized
agaggaaacaaaggagaaac

SEQ ID NO: 382879 - DNA, 20 bp, Artificial Sequence
  chemically synthesized
ttgcagtagaggaaacaaag

SEQ ID NO: 382880 - DNA, 20 bp, Artificial Sequence
  chemically synthesized
atttgcagtagaggaaacaa

SEQ ID NO: 382881 - DNA, 20 bp, Artificial Sequence
  chemically synthesized
catttgcagtagaggaaaca

SEQ ID NO: 382882 - DNA, 20 bp, Artificial Sequence
  chemically synthesized
gtattatccatttgcagtag

SEQ ID NO: 382883 - DNA, 20 bp, Artificial Sequence
  chemically synthesized
agtattatccatttgcagta

SEQ ID NO: 382884 - DNA, 20 bp, Artificial Sequence
  chemically synthesized
tttgtttcctctactgcaaa

SEQ ID NO: 382885 - DNA, 20 bp, Artificial Sequence
  chemically synthesized
acagtattatccatttgcag

SEQ ID NO: 382886 - DNA, 20 bp, Artificial Sequence
  chemically synthesized
ggcacagtattatccatttg

SEQ ID NO: 382887 - DNA, 20 bp, Artificial Sequence
  chemically synthesized
ccaattagttgaacatggca

SEQ ID NO: 382888 - DNA, 20 bp, Artificial Sequence
  chemically synthesized
tatggccaattagttgaaca

SEQ ID NO: 382889 - DNA, 20 bp, Artificial Sequence
  chemically synthesized
ctgtgccatgttcaactaat

SEQ ID NO: 382890 - DNA, 20 bp, Artificial Sequence
  chemically synthesized
cctcagtaactatggccaat

SEQ ID NO: 382891 - DNA, 20 bp, Artificial Sequence
  chemically synthesized
catgttcaactaattggcca

SEQ ID NO: 382892 - DNA, 20 bp, Artificial Sequence
  chemically synthesized
tttgatatcctcagtaacta

SEQ ID NO: 382893 - DNA, 20 bp, Artificial Sequence
  chemically synthesized
actaattggccatagttact

SEQ ID NO: 382894 - DNA, 20 bp, Artificial Sequence
  chemically synthesized
ctaattggccatagttactg

SEQ ID NO: 382895 - DNA, 20 bp, Artificial Sequence
  chemically synthesized
ttgatgggttttgatatcct

SEQ ID NO: 382896 - DNA, 20 bp, Artificial Sequence
  chemically synthesized
tgaggatatcaaaacccatc

SEQ ID NO: 382897 - DNA, 20 bp, Artificial Sequence
  chemically synthesized
gaaaagtatctgtgcttgat

SEQ ID NO: 382898 - DNA, 20 bp, Artificial Sequence
  chemically synthesized
atatcaaaacccatcaagca

SEQ ID NO: 382899 - DNA, 20 bp, Artificial Sequence
  chemically synthesized
agaaaagtatctgtgcttga

SEQ ID NO: 382900 - DNA, 20 bp, Artificial Sequence
  chemically synthesized
ataataataatataaaagaa

SEQ ID NO: 382901 - DNA, 20 bp, Artificial Sequence
  chemically synthesized
aaaatataataataatataa

SEQ ID NO: 382902 - DNA, 20 bp, Artificial Sequence
  chemically synthesized
ttatattattattatatttt

SEQ ID NO: 382903 - DNA, 20 bp, Artificial Sequence
  chemically synthesized
tattattatattttaagttc

SEQ ID NO: 382904 - DNA, 20 bp, Artificial Sequence
  chemically synthesized
attattatattttaagttct

SEQ ID NO: 382905 - DNA, 20 bp, Artificial Sequence
  chemically synthesized
cacgttctgcacatgtatcc

SEQ ID NO: 382906 - DNA, 20 bp, Artificial Sequence
  chemically synthesized
taagttctgggatacatgtg

SEQ ID NO: 382907 - DNA, 20 bp, Artificial Sequence
  chemically synthesized
ggatacatgtgcagaacgtg

SEQ ID NO: 382908 - DNA, 20 bp, Artificial Sequence
  chemically synthesized
gatacatgtgcagaacgtgc

SEQ ID NO: 382909 - DNA, 20 bp, Artificial Sequence
  chemically synthesized
gaacgtgcaggtttgttaca

SEQ ID NO: 382910 - DNA, 20 bp, Artificial Sequence
  chemically synthesized
aacgtgcaggtttgttacat

SEQ ID NO: 382911 - DNA, 20 bp, Artificial Sequence
  chemically synthesized
acataggtatgcacgtgcta

SEQ ID NO: 382912 - DNA, 20 bp, Artificial Sequence
  chemically synthesized
taggtatgcacgtgctatgg

SEQ ID NO: 382913 - DNA, 20 bp, Artificial Sequence
  chemically synthesized
atgggtgcagcagtccacca

SEQ ID NO: 382914 - DNA, 20 bp, Artificial Sequence
  chemically synthesized
tgacgggttgatgggtgcag

SEQ ID NO: 382915 - DNA, 20 bp, Artificial Sequence
  chemically synthesized
agatgacgggttgatgggtg

SEQ ID NO: 382916 - DNA, 20 bp, Artificial Sequence
  chemically synthesized
aatgtagatgacgggttgat

SEQ ID NO: 382917 - DNA, 20 bp, Artificial Sequence
  chemically synthesized
taatgtagatgacgggttga

SEQ ID NO: 382918 - DNA, 20 bp, Artificial Sequence
  chemically synthesized
aaatacctaatgtagatgac

SEQ ID NO: 382919 - DNA, 20 bp, Artificial Sequence
  chemically synthesized
gaaatacctaatgtagatga

SEQ ID NO: 382920 - DNA, 20 bp, Artificial Sequence
  chemically synthesized
catcaacccgtcatctacat

SEQ ID NO: 382921 - DNA, 20 bp, Artificial Sequence
  chemically synthesized
atcaacccgtcatctacatt

SEQ ID NO: 382922 - DNA, 20 bp, Artificial Sequence
  chemically synthesized
attaggagaaatacctaatg

SEQ ID NO: 382923 - DNA, 20 bp, Artificial Sequence
  chemically synthesized
aaagggagggatagcattag

SEQ ID NO: 382924 - DNA, 20 bp, Artificial Sequence
  chemically synthesized
gcaaagggagggatagcatt

SEQ ID NO: 382925 - DNA, 20 bp, Artificial Sequence
  chemically synthesized
ggcaaagggagggatagcat

SEQ ID NO: 382926 - DNA, 20 bp, Artificial Sequence
  chemically synthesized
gtggggggcaaagggaggga

SEQ ID NO: 382927 - DNA, 20 bp, Artificial Sequence
  chemically synthesized
gggggtggggggcaaaggga

SEQ ID NO: 382928 - DNA, 20 bp, Artificial Sequence
  chemically synthesized
agggggtggggggcaaaggg

SEQ ID NO: 382929 - DNA, 20 bp, Artificial Sequence
  chemically synthesized
cagggggtggggggcaaagg

SEQ ID NO: 382930 - DNA, 20 bp, Artificial Sequence
  chemically synthesized
gtcagggggtggggggcaaa

SEQ ID NO: 382931 - DNA, 20 bp, Artificial Sequence
  chemically synthesized
tgtcagggggtggggggcaa

SEQ ID NO: 382932 - DNA, 20 bp, Artificial Sequence
  chemically synthesized
ctgtcagggggtggggggca

SEQ ID NO: 382933 - DNA, 20 bp, Artificial Sequence
  chemically synthesized
tgggcctgtcagggggtggg

SEQ ID NO: 382934 - DNA, 20 bp, Artificial Sequence
  chemically synthesized
ctgggcctgtcagggggtgg

SEQ ID NO: 382935 - DNA, 20 bp, Artificial Sequence
  chemically synthesized
cctgggcctgtcagggggtg

SEQ ID NO: 382936 - DNA, 20 bp, Artificial Sequence
  chemically synthesized
acctgggcctgtcagggggt

SEQ ID NO: 382937 - DNA, 20 bp, Artificial Sequence
  chemically synthesized
cacctgggcctgtcaggggg

SEQ ID NO: 382938 - DNA, 20 bp, Artificial Sequence
  chemically synthesized
ctttgccccccaccccctga

SEQ ID NO: 382939 - DNA, 20 bp, Artificial Sequence
  chemically synthesized
tttgccccccaccccctgac

SEQ ID NO: 382940 - DNA, 20 bp, Artificial Sequence
  chemically synthesized
acacacctgggcctgtcagg

SEQ ID NO: 382941 - DNA, 20 bp, Artificial Sequence
  chemically synthesized
cacacacctgggcctgtcag

SEQ ID NO: 382942 - DNA, 20 bp, Artificial Sequence
  chemically synthesized
tcacacacctgggcctgtca

SEQ ID NO: 382943 - DNA, 20 bp, Artificial Sequence
  chemically synthesized
atcacacacctgggcctgtc

SEQ ID NO: 382944 - DNA, 20 bp, Artificial Sequence
  chemically synthesized
cccccaccccctgacaggcc

SEQ ID NO: 382945 - DNA, 20 bp, Artificial Sequence
  chemically synthesized
catcacacacctgggcctgt

SEQ ID NO: 382946 - DNA, 20 bp, Artificial Sequence
  chemically synthesized
ccccaccccctgacaggccc

SEQ ID NO: 382947 - DNA, 20 bp, Artificial Sequence
  chemically synthesized
gaagggaacatcacacacct

SEQ ID NO: 382948 - DNA, 20 bp, Artificial Sequence
  chemically synthesized
ggaagggaacatcacacacc

SEQ ID NO: 382949 - DNA, 20 bp, Artificial Sequence
  chemically synthesized
gaacacatggacacagggaa

SEQ ID NO: 382950 - DNA, 20 bp, Artificial Sequence
  chemically synthesized
agaacacatggacacaggga

SEQ ID NO: 382951 - DNA, 20 bp, Artificial Sequence
  chemically synthesized
aagaacacatggacacaggg

SEQ ID NO: 382952 - DNA, 20 bp, Artificial Sequence
  chemically synthesized
aacaagaacacatggacaca

SEQ ID NO: 382953 - DNA, 20 bp, Artificial Sequence
  chemically synthesized
caacaagaacacatggacac

SEQ ID NO: 382954 - DNA, 20 bp, Artificial Sequence
  chemically synthesized
acaacaagaacacatggaca

SEQ ID NO: 382955 - DNA, 20 bp, Artificial Sequence
  chemically synthesized
agttgaacaacaagaacaca

SEQ ID NO: 382956 - DNA, 20 bp, Artificial Sequence
  chemically synthesized
ataagtgggagttgaacaac

SEQ ID NO: 382957 - DNA, 20 bp, Artificial Sequence
  chemically synthesized
atgttctgtcttataagtgg

SEQ ID NO: 382958 - DNA, 20 bp, Artificial Sequence
  chemically synthesized
gttgttcaactcccacttat

SEQ ID NO: 382959 - DNA, 20 bp, Artificial Sequence
  chemically synthesized
acatgttctgtcttataagt

SEQ ID NO: 382960 - DNA, 20 bp, Artificial Sequence
  chemically synthesized
cacatgttctgtcttataag

SEQ ID NO: 382961 - DNA, 20 bp, Artificial Sequence
  chemically synthesized
ttcaactcccacttataaga

SEQ ID NO: 382962 - DNA, 20 bp, Artificial Sequence
  chemically synthesized
taccacatgttctgtcttat

SEQ ID NO: 382963 - DNA, 20 bp, Artificial Sequence
  chemically synthesized
cacttataagacagaacatg

SEQ ID NO: 382964 - DNA, 20 bp, Artificial Sequence
  chemically synthesized
aagacagaacatgtggtatt

SEQ ID NO: 382965 - DNA, 20 bp, Artificial Sequence
  chemically synthesized
tcagcaaactaaaacaggaa

SEQ ID NO: 382966 - DNA, 20 bp, Artificial Sequence
  chemically synthesized
ttggttttctgttcctgttt

SEQ ID NO: 382967 - DNA, 20 bp, Artificial Sequence
  chemically synthesized
cattctcagcaaactaaaac

SEQ ID NO: 382968 - DNA, 20 bp, Artificial Sequence
  chemically synthesized
tcattctcagcaaactaaaa

SEQ ID NO: 382969 - DNA, 20 bp, Artificial Sequence
  chemically synthesized
tgttcctgttttagtttgct

SEQ ID NO: 382970 - DNA, 20 bp, Artificial Sequence
  chemically synthesized
ttttagtttgctgagaatga

SEQ ID NO: 382971 - DNA, 20 bp, Artificial Sequence
  chemically synthesized
aagctggaaaccatcattct

SEQ ID NO: 382972 - DNA, 20 bp, Artificial Sequence
  chemically synthesized
ttgctgagaatgatggtttc

SEQ ID NO: 382973 - DNA, 20 bp, Artificial Sequence
  chemically synthesized
tgcagggacatggatgaagc

SEQ ID NO: 382974 - DNA, 20 bp, Artificial Sequence
  chemically synthesized
cctttgcagggacatggatg

SEQ ID NO: 382975 - DNA, 20 bp, Artificial Sequence
  chemically synthesized
ttatgtcctttgcagggaca

SEQ ID NO: 382976 - DNA, 20 bp, Artificial Sequence
  chemically synthesized
gcttcatccatgtccctgca

SEQ ID NO: 382977 - DNA, 20 bp, Artificial Sequence
  chemically synthesized
cttcatccatgtccctgcaa

SEQ ID NO: 382978 - DNA, 20 bp, Artificial Sequence
  chemically synthesized
atgagtttatgtcctttgca

SEQ ID NO: 382979 - DNA, 20 bp, Artificial Sequence
  chemically synthesized
tatgagtttatgtcctttgc

SEQ ID NO: 382980 - DNA, 20 bp, Artificial Sequence
  chemically synthesized
ttatgagtttatgtcctttg

SEQ ID NO: 382981 - DNA, 20 bp, Artificial Sequence
  chemically synthesized
gtgcagccataaaaaattat

SEQ ID NO: 382982 - DNA, 20 bp, Artificial Sequence
  chemically synthesized
cataaactcataatttttta

SEQ ID NO: 382983 - DNA, 20 bp, Artificial Sequence
  chemically synthesized
cataattttttatggctgca

SEQ ID NO: 382984 - DNA, 20 bp, Artificial Sequence
  chemically synthesized
atacaccatggaatactgtg

SEQ ID NO: 382985 - DNA, 20 bp, Artificial Sequence
  chemically synthesized
tatggctgcacagtattcca

SEQ ID NO: 382986 - DNA, 20 bp, Artificial Sequence
  chemically synthesized
aatgtggcacatatacacca

SEQ ID NO: 382987 - DNA, 20 bp, Artificial Sequence
  chemically synthesized
tagactggataaagaaaatg

SEQ ID NO: 382988 - DNA, 20 bp, Artificial Sequence
  chemically synthesized
tgtgccacattttctttatc

SEQ ID NO: 382989 - DNA, 20 bp, Artificial Sequence
  chemically synthesized
catcaaagatagactggata

SEQ ID NO: 382990 - DNA, 20 bp, Artificial Sequence
  chemically synthesized
aatgcccatcaaagatagac

SEQ ID NO: 382991 - DNA, 20 bp, Artificial Sequence
  chemically synthesized
tttatccagtctatctttga

SEQ ID NO: 382992 - DNA, 20 bp, Artificial Sequence
  chemically synthesized
gttgaaatgcccatcaaaga

SEQ ID NO: 382993 - DNA, 20 bp, Artificial Sequence
  chemically synthesized
ttatccagtctatctttgat

SEQ ID NO: 382994 - DNA, 20 bp, Artificial Sequence
  chemically synthesized
gtaagttgaaatgcccatca

SEQ ID NO: 382995 - DNA, 20 bp, Artificial Sequence
  chemically synthesized
gggcatttcaacttacaatg

SEQ ID NO: 382996 - DNA, 20 bp, Artificial Sequence
  chemically synthesized
tcagcatgtaacttcattgt

SEQ ID NO: 382997 - DNA, 20 bp, Artificial Sequence
  chemically synthesized
ccaaactatgatgggtatat

SEQ ID NO: 382998 - DNA, 20 bp, Artificial Sequence
  chemically synthesized
acatgctgatatacccatca

SEQ ID NO: 382999 - DNA, 20 bp, Artificial Sequence
  chemically synthesized
caaaatttccaaactatgat

SEQ ID NO: 383000 - DNA, 20 bp, Artificial Sequence
  chemically synthesized
tcaaaatttccaaactatga

SEQ ID NO: 383001 - DNA, 20 bp, Artificial Sequence
  chemically synthesized
ctgatatacccatcatagtt

SEQ ID NO: 383002 - DNA, 20 bp, Artificial Sequence
  chemically synthesized
ggtgtatcaaatgcattttc

SEQ ID NO: 383003 - DNA, 20 bp, Artificial Sequence
  chemically synthesized
aatgcatttgatacacctaa

SEQ ID NO: 383004 - DNA, 20 bp, Artificial Sequence
  chemically synthesized
cctatgatgtacagtctgtt

SEQ ID NO: 383005 - DNA, 20 bp, Artificial Sequence
  chemically synthesized
acctatgatgtacagtctgt

SEQ ID NO: 383006 - DNA, 20 bp, Artificial Sequence
  chemically synthesized
acctaacagactgtacatca

SEQ ID NO: 383007 - DNA, 20 bp, Artificial Sequence
  chemically synthesized
ctaggctaacctatgatgta

SEQ ID NO: 383008 - DNA, 20 bp, Artificial Sequence
  chemically synthesized
cctaacagactgtacatcat

SEQ ID NO: 383009 - DNA, 20 bp, Artificial Sequence
  chemically synthesized
acagactgtacatcataggt

SEQ ID NO: 383010 - DNA, 20 bp, Artificial Sequence
  chemically synthesized
ctgtacatcataggttagcc

SEQ ID NO: 383011 - DNA, 20 bp, Artificial Sequence
  chemically synthesized
aagcatgtttaagataggct

SEQ ID NO: 383012 - DNA, 20 bp, Artificial Sequence
  chemically synthesized
taagcatgtttaagataggc

SEQ ID NO: 383013 - DNA, 20 bp, Artificial Sequence
  chemically synthesized
gttctaagcatgtttaagat

SEQ ID NO: 383014 - DNA, 20 bp, Artificial Sequence
  chemically synthesized
tgttctaagcatgtttaaga

SEQ ID NO: 383015 - DNA, 20 bp, Artificial Sequence
  chemically synthesized
taagtgttctaagcatgttt

SEQ ID NO: 383016 - DNA, 20 bp, Artificial Sequence
  chemically synthesized
tagcctatcttaaacatgct

SEQ ID NO: 383017 - DNA, 20 bp, Artificial Sequence
  chemically synthesized
taggctaacgtaagtgttct

SEQ ID NO: 383018 - DNA, 20 bp, Artificial Sequence
  chemically synthesized
catgcttagaacacttacgt

SEQ ID NO: 383019 - DNA, 20 bp, Artificial Sequence
  chemically synthesized
tcccaactgtaggctaacgt

SEQ ID NO: 383020 - DNA, 20 bp, Artificial Sequence
  chemically synthesized
agaacacttacgttagccta

SEQ ID NO: 383021 - DNA, 20 bp, Artificial Sequence
  chemically synthesized
cacttacgttagcctacagt

SEQ ID NO: 383022 - DNA, 20 bp, Artificial Sequence
  chemically synthesized
acttacgttagcctacagtt

SEQ ID NO: 383023 - DNA, 20 bp, Artificial Sequence
  chemically synthesized
atgatttttttcccaactgt

SEQ ID NO: 383024 - DNA, 20 bp, Artificial Sequence
  chemically synthesized
tatgatttttttcccaactg

SEQ ID NO: 383025 - DNA, 20 bp, Artificial Sequence
  chemically synthesized
gaaaaaaatcataaaacaca

SEQ ID NO: 383026 - DNA, 20 bp, Artificial Sequence
  chemically synthesized
tcaacattttattataaaat

SEQ ID NO: 383027 - DNA, 20 bp, Artificial Sequence
  chemically synthesized
ttcaacattttattataaaa

SEQ ID NO: 383028 - DNA, 20 bp, Artificial Sequence
  chemically synthesized
tttattaaatactatactga

SEQ ID NO: 383029 - DNA, 20 bp, Artificial Sequence
  chemically synthesized
tctggttttgactttcagta

SEQ ID NO: 383030 - DNA, 20 bp, Artificial Sequence
  chemically synthesized
actattctggttttgacttt

SEQ ID NO: 383031 - DNA, 20 bp, Artificial Sequence
  chemically synthesized
actatactgaaagtcaaaac

SEQ ID NO: 383032 - DNA, 20 bp, Artificial Sequence
  chemically synthesized
actgaaagtcaaaaccagaa

SEQ ID NO: 383033 - DNA, 20 bp, Artificial Sequence
  chemically synthesized
gaggacctatacaactattc

SEQ ID NO: 383034 - DNA, 20 bp, Artificial Sequence
  chemically synthesized
tcaaaaccagaatagttgta

SEQ ID NO: 383035 - DNA, 20 bp, Artificial Sequence
  chemically synthesized
caaaaccagaatagttgtat

SEQ ID NO: 383036 - DNA, 20 bp, Artificial Sequence
  chemically synthesized
aatagttgtataggtcctca

SEQ ID NO: 383037 - DNA, 20 bp, Artificial Sequence
  chemically synthesized
ttgtataggtcctcaaagta

SEQ ID NO: 383038 - DNA, 20 bp, Artificial Sequence
  chemically synthesized
gctgtggaaaccatactttg

SEQ ID NO: 383039 - DNA, 20 bp, Artificial Sequence
  chemically synthesized
tgctgtggaaaccatacttt

SEQ ID NO: 383040 - DNA, 20 bp, Artificial Sequence
  chemically synthesized
tcctcaaagtatggtttcca

SEQ ID NO: 383041 - DNA, 20 bp, Artificial Sequence
  chemically synthesized
aagtatggtttccacagcat

SEQ ID NO: 383042 - DNA, 20 bp, Artificial Sequence
  chemically synthesized
cgaaagtgatactcatgctg

SEQ ID NO: 383043 - DNA, 20 bp, Artificial Sequence
  chemically synthesized
tcgactttaggatggtgcga

SEQ ID NO: 383044 - DNA, 20 bp, Artificial Sequence
  chemically synthesized
atcactttcgcaccatccta

SEQ ID NO: 383045 - DNA, 20 bp, Artificial Sequence
  chemically synthesized
acaatttttcgactttagga

SEQ ID NO: 383046 - DNA, 20 bp, Artificial Sequence
  chemically synthesized
cttaacaatttttcgacttt

SEQ ID NO: 383047 - DNA, 20 bp, Artificial Sequence
  chemically synthesized
acttaacaatttttcgactt

SEQ ID NO: 383048 - DNA, 20 bp, Artificial Sequence
  chemically synthesized
cctaaagtcgaaaaattgtt

SEQ ID NO: 383049 - DNA, 20 bp, Artificial Sequence
  chemically synthesized
agatggtccccgacatacag

SEQ ID NO: 383050 - DNA, 20 bp, Artificial Sequence
  chemically synthesized
taagttgaactactgtatgt

SEQ ID NO: 383051 - DNA, 20 bp, Artificial Sequence
  chemically synthesized
aagttgaactactgtatgtc

SEQ ID NO: 383052 - DNA, 20 bp, Artificial Sequence
  chemically synthesized
agttgaactactgtatgtcg

SEQ ID NO: 383053 - DNA, 20 bp, Artificial Sequence
  chemically synthesized
cagagatggtccccgacata

SEQ ID NO: 383054 - DNA, 20 bp, Artificial Sequence
  chemically synthesized
actactttcaagtacagaga

SEQ ID NO: 383055 - DNA, 20 bp, Artificial Sequence
  chemically synthesized
tctgactactttcaagtaca

SEQ ID NO: 383056 - DNA, 20 bp, Artificial Sequence
  chemically synthesized
gggaccatctctgtacttga

SEQ ID NO: 383057 - DNA, 20 bp, Artificial Sequence
  chemically synthesized
tttctgactactttcaagta

SEQ ID NO: 383058 - DNA, 20 bp, Artificial Sequence
  chemically synthesized
accatctctgtacttgaaag

SEQ ID NO: 383059 - DNA, 20 bp, Artificial Sequence
  chemically synthesized
ttggttttctgactactttc

SEQ ID NO: 383060 - DNA, 20 bp, Artificial Sequence
  chemically synthesized
tctctgtacttgaaagtagt

SEQ ID NO: 383061 - DNA, 20 bp, Artificial Sequence
  chemically synthesized
aagtagtcagaaaaccaaaa

SEQ ID NO: 383062 - DNA, 20 bp, Artificial Sequence
  chemically synthesized
atatatttttattacttttt

SEQ ID NO: 383063 - DNA, 20 bp, Artificial Sequence
  chemically synthesized
agtaataaaaatatatgata

SEQ ID NO: 383064 - DNA, 20 bp, Artificial Sequence
  chemically synthesized
ggtattattattattattat

SEQ ID NO: 383065 - DNA, 20 bp, Artificial Sequence
  chemically synthesized
gtattattattattattatt

SEQ ID NO: 383066 - DNA, 20 bp, Artificial Sequence
  chemically synthesized
attattattattattaggtc

SEQ ID NO: 383067 - DNA, 20 bp, Artificial Sequence
  chemically synthesized
tctttctctaagtagaatac

SEQ ID NO: 383068 - DNA, 20 bp, Artificial Sequence
  chemically synthesized
attaggtctagtattctact

SEQ ID NO: 383069 - DNA, 20 bp, Artificial Sequence
  chemically synthesized
taggtctagtattctactta

SEQ ID NO: 383070 - DNA, 20 bp, Artificial Sequence
  chemically synthesized
gaagttcctctttctctaag

SEQ ID NO: 383071 - DNA, 20 bp, Artificial Sequence
  chemically synthesized
tctagtattctacttagaga

SEQ ID NO: 383072 - DNA, 20 bp, Artificial Sequence
  chemically synthesized
tagtattctacttagagaaa

SEQ ID NO: 383073 - DNA, 20 bp, Artificial Sequence
  chemically synthesized
gtggaagttcctctttctct

SEQ ID NO: 383074 - DNA, 20 bp, Artificial Sequence
  chemically synthesized
agtattctacttagagaaag

SEQ ID NO: 383075 - DNA, 20 bp, Artificial Sequence
  chemically synthesized
gagaaagaggaacttccact

SEQ ID NO: 383076 - DNA, 20 bp, Artificial Sequence
  chemically synthesized
ttaatccagatacttagtgg

SEQ ID NO: 383077 - DNA, 20 bp, Artificial Sequence
  chemically synthesized
cttttaatccagatacttag

SEQ ID NO: 383078 - DNA, 20 bp, Artificial Sequence
  chemically synthesized
aggaacttccactaagtatc

SEQ ID NO: 383079 - DNA, 20 bp, Artificial Sequence
  chemically synthesized
cttcttttaatccagatact

SEQ ID NO: 383080 - DNA, 20 bp, Artificial Sequence
  chemically synthesized
ccactaagtatctggattaa

SEQ ID NO: 383081 - DNA, 20 bp, Artificial Sequence
  chemically synthesized
aacaaaagcttcttttaatc

SEQ ID NO: 383082 - DNA, 20 bp, Artificial Sequence
  chemically synthesized
ctaagtatctggattaaaag

SEQ ID NO: 383083 - DNA, 20 bp, Artificial Sequence
  chemically synthesized
tttagttgtataaataacaa

SEQ ID NO: 383084 - DNA, 20 bp, Artificial Sequence
  chemically synthesized
aaataatttctacaacgttt

SEQ ID NO: 383085 - DNA, 20 bp, Artificial Sequence
  chemically synthesized
tttatacaactaaaacgttg

SEQ ID NO: 383086 - DNA, 20 bp, Artificial Sequence
  chemically synthesized
taaaagcgtcttgattagtt

SEQ ID NO: 383087 - DNA, 20 bp, Artificial Sequence
  chemically synthesized
aaattatttcccaactaatc

SEQ ID NO: 383088 - DNA, 20 bp, Artificial Sequence
  chemically synthesized
ttaaaagcgtcttgattagt

SEQ ID NO: 383089 - DNA, 20 bp, Artificial Sequence
  chemically synthesized
gcatttaaaagcgtcttgat

SEQ ID NO: 383090 - DNA, 20 bp, Artificial Sequence
  chemically synthesized
tagattgtgaaggcatttaa

SEQ ID NO: 383091 - DNA, 20 bp, Artificial Sequence
  chemically synthesized
aggttatgattagattgtga

SEQ ID NO: 383092 - DNA, 20 bp, Artificial Sequence
  chemically synthesized
caggttatgattagattgtg

SEQ ID NO: 383093 - DNA, 20 bp, Artificial Sequence
  chemically synthesized
ctagaaaagcaggttatgat

SEQ ID NO: 383094 - DNA, 20 bp, Artificial Sequence
  chemically synthesized
ctaatcataacctgcttttc

SEQ ID NO: 383095 - DNA, 20 bp, Artificial Sequence
  chemically synthesized
aaaaatagggctagaaaagc

SEQ ID NO: 383096 - DNA, 20 bp, Artificial Sequence
  chemically synthesized
caaaaatagggctagaaaag

SEQ ID NO: 383097 - DNA, 20 bp, Artificial Sequence
  chemically synthesized
taccaaaaatagggctagaa

SEQ ID NO: 383098 - DNA, 20 bp, Artificial Sequence
  chemically synthesized
tgaaataccaaaaatagggc

SEQ ID NO: 383099 - DNA, 20 bp, Artificial Sequence
  chemically synthesized
tgcttttctagccctatttt

SEQ ID NO: 383100 - DNA, 20 bp, Artificial Sequence
  chemically synthesized
tgggtgaaataccaaaaata

SEQ ID NO: 383101 - DNA, 20 bp, Artificial Sequence
  chemically synthesized
ttgggtgaaataccaaaaat

SEQ ID NO: 383102 - DNA, 20 bp, Artificial Sequence
  chemically synthesized
cttgggtgaaataccaaaaa

SEQ ID NO: 383103 - DNA, 20 bp, Artificial Sequence
  chemically synthesized
ctatttttggtatttcaccc

SEQ ID NO: 383104 - DNA, 20 bp, Artificial Sequence
  chemically synthesized
ttctgaaatcttgaatgctt

SEQ ID NO: 383105 - DNA, 20 bp, Artificial Sequence
  chemically synthesized
ggtatttcacccaagcattc

SEQ ID NO: 383106 - DNA, 20 bp, Artificial Sequence
  chemically synthesized
tttctgaaatcttgaatgct

SEQ ID NO: 383107 - DNA, 20 bp, Artificial Sequence
  chemically synthesized
cacccaagcattcaagattt

SEQ ID NO: 383108 - DNA, 20 bp, Artificial Sequence
  chemically synthesized
ttcaagatttcagaaacata

SEQ ID NO: 383109 - DNA, 20 bp, Artificial Sequence
  chemically synthesized
tatctgggaaggacaatggg

SEQ ID NO: 383110 - DNA, 20 bp, Artificial Sequence
  chemically synthesized
tagtatctgggaaggacaat

SEQ ID NO: 383111 - DNA, 20 bp, Artificial Sequence
  chemically synthesized
atagtatctgggaaggacaa

SEQ ID NO: 383112 - DNA, 20 bp, Artificial Sequence
  chemically synthesized
tagctacccattgtccttcc

SEQ ID NO: 383113 - DNA, 20 bp, Artificial Sequence
  chemically synthesized
taatttcatagtatctggga

SEQ ID NO: 383114 - DNA, 20 bp, Artificial Sequence
  chemically synthesized
gtaatttcatagtatctggg

SEQ ID NO: 383115 - DNA, 20 bp, Artificial Sequence
  chemically synthesized
aatgtaatttcatagtatct

SEQ ID NO: 383116 - DNA, 20 bp, Artificial Sequence
  chemically synthesized
gaatgtaatttcatagtatc

SEQ ID NO: 383117 - DNA, 20 bp, Artificial Sequence
  chemically synthesized
cttaaaggaatgtaatttca

SEQ ID NO: 383118 - DNA, 20 bp, Artificial Sequence
  chemically synthesized
ctatgaaattacattccttt

SEQ ID NO: 383119 - DNA, 20 bp, Artificial Sequence
  chemically synthesized
caacatgtacaaaagcttaa

SEQ ID NO: 383120 - DNA, 20 bp, Artificial Sequence
  chemically synthesized
ccaacatgtacaaaagctta

SEQ ID NO: 383121 - DNA, 20 bp, Artificial Sequence
  chemically synthesized
ggagggaccaacatgtacaa

SEQ ID NO: 383122 - DNA, 20 bp, Artificial Sequence
  chemically synthesized
ctttaagcttttgtacatgt

SEQ ID NO: 383123 - DNA, 20 bp, Artificial Sequence
  chemically synthesized
acatgttggtccctccctcc

SEQ ID NO: 383124 - DNA, 20 bp, Artificial Sequence
  chemically synthesized
gggttgcattccaggaggga

SEQ ID NO: 383125 - DNA, 20 bp, Artificial Sequence
  chemically synthesized
ggggttgcattccaggaggg

SEQ ID NO: 383126 - DNA, 20 bp, Artificial Sequence
  chemically synthesized
aggggttgcattccaggagg

SEQ ID NO: 383127 - DNA, 20 bp, Artificial Sequence
  chemically synthesized
gtaggggttgcattccagga

SEQ ID NO: 383128 - DNA, 20 bp, Artificial Sequence
  chemically synthesized
agtaggggttgcattccagg

SEQ ID NO: 383129 - DNA, 20 bp, Artificial Sequence
  chemically synthesized
gagtaggggttgcattccag

SEQ ID NO: 383130 - DNA, 20 bp, Artificial Sequence
  chemically synthesized
aggagtaggggttgcattcc

SEQ ID NO: 383131 - DNA, 20 bp, Artificial Sequence
  chemically synthesized
gaggagtaggggttgcattc

SEQ ID NO: 383132 - DNA, 20 bp, Artificial Sequence
  chemically synthesized
ttggggttatggaggagtag

SEQ ID NO: 383133 - DNA, 20 bp, Artificial Sequence
  chemically synthesized
attggggttatggaggagta

SEQ ID NO: 383134 - DNA, 20 bp, Artificial Sequence
  chemically synthesized
aattggggttatggaggagt

SEQ ID NO: 383135 - DNA, 20 bp, Artificial Sequence
  chemically synthesized
gaattggggttatggaggag

SEQ ID NO: 383136 - DNA, 20 bp, Artificial Sequence
  chemically synthesized
gaagaattggggttatggag

SEQ ID NO: 383137 - DNA, 20 bp, Artificial Sequence
  chemically synthesized
atgaagaattggggttatgg

SEQ ID NO: 383138 - DNA, 20 bp, Artificial Sequence
  chemically synthesized
aatgaagaattggggttatg

SEQ ID NO: 383139 - DNA, 20 bp, Artificial Sequence
  chemically synthesized
caaatgaagaattggggtta

SEQ ID NO: 383140 - DNA, 20 bp, Artificial Sequence
  chemically synthesized
atttatcaaatgaagaattg

SEQ ID NO: 383141 - DNA, 20 bp, Artificial Sequence
  chemically synthesized
gatttatcaaatgaagaatt

SEQ ID NO: 383142 - DNA, 20 bp, Artificial Sequence
  chemically synthesized
agatttatcaaatgaagaat

SEQ ID NO: 383143 - DNA, 20 bp, Artificial Sequence
  chemically synthesized
atgtaaagatttatcaaatg

SEQ ID NO: 383144 - DNA, 20 bp, Artificial Sequence
  chemically synthesized
gataaatctcaaagcatgta

SEQ ID NO: 383145 - DNA, 20 bp, Artificial Sequence
  chemically synthesized
gataaatctttacatgcttt

SEQ ID NO: 383146 - DNA, 20 bp, Artificial Sequence
  chemically synthesized
aatatttgagataaatctca

SEQ ID NO: 383147 - DNA, 20 bp, Artificial Sequence
  chemically synthesized
ggaggaatggggtaatattt

SEQ ID NO: 383148 - DNA, 20 bp, Artificial Sequence
  chemically synthesized
tgcttagggtaggaggaatg

SEQ ID NO: 383149 - DNA, 20 bp, Artificial Sequence
  chemically synthesized
ttgcttagggtaggaggaat

SEQ ID NO: 383150 - DNA, 20 bp, Artificial Sequence
  chemically synthesized
tttgcttagggtaggaggaa

SEQ ID NO: 383151 - DNA, 20 bp, Artificial Sequence
  chemically synthesized
atggttttgcttagggtagg

SEQ ID NO: 383152 - DNA, 20 bp, Artificial Sequence
  chemically synthesized
taccccattcctcctaccct

SEQ ID NO: 383153 - DNA, 20 bp, Artificial Sequence
  chemically synthesized
aatggttttgcttagggtag

SEQ ID NO: 383154 - DNA, 20 bp, Artificial Sequence
  chemically synthesized
tgaatggttttgcttagggt

SEQ ID NO: 383155 - DNA, 20 bp, Artificial Sequence
  chemically synthesized
atgaatggttttgcttaggg

SEQ ID NO: 383156 - DNA, 20 bp, Artificial Sequence
  chemically synthesized
gaaatgaatggttttgctta

SEQ ID NO: 383157 - DNA, 20 bp, Artificial Sequence
  chemically synthesized
agaaatgaatggttttgctt

SEQ ID NO: 383158 - DNA, 20 bp, Artificial Sequence
  chemically synthesized
aagaaatgaatggttttgct

SEQ ID NO: 383159 - DNA, 20 bp, Artificial Sequence
  chemically synthesized
tataatgcaaaagaaatgaa

SEQ ID NO: 383160 - DNA, 20 bp, Artificial Sequence
  chemically synthesized
agtaaatatatataatgcaa

SEQ ID NO: 383161 - DNA, 20 bp, Artificial Sequence
  chemically synthesized
gtagcattttgtgtatgcaa

SEQ ID NO: 383162 - DNA, 20 bp, Artificial Sequence
  chemically synthesized
atagtgtgtcatagagaatg

SEQ ID NO: 383163 - DNA, 20 bp, Artificial Sequence
  chemically synthesized
acctagtatagtgtgtcata

SEQ ID NO: 383164 - DNA, 20 bp, Artificial Sequence
  chemically synthesized
caacctagtatagtgtgtca

SEQ ID NO: 383165 - DNA, 20 bp, Artificial Sequence
  chemically synthesized
ttctctatgacacactatac

SEQ ID NO: 383166 - DNA, 20 bp, Artificial Sequence
  chemically synthesized
tctctatgacacactatact

SEQ ID NO: 383167 - DNA, 20 bp, Artificial Sequence
  chemically synthesized
gatgagttcacaacctagta

SEQ ID NO: 383168 - DNA, 20 bp, Artificial Sequence
  chemically synthesized
cacttgatgagttcacaacc

SEQ ID NO: 383169 - DNA, 20 bp, Artificial Sequence
  chemically synthesized
tactaggttgtgaactcatc

SEQ ID NO: 383170 - DNA, 20 bp, Artificial Sequence
  chemically synthesized
taaaaaatagtgcacttgat

SEQ ID NO: 383171 - DNA, 20 bp, Artificial Sequence
  chemically synthesized
agaatggaaaaattaaaaaa

SEQ ID NO: 383172 - DNA, 20 bp, Artificial Sequence
  chemically synthesized
cttgagttaggtgtaaagaa

SEQ ID NO: 383173 - DNA, 20 bp, Artificial Sequence
  chemically synthesized
atagacttgagttaggtgta

SEQ ID NO: 383174 - DNA, 20 bp, Artificial Sequence
  chemically synthesized
ccattctttacacctaactc

SEQ ID NO: 383175 - DNA, 20 bp, Artificial Sequence
  chemically synthesized
tatatgcatagacttgagtt

SEQ ID NO: 383176 - DNA, 20 bp, Artificial Sequence
  chemically synthesized
atatatgcatagacttgagt

SEQ ID NO: 383177 - DNA, 20 bp, Artificial Sequence
  chemically synthesized
aaaaatatatgcatagactt

SEQ ID NO: 383178 - DNA, 20 bp, Artificial Sequence
  chemically synthesized
ataatagaaaaatatatgca

SEQ ID NO: 383179 - DNA, 20 bp, Artificial Sequence
  chemically synthesized
ataatatatgaatcatataa

SEQ ID NO: 383180 - DNA, 20 bp, Artificial Sequence
  chemically synthesized
attgttaatatgtattaata

SEQ ID NO: 383181 - DNA, 20 bp, Artificial Sequence
  chemically synthesized
taacatatatgaaatatata

SEQ ID NO: 383182 - DNA, 20 bp, Artificial Sequence
  chemically synthesized
gaatatatataatatgtaat

SEQ ID NO: 383183 - DNA, 20 bp, Artificial Sequence
  chemically synthesized
catatgattcatatattata

SEQ ID NO: 383184 - DNA, 20 bp, Artificial Sequence
  chemically synthesized
atatattatatggattcata

SEQ ID NO: 383185 - DNA, 20 bp, Artificial Sequence
  chemically synthesized
tatattatatggattcatat

SEQ ID NO: 383186 - DNA, 20 bp, Artificial Sequence
  chemically synthesized
atataggtttgttaaattaa

SEQ ID NO: 383187 - DNA, 20 bp, Artificial Sequence
  chemically synthesized
gtttgttaaattaacagtga

SEQ ID NO: 383188 - DNA, 20 bp, Artificial Sequence
  chemically synthesized
taaattaacagtgaaagccc

SEQ ID NO: 383189 - DNA, 20 bp, Artificial Sequence
  chemically synthesized
tacaatttcctcaaaaactg

SEQ ID NO: 383190 - DNA, 20 bp, Artificial Sequence
  chemically synthesized
cagtgaaagccccagttttt

SEQ ID NO: 383191 - DNA, 20 bp, Artificial Sequence
  chemically synthesized
atacaatttcctcaaaaact

SEQ ID NO: 383192 - DNA, 20 bp, Artificial Sequence
  chemically synthesized
agtgaaagccccagtttttg

SEQ ID NO: 383193 - DNA, 20 bp, Artificial Sequence
  chemically synthesized
catacaatttcctcaaaaac

SEQ ID NO: 383194 - DNA, 20 bp, Artificial Sequence
  chemically synthesized
tgtatgtattgcctatatct

SEQ ID NO: 383195 - DNA, 20 bp, Artificial Sequence
  chemically synthesized
aaagttgactgccaagatat

SEQ ID NO: 383196 - DNA, 20 bp, Artificial Sequence
  chemically synthesized
taaagttgactgccaagata

SEQ ID NO: 383197 - DNA, 20 bp, Artificial Sequence
  chemically synthesized
atgtattgcctatatcttgg

SEQ ID NO: 383198 - DNA, 20 bp, Artificial Sequence
  chemically synthesized
tattagtaaagttgactgcc

SEQ ID NO: 383199 - DNA, 20 bp, Artificial Sequence
  chemically synthesized
tggcagtcaactttactaat

SEQ ID NO: 383200 - DNA, 20 bp, Artificial Sequence
  chemically synthesized
tttatagcagcttattagta

SEQ ID NO: 383201 - DNA, 20 bp, Artificial Sequence
  chemically synthesized
tttattttatagcagcttat

SEQ ID NO: 383202 - DNA, 20 bp, Artificial Sequence
  chemically synthesized
gaatcatatttattttatag

SEQ ID NO: 383203 - DNA, 20 bp, Artificial Sequence
  chemically synthesized
aatgaatcatatttatttta

SEQ ID NO: 383204 - DNA, 20 bp, Artificial Sequence
  chemically synthesized
taaaataaatatgattcatt

SEQ ID NO: 383205 - DNA, 20 bp, Artificial Sequence
  chemically synthesized
aaataaatatgattcattaa

SEQ ID NO: 383206 - DNA, 20 bp, Artificial Sequence
  chemically synthesized
tgattcattaagagtgtaaa

SEQ ID NO: 383207 - DNA, 20 bp, Artificial Sequence
  chemically synthesized
agtgtaaatggaatcctaat

SEQ ID NO: 383208 - DNA, 20 bp, Artificial Sequence
  chemically synthesized
gtgtaaatggaatcctaata

SEQ ID NO: 383209 - DNA, 20 bp, Artificial Sequence
  chemically synthesized
gtaaatggaatcctaataag

SEQ ID NO: 383210 - DNA, 20 bp, Artificial Sequence
  chemically synthesized
tttagggttatctccttatt

SEQ ID NO: 383211 - DNA, 20 bp, Artificial Sequence
  chemically synthesized
atttagggttatctccttat

SEQ ID NO: 383212 - DNA, 20 bp, Artificial Sequence
  chemically synthesized
gcctgactatcgtaaattta

SEQ ID NO: 383213 - DNA, 20 bp, Artificial Sequence
  chemically synthesized
tgcctgactatcgtaaattt

SEQ ID NO: 383214 - DNA, 20 bp, Artificial Sequence
  chemically synthesized
atgcctgactatcgtaaatt

SEQ ID NO: 383215 - DNA, 20 bp, Artificial Sequence
  chemically synthesized
agataaccctaaatttacga

SEQ ID NO: 383216 - DNA, 20 bp, Artificial Sequence
  chemically synthesized
aaccctaaatttacgatagt

SEQ ID NO: 383217 - DNA, 20 bp, Artificial Sequence
  chemically synthesized
accctaaatttacgatagtc

SEQ ID NO: 383218 - DNA, 20 bp, Artificial Sequence
  chemically synthesized
tagtcaggcatgttgtgcaa

SEQ ID NO: 383219 - DNA, 20 bp, Artificial Sequence
  chemically synthesized
gtcaggcatgttgtgcaaca

SEQ ID NO: 383220 - DNA, 20 bp, Artificial Sequence
  chemically synthesized
cccctagcaattacagaata

SEQ ID NO: 383221 - DNA, 20 bp, Artificial Sequence
  chemically synthesized
aaactgtattctgtaattgc

SEQ ID NO: 383222 - DNA, 20 bp, Artificial Sequence
  chemically synthesized
cactctccccctagcaatta

SEQ ID NO: 383223 - DNA, 20 bp, Artificial Sequence
  chemically synthesized
aactgtattctgtaattgct

SEQ ID NO: 383224 - DNA, 20 bp, Artificial Sequence
  chemically synthesized
actgtattctgtaattgcta

SEQ ID NO: 383225 - DNA, 20 bp, Artificial Sequence
  chemically synthesized
ctgtattctgtaattgctag

SEQ ID NO: 383226 - DNA, 20 bp, Artificial Sequence
  chemically synthesized
tgtattctgtaattgctagg

SEQ ID NO: 383227 - DNA, 20 bp, Artificial Sequence
  chemically synthesized
tattctgtaattgctagggg

SEQ ID NO: 383228 - DNA, 20 bp, Artificial Sequence
  chemically synthesized
ttctgtaattgctaggggga

SEQ ID NO: 383229 - DNA, 20 bp, Artificial Sequence
  chemically synthesized
gtaaccacgcactctccccc

SEQ ID NO: 383230 - DNA, 20 bp, Artificial Sequence
  chemically synthesized
attgctagggggagagtgcg

SEQ ID NO: 383231 - DNA, 20 bp, Artificial Sequence
  chemically synthesized
gagtgcgtggttactgtcga

SEQ ID NO: 383232 - DNA, 20 bp, Artificial Sequence
  chemically synthesized
ctaaataacgcaactatcga

SEQ ID NO: 383233 - DNA, 20 bp, Artificial Sequence
  chemically synthesized
ctgtcgatagttgcgttatt

SEQ ID NO: 383234 - DNA, 20 bp, Artificial Sequence
  chemically synthesized
tttagatcattacattgcat

SEQ ID NO: 383235 - DNA, 20 bp, Artificial Sequence
  chemically synthesized
cataacgtttacatcaatat

SEQ ID NO: 383236 - DNA, 20 bp, Artificial Sequence
  chemically synthesized
gcataacgtttacatcaata

SEQ ID NO: 383237 - DNA, 20 bp, Artificial Sequence
  chemically synthesized
atattgatgtaaacgttatg

SEQ ID NO: 383238 - DNA, 20 bp, Artificial Sequence
  chemically synthesized
tattgatgtaaacgttatgc

SEQ ID NO: 383239 - DNA, 20 bp, Artificial Sequence
  chemically synthesized
catatttattacaaataaat

SEQ ID NO: 383240 - DNA, 20 bp, Artificial Sequence
  chemically synthesized
attacaaataaattagaaaa

SEQ ID NO: 383241 - DNA, 20 bp, Artificial Sequence
  chemically synthesized
tacaaataaattagaaaata

SEQ ID NO: 383242 - DNA, 20 bp, Artificial Sequence
  chemically synthesized
ttcagcaaatcagaataaca

SEQ ID NO: 383243 - DNA, 20 bp, Artificial Sequence
  chemically synthesized
gaacaaaagattcagcaaat

SEQ ID NO: 383244 - DNA, 20 bp, Artificial Sequence
  chemically synthesized
ctacatgtgaacaaaagatt

SEQ ID NO: 383245 - DNA, 20 bp, Artificial Sequence
  chemically synthesized
ctcagcctacatgtgaacaa

SEQ ID NO: 383246 - DNA, 20 bp, Artificial Sequence
  chemically synthesized
ctgaatcttttgttcacatg

SEQ ID NO: 383247 - DNA, 20 bp, Artificial Sequence
  chemically synthesized
tgaatcttttgttcacatgt

SEQ ID NO: 383248 - DNA, 20 bp, Artificial Sequence
  chemically synthesized
cttttgttcacatgtaggct

SEQ ID NO: 383249 - DNA, 20 bp, Artificial Sequence
  chemically synthesized
ttttgttcacatgtaggctg

SEQ ID NO: 383250 - DNA, 20 bp, Artificial Sequence
  chemically synthesized
tattctgttgatttatacct

SEQ ID NO: 383251 - DNA, 20 bp, Artificial Sequence
  chemically synthesized
taggctgaggtataaatcaa

SEQ ID NO: 383252 - DNA, 20 bp, Artificial Sequence
  chemically synthesized
ggtataaatcaacagaataa

SEQ ID NO: 383253 - DNA, 20 bp, Artificial Sequence
  chemically synthesized
acagaataaaagtgttttta

SEQ ID NO: 383254 - DNA, 20 bp, Artificial Sequence
  chemically synthesized
ataaaagtgtttttatggct

SEQ ID NO: 383255 - DNA, 20 bp, Artificial Sequence
  chemically synthesized
taaaagtgtttttatggcta

SEQ ID NO: 383256 - DNA, 20 bp, Artificial Sequence
  chemically synthesized
agtgtttttatggctaaggt

SEQ ID NO: 383257 - DNA, 20 bp, Artificial Sequence
  chemically synthesized
tttgaatctctcactgacct

SEQ ID NO: 383258 - DNA, 20 bp, Artificial Sequence
  chemically synthesized
tttttatggctaaggtcagt

SEQ ID NO: 383259 - DNA, 20 bp, Artificial Sequence
  chemically synthesized
tttatggctaaggtcagtga

SEQ ID NO: 383260 - DNA, 20 bp, Artificial Sequence
  chemically synthesized
agagattcaaacaaacgtat

SEQ ID NO: 383261 - DNA, 20 bp, Artificial Sequence
  chemically synthesized
aaacaaacgtataagcatat

SEQ ID NO: 383262 - DNA, 20 bp, Artificial Sequence
  chemically synthesized
gcatataagtgtgcttatat

SEQ ID NO: 383263 - DNA, 20 bp, Artificial Sequence
  chemically synthesized
ctatgaatacatacttatat

SEQ ID NO: 383264 - DNA, 20 bp, Artificial Sequence
  chemically synthesized
cttatataagtatgtattca

SEQ ID NO: 383265 - DNA, 20 bp, Artificial Sequence
  chemically synthesized
caattgatacgttagcatgt

SEQ ID NO: 383266 - DNA, 20 bp, Artificial Sequence
  chemically synthesized
ctttaaatcaattgatacgt

SEQ ID NO: 383267 - DNA, 20 bp, Artificial Sequence
  chemically synthesized
ctaacgtatcaattgattta

SEQ ID NO: 383268 - DNA, 20 bp, Artificial Sequence
  chemically synthesized
ttgatttaaagttaatttta

SEQ ID NO: 383269 - DNA, 20 bp, Artificial Sequence
  chemically synthesized
tgatttaaagttaattttat

SEQ ID NO: 383270 - DNA, 20 bp, Artificial Sequence
  chemically synthesized
gatttaaagttaattttata

SEQ ID NO: 383271 - DNA, 20 bp, Artificial Sequence
  chemically synthesized
atttaaagttaattttatag

SEQ ID NO: 383272 - DNA, 20 bp, Artificial Sequence
  chemically synthesized
tttaaagttaattttatagg

SEQ ID NO: 383273 - DNA, 20 bp, Artificial Sequence
  chemically synthesized
tgtcacattatcaaacacta

SEQ ID NO: 383274 - DNA, 20 bp, Artificial Sequence
  chemically synthesized
ttaaaaactcatacattctt

SEQ ID NO: 383275 - DNA, 20 bp, Artificial Sequence
  chemically synthesized
tcaaacactaaagaatgtat

SEQ ID NO: 383276 - DNA, 20 bp, Artificial Sequence
  chemically synthesized
tgagtttttaaaatgtccat

SEQ ID NO: 383277 - DNA, 20 bp, Artificial Sequence
  chemically synthesized
ttttaaaatgtccatgagtg

SEQ ID NO: 383278 - DNA, 20 bp, Artificial Sequence
  chemically synthesized
tggcatttggtcttcactca

SEQ ID NO: 383279 - DNA, 20 bp, Artificial Sequence
  chemically synthesized
catgagtgaagaccaaatgc

SEQ ID NO: 383280 - DNA, 20 bp, Artificial Sequence
  chemically synthesized
acactcagttagctggcatt

SEQ ID NO: 383281 - DNA, 20 bp, Artificial Sequence
  chemically synthesized
agaccaaatgccagctaact

SEQ ID NO: 383282 - DNA, 20 bp, Artificial Sequence
  chemically synthesized
ctatgttacactcagttagc

SEQ ID NO: 383283 - DNA, 20 bp, Artificial Sequence
  chemically synthesized
tattctatgttacactcagt

SEQ ID NO: 383284 - DNA, 20 bp, Artificial Sequence
  chemically synthesized
cctatattctatgttacact

SEQ ID NO: 383285 - DNA, 20 bp, Artificial Sequence
  chemically synthesized
ccagctaactgagtgtaaca

SEQ ID NO: 383286 - DNA, 20 bp, Artificial Sequence
  chemically synthesized
actgagtgtaacatagaata

SEQ ID NO: 383287 - DNA, 20 bp, Artificial Sequence
  chemically synthesized
ctgagtgtaacatagaatat

SEQ ID NO: 383288 - DNA, 20 bp, Artificial Sequence
  chemically synthesized
atagaatataggtatattga

SEQ ID NO: 383289 - DNA, 20 bp, Artificial Sequence
  chemically synthesized
acagctttatgatgaaatat

SEQ ID NO: 383290 - DNA, 20 bp, Artificial Sequence
  chemically synthesized
tcaacttatatttcatcata

SEQ ID NO: 383291 - DNA, 20 bp, Artificial Sequence
  chemically synthesized
tcaaaccttaaaatgaaata

SEQ ID NO: 383292 - DNA, 20 bp, Artificial Sequence
  chemically synthesized
ataaagctgtatttcatttt

SEQ ID NO: 383293 - DNA, 20 bp, Artificial Sequence
  chemically synthesized
taaagctgtatttcatttta

SEQ ID NO: 383294 - DNA, 20 bp, Artificial Sequence
  chemically synthesized
ctttgacacagtagatattg

SEQ ID NO: 383295 - DNA, 20 bp, Artificial Sequence
  chemically synthesized
tgctttgacacagtagatat

SEQ ID NO: 383296 - DNA, 20 bp, Artificial Sequence
  chemically synthesized
ctcaatctgctttgacacag

SEQ ID NO: 383297 - DNA, 20 bp, Artificial Sequence
  chemically synthesized
ctccaatatctactgtgtca

SEQ ID NO: 383298 - DNA, 20 bp, Artificial Sequence
  chemically synthesized
atactcaatctgctttgaca

SEQ ID NO: 383299 - DNA, 20 bp, Artificial Sequence
  chemically synthesized
caatatctactgtgtcaaag

SEQ ID NO: 383300 - DNA, 20 bp, Artificial Sequence
  chemically synthesized
ctactgtgtcaaagcagatt

SEQ ID NO: 383301 - DNA, 20 bp, Artificial Sequence
  chemically synthesized
caaagcagattgagtatata

SEQ ID NO: 383302 - DNA, 20 bp, Artificial Sequence
  chemically synthesized
aaagcagattgagtatataa

SEQ ID NO: 383303 - DNA, 20 bp, Artificial Sequence
  chemically synthesized
gattgagtatataaaggaaa

SEQ ID NO: 383304 - DNA, 20 bp, Artificial Sequence
  chemically synthesized
attgagtatataaaggaaat

SEQ ID NO: 383305 - DNA, 20 bp, Artificial Sequence
  chemically synthesized
gtatataaaggaaatgggtt

SEQ ID NO: 383306 - DNA, 20 bp, Artificial Sequence
  chemically synthesized
tataaaggaaatgggttcag

SEQ ID NO: 383307 - DNA, 20 bp, Artificial Sequence
  chemically synthesized
aaaggaaatgggttcagtgg

SEQ ID NO: 383308 - DNA, 20 bp, Artificial Sequence
  chemically synthesized
aggcaaaatttaatttgtca

SEQ ID NO: 383309 - DNA, 20 bp, Artificial Sequence
  chemically synthesized
actttccactttacagaagc

SEQ ID NO: 383310 - DNA, 20 bp, Artificial Sequence
  chemically synthesized
gactttccactttacagaag

SEQ ID NO: 383311 - DNA, 20 bp, Artificial Sequence
  chemically synthesized
aaattttgcctgcttctgta

SEQ ID NO: 383312 - DNA, 20 bp, Artificial Sequence
  chemically synthesized
agggactttccactttacag

SEQ ID NO: 383313 - DNA, 20 bp, Artificial Sequence
  chemically synthesized
ttttgcctgcttctgtaaag

SEQ ID NO: 383314 - DNA, 20 bp, Artificial Sequence
  chemically synthesized
aatagggactttccacttta

SEQ ID NO: 383315 - DNA, 20 bp, Artificial Sequence
  chemically synthesized
gcctgcttctgtaaagtgga

SEQ ID NO: 383316 - DNA, 20 bp, Artificial Sequence
  chemically synthesized
taaagtggaaagtccctatt

SEQ ID NO: 383317 - DNA, 20 bp, Artificial Sequence
  chemically synthesized
caattgtctggttctgaata

SEQ ID NO: 383318 - DNA, 20 bp, Artificial Sequence
  chemically synthesized
acaattgtctggttctgaat

SEQ ID NO: 383319 - DNA, 20 bp, Artificial Sequence
  chemically synthesized
aacaattgtctggttctgaa

SEQ ID NO: 383320 - DNA, 20 bp, Artificial Sequence
  chemically synthesized
ggaaagtccctattcagaac

SEQ ID NO: 383321 - DNA, 20 bp, Artificial Sequence
  chemically synthesized
tagttctagtaacaattgtc

SEQ ID NO: 383322 - DNA, 20 bp, Artificial Sequence
  chemically synthesized
cagaaccagacaattgttac

SEQ ID NO: 383323 - DNA, 20 bp, Artificial Sequence
  chemically synthesized
ctagaccctcattttagttc

SEQ ID NO: 383324 - DNA, 20 bp, Artificial Sequence
  chemically synthesized
attgttactagaactaaaat

SEQ ID NO: 383325 - DNA, 20 bp, Artificial Sequence
  chemically synthesized
ttgttactagaactaaaatg

SEQ ID NO: 383326 - DNA, 20 bp, Artificial Sequence
  chemically synthesized
tgttactagaactaaaatga

SEQ ID NO: 383327 - DNA, 20 bp, Artificial Sequence
  chemically synthesized
gattttctagaccctcattt

SEQ ID NO: 383328 - DNA, 20 bp, Artificial Sequence
  chemically synthesized
ctagaactaaaatgagggtc

SEQ ID NO: 383329 - DNA, 20 bp, Artificial Sequence
  chemically synthesized
gtatatttgaatagattttc

SEQ ID NO: 383330 - DNA, 20 bp, Artificial Sequence
  chemically synthesized
tgcgtgtgtgtatatttgaa

SEQ ID NO: 383331 - DNA, 20 bp, Artificial Sequence
  chemically synthesized
aggacagatacgtttgtgtt

SEQ ID NO: 383332 - DNA, 20 bp, Artificial Sequence
  chemically synthesized
ttatttttacttgataagga

SEQ ID NO: 383333 - DNA, 20 bp, Artificial Sequence
  chemically synthesized
caaacgtatctgtccttatc

SEQ ID NO: 383334 - DNA, 20 bp, Artificial Sequence
  chemically synthesized
ctcattatttttacttgata

SEQ ID NO: 383335 - DNA, 20 bp, Artificial Sequence
  chemically synthesized
gctcattatttttacttgat

SEQ ID NO: 383336 - DNA, 20 bp, Artificial Sequence
  chemically synthesized
ccttatcaagtaaaaataat

SEQ ID NO: 383337 - DNA, 20 bp, Artificial Sequence
  chemically synthesized
actgagcttacattcatgca

SEQ ID NO: 383338 - DNA, 20 bp, Artificial Sequence
  chemically synthesized
aaacatctgtgcatgaatgt

SEQ ID NO: 383339 - DNA, 20 bp, Artificial Sequence
  chemically synthesized
tctgtgcatgaatgtaagct

SEQ ID NO: 383340 - DNA, 20 bp, Artificial Sequence
  chemically synthesized
tagccctgataaagtagact

SEQ ID NO: 383341 - DNA, 20 bp, Artificial Sequence
  chemically synthesized
gtaagctcagtctactttat

SEQ ID NO: 383342 - DNA, 20 bp, Artificial Sequence
  chemically synthesized
taagctcagtctactttatc

SEQ ID NO: 383343 - DNA, 20 bp, Artificial Sequence
  chemically synthesized
cggaaatagccctgataaag

SEQ ID NO: 383344 - DNA, 20 bp, Artificial Sequence
  chemically synthesized
aagctcagtctactttatca

SEQ ID NO: 383345 - DNA, 20 bp, Artificial Sequence
  chemically synthesized
aatcggaaatagccctgata

SEQ ID NO: 383346 - DNA, 20 bp, Artificial Sequence
  chemically synthesized
ctatcagccaaaatcggaaa

SEQ ID NO: 383347 - DNA, 20 bp, Artificial Sequence
  chemically synthesized
atcagggctatttccgattt

SEQ ID NO: 383348 - DNA, 20 bp, Artificial Sequence
  chemically synthesized
actgatctatcagccaaaat

SEQ ID NO: 383349 - DNA, 20 bp, Artificial Sequence
  chemically synthesized
ctatttccgattttggctga

SEQ ID NO: 383350 - DNA, 20 bp, Artificial Sequence
  chemically synthesized
tccgattttggctgatagat

SEQ ID NO: 383351 - DNA, 20 bp, Artificial Sequence
  chemically synthesized
caataaggaaactgatctat

SEQ ID NO: 383352 - DNA, 20 bp, Artificial Sequence
  chemically synthesized
ctattgtagccatatcaata

SEQ ID NO: 383353 - DNA, 20 bp, Artificial Sequence
  chemically synthesized
gatcagtttccttattgata

SEQ ID NO: 383354 - DNA, 20 bp, Artificial Sequence
  chemically synthesized
tctattgtagccatatcaat

SEQ ID NO: 383355 - DNA, 20 bp, Artificial Sequence
  chemically synthesized
ccttattgatatggctacaa

SEQ ID NO: 383356 - DNA, 20 bp, Artificial Sequence
  chemically synthesized
cattcaaatggattctattg

SEQ ID NO: 383357 - DNA, 20 bp, Artificial Sequence
  chemically synthesized
acaatagaatccatttgaat

SEQ ID NO: 383358 - DNA, 20 bp, Artificial Sequence
  chemically synthesized
gttacaaaatctcattcaaa

SEQ ID NO: 383359 - DNA, 20 bp, Artificial Sequence
  chemically synthesized
gaatgagattttgtaaccat

SEQ ID NO: 383360 - DNA, 20 bp, Artificial Sequence
  chemically synthesized
aatgagattttgtaaccata

SEQ ID NO: 383361 - DNA, 20 bp, Artificial Sequence
  chemically synthesized
ttacaaaatacaattcctta

SEQ ID NO: 383362 - DNA, 20 bp, Artificial Sequence
  chemically synthesized
cataaggaattgtattttgt

SEQ ID NO: 383363 - DNA, 20 bp, Artificial Sequence
  chemically synthesized
ataaggaattgtattttgta

SEQ ID NO: 383364 - DNA, 20 bp, Artificial Sequence
  chemically synthesized
aggaattgtattttgtaagg

SEQ ID NO: 383365 - DNA, 20 bp, Artificial Sequence
  chemically synthesized
ggaattgtattttgtaaggt

SEQ ID NO: 383366 - DNA, 20 bp, Artificial Sequence
  chemically synthesized
gaattgtattttgtaaggtg

SEQ ID NO: 383367 - DNA, 20 bp, Artificial Sequence
  chemically synthesized
taatcagtttgaaacaggaa

SEQ ID NO: 383368 - DNA, 20 bp, Artificial Sequence
  chemically synthesized
ttaatcagtttgaaacagga

SEQ ID NO: 383369 - DNA, 20 bp, Artificial Sequence
  chemically synthesized
agtgttaatcagtttgaaac

SEQ ID NO: 383370 - DNA, 20 bp, Artificial Sequence
  chemically synthesized
cagtgttaatcagtttgaaa

SEQ ID NO: 383371 - DNA, 20 bp, Artificial Sequence
  chemically synthesized
agagcagtatcagtgttaat

SEQ ID NO: 383372 - DNA, 20 bp, Artificial Sequence
  chemically synthesized
ttttcacaaaagagcagtat

SEQ ID NO: 383373 - DNA, 20 bp, Artificial Sequence
  chemically synthesized
aggcaattttcacaaaagag

SEQ ID NO: 383374 - DNA, 20 bp, Artificial Sequence
  chemically synthesized
cacaggcaattttcacaaaa

SEQ ID NO: 383375 - DNA, 20 bp, Artificial Sequence
  chemically synthesized
cacacaggcaattttcacaa

SEQ ID NO: 383376 - DNA, 20 bp, Artificial Sequence
  chemically synthesized
ttgtgaaaattgcctgtgtg

SEQ ID NO: 383377 - DNA, 20 bp, Artificial Sequence
  chemically synthesized
tgtgaaaattgcctgtgtgc

SEQ ID NO: 383378 - DNA, 20 bp, Artificial Sequence
  chemically synthesized
tcaaatatggtcctgcacac

SEQ ID NO: 383379 - DNA, 20 bp, Artificial Sequence
  chemically synthesized
ttcaaatatggtcctgcaca

SEQ ID NO: 383380 - DNA, 20 bp, Artificial Sequence
  chemically synthesized
attgttcaaattttcaaata

SEQ ID NO: 383381 - DNA, 20 bp, Artificial Sequence
  chemically synthesized
aaatttgaacaataaataat

SEQ ID NO: 383382 - DNA, 20 bp, Artificial Sequence
  chemically synthesized
ataataagcatatgtaataa

SEQ ID NO: 383383 - DNA, 20 bp, Artificial Sequence
  chemically synthesized
agcatatgtaataaaagtaa

SEQ ID NO: 383384 - DNA, 20 bp, Artificial Sequence
  chemically synthesized
gatgtgtgtcatattatata

SEQ ID NO: 383385 - DNA, 20 bp, Artificial Sequence
  chemically synthesized
cccaccccactaggggagta

SEQ ID NO: 383386 - DNA, 20 bp, Artificial Sequence
  chemically synthesized
atatagtttccgtactcccc

SEQ ID NO: 383387 - DNA, 20 bp, Artificial Sequence
  chemically synthesized
tagtttccgtactcccctag

SEQ ID NO: 383388 - DNA, 20 bp, Artificial Sequence
  chemically synthesized
agtttccgtactcccctagt

SEQ ID NO: 383389 - DNA, 20 bp, Artificial Sequence
  chemically synthesized
atccacccaccccactaggg

SEQ ID NO: 383390 - DNA, 20 bp, Artificial Sequence
  chemically synthesized
gtttccgtactcccctagtg

SEQ ID NO: 383391 - DNA, 20 bp, Artificial Sequence
  chemically synthesized
aaatccacccaccccactag

SEQ ID NO: 383392 - DNA, 20 bp, Artificial Sequence
  chemically synthesized
aaaatccacccaccccacta

SEQ ID NO: 383393 - DNA, 20 bp, Artificial Sequence
  chemically synthesized
tccgtactcccctagtgggg

SEQ ID NO: 383394 - DNA, 20 bp, Artificial Sequence
  chemically synthesized
taaaatccacccaccccact

SEQ ID NO: 383395 - DNA, 20 bp, Artificial Sequence
  chemically synthesized
ccgtactcccctagtggggt

SEQ ID NO: 383396 - DNA, 20 bp, Artificial Sequence
  chemically synthesized
ataaaatccacccaccccac

SEQ ID NO: 383397 - DNA, 20 bp, Artificial Sequence
  chemically synthesized
tactcccctagtggggtggg

SEQ ID NO: 383398 - DNA, 20 bp, Artificial Sequence
  chemically synthesized
gggtgggtggattttatttt

SEQ ID NO: 383399 - DNA, 20 bp, Artificial Sequence
  chemically synthesized
ggtgggtggattttattttc

SEQ ID NO: 383400 - DNA, 20 bp, Artificial Sequence
  chemically synthesized
gtgggtggattttattttca

SEQ ID NO: 383401 - DNA, 20 bp, Artificial Sequence
  chemically synthesized
tgggtggattttattttcag

SEQ ID NO: 383402 - DNA, 20 bp, Artificial Sequence
  chemically synthesized
tgaattgtttataaggttgg

SEQ ID NO: 383403 - DNA, 20 bp, Artificial Sequence
  chemically synthesized
tggtgaattgtttataaggt

SEQ ID NO: 383404 - DNA, 20 bp, Artificial Sequence
  chemically synthesized
gtattggtgaattgtttata

SEQ ID NO: 383405 - DNA, 20 bp, Artificial Sequence
  chemically synthesized
tgtattggtgaattgtttat

SEQ ID NO: 383406 - DNA, 20 bp, Artificial Sequence
  chemically synthesized
cccatagatggaaaatgtat

SEQ ID NO: 383407 - DNA, 20 bp, Artificial Sequence
  chemically synthesized
accaatacattttccatcta

SEQ ID NO: 383408 - DNA, 20 bp, Artificial Sequence
  chemically synthesized
ccaatacattttccatctat

SEQ ID NO: 383409 - DNA, 20 bp, Artificial Sequence
  chemically synthesized
caatacattttccatctatg

SEQ ID NO: 383410 - DNA, 20 bp, Artificial Sequence
  chemically synthesized
ttgcatttttaccccataga

SEQ ID NO: 383411 - DNA, 20 bp, Artificial Sequence
  chemically synthesized
cctattgcatttttacccca

SEQ ID NO: 383412 - DNA, 20 bp, Artificial Sequence
  chemically synthesized
tctatggggtaaaaatgcaa

SEQ ID NO: 383413 - DNA, 20 bp, Artificial Sequence
  chemically synthesized
ctatggggtaaaaatgcaat

SEQ ID NO: 383414 - DNA, 20 bp, Artificial Sequence
  chemically synthesized
ggtaaaaatgcaataggtta

SEQ ID NO: 383415 - DNA, 20 bp, Artificial Sequence
  chemically synthesized
tgcaataggttatagccata

SEQ ID NO: 383416 - DNA, 20 bp, Artificial Sequence
  chemically synthesized
gaggtctggcgtaaactata

SEQ ID NO: 383417 - DNA, 20 bp, Artificial Sequence
  chemically synthesized
tatagccatatagtttacgc

SEQ ID NO: 383418 - DNA, 20 bp, Artificial Sequence
  chemically synthesized
atagtttacgccagacctct

SEQ ID NO: 383419 - DNA, 20 bp, Artificial Sequence
  chemically synthesized
ttccaaatgccttagaggtc

SEQ ID NO: 383420 - DNA, 20 bp, Artificial Sequence
  chemically synthesized
tagtttacgccagacctcta

SEQ ID NO: 383421 - DNA, 20 bp, Artificial Sequence
  chemically synthesized
ctttattccaaatgccttag

SEQ ID NO: 383422 - DNA, 20 bp, Artificial Sequence
  chemically synthesized
cctttattccaaatgcctta

SEQ ID NO: 383423 - DNA, 20 bp, Artificial Sequence
  chemically synthesized
cgccagacctctaaggcatt

SEQ ID NO: 383424 - DNA, 20 bp, Artificial Sequence
  chemically synthesized
tacctttattccaaatgcct

SEQ ID NO: 383425 - DNA, 20 bp, Artificial Sequence
  chemically synthesized
cctctaaggcatttggaata

SEQ ID NO: 383426 - DNA, 20 bp, Artificial Sequence
  chemically synthesized
ctctaaggcatttggaataa

SEQ ID NO: 383427 - DNA, 20 bp, Artificial Sequence
  chemically synthesized
taaggcatttggaataaagg

SEQ ID NO: 383428 - DNA, 20 bp, Artificial Sequence
  chemically synthesized
ttggaataaaggtagaaaaa

SEQ ID NO: 383429 - DNA, 20 bp, Artificial Sequence
  chemically synthesized
tggaataaaggtagaaaaaa

SEQ ID NO: 383430 - DNA, 20 bp, Artificial Sequence
  chemically synthesized
ggaataaaggtagaaaaaaa

SEQ ID NO: 383431 - DNA, 20 bp, Artificial Sequence
  chemically synthesized
aatatttgaataaatatcat

SEQ ID NO: 383432 - DNA, 20 bp, Artificial Sequence
  chemically synthesized
atatttgaataaatatcata

SEQ ID NO: 383433 - DNA, 20 bp, Artificial Sequence
  chemically synthesized
tatttgaataaatatcataa

SEQ ID NO: 383434 - DNA, 20 bp, Artificial Sequence
  chemically synthesized
gaataaatatcataagggtg

SEQ ID NO: 383435 - DNA, 20 bp, Artificial Sequence
  chemically synthesized
aaatatcataagggtgaaga

SEQ ID NO: 383436 - DNA, 20 bp, Artificial Sequence
  chemically synthesized
aatatcataagggtgaagaa

SEQ ID NO: 383437 - DNA, 20 bp, Artificial Sequence
  chemically synthesized
tatcataagggtgaagaaag

SEQ ID NO: 383438 - DNA, 20 bp, Artificial Sequence
  chemically synthesized
tcataagggtgaagaaagga

SEQ ID NO: 383439 - DNA, 20 bp, Artificial Sequence
  chemically synthesized
gggtgaagaaaggagagtcg

SEQ ID NO: 383440 - DNA, 20 bp, Artificial Sequence
  chemically synthesized
ggtgaagaaaggagagtcgt

SEQ ID NO: 383441 - DNA, 20 bp, Artificial Sequence
  chemically synthesized
gagagtcgtgggtacatatt

SEQ ID NO: 383442 - DNA, 20 bp, Artificial Sequence
  chemically synthesized
gagtcgtgggtacatattga

SEQ ID NO: 383443 - DNA, 20 bp, Artificial Sequence
  chemically synthesized
gtgggtacatattgagagaa

SEQ ID NO: 383444 - DNA, 20 bp, Artificial Sequence
  chemically synthesized
agagaaaagtaattataaat

SEQ ID NO: 383445 - DNA, 20 bp, Artificial Sequence
  chemically synthesized
taattataaattggtatgac

SEQ ID NO: 383446 - DNA, 20 bp, Artificial Sequence
  chemically synthesized
ttataaattggtatgactag

SEQ ID NO: 383447 - DNA, 20 bp, Artificial Sequence
  chemically synthesized
ataaattggtatgactagaa

SEQ ID NO: 383448 - DNA, 20 bp, Artificial Sequence
  chemically synthesized
agctcattgccattctcttc

SEQ ID NO: 383449 - DNA, 20 bp, Artificial Sequence
  chemically synthesized
ttggtatgactagaagagaa

SEQ ID NO: 383450 - DNA, 20 bp, Artificial Sequence
  chemically synthesized
gactagaagagaatggcaat

SEQ ID NO: 383451 - DNA, 20 bp, Artificial Sequence
  chemically synthesized
aagagaatggcaatgagctt

SEQ ID NO: 383452 - DNA, 20 bp, Artificial Sequence
  chemically synthesized
ataatggggatcatttgcca

SEQ ID NO: 383453 - DNA, 20 bp, Artificial Sequence
  chemically synthesized
ttggcaaatgatccccatta

SEQ ID NO: 383454 - DNA, 20 bp, Artificial Sequence
  chemically synthesized
gtttaaactacactataatg

SEQ ID NO: 383455 - DNA, 20 bp, Artificial Sequence
  chemically synthesized
cgtttaaactacactataat

SEQ ID NO: 383456 - DNA, 20 bp, Artificial Sequence
  chemically synthesized
tcgtttaaactacactataa

SEQ ID NO: 383457 - DNA, 20 bp, Artificial Sequence
  chemically synthesized
aaatgatccccattatagtg

SEQ ID NO: 383458 - DNA, 20 bp, Artificial Sequence
  chemically synthesized
agtttaaacgattgatgtac

SEQ ID NO: 383459 - DNA, 20 bp, Artificial Sequence
  chemically synthesized
gattgatgtacaagcccgaa

SEQ ID NO: 383460 - DNA, 20 bp, Artificial Sequence
  chemically synthesized
attgatgtacaagcccgaaa

SEQ ID NO: 383461 - DNA, 20 bp, Artificial Sequence
  chemically synthesized
tgatattctccagccttttc

SEQ ID NO: 383462 - DNA, 20 bp, Artificial Sequence
  chemically synthesized
atgtacaagcccgaaaaggc

SEQ ID NO: 383463 - DNA, 20 bp, Artificial Sequence
  chemically synthesized
ctgatattctccagcctttt

SEQ ID NO: 383464 - DNA, 20 bp, Artificial Sequence
  chemically synthesized
gtacaagcccgaaaaggctg

SEQ ID NO: 383465 - DNA, 20 bp, Artificial Sequence
  chemically synthesized
ccagcagatctgatattctc

SEQ ID NO: 383466 - DNA, 20 bp, Artificial Sequence
  chemically synthesized
ccgaaaaggctggagaatat

SEQ ID NO: 383467 - DNA, 20 bp, Artificial Sequence
  chemically synthesized
ctggagaatatcagatctgc

SEQ ID NO: 383468 - DNA, 20 bp, Artificial Sequence
  chemically synthesized
aatatcagatctgctggtta

SEQ ID NO: 383469 - DNA, 20 bp, Artificial Sequence
  chemically synthesized
cagatacaccctgtaaccag

SEQ ID NO: 383470 - DNA, 20 bp, Artificial Sequence
  chemically synthesized
atatcagatctgctggttac

SEQ ID NO: 383471 - DNA, 20 bp, Artificial Sequence
  chemically synthesized
tatcagatctgctggttaca

SEQ ID NO: 383472 - DNA, 20 bp, Artificial Sequence
  chemically synthesized
agtcagatacaccctgtaac

SEQ ID NO: 383473 - DNA, 20 bp, Artificial Sequence
  chemically synthesized
tacagggtgtatctgactac

SEQ ID NO: 383474 - DNA, 20 bp, Artificial Sequence
  chemically synthesized
tgtaccctgaaactggtagt

SEQ ID NO: 383475 - DNA, 20 bp, Artificial Sequence
  chemically synthesized
gtgtatctgactaccagttt

SEQ ID NO: 383476 - DNA, 20 bp, Artificial Sequence
  chemically synthesized
cagctgtaccctgaaactgg

SEQ ID NO: 383477 - DNA, 20 bp, Artificial Sequence
  chemically synthesized
tgtatctgactaccagtttc

SEQ ID NO: 383478 - DNA, 20 bp, Artificial Sequence
  chemically synthesized
gtatctgactaccagtttca

SEQ ID NO: 383479 - DNA, 20 bp, Artificial Sequence
  chemically synthesized
tttcagctgtaccctgaaac

SEQ ID NO: 383480 - DNA, 20 bp, Artificial Sequence
  chemically synthesized
tgactaccagtttcagggta

SEQ ID NO: 383481 - DNA, 20 bp, Artificial Sequence
  chemically synthesized
ctgggatcactgatttattt

SEQ ID NO: 383482 - DNA, 20 bp, Artificial Sequence
  chemically synthesized
agggtacagctgaaataaat

SEQ ID NO: 383483 - DNA, 20 bp, Artificial Sequence
  chemically synthesized
ctgaaataaatcagtgatcc

SEQ ID NO: 383484 - DNA, 20 bp, Artificial Sequence
  chemically synthesized
ataaatcagtgatcccagaa

SEQ ID NO: 383485 - DNA, 20 bp, Artificial Sequence
  chemically synthesized
aatcagtgatcccagaaaag

SEQ ID NO: 383486 - DNA, 20 bp, Artificial Sequence
  chemically synthesized
taaaaagaaacttcttttct

SEQ ID NO: 383487 - DNA, 20 bp, Artificial Sequence
  chemically synthesized
gtaaaaagaaacttcttttc

SEQ ID NO: 383488 - DNA, 20 bp, Artificial Sequence
  chemically synthesized
tcagaagttttgcacgtaaa

SEQ ID NO: 383489 - DNA, 20 bp, Artificial Sequence
  chemically synthesized
tttttacgtgcaaaacttct

SEQ ID NO: 383490 - DNA, 20 bp, Artificial Sequence
  chemically synthesized
acgtgcaaaacttctgagca

SEQ ID NO: 383491 - DNA, 20 bp, Artificial Sequence
  chemically synthesized
gcagagatcactttgctcag

SEQ ID NO: 383492 - DNA, 20 bp, Artificial Sequence
  chemically synthesized
ctggcagagatcactttgct

SEQ ID NO: 383493 - DNA, 20 bp, Artificial Sequence
  chemically synthesized
ctgagcaaagtgatctctgc

SEQ ID NO: 383494 - DNA, 20 bp, Artificial Sequence
  chemically synthesized
gcaaagtgatctctgccagc

SEQ ID NO: 383495 - DNA, 20 bp, Artificial Sequence
  chemically synthesized
atccccagctccagctggca

SEQ ID NO: 383496 - DNA, 20 bp, Artificial Sequence
  chemically synthesized
aaagtgatctctgccagctg

SEQ ID NO: 383497 - DNA, 20 bp, Artificial Sequence
  chemically synthesized
gaatccccagctccagctgg

SEQ ID NO: 383498 - DNA, 20 bp, Artificial Sequence
  chemically synthesized
tgtgaatccccagctccagc

SEQ ID NO: 383499 - DNA, 20 bp, Artificial Sequence
  chemically synthesized
tgatctctgccagctggagc

SEQ ID NO: 383500 - DNA, 20 bp, Artificial Sequence
  chemically synthesized
gatctctgccagctggagct

SEQ ID NO: 383501 - DNA, 20 bp, Artificial Sequence
  chemically synthesized
atctctgccagctggagctg

SEQ ID NO: 383502 - DNA, 20 bp, Artificial Sequence
  chemically synthesized
aggctgtgaatccccagctc

SEQ ID NO: 383503 - DNA, 20 bp, Artificial Sequence
  chemically synthesized
aaatagaggctgtgaatccc

SEQ ID NO: 383504 - DNA, 20 bp, Artificial Sequence
  chemically synthesized
cagctggagctggggattca

SEQ ID NO: 383505 - DNA, 20 bp, Artificial Sequence
  chemically synthesized
ttcttttgatggaaaaatag

SEQ ID NO: 383506 - DNA, 20 bp, Artificial Sequence
  chemically synthesized
attcttttgatggaaaaata

SEQ ID NO: 383507 - DNA, 20 bp, Artificial Sequence
  chemically synthesized
taattcttttgatggaaaaa

SEQ ID NO: 383508 - DNA, 20 bp, Artificial Sequence
  chemically synthesized
agcctctatttttccatcaa

SEQ ID NO: 383509 - DNA, 20 bp, Artificial Sequence
  chemically synthesized
agtcaacttaattcttttga

SEQ ID NO: 383510 - DNA, 20 bp, Artificial Sequence
  chemically synthesized
atttttccatcaaaagaatt

SEQ ID NO: 383511 - DNA, 20 bp, Artificial Sequence
  chemically synthesized
aaaagaattaagttgactcc

SEQ ID NO: 383512 - DNA, 20 bp, Artificial Sequence
  chemically synthesized
gaattaagttgactcccaga

SEQ ID NO: 383513 - DNA, 20 bp, Artificial Sequence
  chemically synthesized
attaagttgactcccagata

SEQ ID NO: 383514 - DNA, 20 bp, Artificial Sequence
  chemically synthesized
tatagttattctctatctgg

SEQ ID NO: 383515 - DNA, 20 bp, Artificial Sequence
  chemically synthesized
tatatagttattctctatct

SEQ ID NO: 383516 - DNA, 20 bp, Artificial Sequence
  chemically synthesized
atatatagttattctctatc

SEQ ID NO: 383517 - DNA, 20 bp, Artificial Sequence
  chemically synthesized
tacatctgaaaaaaaatata

SEQ ID NO: 383518 - DNA, 20 bp, Artificial Sequence
  chemically synthesized
aataactatatatttttttt

SEQ ID NO: 383519 - DNA, 20 bp, Artificial Sequence
  chemically synthesized
tatatattttttttcagatg

SEQ ID NO: 383520 - DNA, 20 bp, Artificial Sequence
  chemically synthesized
tttttcagatgtagcctcct

SEQ ID NO: 383521 - DNA, 20 bp, Artificial Sequence
  chemically synthesized
gatggttttgagtactcagg

SEQ ID NO: 383522 - DNA, 20 bp, Artificial Sequence
  chemically synthesized
agatggttttgagtactcag

SEQ ID NO: 383523 - DNA, 20 bp, Artificial Sequence
  chemically synthesized
ggagatggttttgagtactc

SEQ ID NO: 383524 - DNA, 20 bp, Artificial Sequence
  chemically synthesized
tggagatggttttgagtact

SEQ ID NO: 383525 - DNA, 20 bp, Artificial Sequence
  chemically synthesized
catatcctggagatggtttt

SEQ ID NO: 383526 - DNA, 20 bp, Artificial Sequence
  chemically synthesized
tgagtactcaaaaccatctc

SEQ ID NO: 383527 - DNA, 20 bp, Artificial Sequence
  chemically synthesized
gagtactcaaaaccatctcc

SEQ ID NO: 383528 - DNA, 20 bp, Artificial Sequence
  chemically synthesized
aattttccatatcctggaga

SEQ ID NO: 383529 - DNA, 20 bp, Artificial Sequence
  chemically synthesized
tcaaaaccatctccaggata

SEQ ID NO: 383530 - DNA, 20 bp, Artificial Sequence
  chemically synthesized
ggtgaattttccatatcctg

SEQ ID NO: 383531 - DNA, 20 bp, Artificial Sequence
  chemically synthesized
aaggtgaattttccatatcc

SEQ ID NO: 383532 - DNA, 20 bp, Artificial Sequence
  chemically synthesized
tagccatatacgtttggata

SEQ ID NO: 383533 - DNA, 20 bp, Artificial Sequence
  chemically synthesized
ttagccatatacgtttggat

SEQ ID NO: 383534 - DNA, 20 bp, Artificial Sequence
  chemically synthesized
gaattttagccatatacgtt

SEQ ID NO: 383535 - DNA, 20 bp, Artificial Sequence
  chemically synthesized
tcaccttatccaaacgtata

SEQ ID NO: 383536 - DNA, 20 bp, Artificial Sequence
  chemically synthesized
agtgccttacaaaggaattt

SEQ ID NO: 383537 - DNA, 20 bp, Artificial Sequence
  chemically synthesized
tatggctaaaattcctttgt

SEQ ID NO: 383538 - DNA, 20 bp, Artificial Sequence
  chemically synthesized
atggctaaaattcctttgta

SEQ ID NO: 383539 - DNA, 20 bp, Artificial Sequence
  chemically synthesized
aaataggtagtgccttacaa

SEQ ID NO: 383540 - DNA, 20 bp, Artificial Sequence
  chemically synthesized
gaaataggtagtgccttaca

SEQ ID NO: 383541 - DNA, 20 bp, Artificial Sequence
  chemically synthesized
acaagaaacagggaaatagg

SEQ ID NO: 383542 - DNA, 20 bp, Artificial Sequence
  chemically synthesized
aatacaagaaacagggaaat

SEQ ID NO: 383543 - DNA, 20 bp, Artificial Sequence
  chemically synthesized
aaatacaagaaacagggaaa

SEQ ID NO: 383544 - DNA, 20 bp, Artificial Sequence
  chemically synthesized
ctaatcaaatacaagaaaca

SEQ ID NO: 383545 - DNA, 20 bp, Artificial Sequence
  chemically synthesized
tctaatcaaatacaagaaac

SEQ ID NO: 383546 - DNA, 20 bp, Artificial Sequence
  chemically synthesized
ctctaatcaaatacaagaaa

SEQ ID NO: 383547 - DNA, 20 bp, Artificial Sequence
  chemically synthesized
agttatctctaatcaaatac

SEQ ID NO: 383548 - DNA, 20 bp, Artificial Sequence
  chemically synthesized
ccctgtttcttgtatttgat

SEQ ID NO: 383549 - DNA, 20 bp, Artificial Sequence
  chemically synthesized
ctgtttcttgtatttgatta

SEQ ID NO: 383550 - DNA, 20 bp, Artificial Sequence
  chemically synthesized
tttgattagagataactatt

SEQ ID NO: 383551 - DNA, 20 bp, Artificial Sequence
  chemically synthesized
cataaaccatgttttctcaa

SEQ ID NO: 383552 - DNA, 20 bp, Artificial Sequence
  chemically synthesized
agataactattgagaaaaca

SEQ ID NO: 383553 - DNA, 20 bp, Artificial Sequence
  chemically synthesized
tgagaaaacatggtttatga

SEQ ID NO: 383554 - DNA, 20 bp, Artificial Sequence
  chemically synthesized
aacatggtttatgaaagaaa

SEQ ID NO: 383555 - DNA, 20 bp, Artificial Sequence
  chemically synthesized
acatggtttatgaaagaaat

SEQ ID NO: 383556 - DNA, 20 bp, Artificial Sequence
  chemically synthesized
aaatacattcttatcaaaac

SEQ ID NO: 383557 - DNA, 20 bp, Artificial Sequence
  chemically synthesized
aaatattttcccgttttgat

SEQ ID NO: 383558 - DNA, 20 bp, Artificial Sequence
  chemically synthesized
aaaatacattcttatcaaaa

SEQ ID NO: 383559 - DNA, 20 bp, Artificial Sequence
  chemically synthesized
atgtatttttaaaaaacaaa

SEQ ID NO: 383560 - DNA, 20 bp, Artificial Sequence
  chemically synthesized
aaaaaacaaatggaaaccta

SEQ ID NO: 383561 - DNA, 20 bp, Artificial Sequence
  chemically synthesized
aaatatttttttgtgtcttt

SEQ ID NO: 383562 - DNA, 20 bp, Artificial Sequence
  chemically synthesized
caaatatttttttgtgtctt

SEQ ID NO: 383563 - DNA, 20 bp, Artificial Sequence
  chemically synthesized
gacacaaaaaaatatttgta

SEQ ID NO: 383564 - DNA, 20 bp, Artificial Sequence
  chemically synthesized
acacaaaaaaatatttgtaa

SEQ ID NO: 383565 - DNA, 20 bp, Artificial Sequence
  chemically synthesized
cacaaaaaaatatttgtaaa

SEQ ID NO: 383566 - DNA, 20 bp, Artificial Sequence
  chemically synthesized
acaaaaaaatatttgtaaag

SEQ ID NO: 383567 - DNA, 20 bp, Artificial Sequence
  chemically synthesized
tgtaaaggggataataccct

SEQ ID NO: 383568 - DNA, 20 bp, Artificial Sequence
  chemically synthesized
gtaaaggggataataccctg

SEQ ID NO: 383569 - DNA, 20 bp, Artificial Sequence
  chemically synthesized
taaaggggataataccctga

SEQ ID NO: 383570 - DNA, 20 bp, Artificial Sequence
  chemically synthesized
aggggataataccctgaggg

SEQ ID NO: 383571 - DNA, 20 bp, Artificial Sequence
  chemically synthesized
ggggataataccctgaggga

SEQ ID NO: 383572 - DNA, 20 bp, Artificial Sequence
  chemically synthesized
cttctggctcccttccctca

SEQ ID NO: 383573 - DNA, 20 bp, Artificial Sequence
  chemically synthesized
gggataataccctgagggaa

SEQ ID NO: 383574 - DNA, 20 bp, Artificial Sequence
  chemically synthesized
acttctggctcccttccctc

SEQ ID NO: 383575 - DNA, 20 bp, Artificial Sequence
  chemically synthesized
tacttctggctcccttccct

SEQ ID NO: 383576 - DNA, 20 bp, Artificial Sequence
  chemically synthesized
gataataccctgagggaagg

SEQ ID NO: 383577 - DNA, 20 bp, Artificial Sequence
  chemically synthesized
ataccctgagggaagggagc

SEQ ID NO: 383578 - DNA, 20 bp, Artificial Sequence
  chemically synthesized
ccctgagggaagggagccag

SEQ ID NO: 383579 - DNA, 20 bp, Artificial Sequence
  chemically synthesized
tgagggaagggagccagaag

SEQ ID NO: 383580 - DNA, 20 bp, Artificial Sequence
  chemically synthesized
agggaagggagccagaagta

SEQ ID NO: 383581 - DNA, 20 bp, Artificial Sequence
  chemically synthesized
atatctctagtctctacttc

SEQ ID NO: 383582 - DNA, 20 bp, Artificial Sequence
  chemically synthesized
agggagccagaagtagagac

SEQ ID NO: 383583 - DNA, 20 bp, Artificial Sequence
  chemically synthesized
ggagccagaagtagagacta

SEQ ID NO: 383584 - DNA, 20 bp, Artificial Sequence
  chemically synthesized
aaagtttttcttaatatctc

SEQ ID NO: 383585 - DNA, 20 bp, Artificial Sequence
  chemically synthesized
aagtagagactagagatatt

SEQ ID NO: 383586 - DNA, 20 bp, Artificial Sequence
  chemically synthesized
gccaaaatataaattcatta

SEQ ID NO: 383587 - DNA, 20 bp, Artificial Sequence
  chemically synthesized
actttaatgaatttatattt

SEQ ID NO: 383588 - DNA, 20 bp, Artificial Sequence
  chemically synthesized
aatgaatttatattttggct

SEQ ID NO: 383589 - DNA, 20 bp, Artificial Sequence
  chemically synthesized
tgaatttatattttggctca

SEQ ID NO: 383590 - DNA, 20 bp, Artificial Sequence
  chemically synthesized
tcccttagtaggtgagctct

SEQ ID NO: 383591 - DNA, 20 bp, Artificial Sequence
  chemically synthesized
tggctcagagctcacctact

SEQ ID NO: 383592 - DNA, 20 bp, Artificial Sequence
  chemically synthesized
tgtttactcccttagtaggt

SEQ ID NO: 383593 - DNA, 20 bp, Artificial Sequence
  chemically synthesized
ggctcagagctcacctacta

SEQ ID NO: 383594 - DNA, 20 bp, Artificial Sequence
  chemically synthesized
gctcagagctcacctactaa

SEQ ID NO: 383595 - DNA, 20 bp, Artificial Sequence
  chemically synthesized
tcagagctcacctactaagg

SEQ ID NO: 383596 - DNA, 20 bp, Artificial Sequence
  chemically synthesized
tgcctgtttactcccttagt

SEQ ID NO: 383597 - DNA, 20 bp, Artificial Sequence
  chemically synthesized
ttgcctgtttactcccttag

SEQ ID NO: 383598 - DNA, 20 bp, Artificial Sequence
  chemically synthesized
actttgcctgtttactccct

SEQ ID NO: 383599 - DNA, 20 bp, Artificial Sequence
  chemically synthesized
tcacctactaagggagtaaa

SEQ ID NO: 383600 - DNA, 20 bp, Artificial Sequence
  chemically synthesized
cacctactaagggagtaaac

SEQ ID NO: 383601 - DNA, 20 bp, Artificial Sequence
  chemically synthesized
actaagggagtaaacaggca

SEQ ID NO: 383602 - DNA, 20 bp, Artificial Sequence
  chemically synthesized
agtaaacaggcaaagtcaca

SEQ ID NO: 383603 - DNA, 20 bp, Artificial Sequence
  chemically synthesized
gtaaacaggcaaagtcacaa

SEQ ID NO: 383604 - DNA, 20 bp, Artificial Sequence
  chemically synthesized
cccgaccaatggcaagtgta

SEQ ID NO: 383605 - DNA, 20 bp, Artificial Sequence
  chemically synthesized
ccccgaccaatggcaagtgt

SEQ ID NO: 383606 - DNA, 20 bp, Artificial Sequence
  chemically synthesized
ataatccttacacttgccat

SEQ ID NO: 383607 - DNA, 20 bp, Artificial Sequence
  chemically synthesized
cacctaccccgaccaatggc

SEQ ID NO: 383608 - DNA, 20 bp, Artificial Sequence
  chemically synthesized
tccttacacttgccattggt

SEQ ID NO: 383609 - DNA, 20 bp, Artificial Sequence
  chemically synthesized
ccttacacttgccattggtc

SEQ ID NO: 383610 - DNA, 20 bp, Artificial Sequence
  chemically synthesized
cttacacttgccattggtcg

SEQ ID NO: 383611 - DNA, 20 bp, Artificial Sequence
  chemically synthesized
taatcacctaccccgaccaa

SEQ ID NO: 383612 - DNA, 20 bp, Artificial Sequence
  chemically synthesized
acacttgccattggtcgggg

SEQ ID NO: 383613 - DNA, 20 bp, Artificial Sequence
  chemically synthesized
cacttgccattggtcggggt

SEQ ID NO: 383614 - DNA, 20 bp, Artificial Sequence
  chemically synthesized
cattggtcggggtaggtgat

SEQ ID NO: 383615 - DNA, 20 bp, Artificial Sequence
  chemically synthesized
taatatgcccagaataaata

SEQ ID NO: 383616 - DNA, 20 bp, Artificial Sequence
  chemically synthesized
aaatgatgctttatttattc

SEQ ID NO: 383617 - DNA, 20 bp, Artificial Sequence
  chemically synthesized
aatgatgctttatttattct

SEQ ID NO: 383618 - DNA, 20 bp, Artificial Sequence
  chemically synthesized
ccagttcagtttaatatgcc

SEQ ID NO: 383619 - DNA, 20 bp, Artificial Sequence
  chemically synthesized
ctgggcatattaaactgaac

SEQ ID NO: 383620 - DNA, 20 bp, Artificial Sequence
  chemically synthesized
tgggcatattaaactgaact

SEQ ID NO: 383621 - DNA, 20 bp, Artificial Sequence
  chemically synthesized
ttcatttaaatcacccagtt

SEQ ID NO: 383622 - DNA, 20 bp, Artificial Sequence
  chemically synthesized
tacagttcatttaaatcacc

SEQ ID NO: 383623 - DNA, 20 bp, Artificial Sequence
  chemically synthesized
tgggtgatttaaatgaactg

SEQ ID NO: 383624 - DNA, 20 bp, Artificial Sequence
  chemically synthesized
gggtgatttaaatgaactgt

SEQ ID NO: 383625 - DNA, 20 bp, Artificial Sequence
  chemically synthesized
ctgttgcattgaatttccta

SEQ ID NO: 383626 - DNA, 20 bp, Artificial Sequence
  chemically synthesized
ctgtaggaaattcaatgcaa

SEQ ID NO: 383627 - DNA, 20 bp, Artificial Sequence
  chemically synthesized
agctccttagtcattcattt

SEQ ID NO: 383628 - DNA, 20 bp, Artificial Sequence
  chemically synthesized
aacagctaaaatgaatgact

SEQ ID NO: 383629 - DNA, 20 bp, Artificial Sequence
  chemically synthesized
acagctaaaatgaatgacta

SEQ ID NO: 383630 - DNA, 20 bp, Artificial Sequence
  chemically synthesized
agctaaaatgaatgactaag

SEQ ID NO: 383631 - DNA, 20 bp, Artificial Sequence
  chemically synthesized
aaaatgaatgactaaggagc

SEQ ID NO: 383632 - DNA, 20 bp, Artificial Sequence
  chemically synthesized
attaagatcttctagctcct

SEQ ID NO: 383633 - DNA, 20 bp, Artificial Sequence
  chemically synthesized
atgaatgactaaggagctag

SEQ ID NO: 383634 - DNA, 20 bp, Artificial Sequence
  chemically synthesized
ttatacagattaagatcttc

SEQ ID NO: 383635 - DNA, 20 bp, Artificial Sequence
  chemically synthesized
ctttcagctttatacagatt

SEQ ID NO: 383636 - DNA, 20 bp, Artificial Sequence
  chemically synthesized
agaagatcttaatctgtata

SEQ ID NO: 383637 - DNA, 20 bp, Artificial Sequence
  chemically synthesized
tttgttctttcagctttata

SEQ ID NO: 383638 - DNA, 20 bp, Artificial Sequence
  chemically synthesized
cttaatctgtataaagctga

SEQ ID NO: 383639 - DNA, 20 bp, Artificial Sequence
  chemically synthesized
ttgtgcatattttgttcttt

SEQ ID NO: 383640 - DNA, 20 bp, Artificial Sequence
  chemically synthesized
agaacaaaatatgcacaatt

SEQ ID NO: 383641 - DNA, 20 bp, Artificial Sequence
  chemically synthesized
tctttcctttcattagcaca

SEQ ID NO: 383642 - DNA, 20 bp, Artificial Sequence
  chemically synthesized
tctctttcctttcattagca

SEQ ID NO: 383643 - DNA, 20 bp, Artificial Sequence
  chemically synthesized
atttagctctgtgctaatga

SEQ ID NO: 383644 - DNA, 20 bp, Artificial Sequence
  chemically synthesized
tttagctctgtgctaatgaa

SEQ ID NO: 383645 - DNA, 20 bp, Artificial Sequence
  chemically synthesized
tgttatctctttcctttcat

SEQ ID NO: 383646 - DNA, 20 bp, Artificial Sequence
  chemically synthesized
gctctgtgctaatgaaagga

SEQ ID NO: 383647 - DNA, 20 bp, Artificial Sequence
  chemically synthesized
tctgtgctaatgaaaggaaa

SEQ ID NO: 383648 - DNA, 20 bp, Artificial Sequence
  chemically synthesized
ctgcaccattcagttatttt

SEQ ID NO: 383649 - DNA, 20 bp, Artificial Sequence
  chemically synthesized
taacactaaaaataactgaa

SEQ ID NO: 383650 - DNA, 20 bp, Artificial Sequence
  chemically synthesized
ctaaaaataactgaatggtg

SEQ ID NO: 383651 - DNA, 20 bp, Artificial Sequence
  chemically synthesized
gccttgaagcctgcaccatt

SEQ ID NO: 383652 - DNA, 20 bp, Artificial Sequence
  chemically synthesized
taaaaataactgaatggtgc

SEQ ID NO: 383653 - DNA, 20 bp, Artificial Sequence
  chemically synthesized
aactgaatggtgcaggcttc

SEQ ID NO: 383654 - DNA, 20 bp, Artificial Sequence
  chemically synthesized
actgaatggtgcaggcttca

SEQ ID NO: 383655 - DNA, 20 bp, Artificial Sequence
  chemically synthesized
gaatggtgcaggcttcaagg

SEQ ID NO: 383656 - DNA, 20 bp, Artificial Sequence
  chemically synthesized
agaactcttctgctgccttg

SEQ ID NO: 383657 - DNA, 20 bp, Artificial Sequence
  chemically synthesized
tggtgcaggcttcaaggcag

SEQ ID NO: 383658 - DNA, 20 bp, Artificial Sequence
  chemically synthesized
tgcaggcttcaaggcagcag

SEQ ID NO: 383659 - DNA, 20 bp, Artificial Sequence
  chemically synthesized
caggcttcaaggcagcagaa

SEQ ID NO: 383660 - DNA, 20 bp, Artificial Sequence
  chemically synthesized
tcaaggcagcagaagagttc

SEQ ID NO: 383661 - DNA, 20 bp, Artificial Sequence
  chemically synthesized
cagaagagttctggcacaaa

SEQ ID NO: 383662 - DNA, 20 bp, Artificial Sequence
  chemically synthesized
ctggatagatccatttgtgc

SEQ ID NO: 383663 - DNA, 20 bp, Artificial Sequence
  chemically synthesized
ctggcacaaatggatctatc

SEQ ID NO: 383664 - DNA, 20 bp, Artificial Sequence
  chemically synthesized
aagtctcatttttttctgga

SEQ ID NO: 383665 - DNA, 20 bp, Artificial Sequence
  chemically synthesized
aattaagtctcatttttttc

SEQ ID NO: 383666 - DNA, 20 bp, Artificial Sequence
  chemically synthesized
ggatctatccagaaaaaaat

SEQ ID NO: 383667 - DNA, 20 bp, Artificial Sequence
  chemically synthesized
agtttttcctttgtgtaatt

SEQ ID NO: 383668 - DNA, 20 bp, Artificial Sequence
  chemically synthesized
aaatgagacttaattacaca

SEQ ID NO: 383669 - DNA, 20 bp, Artificial Sequence
  chemically synthesized
aatgagacttaattacacaa

SEQ ID NO: 383670 - DNA, 20 bp, Artificial Sequence
  chemically synthesized
acacttttcctcacagtcaa

SEQ ID NO: 383671 - DNA, 20 bp, Artificial Sequence
  chemically synthesized
aaggaaaaactgttgactgt

SEQ ID NO: 383672 - DNA, 20 bp, Artificial Sequence
  chemically synthesized
aggaaaaactgttgactgtg

SEQ ID NO: 383673 - DNA, 20 bp, Artificial Sequence
  chemically synthesized
aaactgttgactgtgaggaa

SEQ ID NO: 383674 - DNA, 20 bp, Artificial Sequence
  chemically synthesized
tcttgggacacttttcctca

SEQ ID NO: 383675 - DNA, 20 bp, Artificial Sequence
  chemically synthesized
actgtgaggaaaagtgtccc

SEQ ID NO: 383676 - DNA, 20 bp, Artificial Sequence
  chemically synthesized
aacagcagtcatttcatctt

SEQ ID NO: 383677 - DNA, 20 bp, Artificial Sequence
  chemically synthesized
caacagcagtcatttcatct

SEQ ID NO: 383678 - DNA, 20 bp, Artificial Sequence
  chemically synthesized
gatggtttcccattcaacag

SEQ ID NO: 383679 - DNA, 20 bp, Artificial Sequence
  chemically synthesized
atgaaatgactgctgttgaa

SEQ ID NO: 383680 - DNA, 20 bp, Artificial Sequence
  chemically synthesized
tgaaatgactgctgttgaat

SEQ ID NO: 383681 - DNA, 20 bp, Artificial Sequence
  chemically synthesized
tctgatggtttcccattcaa

SEQ ID NO: 383682 - DNA, 20 bp, Artificial Sequence
  chemically synthesized
gctgttgaatgggaaaccat

SEQ ID NO: 383683 - DNA, 20 bp, Artificial Sequence
  chemically synthesized
tgttgaatgggaaaccatca

SEQ ID NO: 383684 - DNA, 20 bp, Artificial Sequence
  chemically synthesized
ttgaatgggaaaccatcaga

SEQ ID NO: 383685 - DNA, 20 bp, Artificial Sequence
  chemically synthesized
tgaatgggaaaccatcagag

SEQ ID NO: 383686 - DNA, 20 bp, Artificial Sequence
  chemically synthesized
tctcgtcactgcctctctga

SEQ ID NO: 383687 - DNA, 20 bp, Artificial Sequence
  chemically synthesized
atgggaaaccatcagagagg

SEQ ID NO: 383688 - DNA, 20 bp, Artificial Sequence
  chemically synthesized
accatcagagaggcagtgac

SEQ ID NO: 383689 - DNA, 20 bp, Artificial Sequence
  chemically synthesized
catcagagaggcagtgacga

SEQ ID NO: 383690 - DNA, 20 bp, Artificial Sequence
  chemically synthesized
tttcagctgcttcagttgtc

SEQ ID NO: 383691 - DNA, 20 bp, Artificial Sequence
  chemically synthesized
gagtgttatctcgacaactg

SEQ ID NO: 383692 - DNA, 20 bp, Artificial Sequence
  chemically synthesized
tgttatctcgacaactgaag

SEQ ID NO: 383693 - DNA, 20 bp, Artificial Sequence
  chemically synthesized
gtgtctcatttcagctgctt

SEQ ID NO: 383694 - DNA, 20 bp, Artificial Sequence
  chemically synthesized
acaactgaagcagctgaaat

SEQ ID NO: 383695 - DNA, 20 bp, Artificial Sequence
  chemically synthesized
tccggcaacgtgtctcattt

SEQ ID NO: 383696 - DNA, 20 bp, Artificial Sequence
  chemically synthesized
gctgaaatgagacacgttgc

SEQ ID NO: 383697 - DNA, 20 bp, Artificial Sequence
  chemically synthesized
aatgagacacgttgccggaa

SEQ ID NO: 383698 - DNA, 20 bp, Artificial Sequence
  chemically synthesized
ttagtctgtaatggcttttc

SEQ ID NO: 383699 - DNA, 20 bp, Artificial Sequence
  chemically synthesized
cgttgccggaaaagccatta

SEQ ID NO: 383700 - DNA, 20 bp, Artificial Sequence
  chemically synthesized
agggggtatttagtctgtaa

SEQ ID NO: 383701 - DNA, 20 bp, Artificial Sequence
  chemically synthesized
ctttaggaccagggggtatt

SEQ ID NO: 383702 - DNA, 20 bp, Artificial Sequence
  chemically synthesized
attacagactaaataccccc

SEQ ID NO: 383703 - DNA, 20 bp, Artificial Sequence
  chemically synthesized
tctatctctttaggaccagg

SEQ ID NO: 383704 - DNA, 20 bp, Artificial Sequence
  chemically synthesized
atctatctctttaggaccag

SEQ ID NO: 383705 - DNA, 20 bp, Artificial Sequence
  chemically synthesized
catctatctctttaggacca

SEQ ID NO: 383706 - DNA, 20 bp, Artificial Sequence
  chemically synthesized
ctaaataccccctggtccta

SEQ ID NO: 383707 - DNA, 20 bp, Artificial Sequence
  chemically synthesized
gcatctatctctttaggacc

SEQ ID NO: 383708 - DNA, 20 bp, Artificial Sequence
  chemically synthesized
tgcatctatctctttaggac

SEQ ID NO: 383709 - DNA, 20 bp, Artificial Sequence
  chemically synthesized
aaataccccctggtcctaaa

SEQ ID NO: 383710 - DNA, 20 bp, Artificial Sequence
  chemically synthesized
accccctggtcctaaagaga

SEQ ID NO: 383711 - DNA, 20 bp, Artificial Sequence
  chemically synthesized
tgatgtgcatctatctcttt

SEQ ID NO: 383712 - DNA, 20 bp, Artificial Sequence
  chemically synthesized
ttgatgtgcatctatctctt

SEQ ID NO: 383713 - DNA, 20 bp, Artificial Sequence
  chemically synthesized
agatagatgcacatcaactt

SEQ ID NO: 383714 - DNA, 20 bp, Artificial Sequence
  chemically synthesized
gatagatgcacatcaactta

SEQ ID NO: 383715 - DNA, 20 bp, Artificial Sequence
  chemically synthesized
tagatgcacatcaacttaag

SEQ ID NO: 383716 - DNA, 20 bp, Artificial Sequence
  chemically synthesized
cctgctctgcaattctcctt

SEQ ID NO: 383717 - DNA, 20 bp, Artificial Sequence
  chemically synthesized
catcaacttaaggagaattg

SEQ ID NO: 383718 - DNA, 20 bp, Artificial Sequence
  chemically synthesized
tcaacttaaggagaattgca

SEQ ID NO: 383719 - DNA, 20 bp, Artificial Sequence
  chemically synthesized
acttaaggagaattgcagag

SEQ ID NO: 383720 - DNA, 20 bp, Artificial Sequence
  chemically synthesized
cttaaggagaattgcagagc

SEQ ID NO: 383721 - DNA, 20 bp, Artificial Sequence
  chemically synthesized
ttgcagagcaggcacaccac

SEQ ID NO: 383722 - DNA, 20 bp, Artificial Sequence
  chemically synthesized
ctcactgccccgtgttctag

SEQ ID NO: 383723 - DNA, 20 bp, Artificial Sequence
  chemically synthesized
gcaggcacaccactagaaca

SEQ ID NO: 383724 - DNA, 20 bp, Artificial Sequence
  chemically synthesized
caggcacaccactagaacac

SEQ ID NO: 383725 - DNA, 20 bp, Artificial Sequence
  chemically synthesized
aggcacaccactagaacacg

SEQ ID NO: 383726 - DNA, 20 bp, Artificial Sequence
  chemically synthesized
tgactcactgccccgtgttc

SEQ ID NO: 383727 - DNA, 20 bp, Artificial Sequence
  chemically synthesized
cacaccactagaacacgggg

SEQ ID NO: 383728 - DNA, 20 bp, Artificial Sequence
  chemically synthesized
ccactagaacacggggcagt

SEQ ID NO: 383729 - DNA, 20 bp, Artificial Sequence
  chemically synthesized
tagaacacggggcagtgagt

SEQ ID NO: 383730 - DNA, 20 bp, Artificial Sequence
  chemically synthesized
agaacacggggcagtgagtc

SEQ ID NO: 383731 - DNA, 20 bp, Artificial Sequence
  chemically synthesized
aacacggggcagtgagtcag

SEQ ID NO: 383732 - DNA, 20 bp, Artificial Sequence
  chemically synthesized
acggggcagtgagtcaggag

SEQ ID NO: 383733 - DNA, 20 bp, Artificial Sequence
  chemically synthesized
cggggcagtgagtcaggagt

SEQ ID NO: 383734 - DNA, 20 bp, Artificial Sequence
  chemically synthesized
ggggcagtgagtcaggagta

SEQ ID NO: 383735 - DNA, 20 bp, Artificial Sequence
  chemically synthesized
cacctaatggcattgagata

SEQ ID NO: 383736 - DNA, 20 bp, Artificial Sequence
  chemically synthesized
agactacacctaatggcatt

SEQ ID NO: 383737 - DNA, 20 bp, Artificial Sequence
  chemically synthesized
ggtctttatctcaatgccat

SEQ ID NO: 383738 - DNA, 20 bp, Artificial Sequence
  chemically synthesized
gtctttatctcaatgccatt

SEQ ID NO: 383739 - DNA, 20 bp, Artificial Sequence
  chemically synthesized
tatctcaatgccattaggtg

SEQ ID NO: 383740 - DNA, 20 bp, Artificial Sequence
  chemically synthesized
ttgagcaagactacacctaa

SEQ ID NO: 383741 - DNA, 20 bp, Artificial Sequence
  chemically synthesized
agaaataaattaggttgagc

SEQ ID NO: 383742 - DNA, 20 bp, Artificial Sequence
  chemically synthesized
ccgcagaaataaattaggtt

SEQ ID NO: 383743 - DNA, 20 bp, Artificial Sequence
  chemically synthesized
ccaagccgcagaaataaatt

SEQ ID NO: 383744 - DNA, 20 bp, Artificial Sequence
  chemically synthesized
tccaagccgcagaaataaat

SEQ ID NO: 383745 - DNA, 20 bp, Artificial Sequence
  chemically synthesized
ctcaacctaatttatttctg

SEQ ID NO: 383746 - DNA, 20 bp, Artificial Sequence
  chemically synthesized
cctaatttatttctgcggct

SEQ ID NO: 383747 - DNA, 20 bp, Artificial Sequence
  chemically synthesized
tcagaaagcaatccaagccg

SEQ ID NO: 383748 - DNA, 20 bp, Artificial Sequence
  chemically synthesized
gaatagtcagaaagcaatcc

SEQ ID NO: 383749 - DNA, 20 bp, Artificial Sequence
  chemically synthesized
actgaagcagaatagtcaga

SEQ ID NO: 383750 - DNA, 20 bp, Artificial Sequence
  chemically synthesized
ttccactgaagcagaatagt

SEQ ID NO: 383751 - DNA, 20 bp, Artificial Sequence
  chemically synthesized
gacattccactgaagcagaa

SEQ ID NO: 383752 - DNA, 20 bp, Artificial Sequence
  chemically synthesized
gctttctgactattctgctt

SEQ ID NO: 383753 - DNA, 20 bp, Artificial Sequence
  chemically synthesized
ttctgactattctgcttcag

SEQ ID NO: 383754 - DNA, 20 bp, Artificial Sequence
  chemically synthesized
acaacgacattccactgaag

SEQ ID NO: 383755 - DNA, 20 bp, Artificial Sequence
  chemically synthesized
gtcacaacgacattccactg

SEQ ID NO: 383756 - DNA, 20 bp, Artificial Sequence
  chemically synthesized
tattttagtagcaacaaaat

SEQ ID NO: 383757 - DNA, 20 bp, Artificial Sequence
  chemically synthesized
ttgttacttaagtattttag

SEQ ID NO: 383758 - DNA, 20 bp, Artificial Sequence
  chemically synthesized
attttgttacttaagtattt

SEQ ID NO: 383759 - DNA, 20 bp, Artificial Sequence
  chemically synthesized
ttgttgctactaaaatactt

SEQ ID NO: 383760 - DNA, 20 bp, Artificial Sequence
  chemically synthesized
agaagtggattttgttactt

SEQ ID NO: 383761 - DNA, 20 bp, Artificial Sequence
  chemically synthesized
attaaatctttatcaagaag

SEQ ID NO: 383762 - DNA, 20 bp, Artificial Sequence
  chemically synthesized
acaaaatccacttcttgata

SEQ ID NO: 383763 - DNA, 20 bp, Artificial Sequence
  chemically synthesized
gacattaaatctttatcaag

SEQ ID NO: 383764 - DNA, 20 bp, Artificial Sequence
  chemically synthesized
gatgacattaaatctttatc

SEQ ID NO: 383765 - DNA, 20 bp, Artificial Sequence
  chemically synthesized
tttaatgtcatctaatccct

SEQ ID NO: 383766 - DNA, 20 bp, Artificial Sequence
  chemically synthesized
tgtccttaactcttagggat

SEQ ID NO: 383767 - DNA, 20 bp, Artificial Sequence
  chemically synthesized
taatgtcatctaatccctaa

SEQ ID NO: 383768 - DNA, 20 bp, Artificial Sequence
  chemically synthesized
tgtaatgtccttaactctta

SEQ ID NO: 383769 - DNA, 20 bp, Artificial Sequence
  chemically synthesized
tcatctaatccctaagagtt

SEQ ID NO: 383770 - DNA, 20 bp, Artificial Sequence
  chemically synthesized
ttgtaatgtccttaactctt

SEQ ID NO: 383771 - DNA, 20 bp, Artificial Sequence
  chemically synthesized
catctaatccctaagagtta

SEQ ID NO: 383772 - DNA, 20 bp, Artificial Sequence
  chemically synthesized
tttgtaatgtccttaactct

SEQ ID NO: 383773 - DNA, 20 bp, Artificial Sequence
  chemically synthesized
taagagttaaggacattaca

SEQ ID NO: 383774 - DNA, 20 bp, Artificial Sequence
  chemically synthesized
aaggacattacaaagattat

SEQ ID NO: 383775 - DNA, 20 bp, Artificial Sequence
  chemically synthesized
atcagtgaatcaatgaatat

SEQ ID NO: 383776 - DNA, 20 bp, Artificial Sequence
  chemically synthesized
agtgaatcaatgaatattgg

SEQ ID NO: 383777 - DNA, 20 bp, Artificial Sequence
  chemically synthesized
tagtcatcatcaaaaaacaa

SEQ ID NO: 383778 - DNA, 20 bp, Artificial Sequence
  chemically synthesized
agtcatcatcaaaaaacaat

SEQ ID NO: 383779 - DNA, 20 bp, Artificial Sequence
  chemically synthesized
tcatcaaaaaacaataggtt

SEQ ID NO: 383780 - DNA, 20 bp, Artificial Sequence
  chemically synthesized
atcaaaaaacaataggttga

SEQ ID NO: 383781 - DNA, 20 bp, Artificial Sequence
  chemically synthesized
aaacaataggttgagagttt

SEQ ID NO: 383782 - DNA, 20 bp, Artificial Sequence
  chemically synthesized
ttcttatatatggttttcat

SEQ ID NO: 383783 - DNA, 20 bp, Artificial Sequence
  chemically synthesized
aactaatgaaaaccatatat

SEQ ID NO: 383784 - DNA, 20 bp, Artificial Sequence
  chemically synthesized
atttataatgttcttatata

SEQ ID NO: 383785 - DNA, 20 bp, Artificial Sequence
  chemically synthesized
cattataaatatgattacaa

SEQ ID NO: 383786 - DNA, 20 bp, Artificial Sequence
  chemically synthesized
tacaatagatgcatctcttt

SEQ ID NO: 383787 - DNA, 20 bp, Artificial Sequence
  chemically synthesized
ttattaccttgtttctaaaa

SEQ ID NO: 383788 - DNA, 20 bp, Artificial Sequence
  chemically synthesized
gtttattaccttgtttctaa

SEQ ID NO: 383789 - DNA, 20 bp, Artificial Sequence
  chemically synthesized
gatgcatctcttttagaaac

SEQ ID NO: 383790 - DNA, 20 bp, Artificial Sequence
  chemically synthesized
atgcatctcttttagaaaca

SEQ ID NO: 383791 - DNA, 20 bp, Artificial Sequence
  chemically synthesized
gtaataaacactgtgcttcc

SEQ ID NO: 383792 - DNA, 20 bp, Artificial Sequence
  chemically synthesized
ttaaatacatcttggaagca

SEQ ID NO: 383793 - DNA, 20 bp, Artificial Sequence
  chemically synthesized
cattcttaaatacatcttgg

SEQ ID NO: 383794 - DNA, 20 bp, Artificial Sequence
  chemically synthesized
caacattcttaaatacatct

SEQ ID NO: 383795 - DNA, 20 bp, Artificial Sequence
  chemically synthesized
tgtgcttccaagatgtattt

SEQ ID NO: 383796 - DNA, 20 bp, Artificial Sequence
  chemically synthesized
agatgtatttaagaatgttg

SEQ ID NO: 383797 - DNA, 20 bp, Artificial Sequence
  chemically synthesized
gatgtatttaagaatgttga

SEQ ID NO: 383798 - DNA, 20 bp, Artificial Sequence
  chemically synthesized
gtatttaagaatgttgaagg

SEQ ID NO: 383799 - DNA, 20 bp, Artificial Sequence
  chemically synthesized
ttaagaatgttgaaggaagt

SEQ ID NO: 383800 - DNA, 20 bp, Artificial Sequence
  chemically synthesized
taagaatgttgaaggaagtg

SEQ ID NO: 383801 - DNA, 20 bp, Artificial Sequence
  chemically synthesized
gggggattataggcacaagt

SEQ ID NO: 383802 - DNA, 20 bp, Artificial Sequence
  chemically synthesized
cccagggggattataggcac

SEQ ID NO: 383803 - DNA, 20 bp, Artificial Sequence
  chemically synthesized
cagcctcccagggggattat

SEQ ID NO: 383804 - DNA, 20 bp, Artificial Sequence
  chemically synthesized
tcagcctcccagggggatta

SEQ ID NO: 383805 - DNA, 20 bp, Artificial Sequence
  chemically synthesized
acttgtgcctataatccccc

SEQ ID NO: 383806 - DNA, 20 bp, Artificial Sequence
  chemically synthesized
cttgtgcctataatccccct

SEQ ID NO: 383807 - DNA, 20 bp, Artificial Sequence
  chemically synthesized
tgtgcctataatccccctgg

SEQ ID NO: 383808 - DNA, 20 bp, Artificial Sequence
  chemically synthesized
gtgcctataatccccctggg

SEQ ID NO: 383809 - DNA, 20 bp, Artificial Sequence
  chemically synthesized
tcccacctcagcctcccagg

SEQ ID NO: 383810 - DNA, 20 bp, Artificial Sequence
  chemically synthesized
ctcccacctcagcctcccag

SEQ ID NO: 383811 - DNA, 20 bp, Artificial Sequence
  chemically synthesized
cctcccacctcagcctccca

SEQ ID NO: 383812 - DNA, 20 bp, Artificial Sequence
  chemically synthesized
ccctcccacctcagcctccc

SEQ ID NO: 383813 - DNA, 20 bp, Artificial Sequence
  chemically synthesized
tataatccccctgggaggct

SEQ ID NO: 383814 - DNA, 20 bp, Artificial Sequence
  chemically synthesized
accctcccacctcagcctcc

SEQ ID NO: 383815 - DNA, 20 bp, Artificial Sequence
  chemically synthesized
ataatccccctgggaggctg

SEQ ID NO: 383816 - DNA, 20 bp, Artificial Sequence
  chemically synthesized
atccccctgggaggctgagg

SEQ ID NO: 383817 - DNA, 20 bp, Artificial Sequence
  chemically synthesized
tccccctgggaggctgaggt

SEQ ID NO: 383818 - DNA, 20 bp, Artificial Sequence
  chemically synthesized
cccctgggaggctgaggtgg

SEQ ID NO: 383819 - DNA, 20 bp, Artificial Sequence
  chemically synthesized
ccctgggaggctgaggtggg

SEQ ID NO: 383820 - DNA, 20 bp, Artificial Sequence
  chemically synthesized
ctcaggtaaccctcccacct

SEQ ID NO: 383821 - DNA, 20 bp, Artificial Sequence
  chemically synthesized
cctgggaggctgaggtggga

SEQ ID NO: 383822 - DNA, 20 bp, Artificial Sequence
  chemically synthesized
ctgaggtgggagggttacct

SEQ ID NO: 383823 - DNA, 20 bp, Artificial Sequence
  chemically synthesized
tgaggtgggagggttacctg

SEQ ID NO: 383824 - DNA, 20 bp, Artificial Sequence
  chemically synthesized
gtgggagggttacctgaggc

SEQ ID NO: 383825 - DNA, 20 bp, Artificial Sequence
  chemically synthesized
tgggagggttacctgaggcc

SEQ ID NO: 383826 - DNA, 20 bp, Artificial Sequence
  chemically synthesized
gatctctaactcctggcctc

SEQ ID NO: 383827 - DNA, 20 bp, Artificial Sequence
  chemically synthesized
ggagggttacctgaggccag

SEQ ID NO: 383828 - DNA, 20 bp, Artificial Sequence
  chemically synthesized
tgatctctaactcctggcct

SEQ ID NO: 383829 - DNA, 20 bp, Artificial Sequence
  chemically synthesized
ggttacctgaggccaggagt

SEQ ID NO: 383830 - DNA, 20 bp, Artificial Sequence
  chemically synthesized
ttacctgaggccaggagtta

SEQ ID NO: 383831 - DNA, 20 bp, Artificial Sequence
  chemically synthesized
ccaggctgatctctaactcc

SEQ ID NO: 383832 - DNA, 20 bp, Artificial Sequence
  chemically synthesized
tgaggccaggagttagagat

SEQ ID NO: 383833 - DNA, 20 bp, Artificial Sequence
  chemically synthesized
ccaggagttagagatcagcc

SEQ ID NO: 383834 - DNA, 20 bp, Artificial Sequence
  chemically synthesized
caggagttagagatcagcct

SEQ ID NO: 383835 - DNA, 20 bp, Artificial Sequence
  chemically synthesized
atggtctctctttgttgccc

SEQ ID NO: 383836 - DNA, 20 bp, Artificial Sequence
  chemically synthesized
agagatcagcctgggcaaca

SEQ ID NO: 383837 - DNA, 20 bp, Artificial Sequence
  chemically synthesized
tatggtctctctttgttgcc

SEQ ID NO: 383838 - DNA, 20 bp, Artificial Sequence
  chemically synthesized
agatcagcctgggcaacaaa

SEQ ID NO: 383839 - DNA, 20 bp, Artificial Sequence
  chemically synthesized
atcagcctgggcaacaaaga

SEQ ID NO: 383840 - DNA, 20 bp, Artificial Sequence
  chemically synthesized
acaaaattcttttaaagata

SEQ ID NO: 383841 - DNA, 20 bp, Artificial Sequence
  chemically synthesized
aagagagaccatatctttaa

SEQ ID NO: 383842 - DNA, 20 bp, Artificial Sequence
  chemically synthesized
actaaaacaaaattctttta

SEQ ID NO: 383843 - DNA, 20 bp, Artificial Sequence
  chemically synthesized
tctttaaaagaattttgttt

SEQ ID NO: 383844 - DNA, 20 bp, Artificial Sequence
  chemically synthesized
taaaagaattttgttttagt

SEQ ID NO: 383845 - DNA, 20 bp, Artificial Sequence
  chemically synthesized
agaattttgttttagttagc

SEQ ID NO: 383846 - DNA, 20 bp, Artificial Sequence
  chemically synthesized
gaattttgttttagttagcc

SEQ ID NO: 383847 - DNA, 20 bp, Artificial Sequence
  chemically synthesized
ttgttttagttagccaggtg

SEQ ID NO: 383848 - DNA, 20 bp, Artificial Sequence
  chemically synthesized
ttttagttagccaggtgaag

SEQ ID NO: 383849 - DNA, 20 bp, Artificial Sequence
  chemically synthesized
caggtgggtgccacttcacc

SEQ ID NO: 383850 - DNA, 20 bp, Artificial Sequence
  chemically synthesized
gaatagctgggattacaggt

SEQ ID NO: 383851 - DNA, 20 bp, Artificial Sequence
  chemically synthesized
tgaatagctgggattacagg

SEQ ID NO: 383852 - DNA, 20 bp, Artificial Sequence
  chemically synthesized
gtggcacccacctgtaatcc

SEQ ID NO: 383853 - DNA, 20 bp, Artificial Sequence
  chemically synthesized
tcctgaatagctgggattac

SEQ ID NO: 383854 - DNA, 20 bp, Artificial Sequence
  chemically synthesized
ctcctgaatagctgggatta

SEQ ID NO: 383855 - DNA, 20 bp, Artificial Sequence
  chemically synthesized
cacctgtaatcccagctatt

SEQ ID NO: 383856 - DNA, 20 bp, Artificial Sequence
  chemically synthesized
agcaatcctcctgaatagct

SEQ ID NO: 383857 - DNA, 20 bp, Artificial Sequence
  chemically synthesized
acctgtaatcccagctattc

SEQ ID NO: 383858 - DNA, 20 bp, Artificial Sequence
  chemically synthesized
aagcaatcctcctgaatagc

SEQ ID NO: 383859 - DNA, 20 bp, Artificial Sequence
  chemically synthesized
ctgtaatcccagctattcag

SEQ ID NO: 383860 - DNA, 20 bp, Artificial Sequence
  chemically synthesized
tgtaatcccagctattcagg

SEQ ID NO: 383861 - DNA, 20 bp, Artificial Sequence
  chemically synthesized
gttcaagcaatcctcctgaa

SEQ ID NO: 383862 - DNA, 20 bp, Artificial Sequence
  chemically synthesized
tcaggaggattgcttgaacc

SEQ ID NO: 383863 - DNA, 20 bp, Artificial Sequence
  chemically synthesized
caggaggattgcttgaacct

SEQ ID NO: 383864 - DNA, 20 bp, Artificial Sequence
  chemically synthesized
aggaggattgcttgaaccta

SEQ ID NO: 383865 - DNA, 20 bp, Artificial Sequence
  chemically synthesized
aggcttgaacccctaggttc

SEQ ID NO: 383866 - DNA, 20 bp, Artificial Sequence
  chemically synthesized
ggaggattgcttgaacctag

SEQ ID NO: 383867 - DNA, 20 bp, Artificial Sequence
  chemically synthesized
tcacccaggcttgaacccct

SEQ ID NO: 383868 - DNA, 20 bp, Artificial Sequence
  chemically synthesized
ttgcttgaacctaggggttc

SEQ ID NO: 383869 - DNA, 20 bp, Artificial Sequence
  chemically synthesized
gtcacccaggcttgaacccc

SEQ ID NO: 383870 - DNA, 20 bp, Artificial Sequence
  chemically synthesized
tgaacctaggggttcaagcc

SEQ ID NO: 383871 - DNA, 20 bp, Artificial Sequence
  chemically synthesized
gaacctaggggttcaagcct

SEQ ID NO: 383872 - DNA, 20 bp, Artificial Sequence
  chemically synthesized
aggggttcaagcctgggtga

SEQ ID NO: 383873 - DNA, 20 bp, Artificial Sequence
  chemically synthesized
gcggtatttctctgtcaccc

SEQ ID NO: 383874 - DNA, 20 bp, Artificial Sequence
  chemically synthesized
gggttcaagcctgggtgaca

SEQ ID NO: 383875 - DNA, 20 bp, Artificial Sequence
  chemically synthesized
tgcggtatttctctgtcacc

SEQ ID NO: 383876 - DNA, 20 bp, Artificial Sequence
  chemically synthesized
taaaattgtttttagagatg

SEQ ID NO: 383877 - DNA, 20 bp, Artificial Sequence
  chemically synthesized
taaatttaaaattgttttta

SEQ ID NO: 383878 - DNA, 20 bp, Artificial Sequence
  chemically synthesized
tttaaatttaaaattgtttt

SEQ ID NO: 383879 - DNA, 20 bp, Artificial Sequence
  chemically synthesized
aacaattttaaatttaaaaa

SEQ ID NO: 383880 - DNA, 20 bp, Artificial Sequence
  chemically synthesized
ttaaatttaaaaatagaaaa

SEQ ID NO: 383881 - DNA, 20 bp, Artificial Sequence
  chemically synthesized
tagaaaaaagcatgctacac

SEQ ID NO: 383882 - DNA, 20 bp, Artificial Sequence
  chemically synthesized
agaaaaaagcatgctacact

SEQ ID NO: 383883 - DNA, 20 bp, Artificial Sequence
  chemically synthesized
atagatcttggggcccagtg

SEQ ID NO: 383884 - DNA, 20 bp, Artificial Sequence
  chemically synthesized
agcatgctacactgggcccc

SEQ ID NO: 383885 - DNA, 20 bp, Artificial Sequence
  chemically synthesized
caagcatagatcttggggcc

SEQ ID NO: 383886 - DNA, 20 bp, Artificial Sequence
  chemically synthesized
ggaggcaagcatagatcttg

SEQ ID NO: 383887 - DNA, 20 bp, Artificial Sequence
  chemically synthesized
tggaggcaagcatagatctt

SEQ ID NO: 383888 - DNA, 20 bp, Artificial Sequence
  chemically synthesized
ttggaggcaagcatagatct

SEQ ID NO: 383889 - DNA, 20 bp, Artificial Sequence
  chemically synthesized
ggaaaaattggaggcaagca

SEQ ID NO: 383890 - DNA, 20 bp, Artificial Sequence
  chemically synthesized
attggggaaaaattggaggc

SEQ ID NO: 383891 - DNA, 20 bp, Artificial Sequence
  chemically synthesized
aaaaattggggaaaaattgg

SEQ ID NO: 383892 - DNA, 20 bp, Artificial Sequence
  chemically synthesized
taaaaattggggaaaaattg

SEQ ID NO: 383893 - DNA, 20 bp, Artificial Sequence
  chemically synthesized
cataaaaattggggaaaaat

SEQ ID NO: 383894 - DNA, 20 bp, Artificial Sequence
  chemically synthesized
aagggaaatcataaaaattg

SEQ ID NO: 383895 - DNA, 20 bp, Artificial Sequence
  chemically synthesized
aaagggaaatcataaaaatt

SEQ ID NO: 383896 - DNA, 20 bp, Artificial Sequence
  chemically synthesized
caaagggaaatcataaaaat

SEQ ID NO: 383897 - DNA, 20 bp, Artificial Sequence
  chemically synthesized
caaatatcacattacacaaa

SEQ ID NO: 383898 - DNA, 20 bp, Artificial Sequence
  chemically synthesized
tcaaatatcacattacacaa

SEQ ID NO: 383899 - DNA, 20 bp, Artificial Sequence
  chemically synthesized
atcaaatatcacattacaca

SEQ ID NO: 383900 - DNA, 20 bp, Artificial Sequence
  chemically synthesized
atgtgatatttgatgcataa

SEQ ID NO: 383901 - DNA, 20 bp, Artificial Sequence
  chemically synthesized
gcataaaagaatatatgtaa

SEQ ID NO: 383902 - DNA, 20 bp, Artificial Sequence
  chemically synthesized
taatggatatgtaaattaca

SEQ ID NO: 383903 - DNA, 20 bp, Artificial Sequence
  chemically synthesized
catatgtttgttttattatt

SEQ ID NO: 383904 - DNA, 20 bp, Artificial Sequence
  chemically synthesized
taatatttcagttattggga

SEQ ID NO: 383905 - DNA, 20 bp, Artificial Sequence
  chemically synthesized
ttgctaatatttcagttatt

SEQ ID NO: 383906 - DNA, 20 bp, Artificial Sequence
  chemically synthesized
gttgctaatatttcagttat

SEQ ID NO: 383907 - DNA, 20 bp, Artificial Sequence
  chemically synthesized
catcccaataactgaaatat

SEQ ID NO: 383908 - DNA, 20 bp, Artificial Sequence
  chemically synthesized
gtgagttgttgctaatattt

SEQ ID NO: 383909 - DNA, 20 bp, Artificial Sequence
  chemically synthesized
gagcacataggttcaggtgt

SEQ ID NO: 383910 - DNA, 20 bp, Artificial Sequence
  chemically synthesized
gtgtaggagcacataggttc

SEQ ID NO: 383911 - DNA, 20 bp, Artificial Sequence
  chemically synthesized
agtgtaggagcacataggtt

SEQ ID NO: 383912 - DNA, 20 bp, Artificial Sequence
  chemically synthesized
gaactagtgtaggagcacat

SEQ ID NO: 383913 - DNA, 20 bp, Artificial Sequence
  chemically synthesized
agaactagtgtaggagcaca

SEQ ID NO: 383914 - DNA, 20 bp, Artificial Sequence
  chemically synthesized
gaacctatgtgctcctacac

SEQ ID NO: 383915 - DNA, 20 bp, Artificial Sequence
  chemically synthesized
agagtgaagaactagtgtag

SEQ ID NO: 383916 - DNA, 20 bp, Artificial Sequence
  chemically synthesized
aaagagtgaagaactagtgt

SEQ ID NO: 383917 - DNA, 20 bp, Artificial Sequence
  chemically synthesized
aaaagagtgaagaactagtg

SEQ ID NO: 383918 - DNA, 20 bp, Artificial Sequence
  chemically synthesized
ggtacaaaagagtgaagaac

SEQ ID NO: 383919 - DNA, 20 bp, Artificial Sequence
  chemically synthesized
gggaggggtacaaaagagtg

SEQ ID NO: 383920 - DNA, 20 bp, Artificial Sequence
  chemically synthesized
atggagggaggggtacaaaa

SEQ ID NO: 383921 - DNA, 20 bp, Artificial Sequence
  chemically synthesized
aaatggagggaggggtacaa

SEQ ID NO: 383922 - DNA, 20 bp, Artificial Sequence
  chemically synthesized
tcctgggtaaatggagggag

SEQ ID NO: 383923 - DNA, 20 bp, Artificial Sequence
  chemically synthesized
atcctgggtaaatggaggga

SEQ ID NO: 383924 - DNA, 20 bp, Artificial Sequence
  chemically synthesized
aatcctgggtaaatggaggg

SEQ ID NO: 383925 - DNA, 20 bp, Artificial Sequence
  chemically synthesized
taatcctgggtaaatggagg

SEQ ID NO: 383926 - DNA, 20 bp, Artificial Sequence
  chemically synthesized
gttaatcctgggtaaatgga

SEQ ID NO: 383927 - DNA, 20 bp, Artificial Sequence
  chemically synthesized
agttaatcctgggtaaatgg

SEQ ID NO: 383928 - DNA, 20 bp, Artificial Sequence
  chemically synthesized
tagttaatcctgggtaaatg

SEQ ID NO: 383929 - DNA, 20 bp, Artificial Sequence
  chemically synthesized
tacccctccctccatttacc

SEQ ID NO: 383930 - DNA, 20 bp, Artificial Sequence
  chemically synthesized
acccctccctccatttaccc

SEQ ID NO: 383931 - DNA, 20 bp, Artificial Sequence
  chemically synthesized
ggtagttaatcctgggtaaa

SEQ ID NO: 383932 - DNA, 20 bp, Artificial Sequence
  chemically synthesized
tctggatggtagttaatcct

SEQ ID NO: 383933 - DNA, 20 bp, Artificial Sequence
  chemically synthesized
ttctggatggtagttaatcc

SEQ ID NO: 383934 - DNA, 20 bp, Artificial Sequence
  chemically synthesized
acccaggattaactaccatc

SEQ ID NO: 383935 - DNA, 20 bp, Artificial Sequence
  chemically synthesized
aatccccagattctggatgg

SEQ ID NO: 383936 - DNA, 20 bp, Artificial Sequence
  chemically synthesized
gacaatccccagattctgga

SEQ ID NO: 383937 - DNA, 20 bp, Artificial Sequence
  chemically synthesized
attaactaccatccagaatc

SEQ ID NO: 383938 - DNA, 20 bp, Artificial Sequence
  chemically synthesized
ttaactaccatccagaatct

SEQ ID NO: 383939 - DNA, 20 bp, Artificial Sequence
  chemically synthesized
taactaccatccagaatctg

SEQ ID NO: 383940 - DNA, 20 bp, Artificial Sequence
  chemically synthesized
atatgacaatccccagattc

SEQ ID NO: 383941 - DNA, 20 bp, Artificial Sequence
  chemically synthesized
ggcaatgatatgacaatccc

SEQ ID NO: 383942 - DNA, 20 bp, Artificial Sequence
  chemically synthesized
gagcaaacaaaagaaatcaa

SEQ ID NO: 383943 - DNA, 20 bp, Artificial Sequence
  chemically synthesized
tgagcaaacaaaagaaatca

SEQ ID NO: 383944 - DNA, 20 bp, Artificial Sequence
  chemically synthesized
caaaacaaatgagcaaacaa

SEQ ID NO: 383945 - DNA, 20 bp, Artificial Sequence
  chemically synthesized
aaaaccaacacaaaacaaat

SEQ ID NO: 383946 - DNA, 20 bp, Artificial Sequence
  chemically synthesized
tttgctcatttgttttgtgt

SEQ ID NO: 383947 - DNA, 20 bp, Artificial Sequence
  chemically synthesized
acctaatgaaaatattgttt

SEQ ID NO: 383948 - DNA, 20 bp, Artificial Sequence
  chemically synthesized
tgccaaaacaatattttcat

SEQ ID NO: 383949 - DNA, 20 bp, Artificial Sequence
  chemically synthesized
gccaaaacaatattttcatt

SEQ ID NO: 383950 - DNA, 20 bp, Artificial Sequence
  chemically synthesized
cattaggtgttcctatgctt

SEQ ID NO: 383951 - DNA, 20 bp, Artificial Sequence
  chemically synthesized
actccagaaagctcaagcat

SEQ ID NO: 383952 - DNA, 20 bp, Artificial Sequence
  chemically synthesized
cactccagaaagctcaagca

SEQ ID NO: 383953 - DNA, 20 bp, Artificial Sequence
  chemically synthesized
gacaacactccagaaagctc

SEQ ID NO: 383954 - DNA, 20 bp, Artificial Sequence
  chemically synthesized
gttcctatgcttgagctttc

SEQ ID NO: 383955 - DNA, 20 bp, Artificial Sequence
  chemically synthesized
tcctatgcttgagctttctg

SEQ ID NO: 383956 - DNA, 20 bp, Artificial Sequence
  chemically synthesized
gtattagacaacactccaga

SEQ ID NO: 383957 - DNA, 20 bp, Artificial Sequence
  chemically synthesized
ccttgtattagacaacactc

SEQ ID NO: 383958 - DNA, 20 bp, Artificial Sequence
  chemically synthesized
tctggagtgttgtctaatac

SEQ ID NO: 383959 - DNA, 20 bp, Artificial Sequence
  chemically synthesized
ctggagtgttgtctaataca

SEQ ID NO: 383960 - DNA, 20 bp, Artificial Sequence
  chemically synthesized
tggagtgttgtctaatacaa

SEQ ID NO: 383961 - DNA, 20 bp, Artificial Sequence
  chemically synthesized
tagtgtgctgacccttgtat

SEQ ID NO: 383962 - DNA, 20 bp, Artificial Sequence
  chemically synthesized
gtgttgtctaatacaagggt

SEQ ID NO: 383963 - DNA, 20 bp, Artificial Sequence
  chemically synthesized
ggtcagcacactaccgccca

SEQ ID NO: 383964 - DNA, 20 bp, Artificial Sequence
  chemically synthesized
gccggggagcccatgggcgg

SEQ ID NO: 383965 - DNA, 20 bp, Artificial Sequence
  chemically synthesized
gtcagcacactaccgcccat

SEQ ID NO: 383966 - DNA, 20 bp, Artificial Sequence
  chemically synthesized
agagccggggagcccatggg

SEQ ID NO: 383967 - DNA, 20 bp, Artificial Sequence
  chemically synthesized
tccagagccggggagcccat

SEQ ID NO: 383968 - DNA, 20 bp, Artificial Sequence
  chemically synthesized
ctccagagccggggagccca

SEQ ID NO: 383969 - DNA, 20 bp, Artificial Sequence
  chemically synthesized
actaccgcccatgggctccc

SEQ ID NO: 383970 - DNA, 20 bp, Artificial Sequence
  chemically synthesized
gcactcactccagagccggg

SEQ ID NO: 383971 - DNA, 20 bp, Artificial Sequence
  chemically synthesized
gcccatgggctccccggctc

SEQ ID NO: 383972 - DNA, 20 bp, Artificial Sequence
  chemically synthesized
gtgcactcactccagagccg

SEQ ID NO: 383973 - DNA, 20 bp, Artificial Sequence
  chemically synthesized
ccatgggctccccggctctg

SEQ ID NO: 383974 - DNA, 20 bp, Artificial Sequence
  chemically synthesized
agtgcactcactccagagcc

SEQ ID NO: 383975 - DNA, 20 bp, Artificial Sequence
  chemically synthesized
aagtgcactcactccagagc

SEQ ID NO: 383976 - DNA, 20 bp, Artificial Sequence
  chemically synthesized
gggctccccggctctggagt

SEQ ID NO: 383977 - DNA, 20 bp, Artificial Sequence
  chemically synthesized
ggggaagtgcactcactcca

SEQ ID NO: 383978 - DNA, 20 bp, Artificial Sequence
  chemically synthesized
ctggggaagtgcactcactc

SEQ ID NO: 383979 - DNA, 20 bp, Artificial Sequence
  chemically synthesized
ctggagtgagtgcacttccc

SEQ ID NO: 383980 - DNA, 20 bp, Artificial Sequence
  chemically synthesized
tggagtgagtgcacttcccc

SEQ ID NO: 383981 - DNA, 20 bp, Artificial Sequence
  chemically synthesized
cactgcgctccagcctgggg

SEQ ID NO: 383982 - DNA, 20 bp, Artificial Sequence
  chemically synthesized
gtgagtgcacttccccaggc

SEQ ID NO: 383983 - DNA, 20 bp, Artificial Sequence
  chemically synthesized
gagtgcacttccccaggctg

SEQ ID NO: 383984 - DNA, 20 bp, Artificial Sequence
  chemically synthesized
cgccactgcgctccagcctg

SEQ ID NO: 383985 - DNA, 20 bp, Artificial Sequence
  chemically synthesized
gcgccactgcgctccagcct

SEQ ID NO: 383986 - DNA, 20 bp, Artificial Sequence
  chemically synthesized
cgcgccactgcgctccagcc

SEQ ID NO: 383987 - DNA, 20 bp, Artificial Sequence
  chemically synthesized
cacttccccaggctggagcg

SEQ ID NO: 383988 - DNA, 20 bp, Artificial Sequence
  chemically synthesized
gagatcgcgccactgcgctc

SEQ ID NO: 383989 - DNA, 20 bp, Artificial Sequence
  chemically synthesized
ttccccaggctggagcgcag

SEQ ID NO: 383990 - DNA, 20 bp, Artificial Sequence
  chemically synthesized
ggagcgcagtggcgcgatct

SEQ ID NO: 383991 - DNA, 20 bp, Artificial Sequence
  chemically synthesized
ggcggagcttgcagtgagcc

SEQ ID NO: 383992 - DNA, 20 bp, Artificial Sequence
  chemically synthesized
gcgcgatctcggctcactgc

SEQ ID NO: 383993 - DNA, 20 bp, Artificial Sequence
  chemically synthesized
cgggaggcggagcttgcagt

SEQ ID NO: 383994 - DNA, 20 bp, Artificial Sequence
  chemically synthesized
aacccgggaggcggagcttg

SEQ ID NO: 383995 - DNA, 20 bp, Artificial Sequence
  chemically synthesized
tcactgcaagctccgcctcc

SEQ ID NO: 383996 - DNA, 20 bp, Artificial Sequence
  chemically synthesized
tggcgtgaacccgggaggcg

SEQ ID NO: 383997 - DNA, 20 bp, Artificial Sequence
  chemically synthesized
cactgcaagctccgcctccc

SEQ ID NO: 383998 - DNA, 20 bp, Artificial Sequence
  chemically synthesized
aatggcgtgaacccgggagg

SEQ ID NO: 383999 - DNA, 20 bp, Artificial Sequence
  chemically synthesized
gagaatggcgtgaacccggg

SEQ ID NO: 384000 - DNA, 20 bp, Artificial Sequence
  chemically synthesized
ggagaatggcgtgaacccgg

SEQ ID NO: 384001 - DNA, 20 bp, Artificial Sequence
  chemically synthesized
caggagaatggcgtgaaccc

SEQ ID NO: 384002 - DNA, 20 bp, Artificial Sequence
  chemically synthesized
gcaggagaatggcgtgaacc

SEQ ID NO: 384003 - DNA, 20 bp, Artificial Sequence
  chemically synthesized
gggaggctgaggcaggagaa

SEQ ID NO: 384004 - DNA, 20 bp, Artificial Sequence
  chemically synthesized
ttcacgccattctcctgcct

SEQ ID NO: 384005 - DNA, 20 bp, Artificial Sequence
  chemically synthesized
tactcgggaggctgaggcag

SEQ ID NO: 384006 - DNA, 20 bp, Artificial Sequence
  chemically synthesized
gctactcgggaggctgaggc

SEQ ID NO: 384007 - DNA, 20 bp, Artificial Sequence
  chemically synthesized
agctactcgggaggctgagg

SEQ ID NO: 384008 - DNA, 20 bp, Artificial Sequence
  chemically synthesized
cccagctactcgggaggctg

SEQ ID NO: 384009 - DNA, 20 bp, Artificial Sequence
  chemically synthesized
tcccagctactcgggaggct

SEQ ID NO: 384010 - DNA, 20 bp, Artificial Sequence
  chemically synthesized
ttctcctgcctcagcctccc

SEQ ID NO: 384011 - DNA, 20 bp, Artificial Sequence
  chemically synthesized
tcctgcctcagcctcccgag

SEQ ID NO: 384012 - DNA, 20 bp, Artificial Sequence
  chemically synthesized
tgtagtcccagctactcggg

SEQ ID NO: 384013 - DNA, 20 bp, Artificial Sequence
  chemically synthesized
ctgtagtcccagctactcgg

SEQ ID NO: 384014 - DNA, 20 bp, Artificial Sequence
  chemically synthesized
gcctcagcctcccgagtagc

SEQ ID NO: 384015 - DNA, 20 bp, Artificial Sequence
  chemically synthesized
gcctgtagtcccagctactc

SEQ ID NO: 384016 - DNA, 20 bp, Artificial Sequence
  chemically synthesized
cctcagcctcccgagtagct

SEQ ID NO: 384017 - DNA, 20 bp, Artificial Sequence
  chemically synthesized
cgcctgtagtcccagctact

SEQ ID NO: 384018 - DNA, 20 bp, Artificial Sequence
  chemically synthesized
ctcccgagtagctgggacta

SEQ ID NO: 384019 - DNA, 20 bp, Artificial Sequence
  chemically synthesized
tcccgagtagctgggactac

SEQ ID NO: 384020 - DNA, 20 bp, Artificial Sequence
  chemically synthesized
gtggcgggcgcctgtagtcc

SEQ ID NO: 384021 - DNA, 20 bp, Artificial Sequence
  chemically synthesized
ggcgtggtggcgggcgcctg

SEQ ID NO: 384022 - DNA, 20 bp, Artificial Sequence
  chemically synthesized
aattagcggggcgtggtggc

SEQ ID NO: 384023 - DNA, 20 bp, Artificial Sequence
  chemically synthesized
aaattagcggggcgtggtgg

SEQ ID NO: 384024 - DNA, 20 bp, Artificial Sequence
  chemically synthesized
aagaaattagcggggcgtgg

SEQ ID NO: 384025 - DNA, 20 bp, Artificial Sequence
  chemically synthesized
tacaagaaattagcggggcg

SEQ ID NO: 384026 - DNA, 20 bp, Artificial Sequence
  chemically synthesized
aaaaatacaagaaattagcg

SEQ ID NO: 384027 - DNA, 20 bp, Artificial Sequence
  chemically synthesized
taaaaatacaagaaattagc

SEQ ID NO: 384028 - DNA, 20 bp, Artificial Sequence
  chemically synthesized
ctaaaaatacaagaaattag

SEQ ID NO: 384029 - DNA, 20 bp, Artificial Sequence
  chemically synthesized
ctactaaaaatacaagaaat

SEQ ID NO: 384030 - DNA, 20 bp, Artificial Sequence
  chemically synthesized
ccgctaatttcttgtatttt

SEQ ID NO: 384031 - DNA, 20 bp, Artificial Sequence
  chemically synthesized
cccgtctctactaaaaatac

SEQ ID NO: 384032 - DNA, 20 bp, Artificial Sequence
  chemically synthesized
ctaatttcttgtatttttag

SEQ ID NO: 384033 - DNA, 20 bp, Artificial Sequence
  chemically synthesized
aatttcttgtatttttagta

SEQ ID NO: 384034 - DNA, 20 bp, Artificial Sequence
  chemically synthesized
tcttgtatttttagtagaga

SEQ ID NO: 384035 - DNA, 20 bp, Artificial Sequence
  chemically synthesized
cttgtatttttagtagagac

SEQ ID NO: 384036 - DNA, 20 bp, Artificial Sequence
  chemically synthesized
ttgtatttttagtagagacg

SEQ ID NO: 384037 - DNA, 20 bp, Artificial Sequence
  chemically synthesized
gagacggggtttcaccgtgt

SEQ ID NO: 384038 - DNA, 20 bp, Artificial Sequence
  chemically synthesized
cggggtttcaccgtgttagc

SEQ ID NO: 384039 - DNA, 20 bp, Artificial Sequence
  chemically synthesized
cgagaccatcctggctaaca

SEQ ID NO: 384040 - DNA, 20 bp, Artificial Sequence
  chemically synthesized
ggggtttcaccgtgttagcc

SEQ ID NO: 384041 - DNA, 20 bp, Artificial Sequence
  chemically synthesized
tttcaccgtgttagccagga

SEQ ID NO: 384042 - DNA, 20 bp, Artificial Sequence
  chemically synthesized
tcagcagatcgagaccatcc

SEQ ID NO: 384043 - DNA, 20 bp, Artificial Sequence
  chemically synthesized
gatcatgaggtcagcagatc

SEQ ID NO: 384044 - DNA, 20 bp, Artificial Sequence
  chemically synthesized
tgggcggatcatgaggtcag

SEQ ID NO: 384045 - DNA, 20 bp, Artificial Sequence
  chemically synthesized
agatgggcggatcatgaggt

SEQ ID NO: 384046 - DNA, 20 bp, Artificial Sequence
  chemically synthesized
gccgagatgggcggatcatg

SEQ ID NO: 384047 - DNA, 20 bp, Artificial Sequence
  chemically synthesized
ggccgagatgggcggatcat

SEQ ID NO: 384048 - DNA, 20 bp, Artificial Sequence
  chemically synthesized
acctcatgatccgcccatct

SEQ ID NO: 384049 - DNA, 20 bp, Artificial Sequence
  chemically synthesized
ctttgggaggccgagatggg

SEQ ID NO: 384050 - DNA, 20 bp, Artificial Sequence
  chemically synthesized
gcactttgggaggccgagat

SEQ ID NO: 384051 - DNA, 20 bp, Artificial Sequence
  chemically synthesized
agcactttgggaggccgaga

SEQ ID NO: 384052 - DNA, 20 bp, Artificial Sequence
  chemically synthesized
tcccagcactttgggaggcc

SEQ ID NO: 384053 - DNA, 20 bp, Artificial Sequence
  chemically synthesized
ccgcccatctcggcctccca

SEQ ID NO: 384054 - DNA, 20 bp, Artificial Sequence
  chemically synthesized
tgtaatcccagcactttggg

SEQ ID NO: 384055 - DNA, 20 bp, Artificial Sequence
  chemically synthesized
ctgtaatcccagcactttgg

SEQ ID NO: 384056 - DNA, 20 bp, Artificial Sequence
  chemically synthesized
atctcggcctcccaaagtgc

SEQ ID NO: 384057 - DNA, 20 bp, Artificial Sequence
  chemically synthesized
gcctgtaatcccagcacttt

SEQ ID NO: 384058 - DNA, 20 bp, Artificial Sequence
  chemically synthesized
tctcggcctcccaaagtgct

SEQ ID NO: 384059 - DNA, 20 bp, Artificial Sequence
  chemically synthesized
cgcctgtaatcccagcactt

SEQ ID NO: 384060 - DNA, 20 bp, Artificial Sequence
  chemically synthesized
ctcccaaagtgctgggatta

SEQ ID NO: 384061 - DNA, 20 bp, Artificial Sequence
  chemically synthesized
tcccaaagtgctgggattac

SEQ ID NO: 384062 - DNA, 20 bp, Artificial Sequence
  chemically synthesized
gtggctcacgcctgtaatcc

SEQ ID NO: 384063 - DNA, 20 bp, Artificial Sequence
  chemically synthesized
agtgctgggattacaggcgt

SEQ ID NO: 384064 - DNA, 20 bp, Artificial Sequence
  chemically synthesized
caggcgtgagccaccgcgcc

SEQ ID NO: 384065 - DNA, 20 bp, Artificial Sequence
  chemically synthesized
gtcagggaggccgggcgcgg

SEQ ID NO: 384066 - DNA, 20 bp, Artificial Sequence
  chemically synthesized
actgtcagggaggccgggcg

SEQ ID NO: 384067 - DNA, 20 bp, Artificial Sequence
  chemically synthesized
taaaaactgtcagggaggcc

SEQ ID NO: 384068 - DNA, 20 bp, Artificial Sequence
  chemically synthesized
ttaaaaactgtcagggaggc

SEQ ID NO: 384069 - DNA, 20 bp, Artificial Sequence
  chemically synthesized
accgcgcccggcctccctga

SEQ ID NO: 384070 - DNA, 20 bp, Artificial Sequence
  chemically synthesized
atttttaaaaactgtcaggg

SEQ ID NO: 384071 - DNA, 20 bp, Artificial Sequence
  chemically synthesized
catttttaaaaactgtcagg

SEQ ID NO: 384072 - DNA, 20 bp, Artificial Sequence
  chemically synthesized
ttcatttttaaaaactgtca

SEQ ID NO: 384073 - DNA, 20 bp, Artificial Sequence
  chemically synthesized
cttcatttttaaaaactgtc

SEQ ID NO: 384074 - DNA, 20 bp, Artificial Sequence
  chemically synthesized
acttcatttttaaaaactgt

SEQ ID NO: 384075 - DNA, 20 bp, Artificial Sequence
  chemically synthesized
cctgacagtttttaaaaatg

SEQ ID NO: 384076 - DNA, 20 bp, Artificial Sequence
  chemically synthesized
ttttaaaaatgaagttttat

SEQ ID NO: 384077 - DNA, 20 bp, Artificial Sequence
  chemically synthesized
atgagtgaataggtgtgagt

SEQ ID NO: 384078 - DNA, 20 bp, Artificial Sequence
  chemically synthesized
ttatatgagtgaataggtgt

SEQ ID NO: 384079 - DNA, 20 bp, Artificial Sequence
  chemically synthesized
tagttattatatgagtgaat

SEQ ID NO: 384080 - DNA, 20 bp, Artificial Sequence
  chemically synthesized
atagttattatatgagtgaa

SEQ ID NO: 384081 - DNA, 20 bp, Artificial Sequence
  chemically synthesized
agcagccatagttattatat

SEQ ID NO: 384082 - DNA, 20 bp, Artificial Sequence
  chemically synthesized
attcactcatataataacta

SEQ ID NO: 384083 - DNA, 20 bp, Artificial Sequence
  chemically synthesized
ttgtggcatcaaagcagcca

SEQ ID NO: 384084 - DNA, 20 bp, Artificial Sequence
  chemically synthesized
atgttgttgtggcatcaaag

SEQ ID NO: 384085 - DNA, 20 bp, Artificial Sequence
  chemically synthesized
actatgttgttgtggcatca

SEQ ID NO: 384086 - DNA, 20 bp, Artificial Sequence
  chemically synthesized
aatacctaactatgttgttg

SEQ ID NO: 384087 - DNA, 20 bp, Artificial Sequence
  chemically synthesized
gctttgatgccacaacaaca

SEQ ID NO: 384088 - DNA, 20 bp, Artificial Sequence
  chemically synthesized
tgatgccacaacaacatagt

SEQ ID NO: 384089 - DNA, 20 bp, Artificial Sequence
  chemically synthesized
gatgccacaacaacatagtt

SEQ ID NO: 384090 - DNA, 20 bp, Artificial Sequence
  chemically synthesized
taggtatttgcaatatgacc

SEQ ID NO: 384091 - DNA, 20 bp, Artificial Sequence
  chemically synthesized
gtatttgcaatatgacctag

SEQ ID NO: 384092 - DNA, 20 bp, Artificial Sequence
  chemically synthesized
agtacatatttcaggcttct

SEQ ID NO: 384093 - DNA, 20 bp, Artificial Sequence
  chemically synthesized
tagtacatatttcaggcttc

SEQ ID NO: 384094 - DNA, 20 bp, Artificial Sequence
  chemically synthesized
ggccagatagtacatatttc

SEQ ID NO: 384095 - DNA, 20 bp, Artificial Sequence
  chemically synthesized
gggccagatagtacatattt

SEQ ID NO: 384096 - DNA, 20 bp, Artificial Sequence
  chemically synthesized
agcctgaaatatgtactatc

SEQ ID NO: 384097 - DNA, 20 bp, Artificial Sequence
  chemically synthesized
cattttcttaaagggccaga

SEQ ID NO: 384098 - DNA, 20 bp, Artificial Sequence
  chemically synthesized
tatgtactatctggcccttt

SEQ ID NO: 384099 - DNA, 20 bp, Artificial Sequence
  chemically synthesized
caaacattttcttaaagggc

SEQ ID NO: 384100 - DNA, 20 bp, Artificial Sequence
  chemically synthesized
tccacaaacattttcttaaa

SEQ ID NO: 384101 - DNA, 20 bp, Artificial Sequence
  chemically synthesized
gtccacaaacattttcttaa

SEQ ID NO: 384102 - DNA, 20 bp, Artificial Sequence
  chemically synthesized
ggtccacaaacattttctta

SEQ ID NO: 384103 - DNA, 20 bp, Artificial Sequence
  chemically synthesized
gccctttaagaaaatgtttg

SEQ ID NO: 384104 - DNA, 20 bp, Artificial Sequence
  chemically synthesized
atcataaaaacataatgtag

SEQ ID NO: 384105 - DNA, 20 bp, Artificial Sequence
  chemically synthesized
aatcataaaaacataatgta

SEQ ID NO: 384106 - DNA, 20 bp, Artificial Sequence
  chemically synthesized
aaaatcataaaaacataatg

SEQ ID NO: 384107 - DNA, 20 bp, Artificial Sequence
  chemically synthesized
atgatcacatgtaagaatat

SEQ ID NO: 384108 - DNA, 20 bp, Artificial Sequence
  chemically synthesized
aattaactatgatcacatgt

SEQ ID NO: 384109 - DNA, 20 bp, Artificial Sequence
  chemically synthesized
catattcttacatgtgatca

SEQ ID NO: 384110 - DNA, 20 bp, Artificial Sequence
  chemically synthesized
taccatggaatattatatag

SEQ ID NO: 384111 - DNA, 20 bp, Artificial Sequence
  chemically synthesized
tcataccatggaatattata

SEQ ID NO: 384112 - DNA, 20 bp, Artificial Sequence
  chemically synthesized
tactgctatataatattcca

SEQ ID NO: 384113 - DNA, 20 bp, Artificial Sequence
  chemically synthesized
attgtattatggtcatacca

SEQ ID NO: 384114 - DNA, 20 bp, Artificial Sequence
  chemically synthesized
aatagcaaataattgtatta

SEQ ID NO: 384115 - DNA, 20 bp, Artificial Sequence
  chemically synthesized
cgtagctacagtgttcataa

SEQ ID NO: 384116 - DNA, 20 bp, Artificial Sequence
  chemically synthesized
atttgctattatgaacactg

SEQ ID NO: 384117 - DNA, 20 bp, Artificial Sequence
  chemically synthesized
gggaaggacattcgtagcta

SEQ ID NO: 384118 - DNA, 20 bp, Artificial Sequence
  chemically synthesized
gagggagggaaggacattcg

SEQ ID NO: 384119 - DNA, 20 bp, Artificial Sequence
  chemically synthesized
cagtgccagagagggaggga

SEQ ID NO: 384120 - DNA, 20 bp, Artificial Sequence
  chemically synthesized
ccagtgccagagagggaggg

SEQ ID NO: 384121 - DNA, 20 bp, Artificial Sequence
  chemically synthesized
tctccagtgccagagaggga

SEQ ID NO: 384122 - DNA, 20 bp, Artificial Sequence
  chemically synthesized
aatgtccttccctccctctc

SEQ ID NO: 384123 - DNA, 20 bp, Artificial Sequence
  chemically synthesized
gtctccagtgccagagaggg

SEQ ID NO: 384124 - DNA, 20 bp, Artificial Sequence
  chemically synthesized
tgtctccagtgccagagagg

SEQ ID NO: 384125 - DNA, 20 bp, Artificial Sequence
  chemically synthesized
agtgtctccagtgccagaga

SEQ ID NO: 384126 - DNA, 20 bp, Artificial Sequence
  chemically synthesized
gagtgtctccagtgccagag

SEQ ID NO: 384127 - DNA, 20 bp, Artificial Sequence
  chemically synthesized
tgagtgtctccagtgccaga

SEQ ID NO: 384128 - DNA, 20 bp, Artificial Sequence
  chemically synthesized
cttccctccctctctggcac

SEQ ID NO: 384129 - DNA, 20 bp, Artificial Sequence
  chemically synthesized
actgagtgtctccagtgcca

SEQ ID NO: 384130 - DNA, 20 bp, Artificial Sequence
  chemically synthesized
tccctccctctctggcactg

SEQ ID NO: 384131 - DNA, 20 bp, Artificial Sequence
  chemically synthesized
acactgagtgtctccagtgc

SEQ ID NO: 384132 - DNA, 20 bp, Artificial Sequence
  chemically synthesized
caatttacactgagtgtctc

SEQ ID NO: 384133 - DNA, 20 bp, Artificial Sequence
  chemically synthesized
tctctggcactggagacact

SEQ ID NO: 384134 - DNA, 20 bp, Artificial Sequence
  chemically synthesized
ttaggaaatcaatttacact

SEQ ID NO: 384135 - DNA, 20 bp, Artificial Sequence
  chemically synthesized
aaggattaaagaattaattt

SEQ ID NO: 384136 - DNA, 20 bp, Artificial Sequence
  chemically synthesized
aaaggattaaagaattaatt

SEQ ID NO: 384137 - DNA, 20 bp, Artificial Sequence
  chemically synthesized
attcagcgcaaaaaggatta

SEQ ID NO: 384138 - DNA, 20 bp, Artificial Sequence
  chemically synthesized
cttctatattcagcgcaaaa

SEQ ID NO: 384139 - DNA, 20 bp, Artificial Sequence
  chemically synthesized
acttctatattcagcgcaaa

SEQ ID NO: 384140 - DNA, 20 bp, Artificial Sequence
  chemically synthesized
aatcctttttgcgctgaata

SEQ ID NO: 384141 - DNA, 20 bp, Artificial Sequence
  chemically synthesized
cctttttgcgctgaatatag

SEQ ID NO: 384142 - DNA, 20 bp, Artificial Sequence
  chemically synthesized
gactttgtgacttctatatt

SEQ ID NO: 384143 - DNA, 20 bp, Artificial Sequence
  chemically synthesized
cgctgaatatagaagtcaca

SEQ ID NO: 384144 - DNA, 20 bp, Artificial Sequence
  chemically synthesized
acaaagtcacacaaacatta

SEQ ID NO: 384145 - DNA, 20 bp, Artificial Sequence
  chemically synthesized
cacaaacattaaagaatatt

SEQ ID NO: 384146 - DNA, 20 bp, Artificial Sequence
  chemically synthesized
attaaagaatatttggaaat

SEQ ID NO: 384147 - DNA, 20 bp, Artificial Sequence
  chemically synthesized
taaagaatatttggaaataa

SEQ ID NO: 384148 - DNA, 20 bp, Artificial Sequence
  chemically synthesized
agaatatttggaaataagag

SEQ ID NO: 384149 - DNA, 20 bp, Artificial Sequence
  chemically synthesized
aatatttggaaataagagta

SEQ ID NO: 384150 - DNA, 20 bp, Artificial Sequence
  chemically synthesized
ttggaaataagagtagagta

SEQ ID NO: 384151 - DNA, 20 bp, Artificial Sequence
  chemically synthesized
gagtagagtacagaaaatgc

SEQ ID NO: 384152 - DNA, 20 bp, Artificial Sequence
  chemically synthesized
agtagagtacagaaaatgca

SEQ ID NO: 384153 - DNA, 20 bp, Artificial Sequence
  chemically synthesized
ggttgtctaagggggagaga

SEQ ID NO: 384154 - DNA, 20 bp, Artificial Sequence
  chemically synthesized
acaattctatctctccccct

SEQ ID NO: 384155 - DNA, 20 bp, Artificial Sequence
  chemically synthesized
taccggttgtctaaggggga

SEQ ID NO: 384156 - DNA, 20 bp, Artificial Sequence
  chemically synthesized
attaccggttgtctaagggg

SEQ ID NO: 384157 - DNA, 20 bp, Artificial Sequence
  chemically synthesized
gtattaccggttgtctaagg

SEQ ID NO: 384158 - DNA, 20 bp, Artificial Sequence
  chemically synthesized
agtattaccggttgtctaag

SEQ ID NO: 384159 - DNA, 20 bp, Artificial Sequence
  chemically synthesized
tagtattaccggttgtctaa

SEQ ID NO: 384160 - DNA, 20 bp, Artificial Sequence
  chemically synthesized
ttagtattaccggttgtcta

SEQ ID NO: 384161 - DNA, 20 bp, Artificial Sequence
  chemically synthesized
atctctcccccttagacaac

SEQ ID NO: 384162 - DNA, 20 bp, Artificial Sequence
  chemically synthesized
attagtattaccggttgtct

SEQ ID NO: 384163 - DNA, 20 bp, Artificial Sequence
  chemically synthesized
aggcataacattagtattac

SEQ ID NO: 384164 - DNA, 20 bp, Artificial Sequence
  chemically synthesized
agaggaaaaaggcataacat

SEQ ID NO: 384165 - DNA, 20 bp, Artificial Sequence
  chemically synthesized
gtttcacagcaagaggaaaa

SEQ ID NO: 384166 - DNA, 20 bp, Artificial Sequence
  chemically synthesized
agtttcacagcaagaggaaa

SEQ ID NO: 384167 - DNA, 20 bp, Artificial Sequence
  chemically synthesized
ataaggagtttcacagcaag

SEQ ID NO: 384168 - DNA, 20 bp, Artificial Sequence
  chemically synthesized
gataaggagtttcacagcaa

SEQ ID NO: 384169 - DNA, 20 bp, Artificial Sequence
  chemically synthesized
tggataaggagtttcacagc

SEQ ID NO: 384170 - DNA, 20 bp, Artificial Sequence
  chemically synthesized
ttaatggataaggagtttca

SEQ ID NO: 384171 - DNA, 20 bp, Artificial Sequence
  chemically synthesized
cttagctgttaatggataag

SEQ ID NO: 384172 - DNA, 20 bp, Artificial Sequence
  chemically synthesized
tccttagctgttaatggata

SEQ ID NO: 384173 - DNA, 20 bp, Artificial Sequence
  chemically synthesized
ttccttagctgttaatggat

SEQ ID NO: 384174 - DNA, 20 bp, Artificial Sequence
  chemically synthesized
tgaaactccttatccattaa

SEQ ID NO: 384175 - DNA, 20 bp, Artificial Sequence
  chemically synthesized
gatccttccttagctgttaa

SEQ ID NO: 384176 - DNA, 20 bp, Artificial Sequence
  chemically synthesized
ctccttatccattaacagct

SEQ ID NO: 384177 - DNA, 20 bp, Artificial Sequence
  chemically synthesized
tccttatccattaacagcta

SEQ ID NO: 384178 - DNA, 20 bp, Artificial Sequence
  chemically synthesized
ttatccattaacagctaagg

SEQ ID NO: 384179 - DNA, 20 bp, Artificial Sequence
  chemically synthesized
tatccattaacagctaagga

SEQ ID NO: 384180 - DNA, 20 bp, Artificial Sequence
  chemically synthesized
aggcgacagtgatccttcct

SEQ ID NO: 384181 - DNA, 20 bp, Artificial Sequence
  chemically synthesized
gaaaaaggaaggtgaggcga

SEQ ID NO: 384182 - DNA, 20 bp, Artificial Sequence
  chemically synthesized
caggatgaaaaaggaaggtg

SEQ ID NO: 384183 - DNA, 20 bp, Artificial Sequence
  chemically synthesized
gcaggatgaaaaaggaaggt

SEQ ID NO: 384184 - DNA, 20 bp, Artificial Sequence
  chemically synthesized
ataggcaggatgaaaaagga

SEQ ID NO: 384185 - DNA, 20 bp, Artificial Sequence
  chemically synthesized
aataggcaggatgaaaaagg

SEQ ID NO: 384186 - DNA, 20 bp, Artificial Sequence
  chemically synthesized
cataataggcaggatgaaaa

SEQ ID NO: 384187 - DNA, 20 bp, Artificial Sequence
  chemically synthesized
tcataataggcaggatgaaa

SEQ ID NO: 384188 - DNA, 20 bp, Artificial Sequence
  chemically synthesized
atggattattcataataggc

SEQ ID NO: 384189 - DNA, 20 bp, Artificial Sequence
  chemically synthesized
tatggattattcataatagg

SEQ ID NO: 384190 - DNA, 20 bp, Artificial Sequence
  chemically synthesized
atttatggattattcataat

SEQ ID NO: 384191 - DNA, 20 bp, Artificial Sequence
  chemically synthesized
gatttatggattattcataa

SEQ ID NO: 384192 - DNA, 20 bp, Artificial Sequence
  chemically synthesized
aatcattaaaatgagattta

SEQ ID NO: 384193 - DNA, 20 bp, Artificial Sequence
  chemically synthesized
tctagtgaaatcattaaaat

SEQ ID NO: 384194 - DNA, 20 bp, Artificial Sequence
  chemically synthesized
tctcattttaatgatttcac

SEQ ID NO: 384195 - DNA, 20 bp, Artificial Sequence
  chemically synthesized
attttaatgatttcactaga

SEQ ID NO: 384196 - DNA, 20 bp, Artificial Sequence
  chemically synthesized
tatttacatttaatgctttc

SEQ ID NO: 384197 - DNA, 20 bp, Artificial Sequence
  chemically synthesized
cattaaatgtaaataatccg

SEQ ID NO: 384198 - DNA, 20 bp, Artificial Sequence
  chemically synthesized
attaaatgtaaataatccgt

SEQ ID NO: 384199 - DNA, 20 bp, Artificial Sequence
  chemically synthesized
ttaaatgtaaataatccgtg

SEQ ID NO: 384200 - DNA, 20 bp, Artificial Sequence
  chemically synthesized
taaatgtaaataatccgtgg

SEQ ID NO: 384201 - DNA, 20 bp, Artificial Sequence
  chemically synthesized
atgtaaataatccgtggggg

SEQ ID NO: 384202 - DNA, 20 bp, Artificial Sequence
  chemically synthesized
acctcctatgtccaccccca

SEQ ID NO: 384203 - DNA, 20 bp, Artificial Sequence
  chemically synthesized
ataatccgtgggggtggaca

SEQ ID NO: 384204 - DNA, 20 bp, Artificial Sequence
  chemically synthesized
taatccgtgggggtggacat

SEQ ID NO: 384205 - DNA, 20 bp, Artificial Sequence
  chemically synthesized
atccgtgggggtggacatag

SEQ ID NO: 384206 - DNA, 20 bp, Artificial Sequence
  chemically synthesized
tccgtgggggtggacatagg

SEQ ID NO: 384207 - DNA, 20 bp, Artificial Sequence
  chemically synthesized
gtggacataggaggtaatat

SEQ ID NO: 384208 - DNA, 20 bp, Artificial Sequence
  chemically synthesized
cataggaggtaatattagac

SEQ ID NO: 384209 - DNA, 20 bp, Artificial Sequence
  chemically synthesized
aggtaatattagacgagcaa

SEQ ID NO: 384210 - DNA, 20 bp, Artificial Sequence
  chemically synthesized
ggtaatattagacgagcaaa

SEQ ID NO: 384211 - DNA, 20 bp, Artificial Sequence
  chemically synthesized
aatattagacgagcaaaagg

SEQ ID NO: 384212 - DNA, 20 bp, Artificial Sequence
  chemically synthesized
tattagacgagcaaaaggaa

SEQ ID NO: 384213 - DNA, 20 bp, Artificial Sequence
  chemically synthesized
attagacgagcaaaaggaag

SEQ ID NO: 384214 - DNA, 20 bp, Artificial Sequence
  chemically synthesized
gacgagcaaaaggaagaggc

SEQ ID NO: 384215 - DNA, 20 bp, Artificial Sequence
  chemically synthesized
aaggaagaggcaagatttaa

SEQ ID NO: 384216 - DNA, 20 bp, Artificial Sequence
  chemically synthesized
aagatttaaaagaccttatt

SEQ ID NO: 384217 - DNA, 20 bp, Artificial Sequence
  chemically synthesized
aacattttaaaagcttaata

SEQ ID NO: 384218 - DNA, 20 bp, Artificial Sequence
  chemically synthesized
aaacattttaaaagcttaat

SEQ ID NO: 384219 - DNA, 20 bp, Artificial Sequence
  chemically synthesized
catgtgctaaaacattttaa

SEQ ID NO: 384220 - DNA, 20 bp, Artificial Sequence
  chemically synthesized
attaagcttttaaaatgttt

SEQ ID NO: 384221 - DNA, 20 bp, Artificial Sequence
  chemically synthesized
tgtgtgtgaaatattaagaa

SEQ ID NO: 384222 - DNA, 20 bp, Artificial Sequence
  chemically synthesized
ttttgtgtgtgtgaaatatt

SEQ ID NO: 384223 - DNA, 20 bp, Artificial Sequence
  chemically synthesized
cacacacaaaaaaaactgtc

SEQ ID NO: 384224 - DNA, 20 bp, Artificial Sequence
  chemically synthesized
aatcacctgtggtttctaga

SEQ ID NO: 384225 - DNA, 20 bp, Artificial Sequence
  chemically synthesized
aaaaaactgtctagaaacca

SEQ ID NO: 384226 - DNA, 20 bp, Artificial Sequence
  chemically synthesized
atgaaatcacctgtggtttc

SEQ ID NO: 384227 - DNA, 20 bp, Artificial Sequence
  chemically synthesized
aaaaactgtctagaaaccac

SEQ ID NO: 384228 - DNA, 20 bp, Artificial Sequence
  chemically synthesized
taaagttatgaaatcacctg

SEQ ID NO: 384229 - DNA, 20 bp, Artificial Sequence
  chemically synthesized
aaaaaaaagagatacaagta

SEQ ID NO: 384230 - DNA, 20 bp, Artificial Sequence
  chemically synthesized
gaaaaaaaaaaaagagatac

SEQ ID NO: 384231 - DNA, 20 bp, Artificial Sequence
  chemically synthesized
gtctccagaaaaaaaaaaaa

SEQ ID NO: 384232 - DNA, 20 bp, Artificial Sequence
  chemically synthesized
ccgtctccagaaaaaaaaaa

SEQ ID NO: 384233 - DNA, 20 bp, Artificial Sequence
  chemically synthesized
gtatctcttttttttttttc

SEQ ID NO: 384234 - DNA, 20 bp, Artificial Sequence
  chemically synthesized
atctcttttttttttttctg

SEQ ID NO: 384235 - DNA, 20 bp, Artificial Sequence
  chemically synthesized
cttttttttttttctggaga

SEQ ID NO: 384236 - DNA, 20 bp, Artificial Sequence
  chemically synthesized
tttttttttttctggagacg

SEQ ID NO: 384237 - DNA, 20 bp, Artificial Sequence
  chemically synthesized
caagagcaaaactccgtctc

SEQ ID NO: 384238 - DNA, 20 bp, Artificial Sequence
  chemically synthesized
cactccagcctgggcaacaa

SEQ ID NO: 384239 - DNA, 20 bp, Artificial Sequence
  chemically synthesized
ggagttttgctcttgttgcc

SEQ ID NO: 384240 - DNA, 20 bp, Artificial Sequence
  chemically synthesized
gagttttgctcttgttgccc

SEQ ID NO: 384241 - DNA, 20 bp, Artificial Sequence
  chemically synthesized
tgcactccagcctgggcaac

SEQ ID NO: 384242 - DNA, 20 bp, Artificial Sequence
  chemically synthesized
tttgctcttgttgcccaggc

SEQ ID NO: 384243 - DNA, 20 bp, Artificial Sequence
  chemically synthesized
tgctcttgttgcccaggctg

SEQ ID NO: 384244 - DNA, 20 bp, Artificial Sequence
  chemically synthesized
gcgccattgcactccagcct

SEQ ID NO: 384245 - DNA, 20 bp, Artificial Sequence
  chemically synthesized
ggcgccattgcactccagcc

SEQ ID NO: 384246 - DNA, 20 bp, Artificial Sequence
  chemically synthesized
gagatggcgccattgcactc

SEQ ID NO: 384247 - DNA, 20 bp, Artificial Sequence
  chemically synthesized
ttgcccaggctggagtgcaa

SEQ ID NO: 384248 - DNA, 20 bp, Artificial Sequence
  chemically synthesized
ggagtgcaatggcgccatct

SEQ ID NO: 384249 - DNA, 20 bp, Artificial Sequence
  chemically synthesized
gaggttgtggtgagctgaga

SEQ ID NO: 384250 - DNA, 20 bp, Artificial Sequence
  chemically synthesized
ggcggaggttgtggtgagct

SEQ ID NO: 384251 - DNA, 20 bp, Artificial Sequence
  chemically synthesized
caggaggcggaggttgtggt

SEQ ID NO: 384252 - DNA, 20 bp, Artificial Sequence
  chemically synthesized
aacccaggaggcggaggttg

SEQ ID NO: 384253 - DNA, 20 bp, Artificial Sequence
  chemically synthesized
ctcttgaacccaggaggcgg

SEQ ID NO: 384254 - DNA, 20 bp, Artificial Sequence
  chemically synthesized
tcaccacaacctccgcctcc

SEQ ID NO: 384255 - DNA, 20 bp, Artificial Sequence
  chemically synthesized
tctcttgaacccaggaggcg

SEQ ID NO: 384256 - DNA, 20 bp, Artificial Sequence
  chemically synthesized
caccacaacctccgcctcct

SEQ ID NO: 384257 - DNA, 20 bp, Artificial Sequence
  chemically synthesized
aatctcttgaacccaggagg

SEQ ID NO: 384258 - DNA, 20 bp, Artificial Sequence
  chemically synthesized
gagaatctcttgaacccagg

SEQ ID NO: 384259 - DNA, 20 bp, Artificial Sequence
  chemically synthesized
ggagaatctcttgaacccag

SEQ ID NO: 384260 - DNA, 20 bp, Artificial Sequence
  chemically synthesized
aacctccgcctcctgggttc

SEQ ID NO: 384261 - DNA, 20 bp, Artificial Sequence
  chemically synthesized
caggagaatctcttgaaccc

SEQ ID NO: 384262 - DNA, 20 bp, Artificial Sequence
  chemically synthesized
cctccgcctcctgggttcaa

SEQ ID NO: 384263 - DNA, 20 bp, Artificial Sequence
  chemically synthesized
gcaggagaatctcttgaacc

SEQ ID NO: 384264 - DNA, 20 bp, Artificial Sequence
  chemically synthesized
ttcaagagattctcctgcct

SEQ ID NO: 384265 - DNA, 20 bp, Artificial Sequence
  chemically synthesized
tactccggagtctgaggcag

SEQ ID NO: 384266 - DNA, 20 bp, Artificial Sequence
  chemically synthesized
gctactccggagtctgaggc

SEQ ID NO: 384267 - DNA, 20 bp, Artificial Sequence
  chemically synthesized
agctactccggagtctgagg

SEQ ID NO: 384268 - DNA, 20 bp, Artificial Sequence
  chemically synthesized
gattctcctgcctcagactc

SEQ ID NO: 384269 - DNA, 20 bp, Artificial Sequence
  chemically synthesized
cccagctactccggagtctg

SEQ ID NO: 384270 - DNA, 20 bp, Artificial Sequence
  chemically synthesized
ccccagctactccggagtct

SEQ ID NO: 384271 - DNA, 20 bp, Artificial Sequence
  chemically synthesized
ttctcctgcctcagactccg

SEQ ID NO: 384272 - DNA, 20 bp, Artificial Sequence
  chemically synthesized
tcctgcctcagactccggag

SEQ ID NO: 384273 - DNA, 20 bp, Artificial Sequence
  chemically synthesized
ctgtaaccccagctactccg

SEQ ID NO: 384274 - DNA, 20 bp, Artificial Sequence
  chemically synthesized
gcctcagactccggagtagc

SEQ ID NO: 384275 - DNA, 20 bp, Artificial Sequence
  chemically synthesized
gcctgtaaccccagctactc

SEQ ID NO: 384276 - DNA, 20 bp, Artificial Sequence
  chemically synthesized
cctcagactccggagtagct

SEQ ID NO: 384277 - DNA, 20 bp, Artificial Sequence
  chemically synthesized
ctcagactccggagtagctg

SEQ ID NO: 384278 - DNA, 20 bp, Artificial Sequence
  chemically synthesized
ctccggagtagctggggtta

SEQ ID NO: 384279 - DNA, 20 bp, Artificial Sequence
  chemically synthesized
tccggagtagctggggttac

SEQ ID NO: 384280 - DNA, 20 bp, Artificial Sequence
  chemically synthesized
gtggtgcatgcctgtaaccc

SEQ ID NO: 384281 - DNA, 20 bp, Artificial Sequence
  chemically synthesized
caggcatgcaccaccacgcc

SEQ ID NO: 384282 - DNA, 20 bp, Artificial Sequence
  chemically synthesized
acaaaattagccaggcgtgg

SEQ ID NO: 384283 - DNA, 20 bp, Artificial Sequence
  chemically synthesized
aatacaaaattagccaggcg

SEQ ID NO: 384284 - DNA, 20 bp, Artificial Sequence
  chemically synthesized
ctaaaaatacaaaattagcc

SEQ ID NO: 384285 - DNA, 20 bp, Artificial Sequence
  chemically synthesized
actaaaaatacaaaattagc

SEQ ID NO: 384286 - DNA, 20 bp, Artificial Sequence
  chemically synthesized
ctctactaaaaatacaaaat

SEQ ID NO: 384287 - DNA, 20 bp, Artificial Sequence
  chemically synthesized
cctggctaattttgtatttt

SEQ ID NO: 384288 - DNA, 20 bp, Artificial Sequence
  chemically synthesized
ggctaattttgtatttttag

SEQ ID NO: 384289 - DNA, 20 bp, Artificial Sequence
  chemically synthesized
ctaattttgtatttttagta

SEQ ID NO: 384290 - DNA, 20 bp, Artificial Sequence
  chemically synthesized
ttttgtatttttagtagaga

SEQ ID NO: 384291 - DNA, 20 bp, Artificial Sequence
  chemically synthesized
tttgtatttttagtagagat

SEQ ID NO: 384292 - DNA, 20 bp, Artificial Sequence
  chemically synthesized
cagcctgaccaaagtggaaa

SEQ ID NO: 384293 - DNA, 20 bp, Artificial Sequence
  chemically synthesized
gagatgggctttttccactt

SEQ ID NO: 384294 - DNA, 20 bp, Artificial Sequence
  chemically synthesized
tgggctttttccactttggt

SEQ ID NO: 384295 - DNA, 20 bp, Artificial Sequence
  chemically synthesized
cgagaccagcctgaccaaag

SEQ ID NO: 384296 - DNA, 20 bp, Artificial Sequence
  chemically synthesized
gggctttttccactttggtc

SEQ ID NO: 384297 - DNA, 20 bp, Artificial Sequence
  chemically synthesized
gttcgagaccagcctgacca

SEQ ID NO: 384298 - DNA, 20 bp, Artificial Sequence
  chemically synthesized
tttttccactttggtcaggc

SEQ ID NO: 384299 - DNA, 20 bp, Artificial Sequence
  chemically synthesized
tgaggtcaggagttcgagac

SEQ ID NO: 384300 - DNA, 20 bp, Artificial Sequence
  chemically synthesized
tcacctgaggtcaggagttc

SEQ ID NO: 384301 - DNA, 20 bp, Artificial Sequence
  chemically synthesized
tggtctcgaactcctgacct

SEQ ID NO: 384302 - DNA, 20 bp, Artificial Sequence
  chemically synthesized
ggcagatcacctgaggtcag

SEQ ID NO: 384303 - DNA, 20 bp, Artificial Sequence
  chemically synthesized
ggtctcgaactcctgacctc

SEQ ID NO: 384304 - DNA, 20 bp, Artificial Sequence
  chemically synthesized
caggcagatcacctgaggtc

SEQ ID NO: 384305 - DNA, 20 bp, Artificial Sequence
  chemically synthesized
gcaggcagatcacctgaggt

SEQ ID NO: 384306 - DNA, 20 bp, Artificial Sequence
  chemically synthesized
cgaggcaggcagatcacctg

SEQ ID NO: 384307 - DNA, 20 bp, Artificial Sequence
  chemically synthesized
ccgaggcaggcagatcacct

SEQ ID NO: 384308 - DNA, 20 bp, Artificial Sequence
  chemically synthesized
ctcaggtgatctgcctgcct

SEQ ID NO: 384309 - DNA, 20 bp, Artificial Sequence
  chemically synthesized
ctttgggaggccgaggcagg

SEQ ID NO: 384310 - DNA, 20 bp, Artificial Sequence
  chemically synthesized
acactttgggaggccgaggc

SEQ ID NO: 384311 - DNA, 20 bp, Artificial Sequence
  chemically synthesized
aacactttgggaggccgagg

SEQ ID NO: 384312 - DNA, 20 bp, Artificial Sequence
  chemically synthesized
cccaacactttgggaggccg

SEQ ID NO: 384313 - DNA, 20 bp, Artificial Sequence
  chemically synthesized
tcccaacactttgggaggcc

SEQ ID NO: 384314 - DNA, 20 bp, Artificial Sequence
  chemically synthesized
ctgcctgcctcggcctccca

SEQ ID NO: 384315 - DNA, 20 bp, Artificial Sequence
  chemically synthesized
gtaaatcccaacactttggg

SEQ ID NO: 384316 - DNA, 20 bp, Artificial Sequence
  chemically synthesized
tgtaaatcccaacactttgg

SEQ ID NO: 384317 - DNA, 20 bp, Artificial Sequence
  chemically synthesized
gcctcggcctcccaaagtgt

SEQ ID NO: 384318 - DNA, 20 bp, Artificial Sequence
  chemically synthesized
cctgtaaatcccaacacttt

SEQ ID NO: 384319 - DNA, 20 bp, Artificial Sequence
  chemically synthesized
cctcggcctcccaaagtgtt

SEQ ID NO: 384320 - DNA, 20 bp, Artificial Sequence
  chemically synthesized
gcctgtaaatcccaacactt

SEQ ID NO: 384321 - DNA, 20 bp, Artificial Sequence
  chemically synthesized
tcccaaagtgttgggattta

SEQ ID NO: 384322 - DNA, 20 bp, Artificial Sequence
  chemically synthesized
cccaaagtgttgggatttac

SEQ ID NO: 384323 - DNA, 20 bp, Artificial Sequence
  chemically synthesized
gtgttgggatttacaggcgt

SEQ ID NO: 384324 - DNA, 20 bp, Artificial Sequence
  chemically synthesized
caggcgtgagccaccgcgcc

SEQ ID NO: 384325 - DNA, 20 bp, Artificial Sequence
  chemically synthesized
tacaagtaagctgggcgcgg

SEQ ID NO: 384326 - DNA, 20 bp, Artificial Sequence
  chemically synthesized
agatacaagtaagctgggcg

SEQ ID NO: 384327 - DNA, 20 bp, Artificial Sequence
  chemically synthesized
ttaagagatacaagtaagct

SEQ ID NO: 384328 - DNA, 20 bp, Artificial Sequence
  chemically synthesized
attaagagatacaagtaagc

SEQ ID NO: 384329 - DNA, 20 bp, Artificial Sequence
  chemically synthesized
tgggattaagagatacaagt

SEQ ID NO: 384330 - DNA, 20 bp, Artificial Sequence
  chemically synthesized
atgatgggattaagagatac

SEQ ID NO: 384331 - DNA, 20 bp, Artificial Sequence
  chemically synthesized
cccctttatgatgggattaa

SEQ ID NO: 384332 - DNA, 20 bp, Artificial Sequence
  chemically synthesized
tgcccctttatgatgggatt

SEQ ID NO: 384333 - DNA, 20 bp, Artificial Sequence
  chemically synthesized
tatctcttaatcccatcata

SEQ ID NO: 384334 - DNA, 20 bp, Artificial Sequence
  chemically synthesized
atctcttaatcccatcataa

SEQ ID NO: 384335 - DNA, 20 bp, Artificial Sequence
  chemically synthesized
aggatatgcccctttatgat

SEQ ID NO: 384336 - DNA, 20 bp, Artificial Sequence
  chemically synthesized
tctcttaatcccatcataaa

SEQ ID NO: 384337 - DNA, 20 bp, Artificial Sequence
  chemically synthesized
taggatatgcccctttatga

SEQ ID NO: 384338 - DNA, 20 bp, Artificial Sequence
  chemically synthesized
ctcttaatcccatcataaag

SEQ ID NO: 384339 - DNA, 20 bp, Artificial Sequence
  chemically synthesized
ttgttggcttttaaagtaat

SEQ ID NO: 384340 - DNA, 20 bp, Artificial Sequence
  chemically synthesized
attgttggcttttaaagtaa

SEQ ID NO: 384341 - DNA, 20 bp, Artificial Sequence
  chemically synthesized
ggcatatcctattactttaa

SEQ ID NO: 384342 - DNA, 20 bp, Artificial Sequence
  chemically synthesized
gagggaattgttggctttta

SEQ ID NO: 384343 - DNA, 20 bp, Artificial Sequence
  chemically synthesized
tgaaaatgagagggaattgt

SEQ ID NO: 384344 - DNA, 20 bp, Artificial Sequence
  chemically synthesized
catggtgaatgaaaatgaga

SEQ ID NO: 384345 - DNA, 20 bp, Artificial Sequence
  chemically synthesized
tcatggtgaatgaaaatgag

SEQ ID NO: 384346 - DNA, 20 bp, Artificial Sequence
  chemically synthesized
ctcatggtgaatgaaaatga

SEQ ID NO: 384347 - DNA, 20 bp, Artificial Sequence
  chemically synthesized
aactcatggtgaatgaaaat

SEQ ID NO: 384348 - DNA, 20 bp, Artificial Sequence
  chemically synthesized
ctctcattttcattcaccat

SEQ ID NO: 384349 - DNA, 20 bp, Artificial Sequence
  chemically synthesized
tcaggagtagtagtaactca

SEQ ID NO: 384350 - DNA, 20 bp, Artificial Sequence
  chemically synthesized
tgtgaaggtttcaggagtag

SEQ ID NO: 384351 - DNA, 20 bp, Artificial Sequence
  chemically synthesized
ctttgtgaaggtttcaggag

SEQ ID NO: 384352 - DNA, 20 bp, Artificial Sequence
  chemically synthesized
aaactttgtgaaggtttcag

SEQ ID NO: 384353 - DNA, 20 bp, Artificial Sequence
  chemically synthesized
ggaaactttgtgaaggtttc

SEQ ID NO: 384354 - DNA, 20 bp, Artificial Sequence
  chemically synthesized
gggaaactttgtgaaggttt

SEQ ID NO: 384355 - DNA, 20 bp, Artificial Sequence
  chemically synthesized
ctactcctgaaaccttcaca

SEQ ID NO: 384356 - DNA, 20 bp, Artificial Sequence
  chemically synthesized
gtttctgggaaactttgtga

SEQ ID NO: 384357 - DNA, 20 bp, Artificial Sequence
  chemically synthesized
tgtttctgggaaactttgtg

SEQ ID NO: 384358 - DNA, 20 bp, Artificial Sequence
  chemically synthesized
gaaaccttcacaaagtttcc

SEQ ID NO: 384359 - DNA, 20 bp, Artificial Sequence
  chemically synthesized
ttcacaaagtttcccagaaa

SEQ ID NO: 384360 - DNA, 20 bp, Artificial Sequence
  chemically synthesized
tcacaaagtttcccagaaac

SEQ ID NO: 384361 - DNA, 20 bp, Artificial Sequence
  chemically synthesized
gagtgggctgtcctgtttct

SEQ ID NO: 384362 - DNA, 20 bp, Artificial Sequence
  chemically synthesized
ggagtgggctgtcctgtttc

SEQ ID NO: 384363 - DNA, 20 bp, Artificial Sequence
  chemically synthesized
aaagtttcccagaaacagga

SEQ ID NO: 384364 - DNA, 20 bp, Artificial Sequence
  chemically synthesized
gaaacaggacagcccactcc

SEQ ID NO: 384365 - DNA, 20 bp, Artificial Sequence
  chemically synthesized
gaggcccatgggctaggagt

SEQ ID NO: 384366 - DNA, 20 bp, Artificial Sequence
  chemically synthesized
agaggcccatgggctaggag

SEQ ID NO: 384367 - DNA, 20 bp, Artificial Sequence
  chemically synthesized
ggaagaggcccatgggctag

SEQ ID NO: 384368 - DNA, 20 bp, Artificial Sequence
  chemically synthesized
gacagcccactcctagccca

SEQ ID NO: 384369 - DNA, 20 bp, Artificial Sequence
  chemically synthesized
acagcccactcctagcccat

SEQ ID NO: 384370 - DNA, 20 bp, Artificial Sequence
  chemically synthesized
agggaagaggcccatgggct

SEQ ID NO: 384371 - DNA, 20 bp, Artificial Sequence
  chemically synthesized
aagggaagaggcccatgggc

SEQ ID NO: 384372 - DNA, 20 bp, Artificial Sequence
  chemically synthesized
gaggaagggaagaggcccat

SEQ ID NO: 384373 - DNA, 20 bp, Artificial Sequence
  chemically synthesized
tgaggaagggaagaggccca

SEQ ID NO: 384374 - DNA, 20 bp, Artificial Sequence
  chemically synthesized
taagaaatgaggaagggaag

SEQ ID NO: 384375 - DNA, 20 bp, Artificial Sequence
  chemically synthesized
gtaagaaatgaggaagggaa

SEQ ID NO: 384376 - DNA, 20 bp, Artificial Sequence
  chemically synthesized
gggtaagaaatgaggaaggg

SEQ ID NO: 384377 - DNA, 20 bp, Artificial Sequence
  chemically synthesized
aaagggtaagaaatgaggaa

SEQ ID NO: 384378 - DNA, 20 bp, Artificial Sequence
  chemically synthesized
aaaagggtaagaaatgagga

SEQ ID NO: 384379 - DNA, 20 bp, Artificial Sequence
  chemically synthesized
gaaaagggtaagaaatgagg

SEQ ID NO: 384380 - DNA, 20 bp, Artificial Sequence
  chemically synthesized
gaagaaaagggtaagaaatg

SEQ ID NO: 384381 - DNA, 20 bp, Artificial Sequence
  chemically synthesized
ggaagaaaagggtaagaaat

SEQ ID NO: 384382 - DNA, 20 bp, Artificial Sequence
  chemically synthesized
gcagggaggaagaaaagggt

SEQ ID NO: 384383 - DNA, 20 bp, Artificial Sequence
  chemically synthesized
aaaagcagggaggaagaaaa

SEQ ID NO: 384384 - DNA, 20 bp, Artificial Sequence
  chemically synthesized
aaaaagcagggaggaagaaa

SEQ ID NO: 384385 - DNA, 20 bp, Artificial Sequence
  chemically synthesized
aaaaaagcagggaggaagaa

SEQ ID NO: 384386 - DNA, 20 bp, Artificial Sequence
  chemically synthesized
caagaaaaaaagcagggagg

SEQ ID NO: 384387 - DNA, 20 bp, Artificial Sequence
  chemically synthesized
tttcaagaaaaaaagcaggg

SEQ ID NO: 384388 - DNA, 20 bp, Artificial Sequence
  chemically synthesized
atttcaagaaaaaaagcagg

SEQ ID NO: 384389 - DNA, 20 bp, Artificial Sequence
  chemically synthesized
ttatttcaagaaaaaaagca

SEQ ID NO: 384390 - DNA, 20 bp, Artificial Sequence
  chemically synthesized
tttatttcaagaaaaaaagc

SEQ ID NO: 384391 - DNA, 20 bp, Artificial Sequence
  chemically synthesized
ttttatttcaagaaaaaaag

SEQ ID NO: 384392 - DNA, 20 bp, Artificial Sequence
  chemically synthesized
aaattttatttcaagaaaaa

SEQ ID NO: 384393 - DNA, 20 bp, Artificial Sequence
  chemically synthesized
ttttggggaaattttatttc

SEQ ID NO: 384394 - DNA, 20 bp, Artificial Sequence
  chemically synthesized
ttgaaataaaatttccccaa

SEQ ID NO: 384395 - DNA, 20 bp, Artificial Sequence
  chemically synthesized
aataaaatttccccaaaagc

SEQ ID NO: 384396 - DNA, 20 bp, Artificial Sequence
  chemically synthesized
cagtggcagactagcttttg

SEQ ID NO: 384397 - DNA, 20 bp, Artificial Sequence
  chemically synthesized
gcagtggcagactagctttt

SEQ ID NO: 384398 - DNA, 20 bp, Artificial Sequence
  chemically synthesized
tgcagtggcagactagcttt

SEQ ID NO: 384399 - DNA, 20 bp, Artificial Sequence
  chemically synthesized
atgtgcttgcagtggcagac

SEQ ID NO: 384400 - DNA, 20 bp, Artificial Sequence
  chemically synthesized
aaaagctagtctgccactgc

SEQ ID NO: 384401 - DNA, 20 bp, Artificial Sequence
  chemically synthesized
tgaggatgtgcttgcagtgg

SEQ ID NO: 384402 - DNA, 20 bp, Artificial Sequence
  chemically synthesized
atctgaggatgtgcttgcag

SEQ ID NO: 384403 - DNA, 20 bp, Artificial Sequence
  chemically synthesized
gttatctgaggatgtgcttg

SEQ ID NO: 384404 - DNA, 20 bp, Artificial Sequence
  chemically synthesized
tgccactgcaagcacatcct

SEQ ID NO: 384405 - DNA, 20 bp, Artificial Sequence
  chemically synthesized
ttcctttatccagttatctg

SEQ ID NO: 384406 - DNA, 20 bp, Artificial Sequence
  chemically synthesized
caagcacatcctcagataac

SEQ ID NO: 384407 - DNA, 20 bp, Artificial Sequence
  chemically synthesized
cttcctttatccagttatct

SEQ ID NO: 384408 - DNA, 20 bp, Artificial Sequence
  chemically synthesized
catcctcagataactggata

SEQ ID NO: 384409 - DNA, 20 bp, Artificial Sequence
  chemically synthesized
atcctcagataactggataa

SEQ ID NO: 384410 - DNA, 20 bp, Artificial Sequence
  chemically synthesized
ccacattatcttcctttatc

SEQ ID NO: 384411 - DNA, 20 bp, Artificial Sequence
  chemically synthesized
ctcagataactggataaagg

SEQ ID NO: 384412 - DNA, 20 bp, Artificial Sequence
  chemically synthesized
ctggataaaggaagataatg

SEQ ID NO: 384413 - DNA, 20 bp, Artificial Sequence
  chemically synthesized
taaaggaagataatgtggca

SEQ ID NO: 384414 - DNA, 20 bp, Artificial Sequence
  chemically synthesized
aaggaagataatgtggcaca

SEQ ID NO: 384415 - DNA, 20 bp, Artificial Sequence
  chemically synthesized
aggaagataatgtggcacag

SEQ ID NO: 384416 - DNA, 20 bp, Artificial Sequence
  chemically synthesized
gaagataatgtggcacagag

SEQ ID NO: 384417 - DNA, 20 bp, Artificial Sequence
  chemically synthesized
taatgtggcacagaggagtc

SEQ ID NO: 384418 - DNA, 20 bp, Artificial Sequence
  chemically synthesized
aatgtggcacagaggagtct

SEQ ID NO: 384419 - DNA, 20 bp, Artificial Sequence
  chemically synthesized
atgtggcacagaggagtctg

SEQ ID NO: 384420 - DNA, 20 bp, Artificial Sequence
  chemically synthesized
tatttggctagaagtatccc

SEQ ID NO: 384421 - DNA, 20 bp, Artificial Sequence
  chemically synthesized
gaggagtctggggatacttc

SEQ ID NO: 384422 - DNA, 20 bp, Artificial Sequence
  chemically synthesized
cacaaaaactatttggctag

SEQ ID NO: 384423 - DNA, 20 bp, Artificial Sequence
  chemically synthesized
tggggatacttctagccaaa

SEQ ID NO: 384424 - DNA, 20 bp, Artificial Sequence
  chemically synthesized
tggcacaaaaactatttggc

SEQ ID NO: 384425 - DNA, 20 bp, Artificial Sequence
  chemically synthesized
attatggcacaaaaactatt

SEQ ID NO: 384426 - DNA, 20 bp, Artificial Sequence
  chemically synthesized
tactgtcataaagattatta

SEQ ID NO: 384427 - DNA, 20 bp, Artificial Sequence
  chemically synthesized
tgccataataatctttatga

SEQ ID NO: 384428 - DNA, 20 bp, Artificial Sequence
  chemically synthesized
ttcaggatcctactgtcata

SEQ ID NO: 384429 - DNA, 20 bp, Artificial Sequence
  chemically synthesized
cataataatctttatgacag

SEQ ID NO: 384430 - DNA, 20 bp, Artificial Sequence
  chemically synthesized
ataataatctttatgacagt

SEQ ID NO: 384431 - DNA, 20 bp, Artificial Sequence
  chemically synthesized
agtgttctaggtaacatttc

SEQ ID NO: 384432 - DNA, 20 bp, Artificial Sequence
  chemically synthesized
aagtgttctaggtaacattt

SEQ ID NO: 384433 - DNA, 20 bp, Artificial Sequence
  chemically synthesized
taggatcctgaaatgttacc

SEQ ID NO: 384434 - DNA, 20 bp, Artificial Sequence
  chemically synthesized
ggactaggcacaagtgttct

SEQ ID NO: 384435 - DNA, 20 bp, Artificial Sequence
  chemically synthesized
gggactaggcacaagtgttc

SEQ ID NO: 384436 - DNA, 20 bp, Artificial Sequence
  chemically synthesized
ttacctagaacacttgtgcc

SEQ ID NO: 384437 - DNA, 20 bp, Artificial Sequence
  chemically synthesized
cagaaattgggactaggcac

SEQ ID NO: 384438 - DNA, 20 bp, Artificial Sequence
  chemically synthesized
tcccaccagaaattgggact

SEQ ID NO: 384439 - DNA, 20 bp, Artificial Sequence
  chemically synthesized
atcccaccagaaattgggac

SEQ ID NO: 384440 - DNA, 20 bp, Artificial Sequence
  chemically synthesized
ttgtgcctagtcccaatttc

SEQ ID NO: 384441 - DNA, 20 bp, Artificial Sequence
  chemically synthesized
gttttatcccaccagaaatt

SEQ ID NO: 384442 - DNA, 20 bp, Artificial Sequence
  chemically synthesized
agttttatcccaccagaaat

SEQ ID NO: 384443 - DNA, 20 bp, Artificial Sequence
  chemically synthesized
tgcctagtcccaatttctgg

SEQ ID NO: 384444 - DNA, 20 bp, Artificial Sequence
  chemically synthesized
gcctagtcccaatttctggt

SEQ ID NO: 384445 - DNA, 20 bp, Artificial Sequence
  chemically synthesized
tatatacagttttatcccac

SEQ ID NO: 384446 - DNA, 20 bp, Artificial Sequence
  chemically synthesized
ggtgggataaaactgtatat

SEQ ID NO: 384447 - DNA, 20 bp, Artificial Sequence
  chemically synthesized
gtgggataaaactgtatata

SEQ ID NO: 384448 - DNA, 20 bp, Artificial Sequence
  chemically synthesized
tgggataaaactgtatataa

SEQ ID NO: 384449 - DNA, 20 bp, Artificial Sequence
  chemically synthesized
tgtaatgattcccttatata

SEQ ID NO: 384450 - DNA, 20 bp, Artificial Sequence
  chemically synthesized
tgtatataagggaatcatta

SEQ ID NO: 384451 - DNA, 20 bp, Artificial Sequence
  chemically synthesized
gtatataagggaatcattac

SEQ ID NO: 384452 - DNA, 20 bp, Artificial Sequence
  chemically synthesized
cattacaggtgcttgcgtct

SEQ ID NO: 384453 - DNA, 20 bp, Artificial Sequence
  chemically synthesized
gccagaagtgtctcagacgc

SEQ ID NO: 384454 - DNA, 20 bp, Artificial Sequence
  chemically synthesized
aatcatagccagaagtgtct

SEQ ID NO: 384455 - DNA, 20 bp, Artificial Sequence
  chemically synthesized
gcttgcgtctgagacacttc

SEQ ID NO: 384456 - DNA, 20 bp, Artificial Sequence
  chemically synthesized
ggagactcaatcatagccag

SEQ ID NO: 384457 - DNA, 20 bp, Artificial Sequence
  chemically synthesized
gtaggagactcaatcatagc

SEQ ID NO: 384458 - DNA, 20 bp, Artificial Sequence
  chemically synthesized
agacacttctggctatgatt

SEQ ID NO: 384459 - DNA, 20 bp, Artificial Sequence
  chemically synthesized
atgtgtaggagactcaatca

SEQ ID NO: 384460 - DNA, 20 bp, Artificial Sequence
  chemically synthesized
cgttttttgataatgtgtag

SEQ ID NO: 384461 - DNA, 20 bp, Artificial Sequence
  chemically synthesized
cacgttttttgataatgtgt

SEQ ID NO: 384462 - DNA, 20 bp, Artificial Sequence
  chemically synthesized
acacgttttttgataatgtg

SEQ ID NO: 384463 - DNA, 20 bp, Artificial Sequence
  chemically synthesized
ttcatttacttttgttatta

SEQ ID NO: 384464 - DNA, 20 bp, Artificial Sequence
  chemically synthesized
gtgtaatgctttaataacaa

SEQ ID NO: 384465 - DNA, 20 bp, Artificial Sequence
  chemically synthesized
aaagtaaatgaaaatcctca

SEQ ID NO: 384466 - DNA, 20 bp, Artificial Sequence
  chemically synthesized
aagtaaatgaaaatcctcaa

SEQ ID NO: 384467 - DNA, 20 bp, Artificial Sequence
  chemically synthesized
gtaaatgaaaatcctcaaag

SEQ ID NO: 384468 - DNA, 20 bp, Artificial Sequence
  chemically synthesized
ttagcatattaactcctttg

SEQ ID NO: 384469 - DNA, 20 bp, Artificial Sequence
  chemically synthesized
attagcatattaactccttt

SEQ ID NO: 384470 - DNA, 20 bp, Artificial Sequence
  chemically synthesized
agttaatatgctaatgtaca

SEQ ID NO: 384471 - DNA, 20 bp, Artificial Sequence
  chemically synthesized
tataaagtgactatgtacat

SEQ ID NO: 384472 - DNA, 20 bp, Artificial Sequence
  chemically synthesized
aatgtacatagtcactttat

SEQ ID NO: 384473 - DNA, 20 bp, Artificial Sequence
  chemically synthesized
tgtacatagtcactttataa

SEQ ID NO: 384474 - DNA, 20 bp, Artificial Sequence
  chemically synthesized
gtacatagtcactttataag

SEQ ID NO: 384475 - DNA, 20 bp, Artificial Sequence
  chemically synthesized
tacatagtcactttataaga

SEQ ID NO: 384476 - DNA, 20 bp, Artificial Sequence
  chemically synthesized
gcttacactaccctcttata

SEQ ID NO: 384477 - DNA, 20 bp, Artificial Sequence
  chemically synthesized
atagtcactttataagaggg

SEQ ID NO: 384478 - DNA, 20 bp, Artificial Sequence
  chemically synthesized
actttataagagggtagtgt

SEQ ID NO: 384479 - DNA, 20 bp, Artificial Sequence
  chemically synthesized
gactctgattgagttaatgt

SEQ ID NO: 384480 - DNA, 20 bp, Artificial Sequence
  chemically synthesized
ggactctgattgagttaatg

SEQ ID NO: 384481 - DNA, 20 bp, Artificial Sequence
  chemically synthesized
ttatcccacattaactcaat

SEQ ID NO: 384482 - DNA, 20 bp, Artificial Sequence
  chemically synthesized
atcccacattaactcaatca

SEQ ID NO: 384483 - DNA, 20 bp, Artificial Sequence
  chemically synthesized
tttctaccgggactctgatt

SEQ ID NO: 384484 - DNA, 20 bp, Artificial Sequence
  chemically synthesized
cattaactcaatcagagtcc

SEQ ID NO: 384485 - DNA, 20 bp, Artificial Sequence
  chemically synthesized
taactcaatcagagtcccgg

SEQ ID NO: 384486 - DNA, 20 bp, Artificial Sequence
  chemically synthesized
tcaatcctccagtttctacc

SEQ ID NO: 384487 - DNA, 20 bp, Artificial Sequence
  chemically synthesized
atcaatcctccagtttctac

SEQ ID NO: 384488 - DNA, 20 bp, Artificial Sequence
  chemically synthesized
atcagagtcccggtagaaac

SEQ ID NO: 384489 - DNA, 20 bp, Artificial Sequence
  chemically synthesized
cagagtcccggtagaaactg

SEQ ID NO: 384490 - DNA, 20 bp, Artificial Sequence
  chemically synthesized
agagtcccggtagaaactgg

SEQ ID NO: 384491 - DNA, 20 bp, Artificial Sequence
  chemically synthesized
agattgagaaatcaatcctc

SEQ ID NO: 384492 - DNA, 20 bp, Artificial Sequence
  chemically synthesized
gaggattgatttctcaatct

SEQ ID NO: 384493 - DNA, 20 bp, Artificial Sequence
  chemically synthesized
aggattgatttctcaatctc

SEQ ID NO: 384494 - DNA, 20 bp, Artificial Sequence
  chemically synthesized
ggattgatttctcaatctcg

SEQ ID NO: 384495 - DNA, 20 bp, Artificial Sequence
  chemically synthesized
gcctcacataccccgagatt

SEQ ID NO: 384496 - DNA, 20 bp, Artificial Sequence
  chemically synthesized
aaactggcctcacatacccc

SEQ ID NO: 384497 - DNA, 20 bp, Artificial Sequence
  chemically synthesized
ttctcaatctcggggtatgt

SEQ ID NO: 384498 - DNA, 20 bp, Artificial Sequence
  chemically synthesized
tctcaatctcggggtatgtg

SEQ ID NO: 384499 - DNA, 20 bp, Artificial Sequence
  chemically synthesized
aatctcggggtatgtgaggc

SEQ ID NO: 384500 - DNA, 20 bp, Artificial Sequence
  chemically synthesized
tgataacccctttagcaaac

SEQ ID NO: 384501 - DNA, 20 bp, Artificial Sequence
  chemically synthesized
tatgtgaggccagtttgcta

SEQ ID NO: 384502 - DNA, 20 bp, Artificial Sequence
  chemically synthesized
atgtgaggccagtttgctaa

SEQ ID NO: 384503 - DNA, 20 bp, Artificial Sequence
  chemically synthesized
tgtgaggccagtttgctaaa

SEQ ID NO: 384504 - DNA, 20 bp, Artificial Sequence
  chemically synthesized
gtgaggccagtttgctaaag

SEQ ID NO: 384505 - DNA, 20 bp, Artificial Sequence
  chemically synthesized
atctctgttgataacccctt

SEQ ID NO: 384506 - DNA, 20 bp, Artificial Sequence
  chemically synthesized
tttgctaaaggggttatcaa

SEQ ID NO: 384507 - DNA, 20 bp, Artificial Sequence
  chemically synthesized
tgctaaaggggttatcaaca

SEQ ID NO: 384508 - DNA, 20 bp, Artificial Sequence
  chemically synthesized
gttatcaacagagatatgct

SEQ ID NO: 384509 - DNA, 20 bp, Artificial Sequence
  chemically synthesized
aacagagatatgctcagtgt

SEQ ID NO: 384510 - DNA, 20 bp, Artificial Sequence
  chemically synthesized
acagagatatgctcagtgtt

SEQ ID NO: 384511 - DNA, 20 bp, Artificial Sequence
  chemically synthesized
ttcttgaatttcctaacact

SEQ ID NO: 384512 - DNA, 20 bp, Artificial Sequence
  chemically synthesized
tgctcagtgttaggaaattc

SEQ ID NO: 384513 - DNA, 20 bp, Artificial Sequence
  chemically synthesized
tcagtgttaggaaattcaag

SEQ ID NO: 384514 - DNA, 20 bp, Artificial Sequence
  chemically synthesized
cagtgttaggaaattcaaga

SEQ ID NO: 384515 - DNA, 20 bp, Artificial Sequence
  chemically synthesized
agtgttaggaaattcaagaa

SEQ ID NO: 384516 - DNA, 20 bp, Artificial Sequence
  chemically synthesized
ggaaattcaagaagggatga

SEQ ID NO: 384517 - DNA, 20 bp, Artificial Sequence
  chemically synthesized
aaattcaagaagggatgacg

SEQ ID NO: 384518 - DNA, 20 bp, Artificial Sequence
  chemically synthesized
attcaagaagggatgacgga

SEQ ID NO: 384519 - DNA, 20 bp, Artificial Sequence
  chemically synthesized
ggatgacggagagttaactg

SEQ ID NO: 384520 - DNA, 20 bp, Artificial Sequence
  chemically synthesized
ctcttaacccttgaggtcta

SEQ ID NO: 384521 - DNA, 20 bp, Artificial Sequence
  chemically synthesized
gagagttaactgtagacctc

SEQ ID NO: 384522 - DNA, 20 bp, Artificial Sequence
  chemically synthesized
agagttaactgtagacctca

SEQ ID NO: 384523 - DNA, 20 bp, Artificial Sequence
  chemically synthesized
gagttaactgtagacctcaa

SEQ ID NO: 384524 - DNA, 20 bp, Artificial Sequence
  chemically synthesized
gtccttcctcttaacccttg

SEQ ID NO: 384525 - DNA, 20 bp, Artificial Sequence
  chemically synthesized
aactgtagacctcaagggtt

SEQ ID NO: 384526 - DNA, 20 bp, Artificial Sequence
  chemically synthesized
cgtccttcctcttaaccctt

SEQ ID NO: 384527 - DNA, 20 bp, Artificial Sequence
  chemically synthesized
ctgtagacctcaagggttaa

SEQ ID NO: 384528 - DNA, 20 bp, Artificial Sequence
  chemically synthesized
tgtagacctcaagggttaag

SEQ ID NO: 384529 - DNA, 20 bp, Artificial Sequence
  chemically synthesized
agacctcaagggttaagagg

SEQ ID NO: 384530 - DNA, 20 bp, Artificial Sequence
  chemically synthesized
gacctcaagggttaagagga

SEQ ID NO: 384531 - DNA, 20 bp, Artificial Sequence
  chemically synthesized
aggaaggacgtttcctgaac

SEQ ID NO: 384532 - DNA, 20 bp, Artificial Sequence
  chemically synthesized
gaaggacgtttcctgaacta

SEQ ID NO: 384533 - DNA, 20 bp, Artificial Sequence
  chemically synthesized
tgggtctggctctctagttc

SEQ ID NO: 384534 - DNA, 20 bp, Artificial Sequence
  chemically synthesized
aggacgtttcctgaactaga

SEQ ID NO: 384535 - DNA, 20 bp, Artificial Sequence
  chemically synthesized
ttgggtctggctctctagtt

SEQ ID NO: 384536 - DNA, 20 bp, Artificial Sequence
  chemically synthesized
cgtttcctgaactagagagc

SEQ ID NO: 384537 - DNA, 20 bp, Artificial Sequence
  chemically synthesized
ttctattgggtctggctctc

SEQ ID NO: 384538 - DNA, 20 bp, Artificial Sequence
  chemically synthesized
aactagagagccagacccaa

SEQ ID NO: 384539 - DNA, 20 bp, Artificial Sequence
  chemically synthesized
tcttgcatttctattgggtc

SEQ ID NO: 384540 - DNA, 20 bp, Artificial Sequence
  chemically synthesized
ttctctcttgcatttctatt

SEQ ID NO: 384541 - DNA, 20 bp, Artificial Sequence
  chemically synthesized
gttctctcttgcatttctat

SEQ ID NO: 384542 - DNA, 20 bp, Artificial Sequence
  chemically synthesized
gccagacccaatagaaatgc

SEQ ID NO: 384543 - DNA, 20 bp, Artificial Sequence
  chemically synthesized
cagacccaatagaaatgcaa

SEQ ID NO: 384544 - DNA, 20 bp, Artificial Sequence
  chemically synthesized
gacccaatagaaatgcaaga

SEQ ID NO: 384545 - DNA, 20 bp, Artificial Sequence
  chemically synthesized
aaatgcaagagagaactgtc

SEQ ID NO: 384546 - DNA, 20 bp, Artificial Sequence
  chemically synthesized
tgcaagagagaactgtccag

SEQ ID NO: 384547 - DNA, 20 bp, Artificial Sequence
  chemically synthesized
agaccagagcttctgctgga

SEQ ID NO: 384548 - DNA, 20 bp, Artificial Sequence
  chemically synthesized
aagagagaactgtccagcag

SEQ ID NO: 384549 - DNA, 20 bp, Artificial Sequence
  chemically synthesized
cattagaccagagcttctgc

SEQ ID NO: 384550 - DNA, 20 bp, Artificial Sequence
  chemically synthesized
gaactgtccagcagaagctc

SEQ ID NO: 384551 - DNA, 20 bp, Artificial Sequence
  chemically synthesized
gaacagctaacattagacca

SEQ ID NO: 384552 - DNA, 20 bp, Artificial Sequence
  chemically synthesized
ctgaacagctaacattagac

SEQ ID NO: 384553 - DNA, 20 bp, Artificial Sequence
  chemically synthesized
cagaagctctggtctaatgt

SEQ ID NO: 384554 - DNA, 20 bp, Artificial Sequence
  chemically synthesized
tagctctgaacagctaacat

SEQ ID NO: 384555 - DNA, 20 bp, Artificial Sequence
  chemically synthesized
ctggtctaatgttagctgtt

SEQ ID NO: 384556 - DNA, 20 bp, Artificial Sequence
  chemically synthesized
ggtctaatgttagctgttca

SEQ ID NO: 384557 - DNA, 20 bp, Artificial Sequence
  chemically synthesized
ttccacaggttagctctgaa

SEQ ID NO: 384558 - DNA, 20 bp, Artificial Sequence
  chemically synthesized
agctgttcagagctaacctg

SEQ ID NO: 384559 - DNA, 20 bp, Artificial Sequence
  chemically synthesized
cccatgggatttccacaggt

SEQ ID NO: 384560 - DNA, 20 bp, Artificial Sequence
  chemically synthesized
tggccccatgggatttccac

SEQ ID NO: 384561 - DNA, 20 bp, Artificial Sequence
  chemically synthesized
gtggccccatgggatttcca

SEQ ID NO: 384562 - DNA, 20 bp, Artificial Sequence
  chemically synthesized
gctaacctgtggaaatccca

SEQ ID NO: 384563 - DNA, 20 bp, Artificial Sequence
  chemically synthesized
ctaacctgtggaaatcccat

SEQ ID NO: 384564 - DNA, 20 bp, Artificial Sequence
  chemically synthesized
taacctgtggaaatcccatg

SEQ ID NO: 384565 - DNA, 20 bp, Artificial Sequence
  chemically synthesized
ttattttcatgtggccccat

SEQ ID NO: 384566 - DNA, 20 bp, Artificial Sequence
  chemically synthesized
tttattttcatgtggcccca

SEQ ID NO: 384567 - DNA, 20 bp, Artificial Sequence
  chemically synthesized
gtggagtatttattttcatg

SEQ ID NO: 384568 - DNA, 20 bp, Artificial Sequence
  chemically synthesized
cagtggataagaaaagggtg

SEQ ID NO: 384569 - DNA, 20 bp, Artificial Sequence
  chemically synthesized
tacagtggataagaaaaggg

SEQ ID NO: 384570 - DNA, 20 bp, Artificial Sequence
  chemically synthesized
gagtacagtggataagaaaa

SEQ ID NO: 384571 - DNA, 20 bp, Artificial Sequence
  chemically synthesized
ggagtacagtggataagaaa

SEQ ID NO: 384572 - DNA, 20 bp, Artificial Sequence
  chemically synthesized
aggagtacagtggataagaa

SEQ ID NO: 384573 - DNA, 20 bp, Artificial Sequence
  chemically synthesized
gcaggaggagtacagtggat

SEQ ID NO: 384574 - DNA, 20 bp, Artificial Sequence
  chemically synthesized
ctgcagcaggaggagtacag

SEQ ID NO: 384575 - DNA, 20 bp, Artificial Sequence
  chemically synthesized
aggctgcagcaggaggagta

SEQ ID NO: 384576 - DNA, 20 bp, Artificial Sequence
  chemically synthesized
gagacaggctgcagcaggag

SEQ ID NO: 384577 - DNA, 20 bp, Artificial Sequence
  chemically synthesized
ccactgtactcctcctgctg

SEQ ID NO: 384578 - DNA, 20 bp, Artificial Sequence
  chemically synthesized
ttgagacaggctgcagcagg

SEQ ID NO: 384579 - DNA, 20 bp, Artificial Sequence
  chemically synthesized
gttgagacaggctgcagcag

SEQ ID NO: 384580 - DNA, 20 bp, Artificial Sequence
  chemically synthesized
cagttgagacaggctgcagc

SEQ ID NO: 384581 - DNA, 20 bp, Artificial Sequence
  chemically synthesized
ccagttgagacaggctgcag

SEQ ID NO: 384582 - DNA, 20 bp, Artificial Sequence
  chemically synthesized
tttccagttgagacaggctg

SEQ ID NO: 384583 - DNA, 20 bp, Artificial Sequence
  chemically synthesized
ctacagtttccagttgagac

SEQ ID NO: 384584 - DNA, 20 bp, Artificial Sequence
  chemically synthesized
ctgctgcagcctgtctcaac

SEQ ID NO: 384585 - DNA, 20 bp, Artificial Sequence
  chemically synthesized
cctacagtttccagttgaga

SEQ ID NO: 384586 - DNA, 20 bp, Artificial Sequence
  chemically synthesized
ttgccctacagtttccagtt

SEQ ID NO: 384587 - DNA, 20 bp, Artificial Sequence
  chemically synthesized
cctgtctcaactggaaactg

SEQ ID NO: 384588 - DNA, 20 bp, Artificial Sequence
  chemically synthesized
ttcctttgccctacagtttc

SEQ ID NO: 384589 - DNA, 20 bp, Artificial Sequence
  chemically synthesized
ctgtctcaactggaaactgt

SEQ ID NO: 384590 - DNA, 20 bp, Artificial Sequence
  chemically synthesized
tgtctcaactggaaactgta

SEQ ID NO: 384591 - DNA, 20 bp, Artificial Sequence
  chemically synthesized
caactggaaactgtagggca

SEQ ID NO: 384592 - DNA, 20 bp, Artificial Sequence
  chemically synthesized
atcagagttcctttgcccta

SEQ ID NO: 384593 - DNA, 20 bp, Artificial Sequence
  chemically synthesized
aactggaaactgtagggcaa

SEQ ID NO: 384594 - DNA, 20 bp, Artificial Sequence
  chemically synthesized
gccctttaggaatggcatca

SEQ ID NO: 384595 - DNA, 20 bp, Artificial Sequence
  chemically synthesized
ctgccctttaggaatggcat

SEQ ID NO: 384596 - DNA, 20 bp, Artificial Sequence
  chemically synthesized
gaactctgatgccattccta

SEQ ID NO: 384597 - DNA, 20 bp, Artificial Sequence
  chemically synthesized
aactctgatgccattcctaa

SEQ ID NO: 384598 - DNA, 20 bp, Artificial Sequence
  chemically synthesized
tggggactgccctttaggaa

SEQ ID NO: 384599 - DNA, 20 bp, Artificial Sequence
  chemically synthesized
actctgatgccattcctaaa

SEQ ID NO: 384600 - DNA, 20 bp, Artificial Sequence
  chemically synthesized
ctgatgccattcctaaaggg

SEQ ID NO: 384601 - DNA, 20 bp, Artificial Sequence
  chemically synthesized
tgtcctggggactgcccttt

SEQ ID NO: 384602 - DNA, 20 bp, Artificial Sequence
  chemically synthesized
gtgtcctggggactgccctt

SEQ ID NO: 384603 - DNA, 20 bp, Artificial Sequence
  chemically synthesized
cattcctaaagggcagtccc

SEQ ID NO: 384604 - DNA, 20 bp, Artificial Sequence
  chemically synthesized
attcctaaagggcagtcccc

SEQ ID NO: 384605 - DNA, 20 bp, Artificial Sequence
  chemically synthesized
ccactgtgctttgtgtcctg

SEQ ID NO: 384606 - DNA, 20 bp, Artificial Sequence
  chemically synthesized
accactgtgctttgtgtcct

SEQ ID NO: 384607 - DNA, 20 bp, Artificial Sequence
  chemically synthesized
agggcagtccccaggacaca

SEQ ID NO: 384608 - DNA, 20 bp, Artificial Sequence
  chemically synthesized
taccactgtgctttgtgtcc

SEQ ID NO: 384609 - DNA, 20 bp, Artificial Sequence
  chemically synthesized
agtccccaggacacaaagca

SEQ ID NO: 384610 - DNA, 20 bp, Artificial Sequence
  chemically synthesized
ccccaggacacaaagcacag

SEQ ID NO: 384611 - DNA, 20 bp, Artificial Sequence
  chemically synthesized
ggacacaaagcacagtggta

SEQ ID NO: 384612 - DNA, 20 bp, Artificial Sequence
  chemically synthesized
cagtggtaaagaatgaaaaa

SEQ ID NO: 384613 - DNA, 20 bp, Artificial Sequence
  chemically synthesized
agaatgaaaaatggatttga

SEQ ID NO: 384614 - DNA, 20 bp, Artificial Sequence
  chemically synthesized
gaatgaaaaatggatttgaa

SEQ ID NO: 384615 - DNA, 20 bp, Artificial Sequence
  chemically synthesized
aaaaatggatttgaaaggac

SEQ ID NO: 384616 - DNA, 20 bp, Artificial Sequence
  chemically synthesized
aaatggatttgaaaggacaa

SEQ ID NO: 384617 - DNA, 20 bp, Artificial Sequence
  chemically synthesized
aatggatttgaaaggacaag

SEQ ID NO: 384618 - DNA, 20 bp, Artificial Sequence
  chemically synthesized
atggatttgaaaggacaaga

SEQ ID NO: 384619 - DNA, 20 bp, Artificial Sequence
  chemically synthesized
atttgaaaggacaagaggga

SEQ ID NO: 384620 - DNA, 20 bp, Artificial Sequence
  chemically synthesized
agggaaagaatttatgcact

SEQ ID NO: 384621 - DNA, 20 bp, Artificial Sequence
  chemically synthesized
tgaaagggaaaagttatgct

SEQ ID NO: 384622 - DNA, 20 bp, Artificial Sequence
  chemically synthesized
tagattaacttgaaagggaa

SEQ ID NO: 384623 - DNA, 20 bp, Artificial Sequence
  chemically synthesized
aagcataacttttccctttc

SEQ ID NO: 384624 - DNA, 20 bp, Artificial Sequence
  chemically synthesized
catactagattaacttgaaa

SEQ ID NO: 384625 - DNA, 20 bp, Artificial Sequence
  chemically synthesized
acatactagattaacttgaa

SEQ ID NO: 384626 - DNA, 20 bp, Artificial Sequence
  chemically synthesized
aacatactagattaacttga

SEQ ID NO: 384627 - DNA, 20 bp, Artificial Sequence
  chemically synthesized
ttttccctttcaagttaatc

SEQ ID NO: 384628 - DNA, 20 bp, Artificial Sequence
  chemically synthesized
tcaagttaatctagtatgtt

SEQ ID NO: 384629 - DNA, 20 bp, Artificial Sequence
  chemically synthesized
agcaaaccaactcaacatac

SEQ ID NO: 384630 - DNA, 20 bp, Artificial Sequence
  chemically synthesized
gttaatctagtatgttgagt

SEQ ID NO: 384631 - DNA, 20 bp, Artificial Sequence
  chemically synthesized
aacaggggggtttagttaaa

SEQ ID NO: 384632 - DNA, 20 bp, Artificial Sequence
  chemically synthesized
gaaacaggggggtttagtta

SEQ ID NO: 384633 - DNA, 20 bp, Artificial Sequence
  chemically synthesized
gctttggaaacaggggggtt

SEQ ID NO: 384634 - DNA, 20 bp, Artificial Sequence
  chemically synthesized
ctcaggctttggaaacaggg

SEQ ID NO: 384635 - DNA, 20 bp, Artificial Sequence
  chemically synthesized
cctcaggctttggaaacagg

SEQ ID NO: 384636 - DNA, 20 bp, Artificial Sequence
  chemically synthesized
tcctcaggctttggaaacag

SEQ ID NO: 384637 - DNA, 20 bp, Artificial Sequence
  chemically synthesized
atcctcaggctttggaaaca

SEQ ID NO: 384638 - DNA, 20 bp, Artificial Sequence
  chemically synthesized
actaaacccccctgtttcca

SEQ ID NO: 384639 - DNA, 20 bp, Artificial Sequence
  chemically synthesized
tatcctcaggctttggaaac

SEQ ID NO: 384640 - DNA, 20 bp, Artificial Sequence
  chemically synthesized
ttatcctcaggctttggaaa

SEQ ID NO: 384641 - DNA, 20 bp, Artificial Sequence
  chemically synthesized
cccccctgtttccaaagcct

SEQ ID NO: 384642 - DNA, 20 bp, Artificial Sequence
  chemically synthesized
ccccctgtttccaaagcctg

SEQ ID NO: 384643 - DNA, 20 bp, Artificial Sequence
  chemically synthesized
agtatgttatcctcaggctt

SEQ ID NO: 384644 - DNA, 20 bp, Artificial Sequence
  chemically synthesized
gtaggtagtatgttatcctc

SEQ ID NO: 384645 - DNA, 20 bp, Artificial Sequence
  chemically synthesized
agtaggtagtatgttatcct

SEQ ID NO: 384646 - DNA, 20 bp, Artificial Sequence
  chemically synthesized
aggataacatactacctact

SEQ ID NO: 384647 - DNA, 20 bp, Artificial Sequence
  chemically synthesized
ttgtttaccaactcagtagg

SEQ ID NO: 384648 - DNA, 20 bp, Artificial Sequence
  chemically synthesized
taacatactacctactgagt

SEQ ID NO: 384649 - DNA, 20 bp, Artificial Sequence
  chemically synthesized
aggttgtttaccaactcagt

SEQ ID NO: 384650 - DNA, 20 bp, Artificial Sequence
  chemically synthesized
aaggttgtttaccaactcag

SEQ ID NO: 384651 - DNA, 20 bp, Artificial Sequence
  chemically synthesized
cttaaggttgtttaccaact

SEQ ID NO: 384652 - DNA, 20 bp, Artificial Sequence
  chemically synthesized
ctgagttggtaaacaacctt

SEQ ID NO: 384653 - DNA, 20 bp, Artificial Sequence
  chemically synthesized
tgagttggtaaacaacctta

SEQ ID NO: 384654 - DNA, 20 bp, Artificial Sequence
  chemically synthesized
gttggtaaacaaccttaagg

SEQ ID NO: 384655 - DNA, 20 bp, Artificial Sequence
  chemically synthesized
gctccaggactgctgcctta

SEQ ID NO: 384656 - DNA, 20 bp, Artificial Sequence
  chemically synthesized
ggtaaacaaccttaaggcag

SEQ ID NO: 384657 - DNA, 20 bp, Artificial Sequence
  chemically synthesized
ggctccaggactgctgcctt

SEQ ID NO: 384658 - DNA, 20 bp, Artificial Sequence
  chemically synthesized
caaccttaaggcagcagtcc

SEQ ID NO: 384659 - DNA, 20 bp, Artificial Sequence
  chemically synthesized
accttaaggcagcagtcctg

SEQ ID NO: 384660 - DNA, 20 bp, Artificial Sequence
  chemically synthesized
aaggcagcagtcctggagcc

SEQ ID NO: 384661 - DNA, 20 bp, Artificial Sequence
  chemically synthesized
aatgtctctgtctaggctcc

SEQ ID NO: 384662 - DNA, 20 bp, Artificial Sequence
  chemically synthesized
caatgtctctgtctaggctc

SEQ ID NO: 384663 - DNA, 20 bp, Artificial Sequence
  chemically synthesized
cagcagtcctggagcctaga

SEQ ID NO: 384664 - DNA, 20 bp, Artificial Sequence
  chemically synthesized
gcagtcctggagcctagaca

SEQ ID NO: 384665 - DNA, 20 bp, Artificial Sequence
  chemically synthesized
ctcatccaatgtctctgtct

SEQ ID NO: 384666 - DNA, 20 bp, Artificial Sequence
  chemically synthesized
actcatccaatgtctctgtc

SEQ ID NO: 384667 - DNA, 20 bp, Artificial Sequence
  chemically synthesized
tggagcctagacagagacat

SEQ ID NO: 384668 - DNA, 20 bp, Artificial Sequence
  chemically synthesized
cctagacagagacattggat

SEQ ID NO: 384669 - DNA, 20 bp, Artificial Sequence
  chemically synthesized
agacagagacattggatgag

SEQ ID NO: 384670 - DNA, 20 bp, Artificial Sequence
  chemically synthesized
acattggatgagtagacgaa

SEQ ID NO: 384671 - DNA, 20 bp, Artificial Sequence
  chemically synthesized
attggatgagtagacgaatg

SEQ ID NO: 384672 - DNA, 20 bp, Artificial Sequence
  chemically synthesized
ttggatgagtagacgaatgg

SEQ ID NO: 384673 - DNA, 20 bp, Artificial Sequence
  chemically synthesized
gtagacgaatggaggtacac

SEQ ID NO: 384674 - DNA, 20 bp, Artificial Sequence
  chemically synthesized
tagacgaatggaggtacacg

SEQ ID NO: 384675 - DNA, 20 bp, Artificial Sequence
  chemically synthesized
ggaggtacacgaggtataca

SEQ ID NO: 384676 - DNA, 20 bp, Artificial Sequence
  chemically synthesized
gtacacgaggtatacatgga

SEQ ID NO: 384677 - DNA, 20 bp, Artificial Sequence
  chemically synthesized
ggtatacatggatggatgca

SEQ ID NO: 384678 - DNA, 20 bp, Artificial Sequence
  chemically synthesized
tacatggatggatgcatgga

SEQ ID NO: 384679 - DNA, 20 bp, Artificial Sequence
  chemically synthesized
tggatggatgcatggatgga

SEQ ID NO: 384680 - DNA, 20 bp, Artificial Sequence
  chemically synthesized
ggatggatgcatggatggat

SEQ ID NO: 384681 - DNA, 20 bp, Artificial Sequence
  chemically synthesized
tgcatggatggataggtgaa

SEQ ID NO: 384682 - DNA, 20 bp, Artificial Sequence
  chemically synthesized
tggatggataggtgaatgga

SEQ ID NO: 384683 - DNA, 20 bp, Artificial Sequence
  chemically synthesized
gataggtgaatggatggatg

SEQ ID NO: 384684 - DNA, 20 bp, Artificial Sequence
  chemically synthesized
atggatgaagtcaatcacat

SEQ ID NO: 384685 - DNA, 20 bp, Artificial Sequence
  chemically synthesized
tcaatcacattagtatttta

SEQ ID NO: 384686 - DNA, 20 bp, Artificial Sequence
  chemically synthesized
gactcatcgtgttcagatac

SEQ ID NO: 384687 - DNA, 20 bp, Artificial Sequence
  chemically synthesized
agactcatcgtgttcagata

SEQ ID NO: 384688 - DNA, 20 bp, Artificial Sequence
  chemically synthesized
gaagagagactcatcgtgtt

SEQ ID NO: 384689 - DNA, 20 bp, Artificial Sequence
  chemically synthesized
aacctgtatctgaacacgat

SEQ ID NO: 384690 - DNA, 20 bp, Artificial Sequence
  chemically synthesized
ccataatcaaaggaggaaga

SEQ ID NO: 384691 - DNA, 20 bp, Artificial Sequence
  chemically synthesized
ttccataatcaaaggaggaa

SEQ ID NO: 384692 - DNA, 20 bp, Artificial Sequence
  chemically synthesized
acttccataatcaaaggagg

SEQ ID NO: 384693 - DNA, 20 bp, Artificial Sequence
  chemically synthesized
ttaacttccataatcaaagg

SEQ ID NO: 384694 - DNA, 20 bp, Artificial Sequence
  chemically synthesized
cttaacttccataatcaaag

SEQ ID NO: 384695 - DNA, 20 bp, Artificial Sequence
  chemically synthesized
ctctcttcctcctttgatta

SEQ ID NO: 384696 - DNA, 20 bp, Artificial Sequence
  chemically synthesized
ctcttaacttccataatcaa

SEQ ID NO: 384697 - DNA, 20 bp, Artificial Sequence
  chemically synthesized
gctcttaacttccataatca

SEQ ID NO: 384698 - DNA, 20 bp, Artificial Sequence
  chemically synthesized
tcttcctcctttgattatgg

SEQ ID NO: 384699 - DNA, 20 bp, Artificial Sequence
  chemically synthesized
ctcctttgattatggaagtt

SEQ ID NO: 384700 - DNA, 20 bp, Artificial Sequence
  chemically synthesized
cctttgattatggaagttaa

SEQ ID NO: 384701 - DNA, 20 bp, Artificial Sequence
  chemically synthesized
tgattatggaagttaagagc

SEQ ID NO: 384702 - DNA, 20 bp, Artificial Sequence
  chemically synthesized
ggaagttaagagcaagcact

SEQ ID NO: 384703 - DNA, 20 bp, Artificial Sequence
  chemically synthesized
gaagttaagagcaagcactg

SEQ ID NO: 384704 - DNA, 20 bp, Artificial Sequence
  chemically synthesized
ctatataatattggttacct

SEQ ID NO: 384705 - DNA, 20 bp, Artificial Sequence
  chemically synthesized
tccagaaatctatataatat

SEQ ID NO: 384706 - DNA, 20 bp, Artificial Sequence
  chemically synthesized
ctgaggtaaccaatattata

SEQ ID NO: 384707 - DNA, 20 bp, Artificial Sequence
  chemically synthesized
accaatattatatagatttc

SEQ ID NO: 384708 - DNA, 20 bp, Artificial Sequence
  chemically synthesized
caatattatatagatttctg

SEQ ID NO: 384709 - DNA, 20 bp, Artificial Sequence
  chemically synthesized
gatgagtacctgttttactc

SEQ ID NO: 384710 - DNA, 20 bp, Artificial Sequence
  chemically synthesized
tatagatttctggagtaaaa

SEQ ID NO: 384711 - DNA, 20 bp, Artificial Sequence
  chemically synthesized
atagatttctggagtaaaac

SEQ ID NO: 384712 - DNA, 20 bp, Artificial Sequence
  chemically synthesized
aaatcgttgatagtcatgat

SEQ ID NO: 384713 - DNA, 20 bp, Artificial Sequence
  chemically synthesized
ccccaaattcaaatcgttga

SEQ ID NO: 384714 - DNA, 20 bp, Artificial Sequence
  chemically synthesized
gactatcaacgatttgaatt

SEQ ID NO: 384715 - DNA, 20 bp, Artificial Sequence
  chemically synthesized
actatcaacgatttgaattt

SEQ ID NO: 384716 - DNA, 20 bp, Artificial Sequence
  chemically synthesized
ctatcaacgatttgaatttg

SEQ ID NO: 384717 - DNA, 20 bp, Artificial Sequence
  chemically synthesized
gggatgatgtcaattattca

SEQ ID NO: 384718 - DNA, 20 bp, Artificial Sequence
  chemically synthesized
ttattcaaagaacctgaaaa

SEQ ID NO: 384719 - DNA, 20 bp, Artificial Sequence
  chemically synthesized
gcaacttcactacttttttc

SEQ ID NO: 384720 - DNA, 20 bp, Artificial Sequence
  chemically synthesized
ttcaaagaacctgaaaaaag

SEQ ID NO: 384721 - DNA, 20 bp, Artificial Sequence
  chemically synthesized
agcaacttcactactttttt

SEQ ID NO: 384722 - DNA, 20 bp, Artificial Sequence
  chemically synthesized
agaacctgaaaaaagtagtg

SEQ ID NO: 384723 - DNA, 20 bp, Artificial Sequence
  chemically synthesized
agtagtgaagttgcttatct

SEQ ID NO: 384724 - DNA, 20 bp, Artificial Sequence
  chemically synthesized
gtagtgaagttgcttatctg

SEQ ID NO: 384725 - DNA, 20 bp, Artificial Sequence
  chemically synthesized
gaagttctggggcctcagat

SEQ ID NO: 384726 - DNA, 20 bp, Artificial Sequence
  chemically synthesized
aagttgcttatctgaggccc

SEQ ID NO: 384727 - DNA, 20 bp, Artificial Sequence
  chemically synthesized
tgaaggaagttctggggcct

SEQ ID NO: 384728 - DNA, 20 bp, Artificial Sequence
  chemically synthesized
gtaaaatgaaggaagttctg

SEQ ID NO: 384729 - DNA, 20 bp, Artificial Sequence
  chemically synthesized
agtaaaatgaaggaagttct

SEQ ID NO: 384730 - DNA, 20 bp, Artificial Sequence
  chemically synthesized
gagtaaaatgaaggaagttc

SEQ ID NO: 384731 - DNA, 20 bp, Artificial Sequence
  chemically synthesized
aagccagagtaaaatgaagg

SEQ ID NO: 384732 - DNA, 20 bp, Artificial Sequence
  chemically synthesized
tgaaagccagagtaaaatga

SEQ ID NO: 384733 - DNA, 20 bp, Artificial Sequence
  chemically synthesized
ttgaaagccagagtaaaatg

SEQ ID NO: 384734 - DNA, 20 bp, Artificial Sequence
  chemically synthesized
gaacttccttcattttactc

SEQ ID NO: 384735 - DNA, 20 bp, Artificial Sequence
  chemically synthesized
gtatccaacgttgaaagcca

SEQ ID NO: 384736 - DNA, 20 bp, Artificial Sequence
  chemically synthesized
gtgtatccaacgttgaaagc

SEQ ID NO: 384737 - DNA, 20 bp, Artificial Sequence
  chemically synthesized
tttactctggctttcaacgt

SEQ ID NO: 384738 - DNA, 20 bp, Artificial Sequence
  chemically synthesized
taatgtgtatccaacgttga

SEQ ID NO: 384739 - DNA, 20 bp, Artificial Sequence
  chemically synthesized
ggatacacattaaaattatc

SEQ ID NO: 384740 - DNA, 20 bp, Artificial Sequence
  chemically synthesized
gatacacattaaaattatct

SEQ ID NO: 384741 - DNA, 20 bp, Artificial Sequence
  chemically synthesized
tctcagtttgaaaagtttcc

SEQ ID NO: 384742 - DNA, 20 bp, Artificial Sequence
  chemically synthesized
tccgagcatctcagtttgaa

SEQ ID NO: 384743 - DNA, 20 bp, Artificial Sequence
  chemically synthesized
tctaggaaacttttcaaact

SEQ ID NO: 384744 - DNA, 20 bp, Artificial Sequence
  chemically synthesized
acttttcaaactgagatgct

SEQ ID NO: 384745 - DNA, 20 bp, Artificial Sequence
  chemically synthesized
ggtctgtaatccgagcatct

SEQ ID NO: 384746 - DNA, 20 bp, Artificial Sequence
  chemically synthesized
aaactgagatgctcggatta

SEQ ID NO: 384747 - DNA, 20 bp, Artificial Sequence
  chemically synthesized
acttaagtggtctgtaatcc

SEQ ID NO: 384748 - DNA, 20 bp, Artificial Sequence
  chemically synthesized
gctcggattacagaccactt

SEQ ID NO: 384749 - DNA, 20 bp, Artificial Sequence
  chemically synthesized
ggattacagaccacttaagt

SEQ ID NO: 384750 - DNA, 20 bp, Artificial Sequence
  chemically synthesized
tccacagagtctgacttaag

SEQ ID NO: 384751 - DNA, 20 bp, Artificial Sequence
  chemically synthesized
atttccacagagtctgactt

SEQ ID NO: 384752 - DNA, 20 bp, Artificial Sequence
  chemically synthesized
accacttaagtcagactctg

SEQ ID NO: 384753 - DNA, 20 bp, Artificial Sequence
  chemically synthesized
atctgcgttctatttccaca

SEQ ID NO: 384754 - DNA, 20 bp, Artificial Sequence
  chemically synthesized
taagtcagactctgtggaaa

SEQ ID NO: 384755 - DNA, 20 bp, Artificial Sequence
  chemically synthesized
atatctgcgttctatttcca

SEQ ID NO: 384756 - DNA, 20 bp, Artificial Sequence
  chemically synthesized
gactctgtggaaatagaacg

SEQ ID NO: 384757 - DNA, 20 bp, Artificial Sequence
  chemically synthesized
attggtggagtgtttacaaa

SEQ ID NO: 384758 - DNA, 20 bp, Artificial Sequence
  chemically synthesized
cattttgctacacattggtg

SEQ ID NO: 384759 - DNA, 20 bp, Artificial Sequence
  chemically synthesized
cgcattttgctacacattgg

SEQ ID NO: 384760 - DNA, 20 bp, Artificial Sequence
  chemically synthesized
gtaaacactccaccaatgtg

SEQ ID NO: 384761 - DNA, 20 bp, Artificial Sequence
  chemically synthesized
tttcgcattttgctacacat

SEQ ID NO: 384762 - DNA, 20 bp, Artificial Sequence
  chemically synthesized
aaagagagtggaaagatcag

SEQ ID NO: 384763 - DNA, 20 bp, Artificial Sequence
  chemically synthesized
cttaaagagagtggaaagat

SEQ ID NO: 384764 - DNA, 20 bp, Artificial Sequence
  chemically synthesized
tagatcttaaagagagtgga

SEQ ID NO: 384765 - DNA, 20 bp, Artificial Sequence
  chemically synthesized
atggtagatcttaaagagag

SEQ ID NO: 384766 - DNA, 20 bp, Artificial Sequence
  chemically synthesized
ctgatctttccactctcttt

SEQ ID NO: 384767 - DNA, 20 bp, Artificial Sequence
  chemically synthesized
ataatggtagatcttaaaga

SEQ ID NO: 384768 - DNA, 20 bp, Artificial Sequence
  chemically synthesized
tcataatggtagatcttaaa

SEQ ID NO: 384769 - DNA, 20 bp, Artificial Sequence
  chemically synthesized
gctcataatggtagatctta

SEQ ID NO: 384770 - DNA, 20 bp, Artificial Sequence
  chemically synthesized
tctttaagatctaccattat

SEQ ID NO: 384771 - DNA, 20 bp, Artificial Sequence
  chemically synthesized
gattttggggctcataatgg

SEQ ID NO: 384772 - DNA, 20 bp, Artificial Sequence
  chemically synthesized
aatgattttggggctcataa

SEQ ID NO: 384773 - DNA, 20 bp, Artificial Sequence
  chemically synthesized
agagaaccagaatgattttg

SEQ ID NO: 384774 - DNA, 20 bp, Artificial Sequence
  chemically synthesized
aagagaaccagaatgatttt

SEQ ID NO: 384775 - DNA, 20 bp, Artificial Sequence
  chemically synthesized
caagagaaccagaatgattt

SEQ ID NO: 384776 - DNA, 20 bp, Artificial Sequence
  chemically synthesized
tatgagccccaaaatcattc

SEQ ID NO: 384777 - DNA, 20 bp, Artificial Sequence
  chemically synthesized
caaaatcattctggttctct

SEQ ID NO: 384778 - DNA, 20 bp, Artificial Sequence
  chemically synthesized
atgtaaattaccaagagaac

SEQ ID NO: 384779 - DNA, 20 bp, Artificial Sequence
  chemically synthesized
taaaaaatgtaaattaccaa

SEQ ID NO: 384780 - DNA, 20 bp, Artificial Sequence
  chemically synthesized
tttaaaaaatgtaaattacc

SEQ ID NO: 384781 - DNA, 20 bp, Artificial Sequence
  chemically synthesized
ttggtaatttacatttttta

SEQ ID NO: 384782 - DNA, 20 bp, Artificial Sequence
  chemically synthesized
tggtaatttacattttttaa

SEQ ID NO: 384783 - DNA, 20 bp, Artificial Sequence
  chemically synthesized
cattttttaaaggaaactct

SEQ ID NO: 384784 - DNA, 20 bp, Artificial Sequence
  chemically synthesized
attatcagcaaggcatctta

SEQ ID NO: 384785 - DNA, 20 bp, Artificial Sequence
  chemically synthesized
atattatcagcaaggcatct

SEQ ID NO: 384786 - DNA, 20 bp, Artificial Sequence
  chemically synthesized
catatataatattatcagca

SEQ ID NO: 384787 - DNA, 20 bp, Artificial Sequence
  chemically synthesized
tcatatataatattatcagc

SEQ ID NO: 384788 - DNA, 20 bp, Artificial Sequence
  chemically synthesized
cttttcatatataatattat

SEQ ID NO: 384789 - DNA, 20 bp, Artificial Sequence
  chemically synthesized
ctgataatattatatatgaa

SEQ ID NO: 384790 - DNA, 20 bp, Artificial Sequence
  chemically synthesized
tgataatattatatatgaaa

SEQ ID NO: 384791 - DNA, 20 bp, Artificial Sequence
  chemically synthesized
gataatattatatatgaaaa

SEQ ID NO: 384792 - DNA, 20 bp, Artificial Sequence
  chemically synthesized
aaaagggttatcgaatttat

SEQ ID NO: 384793 - DNA, 20 bp, Artificial Sequence
  chemically synthesized
aaagggttatcgaatttatc

SEQ ID NO: 384794 - DNA, 20 bp, Artificial Sequence
  chemically synthesized
gttatcgaatttatcgggtt

SEQ ID NO: 384795 - DNA, 20 bp, Artificial Sequence
  chemically synthesized
ttatcgaatttatcgggttt

SEQ ID NO: 384796 - DNA, 20 bp, Artificial Sequence
  chemically synthesized
tatcgaatttatcgggtttg

SEQ ID NO: 384797 - DNA, 20 bp, Artificial Sequence
  chemically synthesized
gaatttatcgggtttggggt

SEQ ID NO: 384798 - DNA, 20 bp, Artificial Sequence
  chemically synthesized
aatttatcgggtttggggtt

SEQ ID NO: 384799 - DNA, 20 bp, Artificial Sequence
  chemically synthesized
atttatcgggtttggggttg

SEQ ID NO: 384800 - DNA, 20 bp, Artificial Sequence
  chemically synthesized
tttatcgggtttggggttgg

SEQ ID NO: 384801 - DNA, 20 bp, Artificial Sequence
  chemically synthesized
gggggaaataatacttatca

SEQ ID NO: 384802 - DNA, 20 bp, Artificial Sequence
  chemically synthesized
ggggaaataatacttatcaa

SEQ ID NO: 384803 - DNA, 20 bp, Artificial Sequence
  chemically synthesized
ggaaataatacttatcaaag

SEQ ID NO: 384804 - DNA, 20 bp, Artificial Sequence
  chemically synthesized
catatttttactcctttgat

SEQ ID NO: 384805 - DNA, 20 bp, Artificial Sequence
  chemically synthesized
tatcaaaggagtaaaaatat

SEQ ID NO: 384806 - DNA, 20 bp, Artificial Sequence
  chemically synthesized
caaaggagtaaaaatatgag

SEQ ID NO: 384807 - DNA, 20 bp, Artificial Sequence
  chemically synthesized
gttcataaaataacctgtga

SEQ ID NO: 384808 - DNA, 20 bp, Artificial Sequence
  chemically synthesized
caagtaatctggactatcac

SEQ ID NO: 384809 - DNA, 20 bp, Artificial Sequence
  chemically synthesized
gcaagtaatctggactatca

SEQ ID NO: 384810 - DNA, 20 bp, Artificial Sequence
  chemically synthesized
taaaataacctgtgatagtc

SEQ ID NO: 384811 - DNA, 20 bp, Artificial Sequence
  chemically synthesized
gggaaaatatgcaagtaatc

SEQ ID NO: 384812 - DNA, 20 bp, Artificial Sequence
  chemically synthesized
aaatgcaagggaaaatatgc

SEQ ID NO: 384813 - DNA, 20 bp, Artificial Sequence
  chemically synthesized
ataaggactctgaaatgcaa

SEQ ID NO: 384814 - DNA, 20 bp, Artificial Sequence
  chemically synthesized
gcatattttcccttgcattt

SEQ ID NO: 384815 - DNA, 20 bp, Artificial Sequence
  chemically synthesized
gataaggactctgaaatgca

SEQ ID NO: 384816 - DNA, 20 bp, Artificial Sequence
  chemically synthesized
tgataaggactctgaaatgc

SEQ ID NO: 384817 - DNA, 20 bp, Artificial Sequence
  chemically synthesized
atattttcccttgcatttca

SEQ ID NO: 384818 - DNA, 20 bp, Artificial Sequence
  chemically synthesized
ttgcatttcagagtccttat

SEQ ID NO: 384819 - DNA, 20 bp, Artificial Sequence
  chemically synthesized
cagtcctttgaatactgata

SEQ ID NO: 384820 - DNA, 20 bp, Artificial Sequence
  chemically synthesized
acagtcctttgaatactgat

SEQ ID NO: 384821 - DNA, 20 bp, Artificial Sequence
  chemically synthesized
agagtccttatcagtattca

SEQ ID NO: 384822 - DNA, 20 bp, Artificial Sequence
  chemically synthesized
gagtccttatcagtattcaa

SEQ ID NO: 384823 - DNA, 20 bp, Artificial Sequence
  chemically synthesized
tatcagtattcaaaggactg

SEQ ID NO: 384824 - DNA, 20 bp, Artificial Sequence
  chemically synthesized
tcagtattcaaaggactgta

SEQ ID NO: 384825 - DNA, 20 bp, Artificial Sequence
  chemically synthesized
aagcatttctaaaagctcta

SEQ ID NO: 384826 - DNA, 20 bp, Artificial Sequence
  chemically synthesized
tcaaaggactgtagagcttt

SEQ ID NO: 384827 - DNA, 20 bp, Artificial Sequence
  chemically synthesized
cctcactgaagcatttctaa

SEQ ID NO: 384828 - DNA, 20 bp, Artificial Sequence
  chemically synthesized
tagagcttttagaaatgctt

SEQ ID NO: 384829 - DNA, 20 bp, Artificial Sequence
  chemically synthesized
gcttttagaaatgcttcagt

SEQ ID NO: 384830 - DNA, 20 bp, Artificial Sequence
  chemically synthesized
cttttagaaatgcttcagtg

SEQ ID NO: 384831 - DNA, 20 bp, Artificial Sequence
  chemically synthesized
gtataaagtgttcctcactg

SEQ ID NO: 384832 - DNA, 20 bp, Artificial Sequence
  chemically synthesized
tttatcagggacagagtata

SEQ ID NO: 384833 - DNA, 20 bp, Artificial Sequence
  chemically synthesized
actttcatttatcagggaca

SEQ ID NO: 384834 - DNA, 20 bp, Artificial Sequence
  chemically synthesized
acactttcatttatcaggga

SEQ ID NO: 384835 - DNA, 20 bp, Artificial Sequence
  chemically synthesized
ataaacactttcatttatca

SEQ ID NO: 384836 - DNA, 20 bp, Artificial Sequence
  chemically synthesized
aataaacactttcatttatc

SEQ ID NO: 384837 - DNA, 20 bp, Artificial Sequence
  chemically synthesized
aaataaacactttcatttat

SEQ ID NO: 384838 - DNA, 20 bp, Artificial Sequence
  chemically synthesized
actctgtccctgataaatga

SEQ ID NO: 384839 - DNA, 20 bp, Artificial Sequence
  chemically synthesized
tgaaagtgtttatttcctct

SEQ ID NO: 384840 - DNA, 20 bp, Artificial Sequence
  chemically synthesized
gtgtttatttcctctcagat

SEQ ID NO: 384841 - DNA, 20 bp, Artificial Sequence
  chemically synthesized
ttgttactgacttatctgag

SEQ ID NO: 384842 - DNA, 20 bp, Artificial Sequence
  chemically synthesized
cttgttactgacttatctga

SEQ ID NO: 384843 - DNA, 20 bp, Artificial Sequence
  chemically synthesized
tgcttgttactgacttatct

SEQ ID NO: 384844 - DNA, 20 bp, Artificial Sequence
  chemically synthesized
ttatttcctctcagataagt

SEQ ID NO: 384845 - DNA, 20 bp, Artificial Sequence
  chemically synthesized
ctctcagataagtcagtaac

SEQ ID NO: 384846 - DNA, 20 bp, Artificial Sequence
  chemically synthesized
cagataagtcagtaacaagc

SEQ ID NO: 384847 - DNA, 20 bp, Artificial Sequence
  chemically synthesized
agtaacaagcaagtattttc

SEQ ID NO: 384848 - DNA, 20 bp, Artificial Sequence
  chemically synthesized
agcaagtattttctagcaac

SEQ ID NO: 384849 - DNA, 20 bp, Artificial Sequence
  chemically synthesized
ggtgggtatagtccagttgc

SEQ ID NO: 384850 - DNA, 20 bp, Artificial Sequence
  chemically synthesized
atgaataggtgggtatagtc

SEQ ID NO: 384851 - DNA, 20 bp, Artificial Sequence
  chemically synthesized
gggaaatgaataggtgggta

SEQ ID NO: 384852 - DNA, 20 bp, Artificial Sequence
  chemically synthesized
gccttgggaaatgaataggt

SEQ ID NO: 384853 - DNA, 20 bp, Artificial Sequence
  chemically synthesized
agccttgggaaatgaatagg

SEQ ID NO: 384854 - DNA, 20 bp, Artificial Sequence
  chemically synthesized
atgagccttgggaaatgaat

SEQ ID NO: 384855 - DNA, 20 bp, Artificial Sequence
  chemically synthesized
aatgagccttgggaaatgaa

SEQ ID NO: 384856 - DNA, 20 bp, Artificial Sequence
  chemically synthesized
tacccacctattcatttccc

SEQ ID NO: 384857 - DNA, 20 bp, Artificial Sequence
  chemically synthesized
acccacctattcatttccca

SEQ ID NO: 384858 - DNA, 20 bp, Artificial Sequence
  chemically synthesized
agtgatgcccaatgagcctt

SEQ ID NO: 384859 - DNA, 20 bp, Artificial Sequence
  chemically synthesized
tagtgatgcccaatgagcct

SEQ ID NO: 384860 - DNA, 20 bp, Artificial Sequence
  chemically synthesized
attcatttcccaaggctcat

SEQ ID NO: 384861 - DNA, 20 bp, Artificial Sequence
  chemically synthesized
ttcatttcccaaggctcatt

SEQ ID NO: 384862 - DNA, 20 bp, Artificial Sequence
  chemically synthesized
tattcctagtgatgcccaat

SEQ ID NO: 384863 - DNA, 20 bp, Artificial Sequence
  chemically synthesized
caaggctcattgggcatcac

SEQ ID NO: 384864 - DNA, 20 bp, Artificial Sequence
  chemically synthesized
aaggctcattgggcatcact

SEQ ID NO: 384865 - DNA, 20 bp, Artificial Sequence
  chemically synthesized
actaaaacctgttgtattcc

SEQ ID NO: 384866 - DNA, 20 bp, Artificial Sequence
  chemically synthesized
gggcatcactaggaatacaa

SEQ ID NO: 384867 - DNA, 20 bp, Artificial Sequence
  chemically synthesized
ggcatcactaggaatacaac

SEQ ID NO: 384868 - DNA, 20 bp, Artificial Sequence
  chemically synthesized
actaggaatacaacaggttt

SEQ ID NO: 384869 - DNA, 20 bp, Artificial Sequence
  chemically synthesized
gttttagttactaccaaccc

SEQ ID NO: 384870 - DNA, 20 bp, Artificial Sequence
  chemically synthesized
tctacagtaactggggttgg

SEQ ID NO: 384871 - DNA, 20 bp, Artificial Sequence
  chemically synthesized
aattctacagtaactggggt

SEQ ID NO: 384872 - DNA, 20 bp, Artificial Sequence
  chemically synthesized
gcctaattctacagtaactg

SEQ ID NO: 384873 - DNA, 20 bp, Artificial Sequence
  chemically synthesized
tgcctaattctacagtaact

SEQ ID NO: 384874 - DNA, 20 bp, Artificial Sequence
  chemically synthesized
actaccaaccccagttactg

SEQ ID NO: 384875 - DNA, 20 bp, Artificial Sequence
  chemically synthesized
ttgcctaattctacagtaac

SEQ ID NO: 384876 - DNA, 20 bp, Artificial Sequence
  chemically synthesized
aaccccagttactgtagaat

SEQ ID NO: 384877 - DNA, 20 bp, Artificial Sequence
  chemically synthesized
accccagttactgtagaatt

SEQ ID NO: 384878 - DNA, 20 bp, Artificial Sequence
  chemically synthesized
tatataattgcctaattcta

SEQ ID NO: 384879 - DNA, 20 bp, Artificial Sequence
  chemically synthesized
gtagaattaggcaattatat

SEQ ID NO: 384880 - DNA, 20 bp, Artificial Sequence
  chemically synthesized
agaattaggcaattatataa

SEQ ID NO: 384881 - DNA, 20 bp, Artificial Sequence
  chemically synthesized
tatataagagtttaaaaaat

SEQ ID NO: 384882 - DNA, 20 bp, Artificial Sequence
  chemically synthesized
taagagtttaaaaaatcagt

SEQ ID NO: 384883 - DNA, 20 bp, Artificial Sequence
  chemically synthesized
aagagtttaaaaaatcagta

SEQ ID NO: 384884 - DNA, 20 bp, Artificial Sequence
  chemically synthesized
tgtttttattttaaactact

SEQ ID NO: 384885 - DNA, 20 bp, Artificial Sequence
  chemically synthesized
ctacttttcaattatccaag

SEQ ID NO: 384886 - DNA, 20 bp, Artificial Sequence
  chemically synthesized
tacctacttttcaattatcc

SEQ ID NO: 384887 - DNA, 20 bp, Artificial Sequence
  chemically synthesized
aaactacttggataattgaa

SEQ ID NO: 384888 - DNA, 20 bp, Artificial Sequence
  chemically synthesized
ctacttggataattgaaaag

SEQ ID NO: 384889 - DNA, 20 bp, Artificial Sequence
  chemically synthesized
tacttggataattgaaaagt

SEQ ID NO: 384890 - DNA, 20 bp, Artificial Sequence
  chemically synthesized
ttggataattgaaaagtagg

SEQ ID NO: 384891 - DNA, 20 bp, Artificial Sequence
  chemically synthesized
atacagtcgtttggcaaata

SEQ ID NO: 384892 - DNA, 20 bp, Artificial Sequence
  chemically synthesized
ttaaatctaatacagtcgtt

SEQ ID NO: 384893 - DNA, 20 bp, Artificial Sequence
  chemically synthesized
tatttgccaaacgactgtat

SEQ ID NO: 384894 - DNA, 20 bp, Artificial Sequence
  chemically synthesized
ttctggttttaaatctaata

SEQ ID NO: 384895 - DNA, 20 bp, Artificial Sequence
  chemically synthesized
gactgtattagatttaaaac

SEQ ID NO: 384896 - DNA, 20 bp, Artificial Sequence
  chemically synthesized
tagatttaaaaccagaaaac

SEQ ID NO: 384897 - DNA, 20 bp, Artificial Sequence
  chemically synthesized
ctacataggggcttgttttc

SEQ ID NO: 384898 - DNA, 20 bp, Artificial Sequence
  chemically synthesized
ccagaaaacaagcccctatg

SEQ ID NO: 384899 - DNA, 20 bp, Artificial Sequence
  chemically synthesized
agaatctatattctacatag

SEQ ID NO: 384900 - DNA, 20 bp, Artificial Sequence
  chemically synthesized
gagaatctatattctacata

SEQ ID NO: 384901 - DNA, 20 bp, Artificial Sequence
  chemically synthesized
tgagaatctatattctacat

SEQ ID NO: 384902 - DNA, 20 bp, Artificial Sequence
  chemically synthesized
gtgagaatctatattctaca

SEQ ID NO: 384903 - DNA, 20 bp, Artificial Sequence
  chemically synthesized
acaagcccctatgtagaata

SEQ ID NO: 384904 - DNA, 20 bp, Artificial Sequence
  chemically synthesized
tgtagaatatagattctcac

SEQ ID NO: 384905 - DNA, 20 bp, Artificial Sequence
  chemically synthesized
tacttgatctatgaactggt

SEQ ID NO: 384906 - DNA, 20 bp, Artificial Sequence
  chemically synthesized
tatagattctcaccagttca

SEQ ID NO: 384907 - DNA, 20 bp, Artificial Sequence
  chemically synthesized
ttattacttgatctatgaac

SEQ ID NO: 384908 - DNA, 20 bp, Artificial Sequence
  chemically synthesized
ttctcaccagttcatagatc

SEQ ID NO: 384909 - DNA, 20 bp, Artificial Sequence
  chemically synthesized
cagttcatagatcaagtaat

SEQ ID NO: 384910 - DNA, 20 bp, Artificial Sequence
  chemically synthesized
tcaagtaataagacatttcc

SEQ ID NO: 384911 - DNA, 20 bp, Artificial Sequence
  chemically synthesized
caagtaataagacatttcct

SEQ ID NO: 384912 - DNA, 20 bp, Artificial Sequence
  chemically synthesized
aagtaataagacatttccta

SEQ ID NO: 384913 - DNA, 20 bp, Artificial Sequence
  chemically synthesized
atcaaacaattaaacaccct

SEQ ID NO: 384914 - DNA, 20 bp, Artificial Sequence
  chemically synthesized
tatcaaacaattaaacaccc

SEQ ID NO: 384915 - DNA, 20 bp, Artificial Sequence
  chemically synthesized
gtgtttaattgtttgatact

SEQ ID NO: 384916 - DNA, 20 bp, Artificial Sequence
  chemically synthesized
gtttaattgtttgatactaa

SEQ ID NO: 384917 - DNA, 20 bp, Artificial Sequence
  chemically synthesized
ttcctataatttattgctct

SEQ ID NO: 384918 - DNA, 20 bp, Artificial Sequence
  chemically synthesized
atactaagagcaataaatta

SEQ ID NO: 384919 - DNA, 20 bp, Artificial Sequence
  chemically synthesized
tactaagagcaataaattat

SEQ ID NO: 384920 - DNA, 20 bp, Artificial Sequence
  chemically synthesized
ggaaaataatttgtaataat

SEQ ID NO: 384921 - DNA, 20 bp, Artificial Sequence
  chemically synthesized
ataatttgtaataattggtt

SEQ ID NO: 384922 - DNA, 20 bp, Artificial Sequence
  chemically synthesized
ttaagtaattaaccacaatt

SEQ ID NO: 384923 - DNA, 20 bp, Artificial Sequence
  chemically synthesized
ccatcatcttttcttaattg

SEQ ID NO: 384924 - DNA, 20 bp, Artificial Sequence
  chemically synthesized
taattaaccacaattaagaa

SEQ ID NO: 384925 - DNA, 20 bp, Artificial Sequence
  chemically synthesized
ccacaattaagaaaagatga

SEQ ID NO: 384926 - DNA, 20 bp, Artificial Sequence
  chemically synthesized
gaaaagatgatggaatccct

SEQ ID NO: 384927 - DNA, 20 bp, Artificial Sequence
  chemically synthesized
aaaagatgatggaatccctg

SEQ ID NO: 384928 - DNA, 20 bp, Artificial Sequence
  chemically synthesized
agtattgtcggatatcctca

SEQ ID NO: 384929 - DNA, 20 bp, Artificial Sequence
  chemically synthesized
cagtattgtcggatatcctc

SEQ ID NO: 384930 - DNA, 20 bp, Artificial Sequence
  chemically synthesized
tcagtattgtcggatatcct

SEQ ID NO: 384931 - DNA, 20 bp, Artificial Sequence
  chemically synthesized
tataatgttgtcagtattgt

SEQ ID NO: 384932 - DNA, 20 bp, Artificial Sequence
  chemically synthesized
cttaaagtttataatgttgt

SEQ ID NO: 384933 - DNA, 20 bp, Artificial Sequence
  chemically synthesized
ctgacaacattataaacttt

SEQ ID NO: 384934 - DNA, 20 bp, Artificial Sequence
  chemically synthesized
gacaacattataaactttaa

SEQ ID NO: 384935 - DNA, 20 bp, Artificial Sequence
  chemically synthesized
caactattttttttctctta

SEQ ID NO: 384936 - DNA, 20 bp, Artificial Sequence
  chemically synthesized
aaactttaagagaaaaaaaa

SEQ ID NO: 384937 - DNA, 20 bp, Artificial Sequence
  chemically synthesized
gagaaaaaaaatagttgttg

SEQ ID NO: 384938 - DNA, 20 bp, Artificial Sequence
  chemically synthesized
gaaaaaaaatagttgttgca

SEQ ID NO: 384939 - DNA, 20 bp, Artificial Sequence
  chemically synthesized
aaaaatagttgttgcagagc

SEQ ID NO: 384940 - DNA, 20 bp, Artificial Sequence
  chemically synthesized
tagttgttgcagagcaagaa

SEQ ID NO: 384941 - DNA, 20 bp, Artificial Sequence
  chemically synthesized
aagaaaagtcatcatgtgcc

SEQ ID NO: 384942 - DNA, 20 bp, Artificial Sequence
  chemically synthesized
attagacctctatttgtgct

SEQ ID NO: 384943 - DNA, 20 bp, Artificial Sequence
  chemically synthesized
catcatgtgcctagcacaaa

SEQ ID NO: 384944 - DNA, 20 bp, Artificial Sequence
  chemically synthesized
aattagacctctatttgtgc

SEQ ID NO: 384945 - DNA, 20 bp, Artificial Sequence
  chemically synthesized
tcatgtgcctagcacaaata

SEQ ID NO: 384946 - DNA, 20 bp, Artificial Sequence
  chemically synthesized
catgtgcctagcacaaatag

SEQ ID NO: 384947 - DNA, 20 bp, Artificial Sequence
  chemically synthesized
cacaaatagaggtctaatta

SEQ ID NO: 384948 - DNA, 20 bp, Artificial Sequence
  chemically synthesized
acaaatagaggtctaattat

SEQ ID NO: 384949 - DNA, 20 bp, Artificial Sequence
  chemically synthesized
caaatagaggtctaattata

SEQ ID NO: 384950 - DNA, 20 bp, Artificial Sequence
  chemically synthesized
aaatagaggtctaattatag

SEQ ID NO: 384951 - DNA, 20 bp, Artificial Sequence
  chemically synthesized
aacgtaaaatcccctataat

SEQ ID NO: 384952 - DNA, 20 bp, Artificial Sequence
  chemically synthesized
tttttcataatgtctacaat

SEQ ID NO: 384953 - DNA, 20 bp, Artificial Sequence
  chemically synthesized
aatgtagtatatgctcattg

SEQ ID NO: 384954 - DNA, 20 bp, Artificial Sequence
  chemically synthesized
actgttcgtgattataaatg

SEQ ID NO: 384955 - DNA, 20 bp, Artificial Sequence
  chemically synthesized
actacatttataatcacgaa

SEQ ID NO: 384956 - DNA, 20 bp, Artificial Sequence
  chemically synthesized
tataatcacgaacagtccat

SEQ ID NO: 384957 - DNA, 20 bp, Artificial Sequence
  chemically synthesized
aatcacgaacagtccattag

SEQ ID NO: 384958 - DNA, 20 bp, Artificial Sequence
  chemically synthesized
atcacgaacagtccattagc

SEQ ID NO: 384959 - DNA, 20 bp, Artificial Sequence
  chemically synthesized
agatatatgatacctgctaa

SEQ ID NO: 384960 - DNA, 20 bp, Artificial Sequence
  chemically synthesized
ttagcaggtatcatatatct

SEQ ID NO: 384961 - DNA, 20 bp, Artificial Sequence
  chemically synthesized
caggtatcatatatctgagt

SEQ ID NO: 384962 - DNA, 20 bp, Artificial Sequence
  chemically synthesized
aggtatcatatatctgagtt

SEQ ID NO: 384963 - DNA, 20 bp, Artificial Sequence
  chemically synthesized
tgacagggtatttcccaact

SEQ ID NO: 384964 - DNA, 20 bp, Artificial Sequence
  chemically synthesized
gaagtattagcgaagtgaca

SEQ ID NO: 384965 - DNA, 20 bp, Artificial Sequence
  chemically synthesized
agaagtattagcgaagtgac

SEQ ID NO: 384966 - DNA, 20 bp, Artificial Sequence
  chemically synthesized
aagaagtattagcgaagtga

SEQ ID NO: 384967 - DNA, 20 bp, Artificial Sequence
  chemically synthesized
aaaagaaagaagtattagcg

SEQ ID NO: 384968 - DNA, 20 bp, Artificial Sequence
  chemically synthesized
gaacaaaaagaaagaagtat

SEQ ID NO: 384969 - DNA, 20 bp, Artificial Sequence
  chemically synthesized
ctattagaacaaaaagaaag

SEQ ID NO: 384970 - DNA, 20 bp, Artificial Sequence
  chemically synthesized
acactattagaacaaaaaga

SEQ ID NO: 384971 - DNA, 20 bp, Artificial Sequence
  chemically synthesized
gaatacactattagaacaaa

SEQ ID NO: 384972 - DNA, 20 bp, Artificial Sequence
  chemically synthesized
cttctttctttttgttctaa

SEQ ID NO: 384973 - DNA, 20 bp, Artificial Sequence
  chemically synthesized
ttatttggtgaatacactat

SEQ ID NO: 384974 - DNA, 20 bp, Artificial Sequence
  chemically synthesized
tatatatttagaagattatt

SEQ ID NO: 384975 - DNA, 20 bp, Artificial Sequence
  chemically synthesized
atatacacatatatatttag

SEQ ID NO: 384976 - DNA, 20 bp, Artificial Sequence
  chemically synthesized
tatatatacacatatatatt

SEQ ID NO: 384977 - DNA, 20 bp, Artificial Sequence
  chemically synthesized
atgtgtatatatatatattt

SEQ ID NO: 384978 - DNA, 20 bp, Artificial Sequence
  chemically synthesized
atatatatgtatatatattt

SEQ ID NO: 384979 - DNA, 20 bp, Artificial Sequence
  chemically synthesized
atacgtgtatatatatattt

SEQ ID NO: 384980 - DNA, 20 bp, Artificial Sequence
  chemically synthesized
atatttgagatatatatatg

SEQ ID NO: 384981 - DNA, 20 bp, Artificial Sequence
  chemically synthesized
tatttgagatatatatatgc

SEQ ID NO: 384982 - DNA, 20 bp, Artificial Sequence
  chemically synthesized
ttgagatatatatatgcagg

SEQ ID NO: 384983 - DNA, 20 bp, Artificial Sequence
  chemically synthesized
agatatatatatgcaggaag

SEQ ID NO: 384984 - DNA, 20 bp, Artificial Sequence
  chemically synthesized
atatatatgcaggaagaagt

SEQ ID NO: 384985 - DNA, 20 bp, Artificial Sequence
  chemically synthesized
gaagaagtgagtgacattct

SEQ ID NO: 384986 - DNA, 20 bp, Artificial Sequence
  chemically synthesized
ttttggtcattagtgtttct

SEQ ID NO: 384987 - DNA, 20 bp, Artificial Sequence
  chemically synthesized
ttatgtggttttttggtcat

SEQ ID NO: 384988 - DNA, 20 bp, Artificial Sequence
  chemically synthesized
aaagatattatgtggttttt

SEQ ID NO: 384989 - DNA, 20 bp, Artificial Sequence
  chemically synthesized
cactaagaaaagatattatg

SEQ ID NO: 384990 - DNA, 20 bp, Artificial Sequence
  chemically synthesized
aaccacataatatcttttct

SEQ ID NO: 384991 - DNA, 20 bp, Artificial Sequence
  chemically synthesized
cacataatatcttttcttag

SEQ ID NO: 384992 - DNA, 20 bp, Artificial Sequence
  chemically synthesized
ggaaggaacaccactaagaa

SEQ ID NO: 384993 - DNA, 20 bp, Artificial Sequence
  chemically synthesized
tataaggaaggaacaccact

SEQ ID NO: 384994 - DNA, 20 bp, Artificial Sequence
  chemically synthesized
gtggttggccaatataagga

SEQ ID NO: 384995 - DNA, 20 bp, Artificial Sequence
  chemically synthesized
ggtggttggccaatataagg

SEQ ID NO: 384996 - DNA, 20 bp, Artificial Sequence
  chemically synthesized
gtggtgttccttccttatat

SEQ ID NO: 384997 - DNA, 20 bp, Artificial Sequence
  chemically synthesized
caaggtggttggccaatata

SEQ ID NO: 384998 - DNA, 20 bp, Artificial Sequence
  chemically synthesized
gcaaggtggttggccaatat

SEQ ID NO: 384999 - DNA, 20 bp, Artificial Sequence
  chemically synthesized
attttttattgcaaggtggt

SEQ ID NO: 385000 - DNA, 20 bp, Artificial Sequence
  chemically synthesized
catcattttttattgcaagg

SEQ ID NO: 385001 - DNA, 20 bp, Artificial Sequence
  chemically synthesized
catcatcattttttattgca

SEQ ID NO: 385002 - DNA, 20 bp, Artificial Sequence
  chemically synthesized
acatcatcattttttattgc

SEQ ID NO: 385003 - DNA, 20 bp, Artificial Sequence
  chemically synthesized
tgcaataaaaaatgatgatg

SEQ ID NO: 385004 - DNA, 20 bp, Artificial Sequence
  chemically synthesized
ataaaaaatgatgatgtaga

SEQ ID NO: 385005 - DNA, 20 bp, Artificial Sequence
  chemically synthesized
aaaatgatgatgtagacaga

SEQ ID NO: 385006 - DNA, 20 bp, Artificial Sequence
  chemically synthesized
aaatgatgatgtagacagaa

SEQ ID NO: 385007 - DNA, 20 bp, Artificial Sequence
  chemically synthesized
atgatgtagacagaaaggaa

SEQ ID NO: 385008 - DNA, 20 bp, Artificial Sequence
  chemically synthesized
tgtagacagaaaggaaaagt

SEQ ID NO: 385009 - DNA, 20 bp, Artificial Sequence
  chemically synthesized
tagacagaaaggaaaagtta

SEQ ID NO: 385010 - DNA, 20 bp, Artificial Sequence
  chemically synthesized
aggaaaggaaaaagaatagg

SEQ ID NO: 385011 - DNA, 20 bp, Artificial Sequence
  chemically synthesized
aaaaggaaaggaaaaagaat

SEQ ID NO: 385012 - DNA, 20 bp, Artificial Sequence
  chemically synthesized
taaaaggaaaggaaaaagaa

SEQ ID NO: 385013 - DNA, 20 bp, Artificial Sequence
  chemically synthesized
gggactaaaaggaaaggaaa

SEQ ID NO: 385014 - DNA, 20 bp, Artificial Sequence
  chemically synthesized
tattctttttcctttccttt

SEQ ID NO: 385015 - DNA, 20 bp, Artificial Sequence
  chemically synthesized
taaggagggactaaaaggaa

SEQ ID NO: 385016 - DNA, 20 bp, Artificial Sequence
  chemically synthesized
gtaaggagggactaaaagga

SEQ ID NO: 385017 - DNA, 20 bp, Artificial Sequence
  chemically synthesized
acgtgtaaggagggactaaa

SEQ ID NO: 385018 - DNA, 20 bp, Artificial Sequence
  chemically synthesized
gacgtgtaaggagggactaa

SEQ ID NO: 385019 - DNA, 20 bp, Artificial Sequence
  chemically synthesized
ggcttactgacgtgtaagga

SEQ ID NO: 385020 - DNA, 20 bp, Artificial Sequence
  chemically synthesized
tggcttactgacgtgtaagg

SEQ ID NO: 385021 - DNA, 20 bp, Artificial Sequence
  chemically synthesized
ttggcttactgacgtgtaag

SEQ ID NO: 385022 - DNA, 20 bp, Artificial Sequence
  chemically synthesized
tttagtccctccttacacgt

SEQ ID NO: 385023 - DNA, 20 bp, Artificial Sequence
  chemically synthesized
ctttggcttactgacgtgta

SEQ ID NO: 385024 - DNA, 20 bp, Artificial Sequence
  chemically synthesized
cctttggcttactgacgtgt

SEQ ID NO: 385025 - DNA, 20 bp, Artificial Sequence
  chemically synthesized
gtccctccttacacgtcagt

SEQ ID NO: 385026 - DNA, 20 bp, Artificial Sequence
  chemically synthesized
ccttacacgtcagtaagcca

SEQ ID NO: 385027 - DNA, 20 bp, Artificial Sequence
  chemically synthesized
cttacacgtcagtaagccaa

SEQ ID NO: 385028 - DNA, 20 bp, Artificial Sequence
  chemically synthesized
ttacacgtcagtaagccaaa

SEQ ID NO: 385029 - DNA, 20 bp, Artificial Sequence
  chemically synthesized
tttatcaagaagatgccctt

SEQ ID NO: 385030 - DNA, 20 bp, Artificial Sequence
  chemically synthesized
taaatgtacagtttatcaag

SEQ ID NO: 385031 - DNA, 20 bp, Artificial Sequence
  chemically synthesized
tcataaatgtacagtttatc

SEQ ID NO: 385032 - DNA, 20 bp, Artificial Sequence
  chemically synthesized
ttcctttcttcataaatgta

SEQ ID NO: 385033 - DNA, 20 bp, Artificial Sequence
  chemically synthesized
tgataaactgtacatttatg

SEQ ID NO: 385034 - DNA, 20 bp, Artificial Sequence
  chemically synthesized
aaactgtacatttatgaaga

SEQ ID NO: 385035 - DNA, 20 bp, Artificial Sequence
  chemically synthesized
aactgtacatttatgaagaa

SEQ ID NO: 385036 - DNA, 20 bp, Artificial Sequence
  chemically synthesized
gaaaggaaataaaaaccatt

SEQ ID NO: 385037 - DNA, 20 bp, Artificial Sequence
  chemically synthesized
gctgcataaaatgaacttaa

SEQ ID NO: 385038 - DNA, 20 bp, Artificial Sequence
  chemically synthesized
accattaagttcattttatg

SEQ ID NO: 385039 - DNA, 20 bp, Artificial Sequence
  chemically synthesized
atgcagcatttccactattc

SEQ ID NO: 385040 - DNA, 20 bp, Artificial Sequence
  chemically synthesized
ttctttacttaccagaatag

SEQ ID NO: 385041 - DNA, 20 bp, Artificial Sequence
  chemically synthesized
agcatttccactattctggt

SEQ ID NO: 385042 - DNA, 20 bp, Artificial Sequence
  chemically synthesized
gctttctttacttaccagaa

SEQ ID NO: 385043 - DNA, 20 bp, Artificial Sequence
  chemically synthesized
ttccactattctggtaagta

SEQ ID NO: 385044 - DNA, 20 bp, Artificial Sequence
  chemically synthesized
cacatgctttctttacttac

SEQ ID NO: 385045 - DNA, 20 bp, Artificial Sequence
  chemically synthesized
actattctggtaagtaaaga

SEQ ID NO: 385046 - DNA, 20 bp, Artificial Sequence
  chemically synthesized
aagtaaagaaagcatgtgtg

SEQ ID NO: 385047 - DNA, 20 bp, Artificial Sequence
  chemically synthesized
ttaacttatatggagagtca

SEQ ID NO: 385048 - DNA, 20 bp, Artificial Sequence
  chemically synthesized
atttctatgactctccatat

SEQ ID NO: 385049 - DNA, 20 bp, Artificial Sequence
  chemically synthesized
gaatatttaacttatatgga

SEQ ID NO: 385050 - DNA, 20 bp, Artificial Sequence
  chemically synthesized
gagaatatttaacttatatg

SEQ ID NO: 385051 - DNA, 20 bp, Artificial Sequence
  chemically synthesized
atgagaatatttaacttata

SEQ ID NO: 385052 - DNA, 20 bp, Artificial Sequence
  chemically synthesized
ctatttttagatggatatat

SEQ ID NO: 385053 - DNA, 20 bp, Artificial Sequence
  chemically synthesized
aagtcagtgctatttttaga

SEQ ID NO: 385054 - DNA, 20 bp, Artificial Sequence
  chemically synthesized
ctcatatatccatctaaaaa

SEQ ID NO: 385055 - DNA, 20 bp, Artificial Sequence
  chemically synthesized
actgaagtcagtgctatttt

SEQ ID NO: 385056 - DNA, 20 bp, Artificial Sequence
  chemically synthesized
tctaaaaatagcactgactt

SEQ ID NO: 385057 - DNA, 20 bp, Artificial Sequence
  chemically synthesized
tcctgaaactttactgaagt

SEQ ID NO: 385058 - DNA, 20 bp, Artificial Sequence
  chemically synthesized
aaatagcactgacttcagta

SEQ ID NO: 385059 - DNA, 20 bp, Artificial Sequence
  chemically synthesized
tgtttcctgaaactttactg

SEQ ID NO: 385060 - DNA, 20 bp, Artificial Sequence
  chemically synthesized
cactgacttcagtaaagttt

SEQ ID NO: 385061 - DNA, 20 bp, Artificial Sequence
  chemically synthesized
actgacttcagtaaagtttc

SEQ ID NO: 385062 - DNA, 20 bp, Artificial Sequence
  chemically synthesized
caaaatcaatatacaaaaat

SEQ ID NO: 385063 - DNA, 20 bp, Artificial Sequence
  chemically synthesized
tcagtaacatttctacatac

SEQ ID NO: 385064 - DNA, 20 bp, Artificial Sequence
  chemically synthesized
gcttgaaaattactggtatg

SEQ ID NO: 385065 - DNA, 20 bp, Artificial Sequence
  chemically synthesized
gtgcttagcttgaaaattac

SEQ ID NO: 385066 - DNA, 20 bp, Artificial Sequence
  chemically synthesized
tctacataccagtaattttc

SEQ ID NO: 385067 - DNA, 20 bp, Artificial Sequence
  chemically synthesized
ataccagtaattttcaagct

SEQ ID NO: 385068 - DNA, 20 bp, Artificial Sequence
  chemically synthesized
tgcatacttgatttggtgct

SEQ ID NO: 385069 - DNA, 20 bp, Artificial Sequence
  chemically synthesized
ttcaagctaagcaccaaatc

SEQ ID NO: 385070 - DNA, 20 bp, Artificial Sequence
  chemically synthesized
atgggattgcatacttgatt

SEQ ID NO: 385071 - DNA, 20 bp, Artificial Sequence
  chemically synthesized
tttttatggctattataaat

SEQ ID NO: 385072 - DNA, 20 bp, Artificial Sequence
  chemically synthesized
gtatgcaatcccatttataa

SEQ ID NO: 385073 - DNA, 20 bp, Artificial Sequence
  chemically synthesized
ttttttatggctattataaa

SEQ ID NO: 385074 - DNA, 20 bp, Artificial Sequence
  chemically synthesized
ttcacctcttttatttttta

SEQ ID NO: 385075 - DNA, 20 bp, Artificial Sequence
  chemically synthesized
ataatagccataaaaaataa

SEQ ID NO: 385076 - DNA, 20 bp, Artificial Sequence
  chemically synthesized
aatagccataaaaaataaaa

SEQ ID NO: 385077 - DNA, 20 bp, Artificial Sequence
  chemically synthesized
atagccataaaaaataaaag

SEQ ID NO: 385078 - DNA, 20 bp, Artificial Sequence
  chemically synthesized
aagaggtgaatgatctctat

SEQ ID NO: 385079 - DNA, 20 bp, Artificial Sequence
  chemically synthesized
aggtgaatgatctctatgag

SEQ ID NO: 385080 - DNA, 20 bp, Artificial Sequence
  chemically synthesized
gttctgtaagtcttctcata

SEQ ID NO: 385081 - DNA, 20 bp, Artificial Sequence
  chemically synthesized
gtgttctgtaagtcttctca

SEQ ID NO: 385082 - DNA, 20 bp, Artificial Sequence
  chemically synthesized
gatctctatgagaagactta

SEQ ID NO: 385083 - DNA, 20 bp, Artificial Sequence
  chemically synthesized
ttattttagtagtgttctgt

SEQ ID NO: 385084 - DNA, 20 bp, Artificial Sequence
  chemically synthesized
tcatctgtgatttattttag

SEQ ID NO: 385085 - DNA, 20 bp, Artificial Sequence
  chemically synthesized
gtgtcatctgtgatttattt

SEQ ID NO: 385086 - DNA, 20 bp, Artificial Sequence
  chemically synthesized
aacactactaaaataaatca

SEQ ID NO: 385087 - DNA, 20 bp, Artificial Sequence
  chemically synthesized
tcacagatgacacaaacaaa

SEQ ID NO: 385088 - DNA, 20 bp, Artificial Sequence
  chemically synthesized
ttctaatccatgagtatgga

SEQ ID NO: 385089 - DNA, 20 bp, Artificial Sequence
  chemically synthesized
agaaaaactttccatactca

SEQ ID NO: 385090 - DNA, 20 bp, Artificial Sequence
  chemically synthesized
attcttctaatccatgagta

SEQ ID NO: 385091 - DNA, 20 bp, Artificial Sequence
  chemically synthesized
aactttccatactcatggat

SEQ ID NO: 385092 - DNA, 20 bp, Artificial Sequence
  chemically synthesized
tattgattcttctaatccat

SEQ ID NO: 385093 - DNA, 20 bp, Artificial Sequence
  chemically synthesized
tttccatactcatggattag

SEQ ID NO: 385094 - DNA, 20 bp, Artificial Sequence
  chemically synthesized
aagaatcaatatcattaaaa

SEQ ID NO: 385095 - DNA, 20 bp, Artificial Sequence
  chemically synthesized
gtagattgctttgggtagta

SEQ ID NO: 385096 - DNA, 20 bp, Artificial Sequence
  chemically synthesized
taaaatggccatactaccca

SEQ ID NO: 385097 - DNA, 20 bp, Artificial Sequence
  chemically synthesized
aattcgtagattgctttggg

SEQ ID NO: 385098 - DNA, 20 bp, Artificial Sequence
  chemically synthesized
tttaattcgtagattgcttt

SEQ ID NO: 385099 - DNA, 20 bp, Artificial Sequence
  chemically synthesized
atttaattcgtagattgctt

SEQ ID NO: 385100 - DNA, 20 bp, Artificial Sequence
  chemically synthesized
taggaataacatttaattcg

SEQ ID NO: 385101 - DNA, 20 bp, Artificial Sequence
  chemically synthesized
aatgatgttagtggtttgat

SEQ ID NO: 385102 - DNA, 20 bp, Artificial Sequence
  chemically synthesized
aaatgatgttagtggtttga

SEQ ID NO: 385103 - DNA, 20 bp, Artificial Sequence
  chemically synthesized
tctgtgaaaaatgatgttag

SEQ ID NO: 385104 - DNA, 20 bp, Artificial Sequence
  chemically synthesized
agttctgtgaaaaatgatgt

SEQ ID NO: 385105 - DNA, 20 bp, Artificial Sequence
  chemically synthesized
accactaacatcatttttca

SEQ ID NO: 385106 - DNA, 20 bp, Artificial Sequence
  chemically synthesized
aacatcatttttcacagaac

SEQ ID NO: 385107 - DNA, 20 bp, Artificial Sequence
  chemically synthesized
tttttcacagaactggaaaa

SEQ ID NO: 385108 - DNA, 20 bp, Artificial Sequence
  chemically synthesized
attttagtatagcttttttc

SEQ ID NO: 385109 - DNA, 20 bp, Artificial Sequence
  chemically synthesized
gttctatatgaattttagta

SEQ ID NO: 385110 - DNA, 20 bp, Artificial Sequence
  chemically synthesized
ttttggttctatatgaattt

SEQ ID NO: 385111 - DNA, 20 bp, Artificial Sequence
  chemically synthesized
aagctatactaaaattcata

SEQ ID NO: 385112 - DNA, 20 bp, Artificial Sequence
  chemically synthesized
aaaattcatatagaaccaaa

SEQ ID NO: 385113 - DNA, 20 bp, Artificial Sequence
  chemically synthesized
aaattcatatagaaccaaaa

SEQ ID NO: 385114 - DNA, 20 bp, Artificial Sequence
  chemically synthesized
attcatatagaaccaaaaag

SEQ ID NO: 385115 - DNA, 20 bp, Artificial Sequence
  chemically synthesized
attacttttgggctcctttt

SEQ ID NO: 385116 - DNA, 20 bp, Artificial Sequence
  chemically synthesized
agaaccaaaaaggagcccaa

SEQ ID NO: 385117 - DNA, 20 bp, Artificial Sequence
  chemically synthesized
ttttccttaggattactttt

SEQ ID NO: 385118 - DNA, 20 bp, Artificial Sequence
  chemically synthesized
tttttccttaggattacttt

SEQ ID NO: 385119 - DNA, 20 bp, Artificial Sequence
  chemically synthesized
aggagcccaaaagtaatcct

SEQ ID NO: 385120 - DNA, 20 bp, Artificial Sequence
  chemically synthesized
ggagcccaaaagtaatccta

SEQ ID NO: 385121 - DNA, 20 bp, Artificial Sequence
  chemically synthesized
caaaagtaatcctaaggaaa

SEQ ID NO: 385122 - DNA, 20 bp, Artificial Sequence
  chemically synthesized
tggctttgttctttttcctt

SEQ ID NO: 385123 - DNA, 20 bp, Artificial Sequence
  chemically synthesized
ctggctttgttctttttcct

SEQ ID NO: 385124 - DNA, 20 bp, Artificial Sequence
  chemically synthesized
aatcctaaggaaaaagaaca

SEQ ID NO: 385125 - DNA, 20 bp, Artificial Sequence
  chemically synthesized
ctaaggaaaaagaacaaagc

SEQ ID NO: 385126 - DNA, 20 bp, Artificial Sequence
  chemically synthesized
aaggaaaaagaacaaagcca

SEQ ID NO: 385127 - DNA, 20 bp, Artificial Sequence
  chemically synthesized
aggaaaaagaacaaagccag

SEQ ID NO: 385128 - DNA, 20 bp, Artificial Sequence
  chemically synthesized
aaaaagaacaaagccagagg

SEQ ID NO: 385129 - DNA, 20 bp, Artificial Sequence
  chemically synthesized
gttgggtaatgtgctgcctc

SEQ ID NO: 385130 - DNA, 20 bp, Artificial Sequence
  chemically synthesized
ttatagtatagtttgaagtt

SEQ ID NO: 385131 - DNA, 20 bp, Artificial Sequence
  chemically synthesized
cttatagtatagtttgaagt

SEQ ID NO: 385132 - DNA, 20 bp, Artificial Sequence
  chemically synthesized
tagccttatagtatagtttg

SEQ ID NO: 385133 - DNA, 20 bp, Artificial Sequence
  chemically synthesized
ccaacttcaaactatactat

SEQ ID NO: 385134 - DNA, 20 bp, Artificial Sequence
  chemically synthesized
caacttcaaactatactata

SEQ ID NO: 385135 - DNA, 20 bp, Artificial Sequence
  chemically synthesized
gttgctgtagccttatagta

SEQ ID NO: 385136 - DNA, 20 bp, Artificial Sequence
  chemically synthesized
attcggttgctgtagcctta

SEQ ID NO: 385137 - DNA, 20 bp, Artificial Sequence
  chemically synthesized
caaactatactataaggcta

SEQ ID NO: 385138 - DNA, 20 bp, Artificial Sequence
  chemically synthesized
ccatgctgattcggttgctg

SEQ ID NO: 385139 - DNA, 20 bp, Artificial Sequence
  chemically synthesized
taaggctacagcaaccgaat

SEQ ID NO: 385140 - DNA, 20 bp, Artificial Sequence
  chemically synthesized
aacgttataccatgctgatt

SEQ ID NO: 385141 - DNA, 20 bp, Artificial Sequence
  chemically synthesized
ctacagcaaccgaatcagca

SEQ ID NO: 385142 - DNA, 20 bp, Artificial Sequence
  chemically synthesized
atcagcatggtataacgttt

SEQ ID NO: 385143 - DNA, 20 bp, Artificial Sequence
  chemically synthesized
ttcagttacatacaatgaat

SEQ ID NO: 385144 - DNA, 20 bp, Artificial Sequence
  chemically synthesized
tacatacaatgaataagttc

SEQ ID NO: 385145 - DNA, 20 bp, Artificial Sequence
  chemically synthesized
catacaatgaataagttctg

SEQ ID NO: 385146 - DNA, 20 bp, Artificial Sequence
  chemically synthesized
tatgctgtgcattagatctc

SEQ ID NO: 385147 - DNA, 20 bp, Artificial Sequence
  chemically synthesized
agttctggagatctaatgca

SEQ ID NO: 385148 - DNA, 20 bp, Artificial Sequence
  chemically synthesized
atagtccctatgctgtgcat

SEQ ID NO: 385149 - DNA, 20 bp, Artificial Sequence
  chemically synthesized
tggagatctaatgcacagca

SEQ ID NO: 385150 - DNA, 20 bp, Artificial Sequence
  chemically synthesized
ggagatctaatgcacagcat

SEQ ID NO: 385151 - DNA, 20 bp, Artificial Sequence
  chemically synthesized
gagatctaatgcacagcata

SEQ ID NO: 385152 - DNA, 20 bp, Artificial Sequence
  chemically synthesized
aatgcacagcatagggacta

SEQ ID NO: 385153 - DNA, 20 bp, Artificial Sequence
  chemically synthesized
cacagcatagggactatagt

SEQ ID NO: 385154 - DNA, 20 bp, Artificial Sequence
  chemically synthesized
caatacagtattactgacta

SEQ ID NO: 385155 - DNA, 20 bp, Artificial Sequence
  chemically synthesized
caaatttcaagtatacaata

SEQ ID NO: 385156 - DNA, 20 bp, Artificial Sequence
  chemically synthesized
atttactctcagcaaatttc

SEQ ID NO: 385157 - DNA, 20 bp, Artificial Sequence
  chemically synthesized
ttgtatacttgaaatttgct

SEQ ID NO: 385158 - DNA, 20 bp, Artificial Sequence
  chemically synthesized
gtatacttgaaatttgctga

SEQ ID NO: 385159 - DNA, 20 bp, Artificial Sequence
  chemically synthesized
gaaaacttacaatttactct

SEQ ID NO: 385160 - DNA, 20 bp, Artificial Sequence
  chemically synthesized
atttgctgagagtaaattgt

SEQ ID NO: 385161 - DNA, 20 bp, Artificial Sequence
  chemically synthesized
aattgtaagttttcttacca

SEQ ID NO: 385162 - DNA, 20 bp, Artificial Sequence
  chemically synthesized
agttattttgtgtctgtggt

SEQ ID NO: 385163 - DNA, 20 bp, Artificial Sequence
  chemically synthesized
acatagttattttgtgtctg

SEQ ID NO: 385164 - DNA, 20 bp, Artificial Sequence
  chemically synthesized
agacacaaaataactatgtg

SEQ ID NO: 385165 - DNA, 20 bp, Artificial Sequence
  chemically synthesized
acacaaaataactatgtgaa

SEQ ID NO: 385166 - DNA, 20 bp, Artificial Sequence
  chemically synthesized
aacatatccatctcttcaca

SEQ ID NO: 385167 - DNA, 20 bp, Artificial Sequence
  chemically synthesized
aaaataactatgtgaagaga

SEQ ID NO: 385168 - DNA, 20 bp, Artificial Sequence
  chemically synthesized
gaagagatggatatgttaat

SEQ ID NO: 385169 - DNA, 20 bp, Artificial Sequence
  chemically synthesized
tatgttaattagcttaactg

SEQ ID NO: 385170 - DNA, 20 bp, Artificial Sequence
  chemically synthesized
gtgaactgattactacagtt

SEQ ID NO: 385171 - DNA, 20 bp, Artificial Sequence
  chemically synthesized
attagcttaactgtagtaat

SEQ ID NO: 385172 - DNA, 20 bp, Artificial Sequence
  chemically synthesized
acgcagtgaactgattacta

SEQ ID NO: 385173 - DNA, 20 bp, Artificial Sequence
  chemically synthesized
tgttttgatgtgcatatacg

SEQ ID NO: 385174 - DNA, 20 bp, Artificial Sequence
  chemically synthesized
ctatatttaagatgtataat

SEQ ID NO: 385175 - DNA, 20 bp, Artificial Sequence
  chemically synthesized
cctatatttaagatgtataa

SEQ ID NO: 385176 - DNA, 20 bp, Artificial Sequence
  chemically synthesized
cccattatacatcttaaata

SEQ ID NO: 385177 - DNA, 20 bp, Artificial Sequence
  chemically synthesized
ccattatacatcttaaatat

SEQ ID NO: 385178 - DNA, 20 bp, Artificial Sequence
  chemically synthesized
tataaaaattgcctatattt

SEQ ID NO: 385179 - DNA, 20 bp, Artificial Sequence
  chemically synthesized
aatttttataacatttaaat

SEQ ID NO: 385180 - DNA, 20 bp, Artificial Sequence
  chemically synthesized
tttttataacatttaaataa

SEQ ID NO: 385181 - DNA, 20 bp, Artificial Sequence
  chemically synthesized
agcaaaaacaaaaacaaaaa

SEQ ID NO: 385182 - DNA, 20 bp, Artificial Sequence
  chemically synthesized
aaacaaaaacaaaaacagca

SEQ ID NO: 385183 - DNA, 20 bp, Artificial Sequence
  chemically synthesized
aaacaaaaacagcatggtac

SEQ ID NO: 385184 - DNA, 20 bp, Artificial Sequence
  chemically synthesized
ttatgtgtctgtttttgtgc

SEQ ID NO: 385185 - DNA, 20 bp, Artificial Sequence
  chemically synthesized
gcatggtactggcacaaaaa

SEQ ID NO: 385186 - DNA, 20 bp, Artificial Sequence
  chemically synthesized
aaaacagacacataaaccaa

SEQ ID NO: 385187 - DNA, 20 bp, Artificial Sequence
  chemically synthesized
ggttctctactttgttccat

SEQ ID NO: 385188 - DNA, 20 bp, Artificial Sequence
  chemically synthesized
acacataaaccaatggaaca

SEQ ID NO: 385189 - DNA, 20 bp, Artificial Sequence
  chemically synthesized
cataaaccaatggaacaaag

SEQ ID NO: 385190 - DNA, 20 bp, Artificial Sequence
  chemically synthesized
taaaccaatggaacaaagta

SEQ ID NO: 385191 - DNA, 20 bp, Artificial Sequence
  chemically synthesized
atggaacaaagtagagaacc

SEQ ID NO: 385192 - DNA, 20 bp, Artificial Sequence
  chemically synthesized
aagtagagaacccagaaata

SEQ ID NO: 385193 - DNA, 20 bp, Artificial Sequence
  chemically synthesized
aggtgtgtggctttatttct

SEQ ID NO: 385194 - DNA, 20 bp, Artificial Sequence
  chemically synthesized
caggtgtgtggctttatttc

SEQ ID NO: 385195 - DNA, 20 bp, Artificial Sequence
  chemically synthesized
atcatatggctgcaggtgtg

SEQ ID NO: 385196 - DNA, 20 bp, Artificial Sequence
  chemically synthesized
gaaataaagccacacacctg

SEQ ID NO: 385197 - DNA, 20 bp, Artificial Sequence
  chemically synthesized
gttgaaaatcatatggctgc

SEQ ID NO: 385198 - DNA, 20 bp, Artificial Sequence
  chemically synthesized
tgttgaaaatcatatggctg

SEQ ID NO: 385199 - DNA, 20 bp, Artificial Sequence
  chemically synthesized
caactttgttgaaaatcata

SEQ ID NO: 385200 - DNA, 20 bp, Artificial Sequence
  chemically synthesized
cagccatatgattttcaaca

SEQ ID NO: 385201 - DNA, 20 bp, Artificial Sequence
  chemically synthesized
tcaacaaagttgacaaaaat

SEQ ID NO: 385202 - DNA, 20 bp, Artificial Sequence
  chemically synthesized
aagttgacaaaaataagcaa

SEQ ID NO: 385203 - DNA, 20 bp, Artificial Sequence
  chemically synthesized
agttgacaaaaataagcaat

SEQ ID NO: 385204 - DNA, 20 bp, Artificial Sequence
  chemically synthesized
gacaaaaataagcaatggga

SEQ ID NO: 385205 - DNA, 20 bp, Artificial Sequence
  chemically synthesized
acaaaaataagcaatgggaa

SEQ ID NO: 385206 - DNA, 20 bp, Artificial Sequence
  chemically synthesized
cagtccatttattgaacagg

SEQ ID NO: 385207 - DNA, 20 bp, Artificial Sequence
  chemically synthesized
gccagtccatttattgaaca

SEQ ID NO: 385208 - DNA, 20 bp, Artificial Sequence
  chemically synthesized
agccagtccatttattgaac

SEQ ID NO: 385209 - DNA, 20 bp, Artificial Sequence
  chemically synthesized
tagccagtccatttattgaa

SEQ ID NO: 385210 - DNA, 20 bp, Artificial Sequence
  chemically synthesized
aggactccctgttcaataaa

SEQ ID NO: 385211 - DNA, 20 bp, Artificial Sequence
  chemically synthesized
tccctgttcaataaatggac

SEQ ID NO: 385212 - DNA, 20 bp, Artificial Sequence
  chemically synthesized
tgttcaataaatggactggc

SEQ ID NO: 385213 - DNA, 20 bp, Artificial Sequence
  chemically synthesized
ttcttccacatatggctagc

SEQ ID NO: 385214 - DNA, 20 bp, Artificial Sequence
  chemically synthesized
ttcattcttccacatatggc

SEQ ID NO: 385215 - DNA, 20 bp, Artificial Sequence
  chemically synthesized
atggactggctagccatatg

SEQ ID NO: 385216 - DNA, 20 bp, Artificial Sequence
  chemically synthesized
gactggctagccatatgtgg

SEQ ID NO: 385217 - DNA, 20 bp, Artificial Sequence
  chemically synthesized
cagtttcattcttccacata

SEQ ID NO: 385218 - DNA, 20 bp, Artificial Sequence
  chemically synthesized
catatgtggaagaatgaaac

SEQ ID NO: 385219 - DNA, 20 bp, Artificial Sequence
  chemically synthesized
catgtcgaaaattagggatc

SEQ ID NO: 385220 - DNA, 20 bp, Artificial Sequence
  chemically synthesized
tttatacatgtcgaaaatta

SEQ ID NO: 385221 - DNA, 20 bp, Artificial Sequence
  chemically synthesized
ttttatacatgtcgaaaatt

SEQ ID NO: 385222 - DNA, 20 bp, Artificial Sequence
  chemically synthesized
tttttatacatgtcgaaaat

SEQ ID NO: 385223 - DNA, 20 bp, Artificial Sequence
  chemically synthesized
acatgtataaaaattaaccc

SEQ ID NO: 385224 - DNA, 20 bp, Artificial Sequence
  chemically synthesized
tttaaatctttaatcatctt

SEQ ID NO: 385225 - DNA, 20 bp, Artificial Sequence
  chemically synthesized
atttaaatctttaatcatct

SEQ ID NO: 385226 - DNA, 20 bp, Artificial Sequence
  chemically synthesized
aaattaacccaagatgatta

SEQ ID NO: 385227 - DNA, 20 bp, Artificial Sequence
  chemically synthesized
atgattaaagatttaaatgt

SEQ ID NO: 385228 - DNA, 20 bp, Artificial Sequence
  chemically synthesized
ttaaatgtaagacctcaaac

SEQ ID NO: 385229 - DNA, 20 bp, Artificial Sequence
  chemically synthesized
tctacaattcttctagtttg

SEQ ID NO: 385230 - DNA, 20 bp, Artificial Sequence
  chemically synthesized
aatgtaagacctcaaactag

SEQ ID NO: 385231 - DNA, 20 bp, Artificial Sequence
  chemically synthesized
ttctacaattcttctagttt

SEQ ID NO: 385232 - DNA, 20 bp, Artificial Sequence
  chemically synthesized
gttttcttctacaattcttc

SEQ ID NO: 385233 - DNA, 20 bp, Artificial Sequence
  chemically synthesized
acctcaaactagaagaattg

SEQ ID NO: 385234 - DNA, 20 bp, Artificial Sequence
  chemically synthesized
tcaaactagaagaattgtag

SEQ ID NO: 385235 - DNA, 20 bp, Artificial Sequence
  chemically synthesized
agaattgtagaagaaaacct

SEQ ID NO: 385236 - DNA, 20 bp, Artificial Sequence
  chemically synthesized
tgtccagaatgatgtttctt

SEQ ID NO: 385237 - DNA, 20 bp, Artificial Sequence
  chemically synthesized
atgtccagaatgatgtttct

SEQ ID NO: 385238 - DNA, 20 bp, Artificial Sequence
  chemically synthesized
aaacctaagaaacatcattc

SEQ ID NO: 385239 - DNA, 20 bp, Artificial Sequence
  chemically synthesized
agaaacatcattctggacat

SEQ ID NO: 385240 - DNA, 20 bp, Artificial Sequence
  chemically synthesized
gaaacatcattctggacatt

SEQ ID NO: 385241 - DNA, 20 bp, Artificial Sequence
  chemically synthesized
aaacatcattctggacattg

SEQ ID NO: 385242 - DNA, 20 bp, Artificial Sequence
  chemically synthesized
gctttcctaaccccaatgtc

SEQ ID NO: 385243 - DNA, 20 bp, Artificial Sequence
  chemically synthesized
atcattctggacattggggt

SEQ ID NO: 385244 - DNA, 20 bp, Artificial Sequence
  chemically synthesized
tcattctggacattggggtt

SEQ ID NO: 385245 - DNA, 20 bp, Artificial Sequence
  chemically synthesized
tctggacattggggttagga

SEQ ID NO: 385246 - DNA, 20 bp, Artificial Sequence
  chemically synthesized
tccaattgcttttgaggatt

SEQ ID NO: 385247 - DNA, 20 bp, Artificial Sequence
  chemically synthesized
atttatgactaaatcctcaa

SEQ ID NO: 385248 - DNA, 20 bp, Artificial Sequence
  chemically synthesized
ttttgctccaattgcttttg

SEQ ID NO: 385249 - DNA, 20 bp, Artificial Sequence
  chemically synthesized
gttttgctccaattgctttt

SEQ ID NO: 385250 - DNA, 20 bp, Artificial Sequence
  chemically synthesized
actaaatcctcaaaagcaat

SEQ ID NO: 385251 - DNA, 20 bp, Artificial Sequence
  chemically synthesized
taaatcctcaaaagcaattg

SEQ ID NO: 385252 - DNA, 20 bp, Artificial Sequence
  chemically synthesized
ggtctcgcttgtcaattttt

SEQ ID NO: 385253 - DNA, 20 bp, Artificial Sequence
  chemically synthesized
agcaaaaccaaaaaattgac

SEQ ID NO: 385254 - DNA, 20 bp, Artificial Sequence
  chemically synthesized
aaaccaaaaaattgacaagc

SEQ ID NO: 385255 - DNA, 20 bp, Artificial Sequence
  chemically synthesized
agaagctttttagtttaatt

SEQ ID NO: 385256 - DNA, 20 bp, Artificial Sequence
  chemically synthesized
cagaagctttttagtttaat

SEQ ID NO: 385257 - DNA, 20 bp, Artificial Sequence
  chemically synthesized
cgagacctaattaaactaaa

SEQ ID NO: 385258 - DNA, 20 bp, Artificial Sequence
  chemically synthesized
tttgctgtgcagaagctttt

SEQ ID NO: 385259 - DNA, 20 bp, Artificial Sequence
  chemically synthesized
taaactaaaaagcttctgca

SEQ ID NO: 385260 - DNA, 20 bp, Artificial Sequence
  chemically synthesized
tagtttcttttgctgtgcag

SEQ ID NO: 385261 - DNA, 20 bp, Artificial Sequence
  chemically synthesized
tgatagtttcttttgctgtg

SEQ ID NO: 385262 - DNA, 20 bp, Artificial Sequence
  chemically synthesized
aaaaagcttctgcacagcaa

SEQ ID NO: 385263 - DNA, 20 bp, Artificial Sequence
  chemically synthesized
acagcaaaagaaactatcaa

SEQ ID NO: 385264 - DNA, 20 bp, Artificial Sequence
  chemically synthesized
agcaaaagaaactatcaaca

SEQ ID NO: 385265 - DNA, 20 bp, Artificial Sequence
  chemically synthesized
gttgtctgttactctgttga

SEQ ID NO: 385266 - DNA, 20 bp, Artificial Sequence
  chemically synthesized
agaaactatcaacagagtaa

SEQ ID NO: 385267 - DNA, 20 bp, Artificial Sequence
  chemically synthesized
acagagtaacagacaaccta

SEQ ID NO: 385268 - DNA, 20 bp, Artificial Sequence
  chemically synthesized
gtaacagacaacctacggaa

SEQ ID NO: 385269 - DNA, 20 bp, Artificial Sequence
  chemically synthesized
taacagacaacctacggaac

SEQ ID NO: 385270 - DNA, 20 bp, Artificial Sequence
  chemically synthesized
atgattttctcctgttccgt

SEQ ID NO: 385271 - DNA, 20 bp, Artificial Sequence
  chemically synthesized
aatgattttctcctgttccg

SEQ ID NO: 385272 - DNA, 20 bp, Artificial Sequence
  chemically synthesized
acagacaacctacggaacag

SEQ ID NO: 385273 - DNA, 20 bp, Artificial Sequence
  chemically synthesized
ttgaacctttgtgtgatatg

SEQ ID NO: 385274 - DNA, 20 bp, Artificial Sequence
  chemically synthesized
tacaaactacatatcacaca

SEQ ID NO: 385275 - DNA, 20 bp, Artificial Sequence
  chemically synthesized
acaaactacatatcacacaa

SEQ ID NO: 385276 - DNA, 20 bp, Artificial Sequence
  chemically synthesized
tcacacaaaggttcaatatc

SEQ ID NO: 385277 - DNA, 20 bp, Artificial Sequence
  chemically synthesized
tttaagttccttgtaaattc

SEQ ID NO: 385278 - DNA, 20 bp, Artificial Sequence
  chemically synthesized
gttcaatatctagaatttac

SEQ ID NO: 385279 - DNA, 20 bp, Artificial Sequence
  chemically synthesized
ttcaatatctagaatttaca

SEQ ID NO: 385280 - DNA, 20 bp, Artificial Sequence
  chemically synthesized
ttttgcttgttcagtttttt

SEQ ID NO: 385281 - DNA, 20 bp, Artificial Sequence
  chemically synthesized
aggaacttaaaaaactgaac

SEQ ID NO: 385282 - DNA, 20 bp, Artificial Sequence
  chemically synthesized
ggcgttgtattttgcttgtt

SEQ ID NO: 385283 - DNA, 20 bp, Artificial Sequence
  chemically synthesized
gccctttgcctgttttttga

SEQ ID NO: 385284 - DNA, 20 bp, Artificial Sequence
  chemically synthesized
aatacaacgccatcaaaaaa

SEQ ID NO: 385285 - DNA, 20 bp, Artificial Sequence
  chemically synthesized
atacaacgccatcaaaaaac

SEQ ID NO: 385286 - DNA, 20 bp, Artificial Sequence
  chemically synthesized
acgccatcaaaaaacaggca

SEQ ID NO: 385287 - DNA, 20 bp, Artificial Sequence
  chemically synthesized
cgccatcaaaaaacaggcaa

SEQ ID NO: 385288 - DNA, 20 bp, Artificial Sequence
  chemically synthesized
gccatcaaaaaacaggcaaa

SEQ ID NO: 385289 - DNA, 20 bp, Artificial Sequence
  chemically synthesized
aaacaggcaaagggcatgaa

SEQ ID NO: 385290 - DNA, 20 bp, Artificial Sequence
  chemically synthesized
catgaacagacacctctcaa

SEQ ID NO: 385291 - DNA, 20 bp, Artificial Sequence
  chemically synthesized
cttgtatgtcttcttttgag

SEQ ID NO: 385292 - DNA, 20 bp, Artificial Sequence
  chemically synthesized
gaacagacacctctcaaaag

SEQ ID NO: 385293 - DNA, 20 bp, Artificial Sequence
  chemically synthesized
acttgtatgtcttcttttga

SEQ ID NO: 385294 - DNA, 20 bp, Artificial Sequence
  chemically synthesized
ctacttgtatgtcttctttt

SEQ ID NO: 385295 - DNA, 20 bp, Artificial Sequence
  chemically synthesized
cctctcaaaagaagacatac

SEQ ID NO: 385296 - DNA, 20 bp, Artificial Sequence
  chemically synthesized
ctcaaaagaagacatacaag

SEQ ID NO: 385297 - DNA, 20 bp, Artificial Sequence
  chemically synthesized
aagacatacaagtagcctac

SEQ ID NO: 385298 - DNA, 20 bp, Artificial Sequence
  chemically synthesized
gcattttttcatatgcttgt

SEQ ID NO: 385299 - DNA, 20 bp, Artificial Sequence
  chemically synthesized
agcattttttcatatgcttg

SEQ ID NO: 385300 - DNA, 20 bp, Artificial Sequence
  chemically synthesized
ctctgacaattaatgttatt

SEQ ID NO: 385301 - DNA, 20 bp, Artificial Sequence
  chemically synthesized
tgctgaataacattaattgt

SEQ ID NO: 385302 - DNA, 20 bp, Artificial Sequence
  chemically synthesized
ctgaataacattaattgtca

SEQ ID NO: 385303 - DNA, 20 bp, Artificial Sequence
  chemically synthesized
atgcaaatcaaaaccacaat

SEQ ID NO: 385304 - DNA, 20 bp, Artificial Sequence
  chemically synthesized
tgtgcgatggtatctcattg

SEQ ID NO: 385305 - DNA, 20 bp, Artificial Sequence
  chemically synthesized
cctttctgactggtgtgcga

SEQ ID NO: 385306 - DNA, 20 bp, Artificial Sequence
  chemically synthesized
aatgagataccatcgcacac

SEQ ID NO: 385307 - DNA, 20 bp, Artificial Sequence
  chemically synthesized
agataccatcgcacaccagt

SEQ ID NO: 385308 - DNA, 20 bp, Artificial Sequence
  chemically synthesized
accatcgcacaccagtcaga

SEQ ID NO: 385309 - DNA, 20 bp, Artificial Sequence
  chemically synthesized
ccatcgcacaccagtcagaa

SEQ ID NO: 385310 - DNA, 20 bp, Artificial Sequence
  chemically synthesized
ttaataatggcctttctgac

SEQ ID NO: 385311 - DNA, 20 bp, Artificial Sequence
  chemically synthesized
gttttttgagtttttaataa

SEQ ID NO: 385312 - DNA, 20 bp, Artificial Sequence
  chemically synthesized
accagcatttgttgtttttt

SEQ ID NO: 385313 - DNA, 20 bp, Artificial Sequence
  chemically synthesized
actcaaaaaacaacaaatgc

SEQ ID NO: 385314 - DNA, 20 bp, Artificial Sequence
  chemically synthesized
aaaaacaacaaatgctggtg

SEQ ID NO: 385315 - DNA, 20 bp, Artificial Sequence
  chemically synthesized
ccttttctctgcggcttcac

SEQ ID NO: 385316 - DNA, 20 bp, Artificial Sequence
  chemically synthesized
aacaaatgctggtgaagccg

SEQ ID NO: 385317 - DNA, 20 bp, Artificial Sequence
  chemically synthesized
caaatgctggtgaagccgca

SEQ ID NO: 385318 - DNA, 20 bp, Artificial Sequence
  chemically synthesized
gctggtgaagccgcagagaa

SEQ ID NO: 385319 - DNA, 20 bp, Artificial Sequence
  chemically synthesized
taagcattcccttttctctg

SEQ ID NO: 385320 - DNA, 20 bp, Artificial Sequence
  chemically synthesized
ctggtgaagccgcagagaaa

SEQ ID NO: 385321 - DNA, 20 bp, Artificial Sequence
  chemically synthesized
tggtgaagccgcagagaaaa

SEQ ID NO: 385322 - DNA, 20 bp, Artificial Sequence
  chemically synthesized
cattcccaccaacagtgtat

SEQ ID NO: 385323 - DNA, 20 bp, Artificial Sequence
  chemically synthesized
agggaatgcttatacactgt

SEQ ID NO: 385324 - DNA, 20 bp, Artificial Sequence
  chemically synthesized
gaatgcttatacactgttgg

SEQ ID NO: 385325 - DNA, 20 bp, Artificial Sequence
  chemically synthesized
aatgcttatacactgttggt

SEQ ID NO: 385326 - DNA, 20 bp, Artificial Sequence
  chemically synthesized
ctaatttacattcccaccaa

SEQ ID NO: 385327 - DNA, 20 bp, Artificial Sequence
  chemically synthesized
ctgttggtgggaatgtaaat

SEQ ID NO: 385328 - DNA, 20 bp, Artificial Sequence
  chemically synthesized
ggtgggaatgtaaattagtt

SEQ ID NO: 385329 - DNA, 20 bp, Artificial Sequence
  chemically synthesized
gtaaattagttcagccactg

SEQ ID NO: 385330 - DNA, 20 bp, Artificial Sequence
  chemically synthesized
aattagttcagccactgtgg

SEQ ID NO: 385331 - DNA, 20 bp, Artificial Sequence
  chemically synthesized
attagttcagccactgtgga

SEQ ID NO: 385332 - DNA, 20 bp, Artificial Sequence
  chemically synthesized
ctccaaactgccttccacag

SEQ ID NO: 385333 - DNA, 20 bp, Artificial Sequence
  chemically synthesized
agttcagccactgtggaagg

SEQ ID NO: 385334 - DNA, 20 bp, Artificial Sequence
  chemically synthesized
aatctccaaactgccttcca

SEQ ID NO: 385335 - DNA, 20 bp, Artificial Sequence
  chemically synthesized
agccactgtggaaggcagtt

SEQ ID NO: 385336 - DNA, 20 bp, Artificial Sequence
  chemically synthesized
ccactgtggaaggcagtttg

SEQ ID NO: 385337 - DNA, 20 bp, Artificial Sequence
  chemically synthesized
ggcagtttggagatttccca

SEQ ID NO: 385338 - DNA, 20 bp, Artificial Sequence
  chemically synthesized
agttctgtcttaaattcttt

SEQ ID NO: 385339 - DNA, 20 bp, Artificial Sequence
  chemically synthesized
tagttctgtcttaaattctt

SEQ ID NO: 385340 - DNA, 20 bp, Artificial Sequence
  chemically synthesized
ggagatttcccaaagaattt

SEQ ID NO: 385341 - DNA, 20 bp, Artificial Sequence
  chemically synthesized
atttcccaaagaatttaaga

SEQ ID NO: 385342 - DNA, 20 bp, Artificial Sequence
  chemically synthesized
gggattgctggattgaatgg

SEQ ID NO: 385343 - DNA, 20 bp, Artificial Sequence
  chemically synthesized
gacagaactaccattcaatc

SEQ ID NO: 385344 - DNA, 20 bp, Artificial Sequence
  chemically synthesized
aatgggattgctggattgaa

SEQ ID NO: 385345 - DNA, 20 bp, Artificial Sequence
  chemically synthesized
atattcagtaatgggattgc

SEQ ID NO: 385346 - DNA, 20 bp, Artificial Sequence
  chemically synthesized
ttggatatatattcagtaat

SEQ ID NO: 385347 - DNA, 20 bp, Artificial Sequence
  chemically synthesized
tttggatatatattcagtaa

SEQ ID NO: 385348 - DNA, 20 bp, Artificial Sequence
  chemically synthesized
atttattttggatatatatt

SEQ ID NO: 385349 - DNA, 20 bp, Artificial Sequence
  chemically synthesized
taaaacaattttatttattt

SEQ ID NO: 385350 - DNA, 20 bp, Artificial Sequence
  chemically synthesized
aataaaattgttttaacata

SEQ ID NO: 385351 - DNA, 20 bp, Artificial Sequence
  chemically synthesized
atgcattcacgtgttcatca

SEQ ID NO: 385352 - DNA, 20 bp, Artificial Sequence
  chemically synthesized
catcacagcactattcacaa

SEQ ID NO: 385353 - DNA, 20 bp, Artificial Sequence
  chemically synthesized
catgtctttgctattgtgaa

SEQ ID NO: 385354 - DNA, 20 bp, Artificial Sequence
  chemically synthesized
cagcactattcacaatagca

SEQ ID NO: 385355 - DNA, 20 bp, Artificial Sequence
  chemically synthesized
tattcacaatagcaaagaca

SEQ ID NO: 385356 - DNA, 20 bp, Artificial Sequence
  chemically synthesized
gcaaagacatggaattaacc

SEQ ID NO: 385357 - DNA, 20 bp, Artificial Sequence
  chemically synthesized
tccaccaatgatgtgtatct

SEQ ID NO: 385358 - DNA, 20 bp, Artificial Sequence
  chemically synthesized
gtccaccaatgatgtgtatc

SEQ ID NO: 385359 - DNA, 20 bp, Artificial Sequence
  chemically synthesized
ttaacctagatacacatcat

SEQ ID NO: 385360 - DNA, 20 bp, Artificial Sequence
  chemically synthesized
acctagatacacatcattgg

SEQ ID NO: 385361 - DNA, 20 bp, Artificial Sequence
  chemically synthesized
gatacacatcattggtggac

SEQ ID NO: 385362 - DNA, 20 bp, Artificial Sequence
  chemically synthesized
catcattggtggactggata

SEQ ID NO: 385363 - DNA, 20 bp, Artificial Sequence
  chemically synthesized
atatttagattttctttatc

SEQ ID NO: 385364 - DNA, 20 bp, Artificial Sequence
  chemically synthesized
agtattccatggggtatatt

SEQ ID NO: 385365 - DNA, 20 bp, Artificial Sequence
  chemically synthesized
gaaaatctaaatatacccca

SEQ ID NO: 385366 - DNA, 20 bp, Artificial Sequence
  chemically synthesized
tggctgcatagtattccatg

SEQ ID NO: 385367 - DNA, 20 bp, Artificial Sequence
  chemically synthesized
atggctgcatagtattccat

SEQ ID NO: 385368 - DNA, 20 bp, Artificial Sequence
  chemically synthesized
tatggctgcatagtattcca

SEQ ID NO: 385369 - DNA, 20 bp, Artificial Sequence
  chemically synthesized
ataccccatggaatactatg

SEQ ID NO: 385370 - DNA, 20 bp, Artificial Sequence
  chemically synthesized
cattctgttttatggctgca

SEQ ID NO: 385371 - DNA, 20 bp, Artificial Sequence
  chemically synthesized
aatactatgcagccataaaa

SEQ ID NO: 385372 - DNA, 20 bp, Artificial Sequence
  chemically synthesized
catgatttcattctgtttta

SEQ ID NO: 385373 - DNA, 20 bp, Artificial Sequence
  chemically synthesized
gaatgaaatcatgtccttcg

SEQ ID NO: 385374 - DNA, 20 bp, Artificial Sequence
  chemically synthesized
ctgcatctgtgttgctacga

SEQ ID NO: 385375 - DNA, 20 bp, Artificial Sequence
  chemically synthesized
gctgcatctgtgttgctacg

SEQ ID NO: 385376 - DNA, 20 bp, Artificial Sequence
  chemically synthesized
tcatgtccttcgtagcaaca

SEQ ID NO: 385377 - DNA, 20 bp, Artificial Sequence
  chemically synthesized
ccttcgtagcaacacagatg

SEQ ID NO: 385378 - DNA, 20 bp, Artificial Sequence
  chemically synthesized
caacacagatgcagctgtga

SEQ ID NO: 385379 - DNA, 20 bp, Artificial Sequence
  chemically synthesized
acacagatgcagctgtgatg

SEQ ID NO: 385380 - DNA, 20 bp, Artificial Sequence
  chemically synthesized
cacagatgcagctgtgatgg

SEQ ID NO: 385381 - DNA, 20 bp, Artificial Sequence
  chemically synthesized
taggataatggcctccatca

SEQ ID NO: 385382 - DNA, 20 bp, Artificial Sequence
  chemically synthesized
tgtgatggaggccattatcc

SEQ ID NO: 385383 - DNA, 20 bp, Artificial Sequence
  chemically synthesized
gtgatggaggccattatcct

SEQ ID NO: 385384 - DNA, 20 bp, Artificial Sequence
  chemically synthesized
catgaattcgcctaggataa

SEQ ID NO: 385385 - DNA, 20 bp, Artificial Sequence
  chemically synthesized
gttgctgcatgaattcgcct

SEQ ID NO: 385386 - DNA, 20 bp, Artificial Sequence
  chemically synthesized
cgttgctgcatgaattcgcc

SEQ ID NO: 385387 - DNA, 20 bp, Artificial Sequence
  chemically synthesized
ttatcctaggcgaattcatg

SEQ ID NO: 385388 - DNA, 20 bp, Artificial Sequence
  chemically synthesized
taggcgaattcatgcagcaa

SEQ ID NO: 385389 - DNA, 20 bp, Artificial Sequence
  chemically synthesized
aagtgagaacatgtggtatt

SEQ ID NO: 385390 - DNA, 20 bp, Artificial Sequence
  chemically synthesized
cacttacaagtgagaacatg

SEQ ID NO: 385391 - DNA, 20 bp, Artificial Sequence
  chemically synthesized
taccacatgttctcacttgt

SEQ ID NO: 385392 - DNA, 20 bp, Artificial Sequence
  chemically synthesized
tatagctcccacttacaagt

SEQ ID NO: 385393 - DNA, 20 bp, Artificial Sequence
  chemically synthesized
cacatgttctcacttgtaag

SEQ ID NO: 385394 - DNA, 20 bp, Artificial Sequence
  chemically synthesized
acatgttctcacttgtaagt

SEQ ID NO: 385395 - DNA, 20 bp, Artificial Sequence
  chemically synthesized
aatatatagctcccacttac

SEQ ID NO: 385396 - DNA, 20 bp, Artificial Sequence
  chemically synthesized
atgttctcacttgtaagtgg

SEQ ID NO: 385397 - DNA, 20 bp, Artificial Sequence
  chemically synthesized
tgtaagtgggagctatatat

SEQ ID NO: 385398 - DNA, 20 bp, Artificial Sequence
  chemically synthesized
gtaagtgggagctatatatt

SEQ ID NO: 385399 - DNA, 20 bp, Artificial Sequence
  chemically synthesized
gtccatgagtacccaatata

SEQ ID NO: 385400 - DNA, 20 bp, Artificial Sequence
  chemically synthesized
agctatatattgggtactca

SEQ ID NO: 385401 - DNA, 20 bp, Artificial Sequence
  chemically synthesized
gttttcacctttatgtccat

SEQ ID NO: 385402 - DNA, 20 bp, Artificial Sequence
  chemically synthesized
attgggtactcatggacata

SEQ ID NO: 385403 - DNA, 20 bp, Artificial Sequence
  chemically synthesized
ttgggtactcatggacataa

SEQ ID NO: 385404 - DNA, 20 bp, Artificial Sequence
  chemically synthesized
ggacataaaggtgaaaacga

SEQ ID NO: 385405 - DNA, 20 bp, Artificial Sequence
  chemically synthesized
aaggtgaaaacgatagacac

SEQ ID NO: 385406 - DNA, 20 bp, Artificial Sequence
  chemically synthesized
aggtgaaaacgatagacact

SEQ ID NO: 385407 - DNA, 20 bp, Artificial Sequence
  chemically synthesized
ggtgaaaacgatagacacta

SEQ ID NO: 385408 - DNA, 20 bp, Artificial Sequence
  chemically synthesized
cttccccttctagtaatccc

SEQ ID NO: 385409 - DNA, 20 bp, Artificial Sequence
  chemically synthesized
cgatagacactagggattac

SEQ ID NO: 385410 - DNA, 20 bp, Artificial Sequence
  chemically synthesized
tagacactagggattactag

SEQ ID NO: 385411 - DNA, 20 bp, Artificial Sequence
  chemically synthesized
agacactagggattactaga

SEQ ID NO: 385412 - DNA, 20 bp, Artificial Sequence
  chemically synthesized
gacactagggattactagaa

SEQ ID NO: 385413 - DNA, 20 bp, Artificial Sequence
  chemically synthesized
acactagggattactagaag

SEQ ID NO: 385414 - DNA, 20 bp, Artificial Sequence
  chemically synthesized
ctagggattactagaagggg

SEQ ID NO: 385415 - DNA, 20 bp, Artificial Sequence
  chemically synthesized
cccctccctccttccccttc

SEQ ID NO: 385416 - DNA, 20 bp, Artificial Sequence
  chemically synthesized
tagggattactagaagggga

SEQ ID NO: 385417 - DNA, 20 bp, Artificial Sequence
  chemically synthesized
gggattactagaaggggaag

SEQ ID NO: 385418 - DNA, 20 bp, Artificial Sequence
  chemically synthesized
ggattactagaaggggaagg

SEQ ID NO: 385419 - DNA, 20 bp, Artificial Sequence
  chemically synthesized
gattactagaaggggaagga

SEQ ID NO: 385420 - DNA, 20 bp, Artificial Sequence
  chemically synthesized
ttactagaaggggaaggagg

SEQ ID NO: 385421 - DNA, 20 bp, Artificial Sequence
  chemically synthesized
tactagaaggggaaggaggg

SEQ ID NO: 385422 - DNA, 20 bp, Artificial Sequence
  chemically synthesized
actagaaggggaaggaggga

SEQ ID NO: 385423 - DNA, 20 bp, Artificial Sequence
  chemically synthesized
ctagaaggggaaggagggag

SEQ ID NO: 385424 - DNA, 20 bp, Artificial Sequence
  chemically synthesized
tagaaggggaaggagggagg

SEQ ID NO: 385425 - DNA, 20 bp, Artificial Sequence
  chemically synthesized
ggggaaggagggagggggat

SEQ ID NO: 385426 - DNA, 20 bp, Artificial Sequence
  chemically synthesized
gggaaggagggagggggata

SEQ ID NO: 385427 - DNA, 20 bp, Artificial Sequence
  chemically synthesized
ggaaggagggagggggataa

SEQ ID NO: 385428 - DNA, 20 bp, Artificial Sequence
  chemically synthesized
agggttgaaaaactgactat

SEQ ID NO: 385429 - DNA, 20 bp, Artificial Sequence
  chemically synthesized
gggttgaaaaactgactatt

SEQ ID NO: 385430 - DNA, 20 bp, Artificial Sequence
  chemically synthesized
tgagtatagtacccaatagt

SEQ ID NO: 385431 - DNA, 20 bp, Artificial Sequence
  chemically synthesized
gtactgagtatagtacccaa

SEQ ID NO: 385432 - DNA, 20 bp, Artificial Sequence
  chemically synthesized
tgactattgggtactatact

SEQ ID NO: 385433 - DNA, 20 bp, Artificial Sequence
  chemically synthesized
tgtcacccaggtactgagta

SEQ ID NO: 385434 - DNA, 20 bp, Artificial Sequence
  chemically synthesized
tgggtactatactcagtacc

SEQ ID NO: 385435 - DNA, 20 bp, Artificial Sequence
  chemically synthesized
gggtactatactcagtacct

SEQ ID NO: 385436 - DNA, 20 bp, Artificial Sequence
  chemically synthesized
gatcctgtcacccaggtact

SEQ ID NO: 385437 - DNA, 20 bp, Artificial Sequence
  chemically synthesized
tatactcagtacctgggtga

SEQ ID NO: 385438 - DNA, 20 bp, Artificial Sequence
  chemically synthesized
atactcagtacctgggtgac

SEQ ID NO: 385439 - DNA, 20 bp, Artificial Sequence
  chemically synthesized
tacgaatgatcctgtcaccc

SEQ ID NO: 385440 - DNA, 20 bp, Artificial Sequence
  chemically synthesized
gtacgaatgatcctgtcacc

SEQ ID NO: 385441 - DNA, 20 bp, Artificial Sequence
  chemically synthesized
aagtgaattccaggggtttg

SEQ ID NO: 385442 - DNA, 20 bp, Artificial Sequence
  chemically synthesized
tcattcgtaccccaaacccc

SEQ ID NO: 385443 - DNA, 20 bp, Artificial Sequence
  chemically synthesized
caagtgaattccaggggttt

SEQ ID NO: 385444 - DNA, 20 bp, Artificial Sequence
  chemically synthesized
gcaagtgaattccaggggtt

SEQ ID NO: 385445 - DNA, 20 bp, Artificial Sequence
  chemically synthesized
agcatgcaagtgaattccag

SEQ ID NO: 385446 - DNA, 20 bp, Artificial Sequence
  chemically synthesized
gagcatgcaagtgaattcca

SEQ ID NO: 385447 - DNA, 20 bp, Artificial Sequence
  chemically synthesized
ggagcatgcaagtgaattcc

SEQ ID NO: 385448 - DNA, 20 bp, Artificial Sequence
  chemically synthesized
gggagcatgcaagtgaattc

SEQ ID NO: 385449 - DNA, 20 bp, Artificial Sequence
  chemically synthesized
ccttatgggagggagcatgc

SEQ ID NO: 385450 - DNA, 20 bp, Artificial Sequence
  chemically synthesized
tttcaactccttatgggagg

SEQ ID NO: 385451 - DNA, 20 bp, Artificial Sequence
  chemically synthesized
acttgcatgctccctcccat

SEQ ID NO: 385452 - DNA, 20 bp, Artificial Sequence
  chemically synthesized
cttgcatgctccctcccata

SEQ ID NO: 385453 - DNA, 20 bp, Artificial Sequence
  chemically synthesized
gttttcaactccttatggga

SEQ ID NO: 385454 - DNA, 20 bp, Artificial Sequence
  chemically synthesized
agttttcaactccttatggg

SEQ ID NO: 385455 - DNA, 20 bp, Artificial Sequence
  chemically synthesized
tgcatgctccctcccataag

SEQ ID NO: 385456 - DNA, 20 bp, Artificial Sequence
  chemically synthesized
cagttttcaactccttatgg

SEQ ID NO: 385457 - DNA, 20 bp, Artificial Sequence
  chemically synthesized
accagttttcaactccttat

SEQ ID NO: 385458 - DNA, 20 bp, Artificial Sequence
  chemically synthesized
gaccagttttcaactcctta

SEQ ID NO: 385459 - DNA, 20 bp, Artificial Sequence
  chemically synthesized
tcccataaggagttgaaaac

SEQ ID NO: 385460 - DNA, 20 bp, Artificial Sequence
  chemically synthesized
taaggagttgaaaactggtc

SEQ ID NO: 385461 - DNA, 20 bp, Artificial Sequence
  chemically synthesized
aaggagttgaaaactggtct

SEQ ID NO: 385462 - DNA, 20 bp, Artificial Sequence
  chemically synthesized
gttgcctcatttacctagac

SEQ ID NO: 385463 - DNA, 20 bp, Artificial Sequence
  chemically synthesized
gaaaactggtctaggtaaat

SEQ ID NO: 385464 - DNA, 20 bp, Artificial Sequence
  chemically synthesized
acagggttgcctcatttacc

SEQ ID NO: 385465 - DNA, 20 bp, Artificial Sequence
  chemically synthesized
aaaactggtctaggtaaatg

SEQ ID NO: 385466 - DNA, 20 bp, Artificial Sequence
  chemically synthesized
aaatgaggcaaccctgtcac

SEQ ID NO: 385467 - DNA, 20 bp, Artificial Sequence
  chemically synthesized
ccttcccgggactcgtgaca

SEQ ID NO: 385468 - DNA, 20 bp, Artificial Sequence
  chemically synthesized
cccttcccgggactcgtgac

SEQ ID NO: 385469 - DNA, 20 bp, Artificial Sequence
  chemically synthesized
ccccttcccgggactcgtga

SEQ ID NO: 385470 - DNA, 20 bp, Artificial Sequence
  chemically synthesized
ggcaaccctgtcacgagtcc

SEQ ID NO: 385471 - DNA, 20 bp, Artificial Sequence
  chemically synthesized
gcaaccctgtcacgagtccc

SEQ ID NO: 385472 - DNA, 20 bp, Artificial Sequence
  chemically synthesized
accctgtcacgagtcccggg

SEQ ID NO: 385473 - DNA, 20 bp, Artificial Sequence
  chemically synthesized
ccctgtcacgagtcccggga

SEQ ID NO: 385474 - DNA, 20 bp, Artificial Sequence
  chemically synthesized
cctgtcacgagtcccgggaa

SEQ ID NO: 385475 - DNA, 20 bp, Artificial Sequence
  chemically synthesized
ctgtcacgagtcccgggaag

SEQ ID NO: 385476 - DNA, 20 bp, Artificial Sequence
  chemically synthesized
tatttccctgaccccttccc

SEQ ID NO: 385477 - DNA, 20 bp, Artificial Sequence
  chemically synthesized
ctatttccctgaccccttcc

SEQ ID NO: 385478 - DNA, 20 bp, Artificial Sequence
  chemically synthesized
cacgagtcccgggaaggggt

SEQ ID NO: 385479 - DNA, 20 bp, Artificial Sequence
  chemically synthesized
acgagtcccgggaaggggtc

SEQ ID NO: 385480 - DNA, 20 bp, Artificial Sequence
  chemically synthesized
cgagtcccgggaaggggtca

SEQ ID NO: 385481 - DNA, 20 bp, Artificial Sequence
  chemically synthesized
ccgggaaggggtcagggaaa

SEQ ID NO: 385482 - DNA, 20 bp, Artificial Sequence
  chemically synthesized
cgggaaggggtcagggaaat

SEQ ID NO: 385483 - DNA, 20 bp, Artificial Sequence
  chemically synthesized
agagttgtatgatatcgaag

SEQ ID NO: 385484 - DNA, 20 bp, Artificial Sequence
  chemically synthesized
aagagagttgtatgatatcg

SEQ ID NO: 385485 - DNA, 20 bp, Artificial Sequence
  chemically synthesized
ggaaggaccttttaaaaaga

SEQ ID NO: 385486 - DNA, 20 bp, Artificial Sequence
  chemically synthesized
tcatacaactctctttttaa

SEQ ID NO: 385487 - DNA, 20 bp, Artificial Sequence
  chemically synthesized
ttggaaggaccttttaaaaa

SEQ ID NO: 385488 - DNA, 20 bp, Artificial Sequence
  chemically synthesized
catacaactctctttttaaa

SEQ ID NO: 385489 - DNA, 20 bp, Artificial Sequence
  chemically synthesized
tattggaaggaccttttaaa

SEQ ID NO: 385490 - DNA, 20 bp, Artificial Sequence
  chemically synthesized
aagttggaagaaatattgga

SEQ ID NO: 385491 - DNA, 20 bp, Artificial Sequence
  chemically synthesized
caagttggaagaaatattgg

SEQ ID NO: 385492 - DNA, 20 bp, Artificial Sequence
  chemically synthesized
cttcaagttggaagaaatat

SEQ ID NO: 385493 - DNA, 20 bp, Artificial Sequence
  chemically synthesized
aaagctggacttcaagttgg

SEQ ID NO: 385494 - DNA, 20 bp, Artificial Sequence
  chemically synthesized
ccaatatttcttccaacttg

SEQ ID NO: 385495 - DNA, 20 bp, Artificial Sequence
  chemically synthesized
tgtaaagctggacttcaagt

SEQ ID NO: 385496 - DNA, 20 bp, Artificial Sequence
  chemically synthesized
atttcttccaacttgaagtc

SEQ ID NO: 385497 - DNA, 20 bp, Artificial Sequence
  chemically synthesized
ttgttgtaaagctggacttc

SEQ ID NO: 385498 - DNA, 20 bp, Artificial Sequence
  chemically synthesized
ccagaaacttgttgtaaagc

SEQ ID NO: 385499 - DNA, 20 bp, Artificial Sequence
  chemically synthesized
ttgaagtccagctttacaac

SEQ ID NO: 385500 - DNA, 20 bp, Artificial Sequence
  chemically synthesized
gagtccagaaacttgttgta

SEQ ID NO: 385501 - DNA, 20 bp, Artificial Sequence
  chemically synthesized
ccagctttacaacaagtttc

SEQ ID NO: 385502 - DNA, 20 bp, Artificial Sequence
  chemically synthesized
gagtaggaaagaagagagtc

SEQ ID NO: 385503 - DNA, 20 bp, Artificial Sequence
  chemically synthesized
ctgcagagtaggaaagaaga

SEQ ID NO: 385504 - DNA, 20 bp, Artificial Sequence
  chemically synthesized
acctgcagagtaggaaagaa

SEQ ID NO: 385505 - DNA, 20 bp, Artificial Sequence
  chemically synthesized
taacctgcagagtaggaaag

SEQ ID NO: 385506 - DNA, 20 bp, Artificial Sequence
  chemically synthesized
tgataacctgcagagtagga

SEQ ID NO: 385507 - DNA, 20 bp, Artificial Sequence
  chemically synthesized
ctctcttctttcctactctg

SEQ ID NO: 385508 - DNA, 20 bp, Artificial Sequence
  chemically synthesized
tctcttctttcctactctgc

SEQ ID NO: 385509 - DNA, 20 bp, Artificial Sequence
  chemically synthesized
tttctgataacctgcagagt

SEQ ID NO: 385510 - DNA, 20 bp, Artificial Sequence
  chemically synthesized
ttttctgataacctgcagag

SEQ ID NO: 385511 - DNA, 20 bp, Artificial Sequence
  chemically synthesized
ttattttctgataacctgca

SEQ ID NO: 385512 - DNA, 20 bp, Artificial Sequence
  chemically synthesized
ttttattttctgataacctg

SEQ ID NO: 385513 - DNA, 20 bp, Artificial Sequence
  chemically synthesized
tttcctactctgcaggttat

SEQ ID NO: 385514 - DNA, 20 bp, Artificial Sequence
  chemically synthesized
ttttgttattttgtagtttg

SEQ ID NO: 385515 - DNA, 20 bp, Artificial Sequence
  chemically synthesized
tgggtgtttttgttattttg

SEQ ID NO: 385516 - DNA, 20 bp, Artificial Sequence
  chemically synthesized
acaaaataacaaaaacaccc

SEQ ID NO: 385517 - DNA, 20 bp, Artificial Sequence
  chemically synthesized
cttaactaatcacattgctt

SEQ ID NO: 385518 - DNA, 20 bp, Artificial Sequence
  chemically synthesized
tcttaactaatcacattgct

SEQ ID NO: 385519 - DNA, 20 bp, Artificial Sequence
  chemically synthesized
aaacacccaagcaatgtgat

SEQ ID NO: 385520 - DNA, 20 bp, Artificial Sequence
  chemically synthesized
cccaagcaatgtgattagtt

SEQ ID NO: 385521 - DNA, 20 bp, Artificial Sequence
  chemically synthesized
gattagttaagacattatta

SEQ ID NO: 385522 - DNA, 20 bp, Artificial Sequence
  chemically synthesized
gttaagacattattaaagtg

SEQ ID NO: 385523 - DNA, 20 bp, Artificial Sequence
  chemically synthesized
ttaagacattattaaagtgt

SEQ ID NO: 385524 - DNA, 20 bp, Artificial Sequence
  chemically synthesized
tattaaagtgtgggtgtttc

SEQ ID NO: 385525 - DNA, 20 bp, Artificial Sequence
  chemically synthesized
ttaaagtgtgggtgtttcca

SEQ ID NO: 385526 - DNA, 20 bp, Artificial Sequence
  chemically synthesized
ttgtaaaggggaaacgtctc

SEQ ID NO: 385527 - DNA, 20 bp, Artificial Sequence
  chemically synthesized
gaataggatggtttgtaaag

SEQ ID NO: 385528 - DNA, 20 bp, Artificial Sequence
  chemically synthesized
agaataggatggtttgtaaa

SEQ ID NO: 385529 - DNA, 20 bp, Artificial Sequence
  chemically synthesized
gagaataggatggtttgtaa

SEQ ID NO: 385530 - DNA, 20 bp, Artificial Sequence
  chemically synthesized
agagaataggatggtttgta

SEQ ID NO: 385531 - DNA, 20 bp, Artificial Sequence
  chemically synthesized
caaaaggtaagagaatagga

SEQ ID NO: 385532 - DNA, 20 bp, Artificial Sequence
  chemically synthesized
ttctcaaaaggtaagagaat

SEQ ID NO: 385533 - DNA, 20 bp, Artificial Sequence
  chemically synthesized
cttctcaaaaggtaagagaa

SEQ ID NO: 385534 - DNA, 20 bp, Artificial Sequence
  chemically synthesized
actcccttctcaaaaggtaa

SEQ ID NO: 385535 - DNA, 20 bp, Artificial Sequence
  chemically synthesized
atcctattctcttacctttt

SEQ ID NO: 385536 - DNA, 20 bp, Artificial Sequence
  chemically synthesized
acactcccttctcaaaaggt

SEQ ID NO: 385537 - DNA, 20 bp, Artificial Sequence
  chemically synthesized
ctattctcttaccttttgag

SEQ ID NO: 385538 - DNA, 20 bp, Artificial Sequence
  chemically synthesized
tattctcttaccttttgaga

SEQ ID NO: 385539 - DNA, 20 bp, Artificial Sequence
  chemically synthesized
gcacacactcccttctcaaa

SEQ ID NO: 385540 - DNA, 20 bp, Artificial Sequence
  chemically synthesized
attctcttaccttttgagaa

SEQ ID NO: 385541 - DNA, 20 bp, Artificial Sequence
  chemically synthesized
cgcacacactcccttctcaa

SEQ ID NO: 385542 - DNA, 20 bp, Artificial Sequence
  chemically synthesized
tctcttaccttttgagaagg

SEQ ID NO: 385543 - DNA, 20 bp, Artificial Sequence
  chemically synthesized
ctgtctctcttatgtacacg

SEQ ID NO: 385544 - DNA, 20 bp, Artificial Sequence
  chemically synthesized
gtgcgtgtctacgtgtacat

SEQ ID NO: 385545 - DNA, 20 bp, Artificial Sequence
  chemically synthesized
gcgtgtctacgtgtacataa

SEQ ID NO: 385546 - DNA, 20 bp, Artificial Sequence
  chemically synthesized
gtgtctacgtgtacataaga

SEQ ID NO: 385547 - DNA, 20 bp, Artificial Sequence
  chemically synthesized
ctacgtgtacataagagaga

SEQ ID NO: 385548 - DNA, 20 bp, Artificial Sequence
  chemically synthesized
acgtgtacataagagagaca

SEQ ID NO: 385549 - DNA, 20 bp, Artificial Sequence
  chemically synthesized
gtacataagagagacagaga

SEQ ID NO: 385550 - DNA, 20 bp, Artificial Sequence
  chemically synthesized
aagagagacagagaaagtga

SEQ ID NO: 385551 - DNA, 20 bp, Artificial Sequence
  chemically synthesized
gagagacagagaaagtgaaa

SEQ ID NO: 385552 - DNA, 20 bp, Artificial Sequence
  chemically synthesized
gagacagagaaagtgaaaga

SEQ ID NO: 385553 - DNA, 20 bp, Artificial Sequence
  chemically synthesized
agacagagaaagtgaaagag

SEQ ID NO: 385554 - DNA, 20 bp, Artificial Sequence
  chemically synthesized
gacagagaaagtgaaagaga

SEQ ID NO: 385555 - DNA, 20 bp, Artificial Sequence
  chemically synthesized
cagagaaagtgaaagagagg

SEQ ID NO: 385556 - DNA, 20 bp, Artificial Sequence
  chemically synthesized
aagtgaaagagagggagatt

SEQ ID NO: 385557 - DNA, 20 bp, Artificial Sequence
  chemically synthesized
tgaaagagagggagatttgg

SEQ ID NO: 385558 - DNA, 20 bp, Artificial Sequence
  chemically synthesized
agagggagatttggtagata

SEQ ID NO: 385559 - DNA, 20 bp, Artificial Sequence
  chemically synthesized
tttggtagataaagactcaa

SEQ ID NO: 385560 - DNA, 20 bp, Artificial Sequence
  chemically synthesized
aggaaattcctaagtctatt

SEQ ID NO: 385561 - DNA, 20 bp, Artificial Sequence
  chemically synthesized
agataaagactcaatagact

SEQ ID NO: 385562 - DNA, 20 bp, Artificial Sequence
  chemically synthesized
gataaagactcaatagactt

SEQ ID NO: 385563 - DNA, 20 bp, Artificial Sequence
  chemically synthesized
taacgacataggaaattcct

SEQ ID NO: 385564 - DNA, 20 bp, Artificial Sequence
  chemically synthesized
tcaaattcaaataacgacat

SEQ ID NO: 385565 - DNA, 20 bp, Artificial Sequence
  chemically synthesized
ctcaaattcaaataacgaca

SEQ ID NO: 385566 - DNA, 20 bp, Artificial Sequence
  chemically synthesized
ctatgtcgttatttgaattt

SEQ ID NO: 385567 - DNA, 20 bp, Artificial Sequence
  chemically synthesized
atgtcgttatttgaatttga

SEQ ID NO: 385568 - DNA, 20 bp, Artificial Sequence
  chemically synthesized
tttgaatttgagagattact

SEQ ID NO: 385569 - DNA, 20 bp, Artificial Sequence
  chemically synthesized
tttgagagattactgagtgt

SEQ ID NO: 385570 - DNA, 20 bp, Artificial Sequence
  chemically synthesized
ggattatcttttcttacact

SEQ ID NO: 385571 - DNA, 20 bp, Artificial Sequence
  chemically synthesized
gagattactgagtgtaagaa

SEQ ID NO: 385572 - DNA, 20 bp, Artificial Sequence
  chemically synthesized
taagaaaagataatccattt

SEQ ID NO: 385573 - DNA, 20 bp, Artificial Sequence
  chemically synthesized
aaaagataatccattttggc

SEQ ID NO: 385574 - DNA, 20 bp, Artificial Sequence
  chemically synthesized
agccactgctccagccaaaa

SEQ ID NO: 385575 - DNA, 20 bp, Artificial Sequence
  chemically synthesized
aagataatccattttggctg

SEQ ID NO: 385576 - DNA, 20 bp, Artificial Sequence
  chemically synthesized
ataatccattttggctggag

SEQ ID NO: 385577 - DNA, 20 bp, Artificial Sequence
  chemically synthesized
atccattttggctggagcag

SEQ ID NO: 385578 - DNA, 20 bp, Artificial Sequence
  chemically synthesized
acaggcatgagccactgctc

SEQ ID NO: 385579 - DNA, 20 bp, Artificial Sequence
  chemically synthesized
attgctgggattacaggcat

SEQ ID NO: 385580 - DNA, 20 bp, Artificial Sequence
  chemically synthesized
gtggctcatgcctgtaatcc

SEQ ID NO: 385581 - DNA, 20 bp, Artificial Sequence
  chemically synthesized
tcccaaattgctgggattac

SEQ ID NO: 385582 - DNA, 20 bp, Artificial Sequence
  chemically synthesized
ctcccaaattgctgggatta

SEQ ID NO: 385583 - DNA, 20 bp, Artificial Sequence
  chemically synthesized
tgcctgtaatcccagcaatt

SEQ ID NO: 385584 - DNA, 20 bp, Artificial Sequence
  chemically synthesized
cctcggcctcccaaattgct

SEQ ID NO: 385585 - DNA, 20 bp, Artificial Sequence
  chemically synthesized
gcctgtaatcccagcaattt

SEQ ID NO: 385586 - DNA, 20 bp, Artificial Sequence
  chemically synthesized
gcctcggcctcccaaattgc

SEQ ID NO: 385587 - DNA, 20 bp, Artificial Sequence
  chemically synthesized
ctgtaatcccagcaatttgg

SEQ ID NO: 385588 - DNA, 20 bp, Artificial Sequence
  chemically synthesized
tgtaatcccagcaatttggg

SEQ ID NO: 385589 - DNA, 20 bp, Artificial Sequence
  chemically synthesized
tcccagcaatttgggaggcc

SEQ ID NO: 385590 - DNA, 20 bp, Artificial Sequence
  chemically synthesized
cccagcaatttgggaggccg

SEQ ID NO: 385591 - DNA, 20 bp, Artificial Sequence
  chemically synthesized
agcaatttgggaggccgagg

SEQ ID NO: 385592 - DNA, 20 bp, Artificial Sequence
  chemically synthesized
gcaatttgggaggccgaggc

SEQ ID NO: 385593 - DNA, 20 bp, Artificial Sequence
  chemically synthesized
atttgggaggccgaggcggg

SEQ ID NO: 385594 - DNA, 20 bp, Artificial Sequence
  chemically synthesized
ctcaggtgatccacccgcct

SEQ ID NO: 385595 - DNA, 20 bp, Artificial Sequence
  chemically synthesized
ccgaggcgggtggatcacct

SEQ ID NO: 385596 - DNA, 20 bp, Artificial Sequence
  chemically synthesized
cgaggcgggtggatcacctg

SEQ ID NO: 385597 - DNA, 20 bp, Artificial Sequence
  chemically synthesized
gcgggtggatcacctgaggt

SEQ ID NO: 385598 - DNA, 20 bp, Artificial Sequence
  chemically synthesized
cgggtggatcacctgaggtc

SEQ ID NO: 385599 - DNA, 20 bp, Artificial Sequence
  chemically synthesized
ggtctcaaactcctgacctc

SEQ ID NO: 385600 - DNA, 20 bp, Artificial Sequence
  chemically synthesized
ggtggatcacctgaggtcag

SEQ ID NO: 385601 - DNA, 20 bp, Artificial Sequence
  chemically synthesized
tggtctcaaactcctgacct

SEQ ID NO: 385602 - DNA, 20 bp, Artificial Sequence
  chemically synthesized
tcacctgaggtcaggagttt

SEQ ID NO: 385603 - DNA, 20 bp, Artificial Sequence
  chemically synthesized
tgaggtcaggagtttgagac

SEQ ID NO: 385604 - DNA, 20 bp, Artificial Sequence
  chemically synthesized
tcaggagtttgagaccagcc

SEQ ID NO: 385605 - DNA, 20 bp, Artificial Sequence
  chemically synthesized
tttcaccatgttggccaggc

SEQ ID NO: 385606 - DNA, 20 bp, Artificial Sequence
  chemically synthesized
ggggtttcaccatgttggcc

SEQ ID NO: 385607 - DNA, 20 bp, Artificial Sequence
  chemically synthesized
tgagaccagcctggccaaca

SEQ ID NO: 385608 - DNA, 20 bp, Artificial Sequence
  chemically synthesized
tggggtttcaccatgttggc

SEQ ID NO: 385609 - DNA, 20 bp, Artificial Sequence
  chemically synthesized
gagatggggtttcaccatgt

SEQ ID NO: 385610 - DNA, 20 bp, Artificial Sequence
  chemically synthesized
ttgtatttttagtagagatg

SEQ ID NO: 385611 - DNA, 20 bp, Artificial Sequence
  chemically synthesized
tttgtatttttagtagagat

SEQ ID NO: 385612 - DNA, 20 bp, Artificial Sequence
  chemically synthesized
ttttgtatttttagtagaga

SEQ ID NO: 385613 - DNA, 20 bp, Artificial Sequence
  chemically synthesized
taatttttgtatttttagta

SEQ ID NO: 385614 - DNA, 20 bp, Artificial Sequence
  chemically synthesized
gctaatttttgtatttttag

SEQ ID NO: 385615 - DNA, 20 bp, Artificial Sequence
  chemically synthesized
ctggctaatttttgtatttt

SEQ ID NO: 385616 - DNA, 20 bp, Artificial Sequence
  chemically synthesized
tctactaaaaatacaaaaat

SEQ ID NO: 385617 - DNA, 20 bp, Artificial Sequence
  chemically synthesized
ctaaaaatacaaaaattagc

SEQ ID NO: 385618 - DNA, 20 bp, Artificial Sequence
  chemically synthesized
taaaaatacaaaaattagcc

SEQ ID NO: 385619 - DNA, 20 bp, Artificial Sequence
  chemically synthesized
atacaaaaattagccaggtg

SEQ ID NO: 385620 - DNA, 20 bp, Artificial Sequence
  chemically synthesized
caaaaattagccaggtgtgg

SEQ ID NO: 385621 - DNA, 20 bp, Artificial Sequence
  chemically synthesized
taggcacacaccgccacacc

SEQ ID NO: 385622 - DNA, 20 bp, Artificial Sequence
  chemically synthesized
gcggtgtgtgcctataatcc

SEQ ID NO: 385623 - DNA, 20 bp, Artificial Sequence
  chemically synthesized
tcccaactagctgggattat

SEQ ID NO: 385624 - DNA, 20 bp, Artificial Sequence
  chemically synthesized
ctcccaactagctgggatta

SEQ ID NO: 385625 - DNA, 20 bp, Artificial Sequence
  chemically synthesized
tgtgtgcctataatcccagc

SEQ ID NO: 385626 - DNA, 20 bp, Artificial Sequence
  chemically synthesized
tgcctataatcccagctagt

SEQ ID NO: 385627 - DNA, 20 bp, Artificial Sequence
  chemically synthesized
cctcagcctcccaactagct

SEQ ID NO: 385628 - DNA, 20 bp, Artificial Sequence
  chemically synthesized
gcctataatcccagctagtt

SEQ ID NO: 385629 - DNA, 20 bp, Artificial Sequence
  chemically synthesized
gcctcagcctcccaactagc

SEQ ID NO: 385630 - DNA, 20 bp, Artificial Sequence
  chemically synthesized
ctataatcccagctagttgg

SEQ ID NO: 385631 - DNA, 20 bp, Artificial Sequence
  chemically synthesized
tataatcccagctagttggg

SEQ ID NO: 385632 - DNA, 20 bp, Artificial Sequence
  chemically synthesized
ttctgcctcagcctcccaac

SEQ ID NO: 385633 - DNA, 20 bp, Artificial Sequence
  chemically synthesized
tcccagctagttgggaggct

SEQ ID NO: 385634 - DNA, 20 bp, Artificial Sequence
  chemically synthesized
cccagctagttgggaggctg

SEQ ID NO: 385635 - DNA, 20 bp, Artificial Sequence
  chemically synthesized
agctagttgggaggctgagg

SEQ ID NO: 385636 - DNA, 20 bp, Artificial Sequence
  chemically synthesized
tagttgggaggctgaggcag

SEQ ID NO: 385637 - DNA, 20 bp, Artificial Sequence
  chemically synthesized
ttgaagcgattcttctgcct

SEQ ID NO: 385638 - DNA, 20 bp, Artificial Sequence
  chemically synthesized
gcagaagaatcgcttcaatc

SEQ ID NO: 385639 - DNA, 20 bp, Artificial Sequence
  chemically synthesized
cagaagaatcgcttcaatcc

SEQ ID NO: 385640 - DNA, 20 bp, Artificial Sequence
  chemically synthesized
agcctctgcctcctggattg

SEQ ID NO: 385641 - DNA, 20 bp, Artificial Sequence
  chemically synthesized
gaagaatcgcttcaatccag

SEQ ID NO: 385642 - DNA, 20 bp, Artificial Sequence
  chemically synthesized
aagaatcgcttcaatccagg

SEQ ID NO: 385643 - DNA, 20 bp, Artificial Sequence
  chemically synthesized
aatcgcttcaatccaggagg

SEQ ID NO: 385644 - DNA, 20 bp, Artificial Sequence
  chemically synthesized
tcgcttcaatccaggaggca

SEQ ID NO: 385645 - DNA, 20 bp, Artificial Sequence
  chemically synthesized
tcactgcagcctctgcctcc

SEQ ID NO: 385646 - DNA, 20 bp, Artificial Sequence
  chemically synthesized
cgcttcaatccaggaggcag

SEQ ID NO: 385647 - DNA, 20 bp, Artificial Sequence
  chemically synthesized
aatccaggaggcagaggctg

SEQ ID NO: 385648 - DNA, 20 bp, Artificial Sequence
  chemically synthesized
caggaggcagaggctgcagt

SEQ ID NO: 385649 - DNA, 20 bp, Artificial Sequence
  chemically synthesized
ggtgccatctcggctcactg

SEQ ID NO: 385650 - DNA, 20 bp, Artificial Sequence
  chemically synthesized
ggcagaggctgcagtgagcc

SEQ ID NO: 385651 - DNA, 20 bp, Artificial Sequence
  chemically synthesized
gaggctgcagtgagccgaga

SEQ ID NO: 385652 - DNA, 20 bp, Artificial Sequence
  chemically synthesized
ggagtgcagtggtgccatct

SEQ ID NO: 385653 - DNA, 20 bp, Artificial Sequence
  chemically synthesized
tcacccaggctggagtgcag

SEQ ID NO: 385654 - DNA, 20 bp, Artificial Sequence
  chemically synthesized
gagatggcaccactgcactc

SEQ ID NO: 385655 - DNA, 20 bp, Artificial Sequence
  chemically synthesized
ctgtcacccaggctggagtg

SEQ ID NO: 385656 - DNA, 20 bp, Artificial Sequence
  chemically synthesized
ggcaccactgcactccagcc

SEQ ID NO: 385657 - DNA, 20 bp, Artificial Sequence
  chemically synthesized
gcaccactgcactccagcct

SEQ ID NO: 385658 - DNA, 20 bp, Artificial Sequence
  chemically synthesized
tcactctgtcacccaggctg

SEQ ID NO: 385659 - DNA, 20 bp, Artificial Sequence
  chemically synthesized
tctcactctgtcacccaggc

SEQ ID NO: 385660 - DNA, 20 bp, Artificial Sequence
  chemically synthesized
ctgcactccagcctgggtga

SEQ ID NO: 385661 - DNA, 20 bp, Artificial Sequence
  chemically synthesized
agagtctcactctgtcaccc

SEQ ID NO: 385662 - DNA, 20 bp, Artificial Sequence
  chemically synthesized
gcactccagcctgggtgaca

SEQ ID NO: 385663 - DNA, 20 bp, Artificial Sequence
  chemically synthesized
cagagtctcactctgtcacc

SEQ ID NO: 385664 - DNA, 20 bp, Artificial Sequence
  chemically synthesized
tccagcctgggtgacagagt

SEQ ID NO: 385665 - DNA, 20 bp, Artificial Sequence
  chemically synthesized
tttttttgttttttgagaca

SEQ ID NO: 385666 - DNA, 20 bp, Artificial Sequence
  chemically synthesized
tctttttttgttttttgaga

SEQ ID NO: 385667 - DNA, 20 bp, Artificial Sequence
  chemically synthesized
tttttctttttttgtttttt

SEQ ID NO: 385668 - DNA, 20 bp, Artificial Sequence
  chemically synthesized
tctgtctcaaaaaacaaaaa

SEQ ID NO: 385669 - DNA, 20 bp, Artificial Sequence
  chemically synthesized
aaaacaaaaaaagaaaaaaa

SEQ ID NO: 385670 - DNA, 20 bp, Artificial Sequence
  chemically synthesized
aacaaaaaaagaaaaaaaaa

SEQ ID NO: 385671 - DNA, 20 bp, Artificial Sequence
  chemically synthesized
tttcaagattcaagttaaaa

SEQ ID NO: 385672 - DNA, 20 bp, Artificial Sequence
  chemically synthesized
tacagaaaatttcaagattc

SEQ ID NO: 385673 - DNA, 20 bp, Artificial Sequence
  chemically synthesized
gctactttacagaaaatttc

SEQ ID NO: 385674 - DNA, 20 bp, Artificial Sequence
  chemically synthesized
gaatcttgaaattttctgta

SEQ ID NO: 385675 - DNA, 20 bp, Artificial Sequence
  chemically synthesized
tcttgaaattttctgtaaag

SEQ ID NO: 385676 - DNA, 20 bp, Artificial Sequence
  chemically synthesized
aatttacctctgctacttta

SEQ ID NO: 385677 - DNA, 20 bp, Artificial Sequence
  chemically synthesized
tgaaattttctgtaaagtag

SEQ ID NO: 385678 - DNA, 20 bp, Artificial Sequence
  chemically synthesized
aaattttctgtaaagtagca

SEQ ID NO: 385679 - DNA, 20 bp, Artificial Sequence
  chemically synthesized
aattttctgtaaagtagcag

SEQ ID NO: 385680 - DNA, 20 bp, Artificial Sequence
  chemically synthesized
gtagcagaggtaaattgcca

SEQ ID NO: 385681 - DNA, 20 bp, Artificial Sequence
  chemically synthesized
ttcctttcctatgatttcca

SEQ ID NO: 385682 - DNA, 20 bp, Artificial Sequence
  chemically synthesized
gtaaattgccatggaaatca

SEQ ID NO: 385683 - DNA, 20 bp, Artificial Sequence
  chemically synthesized
taaattgccatggaaatcat

SEQ ID NO: 385684 - DNA, 20 bp, Artificial Sequence
  chemically synthesized
ttgccatggaaatcatagga

SEQ ID NO: 385685 - DNA, 20 bp, Artificial Sequence
  chemically synthesized
tgccatggaaatcataggaa

SEQ ID NO: 385686 - DNA, 20 bp, Artificial Sequence
  chemically synthesized
aatcataggaaaggaaatat

SEQ ID NO: 385687 - DNA, 20 bp, Artificial Sequence
  chemically synthesized
aaggaaatataagcccaaca

SEQ ID NO: 385688 - DNA, 20 bp, Artificial Sequence
  chemically synthesized
gcagagtctattaccgtgtt

SEQ ID NO: 385689 - DNA, 20 bp, Artificial Sequence
  chemically synthesized
tgcagagtctattaccgtgt

SEQ ID NO: 385690 - DNA, 20 bp, Artificial Sequence
  chemically synthesized
atataagcccaacacggtaa

SEQ ID NO: 385691 - DNA, 20 bp, Artificial Sequence
  chemically synthesized
cataaatatatttcattgca

SEQ ID NO: 385692 - DNA, 20 bp, Artificial Sequence
  chemically synthesized
accataaatatatttcattg

SEQ ID NO: 385693 - DNA, 20 bp, Artificial Sequence
  chemically synthesized
tctgcaatgaaatatattta

SEQ ID NO: 385694 - DNA, 20 bp, Artificial Sequence
  chemically synthesized
tatttatggtgctataataa

SEQ ID NO: 385695 - DNA, 20 bp, Artificial Sequence
  chemically synthesized
cagtatgtacactattatta

SEQ ID NO: 385696 - DNA, 20 bp, Artificial Sequence
  chemically synthesized
aaaaattgaaaacatataaa

SEQ ID NO: 385697 - DNA, 20 bp, Artificial Sequence
  chemically synthesized
gtttatatgttttcaatttt

SEQ ID NO: 385698 - DNA, 20 bp, Artificial Sequence
  chemically synthesized
ttaggtctcgtgttttgtca

SEQ ID NO: 385699 - DNA, 20 bp, Artificial Sequence
  chemically synthesized
ataaatctttgacaaaacac

SEQ ID NO: 385700 - DNA, 20 bp, Artificial Sequence
  chemically synthesized
caaaacacgagacctaatca

SEQ ID NO: 385701 - DNA, 20 bp, Artificial Sequence
  chemically synthesized
tgtgttctctaactatgatt

SEQ ID NO: 385702 - DNA, 20 bp, Artificial Sequence
  chemically synthesized
ctgtgttctctaactatgat

SEQ ID NO: 385703 - DNA, 20 bp, Artificial Sequence
  chemically synthesized
acacgagacctaatcatagt

SEQ ID NO: 385704 - DNA, 20 bp, Artificial Sequence
  chemically synthesized
acgagacctaatcatagtta

SEQ ID NO: 385705 - DNA, 20 bp, Artificial Sequence
  chemically synthesized
ctaatcatagttagagaaca

SEQ ID NO: 385706 - DNA, 20 bp, Artificial Sequence
  chemically synthesized
atcatagttagagaacacag

SEQ ID NO: 385707 - DNA, 20 bp, Artificial Sequence
  chemically synthesized
tcatagttagagaacacaga

SEQ ID NO: 385708 - DNA, 20 bp, Artificial Sequence
  chemically synthesized
tctacttttaattttatgtt

SEQ ID NO: 385709 - DNA, 20 bp, Artificial Sequence
  chemically synthesized
gcaactcaacataaaattaa

SEQ ID NO: 385710 - DNA, 20 bp, Artificial Sequence
  chemically synthesized
actcaacataaaattaaaag

SEQ ID NO: 385711 - DNA, 20 bp, Artificial Sequence
  chemically synthesized
aaaattaaaagtagacttta

SEQ ID NO: 385712 - DNA, 20 bp, Artificial Sequence
  chemically synthesized
ttcttctcccaaattctgta

SEQ ID NO: 385713 - DNA, 20 bp, Artificial Sequence
  chemically synthesized
aaagtagactttacagaatt

SEQ ID NO: 385714 - DNA, 20 bp, Artificial Sequence
  chemically synthesized
aagtagactttacagaattt

SEQ ID NO: 385715 - DNA, 20 bp, Artificial Sequence
  chemically synthesized
gtagactttacagaatttgg

SEQ ID NO: 385716 - DNA, 20 bp, Artificial Sequence
  chemically synthesized
gactttacagaatttgggag

SEQ ID NO: 385717 - DNA, 20 bp, Artificial Sequence
  chemically synthesized
agaatttgggagaagaaatt

SEQ ID NO: 385718 - DNA, 20 bp, Artificial Sequence
  chemically synthesized
atttgggagaagaaattcag

SEQ ID NO: 385719 - DNA, 20 bp, Artificial Sequence
  chemically synthesized
tttgggagaagaaattcagt

SEQ ID NO: 385720 - DNA, 20 bp, Artificial Sequence
  chemically synthesized
tgggagaagaaattcagtag

SEQ ID NO: 385721 - DNA, 20 bp, Artificial Sequence
  chemically synthesized
gagaagaaattcagtaggag

SEQ ID NO: 385722 - DNA, 20 bp, Artificial Sequence
  chemically synthesized
gaaattcagtaggagaagtg

SEQ ID NO: 385723 - DNA, 20 bp, Artificial Sequence
  chemically synthesized
gtaggagaagtgaagaaaca

SEQ ID NO: 385724 - DNA, 20 bp, Artificial Sequence
  chemically synthesized
aggagaagtgaagaaacatg

SEQ ID NO: 385725 - DNA, 20 bp, Artificial Sequence
  chemically synthesized
ggagaagtgaagaaacatgg

SEQ ID NO: 385726 - DNA, 20 bp, Artificial Sequence
  chemically synthesized
tgataaaatggggattttag

SEQ ID NO: 385727 - DNA, 20 bp, Artificial Sequence
  chemically synthesized
acatgataaaatggggattt

SEQ ID NO: 385728 - DNA, 20 bp, Artificial Sequence
  chemically synthesized
acccttcacatgataaaatg

SEQ ID NO: 385729 - DNA, 20 bp, Artificial Sequence
  chemically synthesized
aacccttcacatgataaaat

SEQ ID NO: 385730 - DNA, 20 bp, Artificial Sequence
  chemically synthesized
taacccttcacatgataaaa

SEQ ID NO: 385731 - DNA, 20 bp, Artificial Sequence
  chemically synthesized
aatccccattttatcatgtg

SEQ ID NO: 385732 - DNA, 20 bp, Artificial Sequence
  chemically synthesized
atccccattttatcatgtga

SEQ ID NO: 385733 - DNA, 20 bp, Artificial Sequence
  chemically synthesized
tccccattttatcatgtgaa

SEQ ID NO: 385734 - DNA, 20 bp, Artificial Sequence
  chemically synthesized
attttatcatgtgaagggtt

SEQ ID NO: 385735 - DNA, 20 bp, Artificial Sequence
  chemically synthesized
tttcttcaaaacagtgtcaa

SEQ ID NO: 385736 - DNA, 20 bp, Artificial Sequence
  chemically synthesized
atacttttgacactgttttg

SEQ ID NO: 385737 - DNA, 20 bp, Artificial Sequence
  chemically synthesized
gttaatttttttcttcaaaa

SEQ ID NO: 385738 - DNA, 20 bp, Artificial Sequence
  chemically synthesized
gaagaaaaaaattaacattt

SEQ ID NO: 385739 - DNA, 20 bp, Artificial Sequence
  chemically synthesized
aagaaaaaaattaacattta

SEQ ID NO: 385740 - DNA, 20 bp, Artificial Sequence
  chemically synthesized
catttaaggtcttcatgtaa

SEQ ID NO: 385741 - DNA, 20 bp, Artificial Sequence
  chemically synthesized
actaatttttcttttacatg

SEQ ID NO: 385742 - DNA, 20 bp, Artificial Sequence
  chemically synthesized
tcttcatgtaaaagaaaaat

SEQ ID NO: 385743 - DNA, 20 bp, Artificial Sequence
  chemically synthesized
gtaaaagaaaaattagttaa

SEQ ID NO: 385744 - DNA, 20 bp, Artificial Sequence
  chemically synthesized
tagttaatagaacaaataca

SEQ ID NO: 385745 - DNA, 20 bp, Artificial Sequence
  chemically synthesized
agttaatagaacaaatacat

SEQ ID NO: 385746 - DNA, 20 bp, Artificial Sequence
  chemically synthesized
gttaatagaacaaatacatg

SEQ ID NO: 385747 - DNA, 20 bp, Artificial Sequence
  chemically synthesized
aatagaacaaatacatgggg

SEQ ID NO: 385748 - DNA, 20 bp, Artificial Sequence
  chemically synthesized
tacatggggtagatataaat

SEQ ID NO: 385749 - DNA, 20 bp, Artificial Sequence
  chemically synthesized
gataatttttcatctctcat

SEQ ID NO: 385750 - DNA, 20 bp, Artificial Sequence
  chemically synthesized
taatttttcatctctcataa

SEQ ID NO: 385751 - DNA, 20 bp, Artificial Sequence
  chemically synthesized
gtctacagtctctcttatga

SEQ ID NO: 385752 - DNA, 20 bp, Artificial Sequence
  chemically synthesized
atttttcatctctcataaga

SEQ ID NO: 385753 - DNA, 20 bp, Artificial Sequence
  chemically synthesized
tggtctacagtctctcttat

SEQ ID NO: 385754 - DNA, 20 bp, Artificial Sequence
  chemically synthesized
atctctcataagagagactg

SEQ ID NO: 385755 - DNA, 20 bp, Artificial Sequence
  chemically synthesized
tctcattttttcatggtcta

SEQ ID NO: 385756 - DNA, 20 bp, Artificial Sequence
  chemically synthesized
ttgattttctcattttttca

SEQ ID NO: 385757 - DNA, 20 bp, Artificial Sequence
  chemically synthesized
actgtagaccatgaaaaaat

SEQ ID NO: 385758 - DNA, 20 bp, Artificial Sequence
  chemically synthesized
catgaaaaaatgagaaaatc

SEQ ID NO: 385759 - DNA, 20 bp, Artificial Sequence
  chemically synthesized
aaaatgagaaaatcaagaat

SEQ ID NO: 385760 - DNA, 20 bp, Artificial Sequence
  chemically synthesized
aatgagaaaatcaagaatta

SEQ ID NO: 385761 - DNA, 20 bp, Artificial Sequence
  chemically synthesized
gagatataaacatgttatta

SEQ ID NO: 385762 - DNA, 20 bp, Artificial Sequence
  chemically synthesized
attacagatttgtcacgcat

SEQ ID NO: 385763 - DNA, 20 bp, Artificial Sequence
  chemically synthesized
gatttgtcacgcattagaaa

SEQ ID NO: 385764 - DNA, 20 bp, Artificial Sequence
  chemically synthesized
tttgtcacgcattagaaaaa

SEQ ID NO: 385765 - DNA, 20 bp, Artificial Sequence
  chemically synthesized
ctcctcagaggcagatattt

SEQ ID NO: 385766 - DNA, 20 bp, Artificial Sequence
  chemically synthesized
tgactcaaatatctgcctct

SEQ ID NO: 385767 - DNA, 20 bp, Artificial Sequence
  chemically synthesized
gactcaaatatctgcctctg

SEQ ID NO: 385768 - DNA, 20 bp, Artificial Sequence
  chemically synthesized
catttctcactcctcagagg

SEQ ID NO: 385769 - DNA, 20 bp, Artificial Sequence
  chemically synthesized
ctcaaatatctgcctctgag

SEQ ID NO: 385770 - DNA, 20 bp, Artificial Sequence
  chemically synthesized
tctcatttctcactcctcag

SEQ ID NO: 385771 - DNA, 20 bp, Artificial Sequence
  chemically synthesized
ctctcatttctcactcctca

SEQ ID NO: 385772 - DNA, 20 bp, Artificial Sequence
  chemically synthesized
aatatctgcctctgaggagt

SEQ ID NO: 385773 - DNA, 20 bp, Artificial Sequence
  chemically synthesized
ctctctcatttctcactcct

SEQ ID NO: 385774 - DNA, 20 bp, Artificial Sequence
  chemically synthesized
gcctctgaggagtgagaaat

SEQ ID NO: 385775 - DNA, 20 bp, Artificial Sequence
  chemically synthesized
ctctgaggagtgagaaatga

SEQ ID NO: 385776 - DNA, 20 bp, Artificial Sequence
  chemically synthesized
ctgaggagtgagaaatgaga

SEQ ID NO: 385777 - DNA, 20 bp, Artificial Sequence
  chemically synthesized
tgaggagtgagaaatgagag

SEQ ID NO: 385778 - DNA, 20 bp, Artificial Sequence
  chemically synthesized
tgagaaatgagagaggaatg

SEQ ID NO: 385779 - DNA, 20 bp, Artificial Sequence
  chemically synthesized
aatgcagcatatttaaataa

SEQ ID NO: 385780 - DNA, 20 bp, Artificial Sequence
  chemically synthesized
tttaaataaaagaacttatg

SEQ ID NO: 385781 - DNA, 20 bp, Artificial Sequence
  chemically synthesized
tcaagtaatttttacttcat

SEQ ID NO: 385782 - DNA, 20 bp, Artificial Sequence
  chemically synthesized
aaattatctgtacatgattc

SEQ ID NO: 385783 - DNA, 20 bp, Artificial Sequence
  chemically synthesized
aaaattacttgaatcatgta

SEQ ID NO: 385784 - DNA, 20 bp, Artificial Sequence
  chemically synthesized
acaaatttatattcattaat

SEQ ID NO: 385785 - DNA, 20 bp, Artificial Sequence
  chemically synthesized
tttcttattggaattttaaa

SEQ ID NO: 385786 - DNA, 20 bp, Artificial Sequence
  chemically synthesized
acactttttaaaattccaat

SEQ ID NO: 385787 - DNA, 20 bp, Artificial Sequence
  chemically synthesized
agtctctcattttttcttat

SEQ ID NO: 385788 - DNA, 20 bp, Artificial Sequence
  chemically synthesized
aaattccaataagaaaaaat

SEQ ID NO: 385789 - DNA, 20 bp, Artificial Sequence
  chemically synthesized
attccaataagaaaaaatga

SEQ ID NO: 385790 - DNA, 20 bp, Artificial Sequence
  chemically synthesized
aaaaatgagagacttaaaat

SEQ ID NO: 385791 - DNA, 20 bp, Artificial Sequence
  chemically synthesized
aaaatgagagacttaaaatt

SEQ ID NO: 385792 - DNA, 20 bp, Artificial Sequence
  chemically synthesized
atgcattcctacctaatttt

SEQ ID NO: 385793 - DNA, 20 bp, Artificial Sequence
  chemically synthesized
atgagagacttaaaattagg

SEQ ID NO: 385794 - DNA, 20 bp, Artificial Sequence
  chemically synthesized
tgagagacttaaaattaggt

SEQ ID NO: 385795 - DNA, 20 bp, Artificial Sequence
  chemically synthesized
ttaggtaggaatgcatttcc

SEQ ID NO: 385796 - DNA, 20 bp, Artificial Sequence
  chemically synthesized
aggtaggaatgcatttccca

SEQ ID NO: 385797 - DNA, 20 bp, Artificial Sequence
  chemically synthesized
ggtaggaatgcatttcccag

SEQ ID NO: 385798 - DNA, 20 bp, Artificial Sequence
  chemically synthesized
aatataaatttttaacctct

SEQ ID NO: 385799 - DNA, 20 bp, Artificial Sequence
  chemically synthesized
aaatataaatttttaacctc

SEQ ID NO: 385800 - DNA, 20 bp, Artificial Sequence
  chemically synthesized
tttaatatatatgcatatat

SEQ ID NO: 385801 - DNA, 20 bp, Artificial Sequence
  chemically synthesized
aatatatatgcatatataag

SEQ ID NO: 385802 - DNA, 20 bp, Artificial Sequence
  chemically synthesized
atatatatgcatatataagc

SEQ ID NO: 385803 - DNA, 20 bp, Artificial Sequence
  chemically synthesized
atataagcgggatcataata

SEQ ID NO: 385804 - DNA, 20 bp, Artificial Sequence
  chemically synthesized
tgtatacatactgtgtatta

SEQ ID NO: 385805 - DNA, 20 bp, Artificial Sequence
  chemically synthesized
ataaagcagactgtaataca

SEQ ID NO: 385806 - DNA, 20 bp, Artificial Sequence
  chemically synthesized
acatacatgaaaaaataaag

SEQ ID NO: 385807 - DNA, 20 bp, Artificial Sequence
  chemically synthesized
aatacatacatgaaaaaata

SEQ ID NO: 385808 - DNA, 20 bp, Artificial Sequence
  chemically synthesized
tattttttcatgtatgtatt

SEQ ID NO: 385809 - DNA, 20 bp, Artificial Sequence
  chemically synthesized
ggtgattgcattgatattaa

SEQ ID NO: 385810 - DNA, 20 bp, Artificial Sequence
  chemically synthesized
aggtgattgcattgatatta

SEQ ID NO: 385811 - DNA, 20 bp, Artificial Sequence
  chemically synthesized
aatttaaaataaaattttac

SEQ ID NO: 385812 - DNA, 20 bp, Artificial Sequence
  chemically synthesized
aaatttaaaataaaatttta

SEQ ID NO: 385813 - DNA, 20 bp, Artificial Sequence
  chemically synthesized
tattttaaatttcccttctt

SEQ ID NO: 385814 - DNA, 20 bp, Artificial Sequence
  chemically synthesized
ttttaaatttcccttcttta

SEQ ID NO: 385815 - DNA, 20 bp, Artificial Sequence
  chemically synthesized
aatgatatatctctaaagaa

SEQ ID NO: 385816 - DNA, 20 bp, Artificial Sequence
  chemically synthesized
aaatgatatatctctaaaga

SEQ ID NO: 385817 - DNA, 20 bp, Artificial Sequence
  chemically synthesized
aaaatgatatatctctaaag

SEQ ID NO: 385818 - DNA, 20 bp, Artificial Sequence
  chemically synthesized
taaaaaatgatatatctcta

SEQ ID NO: 385819 - DNA, 20 bp, Artificial Sequence
  chemically synthesized
tttagagatatatcattttt

SEQ ID NO: 385820 - DNA, 20 bp, Artificial Sequence
  chemically synthesized
agagatatatcattttttag

SEQ ID NO: 385821 - DNA, 20 bp, Artificial Sequence
  chemically synthesized
caccagtattcatcagtagg

SEQ ID NO: 385822 - DNA, 20 bp, Artificial Sequence
  chemically synthesized
acaccagtattcatcagtag

SEQ ID NO: 385823 - DNA, 20 bp, Artificial Sequence
  chemically synthesized
caacaccagtattcatcagt

SEQ ID NO: 385824 - DNA, 20 bp, Artificial Sequence
  chemically synthesized
acaacaccagtattcatcag

SEQ ID NO: 385825 - DNA, 20 bp, Artificial Sequence
  chemically synthesized
gaaacaacaccagtattcat

SEQ ID NO: 385826 - DNA, 20 bp, Artificial Sequence
  chemically synthesized
agcctcctactgatgaatac

SEQ ID NO: 385827 - DNA, 20 bp, Artificial Sequence
  chemically synthesized
gtgaaaaatggaaacaacac

SEQ ID NO: 385828 - DNA, 20 bp, Artificial Sequence
  chemically synthesized
attgttattacagtgaaaaa

SEQ ID NO: 385829 - DNA, 20 bp, Artificial Sequence
  chemically synthesized
ttattgtttaattgttatta

SEQ ID NO: 385830 - DNA, 20 bp, Artificial Sequence
  chemically synthesized
taacaattaaacaataaata

SEQ ID NO: 385831 - DNA, 20 bp, Artificial Sequence
  chemically synthesized
aacaattaaacaataaatat

SEQ ID NO: 385832 - DNA, 20 bp, Artificial Sequence
  chemically synthesized
caataaatataggtacaact

SEQ ID NO: 385833 - DNA, 20 bp, Artificial Sequence
  chemically synthesized
tacatctatgtgcaaagact

SEQ ID NO: 385834 - DNA, 20 bp, Artificial Sequence
  chemically synthesized
tacaactcagtctttgcaca

SEQ ID NO: 385835 - DNA, 20 bp, Artificial Sequence
  chemically synthesized
aatgcttacatctatgtgca

SEQ ID NO: 385836 - DNA, 20 bp, Artificial Sequence
  chemically synthesized
cagtctttgcacatagatgt

SEQ ID NO: 385837 - DNA, 20 bp, Artificial Sequence
  chemically synthesized
catttccagggaaattatcg

SEQ ID NO: 385838 - DNA, 20 bp, Artificial Sequence
  chemically synthesized
catttcttcgataatttccc

SEQ ID NO: 385839 - DNA, 20 bp, Artificial Sequence
  chemically synthesized
actaagcaattgcatttcca

SEQ ID NO: 385840 - DNA, 20 bp, Artificial Sequence
  chemically synthesized
gactaagcaattgcatttcc

SEQ ID NO: 385841 - DNA, 20 bp, Artificial Sequence
  chemically synthesized
tgactaagcaattgcatttc

SEQ ID NO: 385842 - DNA, 20 bp, Artificial Sequence
  chemically synthesized
tccctggaaatgcaattgct

SEQ ID NO: 385843 - DNA, 20 bp, Artificial Sequence
  chemically synthesized
ggaaatgcaattgcttagtc

SEQ ID NO: 385844 - DNA, 20 bp, Artificial Sequence
  chemically synthesized
aagcgtgcttacacttgact

SEQ ID NO: 385845 - DNA, 20 bp, Artificial Sequence
  chemically synthesized
gcaattgcttagtcaagtgt

SEQ ID NO: 385846 - DNA, 20 bp, Artificial Sequence
  chemically synthesized
ttgcaataccaatcaagaga

SEQ ID NO: 385847 - DNA, 20 bp, Artificial Sequence
  chemically synthesized
taagcacgctttctcttgat

SEQ ID NO: 385848 - DNA, 20 bp, Artificial Sequence
  chemically synthesized
cagtttgcaataccaatcaa

SEQ ID NO: 385849 - DNA, 20 bp, Artificial Sequence
  chemically synthesized
agcagtttgcaataccaatc

SEQ ID NO: 385850 - DNA, 20 bp, Artificial Sequence
  chemically synthesized
atcaatttatttcatgagag

SEQ ID NO: 385851 - DNA, 20 bp, Artificial Sequence
  chemically synthesized
tgaatcaatttatttcatga

SEQ ID NO: 385852 - DNA, 20 bp, Artificial Sequence
  chemically synthesized
actgaatcaatttatttcat

SEQ ID NO: 385853 - DNA, 20 bp, Artificial Sequence
  chemically synthesized
tctcatgaaataaattgatt

SEQ ID NO: 385854 - DNA, 20 bp, Artificial Sequence
  chemically synthesized
aaattgattcagtcttctgt

SEQ ID NO: 385855 - DNA, 20 bp, Artificial Sequence
  chemically synthesized
ttgattcagtcttctgtcag

SEQ ID NO: 385856 - DNA, 20 bp, Artificial Sequence
  chemically synthesized
actttgtatgcttctgacag

SEQ ID NO: 385857 - DNA, 20 bp, Artificial Sequence
  chemically synthesized
tatactttgtatgcttctga

SEQ ID NO: 385858 - DNA, 20 bp, Artificial Sequence
  chemically synthesized
tcttctgtcagaagcataca

SEQ ID NO: 385859 - DNA, 20 bp, Artificial Sequence
  chemically synthesized
cagaagcatacaaagtatac

SEQ ID NO: 385860 - DNA, 20 bp, Artificial Sequence
  chemically synthesized
agaagcatacaaagtataca

SEQ ID NO: 385861 - DNA, 20 bp, Artificial Sequence
  chemically synthesized
catacaaagtatacaaggaa

SEQ ID NO: 385862 - DNA, 20 bp, Artificial Sequence
  chemically synthesized
ttatttttattttcattatt

SEQ ID NO: 385863 - DNA, 20 bp, Artificial Sequence
  chemically synthesized
ttcattatttggttacaaat

SEQ ID NO: 385864 - DNA, 20 bp, Artificial Sequence
  chemically synthesized
aacattttttcatatacctt

SEQ ID NO: 385865 - DNA, 20 bp, Artificial Sequence
  chemically synthesized
agaaaataaaacacatccaa

SEQ ID NO: 385866 - DNA, 20 bp, Artificial Sequence
  chemically synthesized
aagaaaataaaacacatcca

SEQ ID NO: 385867 - DNA, 20 bp, Artificial Sequence
  chemically synthesized
accccatatatttggacaaa

SEQ ID NO: 385868 - DNA, 20 bp, Artificial Sequence
  chemically synthesized
tttctttttgtccaaatata

SEQ ID NO: 385869 - DNA, 20 bp, Artificial Sequence
  chemically synthesized
ttctttttgtccaaatatat

SEQ ID NO: 385870 - DNA, 20 bp, Artificial Sequence
  chemically synthesized
acacatgtaccccatatatt

SEQ ID NO: 385871 - DNA, 20 bp, Artificial Sequence
  chemically synthesized
tctttttgtccaaatatatg

SEQ ID NO: 385872 - DNA, 20 bp, Artificial Sequence
  chemically synthesized
gtgtaattttgttacatgca

SEQ ID NO: 385873 - DNA, 20 bp, Artificial Sequence
  chemically synthesized
tgttacatgcatagattgtg

SEQ ID NO: 385874 - DNA, 20 bp, Artificial Sequence
  chemically synthesized
tacatgcatagattgtgtag

SEQ ID NO: 385875 - DNA, 20 bp, Artificial Sequence
  chemically synthesized
gcatagattgtgtagtggtc

SEQ ID NO: 385876 - DNA, 20 bp, Artificial Sequence
  chemically synthesized
agattgtgtagtggtcaagt

SEQ ID NO: 385877 - DNA, 20 bp, Artificial Sequence
  chemically synthesized
gattgtgtagtggtcaagtt

SEQ ID NO: 385878 - DNA, 20 bp, Artificial Sequence
  chemically synthesized
attgtgtagtggtcaagtta

SEQ ID NO: 385879 - DNA, 20 bp, Artificial Sequence
  chemically synthesized
agtggtcaagttagggcttt

SEQ ID NO: 385880 - DNA, 20 bp, Artificial Sequence
  chemically synthesized
tggtcaagttagggctttta

SEQ ID NO: 385881 - DNA, 20 bp, Artificial Sequence
  chemically synthesized
ttgggtgagggacgctctaa

SEQ ID NO: 385882 - DNA, 20 bp, Artificial Sequence
  chemically synthesized
tgtatgatatatttgggtga

SEQ ID NO: 385883 - DNA, 20 bp, Artificial Sequence
  chemically synthesized
gtgtatgatatatttgggtg

SEQ ID NO: 385884 - DNA, 20 bp, Artificial Sequence
  chemically synthesized
tgtgtatgatatatttgggt

SEQ ID NO: 385885 - DNA, 20 bp, Artificial Sequence
  chemically synthesized
ttaatgtgtatgatatattt

SEQ ID NO: 385886 - DNA, 20 bp, Artificial Sequence
  chemically synthesized
attaatgtgtatgatatatt

SEQ ID NO: 385887 - DNA, 20 bp, Artificial Sequence
  chemically synthesized
gttggagtggagtggataat

SEQ ID NO: 385888 - DNA, 20 bp, Artificial Sequence
  chemically synthesized
gtgagggggttggagtggag

SEQ ID NO: 385889 - DNA, 20 bp, Artificial Sequence
  chemically synthesized
agggtgagggggttggagtg

SEQ ID NO: 385890 - DNA, 20 bp, Artificial Sequence
  chemically synthesized
gtagggtgagggggttggag

SEQ ID NO: 385891 - DNA, 20 bp, Artificial Sequence
  chemically synthesized
ttagtagggtgagggggttg

SEQ ID NO: 385892 - DNA, 20 bp, Artificial Sequence
  chemically synthesized
acttagtagggtgagggggt

SEQ ID NO: 385893 - DNA, 20 bp, Artificial Sequence
  chemically synthesized
ggaaacttagtagggtgagg

SEQ ID NO: 385894 - DNA, 20 bp, Artificial Sequence
  chemically synthesized
tggaaacttagtagggtgag

SEQ ID NO: 385895 - DNA, 20 bp, Artificial Sequence
  chemically synthesized
atggaaacttagtagggtga

SEQ ID NO: 385896 - DNA, 20 bp, Artificial Sequence
  chemically synthesized
aatggaaacttagtagggtg

SEQ ID NO: 385897 - DNA, 20 bp, Artificial Sequence
  chemically synthesized
caatggaaacttagtagggt

SEQ ID NO: 385898 - DNA, 20 bp, Artificial Sequence
  chemically synthesized
tccaaccccctcaccctact

SEQ ID NO: 385899 - DNA, 20 bp, Artificial Sequence
  chemically synthesized
tagacaatggaaacttagta

SEQ ID NO: 385900 - DNA, 20 bp, Artificial Sequence
  chemically synthesized
atagacaatggaaacttagt

SEQ ID NO: 385901 - DNA, 20 bp, Artificial Sequence
  chemically synthesized
gatagacaatggaaacttag

SEQ ID NO: 385902 - DNA, 20 bp, Artificial Sequence
  chemically synthesized
aatgatagacaatggaaact

SEQ ID NO: 385903 - DNA, 20 bp, Artificial Sequence
  chemically synthesized
gagagtggaatgatagacaa

SEQ ID NO: 385904 - DNA, 20 bp, Artificial Sequence
  chemically synthesized
gtacacagagagtggaatga

SEQ ID NO: 385905 - DNA, 20 bp, Artificial Sequence
  chemically synthesized
gtacacatgtacacagagag

SEQ ID NO: 385906 - DNA, 20 bp, Artificial Sequence
  chemically synthesized
tgtgtacacatgtacacaga

SEQ ID NO: 385907 - DNA, 20 bp, Artificial Sequence
  chemically synthesized
aatgtgtacacatgtacaca

SEQ ID NO: 385908 - DNA, 20 bp, Artificial Sequence
  chemically synthesized
aaaatgtgtacacatgtaca

SEQ ID NO: 385909 - DNA, 20 bp, Artificial Sequence
  chemically synthesized
gtacatgtgtacacattttt

SEQ ID NO: 385910 - DNA, 20 bp, Artificial Sequence
  chemically synthesized
cattttttagcacacaatta

SEQ ID NO: 385911 - DNA, 20 bp, Artificial Sequence
  chemically synthesized
attttttagcacacaattat

SEQ ID NO: 385912 - DNA, 20 bp, Artificial Sequence
  chemically synthesized
tgaaatgaaccagacacaga

SEQ ID NO: 385913 - DNA, 20 bp, Artificial Sequence
  chemically synthesized
aatatttgactttctgtgtc

SEQ ID NO: 385914 - DNA, 20 bp, Artificial Sequence
  chemically synthesized
taagtgaaatgaaccagaca

SEQ ID NO: 385915 - DNA, 20 bp, Artificial Sequence
  chemically synthesized
ttattttaagtgaaatgaac

SEQ ID NO: 385916 - DNA, 20 bp, Artificial Sequence
  chemically synthesized
gacctggaggtcattatttt

SEQ ID NO: 385917 - DNA, 20 bp, Artificial Sequence
  chemically synthesized
tcacttaaaataatgacctc

SEQ ID NO: 385918 - DNA, 20 bp, Artificial Sequence
  chemically synthesized
cacttaaaataatgacctcc

SEQ ID NO: 385919 - DNA, 20 bp, Artificial Sequence
  chemically synthesized
gaagaaagtgttagacctgg

SEQ ID NO: 385920 - DNA, 20 bp, Artificial Sequence
  chemically synthesized
ggaagaaagtgttagacctg

SEQ ID NO: 385921 - DNA, 20 bp, Artificial Sequence
  chemically synthesized
caggaagaaagtgttagacc

SEQ ID NO: 385922 - DNA, 20 bp, Artificial Sequence
  chemically synthesized
agcatacaggaagaaagtgt

SEQ ID NO: 385923 - DNA, 20 bp, Artificial Sequence
  chemically synthesized
attttaagcatacaggaaga

SEQ ID NO: 385924 - DNA, 20 bp, Artificial Sequence
  chemically synthesized
cctaattttaagcatacagg

SEQ ID NO: 385925 - DNA, 20 bp, Artificial Sequence
  chemically synthesized
ttgcctaattttaagcatac

SEQ ID NO: 385926 - DNA, 20 bp, Artificial Sequence
  chemically synthesized
attgcctaattttaagcata

SEQ ID NO: 385927 - DNA, 20 bp, Artificial Sequence
  chemically synthesized
tcttcctgtatgcttaaaat

SEQ ID NO: 385928 - DNA, 20 bp, Artificial Sequence
  chemically synthesized
cttcctgtatgcttaaaatt

SEQ ID NO: 385929 - DNA, 20 bp, Artificial Sequence
  chemically synthesized
taaatgcattgcctaatttt

SEQ ID NO: 385930 - DNA, 20 bp, Artificial Sequence
  chemically synthesized
ttgaatcttacaaatcaatt

SEQ ID NO: 385931 - DNA, 20 bp, Artificial Sequence
  chemically synthesized
atttttctgaattgatttgt

SEQ ID NO: 385932 - DNA, 20 bp, Artificial Sequence
  chemically synthesized
tgatttgtaagattcaattt

SEQ ID NO: 385933 - DNA, 20 bp, Artificial Sequence
  chemically synthesized
aagattcaatttcagtttac

SEQ ID NO: 385934 - DNA, 20 bp, Artificial Sequence
  chemically synthesized
aaaatctgtacattaaaaac

SEQ ID NO: 385935 - DNA, 20 bp, Artificial Sequence
  chemically synthesized
gtttactggtttttaatgta

SEQ ID NO: 385936 - DNA, 20 bp, Artificial Sequence
  chemically synthesized
aatttaaaatggaaaacaca

SEQ ID NO: 385937 - DNA, 20 bp, Artificial Sequence
  chemically synthesized
taaaaacccaaaatttaaaa

SEQ ID NO: 385938 - DNA, 20 bp, Artificial Sequence
  chemically synthesized
gtgttttccattttaaattt

SEQ ID NO: 385939 - DNA, 20 bp, Artificial Sequence
  chemically synthesized
tgttttccattttaaatttt

SEQ ID NO: 385940 - DNA, 20 bp, Artificial Sequence
  chemically synthesized
tttttaaaatcatttctaca

SEQ ID NO: 385941 - DNA, 20 bp, Artificial Sequence
  chemically synthesized
ggcgatggtagagaactatg

SEQ ID NO: 385942 - DNA, 20 bp, Artificial Sequence
  chemically synthesized
tctacaatgaggcgatggta

SEQ ID NO: 385943 - DNA, 20 bp, Artificial Sequence
  chemically synthesized
tttctacaatgaggcgatgg

SEQ ID NO: 385944 - DNA, 20 bp, Artificial Sequence
  chemically synthesized
atatttctacaatgaggcga

SEQ ID NO: 385945 - DNA, 20 bp, Artificial Sequence
  chemically synthesized
tctctaccatcgcctcattg

SEQ ID NO: 385946 - DNA, 20 bp, Artificial Sequence
  chemically synthesized
aggtgaatatttctacaatg

SEQ ID NO: 385947 - DNA, 20 bp, Artificial Sequence
  chemically synthesized
taggtgaatatttctacaat

SEQ ID NO: 385948 - DNA, 20 bp, Artificial Sequence
  chemically synthesized
caaagaacaggaagaacgat

SEQ ID NO: 385949 - DNA, 20 bp, Artificial Sequence
  chemically synthesized
ccaaagaacaggaagaacga

SEQ ID NO: 385950 - DNA, 20 bp, Artificial Sequence
  chemically synthesized
taagaagcccaaagaacagg

SEQ ID NO: 385951 - DNA, 20 bp, Artificial Sequence
  chemically synthesized
ctatcgttcttcctgttctt

SEQ ID NO: 385952 - DNA, 20 bp, Artificial Sequence
  chemically synthesized
tatcgttcttcctgttcttt

SEQ ID NO: 385953 - DNA, 20 bp, Artificial Sequence
  chemically synthesized
gcttaagaagcccaaagaac

SEQ ID NO: 385954 - DNA, 20 bp, Artificial Sequence
  chemically synthesized
agcttaagaagcccaaagaa

SEQ ID NO: 385955 - DNA, 20 bp, Artificial Sequence
  chemically synthesized
aattaagcttaagaagccca

SEQ ID NO: 385956 - DNA, 20 bp, Artificial Sequence
  chemically synthesized
tcctgttctttgggcttctt

SEQ ID NO: 385957 - DNA, 20 bp, Artificial Sequence
  chemically synthesized
caatcataattaagcttaag

SEQ ID NO: 385958 - DNA, 20 bp, Artificial Sequence
  chemically synthesized
attcaatcataattaagctt

SEQ ID NO: 385959 - DNA, 20 bp, Artificial Sequence
  chemically synthesized
acaaatattcaatcataatt

SEQ ID NO: 385960 - DNA, 20 bp, Artificial Sequence
  chemically synthesized
ttatgattgaatatttgttc

SEQ ID NO: 385961 - DNA, 20 bp, Artificial Sequence
  chemically synthesized
tatgattgaatatttgttca

SEQ ID NO: 385962 - DNA, 20 bp, Artificial Sequence
  chemically synthesized
aaaccctgctttacacaatg

SEQ ID NO: 385963 - DNA, 20 bp, Artificial Sequence
  chemically synthesized
ttaattcactgcattgtgta

SEQ ID NO: 385964 - DNA, 20 bp, Artificial Sequence
  chemically synthesized
attcactgcattgtgtaaag

SEQ ID NO: 385965 - DNA, 20 bp, Artificial Sequence
  chemically synthesized
ttcactgcattgtgtaaagc

SEQ ID NO: 385966 - DNA, 20 bp, Artificial Sequence
  chemically synthesized
tcactgcattgtgtaaagca

SEQ ID NO: 385967 - DNA, 20 bp, Artificial Sequence
  chemically synthesized
gttttgataatcatgttaaa

SEQ ID NO: 385968 - DNA, 20 bp, Artificial Sequence
  chemically synthesized
ggttttgataatcatgttaa

SEQ ID NO: 385969 - DNA, 20 bp, Artificial Sequence
  chemically synthesized
gagatggactatgaaagaaa

SEQ ID NO: 385970 - DNA, 20 bp, Artificial Sequence
  chemically synthesized
tatcaaaaccatttctttca

SEQ ID NO: 385971 - DNA, 20 bp, Artificial Sequence
  chemically synthesized
tggatagagatggactatga

SEQ ID NO: 385972 - DNA, 20 bp, Artificial Sequence
  chemically synthesized
ttcaaatcagtggatagaga

SEQ ID NO: 385973 - DNA, 20 bp, Artificial Sequence
  chemically synthesized
gaatttcaaatcagtggata

SEQ ID NO: 385974 - DNA, 20 bp, Artificial Sequence
  chemically synthesized
tggaatttcaaatcagtgga

SEQ ID NO: 385975 - DNA, 20 bp, Artificial Sequence
  chemically synthesized
aaaatggaatttcaaatcag

SEQ ID NO: 385976 - DNA, 20 bp, Artificial Sequence
  chemically synthesized
ataaaaatggaatttcaaat

SEQ ID NO: 385977 - DNA, 20 bp, Artificial Sequence
  chemically synthesized
tcaagtgtatataataaaaa

SEQ ID NO: 385978 - DNA, 20 bp, Artificial Sequence
  chemically synthesized
catttttattatatacactt

SEQ ID NO: 385979 - DNA, 20 bp, Artificial Sequence
  chemically synthesized
gaaaatcccaaaatatgctc

SEQ ID NO: 385980 - DNA, 20 bp, Artificial Sequence
  chemically synthesized
atatacacttgagcatattt

SEQ ID NO: 385981 - DNA, 20 bp, Artificial Sequence
  chemically synthesized
tatacacttgagcatatttt

SEQ ID NO: 385982 - DNA, 20 bp, Artificial Sequence
  chemically synthesized
aacagattagtgaaacaaaa

SEQ ID NO: 385983 - DNA, 20 bp, Artificial Sequence
  chemically synthesized
caaacagattagtgaaacaa

SEQ ID NO: 385984 - DNA, 20 bp, Artificial Sequence
  chemically synthesized
aaaagtctatacaaacagat

SEQ ID NO: 385985 - DNA, 20 bp, Artificial Sequence
  chemically synthesized
gtttcactaatctgtttgta

SEQ ID NO: 385986 - DNA, 20 bp, Artificial Sequence
  chemically synthesized
ctactaaaagtctatacaaa

SEQ ID NO: 385987 - DNA, 20 bp, Artificial Sequence
  chemically synthesized
aatctgtttgtatagacttt

SEQ ID NO: 385988 - DNA, 20 bp, Artificial Sequence
  chemically synthesized
ctgtttgtatagacttttag

SEQ ID NO: 385989 - DNA, 20 bp, Artificial Sequence
  chemically synthesized
aaaaaaaaaaaatctactaa

SEQ ID NO: 385990 - DNA, 20 bp, Artificial Sequence
  chemically synthesized
attttttttttttttttata

SEQ ID NO: 385991 - DNA, 20 bp, Artificial Sequence
  chemically synthesized
tttttttttttttttataca

SEQ ID NO: 385992 - DNA, 20 bp, Artificial Sequence
  chemically synthesized
tccagcctgggcaacagagc

SEQ ID NO: 385993 - DNA, 20 bp, Artificial Sequence
  chemically synthesized
cagagtcttgctctgttgcc

SEQ ID NO: 385994 - DNA, 20 bp, Artificial Sequence
  chemically synthesized
gcactccagcctgggcaaca

SEQ ID NO: 385995 - DNA, 20 bp, Artificial Sequence
  chemically synthesized
agagtcttgctctgttgccc

SEQ ID NO: 385996 - DNA, 20 bp, Artificial Sequence
  chemically synthesized
ctgcactccagcctgggcaa

SEQ ID NO: 385997 - DNA, 20 bp, Artificial Sequence
  chemically synthesized
tcttgctctgttgcccaggc

SEQ ID NO: 385998 - DNA, 20 bp, Artificial Sequence
  chemically synthesized
ttgctctgttgcccaggctg

SEQ ID NO: 385999 - DNA, 20 bp, Artificial Sequence
  chemically synthesized
tcgccactgcactccagcct

SEQ ID NO: 386000 - DNA, 20 bp, Artificial Sequence
  chemically synthesized
ttcgccactgcactccagcc

SEQ ID NO: 386001 - DNA, 20 bp, Artificial Sequence
  chemically synthesized
ctgttgcccaggctggagtg

SEQ ID NO: 386002 - DNA, 20 bp, Artificial Sequence
  chemically synthesized
gagatttcgccactgcactc

SEQ ID NO: 386003 - DNA, 20 bp, Artificial Sequence
  chemically synthesized
ttgcccaggctggagtgcag

SEQ ID NO: 386004 - DNA, 20 bp, Artificial Sequence
  chemically synthesized
ggagtgcagtggcgaaatct

SEQ ID NO: 386005 - DNA, 20 bp, Artificial Sequence
  chemically synthesized
ggcagaggttgcagtgagct

SEQ ID NO: 386006 - DNA, 20 bp, Artificial Sequence
  chemically synthesized
agggaggcagaggttgcagt

SEQ ID NO: 386007 - DNA, 20 bp, Artificial Sequence
  chemically synthesized
atccagggaggcagaggttg

SEQ ID NO: 386008 - DNA, 20 bp, Artificial Sequence
  chemically synthesized
cgcttgatccagggaggcag

SEQ ID NO: 386009 - DNA, 20 bp, Artificial Sequence
  chemically synthesized
tcgcttgatccagggaggca

SEQ ID NO: 386010 - DNA, 20 bp, Artificial Sequence
  chemically synthesized
cactgcaacctctgcctccc

SEQ ID NO: 386011 - DNA, 20 bp, Artificial Sequence
  chemically synthesized
aatcgcttgatccagggagg

SEQ ID NO: 386012 - DNA, 20 bp, Artificial Sequence
  chemically synthesized
gagaatcgcttgatccaggg

SEQ ID NO: 386013 - DNA, 20 bp, Artificial Sequence
  chemically synthesized
ggagaatcgcttgatccagg

SEQ ID NO: 386014 - DNA, 20 bp, Artificial Sequence
  chemically synthesized
aacctctgcctccctggatc

SEQ ID NO: 386015 - DNA, 20 bp, Artificial Sequence
  chemically synthesized
caggagaatcgcttgatcca

SEQ ID NO: 386016 - DNA, 20 bp, Artificial Sequence
  chemically synthesized
gcaggagaatcgcttgatcc

SEQ ID NO: 386017 - DNA, 20 bp, Artificial Sequence
  chemically synthesized
ggcaggagaatcgcttgatc

SEQ ID NO: 386018 - DNA, 20 bp, Artificial Sequence
  chemically synthesized
atcaagcgattctcctgccg

SEQ ID NO: 386019 - DNA, 20 bp, Artificial Sequence
  chemically synthesized
tactcgggaggctgcggcag

SEQ ID NO: 386020 - DNA, 20 bp, Artificial Sequence
  chemically synthesized
gctactcgggaggctgcggc

SEQ ID NO: 386021 - DNA, 20 bp, Artificial Sequence
  chemically synthesized
agctactcgggaggctgcgg

SEQ ID NO: 386022 - DNA, 20 bp, Artificial Sequence
  chemically synthesized
cccagctactcgggaggctg

SEQ ID NO: 386023 - DNA, 20 bp, Artificial Sequence
  chemically synthesized
ttctcctgccgcagcctccc

SEQ ID NO: 386024 - DNA, 20 bp, Artificial Sequence
  chemically synthesized
tcctgccgcagcctcccgag

SEQ ID NO: 386025 - DNA, 20 bp, Artificial Sequence
  chemically synthesized
tgtaatcccagctactcggg

SEQ ID NO: 386026 - DNA, 20 bp, Artificial Sequence
  chemically synthesized
ctgtaatcccagctactcgg

SEQ ID NO: 386027 - DNA, 20 bp, Artificial Sequence
  chemically synthesized
gccgcagcctcccgagtagc

SEQ ID NO: 386028 - DNA, 20 bp, Artificial Sequence
  chemically synthesized
gcctgtaatcccagctactc

SEQ ID NO: 386029 - DNA, 20 bp, Artificial Sequence
  chemically synthesized
ccgcagcctcccgagtagct

SEQ ID NO: 386030 - DNA, 20 bp, Artificial Sequence
  chemically synthesized
cgcctgtaatcccagctact

SEQ ID NO: 386031 - DNA, 20 bp, Artificial Sequence
  chemically synthesized
ctcccgagtagctgggatta

SEQ ID NO: 386032 - DNA, 20 bp, Artificial Sequence
  chemically synthesized
tcccgagtagctgggattac

SEQ ID NO: 386033 - DNA, 20 bp, Artificial Sequence
  chemically synthesized
atggcaggcgcctgtaatcc

SEQ ID NO: 386034 - DNA, 20 bp, Artificial Sequence
  chemically synthesized
aattagccgggcatgatggc

SEQ ID NO: 386035 - DNA, 20 bp, Artificial Sequence
  chemically synthesized
aaattagccgggcatgatgg

SEQ ID NO: 386036 - DNA, 20 bp, Artificial Sequence
  chemically synthesized
caggcgcctgccatcatgcc

SEQ ID NO: 386037 - DNA, 20 bp, Artificial Sequence
  chemically synthesized
caaaaattagccgggcatga

SEQ ID NO: 386038 - DNA, 20 bp, Artificial Sequence
  chemically synthesized
taaaaatacaaaaattagcc

SEQ ID NO: 386039 - DNA, 20 bp, Artificial Sequence
  chemically synthesized
ttaaaaatacaaaaattagc

SEQ ID NO: 386040 - DNA, 20 bp, Artificial Sequence
  chemically synthesized
ctacttaaaaatacaaaaat

SEQ ID NO: 386041 - DNA, 20 bp, Artificial Sequence
  chemically synthesized
cggctaatttttgtattttt

SEQ ID NO: 386042 - DNA, 20 bp, Artificial Sequence
  chemically synthesized
ctaatttttgtatttttaag

SEQ ID NO: 386043 - DNA, 20 bp, Artificial Sequence
  chemically synthesized
aatttttgtatttttaagta

SEQ ID NO: 386044 - DNA, 20 bp, Artificial Sequence
  chemically synthesized
atttttgtatttttaagtag

SEQ ID NO: 386045 - DNA, 20 bp, Artificial Sequence
  chemically synthesized
ttgtatttttaagtagaggc

SEQ ID NO: 386046 - DNA, 20 bp, Artificial Sequence
  chemically synthesized
tgtatttttaagtagaggct

SEQ ID NO: 386047 - DNA, 20 bp, Artificial Sequence
  chemically synthesized
ctaaccaacatcgtgaaacc

SEQ ID NO: 386048 - DNA, 20 bp, Artificial Sequence
  chemically synthesized
gaggctgggtttcacgatgt

SEQ ID NO: 386049 - DNA, 20 bp, Artificial Sequence
  chemically synthesized
ctgggtttcacgatgttggt

SEQ ID NO: 386050 - DNA, 20 bp, Artificial Sequence
  chemically synthesized
tgggtttcacgatgttggtt

SEQ ID NO: 386051 - DNA, 20 bp, Artificial Sequence
  chemically synthesized
tttcacgatgttggttaggc

SEQ ID NO: 386052 - DNA, 20 bp, Artificial Sequence
  chemically synthesized
tgaggtcaggagttcgagac

SEQ ID NO: 386053 - DNA, 20 bp, Artificial Sequence
  chemically synthesized
tcacctgaggtcaggagttc

SEQ ID NO: 386054 - DNA, 20 bp, Artificial Sequence
  chemically synthesized
tggtctcgaactcctgacct

SEQ ID NO: 386055 - DNA, 20 bp, Artificial Sequence
  chemically synthesized
ggtggatcacctgaggtcag

SEQ ID NO: 386056 - DNA, 20 bp, Artificial Sequence
  chemically synthesized
ggtctcgaactcctgacctc

SEQ ID NO: 386057 - DNA, 20 bp, Artificial Sequence
  chemically synthesized
cgggtggatcacctgaggtc

SEQ ID NO: 386058 - DNA, 20 bp, Artificial Sequence
  chemically synthesized
gcgggtggatcacctgaggt

SEQ ID NO: 386059 - DNA, 20 bp, Artificial Sequence
  chemically synthesized
cgaggcgggtggatcacctg

SEQ ID NO: 386060 - DNA, 20 bp, Artificial Sequence
  chemically synthesized
ccgaggcgggtggatcacct

SEQ ID NO: 386061 - DNA, 20 bp, Artificial Sequence
  chemically synthesized
ctcaggtgatccacccgcct

SEQ ID NO: 386062 - DNA, 20 bp, Artificial Sequence
  chemically synthesized
ctttgcgaggccgaggcggg

SEQ ID NO: 386063 - DNA, 20 bp, Artificial Sequence
  chemically synthesized
gcactttgcgaggccgaggc

SEQ ID NO: 386064 - DNA, 20 bp, Artificial Sequence
  chemically synthesized
agcactttgcgaggccgagg

SEQ ID NO: 386065 - DNA, 20 bp, Artificial Sequence
  chemically synthesized
cccagcactttgcgaggccg

SEQ ID NO: 386066 - DNA, 20 bp, Artificial Sequence
  chemically synthesized
tcccagcactttgcgaggcc

SEQ ID NO: 386067 - DNA, 20 bp, Artificial Sequence
  chemically synthesized
ccacccgcctcggcctcgca

SEQ ID NO: 386068 - DNA, 20 bp, Artificial Sequence
  chemically synthesized
tgtaatcccagcactttgcg

SEQ ID NO: 386069 - DNA, 20 bp, Artificial Sequence
  chemically synthesized
ctgtaatcccagcactttgc

SEQ ID NO: 386070 - DNA, 20 bp, Artificial Sequence
  chemically synthesized
gcctcggcctcgcaaagtgc

SEQ ID NO: 386071 - DNA, 20 bp, Artificial Sequence
  chemically synthesized
cctcggcctcgcaaagtgct

SEQ ID NO: 386072 - DNA, 20 bp, Artificial Sequence
  chemically synthesized
ctcgcaaagtgctgggatta

SEQ ID NO: 386073 - DNA, 20 bp, Artificial Sequence
  chemically synthesized
tcgcaaagtgctgggattac

SEQ ID NO: 386074 - DNA, 20 bp, Artificial Sequence
  chemically synthesized
gtgtctcacgcctgtaatcc

SEQ ID NO: 386075 - DNA, 20 bp, Artificial Sequence
  chemically synthesized
agtgctgggattacaggcgt

SEQ ID NO: 386076 - DNA, 20 bp, Artificial Sequence
  chemically synthesized
caggcgtgagacaccgcacc

SEQ ID NO: 386077 - DNA, 20 bp, Artificial Sequence
  chemically synthesized
aaacttctactggctgggtg

SEQ ID NO: 386078 - DNA, 20 bp, Artificial Sequence
  chemically synthesized
cgtgagacaccgcacccagc

SEQ ID NO: 386079 - DNA, 20 bp, Artificial Sequence
  chemically synthesized
gagacaccgcacccagccag

SEQ ID NO: 386080 - DNA, 20 bp, Artificial Sequence
  chemically synthesized
taataaaacttctactggct

SEQ ID NO: 386081 - DNA, 20 bp, Artificial Sequence
  chemically synthesized
ttaataaaacttctactggc

SEQ ID NO: 386082 - DNA, 20 bp, Artificial Sequence
  chemically synthesized
acaccgcacccagccagtag

SEQ ID NO: 386083 - DNA, 20 bp, Artificial Sequence
  chemically synthesized
gtgtttaataaaacttctac

SEQ ID NO: 386084 - DNA, 20 bp, Artificial Sequence
  chemically synthesized
agttttattaaacactctaa

SEQ ID NO: 386085 - DNA, 20 bp, Artificial Sequence
  chemically synthesized
atttgcccatgtagctatta

SEQ ID NO: 386086 - DNA, 20 bp, Artificial Sequence
  chemically synthesized
tcatttgcccatgtagctat

SEQ ID NO: 386087 - DNA, 20 bp, Artificial Sequence
  chemically synthesized
taaacactctaatagctaca

SEQ ID NO: 386088 - DNA, 20 bp, Artificial Sequence
  chemically synthesized
aaacactctaatagctacat

SEQ ID NO: 386089 - DNA, 20 bp, Artificial Sequence
  chemically synthesized
tgaaaggtcatttgcccatg

SEQ ID NO: 386090 - DNA, 20 bp, Artificial Sequence
  chemically synthesized
gggcaaatgacctttcattt

SEQ ID NO: 386091 - DNA, 20 bp, Artificial Sequence
  chemically synthesized
tgttgaaaaccttaaatgaa

SEQ ID NO: 386092 - DNA, 20 bp, Artificial Sequence
  chemically synthesized
ggcaaatgacctttcattta

SEQ ID NO: 386093 - DNA, 20 bp, Artificial Sequence
  chemically synthesized
atgttgaaaaccttaaatga

SEQ ID NO: 386094 - DNA, 20 bp, Artificial Sequence
  chemically synthesized
gcaatatagatgaggattaa

SEQ ID NO: 386095 - DNA, 20 bp, Artificial Sequence
  chemically synthesized
atctggcagcaatatagatg

SEQ ID NO: 386096 - DNA, 20 bp, Artificial Sequence
  chemically synthesized
tatctggcagcaatatagat

SEQ ID NO: 386097 - DNA, 20 bp, Artificial Sequence
  chemically synthesized
aagtttatctggcagcaata

SEQ ID NO: 386098 - DNA, 20 bp, Artificial Sequence
  chemically synthesized
atcctcatctatattgctgc

SEQ ID NO: 386099 - DNA, 20 bp, Artificial Sequence
  chemically synthesized
ttactctaaagtttatctgg

SEQ ID NO: 386100 - DNA, 20 bp, Artificial Sequence
  chemically synthesized
gaattactctaaagtttatc

SEQ ID NO: 386101 - DNA, 20 bp, Artificial Sequence
  chemically synthesized
tattgctgccagataaactt

SEQ ID NO: 386102 - DNA, 20 bp, Artificial Sequence
  chemically synthesized
ttgctgccagataaacttta

SEQ ID NO: 386103 - DNA, 20 bp, Artificial Sequence
  chemically synthesized
atgtgacaagaattactcta

SEQ ID NO: 386104 - DNA, 20 bp, Artificial Sequence
  chemically synthesized
aggaagacattggatgtgac

SEQ ID NO: 386105 - DNA, 20 bp, Artificial Sequence
  chemically synthesized
ttggggtggcaggaagacat

SEQ ID NO: 386106 - DNA, 20 bp, Artificial Sequence
  chemically synthesized
atttaaattggggtggcagg

SEQ ID NO: 386107 - DNA, 20 bp, Artificial Sequence
  chemically synthesized
aaaatttaaattggggtggc

SEQ ID NO: 386108 - DNA, 20 bp, Artificial Sequence
  chemically synthesized
taaaatttaaattggggtgg

SEQ ID NO: 386109 - DNA, 20 bp, Artificial Sequence
  chemically synthesized
acataaaatttaaattgggg

SEQ ID NO: 386110 - DNA, 20 bp, Artificial Sequence
  chemically synthesized
aacacataaaatttaaattg

SEQ ID NO: 386111 - DNA, 20 bp, Artificial Sequence
  chemically synthesized
aaacacataaaatttaaatt

SEQ ID NO: 386112 - DNA, 20 bp, Artificial Sequence
  chemically synthesized
gaaacacataaaatttaaat

SEQ ID NO: 386113 - DNA, 20 bp, Artificial Sequence
  chemically synthesized
taaattttatgtgtttctat

SEQ ID NO: 386114 - DNA, 20 bp, Artificial Sequence
  chemically synthesized
caaattaagctaaaatctga

SEQ ID NO: 386115 - DNA, 20 bp, Artificial Sequence
  chemically synthesized
tatgtgtttctatcagattt

SEQ ID NO: 386116 - DNA, 20 bp, Artificial Sequence
  chemically synthesized
tcagattttagcttaatttg

SEQ ID NO: 386117 - DNA, 20 bp, Artificial Sequence
  chemically synthesized
catataatttactacaaatt

SEQ ID NO: 386118 - DNA, 20 bp, Artificial Sequence
  chemically synthesized
tggtgggaatattaatattt

SEQ ID NO: 386119 - DNA, 20 bp, Artificial Sequence
  chemically synthesized
aaaatattaatattcccacc

SEQ ID NO: 386120 - DNA, 20 bp, Artificial Sequence
  chemically synthesized
ataattttatatttcttggt

SEQ ID NO: 386121 - DNA, 20 bp, Artificial Sequence
  chemically synthesized
tataattttatatttcttgg

SEQ ID NO: 386122 - DNA, 20 bp, Artificial Sequence
  chemically synthesized
agatataattttatatttct

SEQ ID NO: 386123 - DNA, 20 bp, Artificial Sequence
  chemically synthesized
tataaaattatatctgtcca

SEQ ID NO: 386124 - DNA, 20 bp, Artificial Sequence
  chemically synthesized
agaatatttgcatccatgga

SEQ ID NO: 386125 - DNA, 20 bp, Artificial Sequence
  chemically synthesized
taacagaatatttgcatcca

SEQ ID NO: 386126 - DNA, 20 bp, Artificial Sequence
  chemically synthesized
agcctttactggaaaaataa

SEQ ID NO: 386127 - DNA, 20 bp, Artificial Sequence
  chemically synthesized
caaatattctgttatttttc

SEQ ID NO: 386128 - DNA, 20 bp, Artificial Sequence
  chemically synthesized
attctgttatttttccagta

SEQ ID NO: 386129 - DNA, 20 bp, Artificial Sequence
  chemically synthesized
ttctgttatttttccagtaa

SEQ ID NO: 386130 - DNA, 20 bp, Artificial Sequence
  chemically synthesized
ggtgatatacaagcctttac

SEQ ID NO: 386131 - DNA, 20 bp, Artificial Sequence
  chemically synthesized
catgaaatttggtgatatac

SEQ ID NO: 386132 - DNA, 20 bp, Artificial Sequence
  chemically synthesized
aatttatttagcatgaaatt

SEQ ID NO: 386133 - DNA, 20 bp, Artificial Sequence
  chemically synthesized
gaaattactgtgaatttatt

SEQ ID NO: 386134 - DNA, 20 bp, Artificial Sequence
  chemically synthesized
tttcatgctaaataaattca

SEQ ID NO: 386135 - DNA, 20 bp, Artificial Sequence
  chemically synthesized
tttcacattttgaacttctg

SEQ ID NO: 386136 - DNA, 20 bp, Artificial Sequence
  chemically synthesized
aaagctatcattttccacag

SEQ ID NO: 386137 - DNA, 20 bp, Artificial Sequence
  chemically synthesized
atcaaagctatcattttcca

SEQ ID NO: 386138 - DNA, 20 bp, Artificial Sequence
  chemically synthesized
tgaacttctgtggaaaatga

SEQ ID NO: 386139 - DNA, 20 bp, Artificial Sequence
  chemically synthesized
taacaacctattgaaaatca

SEQ ID NO: 386140 - DNA, 20 bp, Artificial Sequence
  chemically synthesized
atgatagctttgattttcaa

SEQ ID NO: 386141 - DNA, 20 bp, Artificial Sequence
  chemically synthesized
tgatagctttgattttcaat

SEQ ID NO: 386142 - DNA, 20 bp, Artificial Sequence
  chemically synthesized
gattttcaataggttgttaa

SEQ ID NO: 386143 - DNA, 20 bp, Artificial Sequence
  chemically synthesized
ttttcaataggttgttaaaa

SEQ ID NO: 386144 - DNA, 20 bp, Artificial Sequence
  chemically synthesized
taggttgttaaaagagaaat

SEQ ID NO: 386145 - DNA, 20 bp, Artificial Sequence
  chemically synthesized
ttaaaagagaaattagcatt

SEQ ID NO: 386146 - DNA, 20 bp, Artificial Sequence
  chemically synthesized
aattaatatttaattatttc

SEQ ID NO: 386147 - DNA, 20 bp, Artificial Sequence
  chemically synthesized
attaatatttaattatttct

SEQ ID NO: 386148 - DNA, 20 bp, Artificial Sequence
  chemically synthesized
cattaagaaaagaaaaaacc

SEQ ID NO: 386149 - DNA, 20 bp, Artificial Sequence
  chemically synthesized
gtcccaaagctcattaagaa

SEQ ID NO: 386150 - DNA, 20 bp, Artificial Sequence
  chemically synthesized
aggttttttcttttcttaat

SEQ ID NO: 386151 - DNA, 20 bp, Artificial Sequence
  chemically synthesized
aattagtcccaaagctcatt

SEQ ID NO: 386152 - DNA, 20 bp, Artificial Sequence
  chemically synthesized
tttcttttcttaatgagctt

SEQ ID NO: 386153 - DNA, 20 bp, Artificial Sequence
  chemically synthesized
ttcttttcttaatgagcttt

SEQ ID NO: 386154 - DNA, 20 bp, Artificial Sequence
  chemically synthesized
aatgggaaaaattagtccca

SEQ ID NO: 386155 - DNA, 20 bp, Artificial Sequence
  chemically synthesized
ttataactaatgggaaaaat

SEQ ID NO: 386156 - DNA, 20 bp, Artificial Sequence
  chemically synthesized
ttgggactaatttttcccat

SEQ ID NO: 386157 - DNA, 20 bp, Artificial Sequence
  chemically synthesized
tgacaactattataactaat

SEQ ID NO: 386158 - DNA, 20 bp, Artificial Sequence
  chemically synthesized
atgacaactattataactaa

SEQ ID NO: 386159 - DNA, 20 bp, Artificial Sequence
  chemically synthesized
atttttcccattagttataa

SEQ ID NO: 386160 - DNA, 20 bp, Artificial Sequence
  chemically synthesized
gttgtcattgttgatttact

SEQ ID NO: 386161 - DNA, 20 bp, Artificial Sequence
  chemically synthesized
ttgttgatttacttagtacc

SEQ ID NO: 386162 - DNA, 20 bp, Artificial Sequence
  chemically synthesized
gatattgtcaacttggtact

SEQ ID NO: 386163 - DNA, 20 bp, Artificial Sequence
  chemically synthesized
aatagatgatattgtcaact

SEQ ID NO: 386164 - DNA, 20 bp, Artificial Sequence
  chemically synthesized
agtcaaattattcatattaa

SEQ ID NO: 386165 - DNA, 20 bp, Artificial Sequence
  chemically synthesized
agtataagtattggggaaaa

SEQ ID NO: 386166 - DNA, 20 bp, Artificial Sequence
  chemically synthesized
aacaggaagtataagtattg

SEQ ID NO: 386167 - DNA, 20 bp, Artificial Sequence
  chemically synthesized
aaacaggaagtataagtatt

SEQ ID NO: 386168 - DNA, 20 bp, Artificial Sequence
  chemically synthesized
gaaacaggaagtataagtat

SEQ ID NO: 386169 - DNA, 20 bp, Artificial Sequence
  chemically synthesized
gtaaaagaaacaggaagtat

SEQ ID NO: 386170 - DNA, 20 bp, Artificial Sequence
  chemically synthesized
agccaagtaaaagaaacagg

SEQ ID NO: 386171 - DNA, 20 bp, Artificial Sequence
  chemically synthesized
agaagccaagtaaaagaaac

SEQ ID NO: 386172 - DNA, 20 bp, Artificial Sequence
  chemically synthesized
aagaagccaagtaaaagaaa

SEQ ID NO: 386173 - DNA, 20 bp, Artificial Sequence
  chemically synthesized
tacttcctgtttcttttact

SEQ ID NO: 386174 - DNA, 20 bp, Artificial Sequence
  chemically synthesized
cagtgaaagaagccaagtaa

SEQ ID NO: 386175 - DNA, 20 bp, Artificial Sequence
  chemically synthesized
tctagtcagtgaaagaagcc

SEQ ID NO: 386176 - DNA, 20 bp, Artificial Sequence
  chemically synthesized
catattctagtcagtgaaag

SEQ ID NO: 386177 - DNA, 20 bp, Artificial Sequence
  chemically synthesized
ttgcatattctagtcagtga

SEQ ID NO: 386178 - DNA, 20 bp, Artificial Sequence
  chemically synthesized
acttggcttctttcactgac

SEQ ID NO: 386179 - DNA, 20 bp, Artificial Sequence
  chemically synthesized
gctattttgcatattctagt

SEQ ID NO: 386180 - DNA, 20 bp, Artificial Sequence
  chemically synthesized
aaatgctattttgcatattc

SEQ ID NO: 386181 - DNA, 20 bp, Artificial Sequence
  chemically synthesized
actgactagaatatgcaaaa

SEQ ID NO: 386182 - DNA, 20 bp, Artificial Sequence
  chemically synthesized
tatgcaaaatagcatttaaa

SEQ ID NO: 386183 - DNA, 20 bp, Artificial Sequence
  chemically synthesized
tgcaaaatagcatttaaaaa

SEQ ID NO: 386184 - DNA, 20 bp, Artificial Sequence
  chemically synthesized
aaaatagcatttaaaaagag

SEQ ID NO: 386185 - DNA, 20 bp, Artificial Sequence
  chemically synthesized
gcatttaaaaagagcagttt

SEQ ID NO: 386186 - DNA, 20 bp, Artificial Sequence
  chemically synthesized
tttaaaaagagcagttttgg

SEQ ID NO: 386187 - DNA, 20 bp, Artificial Sequence
  chemically synthesized
agcagttttggtagtcattc

SEQ ID NO: 386188 - DNA, 20 bp, Artificial Sequence
  chemically synthesized
attaaaattagaaatataac

SEQ ID NO: 386189 - DNA, 20 bp, Artificial Sequence
  chemically synthesized
gaaggtatcctcattaaaat

SEQ ID NO: 386190 - DNA, 20 bp, Artificial Sequence
  chemically synthesized
gttatatttctaattttaat

SEQ ID NO: 386191 - DNA, 20 bp, Artificial Sequence
  chemically synthesized
ttatatttctaattttaatg

SEQ ID NO: 386192 - DNA, 20 bp, Artificial Sequence
  chemically synthesized
gatcaatgttgaaatattga

SEQ ID NO: 386193 - DNA, 20 bp, Artificial Sequence
  chemically synthesized
tgatcaatgttgaaatattg

SEQ ID NO: 386194 - DNA, 20 bp, Artificial Sequence
  chemically synthesized
caatatttcaacattgatca

SEQ ID NO: 386195 - DNA, 20 bp, Artificial Sequence
  chemically synthesized
atatttcaacattgatcaca

SEQ ID NO: 386196 - DNA, 20 bp, Artificial Sequence
  chemically synthesized
ttcaacattgatcacagagt

SEQ ID NO: 386197 - DNA, 20 bp, Artificial Sequence
  chemically synthesized
acagagttggctcttgtttt

SEQ ID NO: 386198 - DNA, 20 bp, Artificial Sequence
  chemically synthesized
tattgtctatctcaaaacaa

SEQ ID NO: 386199 - DNA, 20 bp, Artificial Sequence
  chemically synthesized
aatattgtctatctcaaaac

SEQ ID NO: 386200 - DNA, 20 bp, Artificial Sequence
  chemically synthesized
agttggctcttgttttgaga

SEQ ID NO: 386201 - DNA, 20 bp, Artificial Sequence
  chemically synthesized
aagaatagatgatagtttat

SEQ ID NO: 386202 - DNA, 20 bp, Artificial Sequence
  chemically synthesized
agcaatgtaagaatagatga

SEQ ID NO: 386203 - DNA, 20 bp, Artificial Sequence
  chemically synthesized
aacttttagcaatgtaagaa

SEQ ID NO: 386204 - DNA, 20 bp, Artificial Sequence
  chemically synthesized
aacaaaacttttagcaatgt

SEQ ID NO: 386205 - DNA, 20 bp, Artificial Sequence
  chemically synthesized
atctattcttacattgctaa

SEQ ID NO: 386206 - DNA, 20 bp, Artificial Sequence
  chemically synthesized
aggagtagaaacaaaacttt

SEQ ID NO: 386207 - DNA, 20 bp, Artificial Sequence
  chemically synthesized
atctgtccctaatttaggag

SEQ ID NO: 386208 - DNA, 20 bp, Artificial Sequence
  chemically synthesized
ttttgtttctactcctaaat

SEQ ID NO: 386209 - DNA, 20 bp, Artificial Sequence
  chemically synthesized
tttgtttctactcctaaatt

SEQ ID NO: 386210 - DNA, 20 bp, Artificial Sequence
  chemically synthesized
agaatctgtccctaatttag

SEQ ID NO: 386211 - DNA, 20 bp, Artificial Sequence
  chemically synthesized
ttgtttctactcctaaatta

SEQ ID NO: 386212 - DNA, 20 bp, Artificial Sequence
  chemically synthesized
aaagaatctgtccctaattt

SEQ ID NO: 386213 - DNA, 20 bp, Artificial Sequence
  chemically synthesized
aaaagaatctgtccctaatt

SEQ ID NO: 386214 - DNA, 20 bp, Artificial Sequence
  chemically synthesized
ttctactcctaaattaggga

SEQ ID NO: 386215 - DNA, 20 bp, Artificial Sequence
  chemically synthesized
aaaaagtattgataaatgaa

SEQ ID NO: 386216 - DNA, 20 bp, Artificial Sequence
  chemically synthesized
aatactttttagttatgaaa

SEQ ID NO: 386217 - DNA, 20 bp, Artificial Sequence
  chemically synthesized
aatactttttcataactaaa

SEQ ID NO: 386218 - DNA, 20 bp, Artificial Sequence
  chemically synthesized
aaaaaatatacaatactttt

SEQ ID NO: 386219 - DNA, 20 bp, Artificial Sequence
  chemically synthesized
cattgtaggtaaagatcaga

SEQ ID NO: 386220 - DNA, 20 bp, Artificial Sequence
  chemically synthesized
tcattgtaggtaaagatcag

SEQ ID NO: 386221 - DNA, 20 bp, Artificial Sequence
  chemically synthesized
ccttcattgtaggtaaagat

SEQ ID NO: 386222 - DNA, 20 bp, Artificial Sequence
  chemically synthesized
tacatccttcattgtaggta

SEQ ID NO: 386223 - DNA, 20 bp, Artificial Sequence
  chemically synthesized
tctgatctttacctacaatg

SEQ ID NO: 386224 - DNA, 20 bp, Artificial Sequence
  chemically synthesized
ctgatctttacctacaatga

SEQ ID NO: 386225 - DNA, 20 bp, Artificial Sequence
  chemically synthesized
ctatttacatccttcattgt

SEQ ID NO: 386226 - DNA, 20 bp, Artificial Sequence
  chemically synthesized
tctatttacatccttcattg

SEQ ID NO: 386227 - DNA, 20 bp, Artificial Sequence
  chemically synthesized
cctacaatgaaggatgtaaa

SEQ ID NO: 386228 - DNA, 20 bp, Artificial Sequence
  chemically synthesized
gatgtaaatagattctctta

SEQ ID NO: 386229 - DNA, 20 bp, Artificial Sequence
  chemically synthesized
gtaaatagattctcttatag

SEQ ID NO: 386230 - DNA, 20 bp, Artificial Sequence
  chemically synthesized
taaatagattctcttatagt

SEQ ID NO: 386231 - DNA, 20 bp, Artificial Sequence
  chemically synthesized
aacatatatgcctactataa

SEQ ID NO: 386232 - DNA, 20 bp, Artificial Sequence
  chemically synthesized
aaaacatatatgcctactat

SEQ ID NO: 386233 - DNA, 20 bp, Artificial Sequence
  chemically synthesized
tgccaaattggatttatttc

SEQ ID NO: 386234 - DNA, 20 bp, Artificial Sequence
  chemically synthesized
atgccaaattggatttattt

SEQ ID NO: 386235 - DNA, 20 bp, Artificial Sequence
  chemically synthesized
ttcctgaaataaatccaatt

SEQ ID NO: 386236 - DNA, 20 bp, Artificial Sequence
  chemically synthesized
aagaagttatcatgccaaat

SEQ ID NO: 386237 - DNA, 20 bp, Artificial Sequence
  chemically synthesized
gatttagccaataagagaag

SEQ ID NO: 386238 - DNA, 20 bp, Artificial Sequence
  chemically synthesized
atgataacttcttctcttat

SEQ ID NO: 386239 - DNA, 20 bp, Artificial Sequence
  chemically synthesized
gcagatttagccaataagag

SEQ ID NO: 386240 - DNA, 20 bp, Artificial Sequence
  chemically synthesized
atagcagatttagccaataa

SEQ ID NO: 386241 - DNA, 20 bp, Artificial Sequence
  chemically synthesized
acatagcagatttagccaat

SEQ ID NO: 386242 - DNA, 20 bp, Artificial Sequence
  chemically synthesized
cttataaaacatagcagatt

SEQ ID NO: 386243 - DNA, 20 bp, Artificial Sequence
  chemically synthesized
tcaaatcttataaaacatag

SEQ ID NO: 386244 - DNA, 20 bp, Artificial Sequence
  chemically synthesized
cgttcaaatcttataaaaca

SEQ ID NO: 386245 - DNA, 20 bp, Artificial Sequence
  chemically synthesized
ctaaatctgctatgttttat

SEQ ID NO: 386246 - DNA, 20 bp, Artificial Sequence
  chemically synthesized
atttgaacgtctgtattcct

SEQ ID NO: 386247 - DNA, 20 bp, Artificial Sequence
  chemically synthesized
atcaaccaatctcaggaata

SEQ ID NO: 386248 - DNA, 20 bp, Artificial Sequence
  chemically synthesized
aacgtctgtattcctgagat

SEQ ID NO: 386249 - DNA, 20 bp, Artificial Sequence
  chemically synthesized
gaaaactatcaaccaatctc

SEQ ID NO: 386250 - DNA, 20 bp, Artificial Sequence
  chemically synthesized
tgaaaactatcaaccaatct

SEQ ID NO: 386251 - DNA, 20 bp, Artificial Sequence
  chemically synthesized
gtattcctgagattggttga

SEQ ID NO: 386252 - DNA, 20 bp, Artificial Sequence
  chemically synthesized
attatgagacttcaaaaaaa

SEQ ID NO: 386253 - DNA, 20 bp, Artificial Sequence
  chemically synthesized
atgtgtatgctatttttttg

SEQ ID NO: 386254 - DNA, 20 bp, Artificial Sequence
  chemically synthesized
ttttttgaagtctcataatc

SEQ ID NO: 386255 - DNA, 20 bp, Artificial Sequence
  chemically synthesized
gcccttataatcttgattat

SEQ ID NO: 386256 - DNA, 20 bp, Artificial Sequence
  chemically synthesized
agtctcataatcaagattat

SEQ ID NO: 386257 - DNA, 20 bp, Artificial Sequence
  chemically synthesized
gtctcataatcaagattata

SEQ ID NO: 386258 - DNA, 20 bp, Artificial Sequence
  chemically synthesized
tctcataatcaagattataa

SEQ ID NO: 386259 - DNA, 20 bp, Artificial Sequence
  chemically synthesized
aatcaagattataagggctt

SEQ ID NO: 386260 - DNA, 20 bp, Artificial Sequence
  chemically synthesized
acctctatgttcatgttcta

SEQ ID NO: 386261 - DNA, 20 bp, Artificial Sequence
  chemically synthesized
agggctttagaacatgaaca

SEQ ID NO: 386262 - DNA, 20 bp, Artificial Sequence
  chemically synthesized
ggctttagaacatgaacata

SEQ ID NO: 386263 - DNA, 20 bp, Artificial Sequence
  chemically synthesized
gctttagaacatgaacatag

SEQ ID NO: 386264 - DNA, 20 bp, Artificial Sequence
  chemically synthesized
aggtttaaatactattttca

SEQ ID NO: 386265 - DNA, 20 bp, Artificial Sequence
  chemically synthesized
aaaattccaaaccatgaaaa

SEQ ID NO: 386266 - DNA, 20 bp, Artificial Sequence
  chemically synthesized
taaatactattttcatggtt

SEQ ID NO: 386267 - DNA, 20 bp, Artificial Sequence
  chemically synthesized
atggtttggaattttgtaaa

SEQ ID NO: 386268 - DNA, 20 bp, Artificial Sequence
  chemically synthesized
gtaaacagataattcatact

SEQ ID NO: 386269 - DNA, 20 bp, Artificial Sequence
  chemically synthesized
agaaatgctttcaaacaact

SEQ ID NO: 386270 - DNA, 20 bp, Artificial Sequence
  chemically synthesized
attcatacttagttgtttga

SEQ ID NO: 386271 - DNA, 20 bp, Artificial Sequence
  chemically synthesized
tttgaaagcatttctcaata

SEQ ID NO: 386272 - DNA, 20 bp, Artificial Sequence
  chemically synthesized
aacttcaaaaatactatatt

SEQ ID NO: 386273 - DNA, 20 bp, Artificial Sequence
  chemically synthesized
ttctcaatatagtatttttg

SEQ ID NO: 386274 - DNA, 20 bp, Artificial Sequence
  chemically synthesized
aaacctttaaaaagcagtac

SEQ ID NO: 386275 - DNA, 20 bp, Artificial Sequence
  chemically synthesized
atttcttgtactgcttttta

SEQ ID NO: 386276 - DNA, 20 bp, Artificial Sequence
  chemically synthesized
tgtaagaaacctttaaaaag

SEQ ID NO: 386277 - DNA, 20 bp, Artificial Sequence
  chemically synthesized
tttcttgtactgctttttaa

SEQ ID NO: 386278 - DNA, 20 bp, Artificial Sequence
  chemically synthesized
ttctgtaagaaacctttaaa

SEQ ID NO: 386279 - DNA, 20 bp, Artificial Sequence
  chemically synthesized
tgctttttaaaggtttctta

SEQ ID NO: 386280 - DNA, 20 bp, Artificial Sequence
  chemically synthesized
aactaaacatttgattctgt

SEQ ID NO: 386281 - DNA, 20 bp, Artificial Sequence
  chemically synthesized
ttcttacagaatcaaatgtt

SEQ ID NO: 386282 - DNA, 20 bp, Artificial Sequence
  chemically synthesized
tgagattaaagggaaaataa

SEQ ID NO: 386283 - DNA, 20 bp, Artificial Sequence
  chemically synthesized
tttgagattaaagggaaaat

SEQ ID NO: 386284 - DNA, 20 bp, Artificial Sequence
  chemically synthesized
tttttatatttgagattaaa

SEQ ID NO: 386285 - DNA, 20 bp, Artificial Sequence
  chemically synthesized
ttttttatatttgagattaa

SEQ ID NO: 386286 - DNA, 20 bp, Artificial Sequence
  chemically synthesized
tttttttatatttgagatta

SEQ ID NO: 386287 - DNA, 20 bp, Artificial Sequence
  chemically synthesized
gccttaatttttttatattt

SEQ ID NO: 386288 - DNA, 20 bp, Artificial Sequence
  chemically synthesized
atctcaaatataaaaaaatt

SEQ ID NO: 386289 - DNA, 20 bp, Artificial Sequence
  chemically synthesized
tctcaaatataaaaaaatta

SEQ ID NO: 386290 - DNA, 20 bp, Artificial Sequence
  chemically synthesized
ctgtaatcaaagaaaattaa

SEQ ID NO: 386291 - DNA, 20 bp, Artificial Sequence
  chemically synthesized
ctattaattttctttgatta

SEQ ID NO: 386292 - DNA, 20 bp, Artificial Sequence
  chemically synthesized
taagaacaaagctgtaatca

SEQ ID NO: 386293 - DNA, 20 bp, Artificial Sequence
  chemically synthesized
aaacttctggaataagaaca

SEQ ID NO: 386294 - DNA, 20 bp, Artificial Sequence
  chemically synthesized
ttacagctttgttcttattc

SEQ ID NO: 386295 - DNA, 20 bp, Artificial Sequence
  chemically synthesized
cagctttgttcttattccag

SEQ ID NO: 386296 - DNA, 20 bp, Artificial Sequence
  chemically synthesized
cacatgaaaacttctggaat

SEQ ID NO: 386297 - DNA, 20 bp, Artificial Sequence
  chemically synthesized
aaaatacacatgaaaacttc

SEQ ID NO: 386298 - DNA, 20 bp, Artificial Sequence
  chemically synthesized
catttaaaaattaatgaata

SEQ ID NO: 386299 - DNA, 20 bp, Artificial Sequence
  chemically synthesized
ccatttaaaaattaatgaat

SEQ ID NO: 386300 - DNA, 20 bp, Artificial Sequence
  chemically synthesized
cttattcattaatttttaaa

SEQ ID NO: 386301 - DNA, 20 bp, Artificial Sequence
  chemically synthesized
ccttgaaccaaaaaaaaagt

SEQ ID NO: 386302 - DNA, 20 bp, Artificial Sequence
  chemically synthesized
tccttgaaccaaaaaaaaag

SEQ ID NO: 386303 - DNA, 20 bp, Artificial Sequence
  chemically synthesized
taaatggcctactttttttt

SEQ ID NO: 386304 - DNA, 20 bp, Artificial Sequence
  chemically synthesized
ctttccttgaaccaaaaaaa

SEQ ID NO: 386305 - DNA, 20 bp, Artificial Sequence
  chemically synthesized
gcctactttttttttggttc

SEQ ID NO: 386306 - DNA, 20 bp, Artificial Sequence
  chemically synthesized
cctactttttttttggttca

SEQ ID NO: 386307 - DNA, 20 bp, Artificial Sequence
  chemically synthesized
ctttttttttggttcaagga

SEQ ID NO: 386308 - DNA, 20 bp, Artificial Sequence
  chemically synthesized
ttgtaacaggagagaaaaag

SEQ ID NO: 386309 - DNA, 20 bp, Artificial Sequence
  chemically synthesized
tttttgtaacaggagagaaa

SEQ ID NO: 386310 - DNA, 20 bp, Artificial Sequence
  chemically synthesized
acattgtttttgtaacagga

SEQ ID NO: 386311 - DNA, 20 bp, Artificial Sequence
  chemically synthesized
atacattgtttttgtaacag

SEQ ID NO: 386312 - DNA, 20 bp, Artificial Sequence
  chemically synthesized
acatacattgtttttgtaac

SEQ ID NO: 386313 - DNA, 20 bp, Artificial Sequence
  chemically synthesized
aacatacattgtttttgtaa

SEQ ID NO: 386314 - DNA, 20 bp, Artificial Sequence
  chemically synthesized
caatgtatgtttaccataaa

SEQ ID NO: 386315 - DNA, 20 bp, Artificial Sequence
  chemically synthesized
gttattgttgtatcttttta

SEQ ID NO: 386316 - DNA, 20 bp, Artificial Sequence
  chemically synthesized
aagatacaacaataactatt

SEQ ID NO: 386317 - DNA, 20 bp, Artificial Sequence
  chemically synthesized
acaacaataactattaagaa

SEQ ID NO: 386318 - DNA, 20 bp, Artificial Sequence
  chemically synthesized
gttatctgtacttttcttaa

SEQ ID NO: 386319 - DNA, 20 bp, Artificial Sequence
  chemically synthesized
aataactattaagaaaagta

SEQ ID NO: 386320 - DNA, 20 bp, Artificial Sequence
  chemically synthesized
gtgctgcttaatgaaaaaat

SEQ ID NO: 386321 - DNA, 20 bp, Artificial Sequence
  chemically synthesized
agataactcattttttcatt

SEQ ID NO: 386322 - DNA, 20 bp, Artificial Sequence
  chemically synthesized
taactcattttttcattaag

SEQ ID NO: 386323 - DNA, 20 bp, Artificial Sequence
  chemically synthesized
agacaacaggatgttagcag

SEQ ID NO: 386324 - DNA, 20 bp, Artificial Sequence
  chemically synthesized
agtagacaacaggatgttag

SEQ ID NO: 386325 - DNA, 20 bp, Artificial Sequence
  chemically synthesized
cagagtagacaacaggatgt

SEQ ID NO: 386326 - DNA, 20 bp, Artificial Sequence
  chemically synthesized
aaacactcagagtagacaac

SEQ ID NO: 386327 - DNA, 20 bp, Artificial Sequence
  chemically synthesized
aaaacactcagagtagacaa

SEQ ID NO: 386328 - DNA, 20 bp, Artificial Sequence
  chemically synthesized
aacatcctgttgtctactct

SEQ ID NO: 386329 - DNA, 20 bp, Artificial Sequence
  chemically synthesized
atacagaaaaacactcagag

SEQ ID NO: 386330 - DNA, 20 bp, Artificial Sequence
  chemically synthesized
gatatacagaaaaacactca

SEQ ID NO: 386331 - DNA, 20 bp, Artificial Sequence
  chemically synthesized
cagatatacagaaaaacact

SEQ ID NO: 386332 - DNA, 20 bp, Artificial Sequence
  chemically synthesized
gatttttatagacagatata

SEQ ID NO: 386333 - DNA, 20 bp, Artificial Sequence
  chemically synthesized
ttacgttagatttttataga

SEQ ID NO: 386334 - DNA, 20 bp, Artificial Sequence
  chemically synthesized
gaatttacgttagattttta

SEQ ID NO: 386335 - DNA, 20 bp, Artificial Sequence
  chemically synthesized
atcggacattgaatttacgt

SEQ ID NO: 386336 - DNA, 20 bp, Artificial Sequence
  chemically synthesized
tttttagataatacaggaat

SEQ ID NO: 386337 - DNA, 20 bp, Artificial Sequence
  chemically synthesized
atataatttttagataatac

SEQ ID NO: 386338 - DNA, 20 bp, Artificial Sequence
  chemically synthesized
gatataatttttagataata

SEQ ID NO: 386339 - DNA, 20 bp, Artificial Sequence
  chemically synthesized
agatcatatgatataatttt

SEQ ID NO: 386340 - DNA, 20 bp, Artificial Sequence
  chemically synthesized
aaataggaaaagatgattag

SEQ ID NO: 386341 - DNA, 20 bp, Artificial Sequence
  chemically synthesized
aacaaataggaaaagatgat

SEQ ID NO: 386342 - DNA, 20 bp, Artificial Sequence
  chemically synthesized
caatttaaaacaaataggaa

SEQ ID NO: 386343 - DNA, 20 bp, Artificial Sequence
  chemically synthesized
gcaagcaatttaaaacaaat

SEQ ID NO: 386344 - DNA, 20 bp, Artificial Sequence
  chemically synthesized
agcaagcaatttaaaacaaa

SEQ ID NO: 386345 - DNA, 20 bp, Artificial Sequence
  chemically synthesized
atttgttttaaattgcttgc

SEQ ID NO: 386346 - DNA, 20 bp, Artificial Sequence
  chemically synthesized
tgtaatgtaacaaaaccagc

SEQ ID NO: 386347 - DNA, 20 bp, Artificial Sequence
  chemically synthesized
aaaatgtaatgtaacaaaac

SEQ ID NO: 386348 - DNA, 20 bp, Artificial Sequence
  chemically synthesized
tgttacattacatttttttc

SEQ ID NO: 386349 - DNA, 20 bp, Artificial Sequence
  chemically synthesized
ctgttttgttataaaatgtc

SEQ ID NO: 386350 - DNA, 20 bp, Artificial Sequence
  chemically synthesized
ctagacattttataacaaaa

SEQ ID NO: 386351 - DNA, 20 bp, Artificial Sequence
  chemically synthesized
gttgcaaacatatgtttatg

SEQ ID NO: 386352 - DNA, 20 bp, Artificial Sequence
  chemically synthesized
aaaaaaatgtcaacgaagca

SEQ ID NO: 386353 - DNA, 20 bp, Artificial Sequence
  chemically synthesized
aaaaaaaatgtcaacgaagc

SEQ ID NO: 386354 - DNA, 20 bp, Artificial Sequence
  chemically synthesized
gaaaaaaaatgtcaacgaag

SEQ ID NO: 386355 - DNA, 20 bp, Artificial Sequence
  chemically synthesized
caagaaaaaaaatgtcaacg

SEQ ID NO: 386356 - DNA, 20 bp, Artificial Sequence
  chemically synthesized
cattttttttcttgttcata

SEQ ID NO: 386357 - DNA, 20 bp, Artificial Sequence
  chemically synthesized
gaaaatccagccatatgaac

SEQ ID NO: 386358 - DNA, 20 bp, Artificial Sequence
  chemically synthesized
ttttttcttgttcatatggc

SEQ ID NO: 386359 - DNA, 20 bp, Artificial Sequence
  chemically synthesized
ccgtaaattcaaagaaaatc

SEQ ID NO: 386360 - DNA, 20 bp, Artificial Sequence
  chemically synthesized
tacaaaagcccgtaaattca

SEQ ID NO: 386361 - DNA, 20 bp, Artificial Sequence
  chemically synthesized
ctggattttctttgaattta

SEQ ID NO: 386362 - DNA, 20 bp, Artificial Sequence
  chemically synthesized
tggattttctttgaatttac

SEQ ID NO: 386363 - DNA, 20 bp, Artificial Sequence
  chemically synthesized
tgaatttacgggcttttgta

SEQ ID NO: 386364 - DNA, 20 bp, Artificial Sequence
  chemically synthesized
gaatttacgggcttttgtat

SEQ ID NO: 386365 - DNA, 20 bp, Artificial Sequence
  chemically synthesized
atatagcagctcccatacaa

SEQ ID NO: 386366 - DNA, 20 bp, Artificial Sequence
  chemically synthesized
atttacgggcttttgtatgg

SEQ ID NO: 386367 - DNA, 20 bp, Artificial Sequence
  chemically synthesized
tgaacttgtaaacaatatag

SEQ ID NO: 386368 - DNA, 20 bp, Artificial Sequence
  chemically synthesized
cattgaacttgtaaacaata

SEQ ID NO: 386369 - DNA, 20 bp, Artificial Sequence
  chemically synthesized
ggagctgctatattgtttac

SEQ ID NO: 386370 - DNA, 20 bp, Artificial Sequence
  chemically synthesized
tatattgtttacaagttcaa

SEQ ID NO: 386371 - DNA, 20 bp, Artificial Sequence
  chemically synthesized
taatgcacaggaaaggttgc

SEQ ID NO: 386372 - DNA, 20 bp, Artificial Sequence
  chemically synthesized
gtgactataatgcacaggaa

SEQ ID NO: 386373 - DNA, 20 bp, Artificial Sequence
  chemically synthesized
ggtgactataatgcacagga

SEQ ID NO: 386374 - DNA, 20 bp, Artificial Sequence
  chemically synthesized
cccaggtgactataatgcac

SEQ ID NO: 386375 - DNA, 20 bp, Artificial Sequence
  chemically synthesized
gcaacctttcctgtgcatta

SEQ ID NO: 386376 - DNA, 20 bp, Artificial Sequence
  chemically synthesized
ccccaggtgactataatgca

SEQ ID NO: 386377 - DNA, 20 bp, Artificial Sequence
  chemically synthesized
tcctgtgcattatagtcacc

SEQ ID NO: 386378 - DNA, 20 bp, Artificial Sequence
  chemically synthesized
cctgtgcattatagtcacct

SEQ ID NO: 386379 - DNA, 20 bp, Artificial Sequence
  chemically synthesized
ctgtgcattatagtcacctg

SEQ ID NO: 386380 - DNA, 20 bp, Artificial Sequence
  chemically synthesized
gtgcattatagtcacctggg

SEQ ID NO: 386381 - DNA, 20 bp, Artificial Sequence
  chemically synthesized
gggctgtttaaaagctcccc

SEQ ID NO: 386382 - DNA, 20 bp, Artificial Sequence
  chemically synthesized
tgggctgtttaaaagctccc

SEQ ID NO: 386383 - DNA, 20 bp, Artificial Sequence
  chemically synthesized
tcacctggggagcttttaaa

SEQ ID NO: 386384 - DNA, 20 bp, Artificial Sequence
  chemically synthesized
ctagtcactgggctgtttaa

SEQ ID NO: 386385 - DNA, 20 bp, Artificial Sequence
  chemically synthesized
tggggagcttttaaacagcc

SEQ ID NO: 386386 - DNA, 20 bp, Artificial Sequence
  chemically synthesized
cttttaaacagcccagtgac

SEQ ID NO: 386387 - DNA, 20 bp, Artificial Sequence
  chemically synthesized
ttttaaacagcccagtgact

SEQ ID NO: 386388 - DNA, 20 bp, Artificial Sequence
  chemically synthesized
taggtggcaacctagtcact

SEQ ID NO: 386389 - DNA, 20 bp, Artificial Sequence
  chemically synthesized
ttaggtggcaacctagtcac

SEQ ID NO: 386390 - DNA, 20 bp, Artificial Sequence
  chemically synthesized
aattggtttaggtggcaacc

SEQ ID NO: 386391 - DNA, 20 bp, Artificial Sequence
  chemically synthesized
tctaatttaattggtttagg

SEQ ID NO: 386392 - DNA, 20 bp, Artificial Sequence
  chemically synthesized
gtttctaatttaattggttt

SEQ ID NO: 386393 - DNA, 20 bp, Artificial Sequence
  chemically synthesized
agtttctaatttaattggtt

SEQ ID NO: 386394 - DNA, 20 bp, Artificial Sequence
  chemically synthesized
gccacctaaaccaattaaat

SEQ ID NO: 386395 - DNA, 20 bp, Artificial Sequence
  chemically synthesized
tgggaagtttctaatttaat

SEQ ID NO: 386396 - DNA, 20 bp, Artificial Sequence
  chemically synthesized
caattaaattagaaacttcc

SEQ ID NO: 386397 - DNA, 20 bp, Artificial Sequence
  chemically synthesized
aattaaattagaaacttccc

SEQ ID NO: 386398 - DNA, 20 bp, Artificial Sequence
  chemically synthesized
taaattagaaacttcccagg

SEQ ID NO: 386399 - DNA, 20 bp, Artificial Sequence
  chemically synthesized
aaattagaaacttcccaggt

SEQ ID NO: 386400 - DNA, 20 bp, Artificial Sequence
  chemically synthesized
atgcctaggtcccacctggg

SEQ ID NO: 386401 - DNA, 20 bp, Artificial Sequence
  chemically synthesized
cagatgcctaggtcccacct

SEQ ID NO: 386402 - DNA, 20 bp, Artificial Sequence
  chemically synthesized
acagatgcctaggtcccacc

SEQ ID NO: 386403 - DNA, 20 bp, Artificial Sequence
  chemically synthesized
gaaacttcccaggtgggacc

SEQ ID NO: 386404 - DNA, 20 bp, Artificial Sequence
  chemically synthesized
aaacttcccaggtgggacct

SEQ ID NO: 386405 - DNA, 20 bp, Artificial Sequence
  chemically synthesized
tttaaaacttacagatgcct

SEQ ID NO: 386406 - DNA, 20 bp, Artificial Sequence
  chemically synthesized
ctttaaaacttacagatgcc

SEQ ID NO: 386407 - DNA, 20 bp, Artificial Sequence
  chemically synthesized
ggtgggacctaggcatctgt

SEQ ID NO: 386408 - DNA, 20 bp, Artificial Sequence
  chemically synthesized
acgagagtctttaaaactta

SEQ ID NO: 386409 - DNA, 20 bp, Artificial Sequence
  chemically synthesized
ctaggcatctgtaagtttta

SEQ ID NO: 386410 - DNA, 20 bp, Artificial Sequence
  chemically synthesized
tgatatttagaacatcacga

SEQ ID NO: 386411 - DNA, 20 bp, Artificial Sequence
  chemically synthesized
gctgatatttagaacatcac

SEQ ID NO: 386412 - DNA, 20 bp, Artificial Sequence
  chemically synthesized
tctcgtgatgttctaaatat

SEQ ID NO: 386413 - DNA, 20 bp, Artificial Sequence
  chemically synthesized
cctctgcctttgctgatatt

SEQ ID NO: 386414 - DNA, 20 bp, Artificial Sequence
  chemically synthesized
tgatgttctaaatatcagca

SEQ ID NO: 386415 - DNA, 20 bp, Artificial Sequence
  chemically synthesized
gatgttctaaatatcagcaa

SEQ ID NO: 386416 - DNA, 20 bp, Artificial Sequence
  chemically synthesized
gttctaaatatcagcaaagg

SEQ ID NO: 386417 - DNA, 20 bp, Artificial Sequence
  chemically synthesized
tctaaatatcagcaaaggca

SEQ ID NO: 386418 - DNA, 20 bp, Artificial Sequence
  chemically synthesized
ctaaatatcagcaaaggcag

SEQ ID NO: 386419 - DNA, 20 bp, Artificial Sequence
  chemically synthesized
agcaaaggcagaggaccatt

SEQ ID NO: 386420 - DNA, 20 bp, Artificial Sequence
  chemically synthesized
aaatattctaacaagctcaa

SEQ ID NO: 386421 - DNA, 20 bp, Artificial Sequence
  chemically synthesized
cagaggaccattgagcttgt

SEQ ID NO: 386422 - DNA, 20 bp, Artificial Sequence
  chemically synthesized
cctttcccaaatattctaac

SEQ ID NO: 386423 - DNA, 20 bp, Artificial Sequence
  chemically synthesized
attgagcttgttagaatatt

SEQ ID NO: 386424 - DNA, 20 bp, Artificial Sequence
  chemically synthesized
ttgagcttgttagaatattt

SEQ ID NO: 386425 - DNA, 20 bp, Artificial Sequence
  chemically synthesized
gcttgttagaatatttggga

SEQ ID NO: 386426 - DNA, 20 bp, Artificial Sequence
  chemically synthesized
cttgttagaatatttgggaa

SEQ ID NO: 386427 - DNA, 20 bp, Artificial Sequence
  chemically synthesized
ttgttagaatatttgggaaa

SEQ ID NO: 386428 - DNA, 20 bp, Artificial Sequence
  chemically synthesized
atttgggaaagggtgtttct

SEQ ID NO: 386429 - DNA, 20 bp, Artificial Sequence
  chemically synthesized
taagccttaagttttaatct

SEQ ID NO: 386430 - DNA, 20 bp, Artificial Sequence
  chemically synthesized
tgtttctaagattaaaactt

SEQ ID NO: 386431 - DNA, 20 bp, Artificial Sequence
  chemically synthesized
gtttctaagattaaaactta

SEQ ID NO: 386432 - DNA, 20 bp, Artificial Sequence
  chemically synthesized
ttacgaaatacataagcctt

SEQ ID NO: 386433 - DNA, 20 bp, Artificial Sequence
  chemically synthesized
gctgcgtttacgaaatacat

SEQ ID NO: 386434 - DNA, 20 bp, Artificial Sequence
  chemically synthesized
gcttatgtatttcgtaaacg

SEQ ID NO: 386435 - DNA, 20 bp, Artificial Sequence
  chemically synthesized
tgtttactaatttgttaaag

SEQ ID NO: 386436 - DNA, 20 bp, Artificial Sequence
  chemically synthesized
gcttgtttactaatttgtta

SEQ ID NO: 386437 - DNA, 20 bp, Artificial Sequence
  chemically synthesized
acgcagctgctttaacaaat

SEQ ID NO: 386438 - DNA, 20 bp, Artificial Sequence
  chemically synthesized
gctttaacaaattagtaaac

SEQ ID NO: 386439 - DNA, 20 bp, Artificial Sequence
  chemically synthesized
attagtaaacaagctaatcc

SEQ ID NO: 386440 - DNA, 20 bp, Artificial Sequence
  chemically synthesized
ttttttagagatactaggat

SEQ ID NO: 386441 - DNA, 20 bp, Artificial Sequence
  chemically synthesized
tagtgttttttagagatact

SEQ ID NO: 386442 - DNA, 20 bp, Artificial Sequence
  chemically synthesized
ctagtgttttttagagatac

SEQ ID NO: 386443 - DNA, 20 bp, Artificial Sequence
  chemically synthesized
aattaaactagtgtttttta

SEQ ID NO: 386444 - DNA, 20 bp, Artificial Sequence
  chemically synthesized
aaaattaaactagtgttttt

SEQ ID NO: 386445 - DNA, 20 bp, Artificial Sequence
  chemically synthesized
ctagtatctctaaaaaacac

SEQ ID NO: 386446 - DNA, 20 bp, Artificial Sequence
  chemically synthesized
agctccaggcaaaattaaac

SEQ ID NO: 386447 - DNA, 20 bp, Artificial Sequence
  chemically synthesized
aacactagtttaattttgcc

SEQ ID NO: 386448 - DNA, 20 bp, Artificial Sequence
  chemically synthesized
cactagtttaattttgcctg

SEQ ID NO: 386449 - DNA, 20 bp, Artificial Sequence
  chemically synthesized
tttaattttgcctggagctg

SEQ ID NO: 386450 - DNA, 20 bp, Artificial Sequence
  chemically synthesized
atattgagaactgcagctcc

SEQ ID NO: 386451 - DNA, 20 bp, Artificial Sequence
  chemically synthesized
tatattgagaactgcagctc

SEQ ID NO: 386452 - DNA, 20 bp, Artificial Sequence
  chemically synthesized
ggacaatatattgagaactg

SEQ ID NO: 386453 - DNA, 20 bp, Artificial Sequence
  chemically synthesized
gatatgctggacaatatatt

SEQ ID NO: 386454 - DNA, 20 bp, Artificial Sequence
  chemically synthesized
gcagttctcaatatattgtc

SEQ ID NO: 386455 - DNA, 20 bp, Artificial Sequence
  chemically synthesized
tccctgcatggaggatatgc

SEQ ID NO: 386456 - DNA, 20 bp, Artificial Sequence
  chemically synthesized
tgtccagcatatcctccatg

SEQ ID NO: 386457 - DNA, 20 bp, Artificial Sequence
  chemically synthesized
gtccagcatatcctccatgc

SEQ ID NO: 386458 - DNA, 20 bp, Artificial Sequence
  chemically synthesized
tccagcatatcctccatgca

SEQ ID NO: 386459 - DNA, 20 bp, Artificial Sequence
  chemically synthesized
acagtggtttccctgcatgg

SEQ ID NO: 386460 - DNA, 20 bp, Artificial Sequence
  chemically synthesized
tacagtggtttccctgcatg

SEQ ID NO: 386461 - DNA, 20 bp, Artificial Sequence
  chemically synthesized
tatacagtggtttccctgca

SEQ ID NO: 386462 - DNA, 20 bp, Artificial Sequence
  chemically synthesized
ataagtattggtgtatacag

SEQ ID NO: 386463 - DNA, 20 bp, Artificial Sequence
  chemically synthesized
ctcataagtattggtgtata

SEQ ID NO: 386464 - DNA, 20 bp, Artificial Sequence
  chemically synthesized
tcatcctccctcataagtat

SEQ ID NO: 386465 - DNA, 20 bp, Artificial Sequence
  chemically synthesized
ctgtatacaccaatacttat

SEQ ID NO: 386466 - DNA, 20 bp, Artificial Sequence
  chemically synthesized
tgtatacaccaatacttatg

SEQ ID NO: 386467 - DNA, 20 bp, Artificial Sequence
  chemically synthesized
gtatacaccaatacttatga

SEQ ID NO: 386468 - DNA, 20 bp, Artificial Sequence
  chemically synthesized
atacaccaatacttatgagg

SEQ ID NO: 386469 - DNA, 20 bp, Artificial Sequence
  chemically synthesized
tacaccaatacttatgaggg

SEQ ID NO: 386470 - DNA, 20 bp, Artificial Sequence
  chemically synthesized
gaaaaatcatcctccctcat

SEQ ID NO: 386471 - DNA, 20 bp, Artificial Sequence
  chemically synthesized
aaaaggcaattaaagatttg

SEQ ID NO: 386472 - DNA, 20 bp, Artificial Sequence
  chemically synthesized
gattttctaaaaggcaatta

SEQ ID NO: 386473 - DNA, 20 bp, Artificial Sequence
  chemically synthesized
gcaaatctttaattgccttt

SEQ ID NO: 386474 - DNA, 20 bp, Artificial Sequence
  chemically synthesized
aactggatggattttctaaa

SEQ ID NO: 386475 - DNA, 20 bp, Artificial Sequence
  chemically synthesized
aaactggatggattttctaa

SEQ ID NO: 386476 - DNA, 20 bp, Artificial Sequence
  chemically synthesized
tgccttttagaaaatccatc

SEQ ID NO: 386477 - DNA, 20 bp, Artificial Sequence
  chemically synthesized
cttgcttaaggaaaactgga

SEQ ID NO: 386478 - DNA, 20 bp, Artificial Sequence
  chemically synthesized
aaaacttgcttaaggaaaac

SEQ ID NO: 386479 - DNA, 20 bp, Artificial Sequence
  chemically synthesized
aaatccatccagttttcctt

SEQ ID NO: 386480 - DNA, 20 bp, Artificial Sequence
  chemically synthesized
ccatccagttttccttaagc

SEQ ID NO: 386481 - DNA, 20 bp, Artificial Sequence
  chemically synthesized
tgctttctaaaacttgctta

SEQ ID NO: 386482 - DNA, 20 bp, Artificial Sequence
  chemically synthesized
gtgctttctaaaacttgctt

SEQ ID NO: 386483 - DNA, 20 bp, Artificial Sequence
  chemically synthesized
agttttccttaagcaagttt

SEQ ID NO: 386484 - DNA, 20 bp, Artificial Sequence
  chemically synthesized
ttccttaagcaagttttaga

SEQ ID NO: 386485 - DNA, 20 bp, Artificial Sequence
  chemically synthesized
gttttagaaagcacatacac

SEQ ID NO: 386486 - DNA, 20 bp, Artificial Sequence
  chemically synthesized
tacacgagcaattacaaatc

SEQ ID NO: 386487 - DNA, 20 bp, Artificial Sequence
  chemically synthesized
gcaattacaaatctggcctt

SEQ ID NO: 386488 - DNA, 20 bp, Artificial Sequence
  chemically synthesized
tcttgagttaggctgaaggc

SEQ ID NO: 386489 - DNA, 20 bp, Artificial Sequence
  chemically synthesized
taattcttgagttaggctga

SEQ ID NO: 386490 - DNA, 20 bp, Artificial Sequence
  chemically synthesized
ttaattcttgagttaggctg

SEQ ID NO: 386491 - DNA, 20 bp, Artificial Sequence
  chemically synthesized
tctggccttcagcctaactc

SEQ ID NO: 386492 - DNA, 20 bp, Artificial Sequence
  chemically synthesized
atttttttaattcttgagtt

SEQ ID NO: 386493 - DNA, 20 bp, Artificial Sequence
  chemically synthesized
tatttttttaattcttgagt

SEQ ID NO: 386494 - DNA, 20 bp, Artificial Sequence
  chemically synthesized
attttatttttttaattctt

SEQ ID NO: 386495 - DNA, 20 bp, Artificial Sequence
  chemically synthesized
attaaaaaaataaaatctca

SEQ ID NO: 386496 - DNA, 20 bp, Artificial Sequence
  chemically synthesized
aaaaataaaatctcaaagtg

SEQ ID NO: 386497 - DNA, 20 bp, Artificial Sequence
  chemically synthesized
aattaatacaacttcacttt

SEQ ID NO: 386498 - DNA, 20 bp, Artificial Sequence
  chemically synthesized
aataaaagtaaggagaaaaa

SEQ ID NO: 386499 - DNA, 20 bp, Artificial Sequence
  chemically synthesized
ttttatgaaataaaagtaag

SEQ ID NO: 386500 - DNA, 20 bp, Artificial Sequence
  chemically synthesized
atttttatgaaataaaagta

SEQ ID NO: 386501 - DNA, 20 bp, Artificial Sequence
  chemically synthesized
tatttttatgaaataaaagt

SEQ ID NO: 386502 - DNA, 20 bp, Artificial Sequence
  chemically synthesized
tgtctatttttatgaaataa

SEQ ID NO: 386503 - DNA, 20 bp, Artificial Sequence
  chemically synthesized
ttacttttatttcataaaaa

SEQ ID NO: 386504 - DNA, 20 bp, Artificial Sequence
  chemically synthesized
aagaagccagttttatgata

SEQ ID NO: 386505 - DNA, 20 bp, Artificial Sequence
  chemically synthesized
agacatctttatcataaaac

SEQ ID NO: 386506 - DNA, 20 bp, Artificial Sequence
  chemically synthesized
cccaaatgatgtcaagaagc

SEQ ID NO: 386507 - DNA, 20 bp, Artificial Sequence
  chemically synthesized
tggccccaaatgatgtcaag

SEQ ID NO: 386508 - DNA, 20 bp, Artificial Sequence
  chemically synthesized
aagtggccccaaatgatgtc

SEQ ID NO: 386509 - DNA, 20 bp, Artificial Sequence
  chemically synthesized
actggcttcttgacatcatt

SEQ ID NO: 386510 - DNA, 20 bp, Artificial Sequence
  chemically synthesized
ctggcttcttgacatcattt

SEQ ID NO: 386511 - DNA, 20 bp, Artificial Sequence
  chemically synthesized
tggcttcttgacatcatttg

SEQ ID NO: 386512 - DNA, 20 bp, Artificial Sequence
  chemically synthesized
attgtctttcagagggaaag

SEQ ID NO: 386513 - DNA, 20 bp, Artificial Sequence
  chemically synthesized
agaattgtctttcagaggga

SEQ ID NO: 386514 - DNA, 20 bp, Artificial Sequence
  chemically synthesized
tggggccactttccctctga

SEQ ID NO: 386515 - DNA, 20 bp, Artificial Sequence
  chemically synthesized
aattagaattgtctttcaga

SEQ ID NO: 386516 - DNA, 20 bp, Artificial Sequence
  chemically synthesized
caattagaattgtctttcag

SEQ ID NO: 386517 - DNA, 20 bp, Artificial Sequence
  chemically synthesized
gcaattagaattgtctttca

SEQ ID NO: 386518 - DNA, 20 bp, Artificial Sequence
  chemically synthesized
atgcaattagaattgtcttt

SEQ ID NO: 386519 - DNA, 20 bp, Artificial Sequence
  chemically synthesized
tgagaacaagtaaatgcaat

SEQ ID NO: 386520 - DNA, 20 bp, Artificial Sequence
  chemically synthesized
taattgcatttacttgttct

SEQ ID NO: 386521 - DNA, 20 bp, Artificial Sequence
  chemically synthesized
aaatgtatgattctgagaac

SEQ ID NO: 386522 - DNA, 20 bp, Artificial Sequence
  chemically synthesized
ttaaaaaaatgtatgattct

SEQ ID NO: 386523 - DNA, 20 bp, Artificial Sequence
  chemically synthesized
catttttttaaaaatgaaaa

SEQ ID NO: 386524 - DNA, 20 bp, Artificial Sequence
  chemically synthesized
aatgaaaatagtttgtacac

SEQ ID NO: 386525 - DNA, 20 bp, Artificial Sequence
  chemically synthesized
agtttgtacacgagttgcca

SEQ ID NO: 386526 - DNA, 20 bp, Artificial Sequence
  chemically synthesized
gtacacgagttgccaaagaa

SEQ ID NO: 386527 - DNA, 20 bp, Artificial Sequence
  chemically synthesized
cactgaattagaccattctt

SEQ ID NO: 386528 - DNA, 20 bp, Artificial Sequence
  chemically synthesized
tgccaaagaatggtctaatt

SEQ ID NO: 386529 - DNA, 20 bp, Artificial Sequence
  chemically synthesized
tctttgtcctgacactgaat

SEQ ID NO: 386530 - DNA, 20 bp, Artificial Sequence
  chemically synthesized
agaatggtctaattcagtgt

SEQ ID NO: 386531 - DNA, 20 bp, Artificial Sequence
  chemically synthesized
gaatggtctaattcagtgtc

SEQ ID NO: 386532 - DNA, 20 bp, Artificial Sequence
  chemically synthesized
tctaattcagtgtcaggaca

SEQ ID NO: 386533 - DNA, 20 bp, Artificial Sequence
  chemically synthesized
attcagtgtcaggacaaaga

SEQ ID NO: 386534 - DNA, 20 bp, Artificial Sequence
  chemically synthesized
atgactaaataatgcaaaat

SEQ ID NO: 386535 - DNA, 20 bp, Artificial Sequence
  chemically synthesized
tggtctaattttgcattatt

SEQ ID NO: 386536 - DNA, 20 bp, Artificial Sequence
  chemically synthesized
ttactagttttgtttttaat

SEQ ID NO: 386537 - DNA, 20 bp, Artificial Sequence
  chemically synthesized
catctaattaaaaacaaaac

SEQ ID NO: 386538 - DNA, 20 bp, Artificial Sequence
  chemically synthesized
ctttatggctaaattattac

SEQ ID NO: 386539 - DNA, 20 bp, Artificial Sequence
  chemically synthesized
aaacaaaactagtaataatt

SEQ ID NO: 386540 - DNA, 20 bp, Artificial Sequence
  chemically synthesized
ctagtaataatttagccata

SEQ ID NO: 386541 - DNA, 20 bp, Artificial Sequence
  chemically synthesized
ttcttcaatgaacagcttta

SEQ ID NO: 386542 - DNA, 20 bp, Artificial Sequence
  chemically synthesized
agccataaagctgttcattg

SEQ ID NO: 386543 - DNA, 20 bp, Artificial Sequence
  chemically synthesized
tgcttttattcttcaatgaa

SEQ ID NO: 386544 - DNA, 20 bp, Artificial Sequence
  chemically synthesized
agctgttcattgaagaataa

SEQ ID NO: 386545 - DNA, 20 bp, Artificial Sequence
  chemically synthesized
ttgttaattaacttttcatt

SEQ ID NO: 386546 - DNA, 20 bp, Artificial Sequence
  chemically synthesized
tgttaattaacttttcattg

SEQ ID NO: 386547 - DNA, 20 bp, Artificial Sequence
  chemically synthesized
gtatgactttcctcaatgaa

SEQ ID NO: 386548 - DNA, 20 bp, Artificial Sequence
  chemically synthesized
aattaacttttcattgagga

SEQ ID NO: 386549 - DNA, 20 bp, Artificial Sequence
  chemically synthesized
cataacatttcaaaatgccc

SEQ ID NO: 386550 - DNA, 20 bp, Artificial Sequence
  chemically synthesized
ataacatttcaaaatgccct

SEQ ID NO: 386551 - DNA, 20 bp, Artificial Sequence
  chemically synthesized
cttaattttgtaatttccca

SEQ ID NO: 386552 - DNA, 20 bp, Artificial Sequence
  chemically synthesized
ccttaattttgtaatttccc

SEQ ID NO: 386553 - DNA, 20 bp, Artificial Sequence
  chemically synthesized
accttaattttgtaatttcc

SEQ ID NO: 386554 - DNA, 20 bp, Artificial Sequence
  chemically synthesized
ccctgggaaattacaaaatt

SEQ ID NO: 386555 - DNA, 20 bp, Artificial Sequence
  chemically synthesized
cctgggaaattacaaaatta

SEQ ID NO: 386556 - DNA, 20 bp, Artificial Sequence
  chemically synthesized
ggtaaaatgtttcattgtta

SEQ ID NO: 386557 - DNA, 20 bp, Artificial Sequence
  chemically synthesized
tgggtaaaatgtttcattgt

SEQ ID NO: 386558 - DNA, 20 bp, Artificial Sequence
  chemically synthesized
taacaatgaaacattttacc

SEQ ID NO: 386559 - DNA, 20 bp, Artificial Sequence
  chemically synthesized
aacaatgaaacattttaccc

SEQ ID NO: 386560 - DNA, 20 bp, Artificial Sequence
  chemically synthesized
agaatcctcattagaggcct

SEQ ID NO: 386561 - DNA, 20 bp, Artificial Sequence
  chemically synthesized
gagaatcctcattagaggcc

SEQ ID NO: 386562 - DNA, 20 bp, Artificial Sequence
  chemically synthesized
attttacccaggcctctaat

SEQ ID NO: 386563 - DNA, 20 bp, Artificial Sequence
  chemically synthesized
ttttacccaggcctctaatg

SEQ ID NO: 386564 - DNA, 20 bp, Artificial Sequence
  chemically synthesized
taactgagaatcctcattag

SEQ ID NO: 386565 - DNA, 20 bp, Artificial Sequence
  chemically synthesized
ttaactgagaatcctcatta

SEQ ID NO: 386566 - DNA, 20 bp, Artificial Sequence
  chemically synthesized
ccttaactgagaatcctcat

SEQ ID NO: 386567 - DNA, 20 bp, Artificial Sequence
  chemically synthesized
aggcctctaatgaggattct

SEQ ID NO: 386568 - DNA, 20 bp, Artificial Sequence
  chemically synthesized
tctaatgaggattctcagtt

SEQ ID NO: 386569 - DNA, 20 bp, Artificial Sequence
  chemically synthesized
ctaatgaggattctcagtta

SEQ ID NO: 386570 - DNA, 20 bp, Artificial Sequence
  chemically synthesized
taatgaggattctcagttaa

SEQ ID NO: 386571 - DNA, 20 bp, Artificial Sequence
  chemically synthesized
aatgaggattctcagttaag

SEQ ID NO: 386572 - DNA, 20 bp, Artificial Sequence
  chemically synthesized
ctctgctcctccccttaact

SEQ ID NO: 386573 - DNA, 20 bp, Artificial Sequence
  chemically synthesized
tgaggattctcagttaaggg

SEQ ID NO: 386574 - DNA, 20 bp, Artificial Sequence
  chemically synthesized
gaggattctcagttaagggg

SEQ ID NO: 386575 - DNA, 20 bp, Artificial Sequence
  chemically synthesized
ggattctcagttaaggggag

SEQ ID NO: 386576 - DNA, 20 bp, Artificial Sequence
  chemically synthesized
ttctcagttaaggggaggag

SEQ ID NO: 386577 - DNA, 20 bp, Artificial Sequence
  chemically synthesized
ctcagttaaggggaggagca

SEQ ID NO: 386578 - DNA, 20 bp, Artificial Sequence
  chemically synthesized
tcagttaaggggaggagcag

SEQ ID NO: 386579 - DNA, 20 bp, Artificial Sequence
  chemically synthesized
cagaggaatgcataaacaca

SEQ ID NO: 386580 - DNA, 20 bp, Artificial Sequence
  chemically synthesized
agaggaatgcataaacacat

SEQ ID NO: 386581 - DNA, 20 bp, Artificial Sequence
  chemically synthesized
aggaatgcataaacacatgg

SEQ ID NO: 386582 - DNA, 20 bp, Artificial Sequence
  chemically synthesized
ggaatgcataaacacatggg

SEQ ID NO: 386583 - DNA, 20 bp, Artificial Sequence
  chemically synthesized
atgcataaacacatgggagg

SEQ ID NO: 386584 - DNA, 20 bp, Artificial Sequence
  chemically synthesized
tgcataaacacatgggaggt

SEQ ID NO: 386585 - DNA, 20 bp, Artificial Sequence
  chemically synthesized
gcataaacacatgggaggtg

SEQ ID NO: 386586 - DNA, 20 bp, Artificial Sequence
  chemically synthesized
taaacacatgggaggtgggg

SEQ ID NO: 386587 - DNA, 20 bp, Artificial Sequence
  chemically synthesized
aacacatgggaggtggggtg

SEQ ID NO: 386588 - DNA, 20 bp, Artificial Sequence
  chemically synthesized
acatgggaggtggggtggag

SEQ ID NO: 386589 - DNA, 20 bp, Artificial Sequence
  chemically synthesized
ggtggggtggagcggaaacc

SEQ ID NO: 386590 - DNA, 20 bp, Artificial Sequence
  chemically synthesized
tggagcggaaacccagcttc

SEQ ID NO: 386591 - DNA, 20 bp, Artificial Sequence
  chemically synthesized
ggagcggaaacccagcttcc

SEQ ID NO: 386592 - DNA, 20 bp, Artificial Sequence
  chemically synthesized
aaaacatcttcctggaagct

SEQ ID NO: 386593 - DNA, 20 bp, Artificial Sequence
  chemically synthesized
taaaacatcttcctggaagc

SEQ ID NO: 386594 - DNA, 20 bp, Artificial Sequence
  chemically synthesized
gcggaaacccagcttccagg

SEQ ID NO: 386595 - DNA, 20 bp, Artificial Sequence
  chemically synthesized
ctcctaaaacatcttcctgg

SEQ ID NO: 386596 - DNA, 20 bp, Artificial Sequence
  chemically synthesized
tttctcctaaaacatcttcc

SEQ ID NO: 386597 - DNA, 20 bp, Artificial Sequence
  chemically synthesized
cagcttccaggaagatgttt

SEQ ID NO: 386598 - DNA, 20 bp, Artificial Sequence
  chemically synthesized
agcttccaggaagatgtttt

SEQ ID NO: 386599 - DNA, 20 bp, Artificial Sequence
  chemically synthesized
cttccaggaagatgttttag

SEQ ID NO: 386600 - DNA, 20 bp, Artificial Sequence
  chemically synthesized
gaagatgttttaggagaaaa

SEQ ID NO: 386601 - DNA, 20 bp, Artificial Sequence
  chemically synthesized
ttaggagaaaacagattcct

SEQ ID NO: 386602 - DNA, 20 bp, Artificial Sequence
  chemically synthesized
tgttgtacctcaaatagctt

SEQ ID NO: 386603 - DNA, 20 bp, Artificial Sequence
  chemically synthesized
ctgttgtacctcaaatagct

SEQ ID NO: 386604 - DNA, 20 bp, Artificial Sequence
  chemically synthesized
aacagattcctaagctattt

SEQ ID NO: 386605 - DNA, 20 bp, Artificial Sequence
  chemically synthesized
acagattcctaagctatttg

SEQ ID NO: 386606 - DNA, 20 bp, Artificial Sequence
  chemically synthesized
tcggtctgttgtacctcaaa

SEQ ID NO: 386607 - DNA, 20 bp, Artificial Sequence
  chemically synthesized
ctaagctatttgaggtacaa

SEQ ID NO: 386608 - DNA, 20 bp, Artificial Sequence
  chemically synthesized
atttgaggtacaacagaccg

SEQ ID NO: 386609 - DNA, 20 bp, Artificial Sequence
  chemically synthesized
tttgaggtacaacagaccga

SEQ ID NO: 386610 - DNA, 20 bp, Artificial Sequence
  chemically synthesized
attgcactgcacattgcctt

SEQ ID NO: 386611 - DNA, 20 bp, Artificial Sequence
  chemically synthesized
aacagaccgaaggcaatgtg

SEQ ID NO: 386612 - DNA, 20 bp, Artificial Sequence
  chemically synthesized
ttttataacagataagttta

SEQ ID NO: 386613 - DNA, 20 bp, Artificial Sequence
  chemically synthesized
gttttataacagataagttt

SEQ ID NO: 386614 - DNA, 20 bp, Artificial Sequence
  chemically synthesized
agttttataacagataagtt

SEQ ID NO: 386615 - DNA, 20 bp, Artificial Sequence
  chemically synthesized
gattcagttttataacagat

SEQ ID NO: 386616 - DNA, 20 bp, Artificial Sequence
  chemically synthesized
ttaaggattcagttttataa

SEQ ID NO: 386617 - DNA, 20 bp, Artificial Sequence
  chemically synthesized
tgttataaaactgaatcctt

SEQ ID NO: 386618 - DNA, 20 bp, Artificial Sequence
  chemically synthesized
gtacaaccagcttaaggatt

SEQ ID NO: 386619 - DNA, 20 bp, Artificial Sequence
  chemically synthesized
ataaaactgaatccttaagc

SEQ ID NO: 386620 - DNA, 20 bp, Artificial Sequence
  chemically synthesized
gactttgtacaaccagctta

SEQ ID NO: 386621 - DNA, 20 bp, Artificial Sequence
  chemically synthesized
tgactttgtacaaccagctt

SEQ ID NO: 386622 - DNA, 20 bp, Artificial Sequence
  chemically synthesized
gttgtgtgactttgtacaac

SEQ ID NO: 386623 - DNA, 20 bp, Artificial Sequence
  chemically synthesized
atccttaagctggttgtaca

SEQ ID NO: 386624 - DNA, 20 bp, Artificial Sequence
  chemically synthesized
gttgtacaaagtcacacaac

SEQ ID NO: 386625 - DNA, 20 bp, Artificial Sequence
  chemically synthesized
tacaaagtcacacaactagt

SEQ ID NO: 386626 - DNA, 20 bp, Artificial Sequence
  chemically synthesized
tttgtagaacattaactgac

SEQ ID NO: 386627 - DNA, 20 bp, Artificial Sequence
  chemically synthesized
gtcagttaatgttctacaaa

SEQ ID NO: 386628 - DNA, 20 bp, Artificial Sequence
  chemically synthesized
atctctgaaagagctatttg

SEQ ID NO: 386629 - DNA, 20 bp, Artificial Sequence
  chemically synthesized
tgttctacaaatagctcttt

SEQ ID NO: 386630 - DNA, 20 bp, Artificial Sequence
  chemically synthesized
ttctacaaatagctctttca

SEQ ID NO: 386631 - DNA, 20 bp, Artificial Sequence
  chemically synthesized
tagtagaaaaatctctgaaa

SEQ ID NO: 386632 - DNA, 20 bp, Artificial Sequence
  chemically synthesized
tctagtagaaaaatctctga

SEQ ID NO: 386633 - DNA, 20 bp, Artificial Sequence
  chemically synthesized
tctttcagagatttttctac

SEQ ID NO: 386634 - DNA, 20 bp, Artificial Sequence
  chemically synthesized
aaataaggtgacaagtctag

SEQ ID NO: 386635 - DNA, 20 bp, Artificial Sequence
  chemically synthesized
tttaaataaggtgacaagtc

SEQ ID NO: 386636 - DNA, 20 bp, Artificial Sequence
  chemically synthesized
caaggtttaaataaggtgac

SEQ ID NO: 386637 - DNA, 20 bp, Artificial Sequence
  chemically synthesized
ggggtttcaaggtttaaata

SEQ ID NO: 386638 - DNA, 20 bp, Artificial Sequence
  chemically synthesized
tggggtttcaaggtttaaat

SEQ ID NO: 386639 - DNA, 20 bp, Artificial Sequence
  chemically synthesized
caattttgagtggggtttca

SEQ ID NO: 386640 - DNA, 20 bp, Artificial Sequence
  chemically synthesized
tcaattttgagtggggtttc

SEQ ID NO: 386641 - DNA, 20 bp, Artificial Sequence
  chemically synthesized
ctcactgtcaattttgagtg

SEQ ID NO: 386642 - DNA, 20 bp, Artificial Sequence
  chemically synthesized
tctcactgtcaattttgagt

SEQ ID NO: 386643 - DNA, 20 bp, Artificial Sequence
  chemically synthesized
ctctcactgtcaattttgag

SEQ ID NO: 386644 - DNA, 20 bp, Artificial Sequence
  chemically synthesized
tttctctcactgtcaatttt

SEQ ID NO: 386645 - DNA, 20 bp, Artificial Sequence
  chemically synthesized
gaaaccccactcaaaattga

SEQ ID NO: 386646 - DNA, 20 bp, Artificial Sequence
  chemically synthesized
ccccactcaaaattgacagt

SEQ ID NO: 386647 - DNA, 20 bp, Artificial Sequence
  chemically synthesized
ccactcaaaattgacagtga

SEQ ID NO: 386648 - DNA, 20 bp, Artificial Sequence
  chemically synthesized
aaaattgacagtgagagaaa

SEQ ID NO: 386649 - DNA, 20 bp, Artificial Sequence
  chemically synthesized
acacacacacacacacacac

SEQ ID NO: 386650 - DNA, 20 bp, Artificial Sequence
  chemically synthesized
cacacacacacacacacacc

SEQ ID NO: 386651 - DNA, 20 bp, Artificial Sequence
  chemically synthesized
acacacacacacacacacca

SEQ ID NO: 386652 - DNA, 20 bp, Artificial Sequence
  chemically synthesized
acacacacacacaccaggga

SEQ ID NO: 386653 - DNA, 20 bp, Artificial Sequence
  chemically synthesized
acacacacacaccagggacg

SEQ ID NO: 386654 - DNA, 20 bp, Artificial Sequence
  chemically synthesized
cacacacacaccagggacgg

SEQ ID NO: 386655 - DNA, 20 bp, Artificial Sequence
  chemically synthesized
actttctctccctccgtccc

SEQ ID NO: 386656 - DNA, 20 bp, Artificial Sequence
  chemically synthesized
acacacacaccagggacgga

SEQ ID NO: 386657 - DNA, 20 bp, Artificial Sequence
  chemically synthesized
acacacaccagggacggagg

SEQ ID NO: 386658 - DNA, 20 bp, Artificial Sequence
  chemically synthesized
acacaccagggacggaggga

SEQ ID NO: 386659 - DNA, 20 bp, Artificial Sequence
  chemically synthesized
accagggacggagggagaga

SEQ ID NO: 386660 - DNA, 20 bp, Artificial Sequence
  chemically synthesized
agggagagaaagtgtattaa

SEQ ID NO: 386661 - DNA, 20 bp, Artificial Sequence
  chemically synthesized
cccaaggccaagaggggttt

SEQ ID NO: 386662 - DNA, 20 bp, Artificial Sequence
  chemically synthesized
ttaatagctaaaacccctct

SEQ ID NO: 386663 - DNA, 20 bp, Artificial Sequence
  chemically synthesized
ttctttcccaaggccaagag

SEQ ID NO: 386664 - DNA, 20 bp, Artificial Sequence
  chemically synthesized
tttctttcccaaggccaaga

SEQ ID NO: 386665 - DNA, 20 bp, Artificial Sequence
  chemically synthesized
gtttctttcccaaggccaag

SEQ ID NO: 386666 - DNA, 20 bp, Artificial Sequence
  chemically synthesized
gctaaaacccctcttggcct

SEQ ID NO: 386667 - DNA, 20 bp, Artificial Sequence
  chemically synthesized
agtttctttcccaaggccaa

SEQ ID NO: 386668 - DNA, 20 bp, Artificial Sequence
  chemically synthesized
ctaaaacccctcttggcctt

SEQ ID NO: 386669 - DNA, 20 bp, Artificial Sequence
  chemically synthesized
agagtttctttcccaaggcc

SEQ ID NO: 386670 - DNA, 20 bp, Artificial Sequence
  chemically synthesized
aacccctcttggccttggga

SEQ ID NO: 386671 - DNA, 20 bp, Artificial Sequence
  chemically synthesized
ggtagagagtttctttccca

SEQ ID NO: 386672 - DNA, 20 bp, Artificial Sequence
  chemically synthesized
gggtagagagtttctttccc

SEQ ID NO: 386673 - DNA, 20 bp, Artificial Sequence
  chemically synthesized
tcttattaacagagggtaga

SEQ ID NO: 386674 - DNA, 20 bp, Artificial Sequence
  chemically synthesized
cttcttattaacagagggta

SEQ ID NO: 386675 - DNA, 20 bp, Artificial Sequence
  chemically synthesized
cacttcttattaacagaggg

SEQ ID NO: 386676 - DNA, 20 bp, Artificial Sequence
  chemically synthesized
tctcacttcttattaacaga

SEQ ID NO: 386677 - DNA, 20 bp, Artificial Sequence
  chemically synthesized
ctctcacttcttattaacag

SEQ ID NO: 386678 - DNA, 20 bp, Artificial Sequence
  chemically synthesized
actctctaccctctgttaat

SEQ ID NO: 386679 - DNA, 20 bp, Artificial Sequence
  chemically synthesized
tctctcacttcttattaaca

SEQ ID NO: 386680 - DNA, 20 bp, Artificial Sequence
  chemically synthesized
gctctctcacttcttattaa

SEQ ID NO: 386681 - DNA, 20 bp, Artificial Sequence
  chemically synthesized
ctctaccctctgttaataag

SEQ ID NO: 386682 - DNA, 20 bp, Artificial Sequence
  chemically synthesized
accctctgttaataagaagt

SEQ ID NO: 386683 - DNA, 20 bp, Artificial Sequence
  chemically synthesized
cctctgttaataagaagtga

SEQ ID NO: 386684 - DNA, 20 bp, Artificial Sequence
  chemically synthesized
tctgttaataagaagtgaga

SEQ ID NO: 386685 - DNA, 20 bp, Artificial Sequence
  chemically synthesized
tgatttattcaaagaggagg

SEQ ID NO: 386686 - DNA, 20 bp, Artificial Sequence
  chemically synthesized
acctgatttattcaaagagg

SEQ ID NO: 386687 - DNA, 20 bp, Artificial Sequence
  chemically synthesized
aacctgatttattcaaagag

SEQ ID NO: 386688 - DNA, 20 bp, Artificial Sequence
  chemically synthesized
agaacctgatttattcaaag

SEQ ID NO: 386689 - DNA, 20 bp, Artificial Sequence
  chemically synthesized
aagaacctgatttattcaaa

SEQ ID NO: 386690 - DNA, 20 bp, Artificial Sequence
  chemically synthesized
taaagaacctgatttattca

SEQ ID NO: 386691 - DNA, 20 bp, Artificial Sequence
  chemically synthesized
tgcctcctctttgaataaat

SEQ ID NO: 386692 - DNA, 20 bp, Artificial Sequence
  chemically synthesized
gcctcctctttgaataaatc

SEQ ID NO: 386693 - DNA, 20 bp, Artificial Sequence
  chemically synthesized
tttgaataaatcaggttctt

SEQ ID NO: 386694 - DNA, 20 bp, Artificial Sequence
  chemically synthesized
ccttaactctacattgtcta

SEQ ID NO: 386695 - DNA, 20 bp, Artificial Sequence
  chemically synthesized
atcaggttctttagacaatg

SEQ ID NO: 386696 - DNA, 20 bp, Artificial Sequence
  chemically synthesized
caggttctttagacaatgta

SEQ ID NO: 386697 - DNA, 20 bp, Artificial Sequence
  chemically synthesized
tctttagacaatgtagagtt

SEQ ID NO: 386698 - DNA, 20 bp, Artificial Sequence
  chemically synthesized
ctttagacaatgtagagtta

SEQ ID NO: 386699 - DNA, 20 bp, Artificial Sequence
  chemically synthesized
tttagacaatgtagagttaa

SEQ ID NO: 386700 - DNA, 20 bp, Artificial Sequence
  chemically synthesized
agagaacagggtgatgagta

SEQ ID NO: 386701 - DNA, 20 bp, Artificial Sequence
  chemically synthesized
catccagagaacagggtgat

SEQ ID NO: 386702 - DNA, 20 bp, Artificial Sequence
  chemically synthesized
ttactcatcaccctgttctc

SEQ ID NO: 386703 - DNA, 20 bp, Artificial Sequence
  chemically synthesized
tacatggcatccagagaaca

SEQ ID NO: 386704 - DNA, 20 bp, Artificial Sequence
  chemically synthesized
ttacatggcatccagagaac

SEQ ID NO: 386705 - DNA, 20 bp, Artificial Sequence
  chemically synthesized
cttacatggcatccagagaa

SEQ ID NO: 386706 - DNA, 20 bp, Artificial Sequence
  chemically synthesized
gtgagcttacatggcatcca

SEQ ID NO: 386707 - DNA, 20 bp, Artificial Sequence
  chemically synthesized
tggtgagcttacatggcatc

SEQ ID NO: 386708 - DNA, 20 bp, Artificial Sequence
  chemically synthesized
ctgttctctggatgccatgt

SEQ ID NO: 386709 - DNA, 20 bp, Artificial Sequence
  chemically synthesized
aagaatctggtgagcttaca

SEQ ID NO: 386710 - DNA, 20 bp, Artificial Sequence
  chemically synthesized
tggatgccatgtaagctcac

SEQ ID NO: 386711 - DNA, 20 bp, Artificial Sequence
  chemically synthesized
tagtttcacaagaatctggt

SEQ ID NO: 386712 - DNA, 20 bp, Artificial Sequence
  chemically synthesized
tctgtagtttcacaagaatc

SEQ ID NO: 386713 - DNA, 20 bp, Artificial Sequence
  chemically synthesized
tccattctctgtagtttcac

SEQ ID NO: 386714 - DNA, 20 bp, Artificial Sequence
  chemically synthesized
accagattcttgtgaaacta

SEQ ID NO: 386715 - DNA, 20 bp, Artificial Sequence
  chemically synthesized
cagattcttgtgaaactaca

SEQ ID NO: 386716 - DNA, 20 bp, Artificial Sequence
  chemically synthesized
tcttgtgaaactacagagaa

SEQ ID NO: 386717 - DNA, 20 bp, Artificial Sequence
  chemically synthesized
actgtctaatccattctctg

SEQ ID NO: 386718 - DNA, 20 bp, Artificial Sequence
  chemically synthesized
tgaaactacagagaatggat

SEQ ID NO: 386719 - DNA, 20 bp, Artificial Sequence
  chemically synthesized
actacagagaatggattaga

SEQ ID NO: 386720 - DNA, 20 bp, Artificial Sequence
  chemically synthesized
aagtacaatctgttatgttt

SEQ ID NO: 386721 - DNA, 20 bp, Artificial Sequence
  chemically synthesized
ttagacagtccaaaacataa

SEQ ID NO: 386722 - DNA, 20 bp, Artificial Sequence
  chemically synthesized
ccacttaccagagcaaacac

SEQ ID NO: 386723 - DNA, 20 bp, Artificial Sequence
  chemically synthesized
gattgtacttgtgtttgctc

SEQ ID NO: 386724 - DNA, 20 bp, Artificial Sequence
  chemically synthesized
gtacttgtgtttgctctggt

SEQ ID NO: 386725 - DNA, 20 bp, Artificial Sequence
  chemically synthesized
cttgtgtttgctctggtaag

SEQ ID NO: 386726 - DNA, 20 bp, Artificial Sequence
  chemically synthesized
aactaaagctccacttacca

SEQ ID NO: 386727 - DNA, 20 bp, Artificial Sequence
  chemically synthesized
tgtgtttgctctggtaagtg

SEQ ID NO: 386728 - DNA, 20 bp, Artificial Sequence
  chemically synthesized
caaactaaagctccacttac

SEQ ID NO: 386729 - DNA, 20 bp, Artificial Sequence
  chemically synthesized
tgctctggtaagtggagctt

SEQ ID NO: 386730 - DNA, 20 bp, Artificial Sequence
  chemically synthesized
tatttctctacatcaaacta

SEQ ID NO: 386731 - DNA, 20 bp, Artificial Sequence
  chemically synthesized
agtggagctttagtttgatg

SEQ ID NO: 386732 - DNA, 20 bp, Artificial Sequence
  chemically synthesized
tggagctttagtttgatgta

SEQ ID NO: 386733 - DNA, 20 bp, Artificial Sequence
  chemically synthesized
ttagtttgatgtagagaaat

SEQ ID NO: 386734 - DNA, 20 bp, Artificial Sequence
  chemically synthesized
agtttgatgtagagaaataa

SEQ ID NO: 386735 - DNA, 20 bp, Artificial Sequence
  chemically synthesized
gtttgatgtagagaaataag

SEQ ID NO: 386736 - DNA, 20 bp, Artificial Sequence
  chemically synthesized
tgtagagaaataagaggaac

SEQ ID NO: 386737 - DNA, 20 bp, Artificial Sequence
  chemically synthesized
tgtccaggtgaaagaaatgc

SEQ ID NO: 386738 - DNA, 20 bp, Artificial Sequence
  chemically synthesized
gaaccggcatttctttcacc

SEQ ID NO: 386739 - DNA, 20 bp, Artificial Sequence
  chemically synthesized
ctttcataatgtccaggtga

SEQ ID NO: 386740 - DNA, 20 bp, Artificial Sequence
  chemically synthesized
acctctctttcataatgtcc

SEQ ID NO: 386741 - DNA, 20 bp, Artificial Sequence
  chemically synthesized
tacctctctttcataatgtc

SEQ ID NO: 386742 - DNA, 20 bp, Artificial Sequence
  chemically synthesized
ctttcacctggacattatga

SEQ ID NO: 386743 - DNA, 20 bp, Artificial Sequence
  chemically synthesized
ttcacctggacattatgaaa

SEQ ID NO: 386744 - DNA, 20 bp, Artificial Sequence
  chemically synthesized
cacctggacattatgaaaga

SEQ ID NO: 386745 - DNA, 20 bp, Artificial Sequence
  chemically synthesized
acctggacattatgaaagag

SEQ ID NO: 386746 - DNA, 20 bp, Artificial Sequence
  chemically synthesized
gctcacttaattggatgatt

SEQ ID NO: 386747 - DNA, 20 bp, Artificial Sequence
  chemically synthesized
ggtatctgaatcatccaatt

SEQ ID NO: 386748 - DNA, 20 bp, Artificial Sequence
  chemically synthesized
tctgaatcatccaattaagt

SEQ ID NO: 386749 - DNA, 20 bp, Artificial Sequence
  chemically synthesized
agatttcctgctcacttaat

SEQ ID NO: 386750 - DNA, 20 bp, Artificial Sequence
  chemically synthesized
gaatcatccaattaagtgag

SEQ ID NO: 386751 - DNA, 20 bp, Artificial Sequence
  chemically synthesized
aatcatccaattaagtgagc

SEQ ID NO: 386752 - DNA, 20 bp, Artificial Sequence
  chemically synthesized
aattaagtgagcaggaaatc

SEQ ID NO: 386753 - DNA, 20 bp, Artificial Sequence
  chemically synthesized
gtaaaacacctacaatattc

SEQ ID NO: 386754 - DNA, 20 bp, Artificial Sequence
  chemically synthesized
gcaggaaatctggaatattg

SEQ ID NO: 386755 - DNA, 20 bp, Artificial Sequence
  chemically synthesized
caggaaatctggaatattgt

SEQ ID NO: 386756 - DNA, 20 bp, Artificial Sequence
  chemically synthesized
agcaggtagaaagaaagaat

SEQ ID NO: 386757 - DNA, 20 bp, Artificial Sequence
  chemically synthesized
caattaagcaggtagaaaga

SEQ ID NO: 386758 - DNA, 20 bp, Artificial Sequence
  chemically synthesized
gatacaattaagcaggtaga

SEQ ID NO: 386759 - DNA, 20 bp, Artificial Sequence
  chemically synthesized
cacagatacaattaagcagg

SEQ ID NO: 386760 - DNA, 20 bp, Artificial Sequence
  chemically synthesized
tagcacagatacaattaagc

SEQ ID NO: 386761 - DNA, 20 bp, Artificial Sequence
  chemically synthesized
atagcacagatacaattaag

SEQ ID NO: 386762 - DNA, 20 bp, Artificial Sequence
  chemically synthesized
gaaatagcacagatacaatt

SEQ ID NO: 386763 - DNA, 20 bp, Artificial Sequence
  chemically synthesized
tgcatttaacagaaatagca

SEQ ID NO: 386764 - DNA, 20 bp, Artificial Sequence
  chemically synthesized
gcagatgcatttaacagaaa

SEQ ID NO: 386765 - DNA, 20 bp, Artificial Sequence
  chemically synthesized
ttcaccgcagatgcatttaa

SEQ ID NO: 386766 - DNA, 20 bp, Artificial Sequence
  chemically synthesized
atttctgttaaatgcatctg

SEQ ID NO: 386767 - DNA, 20 bp, Artificial Sequence
  chemically synthesized
agcaactgcaaagttcaccg

SEQ ID NO: 386768 - DNA, 20 bp, Artificial Sequence
  chemically synthesized
tgcatctgcggtgaactttg

SEQ ID NO: 386769 - DNA, 20 bp, Artificial Sequence
  chemically synthesized
cgctctccttagcaactgca

SEQ ID NO: 386770 - DNA, 20 bp, Artificial Sequence
  chemically synthesized
cggtgaactttgcagttgct

SEQ ID NO: 386771 - DNA, 20 bp, Artificial Sequence
  chemically synthesized
ggtgaactttgcagttgcta

SEQ ID NO: 386772 - DNA, 20 bp, Artificial Sequence
  chemically synthesized
tgaactttgcagttgctaag

SEQ ID NO: 386773 - DNA, 20 bp, Artificial Sequence
  chemically synthesized
aactttgcagttgctaagga

SEQ ID NO: 386774 - DNA, 20 bp, Artificial Sequence
  chemically synthesized
gaattggcaaacgctctcct

SEQ ID NO: 386775 - DNA, 20 bp, Artificial Sequence
  chemically synthesized
ttagactaggcatatggaat

SEQ ID NO: 386776 - DNA, 20 bp, Artificial Sequence
  chemically synthesized
gtttgccaattccatatgcc

SEQ ID NO: 386777 - DNA, 20 bp, Artificial Sequence
  chemically synthesized
cctaccttagactaggcata

SEQ ID NO: 386778 - DNA, 20 bp, Artificial Sequence
  chemically synthesized
caattccatatgcctagtct

SEQ ID NO: 386779 - DNA, 20 bp, Artificial Sequence
  chemically synthesized
aattccatatgcctagtcta

SEQ ID NO: 386780 - DNA, 20 bp, Artificial Sequence
  chemically synthesized
gcttcagcctaccttagact

SEQ ID NO: 386781 - DNA, 20 bp, Artificial Sequence
  chemically synthesized
agcttcagcctaccttagac

SEQ ID NO: 386782 - DNA, 20 bp, Artificial Sequence
  chemically synthesized
tccatatgcctagtctaagg

SEQ ID NO: 386783 - DNA, 20 bp, Artificial Sequence
  chemically synthesized
ccatatgcctagtctaaggt

SEQ ID NO: 386784 - DNA, 20 bp, Artificial Sequence
  chemically synthesized
agattagcttcagcctacct

SEQ ID NO: 386785 - DNA, 20 bp, Artificial Sequence
  chemically synthesized
gcctagtctaaggtaggctg

SEQ ID NO: 386786 - DNA, 20 bp, Artificial Sequence
  chemically synthesized
ccagaatgacagattagctt

SEQ ID NO: 386787 - DNA, 20 bp, Artificial Sequence
  chemically synthesized
gcttctccagaatgacagat

SEQ ID NO: 386788 - DNA, 20 bp, Artificial Sequence
  chemically synthesized
ctgaagctaatctgtcattc

SEQ ID NO: 386789 - DNA, 20 bp, Artificial Sequence
  chemically synthesized
ctcttgcttctccagaatga

SEQ ID NO: 386790 - DNA, 20 bp, Artificial Sequence
  chemically synthesized
gaagctaatctgtcattctg

SEQ ID NO: 386791 - DNA, 20 bp, Artificial Sequence
  chemically synthesized
gctaatctgtcattctggag

SEQ ID NO: 386792 - DNA, 20 bp, Artificial Sequence
  chemically synthesized
atctgtcattctggagaagc

SEQ ID NO: 386793 - DNA, 20 bp, Artificial Sequence
  chemically synthesized
cttagcttctcttgcttctc

SEQ ID NO: 386794 - DNA, 20 bp, Artificial Sequence
  chemically synthesized
ctgtcattctggagaagcaa

SEQ ID NO: 386795 - DNA, 20 bp, Artificial Sequence
  chemically synthesized
tcattctggagaagcaagag

SEQ ID NO: 386796 - DNA, 20 bp, Artificial Sequence
  chemically synthesized
ctggagaagcaagagaagct

SEQ ID NO: 386797 - DNA, 20 bp, Artificial Sequence
  chemically synthesized
tggagaagcaagagaagcta

SEQ ID NO: 386798 - DNA, 20 bp, Artificial Sequence
  chemically synthesized
actaaatattatgaaaacct

SEQ ID NO: 386799 - DNA, 20 bp, Artificial Sequence
  chemically synthesized
gctaaggttttcataatatt

SEQ ID NO: 386800 - DNA, 20 bp, Artificial Sequence
  chemically synthesized
tttcataatatttagttgat

SEQ ID NO: 386801 - DNA, 20 bp, Artificial Sequence
  chemically synthesized
ttcataatatttagttgata

SEQ ID NO: 386802 - DNA, 20 bp, Artificial Sequence
  chemically synthesized
tcataatatttagttgataa

SEQ ID NO: 386803 - DNA, 20 bp, Artificial Sequence
  chemically synthesized
atatttagttgataagggat

SEQ ID NO: 386804 - DNA, 20 bp, Artificial Sequence
  chemically synthesized
ttgataagggatgagaactt

SEQ ID NO: 386805 - DNA, 20 bp, Artificial Sequence
  chemically synthesized
taagagataacatgtatcta

SEQ ID NO: 386806 - DNA, 20 bp, Artificial Sequence
  chemically synthesized
ttggaaaaatagcaaagtaa

SEQ ID NO: 386807 - DNA, 20 bp, Artificial Sequence
  chemically synthesized
ttttggaaaaatagcaaagt

SEQ ID NO: 386808 - DNA, 20 bp, Artificial Sequence
  chemically synthesized
acatttttggaaaaatagca

SEQ ID NO: 386809 - DNA, 20 bp, Artificial Sequence
  chemically synthesized
caaatacatttttggaaaaa

SEQ ID NO: 386810 - DNA, 20 bp, Artificial Sequence
  chemically synthesized
cagtgtttcaaatacatttt

SEQ ID NO: 386811 - DNA, 20 bp, Artificial Sequence
  chemically synthesized
aatgtatttgaaacactgtt

SEQ ID NO: 386812 - DNA, 20 bp, Artificial Sequence
  chemically synthesized
gtatttgaaacactgttaag

SEQ ID NO: 386813 - DNA, 20 bp, Artificial Sequence
  chemically synthesized
atttgaaacactgttaagca

SEQ ID NO: 386814 - DNA, 20 bp, Artificial Sequence
  chemically synthesized
aatattattgctctgcttaa

SEQ ID NO: 386815 - DNA, 20 bp, Artificial Sequence
  chemically synthesized
gcagagcaataatatttatg

SEQ ID NO: 386816 - DNA, 20 bp, Artificial Sequence
  chemically synthesized
tgcagcattttacattttta

SEQ ID NO: 386817 - DNA, 20 bp, Artificial Sequence
  chemically synthesized
atgcatgatgtaatatttaa

SEQ ID NO: 386818 - DNA, 20 bp, Artificial Sequence
  chemically synthesized
gatgcatgatgtaatattta

SEQ ID NO: 386819 - DNA, 20 bp, Artificial Sequence
  chemically synthesized
catcaaaaattatcgatacc

SEQ ID NO: 386820 - DNA, 20 bp, Artificial Sequence
  chemically synthesized
aaattgagacaatcacatct

SEQ ID NO: 386821 - DNA, 20 bp, Artificial Sequence
  chemically synthesized
agatgtgattgtctcaattt

SEQ ID NO: 386822 - DNA, 20 bp, Artificial Sequence
  chemically synthesized
atgtgattgtctcaatttta

SEQ ID NO: 386823 - DNA, 20 bp, Artificial Sequence
  chemically synthesized
attttatcgtctctaaaatt

SEQ ID NO: 386824 - DNA, 20 bp, Artificial Sequence
  chemically synthesized
gagacgataaaattaaaaat

SEQ ID NO: 386825 - DNA, 20 bp, Artificial Sequence
  chemically synthesized
gacgataaaattaaaaataa

SEQ ID NO: 386826 - DNA, 20 bp, Artificial Sequence
  chemically synthesized
acgataaaattaaaaataag

SEQ ID NO: 386827 - DNA, 20 bp, Artificial Sequence
  chemically synthesized
ttataaaataatgacatttt

SEQ ID NO: 386828 - DNA, 20 bp, Artificial Sequence
  chemically synthesized
attttataataactgaacaa

SEQ ID NO: 386829 - DNA, 20 bp, Artificial Sequence
  chemically synthesized
gttgaggtaaaacttttgtt

SEQ ID NO: 386830 - DNA, 20 bp, Artificial Sequence
  chemically synthesized
gtttttgatgttaaatgttg

SEQ ID NO: 386831 - DNA, 20 bp, Artificial Sequence
  chemically synthesized
tgtttttgatgttaaatgtt

SEQ ID NO: 386832 - DNA, 20 bp, Artificial Sequence
  chemically synthesized
aaaaacattttcatttttat

SEQ ID NO: 386833 - DNA, 20 bp, Artificial Sequence
  chemically synthesized
tattttatgtgacgagcaaa

SEQ ID NO: 386834 - DNA, 20 bp, Artificial Sequence
  chemically synthesized
tttaaaatattttatgtgac

SEQ ID NO: 386835 - DNA, 20 bp, Artificial Sequence
  chemically synthesized
tcgtcacataaaatatttta

SEQ ID NO: 386836 - DNA, 20 bp, Artificial Sequence
  chemically synthesized
gtcacataaaatattttaaa

SEQ ID NO: 386837 - DNA, 20 bp, Artificial Sequence
  chemically synthesized
aaatattttaaagagatgtt

SEQ ID NO: 386838 - DNA, 20 bp, Artificial Sequence
  chemically synthesized
aatattttaaagagatgttt

SEQ ID NO: 386839 - DNA, 20 bp, Artificial Sequence
  chemically synthesized
atattttaaagagatgtttg

SEQ ID NO: 386840 - DNA, 20 bp, Artificial Sequence
  chemically synthesized
agagatgtttggggtttaaa

SEQ ID NO: 386841 - DNA, 20 bp, Artificial Sequence
  chemically synthesized
gtttggggtttaaacagatt

SEQ ID NO: 386842 - DNA, 20 bp, Artificial Sequence
  chemically synthesized
aaacagattaagtatttcta

SEQ ID NO: 386843 - DNA, 20 bp, Artificial Sequence
  chemically synthesized
tttgttaattcaaggcacta

SEQ ID NO: 386844 - DNA, 20 bp, Artificial Sequence
  chemically synthesized
tacttttatttgttaattca

SEQ ID NO: 386845 - DNA, 20 bp, Artificial Sequence
  chemically synthesized
ttacttttatttgttaattc

SEQ ID NO: 386846 - DNA, 20 bp, Artificial Sequence
  chemically synthesized
tgccttgaattaacaaataa

SEQ ID NO: 386847 - DNA, 20 bp, Artificial Sequence
  chemically synthesized
acaatagatgggtgtagttt

SEQ ID NO: 386848 - DNA, 20 bp, Artificial Sequence
  chemically synthesized
agcaagacaatagatgggtg

SEQ ID NO: 386849 - DNA, 20 bp, Artificial Sequence
  chemically synthesized
ttcatagcaagacaatagat

SEQ ID NO: 386850 - DNA, 20 bp, Artificial Sequence
  chemically synthesized
tttcatagcaagacaataga

SEQ ID NO: 386851 - DNA, 20 bp, Artificial Sequence
  chemically synthesized
taggtttcatagcaagacaa

SEQ ID NO: 386852 - DNA, 20 bp, Artificial Sequence
  chemically synthesized
ttacctctaggtttcatagc

SEQ ID NO: 386853 - DNA, 20 bp, Artificial Sequence
  chemically synthesized
tattgtcttgctatgaaacc

SEQ ID NO: 386854 - DNA, 20 bp, Artificial Sequence
  chemically synthesized
cactttacctctaggtttca

SEQ ID NO: 386855 - DNA, 20 bp, Artificial Sequence
  chemically synthesized
ttgtcttgctatgaaaccta

SEQ ID NO: 386856 - DNA, 20 bp, Artificial Sequence
  chemically synthesized
tgtcttgctatgaaacctag

SEQ ID NO: 386857 - DNA, 20 bp, Artificial Sequence
  chemically synthesized
tgctatgaaacctagaggta

SEQ ID NO: 386858 - DNA, 20 bp, Artificial Sequence
  chemically synthesized
ttcacatacactttacctct

SEQ ID NO: 386859 - DNA, 20 bp, Artificial Sequence
  chemically synthesized
cttcacatacactttacctc

SEQ ID NO: 386860 - DNA, 20 bp, Artificial Sequence
  chemically synthesized
ctagaggtaaagtgtatgtg

SEQ ID NO: 386861 - DNA, 20 bp, Artificial Sequence
  chemically synthesized
aaagtgtatgtgaagtaaaa

SEQ ID NO: 386862 - DNA, 20 bp, Artificial Sequence
  chemically synthesized
gaagtaaaacagtatttttg

SEQ ID NO: 386863 - DNA, 20 bp, Artificial Sequence
  chemically synthesized
gatttaattgaagcaatggt

SEQ ID NO: 386864 - DNA, 20 bp, Artificial Sequence
  chemically synthesized
taacgatttaattgaagcaa

SEQ ID NO: 386865 - DNA, 20 bp, Artificial Sequence
  chemically synthesized
tgtatgtaacgatttaattg

SEQ ID NO: 386866 - DNA, 20 bp, Artificial Sequence
  chemically synthesized
cacacgcacacataatatat

SEQ ID NO: 386867 - DNA, 20 bp, Artificial Sequence
  chemically synthesized
acacataatatattagatga

SEQ ID NO: 386868 - DNA, 20 bp, Artificial Sequence
  chemically synthesized
ataatatattagatgataga

SEQ ID NO: 386869 - DNA, 20 bp, Artificial Sequence
  chemically synthesized
atattagatgatagatagat

SEQ ID NO: 386870 - DNA, 20 bp, Artificial Sequence
  chemically synthesized
tagatgatagatagattaga

SEQ ID NO: 386871 - DNA, 20 bp, Artificial Sequence
  chemically synthesized
agatgatagatagattagat

SEQ ID NO: 386872 - DNA, 20 bp, Artificial Sequence
  chemically synthesized
tgatagatagattagatagg

SEQ ID NO: 386873 - DNA, 20 bp, Artificial Sequence
  chemically synthesized
gatagatagattagataggt

SEQ ID NO: 386874 - DNA, 20 bp, Artificial Sequence
  chemically synthesized
agatagattagataggtagg

SEQ ID NO: 386875 - DNA, 20 bp, Artificial Sequence
  chemically synthesized
gatagattagataggtaggt

SEQ ID NO: 386876 - DNA, 20 bp, Artificial Sequence
  chemically synthesized
agattagataggtaggtagg

SEQ ID NO: 386877 - DNA, 20 bp, Artificial Sequence
  chemically synthesized
gattagataggtaggtaggt

SEQ ID NO: 386878 - DNA, 20 bp, Artificial Sequence
  chemically synthesized
tagataggtaggtaggtagg

SEQ ID NO: 386879 - DNA, 20 bp, Artificial Sequence
  chemically synthesized
taggtaggtaggtaggtaga

SEQ ID NO: 386880 - DNA, 20 bp, Artificial Sequence
  chemically synthesized
taggtaggtaggtagataga

SEQ ID NO: 386881 - DNA, 20 bp, Artificial Sequence
  chemically synthesized
taggtaggtagatagataga

SEQ ID NO: 386882 - DNA, 20 bp, Artificial Sequence
  chemically synthesized
taggtagatagatagataga

SEQ ID NO: 386883 - DNA, 20 bp, Artificial Sequence
  chemically synthesized
tagatagatagatagataga

SEQ ID NO: 386884 - DNA, 20 bp, Artificial Sequence
  chemically synthesized
tagatagatagatagataga

SEQ ID NO: 386885 - DNA, 20 bp, Artificial Sequence
  chemically synthesized
tagatagatagatagataga

SEQ ID NO: 386886 - DNA, 20 bp, Artificial Sequence
  chemically synthesized
tagatagatagatagataga

SEQ ID NO: 386887 - DNA, 20 bp, Artificial Sequence
  chemically synthesized
tagatagatagatagataga

SEQ ID NO: 386888 - DNA, 20 bp, Artificial Sequence
  chemically synthesized
tagatagatagatagataga

SEQ ID NO: 386889 - DNA, 20 bp, Artificial Sequence
  chemically synthesized
tagatagatagatagataga

SEQ ID NO: 386890 - DNA, 20 bp, Artificial Sequence
  chemically synthesized
tagatagatagatagataga

SEQ ID NO: 386891 - DNA, 20 bp, Artificial Sequence
  chemically synthesized
tagatagatagatagataga

SEQ ID NO: 386892 - DNA, 20 bp, Artificial Sequence
  chemically synthesized
tagatagatagatagacaga

SEQ ID NO: 386893 - DNA, 20 bp, Artificial Sequence
  chemically synthesized
tagatagatagacagacaga

SEQ ID NO: 386894 - DNA, 20 bp, Artificial Sequence
  chemically synthesized
tagatagacagacagacaga

SEQ ID NO: 386895 - DNA, 20 bp, Artificial Sequence
  chemically synthesized
tagacagacagacagacaga

SEQ ID NO: 386896 - DNA, 20 bp, Artificial Sequence
  chemically synthesized
cagacagacagacagacaga

SEQ ID NO: 386897 - DNA, 20 bp, Artificial Sequence
  chemically synthesized
cagacagacagacagacaga

SEQ ID NO: 386898 - DNA, 20 bp, Artificial Sequence
  chemically synthesized
agacagacagacagacagat

SEQ ID NO: 386899 - DNA, 20 bp, Artificial Sequence
  chemically synthesized
cttgccagtttttttcagtg

SEQ ID NO: 386900 - DNA, 20 bp, Artificial Sequence
  chemically synthesized
gcttgccagtttttttcagt

SEQ ID NO: 386901 - DNA, 20 bp, Artificial Sequence
  chemically synthesized
agcttgccagtttttttcag

SEQ ID NO: 386902 - DNA, 20 bp, Artificial Sequence
  chemically synthesized
gcaagcttgccagttttttt

SEQ ID NO: 386903 - DNA, 20 bp, Artificial Sequence
  chemically synthesized
tgatccccactgaaaaaaac

SEQ ID NO: 386904 - DNA, 20 bp, Artificial Sequence
  chemically synthesized
ccccactgaaaaaaactggc

SEQ ID NO: 386905 - DNA, 20 bp, Artificial Sequence
  chemically synthesized
tcacttttaggcaagcttgc

SEQ ID NO: 386906 - DNA, 20 bp, Artificial Sequence
  chemically synthesized
aaactggcaagcttgcctaa

SEQ ID NO: 386907 - DNA, 20 bp, Artificial Sequence
  chemically synthesized
aattctcctcacttttaggc

SEQ ID NO: 386908 - DNA, 20 bp, Artificial Sequence
  chemically synthesized
tggcaagcttgcctaaaagt

SEQ ID NO: 386909 - DNA, 20 bp, Artificial Sequence
  chemically synthesized
ggcaagcttgcctaaaagtg

SEQ ID NO: 386910 - DNA, 20 bp, Artificial Sequence
  chemically synthesized
taataattctcctcactttt

SEQ ID NO: 386911 - DNA, 20 bp, Artificial Sequence
  chemically synthesized
ttaataattctcctcacttt

SEQ ID NO: 386912 - DNA, 20 bp, Artificial Sequence
  chemically synthesized
caagcttgcctaaaagtgag

SEQ ID NO: 386913 - DNA, 20 bp, Artificial Sequence
  chemically synthesized
taaaagtgaggagaattatt

SEQ ID NO: 386914 - DNA, 20 bp, Artificial Sequence
  chemically synthesized
tgaggagaattattaagaaa

SEQ ID NO: 386915 - DNA, 20 bp, Artificial Sequence
  chemically synthesized
taagaaatagtaaactaccc

SEQ ID NO: 386916 - DNA, 20 bp, Artificial Sequence
  chemically synthesized
aagaaatagtaaactaccca

SEQ ID NO: 386917 - DNA, 20 bp, Artificial Sequence
  chemically synthesized
aagaacagaatgtccttggg

SEQ ID NO: 386918 - DNA, 20 bp, Artificial Sequence
  chemically synthesized
gaaaagaacagaatgtcctt

SEQ ID NO: 386919 - DNA, 20 bp, Artificial Sequence
  chemically synthesized
ggaaaagaacagaatgtcct

SEQ ID NO: 386920 - DNA, 20 bp, Artificial Sequence
  chemically synthesized
tttatgtgtaaggaaaagaa

SEQ ID NO: 386921 - DNA, 20 bp, Artificial Sequence
  chemically synthesized
tcatatttatgtgtaaggaa

SEQ ID NO: 386922 - DNA, 20 bp, Artificial Sequence
  chemically synthesized
atcgttcatatttatgtgta

SEQ ID NO: 386923 - DNA, 20 bp, Artificial Sequence
  chemically synthesized
catcgttcatatttatgtgt

SEQ ID NO: 386924 - DNA, 20 bp, Artificial Sequence
  chemically synthesized
ttacacataaatatgaacga

SEQ ID NO: 386925 - DNA, 20 bp, Artificial Sequence
  chemically synthesized
tgaacgatggtgctcccctt

SEQ ID NO: 386926 - DNA, 20 bp, Artificial Sequence
  chemically synthesized
agaaagttggaaccaaaggg

SEQ ID NO: 386927 - DNA, 20 bp, Artificial Sequence
  chemically synthesized
acagaaagttggaaccaaag

SEQ ID NO: 386928 - DNA, 20 bp, Artificial Sequence
  chemically synthesized
cacagaaagttggaaccaaa

SEQ ID NO: 386929 - DNA, 20 bp, Artificial Sequence
  chemically synthesized
acacagaaagttggaaccaa

SEQ ID NO: 386930 - DNA, 20 bp, Artificial Sequence
  chemically synthesized
aacacagaaagttggaacca

SEQ ID NO: 386931 - DNA, 20 bp, Artificial Sequence
  chemically synthesized
ggggatgaaacacagaaagt

SEQ ID NO: 386932 - DNA, 20 bp, Artificial Sequence
  chemically synthesized
gataggggatgaaacacaga

SEQ ID NO: 386933 - DNA, 20 bp, Artificial Sequence
  chemically synthesized
gcatgataggggatgaaaca

SEQ ID NO: 386934 - DNA, 20 bp, Artificial Sequence
  chemically synthesized
acacaatggtggcatgatag

SEQ ID NO: 386935 - DNA, 20 bp, Artificial Sequence
  chemically synthesized
aacacaatggtggcatgata

SEQ ID NO: 386936 - DNA, 20 bp, Artificial Sequence
  chemically synthesized
taacacaatggtggcatgat

SEQ ID NO: 386937 - DNA, 20 bp, Artificial Sequence
  chemically synthesized
ctaacacaatggtggcatga

SEQ ID NO: 386938 - DNA, 20 bp, Artificial Sequence
  chemically synthesized
gggaaacactaacacaatgg

SEQ ID NO: 386939 - DNA, 20 bp, Artificial Sequence
  chemically synthesized
ctatcatgccaccattgtgt

SEQ ID NO: 386940 - DNA, 20 bp, Artificial Sequence
  chemically synthesized
aatgggaaacactaacacaa

SEQ ID NO: 386941 - DNA, 20 bp, Artificial Sequence
  chemically synthesized
tttgaatgtaaaggagaaat

SEQ ID NO: 386942 - DNA, 20 bp, Artificial Sequence
  chemically synthesized
ctttgaatgtaaaggagaaa

SEQ ID NO: 386943 - DNA, 20 bp, Artificial Sequence
  chemically synthesized
gcaacactttgaatgtaaag

SEQ ID NO: 386944 - DNA, 20 bp, Artificial Sequence
  chemically synthesized
aggcaacactttgaatgtaa

SEQ ID NO: 386945 - DNA, 20 bp, Artificial Sequence
  chemically synthesized
caggcaacactttgaatgta

SEQ ID NO: 386946 - DNA, 20 bp, Artificial Sequence
  chemically synthesized
ccatttctcctttacattca

SEQ ID NO: 386947 - DNA, 20 bp, Artificial Sequence
  chemically synthesized
attaaaatattaaatgggac

SEQ ID NO: 386948 - DNA, 20 bp, Artificial Sequence
  chemically synthesized
gattaaaatattaaatggga

SEQ ID NO: 386949 - DNA, 20 bp, Artificial Sequence
  chemically synthesized
ttcagattaaaatattaaat

SEQ ID NO: 386950 - DNA, 20 bp, Artificial Sequence
  chemically synthesized
cttcagattaaaatattaaa

SEQ ID NO: 386951 - DNA, 20 bp, Artificial Sequence
  chemically synthesized
ccatttaatattttaatctg

SEQ ID NO: 386952 - DNA, 20 bp, Artificial Sequence
  chemically synthesized
tcccatcccaaggatttctt

SEQ ID NO: 386953 - DNA, 20 bp, Artificial Sequence
  chemically synthesized
ttttaatctgaagaaatcct

SEQ ID NO: 386954 - DNA, 20 bp, Artificial Sequence
  chemically synthesized
tttaatctgaagaaatcctt

SEQ ID NO: 386955 - DNA, 20 bp, Artificial Sequence
  chemically synthesized
atctgaagaaatccttggga

SEQ ID NO: 386956 - DNA, 20 bp, Artificial Sequence
  chemically synthesized
tctgaagaaatccttgggat

SEQ ID NO: 386957 - DNA, 20 bp, Artificial Sequence
  chemically synthesized
ccattgtgtttcccatccca

SEQ ID NO: 386958 - DNA, 20 bp, Artificial Sequence
  chemically synthesized
accattgtgtttcccatccc

SEQ ID NO: 386959 - DNA, 20 bp, Artificial Sequence
  chemically synthesized
ccttgggatgggaaacacaa

SEQ ID NO: 386960 - DNA, 20 bp, Artificial Sequence
  chemically synthesized
ggatgggaaacacaatggta

SEQ ID NO: 386961 - DNA, 20 bp, Artificial Sequence
  chemically synthesized
aaacacaatggtaaagaatg

SEQ ID NO: 386962 - DNA, 20 bp, Artificial Sequence
  chemically synthesized
taatcatcagtatttttaaa

SEQ ID NO: 386963 - DNA, 20 bp, Artificial Sequence
  chemically synthesized
taagaatacattgtaatcat

SEQ ID NO: 386964 - DNA, 20 bp, Artificial Sequence
  chemically synthesized
gattacaatgtattcttaac

SEQ ID NO: 386965 - DNA, 20 bp, Artificial Sequence
  chemically synthesized
aaattcatccaaagcttgtt

SEQ ID NO: 386966 - DNA, 20 bp, Artificial Sequence
  chemically synthesized
aatgtattcttaacaagctt

SEQ ID NO: 386967 - DNA, 20 bp, Artificial Sequence
  chemically synthesized
gactaatacaaattcatcca

SEQ ID NO: 386968 - DNA, 20 bp, Artificial Sequence
  chemically synthesized
agctttggatgaatttgtat

SEQ ID NO: 386969 - DNA, 20 bp, Artificial Sequence
  chemically synthesized
atttgtattagtcgcccaaa

SEQ ID NO: 386970 - DNA, 20 bp, Artificial Sequence
  chemically synthesized
gattttttttagaactgttt

SEQ ID NO: 386971 - DNA, 20 bp, Artificial Sequence
  chemically synthesized
tgattttttttagaactgtt

SEQ ID NO: 386972 - DNA, 20 bp, Artificial Sequence
  chemically synthesized
gctgttatgctgattttttt

SEQ ID NO: 386973 - DNA, 20 bp, Artificial Sequence
  chemically synthesized
caaacagttctaaaaaaaat

SEQ ID NO: 386974 - DNA, 20 bp, Artificial Sequence
  chemically synthesized
tctaaaaaaaatcagcataa

SEQ ID NO: 386975 - DNA, 20 bp, Artificial Sequence
  chemically synthesized
gggacatattcagaaaggat

SEQ ID NO: 386976 - DNA, 20 bp, Artificial Sequence
  chemically synthesized
tttcagggacatattcagaa

SEQ ID NO: 386977 - DNA, 20 bp, Artificial Sequence
  chemically synthesized
ctttcagggacatattcaga

SEQ ID NO: 386978 - DNA, 20 bp, Artificial Sequence
  chemically synthesized
ttttctttcagggacatatt

SEQ ID NO: 386979 - DNA, 20 bp, Artificial Sequence
  chemically synthesized
ctttctgaatatgtccctga

SEQ ID NO: 386980 - DNA, 20 bp, Artificial Sequence
  chemically synthesized
agtgctgagcttttctttca

SEQ ID NO: 386981 - DNA, 20 bp, Artificial Sequence
  chemically synthesized
tgaatatgtccctgaaagaa

SEQ ID NO: 386982 - DNA, 20 bp, Artificial Sequence
  chemically synthesized
cagtgctgagcttttctttc

SEQ ID NO: 386983 - DNA, 20 bp, Artificial Sequence
  chemically synthesized
acagtgctgagcttttcttt

SEQ ID NO: 386984 - DNA, 20 bp, Artificial Sequence
  chemically synthesized
atgtccctgaaagaaaagct

SEQ ID NO: 386985 - DNA, 20 bp, Artificial Sequence
  chemically synthesized
atggagttgcatacagtgct

SEQ ID NO: 386986 - DNA, 20 bp, Artificial Sequence
  chemically synthesized
ccatatgatggagttgcata

SEQ ID NO: 386987 - DNA, 20 bp, Artificial Sequence
  chemically synthesized
ctgtatgcaactccatcata

SEQ ID NO: 386988 - DNA, 20 bp, Artificial Sequence
  chemically synthesized
gttctgggctccatatgatg

SEQ ID NO: 386989 - DNA, 20 bp, Artificial Sequence
  chemically synthesized
gtatgcaactccatcatatg

SEQ ID NO: 386990 - DNA, 20 bp, Artificial Sequence
  chemically synthesized
atgttctgggctccatatga

SEQ ID NO: 386991 - DNA, 20 bp, Artificial Sequence
  chemically synthesized
caactccatcatatggagcc

SEQ ID NO: 386992 - DNA, 20 bp, Artificial Sequence
  chemically synthesized
tatccacaaagagatgttct

SEQ ID NO: 386993 - DNA, 20 bp, Artificial Sequence
  chemically synthesized
atatccacaaagagatgttc

SEQ ID NO: 386994 - DNA, 20 bp, Artificial Sequence
  chemically synthesized
gagcccagaacatctctttg

SEQ ID NO: 386995 - DNA, 20 bp, Artificial Sequence
  chemically synthesized
tttagtcacatatccacaaa

SEQ ID NO: 386996 - DNA, 20 bp, Artificial Sequence
  chemically synthesized
cctttagtcacatatccaca

SEQ ID NO: 386997 - DNA, 20 bp, Artificial Sequence
  chemically synthesized
tctttgtggatatgtgacta

SEQ ID NO: 386998 - DNA, 20 bp, Artificial Sequence
  chemically synthesized
ctttgtggatatgtgactaa

SEQ ID NO: 386999 - DNA, 20 bp, Artificial Sequence
  chemically synthesized
ctggatgtttattttgcctt

SEQ ID NO: 387000 - DNA, 20 bp, Artificial Sequence
  chemically synthesized
ctaaaggcaaaataaacatc

SEQ ID NO: 387001 - DNA, 20 bp, Artificial Sequence
  chemically synthesized
caaaataaacatccagtgta

SEQ ID NO: 387002 - DNA, 20 bp, Artificial Sequence
  chemically synthesized
aaaataaacatccagtgtaa

SEQ ID NO: 387003 - DNA, 20 bp, Artificial Sequence
  chemically synthesized
ttgcctctgcacctttacac

SEQ ID NO: 387004 - DNA, 20 bp, Artificial Sequence
  chemically synthesized
aaacatccagtgtaaaggtg

SEQ ID NO: 387005 - DNA, 20 bp, Artificial Sequence
  chemically synthesized
acatccagtgtaaaggtgca

SEQ ID NO: 387006 - DNA, 20 bp, Artificial Sequence
  chemically synthesized
catccagtgtaaaggtgcag

SEQ ID NO: 387007 - DNA, 20 bp, Artificial Sequence
  chemically synthesized
ggcaaaaaaaaaaaaaaaaa

SEQ ID NO: 387008 - DNA, 20 bp, Artificial Sequence
  chemically synthesized
caaaaaaaaaaaaaaaaata

SEQ ID NO: 387009 - DNA, 20 bp, Artificial Sequence
  chemically synthesized
aaaaaaaaaaaaaaatagag

SEQ ID NO: 387010 - DNA, 20 bp, Artificial Sequence
  chemically synthesized
aaaaaaatagagtggtctat

SEQ ID NO: 387011 - DNA, 20 bp, Artificial Sequence
  chemically synthesized
aaaaatagagtggtctattg

SEQ ID NO: 387012 - DNA, 20 bp, Artificial Sequence
  chemically synthesized
aaaatagagtggtctattgg

SEQ ID NO: 387013 - DNA, 20 bp, Artificial Sequence
  chemically synthesized
tccatctgtatttcctccaa

SEQ ID NO: 387014 - DNA, 20 bp, Artificial Sequence
  chemically synthesized
gtggtctattggaggaaata

SEQ ID NO: 387015 - DNA, 20 bp, Artificial Sequence
  chemically synthesized
tctattggaggaaatacaga

SEQ ID NO: 387016 - DNA, 20 bp, Artificial Sequence
  chemically synthesized
tggaggaaatacagatggac

SEQ ID NO: 387017 - DNA, 20 bp, Artificial Sequence
  chemically synthesized
tacagatggactggtattgc

SEQ ID NO: 387018 - DNA, 20 bp, Artificial Sequence
  chemically synthesized
caccgttctactagcaatac

SEQ ID NO: 387019 - DNA, 20 bp, Artificial Sequence
  chemically synthesized
agatggactggtattgctag

SEQ ID NO: 387020 - DNA, 20 bp, Artificial Sequence
  chemically synthesized
gactggtattgctagtagaa

SEQ ID NO: 387021 - DNA, 20 bp, Artificial Sequence
  chemically synthesized
ttcattcaccaccgttctac

SEQ ID NO: 387022 - DNA, 20 bp, Artificial Sequence
  chemically synthesized
tggtattgctagtagaacgg

SEQ ID NO: 387023 - DNA, 20 bp, Artificial Sequence
  chemically synthesized
tagtagaacggtggtgaatg

SEQ ID NO: 387024 - DNA, 20 bp, Artificial Sequence
  chemically synthesized
agaacggtggtgaatgaagc

SEQ ID NO: 387025 - DNA, 20 bp, Artificial Sequence
  chemically synthesized
ggtgaatgaagctagaacta

SEQ ID NO: 387026 - DNA, 20 bp, Artificial Sequence
  chemically synthesized
ctagttcatggctatagttc

SEQ ID NO: 387027 - DNA, 20 bp, Artificial Sequence
  chemically synthesized
aaaaatctagttcatggcta

SEQ ID NO: 387028 - DNA, 20 bp, Artificial Sequence
  chemically synthesized
ctagaactatagccatgaac

SEQ ID NO: 387029 - DNA, 20 bp, Artificial Sequence
  chemically synthesized
gtttctaaaaatctagttca

SEQ ID NO: 387030 - DNA, 20 bp, Artificial Sequence
  chemically synthesized
atagccatgaactagatttt

SEQ ID NO: 387031 - DNA, 20 bp, Artificial Sequence
  chemically synthesized
gatactggtttctaaaaatc

SEQ ID NO: 387032 - DNA, 20 bp, Artificial Sequence
  chemically synthesized
tgaactagatttttagaaac

SEQ ID NO: 387033 - DNA, 20 bp, Artificial Sequence
  chemically synthesized
aacccccaagtataggatac

SEQ ID NO: 387034 - DNA, 20 bp, Artificial Sequence
  chemically synthesized
agaaaccagtatcctatact

SEQ ID NO: 387035 - DNA, 20 bp, Artificial Sequence
  chemically synthesized
gaaaccagtatcctatactt

SEQ ID NO: 387036 - DNA, 20 bp, Artificial Sequence
  chemically synthesized
aaaccagtatcctatacttg

SEQ ID NO: 387037 - DNA, 20 bp, Artificial Sequence
  chemically synthesized
gaaatctaacccccaagtat

SEQ ID NO: 387038 - DNA, 20 bp, Artificial Sequence
  chemically synthesized
aaccagtatcctatacttgg

SEQ ID NO: 387039 - DNA, 20 bp, Artificial Sequence
  chemically synthesized
tgaaatctaacccccaagta

SEQ ID NO: 387040 - DNA, 20 bp, Artificial Sequence
  chemically synthesized
agtatcctatacttgggggt

SEQ ID NO: 387041 - DNA, 20 bp, Artificial Sequence
  chemically synthesized
cataatgaaatctaaccccc

SEQ ID NO: 387042 - DNA, 20 bp, Artificial Sequence
  chemically synthesized
gggggttagatttcattatg

SEQ ID NO: 387043 - DNA, 20 bp, Artificial Sequence
  chemically synthesized
gttagatttcattatgtaga

SEQ ID NO: 387044 - DNA, 20 bp, Artificial Sequence
  chemically synthesized
agatttcattatgtagacag

SEQ ID NO: 387045 - DNA, 20 bp, Artificial Sequence
  chemically synthesized
cattatgtagacagtagttg

SEQ ID NO: 387046 - DNA, 20 bp, Artificial Sequence
  chemically synthesized
acagtagttgtggcaaccta

SEQ ID NO: 387047 - DNA, 20 bp, Artificial Sequence
  chemically synthesized
cagtagttgtggcaacctat

SEQ ID NO: 387048 - DNA, 20 bp, Artificial Sequence
  chemically synthesized
tggaccctacttaatcccat

SEQ ID NO: 387049 - DNA, 20 bp, Artificial Sequence
  chemically synthesized
ttgtggcaacctatgggatt

SEQ ID NO: 387050 - DNA, 20 bp, Artificial Sequence
  chemically synthesized
ttggaccctacttaatccca

SEQ ID NO: 387051 - DNA, 20 bp, Artificial Sequence
  chemically synthesized
tggcaacctatgggattaag

SEQ ID NO: 387052 - DNA, 20 bp, Artificial Sequence
  chemically synthesized
ggcaacctatgggattaagt

SEQ ID NO: 387053 - DNA, 20 bp, Artificial Sequence
  chemically synthesized
gcaacctatgggattaagta

SEQ ID NO: 387054 - DNA, 20 bp, Artificial Sequence
  chemically synthesized
tactactacatatttgtttt

SEQ ID NO: 387055 - DNA, 20 bp, Artificial Sequence
  chemically synthesized
agggtccaaaaacaaatatg

SEQ ID NO: 387056 - DNA, 20 bp, Artificial Sequence
  chemically synthesized
gtccaaaaacaaatatgtag

SEQ ID NO: 387057 - DNA, 20 bp, Artificial Sequence
  chemically synthesized
caaaaacaaatatgtagtag

SEQ ID NO: 387058 - DNA, 20 bp, Artificial Sequence
  chemically synthesized
aaacaaatatgtagtagtag

SEQ ID NO: 387059 - DNA, 20 bp, Artificial Sequence
  chemically synthesized
caaatatgtagtagtagtag

SEQ ID NO: 387060 - DNA, 20 bp, Artificial Sequence
  chemically synthesized
atatgtagtagtagtagtag

SEQ ID NO: 387061 - DNA, 20 bp, Artificial Sequence
  chemically synthesized
tgtagtagtagtagtagtag

SEQ ID NO: 387062 - DNA, 20 bp, Artificial Sequence
  chemically synthesized
agtagtagtagtagtagcag

SEQ ID NO: 387063 - DNA, 20 bp, Artificial Sequence
  chemically synthesized
agtagtagtagtagcagcag

SEQ ID NO: 387064 - DNA, 20 bp, Artificial Sequence
  chemically synthesized
agtagtagtagcagcagcag

SEQ ID NO: 387065 - DNA, 20 bp, Artificial Sequence
  chemically synthesized
agtagtagcagcagcagcag

SEQ ID NO: 387066 - DNA, 20 bp, Artificial Sequence
  chemically synthesized
agcagcagcagcagtagtaa

SEQ ID NO: 387067 - DNA, 20 bp, Artificial Sequence
  chemically synthesized
gtaacagcaatgacaacatc

SEQ ID NO: 387068 - DNA, 20 bp, Artificial Sequence
  chemically synthesized
taacagcaatgacaacatct

SEQ ID NO: 387069 - DNA, 20 bp, Artificial Sequence
  chemically synthesized
tttaagtgctcaatagatcc

SEQ ID NO: 387070 - DNA, 20 bp, Artificial Sequence
  chemically synthesized
gacaacatctaggatctatt

SEQ ID NO: 387071 - DNA, 20 bp, Artificial Sequence
  chemically synthesized
ggcctgttttaagtgctcaa

SEQ ID NO: 387072 - DNA, 20 bp, Artificial Sequence
  chemically synthesized
gatctattgagcacttaaaa

SEQ ID NO: 387073 - DNA, 20 bp, Artificial Sequence
  chemically synthesized
atctattgagcacttaaaac

SEQ ID NO: 387074 - DNA, 20 bp, Artificial Sequence
  chemically synthesized
aacagtatttggcctgtttt

SEQ ID NO: 387075 - DNA, 20 bp, Artificial Sequence
  chemically synthesized
aaagagcttaaaacagtatt

SEQ ID NO: 387076 - DNA, 20 bp, Artificial Sequence
  chemically synthesized
aacaggccaaatactgtttt

SEQ ID NO: 387077 - DNA, 20 bp, Artificial Sequence
  chemically synthesized
tacaagtaaagagcttaaaa

SEQ ID NO: 387078 - DNA, 20 bp, Artificial Sequence
  chemically synthesized
aaatagctgatacaagtaaa

SEQ ID NO: 387079 - DNA, 20 bp, Artificial Sequence
  chemically synthesized
ttaaatagctgatacaagta

SEQ ID NO: 387080 - DNA, 20 bp, Artificial Sequence
  chemically synthesized
tttaagctctttacttgtat

SEQ ID NO: 387081 - DNA, 20 bp, Artificial Sequence
  chemically synthesized
gagaattaaatagctgatac

SEQ ID NO: 387082 - DNA, 20 bp, Artificial Sequence
  chemically synthesized
ttatttctatgagaattaaa

SEQ ID NO: 387083 - DNA, 20 bp, Artificial Sequence
  chemically synthesized
tatcagctatttaattctca

SEQ ID NO: 387084 - DNA, 20 bp, Artificial Sequence
  chemically synthesized
aaaatgatacttatttctat

SEQ ID NO: 387085 - DNA, 20 bp, Artificial Sequence
  chemically synthesized
tatttaattctcatagaaat

SEQ ID NO: 387086 - DNA, 20 bp, Artificial Sequence
  chemically synthesized
atcattttatcatcatttta

SEQ ID NO: 387087 - DNA, 20 bp, Artificial Sequence
  chemically synthesized
tcattttatcatcattttac

SEQ ID NO: 387088 - DNA, 20 bp, Artificial Sequence
  chemically synthesized
tttatcatcattttacaggt

SEQ ID NO: 387089 - DNA, 20 bp, Artificial Sequence
  chemically synthesized
cattttacaggtgagtgatg

SEQ ID NO: 387090 - DNA, 20 bp, Artificial Sequence
  chemically synthesized
ctacctccataatgtgtagc

SEQ ID NO: 387091 - DNA, 20 bp, Artificial Sequence
  chemically synthesized
aagtatcttgctacacatta

SEQ ID NO: 387092 - DNA, 20 bp, Artificial Sequence
  chemically synthesized
cttactacctccataatgtg

SEQ ID NO: 387093 - DNA, 20 bp, Artificial Sequence
  chemically synthesized
gtatcttgctacacattatg

SEQ ID NO: 387094 - DNA, 20 bp, Artificial Sequence
  chemically synthesized
tatcttgctacacattatgg

SEQ ID NO: 387095 - DNA, 20 bp, Artificial Sequence
  chemically synthesized
cttgctacacattatggagg

SEQ ID NO: 387096 - DNA, 20 bp, Artificial Sequence
  chemically synthesized
ctacacattatggaggtagt

SEQ ID NO: 387097 - DNA, 20 bp, Artificial Sequence
  chemically synthesized
cacattatggaggtagtaag

SEQ ID NO: 387098 - DNA, 20 bp, Artificial Sequence
  chemically synthesized
tatggaggtagtaagtagca

SEQ ID NO: 387099 - DNA, 20 bp, Artificial Sequence
  chemically synthesized
gaggtagtaagtagcaaagc

SEQ ID NO: 387100 - DNA, 20 bp, Artificial Sequence
  chemically synthesized
actggtttctgtttgaattc

SEQ ID NO: 387101 - DNA, 20 bp, Artificial Sequence
  chemically synthesized
tagcaaagctggaattcaaa

SEQ ID NO: 387102 - DNA, 20 bp, Artificial Sequence
  chemically synthesized
gctggaattcaaacagaaac

SEQ ID NO: 387103 - DNA, 20 bp, Artificial Sequence
  chemically synthesized
ggtgcagtgtaaaggcacac

SEQ ID NO: 387104 - DNA, 20 bp, Artificial Sequence
  chemically synthesized
tacagggtggtgcagtgtaa

SEQ ID NO: 387105 - DNA, 20 bp, Artificial Sequence
  chemically synthesized
atacagggtggtgcagtgta

SEQ ID NO: 387106 - DNA, 20 bp, Artificial Sequence
  chemically synthesized
cctaagcatacagggtggtg

SEQ ID NO: 387107 - DNA, 20 bp, Artificial Sequence
  chemically synthesized
atctccctaagcatacaggg

SEQ ID NO: 387108 - DNA, 20 bp, Artificial Sequence
  chemically synthesized
gtgatctccctaagcataca

SEQ ID NO: 387109 - DNA, 20 bp, Artificial Sequence
  chemically synthesized
actgcaccaccctgtatgct

SEQ ID NO: 387110 - DNA, 20 bp, Artificial Sequence
  chemically synthesized
agtgatctccctaagcatac

SEQ ID NO: 387111 - DNA, 20 bp, Artificial Sequence
  chemically synthesized
ctgcaccaccctgtatgctt

SEQ ID NO: 387112 - DNA, 20 bp, Artificial Sequence
  chemically synthesized
gagtgatctccctaagcata

SEQ ID NO: 387113 - DNA, 20 bp, Artificial Sequence
  chemically synthesized
tgcaccaccctgtatgctta

SEQ ID NO: 387114 - DNA, 20 bp, Artificial Sequence
  chemically synthesized
caccaccctgtatgcttagg

SEQ ID NO: 387115 - DNA, 20 bp, Artificial Sequence
  chemically synthesized
gccaacagagtgatctccct

SEQ ID NO: 387116 - DNA, 20 bp, Artificial Sequence
  chemically synthesized
gcttagggagatcactctgt

SEQ ID NO: 387117 - DNA, 20 bp, Artificial Sequence
  chemically synthesized
ccccctgcaatgtgccaaca

SEQ ID NO: 387118 - DNA, 20 bp, Artificial Sequence
  chemically synthesized
ctccccctgcaatgtgccaa

SEQ ID NO: 387119 - DNA, 20 bp, Artificial Sequence
  chemically synthesized
atcactctgttggcacattg

SEQ ID NO: 387120 - DNA, 20 bp, Artificial Sequence
  chemically synthesized
tcactctgttggcacattgc

SEQ ID NO: 387121 - DNA, 20 bp, Artificial Sequence
  chemically synthesized
cactctgttggcacattgca

SEQ ID NO: 387122 - DNA, 20 bp, Artificial Sequence
  chemically synthesized
actctgttggcacattgcag

SEQ ID NO: 387123 - DNA, 20 bp, Artificial Sequence
  chemically synthesized
ctctgttggcacattgcagg

SEQ ID NO: 387124 - DNA, 20 bp, Artificial Sequence
  chemically synthesized
ctgttggcacattgcagggg

SEQ ID NO: 387125 - DNA, 20 bp, Artificial Sequence
  chemically synthesized
ttggcacattgcagggggag

SEQ ID NO: 387126 - DNA, 20 bp, Artificial Sequence
  chemically synthesized
tggcacattgcagggggaga

SEQ ID NO: 387127 - DNA, 20 bp, Artificial Sequence
  chemically synthesized
ttgcagggggagaaggacat

SEQ ID NO: 387128 - DNA, 20 bp, Artificial Sequence
  chemically synthesized
gcagggggagaaggacattg

SEQ ID NO: 387129 - DNA, 20 bp, Artificial Sequence
  chemically synthesized
atatatggccgtggtgaata

SEQ ID NO: 387130 - DNA, 20 bp, Artificial Sequence
  chemically synthesized
attggagactgtattcacca

SEQ ID NO: 387131 - DNA, 20 bp, Artificial Sequence
  chemically synthesized
catcacacaatatatggccg

SEQ ID NO: 387132 - DNA, 20 bp, Artificial Sequence
  chemically synthesized
atataccatcacacaatata

SEQ ID NO: 387133 - DNA, 20 bp, Artificial Sequence
  chemically synthesized
cacggccatatattgtgtga

SEQ ID NO: 387134 - DNA, 20 bp, Artificial Sequence
  chemically synthesized
ttgtgtgatggtatatttct

SEQ ID NO: 387135 - DNA, 20 bp, Artificial Sequence
  chemically synthesized
gtgatggtatatttcttgga

SEQ ID NO: 387136 - DNA, 20 bp, Artificial Sequence
  chemically synthesized
gttcccgaattgtgctttcc

SEQ ID NO: 387137 - DNA, 20 bp, Artificial Sequence
  chemically synthesized
atttcttggaaagcacaatt

SEQ ID NO: 387138 - DNA, 20 bp, Artificial Sequence
  chemically synthesized
tttcttggaaagcacaattc

SEQ ID NO: 387139 - DNA, 20 bp, Artificial Sequence
  chemically synthesized
agcacaattcgggaacacca

SEQ ID NO: 387140 - DNA, 20 bp, Artificial Sequence
  chemically synthesized
acaattcgggaacaccatag

SEQ ID NO: 387141 - DNA, 20 bp, Artificial Sequence
  chemically synthesized
aattcgggaacaccatagca

SEQ ID NO: 387142 - DNA, 20 bp, Artificial Sequence
  chemically synthesized
aatatttgccttctctgcta

SEQ ID NO: 387143 - DNA, 20 bp, Artificial Sequence
  chemically synthesized
tcgggaacaccatagcagag

SEQ ID NO: 387144 - DNA, 20 bp, Artificial Sequence
  chemically synthesized
cgggaacaccatagcagaga

SEQ ID NO: 387145 - DNA, 20 bp, Artificial Sequence
  chemically synthesized
gcagagaaggcaaatattat

SEQ ID NO: 387146 - DNA, 20 bp, Artificial Sequence
  chemically synthesized
aatattatcagccttcttta

SEQ ID NO: 387147 - DNA, 20 bp, Artificial Sequence
  chemically synthesized
atattatcagccttctttac

SEQ ID NO: 387148 - DNA, 20 bp, Artificial Sequence
  chemically synthesized
tatgttctaacctgtaaaga

SEQ ID NO: 387149 - DNA, 20 bp, Artificial Sequence
  chemically synthesized
ctatgttctaacctgtaaag

SEQ ID NO: 387150 - DNA, 20 bp, Artificial Sequence
  chemically synthesized
tatcagccttctttacaggt

SEQ ID NO: 387151 - DNA, 20 bp, Artificial Sequence
  chemically synthesized
agtctatgttctaacctgta

SEQ ID NO: 387152 - DNA, 20 bp, Artificial Sequence
  chemically synthesized
cttctttacaggttagaaca

SEQ ID NO: 387153 - DNA, 20 bp, Artificial Sequence
  chemically synthesized
tacaggttagaacatagact

SEQ ID NO: 387154 - DNA, 20 bp, Artificial Sequence
  chemically synthesized
caggttagaacatagactca

SEQ ID NO: 387155 - DNA, 20 bp, Artificial Sequence
  chemically synthesized
ccaattaatttaaacactct

SEQ ID NO: 387156 - DNA, 20 bp, Artificial Sequence
  chemically synthesized
ctcagagtgtttaaattaat

SEQ ID NO: 387157 - DNA, 20 bp, Artificial Sequence
  chemically synthesized
tatgaagattcagaagggta

SEQ ID NO: 387158 - DNA, 20 bp, Artificial Sequence
  chemically synthesized
gtatgaagattcagaagggt

SEQ ID NO: 387159 - DNA, 20 bp, Artificial Sequence
  chemically synthesized
cagtgtatgaagattcagaa

SEQ ID NO: 387160 - DNA, 20 bp, Artificial Sequence
  chemically synthesized
gcagtgtatgaagattcaga

SEQ ID NO: 387161 - DNA, 20 bp, Artificial Sequence
  chemically synthesized
tgcagtgtatgaagattcag

SEQ ID NO: 387162 - DNA, 20 bp, Artificial Sequence
  chemically synthesized
aagtgcagtgtatgaagatt

SEQ ID NO: 387163 - DNA, 20 bp, Artificial Sequence
  chemically synthesized
ggtagaaagtgcagtgtatg

SEQ ID NO: 387164 - DNA, 20 bp, Artificial Sequence
  chemically synthesized
attctgatgggtagaaagtg

SEQ ID NO: 387165 - DNA, 20 bp, Artificial Sequence
  chemically synthesized
aagtaattctgatgggtaga

SEQ ID NO: 387166 - DNA, 20 bp, Artificial Sequence
  chemically synthesized
acactgcactttctacccat

SEQ ID NO: 387167 - DNA, 20 bp, Artificial Sequence
  chemically synthesized
gaataagtaattctgatggg

SEQ ID NO: 387168 - DNA, 20 bp, Artificial Sequence
  chemically synthesized
taggaataagtaattctgat

SEQ ID NO: 387169 - DNA, 20 bp, Artificial Sequence
  chemically synthesized
ataggaataagtaattctga

SEQ ID NO: 387170 - DNA, 20 bp, Artificial Sequence
  chemically synthesized
tgatcttaggaaataggaat

SEQ ID NO: 387171 - DNA, 20 bp, Artificial Sequence
  chemically synthesized
attacttattcctatttcct

SEQ ID NO: 387172 - DNA, 20 bp, Artificial Sequence
  chemically synthesized
aatgactgatcttaggaaat

SEQ ID NO: 387173 - DNA, 20 bp, Artificial Sequence
  chemically synthesized
gaatgactgatcttaggaaa

SEQ ID NO: 387174 - DNA, 20 bp, Artificial Sequence
  chemically synthesized
ttattcctatttcctaagat

SEQ ID NO: 387175 - DNA, 20 bp, Artificial Sequence
  chemically synthesized
tttctggaatgactgatctt

SEQ ID NO: 387176 - DNA, 20 bp, Artificial Sequence
  chemically synthesized
ttttctggaatgactgatct

SEQ ID NO: 387177 - DNA, 20 bp, Artificial Sequence
  chemically synthesized
tttcctaagatcagtcattc

SEQ ID NO: 387178 - DNA, 20 bp, Artificial Sequence
  chemically synthesized
agaagaaagttcattttttc

SEQ ID NO: 387179 - DNA, 20 bp, Artificial Sequence
  chemically synthesized
ctgaattcataaaaagaaga

SEQ ID NO: 387180 - DNA, 20 bp, Artificial Sequence
  chemically synthesized
ccttctgaattcataaaaag

SEQ ID NO: 387181 - DNA, 20 bp, Artificial Sequence
  chemically synthesized
ggtccttctgaattcataaa

SEQ ID NO: 387182 - DNA, 20 bp, Artificial Sequence
  chemically synthesized
ctttcttctttttatgaatt

SEQ ID NO: 387183 - DNA, 20 bp, Artificial Sequence
  chemically synthesized
tcttctttttatgaattcag

SEQ ID NO: 387184 - DNA, 20 bp, Artificial Sequence
  chemically synthesized
cttctttttatgaattcaga

SEQ ID NO: 387185 - DNA, 20 bp, Artificial Sequence
  chemically synthesized
ttttatgaattcagaaggac

SEQ ID NO: 387186 - DNA, 20 bp, Artificial Sequence
  chemically synthesized
ttatgaattcagaaggaccg

SEQ ID NO: 387187 - DNA, 20 bp, Artificial Sequence
  chemically synthesized
gaattcagaaggaccggaga

SEQ ID NO: 387188 - DNA, 20 bp, Artificial Sequence
  chemically synthesized
aattcagaaggaccggagac

SEQ ID NO: 387189 - DNA, 20 bp, Artificial Sequence
  chemically synthesized
gcgtcttgcctacctgtctc

SEQ ID NO: 387190 - DNA, 20 bp, Artificial Sequence
  chemically synthesized
tcagaaggaccggagacagg

SEQ ID NO: 387191 - DNA, 20 bp, Artificial Sequence
  chemically synthesized
cagaaggaccggagacaggt

SEQ ID NO: 387192 - DNA, 20 bp, Artificial Sequence
  chemically synthesized
aggaccggagacaggtaggc

SEQ ID NO: 387193 - DNA, 20 bp, Artificial Sequence
  chemically synthesized
ggcaagacgcatgaacacaa

SEQ ID NO: 387194 - DNA, 20 bp, Artificial Sequence
  chemically synthesized
acaaaagtgtcttaaaatct

SEQ ID NO: 387195 - DNA, 20 bp, Artificial Sequence
  chemically synthesized
gaatgtatctctgagatttt

SEQ ID NO: 387196 - DNA, 20 bp, Artificial Sequence
  chemically synthesized
aaaagtgtcttaaaatctca

SEQ ID NO: 387197 - DNA, 20 bp, Artificial Sequence
  chemically synthesized
gcacaaatgaatgtatctct

SEQ ID NO: 387198 - DNA, 20 bp, Artificial Sequence
  chemically synthesized
ctgaatgaatgaataagtga

SEQ ID NO: 387199 - DNA, 20 bp, Artificial Sequence
  chemically synthesized
tgattactgaatgaatgaat

SEQ ID NO: 387200 - DNA, 20 bp, Artificial Sequence
  chemically synthesized
ctttcacttattcattcatt

SEQ ID NO: 387201 - DNA, 20 bp, Artificial Sequence
  chemically synthesized
attcattcagtaatcattta

SEQ ID NO: 387202 - DNA, 20 bp, Artificial Sequence
  chemically synthesized
tcattcagtaatcatttata

SEQ ID NO: 387203 - DNA, 20 bp, Artificial Sequence
  chemically synthesized
ttatagcacatggttcataa

SEQ ID NO: 387204 - DNA, 20 bp, Artificial Sequence
  chemically synthesized
gggacctagcttatagcaca

SEQ ID NO: 387205 - DNA, 20 bp, Artificial Sequence
  chemically synthesized
ttttatgaaccatgtgctat

SEQ ID NO: 387206 - DNA, 20 bp, Artificial Sequence
  chemically synthesized
atgaaccatgtgctataagc

SEQ ID NO: 387207 - DNA, 20 bp, Artificial Sequence
  chemically synthesized
tgaaccatgtgctataagct

SEQ ID NO: 387208 - DNA, 20 bp, Artificial Sequence
  chemically synthesized
tactcccgggacctagctta

SEQ ID NO: 387209 - DNA, 20 bp, Artificial Sequence
  chemically synthesized
atgtgctataagctaggtcc

SEQ ID NO: 387210 - DNA, 20 bp, Artificial Sequence
  chemically synthesized
tgtgctataagctaggtccc

SEQ ID NO: 387211 - DNA, 20 bp, Artificial Sequence
  chemically synthesized
cgccttttactcccgggacc

SEQ ID NO: 387212 - DNA, 20 bp, Artificial Sequence
  chemically synthesized
tgctataagctaggtcccgg

SEQ ID NO: 387213 - DNA, 20 bp, Artificial Sequence
  chemically synthesized
tactcccgccttttactccc

SEQ ID NO: 387214 - DNA, 20 bp, Artificial Sequence
  chemically synthesized
aagctaggtcccgggagtaa

SEQ ID NO: 387215 - DNA, 20 bp, Artificial Sequence
  chemically synthesized
ttactcccgccttttactcc

SEQ ID NO: 387216 - DNA, 20 bp, Artificial Sequence
  chemically synthesized
agctaggtcccgggagtaaa

SEQ ID NO: 387217 - DNA, 20 bp, Artificial Sequence
  chemically synthesized
taggtcccgggagtaaaagg

SEQ ID NO: 387218 - DNA, 20 bp, Artificial Sequence
  chemically synthesized
aggtcccgggagtaaaaggc

SEQ ID NO: 387219 - DNA, 20 bp, Artificial Sequence
  chemically synthesized
gtcccgggagtaaaaggcgg

SEQ ID NO: 387220 - DNA, 20 bp, Artificial Sequence
  chemically synthesized
cgggagtaaaaggcgggagt

SEQ ID NO: 387221 - DNA, 20 bp, Artificial Sequence
  chemically synthesized
gcgggagtaagctgacaatt

SEQ ID NO: 387222 - DNA, 20 bp, Artificial Sequence
  chemically synthesized
acaaaagaaaacttaattgt

SEQ ID NO: 387223 - DNA, 20 bp, Artificial Sequence
  chemically synthesized
ggacaaaattcaatggacaa

SEQ ID NO: 387224 - DNA, 20 bp, Artificial Sequence
  chemically synthesized
gcgaattggacaaaattcaa

SEQ ID NO: 387225 - DNA, 20 bp, Artificial Sequence
  chemically synthesized
attgaattttgtccaattcg

SEQ ID NO: 387226 - DNA, 20 bp, Artificial Sequence
  chemically synthesized
ttgaattttgtccaattcgc

SEQ ID NO: 387227 - DNA, 20 bp, Artificial Sequence
  chemically synthesized
accaagtaccacctgcgaat

SEQ ID NO: 387228 - DNA, 20 bp, Artificial Sequence
  chemically synthesized
aattttgtccaattcgcagg

SEQ ID NO: 387229 - DNA, 20 bp, Artificial Sequence
  chemically synthesized
tccaattcgcaggtggtact

SEQ ID NO: 387230 - DNA, 20 bp, Artificial Sequence
  chemically synthesized
attcgcaggtggtacttggt

SEQ ID NO: 387231 - DNA, 20 bp, Artificial Sequence
  chemically synthesized
tttaggaggttcaaccaacc

SEQ ID NO: 387232 - DNA, 20 bp, Artificial Sequence
  chemically synthesized
ttggttggttgaacctccta

SEQ ID NO: 387233 - DNA, 20 bp, Artificial Sequence
  chemically synthesized
agctagaaggtaactttagg

SEQ ID NO: 387234 - DNA, 20 bp, Artificial Sequence
  chemically synthesized
gagctagaaggtaactttag

SEQ ID NO: 387235 - DNA, 20 bp, Artificial Sequence
  chemically synthesized
atgagctagaaggtaacttt

SEQ ID NO: 387236 - DNA, 20 bp, Artificial Sequence
  chemically synthesized
catgagctagaaggtaactt

SEQ ID NO: 387237 - DNA, 20 bp, Artificial Sequence
  chemically synthesized
aacctcctaaagttaccttc

SEQ ID NO: 387238 - DNA, 20 bp, Artificial Sequence
  chemically synthesized
agttgggggcatgagctaga

SEQ ID NO: 387239 - DNA, 20 bp, Artificial Sequence
  chemically synthesized
tagttgggggcatgagctag

SEQ ID NO: 387240 - DNA, 20 bp, Artificial Sequence
  chemically synthesized
aaatagttgggggcatgagc

SEQ ID NO: 387241 - DNA, 20 bp, Artificial Sequence
  chemically synthesized
tggcaaatagttgggggcat

SEQ ID NO: 387242 - DNA, 20 bp, Artificial Sequence
  chemically synthesized
gtaaagtggcaaatagttgg

SEQ ID NO: 387243 - DNA, 20 bp, Artificial Sequence
  chemically synthesized
tgtaaagtggcaaatagttg

SEQ ID NO: 387244 - DNA, 20 bp, Artificial Sequence
  chemically synthesized
ttgtaaagtggcaaatagtt

SEQ ID NO: 387245 - DNA, 20 bp, Artificial Sequence
  chemically synthesized
tttgtaaagtggcaaatagt

SEQ ID NO: 387246 - DNA, 20 bp, Artificial Sequence
  chemically synthesized
cgtttttgtaaagtggcaaa

SEQ ID NO: 387247 - DNA, 20 bp, Artificial Sequence
  chemically synthesized
tgtgtgacgtttttgtaaag

SEQ ID NO: 387248 - DNA, 20 bp, Artificial Sequence
  chemically synthesized
gtgtgtgtgacgtttttgta

SEQ ID NO: 387249 - DNA, 20 bp, Artificial Sequence
  chemically synthesized
cgtcacacacaccataaact

SEQ ID NO: 387250 - DNA, 20 bp, Artificial Sequence
  chemically synthesized
ctgatgattttctcagttta

SEQ ID NO: 387251 - DNA, 20 bp, Artificial Sequence
  chemically synthesized
ccctggactgatgattttct

SEQ ID NO: 387252 - DNA, 20 bp, Artificial Sequence
  chemically synthesized
ccataaactgagaaaatcat

SEQ ID NO: 387253 - DNA, 20 bp, Artificial Sequence
  chemically synthesized
aactgagaaaatcatcagtc

SEQ ID NO: 387254 - DNA, 20 bp, Artificial Sequence
  chemically synthesized
actgagaaaatcatcagtcc

SEQ ID NO: 387255 - DNA, 20 bp, Artificial Sequence
  chemically synthesized
ctgagaaaatcatcagtcca

SEQ ID NO: 387256 - DNA, 20 bp, Artificial Sequence
  chemically synthesized
gagaaaatcatcagtccagg

SEQ ID NO: 387257 - DNA, 20 bp, Artificial Sequence
  chemically synthesized
agaaaatcatcagtccaggg

SEQ ID NO: 387258 - DNA, 20 bp, Artificial Sequence
  chemically synthesized
gcagaaggaatgagcctccc

SEQ ID NO: 387259 - DNA, 20 bp, Artificial Sequence
  chemically synthesized
ttcttcatcgcagaaggaat

SEQ ID NO: 387260 - DNA, 20 bp, Artificial Sequence
  chemically synthesized
taggaattcttcatcgcaga

SEQ ID NO: 387261 - DNA, 20 bp, Artificial Sequence
  chemically synthesized
ataggaattcttcatcgcag

SEQ ID NO: 387262 - DNA, 20 bp, Artificial Sequence
  chemically synthesized
ggctcattccttctgcgatg

SEQ ID NO: 387263 - DNA, 20 bp, Artificial Sequence
  chemically synthesized
aatataggaattcttcatcg

SEQ ID NO: 387264 - DNA, 20 bp, Artificial Sequence
  chemically synthesized
gctgaatattgcgacaatat

SEQ ID NO: 387265 - DNA, 20 bp, Artificial Sequence
  chemically synthesized
agctgaatattgcgacaata

SEQ ID NO: 387266 - DNA, 20 bp, Artificial Sequence
  chemically synthesized
tcctatattgtcgcaatatt

SEQ ID NO: 387267 - DNA, 20 bp, Artificial Sequence
  chemically synthesized
tgtcgcaatattcagctgac

SEQ ID NO: 387268 - DNA, 20 bp, Artificial Sequence
  chemically synthesized
agttttaccccatggcttgt

SEQ ID NO: 387269 - DNA, 20 bp, Artificial Sequence
  chemically synthesized
aatattcagctgacaagcca

SEQ ID NO: 387270 - DNA, 20 bp, Artificial Sequence
  chemically synthesized
atattcagctgacaagccat

SEQ ID NO: 387271 - DNA, 20 bp, Artificial Sequence
  chemically synthesized
tattcagctgacaagccatg

SEQ ID NO: 387272 - DNA, 20 bp, Artificial Sequence
  chemically synthesized
ctcacagtagttttacccca

SEQ ID NO: 387273 - DNA, 20 bp, Artificial Sequence
  chemically synthesized
ccatggggtaaaactactgt

SEQ ID NO: 387274 - DNA, 20 bp, Artificial Sequence
  chemically synthesized
agaagttgaaatgctcacag

SEQ ID NO: 387275 - DNA, 20 bp, Artificial Sequence
  chemically synthesized
atcagaagttgaaatgctca

SEQ ID NO: 387276 - DNA, 20 bp, Artificial Sequence
  chemically synthesized
aaatggtggggtataatcag

SEQ ID NO: 387277 - DNA, 20 bp, Artificial Sequence
  chemically synthesized
aaaaaatggtggggtataat

SEQ ID NO: 387278 - DNA, 20 bp, Artificial Sequence
  chemically synthesized
ttccatcagaaaaaatggtg

SEQ ID NO: 387279 - DNA, 20 bp, Artificial Sequence
  chemically synthesized
attccatcagaaaaaatggt

SEQ ID NO: 387280 - DNA, 20 bp, Artificial Sequence
  chemically synthesized
tattccatcagaaaaaatgg

SEQ ID NO: 387281 - DNA, 20 bp, Artificial Sequence
  chemically synthesized
ctgtattccatcagaaaaaa

SEQ ID NO: 387282 - DNA, 20 bp, Artificial Sequence
  chemically synthesized
taccccaccattttttctga

SEQ ID NO: 387283 - DNA, 20 bp, Artificial Sequence
  chemically synthesized
ggccactctctgtattccat

SEQ ID NO: 387284 - DNA, 20 bp, Artificial Sequence
  chemically synthesized
ccattttttctgatggaata

SEQ ID NO: 387285 - DNA, 20 bp, Artificial Sequence
  chemically synthesized
attttttctgatggaataca

SEQ ID NO: 387286 - DNA, 20 bp, Artificial Sequence
  chemically synthesized
tttttctgatggaatacaga

SEQ ID NO: 387287 - DNA, 20 bp, Artificial Sequence
  chemically synthesized
ttctgatggaatacagagag

SEQ ID NO: 387288 - DNA, 20 bp, Artificial Sequence
  chemically synthesized
aatacagagagtggccaaac

SEQ ID NO: 387289 - DNA, 20 bp, Artificial Sequence
  chemically synthesized
acagagagtggccaaaccag

SEQ ID NO: 387290 - DNA, 20 bp, Artificial Sequence
  chemically synthesized
ctgaaggaaggctgctggtt

SEQ ID NO: 387291 - DNA, 20 bp, Artificial Sequence
  chemically synthesized
gtggcctgaaggaaggctgc

SEQ ID NO: 387292 - DNA, 20 bp, Artificial Sequence
  chemically synthesized
ccaaaccagcagccttcctt

SEQ ID NO: 387293 - DNA, 20 bp, Artificial Sequence
  chemically synthesized
caaaccagcagccttccttc

SEQ ID NO: 387294 - DNA, 20 bp, Artificial Sequence
  chemically synthesized
gggaaatgtggcctgaagga

SEQ ID NO: 387295 - DNA, 20 bp, Artificial Sequence
  chemically synthesized
ggggaaatgtggcctgaagg

SEQ ID NO: 387296 - DNA, 20 bp, Artificial Sequence
  chemically synthesized
gctggggaaatgtggcctga

SEQ ID NO: 387297 - DNA, 20 bp, Artificial Sequence
  chemically synthesized
ggctggggaaatgtggcctg

SEQ ID NO: 387298 - DNA, 20 bp, Artificial Sequence
  chemically synthesized
acttctgggctggggaaatg

SEQ ID NO: 387299 - DNA, 20 bp, Artificial Sequence
  chemically synthesized
tccttcaggccacatttccc

SEQ ID NO: 387300 - DNA, 20 bp, Artificial Sequence
  chemically synthesized
caggccacatttccccagcc

SEQ ID NO: 387301 - DNA, 20 bp, Artificial Sequence
  chemically synthesized
ttttaggaacttctgggctg

SEQ ID NO: 387302 - DNA, 20 bp, Artificial Sequence
  chemically synthesized
gccacatttccccagcccag

SEQ ID NO: 387303 - DNA, 20 bp, Artificial Sequence
  chemically synthesized
attttaggaacttctgggct

SEQ ID NO: 387304 - DNA, 20 bp, Artificial Sequence
  chemically synthesized
gattttaggaacttctgggc

SEQ ID NO: 387305 - DNA, 20 bp, Artificial Sequence
  chemically synthesized
acaagattttaggaacttct

SEQ ID NO: 387306 - DNA, 20 bp, Artificial Sequence
  chemically synthesized
cacaagattttaggaacttc

SEQ ID NO: 387307 - DNA, 20 bp, Artificial Sequence
  chemically synthesized
aatcgcctccacaagatttt

SEQ ID NO: 387308 - DNA, 20 bp, Artificial Sequence
  chemically synthesized
gaatcgcctccacaagattt

SEQ ID NO: 387309 - DNA, 20 bp, Artificial Sequence
  chemically synthesized
cagaagttcctaaaatcttg

SEQ ID NO: 387310 - DNA, 20 bp, Artificial Sequence
  chemically synthesized
gaagttcctaaaatcttgtg

SEQ ID NO: 387311 - DNA, 20 bp, Artificial Sequence
  chemically synthesized
aagttcctaaaatcttgtgg

SEQ ID NO: 387312 - DNA, 20 bp, Artificial Sequence
  chemically synthesized
taaagctgaatcgcctccac

SEQ ID NO: 387313 - DNA, 20 bp, Artificial Sequence
  chemically synthesized
aaaatcttgtggaggcgatt

SEQ ID NO: 387314 - DNA, 20 bp, Artificial Sequence
  chemically synthesized
ataaataactgtcaaatata

SEQ ID NO: 387315 - DNA, 20 bp, Artificial Sequence
  chemically synthesized
cgattcagctttatatttga

SEQ ID NO: 387316 - DNA, 20 bp, Artificial Sequence
  chemically synthesized
ttgacagttatttatatttc

SEQ ID NO: 387317 - DNA, 20 bp, Artificial Sequence
  chemically synthesized
tatttatatttctggcccta

SEQ ID NO: 387318 - DNA, 20 bp, Artificial Sequence
  chemically synthesized
tcggacagagtctgtagggc

SEQ ID NO: 387319 - DNA, 20 bp, Artificial Sequence
  chemically synthesized
ttgctcggacagagtctgta

SEQ ID NO: 387320 - DNA, 20 bp, Artificial Sequence
  chemically synthesized
tttgctcggacagagtctgt

SEQ ID NO: 387321 - DNA, 20 bp, Artificial Sequence
  chemically synthesized
ttttgctcggacagagtctg

SEQ ID NO: 387322 - DNA, 20 bp, Artificial Sequence
  chemically synthesized
tggccctacagactctgtcc

SEQ ID NO: 387323 - DNA, 20 bp, Artificial Sequence
  chemically synthesized
gaaaagcttttgctcggaca

SEQ ID NO: 387324 - DNA, 20 bp, Artificial Sequence
  chemically synthesized
tagaaaagcttttgctcgga

SEQ ID NO: 387325 - DNA, 20 bp, Artificial Sequence
  chemically synthesized
tacagactctgtccgagcaa

SEQ ID NO: 387326 - DNA, 20 bp, Artificial Sequence
  chemically synthesized
tgtctagaaaagcttttgct

SEQ ID NO: 387327 - DNA, 20 bp, Artificial Sequence
  chemically synthesized
tgtccgagcaaaagcttttc

SEQ ID NO: 387328 - DNA, 20 bp, Artificial Sequence
  chemically synthesized
ttaaaattatatgtctagaa

SEQ ID NO: 387329 - DNA, 20 bp, Artificial Sequence
  chemically synthesized
tccccttaaaattatatgtc

SEQ ID NO: 387330 - DNA, 20 bp, Artificial Sequence
  chemically synthesized
ttttctagacatataatttt

SEQ ID NO: 387331 - DNA, 20 bp, Artificial Sequence
  chemically synthesized
tttctagacatataatttta

SEQ ID NO: 387332 - DNA, 20 bp, Artificial Sequence
  chemically synthesized
ttctagacatataattttaa

SEQ ID NO: 387333 - DNA, 20 bp, Artificial Sequence
  chemically synthesized
tctagacatataattttaag

SEQ ID NO: 387334 - DNA, 20 bp, Artificial Sequence
  chemically synthesized
ggggaaaatatcaatatttg

SEQ ID NO: 387335 - DNA, 20 bp, Artificial Sequence
  chemically synthesized
tatcaatatttgaagaaaac

SEQ ID NO: 387336 - DNA, 20 bp, Artificial Sequence
  chemically synthesized
tttgaagaaaacaagtgtgc

SEQ ID NO: 387337 - DNA, 20 bp, Artificial Sequence
  chemically synthesized
cataaggtagagggacattc

SEQ ID NO: 387338 - DNA, 20 bp, Artificial Sequence
  chemically synthesized
caaatgaatcataaggtaga

SEQ ID NO: 387339 - DNA, 20 bp, Artificial Sequence
  chemically synthesized
acaaatgaatcataaggtag

SEQ ID NO: 387340 - DNA, 20 bp, Artificial Sequence
  chemically synthesized
aacaaatgaatcataaggta

SEQ ID NO: 387341 - DNA, 20 bp, Artificial Sequence
  chemically synthesized
ataacaaatgaatcataagg

SEQ ID NO: 387342 - DNA, 20 bp, Artificial Sequence
  chemically synthesized
ggaataacaaatgaatcata

SEQ ID NO: 387343 - DNA, 20 bp, Artificial Sequence
  chemically synthesized
aggaataacaaatgaatcat

SEQ ID NO: 387344 - DNA, 20 bp, Artificial Sequence
  chemically synthesized
tatgattcatttgttattcc

SEQ ID NO: 387345 - DNA, 20 bp, Artificial Sequence
  chemically synthesized
atgattcatttgttattcct

SEQ ID NO: 387346 - DNA, 20 bp, Artificial Sequence
  chemically synthesized
tgattcatttgttattccta

SEQ ID NO: 387347 - DNA, 20 bp, Artificial Sequence
  chemically synthesized
aacctgctgcagaacaccct

SEQ ID NO: 387348 - DNA, 20 bp, Artificial Sequence
  chemically synthesized
taacctgctgcagaacaccc

SEQ ID NO: 387349 - DNA, 20 bp, Artificial Sequence
  chemically synthesized
gttattcctagggtgttctg

SEQ ID NO: 387350 - DNA, 20 bp, Artificial Sequence
  chemically synthesized
attcctagggtgttctgcag

SEQ ID NO: 387351 - DNA, 20 bp, Artificial Sequence
  chemically synthesized
ttcctagggtgttctgcagc

SEQ ID NO: 387352 - DNA, 20 bp, Artificial Sequence
  chemically synthesized
atagcccacttaacctgctg

SEQ ID NO: 387353 - DNA, 20 bp, Artificial Sequence
  chemically synthesized
agggtgttctgcagcaggtt

SEQ ID NO: 387354 - DNA, 20 bp, Artificial Sequence
  chemically synthesized
gtgttctgcagcaggttaag

SEQ ID NO: 387355 - DNA, 20 bp, Artificial Sequence
  chemically synthesized
tgttctgcagcaggttaagt

SEQ ID NO: 387356 - DNA, 20 bp, Artificial Sequence
  chemically synthesized
gttaagtgggctattgaaca

SEQ ID NO: 387357 - DNA, 20 bp, Artificial Sequence
  chemically synthesized
ctggggttttctttgttcaa

SEQ ID NO: 387358 - DNA, 20 bp, Artificial Sequence
  chemically synthesized
ctattgaacaaagaaaaccc

SEQ ID NO: 387359 - DNA, 20 bp, Artificial Sequence
  chemically synthesized
tattgaacaaagaaaacccc

SEQ ID NO: 387360 - DNA, 20 bp, Artificial Sequence
  chemically synthesized
agaatatgtcagaattcctg

SEQ ID NO: 387361 - DNA, 20 bp, Artificial Sequence
  chemically synthesized
tagaatatgtcagaattcct

SEQ ID NO: 387362 - DNA, 20 bp, Artificial Sequence
  chemically synthesized
atagaatatgtcagaattcc

SEQ ID NO: 387363 - DNA, 20 bp, Artificial Sequence
  chemically synthesized
tttaaggtaatagaatatgt

SEQ ID NO: 387364 - DNA, 20 bp, Artificial Sequence
  chemically synthesized
tttcgatcagtttaaggtaa

SEQ ID NO: 387365 - DNA, 20 bp, Artificial Sequence
  chemically synthesized
gctgattttcgatcagttta

SEQ ID NO: 387366 - DNA, 20 bp, Artificial Sequence
  chemically synthesized
agctgattttcgatcagttt

SEQ ID NO: 387367 - DNA, 20 bp, Artificial Sequence
  chemically synthesized
aagaaaagctgattttcgat

SEQ ID NO: 387368 - DNA, 20 bp, Artificial Sequence
  chemically synthesized
accttaaactgatcgaaaat

SEQ ID NO: 387369 - DNA, 20 bp, Artificial Sequence
  chemically synthesized
aattcatctcaacagaagaa

SEQ ID NO: 387370 - DNA, 20 bp, Artificial Sequence
  chemically synthesized
aaatcagcttttcttctgtt

SEQ ID NO: 387371 - DNA, 20 bp, Artificial Sequence
  chemically synthesized
caagtaattcatctcaacag

SEQ ID NO: 387372 - DNA, 20 bp, Artificial Sequence
  chemically synthesized
tgtcaagtaattcatctcaa

SEQ ID NO: 387373 - DNA, 20 bp, Artificial Sequence
  chemically synthesized
tgttgagatgaattacttga

SEQ ID NO: 387374 - DNA, 20 bp, Artificial Sequence
  chemically synthesized
gagatgaattacttgacagt

SEQ ID NO: 387375 - DNA, 20 bp, Artificial Sequence
  chemically synthesized
gaatttttctactgactgtc

SEQ ID NO: 387376 - DNA, 20 bp, Artificial Sequence
  chemically synthesized
atgaattacttgacagtcag

SEQ ID NO: 387377 - DNA, 20 bp, Artificial Sequence
  chemically synthesized
cagtagaaaaattcttccca

SEQ ID NO: 387378 - DNA, 20 bp, Artificial Sequence
  chemically synthesized
agtagaaaaattcttcccat

SEQ ID NO: 387379 - DNA, 20 bp, Artificial Sequence
  chemically synthesized
agaaaggagaaacccatggg

SEQ ID NO: 387380 - DNA, 20 bp, Artificial Sequence
  chemically synthesized
ttcagaaaggagaaacccat

SEQ ID NO: 387381 - DNA, 20 bp, Artificial Sequence
  chemically synthesized
tttcagaaaggagaaaccca

SEQ ID NO: 387382 - DNA, 20 bp, Artificial Sequence
  chemically synthesized
gtgggaaaggtttcagaaag

SEQ ID NO: 387383 - DNA, 20 bp, Artificial Sequence
  chemically synthesized
gggtgggaaaggtttcagaa

SEQ ID NO: 387384 - DNA, 20 bp, Artificial Sequence
  chemically synthesized
ggggtgggaaaggtttcaga

SEQ ID NO: 387385 - DNA, 20 bp, Artificial Sequence
  chemically synthesized
actgggggtgggaaaggttt

SEQ ID NO: 387386 - DNA, 20 bp, Artificial Sequence
  chemically synthesized
ctgaggactgggggtgggaa

SEQ ID NO: 387387 - DNA, 20 bp, Artificial Sequence
  chemically synthesized
tctgaggactgggggtggga

SEQ ID NO: 387388 - DNA, 20 bp, Artificial Sequence
  chemically synthesized
tctgaaacctttcccacccc

SEQ ID NO: 387389 - DNA, 20 bp, Artificial Sequence
  chemically synthesized
tatttctgaggactgggggt

SEQ ID NO: 387390 - DNA, 20 bp, Artificial Sequence
  chemically synthesized
atatttctgaggactggggg

SEQ ID NO: 387391 - DNA, 20 bp, Artificial Sequence
  chemically synthesized
agtatatttctgaggactgg

SEQ ID NO: 387392 - DNA, 20 bp, Artificial Sequence
  chemically synthesized
cctttcccacccccagtcct

SEQ ID NO: 387393 - DNA, 20 bp, Artificial Sequence
  chemically synthesized
aagtatatttctgaggactg

SEQ ID NO: 387394 - DNA, 20 bp, Artificial Sequence
  chemically synthesized
aaagtatatttctgaggact

SEQ ID NO: 387395 - DNA, 20 bp, Artificial Sequence
  chemically synthesized
caaagtatatttctgaggac

SEQ ID NO: 387396 - DNA, 20 bp, Artificial Sequence
  chemically synthesized
ctcaccaaagtatatttctg

SEQ ID NO: 387397 - DNA, 20 bp, Artificial Sequence
  chemically synthesized
actcaccaaagtatatttct

SEQ ID NO: 387398 - DNA, 20 bp, Artificial Sequence
  chemically synthesized
cagtcctcagaaatatactt

SEQ ID NO: 387399 - DNA, 20 bp, Artificial Sequence
  chemically synthesized
cctcagaaatatactttggt

SEQ ID NO: 387400 - DNA, 20 bp, Artificial Sequence
  chemically synthesized
gggatagaggaaactcacca

SEQ ID NO: 387401 - DNA, 20 bp, Artificial Sequence
  chemically synthesized
tgaataatgctttgggatag

SEQ ID NO: 387402 - DNA, 20 bp, Artificial Sequence
  chemically synthesized
ggtgagtttcctctatccca

SEQ ID NO: 387403 - DNA, 20 bp, Artificial Sequence
  chemically synthesized
atgaataatgctttgggata

SEQ ID NO: 387404 - DNA, 20 bp, Artificial Sequence
  chemically synthesized
atatgaataatgctttggga

SEQ ID NO: 387405 - DNA, 20 bp, Artificial Sequence
  chemically synthesized
gattatatgaataatgcttt

SEQ ID NO: 387406 - DNA, 20 bp, Artificial Sequence
  chemically synthesized
ggattatatgaataatgctt

SEQ ID NO: 387407 - DNA, 20 bp, Artificial Sequence
  chemically synthesized
aagcattattcatataatcc

SEQ ID NO: 387408 - DNA, 20 bp, Artificial Sequence
  chemically synthesized
aagtctctttcagtttttct

SEQ ID NO: 387409 - DNA, 20 bp, Artificial Sequence
  chemically synthesized
tataatccaagaaaaactga

SEQ ID NO: 387410 - DNA, 20 bp, Artificial Sequence
  chemically synthesized
taatccaagaaaaactgaaa

SEQ ID NO: 387411 - DNA, 20 bp, Artificial Sequence
  chemically synthesized
attagtcctcaagtctcttt

SEQ ID NO: 387412 - DNA, 20 bp, Artificial Sequence
  chemically synthesized
agaaaaactgaaagagactt

SEQ ID NO: 387413 - DNA, 20 bp, Artificial Sequence
  chemically synthesized
gaaaaactgaaagagacttg

SEQ ID NO: 387414 - DNA, 20 bp, Artificial Sequence
  chemically synthesized
atcattgcaaattagtcctc

SEQ ID NO: 387415 - DNA, 20 bp, Artificial Sequence
  chemically synthesized
tacctcagatcattgcaaat

SEQ ID NO: 387416 - DNA, 20 bp, Artificial Sequence
  chemically synthesized
ggactaatttgcaatgatct

SEQ ID NO: 387417 - DNA, 20 bp, Artificial Sequence
  chemically synthesized
gactaatttgcaatgatctg

SEQ ID NO: 387418 - DNA, 20 bp, Artificial Sequence
  chemically synthesized
ataaaatatttcaggtacct

SEQ ID NO: 387419 - DNA, 20 bp, Artificial Sequence
  chemically synthesized
taaaatgaataaaatatttc

SEQ ID NO: 387420 - DNA, 20 bp, Artificial Sequence
  chemically synthesized
ataaaatgaataaaatattt

SEQ ID NO: 387421 - DNA, 20 bp, Artificial Sequence
  chemically synthesized
tagtaagtgtatttatttca

SEQ ID NO: 387422 - DNA, 20 bp, Artificial Sequence
  chemically synthesized
agagttacccttaggatagt

SEQ ID NO: 387423 - DNA, 20 bp, Artificial Sequence
  chemically synthesized
ataaatacacttactatcct

SEQ ID NO: 387424 - DNA, 20 bp, Artificial Sequence
  chemically synthesized
taaatacacttactatccta

SEQ ID NO: 387425 - DNA, 20 bp, Artificial Sequence
  chemically synthesized
aaatacacttactatcctaa

SEQ ID NO: 387426 - DNA, 20 bp, Artificial Sequence
  chemically synthesized
tatcagagttacccttagga

SEQ ID NO: 387427 - DNA, 20 bp, Artificial Sequence
  chemically synthesized
ttaatatcagagttaccctt

SEQ ID NO: 387428 - DNA, 20 bp, Artificial Sequence
  chemically synthesized
tttaatatcagagttaccct

SEQ ID NO: 387429 - DNA, 20 bp, Artificial Sequence
  chemically synthesized
tgtgagtctttttaatatca

SEQ ID NO: 387430 - DNA, 20 bp, Artificial Sequence
  chemically synthesized
aatgtgagtctttttaatat

SEQ ID NO: 387431 - DNA, 20 bp, Artificial Sequence
  chemically synthesized
agggtaactctgatattaaa

SEQ ID NO: 387432 - DNA, 20 bp, Artificial Sequence
  chemically synthesized
ggtatatatgtaataaatgt

SEQ ID NO: 387433 - DNA, 20 bp, Artificial Sequence
  chemically synthesized
cacatttattacatatatac

SEQ ID NO: 387434 - DNA, 20 bp, Artificial Sequence
  chemically synthesized
catttattacatatatacca

SEQ ID NO: 387435 - DNA, 20 bp, Artificial Sequence
  chemically synthesized
ctatttggggatataggctc

SEQ ID NO: 387436 - DNA, 20 bp, Artificial Sequence
  chemically synthesized
ataattctatttggggatat

SEQ ID NO: 387437 - DNA, 20 bp, Artificial Sequence
  chemically synthesized
aataattctatttggggata

SEQ ID NO: 387438 - DNA, 20 bp, Artificial Sequence
  chemically synthesized
ccagagcctatatccccaaa

SEQ ID NO: 387439 - DNA, 20 bp, Artificial Sequence
  chemically synthesized
ctcataaataattctatttg

SEQ ID NO: 387440 - DNA, 20 bp, Artificial Sequence
  chemically synthesized
tctcataaataattctattt

SEQ ID NO: 387441 - DNA, 20 bp, Artificial Sequence
  chemically synthesized
ttctcataaataattctatt

SEQ ID NO: 387442 - DNA, 20 bp, Artificial Sequence
  chemically synthesized
ccccaaatagaattatttat

SEQ ID NO: 387443 - DNA, 20 bp, Artificial Sequence
  chemically synthesized
tagtatctttatttgcgtta

SEQ ID NO: 387444 - DNA, 20 bp, Artificial Sequence
  chemically synthesized
ttagtatctttatttgcgtt

SEQ ID NO: 387445 - DNA, 20 bp, Artificial Sequence
  chemically synthesized
gagaaaccttaacgcaaata

SEQ ID NO: 387446 - DNA, 20 bp, Artificial Sequence
  chemically synthesized
ttaacgcaaataaagatact

SEQ ID NO: 387447 - DNA, 20 bp, Artificial Sequence
  chemically synthesized
aaataaagatactaagccct

SEQ ID NO: 387448 - DNA, 20 bp, Artificial Sequence
  chemically synthesized
aataaagatactaagccctc

SEQ ID NO: 387449 - DNA, 20 bp, Artificial Sequence
  chemically synthesized
cacaagaggccccgagggct

SEQ ID NO: 387450 - DNA, 20 bp, Artificial Sequence
  chemically synthesized
ataaagatactaagccctcg

SEQ ID NO: 387451 - DNA, 20 bp, Artificial Sequence
  chemically synthesized
aaaagcacaagaggccccga

SEQ ID NO: 387452 - DNA, 20 bp, Artificial Sequence
  chemically synthesized
taaaagcacaagaggccccg

SEQ ID NO: 387453 - DNA, 20 bp, Artificial Sequence
  chemically synthesized
ataaaagcacaagaggcccc

SEQ ID NO: 387454 - DNA, 20 bp, Artificial Sequence
  chemically synthesized
gtcaaatataaaagcacaag

SEQ ID NO: 387455 - DNA, 20 bp, Artificial Sequence
  chemically synthesized
tgtcaaatataaaagcacaa

SEQ ID NO: 387456 - DNA, 20 bp, Artificial Sequence
  chemically synthesized
gatgtcaaatataaaagcac

SEQ ID NO: 387457 - DNA, 20 bp, Artificial Sequence
  chemically synthesized
agaggagatgtcaaatataa

SEQ ID NO: 387458 - DNA, 20 bp, Artificial Sequence
  chemically synthesized
acatgaatatttaaaaagag

SEQ ID NO: 387459 - DNA, 20 bp, Artificial Sequence
  chemically synthesized
ctacatgaatatttaaaaag

SEQ ID NO: 387460 - DNA, 20 bp, Artificial Sequence
  chemically synthesized
tctacatgaatatttaaaaa

SEQ ID NO: 387461 - DNA, 20 bp, Artificial Sequence
  chemically synthesized
attctacatgaatatttaaa

SEQ ID NO: 387462 - DNA, 20 bp, Artificial Sequence
  chemically synthesized
cctctttttaaatattcatg

SEQ ID NO: 387463 - DNA, 20 bp, Artificial Sequence
  chemically synthesized
ttttaaatattcatgtagaa

SEQ ID NO: 387464 - DNA, 20 bp, Artificial Sequence
  chemically synthesized
tattcatgtagaatagcctt

SEQ ID NO: 387465 - DNA, 20 bp, Artificial Sequence
  chemically synthesized
tcatgtagaatagccttaag

SEQ ID NO: 387466 - DNA, 20 bp, Artificial Sequence
  chemically synthesized
catcttcaagtttctactta

SEQ ID NO: 387467 - DNA, 20 bp, Artificial Sequence
  chemically synthesized
acatcttcaagtttctactt

SEQ ID NO: 387468 - DNA, 20 bp, Artificial Sequence
  chemically synthesized
tagccttaagtagaaacttg

SEQ ID NO: 387469 - DNA, 20 bp, Artificial Sequence
  chemically synthesized
ttttatactagcacatcttc

SEQ ID NO: 387470 - DNA, 20 bp, Artificial Sequence
  chemically synthesized
gtagaaacttgaagatgtgc

SEQ ID NO: 387471 - DNA, 20 bp, Artificial Sequence
  chemically synthesized
ctcaggaaaatgttttatac

SEQ ID NO: 387472 - DNA, 20 bp, Artificial Sequence
  chemically synthesized
ctagtataaaacattttcct

SEQ ID NO: 387473 - DNA, 20 bp, Artificial Sequence
  chemically synthesized
catcaacaataaagtggctc

SEQ ID NO: 387474 - DNA, 20 bp, Artificial Sequence
  chemically synthesized
ccatcaacaataaagtggct

SEQ ID NO: 387475 - DNA, 20 bp, Artificial Sequence
  chemically synthesized
acaccccatcaacaataaag

SEQ ID NO: 387476 - DNA, 20 bp, Artificial Sequence
  chemically synthesized
aaaacaccccatcaacaata

SEQ ID NO: 387477 - DNA, 20 bp, Artificial Sequence
  chemically synthesized
ctgagccactttattgttga

SEQ ID NO: 387478 - DNA, 20 bp, Artificial Sequence
  chemically synthesized
tgagccactttattgttgat

SEQ ID NO: 387479 - DNA, 20 bp, Artificial Sequence
  chemically synthesized
gagccactttattgttgatg

SEQ ID NO: 387480 - DNA, 20 bp, Artificial Sequence
  chemically synthesized
gatggggtgttttctcaatc

SEQ ID NO: 387481 - DNA, 20 bp, Artificial Sequence
  chemically synthesized
gacttactgagatccagatt

SEQ ID NO: 387482 - DNA, 20 bp, Artificial Sequence
  chemically synthesized
tgttttctcaatctggatct

SEQ ID NO: 387483 - DNA, 20 bp, Artificial Sequence
  chemically synthesized
gggaaagacttactgagatc

SEQ ID NO: 387484 - DNA, 20 bp, Artificial Sequence
  chemically synthesized
ttctcaatctggatctcagt

SEQ ID NO: 387485 - DNA, 20 bp, Artificial Sequence
  chemically synthesized
atttaagggaaagacttact

SEQ ID NO: 387486 - DNA, 20 bp, Artificial Sequence
  chemically synthesized
gccctttttcatttaaggga

SEQ ID NO: 387487 - DNA, 20 bp, Artificial Sequence
  chemically synthesized
aatagccctttttcatttaa

SEQ ID NO: 387488 - DNA, 20 bp, Artificial Sequence
  chemically synthesized
aaatagccctttttcattta

SEQ ID NO: 387489 - DNA, 20 bp, Artificial Sequence
  chemically synthesized
gaaatagccctttttcattt

SEQ ID NO: 387490 - DNA, 20 bp, Artificial Sequence
  chemically synthesized
agtctttcccttaaatgaaa

SEQ ID NO: 387491 - DNA, 20 bp, Artificial Sequence
  chemically synthesized
gtctttcccttaaatgaaaa

SEQ ID NO: 387492 - DNA, 20 bp, Artificial Sequence
  chemically synthesized
tctttcccttaaatgaaaaa

SEQ ID NO: 387493 - DNA, 20 bp, Artificial Sequence
  chemically synthesized
ttcatacatggtttgagaaa

SEQ ID NO: 387494 - DNA, 20 bp, Artificial Sequence
  chemically synthesized
ctggcattcatacatggttt

SEQ ID NO: 387495 - DNA, 20 bp, Artificial Sequence
  chemically synthesized
caaatgctggcattcataca

SEQ ID NO: 387496 - DNA, 20 bp, Artificial Sequence
  chemically synthesized
ctcaaaccatgtatgaatgc

SEQ ID NO: 387497 - DNA, 20 bp, Artificial Sequence
  chemically synthesized
aaaagaagctgaacaaatgc

SEQ ID NO: 387498 - DNA, 20 bp, Artificial Sequence
  chemically synthesized
tatgaatgccagcatttgtt

SEQ ID NO: 387499 - DNA, 20 bp, Artificial Sequence
  chemically synthesized
aaaaaaacaaacaaaaaaag

SEQ ID NO: 387500 - DNA, 20 bp, Artificial Sequence
  chemically synthesized
aaaaaaaaaacaaacaaaaa

SEQ ID NO: 387501 - DNA, 20 bp, Artificial Sequence
  chemically synthesized
tttgtttgtttttttttttt

SEQ ID NO: 387502 - DNA, 20 bp, Artificial Sequence
  chemically synthesized
tgttttttttttttgagact

SEQ ID NO: 387503 - DNA, 20 bp, Artificial Sequence
  chemically synthesized
ctgggcgacagagtgagact

SEQ ID NO: 387504 - DNA, 20 bp, Artificial Sequence
  chemically synthesized
tccagcctgggcgacagagt

SEQ ID NO: 387505 - DNA, 20 bp, Artificial Sequence
  chemically synthesized
ctcagtctcactctgtcgcc

SEQ ID NO: 387506 - DNA, 20 bp, Artificial Sequence
  chemically synthesized
gcactccagcctgggcgaca

SEQ ID NO: 387507 - DNA, 20 bp, Artificial Sequence
  chemically synthesized
tcagtctcactctgtcgccc

SEQ ID NO: 387508 - DNA, 20 bp, Artificial Sequence
  chemically synthesized
ctgcactccagcctgggcga

SEQ ID NO: 387509 - DNA, 20 bp, Artificial Sequence
  chemically synthesized
tctcactctgtcgcccaggc

SEQ ID NO: 387510 - DNA, 20 bp, Artificial Sequence
  chemically synthesized
tcactctgtcgcccaggctg

SEQ ID NO: 387511 - DNA, 20 bp, Artificial Sequence
  chemically synthesized
gtgccactgcactccagcct

SEQ ID NO: 387512 - DNA, 20 bp, Artificial Sequence
  chemically synthesized
tgtgccactgcactccagcc

SEQ ID NO: 387513 - DNA, 20 bp, Artificial Sequence
  chemically synthesized
ctgtcgcccaggctggagtg

SEQ ID NO: 387514 - DNA, 20 bp, Artificial Sequence
  chemically synthesized
gcgattgtgccactgcactc

SEQ ID NO: 387515 - DNA, 20 bp, Artificial Sequence
  chemically synthesized
tcgcccaggctggagtgcag

SEQ ID NO: 387516 - DNA, 20 bp, Artificial Sequence
  chemically synthesized
ggagtgcagtggcacaatcg

SEQ ID NO: 387517 - DNA, 20 bp, Artificial Sequence
  chemically synthesized
aacccaggaggcagaggttg

SEQ ID NO: 387518 - DNA, 20 bp, Artificial Sequence
  chemically synthesized
cgcttgaacccaggaggcag

SEQ ID NO: 387519 - DNA, 20 bp, Artificial Sequence
  chemically synthesized
tcactgcaacctctgcctcc

SEQ ID NO: 387520 - DNA, 20 bp, Artificial Sequence
  chemically synthesized
tcgcttgaacccaggaggca

SEQ ID NO: 387521 - DNA, 20 bp, Artificial Sequence
  chemically synthesized
cactgcaacctctgcctcct

SEQ ID NO: 387522 - DNA, 20 bp, Artificial Sequence
  chemically synthesized
aatcgcttgaacccaggagg

SEQ ID NO: 387523 - DNA, 20 bp, Artificial Sequence
  chemically synthesized
gagaatcgcttgaacccagg

SEQ ID NO: 387524 - DNA, 20 bp, Artificial Sequence
  chemically synthesized
ggagaatcgcttgaacccag

SEQ ID NO: 387525 - DNA, 20 bp, Artificial Sequence
  chemically synthesized
aacctctgcctcctgggttc

SEQ ID NO: 387526 - DNA, 20 bp, Artificial Sequence
  chemically synthesized
cgggagaatcgcttgaaccc

SEQ ID NO: 387527 - DNA, 20 bp, Artificial Sequence
  chemically synthesized
gcgggagaatcgcttgaacc

SEQ ID NO: 387528 - DNA, 20 bp, Artificial Sequence
  chemically synthesized
ttcaagcgattctcccgcct

SEQ ID NO: 387529 - DNA, 20 bp, Artificial Sequence
  chemically synthesized
tactcggggagctgaggcgg

SEQ ID NO: 387530 - DNA, 20 bp, Artificial Sequence
  chemically synthesized
gctactcggggagctgaggc

SEQ ID NO: 387531 - DNA, 20 bp, Artificial Sequence
  chemically synthesized
agctactcggggagctgagg

SEQ ID NO: 387532 - DNA, 20 bp, Artificial Sequence
  chemically synthesized
cccagctactcggggagctg

SEQ ID NO: 387533 - DNA, 20 bp, Artificial Sequence
  chemically synthesized
tcccagctactcggggagct

SEQ ID NO: 387534 - DNA, 20 bp, Artificial Sequence
  chemically synthesized
ttctcccgcctcagctcccc

SEQ ID NO: 387535 - DNA, 20 bp, Artificial Sequence
  chemically synthesized
tcccgcctcagctccccgag

SEQ ID NO: 387536 - DNA, 20 bp, Artificial Sequence
  chemically synthesized
tgtaatcccagctactcggg

SEQ ID NO: 387537 - DNA, 20 bp, Artificial Sequence
  chemically synthesized
cttgtaatcccagctactcg

SEQ ID NO: 387538 - DNA, 20 bp, Artificial Sequence
  chemically synthesized
gcctcagctccccgagtagc

SEQ ID NO: 387539 - DNA, 20 bp, Artificial Sequence
  chemically synthesized
gcttgtaatcccagctactc

SEQ ID NO: 387540 - DNA, 20 bp, Artificial Sequence
  chemically synthesized
cctcagctccccgagtagct

SEQ ID NO: 387541 - DNA, 20 bp, Artificial Sequence
  chemically synthesized
tgcttgtaatcccagctact

SEQ ID NO: 387542 - DNA, 20 bp, Artificial Sequence
  chemically synthesized
ccccgagtagctgggattac

SEQ ID NO: 387543 - DNA, 20 bp, Artificial Sequence
  chemically synthesized
gtggtacatgcttgtaatcc

SEQ ID NO: 387544 - DNA, 20 bp, Artificial Sequence
  chemically synthesized
caagcatgtaccactgcacc

SEQ ID NO: 387545 - DNA, 20 bp, Artificial Sequence
  chemically synthesized
caaaaattagccgggtgcag

SEQ ID NO: 387546 - DNA, 20 bp, Artificial Sequence
  chemically synthesized
atacaaaaattagccgggtg

SEQ ID NO: 387547 - DNA, 20 bp, Artificial Sequence
  chemically synthesized
taaaaatacaaaaattagcc

SEQ ID NO: 387548 - DNA, 20 bp, Artificial Sequence
  chemically synthesized
ctaaaaatacaaaaattagc

SEQ ID NO: 387549 - DNA, 20 bp, Artificial Sequence
  chemically synthesized
tgtactaaaaatacaaaaat

SEQ ID NO: 387550 - DNA, 20 bp, Artificial Sequence
  chemically synthesized
ccggctaatttttgtatttt

SEQ ID NO: 387551 - DNA, 20 bp, Artificial Sequence
  chemically synthesized
taatttttgtatttttagta

SEQ ID NO: 387552 - DNA, 20 bp, Artificial Sequence
  chemically synthesized
ttttgtatttttagtacaga

SEQ ID NO: 387553 - DNA, 20 bp, Artificial Sequence
  chemically synthesized
tttgtatttttagtacagat

SEQ ID NO: 387554 - DNA, 20 bp, Artificial Sequence
  chemically synthesized
cagatgggatttcaccgcgt

SEQ ID NO: 387555 - DNA, 20 bp, Artificial Sequence
  chemically synthesized
tgggatttcaccgcgttggt

SEQ ID NO: 387556 - DNA, 20 bp, Artificial Sequence
  chemically synthesized
caagaccagcctgaccaacg

SEQ ID NO: 387557 - DNA, 20 bp, Artificial Sequence
  chemically synthesized
gggatttcaccgcgttggtc

SEQ ID NO: 387558 - DNA, 20 bp, Artificial Sequence
  chemically synthesized
tttcaccgcgttggtcaggc

SEQ ID NO: 387559 - DNA, 20 bp, Artificial Sequence
  chemically synthesized
tgaggtcaggagttcaagac

SEQ ID NO: 387560 - DNA, 20 bp, Artificial Sequence
  chemically synthesized
gatcatgaggtcaggagttc

SEQ ID NO: 387561 - DNA, 20 bp, Artificial Sequence
  chemically synthesized
cgggcggatcatgaggtcag

SEQ ID NO: 387562 - DNA, 20 bp, Artificial Sequence
  chemically synthesized
ggcgggcggatcatgaggtc

SEQ ID NO: 387563 - DNA, 20 bp, Artificial Sequence
  chemically synthesized
aggcgggcggatcatgaggt

SEQ ID NO: 387564 - DNA, 20 bp, Artificial Sequence
  chemically synthesized
gcagaggcgggcggatcatg

SEQ ID NO: 387565 - DNA, 20 bp, Artificial Sequence
  chemically synthesized
agcagaggcgggcggatcat

SEQ ID NO: 387566 - DNA, 20 bp, Artificial Sequence
  chemically synthesized
ctttgggaagcagaggcggg

SEQ ID NO: 387567 - DNA, 20 bp, Artificial Sequence
  chemically synthesized
gcactttgggaagcagaggc

SEQ ID NO: 387568 - DNA, 20 bp, Artificial Sequence
  chemically synthesized
agcactttgggaagcagagg

SEQ ID NO: 387569 - DNA, 20 bp, Artificial Sequence
  chemically synthesized
cccagcactttgggaagcag

SEQ ID NO: 387570 - DNA, 20 bp, Artificial Sequence
  chemically synthesized
tcccagcactttgggaagca

SEQ ID NO: 387571 - DNA, 20 bp, Artificial Sequence
  chemically synthesized
ccgcccgcctctgcttccca

SEQ ID NO: 387572 - DNA, 20 bp, Artificial Sequence
  chemically synthesized
aatcccagcactttgggaag

SEQ ID NO: 387573 - DNA, 20 bp, Artificial Sequence
  chemically synthesized
tgtaatcccagcactttggg

SEQ ID NO: 387574 - DNA, 20 bp, Artificial Sequence
  chemically synthesized
gcctctgcttcccaaagtgc

SEQ ID NO: 387575 - DNA, 20 bp, Artificial Sequence
  chemically synthesized
gcctgtaatcccagcacttt

SEQ ID NO: 387576 - DNA, 20 bp, Artificial Sequence
  chemically synthesized
cctctgcttcccaaagtgct

SEQ ID NO: 387577 - DNA, 20 bp, Artificial Sequence
  chemically synthesized
ggcctgtaatcccagcactt

SEQ ID NO: 387578 - DNA, 20 bp, Artificial Sequence
  chemically synthesized
ttcccaaagtgctgggatta

SEQ ID NO: 387579 - DNA, 20 bp, Artificial Sequence
  chemically synthesized
tcccaaagtgctgggattac

SEQ ID NO: 387580 - DNA, 20 bp, Artificial Sequence
  chemically synthesized
gtggctcaggcctgtaatcc

SEQ ID NO: 387581 - DNA, 20 bp, Artificial Sequence
  chemically synthesized
agtgctgggattacaggcct

SEQ ID NO: 387582 - DNA, 20 bp, Artificial Sequence
  chemically synthesized
aaggctgggcacagtggctc

SEQ ID NO: 387583 - DNA, 20 bp, Artificial Sequence
  chemically synthesized
caaggctgggcacagtggct

SEQ ID NO: 387584 - DNA, 20 bp, Artificial Sequence
  chemically synthesized
caggcctgagccactgtgcc

SEQ ID NO: 387585 - DNA, 20 bp, Artificial Sequence
  chemically synthesized
ctgaacaaggctgggcacag

SEQ ID NO: 387586 - DNA, 20 bp, Artificial Sequence
  chemically synthesized
gagctgaacaaggctgggca

SEQ ID NO: 387587 - DNA, 20 bp, Artificial Sequence
  chemically synthesized
taaaggagctgaacaaggct

SEQ ID NO: 387588 - DNA, 20 bp, Artificial Sequence
  chemically synthesized
ctaaaggagctgaacaaggc

SEQ ID NO: 387589 - DNA, 20 bp, Artificial Sequence
  chemically synthesized
ccactgtgcccagccttgtt

SEQ ID NO: 387590 - DNA, 20 bp, Artificial Sequence
  chemically synthesized
taagctaaaggagctgaaca

SEQ ID NO: 387591 - DNA, 20 bp, Artificial Sequence
  chemically synthesized
gtaagctaaaggagctgaac

SEQ ID NO: 387592 - DNA, 20 bp, Artificial Sequence
  chemically synthesized
ccagccttgttcagctcctt

SEQ ID NO: 387593 - DNA, 20 bp, Artificial Sequence
  chemically synthesized
tgctctaaagtaagctaaag

SEQ ID NO: 387594 - DNA, 20 bp, Artificial Sequence
  chemically synthesized
actgctctaaagtaagctaa

SEQ ID NO: 387595 - DNA, 20 bp, Artificial Sequence
  chemically synthesized
gactgctctaaagtaagcta

SEQ ID NO: 387596 - DNA, 20 bp, Artificial Sequence
  chemically synthesized
tcagctcctttagcttactt

SEQ ID NO: 387597 - DNA, 20 bp, Artificial Sequence
  chemically synthesized
agctcctttagcttacttta

SEQ ID NO: 387598 - DNA, 20 bp, Artificial Sequence
  chemically synthesized
acctgtgactgctctaaagt

SEQ ID NO: 387599 - DNA, 20 bp, Artificial Sequence
  chemically synthesized
tcctttagcttactttagag

SEQ ID NO: 387600 - DNA, 20 bp, Artificial Sequence
  chemically synthesized
ggcaacctgtgactgctcta

SEQ ID NO: 387601 - DNA, 20 bp, Artificial Sequence
  chemically synthesized
agcttactttagagcagtca

SEQ ID NO: 387602 - DNA, 20 bp, Artificial Sequence
  chemically synthesized
gcttactttagagcagtcac

SEQ ID NO: 387603 - DNA, 20 bp, Artificial Sequence
  chemically synthesized
gtcacaggttgccacttttc

SEQ ID NO: 387604 - DNA, 20 bp, Artificial Sequence
  chemically synthesized
tgtccctgatgctggaaaag

SEQ ID NO: 387605 - DNA, 20 bp, Artificial Sequence
  chemically synthesized
ctttgtccctgatgctggaa

SEQ ID NO: 387606 - DNA, 20 bp, Artificial Sequence
  chemically synthesized
ggttgccacttttccagcat

SEQ ID NO: 387607 - DNA, 20 bp, Artificial Sequence
  chemically synthesized
gttgccacttttccagcatc

SEQ ID NO: 387608 - DNA, 20 bp, Artificial Sequence
  chemically synthesized
ttgccacttttccagcatca

SEQ ID NO: 387609 - DNA, 20 bp, Artificial Sequence
  chemically synthesized
ctgaactttgtccctgatgc

SEQ ID NO: 387610 - DNA, 20 bp, Artificial Sequence
  chemically synthesized
cttttccagcatcagggaca

SEQ ID NO: 387611 - DNA, 20 bp, Artificial Sequence
  chemically synthesized
ccagcatcagggacaaagtt

SEQ ID NO: 387612 - DNA, 20 bp, Artificial Sequence
  chemically synthesized
cacgtcgattctaaaaatca

SEQ ID NO: 387613 - DNA, 20 bp, Artificial Sequence
  chemically synthesized
tcccacgagactgtgatttt

SEQ ID NO: 387614 - DNA, 20 bp, Artificial Sequence
  chemically synthesized
ttctaaaaatcacagtctcg

SEQ ID NO: 387615 - DNA, 20 bp, Artificial Sequence
  chemically synthesized
tctaaaaatcacagtctcgt

SEQ ID NO: 387616 - DNA, 20 bp, Artificial Sequence
  chemically synthesized
taaaaatcacagtctcgtgg

SEQ ID NO: 387617 - DNA, 20 bp, Artificial Sequence
  chemically synthesized
aaaaatcacagtctcgtggg

SEQ ID NO: 387618 - DNA, 20 bp, Artificial Sequence
  chemically synthesized
acagatattccacctcccac

SEQ ID NO: 387619 - DNA, 20 bp, Artificial Sequence
  chemically synthesized
aatcacagtctcgtgggagg

SEQ ID NO: 387620 - DNA, 20 bp, Artificial Sequence
  chemically synthesized
aaatatgttatgagttgtga

SEQ ID NO: 387621 - DNA, 20 bp, Artificial Sequence
  chemically synthesized
agcagtaggaaatatgttat

SEQ ID NO: 387622 - DNA, 20 bp, Artificial Sequence
  chemically synthesized
tatatggaacatgaagcagt

SEQ ID NO: 387623 - DNA, 20 bp, Artificial Sequence
  chemically synthesized
atatatggaacatgaagcag

SEQ ID NO: 387624 - DNA, 20 bp, Artificial Sequence
  chemically synthesized
ctaatatatggaacatgaag

SEQ ID NO: 387625 - DNA, 20 bp, Artificial Sequence
  chemically synthesized
tttctaatatatggaacatg

SEQ ID NO: 387626 - DNA, 20 bp, Artificial Sequence
  chemically synthesized
ctgcttcatgttccatatat

SEQ ID NO: 387627 - DNA, 20 bp, Artificial Sequence
  chemically synthesized
gtgaatgggtttctaatata

SEQ ID NO: 387628 - DNA, 20 bp, Artificial Sequence
  chemically synthesized
tggggaaattagtggtgaat

SEQ ID NO: 387629 - DNA, 20 bp, Artificial Sequence
  chemically synthesized
ttggggaaattagtggtgaa

SEQ ID NO: 387630 - DNA, 20 bp, Artificial Sequence
  chemically synthesized
tgtaaatttggggaaattag

SEQ ID NO: 387631 - DNA, 20 bp, Artificial Sequence
  chemically synthesized
acttgtaaatttggggaaat

SEQ ID NO: 387632 - DNA, 20 bp, Artificial Sequence
  chemically synthesized
actcttaacttgtaaatttg

SEQ ID NO: 387633 - DNA, 20 bp, Artificial Sequence
  chemically synthesized
aactcttaacttgtaaattt

SEQ ID NO: 387634 - DNA, 20 bp, Artificial Sequence
  chemically synthesized
actaatttccccaaatttac

SEQ ID NO: 387635 - DNA, 20 bp, Artificial Sequence
  chemically synthesized
aaactcttaacttgtaaatt

SEQ ID NO: 387636 - DNA, 20 bp, Artificial Sequence
  chemically synthesized
tttccccaaatttacaagtt

SEQ ID NO: 387637 - DNA, 20 bp, Artificial Sequence
  chemically synthesized
tccccaaatttacaagttaa

SEQ ID NO: 387638 - DNA, 20 bp, Artificial Sequence
  chemically synthesized
caagttaagagtttaaatta

SEQ ID NO: 387639 - DNA, 20 bp, Artificial Sequence
  chemically synthesized
agtttaaattatagttttat

SEQ ID NO: 387640 - DNA, 20 bp, Artificial Sequence
  chemically synthesized
ccatgacctgaaaaataaag

SEQ ID NO: 387641 - DNA, 20 bp, Artificial Sequence
  chemically synthesized
aatttatctactttattttt

SEQ ID NO: 387642 - DNA, 20 bp, Artificial Sequence
  chemically synthesized
aatccatgacctgaaaaata

SEQ ID NO: 387643 - DNA, 20 bp, Artificial Sequence
  chemically synthesized
atttatctactttatttttc

SEQ ID NO: 387644 - DNA, 20 bp, Artificial Sequence
  chemically synthesized
ctactttatttttcaggtca

SEQ ID NO: 387645 - DNA, 20 bp, Artificial Sequence
  chemically synthesized
atttttcaggtcatggattc

SEQ ID NO: 387646 - DNA, 20 bp, Artificial Sequence
  chemically synthesized
accttacttcatatgagagc

SEQ ID NO: 387647 - DNA, 20 bp, Artificial Sequence
  chemically synthesized
tggattctagctctcatatg

SEQ ID NO: 387648 - DNA, 20 bp, Artificial Sequence
  chemically synthesized
taagaccttacttcatatga

SEQ ID NO: 387649 - DNA, 20 bp, Artificial Sequence
  chemically synthesized
attaagaccttacttcatat

SEQ ID NO: 387650 - DNA, 20 bp, Artificial Sequence
  chemically synthesized
ttctagctctcatatgaagt

SEQ ID NO: 387651 - DNA, 20 bp, Artificial Sequence
  chemically synthesized
tctagctctcatatgaagta

SEQ ID NO: 387652 - DNA, 20 bp, Artificial Sequence
  chemically synthesized
gtaaagaaataaaaagcatt

SEQ ID NO: 387653 - DNA, 20 bp, Artificial Sequence
  chemically synthesized
acataaggtaaagaaataaa

SEQ ID NO: 387654 - DNA, 20 bp, Artificial Sequence
  chemically synthesized
ctgaaatttaacataaggta

SEQ ID NO: 387655 - DNA, 20 bp, Artificial Sequence
  chemically synthesized
tcaatctgaaatttaacata

SEQ ID NO: 387656 - DNA, 20 bp, Artificial Sequence
  chemically synthesized
atcaatctgaaatttaacat

SEQ ID NO: 387657 - DNA, 20 bp, Artificial Sequence
  chemically synthesized
ctttaccttatgttaaattt

SEQ ID NO: 387658 - DNA, 20 bp, Artificial Sequence
  chemically synthesized
atgttaaatttcagattgat

SEQ ID NO: 387659 - DNA, 20 bp, Artificial Sequence
  chemically synthesized
gaactttcaatattattaga

SEQ ID NO: 387660 - DNA, 20 bp, Artificial Sequence
  chemically synthesized
atgtgaactttcaatattat

SEQ ID NO: 387661 - DNA, 20 bp, Artificial Sequence
  chemically synthesized
gagctttctaataatattga

SEQ ID NO: 387662 - DNA, 20 bp, Artificial Sequence
  chemically synthesized
gaaagttcacattactacct

SEQ ID NO: 387663 - DNA, 20 bp, Artificial Sequence
  chemically synthesized
agttcacattactaccttag

SEQ ID NO: 387664 - DNA, 20 bp, Artificial Sequence
  chemically synthesized
atttggaagctctactaagg

SEQ ID NO: 387665 - DNA, 20 bp, Artificial Sequence
  chemically synthesized
ttcacattactaccttagta

SEQ ID NO: 387666 - DNA, 20 bp, Artificial Sequence
  chemically synthesized
tgaatttggaagctctacta

SEQ ID NO: 387667 - DNA, 20 bp, Artificial Sequence
  chemically synthesized
ttgaatttggaagctctact

SEQ ID NO: 387668 - DNA, 20 bp, Artificial Sequence
  chemically synthesized
aaatttcaatttgaatttgg

SEQ ID NO: 387669 - DNA, 20 bp, Artificial Sequence
  chemically synthesized
gtgaaatttcaatttgaatt

SEQ ID NO: 387670 - DNA, 20 bp, Artificial Sequence
  chemically synthesized
aattcaaattgaaatttcac

SEQ ID NO: 387671 - DNA, 20 bp, Artificial Sequence
  chemically synthesized
attcaaattgaaatttcact

SEQ ID NO: 387672 - DNA, 20 bp, Artificial Sequence
  chemically synthesized
aaattgaaatttcactgggc

SEQ ID NO: 387673 - DNA, 20 bp, Artificial Sequence
  chemically synthesized
aattgaaatttcactgggct

SEQ ID NO: 387674 - DNA, 20 bp, Artificial Sequence
  chemically synthesized
gtgagccaccgcacccagcc

SEQ ID NO: 387675 - DNA, 20 bp, Artificial Sequence
  chemically synthesized
aaatttcactgggctgggtg

SEQ ID NO: 387676 - DNA, 20 bp, Artificial Sequence
  chemically synthesized
tttcactgggctgggtgcgg

SEQ ID NO: 387677 - DNA, 20 bp, Artificial Sequence
  chemically synthesized
caggtgtgagccaccgcacc

SEQ ID NO: 387678 - DNA, 20 bp, Artificial Sequence
  chemically synthesized
aatgctgtgattacaggtgt

SEQ ID NO: 387679 - DNA, 20 bp, Artificial Sequence
  chemically synthesized
gtggctcacacctgtaatca

SEQ ID NO: 387680 - DNA, 20 bp, Artificial Sequence
  chemically synthesized
ttccaaaatgctgtgattac

SEQ ID NO: 387681 - DNA, 20 bp, Artificial Sequence
  chemically synthesized
cttccaaaatgctgtgatta

SEQ ID NO: 387682 - DNA, 20 bp, Artificial Sequence
  chemically synthesized
cacctgtaatcacagcattt

SEQ ID NO: 387683 - DNA, 20 bp, Artificial Sequence
  chemically synthesized
ctgtaatcacagcattttgg

SEQ ID NO: 387684 - DNA, 20 bp, Artificial Sequence
  chemically synthesized
tgtaatcacagcattttgga

SEQ ID NO: 387685 - DNA, 20 bp, Artificial Sequence
  chemically synthesized
tcacagcattttggaaggcc

SEQ ID NO: 387686 - DNA, 20 bp, Artificial Sequence
  chemically synthesized
agcattttggaaggccaaga

SEQ ID NO: 387687 - DNA, 20 bp, Artificial Sequence
  chemically synthesized
gcattttggaaggccaagac

SEQ ID NO: 387688 - DNA, 20 bp, Artificial Sequence
  chemically synthesized
ttttggaaggccaagacggg

SEQ ID NO: 387689 - DNA, 20 bp, Artificial Sequence
  chemically synthesized
ctcaagtgatctgcccgtct

SEQ ID NO: 387690 - DNA, 20 bp, Artificial Sequence
  chemically synthesized
ccaagacgggcagatcactt

SEQ ID NO: 387691 - DNA, 20 bp, Artificial Sequence
  chemically synthesized
caagacgggcagatcacttg

SEQ ID NO: 387692 - DNA, 20 bp, Artificial Sequence
  chemically synthesized
acgggcagatcacttgaggt

SEQ ID NO: 387693 - DNA, 20 bp, Artificial Sequence
  chemically synthesized
cgggcagatcacttgaggtc

SEQ ID NO: 387694 - DNA, 20 bp, Artificial Sequence
  chemically synthesized
ggtcttgaactcctgacctc

SEQ ID NO: 387695 - DNA, 20 bp, Artificial Sequence
  chemically synthesized
ggcagatcacttgaggtcag

SEQ ID NO: 387696 - DNA, 20 bp, Artificial Sequence
  chemically synthesized
tcacttgaggtcaggagttc

SEQ ID NO: 387697 - DNA, 20 bp, Artificial Sequence
  chemically synthesized
tgaggtcaggagttcaagac

SEQ ID NO: 387698 - DNA, 20 bp, Artificial Sequence
  chemically synthesized
tcaggagttcaagaccagcc

SEQ ID NO: 387699 - DNA, 20 bp, Artificial Sequence
  chemically synthesized
cttcaccatgttggccaggc

SEQ ID NO: 387700 - DNA, 20 bp, Artificial Sequence
  chemically synthesized
ggggcttcaccatgttggcc

SEQ ID NO: 387701 - DNA, 20 bp, Artificial Sequence
  chemically synthesized
caagaccagcctggccaaca

SEQ ID NO: 387702 - DNA, 20 bp, Artificial Sequence
  chemically synthesized
cggggcttcaccatgttggc

SEQ ID NO: 387703 - DNA, 20 bp, Artificial Sequence
  chemically synthesized
gagacggggcttcaccatgt

SEQ ID NO: 387704 - DNA, 20 bp, Artificial Sequence
  chemically synthesized
ccagcctggccaacatggtg

SEQ ID NO: 387705 - DNA, 20 bp, Artificial Sequence
  chemically synthesized
ttgtatttttagtagagacg

SEQ ID NO: 387706 - DNA, 20 bp, Artificial Sequence
  chemically synthesized
tttgtatttttagtagagac

SEQ ID NO: 387707 - DNA, 20 bp, Artificial Sequence
  chemically synthesized
ttttgtatttttagtagaga

SEQ ID NO: 387708 - DNA, 20 bp, Artificial Sequence
  chemically synthesized
tattttttgtatttttagta

SEQ ID NO: 387709 - DNA, 20 bp, Artificial Sequence
  chemically synthesized
actattttttgtatttttag

SEQ ID NO: 387710 - DNA, 20 bp, Artificial Sequence
  chemically synthesized
ccaactattttttgtatttt

SEQ ID NO: 387711 - DNA, 20 bp, Artificial Sequence
  chemically synthesized
tctactaaaaatacaaaaaa

SEQ ID NO: 387712 - DNA, 20 bp, Artificial Sequence
  chemically synthesized
ctaaaaatacaaaaaatagt

SEQ ID NO: 387713 - DNA, 20 bp, Artificial Sequence
  chemically synthesized
taaaaatacaaaaaatagtt

SEQ ID NO: 387714 - DNA, 20 bp, Artificial Sequence
  chemically synthesized
aaatacaaaaaatagttggg

SEQ ID NO: 387715 - DNA, 20 bp, Artificial Sequence
  chemically synthesized
caaaaaatagttgggtggct

SEQ ID NO: 387716 - DNA, 20 bp, Artificial Sequence
  chemically synthesized
tgggattacaggcatgcacc

SEQ ID NO: 387717 - DNA, 20 bp, Artificial Sequence
  chemically synthesized
ttggtgcatgcctgtaatcc

SEQ ID NO: 387718 - DNA, 20 bp, Artificial Sequence
  chemically synthesized
tcccgagtagctgggattac

SEQ ID NO: 387719 - DNA, 20 bp, Artificial Sequence
  chemically synthesized
ctcccgagtagctgggatta

SEQ ID NO: 387720 - DNA, 20 bp, Artificial Sequence
  chemically synthesized
tgcctgtaatcccagctact

SEQ ID NO: 387721 - DNA, 20 bp, Artificial Sequence
  chemically synthesized
cctcagcctcccgagtagct

SEQ ID NO: 387722 - DNA, 20 bp, Artificial Sequence
  chemically synthesized
gcctgtaatcccagctactc

SEQ ID NO: 387723 - DNA, 20 bp, Artificial Sequence
  chemically synthesized
gcctcagcctcccgagtagc

SEQ ID NO: 387724 - DNA, 20 bp, Artificial Sequence
  chemically synthesized
ctgtaatcccagctactcgg

SEQ ID NO: 387725 - DNA, 20 bp, Artificial Sequence
  chemically synthesized
tgtaatcccagctactcggg

SEQ ID NO: 387726 - DNA, 20 bp, Artificial Sequence
  chemically synthesized
tcctgcctcagcctcccgag

SEQ ID NO: 387727 - DNA, 20 bp, Artificial Sequence
  chemically synthesized
ttctcctgcctcagcctccc

SEQ ID NO: 387728 - DNA, 20 bp, Artificial Sequence
  chemically synthesized
tcccagctactcgggaggct

SEQ ID NO: 387729 - DNA, 20 bp, Artificial Sequence
  chemically synthesized
cccagctactcgggaggctg

SEQ ID NO: 387730 - DNA, 20 bp, Artificial Sequence
  chemically synthesized
agctactcgggaggctgagg

SEQ ID NO: 387731 - DNA, 20 bp, Artificial Sequence
  chemically synthesized
gctactcgggaggctgaggc

SEQ ID NO: 387732 - DNA, 20 bp, Artificial Sequence
  chemically synthesized
tactcgggaggctgaggcag

SEQ ID NO: 387733 - DNA, 20 bp, Artificial Sequence
  chemically synthesized
ttcaagtgattctcctgcct

SEQ ID NO: 387734 - DNA, 20 bp, Artificial Sequence
  chemically synthesized
gcaggagaatcacttgaacc

SEQ ID NO: 387735 - DNA, 20 bp, Artificial Sequence
  chemically synthesized
caggagaatcacttgaaccc

SEQ ID NO: 387736 - DNA, 20 bp, Artificial Sequence
  chemically synthesized
aacctccatctcctgggttc

SEQ ID NO: 387737 - DNA, 20 bp, Artificial Sequence
  chemically synthesized
ggagaatcacttgaacccag

SEQ ID NO: 387738 - DNA, 20 bp, Artificial Sequence
  chemically synthesized
aatcacttgaacccaggaga

SEQ ID NO: 387739 - DNA, 20 bp, Artificial Sequence
  chemically synthesized
cactacaacctccatctcct

SEQ ID NO: 387740 - DNA, 20 bp, Artificial Sequence
  chemically synthesized
tcacttgaacccaggagatg

SEQ ID NO: 387741 - DNA, 20 bp, Artificial Sequence
  chemically synthesized
tcactacaacctccatctcc

SEQ ID NO: 387742 - DNA, 20 bp, Artificial Sequence
  chemically synthesized
cacttgaacccaggagatgg

SEQ ID NO: 387743 - DNA, 20 bp, Artificial Sequence
  chemically synthesized
aacccaggagatggaggttg

SEQ ID NO: 387744 - DNA, 20 bp, Artificial Sequence
  chemically synthesized
caggagatggaggttgtagt

SEQ ID NO: 387745 - DNA, 20 bp, Artificial Sequence
  chemically synthesized
gagatggaggttgtagtgag

SEQ ID NO: 387746 - DNA, 20 bp, Artificial Sequence
  chemically synthesized
gatggaggttgtagtgagca

SEQ ID NO: 387747 - DNA, 20 bp, Artificial Sequence
  chemically synthesized
gagatcgcgtcactgcactc

SEQ ID NO: 387748 - DNA, 20 bp, Artificial Sequence
  chemically synthesized
ctgtcacccaggctggagtg

SEQ ID NO: 387749 - DNA, 20 bp, Artificial Sequence
  chemically synthesized
cgcgtcactgcactccagcc

SEQ ID NO: 387750 - DNA, 20 bp, Artificial Sequence
  chemically synthesized
gcgtcactgcactccagcct

SEQ ID NO: 387751 - DNA, 20 bp, Artificial Sequence
  chemically synthesized
ttgctctgtcacccaggctg

SEQ ID NO: 387752 - DNA, 20 bp, Artificial Sequence
  chemically synthesized
tcttgctctgtcacccaggc

SEQ ID NO: 387753 - DNA, 20 bp, Artificial Sequence
  chemically synthesized
ctgcactccagcctgggtga

SEQ ID NO: 387754 - DNA, 20 bp, Artificial Sequence
  chemically synthesized
ggagtcttgctctgtcaccc

SEQ ID NO: 387755 - DNA, 20 bp, Artificial Sequence
  chemically synthesized
gcactccagcctgggtgaca

SEQ ID NO: 387756 - DNA, 20 bp, Artificial Sequence
  chemically synthesized
tggagtcttgctctgtcacc

SEQ ID NO: 387757 - DNA, 20 bp, Artificial Sequence
  chemically synthesized
tccagcctgggtgacagagc

SEQ ID NO: 387758 - DNA, 20 bp, Artificial Sequence
  chemically synthesized
ttttttttttttttttggtg

SEQ ID NO: 387759 - DNA, 20 bp, Artificial Sequence
  chemically synthesized
ttttttttttttttttttgg

SEQ ID NO: 387760 - DNA, 20 bp, Artificial Sequence
  chemically synthesized
ttcttttttttttttttttt

SEQ ID NO: 387761 - DNA, 20 bp, Artificial Sequence
  chemically synthesized
caccaaaaaaaaaaaaaaaa

SEQ ID NO: 387762 - DNA, 20 bp, Artificial Sequence
  chemically synthesized
caaaaaaaaaaaaaaaaaag

SEQ ID NO: 387763 - DNA, 20 bp, Artificial Sequence
  chemically synthesized
aaaaaaaaaaaaaaaagaag

SEQ ID NO: 387764 - DNA, 20 bp, Artificial Sequence
  chemically synthesized
aaaaaaaaaaagaagaagaa

SEQ ID NO: 387765 - DNA, 20 bp, Artificial Sequence
  chemically synthesized
aagaagaagaaaagaaattt

SEQ ID NO: 387766 - DNA, 20 bp, Artificial Sequence
  chemically synthesized
gaagaaaagaaatttaagcg

SEQ ID NO: 387767 - DNA, 20 bp, Artificial Sequence
  chemically synthesized
agaaatttaagcgaagatgt

SEQ ID NO: 387768 - DNA, 20 bp, Artificial Sequence
  chemically synthesized
gaagatgtgagtaactgtat

SEQ ID NO: 387769 - DNA, 20 bp, Artificial Sequence
  chemically synthesized
aaaatgagtctggtctgata

SEQ ID NO: 387770 - DNA, 20 bp, Artificial Sequence
  chemically synthesized
tgtgagtaactgtatcagac

SEQ ID NO: 387771 - DNA, 20 bp, Artificial Sequence
  chemically synthesized
tttacatataaaaatgagtc

SEQ ID NO: 387772 - DNA, 20 bp, Artificial Sequence
  chemically synthesized
catcttttacatataaaaat

SEQ ID NO: 387773 - DNA, 20 bp, Artificial Sequence
  chemically synthesized
agactcatttttatatgtaa

SEQ ID NO: 387774 - DNA, 20 bp, Artificial Sequence
  chemically synthesized
tttatatgtaaaagatgaaa

SEQ ID NO: 387775 - DNA, 20 bp, Artificial Sequence
  chemically synthesized
atctttgcctttattaagag

SEQ ID NO: 387776 - DNA, 20 bp, Artificial Sequence
  chemically synthesized
ggcgttttctactcttaata

SEQ ID NO: 387777 - DNA, 20 bp, Artificial Sequence
  chemically synthesized
gcgttttctactcttaataa

SEQ ID NO: 387778 - DNA, 20 bp, Artificial Sequence
  chemically synthesized
ttcatctttgcctttattaa

SEQ ID NO: 387779 - DNA, 20 bp, Artificial Sequence
  chemically synthesized
agttcatctttgcctttatt

SEQ ID NO: 387780 - DNA, 20 bp, Artificial Sequence
  chemically synthesized
ttctactcttaataaaggca

SEQ ID NO: 387781 - DNA, 20 bp, Artificial Sequence
  chemically synthesized
gctcattttgcattatgtat

SEQ ID NO: 387782 - DNA, 20 bp, Artificial Sequence
  chemically synthesized
actaatacataatgcaaaat

SEQ ID NO: 387783 - DNA, 20 bp, Artificial Sequence
  chemically synthesized
acataatgcaaaatgagcac

SEQ ID NO: 387784 - DNA, 20 bp, Artificial Sequence
  chemically synthesized
taatgcaaaatgagcactgg

SEQ ID NO: 387785 - DNA, 20 bp, Artificial Sequence
  chemically synthesized
atgcaaaatgagcactggaa

SEQ ID NO: 387786 - DNA, 20 bp, Artificial Sequence
  chemically synthesized
cccatcttgtatatctcttc

SEQ ID NO: 387787 - DNA, 20 bp, Artificial Sequence
  chemically synthesized
gagcactggaagagatatac

SEQ ID NO: 387788 - DNA, 20 bp, Artificial Sequence
  chemically synthesized
actggaagagatatacaaga

SEQ ID NO: 387789 - DNA, 20 bp, Artificial Sequence
  chemically synthesized
ctggaagagatatacaagat

SEQ ID NO: 387790 - DNA, 20 bp, Artificial Sequence
  chemically synthesized
aagagatatacaagatgggt

SEQ ID NO: 387791 - DNA, 20 bp, Artificial Sequence
  chemically synthesized
gagatatacaagatgggtaa

SEQ ID NO: 387792 - DNA, 20 bp, Artificial Sequence
  chemically synthesized
atgaaaaatacaaaaattga

SEQ ID NO: 387793 - DNA, 20 bp, Artificial Sequence
  chemically synthesized
ttttgtatttttcattcatt

SEQ ID NO: 387794 - DNA, 20 bp, Artificial Sequence
  chemically synthesized
tcattcagcaaataattacc

SEQ ID NO: 387795 - DNA, 20 bp, Artificial Sequence
  chemically synthesized
tcagcaaataattaccaagc

SEQ ID NO: 387796 - DNA, 20 bp, Artificial Sequence
  chemically synthesized
ttacgtatgtatgacttgct

SEQ ID NO: 387797 - DNA, 20 bp, Artificial Sequence
  chemically synthesized
caagtcatacatacgtaaaa

SEQ ID NO: 387798 - DNA, 20 bp, Artificial Sequence
  chemically synthesized
gagatgggacaaaaaatata

SEQ ID NO: 387799 - DNA, 20 bp, Artificial Sequence
  chemically synthesized
ttcatcactatcatagagat

SEQ ID NO: 387800 - DNA, 20 bp, Artificial Sequence
  chemically synthesized
tttcatcactatcatagaga

SEQ ID NO: 387801 - DNA, 20 bp, Artificial Sequence
  chemically synthesized
tttttgtcccatctctatga

SEQ ID NO: 387802 - DNA, 20 bp, Artificial Sequence
  chemically synthesized
tcactttcatcactatcata

SEQ ID NO: 387803 - DNA, 20 bp, Artificial Sequence
  chemically synthesized
attcactttcatcactatca

SEQ ID NO: 387804 - DNA, 20 bp, Artificial Sequence
  chemically synthesized
catctctatgatagtgatga

SEQ ID NO: 387805 - DNA, 20 bp, Artificial Sequence
  chemically synthesized
taatatttatcattttttta

SEQ ID NO: 387806 - DNA, 20 bp, Artificial Sequence
  chemically synthesized
aaatgataaatattaaatat

SEQ ID NO: 387807 - DNA, 20 bp, Artificial Sequence
  chemically synthesized
gataaatattaaatatcggc

SEQ ID NO: 387808 - DNA, 20 bp, Artificial Sequence
  chemically synthesized
caatgataatattttgtatc

SEQ ID NO: 387809 - DNA, 20 bp, Artificial Sequence
  chemically synthesized
tagatacaaaatattatcat

SEQ ID NO: 387810 - DNA, 20 bp, Artificial Sequence
  chemically synthesized
ttatcattggtgtatataac

SEQ ID NO: 387811 - DNA, 20 bp, Artificial Sequence
  chemically synthesized
ggtgtatataaccagaattt

SEQ ID NO: 387812 - DNA, 20 bp, Artificial Sequence
  chemically synthesized
caatgattcaacttaaattc

SEQ ID NO: 387813 - DNA, 20 bp, Artificial Sequence
  chemically synthesized
cagaatttaagttgaatcat

SEQ ID NO: 387814 - DNA, 20 bp, Artificial Sequence
  chemically synthesized
aagttgaatcattggcatca

SEQ ID NO: 387815 - DNA, 20 bp, Artificial Sequence
  chemically synthesized
ttggcatcaaagattttaaa

SEQ ID NO: 387816 - DNA, 20 bp, Artificial Sequence
  chemically synthesized
atcaaagattttaaatagtt

SEQ ID NO: 387817 - DNA, 20 bp, Artificial Sequence
  chemically synthesized
aaaattaaaaaatacattgc

SEQ ID NO: 387818 - DNA, 20 bp, Artificial Sequence
  chemically synthesized
agctccttgtaagtggggac

SEQ ID NO: 387819 - DNA, 20 bp, Artificial Sequence
  chemically synthesized
cattgctagtccccacttac

SEQ ID NO: 387820 - DNA, 20 bp, Artificial Sequence
  chemically synthesized
tctcaagctccttgtaagtg

SEQ ID NO: 387821 - DNA, 20 bp, Artificial Sequence
  chemically synthesized
attgctagtccccacttaca

SEQ ID NO: 387822 - DNA, 20 bp, Artificial Sequence
  chemically synthesized
ttctcaagctccttgtaagt

SEQ ID NO: 387823 - DNA, 20 bp, Artificial Sequence
  chemically synthesized
cttctcaagctccttgtaag

SEQ ID NO: 387824 - DNA, 20 bp, Artificial Sequence
  chemically synthesized
tgctagtccccacttacaag

SEQ ID NO: 387825 - DNA, 20 bp, Artificial Sequence
  chemically synthesized
tctcttctcaagctccttgt

SEQ ID NO: 387826 - DNA, 20 bp, Artificial Sequence
  chemically synthesized
tccccacttacaaggagctt

SEQ ID NO: 387827 - DNA, 20 bp, Artificial Sequence
  chemically synthesized
ccacttacaaggagcttgag

SEQ ID NO: 387828 - DNA, 20 bp, Artificial Sequence
  chemically synthesized
acttacaaggagcttgagaa

SEQ ID NO: 387829 - DNA, 20 bp, Artificial Sequence
  chemically synthesized
tatttttattttctcttctc

SEQ ID NO: 387830 - DNA, 20 bp, Artificial Sequence
  chemically synthesized
atatttctgtattgatttgt

SEQ ID NO: 387831 - DNA, 20 bp, Artificial Sequence
  chemically synthesized
aaaataccaacaaatcaata

SEQ ID NO: 387832 - DNA, 20 bp, Artificial Sequence
  chemically synthesized
caatacagaaatattcacta

SEQ ID NO: 387833 - DNA, 20 bp, Artificial Sequence
  chemically synthesized
tcattgagtttcatgatcta

SEQ ID NO: 387834 - DNA, 20 bp, Artificial Sequence
  chemically synthesized
aaactttattacaggtcatt

SEQ ID NO: 387835 - DNA, 20 bp, Artificial Sequence
  chemically synthesized
aaactcaatgacctgtaata

SEQ ID NO: 387836 - DNA, 20 bp, Artificial Sequence
  chemically synthesized
tttttcttaaactttattac

SEQ ID NO: 387837 - DNA, 20 bp, Artificial Sequence
  chemically synthesized
gtttttcttaaactttatta

SEQ ID NO: 387838 - DNA, 20 bp, Artificial Sequence
  chemically synthesized
aatgacctgtaataaagttt

SEQ ID NO: 387839 - DNA, 20 bp, Artificial Sequence
  chemically synthesized
acaattttatattgccttga

SEQ ID NO: 387840 - DNA, 20 bp, Artificial Sequence
  chemically synthesized
tgatttgggctattctatca

SEQ ID NO: 387841 - DNA, 20 bp, Artificial Sequence
  chemically synthesized
tttatattgccttgatagaa

SEQ ID NO: 387842 - DNA, 20 bp, Artificial Sequence
  chemically synthesized
atgatttgggctattctatc

SEQ ID NO: 387843 - DNA, 20 bp, Artificial Sequence
  chemically synthesized
tccatctgctttgatgattt

SEQ ID NO: 387844 - DNA, 20 bp, Artificial Sequence
  chemically synthesized
ttccatctgctttgatgatt

SEQ ID NO: 387845 - DNA, 20 bp, Artificial Sequence
  chemically synthesized
tagaatagcccaaatcatca

SEQ ID NO: 387846 - DNA, 20 bp, Artificial Sequence
  chemically synthesized
aatagcccaaatcatcaaag

SEQ ID NO: 387847 - DNA, 20 bp, Artificial Sequence
  chemically synthesized
gcccaaatcatcaaagcaga

SEQ ID NO: 387848 - DNA, 20 bp, Artificial Sequence
  chemically synthesized
caaagcagatggaattttca

SEQ ID NO: 387849 - DNA, 20 bp, Artificial Sequence
  chemically synthesized
gcagatggaattttcaaaga

SEQ ID NO: 387850 - DNA, 20 bp, Artificial Sequence
  chemically synthesized
caaagacagtatgctatcat

SEQ ID NO: 387851 - DNA, 20 bp, Artificial Sequence
  chemically synthesized
cgcacatgtctttctcatga

SEQ ID NO: 387852 - DNA, 20 bp, Artificial Sequence
  chemically synthesized
gacagtatgctatcatgaga

SEQ ID NO: 387853 - DNA, 20 bp, Artificial Sequence
  chemically synthesized
tatcatgagaaagacatgtg

SEQ ID NO: 387854 - DNA, 20 bp, Artificial Sequence
  chemically synthesized
agaaagacatgtgcggaaac

SEQ ID NO: 387855 - DNA, 20 bp, Artificial Sequence
  chemically synthesized
gaaagacatgtgcggaaact

SEQ ID NO: 387856 - DNA, 20 bp, Artificial Sequence
  chemically synthesized
agacatgtgcggaaactagg

SEQ ID NO: 387857 - DNA, 20 bp, Artificial Sequence
  chemically synthesized
catgtgcggaaactaggaag

SEQ ID NO: 387858 - DNA, 20 bp, Artificial Sequence
  chemically synthesized
tcagaatacaagcttcttcc

SEQ ID NO: 387859 - DNA, 20 bp, Artificial Sequence
  chemically synthesized
tggtaacacattcagaatac

SEQ ID NO: 387860 - DNA, 20 bp, Artificial Sequence
  chemically synthesized
taacctcttggtaacacatt

SEQ ID NO: 387861 - DNA, 20 bp, Artificial Sequence
  chemically synthesized
tgtattctgaatgtgttacc

SEQ ID NO: 387862 - DNA, 20 bp, Artificial Sequence
  chemically synthesized
tattctgaatgtgttaccaa

SEQ ID NO: 387863 - DNA, 20 bp, Artificial Sequence
  chemically synthesized
attctgaatgtgttaccaag

SEQ ID NO: 387864 - DNA, 20 bp, Artificial Sequence
  chemically synthesized
ttacattcattgtaacctct

SEQ ID NO: 387865 - DNA, 20 bp, Artificial Sequence
  chemically synthesized
tgtaataaaacatctttttg

SEQ ID NO: 387866 - DNA, 20 bp, Artificial Sequence
  chemically synthesized
tccatatttcttaccacaaa

SEQ ID NO: 387867 - DNA, 20 bp, Artificial Sequence
  chemically synthesized
ataaaacatctttttgtggt

SEQ ID NO: 387868 - DNA, 20 bp, Artificial Sequence
  chemically synthesized
tctttttgtggtaagaaata

SEQ ID NO: 387869 - DNA, 20 bp, Artificial Sequence
  chemically synthesized
tttgtggtaagaaatatgga

SEQ ID NO: 387870 - DNA, 20 bp, Artificial Sequence
  chemically synthesized
tggtaagaaatatggaaaga

SEQ ID NO: 387871 - DNA, 20 bp, Artificial Sequence
  chemically synthesized
taagaaatatggaaagacag

SEQ ID NO: 387872 - DNA, 20 bp, Artificial Sequence
  chemically synthesized
aggagattaatgcagtagaa

SEQ ID NO: 387873 - DNA, 20 bp, Artificial Sequence
  chemically synthesized
ctggaaggagattaatgcag

SEQ ID NO: 387874 - DNA, 20 bp, Artificial Sequence
  chemically synthesized
aacctggaaggagattaatg

SEQ ID NO: 387875 - DNA, 20 bp, Artificial Sequence
  chemically synthesized
ctactgcattaatctccttc

SEQ ID NO: 387876 - DNA, 20 bp, Artificial Sequence
  chemically synthesized
tactgcattaatctccttcc

SEQ ID NO: 387877 - DNA, 20 bp, Artificial Sequence
  chemically synthesized
tgcacctgttaacctggaag

SEQ ID NO: 387878 - DNA, 20 bp, Artificial Sequence
  chemically synthesized
gctgcacctgttaacctgga

SEQ ID NO: 387879 - DNA, 20 bp, Artificial Sequence
  chemically synthesized
tgctgcacctgttaacctgg

SEQ ID NO: 387880 - DNA, 20 bp, Artificial Sequence
  chemically synthesized
ttaatctccttccaggttaa

SEQ ID NO: 387881 - DNA, 20 bp, Artificial Sequence
  chemically synthesized
taatctccttccaggttaac

SEQ ID NO: 387882 - DNA, 20 bp, Artificial Sequence
  chemically synthesized
tgctgctgcacctgttaacc

SEQ ID NO: 387883 - DNA, 20 bp, Artificial Sequence
  chemically synthesized
tccttccaggttaacaggtg

SEQ ID NO: 387884 - DNA, 20 bp, Artificial Sequence
  chemically synthesized
ttccaggttaacaggtgcag

SEQ ID NO: 387885 - DNA, 20 bp, Artificial Sequence
  chemically synthesized
caggttaacaggtgcagcag

SEQ ID NO: 387886 - DNA, 20 bp, Artificial Sequence
  chemically synthesized
ttaacaggtgcagcagcagt

SEQ ID NO: 387887 - DNA, 20 bp, Artificial Sequence
  chemically synthesized
ggtgcagcagcagttggctt

SEQ ID NO: 387888 - DNA, 20 bp, Artificial Sequence
  chemically synthesized
cgcattaacaagagtttctg

SEQ ID NO: 387889 - DNA, 20 bp, Artificial Sequence
  chemically synthesized
tctgaggaacgcattaacaa

SEQ ID NO: 387890 - DNA, 20 bp, Artificial Sequence
  chemically synthesized
agtctgaggaacgcattaac

SEQ ID NO: 387891 - DNA, 20 bp, Artificial Sequence
  chemically synthesized
actcttgttaatgcgttcct

SEQ ID NO: 387892 - DNA, 20 bp, Artificial Sequence
  chemically synthesized
gaagcagatgggacagtctg

SEQ ID NO: 387893 - DNA, 20 bp, Artificial Sequence
  chemically synthesized
agaagcagatgggacagtct

SEQ ID NO: 387894 - DNA, 20 bp, Artificial Sequence
  chemically synthesized
acaataagaagcagatggga

SEQ ID NO: 387895 - DNA, 20 bp, Artificial Sequence
  chemically synthesized
gcaaacaataagaagcagat

SEQ ID NO: 387896 - DNA, 20 bp, Artificial Sequence
  chemically synthesized
agcaaacaataagaagcaga

SEQ ID NO: 387897 - DNA, 20 bp, Artificial Sequence
  chemically synthesized
atggagcaaacaataagaag

SEQ ID NO: 387898 - DNA, 20 bp, Artificial Sequence
  chemically synthesized
tgtatggagcaaacaataag

SEQ ID NO: 387899 - DNA, 20 bp, Artificial Sequence
  chemically synthesized
ctttgtatggagcaaacaat

SEQ ID NO: 387900 - DNA, 20 bp, Artificial Sequence
  chemically synthesized
cttattgtttgctccataca

SEQ ID NO: 387901 - DNA, 20 bp, Artificial Sequence
  chemically synthesized
ttattgtttgctccatacaa

SEQ ID NO: 387902 - DNA, 20 bp, Artificial Sequence
  chemically synthesized
tattaacatgcctttgtatg

SEQ ID NO: 387903 - DNA, 20 bp, Artificial Sequence
  chemically synthesized
catattaacatgcctttgta

SEQ ID NO: 387904 - DNA, 20 bp, Artificial Sequence
  chemically synthesized
aaacaatgatgatatgtagg

SEQ ID NO: 387905 - DNA, 20 bp, Artificial Sequence
  chemically synthesized
atgaaacaatgatgatatgt

SEQ ID NO: 387906 - DNA, 20 bp, Artificial Sequence
  chemically synthesized
aatgaaacaatgatgatatg

SEQ ID NO: 387907 - DNA, 20 bp, Artificial Sequence
  chemically synthesized
tcatgttggcacagttcagt

SEQ ID NO: 387908 - DNA, 20 bp, Artificial Sequence
  chemically synthesized
tctatcatgttggcacagtt

SEQ ID NO: 387909 - DNA, 20 bp, Artificial Sequence
  chemically synthesized
tcttttctatcatgttggca

SEQ ID NO: 387910 - DNA, 20 bp, Artificial Sequence
  chemically synthesized
actgaactgtgccaacatga

SEQ ID NO: 387911 - DNA, 20 bp, Artificial Sequence
  chemically synthesized
ttgattcttttctatcatgt

SEQ ID NO: 387912 - DNA, 20 bp, Artificial Sequence
  chemically synthesized
actgtgccaacatgatagaa

SEQ ID NO: 387913 - DNA, 20 bp, Artificial Sequence
  chemically synthesized
caacatgatagaaaagaatc

SEQ ID NO: 387914 - DNA, 20 bp, Artificial Sequence
  chemically synthesized
tagtatcttaaaattatagt

SEQ ID NO: 387915 - DNA, 20 bp, Artificial Sequence
  chemically synthesized
atcaagcttactataatttt

SEQ ID NO: 387916 - DNA, 20 bp, Artificial Sequence
  chemically synthesized
gtcttagtatcttaaaatta

SEQ ID NO: 387917 - DNA, 20 bp, Artificial Sequence
  chemically synthesized
tactataattttaagatact

SEQ ID NO: 387918 - DNA, 20 bp, Artificial Sequence
  chemically synthesized
gtttttactagtaagtgtct

SEQ ID NO: 387919 - DNA, 20 bp, Artificial Sequence
  chemically synthesized
taagatactaagacacttac

SEQ ID NO: 387920 - DNA, 20 bp, Artificial Sequence
  chemically synthesized
taaacattgtttttactagt

SEQ ID NO: 387921 - DNA, 20 bp, Artificial Sequence
  chemically synthesized
tcgataaacattgtttttac

SEQ ID NO: 387922 - DNA, 20 bp, Artificial Sequence
  chemically synthesized
aaacaatgtttatcgaattt

SEQ ID NO: 387923 - DNA, 20 bp, Artificial Sequence
  chemically synthesized
tatcgaatttaagacctttg

SEQ ID NO: 387924 - DNA, 20 bp, Artificial Sequence
  chemically synthesized
tctctgttatgagtccacaa

SEQ ID NO: 387925 - DNA, 20 bp, Artificial Sequence
  chemically synthesized
ttctctgttatgagtccaca

SEQ ID NO: 387926 - DNA, 20 bp, Artificial Sequence
  chemically synthesized
agacctttgtggactcataa

SEQ ID NO: 387927 - DNA, 20 bp, Artificial Sequence
  chemically synthesized
acctttgtggactcataaca

SEQ ID NO: 387928 - DNA, 20 bp, Artificial Sequence
  chemically synthesized
cagaactagttctctgttat

SEQ ID NO: 387929 - DNA, 20 bp, Artificial Sequence
  chemically synthesized
gtggactcataacagagaac

SEQ ID NO: 387930 - DNA, 20 bp, Artificial Sequence
  chemically synthesized
aggaacctgttgcacagaac

SEQ ID NO: 387931 - DNA, 20 bp, Artificial Sequence
  chemically synthesized
agagaactagttctgtgcaa

SEQ ID NO: 387932 - DNA, 20 bp, Artificial Sequence
  chemically synthesized
gagaactagttctgtgcaac

SEQ ID NO: 387933 - DNA, 20 bp, Artificial Sequence
  chemically synthesized
ggtgaaaggaacctgttgca

SEQ ID NO: 387934 - DNA, 20 bp, Artificial Sequence
  chemically synthesized
attgaatggcttgaggtgaa

SEQ ID NO: 387935 - DNA, 20 bp, Artificial Sequence
  chemically synthesized
caacaggttcctttcacctc

SEQ ID NO: 387936 - DNA, 20 bp, Artificial Sequence
  chemically synthesized
gattgaatggcttgaggtga

SEQ ID NO: 387937 - DNA, 20 bp, Artificial Sequence
  chemically synthesized
aatgttgattgaatggcttg

SEQ ID NO: 387938 - DNA, 20 bp, Artificial Sequence
  chemically synthesized
aaatgttgattgaatggctt

SEQ ID NO: 387939 - DNA, 20 bp, Artificial Sequence
  chemically synthesized
tttttaaaatgttgattgaa

SEQ ID NO: 387940 - DNA, 20 bp, Artificial Sequence
  chemically synthesized
ggtccttggagcaatcgtat

SEQ ID NO: 387941 - DNA, 20 bp, Artificial Sequence
  chemically synthesized
aattccaatacgattgctcc

SEQ ID NO: 387942 - DNA, 20 bp, Artificial Sequence
  chemically synthesized
attccaatacgattgctcca

SEQ ID NO: 387943 - DNA, 20 bp, Artificial Sequence
  chemically synthesized
gtatctctcataggtccttg

SEQ ID NO: 387944 - DNA, 20 bp, Artificial Sequence
  chemically synthesized
aagtatctctcataggtcct

SEQ ID NO: 387945 - DNA, 20 bp, Artificial Sequence
  chemically synthesized
cgattgctccaaggacctat

SEQ ID NO: 387946 - DNA, 20 bp, Artificial Sequence
  chemically synthesized
attgctccaaggacctatga

SEQ ID NO: 387947 - DNA, 20 bp, Artificial Sequence
  chemically synthesized
gaatccaaagtatctctcat

SEQ ID NO: 387948 - DNA, 20 bp, Artificial Sequence
  chemically synthesized
tgaatccaaagtatctctca

SEQ ID NO: 387949 - DNA, 20 bp, Artificial Sequence
  chemically synthesized
aggacctatgagagatactt

SEQ ID NO: 387950 - DNA, 20 bp, Artificial Sequence
  chemically synthesized
atgagagatactttggattc

SEQ ID NO: 387951 - DNA, 20 bp, Artificial Sequence
  chemically synthesized
ctctgaggtccttgaatcca

SEQ ID NO: 387952 - DNA, 20 bp, Artificial Sequence
  chemically synthesized
tgagagatactttggattca

SEQ ID NO: 387953 - DNA, 20 bp, Artificial Sequence
  chemically synthesized
tactttggattcaaggacct

SEQ ID NO: 387954 - DNA, 20 bp, Artificial Sequence
  chemically synthesized
ctttggattcaaggacctca

SEQ ID NO: 387955 - DNA, 20 bp, Artificial Sequence
  chemically synthesized
gattcaaggacctcagagtc

SEQ ID NO: 387956 - DNA, 20 bp, Artificial Sequence
  chemically synthesized
agagtttccactcgactctg

SEQ ID NO: 387957 - DNA, 20 bp, Artificial Sequence
  chemically synthesized
aagagtttccactcgactct

SEQ ID NO: 387958 - DNA, 20 bp, Artificial Sequence
  chemically synthesized
tcaaggacctcagagtcgag

SEQ ID NO: 387959 - DNA, 20 bp, Artificial Sequence
  chemically synthesized
tcacattctatttaaagaaa

SEQ ID NO: 387960 - DNA, 20 bp, Artificial Sequence
  chemically synthesized
ggtcacattctatttaaaga

SEQ ID NO: 387961 - DNA, 20 bp, Artificial Sequence
  chemically synthesized
gtggaaactctttctttaaa

SEQ ID NO: 387962 - DNA, 20 bp, Artificial Sequence
  chemically synthesized
tctgggtcacattctattta

SEQ ID NO: 387963 - DNA, 20 bp, Artificial Sequence
  chemically synthesized
tctttaaatagaatgtgacc

SEQ ID NO: 387964 - DNA, 20 bp, Artificial Sequence
  chemically synthesized
ttaaatagaatgtgacccag

SEQ ID NO: 387965 - DNA, 20 bp, Artificial Sequence
  chemically synthesized
ctgtttcatattgggcttct

SEQ ID NO: 387966 - DNA, 20 bp, Artificial Sequence
  chemically synthesized
tctgtttcatattgggcttc

SEQ ID NO: 387967 - DNA, 20 bp, Artificial Sequence
  chemically synthesized
ctcttcatctgtttcatatt

SEQ ID NO: 387968 - DNA, 20 bp, Artificial Sequence
  chemically synthesized
actcttcatctgtttcatat

SEQ ID NO: 387969 - DNA, 20 bp, Artificial Sequence
  chemically synthesized
cccagaagcccaatatgaaa

SEQ ID NO: 387970 - DNA, 20 bp, Artificial Sequence
  chemically synthesized
agcccaatatgaaacagatg

SEQ ID NO: 387971 - DNA, 20 bp, Artificial Sequence
  chemically synthesized
cccaatatgaaacagatgaa

SEQ ID NO: 387972 - DNA, 20 bp, Artificial Sequence
  chemically synthesized
atatgaaacagatgaagagt

SEQ ID NO: 387973 - DNA, 20 bp, Artificial Sequence
  chemically synthesized
cagatgaagagtgagctatt

SEQ ID NO: 387974 - DNA, 20 bp, Artificial Sequence
  chemically synthesized
tcagcattcctttagctgaa

SEQ ID NO: 387975 - DNA, 20 bp, Artificial Sequence
  chemically synthesized
aagagtgagctattcagcta

SEQ ID NO: 387976 - DNA, 20 bp, Artificial Sequence
  chemically synthesized
agagtgagctattcagctaa

SEQ ID NO: 387977 - DNA, 20 bp, Artificial Sequence
  chemically synthesized
taccaccatcagcattcctt

SEQ ID NO: 387978 - DNA, 20 bp, Artificial Sequence
  chemically synthesized
ttcagctaaaggaatgctga

SEQ ID NO: 387979 - DNA, 20 bp, Artificial Sequence
  chemically synthesized
agctaaaggaatgctgatgg

SEQ ID NO: 387980 - DNA, 20 bp, Artificial Sequence
  chemically synthesized
taaaggaatgctgatggtgg

SEQ ID NO: 387981 - DNA, 20 bp, Artificial Sequence
  chemically synthesized
accaccaccactaccaccat

SEQ ID NO: 387982 - DNA, 20 bp, Artificial Sequence
  chemically synthesized
aggaatgctgatggtggtag

SEQ ID NO: 387983 - DNA, 20 bp, Artificial Sequence
  chemically synthesized
aatgctgatggtggtagtgg

SEQ ID NO: 387984 - DNA, 20 bp, Artificial Sequence
  chemically synthesized
gctgatggtggtagtggtgg

SEQ ID NO: 387985 - DNA, 20 bp, Artificial Sequence
  chemically synthesized
gatggtggtagtggtggtgg

SEQ ID NO: 387986 - DNA, 20 bp, Artificial Sequence
  chemically synthesized
atggtggtagtggtggtggt

SEQ ID NO: 387987 - DNA, 20 bp, Artificial Sequence
  chemically synthesized
tgtgtagggtgagaagacag

SEQ ID NO: 387988 - DNA, 20 bp, Artificial Sequence
  chemically synthesized
ccatgtgtagggtgagaaga

SEQ ID NO: 387989 - DNA, 20 bp, Artificial Sequence
  chemically synthesized
agggccatgtgtagggtgag

SEQ ID NO: 387990 - DNA, 20 bp, Artificial Sequence
  chemically synthesized
tcaagggccatgtgtagggt

SEQ ID NO: 387991 - DNA, 20 bp, Artificial Sequence
  chemically synthesized
ctgtcttctcaccctacaca

SEQ ID NO: 387992 - DNA, 20 bp, Artificial Sequence
  chemically synthesized
tgtttcaagggccatgtgta

SEQ ID NO: 387993 - DNA, 20 bp, Artificial Sequence
  chemically synthesized
gtgtttcaagggccatgtgt

SEQ ID NO: 387994 - DNA, 20 bp, Artificial Sequence
  chemically synthesized
agtgtttcaagggccatgtg

SEQ ID NO: 387995 - DNA, 20 bp, Artificial Sequence
  chemically synthesized
gggttttagtagtgtttcaa

SEQ ID NO: 387996 - DNA, 20 bp, Artificial Sequence
  chemically synthesized
tgggttttagtagtgtttca

SEQ ID NO: 387997 - DNA, 20 bp, Artificial Sequence
  chemically synthesized
gtgggttttagtagtgtttc

SEQ ID NO: 387998 - DNA, 20 bp, Artificial Sequence
  chemically synthesized
ggagccttagtgggttttag

SEQ ID NO: 387999 - DNA, 20 bp, Artificial Sequence
  chemically synthesized
actggagccttagtgggttt

SEQ ID NO: 388000 - DNA, 20 bp, Artificial Sequence
  chemically synthesized
aaacactactaaaacccact

SEQ ID NO: 388001 - DNA, 20 bp, Artificial Sequence
  chemically synthesized
aacactactaaaacccacta

SEQ ID NO: 388002 - DNA, 20 bp, Artificial Sequence
  chemically synthesized
agtctcactggagccttagt

SEQ ID NO: 388003 - DNA, 20 bp, Artificial Sequence
  chemically synthesized
tagtctcactggagccttag

SEQ ID NO: 388004 - DNA, 20 bp, Artificial Sequence
  chemically synthesized
actaaaacccactaaggctc

SEQ ID NO: 388005 - DNA, 20 bp, Artificial Sequence
  chemically synthesized
caatagtctcactggagcct

SEQ ID NO: 388006 - DNA, 20 bp, Artificial Sequence
  chemically synthesized
aaacccactaaggctccagt

SEQ ID NO: 388007 - DNA, 20 bp, Artificial Sequence
  chemically synthesized
attttacaatagtctcactg

SEQ ID NO: 388008 - DNA, 20 bp, Artificial Sequence
  chemically synthesized
gaattttacaatagtctcac

SEQ ID NO: 388009 - DNA, 20 bp, Artificial Sequence
  chemically synthesized
aatatatgggaattttacaa

SEQ ID NO: 388010 - DNA, 20 bp, Artificial Sequence
  chemically synthesized
ctaggaactggagaatatat

SEQ ID NO: 388011 - DNA, 20 bp, Artificial Sequence
  chemically synthesized
actaggaactggagaatata

SEQ ID NO: 388012 - DNA, 20 bp, Artificial Sequence
  chemically synthesized
taaaattcccatatattctc

SEQ ID NO: 388013 - DNA, 20 bp, Artificial Sequence
  chemically synthesized
cccatatattctccagttcc

SEQ ID NO: 388014 - DNA, 20 bp, Artificial Sequence
  chemically synthesized
ggtggacaaactaggaactg

SEQ ID NO: 388015 - DNA, 20 bp, Artificial Sequence
  chemically synthesized
ttggtggacaaactaggaac

SEQ ID NO: 388016 - DNA, 20 bp, Artificial Sequence
  chemically synthesized
ataggtttggtggacaaact

SEQ ID NO: 388017 - DNA, 20 bp, Artificial Sequence
  chemically synthesized
gataggtttggtggacaaac

SEQ ID NO: 388018 - DNA, 20 bp, Artificial Sequence
  chemically synthesized
aaagctgtggataggtttgg

SEQ ID NO: 388019 - DNA, 20 bp, Artificial Sequence
  chemically synthesized
agaaaagctgtggataggtt

SEQ ID NO: 388020 - DNA, 20 bp, Artificial Sequence
  chemically synthesized
ttgtccaccaaacctatcca

SEQ ID NO: 388021 - DNA, 20 bp, Artificial Sequence
  chemically synthesized
aacaaagaaaagctgtggat

SEQ ID NO: 388022 - DNA, 20 bp, Artificial Sequence
  chemically synthesized
aaacaaagaaaagctgtgga

SEQ ID NO: 388023 - DNA, 20 bp, Artificial Sequence
  chemically synthesized
ttaaaaacaaagaaaagctg

SEQ ID NO: 388024 - DNA, 20 bp, Artificial Sequence
  chemically synthesized
taaaagttaaaaacaaagaa

SEQ ID NO: 388025 - DNA, 20 bp, Artificial Sequence
  chemically synthesized
gaacttaaaagttaaaaaca

SEQ ID NO: 388026 - DNA, 20 bp, Artificial Sequence
  chemically synthesized
tttctttgtttttaactttt

SEQ ID NO: 388027 - DNA, 20 bp, Artificial Sequence
  chemically synthesized
ttgtttttaacttttaagtt

SEQ ID NO: 388028 - DNA, 20 bp, Artificial Sequence
  chemically synthesized
acatgtacccctgaacttaa

SEQ ID NO: 388029 - DNA, 20 bp, Artificial Sequence
  chemically synthesized
tgtttttaacttttaagttc

SEQ ID NO: 388030 - DNA, 20 bp, Artificial Sequence
  chemically synthesized
gtttttaacttttaagttca

SEQ ID NO: 388031 - DNA, 20 bp, Artificial Sequence
  chemically synthesized
tttttaacttttaagttcag

SEQ ID NO: 388032 - DNA, 20 bp, Artificial Sequence
  chemically synthesized
acatgtgcatgtgtgttata

SEQ ID NO: 388033 - DNA, 20 bp, Artificial Sequence
  chemically synthesized
catgtgcatgtgtgttatat

SEQ ID NO: 388034 - DNA, 20 bp, Artificial Sequence
  chemically synthesized
atataggtaaacttatgtca

SEQ ID NO: 388035 - DNA, 20 bp, Artificial Sequence
  chemically synthesized
tataggtaaacttatgtcat

SEQ ID NO: 388036 - DNA, 20 bp, Artificial Sequence
  chemically synthesized
acaacaaatccccatgacat

SEQ ID NO: 388037 - DNA, 20 bp, Artificial Sequence
  chemically synthesized
ataggtaaacttatgtcatg

SEQ ID NO: 388038 - DNA, 20 bp, Artificial Sequence
  chemically synthesized
tgtcatggggatttgttgta

SEQ ID NO: 388039 - DNA, 20 bp, Artificial Sequence
  chemically synthesized
gtacagattattttgtcatc

SEQ ID NO: 388040 - DNA, 20 bp, Artificial Sequence
  chemically synthesized
ttattttgtcatccagatat

SEQ ID NO: 388041 - DNA, 20 bp, Artificial Sequence
  chemically synthesized
atggttagtaggcttatatc

SEQ ID NO: 388042 - DNA, 20 bp, Artificial Sequence
  chemically synthesized
aaaaataactgatggttagt

SEQ ID NO: 388043 - DNA, 20 bp, Artificial Sequence
  chemically synthesized
aaaaaataactgatggttag

SEQ ID NO: 388044 - DNA, 20 bp, Artificial Sequence
  chemically synthesized
gatataagcctactaaccat

SEQ ID NO: 388045 - DNA, 20 bp, Artificial Sequence
  chemically synthesized
aaaaaaaaataactgatggt

SEQ ID NO: 388046 - DNA, 20 bp, Artificial Sequence
  chemically synthesized
gattaaaaaaaaataactga

SEQ ID NO: 388047 - DNA, 20 bp, Artificial Sequence
  chemically synthesized
tggagggtgggaggagggag

SEQ ID NO: 388048 - DNA, 20 bp, Artificial Sequence
  chemically synthesized
gtggagggtgggaggaggga

SEQ ID NO: 388049 - DNA, 20 bp, Artificial Sequence
  chemically synthesized
gggtggagggtgggaggagg

SEQ ID NO: 388050 - DNA, 20 bp, Artificial Sequence
  chemically synthesized
gagggtggagggtgggagga

SEQ ID NO: 388051 - DNA, 20 bp, Artificial Sequence
  chemically synthesized
ggagggtggagggtgggagg

SEQ ID NO: 388052 - DNA, 20 bp, Artificial Sequence
  chemically synthesized
tggagggtggagggtgggag

SEQ ID NO: 388053 - DNA, 20 bp, Artificial Sequence
  chemically synthesized
gttggagggtggagggtggg

SEQ ID NO: 388054 - DNA, 20 bp, Artificial Sequence
  chemically synthesized
tgttggagggtggagggtgg

SEQ ID NO: 388055 - DNA, 20 bp, Artificial Sequence
  chemically synthesized
cctgttggagggtggagggt

SEQ ID NO: 388056 - DNA, 20 bp, Artificial Sequence
  chemically synthesized
acctgttggagggtggaggg

SEQ ID NO: 388057 - DNA, 20 bp, Artificial Sequence
  chemically synthesized
gggacctgttggagggtgga

SEQ ID NO: 388058 - DNA, 20 bp, Artificial Sequence
  chemically synthesized
tgggacctgttggagggtgg

SEQ ID NO: 388059 - DNA, 20 bp, Artificial Sequence
  chemically synthesized
ttgggacctgttggagggtg

SEQ ID NO: 388060 - DNA, 20 bp, Artificial Sequence
  chemically synthesized
cattgggacctgttggaggg

SEQ ID NO: 388061 - DNA, 20 bp, Artificial Sequence
  chemically synthesized
tcccaccctccaccctccaa

SEQ ID NO: 388062 - DNA, 20 bp, Artificial Sequence
  chemically synthesized
cccaccctccaccctccaac

SEQ ID NO: 388063 - DNA, 20 bp, Artificial Sequence
  chemically synthesized
atacattgggacctgttgga

SEQ ID NO: 388064 - DNA, 20 bp, Artificial Sequence
  chemically synthesized
catacattgggacctgttgg

SEQ ID NO: 388065 - DNA, 20 bp, Artificial Sequence
  chemically synthesized
acatacattgggacctgttg

SEQ ID NO: 388066 - DNA, 20 bp, Artificial Sequence
  chemically synthesized
taacatacattgggacctgt

SEQ ID NO: 388067 - DNA, 20 bp, Artificial Sequence
  chemically synthesized
agaggggaataacatacatt

SEQ ID NO: 388068 - DNA, 20 bp, Artificial Sequence
  chemically synthesized
tagaggggaataacatacat

SEQ ID NO: 388069 - DNA, 20 bp, Artificial Sequence
  chemically synthesized
aatgtatgttattcccctct

SEQ ID NO: 388070 - DNA, 20 bp, Artificial Sequence
  chemically synthesized
aaacacatggacacttagag

SEQ ID NO: 388071 - DNA, 20 bp, Artificial Sequence
  chemically synthesized
aaaacacatggacacttaga

SEQ ID NO: 388072 - DNA, 20 bp, Artificial Sequence
  chemically synthesized
gaaaacacatggacacttag

SEQ ID NO: 388073 - DNA, 20 bp, Artificial Sequence
  chemically synthesized
tgaaaacacatggacactta

SEQ ID NO: 388074 - DNA, 20 bp, Artificial Sequence
  chemically synthesized
gatgaaaacacatggacact

SEQ ID NO: 388075 - DNA, 20 bp, Artificial Sequence
  chemically synthesized
agctaaatgatgaaaacaca

SEQ ID NO: 388076 - DNA, 20 bp, Artificial Sequence
  chemically synthesized
gtccatgtgttttcatcatt

SEQ ID NO: 388077 - DNA, 20 bp, Artificial Sequence
  chemically synthesized
gtcttctcacttgcaggtgg

SEQ ID NO: 388078 - DNA, 20 bp, Artificial Sequence
  chemically synthesized
atcatttagctcccacctgc

SEQ ID NO: 388079 - DNA, 20 bp, Artificial Sequence
  chemically synthesized
gtgtcttctcacttgcaggt

SEQ ID NO: 388080 - DNA, 20 bp, Artificial Sequence
  chemically synthesized
tgtgtcttctcacttgcagg

SEQ ID NO: 388081 - DNA, 20 bp, Artificial Sequence
  chemically synthesized
tttagctcccacctgcaagt

SEQ ID NO: 388082 - DNA, 20 bp, Artificial Sequence
  chemically synthesized
tactgtgtcttctcacttgc

SEQ ID NO: 388083 - DNA, 20 bp, Artificial Sequence
  chemically synthesized
atactgtgtcttctcacttg

SEQ ID NO: 388084 - DNA, 20 bp, Artificial Sequence
  chemically synthesized
agctcccacctgcaagtgag

SEQ ID NO: 388085 - DNA, 20 bp, Artificial Sequence
  chemically synthesized
cacctgcaagtgagaagaca

SEQ ID NO: 388086 - DNA, 20 bp, Artificial Sequence
  chemically synthesized
ttagcaaactaatacagtaa

SEQ ID NO: 388087 - DNA, 20 bp, Artificial Sequence
  chemically synthesized
ttgattttctgttactgtat

SEQ ID NO: 388088 - DNA, 20 bp, Artificial Sequence
  chemically synthesized
ttatccttagcaaactaata

SEQ ID NO: 388089 - DNA, 20 bp, Artificial Sequence
  chemically synthesized
tgttactgtattagtttgct

SEQ ID NO: 388090 - DNA, 20 bp, Artificial Sequence
  chemically synthesized
gttactgtattagtttgcta

SEQ ID NO: 388091 - DNA, 20 bp, Artificial Sequence
  chemically synthesized
tattagtttgctaaggataa

SEQ ID NO: 388092 - DNA, 20 bp, Artificial Sequence
  chemically synthesized
gagttggaggccattatcct

SEQ ID NO: 388093 - DNA, 20 bp, Artificial Sequence
  chemically synthesized
aggaacatggatggagttgg

SEQ ID NO: 388094 - DNA, 20 bp, Artificial Sequence
  chemically synthesized
caggaacatggatggagttg

SEQ ID NO: 388095 - DNA, 20 bp, Artificial Sequence
  chemically synthesized
tgcaggaacatggatggagt

SEQ ID NO: 388096 - DNA, 20 bp, Artificial Sequence
  chemically synthesized
actttgcaggaacatggatg

SEQ ID NO: 388097 - DNA, 20 bp, Artificial Sequence
  chemically synthesized
gtactttgcaggaacatgga

SEQ ID NO: 388098 - DNA, 20 bp, Artificial Sequence
  chemically synthesized
ccatgtactttgcaggaaca

SEQ ID NO: 388099 - DNA, 20 bp, Artificial Sequence
  chemically synthesized
actccatccatgttcctgca

SEQ ID NO: 388100 - DNA, 20 bp, Artificial Sequence
  chemically synthesized
aatgagaccatgtactttgc

SEQ ID NO: 388101 - DNA, 20 bp, Artificial Sequence
  chemically synthesized
gaatgagaccatgtactttg

SEQ ID NO: 388102 - DNA, 20 bp, Artificial Sequence
  chemically synthesized
ccatgttcctgcaaagtaca

SEQ ID NO: 388103 - DNA, 20 bp, Artificial Sequence
  chemically synthesized
gcgtagccataagaaagaat

SEQ ID NO: 388104 - DNA, 20 bp, Artificial Sequence
  chemically synthesized
catggtctcattctttctta

SEQ ID NO: 388105 - DNA, 20 bp, Artificial Sequence
  chemically synthesized
tatactgcgtagccataaga

SEQ ID NO: 388106 - DNA, 20 bp, Artificial Sequence
  chemically synthesized
atggtatactgcgtagccat

SEQ ID NO: 388107 - DNA, 20 bp, Artificial Sequence
  chemically synthesized
cattctttcttatggctacg

SEQ ID NO: 388108 - DNA, 20 bp, Artificial Sequence
  chemically synthesized
atacaccatggtatactgcg

SEQ ID NO: 388109 - DNA, 20 bp, Artificial Sequence
  chemically synthesized
tatggctacgcagtatacca

SEQ ID NO: 388110 - DNA, 20 bp, Artificial Sequence
  chemically synthesized
aatgtggtacatatacacca

SEQ ID NO: 388111 - DNA, 20 bp, Artificial Sequence
  chemically synthesized
tagactggataaagcaaatg

SEQ ID NO: 388112 - DNA, 20 bp, Artificial Sequence
  chemically synthesized
tgtaccacatttgctttatc

SEQ ID NO: 388113 - DNA, 20 bp, Artificial Sequence
  chemically synthesized
caccaatgatagactggata

SEQ ID NO: 388114 - DNA, 20 bp, Artificial Sequence
  chemically synthesized
aatgcccaccaatgatagac

SEQ ID NO: 388115 - DNA, 20 bp, Artificial Sequence
  chemically synthesized
tgctttatccagtctatcat

SEQ ID NO: 388116 - DNA, 20 bp, Artificial Sequence
  chemically synthesized
tttatccagtctatcattgg

SEQ ID NO: 388117 - DNA, 20 bp, Artificial Sequence
  chemically synthesized
acctaaatgcccaccaatga

SEQ ID NO: 388118 - DNA, 20 bp, Artificial Sequence
  chemically synthesized
ttatccagtctatcattggt

SEQ ID NO: 388119 - DNA, 20 bp, Artificial Sequence
  chemically synthesized
gtctatcattggtgggcatt

SEQ ID NO: 388120 - DNA, 20 bp, Artificial Sequence
  chemically synthesized
tctatcattggtgggcattt

SEQ ID NO: 388121 - DNA, 20 bp, Artificial Sequence
  chemically synthesized
tattcacaatagcaaagacg

SEQ ID NO: 388122 - DNA, 20 bp, Artificial Sequence
  chemically synthesized
cagcactattcacaatagca

SEQ ID NO: 388123 - DNA, 20 bp, Artificial Sequence
  chemically synthesized
cacgtctttgctattgtgaa

SEQ ID NO: 388124 - DNA, 20 bp, Artificial Sequence
  chemically synthesized
cattgcagcactattcacaa

SEQ ID NO: 388125 - DNA, 20 bp, Artificial Sequence
  chemically synthesized
atgcacacgtatgttcattg

SEQ ID NO: 388126 - DNA, 20 bp, Artificial Sequence
  chemically synthesized
gtgtgcatgtgcctttgtaa

SEQ ID NO: 388127 - DNA, 20 bp, Artificial Sequence
  chemically synthesized
tataaatcgttctattacaa

SEQ ID NO: 388128 - DNA, 20 bp, Artificial Sequence
  chemically synthesized
atataaatcgttctattaca

SEQ ID NO: 388129 - DNA, 20 bp, Artificial Sequence
  chemically synthesized
tagaacgatttatattcctt

SEQ ID NO: 388130 - DNA, 20 bp, Artificial Sequence
  chemically synthesized
agaacgatttatattccttt

SEQ ID NO: 388131 - DNA, 20 bp, Artificial Sequence
  chemically synthesized
attactgcatttatacccaa

SEQ ID NO: 388132 - DNA, 20 bp, Artificial Sequence
  chemically synthesized
cattactgcatttataccca

SEQ ID NO: 388133 - DNA, 20 bp, Artificial Sequence
  chemically synthesized
tattcctttgggtataaatg

SEQ ID NO: 388134 - DNA, 20 bp, Artificial Sequence
  chemically synthesized
aaatgcagtaatgatattgc

SEQ ID NO: 388135 - DNA, 20 bp, Artificial Sequence
  chemically synthesized
aatgcagtaatgatattgct

SEQ ID NO: 388136 - DNA, 20 bp, Artificial Sequence
  chemically synthesized
taatgatattgctgggttga

SEQ ID NO: 388137 - DNA, 20 bp, Artificial Sequence
  chemically synthesized
agacagaaataccatcaacc

SEQ ID NO: 388138 - DNA, 20 bp, Artificial Sequence
  chemically synthesized
gttgatggtatttctgtctg

SEQ ID NO: 388139 - DNA, 20 bp, Artificial Sequence
  chemically synthesized
ttgatggtatttctgtctgt

SEQ ID NO: 388140 - DNA, 20 bp, Artificial Sequence
  chemically synthesized
attcctcaaagacctacaga

SEQ ID NO: 388141 - DNA, 20 bp, Artificial Sequence
  chemically synthesized
ggcaattcctcaaagaccta

SEQ ID NO: 388142 - DNA, 20 bp, Artificial Sequence
  chemically synthesized
atttctgtctgtaggtcttt

SEQ ID NO: 388143 - DNA, 20 bp, Artificial Sequence
  chemically synthesized
tttctgtctgtaggtctttg

SEQ ID NO: 388144 - DNA, 20 bp, Artificial Sequence
  chemically synthesized
gacagtgtggcaattcctca

SEQ ID NO: 388145 - DNA, 20 bp, Artificial Sequence
  chemically synthesized
aaccattgtggaagacagtg

SEQ ID NO: 388146 - DNA, 20 bp, Artificial Sequence
  chemically synthesized
agttcaaccattgtggaaga

SEQ ID NO: 388147 - DNA, 20 bp, Artificial Sequence
  chemically synthesized
tgccacactgtcttccacaa

SEQ ID NO: 388148 - DNA, 20 bp, Artificial Sequence
  chemically synthesized
cattagttcaaccattgtgg

SEQ ID NO: 388149 - DNA, 20 bp, Artificial Sequence
  chemically synthesized
gtacattagttcaaccattg

SEQ ID NO: 388150 - DNA, 20 bp, Artificial Sequence
  chemically synthesized
acaatggttgaactaatgta

SEQ ID NO: 388151 - DNA, 20 bp, Artificial Sequence
  chemically synthesized
ttgttggtgggactgtacat

SEQ ID NO: 388152 - DNA, 20 bp, Artificial Sequence
  chemically synthesized
agcacgtatacattgttggt

SEQ ID NO: 388153 - DNA, 20 bp, Artificial Sequence
  chemically synthesized
gagcacgtatacattgttgg

SEQ ID NO: 388154 - DNA, 20 bp, Artificial Sequence
  chemically synthesized
aaggagcacgtatacattgt

SEQ ID NO: 388155 - DNA, 20 bp, Artificial Sequence
  chemically synthesized
gcacggttgtggggaaaaag

SEQ ID NO: 388156 - DNA, 20 bp, Artificial Sequence
  chemically synthesized
tagcacggttgtggggaaaa

SEQ ID NO: 388157 - DNA, 20 bp, Artificial Sequence
  chemically synthesized
ctagcacggttgtggggaaa

SEQ ID NO: 388158 - DNA, 20 bp, Artificial Sequence
  chemically synthesized
tagatgctagcacggttgtg

SEQ ID NO: 388159 - DNA, 20 bp, Artificial Sequence
  chemically synthesized
gtagatgctagcacggttgt

SEQ ID NO: 388160 - DNA, 20 bp, Artificial Sequence
  chemically synthesized
agtagatgctagcacggttg

SEQ ID NO: 388161 - DNA, 20 bp, Artificial Sequence
  chemically synthesized
ctttttccccacaaccgtgc

SEQ ID NO: 388162 - DNA, 20 bp, Artificial Sequence
  chemically synthesized
aaaaatagtagatgctagca

SEQ ID NO: 388163 - DNA, 20 bp, Artificial Sequence
  chemically synthesized
agtcaaaaaatagtagatgc

SEQ ID NO: 388164 - DNA, 20 bp, Artificial Sequence
  chemically synthesized
aataaaaagtcaaaaaatag

SEQ ID NO: 388165 - DNA, 20 bp, Artificial Sequence
  chemically synthesized
attaataaaaagtcaaaaaa

SEQ ID NO: 388166 - DNA, 20 bp, Artificial Sequence
  chemically synthesized
tcaggacggctattaataaa

SEQ ID NO: 388167 - DNA, 20 bp, Artificial Sequence
  chemically synthesized
attttttgactttttattaa

SEQ ID NO: 388168 - DNA, 20 bp, Artificial Sequence
  chemically synthesized
ttattaatagccgtcctgac

SEQ ID NO: 388169 - DNA, 20 bp, Artificial Sequence
  chemically synthesized
ccatctcacaccagtcagga

SEQ ID NO: 388170 - DNA, 20 bp, Artificial Sequence
  chemically synthesized
aataccatctcacaccagtc

SEQ ID NO: 388171 - DNA, 20 bp, Artificial Sequence
  chemically synthesized
aaataccatctcacaccagt

SEQ ID NO: 388172 - DNA, 20 bp, Artificial Sequence
  chemically synthesized
atagccgtcctgactggtgt

SEQ ID NO: 388173 - DNA, 20 bp, Artificial Sequence
  chemically synthesized
aatgaaataccatctcacac

SEQ ID NO: 388174 - DNA, 20 bp, Artificial Sequence
  chemically synthesized
ccgtcctgactggtgtgaga

SEQ ID NO: 388175 - DNA, 20 bp, Artificial Sequence
  chemically synthesized
tgtgagatggtatttcattg

SEQ ID NO: 388176 - DNA, 20 bp, Artificial Sequence
  chemically synthesized
atttgcatttctctaatgat

SEQ ID NO: 388177 - DNA, 20 bp, Artificial Sequence
  chemically synthesized
ctcaacatcactaatcatta

SEQ ID NO: 388178 - DNA, 20 bp, Artificial Sequence
  chemically synthesized
agctcaacatcactaatcat

SEQ ID NO: 388179 - DNA, 20 bp, Artificial Sequence
  chemically synthesized
ctctaatgattagtgatgtt

SEQ ID NO: 388180 - DNA, 20 bp, Artificial Sequence
  chemically synthesized
ggccaacaagcatatgaaaa

SEQ ID NO: 388181 - DNA, 20 bp, Artificial Sequence
  chemically synthesized
agcttttttcatatgcttgt

SEQ ID NO: 388182 - DNA, 20 bp, Artificial Sequence
  chemically synthesized
aagacatacatgcggccaac

SEQ ID NO: 388183 - DNA, 20 bp, Artificial Sequence
  chemically synthesized
ctcaaaagaagacatacatg

SEQ ID NO: 388184 - DNA, 20 bp, Artificial Sequence
  chemically synthesized
ccgcatgtatgtcttctttt

SEQ ID NO: 388185 - DNA, 20 bp, Artificial Sequence
  chemically synthesized
gaacagacacttctcaaaag

SEQ ID NO: 388186 - DNA, 20 bp, Artificial Sequence
  chemically synthesized
catgtatgtcttcttttgag

SEQ ID NO: 388187 - DNA, 20 bp, Artificial Sequence
  chemically synthesized
catgaacagacacttctcaa

SEQ ID NO: 388188 - DNA, 20 bp, Artificial Sequence
  chemically synthesized
aagtgggcaaagggcatgaa

SEQ ID NO: 388189 - DNA, 20 bp, Artificial Sequence
  chemically synthesized
ctactaaaaaagtgggcaaa

SEQ ID NO: 388190 - DNA, 20 bp, Artificial Sequence
  chemically synthesized
cctactaaaaaagtgggcaa

SEQ ID NO: 388191 - DNA, 20 bp, Artificial Sequence
  chemically synthesized
ccctactaaaaaagtgggca

SEQ ID NO: 388192 - DNA, 20 bp, Artificial Sequence
  chemically synthesized
atgccctttgcccacttttt

SEQ ID NO: 388193 - DNA, 20 bp, Artificial Sequence
  chemically synthesized
aaaaaccctactaaaaaagt

SEQ ID NO: 388194 - DNA, 20 bp, Artificial Sequence
  chemically synthesized
aaaaaaccctactaaaaaag

SEQ ID NO: 388195 - DNA, 20 bp, Artificial Sequence
  chemically synthesized
ccctttgcccacttttttag

SEQ ID NO: 388196 - DNA, 20 bp, Artificial Sequence
  chemically synthesized
cctttgcccacttttttagt

SEQ ID NO: 388197 - DNA, 20 bp, Artificial Sequence
  chemically synthesized
aaaaaaaaaccctactaaaa

SEQ ID NO: 388198 - DNA, 20 bp, Artificial Sequence
  chemically synthesized
ctttgcccacttttttagta

SEQ ID NO: 388199 - DNA, 20 bp, Artificial Sequence
  chemically synthesized
agtagggtttttttttctca

SEQ ID NO: 388200 - DNA, 20 bp, Artificial Sequence
  chemically synthesized
aggaacttaaacaaatctat

SEQ ID NO: 388201 - DNA, 20 bp, Artificial Sequence
  chemically synthesized
tttttctcatagatttgttt

SEQ ID NO: 388202 - DNA, 20 bp, Artificial Sequence
  chemically synthesized
tctaaaatccagcatttata

SEQ ID NO: 388203 - DNA, 20 bp, Artificial Sequence
  chemically synthesized
gtctaaaatccagcatttat

SEQ ID NO: 388204 - DNA, 20 bp, Artificial Sequence
  chemically synthesized
tttaagttccttataaatgc

SEQ ID NO: 388205 - DNA, 20 bp, Artificial Sequence
  chemically synthesized
tccttataaatgctggattt

SEQ ID NO: 388206 - DNA, 20 bp, Artificial Sequence
  chemically synthesized
tccgacaaaggtctaaaatc

SEQ ID NO: 388207 - DNA, 20 bp, Artificial Sequence
  chemically synthesized
gctggattttagacctttgt

SEQ ID NO: 388208 - DNA, 20 bp, Artificial Sequence
  chemically synthesized
gcaaactatgcatccgacaa

SEQ ID NO: 388209 - DNA, 20 bp, Artificial Sequence
  chemically synthesized
tgcaaactatgcatccgaca

SEQ ID NO: 388210 - DNA, 20 bp, Artificial Sequence
  chemically synthesized
ttagacctttgtcggatgca

SEQ ID NO: 388211 - DNA, 20 bp, Artificial Sequence
  chemically synthesized
gcagacaaactacagaatgg

SEQ ID NO: 388212 - DNA, 20 bp, Artificial Sequence
  chemically synthesized
aaacattttcttccattctg

SEQ ID NO: 388213 - DNA, 20 bp, Artificial Sequence
  chemically synthesized
tgagcagacaaactacagaa

SEQ ID NO: 388214 - DNA, 20 bp, Artificial Sequence
  chemically synthesized
cagagtgagcagacaaacta

SEQ ID NO: 388215 - DNA, 20 bp, Artificial Sequence
  chemically synthesized
gaaactatcaacagagtgag

SEQ ID NO: 388216 - DNA, 20 bp, Artificial Sequence
  chemically synthesized
aaggaaactatcaacagagt

SEQ ID NO: 388217 - DNA, 20 bp, Artificial Sequence
  chemically synthesized
ttgtctgctcactctgttga

SEQ ID NO: 388218 - DNA, 20 bp, Artificial Sequence
  chemically synthesized
agcaaaggaaactatcaaca

SEQ ID NO: 388219 - DNA, 20 bp, Artificial Sequence
  chemically synthesized
acagcaaaggaaactatcaa

SEQ ID NO: 388220 - DNA, 20 bp, Artificial Sequence
  chemically synthesized
aaatagtttctgcacagcaa

SEQ ID NO: 388221 - DNA, 20 bp, Artificial Sequence
  chemically synthesized
tgatagtttcctttgctgtg

SEQ ID NO: 388222 - DNA, 20 bp, Artificial Sequence
  chemically synthesized
taaatagtttctgcacagca

SEQ ID NO: 388223 - DNA, 20 bp, Artificial Sequence
  chemically synthesized
taaactaaatagtttctgca

SEQ ID NO: 388224 - DNA, 20 bp, Artificial Sequence
  chemically synthesized
tttgctgtgcagaaactatt

SEQ ID NO: 388225 - DNA, 20 bp, Artificial Sequence
  chemically synthesized
tggcatctaattaaactaaa

SEQ ID NO: 388226 - DNA, 20 bp, Artificial Sequence
  chemically synthesized
cagaaactatttagtttaat

SEQ ID NO: 388227 - DNA, 20 bp, Artificial Sequence
  chemically synthesized
caaaagcaaaaattgaaaaa

SEQ ID NO: 388228 - DNA, 20 bp, Artificial Sequence
  chemically synthesized
gccaaaagcaattgcaacaa

SEQ ID NO: 388229 - DNA, 20 bp, Artificial Sequence
  chemically synthesized
gcttttgttgcaattgcttt

SEQ ID NO: 388230 - DNA, 20 bp, Artificial Sequence
  chemically synthesized
tttcatgacaaagatgccaa

SEQ ID NO: 388231 - DNA, 20 bp, Artificial Sequence
  chemically synthesized
cagacaaaggtttcatgaca

SEQ ID NO: 388232 - DNA, 20 bp, Artificial Sequence
  chemically synthesized
taggacataggaacagacaa

SEQ ID NO: 388233 - DNA, 20 bp, Artificial Sequence
  chemically synthesized
ttaggacataggaacagaca

SEQ ID NO: 388234 - DNA, 20 bp, Artificial Sequence
  chemically synthesized
taccatttaggacataggaa

SEQ ID NO: 388235 - DNA, 20 bp, Artificial Sequence
  chemically synthesized
ggcaataccatttaggacat

SEQ ID NO: 388236 - DNA, 20 bp, Artificial Sequence
  chemically synthesized
gggcaataccatttaggaca

SEQ ID NO: 388237 - DNA, 20 bp, Artificial Sequence
  chemically synthesized
gtctgttcctatgtcctaaa

SEQ ID NO: 388238 - DNA, 20 bp, Artificial Sequence
  chemically synthesized
caacccgggcaataccattt

SEQ ID NO: 388239 - DNA, 20 bp, Artificial Sequence
  chemically synthesized
acaacccgggcaataccatt

SEQ ID NO: 388240 - DNA, 20 bp, Artificial Sequence
  chemically synthesized
atgtcctaaatggtattgcc

SEQ ID NO: 388241 - DNA, 20 bp, Artificial Sequence
  chemically synthesized
tgtcctaaatggtattgccc

SEQ ID NO: 388242 - DNA, 20 bp, Artificial Sequence
  chemically synthesized
aaaaccctggaagacaaccc

SEQ ID NO: 388243 - DNA, 20 bp, Artificial Sequence
  chemically synthesized
aaaaaccctggaagacaacc

SEQ ID NO: 388244 - DNA, 20 bp, Artificial Sequence
  chemically synthesized
gtattgcccgggttgtcttc

SEQ ID NO: 388245 - DNA, 20 bp, Artificial Sequence
  chemically synthesized
tattgcccgggttgtcttcc

SEQ ID NO: 388246 - DNA, 20 bp, Artificial Sequence
  chemically synthesized
attgcccgggttgtcttcca

SEQ ID NO: 388247 - DNA, 20 bp, Artificial Sequence
  chemically synthesized
tcaaactataaaaaccctgg

SEQ ID NO: 388248 - DNA, 20 bp, Artificial Sequence
  chemically synthesized
acctcaaactataaaaaccc

SEQ ID NO: 388249 - DNA, 20 bp, Artificial Sequence
  chemically synthesized
gttgtcttccagggttttta

SEQ ID NO: 388250 - DNA, 20 bp, Artificial Sequence
  chemically synthesized
ttccagggtttttatagttt

SEQ ID NO: 388251 - DNA, 20 bp, Artificial Sequence
  chemically synthesized
tccagggtttttatagtttg

SEQ ID NO: 388252 - DNA, 20 bp, Artificial Sequence
  chemically synthesized
tagtttgaggttttatattt

SEQ ID NO: 388253 - DNA, 20 bp, Artificial Sequence
  chemically synthesized
gattaactcaagatagatta

SEQ ID NO: 388254 - DNA, 20 bp, Artificial Sequence
  chemically synthesized
ttaagtctttaatctatctt

SEQ ID NO: 388255 - DNA, 20 bp, Artificial Sequence
  chemically synthesized
gtacaaagattaactcaaga

SEQ ID NO: 388256 - DNA, 20 bp, Artificial Sequence
  chemically synthesized
ccatgtacaaagattaactc

SEQ ID NO: 388257 - DNA, 20 bp, Artificial Sequence
  chemically synthesized
cttgagttaatctttgtaca

SEQ ID NO: 388258 - DNA, 20 bp, Artificial Sequence
  chemically synthesized
ccttccttacaccatgtaca

SEQ ID NO: 388259 - DNA, 20 bp, Artificial Sequence
  chemically synthesized
ttaatctttgtacatggtgt

SEQ ID NO: 388260 - DNA, 20 bp, Artificial Sequence
  chemically synthesized
taatctttgtacatggtgta

SEQ ID NO: 388261 - DNA, 20 bp, Artificial Sequence
  chemically synthesized
tctttgtacatggtgtaagg

SEQ ID NO: 388262 - DNA, 20 bp, Artificial Sequence
  chemically synthesized
ctttgtacatggtgtaagga

SEQ ID NO: 388263 - DNA, 20 bp, Artificial Sequence
  chemically synthesized
tttgtacatggtgtaaggaa

SEQ ID NO: 388264 - DNA, 20 bp, Artificial Sequence
  chemically synthesized
ttgtacatggtgtaaggaag

SEQ ID NO: 388265 - DNA, 20 bp, Artificial Sequence
  chemically synthesized
catggtgtaaggaaggggtc

SEQ ID NO: 388266 - DNA, 20 bp, Artificial Sequence
  chemically synthesized
cacatgcagaagatagaaac

SEQ ID NO: 388267 - DNA, 20 bp, Artificial Sequence
  chemically synthesized
ggctagccacatgcagaaga

SEQ ID NO: 388268 - DNA, 20 bp, Artificial Sequence
  chemically synthesized
cagtttctatcttctgcatg

SEQ ID NO: 388269 - DNA, 20 bp, Artificial Sequence
  chemically synthesized
aactggctagccacatgcag

SEQ ID NO: 388270 - DNA, 20 bp, Artificial Sequence
  chemically synthesized
gataactggctagccacatg

SEQ ID NO: 388271 - DNA, 20 bp, Artificial Sequence
  chemically synthesized
ttctatcttctgcatgtggc

SEQ ID NO: 388272 - DNA, 20 bp, Artificial Sequence
  chemically synthesized
atcttctgcatgtggctagc

SEQ ID NO: 388273 - DNA, 20 bp, Artificial Sequence
  chemically synthesized
gtggtgctgggataactggc

SEQ ID NO: 388274 - DNA, 20 bp, Artificial Sequence
  chemically synthesized
atgtggctagccagttatcc

SEQ ID NO: 388275 - DNA, 20 bp, Artificial Sequence
  chemically synthesized
ataagtggtgctgggataac

SEQ ID NO: 388276 - DNA, 20 bp, Artificial Sequence
  chemically synthesized
cctattcaataagtggtgct

SEQ ID NO: 388277 - DNA, 20 bp, Artificial Sequence
  chemically synthesized
acctattcaataagtggtgc

SEQ ID NO: 388278 - DNA, 20 bp, Artificial Sequence
  chemically synthesized
aggactacctattcaataag

SEQ ID NO: 388279 - DNA, 20 bp, Artificial Sequence
  chemically synthesized
tcccagcaccacttattgaa

SEQ ID NO: 388280 - DNA, 20 bp, Artificial Sequence
  chemically synthesized
cccagcaccacttattgaat

SEQ ID NO: 388281 - DNA, 20 bp, Artificial Sequence
  chemically synthesized
gaaaggactacctattcaat

SEQ ID NO: 388282 - DNA, 20 bp, Artificial Sequence
  chemically synthesized
agcaccacttattgaatagg

SEQ ID NO: 388283 - DNA, 20 bp, Artificial Sequence
  chemically synthesized
caaaaacaagcaatggggaa

SEQ ID NO: 388284 - DNA, 20 bp, Artificial Sequence
  chemically synthesized
acaaaaacaagcaatgggga

SEQ ID NO: 388285 - DNA, 20 bp, Artificial Sequence
  chemically synthesized
gctgacaaaaacaagcaatg

SEQ ID NO: 388286 - DNA, 20 bp, Artificial Sequence
  chemically synthesized
agctgacaaaaacaagcaat

SEQ ID NO: 388287 - DNA, 20 bp, Artificial Sequence
  chemically synthesized
aagctgacaaaaacaagcaa

SEQ ID NO: 388288 - DNA, 20 bp, Artificial Sequence
  chemically synthesized
tcaacaaagctgacaaaaac

SEQ ID NO: 388289 - DNA, 20 bp, Artificial Sequence
  chemically synthesized
tccccattgcttgtttttgt

SEQ ID NO: 388290 - DNA, 20 bp, Artificial Sequence
  chemically synthesized
tgtttttgtcagctttgttg

SEQ ID NO: 388291 - DNA, 20 bp, Artificial Sequence
  chemically synthesized
caaccatctgatcttcaaca

SEQ ID NO: 388292 - DNA, 20 bp, Artificial Sequence
  chemically synthesized
ttgtcagctttgttgaagat

SEQ ID NO: 388293 - DNA, 20 bp, Artificial Sequence
  chemically synthesized
cagctttgttgaagatcaga

SEQ ID NO: 388294 - DNA, 20 bp, Artificial Sequence
  chemically synthesized
gttgaagatcagatggttgc

SEQ ID NO: 388295 - DNA, 20 bp, Artificial Sequence
  chemically synthesized
ttgaagatcagatggttgct

SEQ ID NO: 388296 - DNA, 20 bp, Artificial Sequence
  chemically synthesized
tcagatggttgctaggtgtg

SEQ ID NO: 388297 - DNA, 20 bp, Artificial Sequence
  chemically synthesized
aagaaataagactgcacacc

SEQ ID NO: 388298 - DNA, 20 bp, Artificial Sequence
  chemically synthesized
aggtgtgcagtcttatttct

SEQ ID NO: 388299 - DNA, 20 bp, Artificial Sequence
  chemically synthesized
aaaacagagaaccaagaaat

SEQ ID NO: 388300 - DNA, 20 bp, Artificial Sequence
  chemically synthesized
atggaacaaaacagagaacc

SEQ ID NO: 388301 - DNA, 20 bp, Artificial Sequence
  chemically synthesized
tggatcaatggaacaaaaca

SEQ ID NO: 388302 - DNA, 20 bp, Artificial Sequence
  chemically synthesized
catggatcaatggaacaaaa

SEQ ID NO: 388303 - DNA, 20 bp, Artificial Sequence
  chemically synthesized
agaacagacacatggatcaa

SEQ ID NO: 388304 - DNA, 20 bp, Artificial Sequence
  chemically synthesized
ctggtacaagaacagacaca

SEQ ID NO: 388305 - DNA, 20 bp, Artificial Sequence
  chemically synthesized
gcatgatactggtacaagaa

SEQ ID NO: 388306 - DNA, 20 bp, Artificial Sequence
  chemically synthesized
ccatgtgtctgttcttgtac

SEQ ID NO: 388307 - DNA, 20 bp, Artificial Sequence
  chemically synthesized
aaacagcatgatactggtac

SEQ ID NO: 388308 - DNA, 20 bp, Artificial Sequence
  chemically synthesized
tggccaaaacagcatgatac

SEQ ID NO: 388309 - DNA, 20 bp, Artificial Sequence
  chemically synthesized
gtaccagtatcatgctgttt

SEQ ID NO: 388310 - DNA, 20 bp, Artificial Sequence
  chemically synthesized
cagggctacagtggccaaaa

SEQ ID NO: 388311 - DNA, 20 bp, Artificial Sequence
  chemically synthesized
tcatgctgttttggccactg

SEQ ID NO: 388312 - DNA, 20 bp, Artificial Sequence
  chemically synthesized
actatactacagggctacag

SEQ ID NO: 388313 - DNA, 20 bp, Artificial Sequence
  chemically synthesized
caaactatactacagggcta

SEQ ID NO: 388314 - DNA, 20 bp, Artificial Sequence
  chemically synthesized
ttttggccactgtagccctg

SEQ ID NO: 388315 - DNA, 20 bp, Artificial Sequence
  chemically synthesized
gccactgtagccctgtagta

SEQ ID NO: 388316 - DNA, 20 bp, Artificial Sequence
  chemically synthesized
tgacttcaaactatactaca

SEQ ID NO: 388317 - DNA, 20 bp, Artificial Sequence
  chemically synthesized
ctgacttcaaactatactac

SEQ ID NO: 388318 - DNA, 20 bp, Artificial Sequence
  chemically synthesized
cctgacttcaaactatacta

SEQ ID NO: 388319 - DNA, 20 bp, Artificial Sequence
  chemically synthesized
tagccctgtagtatagtttg

SEQ ID NO: 388320 - DNA, 20 bp, Artificial Sequence
  chemically synthesized
cctgtagtatagtttgaagt

SEQ ID NO: 388321 - DNA, 20 bp, Artificial Sequence
  chemically synthesized
ctgtagtatagtttgaagtc

SEQ ID NO: 388322 - DNA, 20 bp, Artificial Sequence
  chemically synthesized
gtcaggtaatgtgatgcatc

SEQ ID NO: 388323 - DNA, 20 bp, Artificial Sequence
  chemically synthesized
ctaagcaaaaagagaaaagc

SEQ ID NO: 388324 - DNA, 20 bp, Artificial Sequence
  chemically synthesized
aatactaagcaaaaagagaa

SEQ ID NO: 388325 - DNA, 20 bp, Artificial Sequence
  chemically synthesized
aaggcaatactaagcaaaaa

SEQ ID NO: 388326 - DNA, 20 bp, Artificial Sequence
  chemically synthesized
ccagcttttctctttttgct

SEQ ID NO: 388327 - DNA, 20 bp, Artificial Sequence
  chemically synthesized
ccaaggcaatactaagcaaa

SEQ ID NO: 388328 - DNA, 20 bp, Artificial Sequence
  chemically synthesized
caagtagccaaggcaatact

SEQ ID NO: 388329 - DNA, 20 bp, Artificial Sequence
  chemically synthesized
ctttttgcttagtattgcct

SEQ ID NO: 388330 - DNA, 20 bp, Artificial Sequence
  chemically synthesized
aaaaagagcccaagtagcca

SEQ ID NO: 388331 - DNA, 20 bp, Artificial Sequence
  chemically synthesized
ttagtattgccttggctact

SEQ ID NO: 388332 - DNA, 20 bp, Artificial Sequence
  chemically synthesized
aaaaaagagcccaagtagcc

SEQ ID NO: 388333 - DNA, 20 bp, Artificial Sequence
  chemically synthesized
tagtattgccttggctactt

SEQ ID NO: 388334 - DNA, 20 bp, Artificial Sequence
  chemically synthesized
accaaaaaaaagagcccaag

SEQ ID NO: 388335 - DNA, 20 bp, Artificial Sequence
  chemically synthesized
ggaaccaaaaaaaagagccc

SEQ ID NO: 388336 - DNA, 20 bp, Artificial Sequence
  chemically synthesized
gctacttgggctcttttttt

SEQ ID NO: 388337 - DNA, 20 bp, Artificial Sequence
  chemically synthesized
tcacatggaaccaaaaaaaa

SEQ ID NO: 388338 - DNA, 20 bp, Artificial Sequence
  chemically synthesized
gttcacatggaaccaaaaaa

SEQ ID NO: 388339 - DNA, 20 bp, Artificial Sequence
  chemically synthesized
aaactatttcaaagttcaca

SEQ ID NO: 388340 - DNA, 20 bp, Artificial Sequence
  chemically synthesized
gttccatgtgaactttgaaa

SEQ ID NO: 388341 - DNA, 20 bp, Artificial Sequence
  chemically synthesized
aactagaagaaactatttca

SEQ ID NO: 388342 - DNA, 20 bp, Artificial Sequence
  chemically synthesized
aactttgaaatagtttcttc

SEQ ID NO: 388343 - DNA, 20 bp, Artificial Sequence
  chemically synthesized
gagattcttcagagaactag

SEQ ID NO: 388344 - DNA, 20 bp, Artificial Sequence
  chemically synthesized
attgagattcttcagagaac

SEQ ID NO: 388345 - DNA, 20 bp, Artificial Sequence
  chemically synthesized
tagtttcttctagttctctg

SEQ ID NO: 388346 - DNA, 20 bp, Artificial Sequence
  chemically synthesized
actaccattgagattcttca

SEQ ID NO: 388347 - DNA, 20 bp, Artificial Sequence
  chemically synthesized
aaactaccattgagattctt

SEQ ID NO: 388348 - DNA, 20 bp, Artificial Sequence
  chemically synthesized
agttctctgaagaatctcaa

SEQ ID NO: 388349 - DNA, 20 bp, Artificial Sequence
  chemically synthesized
tctctgaagaatctcaatgg

SEQ ID NO: 388350 - DNA, 20 bp, Artificial Sequence
  chemically synthesized
attcctattaaactaccatt

SEQ ID NO: 388351 - DNA, 20 bp, Artificial Sequence
  chemically synthesized
gaatctcaatggtagtttaa

SEQ ID NO: 388352 - DNA, 20 bp, Artificial Sequence
  chemically synthesized
aatctcaatggtagtttaat

SEQ ID NO: 388353 - DNA, 20 bp, Artificial Sequence
  chemically synthesized
caatggtagtttaataggaa

SEQ ID NO: 388354 - DNA, 20 bp, Artificial Sequence
  chemically synthesized
caatcctaagcaatttatta

SEQ ID NO: 388355 - DNA, 20 bp, Artificial Sequence
  chemically synthesized
ggcaatcctaagcaatttat

SEQ ID NO: 388356 - DNA, 20 bp, Artificial Sequence
  chemically synthesized
attgactctaataaattgct

SEQ ID NO: 388357 - DNA, 20 bp, Artificial Sequence
  chemically synthesized
ttgactctaataaattgctt

SEQ ID NO: 388358 - DNA, 20 bp, Artificial Sequence
  chemically synthesized
caagtagccaaggcaatcct

SEQ ID NO: 388359 - DNA, 20 bp, Artificial Sequence
  chemically synthesized
taaattgcttaggattgcct

SEQ ID NO: 388360 - DNA, 20 bp, Artificial Sequence
  chemically synthesized
taaaagagcccaagtagcca

SEQ ID NO: 388361 - DNA, 20 bp, Artificial Sequence
  chemically synthesized
ttaggattgccttggctact

SEQ ID NO: 388362 - DNA, 20 bp, Artificial Sequence
  chemically synthesized
ataaaagagcccaagtagcc

SEQ ID NO: 388363 - DNA, 20 bp, Artificial Sequence
  chemically synthesized
taggattgccttggctactt

SEQ ID NO: 388364 - DNA, 20 bp, Artificial Sequence
  chemically synthesized
aaccaataaaagagcccaag

SEQ ID NO: 388365 - DNA, 20 bp, Artificial Sequence
  chemically synthesized
tggaaccaataaaagagccc

SEQ ID NO: 388366 - DNA, 20 bp, Artificial Sequence
  chemically synthesized
ggctacttgggctcttttat

SEQ ID NO: 388367 - DNA, 20 bp, Artificial Sequence
  chemically synthesized
ttcatatggaaccaataaaa

SEQ ID NO: 388368 - DNA, 20 bp, Artificial Sequence
  chemically synthesized
agttcatatggaaccaataa

SEQ ID NO: 388369 - DNA, 20 bp, Artificial Sequence
  chemically synthesized
aaactattttaaagttcata

SEQ ID NO: 388370 - DNA, 20 bp, Artificial Sequence
  chemically synthesized
gttccatatgaactttaaaa

SEQ ID NO: 388371 - DNA, 20 bp, Artificial Sequence
  chemically synthesized
aactagaagaaactatttta

SEQ ID NO: 388372 - DNA, 20 bp, Artificial Sequence
  chemically synthesized
aactttaaaatagtttcttc

SEQ ID NO: 388373 - DNA, 20 bp, Artificial Sequence
  chemically synthesized
gagattcttcagagaactag

SEQ ID NO: 388374 - DNA, 20 bp, Artificial Sequence
  chemically synthesized
attgagattcttcagagaac

SEQ ID NO: 388375 - DNA, 20 bp, Artificial Sequence
  chemically synthesized
tagtttcttctagttctctg

SEQ ID NO: 388376 - DNA, 20 bp, Artificial Sequence
  chemically synthesized
actaccattgagattcttca

SEQ ID NO: 388377 - DNA, 20 bp, Artificial Sequence
  chemically synthesized
aaactaccattgagattctt

SEQ ID NO: 388378 - DNA, 20 bp, Artificial Sequence
  chemically synthesized
agttctctgaagaatctcaa

SEQ ID NO: 388379 - DNA, 20 bp, Artificial Sequence
  chemically synthesized
tctctgaagaatctcaatgg

SEQ ID NO: 388380 - DNA, 20 bp, Artificial Sequence
  chemically synthesized
attcctattaaactaccatt

SEQ ID NO: 388381 - DNA, 20 bp, Artificial Sequence
  chemically synthesized
gaatctcaatggtagtttaa

SEQ ID NO: 388382 - DNA, 20 bp, Artificial Sequence
  chemically synthesized
aatctcaatggtagtttaat

SEQ ID NO: 388383 - DNA, 20 bp, Artificial Sequence
  chemically synthesized
caatggtagtttaataggaa

SEQ ID NO: 388384 - DNA, 20 bp, Artificial Sequence
  chemically synthesized
cactgctcaacgcaatttat

SEQ ID NO: 388385 - DNA, 20 bp, Artificial Sequence
  chemically synthesized
tgaatctaataaattgcgtt

SEQ ID NO: 388386 - DNA, 20 bp, Artificial Sequence
  chemically synthesized
atctaataaattgcgttgag

SEQ ID NO: 388387 - DNA, 20 bp, Artificial Sequence
  chemically synthesized
ataaattgcgttgagcagtg

SEQ ID NO: 388388 - DNA, 20 bp, Artificial Sequence
  chemically synthesized
aagaatcaatatcattaaaa

SEQ ID NO: 388389 - DNA, 20 bp, Artificial Sequence
  chemically synthesized
attccatgttcatggatagg

SEQ ID NO: 388390 - DNA, 20 bp, Artificial Sequence
  chemically synthesized
aacattccatgttcatggat

SEQ ID NO: 388391 - DNA, 20 bp, Artificial Sequence
  chemically synthesized
aaacattccatgttcatgga

SEQ ID NO: 388392 - DNA, 20 bp, Artificial Sequence
  chemically synthesized
attcttcctatccatgaaca

SEQ ID NO: 388393 - DNA, 20 bp, Artificial Sequence
  chemically synthesized
ggaaaaacattccatgttca

SEQ ID NO: 388394 - DNA, 20 bp, Artificial Sequence
  chemically synthesized
tcagagatgacagaaacaaa

SEQ ID NO: 388395 - DNA, 20 bp, Artificial Sequence
  chemically synthesized
ctcaaagaaatcagagatga

SEQ ID NO: 388396 - DNA, 20 bp, Artificial Sequence
  chemically synthesized
aacactcctcaaagaaatca

SEQ ID NO: 388397 - DNA, 20 bp, Artificial Sequence
  chemically synthesized
caaacactcctcaaagaaat

SEQ ID NO: 388398 - DNA, 20 bp, Artificial Sequence
  chemically synthesized
ctgtcatctctgatttcttt

SEQ ID NO: 388399 - DNA, 20 bp, Artificial Sequence
  chemically synthesized
tgtcatctctgatttctttg

SEQ ID NO: 388400 - DNA, 20 bp, Artificial Sequence
  chemically synthesized
tcatctctgatttctttgag

SEQ ID NO: 388401 - DNA, 20 bp, Artificial Sequence
  chemically synthesized
gaactaccaaacactcctca

SEQ ID NO: 388402 - DNA, 20 bp, Artificial Sequence
  chemically synthesized
tgatttctttgaggagtgtt

SEQ ID NO: 388403 - DNA, 20 bp, Artificial Sequence
  chemically synthesized
tttctttgaggagtgtttgg

SEQ ID NO: 388404 - DNA, 20 bp, Artificial Sequence
  chemically synthesized
gtgtttggtagttctccacg

SEQ ID NO: 388405 - DNA, 20 bp, Artificial Sequence
  chemically synthesized
gtttggtagttctccacgta

SEQ ID NO: 388406 - DNA, 20 bp, Artificial Sequence
  chemically synthesized
gggtgaaagatctctacgtg

SEQ ID NO: 388407 - DNA, 20 bp, Artificial Sequence
  chemically synthesized
aggggtgaaagatctctacg

SEQ ID NO: 388408 - DNA, 20 bp, Artificial Sequence
  chemically synthesized
acagctaactagaggggtga

SEQ ID NO: 388409 - DNA, 20 bp, Artificial Sequence
  chemically synthesized
gtagagatctttcacccctc

SEQ ID NO: 388410 - DNA, 20 bp, Artificial Sequence
  chemically synthesized
agatctttcacccctctagt

SEQ ID NO: 388411 - DNA, 20 bp, Artificial Sequence
  chemically synthesized
aggaatacagctaactagag

SEQ ID NO: 388412 - DNA, 20 bp, Artificial Sequence
  chemically synthesized
taggaatacagctaactaga

SEQ ID NO: 388413 - DNA, 20 bp, Artificial Sequence
  chemically synthesized
ctaggaatacagctaactag

SEQ ID NO: 388414 - DNA, 20 bp, Artificial Sequence
  chemically synthesized
cctaggaatacagctaacta

SEQ ID NO: 388415 - DNA, 20 bp, Artificial Sequence
  chemically synthesized
tacctaggaatacagctaac

SEQ ID NO: 388416 - DNA, 20 bp, Artificial Sequence
  chemically synthesized
cctctagttagctgtattcc

SEQ ID NO: 388417 - DNA, 20 bp, Artificial Sequence
  chemically synthesized
ctctagttagctgtattcct

SEQ ID NO: 388418 - DNA, 20 bp, Artificial Sequence
  chemically synthesized
gaataaaatacctaggaata

SEQ ID NO: 388419 - DNA, 20 bp, Artificial Sequence
  chemically synthesized
atagaaagaataaaatacct

SEQ ID NO: 388420 - DNA, 20 bp, Artificial Sequence
  chemically synthesized
catagaaagaataaaatacc

SEQ ID NO: 388421 - DNA, 20 bp, Artificial Sequence
  chemically synthesized
taggtattttattctttcta

SEQ ID NO: 388422 - DNA, 20 bp, Artificial Sequence
  chemically synthesized
gtattttattctttctatgg

SEQ ID NO: 388423 - DNA, 20 bp, Artificial Sequence
  chemically synthesized
acattcacaactgccataga

SEQ ID NO: 388424 - DNA, 20 bp, Artificial Sequence
  chemically synthesized
aatcacattcacaactgcca

SEQ ID NO: 388425 - DNA, 20 bp, Artificial Sequence
  chemically synthesized
gcagtgcaacagggagaaat

SEQ ID NO: 388426 - DNA, 20 bp, Artificial Sequence
  chemically synthesized
gttgcatgcagtgcaacagg

SEQ ID NO: 388427 - DNA, 20 bp, Artificial Sequence
  chemically synthesized
ctgttgcatgcagtgcaaca

SEQ ID NO: 388428 - DNA, 20 bp, Artificial Sequence
  chemically synthesized
tctgttgcatgcagtgcaac

SEQ ID NO: 388429 - DNA, 20 bp, Artificial Sequence
  chemically synthesized
atctgttgcatgcagtgcaa

SEQ ID NO: 388430 - DNA, 20 bp, Artificial Sequence
  chemically synthesized
ccctgttgcactgcatgcaa

SEQ ID NO: 388431 - DNA, 20 bp, Artificial Sequence
  chemically synthesized
tccattgcatctgttgcatg

SEQ ID NO: 388432 - DNA, 20 bp, Artificial Sequence
  chemically synthesized
actgcatgcaacagatgcaa

SEQ ID NO: 388433 - DNA, 20 bp, Artificial Sequence
  chemically synthesized
atgcaacagatgcaatggaa

SEQ ID NO: 388434 - DNA, 20 bp, Artificial Sequence
  chemically synthesized
tcctatacaccaacaacaga

SEQ ID NO: 388435 - DNA, 20 bp, Artificial Sequence
  chemically synthesized
aacagatttctctctgttgt

SEQ ID NO: 388436 - DNA, 20 bp, Artificial Sequence
  chemically synthesized
attcctatacaccaacaaca

SEQ ID NO: 388437 - DNA, 20 bp, Artificial Sequence
  chemically synthesized
gcattcctatacaccaacaa

SEQ ID NO: 388438 - DNA, 20 bp, Artificial Sequence
  chemically synthesized
ttctctctgttgttggtgta

SEQ ID NO: 388439 - DNA, 20 bp, Artificial Sequence
  chemically synthesized
tctctctgttgttggtgtat

SEQ ID NO: 388440 - DNA, 20 bp, Artificial Sequence
  chemically synthesized
ttgttggtgtataggaatgc

SEQ ID NO: 388441 - DNA, 20 bp, Artificial Sequence
  chemically synthesized
tataggaatgctagtgattt

SEQ ID NO: 388442 - DNA, 20 bp, Artificial Sequence
  chemically synthesized
aaccaatgtgccaaaatcac

SEQ ID NO: 388443 - DNA, 20 bp, Artificial Sequence
  chemically synthesized
tgctagtgattttggcacat

SEQ ID NO: 388444 - DNA, 20 bp, Artificial Sequence
  chemically synthesized
gcacattggttttgtatcct

SEQ ID NO: 388445 - DNA, 20 bp, Artificial Sequence
  chemically synthesized
aacaacttcagcaaagtctc

SEQ ID NO: 388446 - DNA, 20 bp, Artificial Sequence
  chemically synthesized
aaacaacttcagcaaagtct

SEQ ID NO: 388447 - DNA, 20 bp, Artificial Sequence
  chemically synthesized
tgtatcctgagactttgctg

SEQ ID NO: 388448 - DNA, 20 bp, Artificial Sequence
  chemically synthesized
gctgataaacaacttcagca

SEQ ID NO: 388449 - DNA, 20 bp, Artificial Sequence
  chemically synthesized
cttgtgctgataaacaactt

SEQ ID NO: 388450 - DNA, 20 bp, Artificial Sequence
  chemically synthesized
actttgctgaagttgtttat

SEQ ID NO: 388451 - DNA, 20 bp, Artificial Sequence
  chemically synthesized
ctgaagttgtttatcagcac

SEQ ID NO: 388452 - DNA, 20 bp, Artificial Sequence
  chemically synthesized
aagttgtttatcagcacaag

SEQ ID NO: 388453 - DNA, 20 bp, Artificial Sequence
  chemically synthesized
ttatcagcacaagaagcttt

SEQ ID NO: 388454 - DNA, 20 bp, Artificial Sequence
  chemically synthesized
tatcagcacaagaagctttt

SEQ ID NO: 388455 - DNA, 20 bp, Artificial Sequence
  chemically synthesized
gcacaagaagcttttgggct

SEQ ID NO: 388456 - DNA, 20 bp, Artificial Sequence
  chemically synthesized
accccatggtctcagcccaa

SEQ ID NO: 388457 - DNA, 20 bp, Artificial Sequence
  chemically synthesized
aagcttttgggctgagacca

SEQ ID NO: 388458 - DNA, 20 bp, Artificial Sequence
  chemically synthesized
agcttttgggctgagaccat

SEQ ID NO: 388459 - DNA, 20 bp, Artificial Sequence
  chemically synthesized
tctagaaaaccccatggtct

SEQ ID NO: 388460 - DNA, 20 bp, Artificial Sequence
  chemically synthesized
gcttttgggctgagaccatg

SEQ ID NO: 388461 - DNA, 20 bp, Artificial Sequence
  chemically synthesized
gctatatctagaaaacccca

SEQ ID NO: 388462 - DNA, 20 bp, Artificial Sequence
  chemically synthesized
gctgagaccatggggttttc

SEQ ID NO: 388463 - DNA, 20 bp, Artificial Sequence
  chemically synthesized
accatggggttttctagata

SEQ ID NO: 388464 - DNA, 20 bp, Artificial Sequence
  chemically synthesized
agacaacatgatgctatatc

SEQ ID NO: 388465 - DNA, 20 bp, Artificial Sequence
  chemically synthesized
agcatcatgttgtctgcaaa

SEQ ID NO: 388466 - DNA, 20 bp, Artificial Sequence
  chemically synthesized
catcatgttgtctgcaaaca

SEQ ID NO: 388467 - DNA, 20 bp, Artificial Sequence
  chemically synthesized
agtcaaactatctctgtttg

SEQ ID NO: 388468 - DNA, 20 bp, Artificial Sequence
  chemically synthesized
atgttgtctgcaaacagaga

SEQ ID NO: 388469 - DNA, 20 bp, Artificial Sequence
  chemically synthesized
cctccaactaggaagagagg

SEQ ID NO: 388470 - DNA, 20 bp, Artificial Sequence
  chemically synthesized
agtttgacttcctctcttcc

SEQ ID NO: 388471 - DNA, 20 bp, Artificial Sequence
  chemically synthesized
gcgcctccaactaggaagag

SEQ ID NO: 388472 - DNA, 20 bp, Artificial Sequence
  chemically synthesized
agcgcctccaactaggaaga

SEQ ID NO: 388473 - DNA, 20 bp, Artificial Sequence
  chemically synthesized
aaagcgcctccaactaggaa

SEQ ID NO: 388474 - DNA, 20 bp, Artificial Sequence
  chemically synthesized
tgacttcctctcttcctagt

SEQ ID NO: 388475 - DNA, 20 bp, Artificial Sequence
  chemically synthesized
ataaagcgcctccaactagg

SEQ ID NO: 388476 - DNA, 20 bp, Artificial Sequence
  chemically synthesized
acttcctctcttcctagttg

SEQ ID NO: 388477 - DNA, 20 bp, Artificial Sequence
  chemically synthesized
cttcctctcttcctagttgg

SEQ ID NO: 388478 - DNA, 20 bp, Artificial Sequence
  chemically synthesized
gaaataaagcgcctccaact

SEQ ID NO: 388479 - DNA, 20 bp, Artificial Sequence
  chemically synthesized
agaaataaagcgcctccaac

SEQ ID NO: 388480 - DNA, 20 bp, Artificial Sequence
  chemically synthesized
tcaggcaagagaaagaaata

SEQ ID NO: 388481 - DNA, 20 bp, Artificial Sequence
  chemically synthesized
cagggaaatcaggcaagaga

SEQ ID NO: 388482 - DNA, 20 bp, Artificial Sequence
  chemically synthesized
tgaccagggaaatcaggcaa

SEQ ID NO: 388483 - DNA, 20 bp, Artificial Sequence
  chemically synthesized
cctgaccagggaaatcaggc

SEQ ID NO: 388484 - DNA, 20 bp, Artificial Sequence
  chemically synthesized
aagtcctgaccagggaaatc

SEQ ID NO: 388485 - DNA, 20 bp, Artificial Sequence
  chemically synthesized
tttctcttgcctgatttccc

SEQ ID NO: 388486 - DNA, 20 bp, Artificial Sequence
  chemically synthesized
gaagtcctgaccagggaaat

SEQ ID NO: 388487 - DNA, 20 bp, Artificial Sequence
  chemically synthesized
tcttgcctgatttccctggt

SEQ ID NO: 388488 - DNA, 20 bp, Artificial Sequence
  chemically synthesized
cttgcctgatttccctggtc

SEQ ID NO: 388489 - DNA, 20 bp, Artificial Sequence
  chemically synthesized
agtattagaagtcctgacca

SEQ ID NO: 388490 - DNA, 20 bp, Artificial Sequence
  chemically synthesized
tagtattagaagtcctgacc

SEQ ID NO: 388491 - DNA, 20 bp, Artificial Sequence
  chemically synthesized
atagtattagaagtcctgac

SEQ ID NO: 388492 - DNA, 20 bp, Artificial Sequence
  chemically synthesized
cctatttaacatagtattag

SEQ ID NO: 388493 - DNA, 20 bp, Artificial Sequence
  chemically synthesized
attcctatttaacatagtat

SEQ ID NO: 388494 - DNA, 20 bp, Artificial Sequence
  chemically synthesized
acttctaatactatgttaaa

SEQ ID NO: 388495 - DNA, 20 bp, Artificial Sequence
  chemically synthesized
cttaccattcctatttaaca

SEQ ID NO: 388496 - DNA, 20 bp, Artificial Sequence
  chemically synthesized
cttctaatactatgttaaat

SEQ ID NO: 388497 - DNA, 20 bp, Artificial Sequence
  chemically synthesized
aatactatgttaaataggaa

SEQ ID NO: 388498 - DNA, 20 bp, Artificial Sequence
  chemically synthesized
ctatgttaaataggaatggt

SEQ ID NO: 388499 - DNA, 20 bp, Artificial Sequence
  chemically synthesized
atgttaaataggaatggtaa

SEQ ID NO: 388500 - DNA, 20 bp, Artificial Sequence
  chemically synthesized
gttaaataggaatggtaaga

SEQ ID NO: 388501 - DNA, 20 bp, Artificial Sequence
  chemically synthesized
ttaaataggaatggtaagag

SEQ ID NO: 388502 - DNA, 20 bp, Artificial Sequence
  chemically synthesized
taaataggaatggtaagaga

SEQ ID NO: 388503 - DNA, 20 bp, Artificial Sequence
  chemically synthesized
tggaaaaccagcacaagaca

SEQ ID NO: 388504 - DNA, 20 bp, Artificial Sequence
  chemically synthesized
atggaaaaccagcacaagac

SEQ ID NO: 388505 - DNA, 20 bp, Artificial Sequence
  chemically synthesized
agggcatccttgtcttgtgc

SEQ ID NO: 388506 - DNA, 20 bp, Artificial Sequence
  chemically synthesized
ttcccatggaaaaccagcac

SEQ ID NO: 388507 - DNA, 20 bp, Artificial Sequence
  chemically synthesized
gctgtgttcccatggaaaac

SEQ ID NO: 388508 - DNA, 20 bp, Artificial Sequence
  chemically synthesized
tgtcttgtgctggttttcca

SEQ ID NO: 388509 - DNA, 20 bp, Artificial Sequence
  chemically synthesized
gtcttgtgctggttttccat

SEQ ID NO: 388510 - DNA, 20 bp, Artificial Sequence
  chemically synthesized
taaggaatgctgtgttccca

SEQ ID NO: 388511 - DNA, 20 bp, Artificial Sequence
  chemically synthesized
gctggttttccatgggaaca

SEQ ID NO: 388512 - DNA, 20 bp, Artificial Sequence
  chemically synthesized
ggaacacagcattccttaaa

SEQ ID NO: 388513 - DNA, 20 bp, Artificial Sequence
  chemically synthesized
aggggcttcatgtctattta

SEQ ID NO: 388514 - DNA, 20 bp, Artificial Sequence
  chemically synthesized
caggggcttcatgtctattt

SEQ ID NO: 388515 - DNA, 20 bp, Artificial Sequence
  chemically synthesized
gcattccttaaatagacatg

SEQ ID NO: 388516 - DNA, 20 bp, Artificial Sequence
  chemically synthesized
tttcactggggtgtgggcag

SEQ ID NO: 388517 - DNA, 20 bp, Artificial Sequence
  chemically synthesized
ttttcactggggtgtgggca

SEQ ID NO: 388518 - DNA, 20 bp, Artificial Sequence
  chemically synthesized
tttttcactggggtgtgggc

SEQ ID NO: 388519 - DNA, 20 bp, Artificial Sequence
  chemically synthesized
gtttttcactggggtgtggg

SEQ ID NO: 388520 - DNA, 20 bp, Artificial Sequence
  chemically synthesized
tgaagcccctgcccacaccc

SEQ ID NO: 388521 - DNA, 20 bp, Artificial Sequence
  chemically synthesized
gttgtttttcactggggtgt

SEQ ID NO: 388522 - DNA, 20 bp, Artificial Sequence
  chemically synthesized
agttgtttttcactggggtg

SEQ ID NO: 388523 - DNA, 20 bp, Artificial Sequence
  chemically synthesized
tagtgagttgtttttcactg

SEQ ID NO: 388524 - DNA, 20 bp, Artificial Sequence
  chemically synthesized
gtagtgagttgtttttcact

SEQ ID NO: 388525 - DNA, 20 bp, Artificial Sequence
  chemically synthesized
agtagtgagttgtttttcac

SEQ ID NO: 388526 - DNA, 20 bp, Artificial Sequence
  chemically synthesized
aagcttaatctggaagtagt

SEQ ID NO: 388527 - DNA, 20 bp, Artificial Sequence
  chemically synthesized
gaaaaacaactcactacttc

SEQ ID NO: 388528 - DNA, 20 bp, Artificial Sequence
  chemically synthesized
taaaaagcttaatctggaag

SEQ ID NO: 388529 - DNA, 20 bp, Artificial Sequence
  chemically synthesized
caactcactacttccagatt

SEQ ID NO: 388530 - DNA, 20 bp, Artificial Sequence
  chemically synthesized
atataaaaagcttaatctgg

SEQ ID NO: 388531 - DNA, 20 bp, Artificial Sequence
  chemically synthesized
aaaatataaaaagcttaatc

SEQ ID NO: 388532 - DNA, 20 bp, Artificial Sequence
  chemically synthesized
gagatggccaaaaatataaa

SEQ ID NO: 388533 - DNA, 20 bp, Artificial Sequence
  chemically synthesized
gattaagctttttatatttt

SEQ ID NO: 388534 - DNA, 20 bp, Artificial Sequence
  chemically synthesized
aactttgtaacagtgagaga

SEQ ID NO: 388535 - DNA, 20 bp, Artificial Sequence
  chemically synthesized
aacaaactttgtaacagtga

SEQ ID NO: 388536 - DNA, 20 bp, Artificial Sequence
  chemically synthesized
caaacaaactttgtaacagt

SEQ ID NO: 388537 - DNA, 20 bp, Artificial Sequence
  chemically synthesized
ggccatctctcactgttaca

SEQ ID NO: 388538 - DNA, 20 bp, Artificial Sequence
  chemically synthesized
taaacaaacaaactttgtaa

SEQ ID NO: 388539 - DNA, 20 bp, Artificial Sequence
  chemically synthesized
agtttgtttgtttaaatatt

SEQ ID NO: 388540 - DNA, 20 bp, Artificial Sequence
  chemically synthesized
ttgtttgtttaaatatttag

SEQ ID NO: 388541 - DNA, 20 bp, Artificial Sequence
  chemically synthesized
gtttaaatatttagtggaca

SEQ ID NO: 388542 - DNA, 20 bp, Artificial Sequence
  chemically synthesized
tttaaatatttagtggacaa

SEQ ID NO: 388543 - DNA, 20 bp, Artificial Sequence
  chemically synthesized
ttaaatatttagtggacaaa

SEQ ID NO: 388544 - DNA, 20 bp, Artificial Sequence
  chemically synthesized
tgatgagaagaaaggaaaga

SEQ ID NO: 388545 - DNA, 20 bp, Artificial Sequence
  chemically synthesized
tatgatgagaagaaaggaaa

SEQ ID NO: 388546 - DNA, 20 bp, Artificial Sequence
  chemically synthesized
attatgatgagaagaaagga

SEQ ID NO: 388547 - DNA, 20 bp, Artificial Sequence
  chemically synthesized
tcttattatgatgagaagaa

SEQ ID NO: 388548 - DNA, 20 bp, Artificial Sequence
  chemically synthesized
ttcttattatgatgagaaga

SEQ ID NO: 388549 - DNA, 20 bp, Artificial Sequence
  chemically synthesized
catattcttattatgatgag

SEQ ID NO: 388550 - DNA, 20 bp, Artificial Sequence
  chemically synthesized
aagcatattcttattatgat

SEQ ID NO: 388551 - DNA, 20 bp, Artificial Sequence
  chemically synthesized
tcctttcttctcatcataat

SEQ ID NO: 388552 - DNA, 20 bp, Artificial Sequence
  chemically synthesized
taatcagtggaaatgcaatg

SEQ ID NO: 388553 - DNA, 20 bp, Artificial Sequence
  chemically synthesized
ttcattgcatttccactgat

SEQ ID NO: 388554 - DNA, 20 bp, Artificial Sequence
  chemically synthesized
tcaaatattcagctaatcag

SEQ ID NO: 388555 - DNA, 20 bp, Artificial Sequence
  chemically synthesized
ttttcaaatattcagctaat

SEQ ID NO: 388556 - DNA, 20 bp, Artificial Sequence
  chemically synthesized
attagctgttttcaaatatt

SEQ ID NO: 388557 - DNA, 20 bp, Artificial Sequence
  chemically synthesized
attagctgaatatttgaaaa

SEQ ID NO: 388558 - DNA, 20 bp, Artificial Sequence
  chemically synthesized
ttataattttagggacgtat

SEQ ID NO: 388559 - DNA, 20 bp, Artificial Sequence
  chemically synthesized
gaaagcaacttataatttta

SEQ ID NO: 388560 - DNA, 20 bp, Artificial Sequence
  chemically synthesized
agaaagcaacttataatttt

SEQ ID NO: 388561 - DNA, 20 bp, Artificial Sequence
  chemically synthesized
taatacgtccctaaaattat

SEQ ID NO: 388562 - DNA, 20 bp, Artificial Sequence
  chemically synthesized
tagaaagcaacttataattt

SEQ ID NO: 388563 - DNA, 20 bp, Artificial Sequence
  chemically synthesized
taaaattataagttgctttc

SEQ ID NO: 388564 - DNA, 20 bp, Artificial Sequence
  chemically synthesized
attataagttgctttctaga

SEQ ID NO: 388565 - DNA, 20 bp, Artificial Sequence
  chemically synthesized
ttataagttgctttctagac

SEQ ID NO: 388566 - DNA, 20 bp, Artificial Sequence
  chemically synthesized
aaaactggagcctgtctaga

SEQ ID NO: 388567 - DNA, 20 bp, Artificial Sequence
  chemically synthesized
ctgaaaaactggagcctgtc

SEQ ID NO: 388568 - DNA, 20 bp, Artificial Sequence
  chemically synthesized
gttgctttctagacaggctc

SEQ ID NO: 388569 - DNA, 20 bp, Artificial Sequence
  chemically synthesized
aatgagacactgaaaaactg

SEQ ID NO: 388570 - DNA, 20 bp, Artificial Sequence
  chemically synthesized
ctagacaggctccagttttt

SEQ ID NO: 388571 - DNA, 20 bp, Artificial Sequence
  chemically synthesized
taaatgagacactgaaaaac

SEQ ID NO: 388572 - DNA, 20 bp, Artificial Sequence
  chemically synthesized
ctggggaacataatttaaat

SEQ ID NO: 388573 - DNA, 20 bp, Artificial Sequence
  chemically synthesized
ctcatttaaattatgttccc

SEQ ID NO: 388574 - DNA, 20 bp, Artificial Sequence
  chemically synthesized
catttaaattatgttcccca

SEQ ID NO: 388575 - DNA, 20 bp, Artificial Sequence
  chemically synthesized
atctgtactgttcagctctg

SEQ ID NO: 388576 - DNA, 20 bp, Artificial Sequence
  chemically synthesized
aatctgtactgttcagctct

SEQ ID NO: 388577 - DNA, 20 bp, Artificial Sequence
  chemically synthesized
aaatctgtactgttcagctc

SEQ ID NO: 388578 - DNA, 20 bp, Artificial Sequence
  chemically synthesized
ttatgttccccagagctgaa

SEQ ID NO: 388579 - DNA, 20 bp, Artificial Sequence
  chemically synthesized
ttccccagagctgaacagta

SEQ ID NO: 388580 - DNA, 20 bp, Artificial Sequence
  chemically synthesized
cagaccaaatctgtactgtt

SEQ ID NO: 388581 - DNA, 20 bp, Artificial Sequence
  chemically synthesized
agagctgaacagtacagatt

SEQ ID NO: 388582 - DNA, 20 bp, Artificial Sequence
  chemically synthesized
gacactaaaagtaagttcat

SEQ ID NO: 388583 - DNA, 20 bp, Artificial Sequence
  chemically synthesized
tggtctgatgaacttacttt

SEQ ID NO: 388584 - DNA, 20 bp, Artificial Sequence
  chemically synthesized
tctttgttgacactaaaagt

SEQ ID NO: 388585 - DNA, 20 bp, Artificial Sequence
  chemically synthesized
accctctttgttgacactaa

SEQ ID NO: 388586 - DNA, 20 bp, Artificial Sequence
  chemically synthesized
acttacttttagtgtcaaca

SEQ ID NO: 388587 - DNA, 20 bp, Artificial Sequence
  chemically synthesized
ttacttttagtgtcaacaaa

SEQ ID NO: 388588 - DNA, 20 bp, Artificial Sequence
  chemically synthesized
tacttttagtgtcaacaaag

SEQ ID NO: 388589 - DNA, 20 bp, Artificial Sequence
  chemically synthesized
acttttagtgtcaacaaaga

SEQ ID NO: 388590 - DNA, 20 bp, Artificial Sequence
  chemically synthesized
tgtcaacaaagagggtgttc

SEQ ID NO: 388591 - DNA, 20 bp, Artificial Sequence
  chemically synthesized
gtcaacaaagagggtgttct

SEQ ID NO: 388592 - DNA, 20 bp, Artificial Sequence
  chemically synthesized
atagtaattgaaatggtgcc

SEQ ID NO: 388593 - DNA, 20 bp, Artificial Sequence
  chemically synthesized
aataagtatagtaattgaaa

SEQ ID NO: 388594 - DNA, 20 bp, Artificial Sequence
  chemically synthesized
acaagaaaaacaaataagta

SEQ ID NO: 388595 - DNA, 20 bp, Artificial Sequence
  chemically synthesized
gagatacaagaaaaacaaat

SEQ ID NO: 388596 - DNA, 20 bp, Artificial Sequence
  chemically synthesized
taacattatgatagagatac

SEQ ID NO: 388597 - DNA, 20 bp, Artificial Sequence
  chemically synthesized
atgactttaacattatgata

SEQ ID NO: 388598 - DNA, 20 bp, Artificial Sequence
  chemically synthesized
cgatgactttaacattatga

SEQ ID NO: 388599 - DNA, 20 bp, Artificial Sequence
  chemically synthesized
gtatctctatcataatgtta

SEQ ID NO: 388600 - DNA, 20 bp, Artificial Sequence
  chemically synthesized
agtattaaataaaaaaacaa

SEQ ID NO: 388601 - DNA, 20 bp, Artificial Sequence
  chemically synthesized
aaagtattaaataaaaaaac

SEQ ID NO: 388602 - DNA, 20 bp, Artificial Sequence
  chemically synthesized
gtttttttatttaatacttt

SEQ ID NO: 388603 - DNA, 20 bp, Artificial Sequence
  chemically synthesized
tttttttatttaatactttt

SEQ ID NO: 388604 - DNA, 20 bp, Artificial Sequence
  chemically synthesized
ttttatttaatacttttggg

SEQ ID NO: 388605 - DNA, 20 bp, Artificial Sequence
  chemically synthesized
ttatttaatacttttgggtg

SEQ ID NO: 388606 - DNA, 20 bp, Artificial Sequence
  chemically synthesized
attcccctctctccacccaa

SEQ ID NO: 388607 - DNA, 20 bp, Artificial Sequence
  chemically synthesized
atttaatacttttgggtgga

SEQ ID NO: 388608 - DNA, 20 bp, Artificial Sequence
  chemically synthesized
ttaatacttttgggtggaga

SEQ ID NO: 388609 - DNA, 20 bp, Artificial Sequence
  chemically synthesized
taatacttttgggtggagag

SEQ ID NO: 388610 - DNA, 20 bp, Artificial Sequence
  chemically synthesized
aatacttttgggtggagaga

SEQ ID NO: 388611 - DNA, 20 bp, Artificial Sequence
  chemically synthesized
atacttttgggtggagagag

SEQ ID NO: 388612 - DNA, 20 bp, Artificial Sequence
  chemically synthesized
agagaggggaatgctaactt

SEQ ID NO: 388613 - DNA, 20 bp, Artificial Sequence
  chemically synthesized
gaaaatataatttcttaagt

SEQ ID NO: 388614 - DNA, 20 bp, Artificial Sequence
  chemically synthesized
tagggaaaatataatttctt

SEQ ID NO: 388615 - DNA, 20 bp, Artificial Sequence
  chemically synthesized
catcaaaataaaattgaata

SEQ ID NO: 388616 - DNA, 20 bp, Artificial Sequence
  chemically synthesized
acatcaaaataaaattgaat

SEQ ID NO: 388617 - DNA, 20 bp, Artificial Sequence
  chemically synthesized
tacatcaaaataaaattgaa

SEQ ID NO: 388618 - DNA, 20 bp, Artificial Sequence
  chemically synthesized
caattttattttgatgtatt

SEQ ID NO: 388619 - DNA, 20 bp, Artificial Sequence
  chemically synthesized
gatgtattaagcaactattt

SEQ ID NO: 388620 - DNA, 20 bp, Artificial Sequence
  chemically synthesized
gcacatattaggcactgaaa

SEQ ID NO: 388621 - DNA, 20 bp, Artificial Sequence
  chemically synthesized
tcacatgcctggcacatatt

SEQ ID NO: 388622 - DNA, 20 bp, Artificial Sequence
  chemically synthesized
atcacatgcctggcacatat

SEQ ID NO: 388623 - DNA, 20 bp, Artificial Sequence
  chemically synthesized
tttcagtgcctaatatgtgc

SEQ ID NO: 388624 - DNA, 20 bp, Artificial Sequence
  chemically synthesized
ttcagtgcctaatatgtgcc

SEQ ID NO: 388625 - DNA, 20 bp, Artificial Sequence
  chemically synthesized
cctgctgtttatcacatgcc

SEQ ID NO: 388626 - DNA, 20 bp, Artificial Sequence
  chemically synthesized
tgtgccaggcatgtgataaa

SEQ ID NO: 388627 - DNA, 20 bp, Artificial Sequence
  chemically synthesized
gccaggcatgtgataaacag

SEQ ID NO: 388628 - DNA, 20 bp, Artificial Sequence
  chemically synthesized
ccaggcatgtgataaacagc

SEQ ID NO: 388629 - DNA, 20 bp, Artificial Sequence
  chemically synthesized
gtgataaacagcaggatgca

SEQ ID NO: 388630 - DNA, 20 bp, Artificial Sequence
  chemically synthesized
agcaggatgcaaagtataca

SEQ ID NO: 388631 - DNA, 20 bp, Artificial Sequence
  chemically synthesized
atgtatacaccatgtagatg

SEQ ID NO: 388632 - DNA, 20 bp, Artificial Sequence
  chemically synthesized
atacatagtctacatctaca

SEQ ID NO: 388633 - DNA, 20 bp, Artificial Sequence
  chemically synthesized
gactatatgtatacaccatg

SEQ ID NO: 388634 - DNA, 20 bp, Artificial Sequence
  chemically synthesized
atctacatggtgtatacata

SEQ ID NO: 388635 - DNA, 20 bp, Artificial Sequence
  chemically synthesized
atggtgtatacatatagtca

SEQ ID NO: 388636 - DNA, 20 bp, Artificial Sequence
  chemically synthesized
tagtcaaagaaatattataa

SEQ ID NO: 388637 - DNA, 20 bp, Artificial Sequence
  chemically synthesized
ttataacagttaacatgtat

SEQ ID NO: 388638 - DNA, 20 bp, Artificial Sequence
  chemically synthesized
ttaacatgtattggtaactt

SEQ ID NO: 388639 - DNA, 20 bp, Artificial Sequence
  chemically synthesized
ttcctctatacatatgtctt

SEQ ID NO: 388640 - DNA, 20 bp, Artificial Sequence
  chemically synthesized
ggtaacttaagacatatgta

SEQ ID NO: 388641 - DNA, 20 bp, Artificial Sequence
  chemically synthesized
taacttaagacatatgtata

SEQ ID NO: 388642 - DNA, 20 bp, Artificial Sequence
  chemically synthesized
aacttaagacatatgtatag

SEQ ID NO: 388643 - DNA, 20 bp, Artificial Sequence
  chemically synthesized
acatatgtatagaggaatct

SEQ ID NO: 388644 - DNA, 20 bp, Artificial Sequence
  chemically synthesized
catatgtatagaggaatctg

SEQ ID NO: 388645 - DNA, 20 bp, Artificial Sequence
  chemically synthesized
gtatagaggaatctgaggct

SEQ ID NO: 388646 - DNA, 20 bp, Artificial Sequence
  chemically synthesized
cttgaccacaaaccaagcct

SEQ ID NO: 388647 - DNA, 20 bp, Artificial Sequence
  chemically synthesized
ggaatctgaggcttggtttg

SEQ ID NO: 388648 - DNA, 20 bp, Artificial Sequence
  chemically synthesized
taccatcttgaccacaaacc

SEQ ID NO: 388649 - DNA, 20 bp, Artificial Sequence
  chemically synthesized
ctgaggcttggtttgtggtc

SEQ ID NO: 388650 - DNA, 20 bp, Artificial Sequence
  chemically synthesized
ggcttggtttgtggtcaaga

SEQ ID NO: 388651 - DNA, 20 bp, Artificial Sequence
  chemically synthesized
gatggtatatatataatcct

SEQ ID NO: 388652 - DNA, 20 bp, Artificial Sequence
  chemically synthesized
ctcaagaagcaaacaaacca

SEQ ID NO: 388653 - DNA, 20 bp, Artificial Sequence
  chemically synthesized
tctcaagaagcaaacaaacc

SEQ ID NO: 388654 - DNA, 20 bp, Artificial Sequence
  chemically synthesized
ccttggtttgtttgcttctt

SEQ ID NO: 388655 - DNA, 20 bp, Artificial Sequence
  chemically synthesized
gtttctagatttgtctcaag

SEQ ID NO: 388656 - DNA, 20 bp, Artificial Sequence
  chemically synthesized
gttgtttctagatttgtctc

SEQ ID NO: 388657 - DNA, 20 bp, Artificial Sequence
  chemically synthesized
tttgcttcttgagacaaatc

SEQ ID NO: 388658 - DNA, 20 bp, Artificial Sequence
  chemically synthesized
tactttggcctagttgtttc

SEQ ID NO: 388659 - DNA, 20 bp, Artificial Sequence
  chemically synthesized
gagacaaatctagaaacaac

SEQ ID NO: 388660 - DNA, 20 bp, Artificial Sequence
  chemically synthesized
agacaaatctagaaacaact

SEQ ID NO: 388661 - DNA, 20 bp, Artificial Sequence
  chemically synthesized
atctagaaacaactaggcca

SEQ ID NO: 388662 - DNA, 20 bp, Artificial Sequence
  chemically synthesized
tgatagtgtttactttggcc

SEQ ID NO: 388663 - DNA, 20 bp, Artificial Sequence
  chemically synthesized
atagttgatagtgtttactt

SEQ ID NO: 388664 - DNA, 20 bp, Artificial Sequence
  chemically synthesized
atgactattataatagttga

SEQ ID NO: 388665 - DNA, 20 bp, Artificial Sequence
  chemically synthesized
aacactatcaactattataa

SEQ ID NO: 388666 - DNA, 20 bp, Artificial Sequence
  chemically synthesized
aggagtcatgactattataa

SEQ ID NO: 388667 - DNA, 20 bp, Artificial Sequence
  chemically synthesized
ataatagtcatgactccttt

SEQ ID NO: 388668 - DNA, 20 bp, Artificial Sequence
  chemically synthesized
gaaagaataaatactcaaag

SEQ ID NO: 388669 - DNA, 20 bp, Artificial Sequence
  chemically synthesized
aagaaagaataaatactcaa

SEQ ID NO: 388670 - DNA, 20 bp, Artificial Sequence
  chemically synthesized
gaagaaagaataaatactca

SEQ ID NO: 388671 - DNA, 20 bp, Artificial Sequence
  chemically synthesized
tgagtatttattctttcttc

SEQ ID NO: 388672 - DNA, 20 bp, Artificial Sequence
  chemically synthesized
tctgtcagagttccagaaga

SEQ ID NO: 388673 - DNA, 20 bp, Artificial Sequence
  chemically synthesized
aatatctgtcagagttccag

SEQ ID NO: 388674 - DNA, 20 bp, Artificial Sequence
  chemically synthesized
cacaatatctgtcagagttc

SEQ ID NO: 388675 - DNA, 20 bp, Artificial Sequence
  chemically synthesized
tctttcttctggaactctga

SEQ ID NO: 388676 - DNA, 20 bp, Artificial Sequence
  chemically synthesized
ttaaatcacaatatctgtca

SEQ ID NO: 388677 - DNA, 20 bp, Artificial Sequence
  chemically synthesized
ccttaaatcacaatatctgt

SEQ ID NO: 388678 - DNA, 20 bp, Artificial Sequence
  chemically synthesized
tctgacagatattgtgattt

SEQ ID NO: 388679 - DNA, 20 bp, Artificial Sequence
  chemically synthesized
ctgacagatattgtgattta

SEQ ID NO: 388680 - DNA, 20 bp, Artificial Sequence
  chemically synthesized
tgacagatattgtgatttaa

SEQ ID NO: 388681 - DNA, 20 bp, Artificial Sequence
  chemically synthesized
gatattgtgatttaagggcg

SEQ ID NO: 388682 - DNA, 20 bp, Artificial Sequence
  chemically synthesized
atattgtgatttaagggcgt

SEQ ID NO: 388683 - DNA, 20 bp, Artificial Sequence
  chemically synthesized
tattgtgatttaagggcgta

SEQ ID NO: 388684 - DNA, 20 bp, Artificial Sequence
  chemically synthesized
gtgatttaagggcgtaggga

SEQ ID NO: 388685 - DNA, 20 bp, Artificial Sequence
  chemically synthesized
tgatttaagggcgtagggat

SEQ ID NO: 388686 - DNA, 20 bp, Artificial Sequence
  chemically synthesized
ttaagggcgtagggatagga

SEQ ID NO: 388687 - DNA, 20 bp, Artificial Sequence
  chemically synthesized
taagggcgtagggataggaa

SEQ ID NO: 388688 - DNA, 20 bp, Artificial Sequence
  chemically synthesized
ataggaaaggaaaaaaatga

SEQ ID NO: 388689 - DNA, 20 bp, Artificial Sequence
  chemically synthesized
aaaggaaaaaaatgaaagca

SEQ ID NO: 388690 - DNA, 20 bp, Artificial Sequence
  chemically synthesized
aggaaaaaaatgaaagcaaa

SEQ ID NO: 388691 - DNA, 20 bp, Artificial Sequence
  chemically synthesized
aaaaaatgaaagcaaagaga

SEQ ID NO: 388692 - DNA, 20 bp, Artificial Sequence
  chemically synthesized
aatgaaagcaaagagacagt

SEQ ID NO: 388693 - DNA, 20 bp, Artificial Sequence
  chemically synthesized
gagacagtgagaacactttt

SEQ ID NO: 388694 - DNA, 20 bp, Artificial Sequence
  chemically synthesized
gacagtgagaacacttttta

SEQ ID NO: 388695 - DNA, 20 bp, Artificial Sequence
  chemically synthesized
ggctgtgccctggctctaaa

SEQ ID NO: 388696 - DNA, 20 bp, Artificial Sequence
  chemically synthesized
gtgagaacactttttagagc

SEQ ID NO: 388697 - DNA, 20 bp, Artificial Sequence
  chemically synthesized
tgagaacactttttagagcc

SEQ ID NO: 388698 - DNA, 20 bp, Artificial Sequence
  chemically synthesized
gagaacactttttagagcca

SEQ ID NO: 388699 - DNA, 20 bp, Artificial Sequence
  chemically synthesized
cactttttagagccagggca

SEQ ID NO: 388700 - DNA, 20 bp, Artificial Sequence
  chemically synthesized
cttcatcttaggctgtgccc

SEQ ID NO: 388701 - DNA, 20 bp, Artificial Sequence
  chemically synthesized
ttagagccagggcacagcct

SEQ ID NO: 388702 - DNA, 20 bp, Artificial Sequence
  chemically synthesized
ccagggcacagcctaagatg

SEQ ID NO: 388703 - DNA, 20 bp, Artificial Sequence
  chemically synthesized
tttcatttgttcttcatctt

SEQ ID NO: 388704 - DNA, 20 bp, Artificial Sequence
  chemically synthesized
ctttcatttgttcttcatct

SEQ ID NO: 388705 - DNA, 20 bp, Artificial Sequence
  chemically synthesized
ctaagatgaagaacaaatga

SEQ ID NO: 388706 - DNA, 20 bp, Artificial Sequence
  chemically synthesized
aacaaatgaaagatctacat

SEQ ID NO: 388707 - DNA, 20 bp, Artificial Sequence
  chemically synthesized
aaatgaaagatctacatcag

SEQ ID NO: 388708 - DNA, 20 bp, Artificial Sequence
  chemically synthesized
tttacctttggctgctgatg

SEQ ID NO: 388709 - DNA, 20 bp, Artificial Sequence
  chemically synthesized
aagatctacatcagcagcca

SEQ ID NO: 388710 - DNA, 20 bp, Artificial Sequence
  chemically synthesized
agatctacatcagcagccaa

SEQ ID NO: 388711 - DNA, 20 bp, Artificial Sequence
  chemically synthesized
gaagtgcttatttttacctt

SEQ ID NO: 388712 - DNA, 20 bp, Artificial Sequence
  chemically synthesized
cagcagccaaaggtaaaaat

SEQ ID NO: 388713 - DNA, 20 bp, Artificial Sequence
  chemically synthesized
aaaggtaaaaataagcactt

SEQ ID NO: 388714 - DNA, 20 bp, Artificial Sequence
  chemically synthesized
gtaaaaataagcacttcaga

SEQ ID NO: 388715 - DNA, 20 bp, Artificial Sequence
  chemically synthesized
gaaaatcagttttctttctg

SEQ ID NO: 388716 - DNA, 20 bp, Artificial Sequence
  chemically synthesized
ttttttcttctgtggaaaat

SEQ ID NO: 388717 - DNA, 20 bp, Artificial Sequence
  chemically synthesized
gaaagaaaactgattttcca

SEQ ID NO: 388718 - DNA, 20 bp, Artificial Sequence
  chemically synthesized
agaaaactgattttccacag

SEQ ID NO: 388719 - DNA, 20 bp, Artificial Sequence
  chemically synthesized
ctgccatattttttcttctg

SEQ ID NO: 388720 - DNA, 20 bp, Artificial Sequence
  chemically synthesized
tttccacagaagaaaaaata

SEQ ID NO: 388721 - DNA, 20 bp, Artificial Sequence
  chemically synthesized
ccacagaagaaaaaatatgg

SEQ ID NO: 388722 - DNA, 20 bp, Artificial Sequence
  chemically synthesized
atggcagacataatgtctga

SEQ ID NO: 388723 - DNA, 20 bp, Artificial Sequence
  chemically synthesized
agacataatgtctgatggca

SEQ ID NO: 388724 - DNA, 20 bp, Artificial Sequence
  chemically synthesized
gacataatgtctgatggcat

SEQ ID NO: 388725 - DNA, 20 bp, Artificial Sequence
  chemically synthesized
ccatctggagcctatgccat

SEQ ID NO: 388726 - DNA, 20 bp, Artificial Sequence
  chemically synthesized
atgtctgatggcataggctc

SEQ ID NO: 388727 - DNA, 20 bp, Artificial Sequence
  chemically synthesized
ctgatggcataggctccaga

SEQ ID NO: 388728 - DNA, 20 bp, Artificial Sequence
  chemically synthesized
tgtatttcttattccatctg

SEQ ID NO: 388729 - DNA, 20 bp, Artificial Sequence
  chemically synthesized
tgtgtatttcttattccatc

SEQ ID NO: 388730 - DNA, 20 bp, Artificial Sequence
  chemically synthesized
gcataggctccagatggaat

SEQ ID NO: 388731 - DNA, 20 bp, Artificial Sequence
  chemically synthesized
cagatggaataagaaataca

SEQ ID NO: 388732 - DNA, 20 bp, Artificial Sequence
  chemically synthesized
gaataagaaatacacagctg

SEQ ID NO: 388733 - DNA, 20 bp, Artificial Sequence
  chemically synthesized
ataagaaatacacagctgca

SEQ ID NO: 388734 - DNA, 20 bp, Artificial Sequence
  chemically synthesized
gaaatacacagctgcagagt

SEQ ID NO: 388735 - DNA, 20 bp, Artificial Sequence
  chemically synthesized
aaatacacagctgcagagta

SEQ ID NO: 388736 - DNA, 20 bp, Artificial Sequence
  chemically synthesized
ctgaagatagccttactctg

SEQ ID NO: 388737 - DNA, 20 bp, Artificial Sequence
  chemically synthesized
ctgcagagtaaggctatctt

SEQ ID NO: 388738 - DNA, 20 bp, Artificial Sequence
  chemically synthesized
ttctctcgattaactgaaga

SEQ ID NO: 388739 - DNA, 20 bp, Artificial Sequence
  chemically synthesized
aggcttctctcgattaactg

SEQ ID NO: 388740 - DNA, 20 bp, Artificial Sequence
  chemically synthesized
aaggctatcttcagttaatc

SEQ ID NO: 388741 - DNA, 20 bp, Artificial Sequence
  chemically synthesized
ggctatcttcagttaatcga

SEQ ID NO: 388742 - DNA, 20 bp, Artificial Sequence
  chemically synthesized
tatcttcagttaatcgagag

SEQ ID NO: 388743 - DNA, 20 bp, Artificial Sequence
  chemically synthesized
atcgagagaagcctgatcat

SEQ ID NO: 388744 - DNA, 20 bp, Artificial Sequence
  chemically synthesized
ggctaatgcttctgatgatc

SEQ ID NO: 388745 - DNA, 20 bp, Artificial Sequence
  chemically synthesized
tggctaatgcttctgatgat

SEQ ID NO: 388746 - DNA, 20 bp, Artificial Sequence
  chemically synthesized
gagagaagcctgatcatcag

SEQ ID NO: 388747 - DNA, 20 bp, Artificial Sequence
  chemically synthesized
agcctgatcatcagaagcat

SEQ ID NO: 388748 - DNA, 20 bp, Artificial Sequence
  chemically synthesized
tattatatgtttacagacat

SEQ ID NO: 388749 - DNA, 20 bp, Artificial Sequence
  chemically synthesized
attttattattatatgttta

SEQ ID NO: 388750 - DNA, 20 bp, Artificial Sequence
  chemically synthesized
atataataataaaataaatg

SEQ ID NO: 388751 - DNA, 20 bp, Artificial Sequence
  chemically synthesized
aaaattaacacaaagattta

SEQ ID NO: 388752 - DNA, 20 bp, Artificial Sequence
  chemically synthesized
tataaaacaaaattaacaca

SEQ ID NO: 388753 - DNA, 20 bp, Artificial Sequence
  chemically synthesized
ttgttttataaaaataattc

SEQ ID NO: 388754 - DNA, 20 bp, Artificial Sequence
  chemically synthesized
taattcaagaactgttattt

SEQ ID NO: 388755 - DNA, 20 bp, Artificial Sequence
  chemically synthesized
atataatggttccaaaataa

SEQ ID NO: 388756 - DNA, 20 bp, Artificial Sequence
  chemically synthesized
accttactatatacatataa

SEQ ID NO: 388757 - DNA, 20 bp, Artificial Sequence
  chemically synthesized
ttggaaccattatatgtata

SEQ ID NO: 388758 - DNA, 20 bp, Artificial Sequence
  chemically synthesized
aaccattatatgtatatagt

SEQ ID NO: 388759 - DNA, 20 bp, Artificial Sequence
  chemically synthesized
accattatatgtatatagta

SEQ ID NO: 388760 - DNA, 20 bp, Artificial Sequence
  chemically synthesized
tagtaaggtaattaccatat

SEQ ID NO: 388761 - DNA, 20 bp, Artificial Sequence
  chemically synthesized
cattagtataattgcttata

SEQ ID NO: 388762 - DNA, 20 bp, Artificial Sequence
  chemically synthesized
agcaattatactaatgtcat

SEQ ID NO: 388763 - DNA, 20 bp, Artificial Sequence
  chemically synthesized
atctatgtttctaatgacat

SEQ ID NO: 388764 - DNA, 20 bp, Artificial Sequence
  chemically synthesized
tactaatgtcattagaaaca

SEQ ID NO: 388765 - DNA, 20 bp, Artificial Sequence
  chemically synthesized
tcattagaaacatagatttt

SEQ ID NO: 388766 - DNA, 20 bp, Artificial Sequence
  chemically synthesized
gaaacatagattttcagcgt

SEQ ID NO: 388767 - DNA, 20 bp, Artificial Sequence
  chemically synthesized
aacatagattttcagcgtaa

SEQ ID NO: 388768 - DNA, 20 bp, Artificial Sequence
  chemically synthesized
catagattttcagcgtaaga

SEQ ID NO: 388769 - DNA, 20 bp, Artificial Sequence
  chemically synthesized
agattttcagcgtaagagag

SEQ ID NO: 388770 - DNA, 20 bp, Artificial Sequence
  chemically synthesized
attttcagcgtaagagagaa

SEQ ID NO: 388771 - DNA, 20 bp, Artificial Sequence
  chemically synthesized
gcgtaagagagaagagactg

SEQ ID NO: 388772 - DNA, 20 bp, Artificial Sequence
  chemically synthesized
aacatatttgattttaactg

SEQ ID NO: 388773 - DNA, 20 bp, Artificial Sequence
  chemically synthesized
caccacttggatcaagaatt

SEQ ID NO: 388774 - DNA, 20 bp, Artificial Sequence
  chemically synthesized
tcaccacttggatcaagaat

SEQ ID NO: 388775 - DNA, 20 bp, Artificial Sequence
  chemically synthesized
tcgttcctaattcttgatcc

SEQ ID NO: 388776 - DNA, 20 bp, Artificial Sequence
  chemically synthesized
ctcagatcaccacttggatc

SEQ ID NO: 388777 - DNA, 20 bp, Artificial Sequence
  chemically synthesized
ttcctaattcttgatccaag

SEQ ID NO: 388778 - DNA, 20 bp, Artificial Sequence
  chemically synthesized
ctaccactcagatcaccact

SEQ ID NO: 388779 - DNA, 20 bp, Artificial Sequence
  chemically synthesized
cttgatccaagtggtgatct

SEQ ID NO: 388780 - DNA, 20 bp, Artificial Sequence
  chemically synthesized
gatccaagtggtgatctgag

SEQ ID NO: 388781 - DNA, 20 bp, Artificial Sequence
  chemically synthesized
ccaagtggtgatctgagtgg

SEQ ID NO: 388782 - DNA, 20 bp, Artificial Sequence
  chemically synthesized
aaacacagatagctaccact

SEQ ID NO: 388783 - DNA, 20 bp, Artificial Sequence
  chemically synthesized
ccatataccataaacacaga

SEQ ID NO: 388784 - DNA, 20 bp, Artificial Sequence
  chemically synthesized
gtggtagctatctgtgttta

SEQ ID NO: 388785 - DNA, 20 bp, Artificial Sequence
  chemically synthesized
ataaccatataccataaaca

SEQ ID NO: 388786 - DNA, 20 bp, Artificial Sequence
  chemically synthesized
ctatctgtgtttatggtata

SEQ ID NO: 388787 - DNA, 20 bp, Artificial Sequence
  chemically synthesized
tttaatacactttgttattg

SEQ ID NO: 388788 - DNA, 20 bp, Artificial Sequence
  chemically synthesized
tatgttatgcttcaataaca

SEQ ID NO: 388789 - DNA, 20 bp, Artificial Sequence
  chemically synthesized
ataacaaagtgtattaaaaa

SEQ ID NO: 388790 - DNA, 20 bp, Artificial Sequence
  chemically synthesized
acaaagtgtattaaaaatag

SEQ ID NO: 388791 - DNA, 20 bp, Artificial Sequence
  chemically synthesized
aatagaagaaaatgcaataa

SEQ ID NO: 388792 - DNA, 20 bp, Artificial Sequence
  chemically synthesized
aatgcaataaaagttttaaa

SEQ ID NO: 388793 - DNA, 20 bp, Artificial Sequence
  chemically synthesized
aataaaagttttaaaaagca

SEQ ID NO: 388794 - DNA, 20 bp, Artificial Sequence
  chemically synthesized
ataaaagttttaaaaagcaa

SEQ ID NO: 388795 - DNA, 20 bp, Artificial Sequence
  chemically synthesized
taaaagttttaaaaagcaaa

SEQ ID NO: 388796 - DNA, 20 bp, Artificial Sequence
  chemically synthesized
agttttaaaaagcaaagggc

SEQ ID NO: 388797 - DNA, 20 bp, Artificial Sequence
  chemically synthesized
aaaagcaaagggcaagaata

SEQ ID NO: 388798 - DNA, 20 bp, Artificial Sequence
  chemically synthesized
taaatcgtttcttcaataaa

SEQ ID NO: 388799 - DNA, 20 bp, Artificial Sequence
  chemically synthesized
ttgataagcactgtttattg

SEQ ID NO: 388800 - DNA, 20 bp, Artificial Sequence
  chemically synthesized
aatgtgcaatagtgattgat

SEQ ID NO: 388801 - DNA, 20 bp, Artificial Sequence
  chemically synthesized
aagtgaaataaaatgtgcaa

SEQ ID NO: 388802 - DNA, 20 bp, Artificial Sequence
  chemically synthesized
ttttatttcacttaatttct

SEQ ID NO: 388803 - DNA, 20 bp, Artificial Sequence
  chemically synthesized
taaggtttttctgagaaatt

SEQ ID NO: 388804 - DNA, 20 bp, Artificial Sequence
  chemically synthesized
aatagaaataaggtttttct

SEQ ID NO: 388805 - DNA, 20 bp, Artificial Sequence
  chemically synthesized
agagattttcaatagaaata

SEQ ID NO: 388806 - DNA, 20 bp, Artificial Sequence
  chemically synthesized
cagagattttcaatagaaat

SEQ ID NO: 388807 - DNA, 20 bp, Artificial Sequence
  chemically synthesized
gaagatacagagattttcaa

SEQ ID NO: 388808 - DNA, 20 bp, Artificial Sequence
  chemically synthesized
ttccagtgcctgaagataca

SEQ ID NO: 388809 - DNA, 20 bp, Artificial Sequence
  chemically synthesized
attgaaaatctctgtatctt

SEQ ID NO: 388810 - DNA, 20 bp, Artificial Sequence
  chemically synthesized
ttgaaaatctctgtatcttc

SEQ ID NO: 388811 - DNA, 20 bp, Artificial Sequence
  chemically synthesized
ctttccagtgcctgaagata

SEQ ID NO: 388812 - DNA, 20 bp, Artificial Sequence
  chemically synthesized
atctctgtatcttcaggcac

SEQ ID NO: 388813 - DNA, 20 bp, Artificial Sequence
  chemically synthesized
gggagtctttccagtgcctg

SEQ ID NO: 388814 - DNA, 20 bp, Artificial Sequence
  chemically synthesized
ctgtatcttcaggcactgga

SEQ ID NO: 388815 - DNA, 20 bp, Artificial Sequence
  chemically synthesized
taaattggtgggagtctttc

SEQ ID NO: 388816 - DNA, 20 bp, Artificial Sequence
  chemically synthesized
agttacagttaaattggtgg

SEQ ID NO: 388817 - DNA, 20 bp, Artificial Sequence
  chemically synthesized
cgagttacagttaaattggt

SEQ ID NO: 388818 - DNA, 20 bp, Artificial Sequence
  chemically synthesized
ccgagttacagttaaattgg

SEQ ID NO: 388819 - DNA, 20 bp, Artificial Sequence
  chemically synthesized
catccgagttacagttaaat

SEQ ID NO: 388820 - DNA, 20 bp, Artificial Sequence
  chemically synthesized
ccaccaatttaactgtaact

SEQ ID NO: 388821 - DNA, 20 bp, Artificial Sequence
  chemically synthesized
ggaaatcaacatccgagtta

SEQ ID NO: 388822 - DNA, 20 bp, Artificial Sequence
  chemically synthesized
gtgttaggaaatcaacatcc

SEQ ID NO: 388823 - DNA, 20 bp, Artificial Sequence
  chemically synthesized
ggatgttgatttcctaacac

SEQ ID NO: 388824 - DNA, 20 bp, Artificial Sequence
  chemically synthesized
taatgggaggaacttgtgtt

SEQ ID NO: 388825 - DNA, 20 bp, Artificial Sequence
  chemically synthesized
ataatgggaggaacttgtgt

SEQ ID NO: 388826 - DNA, 20 bp, Artificial Sequence
  chemically synthesized
taggtaaattaaataatggg

SEQ ID NO: 388827 - DNA, 20 bp, Artificial Sequence
  chemically synthesized
ttaggtaaattaaataatgg

SEQ ID NO: 388828 - DNA, 20 bp, Artificial Sequence
  chemically synthesized
ccttaggtaaattaaataat

SEQ ID NO: 388829 - DNA, 20 bp, Artificial Sequence
  chemically synthesized
tccttaggtaaattaaataa

SEQ ID NO: 388830 - DNA, 20 bp, Artificial Sequence
  chemically synthesized
tcccattatttaatttacct

SEQ ID NO: 388831 - DNA, 20 bp, Artificial Sequence
  chemically synthesized
cccattatttaatttaccta

SEQ ID NO: 388832 - DNA, 20 bp, Artificial Sequence
  chemically synthesized
taaggtaactgatagtcctt

SEQ ID NO: 388833 - DNA, 20 bp, Artificial Sequence
  chemically synthesized
ttaaggtaactgatagtcct

SEQ ID NO: 388834 - DNA, 20 bp, Artificial Sequence
  chemically synthesized
ttaatttacctaaggactat

SEQ ID NO: 388835 - DNA, 20 bp, Artificial Sequence
  chemically synthesized
ttttccattaaggtaactga

SEQ ID NO: 388836 - DNA, 20 bp, Artificial Sequence
  chemically synthesized
aggactatcagttaccttaa

SEQ ID NO: 388837 - DNA, 20 bp, Artificial Sequence
  chemically synthesized
agtggaagggttttccatta

SEQ ID NO: 388838 - DNA, 20 bp, Artificial Sequence
  chemically synthesized
aagtggaagggttttccatt

SEQ ID NO: 388839 - DNA, 20 bp, Artificial Sequence
  chemically synthesized
tagagatataataagtggaa

SEQ ID NO: 388840 - DNA, 20 bp, Artificial Sequence
  chemically synthesized
ttagagatataataagtgga

SEQ ID NO: 388841 - DNA, 20 bp, Artificial Sequence
  chemically synthesized
cttagagatataataagtgg

SEQ ID NO: 388842 - DNA, 20 bp, Artificial Sequence
  chemically synthesized
taacttagagatataataag

SEQ ID NO: 388843 - DNA, 20 bp, Artificial Sequence
  chemically synthesized
agataacttagagatataat

SEQ ID NO: 388844 - DNA, 20 bp, Artificial Sequence
  chemically synthesized
cttccacttattatatctct

SEQ ID NO: 388845 - DNA, 20 bp, Artificial Sequence
  chemically synthesized
catgattgttagataactta

SEQ ID NO: 388846 - DNA, 20 bp, Artificial Sequence
  chemically synthesized
gacatgattgttagataact

SEQ ID NO: 388847 - DNA, 20 bp, Artificial Sequence
  chemically synthesized
ttcttaagagacatgattgt

SEQ ID NO: 388848 - DNA, 20 bp, Artificial Sequence
  chemically synthesized
atctaacaatcatgtctctt

SEQ ID NO: 388849 - DNA, 20 bp, Artificial Sequence
  chemically synthesized
aaaaatatatattttcttaa

SEQ ID NO: 388850 - DNA, 20 bp, Artificial Sequence
  chemically synthesized
ataaaaatatatattttctt

SEQ ID NO: 388851 - DNA, 20 bp, Artificial Sequence
  chemically synthesized
aaaatatatatttttatctc

SEQ ID NO: 388852 - DNA, 20 bp, Artificial Sequence
  chemically synthesized
atcttaacttgagattactt

SEQ ID NO: 388853 - DNA, 20 bp, Artificial Sequence
  chemically synthesized
tttttatctcaagtaatctc

SEQ ID NO: 388854 - DNA, 20 bp, Artificial Sequence
  chemically synthesized
atctcaagtaatctcaagtt

SEQ ID NO: 388855 - DNA, 20 bp, Artificial Sequence
  chemically synthesized
aaaggtagtaatcttaactt

SEQ ID NO: 388856 - DNA, 20 bp, Artificial Sequence
  chemically synthesized
ataaacattttagttaaagg

SEQ ID NO: 388857 - DNA, 20 bp, Artificial Sequence
  chemically synthesized
tggataaacattttagttaa

SEQ ID NO: 388858 - DNA, 20 bp, Artificial Sequence
  chemically synthesized
atggataaacattttagtta

SEQ ID NO: 388859 - DNA, 20 bp, Artificial Sequence
  chemically synthesized
aattgaatggataaacattt

SEQ ID NO: 388860 - DNA, 20 bp, Artificial Sequence
  chemically synthesized
tttaataaattttaattgaa

SEQ ID NO: 388861 - DNA, 20 bp, Artificial Sequence
  chemically synthesized
cattcaattaaaatttatta

SEQ ID NO: 388862 - DNA, 20 bp, Artificial Sequence
  chemically synthesized
caattaaaatttattaaagt

SEQ ID NO: 388863 - DNA, 20 bp, Artificial Sequence
  chemically synthesized
attaaagtcagctttgcaaa

SEQ ID NO: 388864 - DNA, 20 bp, Artificial Sequence
  chemically synthesized
aataagaaataccatttgca

SEQ ID NO: 388865 - DNA, 20 bp, Artificial Sequence
  chemically synthesized
atgaaaggaagaagaaaaat

SEQ ID NO: 388866 - DNA, 20 bp, Artificial Sequence
  chemically synthesized
tgtacacatatgaaaggaag

SEQ ID NO: 388867 - DNA, 20 bp, Artificial Sequence
  chemically synthesized
ttttgtacacatatgaaagg

SEQ ID NO: 388868 - DNA, 20 bp, Artificial Sequence
  chemically synthesized
atattttgtacacatatgaa

SEQ ID NO: 388869 - DNA, 20 bp, Artificial Sequence
  chemically synthesized
aatattttgtacacatatga

SEQ ID NO: 388870 - DNA, 20 bp, Artificial Sequence
  chemically synthesized
tacaaaatattaattcaacc

SEQ ID NO: 388871 - DNA, 20 bp, Artificial Sequence
  chemically synthesized
aaaatattaattcaacccag

SEQ ID NO: 388872 - DNA, 20 bp, Artificial Sequence
  chemically synthesized
tagggaggaaaaacacttct

SEQ ID NO: 388873 - DNA, 20 bp, Artificial Sequence
  chemically synthesized
gtagggaggaaaaacacttc

SEQ ID NO: 388874 - DNA, 20 bp, Artificial Sequence
  chemically synthesized
gaagtgtttttcctccctac

SEQ ID NO: 388875 - DNA, 20 bp, Artificial Sequence
  chemically synthesized
agattacctttctggtaggg

SEQ ID NO: 388876 - DNA, 20 bp, Artificial Sequence
  chemically synthesized
aagattacctttctggtagg

SEQ ID NO: 388877 - DNA, 20 bp, Artificial Sequence
  chemically synthesized
tgtttttcctccctaccaga

SEQ ID NO: 388878 - DNA, 20 bp, Artificial Sequence
  chemically synthesized
ataagattacctttctggta

SEQ ID NO: 388879 - DNA, 20 bp, Artificial Sequence
  chemically synthesized
gtttttcctccctaccagaa

SEQ ID NO: 388880 - DNA, 20 bp, Artificial Sequence
  chemically synthesized
aataagattacctttctggt

SEQ ID NO: 388881 - DNA, 20 bp, Artificial Sequence
  chemically synthesized
caataagattacctttctgg

SEQ ID NO: 388882 - DNA, 20 bp, Artificial Sequence
  chemically synthesized
aaccaataagattacctttc

SEQ ID NO: 388883 - DNA, 20 bp, Artificial Sequence
  chemically synthesized
taccagaaaggtaatcttat

SEQ ID NO: 388884 - DNA, 20 bp, Artificial Sequence
  chemically synthesized
gaggtaataaattaaccaat

SEQ ID NO: 388885 - DNA, 20 bp, Artificial Sequence
  chemically synthesized
atgtagaagttaagtgaatg

SEQ ID NO: 388886 - DNA, 20 bp, Artificial Sequence
  chemically synthesized
catgtagaagttaagtgaat

SEQ ID NO: 388887 - DNA, 20 bp, Artificial Sequence
  chemically synthesized
ctgggtaacatgtagaagtt

SEQ ID NO: 388888 - DNA, 20 bp, Artificial Sequence
  chemically synthesized
tttatctgggtaacatgtag

SEQ ID NO: 388889 - DNA, 20 bp, Artificial Sequence
  chemically synthesized
tagtttatctgggtaacatg

SEQ ID NO: 388890 - DNA, 20 bp, Artificial Sequence
  chemically synthesized
cttaacttctacatgttacc

SEQ ID NO: 388891 - DNA, 20 bp, Artificial Sequence
  chemically synthesized
ctggttacaatagtttatct

SEQ ID NO: 388892 - DNA, 20 bp, Artificial Sequence
  chemically synthesized
tctggttacaatagtttatc

SEQ ID NO: 388893 - DNA, 20 bp, Artificial Sequence
  chemically synthesized
cccagataaactattgtaac

SEQ ID NO: 388894 - DNA, 20 bp, Artificial Sequence
  chemically synthesized
aatgtaagttctggttacaa

SEQ ID NO: 388895 - DNA, 20 bp, Artificial Sequence
  chemically synthesized
aatcgtaataatgtaagttc

SEQ ID NO: 388896 - DNA, 20 bp, Artificial Sequence
  chemically synthesized
tattgcaatcgtaataatgt

SEQ ID NO: 388897 - DNA, 20 bp, Artificial Sequence
  chemically synthesized
ttttctcctaaatagcaggt

SEQ ID NO: 388898 - DNA, 20 bp, Artificial Sequence
  chemically synthesized
attattaccaacctgctatt

SEQ ID NO: 388899 - DNA, 20 bp, Artificial Sequence
  chemically synthesized
ttattaccaacctgctattt

SEQ ID NO: 388900 - DNA, 20 bp, Artificial Sequence
  chemically synthesized
tgttttttctcctaaatagc

SEQ ID NO: 388901 - DNA, 20 bp, Artificial Sequence
  chemically synthesized
gtgttttttctcctaaatag

SEQ ID NO: 388902 - DNA, 20 bp, Artificial Sequence
  chemically synthesized
attaccaacctgctatttag

SEQ ID NO: 388903 - DNA, 20 bp, Artificial Sequence
  chemically synthesized
gaagtgttttttctcctaaa

SEQ ID NO: 388904 - DNA, 20 bp, Artificial Sequence
  chemically synthesized
ttaggagaaaaaacacttct

SEQ ID NO: 388905 - DNA, 20 bp, Artificial Sequence
  chemically synthesized
ctgcatttatgatatctaag

SEQ ID NO: 388906 - DNA, 20 bp, Artificial Sequence
  chemically synthesized
aagctgcatttatgatatct

SEQ ID NO: 388907 - DNA, 20 bp, Artificial Sequence
  chemically synthesized
cttcttagatatcataaatg

SEQ ID NO: 388908 - DNA, 20 bp, Artificial Sequence
  chemically synthesized
ataaatgcagctttaacatg

SEQ ID NO: 388909 - DNA, 20 bp, Artificial Sequence
  chemically synthesized
taaagcagttctgcatgtta

SEQ ID NO: 388910 - DNA, 20 bp, Artificial Sequence
  chemically synthesized
cctgtatgcctgttttaaag

SEQ ID NO: 388911 - DNA, 20 bp, Artificial Sequence
  chemically synthesized
catgcagaactgctttaaaa

SEQ ID NO: 388912 - DNA, 20 bp, Artificial Sequence
  chemically synthesized
atgcagaactgctttaaaac

SEQ ID NO: 388913 - DNA, 20 bp, Artificial Sequence
  chemically synthesized
attcctgtatgcctgtttta

SEQ ID NO: 388914 - DNA, 20 bp, Artificial Sequence
  chemically synthesized
actgctttaaaacaggcata

SEQ ID NO: 388915 - DNA, 20 bp, Artificial Sequence
  chemically synthesized
ctgctttaaaacaggcatac

SEQ ID NO: 388916 - DNA, 20 bp, Artificial Sequence
  chemically synthesized
acaggcatacaggaattttt

SEQ ID NO: 388917 - DNA, 20 bp, Artificial Sequence
  chemically synthesized
caggcatacaggaatttttt

SEQ ID NO: 388918 - DNA, 20 bp, Artificial Sequence
  chemically synthesized
aggcatacaggaattttttg

SEQ ID NO: 388919 - DNA, 20 bp, Artificial Sequence
  chemically synthesized
ggcatacaggaattttttgg

SEQ ID NO: 388920 - DNA, 20 bp, Artificial Sequence
  chemically synthesized
gcatacaggaattttttggg

SEQ ID NO: 388921 - DNA, 20 bp, Artificial Sequence
  chemically synthesized
catacaggaattttttgggg

SEQ ID NO: 388922 - DNA, 20 bp, Artificial Sequence
  chemically synthesized
atacaggaattttttggggg

SEQ ID NO: 388923 - DNA, 20 bp, Artificial Sequence
  chemically synthesized
ggaattttttggggggggat

SEQ ID NO: 388924 - DNA, 20 bp, Artificial Sequence
  chemically synthesized
gaattttttggggggggatg

SEQ ID NO: 388925 - DNA, 20 bp, Artificial Sequence
  chemically synthesized
aattttttggggggggatga

SEQ ID NO: 388926 - DNA, 20 bp, Artificial Sequence
  chemically synthesized
attttttggggggggatgag

SEQ ID NO: 388927 - DNA, 20 bp, Artificial Sequence
  chemically synthesized
tgttatttttaatatgtcta

SEQ ID NO: 388928 - DNA, 20 bp, Artificial Sequence
  chemically synthesized
gttatttttaatatgtctaa

SEQ ID NO: 388929 - DNA, 20 bp, Artificial Sequence
  chemically synthesized
ttcattaaatgtattacctt

SEQ ID NO: 388930 - DNA, 20 bp, Artificial Sequence
  chemically synthesized
aacttattataaatattgta

SEQ ID NO: 388931 - DNA, 20 bp, Artificial Sequence
  chemically synthesized
aactatacaatatttataat

SEQ ID NO: 388932 - DNA, 20 bp, Artificial Sequence
  chemically synthesized
tttattttttcttaattatg

SEQ ID NO: 388933 - DNA, 20 bp, Artificial Sequence
  chemically synthesized
tacttacaaacttcataatt

SEQ ID NO: 388934 - DNA, 20 bp, Artificial Sequence
  chemically synthesized
ttcttaattatgaagtttgt

SEQ ID NO: 388935 - DNA, 20 bp, Artificial Sequence
  chemically synthesized
tatgaagtttgtaagtatat

SEQ ID NO: 388936 - DNA, 20 bp, Artificial Sequence
  chemically synthesized
atgaagtttgtaagtatatt

SEQ ID NO: 388937 - DNA, 20 bp, Artificial Sequence
  chemically synthesized
aagtttgtaagtatattagg

SEQ ID NO: 388938 - DNA, 20 bp, Artificial Sequence
  chemically synthesized
agtttgtaagtatattagga

SEQ ID NO: 388939 - DNA, 20 bp, Artificial Sequence
  chemically synthesized
ttaggaaggtaataacttca

SEQ ID NO: 388940 - DNA, 20 bp, Artificial Sequence
  chemically synthesized
gtgtctgccacattgctgtg

SEQ ID NO: 388941 - DNA, 20 bp, Artificial Sequence
  chemically synthesized
gtaataacttcacagcaatg

SEQ ID NO: 388942 - DNA, 20 bp, Artificial Sequence
  chemically synthesized
ataacttcacagcaatgtgg

SEQ ID NO: 388943 - DNA, 20 bp, Artificial Sequence
  chemically synthesized
tcacagcaatgtggcagaca

SEQ ID NO: 388944 - DNA, 20 bp, Artificial Sequence
  chemically synthesized
ggattgttttgaaaattaat

SEQ ID NO: 388945 - DNA, 20 bp, Artificial Sequence
  chemically synthesized
aattttcaaaacaatcctat

SEQ ID NO: 388946 - DNA, 20 bp, Artificial Sequence
  chemically synthesized
cttaagagtatatatctcat

SEQ ID NO: 388947 - DNA, 20 bp, Artificial Sequence
  chemically synthesized
tcttaagagtatatatctca

SEQ ID NO: 388948 - DNA, 20 bp, Artificial Sequence
  chemically synthesized
cctatgagatatatactctt

SEQ ID NO: 388949 - DNA, 20 bp, Artificial Sequence
  chemically synthesized
atttacaaaaggaatcttaa

SEQ ID NO: 388950 - DNA, 20 bp, Artificial Sequence
  chemically synthesized
tcatttacaaaaggaatctt

SEQ ID NO: 388951 - DNA, 20 bp, Artificial Sequence
  chemically synthesized
tcagtctattcatttacaaa

SEQ ID NO: 388952 - DNA, 20 bp, Artificial Sequence
  chemically synthesized
ctcagtctattcatttacaa

SEQ ID NO: 388953 - DNA, 20 bp, Artificial Sequence
  chemically synthesized
agattccttttgtaaatgaa

SEQ ID NO: 388954 - DNA, 20 bp, Artificial Sequence
  chemically synthesized
cttttgtaaatgaatagact

SEQ ID NO: 388955 - DNA, 20 bp, Artificial Sequence
  chemically synthesized
ttttgtaaatgaatagactg

SEQ ID NO: 388956 - DNA, 20 bp, Artificial Sequence
  chemically synthesized
aatgaatagactgaggcaca

SEQ ID NO: 388957 - DNA, 20 bp, Artificial Sequence
  chemically synthesized
tatttaccttctttgtgcct

SEQ ID NO: 388958 - DNA, 20 bp, Artificial Sequence
  chemically synthesized
gaatagactgaggcacaaag

SEQ ID NO: 388959 - DNA, 20 bp, Artificial Sequence
  chemically synthesized
aatagactgaggcacaaaga

SEQ ID NO: 388960 - DNA, 20 bp, Artificial Sequence
  chemically synthesized
agaaggtaaataatttgcct

SEQ ID NO: 388961 - DNA, 20 bp, Artificial Sequence
  chemically synthesized
aaggtaaataatttgcctga

SEQ ID NO: 388962 - DNA, 20 bp, Artificial Sequence
  chemically synthesized
tttgcgcactgaatgctctc

SEQ ID NO: 388963 - DNA, 20 bp, Artificial Sequence
  chemically synthesized
ctttgcgcactgaatgctct

SEQ ID NO: 388964 - DNA, 20 bp, Artificial Sequence
  chemically synthesized
ataatttgcctgagagcatt

SEQ ID NO: 388965 - DNA, 20 bp, Artificial Sequence
  chemically synthesized
ctgagagcattcagtgcgca

SEQ ID NO: 388966 - DNA, 20 bp, Artificial Sequence
  chemically synthesized
gcattcagtgcgcaaagtac

SEQ ID NO: 388967 - DNA, 20 bp, Artificial Sequence
  chemically synthesized
cattcagtgcgcaaagtaca

SEQ ID NO: 388968 - DNA, 20 bp, Artificial Sequence
  chemically synthesized
tctgaagccaaattcaaatt

SEQ ID NO: 388969 - DNA, 20 bp, Artificial Sequence
  chemically synthesized
ttctgaagccaaattcaaat

SEQ ID NO: 388970 - DNA, 20 bp, Artificial Sequence
  chemically synthesized
caaggcacctaatttgaatt

SEQ ID NO: 388971 - DNA, 20 bp, Artificial Sequence
  chemically synthesized
acctaatttgaatttggctt

SEQ ID NO: 388972 - DNA, 20 bp, Artificial Sequence
  chemically synthesized
ctattaagagttggattctg

SEQ ID NO: 388973 - DNA, 20 bp, Artificial Sequence
  chemically synthesized
agaatgtagctattaagagt

SEQ ID NO: 388974 - DNA, 20 bp, Artificial Sequence
  chemically synthesized
cttcagaatccaactcttaa

SEQ ID NO: 388975 - DNA, 20 bp, Artificial Sequence
  chemically synthesized
catcagaatgtagctattaa

SEQ ID NO: 388976 - DNA, 20 bp, Artificial Sequence
  chemically synthesized
gtcatcagaatgtagctatt

SEQ ID NO: 388977 - DNA, 20 bp, Artificial Sequence
  chemically synthesized
gatctagggtcatcagaatg

SEQ ID NO: 388978 - DNA, 20 bp, Artificial Sequence
  chemically synthesized
tagctacattctgatgaccc

SEQ ID NO: 388979 - DNA, 20 bp, Artificial Sequence
  chemically synthesized
gtccctggatctagggtcat

SEQ ID NO: 388980 - DNA, 20 bp, Artificial Sequence
  chemically synthesized
cattctgatgaccctagatc

SEQ ID NO: 388981 - DNA, 20 bp, Artificial Sequence
  chemically synthesized
attctgatgaccctagatcc

SEQ ID NO: 388982 - DNA, 20 bp, Artificial Sequence
  chemically synthesized
gagaagagtccctggatcta

SEQ ID NO: 388983 - DNA, 20 bp, Artificial Sequence
  chemically synthesized
ttctgatgaccctagatcca

SEQ ID NO: 388984 - DNA, 20 bp, Artificial Sequence
  chemically synthesized
tgagaagagtccctggatct

SEQ ID NO: 388985 - DNA, 20 bp, Artificial Sequence
  chemically synthesized
atgagaagagtccctggatc

SEQ ID NO: 388986 - DNA, 20 bp, Artificial Sequence
  chemically synthesized
aattggatgagaagagtccc

SEQ ID NO: 388987 - DNA, 20 bp, Artificial Sequence
  chemically synthesized
aaaccggaattggatgagaa

SEQ ID NO: 388988 - DNA, 20 bp, Artificial Sequence
  chemically synthesized
caaaaccggaattggatgag

SEQ ID NO: 388989 - DNA, 20 bp, Artificial Sequence
  chemically synthesized
caacaaaaccggaattggat

SEQ ID NO: 388990 - DNA, 20 bp, Artificial Sequence
  chemically synthesized
ggactcttctcatccaattc

SEQ ID NO: 388991 - DNA, 20 bp, Artificial Sequence
  chemically synthesized
aaacacaacaaaaccggaat

SEQ ID NO: 388992 - DNA, 20 bp, Artificial Sequence
  chemically synthesized
tacataaaacacaacaaaac

SEQ ID NO: 388993 - DNA, 20 bp, Artificial Sequence
  chemically synthesized
ttatgtaaaacacaccactg

SEQ ID NO: 388994 - DNA, 20 bp, Artificial Sequence
  chemically synthesized
tatgtaaaacacaccactgt

SEQ ID NO: 388995 - DNA, 20 bp, Artificial Sequence
  chemically synthesized
tggaatctgataacccacag

SEQ ID NO: 388996 - DNA, 20 bp, Artificial Sequence
  chemically synthesized
aattggaatctgataaccca

SEQ ID NO: 388997 - DNA, 20 bp, Artificial Sequence
  chemically synthesized
aacacaccactgtgggttat

SEQ ID NO: 388998 - DNA, 20 bp, Artificial Sequence
  chemically synthesized
ctcaagacaatgaacaaaat

SEQ ID NO: 388999 - DNA, 20 bp, Artificial Sequence
  chemically synthesized
ccaattttgttcattgtctt

SEQ ID NO: 389000 - DNA, 20 bp, Artificial Sequence
  chemically synthesized
caattttgttcattgtcttg

SEQ ID NO: 389001 - DNA, 20 bp, Artificial Sequence
  chemically synthesized
aggtaaatgataaaatcctc

SEQ ID NO: 389002 - DNA, 20 bp, Artificial Sequence
  chemically synthesized
cagaattcagtttagtttac

SEQ ID NO: 389003 - DNA, 20 bp, Artificial Sequence
  chemically synthesized
gcagaattcagtttagttta

SEQ ID NO: 389004 - DNA, 20 bp, Artificial Sequence
  chemically synthesized
tgagatggcagaattcagtt

SEQ ID NO: 389005 - DNA, 20 bp, Artificial Sequence
  chemically synthesized
atgggtgagatggcagaatt

SEQ ID NO: 389006 - DNA, 20 bp, Artificial Sequence
  chemically synthesized
tggcaaaatgggtgagatgg

SEQ ID NO: 389007 - DNA, 20 bp, Artificial Sequence
  chemically synthesized
gagtggcaaaatgggtgaga

SEQ ID NO: 389008 - DNA, 20 bp, Artificial Sequence
  chemically synthesized
gtaagagtggcaaaatgggt

SEQ ID NO: 389009 - DNA, 20 bp, Artificial Sequence
  chemically synthesized
tttagtaagagtggcaaaat

SEQ ID NO: 389010 - DNA, 20 bp, Artificial Sequence
  chemically synthesized
atttagtaagagtggcaaaa

SEQ ID NO: 389011 - DNA, 20 bp, Artificial Sequence
  chemically synthesized
aattgagtatttagtaagag

SEQ ID NO: 389012 - DNA, 20 bp, Artificial Sequence
  chemically synthesized
aacaattgagtatttagtaa

SEQ ID NO: 389013 - DNA, 20 bp, Artificial Sequence
  chemically synthesized
taaacaattgagtatttagt

SEQ ID NO: 389014 - DNA, 20 bp, Artificial Sequence
  chemically synthesized
aaactaaacaattgagtatt

SEQ ID NO: 389015 - DNA, 20 bp, Artificial Sequence
  chemically synthesized
ttactaaatactcaattgtt

SEQ ID NO: 389016 - DNA, 20 bp, Artificial Sequence
  chemically synthesized
tgaaggaaaactaaacaatt

SEQ ID NO: 389017 - DNA, 20 bp, Artificial Sequence
  chemically synthesized
gtttagttttccttcaatat

SEQ ID NO: 389018 - DNA, 20 bp, Artificial Sequence
  chemically synthesized
gagatgtagcccgatattga

SEQ ID NO: 389019 - DNA, 20 bp, Artificial Sequence
  chemically synthesized
tttagttttccttcaatatc

SEQ ID NO: 389020 - DNA, 20 bp, Artificial Sequence
  chemically synthesized
agagatgtagcccgatattg

SEQ ID NO: 389021 - DNA, 20 bp, Artificial Sequence
  chemically synthesized
aacatcaatttggagagatg

SEQ ID NO: 389022 - DNA, 20 bp, Artificial Sequence
  chemically synthesized
attataaacatcaatttgga

SEQ ID NO: 389023 - DNA, 20 bp, Artificial Sequence
  chemically synthesized
aaattataaacatcaatttg

SEQ ID NO: 389024 - DNA, 20 bp, Artificial Sequence
  chemically synthesized
aaaaattataaacatcaatt

SEQ ID NO: 389025 - DNA, 20 bp, Artificial Sequence
  chemically synthesized
tgatgtcaagtcaagaggga

SEQ ID NO: 389026 - DNA, 20 bp, Artificial Sequence
  chemically synthesized
gtgatgtcaagtcaagaggg

SEQ ID NO: 389027 - DNA, 20 bp, Artificial Sequence
  chemically synthesized
tcagtgatgtcaagtcaaga

SEQ ID NO: 389028 - DNA, 20 bp, Artificial Sequence
  chemically synthesized
ctcagtgatgtcaagtcaag

SEQ ID NO: 389029 - DNA, 20 bp, Artificial Sequence
  chemically synthesized
tctcagtgatgtcaagtcaa

SEQ ID NO: 389030 - DNA, 20 bp, Artificial Sequence
  chemically synthesized
attctcagtgatgtcaagtc

SEQ ID NO: 389031 - DNA, 20 bp, Artificial Sequence
  chemically synthesized
ttttaattctcagtgatgtc

SEQ ID NO: 389032 - DNA, 20 bp, Artificial Sequence
  chemically synthesized
cctcttgacttgacatcact

SEQ ID NO: 389033 - DNA, 20 bp, Artificial Sequence
  chemically synthesized
ggcagtcagattttaattct

SEQ ID NO: 389034 - DNA, 20 bp, Artificial Sequence
  chemically synthesized
ccagtaaggatttgggcagt

SEQ ID NO: 389035 - DNA, 20 bp, Artificial Sequence
  chemically synthesized
agtcccagtaaggatttggg

SEQ ID NO: 389036 - DNA, 20 bp, Artificial Sequence
  chemically synthesized
aggagtcccagtaaggattt

SEQ ID NO: 389037 - DNA, 20 bp, Artificial Sequence
  chemically synthesized
taggagtcccagtaaggatt

SEQ ID NO: 389038 - DNA, 20 bp, Artificial Sequence
  chemically synthesized
ctgactgcccaaatccttac

SEQ ID NO: 389039 - DNA, 20 bp, Artificial Sequence
  chemically synthesized
tgactgcccaaatccttact

SEQ ID NO: 389040 - DNA, 20 bp, Artificial Sequence
  chemically synthesized
aggttgtaggagtcccagta

SEQ ID NO: 389041 - DNA, 20 bp, Artificial Sequence
  chemically synthesized
taggttgtaggagtcccagt

SEQ ID NO: 389042 - DNA, 20 bp, Artificial Sequence
  chemically synthesized
tcagtaggttgtaggagtcc

SEQ ID NO: 389043 - DNA, 20 bp, Artificial Sequence
  chemically synthesized
gtagaatcagtaggttgtag

SEQ ID NO: 389044 - DNA, 20 bp, Artificial Sequence
  chemically synthesized
cagtagaatcagtaggttgt

SEQ ID NO: 389045 - DNA, 20 bp, Artificial Sequence
  chemically synthesized
ccagtagaatcagtaggttg

SEQ ID NO: 389046 - DNA, 20 bp, Artificial Sequence
  chemically synthesized
gttgtcccagtagaatcagt

SEQ ID NO: 389047 - DNA, 20 bp, Artificial Sequence
  chemically synthesized
ggttgtcccagtagaatcag

SEQ ID NO: 389048 - DNA, 20 bp, Artificial Sequence
  chemically synthesized
ctacaacctactgattctac

SEQ ID NO: 389049 - DNA, 20 bp, Artificial Sequence
  chemically synthesized
gtaggttgtcccagtagaat

SEQ ID NO: 389050 - DNA, 20 bp, Artificial Sequence
  chemically synthesized
tacaacctactgattctact

SEQ ID NO: 389051 - DNA, 20 bp, Artificial Sequence
  chemically synthesized
aaccttgtaggttgtcccag

SEQ ID NO: 389052 - DNA, 20 bp, Artificial Sequence
  chemically synthesized
gacaaccttgtaggttgtcc

SEQ ID NO: 389053 - DNA, 20 bp, Artificial Sequence
  chemically synthesized
attctactgggacaacctac

SEQ ID NO: 389054 - DNA, 20 bp, Artificial Sequence
  chemically synthesized
ttctactgggacaacctaca

SEQ ID NO: 389055 - DNA, 20 bp, Artificial Sequence
  chemically synthesized
cagctacaagacaaccttgt

SEQ ID NO: 389056 - DNA, 20 bp, Artificial Sequence
  chemically synthesized
acagctacaagacaaccttg

SEQ ID NO: 389057 - DNA, 20 bp, Artificial Sequence
  chemically synthesized
caacctacaaggttgtcttg

SEQ ID NO: 389058 - DNA, 20 bp, Artificial Sequence
  chemically synthesized
tgggggagaaagacagctac

SEQ ID NO: 389059 - DNA, 20 bp, Artificial Sequence
  chemically synthesized
caaatcctgggggagaaaga

SEQ ID NO: 389060 - DNA, 20 bp, Artificial Sequence
  chemically synthesized
ttgtagctgtctttctcccc

SEQ ID NO: 389061 - DNA, 20 bp, Artificial Sequence
  chemically synthesized
ttttcaaatcctgggggaga

SEQ ID NO: 389062 - DNA, 20 bp, Artificial Sequence
  chemically synthesized
tgtagctgtctttctccccc

SEQ ID NO: 389063 - DNA, 20 bp, Artificial Sequence
  chemically synthesized
ggctttttcaaatcctgggg

SEQ ID NO: 389064 - DNA, 20 bp, Artificial Sequence
  chemically synthesized
aaggctttttcaaatcctgg

SEQ ID NO: 389065 - DNA, 20 bp, Artificial Sequence
  chemically synthesized
caaggctttttcaaatcctg

SEQ ID NO: 389066 - DNA, 20 bp, Artificial Sequence
  chemically synthesized
gcaaggctttttcaaatcct

SEQ ID NO: 389067 - DNA, 20 bp, Artificial Sequence
  chemically synthesized
tgcaaggctttttcaaatcc

SEQ ID NO: 389068 - DNA, 20 bp, Artificial Sequence
  chemically synthesized
ttctcccccaggatttgaaa

SEQ ID NO: 389069 - DNA, 20 bp, Artificial Sequence
  chemically synthesized
ttcttgggcttcagtgtgca

SEQ ID NO: 389070 - DNA, 20 bp, Artificial Sequence
  chemically synthesized
gttcttgggcttcagtgtgc

SEQ ID NO: 389071 - DNA, 20 bp, Artificial Sequence
  chemically synthesized
tgaaaaagccttgcacactg

SEQ ID NO: 389072 - DNA, 20 bp, Artificial Sequence
  chemically synthesized
agccttgcacactgaagccc

SEQ ID NO: 389073 - DNA, 20 bp, Artificial Sequence
  chemically synthesized
tatatcaagttcttgggctt

SEQ ID NO: 389074 - DNA, 20 bp, Artificial Sequence
  chemically synthesized
gaagtttatatcaagttctt

SEQ ID NO: 389075 - DNA, 20 bp, Artificial Sequence
  chemically synthesized
tgaagtttatatcaagttct

SEQ ID NO: 389076 - DNA, 20 bp, Artificial Sequence
  chemically synthesized
agtcttttgaagtttatatc

SEQ ID NO: 389077 - DNA, 20 bp, Artificial Sequence
  chemically synthesized
gaacttgatataaacttcaa

SEQ ID NO: 389078 - DNA, 20 bp, Artificial Sequence
  chemically synthesized
ttgtggtggtaagtcttttg

SEQ ID NO: 389079 - DNA, 20 bp, Artificial Sequence
  chemically synthesized
acgtgatttgttgtggtggt

SEQ ID NO: 389080 - DNA, 20 bp, Artificial Sequence
  chemically synthesized
ctatacgtgatttgttgtgg

SEQ ID NO: 389081 - DNA, 20 bp, Artificial Sequence
  chemically synthesized
tgcctatacgtgatttgttg

SEQ ID NO: 389082 - DNA, 20 bp, Artificial Sequence
  chemically synthesized
ccaccacaacaaatcacgta

SEQ ID NO: 389083 - DNA, 20 bp, Artificial Sequence
  chemically synthesized
caccacaacaaatcacgtat

SEQ ID NO: 389084 - DNA, 20 bp, Artificial Sequence
  chemically synthesized
gtataggcaaccttcatgcc

SEQ ID NO: 389085 - DNA, 20 bp, Artificial Sequence
  chemically synthesized
agcaggagctccaggcatga

SEQ ID NO: 389086 - DNA, 20 bp, Artificial Sequence
  chemically synthesized
tagcaggagctccaggcatg

SEQ ID NO: 389087 - DNA, 20 bp, Artificial Sequence
  chemically synthesized
ataggcaaccttcatgcctg

SEQ ID NO: 389088 - DNA, 20 bp, Artificial Sequence
  chemically synthesized
gctcttgtagcaggagctcc

SEQ ID NO: 389089 - DNA, 20 bp, Artificial Sequence
  chemically synthesized
ggctcttgtagcaggagctc

SEQ ID NO: 389090 - DNA, 20 bp, Artificial Sequence
  chemically synthesized
atgcctggagctcctgctac

SEQ ID NO: 389091 - DNA, 20 bp, Artificial Sequence
  chemically synthesized
ctgaatggctcttgtagcag

SEQ ID NO: 389092 - DNA, 20 bp, Artificial Sequence
  chemically synthesized
gcctggagctcctgctacaa

SEQ ID NO: 389093 - DNA, 20 bp, Artificial Sequence
  chemically synthesized
ttctgaatggctcttgtagc

SEQ ID NO: 389094 - DNA, 20 bp, Artificial Sequence
  chemically synthesized
tttctgaatggctcttgtag

SEQ ID NO: 389095 - DNA, 20 bp, Artificial Sequence
  chemically synthesized
gactttctgaatggctcttg

SEQ ID NO: 389096 - DNA, 20 bp, Artificial Sequence
  chemically synthesized
ctcctgctacaagagccatt

SEQ ID NO: 389097 - DNA, 20 bp, Artificial Sequence
  chemically synthesized
tgctacaagagccattcaga

SEQ ID NO: 389098 - DNA, 20 bp, Artificial Sequence
  chemically synthesized
gttccagtggactttctgaa

SEQ ID NO: 389099 - DNA, 20 bp, Artificial Sequence
  chemically synthesized
gagccattcagaaagtccac

SEQ ID NO: 389100 - DNA, 20 bp, Artificial Sequence
  chemically synthesized
ggatgatgctggagttccag

SEQ ID NO: 389101 - DNA, 20 bp, Artificial Sequence
  chemically synthesized
cagaaagtccactggaactc

SEQ ID NO: 389102 - DNA, 20 bp, Artificial Sequence
  chemically synthesized
cacggatgatgctggagttc

SEQ ID NO: 389103 - DNA, 20 bp, Artificial Sequence
  chemically synthesized
acagaacacggatgatgctg

SEQ ID NO: 389104 - DNA, 20 bp, Artificial Sequence
  chemically synthesized
gaacagaacacggatgatgc

SEQ ID NO: 389105 - DNA, 20 bp, Artificial Sequence
  chemically synthesized
ttatttcctggaacagaaca

SEQ ID NO: 389106 - DNA, 20 bp, Artificial Sequence
  chemically synthesized
gcatcatccgtgttctgttc

SEQ ID NO: 389107 - DNA, 20 bp, Artificial Sequence
  chemically synthesized
catcatccgtgttctgttcc

SEQ ID NO: 389108 - DNA, 20 bp, Artificial Sequence
  chemically synthesized
gtcatagttatttcctggaa

SEQ ID NO: 389109 - DNA, 20 bp, Artificial Sequence
  chemically synthesized
tcacagtcatagttatttcc

SEQ ID NO: 389110 - DNA, 20 bp, Artificial Sequence
  chemically synthesized
aaacattaatttcacagtca

SEQ ID NO: 389111 - DNA, 20 bp, Artificial Sequence
  chemically synthesized
tggcataaacattaatttca

SEQ ID NO: 389112 - DNA, 20 bp, Artificial Sequence
  chemically synthesized
ttatggtttgaatgtggtga

SEQ ID NO: 389113 - DNA, 20 bp, Artificial Sequence
  chemically synthesized
tctggtttatggtttgaatg

SEQ ID NO: 389114 - DNA, 20 bp, Artificial Sequence
  chemically synthesized
accacattcaaaccataaac

SEQ ID NO: 389115 - DNA, 20 bp, Artificial Sequence
  chemically synthesized
ctgatggattttctggttta

SEQ ID NO: 389116 - DNA, 20 bp, Artificial Sequence
  chemically synthesized
tggtaatctgatggattttc

SEQ ID NO: 389117 - DNA, 20 bp, Artificial Sequence
  chemically synthesized
ccataaaccagaaaatccat

SEQ ID NO: 389118 - DNA, 20 bp, Artificial Sequence
  chemically synthesized
atggtagagtggtaatctga

SEQ ID NO: 389119 - DNA, 20 bp, Artificial Sequence
  chemically synthesized
agcatcttcagatggtagag

SEQ ID NO: 389120 - DNA, 20 bp, Artificial Sequence
  chemically synthesized
ctaagcatcttcagatggta

SEQ ID NO: 389121 - DNA, 20 bp, Artificial Sequence
  chemically synthesized
gattaccactctaccatctg

SEQ ID NO: 389122 - DNA, 20 bp, Artificial Sequence
  chemically synthesized
ttctaagcatcttcagatgg

SEQ ID NO: 389123 - DNA, 20 bp, Artificial Sequence
  chemically synthesized
gaattctaagcatcttcaga

SEQ ID NO: 389124 - DNA, 20 bp, Artificial Sequence
  chemically synthesized
cattgaattctaagcatctt

SEQ ID NO: 389125 - DNA, 20 bp, Artificial Sequence
  chemically synthesized
ctctaccatctgaagatgct

SEQ ID NO: 389126 - DNA, 20 bp, Artificial Sequence
  chemically synthesized
ttttctagacattgaattct

SEQ ID NO: 389127 - DNA, 20 bp, Artificial Sequence
  chemically synthesized
gatgcttagaattcaatgtc

SEQ ID NO: 389128 - DNA, 20 bp, Artificial Sequence
  chemically synthesized
caggcagttaagaagttttc

SEQ ID NO: 389129 - DNA, 20 bp, Artificial Sequence
  chemically synthesized
ctagagggcaggcagttaag

SEQ ID NO: 389130 - DNA, 20 bp, Artificial Sequence
  chemically synthesized
agtctagagggcaggcagtt

SEQ ID NO: 389131 - DNA, 20 bp, Artificial Sequence
  chemically synthesized
tgttgagtctagagggcagg

SEQ ID NO: 389132 - DNA, 20 bp, Artificial Sequence
  chemically synthesized
cttcttaactgcctgccctc

SEQ ID NO: 389133 - DNA, 20 bp, Artificial Sequence
  chemically synthesized
atttgttgagtctagagggc

SEQ ID NO: 389134 - DNA, 20 bp, Artificial Sequence
  chemically synthesized
tatttgttgagtctagaggg

SEQ ID NO: 389135 - DNA, 20 bp, Artificial Sequence
  chemically synthesized
tcctatttgttgagtctaga

SEQ ID NO: 389136 - DNA, 20 bp, Artificial Sequence
  chemically synthesized
atcctatttgttgagtctag

SEQ ID NO: 389137 - DNA, 20 bp, Artificial Sequence
  chemically synthesized
aatcctatttgttgagtcta

SEQ ID NO: 389138 - DNA, 20 bp, Artificial Sequence
  chemically synthesized
taaatcctatttgttgagtc

SEQ ID NO: 389139 - DNA, 20 bp, Artificial Sequence
  chemically synthesized
tgccctctagactcaacaaa

SEQ ID NO: 389140 - DNA, 20 bp, Artificial Sequence
  chemically synthesized
gccctctagactcaacaaat

SEQ ID NO: 389141 - DNA, 20 bp, Artificial Sequence
  chemically synthesized
gaatataaatcctatttgtt

SEQ ID NO: 389142 - DNA, 20 bp, Artificial Sequence
  chemically synthesized
gatttatattcttctccaac

SEQ ID NO: 389143 - DNA, 20 bp, Artificial Sequence
  chemically synthesized
aaaacaaaaacttgttggag

SEQ ID NO: 389144 - DNA, 20 bp, Artificial Sequence
  chemically synthesized
ataaaaacaaaaacttgttg

SEQ ID NO: 389145 - DNA, 20 bp, Artificial Sequence
  chemically synthesized
acataaaaacaaaaacttgt

SEQ ID NO: 389146 - DNA, 20 bp, Artificial Sequence
  chemically synthesized
tgtttttatgtttgtttcca

SEQ ID NO: 389147 - DNA, 20 bp, Artificial Sequence
  chemically synthesized
tttttatgtttgtttccata

SEQ ID NO: 389148 - DNA, 20 bp, Artificial Sequence
  chemically synthesized
ttttatgtttgtttccatag

SEQ ID NO: 389149 - DNA, 20 bp, Artificial Sequence
  chemically synthesized
tttaatgagaggcacctcta

SEQ ID NO: 389150 - DNA, 20 bp, Artificial Sequence
  chemically synthesized
gtgatcaggcatttaatgag

SEQ ID NO: 389151 - DNA, 20 bp, Artificial Sequence
  chemically synthesized
cgtgatcaggcatttaatga

SEQ ID NO: 389152 - DNA, 20 bp, Artificial Sequence
  chemically synthesized
cacgtgatcaggcatttaat

SEQ ID NO: 389153 - DNA, 20 bp, Artificial Sequence
  chemically synthesized
gctggatgatgcacgtgatc

SEQ ID NO: 389154 - DNA, 20 bp, Artificial Sequence
  chemically synthesized
tgctggatgatgcacgtgat

SEQ ID NO: 389155 - DNA, 20 bp, Artificial Sequence
  chemically synthesized
gcctgatcacgtgcatcatc

SEQ ID NO: 389156 - DNA, 20 bp, Artificial Sequence
  chemically synthesized
tgctagtagagcatagttgc

SEQ ID NO: 389157 - DNA, 20 bp, Artificial Sequence
  chemically synthesized
tgagacttgctagtagagca

SEQ ID NO: 389158 - DNA, 20 bp, Artificial Sequence
  chemically synthesized
atccagcaactatgctctac

SEQ ID NO: 389159 - DNA, 20 bp, Artificial Sequence
  chemically synthesized
agcaactatgctctactagc

SEQ ID NO: 389160 - DNA, 20 bp, Artificial Sequence
  chemically synthesized
tcggttgagacttgctagta

SEQ ID NO: 389161 - DNA, 20 bp, Artificial Sequence
  chemically synthesized
catcggttgagacttgctag

SEQ ID NO: 389162 - DNA, 20 bp, Artificial Sequence
  chemically synthesized
aatcatcggttgagacttgc

SEQ ID NO: 389163 - DNA, 20 bp, Artificial Sequence
  chemically synthesized
gactagctaaatcatcggtt

SEQ ID NO: 389164 - DNA, 20 bp, Artificial Sequence
  chemically synthesized
gcaagtctcaaccgatgatt

SEQ ID NO: 389165 - DNA, 20 bp, Artificial Sequence
  chemically synthesized
ctaaggactagctaaatcat

SEQ ID NO: 389166 - DNA, 20 bp, Artificial Sequence
  chemically synthesized
gtctcaaccgatgatttagc

SEQ ID NO: 389167 - DNA, 20 bp, Artificial Sequence
  chemically synthesized
ccgatgatttagctagtcct

SEQ ID NO: 389168 - DNA, 20 bp, Artificial Sequence
  chemically synthesized
gccttttgtttactaaggac

SEQ ID NO: 389169 - DNA, 20 bp, Artificial Sequence
  chemically synthesized
cgattgccttttgtttacta

SEQ ID NO: 389170 - DNA, 20 bp, Artificial Sequence
  chemically synthesized
tcgattgccttttgtttact

SEQ ID NO: 389171 - DNA, 20 bp, Artificial Sequence
  chemically synthesized
agctagtccttagtaaacaa

SEQ ID NO: 389172 - DNA, 20 bp, Artificial Sequence
  chemically synthesized
gctagtccttagtaaacaaa

SEQ ID NO: 389173 - DNA, 20 bp, Artificial Sequence
  chemically synthesized
aaaggcaatcgaatgacaaa

SEQ ID NO: 389174 - DNA, 20 bp, Artificial Sequence
  chemically synthesized
ttcatccttctgaacagtgt

SEQ ID NO: 389175 - DNA, 20 bp, Artificial Sequence
  chemically synthesized
acaaatggacttacactgtt

SEQ ID NO: 389176 - DNA, 20 bp, Artificial Sequence
  chemically synthesized
aatggacttacactgttcag

SEQ ID NO: 389177 - DNA, 20 bp, Artificial Sequence
  chemically synthesized
atggacttacactgttcaga

SEQ ID NO: 389178 - DNA, 20 bp, Artificial Sequence
  chemically synthesized
acattattcatccttctgaa

SEQ ID NO: 389179 - DNA, 20 bp, Artificial Sequence
  chemically synthesized
tcactcctgttcaagtaaag

SEQ ID NO: 389180 - DNA, 20 bp, Artificial Sequence
  chemically synthesized
gcctcactcctgttcaagta

SEQ ID NO: 389181 - DNA, 20 bp, Artificial Sequence
  chemically synthesized
atgtgtcttctttacttgaa

SEQ ID NO: 389182 - DNA, 20 bp, Artificial Sequence
  chemically synthesized
tgtgtcttctttacttgaac

SEQ ID NO: 389183 - DNA, 20 bp, Artificial Sequence
  chemically synthesized
tgtcttctttacttgaacag

SEQ ID NO: 389184 - DNA, 20 bp, Artificial Sequence
  chemically synthesized
gtggagcctcactcctgttc

SEQ ID NO: 389185 - DNA, 20 bp, Artificial Sequence
  chemically synthesized
ttctttacttgaacaggagt

SEQ ID NO: 389186 - DNA, 20 bp, Artificial Sequence
  chemically synthesized
tctttacttgaacaggagtg

SEQ ID NO: 389187 - DNA, 20 bp, Artificial Sequence
  chemically synthesized
aacaggagtgaggctccacc

SEQ ID NO: 389188 - DNA, 20 bp, Artificial Sequence
  chemically synthesized
tcaaggggagcgtcttggtg

SEQ ID NO: 389189 - DNA, 20 bp, Artificial Sequence
  chemically synthesized
ggtcaaggggagcgtcttgg

SEQ ID NO: 389190 - DNA, 20 bp, Artificial Sequence
  chemically synthesized
tttggtcaaggggagcgtct

SEQ ID NO: 389191 - DNA, 20 bp, Artificial Sequence
  chemically synthesized
agctaaagtttggtcaaggg

SEQ ID NO: 389192 - DNA, 20 bp, Artificial Sequence
  chemically synthesized
ctagctaaagtttggtcaag

SEQ ID NO: 389193 - DNA, 20 bp, Artificial Sequence
  chemically synthesized
cctagctaaagtttggtcaa

SEQ ID NO: 389194 - DNA, 20 bp, Artificial Sequence
  chemically synthesized
gcctagctaaagtttggtca

SEQ ID NO: 389195 - DNA, 20 bp, Artificial Sequence
  chemically synthesized
agcctagctaaagtttggtc

SEQ ID NO: 389196 - DNA, 20 bp, Artificial Sequence
  chemically synthesized
cgctccccttgaccaaactt

SEQ ID NO: 389197 - DNA, 20 bp, Artificial Sequence
  chemically synthesized
agaggagcctagctaaagtt

SEQ ID NO: 389198 - DNA, 20 bp, Artificial Sequence
  chemically synthesized
ccccttgaccaaactttagc

SEQ ID NO: 389199 - DNA, 20 bp, Artificial Sequence
  chemically synthesized
cccttgaccaaactttagct

SEQ ID NO: 389200 - DNA, 20 bp, Artificial Sequence
  chemically synthesized
ggctcagaggagcctagcta

SEQ ID NO: 389201 - DNA, 20 bp, Artificial Sequence
  chemically synthesized
gaagagggctcagaggagcc

SEQ ID NO: 389202 - DNA, 20 bp, Artificial Sequence
  chemically synthesized
aactttagctaggctcctct

SEQ ID NO: 389203 - DNA, 20 bp, Artificial Sequence
  chemically synthesized
gctgagaagagggctcagag

SEQ ID NO: 389204 - DNA, 20 bp, Artificial Sequence
  chemically synthesized
tagctgagaagagggctcag

SEQ ID NO: 389205 - DNA, 20 bp, Artificial Sequence
  chemically synthesized
ctagctgagaagagggctca

SEQ ID NO: 389206 - DNA, 20 bp, Artificial Sequence
  chemically synthesized
gcctagctgagaagagggct

SEQ ID NO: 389207 - DNA, 20 bp, Artificial Sequence
  chemically synthesized
gctcctctgagccctcttct

SEQ ID NO: 389208 - DNA, 20 bp, Artificial Sequence
  chemically synthesized
ttatggcctagctgagaaga

SEQ ID NO: 389209 - DNA, 20 bp, Artificial Sequence
  chemically synthesized
gttatggcctagctgagaag

SEQ ID NO: 389210 - DNA, 20 bp, Artificial Sequence
  chemically synthesized
ggttatggcctagctgagaa

SEQ ID NO: 389211 - DNA, 20 bp, Artificial Sequence
  chemically synthesized
ctctgagccctcttctcagc

SEQ ID NO: 389212 - DNA, 20 bp, Artificial Sequence
  chemically synthesized
tctgagccctcttctcagct

SEQ ID NO: 389213 - DNA, 20 bp, Artificial Sequence
  chemically synthesized
aaggttatggcctagctgag

SEQ ID NO: 389214 - DNA, 20 bp, Artificial Sequence
  chemically synthesized
gccaaggttatggcctagct

SEQ ID NO: 389215 - DNA, 20 bp, Artificial Sequence
  chemically synthesized
tgcaggccaaggttatggcc

SEQ ID NO: 389216 - DNA, 20 bp, Artificial Sequence
  chemically synthesized
tctcagctaggccataacct

SEQ ID NO: 389217 - DNA, 20 bp, Artificial Sequence
  chemically synthesized
gtctgtgcaggccaaggtta

SEQ ID NO: 389218 - DNA, 20 bp, Artificial Sequence
  chemically synthesized
gttcaggtctgtgcaggcca

SEQ ID NO: 389219 - DNA, 20 bp, Artificial Sequence
  chemically synthesized
tgttcaggtctgtgcaggcc

SEQ ID NO: 389220 - DNA, 20 bp, Artificial Sequence
  chemically synthesized
ggccataaccttggcctgca

SEQ ID NO: 389221 - DNA, 20 bp, Artificial Sequence
  chemically synthesized
ttttttgttcaggtctgtgc

SEQ ID NO: 389222 - DNA, 20 bp, Artificial Sequence
  chemically synthesized
gttttttgttcaggtctgtg

SEQ ID NO: 389223 - DNA, 20 bp, Artificial Sequence
  chemically synthesized
tatgttagtgttttttgttc

SEQ ID NO: 389224 - DNA, 20 bp, Artificial Sequence
  chemically synthesized
ctatgttagtgttttttgtt

SEQ ID NO: 389225 - DNA, 20 bp, Artificial Sequence
  chemically synthesized
ctgaacaaaaaacactaaca

SEQ ID NO: 389226 - DNA, 20 bp, Artificial Sequence
  chemically synthesized
tgacctgttagaagctatgt

SEQ ID NO: 389227 - DNA, 20 bp, Artificial Sequence
  chemically synthesized
aacactaacatagcttctaa

SEQ ID NO: 389228 - DNA, 20 bp, Artificial Sequence
  chemically synthesized
acactaacatagcttctaac

SEQ ID NO: 389229 - DNA, 20 bp, Artificial Sequence
  chemically synthesized
aggtggctttgacctgttag

SEQ ID NO: 389230 - DNA, 20 bp, Artificial Sequence
  chemically synthesized
gagaggtggctttgacctgt

SEQ ID NO: 389231 - DNA, 20 bp, Artificial Sequence
  chemically synthesized
acatagcttctaacaggtca

SEQ ID NO: 389232 - DNA, 20 bp, Artificial Sequence
  chemically synthesized
acaggtcaaagccacctctc

SEQ ID NO: 389233 - DNA, 20 bp, Artificial Sequence
  chemically synthesized
caggtcaaagccacctctct

SEQ ID NO: 389234 - DNA, 20 bp, Artificial Sequence
  chemically synthesized
ctagagttatcctagagagg

SEQ ID NO: 389235 - DNA, 20 bp, Artificial Sequence
  chemically synthesized
gggctagagttatcctagag

SEQ ID NO: 389236 - DNA, 20 bp, Artificial Sequence
  chemically synthesized
ggggctagagttatcctaga

SEQ ID NO: 389237 - DNA, 20 bp, Artificial Sequence
  chemically synthesized
gtggggctagagttatccta

SEQ ID NO: 389238 - DNA, 20 bp, Artificial Sequence
  chemically synthesized
aagtggggctagagttatcc

SEQ ID NO: 389239 - DNA, 20 bp, Artificial Sequence
  chemically synthesized
ccacctctctaggataactc

SEQ ID NO: 389240 - DNA, 20 bp, Artificial Sequence
  chemically synthesized
atgcaccttaagtggggcta

SEQ ID NO: 389241 - DNA, 20 bp, Artificial Sequence
  chemically synthesized
aaatgcaccttaagtggggc

SEQ ID NO: 389242 - DNA, 20 bp, Artificial Sequence
  chemically synthesized
ggataactctagccccactt

SEQ ID NO: 389243 - DNA, 20 bp, Artificial Sequence
  chemically synthesized
gataactctagccccactta

SEQ ID NO: 389244 - DNA, 20 bp, Artificial Sequence
  chemically synthesized
tcagaaatgcaccttaagtg

SEQ ID NO: 389245 - DNA, 20 bp, Artificial Sequence
  chemically synthesized
ctcagaaatgcaccttaagt

SEQ ID NO: 389246 - DNA, 20 bp, Artificial Sequence
  chemically synthesized
tctcagaaatgcaccttaag

SEQ ID NO: 389247 - DNA, 20 bp, Artificial Sequence
  chemically synthesized
ttttctcagaaatgcacctt

SEQ ID NO: 389248 - DNA, 20 bp, Artificial Sequence
  chemically synthesized
cccacttaaggtgcatttct

SEQ ID NO: 389249 - DNA, 20 bp, Artificial Sequence
  chemically synthesized
ttggcagctttgagttttct

SEQ ID NO: 389250 - DNA, 20 bp, Artificial Sequence
  chemically synthesized
tgcatttctgagaaaactca

SEQ ID NO: 389251 - DNA, 20 bp, Artificial Sequence
  chemically synthesized
taaattattttggcagcttt

SEQ ID NO: 389252 - DNA, 20 bp, Artificial Sequence
  chemically synthesized
caaagggtaaattattttgg

SEQ ID NO: 389253 - DNA, 20 bp, Artificial Sequence
  chemically synthesized
gaacaaagggtaaattattt

SEQ ID NO: 389254 - DNA, 20 bp, Artificial Sequence
  chemically synthesized
aaataatttaccctttgttc

SEQ ID NO: 389255 - DNA, 20 bp, Artificial Sequence
  chemically synthesized
cgggttttgactggaacaaa

SEQ ID NO: 389256 - DNA, 20 bp, Artificial Sequence
  chemically synthesized
tcgggttttgactggaacaa

SEQ ID NO: 389257 - DNA, 20 bp, Artificial Sequence
  chemically synthesized
ttcgggttttgactggaaca

SEQ ID NO: 389258 - DNA, 20 bp, Artificial Sequence
  chemically synthesized
cactgtcttcgggttttgac

SEQ ID NO: 389259 - DNA, 20 bp, Artificial Sequence
  chemically synthesized
tttgttccagtcaaaacccg

SEQ ID NO: 389260 - DNA, 20 bp, Artificial Sequence
  chemically synthesized
ttccagtcaaaacccgaaga

SEQ ID NO: 389261 - DNA, 20 bp, Artificial Sequence
  chemically synthesized
cctgccttctcactgtcttc

SEQ ID NO: 389262 - DNA, 20 bp, Artificial Sequence
  chemically synthesized
tcctgccttctcactgtctt

SEQ ID NO: 389263 - DNA, 20 bp, Artificial Sequence
  chemically synthesized
agtcaaaacccgaagacagt

SEQ ID NO: 389264 - DNA, 20 bp, Artificial Sequence
  chemically synthesized
caaaacccgaagacagtgag

SEQ ID NO: 389265 - DNA, 20 bp, Artificial Sequence
  chemically synthesized
aaaacccgaagacagtgaga

SEQ ID NO: 389266 - DNA, 20 bp, Artificial Sequence
  chemically synthesized
acccgaagacagtgagaagg

SEQ ID NO: 389267 - DNA, 20 bp, Artificial Sequence
  chemically synthesized
cccgaagacagtgagaaggc

SEQ ID NO: 389268 - DNA, 20 bp, Artificial Sequence
  chemically synthesized
cgaagacagtgagaaggcag

SEQ ID NO: 389269 - DNA, 20 bp, Artificial Sequence
  chemically synthesized
gaaggcaggagcctaacctt

SEQ ID NO: 389270 - DNA, 20 bp, Artificial Sequence
  chemically synthesized
gctaaatggcacttaaggtt

SEQ ID NO: 389271 - DNA, 20 bp, Artificial Sequence
  chemically synthesized
tgctaaatggcacttaaggt

SEQ ID NO: 389272 - DNA, 20 bp, Artificial Sequence
  chemically synthesized
cgtttgctaaatggcactta

SEQ ID NO: 389273 - DNA, 20 bp, Artificial Sequence
  chemically synthesized
acgtttgctaaatggcactt

SEQ ID NO: 389274 - DNA, 20 bp, Artificial Sequence
  chemically synthesized
gcctaaccttaagtgccatt

SEQ ID NO: 389275 - DNA, 20 bp, Artificial Sequence
  chemically synthesized
aaacctctacgtttgctaaa

SEQ ID NO: 389276 - DNA, 20 bp, Artificial Sequence
  chemically synthesized
taagtgccatttagcaaacg

SEQ ID NO: 389277 - DNA, 20 bp, Artificial Sequence
  chemically synthesized
agtgccatttagcaaacgta

SEQ ID NO: 389278 - DNA, 20 bp, Artificial Sequence
  chemically synthesized
gtgccatttagcaaacgtag

SEQ ID NO: 389279 - DNA, 20 bp, Artificial Sequence
  chemically synthesized
tagcaaacgtagaggtttcc

SEQ ID NO: 389280 - DNA, 20 bp, Artificial Sequence
  chemically synthesized
agcaaacgtagaggtttccc

SEQ ID NO: 389281 - DNA, 20 bp, Artificial Sequence
  chemically synthesized
gcaaacgtagaggtttccca

SEQ ID NO: 389282 - DNA, 20 bp, Artificial Sequence
  chemically synthesized
gaaaggtgggattgttccct

SEQ ID NO: 389283 - DNA, 20 bp, Artificial Sequence
  chemically synthesized
ggaaaggtgggattgttccc

SEQ ID NO: 389284 - DNA, 20 bp, Artificial Sequence
  chemically synthesized
attacaaaaagtggaaaggt

SEQ ID NO: 389285 - DNA, 20 bp, Artificial Sequence
  chemically synthesized
aattacaaaaagtggaaagg

SEQ ID NO: 389286 - DNA, 20 bp, Artificial Sequence
  chemically synthesized
acaaattacaaaaagtggaa

SEQ ID NO: 389287 - DNA, 20 bp, Artificial Sequence
  chemically synthesized
aacaaattacaaaaagtgga

SEQ ID NO: 389288 - DNA, 20 bp, Artificial Sequence
  chemically synthesized
aagtaacaaattacaaaaag

SEQ ID NO: 389289 - DNA, 20 bp, Artificial Sequence
  chemically synthesized
gggaagtaacaaattacaaa

SEQ ID NO: 389290 - DNA, 20 bp, Artificial Sequence
  chemically synthesized
gtggctcattaaagtcaggg

SEQ ID NO: 389291 - DNA, 20 bp, Artificial Sequence
  chemically synthesized
gtggtggctcattaaagtca

SEQ ID NO: 389292 - DNA, 20 bp, Artificial Sequence
  chemically synthesized
agtggtggctcattaaagtc

SEQ ID NO: 389293 - DNA, 20 bp, Artificial Sequence
  chemically synthesized
gagtggtggctcattaaagt

SEQ ID NO: 389294 - DNA, 20 bp, Artificial Sequence
  chemically synthesized
gttacttccctgactttaat

SEQ ID NO: 389295 - DNA, 20 bp, Artificial Sequence
  chemically synthesized
gtttgagtggtggctcatta

SEQ ID NO: 389296 - DNA, 20 bp, Artificial Sequence
  chemically synthesized
gagagaatgagtttgagtgg

SEQ ID NO: 389297 - DNA, 20 bp, Artificial Sequence
  chemically synthesized
aatgagagaatgagtttgag

SEQ ID NO: 389298 - DNA, 20 bp, Artificial Sequence
  chemically synthesized
gagaatgagagaatgagttt

SEQ ID NO: 389299 - DNA, 20 bp, Artificial Sequence
  chemically synthesized
taaagggagaatgagagaat

SEQ ID NO: 389300 - DNA, 20 bp, Artificial Sequence
  chemically synthesized
gagttttaaagggagaatga

SEQ ID NO: 389301 - DNA, 20 bp, Artificial Sequence
  chemically synthesized
gggagttttaaagggagaat

SEQ ID NO: 389302 - DNA, 20 bp, Artificial Sequence
  chemically synthesized
gtgactgggagttttaaagg

SEQ ID NO: 389303 - DNA, 20 bp, Artificial Sequence
  chemically synthesized
aggtgactgggagttttaaa

SEQ ID NO: 389304 - DNA, 20 bp, Artificial Sequence
  chemically synthesized
gaggtgactgggagttttaa

SEQ ID NO: 389305 - DNA, 20 bp, Artificial Sequence
  chemically synthesized
agaggtgactgggagtttta

SEQ ID NO: 389306 - DNA, 20 bp, Artificial Sequence
  chemically synthesized
cattctccctttaaaactcc

SEQ ID NO: 389307 - DNA, 20 bp, Artificial Sequence
  chemically synthesized
atttgtgtagaggtgactgg

SEQ ID NO: 389308 - DNA, 20 bp, Artificial Sequence
  chemically synthesized
tgatttgtgtagaggtgact

SEQ ID NO: 389309 - DNA, 20 bp, Artificial Sequence
  chemically synthesized
ttgatttgtgtagaggtgac

SEQ ID NO: 389310 - DNA, 20 bp, Artificial Sequence
  chemically synthesized
ctgaactttgatttgtgtag

SEQ ID NO: 389311 - DNA, 20 bp, Artificial Sequence
  chemically synthesized
actgaactttgatttgtgta

SEQ ID NO: 389312 - DNA, 20 bp, Artificial Sequence
  chemically synthesized
gaactgaactttgatttgtg

SEQ ID NO: 389313 - DNA, 20 bp, Artificial Sequence
  chemically synthesized
agtcacctctacacaaatca

SEQ ID NO: 389314 - DNA, 20 bp, Artificial Sequence
  chemically synthesized
cctctacacaaatcaaagtt

SEQ ID NO: 389315 - DNA, 20 bp, Artificial Sequence
  chemically synthesized
acacaaatcaaagttcagtt

SEQ ID NO: 389316 - DNA, 20 bp, Artificial Sequence
  chemically synthesized
tattataatagagaagagtt

SEQ ID NO: 389317 - DNA, 20 bp, Artificial Sequence
  chemically synthesized
tacactattataatagagaa

SEQ ID NO: 389318 - DNA, 20 bp, Artificial Sequence
  chemically synthesized
aatacactattataatagag

SEQ ID NO: 389319 - DNA, 20 bp, Artificial Sequence
  chemically synthesized
agtaatacactattataata

SEQ ID NO: 389320 - DNA, 20 bp, Artificial Sequence
  chemically synthesized
tgaactcttctctattataa

SEQ ID NO: 389321 - DNA, 20 bp, Artificial Sequence
  chemically synthesized
tcagtaatacactattataa

SEQ ID NO: 389322 - DNA, 20 bp, Artificial Sequence
  chemically synthesized
tagtaaggggagattttaat

SEQ ID NO: 389323 - DNA, 20 bp, Artificial Sequence
  chemically synthesized
gtcagtttaattagtaaggg

SEQ ID NO: 389324 - DNA, 20 bp, Artificial Sequence
  chemically synthesized
acgtcagtttaattagtaag

SEQ ID NO: 389325 - DNA, 20 bp, Artificial Sequence
  chemically synthesized
gacgtcagtttaattagtaa

SEQ ID NO: 389326 - DNA, 20 bp, Artificial Sequence
  chemically synthesized
ggacgtcagtttaattagta

SEQ ID NO: 389327 - DNA, 20 bp, Artificial Sequence
  chemically synthesized
tggacgtcagtttaattagt

SEQ ID NO: 389328 - DNA, 20 bp, Artificial Sequence
  chemically synthesized
aaagtggacgtcagtttaat

SEQ ID NO: 389329 - DNA, 20 bp, Artificial Sequence
  chemically synthesized
agataagcaaaagtggacgt

SEQ ID NO: 389330 - DNA, 20 bp, Artificial Sequence
  chemically synthesized
tatccaaagataagcaaaag

SEQ ID NO: 389331 - DNA, 20 bp, Artificial Sequence
  chemically synthesized
agttatccaaagataagcaa

SEQ ID NO: 389332 - DNA, 20 bp, Artificial Sequence
  chemically synthesized
cgtccacttttgcttatctt

SEQ ID NO: 389333 - DNA, 20 bp, Artificial Sequence
  chemically synthesized
ataaccagttatccaaagat

SEQ ID NO: 389334 - DNA, 20 bp, Artificial Sequence
  chemically synthesized
actaaataaccagttatcca

SEQ ID NO: 389335 - DNA, 20 bp, Artificial Sequence
  chemically synthesized
tttgcttatctttggataac

SEQ ID NO: 389336 - DNA, 20 bp, Artificial Sequence
  chemically synthesized
tctttggataactggttatt

SEQ ID NO: 389337 - DNA, 20 bp, Artificial Sequence
  chemically synthesized
aactaaaccaactaaataac

SEQ ID NO: 389338 - DNA, 20 bp, Artificial Sequence
  chemically synthesized
tggataactggttatttagt

SEQ ID NO: 389339 - DNA, 20 bp, Artificial Sequence
  chemically synthesized
aactggttatttagttggtt

SEQ ID NO: 389340 - DNA, 20 bp, Artificial Sequence
  chemically synthesized
ttatttagttggtttagttt

SEQ ID NO: 389341 - DNA, 20 bp, Artificial Sequence
  chemically synthesized
ttcagtttgtgaatgtcatg

SEQ ID NO: 389342 - DNA, 20 bp, Artificial Sequence
  chemically synthesized
tgaatgtcatgtggtctcaa

SEQ ID NO: 389343 - DNA, 20 bp, Artificial Sequence
  chemically synthesized
gaatgtcatgtggtctcaaa

SEQ ID NO: 389344 - DNA, 20 bp, Artificial Sequence
  chemically synthesized
tctatatgatgtgacctttt

SEQ ID NO: 389345 - DNA, 20 bp, Artificial Sequence
  chemically synthesized
tctcaaaaggtcacatcata

SEQ ID NO: 389346 - DNA, 20 bp, Artificial Sequence
  chemically synthesized
ttcattgatgttggcgtgca

SEQ ID NO: 389347 - DNA, 20 bp, Artificial Sequence
  chemically synthesized
cttcacatgttcattgatgt

SEQ ID NO: 389348 - DNA, 20 bp, Artificial Sequence
  chemically synthesized
ccaacatcaatgaacatgtg

SEQ ID NO: 389349 - DNA, 20 bp, Artificial Sequence
  chemically synthesized
acatcaatgaacatgtgaag

SEQ ID NO: 389350 - DNA, 20 bp, Artificial Sequence
  chemically synthesized
catcaatgaacatgtgaaga

SEQ ID NO: 389351 - DNA, 20 bp, Artificial Sequence
  chemically synthesized
tttttttttttttttacaaa

SEQ ID NO: 389352 - DNA, 20 bp, Artificial Sequence
  chemically synthesized
aaaaaaaaaaaaaaaaaaaa

SEQ ID NO: 389353 - DNA, 20 bp, Artificial Sequence
  chemically synthesized
aaaaaaaaaaaaaaaaaaaa

SEQ ID NO: 389354 - DNA, 20 bp, Artificial Sequence
  chemically synthesized
aaaaaaggtcaatttaaacg

SEQ ID NO: 389355 - DNA, 20 bp, Artificial Sequence
  chemically synthesized
atacgttcaatgtaatcatg

SEQ ID NO: 389356 - DNA, 20 bp, Artificial Sequence
  chemically synthesized
gtatttacgtatttgttgaa

SEQ ID NO: 389357 - DNA, 20 bp, Artificial Sequence
  chemically synthesized
taacatatacaattttacaa

SEQ ID NO: 389358 - DNA, 20 bp, Artificial Sequence
  chemically synthesized
ttaacatatacaattttaca

SEQ ID NO: 389359 - DNA, 20 bp, Artificial Sequence
  chemically synthesized
attaacatatacaattttac

SEQ ID NO: 389360 - DNA, 20 bp, Artificial Sequence
  chemically synthesized
tatgttaattatacaaatgt

SEQ ID NO: 389361 - DNA, 20 bp, Artificial Sequence
  chemically synthesized
tatacaaatgttggaatcta

SEQ ID NO: 389362 - DNA, 20 bp, Artificial Sequence
  chemically synthesized
atgttggaatctacagacca

SEQ ID NO: 389363 - DNA, 20 bp, Artificial Sequence
  chemically synthesized
ttttatgcttccatggtctg

SEQ ID NO: 389364 - DNA, 20 bp, Artificial Sequence
  chemically synthesized
ttggaatctacagaccatgg

SEQ ID NO: 389365 - DNA, 20 bp, Artificial Sequence
  chemically synthesized
atatatattttatgcttcca

SEQ ID NO: 389366 - DNA, 20 bp, Artificial Sequence
  chemically synthesized
taggattttctcagaatggg

SEQ ID NO: 389367 - DNA, 20 bp, Artificial Sequence
  chemically synthesized
tatatattgcctcccattct

SEQ ID NO: 389368 - DNA, 20 bp, Artificial Sequence
  chemically synthesized
ataggattttctcagaatgg

SEQ ID NO: 389369 - DNA, 20 bp, Artificial Sequence
  chemically synthesized
caataggattttctcagaat

SEQ ID NO: 389370 - DNA, 20 bp, Artificial Sequence
  chemically synthesized
tcaataggattttctcagaa

SEQ ID NO: 389371 - DNA, 20 bp, Artificial Sequence
  chemically synthesized
atctttcaataggattttct

SEQ ID NO: 389372 - DNA, 20 bp, Artificial Sequence
  chemically synthesized
ttctgagaaaatcctattga

SEQ ID NO: 389373 - DNA, 20 bp, Artificial Sequence
  chemically synthesized
gacataacttatctttcaat

SEQ ID NO: 389374 - DNA, 20 bp, Artificial Sequence
  chemically synthesized
tgacataacttatctttcaa

SEQ ID NO: 389375 - DNA, 20 bp, Artificial Sequence
  chemically synthesized
agaaaatcctattgaaagat

SEQ ID NO: 389376 - DNA, 20 bp, Artificial Sequence
  chemically synthesized
aaagataagttatgtcatca

SEQ ID NO: 389377 - DNA, 20 bp, Artificial Sequence
  chemically synthesized
ataccaaaacgaaacaaaaa

SEQ ID NO: 389378 - DNA, 20 bp, Artificial Sequence
  chemically synthesized
tttctgtttttgtttcgttt

SEQ ID NO: 389379 - DNA, 20 bp, Artificial Sequence
  chemically synthesized
gtttttgtttcgttttggta

SEQ ID NO: 389380 - DNA, 20 bp, Artificial Sequence
  chemically synthesized
tgtttcgttttggtatggct

SEQ ID NO: 389381 - DNA, 20 bp, Artificial Sequence
  chemically synthesized
ttttggtatggcttggtttc

SEQ ID NO: 389382 - DNA, 20 bp, Artificial Sequence
  chemically synthesized
aacaacaaaagccagaaacc

SEQ ID NO: 389383 - DNA, 20 bp, Artificial Sequence
  chemically synthesized
aaaataataacaacaaaagc

SEQ ID NO: 389384 - DNA, 20 bp, Artificial Sequence
  chemically synthesized
agacaaaataataacaacaa

SEQ ID NO: 389385 - DNA, 20 bp, Artificial Sequence
  chemically synthesized
ttgttattattttgtctata

SEQ ID NO: 389386 - DNA, 20 bp, Artificial Sequence
  chemically synthesized
tgttattattttgtctatat

SEQ ID NO: 389387 - DNA, 20 bp, Artificial Sequence
  chemically synthesized
attattttgtctatataggc

SEQ ID NO: 389388 - DNA, 20 bp, Artificial Sequence
  chemically synthesized
taaatgaatacttgcctata

SEQ ID NO: 389389 - DNA, 20 bp, Artificial Sequence
  chemically synthesized
tattcatttatttcctgcat

SEQ ID NO: 389390 - DNA, 20 bp, Artificial Sequence
  chemically synthesized
tagagacccttgactaatgc

SEQ ID NO: 389391 - DNA, 20 bp, Artificial Sequence
  chemically synthesized
ttagagacccttgactaatg

SEQ ID NO: 389392 - DNA, 20 bp, Artificial Sequence
  chemically synthesized
atttatttcctgcattagtc

SEQ ID NO: 389393 - DNA, 20 bp, Artificial Sequence
  chemically synthesized
tttatttcctgcattagtca

SEQ ID NO: 389394 - DNA, 20 bp, Artificial Sequence
  chemically synthesized
ttatttcctgcattagtcaa

SEQ ID NO: 389395 - DNA, 20 bp, Artificial Sequence
  chemically synthesized
tgcattagtcaagggtctct

SEQ ID NO: 389396 - DNA, 20 bp, Artificial Sequence
  chemically synthesized
gcattagtcaagggtctcta

SEQ ID NO: 389397 - DNA, 20 bp, Artificial Sequence
  chemically synthesized
taaaatcaaatatttcctta

SEQ ID NO: 389398 - DNA, 20 bp, Artificial Sequence
  chemically synthesized
gataaaatcaaatatttcct

SEQ ID NO: 389399 - DNA, 20 bp, Artificial Sequence
  chemically synthesized
gaaatatttgattttatcaa

SEQ ID NO: 389400 - DNA, 20 bp, Artificial Sequence
  chemically synthesized
tttgattttatcaacagctg

SEQ ID NO: 389401 - DNA, 20 bp, Artificial Sequence
  chemically synthesized
gattttatcaacagctgaag

SEQ ID NO: 389402 - DNA, 20 bp, Artificial Sequence
  chemically synthesized
attttatcaacagctgaagt

SEQ ID NO: 389403 - DNA, 20 bp, Artificial Sequence
  chemically synthesized
ccaggcactctttcctactt

SEQ ID NO: 389404 - DNA, 20 bp, Artificial Sequence
  chemically synthesized
tatcaacagctgaagtagga

SEQ ID NO: 389405 - DNA, 20 bp, Artificial Sequence
  chemically synthesized
tcaacagctgaagtaggaaa

SEQ ID NO: 389406 - DNA, 20 bp, Artificial Sequence
  chemically synthesized
ctgaagtaggaaagagtgcc

SEQ ID NO: 389407 - DNA, 20 bp, Artificial Sequence
  chemically synthesized
ctaagtggatattatattcc

SEQ ID NO: 389408 - DNA, 20 bp, Artificial Sequence
  chemically synthesized
tctaagtggatattatattc

SEQ ID NO: 389409 - DNA, 20 bp, Artificial Sequence
  chemically synthesized
cctggaatataatatccact

SEQ ID NO: 389410 - DNA, 20 bp, Artificial Sequence
  chemically synthesized
ggaatataatatccacttag

SEQ ID NO: 389411 - DNA, 20 bp, Artificial Sequence
  chemically synthesized
taccataaaaaacttctaag

SEQ ID NO: 389412 - DNA, 20 bp, Artificial Sequence
  chemically synthesized
ccataccataaaaaacttct

SEQ ID NO: 389413 - DNA, 20 bp, Artificial Sequence
  chemically synthesized
atccacttagaagtttttta

SEQ ID NO: 389414 - DNA, 20 bp, Artificial Sequence
  chemically synthesized
cttagaagttttttatggta

SEQ ID NO: 389415 - DNA, 20 bp, Artificial Sequence
  chemically synthesized
atgctgaggttaaatagaat

SEQ ID NO: 389416 - DNA, 20 bp, Artificial Sequence
  chemically synthesized
aatgctgaggttaaatagaa

SEQ ID NO: 389417 - DNA, 20 bp, Artificial Sequence
  chemically synthesized
aattgaatgctgaggttaaa

SEQ ID NO: 389418 - DNA, 20 bp, Artificial Sequence
  chemically synthesized
tcacccattctatttaacct

SEQ ID NO: 389419 - DNA, 20 bp, Artificial Sequence
  chemically synthesized
gtgagagtaattgaatgctg

SEQ ID NO: 389420 - DNA, 20 bp, Artificial Sequence
  chemically synthesized
agtgagagtaattgaatgct

SEQ ID NO: 389421 - DNA, 20 bp, Artificial Sequence
  chemically synthesized
ttaaaaaaaaatagcagtga

SEQ ID NO: 389422 - DNA, 20 bp, Artificial Sequence
  chemically synthesized
gtttaaaaaaaaatagcagt

SEQ ID NO: 389423 - DNA, 20 bp, Artificial Sequence
  chemically synthesized
tcaggtttaaaaaaaaatag

SEQ ID NO: 389424 - DNA, 20 bp, Artificial Sequence
  chemically synthesized
gattcaggtttaaaaaaaaa

SEQ ID NO: 389425 - DNA, 20 bp, Artificial Sequence
  chemically synthesized
aaatgtaaaatgtatgattc

SEQ ID NO: 389426 - DNA, 20 bp, Artificial Sequence
  chemically synthesized
taaatgtaaaatgtatgatt

SEQ ID NO: 389427 - DNA, 20 bp, Artificial Sequence
  chemically synthesized
tttttaaatgtatttgcaat

SEQ ID NO: 389428 - DNA, 20 bp, Artificial Sequence
  chemically synthesized
atacatttaaaaattctaat

SEQ ID NO: 389429 - DNA, 20 bp, Artificial Sequence
  chemically synthesized
tacatttaaaaattctaata

SEQ ID NO: 389430 - DNA, 20 bp, Artificial Sequence
  chemically synthesized
atttaaaaattctaataagg

SEQ ID NO: 389431 - DNA, 20 bp, Artificial Sequence
  chemically synthesized
ttctaaaggctctgccttat

SEQ ID NO: 389432 - DNA, 20 bp, Artificial Sequence
  chemically synthesized
ttaaaaattctaataaggca

SEQ ID NO: 389433 - DNA, 20 bp, Artificial Sequence
  chemically synthesized
ttctaataaggcagagcctt

SEQ ID NO: 389434 - DNA, 20 bp, Artificial Sequence
  chemically synthesized
taataaggcagagcctttag

SEQ ID NO: 389435 - DNA, 20 bp, Artificial Sequence
  chemically synthesized
tgagtcaagcattcttctaa

SEQ ID NO: 389436 - DNA, 20 bp, Artificial Sequence
  chemically synthesized
ctgagtcaagcattcttcta

SEQ ID NO: 389437 - DNA, 20 bp, Artificial Sequence
  chemically synthesized
ctttagaagaatgcttgact

SEQ ID NO: 389438 - DNA, 20 bp, Artificial Sequence
  chemically synthesized
atttattgagtttctgagtc

SEQ ID NO: 389439 - DNA, 20 bp, Artificial Sequence
  chemically synthesized
caaagatttattgagtttct

SEQ ID NO: 389440 - DNA, 20 bp, Artificial Sequence
  chemically synthesized
atagttaacaaagatttatt

SEQ ID NO: 389441 - DNA, 20 bp, Artificial Sequence
  chemically synthesized
atttccttcaatagttaaca

SEQ ID NO: 389442 - DNA, 20 bp, Artificial Sequence
  chemically synthesized
taaatctttgttaactattg

SEQ ID NO: 389443 - DNA, 20 bp, Artificial Sequence
  chemically synthesized
aaatctttgttaactattga

SEQ ID NO: 389444 - DNA, 20 bp, Artificial Sequence
  chemically synthesized
ttaattaaaatttccttcaa

SEQ ID NO: 389445 - DNA, 20 bp, Artificial Sequence
  chemically synthesized
aatcagtaattttgttgagt

SEQ ID NO: 389446 - DNA, 20 bp, Artificial Sequence
  chemically synthesized
aaatcagtaattttgttgag

SEQ ID NO: 389447 - DNA, 20 bp, Artificial Sequence
  chemically synthesized
taaaaatcagtaattttgtt

SEQ ID NO: 389448 - DNA, 20 bp, Artificial Sequence
  chemically synthesized
aaaaaactattaataaaaat

SEQ ID NO: 389449 - DNA, 20 bp, Artificial Sequence
  chemically synthesized
aaattactgatttttattaa

SEQ ID NO: 389450 - DNA, 20 bp, Artificial Sequence
  chemically synthesized
gtatgctaattaaaatatac

SEQ ID NO: 389451 - DNA, 20 bp, Artificial Sequence
  chemically synthesized
agtatgctaattaaaatata

SEQ ID NO: 389452 - DNA, 20 bp, Artificial Sequence
  chemically synthesized
aatcacctgtatattttaat

SEQ ID NO: 389453 - DNA, 20 bp, Artificial Sequence
  chemically synthesized
attttaattagcatactgta

SEQ ID NO: 389454 - DNA, 20 bp, Artificial Sequence
  chemically synthesized
taattagcatactgtaaaga

SEQ ID NO: 389455 - DNA, 20 bp, Artificial Sequence
  chemically synthesized
aaaaatgattactttcttta

SEQ ID NO: 389456 - DNA, 20 bp, Artificial Sequence
  chemically synthesized
tagtgttttttattttaaaa

SEQ ID NO: 389457 - DNA, 20 bp, Artificial Sequence
  chemically synthesized
atagtgttttttattttaaa

SEQ ID NO: 389458 - DNA, 20 bp, Artificial Sequence
  chemically synthesized
gtgataaagtcagtataaca

SEQ ID NO: 389459 - DNA, 20 bp, Artificial Sequence
  chemically synthesized
gattatctcagtgataaagt

SEQ ID NO: 389460 - DNA, 20 bp, Artificial Sequence
  chemically synthesized
gttatactgactttatcact

SEQ ID NO: 389461 - DNA, 20 bp, Artificial Sequence
  chemically synthesized
ttgagattatctcagtgata

SEQ ID NO: 389462 - DNA, 20 bp, Artificial Sequence
  chemically synthesized
ataactgcttgagattatct

SEQ ID NO: 389463 - DNA, 20 bp, Artificial Sequence
  chemically synthesized
tttatcactgagataatctc

SEQ ID NO: 389464 - DNA, 20 bp, Artificial Sequence
  chemically synthesized
atcactgagataatctcaag

SEQ ID NO: 389465 - DNA, 20 bp, Artificial Sequence
  chemically synthesized
gcagctcataataactgctt

SEQ ID NO: 389466 - DNA, 20 bp, Artificial Sequence
  chemically synthesized
taatctcaagcagttattat

SEQ ID NO: 389467 - DNA, 20 bp, Artificial Sequence
  chemically synthesized
agttattatgagctgctttt

SEQ ID NO: 389468 - DNA, 20 bp, Artificial Sequence
  chemically synthesized
accttcaaatagctcaaaag

SEQ ID NO: 389469 - DNA, 20 bp, Artificial Sequence
  chemically synthesized
tgtaccttcaaatagctcaa

SEQ ID NO: 389470 - DNA, 20 bp, Artificial Sequence
  chemically synthesized
agctgcttttgagctatttg

SEQ ID NO: 389471 - DNA, 20 bp, Artificial Sequence
  chemically synthesized
gctgcttttgagctatttga

SEQ ID NO: 389472 - DNA, 20 bp, Artificial Sequence
  chemically synthesized
agtaaaactgtaccttcaaa

SEQ ID NO: 389473 - DNA, 20 bp, Artificial Sequence
  chemically synthesized
ttttgagctatttgaaggta

SEQ ID NO: 389474 - DNA, 20 bp, Artificial Sequence
  chemically synthesized
taggcctggaaattacatag

SEQ ID NO: 389475 - DNA, 20 bp, Artificial Sequence
  chemically synthesized
acataggcctggaaattaca

SEQ ID NO: 389476 - DNA, 20 bp, Artificial Sequence
  chemically synthesized
ttttactgctatgtaatttc

SEQ ID NO: 389477 - DNA, 20 bp, Artificial Sequence
  chemically synthesized
tttactgctatgtaatttcc

SEQ ID NO: 389478 - DNA, 20 bp, Artificial Sequence
  chemically synthesized
tgcctagatgtacataggcc

SEQ ID NO: 389479 - DNA, 20 bp, Artificial Sequence
  chemically synthesized
tcttatgcctagatgtacat

SEQ ID NO: 389480 - DNA, 20 bp, Artificial Sequence
  chemically synthesized
atcttatgcctagatgtaca

SEQ ID NO: 389481 - DNA, 20 bp, Artificial Sequence
  chemically synthesized
tttccaggcctatgtacatc

SEQ ID NO: 389482 - DNA, 20 bp, Artificial Sequence
  chemically synthesized
ttccaggcctatgtacatct

SEQ ID NO: 389483 - DNA, 20 bp, Artificial Sequence
  chemically synthesized
gcctatgtacatctaggcat

SEQ ID NO: 389484 - DNA, 20 bp, Artificial Sequence
  chemically synthesized
agctgagaaaatcttatgcc

SEQ ID NO: 389485 - DNA, 20 bp, Artificial Sequence
  chemically synthesized
atctaggcataagattttct

SEQ ID NO: 389486 - DNA, 20 bp, Artificial Sequence
  chemically synthesized
cgagacgagctttaacagct

SEQ ID NO: 389487 - DNA, 20 bp, Artificial Sequence
  chemically synthesized
taagattttctcagctgtta

SEQ ID NO: 389488 - DNA, 20 bp, Artificial Sequence
  chemically synthesized
ggcaacgagacgagctttaa

SEQ ID NO: 389489 - DNA, 20 bp, Artificial Sequence
  chemically synthesized
gggacaaatggcaacgagac

SEQ ID NO: 389490 - DNA, 20 bp, Artificial Sequence
  chemically synthesized
aagaggggacaaatggcaac

SEQ ID NO: 389491 - DNA, 20 bp, Artificial Sequence
  chemically synthesized
tatcattaagaggggacaaa

SEQ ID NO: 389492 - DNA, 20 bp, Artificial Sequence
  chemically synthesized
gttcttgctatcattaagag

SEQ ID NO: 389493 - DNA, 20 bp, Artificial Sequence
  chemically synthesized
agttcttgctatcattaaga

SEQ ID NO: 389494 - DNA, 20 bp, Artificial Sequence
  chemically synthesized
tagttcttgctatcattaag

SEQ ID NO: 389495 - DNA, 20 bp, Artificial Sequence
  chemically synthesized
catttgtcccctcttaatga

SEQ ID NO: 389496 - DNA, 20 bp, Artificial Sequence
  chemically synthesized
ttagttcttgctatcattaa

SEQ ID NO: 389497 - DNA, 20 bp, Artificial Sequence
  chemically synthesized
acttagttcttgctatcatt

SEQ ID NO: 389498 - DNA, 20 bp, Artificial Sequence
  chemically synthesized
tgtcccctcttaatgatagc

SEQ ID NO: 389499 - DNA, 20 bp, Artificial Sequence
  chemically synthesized
tcttaatgatagcaagaact

SEQ ID NO: 389500 - DNA, 20 bp, Artificial Sequence
  chemically synthesized
tgtgcaaaactgggatgact

SEQ ID NO: 389501 - DNA, 20 bp, Artificial Sequence
  chemically synthesized
tagcaagaactaagtcatcc

SEQ ID NO: 389502 - DNA, 20 bp, Artificial Sequence
  chemically synthesized
agtataatatgtgcaaaact

SEQ ID NO: 389503 - DNA, 20 bp, Artificial Sequence
  chemically synthesized
aagtataatatgtgcaaaac

SEQ ID NO: 389504 - DNA, 20 bp, Artificial Sequence
  chemically synthesized
gcacatattatacttgcgtt

SEQ ID NO: 389505 - DNA, 20 bp, Artificial Sequence
  chemically synthesized
ctggaaaaagaacttaacgc

SEQ ID NO: 389506 - DNA, 20 bp, Artificial Sequence
  chemically synthesized
cttgcgttaagttctttttc

SEQ ID NO: 389507 - DNA, 20 bp, Artificial Sequence
  chemically synthesized
tgtgttcttataactggaaa

SEQ ID NO: 389508 - DNA, 20 bp, Artificial Sequence
  chemically synthesized
taagttctttttccagttat

SEQ ID NO: 389509 - DNA, 20 bp, Artificial Sequence
  chemically synthesized
taaagttgtgttcttataac

SEQ ID NO: 389510 - DNA, 20 bp, Artificial Sequence
  chemically synthesized
aaattatccataagaaatta

SEQ ID NO: 389511 - DNA, 20 bp, Artificial Sequence
  chemically synthesized
aacacaactttaatttctta

SEQ ID NO: 389512 - DNA, 20 bp, Artificial Sequence
  chemically synthesized
gttcagatgaaattatccat

SEQ ID NO: 389513 - DNA, 20 bp, Artificial Sequence
  chemically synthesized
tcggtctaaaatgtgttgtt

SEQ ID NO: 389514 - DNA, 20 bp, Artificial Sequence
  chemically synthesized
ttcatctgaacaacacattt

SEQ ID NO: 389515 - DNA, 20 bp, Artificial Sequence
  chemically synthesized
cacattttagaccgaaactt

SEQ ID NO: 389516 - DNA, 20 bp, Artificial Sequence
  chemically synthesized
tattaaggaaactgaagttt

SEQ ID NO: 389517 - DNA, 20 bp, Artificial Sequence
  chemically synthesized
acaaattattaaggaaactg

SEQ ID NO: 389518 - DNA, 20 bp, Artificial Sequence
  chemically synthesized
atcaaaagtacaaattatta

SEQ ID NO: 389519 - DNA, 20 bp, Artificial Sequence
  chemically synthesized
aatcaaaagtacaaattatt

SEQ ID NO: 389520 - DNA, 20 bp, Artificial Sequence
  chemically synthesized
ataatttgtacttttgattg

SEQ ID NO: 389521 - DNA, 20 bp, Artificial Sequence
  chemically synthesized
tgtcattttcccacaatcaa

SEQ ID NO: 389522 - DNA, 20 bp, Artificial Sequence
  chemically synthesized
taatttgtacttttgattgt

SEQ ID NO: 389523 - DNA, 20 bp, Artificial Sequence
  chemically synthesized
tgattgtgggaaaatgacaa

SEQ ID NO: 389524 - DNA, 20 bp, Artificial Sequence
  chemically synthesized
atgacaacagcatacaataa

SEQ ID NO: 389525 - DNA, 20 bp, Artificial Sequence
  chemically synthesized
aatagaatattatacttttc

SEQ ID NO: 389526 - DNA, 20 bp, Artificial Sequence
  chemically synthesized
gaatattatacttttctagc

SEQ ID NO: 389527 - DNA, 20 bp, Artificial Sequence
  chemically synthesized
tcagccttccccagctagaa

SEQ ID NO: 389528 - DNA, 20 bp, Artificial Sequence
  chemically synthesized
aatattatacttttctagct

SEQ ID NO: 389529 - DNA, 20 bp, Artificial Sequence
  chemically synthesized
atattatacttttctagctg

SEQ ID NO: 389530 - DNA, 20 bp, Artificial Sequence
  chemically synthesized
ttatacttttctagctgggg

SEQ ID NO: 389531 - DNA, 20 bp, Artificial Sequence
  chemically synthesized
tgtcatcagccttccccagc

SEQ ID NO: 389532 - DNA, 20 bp, Artificial Sequence
  chemically synthesized
tatacttttctagctgggga

SEQ ID NO: 389533 - DNA, 20 bp, Artificial Sequence
  chemically synthesized
tttgtgtcatcagccttccc

SEQ ID NO: 389534 - DNA, 20 bp, Artificial Sequence
  chemically synthesized
gtcctatgcttttgtgtcat

SEQ ID NO: 389535 - DNA, 20 bp, Artificial Sequence
  chemically synthesized
ggggaaggctgatgacacaa

SEQ ID NO: 389536 - DNA, 20 bp, Artificial Sequence
  chemically synthesized
aggctgatgacacaaaagca

SEQ ID NO: 389537 - DNA, 20 bp, Artificial Sequence
  chemically synthesized
ggctgatgacacaaaagcat

SEQ ID NO: 389538 - DNA, 20 bp, Artificial Sequence
  chemically synthesized
aaaagcataggactacaaaa

SEQ ID NO: 389539 - DNA, 20 bp, Artificial Sequence
  chemically synthesized
tcatgttttttgccattttg

SEQ ID NO: 389540 - DNA, 20 bp, Artificial Sequence
  chemically synthesized
aatggcaaaaaacatgatta

SEQ ID NO: 389541 - DNA, 20 bp, Artificial Sequence
  chemically synthesized
catgattatagtgtatacat

SEQ ID NO: 389542 - DNA, 20 bp, Artificial Sequence
  chemically synthesized
tatacatgagtttttttgca

SEQ ID NO: 389543 - DNA, 20 bp, Artificial Sequence
  chemically synthesized
tttttttgcaaagatctgaa

SEQ ID NO: 389544 - DNA, 20 bp, Artificial Sequence
  chemically synthesized
tttttgcaaagatctgaata

SEQ ID NO: 389545 - DNA, 20 bp, Artificial Sequence
  chemically synthesized
ttttactgcttttctctatt

SEQ ID NO: 389546 - DNA, 20 bp, Artificial Sequence
  chemically synthesized
gcaaagatctgaatagagaa

SEQ ID NO: 389547 - DNA, 20 bp, Artificial Sequence
  chemically synthesized
aagatctgaatagagaaaag

SEQ ID NO: 389548 - DNA, 20 bp, Artificial Sequence
  chemically synthesized
aatagagaaaagcagtaaaa

SEQ ID NO: 389549 - DNA, 20 bp, Artificial Sequence
  chemically synthesized
atttttcaatatatgttgtg

SEQ ID NO: 389550 - DNA, 20 bp, Artificial Sequence
  chemically synthesized
ggtgcaagttattgtatttt

SEQ ID NO: 389551 - DNA, 20 bp, Artificial Sequence
  chemically synthesized
agtactagctgcaatggtgc

SEQ ID NO: 389552 - DNA, 20 bp, Artificial Sequence
  chemically synthesized
tacaataacttgcaccattg

SEQ ID NO: 389553 - DNA, 20 bp, Artificial Sequence
  chemically synthesized
ataacttgcaccattgcagc

SEQ ID NO: 389554 - DNA, 20 bp, Artificial Sequence
  chemically synthesized
gaatatagtactagctgcaa

SEQ ID NO: 389555 - DNA, 20 bp, Artificial Sequence
  chemically synthesized
ttataatgtgaatatagtac

SEQ ID NO: 389556 - DNA, 20 bp, Artificial Sequence
  chemically synthesized
ggccttttataatgtgaata

SEQ ID NO: 389557 - DNA, 20 bp, Artificial Sequence
  chemically synthesized
gtactatattcacattataa

SEQ ID NO: 389558 - DNA, 20 bp, Artificial Sequence
  chemically synthesized
tactatattcacattataaa

SEQ ID NO: 389559 - DNA, 20 bp, Artificial Sequence
  chemically synthesized
gttgtcttggatacattaaa

SEQ ID NO: 389560 - DNA, 20 bp, Artificial Sequence
  chemically synthesized
aaaggccatttaatgtatcc

SEQ ID NO: 389561 - DNA, 20 bp, Artificial Sequence
  chemically synthesized
tgtgtctgccaatgttgtct

SEQ ID NO: 389562 - DNA, 20 bp, Artificial Sequence
  chemically synthesized
taatgtatccaagacaacat

SEQ ID NO: 389563 - DNA, 20 bp, Artificial Sequence
  chemically synthesized
tgtatccaagacaacattgg

SEQ ID NO: 389564 - DNA, 20 bp, Artificial Sequence
  chemically synthesized
acaacattggcagacacatt

SEQ ID NO: 389565 - DNA, 20 bp, Artificial Sequence
  chemically synthesized
caacattggcagacacatta

SEQ ID NO: 389566 - DNA, 20 bp, Artificial Sequence
  chemically synthesized
cacattaaggttatgctttt

SEQ ID NO: 389567 - DNA, 20 bp, Artificial Sequence
  chemically synthesized
agaaaagcaatagaactcaa

SEQ ID NO: 389568 - DNA, 20 bp, Artificial Sequence
  chemically synthesized
acagaagtacagaaaagcaa

SEQ ID NO: 389569 - DNA, 20 bp, Artificial Sequence
  chemically synthesized
aataaaacagaagtacagaa

SEQ ID NO: 389570 - DNA, 20 bp, Artificial Sequence
  chemically synthesized
aatcaaataaaacagaagta

SEQ ID NO: 389571 - DNA, 20 bp, Artificial Sequence
  chemically synthesized
tttcaaatcaaataaaacag

SEQ ID NO: 389572 - DNA, 20 bp, Artificial Sequence
  chemically synthesized
tattttcaaatcaaataaaa

SEQ ID NO: 389573 - DNA, 20 bp, Artificial Sequence
  chemically synthesized
gaaaatatgatttgttgttg

SEQ ID NO: 389574 - DNA, 20 bp, Artificial Sequence
  chemically synthesized
ctttatggtgaaagggcata

SEQ ID NO: 389575 - DNA, 20 bp, Artificial Sequence
  chemically synthesized
gcacactctttatggtgaaa

SEQ ID NO: 389576 - DNA, 20 bp, Artificial Sequence
  chemically synthesized
ggcacactctttatggtgaa

SEQ ID NO: 389577 - DNA, 20 bp, Artificial Sequence
  chemically synthesized
gggcacactctttatggtga

SEQ ID NO: 389578 - DNA, 20 bp, Artificial Sequence
  chemically synthesized
ctatatgccctttcaccata

SEQ ID NO: 389579 - DNA, 20 bp, Artificial Sequence
  chemically synthesized
atatgccctttcaccataaa

SEQ ID NO: 389580 - DNA, 20 bp, Artificial Sequence
  chemically synthesized
aacaaagggcacactcttta

SEQ ID NO: 389581 - DNA, 20 bp, Artificial Sequence
  chemically synthesized
aagcacgaatataaaacaaa

SEQ ID NO: 389582 - DNA, 20 bp, Artificial Sequence
  chemically synthesized
gaagcacgaatataaaacaa

SEQ ID NO: 389583 - DNA, 20 bp, Artificial Sequence
  chemically synthesized
agaagcacgaatataaaaca

SEQ ID NO: 389584 - DNA, 20 bp, Artificial Sequence
  chemically synthesized
gttttatattcgtgcttcta

SEQ ID NO: 389585 - DNA, 20 bp, Artificial Sequence
  chemically synthesized
ttttatattcgtgcttctat

SEQ ID NO: 389586 - DNA, 20 bp, Artificial Sequence
  chemically synthesized
ttattaaaatttacctatag

SEQ ID NO: 389587 - DNA, 20 bp, Artificial Sequence
  chemically synthesized
tttttattaaaatttaccta

SEQ ID NO: 389588 - DNA, 20 bp, Artificial Sequence
  chemically synthesized
ttaataaaaataattttaat

SEQ ID NO: 389589 - DNA, 20 bp, Artificial Sequence
  chemically synthesized
aaaataattttaatcagcat

SEQ ID NO: 389590 - DNA, 20 bp, Artificial Sequence
  chemically synthesized
aattttaatcagcattggtt

SEQ ID NO: 389591 - DNA, 20 bp, Artificial Sequence
  chemically synthesized
taatcagcattggttgagca

SEQ ID NO: 389592 - DNA, 20 bp, Artificial Sequence
  chemically synthesized
aatcagcattggttgagcat

SEQ ID NO: 389593 - DNA, 20 bp, Artificial Sequence
  chemically synthesized
atcagcattggttgagcata

SEQ ID NO: 389594 - DNA, 20 bp, Artificial Sequence
  chemically synthesized
ggccagtttaaagaaataaa

SEQ ID NO: 389595 - DNA, 20 bp, Artificial Sequence
  chemically synthesized
ggctttttatttctttaaac

SEQ ID NO: 389596 - DNA, 20 bp, Artificial Sequence
  chemically synthesized
gtaataaacaggccagttta

SEQ ID NO: 389597 - DNA, 20 bp, Artificial Sequence
  chemically synthesized
aacctgagtaataaacaggc

SEQ ID NO: 389598 - DNA, 20 bp, Artificial Sequence
  chemically synthesized
ctcaaacctgagtaataaac

SEQ ID NO: 389599 - DNA, 20 bp, Artificial Sequence
  chemically synthesized
actcaaacctgagtaataaa

SEQ ID NO: 389600 - DNA, 20 bp, Artificial Sequence
  chemically synthesized
aaactggcctgtttattact

SEQ ID NO: 389601 - DNA, 20 bp, Artificial Sequence
  chemically synthesized
aactggcctgtttattactc

SEQ ID NO: 389602 - DNA, 20 bp, Artificial Sequence
  chemically synthesized
cctgtttattactcaggttt

SEQ ID NO: 389603 - DNA, 20 bp, Artificial Sequence
  chemically synthesized
gtgtagtgctactcaaacct

SEQ ID NO: 389604 - DNA, 20 bp, Artificial Sequence
  chemically synthesized
gtttattactcaggtttgag

SEQ ID NO: 389605 - DNA, 20 bp, Artificial Sequence
  chemically synthesized
gcttcatgcttggtatagtg

SEQ ID NO: 389606 - DNA, 20 bp, Artificial Sequence
  chemically synthesized
gagtagcactacactatacc

SEQ ID NO: 389607 - DNA, 20 bp, Artificial Sequence
  chemically synthesized
attttgcttcatgcttggta

SEQ ID NO: 389608 - DNA, 20 bp, Artificial Sequence
  chemically synthesized
actacactataccaagcatg

SEQ ID NO: 389609 - DNA, 20 bp, Artificial Sequence
  chemically synthesized
aagacattttgcttcatgct

SEQ ID NO: 389610 - DNA, 20 bp, Artificial Sequence
  chemically synthesized
gaagcaaaatgtcttaacac

SEQ ID NO: 389611 - DNA, 20 bp, Artificial Sequence
  chemically synthesized
aagcaaaatgtcttaacact

SEQ ID NO: 389612 - DNA, 20 bp, Artificial Sequence
  chemically synthesized
agcaaaatgtcttaacacta

SEQ ID NO: 389613 - DNA, 20 bp, Artificial Sequence
  chemically synthesized
gctcagcttcccctagtgtt

SEQ ID NO: 389614 - DNA, 20 bp, Artificial Sequence
  chemically synthesized
gcaaaatgtcttaacactag

SEQ ID NO: 389615 - DNA, 20 bp, Artificial Sequence
  chemically synthesized
aaatgtcttaacactagggg

SEQ ID NO: 389616 - DNA, 20 bp, Artificial Sequence
  chemically synthesized
gaaccaagctcagcttcccc

SEQ ID NO: 389617 - DNA, 20 bp, Artificial Sequence
  chemically synthesized
tcttaacactaggggaagct

SEQ ID NO: 389618 - DNA, 20 bp, Artificial Sequence
  chemically synthesized
acactaggggaagctgagct

SEQ ID NO: 389619 - DNA, 20 bp, Artificial Sequence
  chemically synthesized
tttctacaaagaaccaagct

SEQ ID NO: 389620 - DNA, 20 bp, Artificial Sequence
  chemically synthesized
gagtttttctacaaagaacc

SEQ ID NO: 389621 - DNA, 20 bp, Artificial Sequence
  chemically synthesized
aagctgagcttggttctttg

SEQ ID NO: 389622 - DNA, 20 bp, Artificial Sequence
  chemically synthesized
ctggatagagtttttctaca

SEQ ID NO: 389623 - DNA, 20 bp, Artificial Sequence
  chemically synthesized
ctttgtagaaaaactctatc

SEQ ID NO: 389624 - DNA, 20 bp, Artificial Sequence
  chemically synthesized
tttgtagaaaaactctatcc

SEQ ID NO: 389625 - DNA, 20 bp, Artificial Sequence
  chemically synthesized
tgtagaaaaactctatccag

SEQ ID NO: 389626 - DNA, 20 bp, Artificial Sequence
  chemically synthesized
taccccatgtctcctggata

SEQ ID NO: 389627 - DNA, 20 bp, Artificial Sequence
  chemically synthesized
tctaccccatgtctcctgga

SEQ ID NO: 389628 - DNA, 20 bp, Artificial Sequence
  chemically synthesized
aaaactctatccaggagaca

SEQ ID NO: 389629 - DNA, 20 bp, Artificial Sequence
  chemically synthesized
ttaatctaccccatgtctcc

SEQ ID NO: 389630 - DNA, 20 bp, Artificial Sequence
  chemically synthesized
aaactctatccaggagacat

SEQ ID NO: 389631 - DNA, 20 bp, Artificial Sequence
  chemically synthesized
aactctatccaggagacatg

SEQ ID NO: 389632 - DNA, 20 bp, Artificial Sequence
  chemically synthesized
tctatccaggagacatgggg

SEQ ID NO: 389633 - DNA, 20 bp, Artificial Sequence
  chemically synthesized
agacatggggtagattaata

SEQ ID NO: 389634 - DNA, 20 bp, Artificial Sequence
  chemically synthesized
caaccttcccatatgtgtgg

SEQ ID NO: 389635 - DNA, 20 bp, Artificial Sequence
  chemically synthesized
tcaaccttcccatatgtgtg

SEQ ID NO: 389636 - DNA, 20 bp, Artificial Sequence
  chemically synthesized
cacacacacctccacacata

SEQ ID NO: 389637 - DNA, 20 bp, Artificial Sequence
  chemically synthesized
acacacacctccacacatat

SEQ ID NO: 389638 - DNA, 20 bp, Artificial Sequence
  chemically synthesized
cttcaaccttcccatatgtg

SEQ ID NO: 389639 - DNA, 20 bp, Artificial Sequence
  chemically synthesized
cacacctccacacatatggg

SEQ ID NO: 389640 - DNA, 20 bp, Artificial Sequence
  chemically synthesized
acacctccacacatatggga

SEQ ID NO: 389641 - DNA, 20 bp, Artificial Sequence
  chemically synthesized
ccacacatatgggaaggttg

SEQ ID NO: 389642 - DNA, 20 bp, Artificial Sequence
  chemically synthesized
catgtacccaacaatgtggt

SEQ ID NO: 389643 - DNA, 20 bp, Artificial Sequence
  chemically synthesized
aatatgtctcaccacattgt

SEQ ID NO: 389644 - DNA, 20 bp, Artificial Sequence
  chemically synthesized
atatgtctcaccacattgtt

SEQ ID NO: 389645 - DNA, 20 bp, Artificial Sequence
  chemically synthesized
gtaacatgtacccaacaatg

SEQ ID NO: 389646 - DNA, 20 bp, Artificial Sequence
  chemically synthesized
ttgggtacatgttactgatc

SEQ ID NO: 389647 - DNA, 20 bp, Artificial Sequence
  chemically synthesized
tatatattattaagccagat

SEQ ID NO: 389648 - DNA, 20 bp, Artificial Sequence
  chemically synthesized
aatcctatatattattaagc

SEQ ID NO: 389649 - DNA, 20 bp, Artificial Sequence
  chemically synthesized
gttaaatcctatatattatt

SEQ ID NO: 389650 - DNA, 20 bp, Artificial Sequence
  chemically synthesized
tgatctggcttaataatata

SEQ ID NO: 389651 - DNA, 20 bp, Artificial Sequence
  chemically synthesized
gatctggcttaataatatat

SEQ ID NO: 389652 - DNA, 20 bp, Artificial Sequence
  chemically synthesized
ccaagcatatcaagtacagg

SEQ ID NO: 389653 - DNA, 20 bp, Artificial Sequence
  chemically synthesized
cctccaagcatatcaagtac

SEQ ID NO: 389654 - DNA, 20 bp, Artificial Sequence
  chemically synthesized
gcctccaagcatatcaagta

SEQ ID NO: 389655 - DNA, 20 bp, Artificial Sequence
  chemically synthesized
atattgcctccaagcatatc

SEQ ID NO: 389656 - DNA, 20 bp, Artificial Sequence
  chemically synthesized
cttcctgtacttgatatgct

SEQ ID NO: 389657 - DNA, 20 bp, Artificial Sequence
  chemically synthesized
tcctgtacttgatatgcttg

SEQ ID NO: 389658 - DNA, 20 bp, Artificial Sequence
  chemically synthesized
cctgtacttgatatgcttgg

SEQ ID NO: 389659 - DNA, 20 bp, Artificial Sequence
  chemically synthesized
actgcagtaatattgcctcc

SEQ ID NO: 389660 - DNA, 20 bp, Artificial Sequence
  chemically synthesized
gcttggaggcaatattactg

SEQ ID NO: 389661 - DNA, 20 bp, Artificial Sequence
  chemically synthesized
aggcaatattactgcagtac

SEQ ID NO: 389662 - DNA, 20 bp, Artificial Sequence
  chemically synthesized
tgatgccctggcttgtactg

SEQ ID NO: 389663 - DNA, 20 bp, Artificial Sequence
  chemically synthesized
aatattactgcagtacaagc

SEQ ID NO: 389664 - DNA, 20 bp, Artificial Sequence
  chemically synthesized
atattactgcagtacaagcc

SEQ ID NO: 389665 - DNA, 20 bp, Artificial Sequence
  chemically synthesized
tattactgcagtacaagcca

SEQ ID NO: 389666 - DNA, 20 bp, Artificial Sequence
  chemically synthesized
tgcagtacaagccagggcat

SEQ ID NO: 389667 - DNA, 20 bp, Artificial Sequence
  chemically synthesized
gcatagtgaaactgatgccc

SEQ ID NO: 389668 - DNA, 20 bp, Artificial Sequence
  chemically synthesized
tttctatgctgacaaaagca

SEQ ID NO: 389669 - DNA, 20 bp, Artificial Sequence
  chemically synthesized
cagtttcactatgcttttgt

SEQ ID NO: 389670 - DNA, 20 bp, Artificial Sequence
  chemically synthesized
gctactttctatgctgacaa

SEQ ID NO: 389671 - DNA, 20 bp, Artificial Sequence
  chemically synthesized
tcactatgcttttgtcagca

SEQ ID NO: 389672 - DNA, 20 bp, Artificial Sequence
  chemically synthesized
tatgcttttgtcagcataga

SEQ ID NO: 389673 - DNA, 20 bp, Artificial Sequence
  chemically synthesized
gcttttgtcagcatagaaag

SEQ ID NO: 389674 - DNA, 20 bp, Artificial Sequence
  chemically synthesized
gtcagcatagaaagtagcac

SEQ ID NO: 389675 - DNA, 20 bp, Artificial Sequence
  chemically synthesized
cagcatagaaagtagcacta

SEQ ID NO: 389676 - DNA, 20 bp, Artificial Sequence
  chemically synthesized
agcatagaaagtagcactag

SEQ ID NO: 389677 - DNA, 20 bp, Artificial Sequence
  chemically synthesized
ttcaaattcattttgtcctc

SEQ ID NO: 389678 - DNA, 20 bp, Artificial Sequence
  chemically synthesized
aaaatgaatttgaaccaatg

SEQ ID NO: 389679 - DNA, 20 bp, Artificial Sequence
  chemically synthesized
gtattgtatgaaagcttcat

SEQ ID NO: 389680 - DNA, 20 bp, Artificial Sequence
  chemically synthesized
cccttcagggtattgtatga

SEQ ID NO: 389681 - DNA, 20 bp, Artificial Sequence
  chemically synthesized
agctttcatacaataccctg

SEQ ID NO: 389682 - DNA, 20 bp, Artificial Sequence
  chemically synthesized
gctttcatacaataccctga

SEQ ID NO: 389683 - DNA, 20 bp, Artificial Sequence
  chemically synthesized
ctttcatacaataccctgaa

SEQ ID NO: 389684 - DNA, 20 bp, Artificial Sequence
  chemically synthesized
tcttacactagtacccttca

SEQ ID NO: 389685 - DNA, 20 bp, Artificial Sequence
  chemically synthesized
gtcttacactagtacccttc

SEQ ID NO: 389686 - DNA, 20 bp, Artificial Sequence
  chemically synthesized
tgtcttacactagtaccctt

SEQ ID NO: 389687 - DNA, 20 bp, Artificial Sequence
  chemically synthesized
tacaataccctgaagggtac

SEQ ID NO: 389688 - DNA, 20 bp, Artificial Sequence
  chemically synthesized
accctgaagggtactagtgt

SEQ ID NO: 389689 - DNA, 20 bp, Artificial Sequence
  chemically synthesized
ttcttgcccctgtcttacac

SEQ ID NO: 389690 - DNA, 20 bp, Artificial Sequence
  chemically synthesized
tgaagggtactagtgtaaga

SEQ ID NO: 389691 - DNA, 20 bp, Artificial Sequence
  chemically synthesized
gaagggtactagtgtaagac

SEQ ID NO: 389692 - DNA, 20 bp, Artificial Sequence
  chemically synthesized
aagggtactagtgtaagaca

SEQ ID NO: 389693 - DNA, 20 bp, Artificial Sequence
  chemically synthesized
agggtactagtgtaagacag

SEQ ID NO: 389694 - DNA, 20 bp, Artificial Sequence
  chemically synthesized
tactagtgtaagacaggggc

SEQ ID NO: 389695 - DNA, 20 bp, Artificial Sequence
  chemically synthesized
agtgtaagacaggggcaaga

SEQ ID NO: 389696 - DNA, 20 bp, Artificial Sequence
  chemically synthesized
agacaggggcaagaaagaaa

SEQ ID NO: 389697 - DNA, 20 bp, Artificial Sequence
  chemically synthesized
gaaagaaacagtgatgatgt

SEQ ID NO: 389698 - DNA, 20 bp, Artificial Sequence
  chemically synthesized
atccatgaaggacagttatc

SEQ ID NO: 389699 - DNA, 20 bp, Artificial Sequence
  chemically synthesized
gatccatgaaggacagttat

SEQ ID NO: 389700 - DNA, 20 bp, Artificial Sequence
  chemically synthesized
gacccgataactgtccttca

SEQ ID NO: 389701 - DNA, 20 bp, Artificial Sequence
  chemically synthesized
ttgtgtagatccatgaagga

SEQ ID NO: 389702 - DNA, 20 bp, Artificial Sequence
  chemically synthesized
gaggttgtgtagatccatga

SEQ ID NO: 389703 - DNA, 20 bp, Artificial Sequence
  chemically synthesized
agaggttgtgtagatccatg

SEQ ID NO: 389704 - DNA, 20 bp, Artificial Sequence
  chemically synthesized
aggcatttccagaggttgtg

SEQ ID NO: 389705 - DNA, 20 bp, Artificial Sequence
  chemically synthesized
tcatggatctacacaacctc

SEQ ID NO: 389706 - DNA, 20 bp, Artificial Sequence
  chemically synthesized
caggcagaaggcatttccag

SEQ ID NO: 389707 - DNA, 20 bp, Artificial Sequence
  chemically synthesized
gcaggcagaaggcatttcca

SEQ ID NO: 389708 - DNA, 20 bp, Artificial Sequence
  chemically synthesized
ttgcaggcagaaggcatttc

SEQ ID NO: 389709 - DNA, 20 bp, Artificial Sequence
  chemically synthesized
tgacgcttcttgcaggcaga

SEQ ID NO: 389710 - DNA, 20 bp, Artificial Sequence
  chemically synthesized
ctgacgcttcttgcaggcag

SEQ ID NO: 389711 - DNA, 20 bp, Artificial Sequence
  chemically synthesized
tggaaatgccttctgcctgc

SEQ ID NO: 389712 - DNA, 20 bp, Artificial Sequence
  chemically synthesized
ctcctgacgcttcttgcagg

SEQ ID NO: 389713 - DNA, 20 bp, Artificial Sequence
  chemically synthesized
aaatgccttctgcctgcaag

SEQ ID NO: 389714 - DNA, 20 bp, Artificial Sequence
  chemically synthesized
gggctcctgacgcttcttgc

SEQ ID NO: 389715 - DNA, 20 bp, Artificial Sequence
  chemically synthesized
agggctcctgacgcttcttg

SEQ ID NO: 389716 - DNA, 20 bp, Artificial Sequence
  chemically synthesized
cttctgcctgcaagaagcgt

SEQ ID NO: 389717 - DNA, 20 bp, Artificial Sequence
  chemically synthesized
ttctgcctgcaagaagcgtc

SEQ ID NO: 389718 - DNA, 20 bp, Artificial Sequence
  chemically synthesized
ctgcctgcaagaagcgtcag

SEQ ID NO: 389719 - DNA, 20 bp, Artificial Sequence
  chemically synthesized
gcaagaagcgtcaggagccc

SEQ ID NO: 389720 - DNA, 20 bp, Artificial Sequence
  chemically synthesized
atatattagcatatgttcta

SEQ ID NO: 389721 - DNA, 20 bp, Artificial Sequence
  chemically synthesized
tatatattagcatatgttct

SEQ ID NO: 389722 - DNA, 20 bp, Artificial Sequence
  chemically synthesized
atatatattagcatatgttc

SEQ ID NO: 389723 - DNA, 20 bp, Artificial Sequence
  chemically synthesized
gcctccttaattatatatat

SEQ ID NO: 389724 - DNA, 20 bp, Artificial Sequence
  chemically synthesized
atatgctaatatatataatt

SEQ ID NO: 389725 - DNA, 20 bp, Artificial Sequence
  chemically synthesized
tatgctaatatatataatta

SEQ ID NO: 389726 - DNA, 20 bp, Artificial Sequence
  chemically synthesized
tgctaatatatataattaag

SEQ ID NO: 389727 - DNA, 20 bp, Artificial Sequence
  chemically synthesized
gctaatatatataattaagg

SEQ ID NO: 389728 - DNA, 20 bp, Artificial Sequence
  chemically synthesized
atatataattaaggaggcca

SEQ ID NO: 389729 - DNA, 20 bp, Artificial Sequence
  chemically synthesized
tagagtggtatgattgtctt

SEQ ID NO: 389730 - DNA, 20 bp, Artificial Sequence
  chemically synthesized
ataaatttcgttgaatagag

SEQ ID NO: 389731 - DNA, 20 bp, Artificial Sequence
  chemically synthesized
tatataaatttcgttgaata

SEQ ID NO: 389732 - DNA, 20 bp, Artificial Sequence
  chemically synthesized
aatatataaatttcgttgaa

SEQ ID NO: 389733 - DNA, 20 bp, Artificial Sequence
  chemically synthesized
atacacgcatgccacatata

SEQ ID NO: 389734 - DNA, 20 bp, Artificial Sequence
  chemically synthesized
tgcataaatttctgtatatg

SEQ ID NO: 389735 - DNA, 20 bp, Artificial Sequence
  chemically synthesized
ttatgcatacatgtgtattg

SEQ ID NO: 389736 - DNA, 20 bp, Artificial Sequence
  chemically synthesized
atacatgtgtattgtagttt

SEQ ID NO: 389737 - DNA, 20 bp, Artificial Sequence
  chemically synthesized
agtttcataataaaactcaa

SEQ ID NO: 389738 - DNA, 20 bp, Artificial Sequence
  chemically synthesized
cataataaaactcaaaagtg

SEQ ID NO: 389739 - DNA, 20 bp, Artificial Sequence
  chemically synthesized
tgtgaactgtcttcactttt

SEQ ID NO: 389740 - DNA, 20 bp, Artificial Sequence
  chemically synthesized
ataaaactcaaaagtgaaga

SEQ ID NO: 389741 - DNA, 20 bp, Artificial Sequence
  chemically synthesized
ttcacatgcacacgaattat

SEQ ID NO: 389742 - DNA, 20 bp, Artificial Sequence
  chemically synthesized
gaattattagacacaaaaat

SEQ ID NO: 389743 - DNA, 20 bp, Artificial Sequence
  chemically synthesized
ttattagacacaaaaattgg

SEQ ID NO: 389744 - DNA, 20 bp, Artificial Sequence
  chemically synthesized
tattagacacaaaaattgga

SEQ ID NO: 389745 - DNA, 20 bp, Artificial Sequence
  chemically synthesized
ttagacacaaaaattggaag

SEQ ID NO: 389746 - DNA, 20 bp, Artificial Sequence
  chemically synthesized
tagacacaaaaattggaagg

SEQ ID NO: 389747 - DNA, 20 bp, Artificial Sequence
  chemically synthesized
acaaaaattggaaggaggta

SEQ ID NO: 389748 - DNA, 20 bp, Artificial Sequence
  chemically synthesized
caaaaattggaaggaggtaa

SEQ ID NO: 389749 - DNA, 20 bp, Artificial Sequence
  chemically synthesized
gaaggaggtaaaggataata

SEQ ID NO: 389750 - DNA, 20 bp, Artificial Sequence
  chemically synthesized
ataataaagtgttataataa

SEQ ID NO: 389751 - DNA, 20 bp, Artificial Sequence
  chemically synthesized
taataaagtgttataataac

SEQ ID NO: 389752 - DNA, 20 bp, Artificial Sequence
  chemically synthesized
gtgttataataacaggctga

SEQ ID NO: 389753 - DNA, 20 bp, Artificial Sequence
  chemically synthesized
agacagaatcatagttcttt

SEQ ID NO: 389754 - DNA, 20 bp, Artificial Sequence
  chemically synthesized
ggataaagaagacagaatca

SEQ ID NO: 389755 - DNA, 20 bp, Artificial Sequence
  chemically synthesized
tcattttgggataaagaaga

SEQ ID NO: 389756 - DNA, 20 bp, Artificial Sequence
  chemically synthesized
aagttcattttgggataaag

SEQ ID NO: 389757 - DNA, 20 bp, Artificial Sequence
  chemically synthesized
attaagttcattttgggata

SEQ ID NO: 389758 - DNA, 20 bp, Artificial Sequence
  chemically synthesized
taatttattaagttcatttt

SEQ ID NO: 389759 - DNA, 20 bp, Artificial Sequence
  chemically synthesized
ttaatttattaagttcattt

SEQ ID NO: 389760 - DNA, 20 bp, Artificial Sequence
  chemically synthesized
tgaggttatattaatttatt

SEQ ID NO: 389761 - DNA, 20 bp, Artificial Sequence
  chemically synthesized
attaatataacctcaattgc

SEQ ID NO: 389762 - DNA, 20 bp, Artificial Sequence
  chemically synthesized
tgttcttcctcttgcaattg

SEQ ID NO: 389763 - DNA, 20 bp, Artificial Sequence
  chemically synthesized
gtgttcttcctcttgcaatt

SEQ ID NO: 389764 - DNA, 20 bp, Artificial Sequence
  chemically synthesized
taatataacctcaattgcaa

SEQ ID NO: 389765 - DNA, 20 bp, Artificial Sequence
  chemically synthesized
aatataacctcaattgcaag

SEQ ID NO: 389766 - DNA, 20 bp, Artificial Sequence
  chemically synthesized
ataacctcaattgcaagagg

SEQ ID NO: 389767 - DNA, 20 bp, Artificial Sequence
  chemically synthesized
tgcaagaggaagaacacgtt

SEQ ID NO: 389768 - DNA, 20 bp, Artificial Sequence
  chemically synthesized
gcaagaggaagaacacgttg

SEQ ID NO: 389769 - DNA, 20 bp, Artificial Sequence
  chemically synthesized
acacgttgaggttgcatact

SEQ ID NO: 389770 - DNA, 20 bp, Artificial Sequence
  chemically synthesized
cacgttgaggttgcatacta

SEQ ID NO: 389771 - DNA, 20 bp, Artificial Sequence
  chemically synthesized
atcagatataaaatacacct

SEQ ID NO: 389772 - DNA, 20 bp, Artificial Sequence
  chemically synthesized
aaggtgtattttatatctga

SEQ ID NO: 389773 - DNA, 20 bp, Artificial Sequence
  chemically synthesized
tttcatagctatggaaccat

SEQ ID NO: 389774 - DNA, 20 bp, Artificial Sequence
  chemically synthesized
ttttatatctgatggttcca

SEQ ID NO: 389775 - DNA, 20 bp, Artificial Sequence
  chemically synthesized
catcaagactttcatagcta

SEQ ID NO: 389776 - DNA, 20 bp, Artificial Sequence
  chemically synthesized
tgatggttccatagctatga

SEQ ID NO: 389777 - DNA, 20 bp, Artificial Sequence
  chemically synthesized
tggcatcatcaagactttca

SEQ ID NO: 389778 - DNA, 20 bp, Artificial Sequence
  chemically synthesized
tgcctagcattggcatcatc

SEQ ID NO: 389779 - DNA, 20 bp, Artificial Sequence
  chemically synthesized
agtcttgatgatgccaatgc

SEQ ID NO: 389780 - DNA, 20 bp, Artificial Sequence
  chemically synthesized
gtcttgatgatgccaatgct

SEQ ID NO: 389781 - DNA, 20 bp, Artificial Sequence
  chemically synthesized
caaatttggatgcctagcat

SEQ ID NO: 389782 - DNA, 20 bp, Artificial Sequence
  chemically synthesized
cttctgcaaatttggatgcc

SEQ ID NO: 389783 - DNA, 20 bp, Artificial Sequence
  chemically synthesized
atgctaggcatccaaatttg

SEQ ID NO: 389784 - DNA, 20 bp, Artificial Sequence
  chemically synthesized
agattttgcttctgcaaatt

SEQ ID NO: 389785 - DNA, 20 bp, Artificial Sequence
  chemically synthesized
ctaggcatccaaatttgcag

SEQ ID NO: 389786 - DNA, 20 bp, Artificial Sequence
  chemically synthesized
atttgcagaagcaaaatctc

SEQ ID NO: 389787 - DNA, 20 bp, Artificial Sequence
  chemically synthesized
gcagaagcaaaatctctggt

SEQ ID NO: 389788 - DNA, 20 bp, Artificial Sequence
  chemically synthesized
acacattttcaatctgacca

SEQ ID NO: 389789 - DNA, 20 bp, Artificial Sequence
  chemically synthesized
taacacattttcaatctgac

SEQ ID NO: 389790 - DNA, 20 bp, Artificial Sequence
  chemically synthesized
gtcagattgaaaatgtgtta

SEQ ID NO: 389791 - DNA, 20 bp, Artificial Sequence
  chemically synthesized
gattgaaaatgtgttacagt

SEQ ID NO: 389792 - DNA, 20 bp, Artificial Sequence
  chemically synthesized
attgaaaatgtgttacagta

SEQ ID NO: 389793 - DNA, 20 bp, Artificial Sequence
  chemically synthesized
tgaaaatgtgttacagtaag

SEQ ID NO: 389794 - DNA, 20 bp, Artificial Sequence
  chemically synthesized
gaaaatgtgttacagtaagg

SEQ ID NO: 389795 - DNA, 20 bp, Artificial Sequence
  chemically synthesized
aaatgtgttacagtaaggag

SEQ ID NO: 389796 - DNA, 20 bp, Artificial Sequence
  chemically synthesized
aatgtgttacagtaaggagg

SEQ ID NO: 389797 - DNA, 20 bp, Artificial Sequence
  chemically synthesized
agagaaaaaagatgagagat

SEQ ID NO: 389798 - DNA, 20 bp, Artificial Sequence
  chemically synthesized
tatgcagagaaaaaagatga

SEQ ID NO: 389799 - DNA, 20 bp, Artificial Sequence
  chemically synthesized
tttatgcagagaaaaaagat

SEQ ID NO: 389800 - DNA, 20 bp, Artificial Sequence
  chemically synthesized
caaaatttatgcagagaaaa

SEQ ID NO: 389801 - DNA, 20 bp, Artificial Sequence
  chemically synthesized
gcacactcaaaatttatgca

SEQ ID NO: 389802 - DNA, 20 bp, Artificial Sequence
  chemically synthesized
tagcacactcaaaatttatg

SEQ ID NO: 389803 - DNA, 20 bp, Artificial Sequence
  chemically synthesized
tttttctctgcataaatttt

SEQ ID NO: 389804 - DNA, 20 bp, Artificial Sequence
  chemically synthesized
caacttacttattgtgtggt

SEQ ID NO: 389805 - DNA, 20 bp, Artificial Sequence
  chemically synthesized
gagtgtgctaaccacacaat

SEQ ID NO: 389806 - DNA, 20 bp, Artificial Sequence
  chemically synthesized
ttgacaacttacttattgtg

SEQ ID NO: 389807 - DNA, 20 bp, Artificial Sequence
  chemically synthesized
gtgctaaccacacaataagt

SEQ ID NO: 389808 - DNA, 20 bp, Artificial Sequence
  chemically synthesized
aatacaatcaatcaaaacag

SEQ ID NO: 389809 - DNA, 20 bp, Artificial Sequence
  chemically synthesized
attaatacaatcaatcaaaa

SEQ ID NO: 389810 - DNA, 20 bp, Artificial Sequence
  chemically synthesized
aacatgctcatttcaatatt

SEQ ID NO: 389811 - DNA, 20 bp, Artificial Sequence
  chemically synthesized
attaatccaaatattgaaat

SEQ ID NO: 389812 - DNA, 20 bp, Artificial Sequence
  chemically synthesized
ttaacaaggaagcagtaaag

SEQ ID NO: 389813 - DNA, 20 bp, Artificial Sequence
  chemically synthesized
gcgttaacaaggaagcagta

SEQ ID NO: 389814 - DNA, 20 bp, Artificial Sequence
  chemically synthesized
actaggcgttaacaaggaag

SEQ ID NO: 389815 - DNA, 20 bp, Artificial Sequence
  chemically synthesized
tttactaggcgttaacaagg

SEQ ID NO: 389816 - DNA, 20 bp, Artificial Sequence
  chemically synthesized
acatttactaggcgttaaca

SEQ ID NO: 389817 - DNA, 20 bp, Artificial Sequence
  chemically synthesized
aacatttactaggcgttaac

SEQ ID NO: 389818 - DNA, 20 bp, Artificial Sequence
  chemically synthesized
actgcttccttgttaacgcc

SEQ ID NO: 389819 - DNA, 20 bp, Artificial Sequence
  chemically synthesized
cttagtaattaacatttact

SEQ ID NO: 389820 - DNA, 20 bp, Artificial Sequence
  chemically synthesized
acttagtaattaacatttac

SEQ ID NO: 389821 - DNA, 20 bp, Artificial Sequence
  chemically synthesized
cctagtaaatgttaattact

SEQ ID NO: 389822 - DNA, 20 bp, Artificial Sequence
  chemically synthesized
taaatgttaattactaagta

SEQ ID NO: 389823 - DNA, 20 bp, Artificial Sequence
  chemically synthesized
attcattcagaaactttact

SEQ ID NO: 389824 - DNA, 20 bp, Artificial Sequence
  chemically synthesized
ctctggattatttattcatt

SEQ ID NO: 389825 - DNA, 20 bp, Artificial Sequence
  chemically synthesized
ttctgaatgaataaataatc

SEQ ID NO: 389826 - DNA, 20 bp, Artificial Sequence
  chemically synthesized
ctgaatgaataaataatcca

SEQ ID NO: 389827 - DNA, 20 bp, Artificial Sequence
  chemically synthesized
gtgggtataacatttatctc

SEQ ID NO: 389828 - DNA, 20 bp, Artificial Sequence
  chemically synthesized
taaatgttatacccacacct

SEQ ID NO: 389829 - DNA, 20 bp, Artificial Sequence
  chemically synthesized
aaatgttatacccacacctc

SEQ ID NO: 389830 - DNA, 20 bp, Artificial Sequence
  chemically synthesized
agtgggcattcctgaggtgt

SEQ ID NO: 389831 - DNA, 20 bp, Artificial Sequence
  chemically synthesized
cagtgggcattcctgaggtg

SEQ ID NO: 389832 - DNA, 20 bp, Artificial Sequence
  chemically synthesized
atcaccagtgggcattcctg

SEQ ID NO: 389833 - DNA, 20 bp, Artificial Sequence
  chemically synthesized
gatcaccagtgggcattcct

SEQ ID NO: 389834 - DNA, 20 bp, Artificial Sequence
  chemically synthesized
cacacctcaggaatgcccac

SEQ ID NO: 389835 - DNA, 20 bp, Artificial Sequence
  chemically synthesized
ttctcttgtagatcaccagt

SEQ ID NO: 389836 - DNA, 20 bp, Artificial Sequence
  chemically synthesized
cttctcttgtagatcaccag

SEQ ID NO: 389837 - DNA, 20 bp, Artificial Sequence
  chemically synthesized
caacttctcttgtagatcac

SEQ ID NO: 389838 - DNA, 20 bp, Artificial Sequence
  chemically synthesized
aatgcccactggtgatctac

SEQ ID NO: 389839 - DNA, 20 bp, Artificial Sequence
  chemically synthesized
tgcccactggtgatctacaa

SEQ ID NO: 389840 - DNA, 20 bp, Artificial Sequence
  chemically synthesized
ccactggtgatctacaagag

SEQ ID NO: 389841 - DNA, 20 bp, Artificial Sequence
  chemically synthesized
gttgaccccaacttctcttg

SEQ ID NO: 389842 - DNA, 20 bp, Artificial Sequence
  chemically synthesized
tggtgatctacaagagaagt

SEQ ID NO: 389843 - DNA, 20 bp, Artificial Sequence
  chemically synthesized
ggtgatctacaagagaagtt

SEQ ID NO: 389844 - DNA, 20 bp, Artificial Sequence
  chemically synthesized
gtgatctacaagagaagttg

SEQ ID NO: 389845 - DNA, 20 bp, Artificial Sequence
  chemically synthesized
agagaagttggggtcaacca

SEQ ID NO: 389846 - DNA, 20 bp, Artificial Sequence
  chemically synthesized
tgtatgacctttatacactt

SEQ ID NO: 389847 - DNA, 20 bp, Artificial Sequence
  chemically synthesized
ggggtcaaccaaagtgtata

SEQ ID NO: 389848 - DNA, 20 bp, Artificial Sequence
  chemically synthesized
gggtcaaccaaagtgtataa

SEQ ID NO: 389849 - DNA, 20 bp, Artificial Sequence
  chemically synthesized
caaagtgtataaaggtcata

SEQ ID NO: 389850 - DNA, 20 bp, Artificial Sequence
  chemically synthesized
gtgtataaaggtcatacaga

SEQ ID NO: 389851 - DNA, 20 bp, Artificial Sequence
  chemically synthesized
tgtataaaggtcatacagaa

SEQ ID NO: 389852 - DNA, 20 bp, Artificial Sequence
  chemically synthesized
aaggtcatacagaaaggact

SEQ ID NO: 389853 - DNA, 20 bp, Artificial Sequence
  chemically synthesized
aggtcatacagaaaggactc

SEQ ID NO: 389854 - DNA, 20 bp, Artificial Sequence
  chemically synthesized
gtcatacagaaaggactcag

SEQ ID NO: 389855 - DNA, 20 bp, Artificial Sequence
  chemically synthesized
tcatacagaaaggactcagg

SEQ ID NO: 389856 - DNA, 20 bp, Artificial Sequence
  chemically synthesized
ctcctttacattgacctcct

SEQ ID NO: 389857 - DNA, 20 bp, Artificial Sequence
  chemically synthesized
ggactcaggaggtcaatgta

SEQ ID NO: 389858 - DNA, 20 bp, Artificial Sequence
  chemically synthesized
gactcaggaggtcaatgtaa

SEQ ID NO: 389859 - DNA, 20 bp, Artificial Sequence
  chemically synthesized
ctcaggaggtcaatgtaaag

SEQ ID NO: 389860 - DNA, 20 bp, Artificial Sequence
  chemically synthesized
tcaggaggtcaatgtaaagg

SEQ ID NO: 389861 - DNA, 20 bp, Artificial Sequence
  chemically synthesized
ttttcatctttatgcgatgg

SEQ ID NO: 389862 - DNA, 20 bp, Artificial Sequence
  chemically synthesized
aaggaggcttccatcgcata

SEQ ID NO: 389863 - DNA, 20 bp, Artificial Sequence
  chemically synthesized
tatttttcatctttatgcga

SEQ ID NO: 389864 - DNA, 20 bp, Artificial Sequence
  chemically synthesized
cgcataaagatgaaaaatat

SEQ ID NO: 389865 - DNA, 20 bp, Artificial Sequence
  chemically synthesized
gcataaagatgaaaaatatg

SEQ ID NO: 389866 - DNA, 20 bp, Artificial Sequence
  chemically synthesized
tgaaaaatatgaggacaata

SEQ ID NO: 389867 - DNA, 20 bp, Artificial Sequence
  chemically synthesized
ggacaataaagatcataata

SEQ ID NO: 389868 - DNA, 20 bp, Artificial Sequence
  chemically synthesized
caataaagatcataatacag

SEQ ID NO: 389869 - DNA, 20 bp, Artificial Sequence
  chemically synthesized
aataaagatcataatacaga

SEQ ID NO: 389870 - DNA, 20 bp, Artificial Sequence
  chemically synthesized
aaagatcataatacagaagg

SEQ ID NO: 389871 - DNA, 20 bp, Artificial Sequence
  chemically synthesized
agatcataatacagaaggtg

SEQ ID NO: 389872 - DNA, 20 bp, Artificial Sequence
  chemically synthesized
atcataatacagaaggtgga

SEQ ID NO: 389873 - DNA, 20 bp, Artificial Sequence
  chemically synthesized
atacagaaggtggagagcct

SEQ ID NO: 389874 - DNA, 20 bp, Artificial Sequence
  chemically synthesized
aatatatttaaatgtaactg

SEQ ID NO: 389875 - DNA, 20 bp, Artificial Sequence
  chemically synthesized
aaatatatttaaatgtaact

SEQ ID NO: 389876 - DNA, 20 bp, Artificial Sequence
  chemically synthesized
tatttaaattcatgcattcg

SEQ ID NO: 389877 - DNA, 20 bp, Artificial Sequence
  chemically synthesized
tatcatccagttgtttgttt

SEQ ID NO: 389878 - DNA, 20 bp, Artificial Sequence
  chemically synthesized
gtgatgccaaaacaaacaac

SEQ ID NO: 389879 - DNA, 20 bp, Artificial Sequence
  chemically synthesized
tttatttatttattatcatc

SEQ ID NO: 389880 - DNA, 20 bp, Artificial Sequence
  chemically synthesized
taaataaataaaatattcac

SEQ ID NO: 389881 - DNA, 20 bp, Artificial Sequence
  chemically synthesized
ataaataaaatattcactgg

SEQ ID NO: 389882 - DNA, 20 bp, Artificial Sequence
  chemically synthesized
ataaaatattcactggtggt

SEQ ID NO: 389883 - DNA, 20 bp, Artificial Sequence
  chemically synthesized
taaaatattcactggtggtc

SEQ ID NO: 389884 - DNA, 20 bp, Artificial Sequence
  chemically synthesized
gagccaccgcacccgaccac

SEQ ID NO: 389885 - DNA, 20 bp, Artificial Sequence
  chemically synthesized
tattcactggtggtcgggtg

SEQ ID NO: 389886 - DNA, 20 bp, Artificial Sequence
  chemically synthesized
tcactggtggtcgggtgcgg

SEQ ID NO: 389887 - DNA, 20 bp, Artificial Sequence
  chemically synthesized
agtgctgggattacaggcgt

SEQ ID NO: 389888 - DNA, 20 bp, Artificial Sequence
  chemically synthesized
gtggctcacgcctgtaatcc

SEQ ID NO: 389889 - DNA, 20 bp, Artificial Sequence
  chemically synthesized
tcccaaagtgctgggattac

SEQ ID NO: 389890 - DNA, 20 bp, Artificial Sequence
  chemically synthesized
ctcccaaagtgctgggatta

SEQ ID NO: 389891 - DNA, 20 bp, Artificial Sequence
  chemically synthesized
cgcctgtaatcccagcactt

SEQ ID NO: 389892 - DNA, 20 bp, Artificial Sequence
  chemically synthesized
cctcagcctcccaaagtgct

SEQ ID NO: 389893 - DNA, 20 bp, Artificial Sequence
  chemically synthesized
gcctgtaatcccagcacttt

SEQ ID NO: 389894 - DNA, 20 bp, Artificial Sequence
  chemically synthesized
acctcagcctcccaaagtgc

SEQ ID NO: 389895 - DNA, 20 bp, Artificial Sequence
  chemically synthesized
ctgtaatcccagcactttgg

SEQ ID NO: 389896 - DNA, 20 bp, Artificial Sequence
  chemically synthesized
tgtaatcccagcactttggg

SEQ ID NO: 389897 - DNA, 20 bp, Artificial Sequence
  chemically synthesized
ctgcccacctcagcctccca

SEQ ID NO: 389898 - DNA, 20 bp, Artificial Sequence
  chemically synthesized
tcccagcactttgggaggct

SEQ ID NO: 389899 - DNA, 20 bp, Artificial Sequence
  chemically synthesized
cccagcactttgggaggctg

SEQ ID NO: 389900 - DNA, 20 bp, Artificial Sequence
  chemically synthesized
agcactttgggaggctgagg

SEQ ID NO: 389901 - DNA, 20 bp, Artificial Sequence
  chemically synthesized
gcactttgggaggctgaggt

SEQ ID NO: 389902 - DNA, 20 bp, Artificial Sequence
  chemically synthesized
ctttgggaggctgaggtggg

SEQ ID NO: 389903 - DNA, 20 bp, Artificial Sequence
  chemically synthesized
acctcgtgatctgcccacct

SEQ ID NO: 389904 - DNA, 20 bp, Artificial Sequence
  chemically synthesized
ggctgaggtgggcagatcac

SEQ ID NO: 389905 - DNA, 20 bp, Artificial Sequence
  chemically synthesized
gctgaggtgggcagatcacg

SEQ ID NO: 389906 - DNA, 20 bp, Artificial Sequence
  chemically synthesized
ggtgggcagatcacgaggtc

SEQ ID NO: 389907 - DNA, 20 bp, Artificial Sequence
  chemically synthesized
tgggcagatcacgaggtcaa

SEQ ID NO: 389908 - DNA, 20 bp, Artificial Sequence
  chemically synthesized
gatcacgaggtcaagagatc

SEQ ID NO: 389909 - DNA, 20 bp, Artificial Sequence
  chemically synthesized
tcaagagatcgagaccgtcc

SEQ ID NO: 389910 - DNA, 20 bp, Artificial Sequence
  chemically synthesized
caccatgatgttggccagga

SEQ ID NO: 389911 - DNA, 20 bp, Artificial Sequence
  chemically synthesized
gtttcaccatgatgttggcc

SEQ ID NO: 389912 - DNA, 20 bp, Artificial Sequence
  chemically synthesized
ggtttcaccatgatgttggc

SEQ ID NO: 389913 - DNA, 20 bp, Artificial Sequence
  chemically synthesized
gaccgtcctggccaacatca

SEQ ID NO: 389914 - DNA, 20 bp, Artificial Sequence
  chemically synthesized
acggggtttcaccatgatgt

SEQ ID NO: 389915 - DNA, 20 bp, Artificial Sequence
  chemically synthesized
ttgtatttttagtagagacg

SEQ ID NO: 389916 - DNA, 20 bp, Artificial Sequence
  chemically synthesized
tttgtatttttagtagagac

SEQ ID NO: 389917 - DNA, 20 bp, Artificial Sequence
  chemically synthesized
ttttgtatttttagtagaga

SEQ ID NO: 389918 - DNA, 20 bp, Artificial Sequence
  chemically synthesized
taatttttgtatttttagta

SEQ ID NO: 389919 - DNA, 20 bp, Artificial Sequence
  chemically synthesized
gctaatttttgtatttttag

SEQ ID NO: 389920 - DNA, 20 bp, Artificial Sequence
  chemically synthesized
ccagctaatttttgtatttt

SEQ ID NO: 389921 - DNA, 20 bp, Artificial Sequence
  chemically synthesized
tctactaaaaatacaaaaat

SEQ ID NO: 389922 - DNA, 20 bp, Artificial Sequence
  chemically synthesized
ctaaaaatacaaaaattagc

SEQ ID NO: 389923 - DNA, 20 bp, Artificial Sequence
  chemically synthesized
taaaaatacaaaaattagct

SEQ ID NO: 389924 - DNA, 20 bp, Artificial Sequence
  chemically synthesized
atacaaaaattagctgggcg

SEQ ID NO: 389925 - DNA, 20 bp, Artificial Sequence
  chemically synthesized
caaaaattagctgggcgtgg

SEQ ID NO: 389926 - DNA, 20 bp, Artificial Sequence
  chemically synthesized
cagacgcgcaccaccacgcc

SEQ ID NO: 389927 - DNA, 20 bp, Artificial Sequence
  chemically synthesized
ggcgtggtggtgcgcgtctg

SEQ ID NO: 389928 - DNA, 20 bp, Artificial Sequence
  chemically synthesized
gtggtgcgcgtctgtagtcc

SEQ ID NO: 389929 - DNA, 20 bp, Artificial Sequence
  chemically synthesized
ctcccgaatagctgggacta

SEQ ID NO: 389930 - DNA, 20 bp, Artificial Sequence
  chemically synthesized
cgtctgtagtcccagctatt

SEQ ID NO: 389931 - DNA, 20 bp, Artificial Sequence
  chemically synthesized
cctcatcctcccgaatagct

SEQ ID NO: 389932 - DNA, 20 bp, Artificial Sequence
  chemically synthesized
gtctgtagtcccagctattc

SEQ ID NO: 389933 - DNA, 20 bp, Artificial Sequence
  chemically synthesized
gcctcatcctcccgaatagc

SEQ ID NO: 389934 - DNA, 20 bp, Artificial Sequence
  chemically synthesized
ctgtagtcccagctattcgg

SEQ ID NO: 389935 - DNA, 20 bp, Artificial Sequence
  chemically synthesized
tgtagtcccagctattcggg

SEQ ID NO: 389936 - DNA, 20 bp, Artificial Sequence
  chemically synthesized
tcctgcctcatcctcccgaa

SEQ ID NO: 389937 - DNA, 20 bp, Artificial Sequence
  chemically synthesized
tcccagctattcgggaggat

SEQ ID NO: 389938 - DNA, 20 bp, Artificial Sequence
  chemically synthesized
cccagctattcgggaggatg

SEQ ID NO: 389939 - DNA, 20 bp, Artificial Sequence
  chemically synthesized
agctattcgggaggatgagg

SEQ ID NO: 389940 - DNA, 20 bp, Artificial Sequence
  chemically synthesized
gctattcgggaggatgaggc

SEQ ID NO: 389941 - DNA, 20 bp, Artificial Sequence
  chemically synthesized
tattcgggaggatgaggcag

SEQ ID NO: 389942 - DNA, 20 bp, Artificial Sequence
  chemically synthesized
cctccacctctcaggttcaa

SEQ ID NO: 389943 - DNA, 20 bp, Artificial Sequence
  chemically synthesized
caggagaatcccttgaacct

SEQ ID NO: 389944 - DNA, 20 bp, Artificial Sequence
  chemically synthesized
acctccacctctcaggttca

SEQ ID NO: 389945 - DNA, 20 bp, Artificial Sequence
  chemically synthesized
aacctccacctctcaggttc

SEQ ID NO: 389946 - DNA, 20 bp, Artificial Sequence
  chemically synthesized
ggagaatcccttgaacctga

SEQ ID NO: 389947 - DNA, 20 bp, Artificial Sequence
  chemically synthesized
gagaatcccttgaacctgag

SEQ ID NO: 389948 - DNA, 20 bp, Artificial Sequence
  chemically synthesized
aatcccttgaacctgagagg

SEQ ID NO: 389949 - DNA, 20 bp, Artificial Sequence
  chemically synthesized
acttgcaacctccacctctc

SEQ ID NO: 389950 - DNA, 20 bp, Artificial Sequence
  chemically synthesized
tcccttgaacctgagaggtg

SEQ ID NO: 389951 - DNA, 20 bp, Artificial Sequence
  chemically synthesized
cacttgcaacctccacctct

SEQ ID NO: 389952 - DNA, 20 bp, Artificial Sequence
  chemically synthesized
cccttgaacctgagaggtgg

SEQ ID NO: 389953 - DNA, 20 bp, Artificial Sequence
  chemically synthesized
acctgagaggtggaggttgc

SEQ ID NO: 389954 - DNA, 20 bp, Artificial Sequence
  chemically synthesized
gagaggtggaggttgcaagt

SEQ ID NO: 389955 - DNA, 20 bp, Artificial Sequence
  chemically synthesized
gtggaggttgcaagtgagcc

SEQ ID NO: 389956 - DNA, 20 bp, Artificial Sequence
  chemically synthesized
ggagtgcagcagcgtgatct

SEQ ID NO: 389957 - DNA, 20 bp, Artificial Sequence
  chemically synthesized
gtcaccaggctggagtgcag

SEQ ID NO: 389958 - DNA, 20 bp, Artificial Sequence
  chemically synthesized
aagatcacgctgctgcactc

SEQ ID NO: 389959 - DNA, 20 bp, Artificial Sequence
  chemically synthesized
tctgtcaccaggctggagtg

SEQ ID NO: 389960 - DNA, 20 bp, Artificial Sequence
  chemically synthesized
cacgctgctgcactccagcc

SEQ ID NO: 389961 - DNA, 20 bp, Artificial Sequence
  chemically synthesized
cttgctctgtcaccaggctg

SEQ ID NO: 389962 - DNA, 20 bp, Artificial Sequence
  chemically synthesized
gtcttgctctgtcaccaggc

SEQ ID NO: 389963 - DNA, 20 bp, Artificial Sequence
  chemically synthesized
gctgcactccagcctggtga

SEQ ID NO: 389964 - DNA, 20 bp, Artificial Sequence
  chemically synthesized
tgcactccagcctggtgaca

SEQ ID NO: 389965 - DNA, 20 bp, Artificial Sequence
  chemically synthesized
tggagtcttgctctgtcacc

SEQ ID NO: 389966 - DNA, 20 bp, Artificial Sequence
  chemically synthesized
atggagtcttgctctgtcac

SEQ ID NO: 389967 - DNA, 20 bp, Artificial Sequence
  chemically synthesized
ctccagcctggtgacagagc

SEQ ID NO: 389968 - DNA, 20 bp, Artificial Sequence
  chemically synthesized
ttttttttttttttgagatg

SEQ ID NO: 389969 - DNA, 20 bp, Artificial Sequence
  chemically synthesized
ttttttttttttttttgaga

SEQ ID NO: 389970 - DNA, 20 bp, Artificial Sequence
  chemically synthesized
tttttttttttttttttttt

SEQ ID NO: 389971 - DNA, 20 bp, Artificial Sequence
  chemically synthesized
aaaaaaaaaaaaaaattcac

SEQ ID NO: 389972 - DNA, 20 bp, Artificial Sequence
  chemically synthesized
tagtctcttccaaaagttgc

SEQ ID NO: 389973 - DNA, 20 bp, Artificial Sequence
  chemically synthesized
aaaaattcactggcaacttt

SEQ ID NO: 389974 - DNA, 20 bp, Artificial Sequence
  chemically synthesized
aattcactggcaacttttgg

SEQ ID NO: 389975 - DNA, 20 bp, Artificial Sequence
  chemically synthesized
ttcactggcaacttttggaa

SEQ ID NO: 389976 - DNA, 20 bp, Artificial Sequence
  chemically synthesized
gcttctctagtctcttccaa

SEQ ID NO: 389977 - DNA, 20 bp, Artificial Sequence
  chemically synthesized
tggcaacttttggaagagac

SEQ ID NO: 389978 - DNA, 20 bp, Artificial Sequence
  chemically synthesized
gcaacttttggaagagacta

SEQ ID NO: 389979 - DNA, 20 bp, Artificial Sequence
  chemically synthesized
acttttggaagagactagag

SEQ ID NO: 389980 - DNA, 20 bp, Artificial Sequence
  chemically synthesized
aaaataatgaattgcttctc

SEQ ID NO: 389981 - DNA, 20 bp, Artificial Sequence
  chemically synthesized
tattttgaaaattgttcttt

SEQ ID NO: 389982 - DNA, 20 bp, Artificial Sequence
  chemically synthesized
attttgaaaattgttctttt

SEQ ID NO: 389983 - DNA, 20 bp, Artificial Sequence
  chemically synthesized
ttttgaaaattgttcttttg

SEQ ID NO: 389984 - DNA, 20 bp, Artificial Sequence
  chemically synthesized
tttgaaaattgttcttttgg

SEQ ID NO: 389985 - DNA, 20 bp, Artificial Sequence
  chemically synthesized
tgcttcagtttttcccccaa

SEQ ID NO: 389986 - DNA, 20 bp, Artificial Sequence
  chemically synthesized
ttcttttgggggaaaaactg

SEQ ID NO: 389987 - DNA, 20 bp, Artificial Sequence
  chemically synthesized
gcaaagcagagtaaatgctt

SEQ ID NO: 389988 - DNA, 20 bp, Artificial Sequence
  chemically synthesized
aattgatacaaagcaaagca

SEQ ID NO: 389989 - DNA, 20 bp, Artificial Sequence
  chemically synthesized
ataattgatacaaagcaaag

SEQ ID NO: 389990 - DNA, 20 bp, Artificial Sequence
  chemically synthesized
agtataattgatacaaagca

SEQ ID NO: 389991 - DNA, 20 bp, Artificial Sequence
  chemically synthesized
ctcatagtataattgataca

SEQ ID NO: 389992 - DNA, 20 bp, Artificial Sequence
  chemically synthesized
ctttgtatcaattatactat

SEQ ID NO: 389993 - DNA, 20 bp, Artificial Sequence
  chemically synthesized
tttgtatcaattatactatg

SEQ ID NO: 389994 - DNA, 20 bp, Artificial Sequence
  chemically synthesized
atttctatttggttgcctca

SEQ ID NO: 389995 - DNA, 20 bp, Artificial Sequence
  chemically synthesized
tatactatgaggcaaccaaa

SEQ ID NO: 389996 - DNA, 20 bp, Artificial Sequence
  chemically synthesized
gagaactctgcatttctatt

SEQ ID NO: 389997 - DNA, 20 bp, Artificial Sequence
  chemically synthesized
gaggcaaccaaatagaaatg

SEQ ID NO: 389998 - DNA, 20 bp, Artificial Sequence
  chemically synthesized
ggcaaccaaatagaaatgca

SEQ ID NO: 389999 - DNA, 20 bp, Artificial Sequence
  chemically synthesized
aaatgcagagttctctttat

SEQ ID NO: 390000 - DNA, 20 bp, Artificial Sequence
  chemically synthesized
cactgagcccggcttataaa

SEQ ID NO: 390001 - DNA, 20 bp, Artificial Sequence
  chemically synthesized
gcagagttctctttataagc

SEQ ID NO: 390002 - DNA, 20 bp, Artificial Sequence
  chemically synthesized
gtcactgagcccggcttata

SEQ ID NO: 390003 - DNA, 20 bp, Artificial Sequence
  chemically synthesized
cagagttctctttataagcc

SEQ ID NO: 390004 - DNA, 20 bp, Artificial Sequence
  chemically synthesized
ttctctttataagccgggct

SEQ ID NO: 390005 - DNA, 20 bp, Artificial Sequence
  chemically synthesized
caggtgtgagtcactgagcc

SEQ ID NO: 390006 - DNA, 20 bp, Artificial Sequence
  chemically synthesized
gattacaggtgtgagtcact

SEQ ID NO: 390007 - DNA, 20 bp, Artificial Sequence
  chemically synthesized
agtgctgggattacaggtgt

SEQ ID NO: 390008 - DNA, 20 bp, Artificial Sequence
  chemically synthesized
gtgactcacacctgtaatcc

SEQ ID NO: 390009 - DNA, 20 bp, Artificial Sequence
  chemically synthesized
ttccaaagtgctgggattac

SEQ ID NO: 390010 - DNA, 20 bp, Artificial Sequence
  chemically synthesized
tttccaaagtgctgggatta

SEQ ID NO: 390011 - DNA, 20 bp, Artificial Sequence
  chemically synthesized
cacctgtaatcccagcactt

SEQ ID NO: 390012 - DNA, 20 bp, Artificial Sequence
  chemically synthesized
cctttgctttccaaagtgct

SEQ ID NO: 390013 - DNA, 20 bp, Artificial Sequence
  chemically synthesized
acctttgctttccaaagtgc

SEQ ID NO: 390014 - DNA, 20 bp, Artificial Sequence
  chemically synthesized
tgtaatcccagcactttgga

SEQ ID NO: 390015 - DNA, 20 bp, Artificial Sequence
  chemically synthesized
ccacccacctttgctttcca

SEQ ID NO: 390016 - DNA, 20 bp, Artificial Sequence
  chemically synthesized
tcccagcactttggaaagca

SEQ ID NO: 390017 - DNA, 20 bp, Artificial Sequence
  chemically synthesized
cccagcactttggaaagcaa

SEQ ID NO: 390018 - DNA, 20 bp, Artificial Sequence
  chemically synthesized
agcactttggaaagcaaagg

SEQ ID NO: 390019 - DNA, 20 bp, Artificial Sequence
  chemically synthesized
gcactttggaaagcaaaggt

SEQ ID NO: 390020 - DNA, 20 bp, Artificial Sequence
  chemically synthesized
ctttggaaagcaaaggtggg

SEQ ID NO: 390021 - DNA, 20 bp, Artificial Sequence
  chemically synthesized
caaaggtgggtggatcacct

SEQ ID NO: 390022 - DNA, 20 bp, Artificial Sequence
  chemically synthesized
aaaggtgggtggatcacctg

SEQ ID NO: 390023 - DNA, 20 bp, Artificial Sequence
  chemically synthesized
gtgggtggatcacctgaggt

SEQ ID NO: 390024 - DNA, 20 bp, Artificial Sequence
  chemically synthesized
tgggtggatcacctgaggtc

SEQ ID NO: 390025 - DNA, 20 bp, Artificial Sequence
  chemically synthesized
ggtctcaaactcctgacctc

SEQ ID NO: 390026 - DNA, 20 bp, Artificial Sequence
  chemically synthesized
ggtggatcacctgaggtcag

SEQ ID NO: 390027 - DNA, 20 bp, Artificial Sequence
  chemically synthesized
tggtctcaaactcctgacct

SEQ ID NO: 390028 - DNA, 20 bp, Artificial Sequence
  chemically synthesized
tcacctgaggtcaggagttt

SEQ ID NO: 390029 - DNA, 20 bp, Artificial Sequence
  chemically synthesized
tgaggtcaggagtttgagac

SEQ ID NO: 390030 - DNA, 20 bp, Artificial Sequence
  chemically synthesized
tcaggagtttgagaccagcc

SEQ ID NO: 390031 - DNA, 20 bp, Artificial Sequence
  chemically synthesized
ttctgccatgttggccaggc

SEQ ID NO: 390032 - DNA, 20 bp, Artificial Sequence
  chemically synthesized
gggattctgccatgttggcc

SEQ ID NO: 390033 - DNA, 20 bp, Artificial Sequence
  chemically synthesized
tgagaccagcctggccaaca

SEQ ID NO: 390034 - DNA, 20 bp, Artificial Sequence
  chemically synthesized
tgggattctgccatgttggc

SEQ ID NO: 390035 - DNA, 20 bp, Artificial Sequence
  chemically synthesized
gaccagcctggccaacatgg

SEQ ID NO: 390036 - DNA, 20 bp, Artificial Sequence
  chemically synthesized
gagatgggattctgccatgt

SEQ ID NO: 390037 - DNA, 20 bp, Artificial Sequence
  chemically synthesized
tttgtatttttagtagagat

SEQ ID NO: 390038 - DNA, 20 bp, Artificial Sequence
  chemically synthesized
ttttgtatttttagtagaga

SEQ ID NO: 390039 - DNA, 20 bp, Artificial Sequence
  chemically synthesized
taatttttgtatttttagta

SEQ ID NO: 390040 - DNA, 20 bp, Artificial Sequence
  chemically synthesized
gctaatttttgtatttttag

SEQ ID NO: 390041 - DNA, 20 bp, Artificial Sequence
  chemically synthesized
ccggctaatttttgtatttt

SEQ ID NO: 390042 - DNA, 20 bp, Artificial Sequence
  chemically synthesized
tctactaaaaatacaaaaat

SEQ ID NO: 390043 - DNA, 20 bp, Artificial Sequence
  chemically synthesized
ctaaaaatacaaaaattagc

SEQ ID NO: 390044 - DNA, 20 bp, Artificial Sequence
  chemically synthesized
taaaaatacaaaaattagcc

SEQ ID NO: 390045 - DNA, 20 bp, Artificial Sequence
  chemically synthesized
atacaaaaattagccgggcg

SEQ ID NO: 390046 - DNA, 20 bp, Artificial Sequence
  chemically synthesized
caaaaattagccgggcgtgg

SEQ ID NO: 390047 - DNA, 20 bp, Artificial Sequence
  chemically synthesized
caggcgcacgccaccacgcc

SEQ ID NO: 390048 - DNA, 20 bp, Artificial Sequence
  chemically synthesized
gtggcgtgcgcctgtaatcc

SEQ ID NO: 390049 - DNA, 20 bp, Artificial Sequence
  chemically synthesized
tccctagtagctgggattac

SEQ ID NO: 390050 - DNA, 20 bp, Artificial Sequence
  chemically synthesized
ctccctagtagctgggatta

SEQ ID NO: 390051 - DNA, 20 bp, Artificial Sequence
  chemically synthesized
gcgcctgtaatcccagctac

SEQ ID NO: 390052 - DNA, 20 bp, Artificial Sequence
  chemically synthesized
cgcctgtaatcccagctact

SEQ ID NO: 390053 - DNA, 20 bp, Artificial Sequence
  chemically synthesized
cctcagcctccctagtagct

SEQ ID NO: 390054 - DNA, 20 bp, Artificial Sequence
  chemically synthesized
gcctgtaatcccagctacta

SEQ ID NO: 390055 - DNA, 20 bp, Artificial Sequence
  chemically synthesized
gcctcagcctccctagtagc

SEQ ID NO: 390056 - DNA, 20 bp, Artificial Sequence
  chemically synthesized
ctgtaatcccagctactagg

SEQ ID NO: 390057 - DNA, 20 bp, Artificial Sequence
  chemically synthesized
tgtaatcccagctactaggg

SEQ ID NO: 390058 - DNA, 20 bp, Artificial Sequence
  chemically synthesized
tcctgcctcagcctccctag

SEQ ID NO: 390059 - DNA, 20 bp, Artificial Sequence
  chemically synthesized
ttctcctgcctcagcctccc

SEQ ID NO: 390060 - DNA, 20 bp, Artificial Sequence
  chemically synthesized
tcccagctactagggaggct

SEQ ID NO: 390061 - DNA, 20 bp, Artificial Sequence
  chemically synthesized
cccagctactagggaggctg

SEQ ID NO: 390062 - DNA, 20 bp, Artificial Sequence
  chemically synthesized
agctactagggaggctgagg

SEQ ID NO: 390063 - DNA, 20 bp, Artificial Sequence
  chemically synthesized
gctactagggaggctgaggc

SEQ ID NO: 390064 - DNA, 20 bp, Artificial Sequence
  chemically synthesized
tactagggaggctgaggcag

SEQ ID NO: 390065 - DNA, 20 bp, Artificial Sequence
  chemically synthesized
ttcaagcaattctcctgcct

SEQ ID NO: 390066 - DNA, 20 bp, Artificial Sequence
  chemically synthesized
gcaggagaattgcttgaacc

SEQ ID NO: 390067 - DNA, 20 bp, Artificial Sequence
  chemically synthesized
caggagaattgcttgaacct

SEQ ID NO: 390068 - DNA, 20 bp, Artificial Sequence
  chemically synthesized
aacctctgcctcccaggttc

SEQ ID NO: 390069 - DNA, 20 bp, Artificial Sequence
  chemically synthesized
ggagaattgcttgaacctgg

SEQ ID NO: 390070 - DNA, 20 bp, Artificial Sequence
  chemically synthesized
gagaattgcttgaacctggg

SEQ ID NO: 390071 - DNA, 20 bp, Artificial Sequence
  chemically synthesized
aattgcttgaacctgggagg

SEQ ID NO: 390072 - DNA, 20 bp, Artificial Sequence
  chemically synthesized
cactgcaacctctgcctccc

SEQ ID NO: 390073 - DNA, 20 bp, Artificial Sequence
  chemically synthesized
ttgcttgaacctgggaggca

SEQ ID NO: 390074 - DNA, 20 bp, Artificial Sequence
  chemically synthesized
tcactgcaacctctgcctcc

SEQ ID NO: 390075 - DNA, 20 bp, Artificial Sequence
  chemically synthesized
tgcttgaacctgggaggcag

SEQ ID NO: 390076 - DNA, 20 bp, Artificial Sequence
  chemically synthesized
aacctgggaggcagaggttg

SEQ ID NO: 390077 - DNA, 20 bp, Artificial Sequence
  chemically synthesized
tgggaggcagaggttgcagt

SEQ ID NO: 390078 - DNA, 20 bp, Artificial Sequence
  chemically synthesized
ggcagaggttgcagtgagcc

SEQ ID NO: 390079 - DNA, 20 bp, Artificial Sequence
  chemically synthesized
ggagtgcagtggcataatct

SEQ ID NO: 390080 - DNA, 20 bp, Artificial Sequence
  chemically synthesized
tcacccaggctggagtgcag

SEQ ID NO: 390081 - DNA, 20 bp, Artificial Sequence
  chemically synthesized
gagattatgccactgcactc

SEQ ID NO: 390082 - DNA, 20 bp, Artificial Sequence
  chemically synthesized
ctgtcacccaggctggagtg

SEQ ID NO: 390083 - DNA, 20 bp, Artificial Sequence
  chemically synthesized
tatgccactgcactccagcc

SEQ ID NO: 390084 - DNA, 20 bp, Artificial Sequence
  chemically synthesized
atgccactgcactccagcct

SEQ ID NO: 390085 - DNA, 20 bp, Artificial Sequence
  chemically synthesized
ttgctctgtcacccaggctg

SEQ ID NO: 390086 - DNA, 20 bp, Artificial Sequence
  chemically synthesized
tcttgctctgtcacccaggc

SEQ ID NO: 390087 - DNA, 20 bp, Artificial Sequence
  chemically synthesized
ctgcactccagcctgggtga

SEQ ID NO: 390088 - DNA, 20 bp, Artificial Sequence
  chemically synthesized
agagtcttgctctgtcaccc

SEQ ID NO: 390089 - DNA, 20 bp, Artificial Sequence
  chemically synthesized
gcactccagcctgggtgaca

SEQ ID NO: 390090 - DNA, 20 bp, Artificial Sequence
  chemically synthesized
cagagtcttgctctgtcacc

SEQ ID NO: 390091 - DNA, 20 bp, Artificial Sequence
  chemically synthesized
tccagcctgggtgacagagc

SEQ ID NO: 390092 - DNA, 20 bp, Artificial Sequence
  chemically synthesized
gattttttgtttttgagaca

SEQ ID NO: 390093 - DNA, 20 bp, Artificial Sequence
  chemically synthesized
ttgattttttgtttttgaga

SEQ ID NO: 390094 - DNA, 20 bp, Artificial Sequence
  chemically synthesized
tgttttgattttttgttttt

SEQ ID NO: 390095 - DNA, 20 bp, Artificial Sequence
  chemically synthesized
aaaaatcaaaacaaaacaaa

SEQ ID NO: 390096 - DNA, 20 bp, Artificial Sequence
  chemically synthesized
aaaacaaaaagttctcttta

SEQ ID NO: 390097 - DNA, 20 bp, Artificial Sequence
  chemically synthesized
aggaggagcagttctataaa

SEQ ID NO: 390098 - DNA, 20 bp, Artificial Sequence
  chemically synthesized
ttaggaggagcagttctata

SEQ ID NO: 390099 - DNA, 20 bp, Artificial Sequence
  chemically synthesized
tcttcatttgttaggaggag

SEQ ID NO: 390100 - DNA, 20 bp, Artificial Sequence
  chemically synthesized
acttcttcatttgttaggag

SEQ ID NO: 390101 - DNA, 20 bp, Artificial Sequence
  chemically synthesized
ttacttcttcatttgttagg

SEQ ID NO: 390102 - DNA, 20 bp, Artificial Sequence
  chemically synthesized
tttacttcttcatttgttag

SEQ ID NO: 390103 - DNA, 20 bp, Artificial Sequence
  chemically synthesized
tttttacttcttcatttgtt

SEQ ID NO: 390104 - DNA, 20 bp, Artificial Sequence
  chemically synthesized
actgctcctcctaacaaatg

SEQ ID NO: 390105 - DNA, 20 bp, Artificial Sequence
  chemically synthesized
gtttttacttcttcatttgt

SEQ ID NO: 390106 - DNA, 20 bp, Artificial Sequence
  chemically synthesized
gctcctcctaacaaatgaag

SEQ ID NO: 390107 - DNA, 20 bp, Artificial Sequence
  chemically synthesized
aacaaatgaagaagtaaaaa

SEQ ID NO: 390108 - DNA, 20 bp, Artificial Sequence
  chemically synthesized
ttgattgattatttcattat

SEQ ID NO: 390109 - DNA, 20 bp, Artificial Sequence
  chemically synthesized
atcaaaacaatgatcatcaa

SEQ ID NO: 390110 - DNA, 20 bp, Artificial Sequence
  chemically synthesized
tatataacgtttgatattgg

SEQ ID NO: 390111 - DNA, 20 bp, Artificial Sequence
  chemically synthesized
aggtatataacgtttgatat

SEQ ID NO: 390112 - DNA, 20 bp, Artificial Sequence
  chemically synthesized
tgttgtgtactttcaacaaa

SEQ ID NO: 390113 - DNA, 20 bp, Artificial Sequence
  chemically synthesized
cgttatataccttttgttga

SEQ ID NO: 390114 - DNA, 20 bp, Artificial Sequence
  chemically synthesized
gtgttgtgtactttcaacaa

SEQ ID NO: 390115 - DNA, 20 bp, Artificial Sequence
  chemically synthesized
actcaagatgattgtataga

SEQ ID NO: 390116 - DNA, 20 bp, Artificial Sequence
  chemically synthesized
ttttactcaagatgattgta

SEQ ID NO: 390117 - DNA, 20 bp, Artificial Sequence
  chemically synthesized
actttctatacaatcatctt

SEQ ID NO: 390118 - DNA, 20 bp, Artificial Sequence
  chemically synthesized
attttgttctttttttactc

SEQ ID NO: 390119 - DNA, 20 bp, Artificial Sequence
  chemically synthesized
acaatcatcttgagtaaaaa

SEQ ID NO: 390120 - DNA, 20 bp, Artificial Sequence
  chemically synthesized
aacaaaatcaaactgactac

SEQ ID NO: 390121 - DNA, 20 bp, Artificial Sequence
  chemically synthesized
tctagagagctacttgtagt

SEQ ID NO: 390122 - DNA, 20 bp, Artificial Sequence
  chemically synthesized
aaaatcaaactgactacaag

SEQ ID NO: 390123 - DNA, 20 bp, Artificial Sequence
  chemically synthesized
taagtctagagagctacttg

SEQ ID NO: 390124 - DNA, 20 bp, Artificial Sequence
  chemically synthesized
actgactacaagtagctctc

SEQ ID NO: 390125 - DNA, 20 bp, Artificial Sequence
  chemically synthesized
aattagcagctaagtctaga

SEQ ID NO: 390126 - DNA, 20 bp, Artificial Sequence
  chemically synthesized
tacaagtagctctctagact

SEQ ID NO: 390127 - DNA, 20 bp, Artificial Sequence
  chemically synthesized
caaattagcagctaagtcta

SEQ ID NO: 390128 - DNA, 20 bp, Artificial Sequence
  chemically synthesized
gacaaattagcagctaagtc

SEQ ID NO: 390129 - DNA, 20 bp, Artificial Sequence
  chemically synthesized
gtgctgacaaattagcagct

SEQ ID NO: 390130 - DNA, 20 bp, Artificial Sequence
  chemically synthesized
ctgtggtgctgacaaattag

SEQ ID NO: 390131 - DNA, 20 bp, Artificial Sequence
  chemically synthesized
agacttagctgctaatttgt

SEQ ID NO: 390132 - DNA, 20 bp, Artificial Sequence
  chemically synthesized
ctcctgtggtgctgacaaat

SEQ ID NO: 390133 - DNA, 20 bp, Artificial Sequence
  chemically synthesized
ctgctaatttgtcagcacca

SEQ ID NO: 390134 - DNA, 20 bp, Artificial Sequence
  chemically synthesized
tgctaatttgtcagcaccac

SEQ ID NO: 390135 - DNA, 20 bp, Artificial Sequence
  chemically synthesized
ctaatttgtcagcaccacag

SEQ ID NO: 390136 - DNA, 20 bp, Artificial Sequence
  chemically synthesized
tttgtcagcaccacaggagc

SEQ ID NO: 390137 - DNA, 20 bp, Artificial Sequence
  chemically synthesized
atgtgtttcaccagctcctg

SEQ ID NO: 390138 - DNA, 20 bp, Artificial Sequence
  chemically synthesized
tattgtttaatgtgtttcac

SEQ ID NO: 390139 - DNA, 20 bp, Artificial Sequence
  chemically synthesized
acacattaaacaatatcatg

SEQ ID NO: 390140 - DNA, 20 bp, Artificial Sequence
  chemically synthesized
gtggatgtaatcaacaaacc

SEQ ID NO: 390141 - DNA, 20 bp, Artificial Sequence
  chemically synthesized
taatcaacaaacctagacaa

SEQ ID NO: 390142 - DNA, 20 bp, Artificial Sequence
  chemically synthesized
aatcaacaaacctagacaaa

SEQ ID NO: 390143 - DNA, 20 bp, Artificial Sequence
  chemically synthesized
agaaacaggaccttttgtct

SEQ ID NO: 390144 - DNA, 20 bp, Artificial Sequence
  chemically synthesized
aagaaacaggaccttttgtc

SEQ ID NO: 390145 - DNA, 20 bp, Artificial Sequence
  chemically synthesized
cttttcatttttgaagaaac

SEQ ID NO: 390146 - DNA, 20 bp, Artificial Sequence
  chemically synthesized
ccttttcatttttgaagaaa

SEQ ID NO: 390147 - DNA, 20 bp, Artificial Sequence
  chemically synthesized
actctcccttttcatttttg

SEQ ID NO: 390148 - DNA, 20 bp, Artificial Sequence
  chemically synthesized
cctgtttcttcaaaaatgaa

SEQ ID NO: 390149 - DNA, 20 bp, Artificial Sequence
  chemically synthesized
ctgtttcttcaaaaatgaaa

SEQ ID NO: 390150 - DNA, 20 bp, Artificial Sequence
  chemically synthesized
tgtttcttcaaaaatgaaaa

SEQ ID NO: 390151 - DNA, 20 bp, Artificial Sequence
  chemically synthesized
tttcttcaaaaatgaaaagg

SEQ ID NO: 390152 - DNA, 20 bp, Artificial Sequence
  chemically synthesized
tcttcaaaaatgaaaaggga

SEQ ID NO: 390153 - DNA, 20 bp, Artificial Sequence
  chemically synthesized
caaaaatgaaaagggagagt

SEQ ID NO: 390154 - DNA, 20 bp, Artificial Sequence
  chemically synthesized
tgaaaagggagagtgagaac

SEQ ID NO: 390155 - DNA, 20 bp, Artificial Sequence
  chemically synthesized
gaaaagggagagtgagaacg

SEQ ID NO: 390156 - DNA, 20 bp, Artificial Sequence
  chemically synthesized
gggagagtgagaacgaggat

SEQ ID NO: 390157 - DNA, 20 bp, Artificial Sequence
  chemically synthesized
ggagagtgagaacgaggatg

SEQ ID NO: 390158 - DNA, 20 bp, Artificial Sequence
  chemically synthesized
gagagtgagaacgaggatga

SEQ ID NO: 390159 - DNA, 20 bp, Artificial Sequence
  chemically synthesized
gagtgagaacgaggatgagg

SEQ ID NO: 390160 - DNA, 20 bp, Artificial Sequence
  chemically synthesized
agtgagaacgaggatgaggg

SEQ ID NO: 390161 - DNA, 20 bp, Artificial Sequence
  chemically synthesized
tgagaacgaggatgagggag

SEQ ID NO: 390162 - DNA, 20 bp, Artificial Sequence
  chemically synthesized
gagaacgaggatgagggagg

SEQ ID NO: 390163 - DNA, 20 bp, Artificial Sequence
  chemically synthesized
gaacgaggatgagggaggag

SEQ ID NO: 390164 - DNA, 20 bp, Artificial Sequence
  chemically synthesized
aacgaggatgagggaggagg

SEQ ID NO: 390165 - DNA, 20 bp, Artificial Sequence
  chemically synthesized
gatgagggaggaggaggatg

SEQ ID NO: 390166 - DNA, 20 bp, Artificial Sequence
  chemically synthesized
atgagggaggaggaggatgt

SEQ ID NO: 390167 - DNA, 20 bp, Artificial Sequence
  chemically synthesized
tgagggaggaggaggatgta

SEQ ID NO: 390168 - DNA, 20 bp, Artificial Sequence
  chemically synthesized
gaggaggaggatgtagggtg

SEQ ID NO: 390169 - DNA, 20 bp, Artificial Sequence
  chemically synthesized
ggaggaggatgtagggtgtg

SEQ ID NO: 390170 - DNA, 20 bp, Artificial Sequence
  chemically synthesized
gaggaggatgtagggtgtgg

SEQ ID NO: 390171 - DNA, 20 bp, Artificial Sequence
  chemically synthesized
gatgtagggtgtggaggaaa

SEQ ID NO: 390172 - DNA, 20 bp, Artificial Sequence
  chemically synthesized
tgtagggtgtggaggaaaca

SEQ ID NO: 390173 - DNA, 20 bp, Artificial Sequence
  chemically synthesized
tgtggaggaaacagagacaa

SEQ ID NO: 390174 - DNA, 20 bp, Artificial Sequence
  chemically synthesized
tggaggaaacagagacaaca

SEQ ID NO: 390175 - DNA, 20 bp, Artificial Sequence
  chemically synthesized
gaggaaacagagacaacaga

SEQ ID NO: 390176 - DNA, 20 bp, Artificial Sequence
  chemically synthesized
gaaacagagacaacagagag

SEQ ID NO: 390177 - DNA, 20 bp, Artificial Sequence
  chemically synthesized
aacagagacaacagagagaa

SEQ ID NO: 390178 - DNA, 20 bp, Artificial Sequence
  chemically synthesized
cagagacaacagagagaaga

SEQ ID NO: 390179 - DNA, 20 bp, Artificial Sequence
  chemically synthesized
agagacaacagagagaagag

SEQ ID NO: 390180 - DNA, 20 bp, Artificial Sequence
  chemically synthesized
agacaacagagagaagagag

SEQ ID NO: 390181 - DNA, 20 bp, Artificial Sequence
  chemically synthesized
gagagaagagaggagtccta

SEQ ID NO: 390182 - DNA, 20 bp, Artificial Sequence
  chemically synthesized
agagaagagaggagtcctat

SEQ ID NO: 390183 - DNA, 20 bp, Artificial Sequence
  chemically synthesized
tatttcccaaattatcctat

SEQ ID NO: 390184 - DNA, 20 bp, Artificial Sequence
  chemically synthesized
atatttcccaaattatccta

SEQ ID NO: 390185 - DNA, 20 bp, Artificial Sequence
  chemically synthesized
aggagtcctataggataatt

SEQ ID NO: 390186 - DNA, 20 bp, Artificial Sequence
  chemically synthesized
ggagtcctataggataattt

SEQ ID NO: 390187 - DNA, 20 bp, Artificial Sequence
  chemically synthesized
aaaatgtatttgatgatatt

SEQ ID NO: 390188 - DNA, 20 bp, Artificial Sequence
  chemically synthesized
gatattaagcaaatattttc

SEQ ID NO: 390189 - DNA, 20 bp, Artificial Sequence
  chemically synthesized
atattaagcaaatattttcc

SEQ ID NO: 390190 - DNA, 20 bp, Artificial Sequence
  chemically synthesized
tattaagcaaatattttccg

SEQ ID NO: 390191 - DNA, 20 bp, Artificial Sequence
  chemically synthesized
aagcaaatattttccggggc

SEQ ID NO: 390192 - DNA, 20 bp, Artificial Sequence
  chemically synthesized
agcaaatattttccggggct

SEQ ID NO: 390193 - DNA, 20 bp, Artificial Sequence
  chemically synthesized
tgagccaccgcacccagccc

SEQ ID NO: 390194 - DNA, 20 bp, Artificial Sequence
  chemically synthesized
atattttccggggctgggtg

SEQ ID NO: 390195 - DNA, 20 bp, Artificial Sequence
  chemically synthesized
ttttccggggctgggtgcgg

SEQ ID NO: 390196 - DNA, 20 bp, Artificial Sequence
  chemically synthesized
caggcgtgagccaccgcacc

SEQ ID NO: 390197 - DNA, 20 bp, Artificial Sequence
  chemically synthesized
agtgctgagattacaggcgt

SEQ ID NO: 390198 - DNA, 20 bp, Artificial Sequence
  chemically synthesized
gtggctcacgcctgtaatct

SEQ ID NO: 390199 - DNA, 20 bp, Artificial Sequence
  chemically synthesized
cctcaaagtgctgagattac

SEQ ID NO: 390200 - DNA, 20 bp, Artificial Sequence
  chemically synthesized
ccctcaaagtgctgagatta

SEQ ID NO: 390201 - DNA, 20 bp, Artificial Sequence
  chemically synthesized
ccttggcccctcaaagtgct

SEQ ID NO: 390202 - DNA, 20 bp, Artificial Sequence
  chemically synthesized
gcctgtaatctcagcacttt

SEQ ID NO: 390203 - DNA, 20 bp, Artificial Sequence
  chemically synthesized
cctgtaatctcagcactttg

SEQ ID NO: 390204 - DNA, 20 bp, Artificial Sequence
  chemically synthesized
ctgtaatctcagcactttga

SEQ ID NO: 390205 - DNA, 20 bp, Artificial Sequence
  chemically synthesized
tgtaatctcagcactttgag

SEQ ID NO: 390206 - DNA, 20 bp, Artificial Sequence
  chemically synthesized
ccgcccaccttggcccctca

SEQ ID NO: 390207 - DNA, 20 bp, Artificial Sequence
  chemically synthesized
tctcagcactttgaggggcc

SEQ ID NO: 390208 - DNA, 20 bp, Artificial Sequence
  chemically synthesized
ctcagcactttgaggggcca

SEQ ID NO: 390209 - DNA, 20 bp, Artificial Sequence
  chemically synthesized
agcactttgaggggccaagg

SEQ ID NO: 390210 - DNA, 20 bp, Artificial Sequence
  chemically synthesized
gcactttgaggggccaaggt

SEQ ID NO: 390211 - DNA, 20 bp, Artificial Sequence
  chemically synthesized
ctttgaggggccaaggtggg

SEQ ID NO: 390212 - DNA, 20 bp, Artificial Sequence
  chemically synthesized
ctcaaatgatccgcccacct

SEQ ID NO: 390213 - DNA, 20 bp, Artificial Sequence
  chemically synthesized
ccaaggtgggcggatcattt

SEQ ID NO: 390214 - DNA, 20 bp, Artificial Sequence
  chemically synthesized
caaggtgggcggatcatttg

SEQ ID NO: 390215 - DNA, 20 bp, Artificial Sequence
  chemically synthesized
gtgggcggatcatttgaggt

SEQ ID NO: 390216 - DNA, 20 bp, Artificial Sequence
  chemically synthesized
tgggcggatcatttgaggtc

SEQ ID NO: 390217 - DNA, 20 bp, Artificial Sequence
  chemically synthesized
ggcggatcatttgaggtcag

SEQ ID NO: 390218 - DNA, 20 bp, Artificial Sequence
  chemically synthesized
tcatttgaggtcaggagttc

SEQ ID NO: 390219 - DNA, 20 bp, Artificial Sequence
  chemically synthesized
tgaggtcaggagttcaagac

SEQ ID NO: 390220 - DNA, 20 bp, Artificial Sequence
  chemically synthesized
tttcaccatgttggtcaggc

SEQ ID NO: 390221 - DNA, 20 bp, Artificial Sequence
  chemically synthesized
gggatttcaccatgttggtc

SEQ ID NO: 390222 - DNA, 20 bp, Artificial Sequence
  chemically synthesized
caagaccagcctgaccaaca

SEQ ID NO: 390223 - DNA, 20 bp, Artificial Sequence
  chemically synthesized
tgggatttcaccatgttggt

SEQ ID NO: 390224 - DNA, 20 bp, Artificial Sequence
  chemically synthesized
cagatgggatttcaccatgt

SEQ ID NO: 390225 - DNA, 20 bp, Artificial Sequence
  chemically synthesized
tttgtatttttagtacagat

SEQ ID NO: 390226 - DNA, 20 bp, Artificial Sequence
  chemically synthesized
ttttgtatttttagtacaga

SEQ ID NO: 390227 - DNA, 20 bp, Artificial Sequence
  chemically synthesized
atttttttgtatttttagta

SEQ ID NO: 390228 - DNA, 20 bp, Artificial Sequence
  chemically synthesized
ggataatttttttgtatttt

SEQ ID NO: 390229 - DNA, 20 bp, Artificial Sequence
  chemically synthesized
aaaaatacaaaaaaattatc

SEQ ID NO: 390230 - DNA, 20 bp, Artificial Sequence
  chemically synthesized
aaaatacaaaaaaattatcc

SEQ ID NO: 390231 - DNA, 20 bp, Artificial Sequence
  chemically synthesized
acaaaaaaattatccgggtg

SEQ ID NO: 390232 - DNA, 20 bp, Artificial Sequence
  chemically synthesized
aaaaaattatccgggtgtgg

SEQ ID NO: 390233 - DNA, 20 bp, Artificial Sequence
  chemically synthesized
caggcatgcgccaccacacc

SEQ ID NO: 390234 - DNA, 20 bp, Artificial Sequence
  chemically synthesized
ggtgtggtggcgcatgcctg

SEQ ID NO: 390235 - DNA, 20 bp, Artificial Sequence
  chemically synthesized
gtggtggcgcatgcctgtag

SEQ ID NO: 390236 - DNA, 20 bp, Artificial Sequence
  chemically synthesized
gtggcgcatgcctgtagtag

SEQ ID NO: 390237 - DNA, 20 bp, Artificial Sequence
  chemically synthesized
tcccgagtagctgctactac

SEQ ID NO: 390238 - DNA, 20 bp, Artificial Sequence
  chemically synthesized
ctcccgagtagctgctacta

SEQ ID NO: 390239 - DNA, 20 bp, Artificial Sequence
  chemically synthesized
tgcctgtagtagcagctact

SEQ ID NO: 390240 - DNA, 20 bp, Artificial Sequence
  chemically synthesized
gcctgtagtagcagctactc

SEQ ID NO: 390241 - DNA, 20 bp, Artificial Sequence
  chemically synthesized
ctgtagtagcagctactcgg

SEQ ID NO: 390242 - DNA, 20 bp, Artificial Sequence
  chemically synthesized
tgtagtagcagctactcggg

SEQ ID NO: 390243 - DNA, 20 bp, Artificial Sequence
  chemically synthesized
tcctgcctcagcctcccgag

SEQ ID NO: 390244 - DNA, 20 bp, Artificial Sequence
  chemically synthesized
ttctcctgcctcagcctccc

SEQ ID NO: 390245 - DNA, 20 bp, Artificial Sequence
  chemically synthesized
tagcagctactcgggaggct

SEQ ID NO: 390246 - DNA, 20 bp, Artificial Sequence
  chemically synthesized
agcagctactcgggaggctg

SEQ ID NO: 390247 - DNA, 20 bp, Artificial Sequence
  chemically synthesized
agctactcgggaggctgagg

SEQ ID NO: 390248 - DNA, 20 bp, Artificial Sequence
  chemically synthesized
gctactcgggaggctgaggc

SEQ ID NO: 390249 - DNA, 20 bp, Artificial Sequence
  chemically synthesized
tactcgggaggctgaggcag

SEQ ID NO: 390250 - DNA, 20 bp, Artificial Sequence
  chemically synthesized
ttcaaatgattctcctgcct

SEQ ID NO: 390251 - DNA, 20 bp, Artificial Sequence
  chemically synthesized
gcaggagaatcatttgaacc

SEQ ID NO: 390252 - DNA, 20 bp, Artificial Sequence
  chemically synthesized
caggagaatcatttgaacct

SEQ ID NO: 390253 - DNA, 20 bp, Artificial Sequence
  chemically synthesized
ggagaatcatttgaacctgg

SEQ ID NO: 390254 - DNA, 20 bp, Artificial Sequence
  chemically synthesized
gagaatcatttgaacctggg

SEQ ID NO: 390255 - DNA, 20 bp, Artificial Sequence
  chemically synthesized
aatcatttgaacctgggagg

SEQ ID NO: 390256 - DNA, 20 bp, Artificial Sequence
  chemically synthesized
cactgcaacctccgcctccc

SEQ ID NO: 390257 - DNA, 20 bp, Artificial Sequence
  chemically synthesized
tcatttgaacctgggaggcg

SEQ ID NO: 390258 - DNA, 20 bp, Artificial Sequence
  chemically synthesized
tcactgcaacctccgcctcc

SEQ ID NO: 390259 - DNA, 20 bp, Artificial Sequence
  chemically synthesized
catttgaacctgggaggcgg

SEQ ID NO: 390260 - DNA, 20 bp, Artificial Sequence
  chemically synthesized
aacctgggaggcggaggttg

SEQ ID NO: 390261 - DNA, 20 bp, Artificial Sequence
  chemically synthesized
tgggaggcggaggttgcagt

SEQ ID NO: 390262 - DNA, 20 bp, Artificial Sequence
  chemically synthesized
ggcggaggttgcagtgagcc

SEQ ID NO: 390263 - DNA, 20 bp, Artificial Sequence
  chemically synthesized
ggagtgcagtggcacgatct

SEQ ID NO: 390264 - DNA, 20 bp, Artificial Sequence
  chemically synthesized
tcacccaggctggagtgcag

SEQ ID NO: 390265 - DNA, 20 bp, Artificial Sequence
  chemically synthesized
aagatcgtgccactgcactc

SEQ ID NO: 390266 - DNA, 20 bp, Artificial Sequence
  chemically synthesized
ctgtcacccaggctggagtg

SEQ ID NO: 390267 - DNA, 20 bp, Artificial Sequence
  chemically synthesized
cgtgccactgcactccagcc

SEQ ID NO: 390268 - DNA, 20 bp, Artificial Sequence
  chemically synthesized
gtgccactgcactccagcct

SEQ ID NO: 390269 - DNA, 20 bp, Artificial Sequence
  chemically synthesized
tcgctctgtcacccaggctg

SEQ ID NO: 390270 - DNA, 20 bp, Artificial Sequence
  chemically synthesized
tctcgctctgtcacccaggc

SEQ ID NO: 390271 - DNA, 20 bp, Artificial Sequence
  chemically synthesized
ctgcactccagcctgggtga

SEQ ID NO: 390272 - DNA, 20 bp, Artificial Sequence
  chemically synthesized
agagtctcgctctgtcaccc

SEQ ID NO: 390273 - DNA, 20 bp, Artificial Sequence
  chemically synthesized
gcactccagcctgggtgaca

SEQ ID NO: 390274 - DNA, 20 bp, Artificial Sequence
  chemically synthesized
cagagtctcgctctgtcacc

SEQ ID NO: 390275 - DNA, 20 bp, Artificial Sequence
  chemically synthesized
tccagcctgggtgacagagc

SEQ ID NO: 390276 - DNA, 20 bp, Artificial Sequence
  chemically synthesized
ttttttttttttttgagaca

SEQ ID NO: 390277 - DNA, 20 bp, Artificial Sequence
  chemically synthesized
ttttttttttttttttgaga

SEQ ID NO: 390278 - DNA, 20 bp, Artificial Sequence
  chemically synthesized
cttctttttttttttttttt

SEQ ID NO: 390279 - DNA, 20 bp, Artificial Sequence
  chemically synthesized
tgtctcaaaaaaaaaaaaaa

SEQ ID NO: 390280 - DNA, 20 bp, Artificial Sequence
  chemically synthesized
ctcaaaaaaaaaaaaaaaag

SEQ ID NO: 390281 - DNA, 20 bp, Artificial Sequence
  chemically synthesized
aaaaaaaaaaaaaaaagaag

SEQ ID NO: 390282 - DNA, 20 bp, Artificial Sequence
  chemically synthesized
aaaaaaaaaaaaaaagaagt

SEQ ID NO: 390283 - DNA, 20 bp, Artificial Sequence
  chemically synthesized
aaaaaaaaaaaaaagaagtg

SEQ ID NO: 390284 - DNA, 20 bp, Artificial Sequence
  chemically synthesized
aaaaaaaaaaagaagtgggg

SEQ ID NO: 390285 - DNA, 20 bp, Artificial Sequence
  chemically synthesized
aaaaaaaaaagaagtggggt

SEQ ID NO: 390286 - DNA, 20 bp, Artificial Sequence
  chemically synthesized
aaaaaaaaagaagtggggtg

SEQ ID NO: 390287 - DNA, 20 bp, Artificial Sequence
  chemically synthesized
aaaaaaaagaagtggggtgg

SEQ ID NO: 390288 - DNA, 20 bp, Artificial Sequence
  chemically synthesized
aaaaaaagaagtggggtggg

SEQ ID NO: 390289 - DNA, 20 bp, Artificial Sequence
  chemically synthesized
aaaaaagaagtggggtgggg

SEQ ID NO: 390290 - DNA, 20 bp, Artificial Sequence
  chemically synthesized
agtggggtgggggggttact

SEQ ID NO: 390291 - DNA, 20 bp, Artificial Sequence
  chemically synthesized
gtggggtgggggggttactt

SEQ ID NO: 390292 - DNA, 20 bp, Artificial Sequence
  chemically synthesized
gggggggttacttgggaata

SEQ ID NO: 390293 - DNA, 20 bp, Artificial Sequence
  chemically synthesized
acatttcagactgtattccc

SEQ ID NO: 390294 - DNA, 20 bp, Artificial Sequence
  chemically synthesized
ggaatacagtctgaaatgtt

SEQ ID NO: 390295 - DNA, 20 bp, Artificial Sequence
  chemically synthesized
cacttctactctaaacattt

SEQ ID NO: 390296 - DNA, 20 bp, Artificial Sequence
  chemically synthesized
aatacagtctgaaatgttta

SEQ ID NO: 390297 - DNA, 20 bp, Artificial Sequence
  chemically synthesized
acagtctgaaatgtttagag

SEQ ID NO: 390298 - DNA, 20 bp, Artificial Sequence
  chemically synthesized
gtctgaaatgtttagagtag

SEQ ID NO: 390299 - DNA, 20 bp, Artificial Sequence
  chemically synthesized
gagtagaagtgatatacttt

SEQ ID NO: 390300 - DNA, 20 bp, Artificial Sequence
  chemically synthesized
agtagaagtgatatactttc

SEQ ID NO: 390301 - DNA, 20 bp, Artificial Sequence
  chemically synthesized
gtagaagtgatatactttcg

SEQ ID NO: 390302 - DNA, 20 bp, Artificial Sequence
  chemically synthesized
gttttgaggcaaatccccga

SEQ ID NO: 390303 - DNA, 20 bp, Artificial Sequence
  chemically synthesized
ttcggggatttgcctcaaaa

SEQ ID NO: 390304 - DNA, 20 bp, Artificial Sequence
  chemically synthesized
cggggatttgcctcaaaaca

SEQ ID NO: 390305 - DNA, 20 bp, Artificial Sequence
  chemically synthesized
acttcctattctctgttttg

SEQ ID NO: 390306 - DNA, 20 bp, Artificial Sequence
  chemically synthesized
cacttcctattctctgtttt

SEQ ID NO: 390307 - DNA, 20 bp, Artificial Sequence
  chemically synthesized
atttgcctcaaaacagagaa

SEQ ID NO: 390308 - DNA, 20 bp, Artificial Sequence
  chemically synthesized
tttgcctcaaaacagagaat

SEQ ID NO: 390309 - DNA, 20 bp, Artificial Sequence
  chemically synthesized
gcctcaaaacagagaatagg

SEQ ID NO: 390310 - DNA, 20 bp, Artificial Sequence
  chemically synthesized
tcaaaacagagaataggaag

SEQ ID NO: 390311 - DNA, 20 bp, Artificial Sequence
  chemically synthesized
caaaacagagaataggaagt

SEQ ID NO: 390312 - DNA, 20 bp, Artificial Sequence
  chemically synthesized
aacagagaataggaagtggg

SEQ ID NO: 390313 - DNA, 20 bp, Artificial Sequence
  chemically synthesized
acagagaataggaagtgggt

SEQ ID NO: 390314 - DNA, 20 bp, Artificial Sequence
  chemically synthesized
gagaataggaagtgggtagg

SEQ ID NO: 390315 - DNA, 20 bp, Artificial Sequence
  chemically synthesized
gaataggaagtgggtaggta

SEQ ID NO: 390316 - DNA, 20 bp, Artificial Sequence
  chemically synthesized
ataggaagtgggtaggtaga

SEQ ID NO: 390317 - DNA, 20 bp, Artificial Sequence
  chemically synthesized
taggaagtgggtaggtagag

SEQ ID NO: 390318 - DNA, 20 bp, Artificial Sequence
  chemically synthesized
tgggtaggtagagaggaaac

SEQ ID NO: 390319 - DNA, 20 bp, Artificial Sequence
  chemically synthesized
taggtagagaggaaaccaga

SEQ ID NO: 390320 - DNA, 20 bp, Artificial Sequence
  chemically synthesized
ccattattatcattaccatc

SEQ ID NO: 390321 - DNA, 20 bp, Artificial Sequence
  chemically synthesized
ccagatggtaatgataataa

SEQ ID NO: 390322 - DNA, 20 bp, Artificial Sequence
  chemically synthesized
atggtaatgataataatggt

SEQ ID NO: 390323 - DNA, 20 bp, Artificial Sequence
  chemically synthesized
ggtaatgataataatggtta

SEQ ID NO: 390324 - DNA, 20 bp, Artificial Sequence
  chemically synthesized
taataatggttagagctaat

SEQ ID NO: 390325 - DNA, 20 bp, Artificial Sequence
  chemically synthesized
taatggttagagctaatgag

SEQ ID NO: 390326 - DNA, 20 bp, Artificial Sequence
  chemically synthesized
gcataccatacactgctcat

SEQ ID NO: 390327 - DNA, 20 bp, Artificial Sequence
  chemically synthesized
tagagctaatgagcagtgta

SEQ ID NO: 390328 - DNA, 20 bp, Artificial Sequence
  chemically synthesized
caaacatatacaaaataaaa

SEQ ID NO: 390329 - DNA, 20 bp, Artificial Sequence
  chemically synthesized
atatgtttgaaattcttcat

SEQ ID NO: 390330 - DNA, 20 bp, Artificial Sequence
  chemically synthesized
atgtttgaaattcttcataa

SEQ ID NO: 390331 - DNA, 20 bp, Artificial Sequence
  chemically synthesized
catttattttttctcttatg

SEQ ID NO: 390332 - DNA, 20 bp, Artificial Sequence
  chemically synthesized
ttcataagagaaaaaataaa

SEQ ID NO: 390333 - DNA, 20 bp, Artificial Sequence
  chemically synthesized
tattatgttacaggtgcaca

SEQ ID NO: 390334 - DNA, 20 bp, Artificial Sequence
  chemically synthesized
tcttgtcattattatgttac

SEQ ID NO: 390335 - DNA, 20 bp, Artificial Sequence
  chemically synthesized
atcttgtcattattatgtta

SEQ ID NO: 390336 - DNA, 20 bp, Artificial Sequence
  chemically synthesized
acctgtaacataataatgac

SEQ ID NO: 390337 - DNA, 20 bp, Artificial Sequence
  chemically synthesized
ataataatgacaagatatgt

SEQ ID NO: 390338 - DNA, 20 bp, Artificial Sequence
  chemically synthesized
atgacaagatatgtcagcct

SEQ ID NO: 390339 - DNA, 20 bp, Artificial Sequence
  chemically synthesized
cttaagacatatttattctt

SEQ ID NO: 390340 - DNA, 20 bp, Artificial Sequence
  chemically synthesized
acttaagacatatttattct

SEQ ID NO: 390341 - DNA, 20 bp, Artificial Sequence
  chemically synthesized
cctaagaataaatatgtctt

SEQ ID NO: 390342 - DNA, 20 bp, Artificial Sequence
  chemically synthesized
tgaggtaaaggggataactt

SEQ ID NO: 390343 - DNA, 20 bp, Artificial Sequence
  chemically synthesized
gaagccaagatgaggtaaag

SEQ ID NO: 390344 - DNA, 20 bp, Artificial Sequence
  chemically synthesized
tgaagccaagatgaggtaaa

SEQ ID NO: 390345 - DNA, 20 bp, Artificial Sequence
  chemically synthesized
ttgaagccaagatgaggtaa

SEQ ID NO: 390346 - DNA, 20 bp, Artificial Sequence
  chemically synthesized
tttgaagccaagatgaggta

SEQ ID NO: 390347 - DNA, 20 bp, Artificial Sequence
  chemically synthesized
ttatcccctttacctcatct

SEQ ID NO: 390348 - DNA, 20 bp, Artificial Sequence
  chemically synthesized
gttactttgaagccaagatg

SEQ ID NO: 390349 - DNA, 20 bp, Artificial Sequence
  chemically synthesized
agttactttgaagccaagat

SEQ ID NO: 390350 - DNA, 20 bp, Artificial Sequence
  chemically synthesized
tttacctcatcttggcttca

SEQ ID NO: 390351 - DNA, 20 bp, Artificial Sequence
  chemically synthesized
catatagttactttgaagcc

SEQ ID NO: 390352 - DNA, 20 bp, Artificial Sequence
  chemically synthesized
taaagcatatagttactttg

SEQ ID NO: 390353 - DNA, 20 bp, Artificial Sequence
  chemically synthesized
actataatgattaaagcata

SEQ ID NO: 390354 - DNA, 20 bp, Artificial Sequence
  chemically synthesized
tagacaaactataatgatta

SEQ ID NO: 390355 - DNA, 20 bp, Artificial Sequence
  chemically synthesized
actatatgctttaatcatta

SEQ ID NO: 390356 - DNA, 20 bp, Artificial Sequence
  chemically synthesized
tttaatcattatagtttgtc

SEQ ID NO: 390357 - DNA, 20 bp, Artificial Sequence
  chemically synthesized
ttaatcattatagtttgtct

SEQ ID NO: 390358 - DNA, 20 bp, Artificial Sequence
  chemically synthesized
ttatagtttgtctaggtccc

SEQ ID NO: 390359 - DNA, 20 bp, Artificial Sequence
  chemically synthesized
aaaaacactctctggggacc

SEQ ID NO: 390360 - DNA, 20 bp, Artificial Sequence
  chemically synthesized
atagtttgtctaggtcccca

SEQ ID NO: 390361 - DNA, 20 bp, Artificial Sequence
  chemically synthesized
agtttgtctaggtccccaga

SEQ ID NO: 390362 - DNA, 20 bp, Artificial Sequence
  chemically synthesized
aaatctaaaaacactctctg

SEQ ID NO: 390363 - DNA, 20 bp, Artificial Sequence
  chemically synthesized
aaaatctaaaaacactctct

SEQ ID NO: 390364 - DNA, 20 bp, Artificial Sequence
  chemically synthesized
aaaaatctaaaaacactctc

SEQ ID NO: 390365 - DNA, 20 bp, Artificial Sequence
  chemically synthesized
aggtccccagagagtgtttt

SEQ ID NO: 390366 - DNA, 20 bp, Artificial Sequence
  chemically synthesized
gtttttagatttttatttgt

SEQ ID NO: 390367 - DNA, 20 bp, Artificial Sequence
  chemically synthesized
atttgttagtttatgaactt

SEQ ID NO: 390368 - DNA, 20 bp, Artificial Sequence
  chemically synthesized
ttagtttatgaacttcagtc

SEQ ID NO: 390369 - DNA, 20 bp, Artificial Sequence
  chemically synthesized
gctttctgattacttgactg

SEQ ID NO: 390370 - DNA, 20 bp, Artificial Sequence
  chemically synthesized
atgaacttcagtcaagtaat

SEQ ID NO: 390371 - DNA, 20 bp, Artificial Sequence
  chemically synthesized
acttcagtcaagtaatcaga

SEQ ID NO: 390372 - DNA, 20 bp, Artificial Sequence
  chemically synthesized
taaagactattttattatat

SEQ ID NO: 390373 - DNA, 20 bp, Artificial Sequence
  chemically synthesized
agaaagccaatataataaaa

SEQ ID NO: 390374 - DNA, 20 bp, Artificial Sequence
  chemically synthesized
gcatgttttccagaaagtta

SEQ ID NO: 390375 - DNA, 20 bp, Artificial Sequence
  chemically synthesized
taaaatagtctttaactttc

SEQ ID NO: 390376 - DNA, 20 bp, Artificial Sequence
  chemically synthesized
atgcttgcatgttttccaga

SEQ ID NO: 390377 - DNA, 20 bp, Artificial Sequence
  chemically synthesized
atttatgcttgcatgttttc

SEQ ID NO: 390378 - DNA, 20 bp, Artificial Sequence
  chemically synthesized
taactttctggaaaacatgc

SEQ ID NO: 390379 - DNA, 20 bp, Artificial Sequence
  chemically synthesized
tgctacagaagtataaatga

SEQ ID NO: 390380 - DNA, 20 bp, Artificial Sequence
  chemically synthesized
aaccatcatttatacttctg

SEQ ID NO: 390381 - DNA, 20 bp, Artificial Sequence
  chemically synthesized
caatgtcactgttgctacag

SEQ ID NO: 390382 - DNA, 20 bp, Artificial Sequence
  chemically synthesized
catttatacttctgtagcaa

SEQ ID NO: 390383 - DNA, 20 bp, Artificial Sequence
  chemically synthesized
attcaatgtcactgttgcta

SEQ ID NO: 390384 - DNA, 20 bp, Artificial Sequence
  chemically synthesized
gtgacattgaatcatactca

SEQ ID NO: 390385 - DNA, 20 bp, Artificial Sequence
  chemically synthesized
attgaatcatactcaaagca

SEQ ID NO: 390386 - DNA, 20 bp, Artificial Sequence
  chemically synthesized
aatcttagatactttgcttt

SEQ ID NO: 390387 - DNA, 20 bp, Artificial Sequence
  chemically synthesized
atactcaaagcaaagtatct

SEQ ID NO: 390388 - DNA, 20 bp, Artificial Sequence
  chemically synthesized
aaagcaaagtatctaagatt

SEQ ID NO: 390389 - DNA, 20 bp, Artificial Sequence
  chemically synthesized
agcaaagtatctaagattca

SEQ ID NO: 390390 - DNA, 20 bp, Artificial Sequence
  chemically synthesized
atcctacttactctgaatct

SEQ ID NO: 390391 - DNA, 20 bp, Artificial Sequence
  chemically synthesized
aagtatctaagattcagagt

SEQ ID NO: 390392 - DNA, 20 bp, Artificial Sequence
  chemically synthesized
tatctaagattcagagtaag

SEQ ID NO: 390393 - DNA, 20 bp, Artificial Sequence
  chemically synthesized
atctaagattcagagtaagt

SEQ ID NO: 390394 - DNA, 20 bp, Artificial Sequence
  chemically synthesized
aatctttgcattggacaagt

SEQ ID NO: 390395 - DNA, 20 bp, Artificial Sequence
  chemically synthesized
gctgaatctttgcattggac

SEQ ID NO: 390396 - DNA, 20 bp, Artificial Sequence
  chemically synthesized
attctcacttgtccaatgca

SEQ ID NO: 390397 - DNA, 20 bp, Artificial Sequence
  chemically synthesized
atgtagctgaatctttgcat

SEQ ID NO: 390398 - DNA, 20 bp, Artificial Sequence
  chemically synthesized
acttgtccaatgcaaagatt

SEQ ID NO: 390399 - DNA, 20 bp, Artificial Sequence
  chemically synthesized
tgcaaagattcagctacatc

SEQ ID NO: 390400 - DNA, 20 bp, Artificial Sequence
  chemically synthesized
aaagattcagctacatctgg

SEQ ID NO: 390401 - DNA, 20 bp, Artificial Sequence
  chemically synthesized
actcctttacccaccagatg

SEQ ID NO: 390402 - DNA, 20 bp, Artificial Sequence
  chemically synthesized
aagattcagctacatctggt

SEQ ID NO: 390403 - DNA, 20 bp, Artificial Sequence
  chemically synthesized
tcagctacatctggtgggta

SEQ ID NO: 390404 - DNA, 20 bp, Artificial Sequence
  chemically synthesized
tatttaactcctttacccac

SEQ ID NO: 390405 - DNA, 20 bp, Artificial Sequence
  chemically synthesized
cagctacatctggtgggtaa

SEQ ID NO: 390406 - DNA, 20 bp, Artificial Sequence
  chemically synthesized
gctacatctggtgggtaaag

SEQ ID NO: 390407 - DNA, 20 bp, Artificial Sequence
  chemically synthesized
taaatattaacttcatcttt

SEQ ID NO: 390408 - DNA, 20 bp, Artificial Sequence
  chemically synthesized
taaatagatactaaaagatg

SEQ ID NO: 390409 - DNA, 20 bp, Artificial Sequence
  chemically synthesized
tagatctaaatagatactaa

SEQ ID NO: 390410 - DNA, 20 bp, Artificial Sequence
  chemically synthesized
ttcatcttttagtatctatt

SEQ ID NO: 390411 - DNA, 20 bp, Artificial Sequence
  chemically synthesized
ctatacaaattagatctaaa

SEQ ID NO: 390412 - DNA, 20 bp, Artificial Sequence
  chemically synthesized
ctatttagatctaatttgta

SEQ ID NO: 390413 - DNA, 20 bp, Artificial Sequence
  chemically synthesized
ccttaaccccctatacaaat

SEQ ID NO: 390414 - DNA, 20 bp, Artificial Sequence
  chemically synthesized
tatttagatctaatttgtat

SEQ ID NO: 390415 - DNA, 20 bp, Artificial Sequence
  chemically synthesized
atttagatctaatttgtata

SEQ ID NO: 390416 - DNA, 20 bp, Artificial Sequence
  chemically synthesized
tttagatctaatttgtatag

SEQ ID NO: 390417 - DNA, 20 bp, Artificial Sequence
  chemically synthesized
ttagatctaatttgtatagg

SEQ ID NO: 390418 - DNA, 20 bp, Artificial Sequence
  chemically synthesized
tctaatttgtatagggggtt

SEQ ID NO: 390419 - DNA, 20 bp, Artificial Sequence
  chemically synthesized
ctaatttgtatagggggtta

SEQ ID NO: 390420 - DNA, 20 bp, Artificial Sequence
  chemically synthesized
attaattttatttttatcag

SEQ ID NO: 390421 - DNA, 20 bp, Artificial Sequence
  chemically synthesized
ttattaattttatttttatc

SEQ ID NO: 390422 - DNA, 20 bp, Artificial Sequence
  chemically synthesized
gttattaattttatttttat

SEQ ID NO: 390423 - DNA, 20 bp, Artificial Sequence
  chemically synthesized
gtctaattatggagagtttt

SEQ ID NO: 390424 - DNA, 20 bp, Artificial Sequence
  chemically synthesized
atatgttgtctaattatgga

SEQ ID NO: 390425 - DNA, 20 bp, Artificial Sequence
  chemically synthesized
aacttaaaactctccataat

SEQ ID NO: 390426 - DNA, 20 bp, Artificial Sequence
  chemically synthesized
taatatgttgtctaattatg

SEQ ID NO: 390427 - DNA, 20 bp, Artificial Sequence
  chemically synthesized
gctaatatgttgtctaatta

SEQ ID NO: 390428 - DNA, 20 bp, Artificial Sequence
  chemically synthesized
tccataattagacaacatat

SEQ ID NO: 390429 - DNA, 20 bp, Artificial Sequence
  chemically synthesized
ctcatatttgatgggcatga

SEQ ID NO: 390430 - DNA, 20 bp, Artificial Sequence
  chemically synthesized
tgcagctcctcatatttgat

SEQ ID NO: 390431 - DNA, 20 bp, Artificial Sequence
  chemically synthesized
ttgcagctcctcatatttga

SEQ ID NO: 390432 - DNA, 20 bp, Artificial Sequence
  chemically synthesized
ctttcatgcccatcaaatat

SEQ ID NO: 390433 - DNA, 20 bp, Artificial Sequence
  chemically synthesized
tttcatgcccatcaaatatg

SEQ ID NO: 390434 - DNA, 20 bp, Artificial Sequence
  chemically synthesized
tcatgcccatcaaatatgag

SEQ ID NO: 390435 - DNA, 20 bp, Artificial Sequence
  chemically synthesized
caaatatgaggagctgcaaa

SEQ ID NO: 390436 - DNA, 20 bp, Artificial Sequence
  chemically synthesized
ccttgacactgtgctttttg

SEQ ID NO: 390437 - DNA, 20 bp, Artificial Sequence
  chemically synthesized
atgaggagctgcaaaaagca

SEQ ID NO: 390438 - DNA, 20 bp, Artificial Sequence
  chemically synthesized
gctgcaaaaagcacagtgtc

SEQ ID NO: 390439 - DNA, 20 bp, Artificial Sequence
  chemically synthesized
ctgcaaaaagcacagtgtca

SEQ ID NO: 390440 - DNA, 20 bp, Artificial Sequence
  chemically synthesized
tgcaaaaagcacagtgtcaa

SEQ ID NO: 390441 - DNA, 20 bp, Artificial Sequence
  chemically synthesized
gcaaaaagcacagtgtcaag

SEQ ID NO: 390442 - DNA, 20 bp, Artificial Sequence
  chemically synthesized
aaagcacagtgtcaaggggt

SEQ ID NO: 390443 - DNA, 20 bp, Artificial Sequence
  chemically synthesized
acagtgtcaaggggtaagtc

SEQ ID NO: 390444 - DNA, 20 bp, Artificial Sequence
  chemically synthesized
tgatttttacgtgagaacac

SEQ ID NO: 390445 - DNA, 20 bp, Artificial Sequence
  chemically synthesized
ctgcaagatgatttttacgt

SEQ ID NO: 390446 - DNA, 20 bp, Artificial Sequence
  chemically synthesized
ctcacgtaaaaatcatcttg

SEQ ID NO: 390447 - DNA, 20 bp, Artificial Sequence
  chemically synthesized
taaaaatcatcttgcagata

SEQ ID NO: 390448 - DNA, 20 bp, Artificial Sequence
  chemically synthesized
tttatcctgtctgtatctgc

SEQ ID NO: 390449 - DNA, 20 bp, Artificial Sequence
  chemically synthesized
aatcatcttgcagatacaga

SEQ ID NO: 390450 - DNA, 20 bp, Artificial Sequence
  chemically synthesized
atcatcttgcagatacagac

SEQ ID NO: 390451 - DNA, 20 bp, Artificial Sequence
  chemically synthesized
tcttaggcctcattattatt

SEQ ID NO: 390452 - DNA, 20 bp, Artificial Sequence
  chemically synthesized
aggataaactaaataataat

SEQ ID NO: 390453 - DNA, 20 bp, Artificial Sequence
  chemically synthesized
ggataaactaaataataatg

SEQ ID NO: 390454 - DNA, 20 bp, Artificial Sequence
  chemically synthesized
actaaataataatgaggcct

SEQ ID NO: 390455 - DNA, 20 bp, Artificial Sequence
  chemically synthesized
taataatgaggcctaagatt

SEQ ID NO: 390456 - DNA, 20 bp, Artificial Sequence
  chemically synthesized
cctcctccactccaaatctt

SEQ ID NO: 390457 - DNA, 20 bp, Artificial Sequence
  chemically synthesized
ataatgaggcctaagatttg

SEQ ID NO: 390458 - DNA, 20 bp, Artificial Sequence
  chemically synthesized
tcctcctccactccaaatct

SEQ ID NO: 390459 - DNA, 20 bp, Artificial Sequence
  chemically synthesized
atgaggcctaagatttggag

SEQ ID NO: 390460 - DNA, 20 bp, Artificial Sequence
  chemically synthesized
gaggcctaagatttggagtg

SEQ ID NO: 390461 - DNA, 20 bp, Artificial Sequence
  chemically synthesized
aggcctaagatttggagtgg

SEQ ID NO: 390462 - DNA, 20 bp, Artificial Sequence
  chemically synthesized
gcctaagatttggagtggag

SEQ ID NO: 390463 - DNA, 20 bp, Artificial Sequence
  chemically synthesized
cctaagatttggagtggagg

SEQ ID NO: 390464 - DNA, 20 bp, Artificial Sequence
  chemically synthesized
taagatttggagtggaggag

SEQ ID NO: 390465 - DNA, 20 bp, Artificial Sequence
  chemically synthesized
tggagtggaggaggagtccc

SEQ ID NO: 390466 - DNA, 20 bp, Artificial Sequence
  chemically synthesized
acagccatcaaggtgtactt

SEQ ID NO: 390467 - DNA, 20 bp, Artificial Sequence
  chemically synthesized
aacagccatcaaggtgtact

SEQ ID NO: 390468 - DNA, 20 bp, Artificial Sequence
  chemically synthesized
gagtcccaagtacaccttga

SEQ ID NO: 390469 - DNA, 20 bp, Artificial Sequence
  chemically synthesized
agtgcaggtaacagccatca

SEQ ID NO: 390470 - DNA, 20 bp, Artificial Sequence
  chemically synthesized
aagtgcaggtaacagccatc

SEQ ID NO: 390471 - DNA, 20 bp, Artificial Sequence
  chemically synthesized
ttggttgtaagtgcaggtaa

SEQ ID NO: 390472 - DNA, 20 bp, Artificial Sequence
  chemically synthesized
gctgttttggttgtaagtgc

SEQ ID NO: 390473 - DNA, 20 bp, Artificial Sequence
  chemically synthesized
ggctgttttggttgtaagtg

SEQ ID NO: 390474 - DNA, 20 bp, Artificial Sequence
  chemically synthesized
aaaatggctgttttggttgt

SEQ ID NO: 390475 - DNA, 20 bp, Artificial Sequence
  chemically synthesized
acctgcacttacaaccaaaa

SEQ ID NO: 390476 - DNA, 20 bp, Artificial Sequence
  chemically synthesized
tgacatgaaaatggctgttt

SEQ ID NO: 390477 - DNA, 20 bp, Artificial Sequence
  chemically synthesized
gcacacatttgacatgaaaa

SEQ ID NO: 390478 - DNA, 20 bp, Artificial Sequence
  chemically synthesized
ttcatgtcaaatgtgtgccc

SEQ ID NO: 390479 - DNA, 20 bp, Artificial Sequence
  chemically synthesized
tcatgtcaaatgtgtgccct

SEQ ID NO: 390480 - DNA, 20 bp, Artificial Sequence
  chemically synthesized
tacatagatcttgtatccca

SEQ ID NO: 390481 - DNA, 20 bp, Artificial Sequence
  chemically synthesized
aaatgtgtgccctgggatac

SEQ ID NO: 390482 - DNA, 20 bp, Artificial Sequence
  chemically synthesized
atacatagatcttgtatccc

SEQ ID NO: 390483 - DNA, 20 bp, Artificial Sequence
  chemically synthesized
tatacatagatcttgtatcc

SEQ ID NO: 390484 - DNA, 20 bp, Artificial Sequence
  chemically synthesized
aattctttaaaatgtataca

SEQ ID NO: 390485 - DNA, 20 bp, Artificial Sequence
  chemically synthesized
agatctatgtatacatttta

SEQ ID NO: 390486 - DNA, 20 bp, Artificial Sequence
  chemically synthesized
ttaaagaattattttattac

SEQ ID NO: 390487 - DNA, 20 bp, Artificial Sequence
  chemically synthesized
ttttattacaagtcactctt

SEQ ID NO: 390488 - DNA, 20 bp, Artificial Sequence
  chemically synthesized
tttattacaagtcactcttt

SEQ ID NO: 390489 - DNA, 20 bp, Artificial Sequence
  chemically synthesized
ttattacaagtcactctttg

SEQ ID NO: 390490 - DNA, 20 bp, Artificial Sequence
  chemically synthesized
tagagttgctggaccccaaa

SEQ ID NO: 390491 - DNA, 20 bp, Artificial Sequence
  chemically synthesized
acaagtcactctttggggtc

SEQ ID NO: 390492 - DNA, 20 bp, Artificial Sequence
  chemically synthesized
agtagagttgctggacccca

SEQ ID NO: 390493 - DNA, 20 bp, Artificial Sequence
  chemically synthesized
aggaggcatagtagagttgc

SEQ ID NO: 390494 - DNA, 20 bp, Artificial Sequence
  chemically synthesized
gttataaaggaggcatagta

SEQ ID NO: 390495 - DNA, 20 bp, Artificial Sequence
  chemically synthesized
ctgttataaaggaggcatag

SEQ ID NO: 390496 - DNA, 20 bp, Artificial Sequence
  chemically synthesized
tctctgttataaaggaggca

SEQ ID NO: 390497 - DNA, 20 bp, Artificial Sequence
  chemically synthesized
tctgttctctgttataaagg

SEQ ID NO: 390498 - DNA, 20 bp, Artificial Sequence
  chemically synthesized
atctgttctctgttataaag

SEQ ID NO: 390499 - DNA, 20 bp, Artificial Sequence
  chemically synthesized
ctactatgcctcctttataa

SEQ ID NO: 390500 - DNA, 20 bp, Artificial Sequence
  chemically synthesized
taatctgttctctgttataa

SEQ ID NO: 390501 - DNA, 20 bp, Artificial Sequence
  chemically synthesized
actatgcctcctttataaca

SEQ ID NO: 390502 - DNA, 20 bp, Artificial Sequence
  chemically synthesized
ttaatctgttctctgttata

SEQ ID NO: 390503 - DNA, 20 bp, Artificial Sequence
  chemically synthesized
gcctcctttataacagagaa

SEQ ID NO: 390504 - DNA, 20 bp, Artificial Sequence
  chemically synthesized
agagaacagattaaaacact

SEQ ID NO: 390505 - DNA, 20 bp, Artificial Sequence
  chemically synthesized
acagattaaaacactgagaa

SEQ ID NO: 390506 - DNA, 20 bp, Artificial Sequence
  chemically synthesized
cagattaaaacactgagaat

SEQ ID NO: 390507 - DNA, 20 bp, Artificial Sequence
  chemically synthesized
aaggggaaacttcccattct

SEQ ID NO: 390508 - DNA, 20 bp, Artificial Sequence
  chemically synthesized
attaaaacactgagaatggg

SEQ ID NO: 390509 - DNA, 20 bp, Artificial Sequence
  chemically synthesized
tacatccatgaagcagcaag

SEQ ID NO: 390510 - DNA, 20 bp, Artificial Sequence
  chemically synthesized
ttacatccatgaagcagcaa

SEQ ID NO: 390511 - DNA, 20 bp, Artificial Sequence
  chemically synthesized
cttacatccatgaagcagca

SEQ ID NO: 390512 - DNA, 20 bp, Artificial Sequence
  chemically synthesized
acttacatccatgaagcagc

SEQ ID NO: 390513 - DNA, 20 bp, Artificial Sequence
  chemically synthesized
agtttccccttgctgcttca

SEQ ID NO: 390514 - DNA, 20 bp, Artificial Sequence
  chemically synthesized
ctcaacttacatccatgaag

SEQ ID NO: 390515 - DNA, 20 bp, Artificial Sequence
  chemically synthesized
ctactcaacttacatccatg

SEQ ID NO: 390516 - DNA, 20 bp, Artificial Sequence
  chemically synthesized
ccttgctgcttcatggatgt

SEQ ID NO: 390517 - DNA, 20 bp, Artificial Sequence
  chemically synthesized
ctgcttcatggatgtaagtt

SEQ ID NO: 390518 - DNA, 20 bp, Artificial Sequence
  chemically synthesized
cttcatggatgtaagttgag

SEQ ID NO: 390519 - DNA, 20 bp, Artificial Sequence
  chemically synthesized
tttcagtctgcatgaagtcg

SEQ ID NO: 390520 - DNA, 20 bp, Artificial Sequence
  chemically synthesized
tgagtagctgcgacttcatg

SEQ ID NO: 390521 - DNA, 20 bp, Artificial Sequence
  chemically synthesized
tggttctttcagtctgcatg

SEQ ID NO: 390522 - DNA, 20 bp, Artificial Sequence
  chemically synthesized
tgcgacttcatgcagactga

SEQ ID NO: 390523 - DNA, 20 bp, Artificial Sequence
  chemically synthesized
ggtgctttgcttggttcttt

SEQ ID NO: 390524 - DNA, 20 bp, Artificial Sequence
  chemically synthesized
tcatgcagactgaaagaacc

SEQ ID NO: 390525 - DNA, 20 bp, Artificial Sequence
  chemically synthesized
cagactgaaagaaccaagca

SEQ ID NO: 390526 - DNA, 20 bp, Artificial Sequence
  chemically synthesized
ccactgtttggtgctttgct

SEQ ID NO: 390527 - DNA, 20 bp, Artificial Sequence
  chemically synthesized
gaaccaagcaaagcaccaaa

SEQ ID NO: 390528 - DNA, 20 bp, Artificial Sequence
  chemically synthesized
ccaagcaaagcaccaaacag

SEQ ID NO: 390529 - DNA, 20 bp, Artificial Sequence
  chemically synthesized
acctcttcaatgccactgtt

SEQ ID NO: 390530 - DNA, 20 bp, Artificial Sequence
  chemically synthesized
agcaccaaacagtggcattg

SEQ ID NO: 390531 - DNA, 20 bp, Artificial Sequence
  chemically synthesized
caccaaacagtggcattgaa

SEQ ID NO: 390532 - DNA, 20 bp, Artificial Sequence
  chemically synthesized
accaaacagtggcattgaag

SEQ ID NO: 390533 - DNA, 20 bp, Artificial Sequence
  chemically synthesized
gcattgaagaggttgactga

SEQ ID NO: 390534 - DNA, 20 bp, Artificial Sequence
  chemically synthesized
ttgaagaggttgactgacag

SEQ ID NO: 390535 - DNA, 20 bp, Artificial Sequence
  chemically synthesized
actgtgccctagaccactgt

SEQ ID NO: 390536 - DNA, 20 bp, Artificial Sequence
  chemically synthesized
gaggttgactgacagtggtc

SEQ ID NO: 390537 - DNA, 20 bp, Artificial Sequence
  chemically synthesized
aggttgactgacagtggtct

SEQ ID NO: 390538 - DNA, 20 bp, Artificial Sequence
  chemically synthesized
ggttgactgacagtggtcta

SEQ ID NO: 390539 - DNA, 20 bp, Artificial Sequence
  chemically synthesized
actgacagtggtctagggca

SEQ ID NO: 390540 - DNA, 20 bp, Artificial Sequence
  chemically synthesized
ctgcagctcaaactgtgccc

SEQ ID NO: 390541 - DNA, 20 bp, Artificial Sequence
  chemically synthesized
agtggtctagggcacagttt

SEQ ID NO: 390542 - DNA, 20 bp, Artificial Sequence
  chemically synthesized
ctagggcacagtttgagctg

SEQ ID NO: 390543 - DNA, 20 bp, Artificial Sequence
  chemically synthesized
gtttccctccacgggtgctg

SEQ ID NO: 390544 - DNA, 20 bp, Artificial Sequence
  chemically synthesized
agtttgagctgcagcacccg

SEQ ID NO: 390545 - DNA, 20 bp, Artificial Sequence
  chemically synthesized
tttgagctgcagcacccgtg

SEQ ID NO: 390546 - DNA, 20 bp, Artificial Sequence
  chemically synthesized
ttgagctgcagcacccgtgg

SEQ ID NO: 390547 - DNA, 20 bp, Artificial Sequence
  chemically synthesized
tgagctgcagcacccgtgga

SEQ ID NO: 390548 - DNA, 20 bp, Artificial Sequence
  chemically synthesized
agacagaggtttccctccac

SEQ ID NO: 390549 - DNA, 20 bp, Artificial Sequence
  chemically synthesized
tagacagaggtttccctcca

SEQ ID NO: 390550 - DNA, 20 bp, Artificial Sequence
  chemically synthesized
cgtggagggaaacctctgtc

SEQ ID NO: 390551 - DNA, 20 bp, Artificial Sequence
  chemically synthesized
gctaatgataatctagacag

SEQ ID NO: 390552 - DNA, 20 bp, Artificial Sequence
  chemically synthesized
cgctaatgataatctagaca

SEQ ID NO: 390553 - DNA, 20 bp, Artificial Sequence
  chemically synthesized
tacgctaatgataatctaga

SEQ ID NO: 390554 - DNA, 20 bp, Artificial Sequence
  chemically synthesized
cagctacgctaatgataatc

SEQ ID NO: 390555 - DNA, 20 bp, Artificial Sequence
  chemically synthesized
acctctgtctagattatcat

SEQ ID NO: 390556 - DNA, 20 bp, Artificial Sequence
  chemically synthesized
tgtctagattatcattagcg

SEQ ID NO: 390557 - DNA, 20 bp, Artificial Sequence
  chemically synthesized
attatcattagcgtagctga

SEQ ID NO: 390558 - DNA, 20 bp, Artificial Sequence
  chemically synthesized
tatcattagcgtagctgata

SEQ ID NO: 390559 - DNA, 20 bp, Artificial Sequence
  chemically synthesized
atcattagcgtagctgatag

SEQ ID NO: 390560 - DNA, 20 bp, Artificial Sequence
  chemically synthesized
agaacctttctcacctctat

SEQ ID NO: 390561 - DNA, 20 bp, Artificial Sequence
  chemically synthesized
ttagcgtagctgatagaggt

SEQ ID NO: 390562 - DNA, 20 bp, Artificial Sequence
  chemically synthesized
cgtagctgatagaggtgaga

SEQ ID NO: 390563 - DNA, 20 bp, Artificial Sequence
  chemically synthesized
gtagctgatagaggtgagaa

SEQ ID NO: 390564 - DNA, 20 bp, Artificial Sequence
  chemically synthesized
gatagaggtgagaaaggttc

SEQ ID NO: 390565 - DNA, 20 bp, Artificial Sequence
  chemically synthesized
atagaggtgagaaaggttct

SEQ ID NO: 390566 - DNA, 20 bp, Artificial Sequence
  chemically synthesized
agaggtgagaaaggttctgg

SEQ ID NO: 390567 - DNA, 20 bp, Artificial Sequence
  chemically synthesized
ggtgagaaaggttctgggag

SEQ ID NO: 390568 - DNA, 20 bp, Artificial Sequence
  chemically synthesized
ctgtgattggatgcttctcc

SEQ ID NO: 390569 - DNA, 20 bp, Artificial Sequence
  chemically synthesized
ctgggagaagcatccaatca

SEQ ID NO: 390570 - DNA, 20 bp, Artificial Sequence
  chemically synthesized
gggagaagcatccaatcaca

SEQ ID NO: 390571 - DNA, 20 bp, Artificial Sequence
  chemically synthesized
gcttgacttagctctgtgat

SEQ ID NO: 390572 - DNA, 20 bp, Artificial Sequence
  chemically synthesized
aagcatccaatcacagagct

SEQ ID NO: 390573 - DNA, 20 bp, Artificial Sequence
  chemically synthesized
tccaatcacagagctaagtc

SEQ ID NO: 390574 - DNA, 20 bp, Artificial Sequence
  chemically synthesized
atttggactgatgcttgact

SEQ ID NO: 390575 - DNA, 20 bp, Artificial Sequence
  chemically synthesized
cacagagctaagtcaagcat

SEQ ID NO: 390576 - DNA, 20 bp, Artificial Sequence
  chemically synthesized
tcaagcatcagtccaaattt

SEQ ID NO: 390577 - DNA, 20 bp, Artificial Sequence
  chemically synthesized
cactcagacattctgaaatt

SEQ ID NO: 390578 - DNA, 20 bp, Artificial Sequence
  chemically synthesized
gtccaaatttcagaatgtct

SEQ ID NO: 390579 - DNA, 20 bp, Artificial Sequence
  chemically synthesized
cctgcaggatgtttatcact

SEQ ID NO: 390580 - DNA, 20 bp, Artificial Sequence
  chemically synthesized
tctgagtgataaacatcctg

SEQ ID NO: 390581 - DNA, 20 bp, Artificial Sequence
  chemically synthesized
ctgagtgataaacatcctgc

SEQ ID NO: 390582 - DNA, 20 bp, Artificial Sequence
  chemically synthesized
tgagtgataaacatcctgca

SEQ ID NO: 390583 - DNA, 20 bp, Artificial Sequence
  chemically synthesized
atttgcatcattgtccctgc

SEQ ID NO: 390584 - DNA, 20 bp, Artificial Sequence
  chemically synthesized
aatttgcatcattgtccctg

SEQ ID NO: 390585 - DNA, 20 bp, Artificial Sequence
  chemically synthesized
gcagggacaatgatgcaaat

SEQ ID NO: 390586 - DNA, 20 bp, Artificial Sequence
  chemically synthesized
agggacaatgatgcaaattg

SEQ ID NO: 390587 - DNA, 20 bp, Artificial Sequence
  chemically synthesized
gacaatgatgcaaattggag

SEQ ID NO: 390588 - DNA, 20 bp, Artificial Sequence
  chemically synthesized
aattggagtagaaaacactg

SEQ ID NO: 390589 - DNA, 20 bp, Artificial Sequence
  chemically synthesized
ttggagtagaaaacactgaa

SEQ ID NO: 390590 - DNA, 20 bp, Artificial Sequence
  chemically synthesized
gagtagaaaacactgaagag

SEQ ID NO: 390591 - DNA, 20 bp, Artificial Sequence
  chemically synthesized
gcaagaccttggccactctt

SEQ ID NO: 390592 - DNA, 20 bp, Artificial Sequence
  chemically synthesized
gaaaacactgaagagtggcc

SEQ ID NO: 390593 - DNA, 20 bp, Artificial Sequence
  chemically synthesized
aaaacactgaagagtggcca

SEQ ID NO: 390594 - DNA, 20 bp, Artificial Sequence
  chemically synthesized
catgtgcatttgcaagacct

SEQ ID NO: 390595 - DNA, 20 bp, Artificial Sequence
  chemically synthesized
gcatctccatgtgcatttgc

SEQ ID NO: 390596 - DNA, 20 bp, Artificial Sequence
  chemically synthesized
caaggtcttgcaaatgcaca

SEQ ID NO: 390597 - DNA, 20 bp, Artificial Sequence
  chemically synthesized
aggtcttgcaaatgcacatg

SEQ ID NO: 390598 - DNA, 20 bp, Artificial Sequence
  chemically synthesized
atgcacatggagatgctaac

SEQ ID NO: 390599 - DNA, 20 bp, Artificial Sequence
  chemically synthesized
acatggagatgctaacaagc

SEQ ID NO: 390600 - DNA, 20 bp, Artificial Sequence
  chemically synthesized
ccaggattttgctagcttgt

SEQ ID NO: 390601 - DNA, 20 bp, Artificial Sequence
  chemically synthesized
gctttataccaggattttgc

SEQ ID NO: 390602 - DNA, 20 bp, Artificial Sequence
  chemically synthesized
ctaacaagctagcaaaatcc

SEQ ID NO: 390603 - DNA, 20 bp, Artificial Sequence
  chemically synthesized
gctagcaaaatcctggtata

SEQ ID NO: 390604 - DNA, 20 bp, Artificial Sequence
  chemically synthesized
ggtagtgttggctttatacc

SEQ ID NO: 390605 - DNA, 20 bp, Artificial Sequence
  chemically synthesized
gggtagtgttggctttatac

SEQ ID NO: 390606 - DNA, 20 bp, Artificial Sequence
  chemically synthesized
tgtgtaatcatgggtagtgt

SEQ ID NO: 390607 - DNA, 20 bp, Artificial Sequence
  chemically synthesized
tgaacctgtgtaatcatggg

SEQ ID NO: 390608 - DNA, 20 bp, Artificial Sequence
  chemically synthesized
ttatgaacctgtgtaatcat

SEQ ID NO: 390609 - DNA, 20 bp, Artificial Sequence
  chemically synthesized
attatgaacctgtgtaatca

SEQ ID NO: 390610 - DNA, 20 bp, Artificial Sequence
  chemically synthesized
caacactacccatgattaca

SEQ ID NO: 390611 - DNA, 20 bp, Artificial Sequence
  chemically synthesized
aacactacccatgattacac

SEQ ID NO: 390612 - DNA, 20 bp, Artificial Sequence
  chemically synthesized
tacacaggttcataatgcca

SEQ ID NO: 390613 - DNA, 20 bp, Artificial Sequence
  chemically synthesized
acacaggttcataatgccac

SEQ ID NO: 390614 - DNA, 20 bp, Artificial Sequence
  chemically synthesized
caggttcataatgccacagg

SEQ ID NO: 390615 - DNA, 20 bp, Artificial Sequence
  chemically synthesized
attgtaacctaaactgcctg

SEQ ID NO: 390616 - DNA, 20 bp, Artificial Sequence
  chemically synthesized
tcataatgccacaggcagtt

SEQ ID NO: 390617 - DNA, 20 bp, Artificial Sequence
  chemically synthesized
cataatgccacaggcagttt

SEQ ID NO: 390618 - DNA, 20 bp, Artificial Sequence
  chemically synthesized
aataaaattcatgaattctt

SEQ ID NO: 390619 - DNA, 20 bp, Artificial Sequence
  chemically synthesized
ttcatgaattcttcagtgct

SEQ ID NO: 390620 - DNA, 20 bp, Artificial Sequence
  chemically synthesized
tcctgcccagccaagcactg

SEQ ID NO: 390621 - DNA, 20 bp, Artificial Sequence
  chemically synthesized
tgaattcttcagtgcttggc

SEQ ID NO: 390622 - DNA, 20 bp, Artificial Sequence
  chemically synthesized
gaattcttcagtgcttggct

SEQ ID NO: 390623 - DNA, 20 bp, Artificial Sequence
  chemically synthesized
ttcttcagtgcttggctggg

SEQ ID NO: 390624 - DNA, 20 bp, Artificial Sequence
  chemically synthesized
agtacatatcctgcccagcc

SEQ ID NO: 390625 - DNA, 20 bp, Artificial Sequence
  chemically synthesized
tcttcagtgcttggctgggc

SEQ ID NO: 390626 - DNA, 20 bp, Artificial Sequence
  chemically synthesized
tgttcagtacatatcctgcc

SEQ ID NO: 390627 - DNA, 20 bp, Artificial Sequence
  chemically synthesized
ggcaggatatgtactgaaca

SEQ ID NO: 390628 - DNA, 20 bp, Artificial Sequence
  chemically synthesized
acctacgggagtgctttgtt

SEQ ID NO: 390629 - DNA, 20 bp, Artificial Sequence
  chemically synthesized
tactgaacaaagcactcccg

SEQ ID NO: 390630 - DNA, 20 bp, Artificial Sequence
  chemically synthesized
actgaacaaagcactcccgt

SEQ ID NO: 390631 - DNA, 20 bp, Artificial Sequence
  chemically synthesized
ctgcctttcagtacctacgg

SEQ ID NO: 390632 - DNA, 20 bp, Artificial Sequence
  chemically synthesized
cactgcctttcagtacctac

SEQ ID NO: 390633 - DNA, 20 bp, Artificial Sequence
  chemically synthesized
gcactgcctttcagtaccta

SEQ ID NO: 390634 - DNA, 20 bp, Artificial Sequence
  chemically synthesized
agcactcccgtaggtactga

SEQ ID NO: 390635 - DNA, 20 bp, Artificial Sequence
  chemically synthesized
gcactcccgtaggtactgaa

SEQ ID NO: 390636 - DNA, 20 bp, Artificial Sequence
  chemically synthesized
ctcccgtaggtactgaaagg

SEQ ID NO: 390637 - DNA, 20 bp, Artificial Sequence
  chemically synthesized
agtgaataggcactgccttt

SEQ ID NO: 390638 - DNA, 20 bp, Artificial Sequence
  chemically synthesized
aacatcaccagttagtgaat

SEQ ID NO: 390639 - DNA, 20 bp, Artificial Sequence
  chemically synthesized
taacatcaccagttagtgaa

SEQ ID NO: 390640 - DNA, 20 bp, Artificial Sequence
  chemically synthesized
ggcagtgcctattcactaac

SEQ ID NO: 390641 - DNA, 20 bp, Artificial Sequence
  chemically synthesized
ggatgaataacatcaccagt

SEQ ID NO: 390642 - DNA, 20 bp, Artificial Sequence
  chemically synthesized
aaacggatgaataacatcac

SEQ ID NO: 390643 - DNA, 20 bp, Artificial Sequence
  chemically synthesized
tatgttcctggttcaggaaa

SEQ ID NO: 390644 - DNA, 20 bp, Artificial Sequence
  chemically synthesized
tattcatccgtttcctgaac

SEQ ID NO: 390645 - DNA, 20 bp, Artificial Sequence
  chemically synthesized
attcatccgtttcctgaacc

SEQ ID NO: 390646 - DNA, 20 bp, Artificial Sequence
  chemically synthesized
ggctcctatgttcctggttc

SEQ ID NO: 390647 - DNA, 20 bp, Artificial Sequence
  chemically synthesized
gggctcctatgttcctggtt

SEQ ID NO: 390648 - DNA, 20 bp, Artificial Sequence
  chemically synthesized
cgtttcctgaaccaggaaca

SEQ ID NO: 390649 - DNA, 20 bp, Artificial Sequence
  chemically synthesized
gtttcctgaaccaggaacat

SEQ ID NO: 390650 - DNA, 20 bp, Artificial Sequence
  chemically synthesized
caaaggggctcctatgttcc

SEQ ID NO: 390651 - DNA, 20 bp, Artificial Sequence
  chemically synthesized
ttcctgaaccaggaacatag

SEQ ID NO: 390652 - DNA, 20 bp, Artificial Sequence
  chemically synthesized
ggatgaaagaggagacaaag

SEQ ID NO: 390653 - DNA, 20 bp, Artificial Sequence
  chemically synthesized
gggatgaaagaggagacaaa

SEQ ID NO: 390654 - DNA, 20 bp, Artificial Sequence
  chemically synthesized
agggatgaaagaggagacaa

SEQ ID NO: 390655 - DNA, 20 bp, Artificial Sequence
  chemically synthesized
gagggatgaaagaggagaca

SEQ ID NO: 390656 - DNA, 20 bp, Artificial Sequence
  chemically synthesized
ggctgggagggatgaaagag

SEQ ID NO: 390657 - DNA, 20 bp, Artificial Sequence
  chemically synthesized
ctggctgggagggatgaaag

SEQ ID NO: 390658 - DNA, 20 bp, Artificial Sequence
  chemically synthesized
actggctgggagggatgaaa

SEQ ID NO: 390659 - DNA, 20 bp, Artificial Sequence
  chemically synthesized
ggactggctgggagggatga

SEQ ID NO: 390660 - DNA, 20 bp, Artificial Sequence
  chemically synthesized
gtctcctctttcatccctcc

SEQ ID NO: 390661 - DNA, 20 bp, Artificial Sequence
  chemically synthesized
cctctttcatccctcccagc

SEQ ID NO: 390662 - DNA, 20 bp, Artificial Sequence
  chemically synthesized
gagcaatggactggctggga

SEQ ID NO: 390663 - DNA, 20 bp, Artificial Sequence
  chemically synthesized
tgagcaatggactggctggg

SEQ ID NO: 390664 - DNA, 20 bp, Artificial Sequence
  chemically synthesized
ttgagcaatggactggctgg

SEQ ID NO: 390665 - DNA, 20 bp, Artificial Sequence
  chemically synthesized
cattgagcaatggactggct

SEQ ID NO: 390666 - DNA, 20 bp, Artificial Sequence
  chemically synthesized
acattgagcaatggactggc

SEQ ID NO: 390667 - DNA, 20 bp, Artificial Sequence
  chemically synthesized
ttagacattgagcaatggac

SEQ ID NO: 390668 - DNA, 20 bp, Artificial Sequence
  chemically synthesized
caattttagacattgagcaa

SEQ ID NO: 390669 - DNA, 20 bp, Artificial Sequence
  chemically synthesized
ggaatccaattttagacatt

SEQ ID NO: 390670 - DNA, 20 bp, Artificial Sequence
  chemically synthesized
cattgctcaatgtctaaaat

SEQ ID NO: 390671 - DNA, 20 bp, Artificial Sequence
  chemically synthesized
gatcttggggaatccaattt

SEQ ID NO: 390672 - DNA, 20 bp, Artificial Sequence
  chemically synthesized
tgtctaaaattggattcccc

SEQ ID NO: 390673 - DNA, 20 bp, Artificial Sequence
  chemically synthesized
aaaattggattccccaagat

SEQ ID NO: 390674 - DNA, 20 bp, Artificial Sequence
  chemically synthesized
gtcatttaagtctgatcttg

SEQ ID NO: 390675 - DNA, 20 bp, Artificial Sequence
  chemically synthesized
tgtcatttaagtctgatctt

SEQ ID NO: 390676 - DNA, 20 bp, Artificial Sequence
  chemically synthesized
ttgtcatttaagtctgatct

SEQ ID NO: 390677 - DNA, 20 bp, Artificial Sequence
  chemically synthesized
tggactcaaatttgtcattt

SEQ ID NO: 390678 - DNA, 20 bp, Artificial Sequence
  chemically synthesized
cagacttaaatgacaaattt

SEQ ID NO: 390679 - DNA, 20 bp, Artificial Sequence
  chemically synthesized
atgacaaatttgagtccatg

SEQ ID NO: 390680 - DNA, 20 bp, Artificial Sequence
  chemically synthesized
ctccatcataatcagctaca

SEQ ID NO: 390681 - DNA, 20 bp, Artificial Sequence
  chemically synthesized
gtccatgtagctgattatga

SEQ ID NO: 390682 - DNA, 20 bp, Artificial Sequence
  chemically synthesized
tctgtgatctccatcataat

SEQ ID NO: 390683 - DNA, 20 bp, Artificial Sequence
  chemically synthesized
ccatgtagctgattatgatg

SEQ ID NO: 390684 - DNA, 20 bp, Artificial Sequence
  chemically synthesized
gctgattatgatggagatca

SEQ ID NO: 390685 - DNA, 20 bp, Artificial Sequence
  chemically synthesized
attatgatggagatcacaga

SEQ ID NO: 390686 - DNA, 20 bp, Artificial Sequence
  chemically synthesized
gagatcacagaaagcatcaa

SEQ ID NO: 390687 - DNA, 20 bp, Artificial Sequence
  chemically synthesized
agatcacagaaagcatcaac

SEQ ID NO: 390688 - DNA, 20 bp, Artificial Sequence
  chemically synthesized
tcacagaaagcatcaacagg

SEQ ID NO: 390689 - DNA, 20 bp, Artificial Sequence
  chemically synthesized
agaaagcatcaacaggaagt

SEQ ID NO: 390690 - DNA, 20 bp, Artificial Sequence
  chemically synthesized
catcaacaggaagtgagaaa

SEQ ID NO: 390691 - DNA, 20 bp, Artificial Sequence
  chemically synthesized
atcaacaggaagtgagaaac

SEQ ID NO: 390692 - DNA, 20 bp, Artificial Sequence
  chemically synthesized
aacaggaagtgagaaacagg

SEQ ID NO: 390693 - DNA, 20 bp, Artificial Sequence
  chemically synthesized
agaaacaggaagatctgtga

SEQ ID NO: 390694 - DNA, 20 bp, Artificial Sequence
  chemically synthesized
aaacaggaagatctgtgatg

SEQ ID NO: 390695 - DNA, 20 bp, Artificial Sequence
  chemically synthesized
gctttctgtgatctccatca

SEQ ID NO: 390696 - DNA, 20 bp, Artificial Sequence
  chemically synthesized
aagatctgtgatggagatca

SEQ ID NO: 390697 - DNA, 20 bp, Artificial Sequence
  chemically synthesized
tctgtgatggagatcacaga

SEQ ID NO: 390698 - DNA, 20 bp, Artificial Sequence
  chemically synthesized
gagatcacagaaagcatcaa

SEQ ID NO: 390699 - DNA, 20 bp, Artificial Sequence
  chemically synthesized
agatcacagaaagcatcaac

SEQ ID NO: 390700 - DNA, 20 bp, Artificial Sequence
  chemically synthesized
tcacagaaagcatcaacagg

SEQ ID NO: 390701 - DNA, 20 bp, Artificial Sequence
  chemically synthesized
cagaaagcatcaacaggaag

SEQ ID NO: 390702 - DNA, 20 bp, Artificial Sequence
  chemically synthesized
gaaagcatcaacaggaagta

SEQ ID NO: 390703 - DNA, 20 bp, Artificial Sequence
  chemically synthesized
agcatcaacaggaagtagag

SEQ ID NO: 390704 - DNA, 20 bp, Artificial Sequence
  chemically synthesized
tcaacaggaagtagagaagt

SEQ ID NO: 390705 - DNA, 20 bp, Artificial Sequence
  chemically synthesized
caggaagtagagaagtgaga

SEQ ID NO: 390706 - DNA, 20 bp, Artificial Sequence
  chemically synthesized
ggaagtagagaagtgagata

SEQ ID NO: 390707 - DNA, 20 bp, Artificial Sequence
  chemically synthesized
agtagagaagtgagatagag

SEQ ID NO: 390708 - DNA, 20 bp, Artificial Sequence
  chemically synthesized
gagaagtgagatagagaaga

SEQ ID NO: 390709 - DNA, 20 bp, Artificial Sequence
  chemically synthesized
agaagtgagatagagaagaa

SEQ ID NO: 390710 - DNA, 20 bp, Artificial Sequence
  chemically synthesized
atagagaagaaaggaacaca

SEQ ID NO: 390711 - DNA, 20 bp, Artificial Sequence
  chemically synthesized
agagaagaaaggaacacaca

SEQ ID NO: 390712 - DNA, 20 bp, Artificial Sequence
  chemically synthesized
aacacacagagtacattaat

SEQ ID NO: 390713 - DNA, 20 bp, Artificial Sequence
  chemically synthesized
cacagagtacattaatgagc

SEQ ID NO: 390714 - DNA, 20 bp, Artificial Sequence
  chemically synthesized
taatgagcaagttatgacta

SEQ ID NO: 390715 - DNA, 20 bp, Artificial Sequence
  chemically synthesized
cattaagtcccagtcatcca

SEQ ID NO: 390716 - DNA, 20 bp, Artificial Sequence
  chemically synthesized
aagttatgactatggatgac

SEQ ID NO: 390717 - DNA, 20 bp, Artificial Sequence
  chemically synthesized
agttatgactatggatgact

SEQ ID NO: 390718 - DNA, 20 bp, Artificial Sequence
  chemically synthesized
tctccagtggcattaagtcc

SEQ ID NO: 390719 - DNA, 20 bp, Artificial Sequence
  chemically synthesized
tagaagtctccagtggcatt

SEQ ID NO: 390720 - DNA, 20 bp, Artificial Sequence
  chemically synthesized
tgactgggacttaatgccac

SEQ ID NO: 390721 - DNA, 20 bp, Artificial Sequence
  chemically synthesized
actgggacttaatgccactg

SEQ ID NO: 390722 - DNA, 20 bp, Artificial Sequence
  chemically synthesized
catttgctagaagtctccag

SEQ ID NO: 390723 - DNA, 20 bp, Artificial Sequence
  chemically synthesized
tttcatttgctagaagtctc

SEQ ID NO: 390724 - DNA, 20 bp, Artificial Sequence
  chemically synthesized
ttaatgccactggagacttc

SEQ ID NO: 390725 - DNA, 20 bp, Artificial Sequence
  chemically synthesized
atgtctatttcatttgctag

SEQ ID NO: 390726 - DNA, 20 bp, Artificial Sequence
  chemically synthesized
ggcatgtctatttcatttgc

SEQ ID NO: 390727 - DNA, 20 bp, Artificial Sequence
  chemically synthesized
gagacttctagcaaatgaaa

SEQ ID NO: 390728 - DNA, 20 bp, Artificial Sequence
  chemically synthesized
acactcaaataggatgcatg

SEQ ID NO: 390729 - DNA, 20 bp, Artificial Sequence
  chemically synthesized
tacactcaaataggatgcat

SEQ ID NO: 390730 - DNA, 20 bp, Artificial Sequence
  chemically synthesized
atgcctcatgcatcctattt

SEQ ID NO: 390731 - DNA, 20 bp, Artificial Sequence
  chemically synthesized
taaactttttacactcaaat

SEQ ID NO: 390732 - DNA, 20 bp, Artificial Sequence
  chemically synthesized
ctaaactttttacactcaaa

SEQ ID NO: 390733 - DNA, 20 bp, Artificial Sequence
  chemically synthesized
gcatcctatttgagtgtaaa

SEQ ID NO: 390734 - DNA, 20 bp, Artificial Sequence
  chemically synthesized
ctatttgagtgtaaaaagtt

SEQ ID NO: 390735 - DNA, 20 bp, Artificial Sequence
  chemically synthesized
atttgagtgtaaaaagttta

SEQ ID NO: 390736 - DNA, 20 bp, Artificial Sequence
  chemically synthesized
ggttaataatagatgagaat

SEQ ID NO: 390737 - DNA, 20 bp, Artificial Sequence
  chemically synthesized
tcttcaggttaataatagat

SEQ ID NO: 390738 - DNA, 20 bp, Artificial Sequence
  chemically synthesized
agcattcttcaggttaataa

SEQ ID NO: 390739 - DNA, 20 bp, Artificial Sequence
  chemically synthesized
tctcatctattattaacctg

SEQ ID NO: 390740 - DNA, 20 bp, Artificial Sequence
  chemically synthesized
agacccaagcagcattcttc

SEQ ID NO: 390741 - DNA, 20 bp, Artificial Sequence
  chemically synthesized
aagacccaagcagcattctt

SEQ ID NO: 390742 - DNA, 20 bp, Artificial Sequence
  chemically synthesized
ttaacctgaagaatgctgct

SEQ ID NO: 390743 - DNA, 20 bp, Artificial Sequence
  chemically synthesized
taacctgaagaatgctgctt

SEQ ID NO: 390744 - DNA, 20 bp, Artificial Sequence
  chemically synthesized
tggaatattgaagacccaag

SEQ ID NO: 390745 - DNA, 20 bp, Artificial Sequence
  chemically synthesized
tgctggaatattgaagaccc

SEQ ID NO: 390746 - DNA, 20 bp, Artificial Sequence
  chemically synthesized
ctagaagtgctggaatattg

SEQ ID NO: 390747 - DNA, 20 bp, Artificial Sequence
  chemically synthesized
tgcttgggtcttcaatattc

SEQ ID NO: 390748 - DNA, 20 bp, Artificial Sequence
  chemically synthesized
cttcaatattccagcacttc

SEQ ID NO: 390749 - DNA, 20 bp, Artificial Sequence
  chemically synthesized
gcggggaaggctagaagtgc

SEQ ID NO: 390750 - DNA, 20 bp, Artificial Sequence
  chemically synthesized
gccactgcggggaaggctag

SEQ ID NO: 390751 - DNA, 20 bp, Artificial Sequence
  chemically synthesized
tttgccactgcggggaaggc

SEQ ID NO: 390752 - DNA, 20 bp, Artificial Sequence
  chemically synthesized
agcacttctagccttccccg

SEQ ID NO: 390753 - DNA, 20 bp, Artificial Sequence
  chemically synthesized
tgggtttgccactgcgggga

SEQ ID NO: 390754 - DNA, 20 bp, Artificial Sequence
  chemically synthesized
atgggtttgccactgcgggg

SEQ ID NO: 390755 - DNA, 20 bp, Artificial Sequence
  chemically synthesized
acttctagccttccccgcag

SEQ ID NO: 390756 - DNA, 20 bp, Artificial Sequence
  chemically synthesized
ctgatgggtttgccactgcg

SEQ ID NO: 390757 - DNA, 20 bp, Artificial Sequence
  chemically synthesized
tctgatgggtttgccactgc

SEQ ID NO: 390758 - DNA, 20 bp, Artificial Sequence
  chemically synthesized
ctctgatgggtttgccactg

SEQ ID NO: 390759 - DNA, 20 bp, Artificial Sequence
  chemically synthesized
ccccgcagtggcaaacccat

SEQ ID NO: 390760 - DNA, 20 bp, Artificial Sequence
  chemically synthesized
ccgcagtggcaaacccatca

SEQ ID NO: 390761 - DNA, 20 bp, Artificial Sequence
  chemically synthesized
acctgaagactttctctgat

SEQ ID NO: 390762 - DNA, 20 bp, Artificial Sequence
  chemically synthesized
agtggcaaacccatcagaga

SEQ ID NO: 390763 - DNA, 20 bp, Artificial Sequence
  chemically synthesized
cacctgaagactttctctga

SEQ ID NO: 390764 - DNA, 20 bp, Artificial Sequence
  chemically synthesized
aacccatcagagaaagtctt

SEQ ID NO: 390765 - DNA, 20 bp, Artificial Sequence
  chemically synthesized
acccatcagagaaagtcttc

SEQ ID NO: 390766 - DNA, 20 bp, Artificial Sequence
  chemically synthesized
catctaattgcgtgcacctg

SEQ ID NO: 390767 - DNA, 20 bp, Artificial Sequence
  chemically synthesized
agtcttcaggtgcacgcaat

SEQ ID NO: 390768 - DNA, 20 bp, Artificial Sequence
  chemically synthesized
ggtgcacgcaattagatgat

SEQ ID NO: 390769 - DNA, 20 bp, Artificial Sequence
  chemically synthesized
aattagatgatgagacaaaa

SEQ ID NO: 390770 - DNA, 20 bp, Artificial Sequence
  chemically synthesized
attagatgatgagacaaaat

SEQ ID NO: 390771 - DNA, 20 bp, Artificial Sequence
  chemically synthesized
tagatgatgagacaaaatgg

SEQ ID NO: 390772 - DNA, 20 bp, Artificial Sequence
  chemically synthesized
agacaaaatgggagcgctga

SEQ ID NO: 390773 - DNA, 20 bp, Artificial Sequence
  chemically synthesized
gacaaaatgggagcgctgaa

SEQ ID NO: 390774 - DNA, 20 bp, Artificial Sequence
  chemically synthesized
acaaaatgggagcgctgaaa

SEQ ID NO: 390775 - DNA, 20 bp, Artificial Sequence
  chemically synthesized
ggacgctgtccgtacccttt

SEQ ID NO: 390776 - DNA, 20 bp, Artificial Sequence
  chemically synthesized
atgggagcgctgaaagggta

SEQ ID NO: 390777 - DNA, 20 bp, Artificial Sequence
  chemically synthesized
gagcgctgaaagggtacgga

SEQ ID NO: 390778 - DNA, 20 bp, Artificial Sequence
  chemically synthesized
agggtacggacagcgtccac

SEQ ID NO: 390779 - DNA, 20 bp, Artificial Sequence
  chemically synthesized
agggtactctttaaatctag

SEQ ID NO: 390780 - DNA, 20 bp, Artificial Sequence
  chemically synthesized
gacagcgtccactagattta

SEQ ID NO: 390781 - DNA, 20 bp, Artificial Sequence
  chemically synthesized
tgtagggtactctttaaatc

SEQ ID NO: 390782 - DNA, 20 bp, Artificial Sequence
  chemically synthesized
cagcgtccactagatttaaa

SEQ ID NO: 390783 - DNA, 20 bp, Artificial Sequence
  chemically synthesized
tacactataagataaatgta

SEQ ID NO: 390784 - DNA, 20 bp, Artificial Sequence
  chemically synthesized
ctacactataagataaatgt

SEQ ID NO: 390785 - DNA, 20 bp, Artificial Sequence
  chemically synthesized
tctacactataagataaatg

SEQ ID NO: 390786 - DNA, 20 bp, Artificial Sequence
  chemically synthesized
agtaccctacatttatctta

SEQ ID NO: 390787 - DNA, 20 bp, Artificial Sequence
  chemically synthesized
cctacatttatcttatagtg

SEQ ID NO: 390788 - DNA, 20 bp, Artificial Sequence
  chemically synthesized
acagctatagtctacactat

SEQ ID NO: 390789 - DNA, 20 bp, Artificial Sequence
  chemically synthesized
ttatcttatagtgtagacta

SEQ ID NO: 390790 - DNA, 20 bp, Artificial Sequence
  chemically synthesized
caaaaaagcaagaacagcta

SEQ ID NO: 390791 - DNA, 20 bp, Artificial Sequence
  chemically synthesized
ttggtacaaaaaagcaagaa

SEQ ID NO: 390792 - DNA, 20 bp, Artificial Sequence
  chemically synthesized
gtcatttggtacaaaaaagc

SEQ ID NO: 390793 - DNA, 20 bp, Artificial Sequence
  chemically synthesized
atgagtcatttggtacaaaa

SEQ ID NO: 390794 - DNA, 20 bp, Artificial Sequence
  chemically synthesized
ggaaaaaaagatgagtcatt

SEQ ID NO: 390795 - DNA, 20 bp, Artificial Sequence
  chemically synthesized
taaaggaaggaaaaaaagat

SEQ ID NO: 390796 - DNA, 20 bp, Artificial Sequence
  chemically synthesized
gtttctaaaggaaggaaaaa

SEQ ID NO: 390797 - DNA, 20 bp, Artificial Sequence
  chemically synthesized
tcatctttttttccttcctt

SEQ ID NO: 390798 - DNA, 20 bp, Artificial Sequence
  chemically synthesized
tcaatcttgtttctaaagga

SEQ ID NO: 390799 - DNA, 20 bp, Artificial Sequence
  chemically synthesized
ttcaatcttgtttctaaagg

SEQ ID NO: 390800 - DNA, 20 bp, Artificial Sequence
  chemically synthesized
attttcaatcttgtttctaa

SEQ ID NO: 390801 - DNA, 20 bp, Artificial Sequence
  chemically synthesized
tttttccttcctttagaaac

SEQ ID NO: 390802 - DNA, 20 bp, Artificial Sequence
  chemically synthesized
cattttcaatcttgtttcta

SEQ ID NO: 390803 - DNA, 20 bp, Artificial Sequence
  chemically synthesized
caagattgaaaatgtaatct

SEQ ID NO: 390804 - DNA, 20 bp, Artificial Sequence
  chemically synthesized
aaaatgtaatctcggttgaa

SEQ ID NO: 390805 - DNA, 20 bp, Artificial Sequence
  chemically synthesized
tccatgcttcctgttcaacc

SEQ ID NO: 390806 - DNA, 20 bp, Artificial Sequence
  chemically synthesized
aaatgtaatctcggttgaac

SEQ ID NO: 390807 - DNA, 20 bp, Artificial Sequence
  chemically synthesized
tgtaatctcggttgaacagg

SEQ ID NO: 390808 - DNA, 20 bp, Artificial Sequence
  chemically synthesized
tctcggttgaacaggaagca

SEQ ID NO: 390809 - DNA, 20 bp, Artificial Sequence
  chemically synthesized
tcggttgaacaggaagcatg

SEQ ID NO: 390810 - DNA, 20 bp, Artificial Sequence
  chemically synthesized
ttgaacaggaagcatggaga

SEQ ID NO: 390811 - DNA, 20 bp, Artificial Sequence
  chemically synthesized
tggagatagttcaactgaat

SEQ ID NO: 390812 - DNA, 20 bp, Artificial Sequence
  chemically synthesized
agatagttcaactgaattgg

SEQ ID NO: 390813 - DNA, 20 bp, Artificial Sequence
  chemically synthesized
acaaccagcaacttccaatt

SEQ ID NO: 390814 - DNA, 20 bp, Artificial Sequence
  chemically synthesized
tcaactgaattggaagttgc

SEQ ID NO: 390815 - DNA, 20 bp, Artificial Sequence
  chemically synthesized
gaattggaagttgctggttg

SEQ ID NO: 390816 - DNA, 20 bp, Artificial Sequence
  chemically synthesized
gcatagaaatattctacaac

SEQ ID NO: 390817 - DNA, 20 bp, Artificial Sequence
  chemically synthesized
gcactgtcttgaagaatgca

SEQ ID NO: 390818 - DNA, 20 bp, Artificial Sequence
  chemically synthesized
aatatttctatgcattcttc

SEQ ID NO: 390819 - DNA, 20 bp, Artificial Sequence
  chemically synthesized
tttctatgcattcttcaaga

SEQ ID NO: 390820 - DNA, 20 bp, Artificial Sequence
  chemically synthesized
cttcacatggcactgtcttg

SEQ ID NO: 390821 - DNA, 20 bp, Artificial Sequence
  chemically synthesized
cttcaagacagtgccatgtg

SEQ ID NO: 390822 - DNA, 20 bp, Artificial Sequence
  chemically synthesized
aggtcagaagaggcttcaca

SEQ ID NO: 390823 - DNA, 20 bp, Artificial Sequence
  chemically synthesized
ctaactggacaggtcagaag

SEQ ID NO: 390824 - DNA, 20 bp, Artificial Sequence
  chemically synthesized
gctaactggacaggtcagaa

SEQ ID NO: 390825 - DNA, 20 bp, Artificial Sequence
  chemically synthesized
aagctaactggacaggtcag

SEQ ID NO: 390826 - DNA, 20 bp, Artificial Sequence
  chemically synthesized
gaagcctcttctgacctgtc

SEQ ID NO: 390827 - DNA, 20 bp, Artificial Sequence
  chemically synthesized
taaaagctaactggacaggt

SEQ ID NO: 390828 - DNA, 20 bp, Artificial Sequence
  chemically synthesized
cctcttctgacctgtccagt

SEQ ID NO: 390829 - DNA, 20 bp, Artificial Sequence
  chemically synthesized
gaaataaaagctaactggac

SEQ ID NO: 390830 - DNA, 20 bp, Artificial Sequence
  chemically synthesized
agaaataaaagctaactgga

SEQ ID NO: 390831 - DNA, 20 bp, Artificial Sequence
  chemically synthesized
agagagaaataaaagctaac

SEQ ID NO: 390832 - DNA, 20 bp, Artificial Sequence
  chemically synthesized
cacaaaagagagagaaataa

SEQ ID NO: 390833 - DNA, 20 bp, Artificial Sequence
  chemically synthesized
cagtgctgtcacaaaagaga

SEQ ID NO: 390834 - DNA, 20 bp, Artificial Sequence
  chemically synthesized
tacagtgctgtcacaaaaga

SEQ ID NO: 390835 - DNA, 20 bp, Artificial Sequence
  chemically synthesized
agtacagtgctgtcacaaaa

SEQ ID NO: 390836 - DNA, 20 bp, Artificial Sequence
  chemically synthesized
tatttctctctcttttgtga

SEQ ID NO: 390837 - DNA, 20 bp, Artificial Sequence
  chemically synthesized
aaagtacagtgctgtcacaa

SEQ ID NO: 390838 - DNA, 20 bp, Artificial Sequence
  chemically synthesized
acaataagatgtgcaaagta

SEQ ID NO: 390839 - DNA, 20 bp, Artificial Sequence
  chemically synthesized
atgaaacaataagatgtgca

SEQ ID NO: 390840 - DNA, 20 bp, Artificial Sequence
  chemically synthesized
agtgtgaagaatgaaacaat

SEQ ID NO: 390841 - DNA, 20 bp, Artificial Sequence
  chemically synthesized
gtataatactgaaaagtgtg

SEQ ID NO: 390842 - DNA, 20 bp, Artificial Sequence
  chemically synthesized
gtttcattcttcacactttt

SEQ ID NO: 390843 - DNA, 20 bp, Artificial Sequence
  chemically synthesized
tagataagtataatactgaa

SEQ ID NO: 390844 - DNA, 20 bp, Artificial Sequence
  chemically synthesized
gaatttactggaagatagat

SEQ ID NO: 390845 - DNA, 20 bp, Artificial Sequence
  chemically synthesized
tattatacttatctatcttc

SEQ ID NO: 390846 - DNA, 20 bp, Artificial Sequence
  chemically synthesized
aagaagaatttactggaaga

SEQ ID NO: 390847 - DNA, 20 bp, Artificial Sequence
  chemically synthesized
tgttaagaagaatttactgg

SEQ ID NO: 390848 - DNA, 20 bp, Artificial Sequence
  chemically synthesized
gtctgttaagaagaatttac

SEQ ID NO: 390849 - DNA, 20 bp, Artificial Sequence
  chemically synthesized
ttccagtaaattcttcttaa

SEQ ID NO: 390850 - DNA, 20 bp, Artificial Sequence
  chemically synthesized
gaaaatgatagtctgttaag

SEQ ID NO: 390851 - DNA, 20 bp, Artificial Sequence
  chemically synthesized
caagaaaatgatagtctgtt

SEQ ID NO: 390852 - DNA, 20 bp, Artificial Sequence
  chemically synthesized
tcttgctctcaagaaaatga

SEQ ID NO: 390853 - DNA, 20 bp, Artificial Sequence
  chemically synthesized
taacagactatcattttctt

SEQ ID NO: 390854 - DNA, 20 bp, Artificial Sequence
  chemically synthesized
acagactatcattttcttga

SEQ ID NO: 390855 - DNA, 20 bp, Artificial Sequence
  chemically synthesized
actatcattttcttgagagc

SEQ ID NO: 390856 - DNA, 20 bp, Artificial Sequence
  chemically synthesized
aagacccaattcttgctctc

SEQ ID NO: 390857 - DNA, 20 bp, Artificial Sequence
  chemically synthesized
attttcttgagagcaagaat

SEQ ID NO: 390858 - DNA, 20 bp, Artificial Sequence
  chemically synthesized
ttttcttgagagcaagaatt

SEQ ID NO: 390859 - DNA, 20 bp, Artificial Sequence
  chemically synthesized
ctaaaatacaaagatgaacg

SEQ ID NO: 390860 - DNA, 20 bp, Artificial Sequence
  chemically synthesized
cttcgttcatctttgtattt

SEQ ID NO: 390861 - DNA, 20 bp, Artificial Sequence
  chemically synthesized
tactccatgcctaaaataca

SEQ ID NO: 390862 - DNA, 20 bp, Artificial Sequence
  chemically synthesized
ttcgttcatctttgtatttt

SEQ ID NO: 390863 - DNA, 20 bp, Artificial Sequence
  chemically synthesized
tcatctttgtattttaggca

SEQ ID NO: 390864 - DNA, 20 bp, Artificial Sequence
  chemically synthesized
atctttgtattttaggcatg

SEQ ID NO: 390865 - DNA, 20 bp, Artificial Sequence
  chemically synthesized
tgtattttaggcatggagta

SEQ ID NO: 390866 - DNA, 20 bp, Artificial Sequence
  chemically synthesized
aggcatggagtatagtcccc

SEQ ID NO: 390867 - DNA, 20 bp, Artificial Sequence
  chemically synthesized
ggagtatagtccccaagaac

SEQ ID NO: 390868 - DNA, 20 bp, Artificial Sequence
  chemically synthesized
tgaacacttactggttcttg

SEQ ID NO: 390869 - DNA, 20 bp, Artificial Sequence
  chemically synthesized
atgaacacttactggttctt

SEQ ID NO: 390870 - DNA, 20 bp, Artificial Sequence
  chemically synthesized
gatgaacacttactggttct

SEQ ID NO: 390871 - DNA, 20 bp, Artificial Sequence
  chemically synthesized
tatagtccccaagaaccagt

SEQ ID NO: 390872 - DNA, 20 bp, Artificial Sequence
  chemically synthesized
aacatttgatgaacacttac

SEQ ID NO: 390873 - DNA, 20 bp, Artificial Sequence
  chemically synthesized
acagtcatttattcattcaa

SEQ ID NO: 390874 - DNA, 20 bp, Artificial Sequence
  chemically synthesized
atcattagcagcaatgcaca

SEQ ID NO: 390875 - DNA, 20 bp, Artificial Sequence
  chemically synthesized
atggtgaagaatatcattag

SEQ ID NO: 390876 - DNA, 20 bp, Artificial Sequence
  chemically synthesized
aaaatggtgaagaatatcat

SEQ ID NO: 390877 - DNA, 20 bp, Artificial Sequence
  chemically synthesized
agattctgaagaaaatggtg

SEQ ID NO: 390878 - DNA, 20 bp, Artificial Sequence
  chemically synthesized
atattcttcaccattttctt

SEQ ID NO: 390879 - DNA, 20 bp, Artificial Sequence
  chemically synthesized
taagcagattctgaagaaaa

SEQ ID NO: 390880 - DNA, 20 bp, Artificial Sequence
  chemically synthesized
accagcataagcagattctg

SEQ ID NO: 390881 - DNA, 20 bp, Artificial Sequence
  chemically synthesized
tcttcagaatctgcttatgc

SEQ ID NO: 390882 - DNA, 20 bp, Artificial Sequence
  chemically synthesized
tttaatctgaccagcataag

SEQ ID NO: 390883 - DNA, 20 bp, Artificial Sequence
  chemically synthesized
ccatttaatctgaccagcat

SEQ ID NO: 390884 - DNA, 20 bp, Artificial Sequence
  chemically synthesized
cagaatctgcttatgctggt

SEQ ID NO: 390885 - DNA, 20 bp, Artificial Sequence
  chemically synthesized
gtaaagccatttaatctgac

SEQ ID NO: 390886 - DNA, 20 bp, Artificial Sequence
  chemically synthesized
cttatgctggtcagattaaa

SEQ ID NO: 390887 - DNA, 20 bp, Artificial Sequence
  chemically synthesized
cagattaaatggctttactt

SEQ ID NO: 390888 - DNA, 20 bp, Artificial Sequence
  chemically synthesized
agttggaaacagctcaagta

SEQ ID NO: 390889 - DNA, 20 bp, Artificial Sequence
  chemically synthesized
ttgaaagttggaaacagctc

SEQ ID NO: 390890 - DNA, 20 bp, Artificial Sequence
  chemically synthesized
atctgtttgaaagttggaaa

SEQ ID NO: 390891 - DNA, 20 bp, Artificial Sequence
  chemically synthesized
aaaaaaatctgtttgaaagt

SEQ ID NO: 390892 - DNA, 20 bp, Artificial Sequence
  chemically synthesized
agctgtttccaactttcaaa

SEQ ID NO: 390893 - DNA, 20 bp, Artificial Sequence
  chemically synthesized
aaaaaaaaaaatctgtttga

SEQ ID NO: 390894 - DNA, 20 bp, Artificial Sequence
  chemically synthesized
gattttttttttttttctga

SEQ ID NO: 390895 - DNA, 20 bp, Artificial Sequence
  chemically synthesized
cagtggtgttaaatcactgt

SEQ ID NO: 390896 - DNA, 20 bp, Artificial Sequence
  chemically synthesized
cagtgatttaacaccactga

SEQ ID NO: 390897 - DNA, 20 bp, Artificial Sequence
  chemically synthesized
aggtaactgaaaactttcag

SEQ ID NO: 390898 - DNA, 20 bp, Artificial Sequence
  chemically synthesized
ggaaggtaactgaaaacttt

SEQ ID NO: 390899 - DNA, 20 bp, Artificial Sequence
  chemically synthesized
ttaacaccactgaaagtttt

SEQ ID NO: 390900 - DNA, 20 bp, Artificial Sequence
  chemically synthesized
gaaagttttcagttaccttc

SEQ ID NO: 390901 - DNA, 20 bp, Artificial Sequence
  chemically synthesized
catgttttaaaacaactgga

SEQ ID NO: 390902 - DNA, 20 bp, Artificial Sequence
  chemically synthesized
tcatgttttaaaacaactgg

SEQ ID NO: 390903 - DNA, 20 bp, Artificial Sequence
  chemically synthesized
atttcatgttttaaaacaac

SEQ ID NO: 390904 - DNA, 20 bp, Artificial Sequence
  chemically synthesized
agttgttttaaaacatgaaa

SEQ ID NO: 390905 - DNA, 20 bp, Artificial Sequence
  chemically synthesized
aaacatgaaatagctatttc

SEQ ID NO: 390906 - DNA, 20 bp, Artificial Sequence
  chemically synthesized
ttatttcctttcaccagaaa

SEQ ID NO: 390907 - DNA, 20 bp, Artificial Sequence
  chemically synthesized
gaaatagctatttctggtga

SEQ ID NO: 390908 - DNA, 20 bp, Artificial Sequence
  chemically synthesized
aaatagctatttctggtgaa

SEQ ID NO: 390909 - DNA, 20 bp, Artificial Sequence
  chemically synthesized
tctcctttatttcctttcac

SEQ ID NO: 390910 - DNA, 20 bp, Artificial Sequence
  chemically synthesized
atttctggtgaaaggaaata

SEQ ID NO: 390911 - DNA, 20 bp, Artificial Sequence
  chemically synthesized
tttctggtgaaaggaaataa

SEQ ID NO: 390912 - DNA, 20 bp, Artificial Sequence
  chemically synthesized
tctggtgaaaggaaataaag

SEQ ID NO: 390913 - DNA, 20 bp, Artificial Sequence
  chemically synthesized
ggtgaaaggaaataaaggag

SEQ ID NO: 390914 - DNA, 20 bp, Artificial Sequence
  chemically synthesized
tgaaaggaaataaaggagaa

SEQ ID NO: 390915 - DNA, 20 bp, Artificial Sequence
  chemically synthesized
aggaaataaaggagaagaga

SEQ ID NO: 390916 - DNA, 20 bp, Artificial Sequence
  chemically synthesized
ctcaaaactcaaattgaagt

SEQ ID NO: 390917 - DNA, 20 bp, Artificial Sequence
  chemically synthesized
gatagttctcacttcaattt

SEQ ID NO: 390918 - DNA, 20 bp, Artificial Sequence
  chemically synthesized
tcctctcaaaactcaaattg

SEQ ID NO: 390919 - DNA, 20 bp, Artificial Sequence
  chemically synthesized
ctcacttcaatttgagtttt

SEQ ID NO: 390920 - DNA, 20 bp, Artificial Sequence
  chemically synthesized
cacttcaatttgagttttga

SEQ ID NO: 390921 - DNA, 20 bp, Artificial Sequence
  chemically synthesized
acttcaatttgagttttgag

SEQ ID NO: 390922 - DNA, 20 bp, Artificial Sequence
  chemically synthesized
ttgagaggatcgaattgctt

SEQ ID NO: 390923 - DNA, 20 bp, Artificial Sequence
  chemically synthesized
ggatcgaattgcttcagccc

SEQ ID NO: 390924 - DNA, 20 bp, Artificial Sequence
  chemically synthesized
gatcgaattgcttcagccca

SEQ ID NO: 390925 - DNA, 20 bp, Artificial Sequence
  chemically synthesized
agtattgaccccttgggctg

SEQ ID NO: 390926 - DNA, 20 bp, Artificial Sequence
  chemically synthesized
atcgaattgcttcagcccaa

SEQ ID NO: 390927 - DNA, 20 bp, Artificial Sequence
  chemically synthesized
tcgaattgcttcagcccaag

SEQ ID NO: 390928 - DNA, 20 bp, Artificial Sequence
  chemically synthesized
cctgtcagtattgacccctt

SEQ ID NO: 390929 - DNA, 20 bp, Artificial Sequence
  chemically synthesized
acctgtcagtattgacccct

SEQ ID NO: 390930 - DNA, 20 bp, Artificial Sequence
  chemically synthesized
gcccaaggggtcaatactga

SEQ ID NO: 390931 - DNA, 20 bp, Artificial Sequence
  chemically synthesized
cccaaggggtcaatactgac

SEQ ID NO: 390932 - DNA, 20 bp, Artificial Sequence
  chemically synthesized
agctgctagggatgacctgt

SEQ ID NO: 390933 - DNA, 20 bp, Artificial Sequence
  chemically synthesized
caatactgacaggtcatccc

SEQ ID NO: 390934 - DNA, 20 bp, Artificial Sequence
  chemically synthesized
tactgacaggtcatccctag

SEQ ID NO: 390935 - DNA, 20 bp, Artificial Sequence
  chemically synthesized
gacaggtcatccctagcagc

SEQ ID NO: 390936 - DNA, 20 bp, Artificial Sequence
  chemically synthesized
gacatactctccagctgcta

SEQ ID NO: 390937 - DNA, 20 bp, Artificial Sequence
  chemically synthesized
tgacatactctccagctgct

SEQ ID NO: 390938 - DNA, 20 bp, Artificial Sequence
  chemically synthesized
caggtcatccctagcagctg

SEQ ID NO: 390939 - DNA, 20 bp, Artificial Sequence
  chemically synthesized
ttgacatactctccagctgc

SEQ ID NO: 390940 - DNA, 20 bp, Artificial Sequence
  chemically synthesized
ggtcatccctagcagctgga

SEQ ID NO: 390941 - DNA, 20 bp, Artificial Sequence
  chemically synthesized
tattatcttgacatactctc

SEQ ID NO: 390942 - DNA, 20 bp, Artificial Sequence
  chemically synthesized
tagcagctggagagtatgtc

SEQ ID NO: 390943 - DNA, 20 bp, Artificial Sequence
  chemically synthesized
atgtcaagataatactccaa

SEQ ID NO: 390944 - DNA, 20 bp, Artificial Sequence
  chemically synthesized
aaggataaaaatatcttttg

SEQ ID NO: 390945 - DNA, 20 bp, Artificial Sequence
  chemically synthesized
tgaaggataaaaatatcttt

SEQ ID NO: 390946 - DNA, 20 bp, Artificial Sequence
  chemically synthesized
tttatctttgtagcaaatga

SEQ ID NO: 390947 - DNA, 20 bp, Artificial Sequence
  chemically synthesized
atttatctttgtagcaaatg

SEQ ID NO: 390948 - DNA, 20 bp, Artificial Sequence
  chemically synthesized
tttatccttcatttgctaca

SEQ ID NO: 390949 - DNA, 20 bp, Artificial Sequence
  chemically synthesized
tatgcatttatttatctttg

SEQ ID NO: 390950 - DNA, 20 bp, Artificial Sequence
  chemically synthesized
taaataaatgcatatataca

SEQ ID NO: 390951 - DNA, 20 bp, Artificial Sequence
  chemically synthesized
catatatacaaagtgaacaa

SEQ ID NO: 390952 - DNA, 20 bp, Artificial Sequence
  chemically synthesized
gtgaacaaaagctttgaaaa

SEQ ID NO: 390953 - DNA, 20 bp, Artificial Sequence
  chemically synthesized
ttaacattttactattttca

SEQ ID NO: 390954 - DNA, 20 bp, Artificial Sequence
  chemically synthesized
aaaatagtaaaatgttaaca

SEQ ID NO: 390955 - DNA, 20 bp, Artificial Sequence
  chemically synthesized
aaatagtaaaatgttaacat

SEQ ID NO: 390956 - DNA, 20 bp, Artificial Sequence
  chemically synthesized
agtaaaatgttaacatagga

SEQ ID NO: 390957 - DNA, 20 bp, Artificial Sequence
  chemically synthesized
aatgttaacataggatagta

SEQ ID NO: 390958 - DNA, 20 bp, Artificial Sequence
  chemically synthesized
cacaaacattcattcaataa

SEQ ID NO: 390959 - DNA, 20 bp, Artificial Sequence
  chemically synthesized
ttcaacatatgaattttggg

SEQ ID NO: 390960 - DNA, 20 bp, Artificial Sequence
  chemically synthesized
gatttcaacatatgaatttt

SEQ ID NO: 390961 - DNA, 20 bp, Artificial Sequence
  chemically synthesized
ggatttcaacatatgaattt

SEQ ID NO: 390962 - DNA, 20 bp, Artificial Sequence
  chemically synthesized
atactatcactttgggagtt

SEQ ID NO: 390963 - DNA, 20 bp, Artificial Sequence
  chemically synthesized
tgttgaaatcctaactccca

SEQ ID NO: 390964 - DNA, 20 bp, Artificial Sequence
  chemically synthesized
aatactatcactttgggagt

SEQ ID NO: 390965 - DNA, 20 bp, Artificial Sequence
  chemically synthesized
tcctaatactatcactttgg

SEQ ID NO: 390966 - DNA, 20 bp, Artificial Sequence
  chemically synthesized
aatcctaactcccaaagtga

SEQ ID NO: 390967 - DNA, 20 bp, Artificial Sequence
  chemically synthesized
tctcctaatactatcacttt

SEQ ID NO: 390968 - DNA, 20 bp, Artificial Sequence
  chemically synthesized
atctcctaatactatcactt

SEQ ID NO: 390969 - DNA, 20 bp, Artificial Sequence
  chemically synthesized
aactcccaaagtgatagtat

SEQ ID NO: 390970 - DNA, 20 bp, Artificial Sequence
  chemically synthesized
actcccaaagtgatagtatt

SEQ ID NO: 390971 - DNA, 20 bp, Artificial Sequence
  chemically synthesized
tcccaaagtgatagtattag

SEQ ID NO: 390972 - DNA, 20 bp, Artificial Sequence
  chemically synthesized
aaagtgatagtattaggaga

SEQ ID NO: 390973 - DNA, 20 bp, Artificial Sequence
  chemically synthesized
aagtgatagtattaggagat

SEQ ID NO: 390974 - DNA, 20 bp, Artificial Sequence
  chemically synthesized
atagtattaggagatgggtt

SEQ ID NO: 390975 - DNA, 20 bp, Artificial Sequence
  chemically synthesized
tagtattaggagatgggttt

SEQ ID NO: 390976 - DNA, 20 bp, Artificial Sequence
  chemically synthesized
agtattaggagatgggtttg

SEQ ID NO: 390977 - DNA, 20 bp, Artificial Sequence
  chemically synthesized
gagatgggtttggggctttt

SEQ ID NO: 390978 - DNA, 20 bp, Artificial Sequence
  chemically synthesized
agatgggtttggggcttttt

SEQ ID NO: 390979 - DNA, 20 bp, Artificial Sequence
  chemically synthesized
atgggtttggggctttttgg

SEQ ID NO: 390980 - DNA, 20 bp, Artificial Sequence
  chemically synthesized
tgggtttggggctttttggg

SEQ ID NO: 390981 - DNA, 20 bp, Artificial Sequence
  chemically synthesized
tgacctaatcacctcccaaa

SEQ ID NO: 390982 - DNA, 20 bp, Artificial Sequence
  chemically synthesized
ggggctttttgggaggtgat

SEQ ID NO: 390983 - DNA, 20 bp, Artificial Sequence
  chemically synthesized
gggctttttgggaggtgatt

SEQ ID NO: 390984 - DNA, 20 bp, Artificial Sequence
  chemically synthesized
ttgggaggtgattaggtcac

SEQ ID NO: 390985 - DNA, 20 bp, Artificial Sequence
  chemically synthesized
tgggaggtgattaggtcacg

SEQ ID NO: 390986 - DNA, 20 bp, Artificial Sequence
  chemically synthesized
aggtgattaggtcacgagga

SEQ ID NO: 390987 - DNA, 20 bp, Artificial Sequence
  chemically synthesized
gtgattaggtcacgaggatg

SEQ ID NO: 390988 - DNA, 20 bp, Artificial Sequence
  chemically synthesized
gaggatggagctctcattat

SEQ ID NO: 390989 - DNA, 20 bp, Artificial Sequence
  chemically synthesized
gcaactaattccaataatga

SEQ ID NO: 390990 - DNA, 20 bp, Artificial Sequence
  chemically synthesized
aggcaactaattccaataat

SEQ ID NO: 390991 - DNA, 20 bp, Artificial Sequence
  chemically synthesized
ggagctctcattattggaat

SEQ ID NO: 390992 - DNA, 20 bp, Artificial Sequence
  chemically synthesized
tggaattagttgcctcgtaa

SEQ ID NO: 390993 - DNA, 20 bp, Artificial Sequence
  chemically synthesized
gaattagttgcctcgtaaaa

SEQ ID NO: 390994 - DNA, 20 bp, Artificial Sequence
  chemically synthesized
cctgtaggttctcttttacg

SEQ ID NO: 390995 - DNA, 20 bp, Artificial Sequence
  chemically synthesized
gcctgtaggttctcttttac

SEQ ID NO: 390996 - DNA, 20 bp, Artificial Sequence
  chemically synthesized
gcctcgtaaaagagaaccta

SEQ ID NO: 390997 - DNA, 20 bp, Artificial Sequence
  chemically synthesized
cctcgtaaaagagaacctac

SEQ ID NO: 390998 - DNA, 20 bp, Artificial Sequence
  chemically synthesized
gtaaaagagaacctacaggc

SEQ ID NO: 390999 - DNA, 20 bp, Artificial Sequence
  chemically synthesized
taaaagagaacctacaggcc

SEQ ID NO: 391000 - DNA, 20 bp, Artificial Sequence
  chemically synthesized
agccaccgcgcctggcctgt

SEQ ID NO: 391001 - DNA, 20 bp, Artificial Sequence
  chemically synthesized
gagccaccgcgcctggcctg

SEQ ID NO: 391002 - DNA, 20 bp, Artificial Sequence
  chemically synthesized
gagaacctacaggccaggcg

SEQ ID NO: 391003 - DNA, 20 bp, Artificial Sequence
  chemically synthesized
aacctacaggccaggcgcgg

SEQ ID NO: 391004 - DNA, 20 bp, Artificial Sequence
  chemically synthesized
caggtgtgagccaccgcgcc

SEQ ID NO: 391005 - DNA, 20 bp, Artificial Sequence
  chemically synthesized
agtgctgggattacaggtgt

SEQ ID NO: 391006 - DNA, 20 bp, Artificial Sequence
  chemically synthesized
gtggctcacacctgtaatcc

SEQ ID NO: 391007 - DNA, 20 bp, Artificial Sequence
  chemically synthesized
tcccaaagtgctgggattac

SEQ ID NO: 391008 - DNA, 20 bp, Artificial Sequence
  chemically synthesized
ctcccaaagtgctgggatta

SEQ ID NO: 391009 - DNA, 20 bp, Artificial Sequence
  chemically synthesized
cacctgtaatcccagcactt

SEQ ID NO: 391010 - DNA, 20 bp, Artificial Sequence
  chemically synthesized
ccctggcctcccaaagtgct

SEQ ID NO: 391011 - DNA, 20 bp, Artificial Sequence
  chemically synthesized
acctgtaatcccagcacttt

SEQ ID NO: 391012 - DNA, 20 bp, Artificial Sequence
  chemically synthesized
accctggcctcccaaagtgc

SEQ ID NO: 391013 - DNA, 20 bp, Artificial Sequence
  chemically synthesized
ctgtaatcccagcactttgg

SEQ ID NO: 391014 - DNA, 20 bp, Artificial Sequence
  chemically synthesized
tgtaatcccagcactttggg

SEQ ID NO: 391015 - DNA, 20 bp, Artificial Sequence
  chemically synthesized
ccacccaccctggcctccca

SEQ ID NO: 391016 - DNA, 20 bp, Artificial Sequence
  chemically synthesized
atcccagcactttgggaggc

SEQ ID NO: 391017 - DNA, 20 bp, Artificial Sequence
  chemically synthesized
tcccagcactttgggaggcc

SEQ ID NO: 391018 - DNA, 20 bp, Artificial Sequence
  chemically synthesized
cccagcactttgggaggcca

SEQ ID NO: 391019 - DNA, 20 bp, Artificial Sequence
  chemically synthesized
agcactttgggaggccaggg

SEQ ID NO: 391020 - DNA, 20 bp, Artificial Sequence
  chemically synthesized
gcactttgggaggccagggt

SEQ ID NO: 391021 - DNA, 20 bp, Artificial Sequence
  chemically synthesized
ctttgggaggccagggtggg

SEQ ID NO: 391022 - DNA, 20 bp, Artificial Sequence
  chemically synthesized
acctcgtgatccacccaccc

SEQ ID NO: 391023 - DNA, 20 bp, Artificial Sequence
  chemically synthesized
ggccagggtgggtggatcac

SEQ ID NO: 391024 - DNA, 20 bp, Artificial Sequence
  chemically synthesized
gccagggtgggtggatcacg

SEQ ID NO: 391025 - DNA, 20 bp, Artificial Sequence
  chemically synthesized
gggtgggtggatcacgaggt

SEQ ID NO: 391026 - DNA, 20 bp, Artificial Sequence
  chemically synthesized
ggtgggtggatcacgaggtc

SEQ ID NO: 391027 - DNA, 20 bp, Artificial Sequence
  chemically synthesized
tgggtggatcacgaggtcag

SEQ ID NO: 391028 - DNA, 20 bp, Artificial Sequence
  chemically synthesized
gatcacgaggtcaggagttc

SEQ ID NO: 391029 - DNA, 20 bp, Artificial Sequence
  chemically synthesized
cgaggtcaggagttcaagac

SEQ ID NO: 391030 - DNA, 20 bp, Artificial Sequence
  chemically synthesized
tcaggagttcaagaccagcc

SEQ ID NO: 391031 - DNA, 20 bp, Artificial Sequence
  chemically synthesized
tttcaccattttggccaggc

SEQ ID NO: 391032 - DNA, 20 bp, Artificial Sequence
  chemically synthesized
ggggtttcaccattttggcc

SEQ ID NO: 391033 - DNA, 20 bp, Artificial Sequence
  chemically synthesized
caagaccagcctggccaaaa

SEQ ID NO: 391034 - DNA, 20 bp, Artificial Sequence
  chemically synthesized
tggggtttcaccattttggc

SEQ ID NO: 391035 - DNA, 20 bp, Artificial Sequence
  chemically synthesized
gaggtggggtttcaccattt

SEQ ID NO: 391036 - DNA, 20 bp, Artificial Sequence
  chemically synthesized
ttgtatttttagtagaggtg

SEQ ID NO: 391037 - DNA, 20 bp, Artificial Sequence
  chemically synthesized
tttgtatttttagtagaggt

SEQ ID NO: 391038 - DNA, 20 bp, Artificial Sequence
  chemically synthesized
ttttgtatttttagtagagg

SEQ ID NO: 391039 - DNA, 20 bp, Artificial Sequence
  chemically synthesized
attttttgtatttttagtag

SEQ ID NO: 391040 - DNA, 20 bp, Artificial Sequence
  chemically synthesized
aattttttgtatttttagta

SEQ ID NO: 391041 - DNA, 20 bp, Artificial Sequence
  chemically synthesized
ctaattttttgtatttttag

SEQ ID NO: 391042 - DNA, 20 bp, Artificial Sequence
  chemically synthesized
tggctaattttttgtatttt

SEQ ID NO: 391043 - DNA, 20 bp, Artificial Sequence
  chemically synthesized
ctactaaaaatacaaaaaat

SEQ ID NO: 391044 - DNA, 20 bp, Artificial Sequence
  chemically synthesized
taaaaatacaaaaaattagc

SEQ ID NO: 391045 - DNA, 20 bp, Artificial Sequence
  chemically synthesized
aaaaatacaaaaaattagcc

SEQ ID NO: 391046 - DNA, 20 bp, Artificial Sequence
  chemically synthesized
tacaaaaaattagccaggcg

SEQ ID NO: 391047 - DNA, 20 bp, Artificial Sequence
  chemically synthesized
aaaaaattagccaggcgtgg

SEQ ID NO: 391048 - DNA, 20 bp, Artificial Sequence
  chemically synthesized
taggcacccaccaccacgcc

SEQ ID NO: 391049 - DNA, 20 bp, Artificial Sequence
  chemically synthesized
aaattagccaggcgtggtgg

SEQ ID NO: 391050 - DNA, 20 bp, Artificial Sequence
  chemically synthesized
aattagccaggcgtggtggt

SEQ ID NO: 391051 - DNA, 20 bp, Artificial Sequence
  chemically synthesized
gtggtgggtgcctataatcc

SEQ ID NO: 391052 - DNA, 20 bp, Artificial Sequence
  chemically synthesized
tcccaagtagctgggattat

SEQ ID NO: 391053 - DNA, 20 bp, Artificial Sequence
  chemically synthesized
ctcccaagtagctgggatta

SEQ ID NO: 391054 - DNA, 20 bp, Artificial Sequence
  chemically synthesized
tgcctataatcccagctact

SEQ ID NO: 391055 - DNA, 20 bp, Artificial Sequence
  chemically synthesized
cctcagcctcccaagtagct

SEQ ID NO: 391056 - DNA, 20 bp, Artificial Sequence
  chemically synthesized
gcctataatcccagctactt

SEQ ID NO: 391057 - DNA, 20 bp, Artificial Sequence
  chemically synthesized
gcctcagcctcccaagtagc

SEQ ID NO: 391058 - DNA, 20 bp, Artificial Sequence
  chemically synthesized
ctataatcccagctacttgg

SEQ ID NO: 391059 - DNA, 20 bp, Artificial Sequence
  chemically synthesized
tataatcccagctacttggg

SEQ ID NO: 391060 - DNA, 20 bp, Artificial Sequence
  chemically synthesized
ctctgcctcagcctcccaag

SEQ ID NO: 391061 - DNA, 20 bp, Artificial Sequence
  chemically synthesized
attctctgcctcagcctccc

SEQ ID NO: 391062 - DNA, 20 bp, Artificial Sequence
  chemically synthesized
tcccagctacttgggaggct

SEQ ID NO: 391063 - DNA, 20 bp, Artificial Sequence
  chemically synthesized
cccagctacttgggaggctg

SEQ ID NO: 391064 - DNA, 20 bp, Artificial Sequence
  chemically synthesized
agctacttgggaggctgagg

SEQ ID NO: 391065 - DNA, 20 bp, Artificial Sequence
  chemically synthesized
ctacttgggaggctgaggca

SEQ ID NO: 391066 - DNA, 20 bp, Artificial Sequence
  chemically synthesized
tttcaagcaattctctgcct

SEQ ID NO: 391067 - DNA, 20 bp, Artificial Sequence
  chemically synthesized
gcagagaattgcttgaaacc

SEQ ID NO: 391068 - DNA, 20 bp, Artificial Sequence
  chemically synthesized
aacctctgcctccgggtttc

SEQ ID NO: 391069 - DNA, 20 bp, Artificial Sequence
  chemically synthesized
agagaattgcttgaaacccg

SEQ ID NO: 391070 - DNA, 20 bp, Artificial Sequence
  chemically synthesized
gagaattgcttgaaacccgg

SEQ ID NO: 391071 - DNA, 20 bp, Artificial Sequence
  chemically synthesized
aattgcttgaaacccggagg

SEQ ID NO: 391072 - DNA, 20 bp, Artificial Sequence
  chemically synthesized
ttgcttgaaacccggaggca

SEQ ID NO: 391073 - DNA, 20 bp, Artificial Sequence
  chemically synthesized
tcactgcaacctctgcctcc

SEQ ID NO: 391074 - DNA, 20 bp, Artificial Sequence
  chemically synthesized
tgcttgaaacccggaggcag

SEQ ID NO: 391075 - DNA, 20 bp, Artificial Sequence
  chemically synthesized
ctcactgcaacctctgcctc

SEQ ID NO: 391076 - DNA, 20 bp, Artificial Sequence
  chemically synthesized
aaacccggaggcagaggttg

SEQ ID NO: 391077 - DNA, 20 bp, Artificial Sequence
  chemically synthesized
ccggaggcagaggttgcagt

SEQ ID NO: 391078 - DNA, 20 bp, Artificial Sequence
  chemically synthesized
ggcagaggttgcagtgagcc

SEQ ID NO: 391079 - DNA, 20 bp, Artificial Sequence
  chemically synthesized
ggagggcagtggcacgatct

SEQ ID NO: 391080 - DNA, 20 bp, Artificial Sequence
  chemically synthesized
tctcccaggctggagggcag

SEQ ID NO: 391081 - DNA, 20 bp, Artificial Sequence
  chemically synthesized
aagatcgtgccactgccctc

SEQ ID NO: 391082 - DNA, 20 bp, Artificial Sequence
  chemically synthesized
ctgtctcccaggctggaggg

SEQ ID NO: 391083 - DNA, 20 bp, Artificial Sequence
  chemically synthesized
cgtgccactgccctccagcc

SEQ ID NO: 391084 - DNA, 20 bp, Artificial Sequence
  chemically synthesized
attctgtctcccaggctgga

SEQ ID NO: 391085 - DNA, 20 bp, Artificial Sequence
  chemically synthesized
gtgccactgccctccagcct

SEQ ID NO: 391086 - DNA, 20 bp, Artificial Sequence
  chemically synthesized
cattctgtctcccaggctgg

SEQ ID NO: 391087 - DNA, 20 bp, Artificial Sequence
  chemically synthesized
tcattctgtctcccaggctg

SEQ ID NO: 391088 - DNA, 20 bp, Artificial Sequence
  chemically synthesized
gccactgccctccagcctgg

SEQ ID NO: 391089 - DNA, 20 bp, Artificial Sequence
  chemically synthesized
tctcattctgtctcccaggc

SEQ ID NO: 391090 - DNA, 20 bp, Artificial Sequence
  chemically synthesized
ctgccctccagcctgggaga

SEQ ID NO: 391091 - DNA, 20 bp, Artificial Sequence
  chemically synthesized
agaatctcattctgtctccc

SEQ ID NO: 391092 - DNA, 20 bp, Artificial Sequence
  chemically synthesized
cagaatctcattctgtctcc

SEQ ID NO: 391093 - DNA, 20 bp, Artificial Sequence
  chemically synthesized
tccagcctgggagacagaat

SEQ ID NO: 391094 - DNA, 20 bp, Artificial Sequence
  chemically synthesized
ttttttttttttttttgaga

SEQ ID NO: 391095 - DNA, 20 bp, Artificial Sequence
  chemically synthesized
tttttttttttttttttttt

SEQ ID NO: 391096 - DNA, 20 bp, Artificial Sequence
  chemically synthesized
aaaaaaaaaaaaaaaaaaaa

SEQ ID NO: 391097 - DNA, 20 bp, Artificial Sequence
  chemically synthesized
aaaaaaaaaaaaaaagaacc

SEQ ID NO: 391098 - DNA, 20 bp, Artificial Sequence
  chemically synthesized
gaggggaaagggagcgttct

SEQ ID NO: 391099 - DNA, 20 bp, Artificial Sequence
  chemically synthesized
ggaggggaaagggagcgttc

SEQ ID NO: 391100 - DNA, 20 bp, Artificial Sequence
  chemically synthesized
cacatggtggaggggaaagg

SEQ ID NO: 391101 - DNA, 20 bp, Artificial Sequence
  chemically synthesized
ctcacatggtggaggggaaa

SEQ ID NO: 391102 - DNA, 20 bp, Artificial Sequence
  chemically synthesized
cctcacatggtggaggggaa

SEQ ID NO: 391103 - DNA, 20 bp, Artificial Sequence
  chemically synthesized
tcctcacatggtggagggga

SEQ ID NO: 391104 - DNA, 20 bp, Artificial Sequence
  chemically synthesized
tgattcctcacatggtggag

SEQ ID NO: 391105 - DNA, 20 bp, Artificial Sequence
  chemically synthesized
atgattcctcacatggtgga

SEQ ID NO: 391106 - DNA, 20 bp, Artificial Sequence
  chemically synthesized
gatgattcctcacatggtgg

SEQ ID NO: 391107 - DNA, 20 bp, Artificial Sequence
  chemically synthesized
tgatgattcctcacatggtg

SEQ ID NO: 391108 - DNA, 20 bp, Artificial Sequence
  chemically synthesized
ccctttcccctccaccatgt

SEQ ID NO: 391109 - DNA, 20 bp, Artificial Sequence
  chemically synthesized
cctttcccctccaccatgtg

SEQ ID NO: 391110 - DNA, 20 bp, Artificial Sequence
  chemically synthesized
gttgatgattcctcacatgg

SEQ ID NO: 391111 - DNA, 20 bp, Artificial Sequence
  chemically synthesized
cttgttgatgattcctcaca

SEQ ID NO: 391112 - DNA, 20 bp, Artificial Sequence
  chemically synthesized
ccatgtgaggaatcatcaac

SEQ ID NO: 391113 - DNA, 20 bp, Artificial Sequence
  chemically synthesized
tcaacaagatgaacgtcact

SEQ ID NO: 391114 - DNA, 20 bp, Artificial Sequence
  chemically synthesized
caacaagatgaacgtcactg

SEQ ID NO: 391115 - DNA, 20 bp, Artificial Sequence
  chemically synthesized
caagatgaacgtcactgagg

SEQ ID NO: 391116 - DNA, 20 bp, Artificial Sequence
  chemically synthesized
gatgaacgtcactgaggaag

SEQ ID NO: 391117 - DNA, 20 bp, Artificial Sequence
  chemically synthesized
atgaacgtcactgaggaagc

SEQ ID NO: 391118 - DNA, 20 bp, Artificial Sequence
  chemically synthesized
gtcttgtgagcccgcttcct

SEQ ID NO: 391119 - DNA, 20 bp, Artificial Sequence
  chemically synthesized
cactgaggaagcgggctcac

SEQ ID NO: 391120 - DNA, 20 bp, Artificial Sequence
  chemically synthesized
cagcatgttaggtgtcttgt

SEQ ID NO: 391121 - DNA, 20 bp, Artificial Sequence
  chemically synthesized
tcacaagacacctaacatgc

SEQ ID NO: 391122 - DNA, 20 bp, Artificial Sequence
  chemically synthesized
ccaaaagtcaccagcatgtt

SEQ ID NO: 391123 - DNA, 20 bp, Artificial Sequence
  chemically synthesized
tccaaaagtcaccagcatgt

SEQ ID NO: 391124 - DNA, 20 bp, Artificial Sequence
  chemically synthesized
ctggtgagtccaaaagtcac

SEQ ID NO: 391125 - DNA, 20 bp, Artificial Sequence
  chemically synthesized
cctaacatgctggtgacttt

SEQ ID NO: 391126 - DNA, 20 bp, Artificial Sequence
  chemically synthesized
ctagaggctggtgagtccaa

SEQ ID NO: 391127 - DNA, 20 bp, Artificial Sequence
  chemically synthesized
ctggtgacttttggactcac

SEQ ID NO: 391128 - DNA, 20 bp, Artificial Sequence
  chemically synthesized
tcctagttctagaggctggt

SEQ ID NO: 391129 - DNA, 20 bp, Artificial Sequence
  chemically synthesized
cttttggactcaccagcctc

SEQ ID NO: 391130 - DNA, 20 bp, Artificial Sequence
  chemically synthesized
ttgctcctagttctagaggc

SEQ ID NO: 391131 - DNA, 20 bp, Artificial Sequence
  chemically synthesized
gactcaccagcctctagaac

SEQ ID NO: 391132 - DNA, 20 bp, Artificial Sequence
  chemically synthesized
tgtgttgctcctagttctag

SEQ ID NO: 391133 - DNA, 20 bp, Artificial Sequence
  chemically synthesized
actcaccagcctctagaact

SEQ ID NO: 391134 - DNA, 20 bp, Artificial Sequence
  chemically synthesized
atgtgttgctcctagttcta

SEQ ID NO: 391135 - DNA, 20 bp, Artificial Sequence
  chemically synthesized
tcaccagcctctagaactag

SEQ ID NO: 391136 - DNA, 20 bp, Artificial Sequence
  chemically synthesized
aaatgtgttgctcctagttc

SEQ ID NO: 391137 - DNA, 20 bp, Artificial Sequence
  chemically synthesized
gagcagaaatgtgttgctcc

SEQ ID NO: 391138 - DNA, 20 bp, Artificial Sequence
  chemically synthesized
tctgggtggtttataaagag

SEQ ID NO: 391139 - DNA, 20 bp, Artificial Sequence
  chemically synthesized
atttctgggtggtttataaa

SEQ ID NO: 391140 - DNA, 20 bp, Artificial Sequence
  chemically synthesized
atatttctgggtggtttata

SEQ ID NO: 391141 - DNA, 20 bp, Artificial Sequence
  chemically synthesized
tctgctctttataaaccacc

SEQ ID NO: 391142 - DNA, 20 bp, Artificial Sequence
  chemically synthesized
atagatattatatttctggg

SEQ ID NO: 391143 - DNA, 20 bp, Artificial Sequence
  chemically synthesized
catatagatattatatttct

SEQ ID NO: 391144 - DNA, 20 bp, Artificial Sequence
  chemically synthesized
acatatagatattatatttc

SEQ ID NO: 391145 - DNA, 20 bp, Artificial Sequence
  chemically synthesized
gggtggtggctatatacata

SEQ ID NO: 391146 - DNA, 20 bp, Artificial Sequence
  chemically synthesized
atataatatctatatgtata

SEQ ID NO: 391147 - DNA, 20 bp, Artificial Sequence
  chemically synthesized
gtgtgtacatatatgggtgg

SEQ ID NO: 391148 - DNA, 20 bp, Artificial Sequence
  chemically synthesized
tgtgtgtgtacatatatggg

SEQ ID NO: 391149 - DNA, 20 bp, Artificial Sequence
  chemically synthesized
ctgtgtgtgtgtacatatat

SEQ ID NO: 391150 - DNA, 20 bp, Artificial Sequence
  chemically synthesized
actgtgtgtgtgtacatata

SEQ ID NO: 391151 - DNA, 20 bp, Artificial Sequence
  chemically synthesized
cccatatatgtacacacaca

SEQ ID NO: 391152 - DNA, 20 bp, Artificial Sequence
  chemically synthesized
acacagtttatcaatttttg

SEQ ID NO: 391153 - DNA, 20 bp, Artificial Sequence
  chemically synthesized
atgtatgtggtagcacgtga

SEQ ID NO: 391154 - DNA, 20 bp, Artificial Sequence
  chemically synthesized
ctatgtatgtggtagcacgt

SEQ ID NO: 391155 - DNA, 20 bp, Artificial Sequence
  chemically synthesized
tattttatctatgtatgtgg

SEQ ID NO: 391156 - DNA, 20 bp, Artificial Sequence
  chemically synthesized
ctcacgtgctaccacataca

SEQ ID NO: 391157 - DNA, 20 bp, Artificial Sequence
  chemically synthesized
acatattttatctatgtatg

SEQ ID NO: 391158 - DNA, 20 bp, Artificial Sequence
  chemically synthesized
acatgtatgtaccacataca

SEQ ID NO: 391159 - DNA, 20 bp, Artificial Sequence
  chemically synthesized
gcatattttatctatgtatg

SEQ ID NO: 391160 - DNA, 20 bp, Artificial Sequence
  chemically synthesized
tattttatctatgtatgtgg

SEQ ID NO: 391161 - DNA, 20 bp, Artificial Sequence
  chemically synthesized
aaaatatgctaccacataca

SEQ ID NO: 391162 - DNA, 20 bp, Artificial Sequence
  chemically synthesized
aagtattttatctatgtatg

SEQ ID NO: 391163 - DNA, 20 bp, Artificial Sequence
  chemically synthesized
acatagataaaatacttgcc

SEQ ID NO: 391164 - DNA, 20 bp, Artificial Sequence
  chemically synthesized
ttttatctatgtatctgggc

SEQ ID NO: 391165 - DNA, 20 bp, Artificial Sequence
  chemically synthesized
aaaatacttgcccagataca

SEQ ID NO: 391166 - DNA, 20 bp, Artificial Sequence
  chemically synthesized
gaatttttatctatgtatct

SEQ ID NO: 391167 - DNA, 20 bp, Artificial Sequence
  chemically synthesized
tgaatttttatctatgtatc

SEQ ID NO: 391168 - DNA, 20 bp, Artificial Sequence
  chemically synthesized
agatacatagataaaaattc

SEQ ID NO: 391169 - DNA, 20 bp, Artificial Sequence
  chemically synthesized
taaaaattcaagtaccatca

SEQ ID NO: 391170 - DNA, 20 bp, Artificial Sequence
  chemically synthesized
aggaagaaggtagactttga

SEQ ID NO: 391171 - DNA, 20 bp, Artificial Sequence
  chemically synthesized
ctttatagataggaagaagg

SEQ ID NO: 391172 - DNA, 20 bp, Artificial Sequence
  chemically synthesized
tagctttatagataggaaga

SEQ ID NO: 391173 - DNA, 20 bp, Artificial Sequence
  chemically synthesized
atagctttatagataggaag

SEQ ID NO: 391174 - DNA, 20 bp, Artificial Sequence
  chemically synthesized
tttatagctttatagatagg

SEQ ID NO: 391175 - DNA, 20 bp, Artificial Sequence
  chemically synthesized
ctaccttcttcctatctata

SEQ ID NO: 391176 - DNA, 20 bp, Artificial Sequence
  chemically synthesized
cattttatagctttatagat

SEQ ID NO: 391177 - DNA, 20 bp, Artificial Sequence
  chemically synthesized
tcattttatagctttataga

SEQ ID NO: 391178 - DNA, 20 bp, Artificial Sequence
  chemically synthesized
ccactcattttatagcttta

SEQ ID NO: 391179 - DNA, 20 bp, Artificial Sequence
  chemically synthesized
tatctataaagctataaaat

SEQ ID NO: 391180 - DNA, 20 bp, Artificial Sequence
  chemically synthesized
gtctcataccactcatttta

SEQ ID NO: 391181 - DNA, 20 bp, Artificial Sequence
  chemically synthesized
ctataaagctataaaatgag

SEQ ID NO: 391182 - DNA, 20 bp, Artificial Sequence
  chemically synthesized
agctataaaatgagtggtat

SEQ ID NO: 391183 - DNA, 20 bp, Artificial Sequence
  chemically synthesized
atgagtggtatgagactaaa

SEQ ID NO: 391184 - DNA, 20 bp, Artificial Sequence
  chemically synthesized
aagcacagaacatttctgtt

SEQ ID NO: 391185 - DNA, 20 bp, Artificial Sequence
  chemically synthesized
cagaaatgttctgtgctttt

SEQ ID NO: 391186 - DNA, 20 bp, Artificial Sequence
  chemically synthesized
tgcgtttgtgccaaaaagca

SEQ ID NO: 391187 - DNA, 20 bp, Artificial Sequence
  chemically synthesized
aaatatgcgtttgtgccaaa

SEQ ID NO: 391188 - DNA, 20 bp, Artificial Sequence
  chemically synthesized
atttattatgtatgtattta

SEQ ID NO: 391189 - DNA, 20 bp, Artificial Sequence
  chemically synthesized
ttatagtgttttcatacaaa

SEQ ID NO: 391190 - DNA, 20 bp, Artificial Sequence
  chemically synthesized
ttgacatatatataataaac

SEQ ID NO: 391191 - DNA, 20 bp, Artificial Sequence
  chemically synthesized
acatatgtgcatatgtgttc

SEQ ID NO: 391192 - DNA, 20 bp, Artificial Sequence
  chemically synthesized
tagtattaattgcacaaaag

SEQ ID NO: 391193 - DNA, 20 bp, Artificial Sequence
  chemically synthesized
atgtagtattaattgcacaa

SEQ ID NO: 391194 - DNA, 20 bp, Artificial Sequence
  chemically synthesized
gttgaaatgtgatcgttatg

SEQ ID NO: 391195 - DNA, 20 bp, Artificial Sequence
  chemically synthesized
aagagatgaatttatataaa

SEQ ID NO: 391196 - DNA, 20 bp, Artificial Sequence
  chemically synthesized
tatactacagttttaaacaa

SEQ ID NO: 391197 - DNA, 20 bp, Artificial Sequence
  chemically synthesized
tttatactacagttttaaac

SEQ ID NO: 391198 - DNA, 20 bp, Artificial Sequence
  chemically synthesized
tcatctcttgtttaaaactg

SEQ ID NO: 391199 - DNA, 20 bp, Artificial Sequence
  chemically synthesized
ttgtttaaaactgtagtata

SEQ ID NO: 391200 - DNA, 20 bp, Artificial Sequence
  chemically synthesized
tgcctgtgccctttatacta

SEQ ID NO: 391201 - DNA, 20 bp, Artificial Sequence
  chemically synthesized
tgtttaaaactgtagtataa

SEQ ID NO: 391202 - DNA, 20 bp, Artificial Sequence
  chemically synthesized
gtttaaaactgtagtataaa

SEQ ID NO: 391203 - DNA, 20 bp, Artificial Sequence
  chemically synthesized
aaactgtagtataaagggca

SEQ ID NO: 391204 - DNA, 20 bp, Artificial Sequence
  chemically synthesized
aactgtagtataaagggcac

SEQ ID NO: 391205 - DNA, 20 bp, Artificial Sequence
  chemically synthesized
tagtataaagggcacaggca

SEQ ID NO: 391206 - DNA, 20 bp, Artificial Sequence
  chemically synthesized
cacaggcatggactaccacc

SEQ ID NO: 391207 - DNA, 20 bp, Artificial Sequence
  chemically synthesized
aaatggacatagcttggtgg

SEQ ID NO: 391208 - DNA, 20 bp, Artificial Sequence
  chemically synthesized
tctaaatggacatagcttgg

SEQ ID NO: 391209 - DNA, 20 bp, Artificial Sequence
  chemically synthesized
taatctaaatggacatagct

SEQ ID NO: 391210 - DNA, 20 bp, Artificial Sequence
  chemically synthesized
ataggtaatctaaatggaca

SEQ ID NO: 391211 - DNA, 20 bp, Artificial Sequence
  chemically synthesized
accaccaagctatgtccatt

SEQ ID NO: 391212 - DNA, 20 bp, Artificial Sequence
  chemically synthesized
agtaaaataggtaatctaaa

SEQ ID NO: 391213 - DNA, 20 bp, Artificial Sequence
  chemically synthesized
tagctaggtaatagtaaaat

SEQ ID NO: 391214 - DNA, 20 bp, Artificial Sequence
  chemically synthesized
gtagctaggtaatagtaaaa

SEQ ID NO: 391215 - DNA, 20 bp, Artificial Sequence
  chemically synthesized
ttacctattttactattacc

SEQ ID NO: 391216 - DNA, 20 bp, Artificial Sequence
  chemically synthesized
ttttctttgtagctaggtaa

SEQ ID NO: 391217 - DNA, 20 bp, Artificial Sequence
  chemically synthesized
tttactattacctagctaca

SEQ ID NO: 391218 - DNA, 20 bp, Artificial Sequence
  chemically synthesized
catgggttttctttgtagct

SEQ ID NO: 391219 - DNA, 20 bp, Artificial Sequence
  chemically synthesized
acatgggttttctttgtagc

SEQ ID NO: 391220 - DNA, 20 bp, Artificial Sequence
  chemically synthesized
atggacatgggttttctttg

SEQ ID NO: 391221 - DNA, 20 bp, Artificial Sequence
  chemically synthesized
gtaagggtttagatggacat

SEQ ID NO: 391222 - DNA, 20 bp, Artificial Sequence
  chemically synthesized
agtaagggtttagatggaca

SEQ ID NO: 391223 - DNA, 20 bp, Artificial Sequence
  chemically synthesized
cacatgagtaagggtttaga

SEQ ID NO: 391224 - DNA, 20 bp, Artificial Sequence
  chemically synthesized
ttttcacatgagtaagggtt

SEQ ID NO: 391225 - DNA, 20 bp, Artificial Sequence
  chemically synthesized
ttatgttttcacatgagtaa

SEQ ID NO: 391226 - DNA, 20 bp, Artificial Sequence
  chemically synthesized
tttatgttttcacatgagta

SEQ ID NO: 391227 - DNA, 20 bp, Artificial Sequence
  chemically synthesized
atttatgttttcacatgagt

SEQ ID NO: 391228 - DNA, 20 bp, Artificial Sequence
  chemically synthesized
cttcatttatgttttcacat

SEQ ID NO: 391229 - DNA, 20 bp, Artificial Sequence
  chemically synthesized
ctcatgtgaaaacataaatg

SEQ ID NO: 391230 - DNA, 20 bp, Artificial Sequence
  chemically synthesized
tcatgtgaaaacataaatga

SEQ ID NO: 391231 - DNA, 20 bp, Artificial Sequence
  chemically synthesized
catgtgaaaacataaatgaa

SEQ ID NO: 391232 - DNA, 20 bp, Artificial Sequence
  chemically synthesized
aatgaagggcaaactccttg

SEQ ID NO: 391233 - DNA, 20 bp, Artificial Sequence
  chemically synthesized
gaagggcaaactccttgaag

SEQ ID NO: 391234 - DNA, 20 bp, Artificial Sequence
  chemically synthesized
catagcaattctacttcaag

SEQ ID NO: 391235 - DNA, 20 bp, Artificial Sequence
  chemically synthesized
tacatagcaattctacttca

SEQ ID NO: 391236 - DNA, 20 bp, Artificial Sequence
  chemically synthesized
ttacatagcaattctacttc

SEQ ID NO: 391237 - DNA, 20 bp, Artificial Sequence
  chemically synthesized
agtataattacatatttaca

SEQ ID NO: 391238 - DNA, 20 bp, Artificial Sequence
  chemically synthesized
gcattatctttcaaaattaa

SEQ ID NO: 391239 - DNA, 20 bp, Artificial Sequence
  chemically synthesized
aattatacttttaattttga

SEQ ID NO: 391240 - DNA, 20 bp, Artificial Sequence
  chemically synthesized
ccagactcttgagattaatt

SEQ ID NO: 391241 - DNA, 20 bp, Artificial Sequence
  chemically synthesized
gataatgccaaattaatctc

SEQ ID NO: 391242 - DNA, 20 bp, Artificial Sequence
  chemically synthesized
taatgccaaattaatctcaa

SEQ ID NO: 391243 - DNA, 20 bp, Artificial Sequence
  chemically synthesized
ccaaattaatctcaagagtc

SEQ ID NO: 391244 - DNA, 20 bp, Artificial Sequence
  chemically synthesized
taacacaagcccagactctt

SEQ ID NO: 391245 - DNA, 20 bp, Artificial Sequence
  chemically synthesized
caaattaatctcaagagtct

SEQ ID NO: 391246 - DNA, 20 bp, Artificial Sequence
  chemically synthesized
actatggagtaacacaagcc

SEQ ID NO: 391247 - DNA, 20 bp, Artificial Sequence
  chemically synthesized
cattgactatggagtaacac

SEQ ID NO: 391248 - DNA, 20 bp, Artificial Sequence
  chemically synthesized
tctgggcttgtgttactcca

SEQ ID NO: 391249 - DNA, 20 bp, Artificial Sequence
  chemically synthesized
catcgccatcattgactatg

SEQ ID NO: 391250 - DNA, 20 bp, Artificial Sequence
  chemically synthesized
accatcgccatcattgacta

SEQ ID NO: 391251 - DNA, 20 bp, Artificial Sequence
  chemically synthesized
tgttactccatagtcaatga

SEQ ID NO: 391252 - DNA, 20 bp, Artificial Sequence
  chemically synthesized
tccatagtcaatgatggcga

SEQ ID NO: 391253 - DNA, 20 bp, Artificial Sequence
  chemically synthesized
cattttggaggcaagagttg

SEQ ID NO: 391254 - DNA, 20 bp, Artificial Sequence
  chemically synthesized
gcattttggaggcaagagtt

SEQ ID NO: 391255 - DNA, 20 bp, Artificial Sequence
  chemically synthesized
tgaatgcattttggaggcaa

SEQ ID NO: 391256 - DNA, 20 bp, Artificial Sequence
  chemically synthesized
aatgaatgcattttggaggc

SEQ ID NO: 391257 - DNA, 20 bp, Artificial Sequence
  chemically synthesized
caagaatgaatgcattttgg

SEQ ID NO: 391258 - DNA, 20 bp, Artificial Sequence
  chemically synthesized
tcaagaatgaatgcattttg

SEQ ID NO: 391259 - DNA, 20 bp, Artificial Sequence
  chemically synthesized
attcaagaatgaatgcattt

SEQ ID NO: 391260 - DNA, 20 bp, Artificial Sequence
  chemically synthesized
tcatctgatcaaagttattc

SEQ ID NO: 391261 - DNA, 20 bp, Artificial Sequence
  chemically synthesized
cattcttgaataactttgat

SEQ ID NO: 391262 - DNA, 20 bp, Artificial Sequence
  chemically synthesized
ataagtgtctcatctgatca

SEQ ID NO: 391263 - DNA, 20 bp, Artificial Sequence
  chemically synthesized
ttgaataactttgatcagat

SEQ ID NO: 391264 - DNA, 20 bp, Artificial Sequence
  chemically synthesized
agaatgagcattgagatcat

SEQ ID NO: 391265 - DNA, 20 bp, Artificial Sequence
  chemically synthesized
gtagtaggagaatgagcatt

SEQ ID NO: 391266 - DNA, 20 bp, Artificial Sequence
  chemically synthesized
ccaaagagtagtaggagaat

SEQ ID NO: 391267 - DNA, 20 bp, Artificial Sequence
  chemically synthesized
ggttatccaaagagtagtag

SEQ ID NO: 391268 - DNA, 20 bp, Artificial Sequence
  chemically synthesized
aaggttatccaaagagtagt

SEQ ID NO: 391269 - DNA, 20 bp, Artificial Sequence
  chemically synthesized
caaggttatccaaagagtag

SEQ ID NO: 391270 - DNA, 20 bp, Artificial Sequence
  chemically synthesized
ctcattctcctactactctt

SEQ ID NO: 391271 - DNA, 20 bp, Artificial Sequence
  chemically synthesized
aaacaaggttatccaaagag

SEQ ID NO: 391272 - DNA, 20 bp, Artificial Sequence
  chemically synthesized
gtcaaacaaggttatccaaa

SEQ ID NO: 391273 - DNA, 20 bp, Artificial Sequence
  chemically synthesized
atgtcaaacaaggttatcca

SEQ ID NO: 391274 - DNA, 20 bp, Artificial Sequence
  chemically synthesized
gtaaaaaaaaatgtcaaaca

SEQ ID NO: 391275 - DNA, 20 bp, Artificial Sequence
  chemically synthesized
tgtaaaaaaaaatgtcaaac

SEQ ID NO: 391276 - DNA, 20 bp, Artificial Sequence
  chemically synthesized
ttgtttgacattttttttta

SEQ ID NO: 391277 - DNA, 20 bp, Artificial Sequence
  chemically synthesized
atttttttttacagtgtgta

SEQ ID NO: 391278 - DNA, 20 bp, Artificial Sequence
  chemically synthesized
tttttacagtgtgtaaagca

SEQ ID NO: 391279 - DNA, 20 bp, Artificial Sequence
  chemically synthesized
tttacagtgtgtaaagcaaa

SEQ ID NO: 391280 - DNA, 20 bp, Artificial Sequence
  chemically synthesized
gcatatttgtaaagagtttg

SEQ ID NO: 391281 - DNA, 20 bp, Artificial Sequence
  chemically synthesized
aagcatatttgtaaagagtt

SEQ ID NO: 391282 - DNA, 20 bp, Artificial Sequence
  chemically synthesized
tagcaaagcatatttgtaaa

SEQ ID NO: 391283 - DNA, 20 bp, Artificial Sequence
  chemically synthesized
tttagcaaagcatatttgta

SEQ ID NO: 391284 - DNA, 20 bp, Artificial Sequence
  chemically synthesized
tttacaaatatgctttgcta

SEQ ID NO: 391285 - DNA, 20 bp, Artificial Sequence
  chemically synthesized
ataggtcttattctttagca

SEQ ID NO: 391286 - DNA, 20 bp, Artificial Sequence
  chemically synthesized
aatatgctttgctaaagaat

SEQ ID NO: 391287 - DNA, 20 bp, Artificial Sequence
  chemically synthesized
atcaaataggtcttattctt

SEQ ID NO: 391288 - DNA, 20 bp, Artificial Sequence
  chemically synthesized
aaagaataagacctatttga

SEQ ID NO: 391289 - DNA, 20 bp, Artificial Sequence
  chemically synthesized
accctgttgtgctatcaaat

SEQ ID NO: 391290 - DNA, 20 bp, Artificial Sequence
  chemically synthesized
taccctgttgtgctatcaaa

SEQ ID NO: 391291 - DNA, 20 bp, Artificial Sequence
  chemically synthesized
agacctatttgatagcacaa

SEQ ID NO: 391292 - DNA, 20 bp, Artificial Sequence
  chemically synthesized
gacctatttgatagcacaac

SEQ ID NO: 391293 - DNA, 20 bp, Artificial Sequence
  chemically synthesized
acctatttgatagcacaaca

SEQ ID NO: 391294 - DNA, 20 bp, Artificial Sequence
  chemically synthesized
atttgatagcacaacagggt

SEQ ID NO: 391295 - DNA, 20 bp, Artificial Sequence
  chemically synthesized
atagcacaacagggtaagta

SEQ ID NO: 391296 - DNA, 20 bp, Artificial Sequence
  chemically synthesized
ttatttttaaatttacaatt

SEQ ID NO: 391297 - DNA, 20 bp, Artificial Sequence
  chemically synthesized
gtaaatttaaaaataactaa

SEQ ID NO: 391298 - DNA, 20 bp, Artificial Sequence
  chemically synthesized
aaatttaaaaataactaaaa

SEQ ID NO: 391299 - DNA, 20 bp, Artificial Sequence
  chemically synthesized
gcaatccaattacactcttt

SEQ ID NO: 391300 - DNA, 20 bp, Artificial Sequence
  chemically synthesized
aataactaaaagagtgtaat

SEQ ID NO: 391301 - DNA, 20 bp, Artificial Sequence
  chemically synthesized
gcatttatccttcatgttac

SEQ ID NO: 391302 - DNA, 20 bp, Artificial Sequence
  chemically synthesized
attggattgcttgtaacatg

SEQ ID NO: 391303 - DNA, 20 bp, Artificial Sequence
  chemically synthesized
ttggattgcttgtaacatga

SEQ ID NO: 391304 - DNA, 20 bp, Artificial Sequence
  chemically synthesized
aacatgaaggataaatgctt

SEQ ID NO: 391305 - DNA, 20 bp, Artificial Sequence
  chemically synthesized
acatgaaggataaatgcttg

SEQ ID NO: 391306 - DNA, 20 bp, Artificial Sequence
  chemically synthesized
catgaaggataaatgcttga

SEQ ID NO: 391307 - DNA, 20 bp, Artificial Sequence
  chemically synthesized
atgaaggataaatgcttgag

SEQ ID NO: 391308 - DNA, 20 bp, Artificial Sequence
  chemically synthesized
gaatgggatatacacccctc

SEQ ID NO: 391309 - DNA, 20 bp, Artificial Sequence
  chemically synthesized
ataatcacatcatggagaat

SEQ ID NO: 391310 - DNA, 20 bp, Artificial Sequence
  chemically synthesized
aataatcacatcatggagaa

SEQ ID NO: 391311 - DNA, 20 bp, Artificial Sequence
  chemically synthesized
tgtgaaataatcacatcatg

SEQ ID NO: 391312 - DNA, 20 bp, Artificial Sequence
  chemically synthesized
aatgtgaaataatcacatca

SEQ ID NO: 391313 - DNA, 20 bp, Artificial Sequence
  chemically synthesized
gtacatgagatgttttgata

SEQ ID NO: 391314 - DNA, 20 bp, Artificial Sequence
  chemically synthesized
tatatatttatggggtacat

SEQ ID NO: 391315 - DNA, 20 bp, Artificial Sequence
  chemically synthesized
aatagatatatatatttatg

SEQ ID NO: 391316 - DNA, 20 bp, Artificial Sequence
  chemically synthesized
caatagatatatatatttat

SEQ ID NO: 391317 - DNA, 20 bp, Artificial Sequence
  chemically synthesized
acaatagatatatatattta

SEQ ID NO: 391318 - DNA, 20 bp, Artificial Sequence
  chemically synthesized
ttatttttgtgggtacacaa

SEQ ID NO: 391319 - DNA, 20 bp, Artificial Sequence
  chemically synthesized
ttttagtatcttatttttgt

SEQ ID NO: 391320 - DNA, 20 bp, Artificial Sequence
  chemically synthesized
tattgtgtacccacaaaaat

SEQ ID NO: 391321 - DNA, 20 bp, Artificial Sequence
  chemically synthesized
tttttagtatcttatttttg

SEQ ID NO: 391322 - DNA, 20 bp, Artificial Sequence
  chemically synthesized
ccagctaatttttgtatttt

SEQ ID NO: 391323 - DNA, 20 bp, Artificial Sequence
  chemically synthesized
gatactaaaaatacaaaaat

SEQ ID NO: 391324 - DNA, 20 bp, Artificial Sequence
  chemically synthesized
ctaaaaatacaaaaattagc

SEQ ID NO: 391325 - DNA, 20 bp, Artificial Sequence
  chemically synthesized
atacaaaaattagctggaca

SEQ ID NO: 391326 - DNA, 20 bp, Artificial Sequence
  chemically synthesized
caaaaattagctggacatgg

SEQ ID NO: 391327 - DNA, 20 bp, Artificial Sequence
  chemically synthesized
caggtgtgcgccaccatgtc

SEQ ID NO: 391328 - DNA, 20 bp, Artificial Sequence
  chemically synthesized
gtggcgcacacctgtaatcc

SEQ ID NO: 391329 - DNA, 20 bp, Artificial Sequence
  chemically synthesized
tcctggggagctaggattac

SEQ ID NO: 391330 - DNA, 20 bp, Artificial Sequence
  chemically synthesized
ctcctggggagctaggatta

SEQ ID NO: 391331 - DNA, 20 bp, Artificial Sequence
  chemically synthesized
cacctgtaatcctagctccc

SEQ ID NO: 391332 - DNA, 20 bp, Artificial Sequence
  chemically synthesized
cctcagcctcctggggagct

SEQ ID NO: 391333 - DNA, 20 bp, Artificial Sequence
  chemically synthesized
acctgtaatcctagctcccc

SEQ ID NO: 391334 - DNA, 20 bp, Artificial Sequence
  chemically synthesized
gcctcagcctcctggggagc

SEQ ID NO: 391335 - DNA, 20 bp, Artificial Sequence
  chemically synthesized
ctgtaatcctagctccccag

SEQ ID NO: 391336 - DNA, 20 bp, Artificial Sequence
  chemically synthesized
tgtaatcctagctccccagg

SEQ ID NO: 391337 - DNA, 20 bp, Artificial Sequence
  chemically synthesized
tcctgcctcagcctcctggg

SEQ ID NO: 391338 - DNA, 20 bp, Artificial Sequence
  chemically synthesized
tctcctgcctcagcctcctg

SEQ ID NO: 391339 - DNA, 20 bp, Artificial Sequence
  chemically synthesized
ttctcctgcctcagcctcct

SEQ ID NO: 391340 - DNA, 20 bp, Artificial Sequence
  chemically synthesized
tcctagctccccaggaggct

SEQ ID NO: 391341 - DNA, 20 bp, Artificial Sequence
  chemically synthesized
attctcctgcctcagcctcc

SEQ ID NO: 391342 - DNA, 20 bp, Artificial Sequence
  chemically synthesized
cctagctccccaggaggctg

SEQ ID NO: 391343 - DNA, 20 bp, Artificial Sequence
  chemically synthesized
agctccccaggaggctgagg

SEQ ID NO: 391344 - DNA, 20 bp, Artificial Sequence
  chemically synthesized
gctccccaggaggctgaggc

SEQ ID NO: 391345 - DNA, 20 bp, Artificial Sequence
  chemically synthesized
tccccaggaggctgaggcag

SEQ ID NO: 391346 - DNA, 20 bp, Artificial Sequence
  chemically synthesized
ttcaagcgattctcctgcct

SEQ ID NO: 391347 - DNA, 20 bp, Artificial Sequence
  chemically synthesized
gcaggagaatcgcttgaacc

SEQ ID NO: 391348 - DNA, 20 bp, Artificial Sequence
  chemically synthesized
caggagaatcgcttgaaccc

SEQ ID NO: 391349 - DNA, 20 bp, Artificial Sequence
  chemically synthesized
aacctccgcctcccgggttc

SEQ ID NO: 391350 - DNA, 20 bp, Artificial Sequence
  chemically synthesized
ggagaatcgcttgaacccgg

SEQ ID NO: 391351 - DNA, 20 bp, Artificial Sequence
  chemically synthesized
gagaatcgcttgaacccggg

SEQ ID NO: 391352 - DNA, 20 bp, Artificial Sequence
  chemically synthesized
aatcgcttgaacccgggagg

SEQ ID NO: 391353 - DNA, 20 bp, Artificial Sequence
  chemically synthesized
cactgcaacctccgcctccc

SEQ ID NO: 391354 - DNA, 20 bp, Artificial Sequence
  chemically synthesized
tcgcttgaacccgggaggcg

SEQ ID NO: 391355 - DNA, 20 bp, Artificial Sequence
  chemically synthesized
tcactgcaacctccgcctcc

SEQ ID NO: 391356 - DNA, 20 bp, Artificial Sequence
  chemically synthesized
cgcttgaacccgggaggcgg

SEQ ID NO: 391357 - DNA, 20 bp, Artificial Sequence
  chemically synthesized
aacccgggaggcggaggttg

SEQ ID NO: 391358 - DNA, 20 bp, Artificial Sequence
  chemically synthesized
cgggaggcggaggttgcagt

SEQ ID NO: 391359 - DNA, 20 bp, Artificial Sequence
  chemically synthesized
ggcggaggttgcagtgagcc

SEQ ID NO: 391360 - DNA, 20 bp, Artificial Sequence
  chemically synthesized
gaggttgcagtgagccaaga

SEQ ID NO: 391361 - DNA, 20 bp, Artificial Sequence
  chemically synthesized
ggagtgcagtggcgccatct

SEQ ID NO: 391362 - DNA, 20 bp, Artificial Sequence
  chemically synthesized
tcacccaggctggagtgcag

SEQ ID NO: 391363 - DNA, 20 bp, Artificial Sequence
  chemically synthesized
aagatggcgccactgcactc

SEQ ID NO: 391364 - DNA, 20 bp, Artificial Sequence
  chemically synthesized
ctgtcacccaggctggagtg

SEQ ID NO: 391365 - DNA, 20 bp, Artificial Sequence
  chemically synthesized
ggcgccactgcactccagcc

SEQ ID NO: 391366 - DNA, 20 bp, Artificial Sequence
  chemically synthesized
gcgccactgcactccagcct

SEQ ID NO: 391367 - DNA, 20 bp, Artificial Sequence
  chemically synthesized
tcgctctgtcacccaggctg

SEQ ID NO: 391368 - DNA, 20 bp, Artificial Sequence
  chemically synthesized
tctcgctctgtcacccaggc

SEQ ID NO: 391369 - DNA, 20 bp, Artificial Sequence
  chemically synthesized
ctgcactccagcctgggtga

SEQ ID NO: 391370 - DNA, 20 bp, Artificial Sequence
  chemically synthesized
ggagtctcgctctgtcaccc

SEQ ID NO: 391371 - DNA, 20 bp, Artificial Sequence
  chemically synthesized
gcactccagcctgggtgaca

SEQ ID NO: 391372 - DNA, 20 bp, Artificial Sequence
  chemically synthesized
tggagtctcgctctgtcacc

SEQ ID NO: 391373 - DNA, 20 bp, Artificial Sequence
  chemically synthesized
tccagcctgggtgacagagc

SEQ ID NO: 391374 - DNA, 20 bp, Artificial Sequence
  chemically synthesized
tatcagtattatttgagatg

SEQ ID NO: 391375 - DNA, 20 bp, Artificial Sequence
  chemically synthesized
attatcagtattatttgaga

SEQ ID NO: 391376 - DNA, 20 bp, Artificial Sequence
  chemically synthesized
tatcattatcagtattattt

SEQ ID NO: 391377 - DNA, 20 bp, Artificial Sequence
  chemically synthesized
atcattatcattatcattat

SEQ ID NO: 391378 - DNA, 20 bp, Artificial Sequence
  chemically synthesized
ataaaaataataacgaaatt

SEQ ID NO: 391379 - DNA, 20 bp, Artificial Sequence
  chemically synthesized
aaaataataacgaaattcag

SEQ ID NO: 391380 - DNA, 20 bp, Artificial Sequence
  chemically synthesized
aaattcagtggattctgaat

SEQ ID NO: 391381 - DNA, 20 bp, Artificial Sequence
  chemically synthesized
aattcagtggattctgaata

SEQ ID NO: 391382 - DNA, 20 bp, Artificial Sequence
  chemically synthesized
tcttcttattgtgccttatt

SEQ ID NO: 391383 - DNA, 20 bp, Artificial Sequence
  chemically synthesized
gattctgaataaggcacaat

SEQ ID NO: 391384 - DNA, 20 bp, Artificial Sequence
  chemically synthesized
tctgaataaggcacaataag

SEQ ID NO: 391385 - DNA, 20 bp, Artificial Sequence
  chemically synthesized
gttaagactaaataaagaaa

SEQ ID NO: 391386 - DNA, 20 bp, Artificial Sequence
  chemically synthesized
gaattttctttttctttatt

SEQ ID NO: 391387 - DNA, 20 bp, Artificial Sequence
  chemically synthesized
ttcagtgttaagactaaata

SEQ ID NO: 391388 - DNA, 20 bp, Artificial Sequence
  chemically synthesized
cattaagacttttcagtgtt

SEQ ID NO: 391389 - DNA, 20 bp, Artificial Sequence
  chemically synthesized
tatttagtcttaacactgaa

SEQ ID NO: 391390 - DNA, 20 bp, Artificial Sequence
  chemically synthesized
acacattcattaagactttt

SEQ ID NO: 391391 - DNA, 20 bp, Artificial Sequence
  chemically synthesized
atggtagatacacattcatt

SEQ ID NO: 391392 - DNA, 20 bp, Artificial Sequence
  chemically synthesized
ttctgtctaatttcacatgg

SEQ ID NO: 391393 - DNA, 20 bp, Artificial Sequence
  chemically synthesized
aaattctgtctaatttcaca

SEQ ID NO: 391394 - DNA, 20 bp, Artificial Sequence
  chemically synthesized
gtgtatctaccatgtgaaat

SEQ ID NO: 391395 - DNA, 20 bp, Artificial Sequence
  chemically synthesized
atctaccatgtgaaattaga

SEQ ID NO: 391396 - DNA, 20 bp, Artificial Sequence
  chemically synthesized
tgaaattagacagaatttaa

SEQ ID NO: 391397 - DNA, 20 bp, Artificial Sequence
  chemically synthesized
ttaacagtttaaaatattaa

SEQ ID NO: 391398 - DNA, 20 bp, Artificial Sequence
  chemically synthesized
tagcaattgtttagaacaaa

SEQ ID NO: 391399 - DNA, 20 bp, Artificial Sequence
  chemically synthesized
aaaatattttagcaattgtt

SEQ ID NO: 391400 - DNA, 20 bp, Artificial Sequence
  chemically synthesized
tagatgtaaccaaaatattt

SEQ ID NO: 391401 - DNA, 20 bp, Artificial Sequence
  chemically synthesized
aaacaattgctaaaatattt

SEQ ID NO: 391402 - DNA, 20 bp, Artificial Sequence
  chemically synthesized
aatggttgcctttgtgaggt

SEQ ID NO: 391403 - DNA, 20 bp, Artificial Sequence
  chemically synthesized
tggttacatctaacctcaca

SEQ ID NO: 391404 - DNA, 20 bp, Artificial Sequence
  chemically synthesized
ggttacatctaacctcacaa

SEQ ID NO: 391405 - DNA, 20 bp, Artificial Sequence
  chemically synthesized
agaaaatggttgcctttgtg

SEQ ID NO: 391406 - DNA, 20 bp, Artificial Sequence
  chemically synthesized
tagaaaatggttgcctttgt

SEQ ID NO: 391407 - DNA, 20 bp, Artificial Sequence
  chemically synthesized
tatagaaaagtaatagaaaa

SEQ ID NO: 391408 - DNA, 20 bp, Artificial Sequence
  chemically synthesized
aagtgaatatagaaaagtaa

SEQ ID NO: 391409 - DNA, 20 bp, Artificial Sequence
  chemically synthesized
ggaaaaaagtgaatatagaa

SEQ ID NO: 391410 - DNA, 20 bp, Artificial Sequence
  chemically synthesized
taataggaaaaaagtgaata

SEQ ID NO: 391411 - DNA, 20 bp, Artificial Sequence
  chemically synthesized
cccagtaaataataggaaaa

SEQ ID NO: 391412 - DNA, 20 bp, Artificial Sequence
  chemically synthesized
gaagaaacccagtaaataat

SEQ ID NO: 391413 - DNA, 20 bp, Artificial Sequence
  chemically synthesized
agaagaaacccagtaaataa

SEQ ID NO: 391414 - DNA, 20 bp, Artificial Sequence
  chemically synthesized
acttttttcctattatttac

SEQ ID NO: 391415 - DNA, 20 bp, Artificial Sequence
  chemically synthesized
cttttttcctattatttact

SEQ ID NO: 391416 - DNA, 20 bp, Artificial Sequence
  chemically synthesized
caacaataacagaagaaacc

SEQ ID NO: 391417 - DNA, 20 bp, Artificial Sequence
  chemically synthesized
aaaaacaacaacaataacag

SEQ ID NO: 391418 - DNA, 20 bp, Artificial Sequence
  chemically synthesized
ggaaaaaacaacaacaataa

SEQ ID NO: 391419 - DNA, 20 bp, Artificial Sequence
  chemically synthesized
gttgttgttttttccttttt

SEQ ID NO: 391420 - DNA, 20 bp, Artificial Sequence
  chemically synthesized
agtgaacctctgtctcaaaa

SEQ ID NO: 391421 - DNA, 20 bp, Artificial Sequence
  chemically synthesized
ttgttttttcctttttgaga

SEQ ID NO: 391422 - DNA, 20 bp, Artificial Sequence
  chemically synthesized
gagtgaacctctgtctcaaa

SEQ ID NO: 391423 - DNA, 20 bp, Artificial Sequence
  chemically synthesized
gttttttcctttttgagaca

SEQ ID NO: 391424 - DNA, 20 bp, Artificial Sequence
  chemically synthesized
ttttttcctttttgagacag

SEQ ID NO: 391425 - DNA, 20 bp, Artificial Sequence
  chemically synthesized
cactccagcctgggcaacaa

SEQ ID NO: 391426 - DNA, 20 bp, Artificial Sequence
  chemically synthesized
agaggttcactcttgttgcc

SEQ ID NO: 391427 - DNA, 20 bp, Artificial Sequence
  chemically synthesized
gaggttcactcttgttgccc

SEQ ID NO: 391428 - DNA, 20 bp, Artificial Sequence
  chemically synthesized
tgcactccagcctgggcaac

SEQ ID NO: 391429 - DNA, 20 bp, Artificial Sequence
  chemically synthesized
ttcactcttgttgcccaggc

SEQ ID NO: 391430 - DNA, 20 bp, Artificial Sequence
  chemically synthesized
cactcttgttgcccaggctg

SEQ ID NO: 391431 - DNA, 20 bp, Artificial Sequence
  chemically synthesized
gcgccactgcactccagcct

SEQ ID NO: 391432 - DNA, 20 bp, Artificial Sequence
  chemically synthesized
tgcgccactgcactccagcc

SEQ ID NO: 391433 - DNA, 20 bp, Artificial Sequence
  chemically synthesized
ttgttgcccaggctggagtg

SEQ ID NO: 391434 - DNA, 20 bp, Artificial Sequence
  chemically synthesized
gaaattgcgccactgcactc

SEQ ID NO: 391435 - DNA, 20 bp, Artificial Sequence
  chemically synthesized
ttgcccaggctggagtgcag

SEQ ID NO: 391436 - DNA, 20 bp, Artificial Sequence
  chemically synthesized
ggagtgcagtggcgcaattt

SEQ ID NO: 391437 - DNA, 20 bp, Artificial Sequence
  chemically synthesized
agtggcgcaatttcggctca

SEQ ID NO: 391438 - DNA, 20 bp, Artificial Sequence
  chemically synthesized
cgggaggcagaggttgccat

SEQ ID NO: 391439 - DNA, 20 bp, Artificial Sequence
  chemically synthesized
cacttgaacccgggaggcag

SEQ ID NO: 391440 - DNA, 20 bp, Artificial Sequence
  chemically synthesized
tcatggcaacctctgcctcc

SEQ ID NO: 391441 - DNA, 20 bp, Artificial Sequence
  chemically synthesized
tcacttgaacccgggaggca

SEQ ID NO: 391442 - DNA, 20 bp, Artificial Sequence
  chemically synthesized
catggcaacctctgcctccc

SEQ ID NO: 391443 - DNA, 20 bp, Artificial Sequence
  chemically synthesized
aatcacttgaacccgggagg

SEQ ID NO: 391444 - DNA, 20 bp, Artificial Sequence
  chemically synthesized
gagaatcacttgaacccggg

SEQ ID NO: 391445 - DNA, 20 bp, Artificial Sequence
  chemically synthesized
ggagaatcacttgaacccgg

SEQ ID NO: 391446 - DNA, 20 bp, Artificial Sequence
  chemically synthesized
aacctctgcctcccgggttc

SEQ ID NO: 391447 - DNA, 20 bp, Artificial Sequence
  chemically synthesized
caggagaatcacttgaaccc

SEQ ID NO: 391448 - DNA, 20 bp, Artificial Sequence
  chemically synthesized
gcaggagaatcacttgaacc

SEQ ID NO: 391449 - DNA, 20 bp, Artificial Sequence
  chemically synthesized
ttcaagtgattctcctgcct

SEQ ID NO: 391450 - DNA, 20 bp, Artificial Sequence
  chemically synthesized
tactcaggaggctgaggcag

SEQ ID NO: 391451 - DNA, 20 bp, Artificial Sequence
  chemically synthesized
gctactcaggaggctgaggc

SEQ ID NO: 391452 - DNA, 20 bp, Artificial Sequence
  chemically synthesized
agctactcaggaggctgagg

SEQ ID NO: 391453 - DNA, 20 bp, Artificial Sequence
  chemically synthesized
cccagctactcaggaggctg

SEQ ID NO: 391454 - DNA, 20 bp, Artificial Sequence
  chemically synthesized
tcccagctactcaggaggct

SEQ ID NO: 391455 - DNA, 20 bp, Artificial Sequence
  chemically synthesized
ttctcctgcctcagcctcct

SEQ ID NO: 391456 - DNA, 20 bp, Artificial Sequence
  chemically synthesized
tcctgcctcagcctcctgag

SEQ ID NO: 391457 - DNA, 20 bp, Artificial Sequence
  chemically synthesized
tgtaatcccagctactcagg

SEQ ID NO: 391458 - DNA, 20 bp, Artificial Sequence
  chemically synthesized
ctgtaatcccagctactcag

SEQ ID NO: 391459 - DNA, 20 bp, Artificial Sequence
  chemically synthesized
gcctcagcctcctgagtagc

SEQ ID NO: 391460 - DNA, 20 bp, Artificial Sequence
  chemically synthesized
atctgtaatcccagctactc

SEQ ID NO: 391461 - DNA, 20 bp, Artificial Sequence
  chemically synthesized
cctcagcctcctgagtagct

SEQ ID NO: 391462 - DNA, 20 bp, Artificial Sequence
  chemically synthesized
catctgtaatcccagctact

SEQ ID NO: 391463 - DNA, 20 bp, Artificial Sequence
  chemically synthesized
ctcctgagtagctgggatta

SEQ ID NO: 391464 - DNA, 20 bp, Artificial Sequence
  chemically synthesized
gtggcaggcatctgtaatcc

SEQ ID NO: 391465 - DNA, 20 bp, Artificial Sequence
  chemically synthesized
ggattacagatgcctgccac

SEQ ID NO: 391466 - DNA, 20 bp, Artificial Sequence
  chemically synthesized
gattacagatgcctgccacc

SEQ ID NO: 391467 - DNA, 20 bp, Artificial Sequence
  chemically synthesized
aattagcctgacctggtggc

SEQ ID NO: 391468 - DNA, 20 bp, Artificial Sequence
  chemically synthesized
aaattagcctgacctggtgg

SEQ ID NO: 391469 - DNA, 20 bp, Artificial Sequence
  chemically synthesized
acagatgcctgccaccaggt

SEQ ID NO: 391470 - DNA, 20 bp, Artificial Sequence
  chemically synthesized
cagatgcctgccaccaggtc

SEQ ID NO: 391471 - DNA, 20 bp, Artificial Sequence
  chemically synthesized
caaaaattagcctgacctgg

SEQ ID NO: 391472 - DNA, 20 bp, Artificial Sequence
  chemically synthesized
atacaaaaattagcctgacc

SEQ ID NO: 391473 - DNA, 20 bp, Artificial Sequence
  chemically synthesized
tctactaaaaatacaaaaat

SEQ ID NO: 391474 - DNA, 20 bp, Artificial Sequence
  chemically synthesized
caggctaatttttgtatttt

SEQ ID NO: 391475 - DNA, 20 bp, Artificial Sequence
  chemically synthesized
gctaatttttgtatttttag

SEQ ID NO: 391476 - DNA, 20 bp, Artificial Sequence
  chemically synthesized
taatttttgtatttttagta

SEQ ID NO: 391477 - DNA, 20 bp, Artificial Sequence
  chemically synthesized
ttttgtatttttagtagaga

SEQ ID NO: 391478 - DNA, 20 bp, Artificial Sequence
  chemically synthesized
tttgtatttttagtagagat

SEQ ID NO: 391479 - DNA, 20 bp, Artificial Sequence
  chemically synthesized
ttgtatttttagtagagatg

SEQ ID NO: 391480 - DNA, 20 bp, Artificial Sequence
  chemically synthesized
gagatggggtttcaccatgt

SEQ ID NO: 391481 - DNA, 20 bp, Artificial Sequence
  chemically synthesized
tggggtttcaccatgttggc

SEQ ID NO: 391482 - DNA, 20 bp, Artificial Sequence
  chemically synthesized
caagaccagcctggccaaca

SEQ ID NO: 391483 - DNA, 20 bp, Artificial Sequence
  chemically synthesized
ggggtttcaccatgttggcc

SEQ ID NO: 391484 - DNA, 20 bp, Artificial Sequence
  chemically synthesized
tttcaccatgttggccaggc

SEQ ID NO: 391485 - DNA, 20 bp, Artificial Sequence
  chemically synthesized
tcaagagttcaagaccagcc

SEQ ID NO: 391486 - DNA, 20 bp, Artificial Sequence
  chemically synthesized
ggaagtcaagagttcaagac

SEQ ID NO: 391487 - DNA, 20 bp, Artificial Sequence
  chemically synthesized
tgactggaagtcaagagttc

SEQ ID NO: 391488 - DNA, 20 bp, Artificial Sequence
  chemically synthesized
agcggatgactggaagtcaa

SEQ ID NO: 391489 - DNA, 20 bp, Artificial Sequence
  chemically synthesized
ggtcttgaactcttgacttc

SEQ ID NO: 391490 - DNA, 20 bp, Artificial Sequence
  chemically synthesized
caagcggatgactggaagtc

SEQ ID NO: 391491 - DNA, 20 bp, Artificial Sequence
  chemically synthesized
caaggcaagcggatgactgg

SEQ ID NO: 391492 - DNA, 20 bp, Artificial Sequence
  chemically synthesized
ggccaaggcaagcggatgac

SEQ ID NO: 391493 - DNA, 20 bp, Artificial Sequence
  chemically synthesized
ttccagtcatccgcttgcct

SEQ ID NO: 391494 - DNA, 20 bp, Artificial Sequence
  chemically synthesized
ctttgggaggccaaggcaag

SEQ ID NO: 391495 - DNA, 20 bp, Artificial Sequence
  chemically synthesized
gcactttgggaggccaaggc

SEQ ID NO: 391496 - DNA, 20 bp, Artificial Sequence
  chemically synthesized
cccagcactttgggaggcca

SEQ ID NO: 391497 - DNA, 20 bp, Artificial Sequence
  chemically synthesized
tcccagcactttgggaggcc

SEQ ID NO: 391498 - DNA, 20 bp, Artificial Sequence
  chemically synthesized
ccgcttgccttggcctccca

SEQ ID NO: 391499 - DNA, 20 bp, Artificial Sequence
  chemically synthesized
tgtaatcccagcactttggg

SEQ ID NO: 391500 - DNA, 20 bp, Artificial Sequence
  chemically synthesized
ttgtaatcccagcactttgg

SEQ ID NO: 391501 - DNA, 20 bp, Artificial Sequence
  chemically synthesized
gccttggcctcccaaagtgc

SEQ ID NO: 391502 - DNA, 20 bp, Artificial Sequence
  chemically synthesized
gcttgtaatcccagcacttt

SEQ ID NO: 391503 - DNA, 20 bp, Artificial Sequence
  chemically synthesized
ccttggcctcccaaagtgct

SEQ ID NO: 391504 - DNA, 20 bp, Artificial Sequence
  chemically synthesized
cgcttgtaatcccagcactt

SEQ ID NO: 391505 - DNA, 20 bp, Artificial Sequence
  chemically synthesized
tcccaaagtgctgggattac

SEQ ID NO: 391506 - DNA, 20 bp, Artificial Sequence
  chemically synthesized
gtggctcacgcttgtaatcc

SEQ ID NO: 391507 - DNA, 20 bp, Artificial Sequence
  chemically synthesized
agtgctgggattacaagcgt

SEQ ID NO: 391508 - DNA, 20 bp, Artificial Sequence
  chemically synthesized
caagcgtgagccaccgcact

SEQ ID NO: 391509 - DNA, 20 bp, Artificial Sequence
  chemically synthesized
aacaaactggctgagtgcgg

SEQ ID NO: 391510 - DNA, 20 bp, Artificial Sequence
  chemically synthesized
cctaacaaactggctgagtg

SEQ ID NO: 391511 - DNA, 20 bp, Artificial Sequence
  chemically synthesized
cgtgagccaccgcactcagc

SEQ ID NO: 391512 - DNA, 20 bp, Artificial Sequence
  chemically synthesized
aaaaacctaacaaactggct

SEQ ID NO: 391513 - DNA, 20 bp, Artificial Sequence
  chemically synthesized
accgcactcagccagtttgt

SEQ ID NO: 391514 - DNA, 20 bp, Artificial Sequence
  chemically synthesized
ccgcactcagccagtttgtt

SEQ ID NO: 391515 - DNA, 20 bp, Artificial Sequence
  chemically synthesized
ctaataaaaacctaacaaac

SEQ ID NO: 391516 - DNA, 20 bp, Artificial Sequence
  chemically synthesized
ccagtttgttaggtttttat

SEQ ID NO: 391517 - DNA, 20 bp, Artificial Sequence
  chemically synthesized
cagtttgttaggtttttatt

SEQ ID NO: 391518 - DNA, 20 bp, Artificial Sequence
  chemically synthesized
gttaggtttttattaggtgc

SEQ ID NO: 391519 - DNA, 20 bp, Artificial Sequence
  chemically synthesized
tttttattgattaaaaaata

SEQ ID NO: 391520 - DNA, 20 bp, Artificial Sequence
  chemically synthesized
tttttaatcaataaaaacac

SEQ ID NO: 391521 - DNA, 20 bp, Artificial Sequence
  chemically synthesized
taatcaataaaaacacaagc

SEQ ID NO: 391522 - DNA, 20 bp, Artificial Sequence
  chemically synthesized
ataaaaacacaagcaagcca

SEQ ID NO: 391523 - DNA, 20 bp, Artificial Sequence
  chemically synthesized
cacaagcaagccacagctcc

SEQ ID NO: 391524 - DNA, 20 bp, Artificial Sequence
  chemically synthesized
ttgtacacttcttggagctg

SEQ ID NO: 391525 - DNA, 20 bp, Artificial Sequence
  chemically synthesized
aagcaagccacagctccaag

SEQ ID NO: 391526 - DNA, 20 bp, Artificial Sequence
  chemically synthesized
catttgttgtacacttcttg

SEQ ID NO: 391527 - DNA, 20 bp, Artificial Sequence
  chemically synthesized
atcatttgttgtacacttct

SEQ ID NO: 391528 - DNA, 20 bp, Artificial Sequence
  chemically synthesized
tgtacaacaaatgatttgac

SEQ ID NO: 391529 - DNA, 20 bp, Artificial Sequence
  chemically synthesized
tacaacaaatgatttgactg

SEQ ID NO: 391530 - DNA, 20 bp, Artificial Sequence
  chemically synthesized
tagttaaaaaaattattctc

SEQ ID NO: 391531 - DNA, 20 bp, Artificial Sequence
  chemically synthesized
aatttttttaactaaatact

SEQ ID NO: 391532 - DNA, 20 bp, Artificial Sequence
  chemically synthesized
atatagtgtgaccaagtatt

SEQ ID NO: 391533 - DNA, 20 bp, Artificial Sequence
  chemically synthesized
gccacttatatagtgtgacc

SEQ ID NO: 391534 - DNA, 20 bp, Artificial Sequence
  chemically synthesized
aatacttggtcacactatat

SEQ ID NO: 391535 - DNA, 20 bp, Artificial Sequence
  chemically synthesized
acttggtcacactatataag

SEQ ID NO: 391536 - DNA, 20 bp, Artificial Sequence
  chemically synthesized
ttcttcacatgccacttata

SEQ ID NO: 391537 - DNA, 20 bp, Artificial Sequence
  chemically synthesized
cactatataagtggcatgtg

SEQ ID NO: 391538 - DNA, 20 bp, Artificial Sequence
  chemically synthesized
agtggcatgtgaagaaaaaa

SEQ ID NO: 391539 - DNA, 20 bp, Artificial Sequence
  chemically synthesized
tgaagaaaaaacagtcactt

SEQ ID NO: 391540 - DNA, 20 bp, Artificial Sequence
  chemically synthesized
gaagaaaaaacagtcacttt

SEQ ID NO: 391541 - DNA, 20 bp, Artificial Sequence
  chemically synthesized
tccctgaaattttcggccca

SEQ ID NO: 391542 - DNA, 20 bp, Artificial Sequence
  chemically synthesized
tcactttgggccgaaaattt

SEQ ID NO: 391543 - DNA, 20 bp, Artificial Sequence
  chemically synthesized
gtttttttccctgaaatttt

SEQ ID NO: 391544 - DNA, 20 bp, Artificial Sequence
  chemically synthesized
cactttgggccgaaaatttc

SEQ ID NO: 391545 - DNA, 20 bp, Artificial Sequence
  chemically synthesized
actttgggccgaaaatttca

SEQ ID NO: 391546 - DNA, 20 bp, Artificial Sequence
  chemically synthesized
ttcagggaaaaaaaccctta

SEQ ID NO: 391547 - DNA, 20 bp, Artificial Sequence
  chemically synthesized
cagggaaaaaaacccttatg

SEQ ID NO: 391548 - DNA, 20 bp, Artificial Sequence
  chemically synthesized
aagttatttttactccataa

SEQ ID NO: 391549 - DNA, 20 bp, Artificial Sequence
  chemically synthesized
aaagttatttttactccata

SEQ ID NO: 391550 - DNA, 20 bp, Artificial Sequence
  chemically synthesized
taaagttatttttactccat

SEQ ID NO: 391551 - DNA, 20 bp, Artificial Sequence
  chemically synthesized
atggagtaaaaataacttta

SEQ ID NO: 391552 - DNA, 20 bp, Artificial Sequence
  chemically synthesized
tcattcagcaataaactata

SEQ ID NO: 391553 - DNA, 20 bp, Artificial Sequence
  chemically synthesized
caataaaaatgtaaatcatt

SEQ ID NO: 391554 - DNA, 20 bp, Artificial Sequence
  chemically synthesized
gatttacatttttattgata

SEQ ID NO: 391555 - DNA, 20 bp, Artificial Sequence
  chemically synthesized
aacactgagtatatacaagt

SEQ ID NO: 391556 - DNA, 20 bp, Artificial Sequence
  chemically synthesized
aactaacactgagtatatac

SEQ ID NO: 391557 - DNA, 20 bp, Artificial Sequence
  chemically synthesized
acagctaacttgtatatact

SEQ ID NO: 391558 - DNA, 20 bp, Artificial Sequence
  chemically synthesized
aacttgtatatactcagtgt

SEQ ID NO: 391559 - DNA, 20 bp, Artificial Sequence
  chemically synthesized
tatgattaagaactaacact

SEQ ID NO: 391560 - DNA, 20 bp, Artificial Sequence
  chemically synthesized
aacaggcattaaatatgatt

SEQ ID NO: 391561 - DNA, 20 bp, Artificial Sequence
  chemically synthesized
aggaatgtggcatgtgtaac

SEQ ID NO: 391562 - DNA, 20 bp, Artificial Sequence
  chemically synthesized
gaggaatgtggcatgtgtaa

SEQ ID NO: 391563 - DNA, 20 bp, Artificial Sequence
  chemically synthesized
gaatagtttcatgaggaatg

SEQ ID NO: 391564 - DNA, 20 bp, Artificial Sequence
  chemically synthesized
gaatcatgaatagtttcatg

SEQ ID NO: 391565 - DNA, 20 bp, Artificial Sequence
  chemically synthesized
agaatcatgaatagtttcat

SEQ ID NO: 391566 - DNA, 20 bp, Artificial Sequence
  chemically synthesized
atggggagaagaatcatgaa

SEQ ID NO: 391567 - DNA, 20 bp, Artificial Sequence
  chemically synthesized
caaattattggtatggggag

SEQ ID NO: 391568 - DNA, 20 bp, Artificial Sequence
  chemically synthesized
atacaaattattggtatggg

SEQ ID NO: 391569 - DNA, 20 bp, Artificial Sequence
  chemically synthesized
taatacaaattattggtatg

SEQ ID NO: 391570 - DNA, 20 bp, Artificial Sequence
  chemically synthesized
ataatacaaattattggtat

SEQ ID NO: 391571 - DNA, 20 bp, Artificial Sequence
  chemically synthesized
aataatacaaattattggta

SEQ ID NO: 391572 - DNA, 20 bp, Artificial Sequence
  chemically synthesized
aatggaataatacaaattat

SEQ ID NO: 391573 - DNA, 20 bp, Artificial Sequence
  chemically synthesized
gaaaacatgttatatgagaa

SEQ ID NO: 391574 - DNA, 20 bp, Artificial Sequence
  chemically synthesized
ataccgaaaacatgttatat

SEQ ID NO: 391575 - DNA, 20 bp, Artificial Sequence
  chemically synthesized
attctcatataacatgtttt

SEQ ID NO: 391576 - DNA, 20 bp, Artificial Sequence
  chemically synthesized
aaaatatattgtcaatttaa

SEQ ID NO: 391577 - DNA, 20 bp, Artificial Sequence
  chemically synthesized
tagaacatagaaaattataa

SEQ ID NO: 391578 - DNA, 20 bp, Artificial Sequence
  chemically synthesized
catagaacatagaaaattat

SEQ ID NO: 391579 - DNA, 20 bp, Artificial Sequence
  chemically synthesized
atactatagaacatagaaca

SEQ ID NO: 391580 - DNA, 20 bp, Artificial Sequence
  chemically synthesized
tttctatgttctatgttcta

SEQ ID NO: 391581 - DNA, 20 bp, Artificial Sequence
  chemically synthesized
tcttttaatactatagaaca

SEQ ID NO: 391582 - DNA, 20 bp, Artificial Sequence
  chemically synthesized
tcatgaatcttttaatacta

SEQ ID NO: 391583 - DNA, 20 bp, Artificial Sequence
  chemically synthesized
tctatgttctatagtattaa

SEQ ID NO: 391584 - DNA, 20 bp, Artificial Sequence
  chemically synthesized
gtattaaaagattcatgacc

SEQ ID NO: 391585 - DNA, 20 bp, Artificial Sequence
  chemically synthesized
attaaaagattcatgaccta

SEQ ID NO: 391586 - DNA, 20 bp, Artificial Sequence
  chemically synthesized
atatatatgtgtgtgtctct

SEQ ID NO: 391587 - DNA, 20 bp, Artificial Sequence
  chemically synthesized
tatatatatgtgtgtgtctc

SEQ ID NO: 391588 - DNA, 20 bp, Artificial Sequence
  chemically synthesized
tctataaagttaaatatata

SEQ ID NO: 391589 - DNA, 20 bp, Artificial Sequence
  chemically synthesized
tccatatatatttaacttta

SEQ ID NO: 391590 - DNA, 20 bp, Artificial Sequence
  chemically synthesized
tcaaattcaagaattctata

SEQ ID NO: 391591 - DNA, 20 bp, Artificial Sequence
  chemically synthesized
ctttctattcagtcaaattc

SEQ ID NO: 391592 - DNA, 20 bp, Artificial Sequence
  chemically synthesized
aattcttgaatttgactgaa

SEQ ID NO: 391593 - DNA, 20 bp, Artificial Sequence
  chemically synthesized
cttgaatttgactgaataga

SEQ ID NO: 391594 - DNA, 20 bp, Artificial Sequence
  chemically synthesized
cttggccaccactttctatt

SEQ ID NO: 391595 - DNA, 20 bp, Artificial Sequence
  chemically synthesized
gaatttgactgaatagaaag

SEQ ID NO: 391596 - DNA, 20 bp, Artificial Sequence
  chemically synthesized
tttgactgaatagaaagtgg

SEQ ID NO: 391597 - DNA, 20 bp, Artificial Sequence
  chemically synthesized
ctgaatagaaagtggtggcc

SEQ ID NO: 391598 - DNA, 20 bp, Artificial Sequence
  chemically synthesized
ttaggtagatttaatattct

SEQ ID NO: 391599 - DNA, 20 bp, Artificial Sequence
  chemically synthesized
aaacctctgtgaattttagg

SEQ ID NO: 391600 - DNA, 20 bp, Artificial Sequence
  chemically synthesized
ctcaaacctctgtgaatttt

SEQ ID NO: 391601 - DNA, 20 bp, Artificial Sequence
  chemically synthesized
ttaaatctacctaaaattca

SEQ ID NO: 391602 - DNA, 20 bp, Artificial Sequence
  chemically synthesized
tctcaaacctctgtgaattt

SEQ ID NO: 391603 - DNA, 20 bp, Artificial Sequence
  chemically synthesized
aaatctacctaaaattcaca

SEQ ID NO: 391604 - DNA, 20 bp, Artificial Sequence
  chemically synthesized
aatctacctaaaattcacag

SEQ ID NO: 391605 - DNA, 20 bp, Artificial Sequence
  chemically synthesized
cctaaaattcacagaggttt

SEQ ID NO: 391606 - DNA, 20 bp, Artificial Sequence
  chemically synthesized
cagaggtttgagattcacaa

SEQ ID NO: 391607 - DNA, 20 bp, Artificial Sequence
  chemically synthesized
agaggtttgagattcacaaa

SEQ ID NO: 391608 - DNA, 20 bp, Artificial Sequence
  chemically synthesized
tcacaaaaggtcacttgatt

SEQ ID NO: 391609 - DNA, 20 bp, Artificial Sequence
  chemically synthesized
ctgaacctgtaagccaaatc

SEQ ID NO: 391610 - DNA, 20 bp, Artificial Sequence
  chemically synthesized
aggtcacttgatttggctta

SEQ ID NO: 391611 - DNA, 20 bp, Artificial Sequence
  chemically synthesized
ggtcacttgatttggcttac

SEQ ID NO: 391612 - DNA, 20 bp, Artificial Sequence
  chemically synthesized
cttgatttggcttacaggtt

SEQ ID NO: 391613 - DNA, 20 bp, Artificial Sequence
  chemically synthesized
cttttctcccctgaacctgt

SEQ ID NO: 391614 - DNA, 20 bp, Artificial Sequence
  chemically synthesized
ttgatttggcttacaggttc

SEQ ID NO: 391615 - DNA, 20 bp, Artificial Sequence
  chemically synthesized
tgatttggcttacaggttca

SEQ ID NO: 391616 - DNA, 20 bp, Artificial Sequence
  chemically synthesized
gatttggcttacaggttcag

SEQ ID NO: 391617 - DNA, 20 bp, Artificial Sequence
  chemically synthesized
tttggcttacaggttcaggg

SEQ ID NO: 391618 - DNA, 20 bp, Artificial Sequence
  chemically synthesized
cttacaggttcaggggagaa

SEQ ID NO: 391619 - DNA, 20 bp, Artificial Sequence
  chemically synthesized
ggggagaaaagtaaatttca

SEQ ID NO: 391620 - DNA, 20 bp, Artificial Sequence
  chemically synthesized
gagaaaagtaaatttcatgg

SEQ ID NO: 391621 - DNA, 20 bp, Artificial Sequence
  chemically synthesized
agaaaatcataaatatttgc

SEQ ID NO: 391622 - DNA, 20 bp, Artificial Sequence
  chemically synthesized
aaatcataaatatttgcgag

SEQ ID NO: 391623 - DNA, 20 bp, Artificial Sequence
  chemically synthesized
ataaatatttgcgagtagat

SEQ ID NO: 391624 - DNA, 20 bp, Artificial Sequence
  chemically synthesized
taaatatttgcgagtagata

SEQ ID NO: 391625 - DNA, 20 bp, Artificial Sequence
  chemically synthesized
atatttgcgagtagataagg

SEQ ID NO: 391626 - DNA, 20 bp, Artificial Sequence
  chemically synthesized
tttgcgagtagataaggtag

SEQ ID NO: 391627 - DNA, 20 bp, Artificial Sequence
  chemically synthesized
agtagataaggtagcagatg

SEQ ID NO: 391628 - DNA, 20 bp, Artificial Sequence
  chemically synthesized
gcagatgtagacgttatcta

SEQ ID NO: 391629 - DNA, 20 bp, Artificial Sequence
  chemically synthesized
cagatgtagacgttatctat

SEQ ID NO: 391630 - DNA, 20 bp, Artificial Sequence
  chemically synthesized
agatgtagacgttatctata

SEQ ID NO: 391631 - DNA, 20 bp, Artificial Sequence
  chemically synthesized
tttgctgtcagatttcccta

SEQ ID NO: 391632 - DNA, 20 bp, Artificial Sequence
  chemically synthesized
ttatctatagggaaatctga

SEQ ID NO: 391633 - DNA, 20 bp, Artificial Sequence
  chemically synthesized
atagggaaatctgacagcaa

SEQ ID NO: 391634 - DNA, 20 bp, Artificial Sequence
  chemically synthesized
gctctcattccttttgctgt

SEQ ID NO: 391635 - DNA, 20 bp, Artificial Sequence
  chemically synthesized
tagggaaatctgacagcaaa

SEQ ID NO: 391636 - DNA, 20 bp, Artificial Sequence
  chemically synthesized
aatctgacagcaaaaggaat

SEQ ID NO: 391637 - DNA, 20 bp, Artificial Sequence
  chemically synthesized
tctgacagcaaaaggaatga

SEQ ID NO: 391638 - DNA, 20 bp, Artificial Sequence
  chemically synthesized
acagcaaaaggaatgagagc

SEQ ID NO: 391639 - DNA, 20 bp, Artificial Sequence
  chemically synthesized
cagcaaaaggaatgagagct

SEQ ID NO: 391640 - DNA, 20 bp, Artificial Sequence
  chemically synthesized
ggcccctgaatgtaacatcc

SEQ ID NO: 391641 - DNA, 20 bp, Artificial Sequence
  chemically synthesized
gagagctaggatgttacatt

SEQ ID NO: 391642 - DNA, 20 bp, Artificial Sequence
  chemically synthesized
agagctaggatgttacattc

SEQ ID NO: 391643 - DNA, 20 bp, Artificial Sequence
  chemically synthesized
gagctaggatgttacattca

SEQ ID NO: 391644 - DNA, 20 bp, Artificial Sequence
  chemically synthesized
agctaggatgttacattcag

SEQ ID NO: 391645 - DNA, 20 bp, Artificial Sequence
  chemically synthesized
acattcaggggcctgaatta

SEQ ID NO: 391646 - DNA, 20 bp, Artificial Sequence
  chemically synthesized
tctgtagcaaactgtaattc

SEQ ID NO: 391647 - DNA, 20 bp, Artificial Sequence
  chemically synthesized
atctgtagcaaactgtaatt

SEQ ID NO: 391648 - DNA, 20 bp, Artificial Sequence
  chemically synthesized
gcctgaattacagtttgcta

SEQ ID NO: 391649 - DNA, 20 bp, Artificial Sequence
  chemically synthesized
gtgcggatgtattgtatctg

SEQ ID NO: 391650 - DNA, 20 bp, Artificial Sequence
  chemically synthesized
agatacaatacatccgcact

SEQ ID NO: 391651 - DNA, 20 bp, Artificial Sequence
  chemically synthesized
aatgtaatttttgctaagtg

SEQ ID NO: 391652 - DNA, 20 bp, Artificial Sequence
  chemically synthesized
ttataaatgtaatttttgct

SEQ ID NO: 391653 - DNA, 20 bp, Artificial Sequence
  chemically synthesized
aaaaattacatttataacct

SEQ ID NO: 391654 - DNA, 20 bp, Artificial Sequence
  chemically synthesized
taaaccttgattaaaagcca

SEQ ID NO: 391655 - DNA, 20 bp, Artificial Sequence
  chemically synthesized
gtaaaccttgattaaaagcc

SEQ ID NO: 391656 - DNA, 20 bp, Artificial Sequence
  chemically synthesized
tataaccttggcttttaatc

SEQ ID NO: 391657 - DNA, 20 bp, Artificial Sequence
  chemically synthesized
ataaccttggcttttaatca

SEQ ID NO: 391658 - DNA, 20 bp, Artificial Sequence
  chemically synthesized
ttatggtaaaccttgattaa

SEQ ID NO: 391659 - DNA, 20 bp, Artificial Sequence
  chemically synthesized
tcaaggtttaccataatgaa

SEQ ID NO: 391660 - DNA, 20 bp, Artificial Sequence
  chemically synthesized
ttcttcacagcttttcatta

SEQ ID NO: 391661 - DNA, 20 bp, Artificial Sequence
  chemically synthesized
taccataatgaaaagctgtg

SEQ ID NO: 391662 - DNA, 20 bp, Artificial Sequence
  chemically synthesized
cgagtcatacaagttcttca

SEQ ID NO: 391663 - DNA, 20 bp, Artificial Sequence
  chemically synthesized
aaattataagcgagtcatac

SEQ ID NO: 391664 - DNA, 20 bp, Artificial Sequence
  chemically synthesized
aaaccaaaaaaattataagc

SEQ ID NO: 391665 - DNA, 20 bp, Artificial Sequence
  chemically synthesized
aaaaaaaccaaaaaaattat

SEQ ID NO: 391666 - DNA, 20 bp, Artificial Sequence
  chemically synthesized
tgactcgcttataatttttt

SEQ ID NO: 391667 - DNA, 20 bp, Artificial Sequence
  chemically synthesized
taatttttttggtttttttt

SEQ ID NO: 391668 - DNA, 20 bp, Artificial Sequence
  chemically synthesized
ttttttggttttttttaaga

SEQ ID NO: 391669 - DNA, 20 bp, Artificial Sequence
  chemically synthesized
tttttggttttttttaagat

SEQ ID NO: 391670 - DNA, 20 bp, Artificial Sequence
  chemically synthesized
ttttggttttttttaagata

SEQ ID NO: 391671 - DNA, 20 bp, Artificial Sequence
  chemically synthesized
taagatagggtcttgctctg

SEQ ID NO: 391672 - DNA, 20 bp, Artificial Sequence
  chemically synthesized
tccagcctgggctacagagc

SEQ ID NO: 391673 - DNA, 20 bp, Artificial Sequence
  chemically synthesized
tagggtcttgctctgtagcc

SEQ ID NO: 391674 - DNA, 20 bp, Artificial Sequence
  chemically synthesized
gcactccagcctgggctaca

SEQ ID NO: 391675 - DNA, 20 bp, Artificial Sequence
  chemically synthesized
agggtcttgctctgtagccc

SEQ ID NO: 391676 - DNA, 20 bp, Artificial Sequence
  chemically synthesized
tcgcactccagcctgggcta

SEQ ID NO: 391677 - DNA, 20 bp, Artificial Sequence
  chemically synthesized
tcttgctctgtagcccaggc

SEQ ID NO: 391678 - DNA, 20 bp, Artificial Sequence
  chemically synthesized
ttgctctgtagcccaggctg

SEQ ID NO: 391679 - DNA, 20 bp, Artificial Sequence
  chemically synthesized
gcaccatcgcactccagcct

SEQ ID NO: 391680 - DNA, 20 bp, Artificial Sequence
  chemically synthesized
tgcaccatcgcactccagcc

SEQ ID NO: 391681 - DNA, 20 bp, Artificial Sequence
  chemically synthesized
atcattgcaccatcgcactc

SEQ ID NO: 391682 - DNA, 20 bp, Artificial Sequence
  chemically synthesized
tagcccaggctggagtgcga

SEQ ID NO: 391683 - DNA, 20 bp, Artificial Sequence
  chemically synthesized
ggagtgcgatggtgcaatga

SEQ ID NO: 391684 - DNA, 20 bp, Artificial Sequence
  chemically synthesized
ggtgcaatgatggctcactg

SEQ ID NO: 391685 - DNA, 20 bp, Artificial Sequence
  chemically synthesized
cgggaggtcaaggctgcagt

SEQ ID NO: 391686 - DNA, 20 bp, Artificial Sequence
  chemically synthesized
agcccgggaggtcaaggctg

SEQ ID NO: 391687 - DNA, 20 bp, Artificial Sequence
  chemically synthesized
ctcttgagcccgggaggtca

SEQ ID NO: 391688 - DNA, 20 bp, Artificial Sequence
  chemically synthesized
tcactgcagccttgacctcc

SEQ ID NO: 391689 - DNA, 20 bp, Artificial Sequence
  chemically synthesized
tctcttgagcccgggaggtc

SEQ ID NO: 391690 - DNA, 20 bp, Artificial Sequence
  chemically synthesized
cactgcagccttgacctccc

SEQ ID NO: 391691 - DNA, 20 bp, Artificial Sequence
  chemically synthesized
gaggatctcttgagcccggg

SEQ ID NO: 391692 - DNA, 20 bp, Artificial Sequence
  chemically synthesized
ggaggatctcttgagcccgg

SEQ ID NO: 391693 - DNA, 20 bp, Artificial Sequence
  chemically synthesized
agccttgacctcccgggctc

SEQ ID NO: 391694 - DNA, 20 bp, Artificial Sequence
  chemically synthesized
taggaggatctcttgagccc

SEQ ID NO: 391695 - DNA, 20 bp, Artificial Sequence
  chemically synthesized
ccttgacctcccgggctcaa

SEQ ID NO: 391696 - DNA, 20 bp, Artificial Sequence
  chemically synthesized
gtaggaggatctcttgagcc

SEQ ID NO: 391697 - DNA, 20 bp, Artificial Sequence
  chemically synthesized
ctgaggtaggaggatctctt

SEQ ID NO: 391698 - DNA, 20 bp, Artificial Sequence
  chemically synthesized
ctcaagagatcctcctacct

SEQ ID NO: 391699 - DNA, 20 bp, Artificial Sequence
  chemically synthesized
acttgggaggctgaggtagg

SEQ ID NO: 391700 - DNA, 20 bp, Artificial Sequence
  chemically synthesized
tacttgggaggctgaggtag

SEQ ID NO: 391701 - DNA, 20 bp, Artificial Sequence
  chemically synthesized
gctacttgggaggctgaggt

SEQ ID NO: 391702 - DNA, 20 bp, Artificial Sequence
  chemically synthesized
agctacttgggaggctgagg

SEQ ID NO: 391703 - DNA, 20 bp, Artificial Sequence
  chemically synthesized
cccagctacttgggaggctg

SEQ ID NO: 391704 - DNA, 20 bp, Artificial Sequence
  chemically synthesized
tcccagctacttgggaggct

SEQ ID NO: 391705 - DNA, 20 bp, Artificial Sequence
  chemically synthesized
tcctcctacctcagcctccc

SEQ ID NO: 391706 - DNA, 20 bp, Artificial Sequence
  chemically synthesized
tcctacctcagcctcccaag

SEQ ID NO: 391707 - DNA, 20 bp, Artificial Sequence
  chemically synthesized
tgtattcccagctacttggg

SEQ ID NO: 391708 - DNA, 20 bp, Artificial Sequence
  chemically synthesized
ctgtattcccagctacttgg

SEQ ID NO: 391709 - DNA, 20 bp, Artificial Sequence
  chemically synthesized
acctcagcctcccaagtagc

SEQ ID NO: 391710 - DNA, 20 bp, Artificial Sequence
  chemically synthesized
gcctgtattcccagctactt

SEQ ID NO: 391711 - DNA, 20 bp, Artificial Sequence
  chemically synthesized
cctcagcctcccaagtagct

SEQ ID NO: 391712 - DNA, 20 bp, Artificial Sequence
  chemically synthesized
tgcctgtattcccagctact

SEQ ID NO: 391713 - DNA, 20 bp, Artificial Sequence
  chemically synthesized
ctcccaagtagctgggaata

SEQ ID NO: 391714 - DNA, 20 bp, Artificial Sequence
  chemically synthesized
tcccaagtagctgggaatac

SEQ ID NO: 391715 - DNA, 20 bp, Artificial Sequence
  chemically synthesized
gtggtgcatgcctgtattcc

SEQ ID NO: 391716 - DNA, 20 bp, Artificial Sequence
  chemically synthesized
caaaaattaacagagcgtcg

SEQ ID NO: 391717 - DNA, 20 bp, Artificial Sequence
  chemically synthesized
aaaaaatacaaaaattaaca

SEQ ID NO: 391718 - DNA, 20 bp, Artificial Sequence
  chemically synthesized
aaaaaaaatacaaaaattaa

SEQ ID NO: 391719 - DNA, 20 bp, Artificial Sequence
  chemically synthesized
taatttttgtatttttttta

SEQ ID NO: 391720 - DNA, 20 bp, Artificial Sequence
  chemically synthesized
atttttgtattttttttata

SEQ ID NO: 391721 - DNA, 20 bp, Artificial Sequence
  chemically synthesized
tttttgtattttttttatag

SEQ ID NO: 391722 - DNA, 20 bp, Artificial Sequence
  chemically synthesized
tgtattttttttatagaggt

SEQ ID NO: 391723 - DNA, 20 bp, Artificial Sequence
  chemically synthesized
gtattttttttatagaggtg

SEQ ID NO: 391724 - DNA, 20 bp, Artificial Sequence
  chemically synthesized
tgaggcaagccagggtaaca

SEQ ID NO: 391725 - DNA, 20 bp, Artificial Sequence
  chemically synthesized
gaggttttgccatgttaccc

SEQ ID NO: 391726 - DNA, 20 bp, Artificial Sequence
  chemically synthesized
caggagtttgaggcaagcca

SEQ ID NO: 391727 - DNA, 20 bp, Artificial Sequence
  chemically synthesized
tcaggagtttgaggcaagcc

SEQ ID NO: 391728 - DNA, 20 bp, Artificial Sequence
  chemically synthesized
ctcaggagtttgaggcaagc

SEQ ID NO: 391729 - DNA, 20 bp, Artificial Sequence
  chemically synthesized
tgagctcaggagtttgaggc

SEQ ID NO: 391730 - DNA, 20 bp, Artificial Sequence
  chemically synthesized
cacttgagctcaggagtttg

SEQ ID NO: 391731 - DNA, 20 bp, Artificial Sequence
  chemically synthesized
tcacttgagctcaggagttt

SEQ ID NO: 391732 - DNA, 20 bp, Artificial Sequence
  chemically synthesized
ctggcttgcctcaaactcct

SEQ ID NO: 391733 - DNA, 20 bp, Artificial Sequence
  chemically synthesized
ggcagatcacttgagctcag

SEQ ID NO: 391734 - DNA, 20 bp, Artificial Sequence
  chemically synthesized
tgcctcaaactcctgagctc

SEQ ID NO: 391735 - DNA, 20 bp, Artificial Sequence
  chemically synthesized
tgggcagatcacttgagctc

SEQ ID NO: 391736 - DNA, 20 bp, Artificial Sequence
  chemically synthesized
gtgggcagatcacttgagct

SEQ ID NO: 391737 - DNA, 20 bp, Artificial Sequence
  chemically synthesized
ccaaggtgggcagatcactt

SEQ ID NO: 391738 - DNA, 20 bp, Artificial Sequence
  chemically synthesized
ctcaagtgatctgcccacct

SEQ ID NO: 391739 - DNA, 20 bp, Artificial Sequence
  chemically synthesized
ctttaggaggccaaggtggg

SEQ ID NO: 391740 - DNA, 20 bp, Artificial Sequence
  chemically synthesized
gcactttaggaggccaaggt

SEQ ID NO: 391741 - DNA, 20 bp, Artificial Sequence
  chemically synthesized
agcactttaggaggccaagg

SEQ ID NO: 391742 - DNA, 20 bp, Artificial Sequence
  chemically synthesized
cccagcactttaggaggcca

SEQ ID NO: 391743 - DNA, 20 bp, Artificial Sequence
  chemically synthesized
tcccagcactttaggaggcc

SEQ ID NO: 391744 - DNA, 20 bp, Artificial Sequence
  chemically synthesized
ctgcccaccttggcctccta

SEQ ID NO: 391745 - DNA, 20 bp, Artificial Sequence
  chemically synthesized
tgtaatcccagcactttagg

SEQ ID NO: 391746 - DNA, 20 bp, Artificial Sequence
  chemically synthesized
ctgtaatcccagcactttag

SEQ ID NO: 391747 - DNA, 20 bp, Artificial Sequence
  chemically synthesized
accttggcctcctaaagtgc

SEQ ID NO: 391748 - DNA, 20 bp, Artificial Sequence
  chemically synthesized
gcctgtaatcccagcacttt

SEQ ID NO: 391749 - DNA, 20 bp, Artificial Sequence
  chemically synthesized
ccttggcctcctaaagtgct

SEQ ID NO: 391750 - DNA, 20 bp, Artificial Sequence
  chemically synthesized
tgcctgtaatcccagcactt

SEQ ID NO: 391751 - DNA, 20 bp, Artificial Sequence
  chemically synthesized
ctcctaaagtgctgggatta

SEQ ID NO: 391752 - DNA, 20 bp, Artificial Sequence
  chemically synthesized
tcctaaagtgctgggattac

SEQ ID NO: 391753 - DNA, 20 bp, Artificial Sequence
  chemically synthesized
gtggctcatgcctgtaatcc

SEQ ID NO: 391754 - DNA, 20 bp, Artificial Sequence
  chemically synthesized
agtgctgggattacaggcat

SEQ ID NO: 391755 - DNA, 20 bp, Artificial Sequence
  chemically synthesized
caggcatgagccactgtgcc

SEQ ID NO: 391756 - DNA, 20 bp, Artificial Sequence
  chemically synthesized
tttttttaggctgggcacag

SEQ ID NO: 391757 - DNA, 20 bp, Artificial Sequence
  chemically synthesized
caatttttttaggctgggca

SEQ ID NO: 391758 - DNA, 20 bp, Artificial Sequence
  chemically synthesized
aataacaatttttttaggct

SEQ ID NO: 391759 - DNA, 20 bp, Artificial Sequence
  chemically synthesized
caataacaatttttttaggc

SEQ ID NO: 391760 - DNA, 20 bp, Artificial Sequence
  chemically synthesized
acatcaataacaattttttt

SEQ ID NO: 391761 - DNA, 20 bp, Artificial Sequence
  chemically synthesized
gacatcaataacaatttttt

SEQ ID NO: 391762 - DNA, 20 bp, Artificial Sequence
  chemically synthesized
ttttcctcctgagcagtttt

SEQ ID NO: 391763 - DNA, 20 bp, Artificial Sequence
  chemically synthesized
tgatgtcactaaaaactgct

SEQ ID NO: 391764 - DNA, 20 bp, Artificial Sequence
  chemically synthesized
gatgtcactaaaaactgctc

SEQ ID NO: 391765 - DNA, 20 bp, Artificial Sequence
  chemically synthesized
tgtcactaaaaactgctcag

SEQ ID NO: 391766 - DNA, 20 bp, Artificial Sequence
  chemically synthesized
gtcactaaaaactgctcagg

SEQ ID NO: 391767 - DNA, 20 bp, Artificial Sequence
  chemically synthesized
ctacttattttcctcctgag

SEQ ID NO: 391768 - DNA, 20 bp, Artificial Sequence
  chemically synthesized
gacctacttattttcctcct

SEQ ID NO: 391769 - DNA, 20 bp, Artificial Sequence
  chemically synthesized
aaactgctcaggaggaaaat

SEQ ID NO: 391770 - DNA, 20 bp, Artificial Sequence
  chemically synthesized
ctgctcaggaggaaaataag

SEQ ID NO: 391771 - DNA, 20 bp, Artificial Sequence
  chemically synthesized
tgctcaggaggaaaataagt

SEQ ID NO: 391772 - DNA, 20 bp, Artificial Sequence
  chemically synthesized
aaatattgtttcatcacaat

SEQ ID NO: 391773 - DNA, 20 bp, Artificial Sequence
  chemically synthesized
tttttatttaaaaacaaaac

SEQ ID NO: 391774 - DNA, 20 bp, Artificial Sequence
  chemically synthesized
ttttatttaaaaacaaaact

SEQ ID NO: 391775 - DNA, 20 bp, Artificial Sequence
  chemically synthesized
tttatttaaaaacaaaactg

SEQ ID NO: 391776 - DNA, 20 bp, Artificial Sequence
  chemically synthesized
attactgaataaaatagccc

SEQ ID NO: 391777 - DNA, 20 bp, Artificial Sequence
  chemically synthesized
aaaactggggctattttatt

SEQ ID NO: 391778 - DNA, 20 bp, Artificial Sequence
  chemically synthesized
tggcatattactgaataaaa

SEQ ID NO: 391779 - DNA, 20 bp, Artificial Sequence
  chemically synthesized
tattttattcagtaatatgc

SEQ ID NO: 391780 - DNA, 20 bp, Artificial Sequence
  chemically synthesized
aactcttgctatgtgaatac

SEQ ID NO: 391781 - DNA, 20 bp, Artificial Sequence
  chemically synthesized
gtaatatgccagtattcaca

SEQ ID NO: 391782 - DNA, 20 bp, Artificial Sequence
  chemically synthesized
tatgccagtattcacatagc

SEQ ID NO: 391783 - DNA, 20 bp, Artificial Sequence
  chemically synthesized
tgccagtattcacatagcaa

SEQ ID NO: 391784 - DNA, 20 bp, Artificial Sequence
  chemically synthesized
attcacatagcaagagtttt

SEQ ID NO: 391785 - DNA, 20 bp, Artificial Sequence
  chemically synthesized
catagcaagagttttgagca

SEQ ID NO: 391786 - DNA, 20 bp, Artificial Sequence
  chemically synthesized
atagcaagagttttgagcat

SEQ ID NO: 391787 - DNA, 20 bp, Artificial Sequence
  chemically synthesized
agagttttgagcataggctt

SEQ ID NO: 391788 - DNA, 20 bp, Artificial Sequence
  chemically synthesized
agttttgagcataggctttg

SEQ ID NO: 391789 - DNA, 20 bp, Artificial Sequence
  chemically synthesized
acctagatgctcaggctcca

SEQ ID NO: 391790 - DNA, 20 bp, Artificial Sequence
  chemically synthesized
gagcataggctttggagcct

SEQ ID NO: 391791 - DNA, 20 bp, Artificial Sequence
  chemically synthesized
ggctttggagcctgagcatc

SEQ ID NO: 391792 - DNA, 20 bp, Artificial Sequence
  chemically synthesized
ggatttgaacctagatgctc

SEQ ID NO: 391793 - DNA, 20 bp, Artificial Sequence
  chemically synthesized
gctttggagcctgagcatct

SEQ ID NO: 391794 - DNA, 20 bp, Artificial Sequence
  chemically synthesized
aggatttgaacctagatgct

SEQ ID NO: 391795 - DNA, 20 bp, Artificial Sequence
  chemically synthesized
ttaaagtcaggatttgaacc

SEQ ID NO: 391796 - DNA, 20 bp, Artificial Sequence
  chemically synthesized
cactaataaatgttaaagtc

SEQ ID NO: 391797 - DNA, 20 bp, Artificial Sequence
  chemically synthesized
ccactaataaatgttaaagt

SEQ ID NO: 391798 - DNA, 20 bp, Artificial Sequence
  chemically synthesized
cgtcccactaataaatgtta

SEQ ID NO: 391799 - DNA, 20 bp, Artificial Sequence
  chemically synthesized
atcctgactttaacatttat

SEQ ID NO: 391800 - DNA, 20 bp, Artificial Sequence
  chemically synthesized
ctgactttaacatttattag

SEQ ID NO: 391801 - DNA, 20 bp, Artificial Sequence
  chemically synthesized
tgactttaacatttattagt

SEQ ID NO: 391802 - DNA, 20 bp, Artificial Sequence
  chemically synthesized
aacatttattagtgggacga

SEQ ID NO: 391803 - DNA, 20 bp, Artificial Sequence
  chemically synthesized
acatttattagtgggacgat

SEQ ID NO: 391804 - DNA, 20 bp, Artificial Sequence
  chemically synthesized
ttattagtgggacgatgggt

SEQ ID NO: 391805 - DNA, 20 bp, Artificial Sequence
  chemically synthesized
gggacgatgggtaagttcat

SEQ ID NO: 391806 - DNA, 20 bp, Artificial Sequence
  chemically synthesized
tcattagcatctccgtactt

SEQ ID NO: 391807 - DNA, 20 bp, Artificial Sequence
  chemically synthesized
tggaaagaaactaaagtacg

SEQ ID NO: 391808 - DNA, 20 bp, Artificial Sequence
  chemically synthesized
tatggaaagaaactaaagta

SEQ ID NO: 391809 - DNA, 20 bp, Artificial Sequence
  chemically synthesized
taacatatggaaagaaacta

SEQ ID NO: 391810 - DNA, 20 bp, Artificial Sequence
  chemically synthesized
atccatatttaacatatgga

SEQ ID NO: 391811 - DNA, 20 bp, Artificial Sequence
  chemically synthesized
tattatccatatttaacata

SEQ ID NO: 391812 - DNA, 20 bp, Artificial Sequence
  chemically synthesized
ttctttccatatgttaaata

SEQ ID NO: 391813 - DNA, 20 bp, Artificial Sequence
  chemically synthesized
atgttaaatatggataataa

SEQ ID NO: 391814 - DNA, 20 bp, Artificial Sequence
  chemically synthesized
taataatggtgtctaattca

SEQ ID NO: 391815 - DNA, 20 bp, Artificial Sequence
  chemically synthesized
aataatggtgtctaattcat

SEQ ID NO: 391816 - DNA, 20 bp, Artificial Sequence
  chemically synthesized
ctcataagaatcctatgaat

SEQ ID NO: 391817 - DNA, 20 bp, Artificial Sequence
  chemically synthesized
ctaattcataggattcttat

SEQ ID NO: 391818 - DNA, 20 bp, Artificial Sequence
  chemically synthesized
atcaggcattaaattctcat

SEQ ID NO: 391819 - DNA, 20 bp, Artificial Sequence
  chemically synthesized
agaatttaatgcctgattat

SEQ ID NO: 391820 - DNA, 20 bp, Artificial Sequence
  chemically synthesized
tcctaacctcacttataatc

SEQ ID NO: 391821 - DNA, 20 bp, Artificial Sequence
  chemically synthesized
atcctaacctcacttataat

SEQ ID NO: 391822 - DNA, 20 bp, Artificial Sequence
  chemically synthesized
tttaatgcctgattataagt

SEQ ID NO: 391823 - DNA, 20 bp, Artificial Sequence
  chemically synthesized
ttaatgcctgattataagtg

SEQ ID NO: 391824 - DNA, 20 bp, Artificial Sequence
  chemically synthesized
tgcctgattataagtgaggt

SEQ ID NO: 391825 - DNA, 20 bp, Artificial Sequence
  chemically synthesized
gcctgattataagtgaggtt

SEQ ID NO: 391826 - DNA, 20 bp, Artificial Sequence
  chemically synthesized
gattataagtgaggttagga

SEQ ID NO: 391827 - DNA, 20 bp, Artificial Sequence
  chemically synthesized
gttaggatggtaccttgaca

SEQ ID NO: 391828 - DNA, 20 bp, Artificial Sequence
  chemically synthesized
ataaaacagctactatgtca

SEQ ID NO: 391829 - DNA, 20 bp, Artificial Sequence
  chemically synthesized
aggatggtaccttgacatag

SEQ ID NO: 391830 - DNA, 20 bp, Artificial Sequence
  chemically synthesized
gataaaacagctactatgtc

SEQ ID NO: 391831 - DNA, 20 bp, Artificial Sequence
  chemically synthesized
aatccagaacaatgataaaa

SEQ ID NO: 391832 - DNA, 20 bp, Artificial Sequence
  chemically synthesized
tagctgttttatcattgttc

SEQ ID NO: 391833 - DNA, 20 bp, Artificial Sequence
  chemically synthesized
agataataaatataataatc

SEQ ID NO: 391834 - DNA, 20 bp, Artificial Sequence
  chemically synthesized
tatggtatataaaataggca

SEQ ID NO: 391835 - DNA, 20 bp, Artificial Sequence
  chemically synthesized
gcatgtatggtatataaaat

SEQ ID NO: 391836 - DNA, 20 bp, Artificial Sequence
  chemically synthesized
ggcatgtatggtatataaaa

SEQ ID NO: 391837 - DNA, 20 bp, Artificial Sequence
  chemically synthesized
actttatttacaggcatgta

SEQ ID NO: 391838 - DNA, 20 bp, Artificial Sequence
  chemically synthesized
accatacatgcctgtaaata

SEQ ID NO: 391839 - DNA, 20 bp, Artificial Sequence
  chemically synthesized
cctagacaaactttatttac

SEQ ID NO: 391840 - DNA, 20 bp, Artificial Sequence
  chemically synthesized
tcctagacaaactttattta

SEQ ID NO: 391841 - DNA, 20 bp, Artificial Sequence
  chemically synthesized
gcctgtaaataaagtttgtc

SEQ ID NO: 391842 - DNA, 20 bp, Artificial Sequence
  chemically synthesized
cctgtaaataaagtttgtct

SEQ ID NO: 391843 - DNA, 20 bp, Artificial Sequence
  chemically synthesized
tctggtcttccatggcatcc

SEQ ID NO: 391844 - DNA, 20 bp, Artificial Sequence
  chemically synthesized
aaagtttgtctaggatgcca

SEQ ID NO: 391845 - DNA, 20 bp, Artificial Sequence
  chemically synthesized
gtttgtctaggatgccatgg

SEQ ID NO: 391846 - DNA, 20 bp, Artificial Sequence
  chemically synthesized
tggtgaactctggtcttcca

SEQ ID NO: 391847 - DNA, 20 bp, Artificial Sequence
  chemically synthesized
tctaggatgccatggaagac

SEQ ID NO: 391848 - DNA, 20 bp, Artificial Sequence
  chemically synthesized
taggatgccatggaagacca

SEQ ID NO: 391849 - DNA, 20 bp, Artificial Sequence
  chemically synthesized
tccacaaaggtggtgaactc

SEQ ID NO: 391850 - DNA, 20 bp, Artificial Sequence
  chemically synthesized
accagagttcaccacctttg

SEQ ID NO: 391851 - DNA, 20 bp, Artificial Sequence
  chemically synthesized
ctatcaaatctccacaaagg

SEQ ID NO: 391852 - DNA, 20 bp, Artificial Sequence
  chemically synthesized
cagagttcaccacctttgtg

SEQ ID NO: 391853 - DNA, 20 bp, Artificial Sequence
  chemically synthesized
atcctatcaaatctccacaa

SEQ ID NO: 391854 - DNA, 20 bp, Artificial Sequence
  chemically synthesized
aatcctatcaaatctccaca

SEQ ID NO: 391855 - DNA, 20 bp, Artificial Sequence
  chemically synthesized
ccacctttgtggagatttga

SEQ ID NO: 391856 - DNA, 20 bp, Artificial Sequence
  chemically synthesized
cacctttgtggagatttgat

SEQ ID NO: 391857 - DNA, 20 bp, Artificial Sequence
  chemically synthesized
tttgataggattttcaccat

SEQ ID NO: 391858 - DNA, 20 bp, Artificial Sequence
  chemically synthesized
atatagctcttattatctaa

SEQ ID NO: 391859 - DNA, 20 bp, Artificial Sequence
  chemically synthesized
gattttcaccattagataat

SEQ ID NO: 391860 - DNA, 20 bp, Artificial Sequence
  chemically synthesized
ttttcaccattagataataa

SEQ ID NO: 391861 - DNA, 20 bp, Artificial Sequence
  chemically synthesized
aagaggaaacatacattata

SEQ ID NO: 391862 - DNA, 20 bp, Artificial Sequence
  chemically synthesized
tataatgtatgtttcctctt

SEQ ID NO: 391863 - DNA, 20 bp, Artificial Sequence
  chemically synthesized
catgggagcccagactaaag

SEQ ID NO: 391864 - DNA, 20 bp, Artificial Sequence
  chemically synthesized
tgtatgtttcctctttagtc

SEQ ID NO: 391865 - DNA, 20 bp, Artificial Sequence
  chemically synthesized
tcatgggagcccagactaaa

SEQ ID NO: 391866 - DNA, 20 bp, Artificial Sequence
  chemically synthesized
gtatgtttcctctttagtct

SEQ ID NO: 391867 - DNA, 20 bp, Artificial Sequence
  chemically synthesized
aatcatgggagcccagacta

SEQ ID NO: 391868 - DNA, 20 bp, Artificial Sequence
  chemically synthesized
caccaagaatcatgggagcc

SEQ ID NO: 391869 - DNA, 20 bp, Artificial Sequence
  chemically synthesized
tttggcaccaagaatcatgg

SEQ ID NO: 391870 - DNA, 20 bp, Artificial Sequence
  chemically synthesized
cgtttggcaccaagaatcat

SEQ ID NO: 391871 - DNA, 20 bp, Artificial Sequence
  chemically synthesized
gtctgggctcccatgattct

SEQ ID NO: 391872 - DNA, 20 bp, Artificial Sequence
  chemically synthesized
acgtttggcaccaagaatca

SEQ ID NO: 391873 - DNA, 20 bp, Artificial Sequence
  chemically synthesized
aaaccaaaacgtttggcacc

SEQ ID NO: 391874 - DNA, 20 bp, Artificial Sequence
  chemically synthesized
attcttggtgccaaacgttt

SEQ ID NO: 391875 - DNA, 20 bp, Artificial Sequence
  chemically synthesized
tgaatttaaaccaaaacgtt

SEQ ID NO: 391876 - DNA, 20 bp, Artificial Sequence
  chemically synthesized
caaacgttttggtttaaatt

SEQ ID NO: 391877 - DNA, 20 bp, Artificial Sequence
  chemically synthesized
taaattcagtaactccaatt

SEQ ID NO: 391878 - DNA, 20 bp, Artificial Sequence
  chemically synthesized
acagaaatatggctcaattg

SEQ ID NO: 391879 - DNA, 20 bp, Artificial Sequence
  chemically synthesized
tgacagaaatatggctcaat

SEQ ID NO: 391880 - DNA, 20 bp, Artificial Sequence
  chemically synthesized
ggaagaatttgacagaaata

SEQ ID NO: 391881 - DNA, 20 bp, Artificial Sequence
  chemically synthesized
tgacatttggaagaatttga

SEQ ID NO: 391882 - DNA, 20 bp, Artificial Sequence
  chemically synthesized
cacatatagttgacatttgg

SEQ ID NO: 391883 - DNA, 20 bp, Artificial Sequence
  chemically synthesized
agccacatatagttgacatt

SEQ ID NO: 391884 - DNA, 20 bp, Artificial Sequence
  chemically synthesized
ttccaaatgtcaactatatg

SEQ ID NO: 391885 - DNA, 20 bp, Artificial Sequence
  chemically synthesized
aattgactagaagccacata

SEQ ID NO: 391886 - DNA, 20 bp, Artificial Sequence
  chemically synthesized
tgtcaactatatgtggcttc

SEQ ID NO: 391887 - DNA, 20 bp, Artificial Sequence
  chemically synthesized
aacaaggtcaaattgactag

SEQ ID NO: 391888 - DNA, 20 bp, Artificial Sequence
  chemically synthesized
taaaacaaggtcaaattgac

SEQ ID NO: 391889 - DNA, 20 bp, Artificial Sequence
  chemically synthesized
aaatcagaatcagtaaaaca

SEQ ID NO: 391890 - DNA, 20 bp, Artificial Sequence
  chemically synthesized
taaatcagaatcagtaaaac

SEQ ID NO: 391891 - DNA, 20 bp, Artificial Sequence
  chemically synthesized
tcttgccactaaatcagaat

SEQ ID NO: 391892 - DNA, 20 bp, Artificial Sequence
  chemically synthesized
ttgttttactgattctgatt

SEQ ID NO: 391893 - DNA, 20 bp, Artificial Sequence
  chemically synthesized
ttttactgattctgatttag

SEQ ID NO: 391894 - DNA, 20 bp, Artificial Sequence
  chemically synthesized
ctaccatcttgccactaaat

SEQ ID NO: 391895 - DNA, 20 bp, Artificial Sequence
  chemically synthesized
actgattctgatttagtggc

SEQ ID NO: 391896 - DNA, 20 bp, Artificial Sequence
  chemically synthesized
attctgatttagtggcaaga

SEQ ID NO: 391897 - DNA, 20 bp, Artificial Sequence
  chemically synthesized
ctgatttagtggcaagatgg

SEQ ID NO: 391898 - DNA, 20 bp, Artificial Sequence
  chemically synthesized
aagatggtagatgaatgcaa

SEQ ID NO: 391899 - DNA, 20 bp, Artificial Sequence
  chemically synthesized
atgattaaatttaaaatcac

SEQ ID NO: 391900 - DNA, 20 bp, Artificial Sequence
  chemically synthesized
atttgtaattatatactttt

SEQ ID NO: 391901 - DNA, 20 bp, Artificial Sequence
  chemically synthesized
ggtgaagctttacgtcttaa

SEQ ID NO: 391902 - DNA, 20 bp, Artificial Sequence
  chemically synthesized
ttatatacttttaagacgta

SEQ ID NO: 391903 - DNA, 20 bp, Artificial Sequence
  chemically synthesized
ggcatgttttatgacaggtg

SEQ ID NO: 391904 - DNA, 20 bp, Artificial Sequence
  chemically synthesized
taaagggcatgttttatgac

SEQ ID NO: 391905 - DNA, 20 bp, Artificial Sequence
  chemically synthesized
ataaagggcatgttttatga

SEQ ID NO: 391906 - DNA, 20 bp, Artificial Sequence
  chemically synthesized
gtcataaaacatgcccttta

SEQ ID NO: 391907 - DNA, 20 bp, Artificial Sequence
  chemically synthesized
taaaaccattgtgccataaa

SEQ ID NO: 391908 - DNA, 20 bp, Artificial Sequence
  chemically synthesized
ttaaaaccattgtgccataa

SEQ ID NO: 391909 - DNA, 20 bp, Artificial Sequence
  chemically synthesized
tttaaaaccattgtgccata

SEQ ID NO: 391910 - DNA, 20 bp, Artificial Sequence
  chemically synthesized
acatgccctttatggcacaa

SEQ ID NO: 391911 - DNA, 20 bp, Artificial Sequence
  chemically synthesized
ggcacaatggttttaaaata

SEQ ID NO: 391912 - DNA, 20 bp, Artificial Sequence
  chemically synthesized
tccatttgccaatgagtttt

SEQ ID NO: 391913 - DNA, 20 bp, Artificial Sequence
  chemically synthesized
ttccatttgccaatgagttt

SEQ ID NO: 391914 - DNA, 20 bp, Artificial Sequence
  chemically synthesized
aatatggtcccaaaactcat

SEQ ID NO: 391915 - DNA, 20 bp, Artificial Sequence
  chemically synthesized
ctacctttccatttgccaat

SEQ ID NO: 391916 - DNA, 20 bp, Artificial Sequence
  chemically synthesized
tcccaaaactcattggcaaa

SEQ ID NO: 391917 - DNA, 20 bp, Artificial Sequence
  chemically synthesized
aaaactcattggcaaatgga

SEQ ID NO: 391918 - DNA, 20 bp, Artificial Sequence
  chemically synthesized
aaactcattggcaaatggaa

SEQ ID NO: 391919 - DNA, 20 bp, Artificial Sequence
  chemically synthesized
ctcattggcaaatggaaagg

SEQ ID NO: 391920 - DNA, 20 bp, Artificial Sequence
  chemically synthesized
tcattggcaaatggaaaggt

SEQ ID NO: 391921 - DNA, 20 bp, Artificial Sequence
  chemically synthesized
cattggcaaatggaaaggta

SEQ ID NO: 391922 - DNA, 20 bp, Artificial Sequence
  chemically synthesized
agattgaagaggaaaggaca

SEQ ID NO: 391923 - DNA, 20 bp, Artificial Sequence
  chemically synthesized
tcacccagattgaagaggaa

SEQ ID NO: 391924 - DNA, 20 bp, Artificial Sequence
  chemically synthesized
ctcacccagattgaagagga

SEQ ID NO: 391925 - DNA, 20 bp, Artificial Sequence
  chemically synthesized
caaactcacccagattgaag

SEQ ID NO: 391926 - DNA, 20 bp, Artificial Sequence
  chemically synthesized
atgtcctttcctcttcaatc

SEQ ID NO: 391927 - DNA, 20 bp, Artificial Sequence
  chemically synthesized
acaaactcacccagattgaa

SEQ ID NO: 391928 - DNA, 20 bp, Artificial Sequence
  chemically synthesized
tgtcctttcctcttcaatct

SEQ ID NO: 391929 - DNA, 20 bp, Artificial Sequence
  chemically synthesized
ttacaaactcacccagattg

SEQ ID NO: 391930 - DNA, 20 bp, Artificial Sequence
  chemically synthesized
ctttcctcttcaatctgggt

SEQ ID NO: 391931 - DNA, 20 bp, Artificial Sequence
  chemically synthesized
gaagtagttacaaactcacc

SEQ ID NO: 391932 - DNA, 20 bp, Artificial Sequence
  chemically synthesized
tgagtttgtaactacttcaa

SEQ ID NO: 391933 - DNA, 20 bp, Artificial Sequence
  chemically synthesized
ccatcctctatctgttgaag

SEQ ID NO: 391934 - DNA, 20 bp, Artificial Sequence
  chemically synthesized
tttgtaactacttcaacaga

SEQ ID NO: 391935 - DNA, 20 bp, Artificial Sequence
  chemically synthesized
ttgccatcctctatctgttg

SEQ ID NO: 391936 - DNA, 20 bp, Artificial Sequence
  chemically synthesized
tgtaactacttcaacagata

SEQ ID NO: 391937 - DNA, 20 bp, Artificial Sequence
  chemically synthesized
gtaactacttcaacagatag

SEQ ID NO: 391938 - DNA, 20 bp, Artificial Sequence
  chemically synthesized
ctacttcaacagatagagga

SEQ ID NO: 391939 - DNA, 20 bp, Artificial Sequence
  chemically synthesized
ttcaacagatagaggatggc

SEQ ID NO: 391940 - DNA, 20 bp, Artificial Sequence
  chemically synthesized
caacagatagaggatggcaa

SEQ ID NO: 391941 - DNA, 20 bp, Artificial Sequence
  chemically synthesized
gtaatgttttgtgccctcca

SEQ ID NO: 391942 - DNA, 20 bp, Artificial Sequence
  chemically synthesized
atgttttgtgccctccatgg

SEQ ID NO: 391943 - DNA, 20 bp, Artificial Sequence
  chemically synthesized
ttttatgaccctgccatgga

SEQ ID NO: 391944 - DNA, 20 bp, Artificial Sequence
  chemically synthesized
tgttttgtgccctccatggc

SEQ ID NO: 391945 - DNA, 20 bp, Artificial Sequence
  chemically synthesized
cttttatgaccctgccatgg

SEQ ID NO: 391946 - DNA, 20 bp, Artificial Sequence
  chemically synthesized
gttttgtgccctccatggca

SEQ ID NO: 391947 - DNA, 20 bp, Artificial Sequence
  chemically synthesized
tcttttatgaccctgccatg

SEQ ID NO: 391948 - DNA, 20 bp, Artificial Sequence
  chemically synthesized
ggtcttttatgaccctgcca

SEQ ID NO: 391949 - DNA, 20 bp, Artificial Sequence
  chemically synthesized
cctccatggcagggtcataa

SEQ ID NO: 391950 - DNA, 20 bp, Artificial Sequence
  chemically synthesized
caaacaaggtagtagtcata

SEQ ID NO: 391951 - DNA, 20 bp, Artificial Sequence
  chemically synthesized
tgttctagcaaacaaggtag

SEQ ID NO: 391952 - DNA, 20 bp, Artificial Sequence
  chemically synthesized
cgctgttctagcaaacaagg

SEQ ID NO: 391953 - DNA, 20 bp, Artificial Sequence
  chemically synthesized
atgactactaccttgtttgc

SEQ ID NO: 391954 - DNA, 20 bp, Artificial Sequence
  chemically synthesized
aaacgctgttctagcaaaca

SEQ ID NO: 391955 - DNA, 20 bp, Artificial Sequence
  chemically synthesized
caaacgctgttctagcaaac

SEQ ID NO: 391956 - DNA, 20 bp, Artificial Sequence
  chemically synthesized
tactaccttgtttgctagaa

SEQ ID NO: 391957 - DNA, 20 bp, Artificial Sequence
  chemically synthesized
gttccaagcaaacgctgttc

SEQ ID NO: 391958 - DNA, 20 bp, Artificial Sequence
  chemically synthesized
ttgctagaacagcgtttgct

SEQ ID NO: 391959 - DNA, 20 bp, Artificial Sequence
  chemically synthesized
ctatggtaactcagggttcc

SEQ ID NO: 391960 - DNA, 20 bp, Artificial Sequence
  chemically synthesized
cagcgtttgcttggaaccct

SEQ ID NO: 391961 - DNA, 20 bp, Artificial Sequence
  chemically synthesized
acattttctatggtaactca

SEQ ID NO: 391962 - DNA, 20 bp, Artificial Sequence
  chemically synthesized
cacattttctatggtaactc

SEQ ID NO: 391963 - DNA, 20 bp, Artificial Sequence
  chemically synthesized
acacattttctatggtaact

SEQ ID NO: 391964 - DNA, 20 bp, Artificial Sequence
  chemically synthesized
cttggaaccctgagttacca

SEQ ID NO: 391965 - DNA, 20 bp, Artificial Sequence
  chemically synthesized
cgatactcacacattttcta

SEQ ID NO: 391966 - DNA, 20 bp, Artificial Sequence
  chemically synthesized
agttaccatagaaaatgtgt

SEQ ID NO: 391967 - DNA, 20 bp, Artificial Sequence
  chemically synthesized
gaaaatgtgtgagtatcgta

SEQ ID NO: 391968 - DNA, 20 bp, Artificial Sequence
  chemically synthesized
gtatcgtaaagccaccatgc

SEQ ID NO: 391969 - DNA, 20 bp, Artificial Sequence
  chemically synthesized
tatcgtaaagccaccatgct

SEQ ID NO: 391970 - DNA, 20 bp, Artificial Sequence
  chemically synthesized
ttggcttcttcctagcatgg

SEQ ID NO: 391971 - DNA, 20 bp, Artificial Sequence
  chemically synthesized
cgtaaagccaccatgctagg

SEQ ID NO: 391972 - DNA, 20 bp, Artificial Sequence
  chemically synthesized
tgtttggcttcttcctagca

SEQ ID NO: 391973 - DNA, 20 bp, Artificial Sequence
  chemically synthesized
aaagccaccatgctaggaag

SEQ ID NO: 391974 - DNA, 20 bp, Artificial Sequence
  chemically synthesized
tatgttgtttggcttcttcc

SEQ ID NO: 391975 - DNA, 20 bp, Artificial Sequence
  chemically synthesized
taggaagaagccaaacaaca

SEQ ID NO: 391976 - DNA, 20 bp, Artificial Sequence
  chemically synthesized
tgtgaacttgctatgttgtt

SEQ ID NO: 391977 - DNA, 20 bp, Artificial Sequence
  chemically synthesized
aagaagccaaacaacatagc

SEQ ID NO: 391978 - DNA, 20 bp, Artificial Sequence
  chemically synthesized
caacatagcaagttcacatg

SEQ ID NO: 391979 - DNA, 20 bp, Artificial Sequence
  chemically synthesized
aacatagcaagttcacatgt

SEQ ID NO: 391980 - DNA, 20 bp, Artificial Sequence
  chemically synthesized
caagttcacatgtaggcctt

SEQ ID NO: 391981 - DNA, 20 bp, Artificial Sequence
  chemically synthesized
gctggagggtggaattctga

SEQ ID NO: 391982 - DNA, 20 bp, Artificial Sequence
  chemically synthesized
ggctggagggtggaattctg

SEQ ID NO: 391983 - DNA, 20 bp, Artificial Sequence
  chemically synthesized
gccttcagaattccaccctc

SEQ ID NO: 391984 - DNA, 20 bp, Artificial Sequence
  chemically synthesized
tggactcaatggctggaggg

SEQ ID NO: 391985 - DNA, 20 bp, Artificial Sequence
  chemically synthesized
agttggactcaatggctgga

SEQ ID NO: 391986 - DNA, 20 bp, Artificial Sequence
  chemically synthesized
aagttggactcaatggctgg

SEQ ID NO: 391987 - DNA, 20 bp, Artificial Sequence
  chemically synthesized
taagttggactcaatggctg

SEQ ID NO: 391988 - DNA, 20 bp, Artificial Sequence
  chemically synthesized
aattccaccctccagccatt

SEQ ID NO: 391989 - DNA, 20 bp, Artificial Sequence
  chemically synthesized
gctaagttggactcaatggc

SEQ ID NO: 391990 - DNA, 20 bp, Artificial Sequence
  chemically synthesized
gaaagctaagttggactcaa

SEQ ID NO: 391991 - DNA, 20 bp, Artificial Sequence
  chemically synthesized
tccagccattgagtccaact

SEQ ID NO: 391992 - DNA, 20 bp, Artificial Sequence
  chemically synthesized
tcaagacttgaaagctaagt

SEQ ID NO: 391993 - DNA, 20 bp, Artificial Sequence
  chemically synthesized
ttgagtccaacttagctttc

SEQ ID NO: 391994 - DNA, 20 bp, Artificial Sequence
  chemically synthesized
tctgtcaagacttgaaagct

SEQ ID NO: 391995 - DNA, 20 bp, Artificial Sequence
  chemically synthesized
cctcatctgtcaagacttga

SEQ ID NO: 391996 - DNA, 20 bp, Artificial Sequence
  chemically synthesized
acttagctttcaagtcttga

SEQ ID NO: 391997 - DNA, 20 bp, Artificial Sequence
  chemically synthesized
gctttcaagtcttgacagat

SEQ ID NO: 391998 - DNA, 20 bp, Artificial Sequence
  chemically synthesized
tatctatagcctcatctgtc

SEQ ID NO: 391999 - DNA, 20 bp, Artificial Sequence
  chemically synthesized
ctttcaagtcttgacagatg

SEQ ID NO: 392000 - DNA, 20 bp, Artificial Sequence
  chemically synthesized
agtcttgacagatgaggcta

SEQ ID NO: 392001 - DNA, 20 bp, Artificial Sequence
  chemically synthesized
tttatgctctgcaatatcta

SEQ ID NO: 392002 - DNA, 20 bp, Artificial Sequence
  chemically synthesized
agatgaggctatagatattg

SEQ ID NO: 392003 - DNA, 20 bp, Artificial Sequence
  chemically synthesized
atgaggctatagatattgca

SEQ ID NO: 392004 - DNA, 20 bp, Artificial Sequence
  chemically synthesized
tagatattgcagagcataaa

SEQ ID NO: 392005 - DNA, 20 bp, Artificial Sequence
  chemically synthesized
aattcagataggacacagca

SEQ ID NO: 392006 - DNA, 20 bp, Artificial Sequence
  chemically synthesized
aaattcagataggacacagc

SEQ ID NO: 392007 - DNA, 20 bp, Artificial Sequence
  chemically synthesized
taaattcagataggacacag

SEQ ID NO: 392008 - DNA, 20 bp, Artificial Sequence
  chemically synthesized
taataaattcagataggaca

SEQ ID NO: 392009 - DNA, 20 bp, Artificial Sequence
  chemically synthesized
tgtgagtaataaattcagat

SEQ ID NO: 392010 - DNA, 20 bp, Artificial Sequence
  chemically synthesized
ctgtgagtaataaattcaga

SEQ ID NO: 392011 - DNA, 20 bp, Artificial Sequence
  chemically synthesized
gatgctgtgagtaataaatt

SEQ ID NO: 392012 - DNA, 20 bp, Artificial Sequence
  chemically synthesized
ctatctgaatttattactca

SEQ ID NO: 392013 - DNA, 20 bp, Artificial Sequence
  chemically synthesized
tattatgccgtggatgctgt

SEQ ID NO: 392014 - DNA, 20 bp, Artificial Sequence
  chemically synthesized
tttattactcacagcatcca

SEQ ID NO: 392015 - DNA, 20 bp, Artificial Sequence
  chemically synthesized
acaattactttattatgccg

SEQ ID NO: 392016 - DNA, 20 bp, Artificial Sequence
  chemically synthesized
acagcatccacggcataata

SEQ ID NO: 392017 - DNA, 20 bp, Artificial Sequence
  chemically synthesized
agtaattgttttaaactgct

SEQ ID NO: 392018 - DNA, 20 bp, Artificial Sequence
  chemically synthesized
aaaatcaccctgatacttag

SEQ ID NO: 392019 - DNA, 20 bp, Artificial Sequence
  chemically synthesized
tgttttaaactgctaagtat

SEQ ID NO: 392020 - DNA, 20 bp, Artificial Sequence
  chemically synthesized
gttttaaactgctaagtatc

SEQ ID NO: 392021 - DNA, 20 bp, Artificial Sequence
  chemically synthesized
ttttaaactgctaagtatca

SEQ ID NO: 392022 - DNA, 20 bp, Artificial Sequence
  chemically synthesized
tataaaatcaccctgatact

SEQ ID NO: 392023 - DNA, 20 bp, Artificial Sequence
  chemically synthesized
tatcagggtgattttataca

SEQ ID NO: 392024 - DNA, 20 bp, Artificial Sequence
  chemically synthesized
ggtgattttatacacagcaa

SEQ ID NO: 392025 - DNA, 20 bp, Artificial Sequence
  chemically synthesized
attttatacacagcaaaagt

SEQ ID NO: 392026 - DNA, 20 bp, Artificial Sequence
  chemically synthesized
ttatacacagcaaaagtaag

SEQ ID NO: 392027 - DNA, 20 bp, Artificial Sequence
  chemically synthesized
tatacacagcaaaagtaagt

SEQ ID NO: 392028 - DNA, 20 bp, Artificial Sequence
  chemically synthesized
aatatgtagacatattggca

SEQ ID NO: 392029 - DNA, 20 bp, Artificial Sequence
  chemically synthesized
aaatatgtagacatattggc

SEQ ID NO: 392030 - DNA, 20 bp, Artificial Sequence
  chemically synthesized
gaaatatgtagacatattgg

SEQ ID NO: 392031 - DNA, 20 bp, Artificial Sequence
  chemically synthesized
ttggaaatatgtagacatat

SEQ ID NO: 392032 - DNA, 20 bp, Artificial Sequence
  chemically synthesized
ttcagttgtttggaaatatg

SEQ ID NO: 392033 - DNA, 20 bp, Artificial Sequence
  chemically synthesized
tgtgcatgttttcagttgtt

SEQ ID NO: 392034 - DNA, 20 bp, Artificial Sequence
  chemically synthesized
ttttggggtgtgcatgtttt

SEQ ID NO: 392035 - DNA, 20 bp, Artificial Sequence
  chemically synthesized
ctcattaagaaaacattttg

SEQ ID NO: 392036 - DNA, 20 bp, Artificial Sequence
  chemically synthesized
tctcattaagaaaacatttt

SEQ ID NO: 392037 - DNA, 20 bp, Artificial Sequence
  chemically synthesized
ttctcattaagaaaacattt

SEQ ID NO: 392038 - DNA, 20 bp, Artificial Sequence
  chemically synthesized
ccccaaaatgttttcttaat

SEQ ID NO: 392039 - DNA, 20 bp, Artificial Sequence
  chemically synthesized
gtgagttgtattttctcatt

SEQ ID NO: 392040 - DNA, 20 bp, Artificial Sequence
  chemically synthesized
aggcacagaaataaaaaagt

SEQ ID NO: 392041 - DNA, 20 bp, Artificial Sequence
  chemically synthesized
atcaaggcacagaaataaaa

SEQ ID NO: 392042 - DNA, 20 bp, Artificial Sequence
  chemically synthesized
gcctttttttaatcaaggca

SEQ ID NO: 392043 - DNA, 20 bp, Artificial Sequence
  chemically synthesized
gacgtgcctttttttaatca

SEQ ID NO: 392044 - DNA, 20 bp, Artificial Sequence
  chemically synthesized
ggacgtgcctttttttaatc

SEQ ID NO: 392045 - DNA, 20 bp, Artificial Sequence
  chemically synthesized
ttctgtgccttgattaaaaa

SEQ ID NO: 392046 - DNA, 20 bp, Artificial Sequence
  chemically synthesized
tctgtgccttgattaaaaaa

SEQ ID NO: 392047 - DNA, 20 bp, Artificial Sequence
  chemically synthesized
aaaaaaggcacgtccactaa

SEQ ID NO: 392048 - DNA, 20 bp, Artificial Sequence
  chemically synthesized
aaaaattatcattcttttag

SEQ ID NO: 392049 - DNA, 20 bp, Artificial Sequence
  chemically synthesized
aataaaaattatcattcttt

SEQ ID NO: 392050 - DNA, 20 bp, Artificial Sequence
  chemically synthesized
gataatttttattctgatta

SEQ ID NO: 392051 - DNA, 20 bp, Artificial Sequence
  chemically synthesized
ataatttttattctgattat

SEQ ID NO: 392052 - DNA, 20 bp, Artificial Sequence
  chemically synthesized
atgtttctttatcccataat

SEQ ID NO: 392053 - DNA, 20 bp, Artificial Sequence
  chemically synthesized
tttattctgattatgggata

SEQ ID NO: 392054 - DNA, 20 bp, Artificial Sequence
  chemically synthesized
ttatgggataaagaaacata

SEQ ID NO: 392055 - DNA, 20 bp, Artificial Sequence
  chemically synthesized
gactttttgtatgtcacaaa

SEQ ID NO: 392056 - DNA, 20 bp, Artificial Sequence
  chemically synthesized
ggccatttgtgacatacaaa

SEQ ID NO: 392057 - DNA, 20 bp, Artificial Sequence
  chemically synthesized
gtgacatacaaaaagtctac

SEQ ID NO: 392058 - DNA, 20 bp, Artificial Sequence
  chemically synthesized
acatacaaaaagtctactgg

SEQ ID NO: 392059 - DNA, 20 bp, Artificial Sequence
  chemically synthesized
ttcccactttttgcttccag

SEQ ID NO: 392060 - DNA, 20 bp, Artificial Sequence
  chemically synthesized
tttttcccactttttgcttc

SEQ ID NO: 392061 - DNA, 20 bp, Artificial Sequence
  chemically synthesized
aaaagtctactggaagcaaa

SEQ ID NO: 392062 - DNA, 20 bp, Artificial Sequence
  chemically synthesized
agtctactggaagcaaaaag

SEQ ID NO: 392063 - DNA, 20 bp, Artificial Sequence
  chemically synthesized
gtctactggaagcaaaaagt

SEQ ID NO: 392064 - DNA, 20 bp, Artificial Sequence
  chemically synthesized
aagcaaaaagtgggaaaaaa

SEQ ID NO: 392065 - DNA, 20 bp, Artificial Sequence
  chemically synthesized
ccagtttacgggtattcgta

SEQ ID NO: 392066 - DNA, 20 bp, Artificial Sequence
  chemically synthesized
accagtttacgggtattcgt

SEQ ID NO: 392067 - DNA, 20 bp, Artificial Sequence
  chemically synthesized
ccttacgaatacccgtaaac

SEQ ID NO: 392068 - DNA, 20 bp, Artificial Sequence
  chemically synthesized
tccatttatcaccagtttac

SEQ ID NO: 392069 - DNA, 20 bp, Artificial Sequence
  chemically synthesized
gtccatttatcaccagttta

SEQ ID NO: 392070 - DNA, 20 bp, Artificial Sequence
  chemically synthesized
tttgtttgtccatttatcac

SEQ ID NO: 392071 - DNA, 20 bp, Artificial Sequence
  chemically synthesized
acccgtaaactggtgataaa

SEQ ID NO: 392072 - DNA, 20 bp, Artificial Sequence
  chemically synthesized
ataaatggacaaacaaaatt

SEQ ID NO: 392073 - DNA, 20 bp, Artificial Sequence
  chemically synthesized
ctaaataaaatttcattgta

SEQ ID NO: 392074 - DNA, 20 bp, Artificial Sequence
  chemically synthesized
ccatacaatgaaattttatt

SEQ ID NO: 392075 - DNA, 20 bp, Artificial Sequence
  chemically synthesized
aaattttatttagcaaataa

SEQ ID NO: 392076 - DNA, 20 bp, Artificial Sequence
  chemically synthesized
aattttatttagcaaataaa

SEQ ID NO: 392077 - DNA, 20 bp, Artificial Sequence
  chemically synthesized
ttagcaaataaaaggaatga

SEQ ID NO: 392078 - DNA, 20 bp, Artificial Sequence
  chemically synthesized
attcatattgtagaatgtat

SEQ ID NO: 392079 - DNA, 20 bp, Artificial Sequence
  chemically synthesized
tttaaggtccattcatattg

SEQ ID NO: 392080 - DNA, 20 bp, Artificial Sequence
  chemically synthesized
gatacattctacaatatgaa

SEQ ID NO: 392081 - DNA, 20 bp, Artificial Sequence
  chemically synthesized
cattttgcataatgttttta

SEQ ID NO: 392082 - DNA, 20 bp, Artificial Sequence
  chemically synthesized
tcattttgcataatgttttt

SEQ ID NO: 392083 - DNA, 20 bp, Artificial Sequence
  chemically synthesized
aaaaacattatgcaaaatga

SEQ ID NO: 392084 - DNA, 20 bp, Artificial Sequence
  chemically synthesized
ttatgcaaaatgaaagatta

SEQ ID NO: 392085 - DNA, 20 bp, Artificial Sequence
  chemically synthesized
aaatgaaagattacagacac

SEQ ID NO: 392086 - DNA, 20 bp, Artificial Sequence
  chemically synthesized
atgaaagattacagacacta

SEQ ID NO: 392087 - DNA, 20 bp, Artificial Sequence
  chemically synthesized
tgaaagattacagacactag

SEQ ID NO: 392088 - DNA, 20 bp, Artificial Sequence
  chemically synthesized
atcatactatatgtggcctc

SEQ ID NO: 392089 - DNA, 20 bp, Artificial Sequence
  chemically synthesized
cagacactagaggccacata

SEQ ID NO: 392090 - DNA, 20 bp, Artificial Sequence
  chemically synthesized
aaatggaatcatactatatg

SEQ ID NO: 392091 - DNA, 20 bp, Artificial Sequence
  chemically synthesized
ttttggacatttcatataaa

SEQ ID NO: 392092 - DNA, 20 bp, Artificial Sequence
  chemically synthesized
tttatatgaaatgtccaaaa

SEQ ID NO: 392093 - DNA, 20 bp, Artificial Sequence
  chemically synthesized
ttatatgaaatgtccaaaat

SEQ ID NO: 392094 - DNA, 20 bp, Artificial Sequence
  chemically synthesized
tatgaaatgtccaaaatagg

SEQ ID NO: 392095 - DNA, 20 bp, Artificial Sequence
  chemically synthesized
ctctatagatctgcctattt

SEQ ID NO: 392096 - DNA, 20 bp, Artificial Sequence
  chemically synthesized
gtccaaaataggcagatcta

SEQ ID NO: 392097 - DNA, 20 bp, Artificial Sequence
  chemically synthesized
ccaaaataggcagatctata

SEQ ID NO: 392098 - DNA, 20 bp, Artificial Sequence
  chemically synthesized
tactctgtgttgtgtctcta

SEQ ID NO: 392099 - DNA, 20 bp, Artificial Sequence
  chemically synthesized
agatctatagagacacaaca

SEQ ID NO: 392100 - DNA, 20 bp, Artificial Sequence
  chemically synthesized
atctatagagacacaacaca

SEQ ID NO: 392101 - DNA, 20 bp, Artificial Sequence
  chemically synthesized
tatagagacacaacacagag

SEQ ID NO: 392102 - DNA, 20 bp, Artificial Sequence
  chemically synthesized
agagacacaacacagagtag

SEQ ID NO: 392103 - DNA, 20 bp, Artificial Sequence
  chemically synthesized
caacacagagtagcggttgc

SEQ ID NO: 392104 - DNA, 20 bp, Artificial Sequence
  chemically synthesized
acacagagtagcggttgcca

SEQ ID NO: 392105 - DNA, 20 bp, Artificial Sequence
  chemically synthesized
cacagagtagcggttgccag

SEQ ID NO: 392106 - DNA, 20 bp, Artificial Sequence
  chemically synthesized
gagtagcggttgccagaggc

SEQ ID NO: 392107 - DNA, 20 bp, Artificial Sequence
  chemically synthesized
gtagcggttgccagaggcta

SEQ ID NO: 392108 - DNA, 20 bp, Artificial Sequence
  chemically synthesized
tcctctctccctctagcctc

SEQ ID NO: 392109 - DNA, 20 bp, Artificial Sequence
  chemically synthesized
tagcggttgccagaggctag

SEQ ID NO: 392110 - DNA, 20 bp, Artificial Sequence
  chemically synthesized
agcggttgccagaggctaga

SEQ ID NO: 392111 - DNA, 20 bp, Artificial Sequence
  chemically synthesized
cggttgccagaggctagagg

SEQ ID NO: 392112 - DNA, 20 bp, Artificial Sequence
  chemically synthesized
gttgccagaggctagaggga

SEQ ID NO: 392113 - DNA, 20 bp, Artificial Sequence
  chemically synthesized
tccccattcctctctccctc

SEQ ID NO: 392114 - DNA, 20 bp, Artificial Sequence
  chemically synthesized
tgccagaggctagagggaga

SEQ ID NO: 392115 - DNA, 20 bp, Artificial Sequence
  chemically synthesized
gccagaggctagagggagag

SEQ ID NO: 392116 - DNA, 20 bp, Artificial Sequence
  chemically synthesized
aggctagagggagagaggaa

SEQ ID NO: 392117 - DNA, 20 bp, Artificial Sequence
  chemically synthesized
ggctagagggagagaggaat

SEQ ID NO: 392118 - DNA, 20 bp, Artificial Sequence
  chemically synthesized
gctagagggagagaggaatg

SEQ ID NO: 392119 - DNA, 20 bp, Artificial Sequence
  chemically synthesized
tagagggagagaggaatggg

SEQ ID NO: 392120 - DNA, 20 bp, Artificial Sequence
  chemically synthesized
gaatggggagtgactgctaa

SEQ ID NO: 392121 - DNA, 20 bp, Artificial Sequence
  chemically synthesized
aatggggagtgactgctaat

SEQ ID NO: 392122 - DNA, 20 bp, Artificial Sequence
  chemically synthesized
agaaactgtatgcccattag

SEQ ID NO: 392123 - DNA, 20 bp, Artificial Sequence
  chemically synthesized
aaaagaaactgtatgcccat

SEQ ID NO: 392124 - DNA, 20 bp, Artificial Sequence
  chemically synthesized
agtgactgctaatgggcata

SEQ ID NO: 392125 - DNA, 20 bp, Artificial Sequence
  chemically synthesized
aatgggcatacagtttcttt

SEQ ID NO: 392126 - DNA, 20 bp, Artificial Sequence
  chemically synthesized
atgggcatacagtttctttt

SEQ ID NO: 392127 - DNA, 20 bp, Artificial Sequence
  chemically synthesized
tgggcatacagtttcttttg

SEQ ID NO: 392128 - DNA, 20 bp, Artificial Sequence
  chemically synthesized
aatactttcatcatccccaa

SEQ ID NO: 392129 - DNA, 20 bp, Artificial Sequence
  chemically synthesized
gtttcttttggggatgatga

SEQ ID NO: 392130 - DNA, 20 bp, Artificial Sequence
  chemically synthesized
tgatgaaagtattctgcaac

SEQ ID NO: 392131 - DNA, 20 bp, Artificial Sequence
  chemically synthesized
ctatcatcactatctagttg

SEQ ID NO: 392132 - DNA, 20 bp, Artificial Sequence
  chemically synthesized
gaaagtattctgcaactaga

SEQ ID NO: 392133 - DNA, 20 bp, Artificial Sequence
  chemically synthesized
atgcaactatcatcactatc

SEQ ID NO: 392134 - DNA, 20 bp, Artificial Sequence
  chemically synthesized
ctgcaactagatagtgatga

SEQ ID NO: 392135 - DNA, 20 bp, Artificial Sequence
  chemically synthesized
agatagtgatgatagttgca

SEQ ID NO: 392136 - DNA, 20 bp, Artificial Sequence
  chemically synthesized
gttttttcagtatgttcaca

SEQ ID NO: 392137 - DNA, 20 bp, Artificial Sequence
  chemically synthesized
gtgttttttcagtatgttca

SEQ ID NO: 392138 - DNA, 20 bp, Artificial Sequence
  chemically synthesized
tgtacaattcagtgtttttt

SEQ ID NO: 392139 - DNA, 20 bp, Artificial Sequence
  chemically synthesized
ctctctagaagtgtacaatt

SEQ ID NO: 392140 - DNA, 20 bp, Artificial Sequence
  chemically synthesized
aacactgaattgtacacttc

SEQ ID NO: 392141 - DNA, 20 bp, Artificial Sequence
  chemically synthesized
cactgaattgtacacttcta

SEQ ID NO: 392142 - DNA, 20 bp, Artificial Sequence
  chemically synthesized
ctgaattgtacacttctaga

SEQ ID NO: 392143 - DNA, 20 bp, Artificial Sequence
  chemically synthesized
ctgtaaaattcactctctag

SEQ ID NO: 392144 - DNA, 20 bp, Artificial Sequence
  chemically synthesized
atactgtaaaattcactctc

SEQ ID NO: 392145 - DNA, 20 bp, Artificial Sequence
  chemically synthesized
cttctagagagtgaatttta

SEQ ID NO: 392146 - DNA, 20 bp, Artificial Sequence
  chemically synthesized
atgtgaataatatcttaata

SEQ ID NO: 392147 - DNA, 20 bp, Artificial Sequence
  chemically synthesized
tttgttacagcagctttatt

SEQ ID NO: 392148 - DNA, 20 bp, Artificial Sequence
  chemically synthesized
tcctggggattttgttacag

SEQ ID NO: 392149 - DNA, 20 bp, Artificial Sequence
  chemically synthesized
atatcctggggattttgtta

SEQ ID NO: 392150 - DNA, 20 bp, Artificial Sequence
  chemically synthesized
agctgctgtaacaaaatccc

SEQ ID NO: 392151 - DNA, 20 bp, Artificial Sequence
  chemically synthesized
gctgctgtaacaaaatcccc

SEQ ID NO: 392152 - DNA, 20 bp, Artificial Sequence
  chemically synthesized
tttagaaatgggatatcctg

SEQ ID NO: 392153 - DNA, 20 bp, Artificial Sequence
  chemically synthesized
atttagaaatgggatatcct

SEQ ID NO: 392154 - DNA, 20 bp, Artificial Sequence
  chemically synthesized
tatttagaaatgggatatcc

SEQ ID NO: 392155 - DNA, 20 bp, Artificial Sequence
  chemically synthesized
aaatacgtttatttagaaat

SEQ ID NO: 392156 - DNA, 20 bp, Artificial Sequence
  chemically synthesized
aaaatacgtttatttagaaa

SEQ ID NO: 392157 - DNA, 20 bp, Artificial Sequence
  chemically synthesized
aagggaaaaatacgtttatt

SEQ ID NO: 392158 - DNA, 20 bp, Artificial Sequence
  chemically synthesized
aataaacgtatttttccctt

SEQ ID NO: 392159 - DNA, 20 bp, Artificial Sequence
  chemically synthesized
ataaacgtatttttcccttg

SEQ ID NO: 392160 - DNA, 20 bp, Artificial Sequence
  chemically synthesized
taaacatcagaagacctcaa

SEQ ID NO: 392161 - DNA, 20 bp, Artificial Sequence
  chemically synthesized
gtaaacatcagaagacctca

SEQ ID NO: 392162 - DNA, 20 bp, Artificial Sequence
  chemically synthesized
tgtaaacatcagaagacctc

SEQ ID NO: 392163 - DNA, 20 bp, Artificial Sequence
  chemically synthesized
aaaagaggtgtaaacatcag

SEQ ID NO: 392164 - DNA, 20 bp, Artificial Sequence
  chemically synthesized
acaaaaagaggtgtaaacat

SEQ ID NO: 392165 - DNA, 20 bp, Artificial Sequence
  chemically synthesized
agccacagcacaacaaaaag

SEQ ID NO: 392166 - DNA, 20 bp, Artificial Sequence
  chemically synthesized
aagccacagcacaacaaaaa

SEQ ID NO: 392167 - DNA, 20 bp, Artificial Sequence
  chemically synthesized
aaaagccacagcacaacaaa

SEQ ID NO: 392168 - DNA, 20 bp, Artificial Sequence
  chemically synthesized
cacctctttttgttgtgctg

SEQ ID NO: 392169 - DNA, 20 bp, Artificial Sequence
  chemically synthesized
aatctgcttccaaaaagcca

SEQ ID NO: 392170 - DNA, 20 bp, Artificial Sequence
  chemically synthesized
tttgttgtgctgtggctttt

SEQ ID NO: 392171 - DNA, 20 bp, Artificial Sequence
  chemically synthesized
gttgtgctgtggctttttgg

SEQ ID NO: 392172 - DNA, 20 bp, Artificial Sequence
  chemically synthesized
cagagaaatctgcttccaaa

SEQ ID NO: 392173 - DNA, 20 bp, Artificial Sequence
  chemically synthesized
gtgctgtggctttttggaag

SEQ ID NO: 392174 - DNA, 20 bp, Artificial Sequence
  chemically synthesized
tttttggaagcagatttctc

SEQ ID NO: 392175 - DNA, 20 bp, Artificial Sequence
  chemically synthesized
ttttggaagcagatttctct

SEQ ID NO: 392176 - DNA, 20 bp, Artificial Sequence
  chemically synthesized
aacaaaaatgaacaaaccca

SEQ ID NO: 392177 - DNA, 20 bp, Artificial Sequence
  chemically synthesized
aaaacaaaaatgaacaaacc

SEQ ID NO: 392178 - DNA, 20 bp, Artificial Sequence
  chemically synthesized
tgttcatttttgttttattt

SEQ ID NO: 392179 - DNA, 20 bp, Artificial Sequence
  chemically synthesized
tttttgttttatttcagtat

SEQ ID NO: 392180 - DNA, 20 bp, Artificial Sequence
  chemically synthesized
acaggatatataagcagggt

SEQ ID NO: 392181 - DNA, 20 bp, Artificial Sequence
  chemically synthesized
aaagacaggatatataagca

SEQ ID NO: 392182 - DNA, 20 bp, Artificial Sequence
  chemically synthesized
aaaagacaggatatataagc

SEQ ID NO: 392183 - DNA, 20 bp, Artificial Sequence
  chemically synthesized
aaaaagacaggatatataag

SEQ ID NO: 392184 - DNA, 20 bp, Artificial Sequence
  chemically synthesized
taaaaaaagacaggatatat

SEQ ID NO: 392185 - DNA, 20 bp, Artificial Sequence
  chemically synthesized
ccttaaatttaaaaaaagac

SEQ ID NO: 392186 - DNA, 20 bp, Artificial Sequence
  chemically synthesized
gccttaaatttaaaaaaaga

SEQ ID NO: 392187 - DNA, 20 bp, Artificial Sequence
  chemically synthesized
ttaagccttaaatttaaaaa

SEQ ID NO: 392188 - DNA, 20 bp, Artificial Sequence
  chemically synthesized
tcctgtctttttttaaattt

SEQ ID NO: 392189 - DNA, 20 bp, Artificial Sequence
  chemically synthesized
cctgtctttttttaaattta

SEQ ID NO: 392190 - DNA, 20 bp, Artificial Sequence
  chemically synthesized
gctactgtttgtttgttgtt

SEQ ID NO: 392191 - DNA, 20 bp, Artificial Sequence
  chemically synthesized
aaggcttaacaacaaacaaa

SEQ ID NO: 392192 - DNA, 20 bp, Artificial Sequence
  chemically synthesized
gcttaacaacaaacaaacag

SEQ ID NO: 392193 - DNA, 20 bp, Artificial Sequence
  chemically synthesized
tagcaataatcccaattccc

SEQ ID NO: 392194 - DNA, 20 bp, Artificial Sequence
  chemically synthesized
tgttgaatcactcgggaatt

SEQ ID NO: 392195 - DNA, 20 bp, Artificial Sequence
  chemically synthesized
ttgttgaatcactcgggaat

SEQ ID NO: 392196 - DNA, 20 bp, Artificial Sequence
  chemically synthesized
taaaacttgttgaatcactc

SEQ ID NO: 392197 - DNA, 20 bp, Artificial Sequence
  chemically synthesized
ataaaacttgttgaatcact

SEQ ID NO: 392198 - DNA, 20 bp, Artificial Sequence
  chemically synthesized
caattcccgagtgattcaac

SEQ ID NO: 392199 - DNA, 20 bp, Artificial Sequence
  chemically synthesized
attcaacaagttttattgtg

SEQ ID NO: 392200 - DNA, 20 bp, Artificial Sequence
  chemically synthesized
aacaagttttattgtgcaga

SEQ ID NO: 392201 - DNA, 20 bp, Artificial Sequence
  chemically synthesized
agttttattgtgcagatggt

SEQ ID NO: 392202 - DNA, 20 bp, Artificial Sequence
  chemically synthesized
gtagcaaacaatgagggaaa

SEQ ID NO: 392203 - DNA, 20 bp, Artificial Sequence
  chemically synthesized
ctcctggtagcaaacaatga

SEQ ID NO: 392204 - DNA, 20 bp, Artificial Sequence
  chemically synthesized
tctcctggtagcaaacaatg

SEQ ID NO: 392205 - DNA, 20 bp, Artificial Sequence
  chemically synthesized
ttctcctggtagcaaacaat

SEQ ID NO: 392206 - DNA, 20 bp, Artificial Sequence
  chemically synthesized
tttccctcattgtttgctac

SEQ ID NO: 392207 - DNA, 20 bp, Artificial Sequence
  chemically synthesized
ttccctcattgtttgctacc

SEQ ID NO: 392208 - DNA, 20 bp, Artificial Sequence
  chemically synthesized
ccctcattgtttgctaccag

SEQ ID NO: 392209 - DNA, 20 bp, Artificial Sequence
  chemically synthesized
tttcacagcctttctcctgg

SEQ ID NO: 392210 - DNA, 20 bp, Artificial Sequence
  chemically synthesized
cattgtttgctaccaggaga

SEQ ID NO: 392211 - DNA, 20 bp, Artificial Sequence
  chemically synthesized
attgtttgctaccaggagaa

SEQ ID NO: 392212 - DNA, 20 bp, Artificial Sequence
  chemically synthesized
ctatttcacagcctttctcc

SEQ ID NO: 392213 - DNA, 20 bp, Artificial Sequence
  chemically synthesized
ccaggagaaaggctgtgaaa

SEQ ID NO: 392214 - DNA, 20 bp, Artificial Sequence
  chemically synthesized
gacccagaagaactatttca

SEQ ID NO: 392215 - DNA, 20 bp, Artificial Sequence
  chemically synthesized
aggctgtgaaatagttcttc

SEQ ID NO: 392216 - DNA, 20 bp, Artificial Sequence
  chemically synthesized
ggctgtgaaatagttcttct

SEQ ID NO: 392217 - DNA, 20 bp, Artificial Sequence
  chemically synthesized
aaccatatgttttgacccag

SEQ ID NO: 392218 - DNA, 20 bp, Artificial Sequence
  chemically synthesized
gtgaaccatatgttttgacc

SEQ ID NO: 392219 - DNA, 20 bp, Artificial Sequence
  chemically synthesized
ttcttctgggtcaaaacata

SEQ ID NO: 392220 - DNA, 20 bp, Artificial Sequence
  chemically synthesized
gaagagaccaagatgaaagg

SEQ ID NO: 392221 - DNA, 20 bp, Artificial Sequence
  chemically synthesized
aaaatgacttcctttcatct

SEQ ID NO: 392222 - DNA, 20 bp, Artificial Sequence
  chemically synthesized
caagaagagaccaagatgaa

SEQ ID NO: 392223 - DNA, 20 bp, Artificial Sequence
  chemically synthesized
gcaagaagagaccaagatga

SEQ ID NO: 392224 - DNA, 20 bp, Artificial Sequence
  chemically synthesized
tcagaaggcaagaagagacc

SEQ ID NO: 392225 - DNA, 20 bp, Artificial Sequence
  chemically synthesized
ggtctttcagaaggcaagaa

SEQ ID NO: 392226 - DNA, 20 bp, Artificial Sequence
  chemically synthesized
ttggtctttcagaaggcaag

SEQ ID NO: 392227 - DNA, 20 bp, Artificial Sequence
  chemically synthesized
gaattggtctttcagaaggc

SEQ ID NO: 392228 - DNA, 20 bp, Artificial Sequence
  chemically synthesized
ggtctcttcttgccttctga

SEQ ID NO: 392229 - DNA, 20 bp, Artificial Sequence
  chemically synthesized
ggaggaattggtctttcaga

SEQ ID NO: 392230 - DNA, 20 bp, Artificial Sequence
  chemically synthesized
aggaggaattggtctttcag

SEQ ID NO: 392231 - DNA, 20 bp, Artificial Sequence
  chemically synthesized
attaggaggaattggtcttt

SEQ ID NO: 392232 - DNA, 20 bp, Artificial Sequence
  chemically synthesized
aacttaaaattaggaggaat

SEQ ID NO: 392233 - DNA, 20 bp, Artificial Sequence
  chemically synthesized
aaagtaaacttaaaattagg

SEQ ID NO: 392234 - DNA, 20 bp, Artificial Sequence
  chemically synthesized
aaaagtaaacttaaaattag

SEQ ID NO: 392235 - DNA, 20 bp, Artificial Sequence
  chemically synthesized
gaccaattcctcctaatttt

SEQ ID NO: 392236 - DNA, 20 bp, Artificial Sequence
  chemically synthesized
ccaaaagtaaacttaaaatt

SEQ ID NO: 392237 - DNA, 20 bp, Artificial Sequence
  chemically synthesized
gccaaaagtaaacttaaaat

SEQ ID NO: 392238 - DNA, 20 bp, Artificial Sequence
  chemically synthesized
cctaattttaagtttacttt

SEQ ID NO: 392239 - DNA, 20 bp, Artificial Sequence
  chemically synthesized
acatgagaccattttgccaa

SEQ ID NO: 392240 - DNA, 20 bp, Artificial Sequence
  chemically synthesized
taagtttacttttggcaaaa

SEQ ID NO: 392241 - DNA, 20 bp, Artificial Sequence
  chemically synthesized
aaataaagtcattaatacat

SEQ ID NO: 392242 - DNA, 20 bp, Artificial Sequence
  chemically synthesized
catgtattaatgactttatt

SEQ ID NO: 392243 - DNA, 20 bp, Artificial Sequence
  chemically synthesized
gttactttgttaaccaaata

SEQ ID NO: 392244 - DNA, 20 bp, Artificial Sequence
  chemically synthesized
atgactttatttggttaaca

SEQ ID NO: 392245 - DNA, 20 bp, Artificial Sequence
  chemically synthesized
ttaacaaagtaacatgttta

SEQ ID NO: 392246 - DNA, 20 bp, Artificial Sequence
  chemically synthesized
taacaaagtaacatgtttac

SEQ ID NO: 392247 - DNA, 20 bp, Artificial Sequence
  chemically synthesized
aagtaacatgtttacaggca

SEQ ID NO: 392248 - DNA, 20 bp, Artificial Sequence
  chemically synthesized
agtaacatgtttacaggcat

SEQ ID NO: 392249 - DNA, 20 bp, Artificial Sequence
  chemically synthesized
taacatgtttacaggcatgg

SEQ ID NO: 392250 - DNA, 20 bp, Artificial Sequence
  chemically synthesized
acatgtttacaggcatggga

SEQ ID NO: 392251 - DNA, 20 bp, Artificial Sequence
  chemically synthesized
catgtttacaggcatgggag

SEQ ID NO: 392252 - DNA, 20 bp, Artificial Sequence
  chemically synthesized
ggcatgggagaggataaatg

SEQ ID NO: 392253 - DNA, 20 bp, Artificial Sequence
  chemically synthesized
tgggagaggataaatgaagc

SEQ ID NO: 392254 - DNA, 20 bp, Artificial Sequence
  chemically synthesized
aggataaatgaagctagaaa

SEQ ID NO: 392255 - DNA, 20 bp, Artificial Sequence
  chemically synthesized
ggataaatgaagctagaaaa

SEQ ID NO: 392256 - DNA, 20 bp, Artificial Sequence
  chemically synthesized
ataaatgaagctagaaaaag

SEQ ID NO: 392257 - DNA, 20 bp, Artificial Sequence
  chemically synthesized
attttcagtactcctttttc

SEQ ID NO: 392258 - DNA, 20 bp, Artificial Sequence
  chemically synthesized
aaaaggagtactgaaaatat

SEQ ID NO: 392259 - DNA, 20 bp, Artificial Sequence
  chemically synthesized
acacattaacctaatatttt

SEQ ID NO: 392260 - DNA, 20 bp, Artificial Sequence
  chemically synthesized
aaaggagtactgaaaatatt

SEQ ID NO: 392261 - DNA, 20 bp, Artificial Sequence
  chemically synthesized
gttaatgtgttattgttttc

SEQ ID NO: 392262 - DNA, 20 bp, Artificial Sequence
  chemically synthesized
taatgtgttattgttttcaa

SEQ ID NO: 392263 - DNA, 20 bp, Artificial Sequence
  chemically synthesized
agtttcaaggatgttataga

SEQ ID NO: 392264 - DNA, 20 bp, Artificial Sequence
  chemically synthesized
tgtaagtttcaaggatgtta

SEQ ID NO: 392265 - DNA, 20 bp, Artificial Sequence
  chemically synthesized
cagtggttgtgtaagtttca

SEQ ID NO: 392266 - DNA, 20 bp, Artificial Sequence
  chemically synthesized
tcagtggttgtgtaagtttc

SEQ ID NO: 392267 - DNA, 20 bp, Artificial Sequence
  chemically synthesized
tgtttagtcagtggttgtgt

SEQ ID NO: 392268 - DNA, 20 bp, Artificial Sequence
  chemically synthesized
taaataaaatgtttagtcag

SEQ ID NO: 392269 - DNA, 20 bp, Artificial Sequence
  chemically synthesized
ttctaaataaaatgtttagt

SEQ ID NO: 392270 - DNA, 20 bp, Artificial Sequence
  chemically synthesized
attattctaaataaaatgtt

SEQ ID NO: 392271 - DNA, 20 bp, Artificial Sequence
  chemically synthesized
cactgactaaacattttatt

SEQ ID NO: 392272 - DNA, 20 bp, Artificial Sequence
  chemically synthesized
aacattttatttagaataat

SEQ ID NO: 392273 - DNA, 20 bp, Artificial Sequence
  chemically synthesized
acattttatttagaataatc

SEQ ID NO: 392274 - DNA, 20 bp, Artificial Sequence
  chemically synthesized
tatttagaataatcaggaac

SEQ ID NO: 392275 - DNA, 20 bp, Artificial Sequence
  chemically synthesized
ttagaataatcaggaaccag

SEQ ID NO: 392276 - DNA, 20 bp, Artificial Sequence
  chemically synthesized
tagataagcagattttccac

SEQ ID NO: 392277 - DNA, 20 bp, Artificial Sequence
  chemically synthesized
cagtggaaaatctgcttatc

SEQ ID NO: 392278 - DNA, 20 bp, Artificial Sequence
  chemically synthesized
tgcttcaaggtctagataag

SEQ ID NO: 392279 - DNA, 20 bp, Artificial Sequence
  chemically synthesized
tgatgcttcaaggtctagat

SEQ ID NO: 392280 - DNA, 20 bp, Artificial Sequence
  chemically synthesized
atctgcttatctagaccttg

SEQ ID NO: 392281 - DNA, 20 bp, Artificial Sequence
  chemically synthesized
aaaaatgatgcttcaaggtc

SEQ ID NO: 392282 - DNA, 20 bp, Artificial Sequence
  chemically synthesized
aaaaaaaaaatgatgcttca

SEQ ID NO: 392283 - DNA, 20 bp, Artificial Sequence
  chemically synthesized
gaaaaaaaaaatgatgcttc

SEQ ID NO: 392284 - DNA, 20 bp, Artificial Sequence
  chemically synthesized
tgtaatcaggaagaaatttt

SEQ ID NO: 392285 - DNA, 20 bp, Artificial Sequence
  chemically synthesized
tgccactggatgtaatcagg

SEQ ID NO: 392286 - DNA, 20 bp, Artificial Sequence
  chemically synthesized
atctgccactggatgtaatc

SEQ ID NO: 392287 - DNA, 20 bp, Artificial Sequence
  chemically synthesized
tatctgccactggatgtaat

SEQ ID NO: 392288 - DNA, 20 bp, Artificial Sequence
  chemically synthesized
aatttcttcctgattacatc

SEQ ID NO: 392289 - DNA, 20 bp, Artificial Sequence
  chemically synthesized
ttcttcctgattacatccag

SEQ ID NO: 392290 - DNA, 20 bp, Artificial Sequence
  chemically synthesized
ttcctgattacatccagtgg

SEQ ID NO: 392291 - DNA, 20 bp, Artificial Sequence
  chemically synthesized
caaatagcagtatctgccac

SEQ ID NO: 392292 - DNA, 20 bp, Artificial Sequence
  chemically synthesized
gcaagcaaacaagcaaatag

SEQ ID NO: 392293 - DNA, 20 bp, Artificial Sequence
  chemically synthesized
tgggcaagcaaacaagcaaa

SEQ ID NO: 392294 - DNA, 20 bp, Artificial Sequence
  chemically synthesized
tggatattgggcaagcaaac

SEQ ID NO: 392295 - DNA, 20 bp, Artificial Sequence
  chemically synthesized
gggtttattggatattgggc

SEQ ID NO: 392296 - DNA, 20 bp, Artificial Sequence
  chemically synthesized
tgctgggtttattggatatt

SEQ ID NO: 392297 - DNA, 20 bp, Artificial Sequence
  chemically synthesized
ttgctgggtttattggatat

SEQ ID NO: 392298 - DNA, 20 bp, Artificial Sequence
  chemically synthesized
tgcccaatatccaataaacc

SEQ ID NO: 392299 - DNA, 20 bp, Artificial Sequence
  chemically synthesized
tatttctttgctgggtttat

SEQ ID NO: 392300 - DNA, 20 bp, Artificial Sequence
  chemically synthesized
aatatccaataaacccagca

SEQ ID NO: 392301 - DNA, 20 bp, Artificial Sequence
  chemically synthesized
aagacaactatttctttgct

SEQ ID NO: 392302 - DNA, 20 bp, Artificial Sequence
  chemically synthesized
caagacaactatttctttgc

SEQ ID NO: 392303 - DNA, 20 bp, Artificial Sequence
  chemically synthesized
caataaacccagcaaagaaa

SEQ ID NO: 392304 - DNA, 20 bp, Artificial Sequence
  chemically synthesized
caaagaaatagttgtcttga

SEQ ID NO: 392305 - DNA, 20 bp, Artificial Sequence
  chemically synthesized
ttggctgttaatagtccatc

SEQ ID NO: 392306 - DNA, 20 bp, Artificial Sequence
  chemically synthesized
ttgtcttgatggactattaa

SEQ ID NO: 392307 - DNA, 20 bp, Artificial Sequence
  chemically synthesized
tactgtgggttggctgttaa

SEQ ID NO: 392308 - DNA, 20 bp, Artificial Sequence
  chemically synthesized
gactattaacagccaaccca

SEQ ID NO: 392309 - DNA, 20 bp, Artificial Sequence
  chemically synthesized
aatttgtttttactgtgggt

SEQ ID NO: 392310 - DNA, 20 bp, Artificial Sequence
  chemically synthesized
ttagaatttgtttttactgt

SEQ ID NO: 392311 - DNA, 20 bp, Artificial Sequence
  chemically synthesized
tttagaatttgtttttactg

SEQ ID NO: 392312 - DNA, 20 bp, Artificial Sequence
  chemically synthesized
tactatgctttttaaatttt

SEQ ID NO: 392313 - DNA, 20 bp, Artificial Sequence
  chemically synthesized
acaaattctaaaaatttaaa

SEQ ID NO: 392314 - DNA, 20 bp, Artificial Sequence
  chemically synthesized
ttctaaaaatttaaaaagca

SEQ ID NO: 392315 - DNA, 20 bp, Artificial Sequence
  chemically synthesized
aatgtggagtgaatattttt

SEQ ID NO: 392316 - DNA, 20 bp, Artificial Sequence
  chemically synthesized
agtttaaaaagcaaaatgtg

SEQ ID NO: 392317 - DNA, 20 bp, Artificial Sequence
  chemically synthesized
aaagtttaaaaagcaaaatg

SEQ ID NO: 392318 - DNA, 20 bp, Artificial Sequence
  chemically synthesized
agcattttttaaagtttaaa

SEQ ID NO: 392319 - DNA, 20 bp, Artificial Sequence
  chemically synthesized
aaaaaaaaaagcatttttta

SEQ ID NO: 392320 - DNA, 20 bp, Artificial Sequence
  chemically synthesized
aaaaaaaaaaaaaaaaaaaa

SEQ ID NO: 392321 - DNA, 20 bp, Artificial Sequence
  chemically synthesized
ttttttttgaaaccctgaaa

SEQ ID NO: 392322 - DNA, 20 bp, Artificial Sequence
  chemically synthesized
gcttactgtctactttttca

SEQ ID NO: 392323 - DNA, 20 bp, Artificial Sequence
  chemically synthesized
tttttgaaaccctgaaaaag

SEQ ID NO: 392324 - DNA, 20 bp, Artificial Sequence
  chemically synthesized
ggcttactgtctactttttc

SEQ ID NO: 392325 - DNA, 20 bp, Artificial Sequence
  chemically synthesized
tggcttactgtctacttttt

SEQ ID NO: 392326 - DNA, 20 bp, Artificial Sequence
  chemically synthesized
tgaaaccctgaaaaagtaga

SEQ ID NO: 392327 - DNA, 20 bp, Artificial Sequence
  chemically synthesized
accctgaaaaagtagacagt

SEQ ID NO: 392328 - DNA, 20 bp, Artificial Sequence
  chemically synthesized
tgaaaaagtagacagtaagc

SEQ ID NO: 392329 - DNA, 20 bp, Artificial Sequence
  chemically synthesized
gtagacagtaagccagctcc

SEQ ID NO: 392330 - DNA, 20 bp, Artificial Sequence
  chemically synthesized
tttccaattcttccaggagc

SEQ ID NO: 392331 - DNA, 20 bp, Artificial Sequence
  chemically synthesized
gacagtaagccagctcctgg

SEQ ID NO: 392332 - DNA, 20 bp, Artificial Sequence
  chemically synthesized
ttgatttccaattcttccag

SEQ ID NO: 392333 - DNA, 20 bp, Artificial Sequence
  chemically synthesized
agttgatttccaattcttcc

SEQ ID NO: 392334 - DNA, 20 bp, Artificial Sequence
  chemically synthesized
aagccagctcctggaagaat

SEQ ID NO: 392335 - DNA, 20 bp, Artificial Sequence
  chemically synthesized
cagttgatttccaattcttc

SEQ ID NO: 392336 - DNA, 20 bp, Artificial Sequence
  chemically synthesized
gaattggaaatcaactgcat

SEQ ID NO: 392337 - DNA, 20 bp, Artificial Sequence
  chemically synthesized
aattggaaatcaactgcatg

SEQ ID NO: 392338 - DNA, 20 bp, Artificial Sequence
  chemically synthesized
attggaaatcaactgcatga

SEQ ID NO: 392339 - DNA, 20 bp, Artificial Sequence
  chemically synthesized
cagcttcctagaccctcatg

SEQ ID NO: 392340 - DNA, 20 bp, Artificial Sequence
  chemically synthesized
aaatcaactgcatgagggtc

SEQ ID NO: 392341 - DNA, 20 bp, Artificial Sequence
  chemically synthesized
aatcaactgcatgagggtct

SEQ ID NO: 392342 - DNA, 20 bp, Artificial Sequence
  chemically synthesized
caactgcatgagggtctagg

SEQ ID NO: 392343 - DNA, 20 bp, Artificial Sequence
  chemically synthesized
gcatgagggtctaggaagct

SEQ ID NO: 392344 - DNA, 20 bp, Artificial Sequence
  chemically synthesized
gcttcagcctctcagcttcc

SEQ ID NO: 392345 - DNA, 20 bp, Artificial Sequence
  chemically synthesized
atgagggtctaggaagctga

SEQ ID NO: 392346 - DNA, 20 bp, Artificial Sequence
  chemically synthesized
tgagggtctaggaagctgag

SEQ ID NO: 392347 - DNA, 20 bp, Artificial Sequence
  chemically synthesized
ctgagactgcttcagcctct

SEQ ID NO: 392348 - DNA, 20 bp, Artificial Sequence
  chemically synthesized
tctaggaagctgagaggctg

SEQ ID NO: 392349 - DNA, 20 bp, Artificial Sequence
  chemically synthesized
aggaagctgagaggctgaag

SEQ ID NO: 392350 - DNA, 20 bp, Artificial Sequence
  chemically synthesized
tacttgtcctgagactgctt

SEQ ID NO: 392351 - DNA, 20 bp, Artificial Sequence
  chemically synthesized
ctgagaggctgaagcagtct

SEQ ID NO: 392352 - DNA, 20 bp, Artificial Sequence
  chemically synthesized
tgagaggctgaagcagtctc

SEQ ID NO: 392353 - DNA, 20 bp, Artificial Sequence
  chemically synthesized
ggctgaagcagtctcaggac

SEQ ID NO: 392354 - DNA, 20 bp, Artificial Sequence
  chemically synthesized
cctccctatctacttgtcct

SEQ ID NO: 392355 - DNA, 20 bp, Artificial Sequence
  chemically synthesized
tgaagcagtctcaggacaag

SEQ ID NO: 392356 - DNA, 20 bp, Artificial Sequence
  chemically synthesized
gcagtctcaggacaagtaga

SEQ ID NO: 392357 - DNA, 20 bp, Artificial Sequence
  chemically synthesized
cagtctcaggacaagtagat

SEQ ID NO: 392358 - DNA, 20 bp, Artificial Sequence
  chemically synthesized
agtctcaggacaagtagata

SEQ ID NO: 392359 - DNA, 20 bp, Artificial Sequence
  chemically synthesized
tctcaggacaagtagatagg

SEQ ID NO: 392360 - DNA, 20 bp, Artificial Sequence
  chemically synthesized
ctcaggacaagtagataggg

SEQ ID NO: 392361 - DNA, 20 bp, Artificial Sequence
  chemically synthesized
caggacaagtagatagggag

SEQ ID NO: 392362 - DNA, 20 bp, Artificial Sequence
  chemically synthesized
attttgttgttgagagaaaa

SEQ ID NO: 392363 - DNA, 20 bp, Artificial Sequence
  chemically synthesized
gattttgttgttgagagaaa

SEQ ID NO: 392364 - DNA, 20 bp, Artificial Sequence
  chemically synthesized
aatcacgattttgttgttga

SEQ ID NO: 392365 - DNA, 20 bp, Artificial Sequence
  chemically synthesized
aaaatcacgattttgttgtt

SEQ ID NO: 392366 - DNA, 20 bp, Artificial Sequence
  chemically synthesized
aacaaaatcgtgattttgtt

SEQ ID NO: 392367 - DNA, 20 bp, Artificial Sequence
  chemically synthesized
aaaatcgtgattttgtttag

SEQ ID NO: 392368 - DNA, 20 bp, Artificial Sequence
  chemically synthesized
atcgtgattttgtttagaag

SEQ ID NO: 392369 - DNA, 20 bp, Artificial Sequence
  chemically synthesized
tgattttgtttagaagtagc

SEQ ID NO: 392370 - DNA, 20 bp, Artificial Sequence
  chemically synthesized
gattttgtttagaagtagca

SEQ ID NO: 392371 - DNA, 20 bp, Artificial Sequence
  chemically synthesized
tttagaagtagcaaggtgtc

SEQ ID NO: 392372 - DNA, 20 bp, Artificial Sequence
  chemically synthesized
gaagtagcaaggtgtcaagc

SEQ ID NO: 392373 - DNA, 20 bp, Artificial Sequence
  chemically synthesized
caaggtgtcaagcaagaaca

SEQ ID NO: 392374 - DNA, 20 bp, Artificial Sequence
  chemically synthesized
aggtgtcaagcaagaacaaa

SEQ ID NO: 392375 - DNA, 20 bp, Artificial Sequence
  chemically synthesized
agaacaaagagctctatttc

SEQ ID NO: 392376 - DNA, 20 bp, Artificial Sequence
  chemically synthesized
tgccagagatgcttgaaata

SEQ ID NO: 392377 - DNA, 20 bp, Artificial Sequence
  chemically synthesized
ggtgccagagatgcttgaaa

SEQ ID NO: 392378 - DNA, 20 bp, Artificial Sequence
  chemically synthesized
agctctatttcaagcatctc

SEQ ID NO: 392379 - DNA, 20 bp, Artificial Sequence
  chemically synthesized
tttcaagcatctctggcacc

SEQ ID NO: 392380 - DNA, 20 bp, Artificial Sequence
  chemically synthesized
aaggccatgactgggtgcca

SEQ ID NO: 392381 - DNA, 20 bp, Artificial Sequence
  chemically synthesized
aaaaggccatgactgggtgc

SEQ ID NO: 392382 - DNA, 20 bp, Artificial Sequence
  chemically synthesized
gcatctctggcacccagtca

SEQ ID NO: 392383 - DNA, 20 bp, Artificial Sequence
  chemically synthesized
gatgccaaaaggccatgact

SEQ ID NO: 392384 - DNA, 20 bp, Artificial Sequence
  chemically synthesized
agatgccaaaaggccatgac

SEQ ID NO: 392385 - DNA, 20 bp, Artificial Sequence
  chemically synthesized
ggcacccagtcatggccttt

SEQ ID NO: 392386 - DNA, 20 bp, Artificial Sequence
  chemically synthesized
tcgtcctctcagatgccaaa

SEQ ID NO: 392387 - DNA, 20 bp, Artificial Sequence
  chemically synthesized
gtcgtcctctcagatgccaa

SEQ ID NO: 392388 - DNA, 20 bp, Artificial Sequence
  chemically synthesized
gtcatggccttttggcatct

SEQ ID NO: 392389 - DNA, 20 bp, Artificial Sequence
  chemically synthesized
catggccttttggcatctga

SEQ ID NO: 392390 - DNA, 20 bp, Artificial Sequence
  chemically synthesized
atggccttttggcatctgag

SEQ ID NO: 392391 - DNA, 20 bp, Artificial Sequence
  chemically synthesized
atccctagctgtcgtcctct

SEQ ID NO: 392392 - DNA, 20 bp, Artificial Sequence
  chemically synthesized
tttggcatctgagaggacga

SEQ ID NO: 392393 - DNA, 20 bp, Artificial Sequence
  chemically synthesized
gcatctgagaggacgacagc

SEQ ID NO: 392394 - DNA, 20 bp, Artificial Sequence
  chemically synthesized
catctgagaggacgacagct

SEQ ID NO: 392395 - DNA, 20 bp, Artificial Sequence
  chemically synthesized
atctgagaggacgacagcta

SEQ ID NO: 392396 - DNA, 20 bp, Artificial Sequence
  chemically synthesized
aaaactatcccagaaatccc

SEQ ID NO: 392397 - DNA, 20 bp, Artificial Sequence
  chemically synthesized
ggacgacagctagggatttc

SEQ ID NO: 392398 - DNA, 20 bp, Artificial Sequence
  chemically synthesized
gacgacagctagggatttct

SEQ ID NO: 392399 - DNA, 20 bp, Artificial Sequence
  chemically synthesized
acagctagggatttctggga

SEQ ID NO: 392400 - DNA, 20 bp, Artificial Sequence
  chemically synthesized
tcaggaaaacaaaactatcc

SEQ ID NO: 392401 - DNA, 20 bp, Artificial Sequence
  chemically synthesized
gaagaggcagcatgtacatc

SEQ ID NO: 392402 - DNA, 20 bp, Artificial Sequence
  chemically synthesized
ggaagaggcagcatgtacat

SEQ ID NO: 392403 - DNA, 20 bp, Artificial Sequence
  chemically synthesized
aagcaagaagaaggaagagg

SEQ ID NO: 392404 - DNA, 20 bp, Artificial Sequence
  chemically synthesized
aggaagcaagaagaaggaag

SEQ ID NO: 392405 - DNA, 20 bp, Artificial Sequence
  chemically synthesized
aaggaagcaagaagaaggaa

SEQ ID NO: 392406 - DNA, 20 bp, Artificial Sequence
  chemically synthesized
aaaaggaagcaagaagaagg

SEQ ID NO: 392407 - DNA, 20 bp, Artificial Sequence
  chemically synthesized
tgaaaaaggaagcaagaaga

SEQ ID NO: 392408 - DNA, 20 bp, Artificial Sequence
  chemically synthesized
atgaaaaaggaagcaagaag

SEQ ID NO: 392409 - DNA, 20 bp, Artificial Sequence
  chemically synthesized
aagatgaaaaaggaagcaag

SEQ ID NO: 392410 - DNA, 20 bp, Artificial Sequence
  chemically synthesized
agaaagatgaaaaaggaagc

SEQ ID NO: 392411 - DNA, 20 bp, Artificial Sequence
  chemically synthesized
gagcagaaagatgaaaaagg

SEQ ID NO: 392412 - DNA, 20 bp, Artificial Sequence
  chemically synthesized
tcagagcagaaagatgaaaa

SEQ ID NO: 392413 - DNA, 20 bp, Artificial Sequence
  chemically synthesized
ttcagagcagaaagatgaaa

SEQ ID NO: 392414 - DNA, 20 bp, Artificial Sequence
  chemically synthesized
gtcttacatttcagagcaga

SEQ ID NO: 392415 - DNA, 20 bp, Artificial Sequence
  chemically synthesized
tcaagtcttacatttcagag

SEQ ID NO: 392416 - DNA, 20 bp, Artificial Sequence
  chemically synthesized
gcctcaagtcttacatttca

SEQ ID NO: 392417 - DNA, 20 bp, Artificial Sequence
  chemically synthesized
atctttctgctctgaaatgt

SEQ ID NO: 392418 - DNA, 20 bp, Artificial Sequence
  chemically synthesized
cagcctcaagtcttacattt

SEQ ID NO: 392419 - DNA, 20 bp, Artificial Sequence
  chemically synthesized
tgctctgaaatgtaagactt

SEQ ID NO: 392420 - DNA, 20 bp, Artificial Sequence
  chemically synthesized
gctctgaaatgtaagacttg

SEQ ID NO: 392421 - DNA, 20 bp, Artificial Sequence
  chemically synthesized
tgaaatgtaagacttgaggc

SEQ ID NO: 392422 - DNA, 20 bp, Artificial Sequence
  chemically synthesized
aaatgtaagacttgaggctg

SEQ ID NO: 392423 - DNA, 20 bp, Artificial Sequence
  chemically synthesized
gtttcaacatctccagcctc

SEQ ID NO: 392424 - DNA, 20 bp, Artificial Sequence
  chemically synthesized
gatgatggtttcaacatctc

SEQ ID NO: 392425 - DNA, 20 bp, Artificial Sequence
  chemically synthesized
aactcttggttgcaagatga

SEQ ID NO: 392426 - DNA, 20 bp, Artificial Sequence
  chemically synthesized
gaaaccatcatcttgcaacc

SEQ ID NO: 392427 - DNA, 20 bp, Artificial Sequence
  chemically synthesized
gcttgtcaactcttggttgc

SEQ ID NO: 392428 - DNA, 20 bp, Artificial Sequence
  chemically synthesized
aaccatcatcttgcaaccaa

SEQ ID NO: 392429 - DNA, 20 bp, Artificial Sequence
  chemically synthesized
ttctcatgcttgtcaactct

SEQ ID NO: 392430 - DNA, 20 bp, Artificial Sequence
  chemically synthesized
tcttgcaaccaagagttgac

SEQ ID NO: 392431 - DNA, 20 bp, Artificial Sequence
  chemically synthesized
aaccaagagttgacaagcat

SEQ ID NO: 392432 - DNA, 20 bp, Artificial Sequence
  chemically synthesized
gttgacaagcatgagaatga

SEQ ID NO: 392433 - DNA, 20 bp, Artificial Sequence
  chemically synthesized
acaagcatgagaatgatagt

SEQ ID NO: 392434 - DNA, 20 bp, Artificial Sequence
  chemically synthesized
caagcatgagaatgatagta

SEQ ID NO: 392435 - DNA, 20 bp, Artificial Sequence
  chemically synthesized
agaatgatagtaaggtgtaa

SEQ ID NO: 392436 - DNA, 20 bp, Artificial Sequence
  chemically synthesized
aatgatagtaaggtgtaaaa

SEQ ID NO: 392437 - DNA, 20 bp, Artificial Sequence
  chemically synthesized
atagtaaggtgtaaaagagc

SEQ ID NO: 392438 - DNA, 20 bp, Artificial Sequence
  chemically synthesized
gtaaggtgtaaaagagcaag

SEQ ID NO: 392439 - DNA, 20 bp, Artificial Sequence
  chemically synthesized
gtaaaagagcaagaagatca

SEQ ID NO: 392440 - DNA, 20 bp, Artificial Sequence
  chemically synthesized
taaaagagcaagaagatcaa

SEQ ID NO: 392441 - DNA, 20 bp, Artificial Sequence
  chemically synthesized
aaaagagcaagaagatcaaa

SEQ ID NO: 392442 - DNA, 20 bp, Artificial Sequence
  chemically synthesized
aaagagcaagaagatcaaag

SEQ ID NO: 392443 - DNA, 20 bp, Artificial Sequence
  chemically synthesized
gcaagaagatcaaaggggcc

SEQ ID NO: 392444 - DNA, 20 bp, Artificial Sequence
  chemically synthesized
caagaagatcaaaggggcct

SEQ ID NO: 392445 - DNA, 20 bp, Artificial Sequence
  chemically synthesized
tgtgatggcatgaaaatccc

SEQ ID NO: 392446 - DNA, 20 bp, Artificial Sequence
  chemically synthesized
ctgtgatggcatgaaaatcc

SEQ ID NO: 392447 - DNA, 20 bp, Artificial Sequence
  chemically synthesized
ctgggattttcatgccatca

SEQ ID NO: 392448 - DNA, 20 bp, Artificial Sequence
  chemically synthesized
tgggattttcatgccatcac

SEQ ID NO: 392449 - DNA, 20 bp, Artificial Sequence
  chemically synthesized
gggattttcatgccatcaca

SEQ ID NO: 392450 - DNA, 20 bp, Artificial Sequence
  chemically synthesized
gcaagaaactggccctgtga

SEQ ID NO: 392451 - DNA, 20 bp, Artificial Sequence
  chemically synthesized
ttttcatgccatcacagggc

SEQ ID NO: 392452 - DNA, 20 bp, Artificial Sequence
  chemically synthesized
tggagtctaaagcaagaaac

SEQ ID NO: 392453 - DNA, 20 bp, Artificial Sequence
  chemically synthesized
acagggccagtttcttgctt

SEQ ID NO: 392454 - DNA, 20 bp, Artificial Sequence
  chemically synthesized
gaaggaatggagtctaaagc

SEQ ID NO: 392455 - DNA, 20 bp, Artificial Sequence
  chemically synthesized
atctgaaggaatggagtcta

SEQ ID NO: 392456 - DNA, 20 bp, Artificial Sequence
  chemically synthesized
tgatggaatctgaaggaatg

SEQ ID NO: 392457 - DNA, 20 bp, Artificial Sequence
  chemically synthesized
tgctttagactccattcctt

SEQ ID NO: 392458 - DNA, 20 bp, Artificial Sequence
  chemically synthesized
tatgatggaatctgaaggaa

SEQ ID NO: 392459 - DNA, 20 bp, Artificial Sequence
  chemically synthesized
tctcatatgatggaatctga

SEQ ID NO: 392460 - DNA, 20 bp, Artificial Sequence
  chemically synthesized
ttctcatatgatggaatctg

SEQ ID NO: 392461 - DNA, 20 bp, Artificial Sequence
  chemically synthesized
tccttcagattccatcatat

SEQ ID NO: 392462 - DNA, 20 bp, Artificial Sequence
  chemically synthesized
attttaactttctcatatga

SEQ ID NO: 392463 - DNA, 20 bp, Artificial Sequence
  chemically synthesized
tcagattccatcatatgaga

SEQ ID NO: 392464 - DNA, 20 bp, Artificial Sequence
  chemically synthesized
atgagaaagttaaaatcctc

SEQ ID NO: 392465 - DNA, 20 bp, Artificial Sequence
  chemically synthesized
aagttaaaatcctctggttc

SEQ ID NO: 392466 - DNA, 20 bp, Artificial Sequence
  chemically synthesized
gtagcagaaactagaaccag

SEQ ID NO: 392467 - DNA, 20 bp, Artificial Sequence
  chemically synthesized
agtagcagaaactagaacca

SEQ ID NO: 392468 - DNA, 20 bp, Artificial Sequence
  chemically synthesized
gaagtagcagaaactagaac

SEQ ID NO: 392469 - DNA, 20 bp, Artificial Sequence
  chemically synthesized
tgcatcgaagtagcagaaac

SEQ ID NO: 392470 - DNA, 20 bp, Artificial Sequence
  chemically synthesized
gcatttttgcatcgaagtag

SEQ ID NO: 392471 - DNA, 20 bp, Artificial Sequence
  chemically synthesized
attgcatttttgcatcgaag

SEQ ID NO: 392472 - DNA, 20 bp, Artificial Sequence
  chemically synthesized
gggattgcatttttgcatcg

SEQ ID NO: 392473 - DNA, 20 bp, Artificial Sequence
  chemically synthesized
cgatgcaaaaatgcaatccc

SEQ ID NO: 392474 - DNA, 20 bp, Artificial Sequence
  chemically synthesized
caaaaatgcaatccctggcc

SEQ ID NO: 392475 - DNA, 20 bp, Artificial Sequence
  chemically synthesized
tgagccaccgtgccaggcca

SEQ ID NO: 392476 - DNA, 20 bp, Artificial Sequence
  chemically synthesized
atgagccaccgtgccaggcc

SEQ ID NO: 392477 - DNA, 20 bp, Artificial Sequence
  chemically synthesized
catgagccaccgtgccaggc

SEQ ID NO: 392478 - DNA, 20 bp, Artificial Sequence
  chemically synthesized
atgcaatccctggcctggca

SEQ ID NO: 392479 - DNA, 20 bp, Artificial Sequence
  chemically synthesized
caatccctggcctggcacgg

SEQ ID NO: 392480 - DNA, 20 bp, Artificial Sequence
  chemically synthesized
caagcatgagccaccgtgcc

SEQ ID NO: 392481 - DNA, 20 bp, Artificial Sequence
  chemically synthesized
acaagcatgagccaccgtgc

SEQ ID NO: 392482 - DNA, 20 bp, Artificial Sequence
  chemically synthesized
agtgctaggattacaagcat

SEQ ID NO: 392483 - DNA, 20 bp, Artificial Sequence
  chemically synthesized
gtggctcatgcttgtaatcc

SEQ ID NO: 392484 - DNA, 20 bp, Artificial Sequence
  chemically synthesized
tcccaaagtgctaggattac

SEQ ID NO: 392485 - DNA, 20 bp, Artificial Sequence
  chemically synthesized
tgcttgtaatcctagcactt

SEQ ID NO: 392486 - DNA, 20 bp, Artificial Sequence
  chemically synthesized
cctcggcctcccaaagtgct

SEQ ID NO: 392487 - DNA, 20 bp, Artificial Sequence
  chemically synthesized
gcttgtaatcctagcacttt

SEQ ID NO: 392488 - DNA, 20 bp, Artificial Sequence
  chemically synthesized
acctcggcctcccaaagtgc

SEQ ID NO: 392489 - DNA, 20 bp, Artificial Sequence
  chemically synthesized
ttgtaatcctagcactttgg

SEQ ID NO: 392490 - DNA, 20 bp, Artificial Sequence
  chemically synthesized
tgtaatcctagcactttggg

SEQ ID NO: 392491 - DNA, 20 bp, Artificial Sequence
  chemically synthesized
ccacctacctcggcctccca

SEQ ID NO: 392492 - DNA, 20 bp, Artificial Sequence
  chemically synthesized
tcctagcactttgggaggcc

SEQ ID NO: 392493 - DNA, 20 bp, Artificial Sequence
  chemically synthesized
cctagcactttgggaggccg

SEQ ID NO: 392494 - DNA, 20 bp, Artificial Sequence
  chemically synthesized
agcactttgggaggccgagg

SEQ ID NO: 392495 - DNA, 20 bp, Artificial Sequence
  chemically synthesized
gcactttgggaggccgaggt

SEQ ID NO: 392496 - DNA, 20 bp, Artificial Sequence
  chemically synthesized
ctttgggaggccgaggtagg

SEQ ID NO: 392497 - DNA, 20 bp, Artificial Sequence
  chemically synthesized
ctcaaatgatccacctacct

SEQ ID NO: 392498 - DNA, 20 bp, Artificial Sequence
  chemically synthesized
ccgaggtaggtggatcattt

SEQ ID NO: 392499 - DNA, 20 bp, Artificial Sequence
  chemically synthesized
cgaggtaggtggatcatttg

SEQ ID NO: 392500 - DNA, 20 bp, Artificial Sequence
  chemically synthesized
gtaggtggatcatttgaggt

SEQ ID NO: 392501 - DNA, 20 bp, Artificial Sequence
  chemically synthesized
ggtggatcatttgaggtcag

SEQ ID NO: 392502 - DNA, 20 bp, Artificial Sequence
  chemically synthesized
tgaggtcagaagtttgtgac

SEQ ID NO: 392503 - DNA, 20 bp, Artificial Sequence
  chemically synthesized
tcagaagtttgtgaccagtc

SEQ ID NO: 392504 - DNA, 20 bp, Artificial Sequence
  chemically synthesized
tttcaccatgttggccagac

SEQ ID NO: 392505 - DNA, 20 bp, Artificial Sequence
  chemically synthesized
tgtgaccagtctggccaaca

SEQ ID NO: 392506 - DNA, 20 bp, Artificial Sequence
  chemically synthesized
tggggtttcaccatgttggc

SEQ ID NO: 392507 - DNA, 20 bp, Artificial Sequence
  chemically synthesized
gagatggggtttcaccatgt

SEQ ID NO: 392508 - DNA, 20 bp, Artificial Sequence
  chemically synthesized
ttgtatttttagtagagatg

SEQ ID NO: 392509 - DNA, 20 bp, Artificial Sequence
  chemically synthesized
tttgtatttttagtagagat

SEQ ID NO: 392510 - DNA, 20 bp, Artificial Sequence
  chemically synthesized
ttttgtatttttagtagaga

SEQ ID NO: 392511 - DNA, 20 bp, Artificial Sequence
  chemically synthesized
taatttttgtatttttagta

SEQ ID NO: 392512 - DNA, 20 bp, Artificial Sequence
  chemically synthesized
gctaatttttgtatttttag

SEQ ID NO: 392513 - DNA, 20 bp, Artificial Sequence
  chemically synthesized
ccagctaatttttgtatttt

SEQ ID NO: 392514 - DNA, 20 bp, Artificial Sequence
  chemically synthesized
tctactaaaaatacaaaaat

SEQ ID NO: 392515 - DNA, 20 bp, Artificial Sequence
  chemically synthesized
ctaaaaatacaaaaattagc

SEQ ID NO: 392516 - DNA, 20 bp, Artificial Sequence
  chemically synthesized
taaaaatacaaaaattagct

SEQ ID NO: 392517 - DNA, 20 bp, Artificial Sequence
  chemically synthesized
atacaaaaattagctgggtg

SEQ ID NO: 392518 - DNA, 20 bp, Artificial Sequence
  chemically synthesized
caaaaattagctgggtgtgg

SEQ ID NO: 392519 - DNA, 20 bp, Artificial Sequence
  chemically synthesized
caggcttgcgccaccacacc

SEQ ID NO: 392520 - DNA, 20 bp, Artificial Sequence
  chemically synthesized
ttagctgggtgtggtggcgc

SEQ ID NO: 392521 - DNA, 20 bp, Artificial Sequence
  chemically synthesized
gtggcgcaagcctgtaatcc

SEQ ID NO: 392522 - DNA, 20 bp, Artificial Sequence
  chemically synthesized
tcccgagtagctgggattac

SEQ ID NO: 392523 - DNA, 20 bp, Artificial Sequence
  chemically synthesized
ctcccgagtagctgggatta

SEQ ID NO: 392524 - DNA, 20 bp, Artificial Sequence
  chemically synthesized
agcctgtaatcccagctact

SEQ ID NO: 392525 - DNA, 20 bp, Artificial Sequence
  chemically synthesized
cctcagcctcccgagtagct

SEQ ID NO: 392526 - DNA, 20 bp, Artificial Sequence
  chemically synthesized
gcctgtaatcccagctactc

SEQ ID NO: 392527 - DNA, 20 bp, Artificial Sequence
  chemically synthesized
gcctcagcctcccgagtagc

SEQ ID NO: 392528 - DNA, 20 bp, Artificial Sequence
  chemically synthesized
ctgtaatcccagctactcgg

SEQ ID NO: 392529 - DNA, 20 bp, Artificial Sequence
  chemically synthesized
tgtaatcccagctactcggg

SEQ ID NO: 392530 - DNA, 20 bp, Artificial Sequence
  chemically synthesized
tcctgcctcagcctcccgag

SEQ ID NO: 392531 - DNA, 20 bp, Artificial Sequence
  chemically synthesized
ttctcctgcctcagcctccc

SEQ ID NO: 392532 - DNA, 20 bp, Artificial Sequence
  chemically synthesized
tcccagctactcgggaggct

SEQ ID NO: 392533 - DNA, 20 bp, Artificial Sequence
  chemically synthesized
cccagctactcgggaggctg

SEQ ID NO: 392534 - DNA, 20 bp, Artificial Sequence
  chemically synthesized
agctactcgggaggctgagg

SEQ ID NO: 392535 - DNA, 20 bp, Artificial Sequence
  chemically synthesized
gctactcgggaggctgaggc

SEQ ID NO: 392536 - DNA, 20 bp, Artificial Sequence
  chemically synthesized
tactcgggaggctgaggcag

SEQ ID NO: 392537 - DNA, 20 bp, Artificial Sequence
  chemically synthesized
ttcaagcgattctcctgcct

SEQ ID NO: 392538 - DNA, 20 bp, Artificial Sequence
  chemically synthesized
tgaggcaggagaatcgcttg

SEQ ID NO: 392539 - DNA, 20 bp, Artificial Sequence
  chemically synthesized
gcaggagaatcgcttgaagc

SEQ ID NO: 392540 - DNA, 20 bp, Artificial Sequence
  chemically synthesized
caggagaatcgcttgaagct

SEQ ID NO: 392541 - DNA, 20 bp, Artificial Sequence
  chemically synthesized
aacctccgcctcccagcttc

SEQ ID NO: 392542 - DNA, 20 bp, Artificial Sequence
  chemically synthesized
ggagaatcgcttgaagctgg

SEQ ID NO: 392543 - DNA, 20 bp, Artificial Sequence
  chemically synthesized
gagaatcgcttgaagctggg

SEQ ID NO: 392544 - DNA, 20 bp, Artificial Sequence
  chemically synthesized
aatcgcttgaagctgggagg

SEQ ID NO: 392545 - DNA, 20 bp, Artificial Sequence
  chemically synthesized
tcgcttgaagctgggaggcg

SEQ ID NO: 392546 - DNA, 20 bp, Artificial Sequence
  chemically synthesized
tcactgcaacctccgcctcc

SEQ ID NO: 392547 - DNA, 20 bp, Artificial Sequence
  chemically synthesized
cgcttgaagctgggaggcgg

SEQ ID NO: 392548 - DNA, 20 bp, Artificial Sequence
  chemically synthesized
aagctgggaggcggaggttg

SEQ ID NO: 392549 - DNA, 20 bp, Artificial Sequence
  chemically synthesized
ggcggaggttgcagtgaatt

SEQ ID NO: 392550 - DNA, 20 bp, Artificial Sequence
  chemically synthesized
ttaccaaagctggagtgcag

SEQ ID NO: 392551 - DNA, 20 bp, Artificial Sequence
  chemically synthesized
gagatcgcgcctctgcactc

SEQ ID NO: 392552 - DNA, 20 bp, Artificial Sequence
  chemically synthesized
attaccaaagctggagtgca

SEQ ID NO: 392553 - DNA, 20 bp, Artificial Sequence
  chemically synthesized
ctattaccaaagctggagtg

SEQ ID NO: 392554 - DNA, 20 bp, Artificial Sequence
  chemically synthesized
gcgcctctgcactccagctt

SEQ ID NO: 392555 - DNA, 20 bp, Artificial Sequence
  chemically synthesized
tcgttctattaccaaagctg

SEQ ID NO: 392556 - DNA, 20 bp, Artificial Sequence
  chemically synthesized
tctcgttctattaccaaagc

SEQ ID NO: 392557 - DNA, 20 bp, Artificial Sequence
  chemically synthesized
ctgcactccagctttggtaa

SEQ ID NO: 392558 - DNA, 20 bp, Artificial Sequence
  chemically synthesized
cgagtctcgttctattacca

SEQ ID NO: 392559 - DNA, 20 bp, Artificial Sequence
  chemically synthesized
tccagctttggtaatagaac

SEQ ID NO: 392560 - DNA, 20 bp, Artificial Sequence
  chemically synthesized
tatttttttttttttgagac

SEQ ID NO: 392561 - DNA, 20 bp, Artificial Sequence
  chemically synthesized
ggttgtattttttttttttt

SEQ ID NO: 392562 - DNA, 20 bp, Artificial Sequence
  chemically synthesized
aaaaatacaaccctcacttg

SEQ ID NO: 392563 - DNA, 20 bp, Artificial Sequence
  chemically synthesized
ttgagaggaactgcaagtga

SEQ ID NO: 392564 - DNA, 20 bp, Artificial Sequence
  chemically synthesized
gttgagaggaactgcaagtg

SEQ ID NO: 392565 - DNA, 20 bp, Artificial Sequence
  chemically synthesized
agttgagaggaactgcaagt

SEQ ID NO: 392566 - DNA, 20 bp, Artificial Sequence
  chemically synthesized
gcccagttgagaggaactgc

SEQ ID NO: 392567 - DNA, 20 bp, Artificial Sequence
  chemically synthesized
cacttgcagttcctctcaac

SEQ ID NO: 392568 - DNA, 20 bp, Artificial Sequence
  chemically synthesized
acttgcagttcctctcaact

SEQ ID NO: 392569 - DNA, 20 bp, Artificial Sequence
  chemically synthesized
tggtggtgtgcccagttgag

SEQ ID NO: 392570 - DNA, 20 bp, Artificial Sequence
  chemically synthesized
atggtggtgtgcccagttga

SEQ ID NO: 392571 - DNA, 20 bp, Artificial Sequence
  chemically synthesized
gtatggtggtgtgcccagtt

SEQ ID NO: 392572 - DNA, 20 bp, Artificial Sequence
  chemically synthesized
ccagggtatggtggtgtgcc

SEQ ID NO: 392573 - DNA, 20 bp, Artificial Sequence
  chemically synthesized
taaatgtacccagggtatgg

SEQ ID NO: 392574 - DNA, 20 bp, Artificial Sequence
  chemically synthesized
ctgggcacaccaccataccc

SEQ ID NO: 392575 - DNA, 20 bp, Artificial Sequence
  chemically synthesized
tgggcacaccaccataccct

SEQ ID NO: 392576 - DNA, 20 bp, Artificial Sequence
  chemically synthesized
tcttaaatgtacccagggta

SEQ ID NO: 392577 - DNA, 20 bp, Artificial Sequence
  chemically synthesized
acgtttcttaaatgtaccca

SEQ ID NO: 392578 - DNA, 20 bp, Artificial Sequence
  chemically synthesized
cacgtttcttaaatgtaccc

SEQ ID NO: 392579 - DNA, 20 bp, Artificial Sequence
  chemically synthesized
tcacgtttcttaaatgtacc

SEQ ID NO: 392580 - DNA, 20 bp, Artificial Sequence
  chemically synthesized
accataccctgggtacattt

SEQ ID NO: 392581 - DNA, 20 bp, Artificial Sequence
  chemically synthesized
ggtacatttaagaaacgtga

SEQ ID NO: 392582 - DNA, 20 bp, Artificial Sequence
  chemically synthesized
atccgttatggggacaatca

SEQ ID NO: 392583 - DNA, 20 bp, Artificial Sequence
  chemically synthesized
cactgtgattgtccccataa

SEQ ID NO: 392584 - DNA, 20 bp, Artificial Sequence
  chemically synthesized
gcacctttccatccgttatg

SEQ ID NO: 392585 - DNA, 20 bp, Artificial Sequence
  chemically synthesized
agcacctttccatccgttat

SEQ ID NO: 392586 - DNA, 20 bp, Artificial Sequence
  chemically synthesized
gtgattgtccccataacgga

SEQ ID NO: 392587 - DNA, 20 bp, Artificial Sequence
  chemically synthesized
gagcacctttccatccgtta

SEQ ID NO: 392588 - DNA, 20 bp, Artificial Sequence
  chemically synthesized
ttgtccccataacggatgga

SEQ ID NO: 392589 - DNA, 20 bp, Artificial Sequence
  chemically synthesized
tgtccccataacggatggaa

SEQ ID NO: 392590 - DNA, 20 bp, Artificial Sequence
  chemically synthesized
aacggatggaaaggtgctct

SEQ ID NO: 392591 - DNA, 20 bp, Artificial Sequence
  chemically synthesized
acggatggaaaggtgctcta

SEQ ID NO: 392592 - DNA, 20 bp, Artificial Sequence
  chemically synthesized
ctggatgtctggcgtcctta

SEQ ID NO: 392593 - DNA, 20 bp, Artificial Sequence
  chemically synthesized
gaaaggtgctctaaggacgc

SEQ ID NO: 392594 - DNA, 20 bp, Artificial Sequence
  chemically synthesized
tactggatgtctggcgtcct

SEQ ID NO: 392595 - DNA, 20 bp, Artificial Sequence
  chemically synthesized
ctctaaggacgccagacatc

SEQ ID NO: 392596 - DNA, 20 bp, Artificial Sequence
  chemically synthesized
cctgcgtgttactggatgtc

SEQ ID NO: 392597 - DNA, 20 bp, Artificial Sequence
  chemically synthesized
tggactttcctgcgtgttac

SEQ ID NO: 392598 - DNA, 20 bp, Artificial Sequence
  chemically synthesized
gccagacatccagtaacacg

SEQ ID NO: 392599 - DNA, 20 bp, Artificial Sequence
  chemically synthesized
ccagacatccagtaacacgc

SEQ ID NO: 392600 - DNA, 20 bp, Artificial Sequence
  chemically synthesized
acatccagtaacacgcagga

SEQ ID NO: 392601 - DNA, 20 bp, Artificial Sequence
  chemically synthesized
cagtaacacgcaggaaagtc

SEQ ID NO: 392602 - DNA, 20 bp, Artificial Sequence
  chemically synthesized
agtaacacgcaggaaagtcc

SEQ ID NO: 392603 - DNA, 20 bp, Artificial Sequence
  chemically synthesized
gcaggaaagtccaggaaaat

SEQ ID NO: 392604 - DNA, 20 bp, Artificial Sequence
  chemically synthesized
gaaacaattactcattttcc

SEQ ID NO: 392605 - DNA, 20 bp, Artificial Sequence
  chemically synthesized
taattgtttcatgtcctatt

SEQ ID NO: 392606 - DNA, 20 bp, Artificial Sequence
  chemically synthesized
ctacttttcaaaagctgaat

SEQ ID NO: 392607 - DNA, 20 bp, Artificial Sequence
  chemically synthesized
cctacttttcaaaagctgaa

SEQ ID NO: 392608 - DNA, 20 bp, Artificial Sequence
  chemically synthesized
tgtcctattcagcttttgaa

SEQ ID NO: 392609 - DNA, 20 bp, Artificial Sequence
  chemically synthesized
ggctgtcccctacttttcaa

SEQ ID NO: 392610 - DNA, 20 bp, Artificial Sequence
  chemically synthesized
cctattcagcttttgaaaag

SEQ ID NO: 392611 - DNA, 20 bp, Artificial Sequence
  chemically synthesized
ctattcagcttttgaaaagt

SEQ ID NO: 392612 - DNA, 20 bp, Artificial Sequence
  chemically synthesized
tattcagcttttgaaaagta

SEQ ID NO: 392613 - DNA, 20 bp, Artificial Sequence
  chemically synthesized
attcagcttttgaaaagtag

SEQ ID NO: 392614 - DNA, 20 bp, Artificial Sequence
  chemically synthesized
agcttttgaaaagtagggga

SEQ ID NO: 392615 - DNA, 20 bp, Artificial Sequence
  chemically synthesized
gtaggggacagcctgtttat

SEQ ID NO: 392616 - DNA, 20 bp, Artificial Sequence
  chemically synthesized
atattcacatacttataaac

SEQ ID NO: 392617 - DNA, 20 bp, Artificial Sequence
  chemically synthesized
tatattcacatacttataaa

SEQ ID NO: 392618 - DNA, 20 bp, Artificial Sequence
  chemically synthesized
tttataagtatgtgaatata

SEQ ID NO: 392619 - DNA, 20 bp, Artificial Sequence
  chemically synthesized
gtatgtgaatatatagaacc

SEQ ID NO: 392620 - DNA, 20 bp, Artificial Sequence
  chemically synthesized
tttatatgtaaaattgagct

SEQ ID NO: 392621 - DNA, 20 bp, Artificial Sequence
  chemically synthesized
atttatatgtaaaattgagc

SEQ ID NO: 392622 - DNA, 20 bp, Artificial Sequence
  chemically synthesized
ttgtatttatatgtaaaatt

SEQ ID NO: 392623 - DNA, 20 bp, Artificial Sequence
  chemically synthesized
caattttacatataaataca

SEQ ID NO: 392624 - DNA, 20 bp, Artificial Sequence
  chemically synthesized
tggaaaatgcagtgcatata

SEQ ID NO: 392625 - DNA, 20 bp, Artificial Sequence
  chemically synthesized
agtttcattcttggaaaatg

SEQ ID NO: 392626 - DNA, 20 bp, Artificial Sequence
  chemically synthesized
ttatatgcactgcattttcc

SEQ ID NO: 392627 - DNA, 20 bp, Artificial Sequence
  chemically synthesized
ttgtgggatagtttcattct

SEQ ID NO: 392628 - DNA, 20 bp, Artificial Sequence
  chemically synthesized
ccctttgatttattgtggga

SEQ ID NO: 392629 - DNA, 20 bp, Artificial Sequence
  chemically synthesized
ttttccctttgatttattgt

SEQ ID NO: 392630 - DNA, 20 bp, Artificial Sequence
  chemically synthesized
attttccctttgatttattg

SEQ ID NO: 392631 - DNA, 20 bp, Artificial Sequence
  chemically synthesized
aactatcccacaataaatca

SEQ ID NO: 392632 - DNA, 20 bp, Artificial Sequence
  chemically synthesized
actatcccacaataaatcaa

SEQ ID NO: 392633 - DNA, 20 bp, Artificial Sequence
  chemically synthesized
ctatcccacaataaatcaaa

SEQ ID NO: 392634 - DNA, 20 bp, Artificial Sequence
  chemically synthesized
ggtaaagttctgaataaaat

SEQ ID NO: 392635 - DNA, 20 bp, Artificial Sequence
  chemically synthesized
aaatgtgcacttattttatt

SEQ ID NO: 392636 - DNA, 20 bp, Artificial Sequence
  chemically synthesized
atgattaataacatttggta

SEQ ID NO: 392637 - DNA, 20 bp, Artificial Sequence
  chemically synthesized
tctgtatgattaataacatt

SEQ ID NO: 392638 - DNA, 20 bp, Artificial Sequence
  chemically synthesized
accaaatgttattaatcata

SEQ ID NO: 392639 - DNA, 20 bp, Artificial Sequence
  chemically synthesized
acagcatattttaaagtaat

SEQ ID NO: 392640 - DNA, 20 bp, Artificial Sequence
  chemically synthesized
aacagcatattttaaagtaa

SEQ ID NO: 392641 - DNA, 20 bp, Artificial Sequence
  chemically synthesized
gccatgaacagcatatttta

SEQ ID NO: 392642 - DNA, 20 bp, Artificial Sequence
  chemically synthesized
actttaaaatatgctgttca

SEQ ID NO: 392643 - DNA, 20 bp, Artificial Sequence
  chemically synthesized
aatgattaaaatgccatgaa

SEQ ID NO: 392644 - DNA, 20 bp, Artificial Sequence
  chemically synthesized
tgctgacgtatgcaggtgag

SEQ ID NO: 392645 - DNA, 20 bp, Artificial Sequence
  chemically synthesized
aaatgctgacgtatgcaggt

SEQ ID NO: 392646 - DNA, 20 bp, Artificial Sequence
  chemically synthesized
ctcgaaatgctgacgtatgc

SEQ ID NO: 392647 - DNA, 20 bp, Artificial Sequence
  chemically synthesized
taccactcacctgcatacgt

SEQ ID NO: 392648 - DNA, 20 bp, Artificial Sequence
  chemically synthesized
gctcgaaatgctgacgtatg

SEQ ID NO: 392649 - DNA, 20 bp, Artificial Sequence
  chemically synthesized
cctgcatacgtcagcatttc

SEQ ID NO: 392650 - DNA, 20 bp, Artificial Sequence
  chemically synthesized
cctaaaaccacagaagtaga

SEQ ID NO: 392651 - DNA, 20 bp, Artificial Sequence
  chemically synthesized
tttcgagctgtctacttctg

SEQ ID NO: 392652 - DNA, 20 bp, Artificial Sequence
  chemically synthesized
tgtacctaaaaccacagaag

SEQ ID NO: 392653 - DNA, 20 bp, Artificial Sequence
  chemically synthesized
acctgtacctaaaaccacag

SEQ ID NO: 392654 - DNA, 20 bp, Artificial Sequence
  chemically synthesized
gctgtctacttctgtggttt

SEQ ID NO: 392655 - DNA, 20 bp, Artificial Sequence
  chemically synthesized
ctgtctacttctgtggtttt

SEQ ID NO: 392656 - DNA, 20 bp, Artificial Sequence
  chemically synthesized
agtacctgtacctaaaacca

SEQ ID NO: 392657 - DNA, 20 bp, Artificial Sequence
  chemically synthesized
tacttctgtggttttaggta

SEQ ID NO: 392658 - DNA, 20 bp, Artificial Sequence
  chemically synthesized
acttctgtggttttaggtac

SEQ ID NO: 392659 - DNA, 20 bp, Artificial Sequence
  chemically synthesized
catactgctctagataaatg

SEQ ID NO: 392660 - DNA, 20 bp, Artificial Sequence
  chemically synthesized
gtacaggtactacatttatc

SEQ ID NO: 392661 - DNA, 20 bp, Artificial Sequence
  chemically synthesized
acaggtactacatttatcta

SEQ ID NO: 392662 - DNA, 20 bp, Artificial Sequence
  chemically synthesized
ggtactacatttatctagag

SEQ ID NO: 392663 - DNA, 20 bp, Artificial Sequence
  chemically synthesized
aagaaaggtacatactgctc

SEQ ID NO: 392664 - DNA, 20 bp, Artificial Sequence
  chemically synthesized
attcaatatgaaaataagaa

SEQ ID NO: 392665 - DNA, 20 bp, Artificial Sequence
  chemically synthesized
tattcaatatgaaaataaga

SEQ ID NO: 392666 - DNA, 20 bp, Artificial Sequence
  chemically synthesized
taattattcaatatgaaaat

SEQ ID NO: 392667 - DNA, 20 bp, Artificial Sequence
  chemically synthesized
caataatgaattaaaaataa

SEQ ID NO: 392668 - DNA, 20 bp, Artificial Sequence
  chemically synthesized
ccttgtaaaaaataaatcaa

SEQ ID NO: 392669 - DNA, 20 bp, Artificial Sequence
  chemically synthesized
accttgtaaaaaataaatca

SEQ ID NO: 392670 - DNA, 20 bp, Artificial Sequence
  chemically synthesized
tcctttgatttattttttac

SEQ ID NO: 392671 - DNA, 20 bp, Artificial Sequence
  chemically synthesized
cctttgatttattttttaca

SEQ ID NO: 392672 - DNA, 20 bp, Artificial Sequence
  chemically synthesized
tttttacaaggtaattgttt

SEQ ID NO: 392673 - DNA, 20 bp, Artificial Sequence
  chemically synthesized
agaattttatatatatatgt

SEQ ID NO: 392674 - DNA, 20 bp, Artificial Sequence
  chemically synthesized
atatatgtaagttacatttt

SEQ ID NO: 392675 - DNA, 20 bp, Artificial Sequence
  chemically synthesized
atttttggtaaattctcttt

SEQ ID NO: 392676 - DNA, 20 bp, Artificial Sequence
  chemically synthesized
tttttggtaaattctctttg

SEQ ID NO: 392677 - DNA, 20 bp, Artificial Sequence
  chemically synthesized
ctcccattactatcctcaaa

SEQ ID NO: 392678 - DNA, 20 bp, Artificial Sequence
  chemically synthesized
tggtaaattctctttgagga

SEQ ID NO: 392679 - DNA, 20 bp, Artificial Sequence
  chemically synthesized
tactcccattactatcctca

SEQ ID NO: 392680 - DNA, 20 bp, Artificial Sequence
  chemically synthesized
attctctttgaggatagtaa

SEQ ID NO: 392681 - DNA, 20 bp, Artificial Sequence
  chemically synthesized
ttctctttgaggatagtaat

SEQ ID NO: 392682 - DNA, 20 bp, Artificial Sequence
  chemically synthesized
ctctttgaggatagtaatgg

SEQ ID NO: 392683 - DNA, 20 bp, Artificial Sequence
  chemically synthesized
ttacaaaatatgtcttacaa

SEQ ID NO: 392684 - DNA, 20 bp, Artificial Sequence
  chemically synthesized
acaaaatatgtcttacaaaa

SEQ ID NO: 392685 - DNA, 20 bp, Artificial Sequence
  chemically synthesized
caaaatatgtcttacaaaag

SEQ ID NO: 392686 - DNA, 20 bp, Artificial Sequence
  chemically synthesized
gactgaacaccctcttttgt

SEQ ID NO: 392687 - DNA, 20 bp, Artificial Sequence
  chemically synthesized
aaaatatgtcttacaaaaga

SEQ ID NO: 392688 - DNA, 20 bp, Artificial Sequence
  chemically synthesized
gtcttacaaaagagggtgtt

SEQ ID NO: 392689 - DNA, 20 bp, Artificial Sequence
  chemically synthesized
aaagagggtgttcagtctta

SEQ ID NO: 392690 - DNA, 20 bp, Artificial Sequence
  chemically synthesized
aagagggtgttcagtcttac

SEQ ID NO: 392691 - DNA, 20 bp, Artificial Sequence
  chemically synthesized
agagggtgttcagtcttaca

SEQ ID NO: 392692 - DNA, 20 bp, Artificial Sequence
  chemically synthesized
cgtataggttttaaccctgt

SEQ ID NO: 392693 - DNA, 20 bp, Artificial Sequence
  chemically synthesized
ttacagggttaaaacctata

SEQ ID NO: 392694 - DNA, 20 bp, Artificial Sequence
  chemically synthesized
ttttcttctatgtaccgtat

SEQ ID NO: 392695 - DNA, 20 bp, Artificial Sequence
  chemically synthesized
tttttcttctatgtaccgta

SEQ ID NO: 392696 - DNA, 20 bp, Artificial Sequence
  chemically synthesized
gttaaaacctatacggtaca

SEQ ID NO: 392697 - DNA, 20 bp, Artificial Sequence
  chemically synthesized
aaaacctatacggtacatag

SEQ ID NO: 392698 - DNA, 20 bp, Artificial Sequence
  chemically synthesized
tacggtacatagaagaaaaa

SEQ ID NO: 392699 - DNA, 20 bp, Artificial Sequence
  chemically synthesized
agaagaaaaaaagtttttaa

SEQ ID NO: 392700 - DNA, 20 bp, Artificial Sequence
  chemically synthesized
aaaagtttttaaaagaaaca

SEQ ID NO: 392701 - DNA, 20 bp, Artificial Sequence
  chemically synthesized
agtttttaaaagaaacacgg

SEQ ID NO: 392702 - DNA, 20 bp, Artificial Sequence
  chemically synthesized
ttaaaagaaacacggtagcc

SEQ ID NO: 392703 - DNA, 20 bp, Artificial Sequence
  chemically synthesized
agaaacacggtagcctggcg

SEQ ID NO: 392704 - DNA, 20 bp, Artificial Sequence
  chemically synthesized
aacacggtagcctggcgtgg

SEQ ID NO: 392705 - DNA, 20 bp, Artificial Sequence
  chemically synthesized
caggtgtgagccaccacgcc

SEQ ID NO: 392706 - DNA, 20 bp, Artificial Sequence
  chemically synthesized
acaggtgtgagccaccacgc

SEQ ID NO: 392707 - DNA, 20 bp, Artificial Sequence
  chemically synthesized
tgtgttgggattacaggtgt

SEQ ID NO: 392708 - DNA, 20 bp, Artificial Sequence
  chemically synthesized
tcccaatgtgttgggattac

SEQ ID NO: 392709 - DNA, 20 bp, Artificial Sequence
  chemically synthesized
ctcccaatgtgttgggatta

SEQ ID NO: 392710 - DNA, 20 bp, Artificial Sequence
  chemically synthesized
cacctgtaatcccaacacat

SEQ ID NO: 392711 - DNA, 20 bp, Artificial Sequence
  chemically synthesized
ccttggactcccaatgtgtt

SEQ ID NO: 392712 - DNA, 20 bp, Artificial Sequence
  chemically synthesized
acctgtaatcccaacacatt

SEQ ID NO: 392713 - DNA, 20 bp, Artificial Sequence
  chemically synthesized
accttggactcccaatgtgt

SEQ ID NO: 392714 - DNA, 20 bp, Artificial Sequence
  chemically synthesized
ctgtaatcccaacacattgg

SEQ ID NO: 392715 - DNA, 20 bp, Artificial Sequence
  chemically synthesized
tcccaacacattgggagtcc

SEQ ID NO: 392716 - DNA, 20 bp, Artificial Sequence
  chemically synthesized
cccaacacattgggagtcca

SEQ ID NO: 392717 - DNA, 20 bp, Artificial Sequence
  chemically synthesized
aacacattgggagtccaagg

SEQ ID NO: 392718 - DNA, 20 bp, Artificial Sequence
  chemically synthesized
acacattgggagtccaaggt

SEQ ID NO: 392719 - DNA, 20 bp, Artificial Sequence
  chemically synthesized
cacattgggagtccaaggtg

SEQ ID NO: 392720 - DNA, 20 bp, Artificial Sequence
  chemically synthesized
tcaagcgatccgccccacct

SEQ ID NO: 392721 - DNA, 20 bp, Artificial Sequence
  chemically synthesized
attgggagtccaaggtgggg

SEQ ID NO: 392722 - DNA, 20 bp, Artificial Sequence
  chemically synthesized
caaggtggggcggatcgctt

SEQ ID NO: 392723 - DNA, 20 bp, Artificial Sequence
  chemically synthesized
aaggtggggcggatcgcttg

SEQ ID NO: 392724 - DNA, 20 bp, Artificial Sequence
  chemically synthesized
tggggcggatcgcttgaggt

SEQ ID NO: 392725 - DNA, 20 bp, Artificial Sequence
  chemically synthesized
ggggcggatcgcttgaggtc

SEQ ID NO: 392726 - DNA, 20 bp, Artificial Sequence
  chemically synthesized
ggtctcaaactcctgacctc

SEQ ID NO: 392727 - DNA, 20 bp, Artificial Sequence
  chemically synthesized
ggcggatcgcttgaggtcag

SEQ ID NO: 392728 - DNA, 20 bp, Artificial Sequence
  chemically synthesized
tcgcttgaggtcaggagttt

SEQ ID NO: 392729 - DNA, 20 bp, Artificial Sequence
  chemically synthesized
tgaggtcaggagtttgagac

SEQ ID NO: 392730 - DNA, 20 bp, Artificial Sequence
  chemically synthesized
tcaggagtttgagaccagcc

SEQ ID NO: 392731 - DNA, 20 bp, Artificial Sequence
  chemically synthesized
ttttgccacgttggccaggc

SEQ ID NO: 392732 - DNA, 20 bp, Artificial Sequence
  chemically synthesized
ggggttttgccacgttggcc

SEQ ID NO: 392733 - DNA, 20 bp, Artificial Sequence
  chemically synthesized
tgagaccagcctggccaacg

SEQ ID NO: 392734 - DNA, 20 bp, Artificial Sequence
  chemically synthesized
tggggttttgccacgttggc

SEQ ID NO: 392735 - DNA, 20 bp, Artificial Sequence
  chemically synthesized
gagatggggttttgccacgt

SEQ ID NO: 392736 - DNA, 20 bp, Artificial Sequence
  chemically synthesized
ttattgtaacagtggagatg

SEQ ID NO: 392737 - DNA, 20 bp, Artificial Sequence
  chemically synthesized
tttattgtaacagtggagat

SEQ ID NO: 392738 - DNA, 20 bp, Artificial Sequence
  chemically synthesized
ttttattgtaacagtggaga

SEQ ID NO: 392739 - DNA, 20 bp, Artificial Sequence
  chemically synthesized
gtatttttattgtaacagtg

SEQ ID NO: 392740 - DNA, 20 bp, Artificial Sequence
  chemically synthesized
ttgtatttttattgtaacag

SEQ ID NO: 392741 - DNA, 20 bp, Artificial Sequence
  chemically synthesized
tttttgtatttttattgtaa

SEQ ID NO: 392742 - DNA, 20 bp, Artificial Sequence
  chemically synthesized
ataaaaatacaaaaattaac

SEQ ID NO: 392743 - DNA, 20 bp, Artificial Sequence
  chemically synthesized
taaaaatacaaaaattaacc

SEQ ID NO: 392744 - DNA, 20 bp, Artificial Sequence
  chemically synthesized
atacaaaaattaaccgggca

SEQ ID NO: 392745 - DNA, 20 bp, Artificial Sequence
  chemically synthesized
caaaaattaaccgggcatgg

SEQ ID NO: 392746 - DNA, 20 bp, Artificial Sequence
  chemically synthesized
taggggtgtgccaccatgcc

SEQ ID NO: 392747 - DNA, 20 bp, Artificial Sequence
  chemically synthesized
ggcatggtggcacaccccta

SEQ ID NO: 392748 - DNA, 20 bp, Artificial Sequence
  chemically synthesized
ctgagcagctgggactatag

SEQ ID NO: 392749 - DNA, 20 bp, Artificial Sequence
  chemically synthesized
cctgagcagctgggactata

SEQ ID NO: 392750 - DNA, 20 bp, Artificial Sequence
  chemically synthesized
gtggcacacccctatagtcc

SEQ ID NO: 392751 - DNA, 20 bp, Artificial Sequence
  chemically synthesized
tcctgagcagctgggactat

SEQ ID NO: 392752 - DNA, 20 bp, Artificial Sequence
  chemically synthesized
ctcctgagcagctgggacta

SEQ ID NO: 392753 - DNA, 20 bp, Artificial Sequence
  chemically synthesized
cccctatagtcccagctgct

SEQ ID NO: 392754 - DNA, 20 bp, Artificial Sequence
  chemically synthesized
tctcaacctcctgagcagct

SEQ ID NO: 392755 - DNA, 20 bp, Artificial Sequence
  chemically synthesized
ccctatagtcccagctgctc

SEQ ID NO: 392756 - DNA, 20 bp, Artificial Sequence
  chemically synthesized
gtctcaacctcctgagcagc

SEQ ID NO: 392757 - DNA, 20 bp, Artificial Sequence
  chemically synthesized
ctatagtcccagctgctcag

SEQ ID NO: 392758 - DNA, 20 bp, Artificial Sequence
  chemically synthesized
tatagtcccagctgctcagg

SEQ ID NO: 392759 - DNA, 20 bp, Artificial Sequence
  chemically synthesized
tcctgtctcaacctcctgag

SEQ ID NO: 392760 - DNA, 20 bp, Artificial Sequence
  chemically synthesized
ttctcctgtctcaacctcct

SEQ ID NO: 392761 - DNA, 20 bp, Artificial Sequence
  chemically synthesized
tcccagctgctcaggaggtt

SEQ ID NO: 392762 - DNA, 20 bp, Artificial Sequence
  chemically synthesized
agctgctcaggaggttgaga

SEQ ID NO: 392763 - DNA, 20 bp, Artificial Sequence
  chemically synthesized
gctgctcaggaggttgagac

SEQ ID NO: 392764 - DNA, 20 bp, Artificial Sequence
  chemically synthesized
tgctcaggaggttgagacag

SEQ ID NO: 392765 - DNA, 20 bp, Artificial Sequence
  chemically synthesized
acaggagaatcgcttgaacc

SEQ ID NO: 392766 - DNA, 20 bp, Artificial Sequence
  chemically synthesized
caggagaatcgcttgaaccc

SEQ ID NO: 392767 - DNA, 20 bp, Artificial Sequence
  chemically synthesized
aacctccgcctcctgggttc

SEQ ID NO: 392768 - DNA, 20 bp, Artificial Sequence
  chemically synthesized
ggagaatcgcttgaacccag

SEQ ID NO: 392769 - DNA, 20 bp, Artificial Sequence
  chemically synthesized
gagaatcgcttgaacccagg

SEQ ID NO: 392770 - DNA, 20 bp, Artificial Sequence
  chemically synthesized
aatcgcttgaacccaggagg

SEQ ID NO: 392771 - DNA, 20 bp, Artificial Sequence
  chemically synthesized
caatgcaacctccgcctcct

SEQ ID NO: 392772 - DNA, 20 bp, Artificial Sequence
  chemically synthesized
tcgcttgaacccaggaggcg

SEQ ID NO: 392773 - DNA, 20 bp, Artificial Sequence
  chemically synthesized
tcaatgcaacctccgcctcc

SEQ ID NO: 392774 - DNA, 20 bp, Artificial Sequence
  chemically synthesized
cgcttgaacccaggaggcgg

SEQ ID NO: 392775 - DNA, 20 bp, Artificial Sequence
  chemically synthesized
caggaggcggaggttgcatt

SEQ ID NO: 392776 - DNA, 20 bp, Artificial Sequence
  chemically synthesized
ggcggaggttgcattgagcc

SEQ ID NO: 392777 - DNA, 20 bp, Artificial Sequence
  chemically synthesized
ggagtgcagtggcatgatct

SEQ ID NO: 392778 - DNA, 20 bp, Artificial Sequence
  chemically synthesized
tcactcaggctggagtgcag

SEQ ID NO: 392779 - DNA, 20 bp, Artificial Sequence
  chemically synthesized
gagatcatgccactgcactc

SEQ ID NO: 392780 - DNA, 20 bp, Artificial Sequence
  chemically synthesized
ctgtcactcaggctggagtg

SEQ ID NO: 392781 - DNA, 20 bp, Artificial Sequence
  chemically synthesized
atgccactgcactccagcct

SEQ ID NO: 392782 - DNA, 20 bp, Artificial Sequence
  chemically synthesized
ttgctctgtcactcaggctg

SEQ ID NO: 392783 - DNA, 20 bp, Artificial Sequence
  chemically synthesized
tcttgctctgtcactcaggc

SEQ ID NO: 392784 - DNA, 20 bp, Artificial Sequence
  chemically synthesized
ctgcactccagcctgagtga

SEQ ID NO: 392785 - DNA, 20 bp, Artificial Sequence
  chemically synthesized
ggagtcttgctctgtcactc

SEQ ID NO: 392786 - DNA, 20 bp, Artificial Sequence
  chemically synthesized
gcactccagcctgagtgaca

SEQ ID NO: 392787 - DNA, 20 bp, Artificial Sequence
  chemically synthesized
tggagtcttgctctgtcact

SEQ ID NO: 392788 - DNA, 20 bp, Artificial Sequence
  chemically synthesized
tccagcctgagtgacagagc

SEQ ID NO: 392789 - DNA, 20 bp, Artificial Sequence
  chemically synthesized
tttttcttttttgtgagatg

SEQ ID NO: 392790 - DNA, 20 bp, Artificial Sequence
  chemically synthesized
tttttttcttttttgtgaga

SEQ ID NO: 392791 - DNA, 20 bp, Artificial Sequence
  chemically synthesized
caagactccatctcacaaaa

SEQ ID NO: 392792 - DNA, 20 bp, Artificial Sequence
  chemically synthesized
tttctttttttcttttttgt

SEQ ID NO: 392793 - DNA, 20 bp, Artificial Sequence
  chemically synthesized
catctcacaaaaaagaaaaa

SEQ ID NO: 392794 - DNA, 20 bp, Artificial Sequence
  chemically synthesized
agaaataatgtatacatatt

SEQ ID NO: 392795 - DNA, 20 bp, Artificial Sequence
  chemically synthesized
tgtatacatatttagaaaat

SEQ ID NO: 392796 - DNA, 20 bp, Artificial Sequence
  chemically synthesized
aaatcataatttaatcaatt

SEQ ID NO: 392797 - DNA, 20 bp, Artificial Sequence
  chemically synthesized
aaaatcataatttaatcaat

SEQ ID NO: 392798 - DNA, 20 bp, Artificial Sequence
  chemically synthesized
tgaaggcataggaacattta

SEQ ID NO: 392799 - DNA, 20 bp, Artificial Sequence
  chemically synthesized
tgtaaatgttcctatgcctt

SEQ ID NO: 392800 - DNA, 20 bp, Artificial Sequence
  chemically synthesized
aaataaacatctgaaggcat

SEQ ID NO: 392801 - DNA, 20 bp, Artificial Sequence
  chemically synthesized
aaaataaacatctgaaggca

SEQ ID NO: 392802 - DNA, 20 bp, Artificial Sequence
  chemically synthesized
gtcctaaaataaacatctga

SEQ ID NO: 392803 - DNA, 20 bp, Artificial Sequence
  chemically synthesized
agtcctaaaataaacatctg

SEQ ID NO: 392804 - DNA, 20 bp, Artificial Sequence
  chemically synthesized
atgccttcagatgtttattt

SEQ ID NO: 392805 - DNA, 20 bp, Artificial Sequence
  chemically synthesized
tgccttcagatgtttatttt

SEQ ID NO: 392806 - DNA, 20 bp, Artificial Sequence
  chemically synthesized
agatgtttattttaggactg

SEQ ID NO: 392807 - DNA, 20 bp, Artificial Sequence
  chemically synthesized
ctttagaaccaagtcggcca

SEQ ID NO: 392808 - DNA, 20 bp, Artificial Sequence
  chemically synthesized
ttttaggactgtggccgact

SEQ ID NO: 392809 - DNA, 20 bp, Artificial Sequence
  chemically synthesized
catcttctttagaaccaagt

SEQ ID NO: 392810 - DNA, 20 bp, Artificial Sequence
  chemically synthesized
ctgtggccgacttggttcta

SEQ ID NO: 392811 - DNA, 20 bp, Artificial Sequence
  chemically synthesized
gatccatcttctttagaacc

SEQ ID NO: 392812 - DNA, 20 bp, Artificial Sequence
  chemically synthesized
tggccgacttggttctaaag

SEQ ID NO: 392813 - DNA, 20 bp, Artificial Sequence
  chemically synthesized
cgacttggttctaaagaaga

SEQ ID NO: 392814 - DNA, 20 bp, Artificial Sequence
  chemically synthesized
acctggtgatccatcttctt

SEQ ID NO: 392815 - DNA, 20 bp, Artificial Sequence
  chemically synthesized
ttctaaagaagatggatcac

SEQ ID NO: 392816 - DNA, 20 bp, Artificial Sequence
  chemically synthesized
tctaaagaagatggatcacc

SEQ ID NO: 392817 - DNA, 20 bp, Artificial Sequence
  chemically synthesized
aggaaagccctgtaatgacc

SEQ ID NO: 392818 - DNA, 20 bp, Artificial Sequence
  chemically synthesized
gatggatcaccaggtcatta

SEQ ID NO: 392819 - DNA, 20 bp, Artificial Sequence
  chemically synthesized
atggatcaccaggtcattac

SEQ ID NO: 392820 - DNA, 20 bp, Artificial Sequence
  chemically synthesized
tggatcaccaggtcattaca

SEQ ID NO: 392821 - DNA, 20 bp, Artificial Sequence
  chemically synthesized
tagtttctaattgtgaagga

SEQ ID NO: 392822 - DNA, 20 bp, Artificial Sequence
  chemically synthesized
acagggctttccttcacaat

SEQ ID NO: 392823 - DNA, 20 bp, Artificial Sequence
  chemically synthesized
tatttagtttctaattgtga

SEQ ID NO: 392824 - DNA, 20 bp, Artificial Sequence
  chemically synthesized
atatttagtttctaattgtg

SEQ ID NO: 392825 - DNA, 20 bp, Artificial Sequence
  chemically synthesized
cacaattagaaactaaatat

SEQ ID NO: 392826 - DNA, 20 bp, Artificial Sequence
  chemically synthesized
tctgggttgagtcttatatt

SEQ ID NO: 392827 - DNA, 20 bp, Artificial Sequence
  chemically synthesized
actaaatataagactcaacc

SEQ ID NO: 392828 - DNA, 20 bp, Artificial Sequence
  chemically synthesized
taaatataagactcaaccca

SEQ ID NO: 392829 - DNA, 20 bp, Artificial Sequence
  chemically synthesized
ttctgaaattactctgggtt

SEQ ID NO: 392830 - DNA, 20 bp, Artificial Sequence
  chemically synthesized
tttttttctgaaattactct

SEQ ID NO: 392831 - DNA, 20 bp, Artificial Sequence
  chemically synthesized
ttttttttctgaaattactc

SEQ ID NO: 392832 - DNA, 20 bp, Artificial Sequence
  chemically synthesized
gactcaacccagagtaattt

SEQ ID NO: 392833 - DNA, 20 bp, Artificial Sequence
  chemically synthesized
aaaaaataaaataccaatat

SEQ ID NO: 392834 - DNA, 20 bp, Artificial Sequence
  chemically synthesized
aaaaataaaataccaatata

SEQ ID NO: 392835 - DNA, 20 bp, Artificial Sequence
  chemically synthesized
tttgacaatacaccttatat

SEQ ID NO: 392836 - DNA, 20 bp, Artificial Sequence
  chemically synthesized
caatataaggtgtattgtca

SEQ ID NO: 392837 - DNA, 20 bp, Artificial Sequence
  chemically synthesized
caaagataattgtgctcctg

SEQ ID NO: 392838 - DNA, 20 bp, Artificial Sequence
  chemically synthesized
tatacacagaaaagctgcag

SEQ ID NO: 392839 - DNA, 20 bp, Artificial Sequence
  chemically synthesized
attatacacagaaaagctgc

SEQ ID NO: 392840 - DNA, 20 bp, Artificial Sequence
  chemically synthesized
tattatacacagaaaagctg

SEQ ID NO: 392841 - DNA, 20 bp, Artificial Sequence
  chemically synthesized
agagtctattatacacagaa

SEQ ID NO: 392842 - DNA, 20 bp, Artificial Sequence
  chemically synthesized
tgcagcttttctgtgtataa

SEQ ID NO: 392843 - DNA, 20 bp, Artificial Sequence
  chemically synthesized
aaggaagagtctattataca

SEQ ID NO: 392844 - DNA, 20 bp, Artificial Sequence
  chemically synthesized
aagctgctacaaggaaggaa

SEQ ID NO: 392845 - DNA, 20 bp, Artificial Sequence
  chemically synthesized
gcaagctgctacaaggaagg

SEQ ID NO: 392846 - DNA, 20 bp, Artificial Sequence
  chemically synthesized
aatagactcttccttccttg

SEQ ID NO: 392847 - DNA, 20 bp, Artificial Sequence
  chemically synthesized
taggcaagctgctacaagga

SEQ ID NO: 392848 - DNA, 20 bp, Artificial Sequence
  chemically synthesized
ctaggcaagctgctacaagg

SEQ ID NO: 392849 - DNA, 20 bp, Artificial Sequence
  chemically synthesized
agactcttccttccttgtag

SEQ ID NO: 392850 - DNA, 20 bp, Artificial Sequence
  chemically synthesized
aatctaggcaagctgctaca

SEQ ID NO: 392851 - DNA, 20 bp, Artificial Sequence
  chemically synthesized
caatctaggcaagctgctac

SEQ ID NO: 392852 - DNA, 20 bp, Artificial Sequence
  chemically synthesized
cttccttgtagcagcttgcc

SEQ ID NO: 392853 - DNA, 20 bp, Artificial Sequence
  chemically synthesized
atgtttttcacaatctaggc

SEQ ID NO: 392854 - DNA, 20 bp, Artificial Sequence
  chemically synthesized
caccatgtttttcacaatct

SEQ ID NO: 392855 - DNA, 20 bp, Artificial Sequence
  chemically synthesized
acaccatgtttttcacaatc

SEQ ID NO: 392856 - DNA, 20 bp, Artificial Sequence
  chemically synthesized
tgcctagattgtgaaaaaca

SEQ ID NO: 392857 - DNA, 20 bp, Artificial Sequence
  chemically synthesized
aaaacatggtgtttgaccct

SEQ ID NO: 392858 - DNA, 20 bp, Artificial Sequence
  chemically synthesized
catggtgtttgacccttaga

SEQ ID NO: 392859 - DNA, 20 bp, Artificial Sequence
  chemically synthesized
atggtgtttgacccttagaa

SEQ ID NO: 392860 - DNA, 20 bp, Artificial Sequence
  chemically synthesized
taagtctttgacctttctaa

SEQ ID NO: 392861 - DNA, 20 bp, Artificial Sequence
  chemically synthesized
ataagtctttgacctttcta

SEQ ID NO: 392862 - DNA, 20 bp, Artificial Sequence
  chemically synthesized
tataagtctttgacctttct

SEQ ID NO: 392863 - DNA, 20 bp, Artificial Sequence
  chemically synthesized
tttgacccttagaaaggtca

SEQ ID NO: 392864 - DNA, 20 bp, Artificial Sequence
  chemically synthesized
gaaaggtcaaagacttatat

SEQ ID NO: 392865 - DNA, 20 bp, Artificial Sequence
  chemically synthesized
tatacatatatatcttatat

SEQ ID NO: 392866 - DNA, 20 bp, Artificial Sequence
  chemically synthesized
taagatatatatgtatatat

SEQ ID NO: 392867 - DNA, 20 bp, Artificial Sequence
  chemically synthesized
atatgtacatatatagatat

SEQ ID NO: 392868 - DNA, 20 bp, Artificial Sequence
  chemically synthesized
cactgatatatgtacatata

SEQ ID NO: 392869 - DNA, 20 bp, Artificial Sequence
  chemically synthesized
atctatatatgtacatatat

SEQ ID NO: 392870 - DNA, 20 bp, Artificial Sequence
  chemically synthesized
tatatgtacatatatcagtg

SEQ ID NO: 392871 - DNA, 20 bp, Artificial Sequence
  chemically synthesized
atatgtacatatatcagtgt

SEQ ID NO: 392872 - DNA, 20 bp, Artificial Sequence
  chemically synthesized
tgtacatatatcagtgtggg

SEQ ID NO: 392873 - DNA, 20 bp, Artificial Sequence
  chemically synthesized
gtacatatatcagtgtggga

SEQ ID NO: 392874 - DNA, 20 bp, Artificial Sequence
  chemically synthesized
atatcagtgtgggaaggaaa

SEQ ID NO: 392875 - DNA, 20 bp, Artificial Sequence
  chemically synthesized
atcagtgtgggaaggaaatg

SEQ ID NO: 392876 - DNA, 20 bp, Artificial Sequence
  chemically synthesized
tcagtgtgggaaggaaatgg

SEQ ID NO: 392877 - DNA, 20 bp, Artificial Sequence
  chemically synthesized
gtgggaaggaaatggaggaa

SEQ ID NO: 392878 - DNA, 20 bp, Artificial Sequence
  chemically synthesized
tggaggaatagaatgttaat

SEQ ID NO: 392879 - DNA, 20 bp, Artificial Sequence
  chemically synthesized
aatagaatgttaattggaac

SEQ ID NO: 392880 - DNA, 20 bp, Artificial Sequence
  chemically synthesized
aatgttaattggaacaagac

SEQ ID NO: 392881 - DNA, 20 bp, Artificial Sequence
  chemically synthesized
gttaattggaacaagactag

SEQ ID NO: 392882 - DNA, 20 bp, Artificial Sequence
  chemically synthesized
aattggaacaagactagtag

SEQ ID NO: 392883 - DNA, 20 bp, Artificial Sequence
  chemically synthesized
aagaactaatcagctactac

SEQ ID NO: 392884 - DNA, 20 bp, Artificial Sequence
  chemically synthesized
caagactagtagtagctgat

SEQ ID NO: 392885 - DNA, 20 bp, Artificial Sequence
  chemically synthesized
tagtggaatgaagaactaat

SEQ ID NO: 392886 - DNA, 20 bp, Artificial Sequence
  chemically synthesized
tcgttatgtttagtggaatg

SEQ ID NO: 392887 - DNA, 20 bp, Artificial Sequence
  chemically synthesized
ttgcccatcgttatgtttag

SEQ ID NO: 392888 - DNA, 20 bp, Artificial Sequence
  chemically synthesized
tatttgcccatcgttatgtt

SEQ ID NO: 392889 - DNA, 20 bp, Artificial Sequence
  chemically synthesized
cattccactaaacataacga

SEQ ID NO: 392890 - DNA, 20 bp, Artificial Sequence
  chemically synthesized
attccactaaacataacgat

SEQ ID NO: 392891 - DNA, 20 bp, Artificial Sequence
  chemically synthesized
cataacgatgggcaaatatc

SEQ ID NO: 392892 - DNA, 20 bp, Artificial Sequence
  chemically synthesized
aaaataagacttaaagcagc

SEQ ID NO: 392893 - DNA, 20 bp, Artificial Sequence
  chemically synthesized
ggcaaatatctagctgcttt

SEQ ID NO: 392894 - DNA, 20 bp, Artificial Sequence
  chemically synthesized
ttataaaataagacttaaag

SEQ ID NO: 392895 - DNA, 20 bp, Artificial Sequence
  chemically synthesized
aatttataaaataagactta

SEQ ID NO: 392896 - DNA, 20 bp, Artificial Sequence
  chemically synthesized
tgatattcaatttataaaat

SEQ ID NO: 392897 - DNA, 20 bp, Artificial Sequence
  chemically synthesized
aaattgaatatcaaatacta

SEQ ID NO: 392898 - DNA, 20 bp, Artificial Sequence
  chemically synthesized
gtgaaaatgtattttttctt

SEQ ID NO: 392899 - DNA, 20 bp, Artificial Sequence
  chemically synthesized
aaagaaaaaatacattttca

SEQ ID NO: 392900 - DNA, 20 bp, Artificial Sequence
  chemically synthesized
aaaaaatacattttcacagc

SEQ ID NO: 392901 - DNA, 20 bp, Artificial Sequence
  chemically synthesized
aaaaatacattttcacagcc

SEQ ID NO: 392902 - DNA, 20 bp, Artificial Sequence
  chemically synthesized
aaaaaattctatgtttttcc

SEQ ID NO: 392903 - DNA, 20 bp, Artificial Sequence
  chemically synthesized
tttcacagccaggaaaaaca

SEQ ID NO: 392904 - DNA, 20 bp, Artificial Sequence
  chemically synthesized
ttttcaaatttcaaaatgcc

SEQ ID NO: 392905 - DNA, 20 bp, Artificial Sequence
  chemically synthesized
atttcctctcaagttttact

SEQ ID NO: 392906 - DNA, 20 bp, Artificial Sequence
  chemically synthesized
caaaatgccaagtaaaactt

SEQ ID NO: 392907 - DNA, 20 bp, Artificial Sequence
  chemically synthesized
aaatgccaagtaaaacttga

SEQ ID NO: 392908 - DNA, 20 bp, Artificial Sequence
  chemically synthesized
aatgccaagtaaaacttgag

SEQ ID NO: 392909 - DNA, 20 bp, Artificial Sequence
  chemically synthesized
tttgctcggtatttcctctc

SEQ ID NO: 392910 - DNA, 20 bp, Artificial Sequence
  chemically synthesized
aaaacttgagaggaaatacc

SEQ ID NO: 392911 - DNA, 20 bp, Artificial Sequence
  chemically synthesized
agaggaaataccgagcaaat

SEQ ID NO: 392912 - DNA, 20 bp, Artificial Sequence
  chemically synthesized
gacaaagttccttatttgct

SEQ ID NO: 392913 - DNA, 20 bp, Artificial Sequence
  chemically synthesized
gaggaaataccgagcaaata

SEQ ID NO: 392914 - DNA, 20 bp, Artificial Sequence
  chemically synthesized
caaataaggaactttgtccc

SEQ ID NO: 392915 - DNA, 20 bp, Artificial Sequence
  chemically synthesized
aaataaggaactttgtccca

SEQ ID NO: 392916 - DNA, 20 bp, Artificial Sequence
  chemically synthesized
tgtttccataccttgggaca

SEQ ID NO: 392917 - DNA, 20 bp, Artificial Sequence
  chemically synthesized
aggaactttgtcccaaggta

SEQ ID NO: 392918 - DNA, 20 bp, Artificial Sequence
  chemically synthesized
tgtcaatgtttccatacctt

SEQ ID NO: 392919 - DNA, 20 bp, Artificial Sequence
  chemically synthesized
ttgtcaatgtttccatacct

SEQ ID NO: 392920 - DNA, 20 bp, Artificial Sequence
  chemically synthesized
aacattgacaaaactattac

SEQ ID NO: 392921 - DNA, 20 bp, Artificial Sequence
  chemically synthesized
aggtcagctataactggtaa

SEQ ID NO: 392922 - DNA, 20 bp, Artificial Sequence
  chemically synthesized
gacaaaactattaccagtta

SEQ ID NO: 392923 - DNA, 20 bp, Artificial Sequence
  chemically synthesized
cagtaaaggtcagctataac

SEQ ID NO: 392924 - DNA, 20 bp, Artificial Sequence
  chemically synthesized
aggttttacccagtaaaggt

SEQ ID NO: 392925 - DNA, 20 bp, Artificial Sequence
  chemically synthesized
cagttatagctgacctttac

SEQ ID NO: 392926 - DNA, 20 bp, Artificial Sequence
  chemically synthesized
agttatagctgacctttact

SEQ ID NO: 392927 - DNA, 20 bp, Artificial Sequence
  chemically synthesized
atccaggttttacccagtaa

SEQ ID NO: 392928 - DNA, 20 bp, Artificial Sequence
  chemically synthesized
tatccaggttttacccagta

SEQ ID NO: 392929 - DNA, 20 bp, Artificial Sequence
  chemically synthesized
ctgtttatccaggttttacc

SEQ ID NO: 392930 - DNA, 20 bp, Artificial Sequence
  chemically synthesized
gacctttactgggtaaaacc

SEQ ID NO: 392931 - DNA, 20 bp, Artificial Sequence
  chemically synthesized
ctgggtaaaacctggataaa

SEQ ID NO: 392932 - DNA, 20 bp, Artificial Sequence
  chemically synthesized
aaagtttttcctgtttatcc

SEQ ID NO: 392933 - DNA, 20 bp, Artificial Sequence
  chemically synthesized
tgggtaaaacctggataaac

SEQ ID NO: 392934 - DNA, 20 bp, Artificial Sequence
  chemically synthesized
taaagtttttcctgtttatc

SEQ ID NO: 392935 - DNA, 20 bp, Artificial Sequence
  chemically synthesized
ggataaacaggaaaaacttt

SEQ ID NO: 392936 - DNA, 20 bp, Artificial Sequence
  chemically synthesized
ataaacaggaaaaactttaa

SEQ ID NO: 392937 - DNA, 20 bp, Artificial Sequence
  chemically synthesized
tgaagaagacttttctctta

SEQ ID NO: 392938 - DNA, 20 bp, Artificial Sequence
  chemically synthesized
caggaaaaactttaagagaa

SEQ ID NO: 392939 - DNA, 20 bp, Artificial Sequence
  chemically synthesized
tttaagagaaaagtcttctt

SEQ ID NO: 392940 - DNA, 20 bp, Artificial Sequence
  chemically synthesized
aagagaaaagtcttcttcag

SEQ ID NO: 392941 - DNA, 20 bp, Artificial Sequence
  chemically synthesized
agagaaaagtcttcttcagt

SEQ ID NO: 392942 - DNA, 20 bp, Artificial Sequence
  chemically synthesized
tgggatttgacccactgaag

SEQ ID NO: 392943 - DNA, 20 bp, Artificial Sequence
  chemically synthesized
ccatgggatttgacccactg

SEQ ID NO: 392944 - DNA, 20 bp, Artificial Sequence
  chemically synthesized
cttcagtgggtcaaatccca

SEQ ID NO: 392945 - DNA, 20 bp, Artificial Sequence
  chemically synthesized
gcccagttcatgaaaaccat

SEQ ID NO: 392946 - DNA, 20 bp, Artificial Sequence
  chemically synthesized
cgcccagttcatgaaaacca

SEQ ID NO: 392947 - DNA, 20 bp, Artificial Sequence
  chemically synthesized
atcccatggttttcatgaac

SEQ ID NO: 392948 - DNA, 20 bp, Artificial Sequence
  chemically synthesized
tcccatggttttcatgaact

SEQ ID NO: 392949 - DNA, 20 bp, Artificial Sequence
  chemically synthesized
catggttttcatgaactggg

SEQ ID NO: 392950 - DNA, 20 bp, Artificial Sequence
  chemically synthesized
ctgccctgtagcagtccgcc

SEQ ID NO: 392951 - DNA, 20 bp, Artificial Sequence
  chemically synthesized
atgaactgggcggactgcta

SEQ ID NO: 392952 - DNA, 20 bp, Artificial Sequence
  chemically synthesized
tgaactgggcggactgctac

SEQ ID NO: 392953 - DNA, 20 bp, Artificial Sequence
  chemically synthesized
gaactgggcggactgctaca

SEQ ID NO: 392954 - DNA, 20 bp, Artificial Sequence
  chemically synthesized
aaactcttcctgccctgtag

SEQ ID NO: 392955 - DNA, 20 bp, Artificial Sequence
  chemically synthesized
ctgggcggactgctacaggg

SEQ ID NO: 392956 - DNA, 20 bp, Artificial Sequence
  chemically synthesized
tgggcggactgctacagggc

SEQ ID NO: 392957 - DNA, 20 bp, Artificial Sequence
  chemically synthesized
agtaaactcttcctgccctg

SEQ ID NO: 392958 - DNA, 20 bp, Artificial Sequence
  chemically synthesized
gcggactgctacagggcagg

SEQ ID NO: 392959 - DNA, 20 bp, Artificial Sequence
  chemically synthesized
ggactgctacagggcaggaa

SEQ ID NO: 392960 - DNA, 20 bp, Artificial Sequence
  chemically synthesized
ggcaggaagagtttactaca

SEQ ID NO: 392961 - DNA, 20 bp, Artificial Sequence
  chemically synthesized
caggaagagtttactacaca

SEQ ID NO: 392962 - DNA, 20 bp, Artificial Sequence
  chemically synthesized
tcccacaacttttctctgtg

SEQ ID NO: 392963 - DNA, 20 bp, Artificial Sequence
  chemically synthesized
agagtttactacacagagaa

SEQ ID NO: 392964 - DNA, 20 bp, Artificial Sequence
  chemically synthesized
tactacacagagaaaagttg

SEQ ID NO: 392965 - DNA, 20 bp, Artificial Sequence
  chemically synthesized
actacacagagaaaagttgt

SEQ ID NO: 392966 - DNA, 20 bp, Artificial Sequence
  chemically synthesized
tgggaacacaattatctttg

SEQ ID NO: 392967 - DNA, 20 bp, Artificial Sequence
  chemically synthesized
actggcccaagagttcttca

SEQ ID NO: 392968 - DNA, 20 bp, Artificial Sequence
  chemically synthesized
aattatctttgaagaactct

SEQ ID NO: 392969 - DNA, 20 bp, Artificial Sequence
  chemically synthesized
attatctttgaagaactctt

SEQ ID NO: 392970 - DNA, 20 bp, Artificial Sequence
  chemically synthesized
tctttgaagaactcttgggc

SEQ ID NO: 392971 - DNA, 20 bp, Artificial Sequence
  chemically synthesized
cggggcctacactggcccaa

SEQ ID NO: 392972 - DNA, 20 bp, Artificial Sequence
  chemically synthesized
cacggggcctacactggccc

SEQ ID NO: 392973 - DNA, 20 bp, Artificial Sequence
  chemically synthesized
gaagaactcttgggccagtg

SEQ ID NO: 392974 - DNA, 20 bp, Artificial Sequence
  chemically synthesized
aagaactcttgggccagtgt

SEQ ID NO: 392975 - DNA, 20 bp, Artificial Sequence
  chemically synthesized
tggcaccacggggcctacac

SEQ ID NO: 392976 - DNA, 20 bp, Artificial Sequence
  chemically synthesized
ttgggccagtgtaggccccg

SEQ ID NO: 392977 - DNA, 20 bp, Artificial Sequence
  chemically synthesized
cacagggaactggcaccacg

SEQ ID NO: 392978 - DNA, 20 bp, Artificial Sequence
  chemically synthesized
cagtgtaggccccgtggtgc

SEQ ID NO: 392979 - DNA, 20 bp, Artificial Sequence
  chemically synthesized
gcacagggaactggcaccac

SEQ ID NO: 392980 - DNA, 20 bp, Artificial Sequence
  chemically synthesized
agcacagggaactggcacca

SEQ ID NO: 392981 - DNA, 20 bp, Artificial Sequence
  chemically synthesized
tgcctcttagcacagggaac

SEQ ID NO: 392982 - DNA, 20 bp, Artificial Sequence
  chemically synthesized
tggtgccagttccctgtgct

SEQ ID NO: 392983 - DNA, 20 bp, Artificial Sequence
  chemically synthesized
cctggctgcctcttagcaca

SEQ ID NO: 392984 - DNA, 20 bp, Artificial Sequence
  chemically synthesized
gtgccagttccctgtgctaa

SEQ ID NO: 392985 - DNA, 20 bp, Artificial Sequence
  chemically synthesized
ccctggctgcctcttagcac

SEQ ID NO: 392986 - DNA, 20 bp, Artificial Sequence
  chemically synthesized
tgccagttccctgtgctaag

SEQ ID NO: 392987 - DNA, 20 bp, Artificial Sequence
  chemically synthesized
tccctggctgcctcttagca

SEQ ID NO: 392988 - DNA, 20 bp, Artificial Sequence
  chemically synthesized
cagttccctgtgctaagagg

SEQ ID NO: 392989 - DNA, 20 bp, Artificial Sequence
  chemically synthesized
atatatccctggctgcctct

SEQ ID NO: 392990 - DNA, 20 bp, Artificial Sequence
  chemically synthesized
tccctgtgctaagaggcagc

SEQ ID NO: 392991 - DNA, 20 bp, Artificial Sequence
  chemically synthesized
ccctgtgctaagaggcagcc

SEQ ID NO: 392992 - DNA, 20 bp, Artificial Sequence
  chemically synthesized
cctgtgctaagaggcagcca

SEQ ID NO: 392993 - DNA, 20 bp, Artificial Sequence
  chemically synthesized
aagggtgaggtatatatccc

SEQ ID NO: 392994 - DNA, 20 bp, Artificial Sequence
  chemically synthesized
cagctatatagcaaagggtg

SEQ ID NO: 392995 - DNA, 20 bp, Artificial Sequence
  chemically synthesized
gcagctatatagcaaagggt

SEQ ID NO: 392996 - DNA, 20 bp, Artificial Sequence
  chemically synthesized
caaggcagctatatagcaaa

SEQ ID NO: 392997 - DNA, 20 bp, Artificial Sequence
  chemically synthesized
gcaaggcagctatatagcaa

SEQ ID NO: 392998 - DNA, 20 bp, Artificial Sequence
  chemically synthesized
atacctcaccctttgctata

SEQ ID NO: 392999 - DNA, 20 bp, Artificial Sequence
  chemically synthesized
agcaaggcagctatatagca

SEQ ID NO: 393000 - DNA, 20 bp, Artificial Sequence
  chemically synthesized
ttctaagcaaggcagctata

SEQ ID NO: 393001 - DNA, 20 bp, Artificial Sequence
  chemically synthesized
tgctatatagctgccttgct

SEQ ID NO: 393002 - DNA, 20 bp, Artificial Sequence
  chemically synthesized
gaagaagtttctaagcaagg

SEQ ID NO: 393003 - DNA, 20 bp, Artificial Sequence
  chemically synthesized
ttagaagaagtttctaagca

SEQ ID NO: 393004 - DNA, 20 bp, Artificial Sequence
  chemically synthesized
cttagaagaagtttctaagc

SEQ ID NO: 393005 - DNA, 20 bp, Artificial Sequence
  chemically synthesized
ttctcttagaagaagtttct

SEQ ID NO: 393006 - DNA, 20 bp, Artificial Sequence
  chemically synthesized
cttgcttagaaacttcttct

SEQ ID NO: 393007 - DNA, 20 bp, Artificial Sequence
  chemically synthesized
tgcttagaaacttcttctaa

SEQ ID NO: 393008 - DNA, 20 bp, Artificial Sequence
  chemically synthesized
taaggcatttctcttagaag

SEQ ID NO: 393009 - DNA, 20 bp, Artificial Sequence
  chemically synthesized
agataaggcatttctcttag

SEQ ID NO: 393010 - DNA, 20 bp, Artificial Sequence
  chemically synthesized
aaaagataaggcatttctct

SEQ ID NO: 393011 - DNA, 20 bp, Artificial Sequence
  chemically synthesized
aatataaatctgaaaagata

SEQ ID NO: 393012 - DNA, 20 bp, Artificial Sequence
  chemically synthesized
agagaaatgccttatctttt

SEQ ID NO: 393013 - DNA, 20 bp, Artificial Sequence
  chemically synthesized
taatataaatctgaaaagat

SEQ ID NO: 393014 - DNA, 20 bp, Artificial Sequence
  chemically synthesized
atatttaatataaatctgaa

SEQ ID NO: 393015 - DNA, 20 bp, Artificial Sequence
  chemically synthesized
gataaaggcagaaatagaat

SEQ ID NO: 393016 - DNA, 20 bp, Artificial Sequence
  chemically synthesized
tcctgagataaaggcagaaa

SEQ ID NO: 393017 - DNA, 20 bp, Artificial Sequence
  chemically synthesized
ggaatttcctgagataaagg

SEQ ID NO: 393018 - DNA, 20 bp, Artificial Sequence
  chemically synthesized
ttctatttctgcctttatct

SEQ ID NO: 393019 - DNA, 20 bp, Artificial Sequence
  chemically synthesized
tctatttctgcctttatctc

SEQ ID NO: 393020 - DNA, 20 bp, Artificial Sequence
  chemically synthesized
cttggaatttcctgagataa

SEQ ID NO: 393021 - DNA, 20 bp, Artificial Sequence
  chemically synthesized
acttggaatttcctgagata

SEQ ID NO: 393022 - DNA, 20 bp, Artificial Sequence
  chemically synthesized
atactcacttggaatttcct

SEQ ID NO: 393023 - DNA, 20 bp, Artificial Sequence
  chemically synthesized
cctttatctcaggaaattcc

SEQ ID NO: 393024 - DNA, 20 bp, Artificial Sequence
  chemically synthesized
tatctcaggaaattccaagt

SEQ ID NO: 393025 - DNA, 20 bp, Artificial Sequence
  chemically synthesized
gcatgagcttcatactcact

SEQ ID NO: 393026 - DNA, 20 bp, Artificial Sequence
  chemically synthesized
ggaaattccaagtgagtatg

SEQ ID NO: 393027 - DNA, 20 bp, Artificial Sequence
  chemically synthesized
ctattttagggagggagcat

SEQ ID NO: 393028 - DNA, 20 bp, Artificial Sequence
  chemically synthesized
attttgctattttagggagg

SEQ ID NO: 393029 - DNA, 20 bp, Artificial Sequence
  chemically synthesized
ctattttgctattttaggga

SEQ ID NO: 393030 - DNA, 20 bp, Artificial Sequence
  chemically synthesized
gctattttgctattttaggg

SEQ ID NO: 393031 - DNA, 20 bp, Artificial Sequence
  chemically synthesized
ctcatgctccctccctaaaa

SEQ ID NO: 393032 - DNA, 20 bp, Artificial Sequence
  chemically synthesized
tgctattttgctattttagg

SEQ ID NO: 393033 - DNA, 20 bp, Artificial Sequence
  chemically synthesized
cttgctattttgctatttta

SEQ ID NO: 393034 - DNA, 20 bp, Artificial Sequence
  chemically synthesized
gcttgctattttgctatttt

SEQ ID NO: 393035 - DNA, 20 bp, Artificial Sequence
  chemically synthesized
agcttgctattttgctattt

SEQ ID NO: 393036 - DNA, 20 bp, Artificial Sequence
  chemically synthesized
ccctccctaaaatagcaaaa

SEQ ID NO: 393037 - DNA, 20 bp, Artificial Sequence
  chemically synthesized
ccctaaaatagcaaaatagc

SEQ ID NO: 393038 - DNA, 20 bp, Artificial Sequence
  chemically synthesized
aaaatagcaagctctttgca

SEQ ID NO: 393039 - DNA, 20 bp, Artificial Sequence
  chemically synthesized
tttttaaaaatccatgcaaa

SEQ ID NO: 393040 - DNA, 20 bp, Artificial Sequence
  chemically synthesized
aatttttaaaaatccatgca

SEQ ID NO: 393041 - DNA, 20 bp, Artificial Sequence
  chemically synthesized
aaaaatttatcttttttttt

SEQ ID NO: 393042 - DNA, 20 bp, Artificial Sequence
  chemically synthesized
gagaccctgtctcaaaaaaa

SEQ ID NO: 393043 - DNA, 20 bp, Artificial Sequence
  chemically synthesized
atttatctttttttttgaga

SEQ ID NO: 393044 - DNA, 20 bp, Artificial Sequence
  chemically synthesized
tttatctttttttttgagac

SEQ ID NO: 393045 - DNA, 20 bp, Artificial Sequence
  chemically synthesized
ttatctttttttttgagaca

SEQ ID NO: 393046 - DNA, 20 bp, Artificial Sequence
  chemically synthesized
tccaatctgggtgagagagt

SEQ ID NO: 393047 - DNA, 20 bp, Artificial Sequence
  chemically synthesized
cagggtctcactctctcacc

SEQ ID NO: 393048 - DNA, 20 bp, Artificial Sequence
  chemically synthesized
gcactccaatctgggtgaga

SEQ ID NO: 393049 - DNA, 20 bp, Artificial Sequence
  chemically synthesized
ctgcactccaatctgggtga

SEQ ID NO: 393050 - DNA, 20 bp, Artificial Sequence
  chemically synthesized
cactgcactccaatctgggt

SEQ ID NO: 393051 - DNA, 20 bp, Artificial Sequence
  chemically synthesized
tctcactctctcacccagat

SEQ ID NO: 393052 - DNA, 20 bp, Artificial Sequence
  chemically synthesized
tcactctctcacccagattg

SEQ ID NO: 393053 - DNA, 20 bp, Artificial Sequence
  chemically synthesized
gcaccactgcactccaatct

SEQ ID NO: 393054 - DNA, 20 bp, Artificial Sequence
  chemically synthesized
tgcaccactgcactccaatc

SEQ ID NO: 393055 - DNA, 20 bp, Artificial Sequence
  chemically synthesized
ctctcacccagattggagtg

SEQ ID NO: 393056 - DNA, 20 bp, Artificial Sequence
  chemically synthesized
tcacccagattggagtgcag

SEQ ID NO: 393057 - DNA, 20 bp, Artificial Sequence
  chemically synthesized
ggagtgcagtggtgcaatct

SEQ ID NO: 393058 - DNA, 20 bp, Artificial Sequence
  chemically synthesized
ggcggaggttgcatcgagcc

SEQ ID NO: 393059 - DNA, 20 bp, Artificial Sequence
  chemically synthesized
tgggaggcggaggttgcatc

SEQ ID NO: 393060 - DNA, 20 bp, Artificial Sequence
  chemically synthesized
cacttgagcctgggaggcgg

SEQ ID NO: 393061 - DNA, 20 bp, Artificial Sequence
  chemically synthesized
tcgatgcaacctccgcctcc

SEQ ID NO: 393062 - DNA, 20 bp, Artificial Sequence
  chemically synthesized
tcacttgagcctgggaggcg

SEQ ID NO: 393063 - DNA, 20 bp, Artificial Sequence
  chemically synthesized
cgatgcaacctccgcctccc

SEQ ID NO: 393064 - DNA, 20 bp, Artificial Sequence
  chemically synthesized
aatcacttgagcctgggagg

SEQ ID NO: 393065 - DNA, 20 bp, Artificial Sequence
  chemically synthesized
gggaatcacttgagcctggg

SEQ ID NO: 393066 - DNA, 20 bp, Artificial Sequence
  chemically synthesized
ggggaatcacttgagcctgg

SEQ ID NO: 393067 - DNA, 20 bp, Artificial Sequence
  chemically synthesized
aacctccgcctcccaggctc

SEQ ID NO: 393068 - DNA, 20 bp, Artificial Sequence
  chemically synthesized
tgggggaatcacttgagcct

SEQ ID NO: 393069 - DNA, 20 bp, Artificial Sequence
  chemically synthesized
gtgggggaatcacttgagcc

SEQ ID NO: 393070 - DNA, 20 bp, Artificial Sequence
  chemically synthesized
ctgaggtgggggaatcactt

SEQ ID NO: 393071 - DNA, 20 bp, Artificial Sequence
  chemically synthesized
ctcaagtgattcccccacct

SEQ ID NO: 393072 - DNA, 20 bp, Artificial Sequence
  chemically synthesized
tactcaggaggctgaggtgg

SEQ ID NO: 393073 - DNA, 20 bp, Artificial Sequence
  chemically synthesized
ctactcaggaggctgaggtg

SEQ ID NO: 393074 - DNA, 20 bp, Artificial Sequence
  chemically synthesized
gctactcaggaggctgaggt

SEQ ID NO: 393075 - DNA, 20 bp, Artificial Sequence
  chemically synthesized
agctactcaggaggctgagg

SEQ ID NO: 393076 - DNA, 20 bp, Artificial Sequence
  chemically synthesized
cccagctactcaggaggctg

SEQ ID NO: 393077 - DNA, 20 bp, Artificial Sequence
  chemically synthesized
tcccagctactcaggaggct

SEQ ID NO: 393078 - DNA, 20 bp, Artificial Sequence
  chemically synthesized
ttcccccacctcagcctcct

SEQ ID NO: 393079 - DNA, 20 bp, Artificial Sequence
  chemically synthesized
ccccacctcagcctcctgag

SEQ ID NO: 393080 - DNA, 20 bp, Artificial Sequence
  chemically synthesized
tgtaatcccagctactcagg

SEQ ID NO: 393081 - DNA, 20 bp, Artificial Sequence
  chemically synthesized
ctgtaatcccagctactcag

SEQ ID NO: 393082 - DNA, 20 bp, Artificial Sequence
  chemically synthesized
acctcagcctcctgagtagc

SEQ ID NO: 393083 - DNA, 20 bp, Artificial Sequence
  chemically synthesized
gcctgtaatcccagctactc

SEQ ID NO: 393084 - DNA, 20 bp, Artificial Sequence
  chemically synthesized
cctcagcctcctgagtagct

SEQ ID NO: 393085 - DNA, 20 bp, Artificial Sequence
  chemically synthesized
cgcctgtaatcccagctact

SEQ ID NO: 393086 - DNA, 20 bp, Artificial Sequence
  chemically synthesized
ctcctgagtagctgggatta

SEQ ID NO: 393087 - DNA, 20 bp, Artificial Sequence
  chemically synthesized
tcctgagtagctgggattac

SEQ ID NO: 393088 - DNA, 20 bp, Artificial Sequence
  chemically synthesized
atggcgcacgcctgtaatcc

SEQ ID NO: 393089 - DNA, 20 bp, Artificial Sequence
  chemically synthesized
taaaaattagttcagtgtaa

SEQ ID NO: 393090 - DNA, 20 bp, Artificial Sequence
  chemically synthesized
taaaaatataaaaattagtt

SEQ ID NO: 393091 - DNA, 20 bp, Artificial Sequence
  chemically synthesized
tctactaaaaatataaaaat

SEQ ID NO: 393092 - DNA, 20 bp, Artificial Sequence
  chemically synthesized
tgaactaatttttatatttt

SEQ ID NO: 393093 - DNA, 20 bp, Artificial Sequence
  chemically synthesized
actaatttttatatttttag

SEQ ID NO: 393094 - DNA, 20 bp, Artificial Sequence
  chemically synthesized
taatttttatatttttagta

SEQ ID NO: 393095 - DNA, 20 bp, Artificial Sequence
  chemically synthesized
ttttatatttttagtagaga

SEQ ID NO: 393096 - DNA, 20 bp, Artificial Sequence
  chemically synthesized
tttatatttttagtagagac

SEQ ID NO: 393097 - DNA, 20 bp, Artificial Sequence
  chemically synthesized
agagacgggtttcaccatgt

SEQ ID NO: 393098 - DNA, 20 bp, Artificial Sequence
  chemically synthesized
acgggtttcaccatgttggc

SEQ ID NO: 393099 - DNA, 20 bp, Artificial Sequence
  chemically synthesized
ggagaccaacctggccaaca

SEQ ID NO: 393100 - DNA, 20 bp, Artificial Sequence
  chemically synthesized
cgggtttcaccatgttggcc

SEQ ID NO: 393101 - DNA, 20 bp, Artificial Sequence
  chemically synthesized
tttcaccatgttggccaggt

SEQ ID NO: 393102 - DNA, 20 bp, Artificial Sequence
  chemically synthesized
tcaggagttggagaccaacc

SEQ ID NO: 393103 - DNA, 20 bp, Artificial Sequence
  chemically synthesized
tcatttgaggtcaggagttg

SEQ ID NO: 393104 - DNA, 20 bp, Artificial Sequence
  chemically synthesized
gatcatttgaggtcaggagt

SEQ ID NO: 393105 - DNA, 20 bp, Artificial Sequence
  chemically synthesized
ggtggatcatttgaggtcag

SEQ ID NO: 393106 - DNA, 20 bp, Artificial Sequence
  chemically synthesized
caggtggatcatttgaggtc

SEQ ID NO: 393107 - DNA, 20 bp, Artificial Sequence
  chemically synthesized
acaggtggatcatttgaggt

SEQ ID NO: 393108 - DNA, 20 bp, Artificial Sequence
  chemically synthesized
ccagacaggtggatcatttg

SEQ ID NO: 393109 - DNA, 20 bp, Artificial Sequence
  chemically synthesized
cccagacaggtggatcattt

SEQ ID NO: 393110 - DNA, 20 bp, Artificial Sequence
  chemically synthesized
cctcaaatgatccacctgtc

SEQ ID NO: 393111 - DNA, 20 bp, Artificial Sequence
  chemically synthesized
ctcaaatgatccacctgtct

SEQ ID NO: 393112 - DNA, 20 bp, Artificial Sequence
  chemically synthesized
ctttgggaggcccagacagg

SEQ ID NO: 393113 - DNA, 20 bp, Artificial Sequence
  chemically synthesized
gcactttgggaggcccagac

SEQ ID NO: 393114 - DNA, 20 bp, Artificial Sequence
  chemically synthesized
agcactttgggaggcccaga

SEQ ID NO: 393115 - DNA, 20 bp, Artificial Sequence
  chemically synthesized
tcccagcactttgggaggcc

SEQ ID NO: 393116 - DNA, 20 bp, Artificial Sequence
  chemically synthesized
ccacctgtctgggcctccca

SEQ ID NO: 393117 - DNA, 20 bp, Artificial Sequence
  chemically synthesized
tgtaatcccagcactttggg

SEQ ID NO: 393118 - DNA, 20 bp, Artificial Sequence
  chemically synthesized
ctgtaatcccagcactttgg

SEQ ID NO: 393119 - DNA, 20 bp, Artificial Sequence
  chemically synthesized
gtctgggcctcccaaagtgc

SEQ ID NO: 393120 - DNA, 20 bp, Artificial Sequence
  chemically synthesized
gcctgtaatcccagcacttt

SEQ ID NO: 393121 - DNA, 20 bp, Artificial Sequence
  chemically synthesized
tctgggcctcccaaagtgct

SEQ ID NO: 393122 - DNA, 20 bp, Artificial Sequence
  chemically synthesized
tgcctgtaatcccagcactt

SEQ ID NO: 393123 - DNA, 20 bp, Artificial Sequence
  chemically synthesized
ctcccaaagtgctgggatta

SEQ ID NO: 393124 - DNA, 20 bp, Artificial Sequence
  chemically synthesized
tcccaaagtgctgggattac

SEQ ID NO: 393125 - DNA, 20 bp, Artificial Sequence
  chemically synthesized
gtgtctcatgcctgtaatcc

SEQ ID NO: 393126 - DNA, 20 bp, Artificial Sequence
  chemically synthesized
agtgctgggattacaggcat

SEQ ID NO: 393127 - DNA, 20 bp, Artificial Sequence
  chemically synthesized
caggcatgagacactgcgcc

SEQ ID NO: 393128 - DNA, 20 bp, Artificial Sequence
  chemically synthesized
aaagatcatacggccgggcg

SEQ ID NO: 393129 - DNA, 20 bp, Artificial Sequence
  chemically synthesized
tgtaaaaagatcatacggcc

SEQ ID NO: 393130 - DNA, 20 bp, Artificial Sequence
  chemically synthesized
ttgtaaaaagatcatacggc

SEQ ID NO: 393131 - DNA, 20 bp, Artificial Sequence
  chemically synthesized
aaccttgtaaaaagatcata

SEQ ID NO: 393132 - DNA, 20 bp, Artificial Sequence
  chemically synthesized
cggccgtatgatctttttac

SEQ ID NO: 393133 - DNA, 20 bp, Artificial Sequence
  chemically synthesized
ggccgtatgatctttttaca

SEQ ID NO: 393134 - DNA, 20 bp, Artificial Sequence
  chemically synthesized
gttacttgaaaccttgtaaa

SEQ ID NO: 393135 - DNA, 20 bp, Artificial Sequence
  chemically synthesized
tgatctttttacaaggtttc

SEQ ID NO: 393136 - DNA, 20 bp, Artificial Sequence
  chemically synthesized
agttggaaattttgaagcaa

SEQ ID NO: 393137 - DNA, 20 bp, Artificial Sequence
  chemically synthesized
tagttggaaattttgaagca

SEQ ID NO: 393138 - DNA, 20 bp, Artificial Sequence
  chemically synthesized
ggcaatagttggaaattttg

SEQ ID NO: 393139 - DNA, 20 bp, Artificial Sequence
  chemically synthesized
agcacttgaatggcaatagt

SEQ ID NO: 393140 - DNA, 20 bp, Artificial Sequence
  chemically synthesized
ggaaagcacttgaatggcaa

SEQ ID NO: 393141 - DNA, 20 bp, Artificial Sequence
  chemically synthesized
atttccaactattgccattc

SEQ ID NO: 393142 - DNA, 20 bp, Artificial Sequence
  chemically synthesized
atcagtggaaagcacttgaa

SEQ ID NO: 393143 - DNA, 20 bp, Artificial Sequence
  chemically synthesized
atttgcagactatcagtgga

SEQ ID NO: 393144 - DNA, 20 bp, Artificial Sequence
  chemically synthesized
attcaagtgctttccactga

SEQ ID NO: 393145 - DNA, 20 bp, Artificial Sequence
  chemically synthesized
gtgtatttgcagactatcag

SEQ ID NO: 393146 - DNA, 20 bp, Artificial Sequence
  chemically synthesized
gttgtgtatttgcagactat

SEQ ID NO: 393147 - DNA, 20 bp, Artificial Sequence
  chemically synthesized
cttcaagggttgtgtatttg

SEQ ID NO: 393148 - DNA, 20 bp, Artificial Sequence
  chemically synthesized
ctgcaaatacacaacccttg

SEQ ID NO: 393149 - DNA, 20 bp, Artificial Sequence
  chemically synthesized
agttacaatgagttcttcaa

SEQ ID NO: 393150 - DNA, 20 bp, Artificial Sequence
  chemically synthesized
tagttacaatgagttcttca

SEQ ID NO: 393151 - DNA, 20 bp, Artificial Sequence
  chemically synthesized
atagttacaatgagttcttc

SEQ ID NO: 393152 - DNA, 20 bp, Artificial Sequence
  chemically synthesized
cttttggccatagttacaat

SEQ ID NO: 393153 - DNA, 20 bp, Artificial Sequence
  chemically synthesized
tgaagaactcattgtaacta

SEQ ID NO: 393154 - DNA, 20 bp, Artificial Sequence
  chemically synthesized
ctcattgtaactatggccaa

SEQ ID NO: 393155 - DNA, 20 bp, Artificial Sequence
  chemically synthesized
aacagtgactcttttggcca

SEQ ID NO: 393156 - DNA, 20 bp, Artificial Sequence
  chemically synthesized
cattgtaactatggccaaaa

SEQ ID NO: 393157 - DNA, 20 bp, Artificial Sequence
  chemically synthesized
gtttaaaacagtgactcttt

SEQ ID NO: 393158 - DNA, 20 bp, Artificial Sequence
  chemically synthesized
atgtgagattgtgtttaaaa

SEQ ID NO: 393159 - DNA, 20 bp, Artificial Sequence
  chemically synthesized
tttaaacacaatctcacata

SEQ ID NO: 393160 - DNA, 20 bp, Artificial Sequence
  chemically synthesized
agtttaagtcttctttatgt

SEQ ID NO: 393161 - DNA, 20 bp, Artificial Sequence
  chemically synthesized
aaacacaatctcacataaag

SEQ ID NO: 393162 - DNA, 20 bp, Artificial Sequence
  chemically synthesized
cacataaagaagacttaaac

SEQ ID NO: 393163 - DNA, 20 bp, Artificial Sequence
  chemically synthesized
acataaagaagacttaaact

SEQ ID NO: 393164 - DNA, 20 bp, Artificial Sequence
  chemically synthesized
tcaactagtacacctagttt

SEQ ID NO: 393165 - DNA, 20 bp, Artificial Sequence
  chemically synthesized
aagacttaaactaggtgtac

SEQ ID NO: 393166 - DNA, 20 bp, Artificial Sequence
  chemically synthesized
atggagtcaactagtacacc

SEQ ID NO: 393167 - DNA, 20 bp, Artificial Sequence
  chemically synthesized
attttctagatggagtcaac

SEQ ID NO: 393168 - DNA, 20 bp, Artificial Sequence
  chemically synthesized
gtgtactagttgactccatc

SEQ ID NO: 393169 - DNA, 20 bp, Artificial Sequence
  chemically synthesized
gagaaataattttctagatg

SEQ ID NO: 393170 - DNA, 20 bp, Artificial Sequence
  chemically synthesized
aggagaaataattttctaga

SEQ ID NO: 393171 - DNA, 20 bp, Artificial Sequence
  chemically synthesized
gtctaggagaaataattttc

SEQ ID NO: 393172 - DNA, 20 bp, Artificial Sequence
  chemically synthesized
atctagaaaattatttctcc

SEQ ID NO: 393173 - DNA, 20 bp, Artificial Sequence
  chemically synthesized
agaaaattatttctcctaga

SEQ ID NO: 393174 - DNA, 20 bp, Artificial Sequence
  chemically synthesized
aatctaagatttctgtctag

SEQ ID NO: 393175 - DNA, 20 bp, Artificial Sequence
  chemically synthesized
ctaatctaagatttctgtct

SEQ ID NO: 393176 - DNA, 20 bp, Artificial Sequence
  chemically synthesized
cctaatctaagatttctgtc

SEQ ID NO: 393177 - DNA, 20 bp, Artificial Sequence
  chemically synthesized
tttctcctagacagaaatct

SEQ ID NO: 393178 - DNA, 20 bp, Artificial Sequence
  chemically synthesized
cctagacagaaatcttagat

SEQ ID NO: 393179 - DNA, 20 bp, Artificial Sequence
  chemically synthesized
ctagacagaaatcttagatt

SEQ ID NO: 393180 - DNA, 20 bp, Artificial Sequence
  chemically synthesized
cagtcacatttgcctaatct

SEQ ID NO: 393181 - DNA, 20 bp, Artificial Sequence
  chemically synthesized
tagattaggcaaatgtgact

SEQ ID NO: 393182 - DNA, 20 bp, Artificial Sequence
  chemically synthesized
tataaagactttgtttagct

SEQ ID NO: 393183 - DNA, 20 bp, Artificial Sequence
  chemically synthesized
aaatgtgactgagctaaaca

SEQ ID NO: 393184 - DNA, 20 bp, Artificial Sequence
  chemically synthesized
taaattataaagactttgtt

SEQ ID NO: 393185 - DNA, 20 bp, Artificial Sequence
  chemically synthesized
ctaagaacttgtaaattata

SEQ ID NO: 393186 - DNA, 20 bp, Artificial Sequence
  chemically synthesized
acaaagtctttataatttac

SEQ ID NO: 393187 - DNA, 20 bp, Artificial Sequence
  chemically synthesized
ctttataatttacaagttct

SEQ ID NO: 393188 - DNA, 20 bp, Artificial Sequence
  chemically synthesized
tttataatttacaagttctt

SEQ ID NO: 393189 - DNA, 20 bp, Artificial Sequence
  chemically synthesized
ttataatttacaagttctta

SEQ ID NO: 393190 - DNA, 20 bp, Artificial Sequence
  chemically synthesized
aaaattaagaattgatccct

SEQ ID NO: 393191 - DNA, 20 bp, Artificial Sequence
  chemically synthesized
ttgtggttttgtacaaaatt

SEQ ID NO: 393192 - DNA, 20 bp, Artificial Sequence
  chemically synthesized
agatcatatgttggtaattg

SEQ ID NO: 393193 - DNA, 20 bp, Artificial Sequence
  chemically synthesized
cagagttggagatcatatgt

SEQ ID NO: 393194 - DNA, 20 bp, Artificial Sequence
  chemically synthesized
agaccccattgtcagagttg

SEQ ID NO: 393195 - DNA, 20 bp, Artificial Sequence
  chemically synthesized
taagaccccattgtcagagt

SEQ ID NO: 393196 - DNA, 20 bp, Artificial Sequence
  chemically synthesized
atgatctccaactctgacaa

SEQ ID NO: 393197 - DNA, 20 bp, Artificial Sequence
  chemically synthesized
tgatctccaactctgacaat

SEQ ID NO: 393198 - DNA, 20 bp, Artificial Sequence
  chemically synthesized
aaaataagaccccattgtca

SEQ ID NO: 393199 - DNA, 20 bp, Artificial Sequence
  chemically synthesized
gatctccaactctgacaatg

SEQ ID NO: 393200 - DNA, 20 bp, Artificial Sequence
  chemically synthesized
taaaaataagaccccattgt

SEQ ID NO: 393201 - DNA, 20 bp, Artificial Sequence
  chemically synthesized
ttataatggagattaaaaat

SEQ ID NO: 393202 - DNA, 20 bp, Artificial Sequence
  chemically synthesized
tctgttgccaatttataatg

SEQ ID NO: 393203 - DNA, 20 bp, Artificial Sequence
  chemically synthesized
tttctgttgccaatttataa

SEQ ID NO: 393204 - DNA, 20 bp, Artificial Sequence
  chemically synthesized
ttttaatctccattataaat

SEQ ID NO: 393205 - DNA, 20 bp, Artificial Sequence
  chemically synthesized
tctccattataaattggcaa

SEQ ID NO: 393206 - DNA, 20 bp, Artificial Sequence
  chemically synthesized
ctttactgaaatgagatgag

SEQ ID NO: 393207 - DNA, 20 bp, Artificial Sequence
  chemically synthesized
caactttactgaaatgagat

SEQ ID NO: 393208 - DNA, 20 bp, Artificial Sequence
  chemically synthesized
gaaatcttctcatctcattt

SEQ ID NO: 393209 - DNA, 20 bp, Artificial Sequence
  chemically synthesized
aaagccaactttactgaaat

SEQ ID NO: 393210 - DNA, 20 bp, Artificial Sequence
  chemically synthesized
cttctcatctcatttcagta

SEQ ID NO: 393211 - DNA, 20 bp, Artificial Sequence
  chemically synthesized
tcatctcatttcagtaaagt

SEQ ID NO: 393212 - DNA, 20 bp, Artificial Sequence
  chemically synthesized
agagtttctttattttggca

SEQ ID NO: 393213 - DNA, 20 bp, Artificial Sequence
  chemically synthesized
aagttggctttgccaaaata

SEQ ID NO: 393214 - DNA, 20 bp, Artificial Sequence
  chemically synthesized
caaagagagtttctttattt

SEQ ID NO: 393215 - DNA, 20 bp, Artificial Sequence
  chemically synthesized
atctgattcaggttcaaaga

SEQ ID NO: 393216 - DNA, 20 bp, Artificial Sequence
  chemically synthesized
tcatctgattcaggttcaaa

SEQ ID NO: 393217 - DNA, 20 bp, Artificial Sequence
  chemically synthesized
catcatctgattcaggttca

SEQ ID NO: 393218 - DNA, 20 bp, Artificial Sequence
  chemically synthesized
aactctctttgaacctgaat

SEQ ID NO: 393219 - DNA, 20 bp, Artificial Sequence
  chemically synthesized
gtacatccatcatctgattc

SEQ ID NO: 393220 - DNA, 20 bp, Artificial Sequence
  chemically synthesized
tgtacatccatcatctgatt

SEQ ID NO: 393221 - DNA, 20 bp, Artificial Sequence
  chemically synthesized
tttgaacctgaatcagatga

SEQ ID NO: 393222 - DNA, 20 bp, Artificial Sequence
  chemically synthesized
gaatcagatgatggatgtac

SEQ ID NO: 393223 - DNA, 20 bp, Artificial Sequence
  chemically synthesized
tgtacaagtcacttattttc

SEQ ID NO: 393224 - DNA, 20 bp, Artificial Sequence
  chemically synthesized
gtacaagtcacttattttct

SEQ ID NO: 393225 - DNA, 20 bp, Artificial Sequence
  chemically synthesized
taactctaagcccagaaaat

SEQ ID NO: 393226 - DNA, 20 bp, Artificial Sequence
  chemically synthesized
agtcacttattttctgggct

SEQ ID NO: 393227 - DNA, 20 bp, Artificial Sequence
  chemically synthesized
tcacttattttctgggctta

SEQ ID NO: 393228 - DNA, 20 bp, Artificial Sequence
  chemically synthesized
ctccagagtaactctaagcc

SEQ ID NO: 393229 - DNA, 20 bp, Artificial Sequence
  chemically synthesized
ttactctccagagtaactct

SEQ ID NO: 393230 - DNA, 20 bp, Artificial Sequence
  chemically synthesized
ttctgggcttagagttactc

SEQ ID NO: 393231 - DNA, 20 bp, Artificial Sequence
  chemically synthesized
ctgggcttagagttactctg

SEQ ID NO: 393232 - DNA, 20 bp, Artificial Sequence
  chemically synthesized
gggcttagagttactctgga

SEQ ID NO: 393233 - DNA, 20 bp, Artificial Sequence
  chemically synthesized
taaacattggttactctcca

SEQ ID NO: 393234 - DNA, 20 bp, Artificial Sequence
  chemically synthesized
attaaacattggttactctc

SEQ ID NO: 393235 - DNA, 20 bp, Artificial Sequence
  chemically synthesized
aacattgataaattaaacat

SEQ ID NO: 393236 - DNA, 20 bp, Artificial Sequence
  chemically synthesized
gtttaatttatcaatgttcc

SEQ ID NO: 393237 - DNA, 20 bp, Artificial Sequence
  chemically synthesized
tgttaaactaattaatttct

SEQ ID NO: 393238 - DNA, 20 bp, Artificial Sequence
  chemically synthesized
atgttaaactaattaatttc

SEQ ID NO: 393239 - DNA, 20 bp, Artificial Sequence
  chemically synthesized
caatgttcctagaaattaat

SEQ ID NO: 393240 - DNA, 20 bp, Artificial Sequence
  chemically synthesized
aacactttggtaacaacagt

SEQ ID NO: 393241 - DNA, 20 bp, Artificial Sequence
  chemically synthesized
aaacactttggtaacaacag

SEQ ID NO: 393242 - DNA, 20 bp, Artificial Sequence
  chemically synthesized
gaaaaacactttggtaacaa

SEQ ID NO: 393243 - DNA, 20 bp, Artificial Sequence
  chemically synthesized
atgacctactgttgttacca

SEQ ID NO: 393244 - DNA, 20 bp, Artificial Sequence
  chemically synthesized
acctagtatgaaaaacactt

SEQ ID NO: 393245 - DNA, 20 bp, Artificial Sequence
  chemically synthesized
taccaaagtgtttttcatac

SEQ ID NO: 393246 - DNA, 20 bp, Artificial Sequence
  chemically synthesized
accaaagtgtttttcatact

SEQ ID NO: 393247 - DNA, 20 bp, Artificial Sequence
  chemically synthesized
caggcccaatttgtattacc

SEQ ID NO: 393248 - DNA, 20 bp, Artificial Sequence
  chemically synthesized
tcatactaggtaatacaaat

SEQ ID NO: 393249 - DNA, 20 bp, Artificial Sequence
  chemically synthesized
catactaggtaatacaaatt

SEQ ID NO: 393250 - DNA, 20 bp, Artificial Sequence
  chemically synthesized
acaaattgggcctgattatc

SEQ ID NO: 393251 - DNA, 20 bp, Artificial Sequence
  chemically synthesized
atacaattgcctagataatc

SEQ ID NO: 393252 - DNA, 20 bp, Artificial Sequence
  chemically synthesized
caaattgggcctgattatct

SEQ ID NO: 393253 - DNA, 20 bp, Artificial Sequence
  chemically synthesized
aatacaattgcctagataat

SEQ ID NO: 393254 - DNA, 20 bp, Artificial Sequence
  chemically synthesized
gaaaattaaatacaattgcc

SEQ ID NO: 393255 - DNA, 20 bp, Artificial Sequence
  chemically synthesized
ttgtatttaattttctgttt

SEQ ID NO: 393256 - DNA, 20 bp, Artificial Sequence
  chemically synthesized
ttggttgccatgaaccaaaa

SEQ ID NO: 393257 - DNA, 20 bp, Artificial Sequence
  chemically synthesized
taattttctgttttggttca

SEQ ID NO: 393258 - DNA, 20 bp, Artificial Sequence
  chemically synthesized
ttggttcatggcaaccaaat

SEQ ID NO: 393259 - DNA, 20 bp, Artificial Sequence
  chemically synthesized
aaaagttataagtgccaatt

SEQ ID NO: 393260 - DNA, 20 bp, Artificial Sequence
  chemically synthesized
gacaaaagggaaaaagttat

SEQ ID NO: 393261 - DNA, 20 bp, Artificial Sequence
  chemically synthesized
aattttggacaaaagggaaa

SEQ ID NO: 393262 - DNA, 20 bp, Artificial Sequence
  chemically synthesized
caatggaattttggacaaaa

SEQ ID NO: 393263 - DNA, 20 bp, Artificial Sequence
  chemically synthesized
ccaatggaattttggacaaa

SEQ ID NO: 393264 - DNA, 20 bp, Artificial Sequence
  chemically synthesized
tccaatggaattttggacaa

SEQ ID NO: 393265 - DNA, 20 bp, Artificial Sequence
  chemically synthesized
ccgtcattccaatggaattt

SEQ ID NO: 393266 - DNA, 20 bp, Artificial Sequence
  chemically synthesized
ccttttgtccaaaattccat

SEQ ID NO: 393267 - DNA, 20 bp, Artificial Sequence
  chemically synthesized
aataccttccgtcattccaa

SEQ ID NO: 393268 - DNA, 20 bp, Artificial Sequence
  chemically synthesized
ccaaaattccattggaatga

SEQ ID NO: 393269 - DNA, 20 bp, Artificial Sequence
  chemically synthesized
aaattccattggaatgacgg

SEQ ID NO: 393270 - DNA, 20 bp, Artificial Sequence
  chemically synthesized
aattccattggaatgacgga

SEQ ID NO: 393271 - DNA, 20 bp, Artificial Sequence
  chemically synthesized
acggaaggtattcatgtgtt

SEQ ID NO: 393272 - DNA, 20 bp, Artificial Sequence
  chemically synthesized
ggaaggtattcatgtgttta

SEQ ID NO: 393273 - DNA, 20 bp, Artificial Sequence
  chemically synthesized
gaaggtattcatgtgtttag

SEQ ID NO: 393274 - DNA, 20 bp, Artificial Sequence
  chemically synthesized
gaataaaattataatcaacc

SEQ ID NO: 393275 - DNA, 20 bp, Artificial Sequence
  chemically synthesized
ttataatcaacctagaaaac

SEQ ID NO: 393276 - DNA, 20 bp, Artificial Sequence
  chemically synthesized
tgcttgctttcttgttttct

SEQ ID NO: 393277 - DNA, 20 bp, Artificial Sequence
  chemically synthesized
ttgcttgctttcttgttttc

SEQ ID NO: 393278 - DNA, 20 bp, Artificial Sequence
  chemically synthesized
aatcaacctagaaaacaaga

SEQ ID NO: 393279 - DNA, 20 bp, Artificial Sequence
  chemically synthesized
aacctagaaaacaagaaagc

SEQ ID NO: 393280 - DNA, 20 bp, Artificial Sequence
  chemically synthesized
tagaaaacaagaaagcaagc

SEQ ID NO: 393281 - DNA, 20 bp, Artificial Sequence
  chemically synthesized
acaagaaagcaagcaagcaa

SEQ ID NO: 393282 - DNA, 20 bp, Artificial Sequence
  chemically synthesized
aagcaagcaagcaaaagacc

SEQ ID NO: 393283 - DNA, 20 bp, Artificial Sequence
  chemically synthesized
caagcaaaagaccaagatac

SEQ ID NO: 393284 - DNA, 20 bp, Artificial Sequence
  chemically synthesized
cagtattttcaccagtatct

SEQ ID NO: 393285 - DNA, 20 bp, Artificial Sequence
  chemically synthesized
acatctttcagtattttcac

SEQ ID NO: 393286 - DNA, 20 bp, Artificial Sequence
  chemically synthesized
gatactggtgaaaatactga

SEQ ID NO: 393287 - DNA, 20 bp, Artificial Sequence
  chemically synthesized
ggtgaaaatactgaaagatg

SEQ ID NO: 393288 - DNA, 20 bp, Artificial Sequence
  chemically synthesized
gagatcccatctacatcttt

SEQ ID NO: 393289 - DNA, 20 bp, Artificial Sequence
  chemically synthesized
aaaatactgaaagatgtaga

SEQ ID NO: 393290 - DNA, 20 bp, Artificial Sequence
  chemically synthesized
aaatactgaaagatgtagat

SEQ ID NO: 393291 - DNA, 20 bp, Artificial Sequence
  chemically synthesized
agatgtagatgggatctcac

SEQ ID NO: 393292 - DNA, 20 bp, Artificial Sequence
  chemically synthesized
tagatgggatctcactggta

SEQ ID NO: 393293 - DNA, 20 bp, Artificial Sequence
  chemically synthesized
tctttgttttctttaccagt

SEQ ID NO: 393294 - DNA, 20 bp, Artificial Sequence
  chemically synthesized
ctcttctttgttttctttac

SEQ ID NO: 393295 - DNA, 20 bp, Artificial Sequence
  chemically synthesized
tctcactggtaaagaaaaca

SEQ ID NO: 393296 - DNA, 20 bp, Artificial Sequence
  chemically synthesized
cactggtaaagaaaacaaag

SEQ ID NO: 393297 - DNA, 20 bp, Artificial Sequence
  chemically synthesized
ctggtaaagaaaacaaagaa

SEQ ID NO: 393298 - DNA, 20 bp, Artificial Sequence
  chemically synthesized
gtcaataaaaccacaaacac

SEQ ID NO: 393299 - DNA, 20 bp, Artificial Sequence
  chemically synthesized
cttcttactcctggtgtttg

SEQ ID NO: 393300 - DNA, 20 bp, Artificial Sequence
  chemically synthesized
tcaataaaaccacaaacacc

SEQ ID NO: 393301 - DNA, 20 bp, Artificial Sequence
  chemically synthesized
aataaaaccacaaacaccag

SEQ ID NO: 393302 - DNA, 20 bp, Artificial Sequence
  chemically synthesized
aaaccacaaacaccaggagt

SEQ ID NO: 393303 - DNA, 20 bp, Artificial Sequence
  chemically synthesized
gtgaagcttcttcttactcc

SEQ ID NO: 393304 - DNA, 20 bp, Artificial Sequence
  chemically synthesized
ccacaaacaccaggagtaag

SEQ ID NO: 393305 - DNA, 20 bp, Artificial Sequence
  chemically synthesized
caaacaccaggagtaagaag

SEQ ID NO: 393306 - DNA, 20 bp, Artificial Sequence
  chemically synthesized
atttgtcaaccaaaggtgtg

SEQ ID NO: 393307 - DNA, 20 bp, Artificial Sequence
  chemically synthesized
aagaagaagcttcacacctt

SEQ ID NO: 393308 - DNA, 20 bp, Artificial Sequence
  chemically synthesized
gtacactatttgtcaaccaa

SEQ ID NO: 393309 - DNA, 20 bp, Artificial Sequence
  chemically synthesized
agtacactatttgtcaacca

SEQ ID NO: 393310 - DNA, 20 bp, Artificial Sequence
  chemically synthesized
tcacacctttggttgacaaa

SEQ ID NO: 393311 - DNA, 20 bp, Artificial Sequence
  chemically synthesized
tacaacagccagcagaattg

SEQ ID NO: 393312 - DNA, 20 bp, Artificial Sequence
  chemically synthesized
atagtgtacttcaattctgc

SEQ ID NO: 393313 - DNA, 20 bp, Artificial Sequence
  chemically synthesized
atctcctttacaacagccag

SEQ ID NO: 393314 - DNA, 20 bp, Artificial Sequence
  chemically synthesized
gtaatctcctttacaacagc

SEQ ID NO: 393315 - DNA, 20 bp, Artificial Sequence
  chemically synthesized
caattctgctggctgttgta

SEQ ID NO: 393316 - DNA, 20 bp, Artificial Sequence
  chemically synthesized
aattctgctggctgttgtaa

SEQ ID NO: 393317 - DNA, 20 bp, Artificial Sequence
  chemically synthesized
tcctgtaatctcctttacaa

SEQ ID NO: 393318 - DNA, 20 bp, Artificial Sequence
  chemically synthesized
ttctgctggctgttgtaaag

SEQ ID NO: 393319 - DNA, 20 bp, Artificial Sequence
  chemically synthesized
ggctgttgtaaaggagatta

SEQ ID NO: 393320 - DNA, 20 bp, Artificial Sequence
  chemically synthesized
gctgttgtaaaggagattac

SEQ ID NO: 393321 - DNA, 20 bp, Artificial Sequence
  chemically synthesized
aaaggagattacaggatacc

SEQ ID NO: 393322 - DNA, 20 bp, Artificial Sequence
  chemically synthesized
ggagattacaggatacctgg

SEQ ID NO: 393323 - DNA, 20 bp, Artificial Sequence
  chemically synthesized
tctcccattatatatcttcc

SEQ ID NO: 393324 - DNA, 20 bp, Artificial Sequence
  chemically synthesized
ttctcccattatatatcttc

SEQ ID NO: 393325 - DNA, 20 bp, Artificial Sequence
  chemically synthesized
gatacctggaagatatataa

SEQ ID NO: 393326 - DNA, 20 bp, Artificial Sequence
  chemically synthesized
atacctggaagatatataat

SEQ ID NO: 393327 - DNA, 20 bp, Artificial Sequence
  chemically synthesized
acctggaagatatataatgg

SEQ ID NO: 393328 - DNA, 20 bp, Artificial Sequence
  chemically synthesized
tggaagatatataatgggag

SEQ ID NO: 393329 - DNA, 20 bp, Artificial Sequence
  chemically synthesized
aagatatataatgggagaag

SEQ ID NO: 393330 - DNA, 20 bp, Artificial Sequence
  chemically synthesized
atgggagaagtagtctcata

SEQ ID NO: 393331 - DNA, 20 bp, Artificial Sequence
  chemically synthesized
ggagaagtagtctcatatag

SEQ ID NO: 393332 - DNA, 20 bp, Artificial Sequence
  chemically synthesized
acccacaatagcttctatat

SEQ ID NO: 393333 - DNA, 20 bp, Artificial Sequence
  chemically synthesized
gtctcatatagaagctattg

SEQ ID NO: 393334 - DNA, 20 bp, Artificial Sequence
  chemically synthesized
tctcatatagaagctattgt

SEQ ID NO: 393335 - DNA, 20 bp, Artificial Sequence
  chemically synthesized
taaaggacccaaacccacaa

SEQ ID NO: 393336 - DNA, 20 bp, Artificial Sequence
  chemically synthesized
tatagaagctattgtgggtt

SEQ ID NO: 393337 - DNA, 20 bp, Artificial Sequence
  chemically synthesized
atagaagctattgtgggttt

SEQ ID NO: 393338 - DNA, 20 bp, Artificial Sequence
  chemically synthesized
tattgtgggtttgggtcctt

SEQ ID NO: 393339 - DNA, 20 bp, Artificial Sequence
  chemically synthesized
ttcctcagagaaatttctaa

SEQ ID NO: 393340 - DNA, 20 bp, Artificial Sequence
  chemically synthesized
cttcctcagagaaatttcta

SEQ ID NO: 393341 - DNA, 20 bp, Artificial Sequence
  chemically synthesized
ggtcctttagaaatttctct

SEQ ID NO: 393342 - DNA, 20 bp, Artificial Sequence
  chemically synthesized
gtcctttagaaatttctctg

SEQ ID NO: 393343 - DNA, 20 bp, Artificial Sequence
  chemically synthesized
ctttagaaatttctctgagg

SEQ ID NO: 393344 - DNA, 20 bp, Artificial Sequence
  chemically synthesized
aacttaatgtttcttcctca

SEQ ID NO: 393345 - DNA, 20 bp, Artificial Sequence
  chemically synthesized
acaacttaatgtttcttcct

SEQ ID NO: 393346 - DNA, 20 bp, Artificial Sequence
  chemically synthesized
ttctctgaggaagaaacatt

SEQ ID NO: 393347 - DNA, 20 bp, Artificial Sequence
  chemically synthesized
gaggaagaaacattaagttg

SEQ ID NO: 393348 - DNA, 20 bp, Artificial Sequence
  chemically synthesized
aacattaagttgtggcctaa

SEQ ID NO: 393349 - DNA, 20 bp, Artificial Sequence
  chemically synthesized
agcctcctttttcatctttt

SEQ ID NO: 393350 - DNA, 20 bp, Artificial Sequence
  chemically synthesized
cagcctcctttttcatcttt

SEQ ID NO: 393351 - DNA, 20 bp, Artificial Sequence
  chemically synthesized
ttgtggcctaaaagatgaaa

SEQ ID NO: 393352 - DNA, 20 bp, Artificial Sequence
  chemically synthesized
tgtggcctaaaagatgaaaa

SEQ ID NO: 393353 - DNA, 20 bp, Artificial Sequence
  chemically synthesized
tggcctaaaagatgaaaaag

SEQ ID NO: 393354 - DNA, 20 bp, Artificial Sequence
  chemically synthesized
ggcctaaaagatgaaaaagg

SEQ ID NO: 393355 - DNA, 20 bp, Artificial Sequence
  chemically synthesized
aagatgaaaaaggaggctga

SEQ ID NO: 393356 - DNA, 20 bp, Artificial Sequence
  chemically synthesized
atgaaaaaggaggctgatag

SEQ ID NO: 393357 - DNA, 20 bp, Artificial Sequence
  chemically synthesized
ttaaaatacaggactactat

SEQ ID NO: 393358 - DNA, 20 bp, Artificial Sequence
  chemically synthesized
ctgattttcttttaaaatac

SEQ ID NO: 393359 - DNA, 20 bp, Artificial Sequence
  chemically synthesized
actgattttcttttaaaata

SEQ ID NO: 393360 - DNA, 20 bp, Artificial Sequence
  chemically synthesized
atagtagtcctgtattttaa

SEQ ID NO: 393361 - DNA, 20 bp, Artificial Sequence
  chemically synthesized
cctgtattttaaaagaaaat

SEQ ID NO: 393362 - DNA, 20 bp, Artificial Sequence
  chemically synthesized
aaatcagtatcaccgtaatt

SEQ ID NO: 393363 - DNA, 20 bp, Artificial Sequence
  chemically synthesized
aatcagtatcaccgtaattt

SEQ ID NO: 393364 - DNA, 20 bp, Artificial Sequence
  chemically synthesized
atcagtatcaccgtaattta

SEQ ID NO: 393365 - DNA, 20 bp, Artificial Sequence
  chemically synthesized
caacctccctccctaaatta

SEQ ID NO: 393366 - DNA, 20 bp, Artificial Sequence
  chemically synthesized
cagtatcaccgtaatttagg

SEQ ID NO: 393367 - DNA, 20 bp, Artificial Sequence
  chemically synthesized
agtatcaccgtaatttaggg

SEQ ID NO: 393368 - DNA, 20 bp, Artificial Sequence
  chemically synthesized
gtatcaccgtaatttaggga

SEQ ID NO: 393369 - DNA, 20 bp, Artificial Sequence
  chemically synthesized
atcaccgtaatttagggagg

SEQ ID NO: 393370 - DNA, 20 bp, Artificial Sequence
  chemically synthesized
tcaccgtaatttagggaggg

SEQ ID NO: 393371 - DNA, 20 bp, Artificial Sequence
  chemically synthesized
cgtaatttagggagggaggt

SEQ ID NO: 393372 - DNA, 20 bp, Artificial Sequence
  chemically synthesized
taatttagggagggaggttg

SEQ ID NO: 393373 - DNA, 20 bp, Artificial Sequence
  chemically synthesized
atttagggagggaggttgga

SEQ ID NO: 393374 - DNA, 20 bp, Artificial Sequence
  chemically synthesized
tagggagggaggttggagag

SEQ ID NO: 393375 - DNA, 20 bp, Artificial Sequence
  chemically synthesized
ggagggaggttggagagaag

SEQ ID NO: 393376 - DNA, 20 bp, Artificial Sequence
  chemically synthesized
gttggagagaagtggaaaat

SEQ ID NO: 393377 - DNA, 20 bp, Artificial Sequence
  chemically synthesized
gagagaagtggaaaatcaga

SEQ ID NO: 393378 - DNA, 20 bp, Artificial Sequence
  chemically synthesized
gagaagtggaaaatcagaaa

SEQ ID NO: 393379 - DNA, 20 bp, Artificial Sequence
  chemically synthesized
agtggaaaatcagaaagaga

SEQ ID NO: 393380 - DNA, 20 bp, Artificial Sequence
  chemically synthesized
cagaaagagatagctgttaa

SEQ ID NO: 393381 - DNA, 20 bp, Artificial Sequence
  chemically synthesized
agaaagagatagctgttaaa

SEQ ID NO: 393382 - DNA, 20 bp, Artificial Sequence
  chemically synthesized
tatagggctctaccttttaa

SEQ ID NO: 393383 - DNA, 20 bp, Artificial Sequence
  chemically synthesized
aagagatagctgttaaaagg

SEQ ID NO: 393384 - DNA, 20 bp, Artificial Sequence
  chemically synthesized
gagatagctgttaaaaggta

SEQ ID NO: 393385 - DNA, 20 bp, Artificial Sequence
  chemically synthesized
tgttaaaaggtagagcccta

SEQ ID NO: 393386 - DNA, 20 bp, Artificial Sequence
  chemically synthesized
gttaaaaggtagagccctat

SEQ ID NO: 393387 - DNA, 20 bp, Artificial Sequence
  chemically synthesized
agtttatgccacaacctata

SEQ ID NO: 393388 - DNA, 20 bp, Artificial Sequence
  chemically synthesized
aagtttatgccacaacctat

SEQ ID NO: 393389 - DNA, 20 bp, Artificial Sequence
  chemically synthesized
aggtagagccctataggttg

SEQ ID NO: 393390 - DNA, 20 bp, Artificial Sequence
  chemically synthesized
aaagtttatgccacaaccta

SEQ ID NO: 393391 - DNA, 20 bp, Artificial Sequence
  chemically synthesized
aggttgtggcataaacttta

SEQ ID NO: 393392 - DNA, 20 bp, Artificial Sequence
  chemically synthesized
aatagctgtccattactgta

SEQ ID NO: 393393 - DNA, 20 bp, Artificial Sequence
  chemically synthesized
tggcataaactttacagtaa

SEQ ID NO: 393394 - DNA, 20 bp, Artificial Sequence
  chemically synthesized
ataaactttacagtaatgga

SEQ ID NO: 393395 - DNA, 20 bp, Artificial Sequence
  chemically synthesized
acagtaatggacagctattg

SEQ ID NO: 393396 - DNA, 20 bp, Artificial Sequence
  chemically synthesized
agtaatggacagctattgaa

SEQ ID NO: 393397 - DNA, 20 bp, Artificial Sequence
  chemically synthesized
tgttgtttataactcttcaa

SEQ ID NO: 393398 - DNA, 20 bp, Artificial Sequence
  chemically synthesized
tattgaagagttataaacaa

SEQ ID NO: 393399 - DNA, 20 bp, Artificial Sequence
  chemically synthesized
cccattttcaatatggcaaa

SEQ ID NO: 393400 - DNA, 20 bp, Artificial Sequence
  chemically synthesized
cctgtaccccattttcaata

SEQ ID NO: 393401 - DNA, 20 bp, Artificial Sequence
  chemically synthesized
tccatttgccatattgaaaa

SEQ ID NO: 393402 - DNA, 20 bp, Artificial Sequence
  chemically synthesized
ccatttgccatattgaaaat

SEQ ID NO: 393403 - DNA, 20 bp, Artificial Sequence
  chemically synthesized
catttgccatattgaaaatg

SEQ ID NO: 393404 - DNA, 20 bp, Artificial Sequence
  chemically synthesized
gccatattgaaaatggggta

SEQ ID NO: 393405 - DNA, 20 bp, Artificial Sequence
  chemically synthesized
ccatattgaaaatggggtac

SEQ ID NO: 393406 - DNA, 20 bp, Artificial Sequence
  chemically synthesized
catattgaaaatggggtaca

SEQ ID NO: 393407 - DNA, 20 bp, Artificial Sequence
  chemically synthesized
atattgaaaatggggtacag

SEQ ID NO: 393408 - DNA, 20 bp, Artificial Sequence
  chemically synthesized
tgaaaatggggtacaggggc

SEQ ID NO: 393409 - DNA, 20 bp, Artificial Sequence
  chemically synthesized
gaaaatggggtacaggggcc

SEQ ID NO: 393410 - DNA, 20 bp, Artificial Sequence
  chemically synthesized
atggggtacaggggccaggc

SEQ ID NO: 393411 - DNA, 20 bp, Artificial Sequence
  chemically synthesized
tggggtacaggggccaggcg

SEQ ID NO: 393412 - DNA, 20 bp, Artificial Sequence
  chemically synthesized
ggtacaggggccaggcgagg

SEQ ID NO: 393413 - DNA, 20 bp, Artificial Sequence
  chemically synthesized
caggcgtgaaccacctcgcc

SEQ ID NO: 393414 - DNA, 20 bp, Artificial Sequence
  chemically synthesized
gtggttcacgcctgtaatcc

SEQ ID NO: 393415 - DNA, 20 bp, Artificial Sequence
  chemically synthesized
tcccaaagtgctgggattac

SEQ ID NO: 393416 - DNA, 20 bp, Artificial Sequence
  chemically synthesized
ctcccaaagtgctgggatta

SEQ ID NO: 393417 - DNA, 20 bp, Artificial Sequence
  chemically synthesized
cgcctgtaatcccagcactt

SEQ ID NO: 393418 - DNA, 20 bp, Artificial Sequence
  chemically synthesized
cctcggcctcccaaagtgct

SEQ ID NO: 393419 - DNA, 20 bp, Artificial Sequence
  chemically synthesized
gcctgtaatcccagcacttt

SEQ ID NO: 393420 - DNA, 20 bp, Artificial Sequence
  chemically synthesized
gcctcggcctcccaaagtgc

SEQ ID NO: 393421 - DNA, 20 bp, Artificial Sequence
  chemically synthesized
ctgtaatcccagcactttgg

SEQ ID NO: 393422 - DNA, 20 bp, Artificial Sequence
  chemically synthesized
tgtaatcccagcactttggg

SEQ ID NO: 393423 - DNA, 20 bp, Artificial Sequence
  chemically synthesized
ctgcccgcctcggcctccca

SEQ ID NO: 393424 - DNA, 20 bp, Artificial Sequence
  chemically synthesized
tcccagcactttgggaggcc

SEQ ID NO: 393425 - DNA, 20 bp, Artificial Sequence
  chemically synthesized
cccagcactttgggaggccg

SEQ ID NO: 393426 - DNA, 20 bp, Artificial Sequence
  chemically synthesized
agcactttgggaggccgagg

SEQ ID NO: 393427 - DNA, 20 bp, Artificial Sequence
  chemically synthesized
gcactttgggaggccgaggc

SEQ ID NO: 393428 - DNA, 20 bp, Artificial Sequence
  chemically synthesized
ctttgggaggccgaggcggg

SEQ ID NO: 393429 - DNA, 20 bp, Artificial Sequence
  chemically synthesized
ctcaagtgatctgcccgcct

SEQ ID NO: 393430 - DNA, 20 bp, Artificial Sequence
  chemically synthesized
ccgaggcgggcagatcactt

SEQ ID NO: 393431 - DNA, 20 bp, Artificial Sequence
  chemically synthesized
cgaggcgggcagatcacttg

SEQ ID NO: 393432 - DNA, 20 bp, Artificial Sequence
  chemically synthesized
gcgggcagatcacttgaggt

SEQ ID NO: 393433 - DNA, 20 bp, Artificial Sequence
  chemically synthesized
cgggcagatcacttgaggtc

SEQ ID NO: 393434 - DNA, 20 bp, Artificial Sequence
  chemically synthesized
ggtctcaaactcctgacctc

SEQ ID NO: 393435 - DNA, 20 bp, Artificial Sequence
  chemically synthesized
ggcagatcacttgaggtcag

SEQ ID NO: 393436 - DNA, 20 bp, Artificial Sequence
  chemically synthesized
tcacttgaggtcaggagttt

SEQ ID NO: 393437 - DNA, 20 bp, Artificial Sequence
  chemically synthesized
tgaggtcaggagtttgagac

SEQ ID NO: 393438 - DNA, 20 bp, Artificial Sequence
  chemically synthesized
tcaggagtttgagaccagcc

SEQ ID NO: 393439 - DNA, 20 bp, Artificial Sequence
  chemically synthesized
tttcaccacgttggccaggc

SEQ ID NO: 393440 - DNA, 20 bp, Artificial Sequence
  chemically synthesized
ggagtttcaccacgttggcc

SEQ ID NO: 393441 - DNA, 20 bp, Artificial Sequence
  chemically synthesized
tgagaccagcctggccaacg

SEQ ID NO: 393442 - DNA, 20 bp, Artificial Sequence
  chemically synthesized
cggagtttcaccacgttggc

SEQ ID NO: 393443 - DNA, 20 bp, Artificial Sequence
  chemically synthesized
gagacggagtttcaccacgt

SEQ ID NO: 393444 - DNA, 20 bp, Artificial Sequence
  chemically synthesized
ttctgtttttagtagagacg

SEQ ID NO: 393445 - DNA, 20 bp, Artificial Sequence
  chemically synthesized
ttttctgtttttagtagaga

SEQ ID NO: 393446 - DNA, 20 bp, Artificial Sequence
  chemically synthesized
taatttttctgtttttagta

SEQ ID NO: 393447 - DNA, 20 bp, Artificial Sequence
  chemically synthesized
aactccgtctctactaaaaa

SEQ ID NO: 393448 - DNA, 20 bp, Artificial Sequence
  chemically synthesized
cctaatttttctgtttttag

SEQ ID NO: 393449 - DNA, 20 bp, Artificial Sequence
  chemically synthesized
cagcctaatttttctgtttt

SEQ ID NO: 393450 - DNA, 20 bp, Artificial Sequence
  chemically synthesized
tctactaaaaacagaaaaat

SEQ ID NO: 393451 - DNA, 20 bp, Artificial Sequence
  chemically synthesized
ctactaaaaacagaaaaatt

SEQ ID NO: 393452 - DNA, 20 bp, Artificial Sequence
  chemically synthesized
taaaaacagaaaaattaggc

SEQ ID NO: 393453 - DNA, 20 bp, Artificial Sequence
  chemically synthesized
acagaaaaattaggctggtg

SEQ ID NO: 393454 - DNA, 20 bp, Artificial Sequence
  chemically synthesized
gaaaaattaggctggtgtag

SEQ ID NO: 393455 - DNA, 20 bp, Artificial Sequence
  chemically synthesized
acaggcgcctgctactacac

SEQ ID NO: 393456 - DNA, 20 bp, Artificial Sequence
  chemically synthesized
aaattaggctggtgtagtag

SEQ ID NO: 393457 - DNA, 20 bp, Artificial Sequence
  chemically synthesized
aattaggctggtgtagtagc

SEQ ID NO: 393458 - DNA, 20 bp, Artificial Sequence
  chemically synthesized
gtagcaggcgcctgtaatcc

SEQ ID NO: 393459 - DNA, 20 bp, Artificial Sequence
  chemically synthesized
tcccgagtagctgggattac

SEQ ID NO: 393460 - DNA, 20 bp, Artificial Sequence
  chemically synthesized
ctcccgagtagctgggatta

SEQ ID NO: 393461 - DNA, 20 bp, Artificial Sequence
  chemically synthesized
cgcctgtaatcccagctact

SEQ ID NO: 393462 - DNA, 20 bp, Artificial Sequence
  chemically synthesized
cctcagcctcccgagtagct

SEQ ID NO: 393463 - DNA, 20 bp, Artificial Sequence
  chemically synthesized
gcctgtaatcccagctactc

SEQ ID NO: 393464 - DNA, 20 bp, Artificial Sequence
  chemically synthesized
gcctcagcctcccgagtagc

SEQ ID NO: 393465 - DNA, 20 bp, Artificial Sequence
  chemically synthesized
ctgtaatcccagctactcgg

SEQ ID NO: 393466 - DNA, 20 bp, Artificial Sequence
  chemically synthesized
tgtaatcccagctactcggg

SEQ ID NO: 393467 - DNA, 20 bp, Artificial Sequence
  chemically synthesized
tcgcgcctcagcctcccgag

SEQ ID NO: 393468 - DNA, 20 bp, Artificial Sequence
  chemically synthesized
tcctcgcgcctcagcctccc

SEQ ID NO: 393469 - DNA, 20 bp, Artificial Sequence
  chemically synthesized
tcccagctactcgggaggct

SEQ ID NO: 393470 - DNA, 20 bp, Artificial Sequence
  chemically synthesized
cccagctactcgggaggctg

SEQ ID NO: 393471 - DNA, 20 bp, Artificial Sequence
  chemically synthesized
tactcgggaggctgaggcgc

SEQ ID NO: 393472 - DNA, 20 bp, Artificial Sequence
  chemically synthesized
actcgggaggctgaggcgcg

SEQ ID NO: 393473 - DNA, 20 bp, Artificial Sequence
  chemically synthesized
ttcaagcattcctcgcgcct

SEQ ID NO: 393474 - DNA, 20 bp, Artificial Sequence
  chemically synthesized
gcgcgaggaatgcttgaacc

SEQ ID NO: 393475 - DNA, 20 bp, Artificial Sequence
  chemically synthesized
cgcgaggaatgcttgaaccc

SEQ ID NO: 393476 - DNA, 20 bp, Artificial Sequence
  chemically synthesized
aacctccgcctcctgggttc

SEQ ID NO: 393477 - DNA, 20 bp, Artificial Sequence
  chemically synthesized
cgaggaatgcttgaacccag

SEQ ID NO: 393478 - DNA, 20 bp, Artificial Sequence
  chemically synthesized
gaggaatgcttgaacccagg

SEQ ID NO: 393479 - DNA, 20 bp, Artificial Sequence
  chemically synthesized
gaatgcttgaacccaggagg

SEQ ID NO: 393480 - DNA, 20 bp, Artificial Sequence
  chemically synthesized
cactgcaacctccgcctcct

SEQ ID NO: 393481 - DNA, 20 bp, Artificial Sequence
  chemically synthesized
atgcttgaacccaggaggcg

SEQ ID NO: 393482 - DNA, 20 bp, Artificial Sequence
  chemically synthesized
tcactgcaacctccgcctcc

SEQ ID NO: 393483 - DNA, 20 bp, Artificial Sequence
  chemically synthesized
tgcttgaacccaggaggcgg

SEQ ID NO: 393484 - DNA, 20 bp, Artificial Sequence
  chemically synthesized
aacccaggaggcggaggttg

SEQ ID NO: 393485 - DNA, 20 bp, Artificial Sequence
  chemically synthesized
ggcggaggttgcagtgaacc

SEQ ID NO: 393486 - DNA, 20 bp, Artificial Sequence
  chemically synthesized
gtggtgcagtggcgcgatct

SEQ ID NO: 393487 - DNA, 20 bp, Artificial Sequence
  chemically synthesized
cccaagcaggagtggtgcag

SEQ ID NO: 393488 - DNA, 20 bp, Artificial Sequence
  chemically synthesized
tcgcccaagcaggagtggtg

SEQ ID NO: 393489 - DNA, 20 bp, Artificial Sequence
  chemically synthesized
ctctgtcgcccaagcaggag

SEQ ID NO: 393490 - DNA, 20 bp, Artificial Sequence
  chemically synthesized
gccactgcaccactcctgct

SEQ ID NO: 393491 - DNA, 20 bp, Artificial Sequence
  chemically synthesized
ccactgcaccactcctgctt

SEQ ID NO: 393492 - DNA, 20 bp, Artificial Sequence
  chemically synthesized
tggctctgtcgcccaagcag

SEQ ID NO: 393493 - DNA, 20 bp, Artificial Sequence
  chemically synthesized
tctggctctgtcgcccaagc

SEQ ID NO: 393494 - DNA, 20 bp, Artificial Sequence
  chemically synthesized
gtctggctctgtcgcccaag

SEQ ID NO: 393495 - DNA, 20 bp, Artificial Sequence
  chemically synthesized
caccactcctgcttgggcga

SEQ ID NO: 393496 - DNA, 20 bp, Artificial Sequence
  chemically synthesized
agagtctggctctgtcgccc

SEQ ID NO: 393497 - DNA, 20 bp, Artificial Sequence
  chemically synthesized
ccactcctgcttgggcgaca

SEQ ID NO: 393498 - DNA, 20 bp, Artificial Sequence
  chemically synthesized
tcctgcttgggcgacagagc

SEQ ID NO: 393499 - DNA, 20 bp, Artificial Sequence
  chemically synthesized
tttttttttgagacagagtc

SEQ ID NO: 393500 - DNA, 20 bp, Artificial Sequence
  chemically synthesized
ttttttttttttttgagaca

SEQ ID NO: 393501 - DNA, 20 bp, Artificial Sequence
  chemically synthesized
ttttttttttttttttgaga

SEQ ID NO: 393502 - DNA, 20 bp, Artificial Sequence
  chemically synthesized
tttttttttttttttttttt

SEQ ID NO: 393503 - DNA, 20 bp, Artificial Sequence
  chemically synthesized
aaaaaaaaaaaaaaaaaaaa

SEQ ID NO: 393504 - DNA, 20 bp, Artificial Sequence
  chemically synthesized
aaaaaaaaaaaaaaaaaaaa

SEQ ID NO: 393505 - DNA, 20 bp, Artificial Sequence
  chemically synthesized
aaaaaaaaaaaaaaaaaaag

SEQ ID NO: 393506 - DNA, 20 bp, Artificial Sequence
  chemically synthesized
aaaaaaaaaaaggagtaaaa

SEQ ID NO: 393507 - DNA, 20 bp, Artificial Sequence
  chemically synthesized
aaaaaaaaaggagtaaaatg

SEQ ID NO: 393508 - DNA, 20 bp, Artificial Sequence
  chemically synthesized
aaaaggagtaaaatggagta

SEQ ID NO: 393509 - DNA, 20 bp, Artificial Sequence
  chemically synthesized
aaaggagtaaaatggagtac

SEQ ID NO: 393510 - DNA, 20 bp, Artificial Sequence
  chemically synthesized
aaggagtaaaatggagtaca

SEQ ID NO: 393511 - DNA, 20 bp, Artificial Sequence
  chemically synthesized
taaaatggagtacagggtat

SEQ ID NO: 393512 - DNA, 20 bp, Artificial Sequence
  chemically synthesized
aaaatggagtacagggtatt

SEQ ID NO: 393513 - DNA, 20 bp, Artificial Sequence
  chemically synthesized
atggagtacagggtattagg

SEQ ID NO: 393514 - DNA, 20 bp, Artificial Sequence
  chemically synthesized
ggtattaggaagaatatata

SEQ ID NO: 393515 - DNA, 20 bp, Artificial Sequence
  chemically synthesized
aagaatatataaagtacaat

SEQ ID NO: 393516 - DNA, 20 bp, Artificial Sequence
  chemically synthesized
atatataaagtacaataaga

SEQ ID NO: 393517 - DNA, 20 bp, Artificial Sequence
  chemically synthesized
acaataagatagacaaatgc

SEQ ID NO: 393518 - DNA, 20 bp, Artificial Sequence
  chemically synthesized
tatgcacaaatgaacatcgt

SEQ ID NO: 393519 - DNA, 20 bp, Artificial Sequence
  chemically synthesized
gggaagaagacattgtgtcg

SEQ ID NO: 393520 - DNA, 20 bp, Artificial Sequence
  chemically synthesized
aagggaagaagacattgtgt

SEQ ID NO: 393521 - DNA, 20 bp, Artificial Sequence
  chemically synthesized
tgaagacatttgaagggaag

SEQ ID NO: 393522 - DNA, 20 bp, Artificial Sequence
  chemically synthesized
aagtgaagacatttgaaggg

SEQ ID NO: 393523 - DNA, 20 bp, Artificial Sequence
  chemically synthesized
gaaaagtgaagacatttgaa

SEQ ID NO: 393524 - DNA, 20 bp, Artificial Sequence
  chemically synthesized
ggaaaagtgaagacatttga

SEQ ID NO: 393525 - DNA, 20 bp, Artificial Sequence
  chemically synthesized
tggaaaagtgaagacatttg

SEQ ID NO: 393526 - DNA, 20 bp, Artificial Sequence
  chemically synthesized
atagtgggaatggaaaagtg

SEQ ID NO: 393527 - DNA, 20 bp, Artificial Sequence
  chemically synthesized
ggatgatagtgggaatggaa

SEQ ID NO: 393528 - DNA, 20 bp, Artificial Sequence
  chemically synthesized
ctgaaggatgatagtgggaa

SEQ ID NO: 393529 - DNA, 20 bp, Artificial Sequence
  chemically synthesized
ctaggctgaaggatgatagt

SEQ ID NO: 393530 - DNA, 20 bp, Artificial Sequence
  chemically synthesized
actaggctgaaggatgatag

SEQ ID NO: 393531 - DNA, 20 bp, Artificial Sequence
  chemically synthesized
gagactaggctgaaggatga

SEQ ID NO: 393532 - DNA, 20 bp, Artificial Sequence
  chemically synthesized
ccattcccactatcatcctt

SEQ ID NO: 393533 - DNA, 20 bp, Artificial Sequence
  chemically synthesized
cccactatcatccttcagcc

SEQ ID NO: 393534 - DNA, 20 bp, Artificial Sequence
  chemically synthesized
ggtggtagagactaggctga

SEQ ID NO: 393535 - DNA, 20 bp, Artificial Sequence
  chemically synthesized
tggtggtagagactaggctg

SEQ ID NO: 393536 - DNA, 20 bp, Artificial Sequence
  chemically synthesized
taaaactggtggtagagact

SEQ ID NO: 393537 - DNA, 20 bp, Artificial Sequence
  chemically synthesized
gtaaaactggtggtagagac

SEQ ID NO: 393538 - DNA, 20 bp, Artificial Sequence
  chemically synthesized
ttcagcctagtctctaccac

SEQ ID NO: 393539 - DNA, 20 bp, Artificial Sequence
  chemically synthesized
cgtcagtaaaactggtggta

SEQ ID NO: 393540 - DNA, 20 bp, Artificial Sequence
  chemically synthesized
cgcgtcagtaaaactggtgg

SEQ ID NO: 393541 - DNA, 20 bp, Artificial Sequence
  chemically synthesized
ggacgcgtcagtaaaactgg

SEQ ID NO: 393542 - DNA, 20 bp, Artificial Sequence
  chemically synthesized
gggggacgcgtcagtaaaac

SEQ ID NO: 393543 - DNA, 20 bp, Artificial Sequence
  chemically synthesized
gaaccgtttgggggacgcgt

SEQ ID NO: 393544 - DNA, 20 bp, Artificial Sequence
  chemically synthesized
ttactgacgcgtcccccaaa

SEQ ID NO: 393545 - DNA, 20 bp, Artificial Sequence
  chemically synthesized
agggtgaaggaaccgtttgg

SEQ ID NO: 393546 - DNA, 20 bp, Artificial Sequence
  chemically synthesized
gagggtgaaggaaccgtttg

SEQ ID NO: 393547 - DNA, 20 bp, Artificial Sequence
  chemically synthesized
agagggtgaaggaaccgttt

SEQ ID NO: 393548 - DNA, 20 bp, Artificial Sequence
  chemically synthesized
aagagggtgaaggaaccgtt

SEQ ID NO: 393549 - DNA, 20 bp, Artificial Sequence
  chemically synthesized
caggttggagaagagggtga

SEQ ID NO: 393550 - DNA, 20 bp, Artificial Sequence
  chemically synthesized
gcaggttggagaagagggtg

SEQ ID NO: 393551 - DNA, 20 bp, Artificial Sequence
  chemically synthesized
tgggagcaggttggagaaga

SEQ ID NO: 393552 - DNA, 20 bp, Artificial Sequence
  chemically synthesized
ttgggagcaggttggagaag

SEQ ID NO: 393553 - DNA, 20 bp, Artificial Sequence
  chemically synthesized
cttgggagcaggttggagaa

SEQ ID NO: 393554 - DNA, 20 bp, Artificial Sequence
  chemically synthesized
tacttgggagcaggttggag

SEQ ID NO: 393555 - DNA, 20 bp, Artificial Sequence
  chemically synthesized
ggatacttgggagcaggttg

SEQ ID NO: 393556 - DNA, 20 bp, Artificial Sequence
  chemically synthesized
aaggatacttgggagcaggt

SEQ ID NO: 393557 - DNA, 20 bp, Artificial Sequence
  chemically synthesized
ctcttctccaacctgctccc

SEQ ID NO: 393558 - DNA, 20 bp, Artificial Sequence
  chemically synthesized
tatgaaggatacttgggagc

SEQ ID NO: 393559 - DNA, 20 bp, Artificial Sequence
  chemically synthesized
ctatgaaggatacttgggag

SEQ ID NO: 393560 - DNA, 20 bp, Artificial Sequence
  chemically synthesized
gtactatgaaggatacttgg

SEQ ID NO: 393561 - DNA, 20 bp, Artificial Sequence
  chemically synthesized
ttgtactatgaaggatactt

SEQ ID NO: 393562 - DNA, 20 bp, Artificial Sequence
  chemically synthesized
cttgtactatgaaggatact

SEQ ID NO: 393563 - DNA, 20 bp, Artificial Sequence
  chemically synthesized
ctgctcccaagtatccttca

SEQ ID NO: 393564 - DNA, 20 bp, Artificial Sequence
  chemically synthesized
tttgtttccttgtactatga

SEQ ID NO: 393565 - DNA, 20 bp, Artificial Sequence
  chemically synthesized
atttgtttccttgtactatg

SEQ ID NO: 393566 - DNA, 20 bp, Artificial Sequence
  chemically synthesized
ccaagtatccttcatagtac

SEQ ID NO: 393567 - DNA, 20 bp, Artificial Sequence
  chemically synthesized
caagtatccttcatagtaca

SEQ ID NO: 393568 - DNA, 20 bp, Artificial Sequence
  chemically synthesized
aaatgaaaaatattatgatt

SEQ ID NO: 393569 - DNA, 20 bp, Artificial Sequence
  chemically synthesized
agacatgataaatttttaag

SEQ ID NO: 393570 - DNA, 20 bp, Artificial Sequence
  chemically synthesized
tgaagacatgataaattttt

SEQ ID NO: 393571 - DNA, 20 bp, Artificial Sequence
  chemically synthesized
ctccatctataagtaatatg

SEQ ID NO: 393572 - DNA, 20 bp, Artificial Sequence
  chemically synthesized
tcatgtcttcatattactta

SEQ ID NO: 393573 - DNA, 20 bp, Artificial Sequence
  chemically synthesized
gtcttcatattacttataga

SEQ ID NO: 393574 - DNA, 20 bp, Artificial Sequence
  chemically synthesized
cttcatattacttatagatg

SEQ ID NO: 393575 - DNA, 20 bp, Artificial Sequence
  chemically synthesized
ttttctcaaactccatctat

SEQ ID NO: 393576 - DNA, 20 bp, Artificial Sequence
  chemically synthesized
attacttatagatggagttt

SEQ ID NO: 393577 - DNA, 20 bp, Artificial Sequence
  chemically synthesized
ttacgaacctaggtggggaa

SEQ ID NO: 393578 - DNA, 20 bp, Artificial Sequence
  chemically synthesized
tattaaatctattccccacc

SEQ ID NO: 393579 - DNA, 20 bp, Artificial Sequence
  chemically synthesized
attaaatctattccccacct

SEQ ID NO: 393580 - DNA, 20 bp, Artificial Sequence
  chemically synthesized
attgattacgaacctaggtg

SEQ ID NO: 393581 - DNA, 20 bp, Artificial Sequence
  chemically synthesized
aattgattacgaacctaggt

SEQ ID NO: 393582 - DNA, 20 bp, Artificial Sequence
  chemically synthesized
taattgattacgaacctagg

SEQ ID NO: 393583 - DNA, 20 bp, Artificial Sequence
  chemically synthesized
gcttaattgattacgaacct

SEQ ID NO: 393584 - DNA, 20 bp, Artificial Sequence
  chemically synthesized
ggcttaattgattacgaacc

SEQ ID NO: 393585 - DNA, 20 bp, Artificial Sequence
  chemically synthesized
acctaggttcgtaatcaatt

SEQ ID NO: 393586 - DNA, 20 bp, Artificial Sequence
  chemically synthesized
aatcaattaagccgcacata

SEQ ID NO: 393587 - DNA, 20 bp, Artificial Sequence
  chemically synthesized
atcaattaagccgcacatat

SEQ ID NO: 393588 - DNA, 20 bp, Artificial Sequence
  chemically synthesized
tcgtctgactcctatatgtg

SEQ ID NO: 393589 - DNA, 20 bp, Artificial Sequence
  chemically synthesized
caattaagccgcacatatag

SEQ ID NO: 393590 - DNA, 20 bp, Artificial Sequence
  chemically synthesized
taagccgcacatataggagt

SEQ ID NO: 393591 - DNA, 20 bp, Artificial Sequence
  chemically synthesized
acatataggagtcagacgaa

SEQ ID NO: 393592 - DNA, 20 bp, Artificial Sequence
  chemically synthesized
atataggagtcagacgaata

SEQ ID NO: 393593 - DNA, 20 bp, Artificial Sequence
  chemically synthesized
cagctttatcattagtaaag

SEQ ID NO: 393594 - DNA, 20 bp, Artificial Sequence
  chemically synthesized
aacagctttatcattagtaa

SEQ ID NO: 393595 - DNA, 20 bp, Artificial Sequence
  chemically synthesized
taacagctttatcattagta

SEQ ID NO: 393596 - DNA, 20 bp, Artificial Sequence
  chemically synthesized
tatctcctttactaatgata

SEQ ID NO: 393597 - DNA, 20 bp, Artificial Sequence
  chemically synthesized
gctgataacagctttatcat

SEQ ID NO: 393598 - DNA, 20 bp, Artificial Sequence
  chemically synthesized
actaatgataaagctgttat

SEQ ID NO: 393599 - DNA, 20 bp, Artificial Sequence
  chemically synthesized
aatgctatgttcgctgataa

SEQ ID NO: 393600 - DNA, 20 bp, Artificial Sequence
  chemically synthesized
aaagctgttatcagcgaaca

SEQ ID NO: 393601 - DNA, 20 bp, Artificial Sequence
  chemically synthesized
ttatcagcgaacatagcatt

SEQ ID NO: 393602 - DNA, 20 bp, Artificial Sequence
  chemically synthesized
tagcaaacatacataataag

SEQ ID NO: 393603 - DNA, 20 bp, Artificial Sequence
  chemically synthesized
tattagcaaacatacataat

SEQ ID NO: 393604 - DNA, 20 bp, Artificial Sequence
  chemically synthesized
gatgtcactaggcaaattat

SEQ ID NO: 393605 - DNA, 20 bp, Artificial Sequence
  chemically synthesized
atgtttgctaataatttgcc

SEQ ID NO: 393606 - DNA, 20 bp, Artificial Sequence
  chemically synthesized
gcttactaatggatgtcact

SEQ ID NO: 393607 - DNA, 20 bp, Artificial Sequence
  chemically synthesized
tgcttactaatggatgtcac

SEQ ID NO: 393608 - DNA, 20 bp, Artificial Sequence
  chemically synthesized
atttgcctagtgacatccat

SEQ ID NO: 393609 - DNA, 20 bp, Artificial Sequence
  chemically synthesized
gcctagtgacatccattagt

SEQ ID NO: 393610 - DNA, 20 bp, Artificial Sequence
  chemically synthesized
ttccatttaatgcttactaa

SEQ ID NO: 393611 - DNA, 20 bp, Artificial Sequence
  chemically synthesized
atccattagtaagcattaaa

SEQ ID NO: 393612 - DNA, 20 bp, Artificial Sequence
  chemically synthesized
cattagtaagcattaaatgg

SEQ ID NO: 393613 - DNA, 20 bp, Artificial Sequence
  chemically synthesized
tagtaagcattaaatggaag

SEQ ID NO: 393614 - DNA, 20 bp, Artificial Sequence
  chemically synthesized
taagcattaaatggaagaag

SEQ ID NO: 393615 - DNA, 20 bp, Artificial Sequence
  chemically synthesized
cccatgatataaattatata

SEQ ID NO: 393616 - DNA, 20 bp, Artificial Sequence
  chemically synthesized
ccccatgatataaattatat

SEQ ID NO: 393617 - DNA, 20 bp, Artificial Sequence
  chemically synthesized
cccccatgatataaattata

SEQ ID NO: 393618 - DNA, 20 bp, Artificial Sequence
  chemically synthesized
tccctatataatttatatca

SEQ ID NO: 393619 - DNA, 20 bp, Artificial Sequence
  chemically synthesized
ccctatataatttatatcat

SEQ ID NO: 393620 - DNA, 20 bp, Artificial Sequence
  chemically synthesized
cctatataatttatatcatg

SEQ ID NO: 393621 - DNA, 20 bp, Artificial Sequence
  chemically synthesized
ctatataatttatatcatgg

SEQ ID NO: 393622 - DNA, 20 bp, Artificial Sequence
  chemically synthesized
atgctctttaaattggggtt

SEQ ID NO: 393623 - DNA, 20 bp, Artificial Sequence
  chemically synthesized
gggggcttaaccccaattta

SEQ ID NO: 393624 - DNA, 20 bp, Artificial Sequence
  chemically synthesized
gcttcatgctctttaaattg

SEQ ID NO: 393625 - DNA, 20 bp, Artificial Sequence
  chemically synthesized
ggcttcatgctctttaaatt

SEQ ID NO: 393626 - DNA, 20 bp, Artificial Sequence
  chemically synthesized
gggcttaaccccaatttaaa

SEQ ID NO: 393627 - DNA, 20 bp, Artificial Sequence
  chemically synthesized
tggcttcatgctctttaaat

SEQ ID NO: 393628 - DNA, 20 bp, Artificial Sequence
  chemically synthesized
accccaatttaaagagcatg

SEQ ID NO: 393629 - DNA, 20 bp, Artificial Sequence
  chemically synthesized
gaggaggaattgagtaggta

SEQ ID NO: 393630 - DNA, 20 bp, Artificial Sequence
  chemically synthesized
ttttggaggaggaattgagt

SEQ ID NO: 393631 - DNA, 20 bp, Artificial Sequence
  chemically synthesized
tttttggaggaggaattgag

SEQ ID NO: 393632 - DNA, 20 bp, Artificial Sequence
  chemically synthesized
tgatttttggaggaggaatt

SEQ ID NO: 393633 - DNA, 20 bp, Artificial Sequence
  chemically synthesized
tctaccctgatttttggagg

SEQ ID NO: 393634 - DNA, 20 bp, Artificial Sequence
  chemically synthesized
atctaccctgatttttggag

SEQ ID NO: 393635 - DNA, 20 bp, Artificial Sequence
  chemically synthesized
ccatctaccctgatttttgg

SEQ ID NO: 393636 - DNA, 20 bp, Artificial Sequence
  chemically synthesized
tcaattcctcctccaaaaat

SEQ ID NO: 393637 - DNA, 20 bp, Artificial Sequence
  chemically synthesized
accatctaccctgatttttg

SEQ ID NO: 393638 - DNA, 20 bp, Artificial Sequence
  chemically synthesized
caattcctcctccaaaaatc

SEQ ID NO: 393639 - DNA, 20 bp, Artificial Sequence
  chemically synthesized
aattcctcctccaaaaatca

SEQ ID NO: 393640 - DNA, 20 bp, Artificial Sequence
  chemically synthesized
gaaccatctaccctgatttt

SEQ ID NO: 393641 - DNA, 20 bp, Artificial Sequence
  chemically synthesized
tcctcctccaaaaatcaggg

SEQ ID NO: 393642 - DNA, 20 bp, Artificial Sequence
  chemically synthesized
cctccaaaaatcagggtaga

SEQ ID NO: 393643 - DNA, 20 bp, Artificial Sequence
  chemically synthesized
atgtactccaattaagaaag

SEQ ID NO: 393644 - DNA, 20 bp, Artificial Sequence
  chemically synthesized
ttcatttctgctttcttaat

SEQ ID NO: 393645 - DNA, 20 bp, Artificial Sequence
  chemically synthesized
tccatgtactccaattaaga

SEQ ID NO: 393646 - DNA, 20 bp, Artificial Sequence
  chemically synthesized
catttctgctttcttaattg

SEQ ID NO: 393647 - DNA, 20 bp, Artificial Sequence
  chemically synthesized
tccctccatgtactccaatt

SEQ ID NO: 393648 - DNA, 20 bp, Artificial Sequence
  chemically synthesized
gctttcttaattggagtaca

SEQ ID NO: 393649 - DNA, 20 bp, Artificial Sequence
  chemically synthesized
tttcttaattggagtacatg

SEQ ID NO: 393650 - DNA, 20 bp, Artificial Sequence
  chemically synthesized
ttcttaattggagtacatgg

SEQ ID NO: 393651 - DNA, 20 bp, Artificial Sequence
  chemically synthesized
tcttaattggagtacatgga

SEQ ID NO: 393652 - DNA, 20 bp, Artificial Sequence
  chemically synthesized
aattggagtacatggaggga

SEQ ID NO: 393653 - DNA, 20 bp, Artificial Sequence
  chemically synthesized
attggagtacatggagggac

SEQ ID NO: 393654 - DNA, 20 bp, Artificial Sequence
  chemically synthesized
ttggagtacatggagggaca

SEQ ID NO: 393655 - DNA, 20 bp, Artificial Sequence
  chemically synthesized
acatggagggacagggaaaa

SEQ ID NO: 393656 - DNA, 20 bp, Artificial Sequence
  chemically synthesized
catggagggacagggaaaac

SEQ ID NO: 393657 - DNA, 20 bp, Artificial Sequence
  chemically synthesized
aacgggcaatattattaccc

SEQ ID NO: 393658 - DNA, 20 bp, Artificial Sequence
  chemically synthesized
gcaatattattaccctagcg

SEQ ID NO: 393659 - DNA, 20 bp, Artificial Sequence
  chemically synthesized
ttgtggagagaactacgcta

SEQ ID NO: 393660 - DNA, 20 bp, Artificial Sequence
  chemically synthesized
attgtggagagaactacgct

SEQ ID NO: 393661 - DNA, 20 bp, Artificial Sequence
  chemically synthesized
aattgtggagagaactacgc

SEQ ID NO: 393662 - DNA, 20 bp, Artificial Sequence
  chemically synthesized
ttcaaatatccaattgtgga

SEQ ID NO: 393663 - DNA, 20 bp, Artificial Sequence
  chemically synthesized
agcgtagttctctccacaat

SEQ ID NO: 393664 - DNA, 20 bp, Artificial Sequence
  chemically synthesized
gtttcaaatatccaattgtg

SEQ ID NO: 393665 - DNA, 20 bp, Artificial Sequence
  chemically synthesized
ttgtttcaaatatccaattg

SEQ ID NO: 393666 - DNA, 20 bp, Artificial Sequence
  chemically synthesized
aattggatatttgaaacaac

SEQ ID NO: 393667 - DNA, 20 bp, Artificial Sequence
  chemically synthesized
ggatatttgaaacaacaagc

SEQ ID NO: 393668 - DNA, 20 bp, Artificial Sequence
  chemically synthesized
gatatttgaaacaacaagca

SEQ ID NO: 393669 - DNA, 20 bp, Artificial Sequence
  chemically synthesized
tatttgaaacaacaagcaag

SEQ ID NO: 393670 - DNA, 20 bp, Artificial Sequence
  chemically synthesized
atttgaaacaacaagcaagg

SEQ ID NO: 393671 - DNA, 20 bp, Artificial Sequence
  chemically synthesized
tttgaaacaacaagcaagga

SEQ ID NO: 393672 - DNA, 20 bp, Artificial Sequence
  chemically synthesized
caacaagcaaggagggtcca

SEQ ID NO: 393673 - DNA, 20 bp, Artificial Sequence
  chemically synthesized
tgtatatgcaattaaatctt

SEQ ID NO: 393674 - DNA, 20 bp, Artificial Sequence
  chemically synthesized
tttaattgcatatacattaa

SEQ ID NO: 393675 - DNA, 20 bp, Artificial Sequence
  chemically synthesized
ctctaaagaatattgaaaat

SEQ ID NO: 393676 - DNA, 20 bp, Artificial Sequence
  chemically synthesized
gtctcattttcaatattctt

SEQ ID NO: 393677 - DNA, 20 bp, Artificial Sequence
  chemically synthesized
ctcattttcaatattcttta

SEQ ID NO: 393678 - DNA, 20 bp, Artificial Sequence
  chemically synthesized
gtttgaataagcaaactcta

SEQ ID NO: 393679 - DNA, 20 bp, Artificial Sequence
  chemically synthesized
aattagcaagaagtttgaat

SEQ ID NO: 393680 - DNA, 20 bp, Artificial Sequence
  chemically synthesized
ttgtgatgataattagcaag

SEQ ID NO: 393681 - DNA, 20 bp, Artificial Sequence
  chemically synthesized
ggcttgtgatgataattagc

SEQ ID NO: 393682 - DNA, 20 bp, Artificial Sequence
  chemically synthesized
tagcggcttgtgatgataat

SEQ ID NO: 393683 - DNA, 20 bp, Artificial Sequence
  chemically synthesized
ttcttgctaattatcatcac

SEQ ID NO: 393684 - DNA, 20 bp, Artificial Sequence
  chemically synthesized
aaggaaaatgacagaaatag

SEQ ID NO: 393685 - DNA, 20 bp, Artificial Sequence
  chemically synthesized
cacaaggaaaatgacagaaa

SEQ ID NO: 393686 - DNA, 20 bp, Artificial Sequence
  chemically synthesized
ggacagcacaaggaaaatga

SEQ ID NO: 393687 - DNA, 20 bp, Artificial Sequence
  chemically synthesized
caagtaatatggacagcaca

SEQ ID NO: 393688 - DNA, 20 bp, Artificial Sequence
  chemically synthesized
gcaagtaatatggacagcac

SEQ ID NO: 393689 - DNA, 20 bp, Artificial Sequence
  chemically synthesized
gaagaggcaagtaatatgga

SEQ ID NO: 393690 - DNA, 20 bp, Artificial Sequence
  chemically synthesized
aaaagaagaggcaagtaata

SEQ ID NO: 393691 - DNA, 20 bp, Artificial Sequence
  chemically synthesized
ctagagttaaaagaagaggc

SEQ ID NO: 393692 - DNA, 20 bp, Artificial Sequence
  chemically synthesized
ggtactagagttaaaagaag

SEQ ID NO: 393693 - DNA, 20 bp, Artificial Sequence
  chemically synthesized
tggtactagagttaaaagaa

SEQ ID NO: 393694 - DNA, 20 bp, Artificial Sequence
  chemically synthesized
cttggtactagagttaaaag

SEQ ID NO: 393695 - DNA, 20 bp, Artificial Sequence
  chemically synthesized
cttgcctcttcttttaactc

SEQ ID NO: 393696 - DNA, 20 bp, Artificial Sequence
  chemically synthesized
aatcttggtactagagttaa

SEQ ID NO: 393697 - DNA, 20 bp, Artificial Sequence
  chemically synthesized
cttcttttaactctagtacc

SEQ ID NO: 393698 - DNA, 20 bp, Artificial Sequence
  chemically synthesized
atcagtcaatcttggtacta

SEQ ID NO: 393699 - DNA, 20 bp, Artificial Sequence
  chemically synthesized
tcatcagtcaatcttggtac

SEQ ID NO: 393700 - DNA, 20 bp, Artificial Sequence
  chemically synthesized
ggcctatcatcagtcaatct

SEQ ID NO: 393701 - DNA, 20 bp, Artificial Sequence
  chemically synthesized
gtaccaagattgactgatga

SEQ ID NO: 393702 - DNA, 20 bp, Artificial Sequence
  chemically synthesized
taccaagattgactgatgat

SEQ ID NO: 393703 - DNA, 20 bp, Artificial Sequence
  chemically synthesized
aagattgaatggcctatcat

SEQ ID NO: 393704 - DNA, 20 bp, Artificial Sequence
  chemically synthesized
cggctttggaaaagattgaa

SEQ ID NO: 393705 - DNA, 20 bp, Artificial Sequence
  chemically synthesized
aggccattcaatcttttcca

SEQ ID NO: 393706 - DNA, 20 bp, Artificial Sequence
  chemically synthesized
tgctaacctcggctttggaa

SEQ ID NO: 393707 - DNA, 20 bp, Artificial Sequence
  chemically synthesized
attcaatcttttccaaagcc

SEQ ID NO: 393708 - DNA, 20 bp, Artificial Sequence
  chemically synthesized
ttcaatcttttccaaagccg

SEQ ID NO: 393709 - DNA, 20 bp, Artificial Sequence
  chemically synthesized
aagcatgctaacctcggctt

SEQ ID NO: 393710 - DNA, 20 bp, Artificial Sequence
  chemically synthesized
atcttttccaaagccgaggt

SEQ ID NO: 393711 - DNA, 20 bp, Artificial Sequence
  chemically synthesized
tcagctaagcatgctaacct

SEQ ID NO: 393712 - DNA, 20 bp, Artificial Sequence
  chemically synthesized
aaagccgaggttagcatgct

SEQ ID NO: 393713 - DNA, 20 bp, Artificial Sequence
  chemically synthesized
ttgcccgaactcattcagct

SEQ ID NO: 393714 - DNA, 20 bp, Artificial Sequence
  chemically synthesized
gttagcatgcttagctgaat

SEQ ID NO: 393715 - DNA, 20 bp, Artificial Sequence
  chemically synthesized
gaaatttgcccgaactcatt

SEQ ID NO: 393716 - DNA, 20 bp, Artificial Sequence
  chemically synthesized
catgcttagctgaatgagtt

SEQ ID NO: 393717 - DNA, 20 bp, Artificial Sequence
  chemically synthesized
atgcttagctgaatgagttc

SEQ ID NO: 393718 - DNA, 20 bp, Artificial Sequence
  chemically synthesized
gggcaaatttcaattttatg

SEQ ID NO: 393719 - DNA, 20 bp, Artificial Sequence
  chemically synthesized
tttcaattttatgcggttca

SEQ ID NO: 393720 - DNA, 20 bp, Artificial Sequence
  chemically synthesized
ttttatgcggttcatagcaa

SEQ ID NO: 393721 - DNA, 20 bp, Artificial Sequence
  chemically synthesized
atagcaatagccatattaac

SEQ ID NO: 393722 - DNA, 20 bp, Artificial Sequence
  chemically synthesized
aataaacatactagttaata

SEQ ID NO: 393723 - DNA, 20 bp, Artificial Sequence
  chemically synthesized
ttagagacaaataaacatac

SEQ ID NO: 393724 - DNA, 20 bp, Artificial Sequence
  chemically synthesized
atgtttatttgtctctaaat

SEQ ID NO: 393725 - DNA, 20 bp, Artificial Sequence
  chemically synthesized
tgtttatttgtctctaaata

SEQ ID NO: 393726 - DNA, 20 bp, Artificial Sequence
  chemically synthesized
gaatacctaaaccttattta

SEQ ID NO: 393727 - DNA, 20 bp, Artificial Sequence
  chemically synthesized
cagaatacctaaaccttatt

SEQ ID NO: 393728 - DNA, 20 bp, Artificial Sequence
  chemically synthesized
atttgtctctaaataaggtt

SEQ ID NO: 393729 - DNA, 20 bp, Artificial Sequence
  chemically synthesized
tttgtctctaaataaggttt

SEQ ID NO: 393730 - DNA, 20 bp, Artificial Sequence
  chemically synthesized
ccagtgctagagagacattt

SEQ ID NO: 393731 - DNA, 20 bp, Artificial Sequence
  chemically synthesized
ggtattctgaaatgtctctc

SEQ ID NO: 393732 - DNA, 20 bp, Artificial Sequence
  chemically synthesized
actggaaatccagtgctaga

SEQ ID NO: 393733 - DNA, 20 bp, Artificial Sequence
  chemically synthesized
ctgaaatgtctctctagcac

SEQ ID NO: 393734 - DNA, 20 bp, Artificial Sequence
  chemically synthesized
taactggaaatccagtgcta

SEQ ID NO: 393735 - DNA, 20 bp, Artificial Sequence
  chemically synthesized
attaactggaaatccagtgc

SEQ ID NO: 393736 - DNA, 20 bp, Artificial Sequence
  chemically synthesized
tctctctagcactggatttc

SEQ ID NO: 393737 - DNA, 20 bp, Artificial Sequence
  chemically synthesized
atgctcattaactggaaatc

SEQ ID NO: 393738 - DNA, 20 bp, Artificial Sequence
  chemically synthesized
gcactggatttccagttaat

SEQ ID NO: 393739 - DNA, 20 bp, Artificial Sequence
  chemically synthesized
ctagtgagatgctcattaac

SEQ ID NO: 393740 - DNA, 20 bp, Artificial Sequence
  chemically synthesized
ccagttaatgagcatctcac

SEQ ID NO: 393741 - DNA, 20 bp, Artificial Sequence
  chemically synthesized
tgtcaatataaatttctagt

SEQ ID NO: 393742 - DNA, 20 bp, Artificial Sequence
  chemically synthesized
ttgttgtcaatataaatttc

SEQ ID NO: 393743 - DNA, 20 bp, Artificial Sequence
  chemically synthesized
ctaggggattaatattaata

SEQ ID NO: 393744 - DNA, 20 bp, Artificial Sequence
  chemically synthesized
gctaggggattaatattaat

SEQ ID NO: 393745 - DNA, 20 bp, Artificial Sequence
  chemically synthesized
ccttattaatattaatcccc

SEQ ID NO: 393746 - DNA, 20 bp, Artificial Sequence
  chemically synthesized
cctagtcttgcaaatgctag

SEQ ID NO: 393747 - DNA, 20 bp, Artificial Sequence
  chemically synthesized
tcctagtcttgcaaatgcta

SEQ ID NO: 393748 - DNA, 20 bp, Artificial Sequence
  chemically synthesized
gtcctagtcttgcaaatgct

SEQ ID NO: 393749 - DNA, 20 bp, Artificial Sequence
  chemically synthesized
tgtcctagtcttgcaaatgc

SEQ ID NO: 393750 - DNA, 20 bp, Artificial Sequence
  chemically synthesized
attaatcccctagcatttgc

SEQ ID NO: 393751 - DNA, 20 bp, Artificial Sequence
  chemically synthesized
tcccctagcatttgcaagac

SEQ ID NO: 393752 - DNA, 20 bp, Artificial Sequence
  chemically synthesized
cccctagcatttgcaagact

SEQ ID NO: 393753 - DNA, 20 bp, Artificial Sequence
  chemically synthesized
tgatatctgaaattttgtcc

SEQ ID NO: 393754 - DNA, 20 bp, Artificial Sequence
  chemically synthesized
gcaagactaggacaaaattt

SEQ ID NO: 393755 - DNA, 20 bp, Artificial Sequence
  chemically synthesized
tcatttatatgatatttttg

SEQ ID NO: 393756 - DNA, 20 bp, Artificial Sequence
  chemically synthesized
tataaatacaacaaatatga

SEQ ID NO: 393757 - DNA, 20 bp, Artificial Sequence
  chemically synthesized
acataatttagttatagtaa

SEQ ID NO: 393758 - DNA, 20 bp, Artificial Sequence
  chemically synthesized
ttcaaaacataatttagtta

SEQ ID NO: 393759 - DNA, 20 bp, Artificial Sequence
  chemically synthesized
tggtatttcaaaacataatt

SEQ ID NO: 393760 - DNA, 20 bp, Artificial Sequence
  chemically synthesized
atagctcttagtaaatagta

SEQ ID NO: 393761 - DNA, 20 bp, Artificial Sequence
  chemically synthesized
gaaataccatactatttact

SEQ ID NO: 393762 - DNA, 20 bp, Artificial Sequence
  chemically synthesized
attttatagctcttagtaaa

SEQ ID NO: 393763 - DNA, 20 bp, Artificial Sequence
  chemically synthesized
aataccatactatttactaa

SEQ ID NO: 393764 - DNA, 20 bp, Artificial Sequence
  chemically synthesized
ctatcacattttatagctct

SEQ ID NO: 393765 - DNA, 20 bp, Artificial Sequence
  chemically synthesized
taggatactatcacatttta

SEQ ID NO: 393766 - DNA, 20 bp, Artificial Sequence
  chemically synthesized
ctaagagctataaaatgtga

SEQ ID NO: 393767 - DNA, 20 bp, Artificial Sequence
  chemically synthesized
tattgagatattaattttat

SEQ ID NO: 393768 - DNA, 20 bp, Artificial Sequence
  chemically synthesized
ttattgagatattaatttta

SEQ ID NO: 393769 - DNA, 20 bp, Artificial Sequence
  chemically synthesized
tgacatgttttagagttatt

SEQ ID NO: 393770 - DNA, 20 bp, Artificial Sequence
  chemically synthesized
ttttcaactgacatgtttta

SEQ ID NO: 393771 - DNA, 20 bp, Artificial Sequence
  chemically synthesized
tattttcaactgacatgttt

SEQ ID NO: 393772 - DNA, 20 bp, Artificial Sequence
  chemically synthesized
tcaataactctaaaacatgt

SEQ ID NO: 393773 - DNA, 20 bp, Artificial Sequence
  chemically synthesized
taaaacatgtcagttgaaaa

SEQ ID NO: 393774 - DNA, 20 bp, Artificial Sequence
  chemically synthesized
tgaaaatagtgcatatatat

SEQ ID NO: 393775 - DNA, 20 bp, Artificial Sequence
  chemically synthesized
tatattagtgtgaatgtatg

SEQ ID NO: 393776 - DNA, 20 bp, Artificial Sequence
  chemically synthesized
atattagtgtgaatgtatgt

SEQ ID NO: 393777 - DNA, 20 bp, Artificial Sequence
  chemically synthesized
tattagtgtgaatgtatgtg

SEQ ID NO: 393778 - DNA, 20 bp, Artificial Sequence
  chemically synthesized
attagtgtgaatgtatgtgg

SEQ ID NO: 393779 - DNA, 20 bp, Artificial Sequence
  chemically synthesized
tgtatgtgggggtatgtcaa

SEQ ID NO: 393780 - DNA, 20 bp, Artificial Sequence
  chemically synthesized
tatgtgggggtatgtcaaaa

SEQ ID NO: 393781 - DNA, 20 bp, Artificial Sequence
  chemically synthesized
cagcagaggcttgtattaag

SEQ ID NO: 393782 - DNA, 20 bp, Artificial Sequence
  chemically synthesized
aaagagaatctccttaatac

SEQ ID NO: 393783 - DNA, 20 bp, Artificial Sequence
  chemically synthesized
tccagcagaggcttgtatta

SEQ ID NO: 393784 - DNA, 20 bp, Artificial Sequence
  chemically synthesized
ttccagcagaggcttgtatt

SEQ ID NO: 393785 - DNA, 20 bp, Artificial Sequence
  chemically synthesized
tccttaatacaagcctctgc

SEQ ID NO: 393786 - DNA, 20 bp, Artificial Sequence
  chemically synthesized
ttattttttatttccagcag

SEQ ID NO: 393787 - DNA, 20 bp, Artificial Sequence
  chemically synthesized
tttattttttatttccagca

SEQ ID NO: 393788 - DNA, 20 bp, Artificial Sequence
  chemically synthesized
tctttattttttatttccag

SEQ ID NO: 393789 - DNA, 20 bp, Artificial Sequence
  chemically synthesized
ttttctttattttttatttc

SEQ ID NO: 393790 - DNA, 20 bp, Artificial Sequence
  chemically synthesized
tctgctggaaataaaaaata

SEQ ID NO: 393791 - DNA, 20 bp, Artificial Sequence
  chemically synthesized
aaataaaaaataaagaaaaa

SEQ ID NO: 393792 - DNA, 20 bp, Artificial Sequence
  chemically synthesized
taaaaaataaagaaaaaaag

SEQ ID NO: 393793 - DNA, 20 bp, Artificial Sequence
  chemically synthesized
tgaattatttaataatttct

SEQ ID NO: 393794 - DNA, 20 bp, Artificial Sequence
  chemically synthesized
gttggcacctgagaacatct

SEQ ID NO: 393795 - DNA, 20 bp, Artificial Sequence
  chemically synthesized
aataatttctaagatgttct

SEQ ID NO: 393796 - DNA, 20 bp, Artificial Sequence
  chemically synthesized
ataatttctaagatgttctc

SEQ ID NO: 393797 - DNA, 20 bp, Artificial Sequence
  chemically synthesized
gatttgttgtgttggcacct

SEQ ID NO: 393798 - DNA, 20 bp, Artificial Sequence
  chemically synthesized
ttcattaggatttgttgtgt

SEQ ID NO: 393799 - DNA, 20 bp, Artificial Sequence
  chemically synthesized
taatcaaccctgggttcatt

SEQ ID NO: 393800 - DNA, 20 bp, Artificial Sequence
  chemically synthesized
acaacaaatcctaatgaacc

SEQ ID NO: 393801 - DNA, 20 bp, Artificial Sequence
  chemically synthesized
ttaatcaaccctgggttcat

SEQ ID NO: 393802 - DNA, 20 bp, Artificial Sequence
  chemically synthesized
caacaaatcctaatgaaccc

SEQ ID NO: 393803 - DNA, 20 bp, Artificial Sequence
  chemically synthesized
aacaaatcctaatgaaccca

SEQ ID NO: 393804 - DNA, 20 bp, Artificial Sequence
  chemically synthesized
atctgcatttaatcaaccct

SEQ ID NO: 393805 - DNA, 20 bp, Artificial Sequence
  chemically synthesized
tatctgcatttaatcaaccc

SEQ ID NO: 393806 - DNA, 20 bp, Artificial Sequence
  chemically synthesized
aacccagggttgattaaatg

SEQ ID NO: 393807 - DNA, 20 bp, Artificial Sequence
  chemically synthesized
gggttgattaaatgcagata

SEQ ID NO: 393808 - DNA, 20 bp, Artificial Sequence
  chemically synthesized
ttgattaaatgcagataaag

SEQ ID NO: 393809 - DNA, 20 bp, Artificial Sequence
  chemically synthesized
tgcatttttcaaatctcatg

SEQ ID NO: 393810 - DNA, 20 bp, Artificial Sequence
  chemically synthesized
catttttcaaatctcatgaa

SEQ ID NO: 393811 - DNA, 20 bp, Artificial Sequence
  chemically synthesized
aaaatcttttttctcttcat

SEQ ID NO: 393812 - DNA, 20 bp, Artificial Sequence
  chemically synthesized
caaatctcatgaagagaaaa

SEQ ID NO: 393813 - DNA, 20 bp, Artificial Sequence
  chemically synthesized
tttaattagagaatgatcga

SEQ ID NO: 393814 - DNA, 20 bp, Artificial Sequence
  chemically synthesized
tgtcgatcattctctaatta

SEQ ID NO: 393815 - DNA, 20 bp, Artificial Sequence
  chemically synthesized
taccgttaatactttaatta

SEQ ID NO: 393816 - DNA, 20 bp, Artificial Sequence
  chemically synthesized
cttaccgttaatactttaat

SEQ ID NO: 393817 - DNA, 20 bp, Artificial Sequence
  chemically synthesized
ttctctaattaaagtattaa

SEQ ID NO: 393818 - DNA, 20 bp, Artificial Sequence
  chemically synthesized
ctaattaaagtattaacggt

SEQ ID NO: 393819 - DNA, 20 bp, Artificial Sequence
  chemically synthesized
ttaaagtattaacggtaaga

SEQ ID NO: 393820 - DNA, 20 bp, Artificial Sequence
  chemically synthesized
aaagtattaacggtaagata

SEQ ID NO: 393821 - DNA, 20 bp, Artificial Sequence
  chemically synthesized
ctttccagtaagagggaata

SEQ ID NO: 393822 - DNA, 20 bp, Artificial Sequence
  chemically synthesized
gagactgtattccctcttac

SEQ ID NO: 393823 - DNA, 20 bp, Artificial Sequence
  chemically synthesized
agtttatctttccagtaaga

SEQ ID NO: 393824 - DNA, 20 bp, Artificial Sequence
  chemically synthesized
cagtttatctttccagtaag

SEQ ID NO: 393825 - DNA, 20 bp, Artificial Sequence
  chemically synthesized
acagtttatctttccagtaa

SEQ ID NO: 393826 - DNA, 20 bp, Artificial Sequence
  chemically synthesized
ctgtattccctcttactgga

SEQ ID NO: 393827 - DNA, 20 bp, Artificial Sequence
  chemically synthesized
atacagtttatctttccagt

SEQ ID NO: 393828 - DNA, 20 bp, Artificial Sequence
  chemically synthesized
aaacatacagtttatctttc

SEQ ID NO: 393829 - DNA, 20 bp, Artificial Sequence
  chemically synthesized
acatatattatagaaacata

SEQ ID NO: 393830 - DNA, 20 bp, Artificial Sequence
  chemically synthesized
tgctagggtgacatatatta

SEQ ID NO: 393831 - DNA, 20 bp, Artificial Sequence
  chemically synthesized
ttctataatatatgtcaccc

SEQ ID NO: 393832 - DNA, 20 bp, Artificial Sequence
  chemically synthesized
tgctttgtgtgttgttgcta

SEQ ID NO: 393833 - DNA, 20 bp, Artificial Sequence
  chemically synthesized
atgctttgtgtgttgttgct

SEQ ID NO: 393834 - DNA, 20 bp, Artificial Sequence
  chemically synthesized
gatgctttgtgtgttgttgc

SEQ ID NO: 393835 - DNA, 20 bp, Artificial Sequence
  chemically synthesized
caccctagcaacaacacaca

SEQ ID NO: 393836 - DNA, 20 bp, Artificial Sequence
  chemically synthesized
aaatcagtttttattaaagg

SEQ ID NO: 393837 - DNA, 20 bp, Artificial Sequence
  chemically synthesized
ataaaatcagtttttattaa

SEQ ID NO: 393838 - DNA, 20 bp, Artificial Sequence
  chemically synthesized
tataaaatcagtttttatta

SEQ ID NO: 393839 - DNA, 20 bp, Artificial Sequence
  chemically synthesized
agctcctttaattataaaat

SEQ ID NO: 393840 - DNA, 20 bp, Artificial Sequence
  chemically synthesized
aaaaactgattttataatta

SEQ ID NO: 393841 - DNA, 20 bp, Artificial Sequence
  chemically synthesized
aaaactgattttataattaa

SEQ ID NO: 393842 - DNA, 20 bp, Artificial Sequence
  chemically synthesized
aactgattttataattaaag

SEQ ID NO: 393843 - DNA, 20 bp, Artificial Sequence
  chemically synthesized
agtgactatttttcaacagt

SEQ ID NO: 393844 - DNA, 20 bp, Artificial Sequence
  chemically synthesized
aaaaagtgactatttttcaa

SEQ ID NO: 393845 - DNA, 20 bp, Artificial Sequence
  chemically synthesized
aggagctaactgttgaaaaa

SEQ ID NO: 393846 - DNA, 20 bp, Artificial Sequence
  chemically synthesized
tgaaaaatagtcacttttta

SEQ ID NO: 393847 - DNA, 20 bp, Artificial Sequence
  chemically synthesized
catattcaagtgtctataaa

SEQ ID NO: 393848 - DNA, 20 bp, Artificial Sequence
  chemically synthesized
agaaaccaattttcatattc

SEQ ID NO: 393849 - DNA, 20 bp, Artificial Sequence
  chemically synthesized
agacacttgaatatgaaaat

SEQ ID NO: 393850 - DNA, 20 bp, Artificial Sequence
  chemically synthesized
ttagtattataatgaggtgt

SEQ ID NO: 393851 - DNA, 20 bp, Artificial Sequence
  chemically synthesized
ttgcacttagtattataatg

SEQ ID NO: 393852 - DNA, 20 bp, Artificial Sequence
  chemically synthesized
tttgcacttagtattataat

SEQ ID NO: 393853 - DNA, 20 bp, Artificial Sequence
  chemically synthesized
tcacacctcattataatact

SEQ ID NO: 393854 - DNA, 20 bp, Artificial Sequence
  chemically synthesized
ggcttatactaatttgcact

SEQ ID NO: 393855 - DNA, 20 bp, Artificial Sequence
  chemically synthesized
ttataatactaagtgcaaat

SEQ ID NO: 393856 - DNA, 20 bp, Artificial Sequence
  chemically synthesized
tactaagtgcaaattagtat

SEQ ID NO: 393857 - DNA, 20 bp, Artificial Sequence
  chemically synthesized
tacttggaatggatgagcaa

SEQ ID NO: 393858 - DNA, 20 bp, Artificial Sequence
  chemically synthesized
ttacttggaatggatgagca

SEQ ID NO: 393859 - DNA, 20 bp, Artificial Sequence
  chemically synthesized
ctgctttacttggaatggat

SEQ ID NO: 393860 - DNA, 20 bp, Artificial Sequence
  chemically synthesized
agcctttgctcatccattcc

SEQ ID NO: 393861 - DNA, 20 bp, Artificial Sequence
  chemically synthesized
tgcttctgctttacttggaa

SEQ ID NO: 393862 - DNA, 20 bp, Artificial Sequence
  chemically synthesized
ttgctcatccattccaagta

SEQ ID NO: 393863 - DNA, 20 bp, Artificial Sequence
  chemically synthesized
ctcatccattccaagtaaag

SEQ ID NO: 393864 - DNA, 20 bp, Artificial Sequence
  chemically synthesized
gtctgtgcttctgctttact

SEQ ID NO: 393865 - DNA, 20 bp, Artificial Sequence
  chemically synthesized
atccattccaagtaaagcag

SEQ ID NO: 393866 - DNA, 20 bp, Artificial Sequence
  chemically synthesized
ttccaagtaaagcagaagca

SEQ ID NO: 393867 - DNA, 20 bp, Artificial Sequence
  chemically synthesized
aagtaaagcagaagcacaga

SEQ ID NO: 393868 - DNA, 20 bp, Artificial Sequence
  chemically synthesized
cacagacagatcaaccaacc

SEQ ID NO: 393869 - DNA, 20 bp, Artificial Sequence
  chemically synthesized
tgtcatgtacagtgctaggt

SEQ ID NO: 393870 - DNA, 20 bp, Artificial Sequence
  chemically synthesized
aacgtgtcatgtacagtgct

SEQ ID NO: 393871 - DNA, 20 bp, Artificial Sequence
  chemically synthesized
caacgtgtcatgtacagtgc

SEQ ID NO: 393872 - DNA, 20 bp, Artificial Sequence
  chemically synthesized
ttcctacaacgtgtcatgta

SEQ ID NO: 393873 - DNA, 20 bp, Artificial Sequence
  chemically synthesized
gcactgtacatgacacgttg

SEQ ID NO: 393874 - DNA, 20 bp, Artificial Sequence
  chemically synthesized
cactgtacatgacacgttgt

SEQ ID NO: 393875 - DNA, 20 bp, Artificial Sequence
  chemically synthesized
acacgttgtaggaattcaac

SEQ ID NO: 393876 - DNA, 20 bp, Artificial Sequence
  chemically synthesized
ggtatttaaattaacagaac

SEQ ID NO: 393877 - DNA, 20 bp, Artificial Sequence
  chemically synthesized
attgcaggtatttaaattaa

SEQ ID NO: 393878 - DNA, 20 bp, Artificial Sequence
  chemically synthesized
gttaatttaaatacctgcaa

SEQ ID NO: 393879 - DNA, 20 bp, Artificial Sequence
  chemically synthesized
gatataataaaaactattgc

SEQ ID NO: 393880 - DNA, 20 bp, Artificial Sequence
  chemically synthesized
agatataataaaaactattg

SEQ ID NO: 393881 - DNA, 20 bp, Artificial Sequence
  chemically synthesized
tttttattatatctgcacta

SEQ ID NO: 393882 - DNA, 20 bp, Artificial Sequence
  chemically synthesized
ttttttaaaaatccatagtg

SEQ ID NO: 393883 - DNA, 20 bp, Artificial Sequence
  chemically synthesized
acatattttttaaaaatcca

SEQ ID NO: 393884 - DNA, 20 bp, Artificial Sequence
  chemically synthesized
gatttttaaaaaatatgtaa

SEQ ID NO: 393885 - DNA, 20 bp, Artificial Sequence
  chemically synthesized
gtaacagcaaaaaaactacc

SEQ ID NO: 393886 - DNA, 20 bp, Artificial Sequence
  chemically synthesized
tatattataaatattcttgg

SEQ ID NO: 393887 - DNA, 20 bp, Artificial Sequence
  chemically synthesized
gtttatattataaatattct

SEQ ID NO: 393888 - DNA, 20 bp, Artificial Sequence
  chemically synthesized
aagaatatttataatataaa

SEQ ID NO: 393889 - DNA, 20 bp, Artificial Sequence
  chemically synthesized
aaatagactttttcatgaga

SEQ ID NO: 393890 - DNA, 20 bp, Artificial Sequence
  chemically synthesized
aaatattctttctcatgaaa

SEQ ID NO: 393891 - DNA, 20 bp, Artificial Sequence
  chemically synthesized
tcctaaatagactttttcat

SEQ ID NO: 393892 - DNA, 20 bp, Artificial Sequence
  chemically synthesized
ttctcatgaaaaagtctatt

SEQ ID NO: 393893 - DNA, 20 bp, Artificial Sequence
  chemically synthesized
tctcatgaaaaagtctattt

SEQ ID NO: 393894 - DNA, 20 bp, Artificial Sequence
  chemically synthesized
ccttaccagaagttcctaaa

SEQ ID NO: 393895 - DNA, 20 bp, Artificial Sequence
  chemically synthesized
aaagtctatttaggaacttc

SEQ ID NO: 393896 - DNA, 20 bp, Artificial Sequence
  chemically synthesized
tctatttaggaacttctggt

SEQ ID NO: 393897 - DNA, 20 bp, Artificial Sequence
  chemically synthesized
ctatttaggaacttctggta

SEQ ID NO: 393898 - DNA, 20 bp, Artificial Sequence
  chemically synthesized
tatttaggaacttctggtaa

SEQ ID NO: 393899 - DNA, 20 bp, Artificial Sequence
  chemically synthesized
agttatcttacccttaccag

SEQ ID NO: 393900 - DNA, 20 bp, Artificial Sequence
  chemically synthesized
cgaagttatcttacccttac

SEQ ID NO: 393901 - DNA, 20 bp, Artificial Sequence
  chemically synthesized
taggaacttctggtaagggt

SEQ ID NO: 393902 - DNA, 20 bp, Artificial Sequence
  chemically synthesized
aggaagggaaaaatgggtcg

SEQ ID NO: 393903 - DNA, 20 bp, Artificial Sequence
  chemically synthesized
gggaagaggaagggaaaaat

SEQ ID NO: 393904 - DNA, 20 bp, Artificial Sequence
  chemically synthesized
tgggaagaggaagggaaaaa

SEQ ID NO: 393905 - DNA, 20 bp, Artificial Sequence
  chemically synthesized
tgttttagtgggaagaggaa

SEQ ID NO: 393906 - DNA, 20 bp, Artificial Sequence
  chemically synthesized
ctgttttagtgggaagagga

SEQ ID NO: 393907 - DNA, 20 bp, Artificial Sequence
  chemically synthesized
gctgttttagtgggaagagg

SEQ ID NO: 393908 - DNA, 20 bp, Artificial Sequence
  chemically synthesized
gttgctgttttagtgggaag

SEQ ID NO: 393909 - DNA, 20 bp, Artificial Sequence
  chemically synthesized
tgttgctgttttagtgggaa

SEQ ID NO: 393910 - DNA, 20 bp, Artificial Sequence
  chemically synthesized
tttgttgctgttttagtggg

SEQ ID NO: 393911 - DNA, 20 bp, Artificial Sequence
  chemically synthesized
ccttcctcttcccactaaaa

SEQ ID NO: 393912 - DNA, 20 bp, Artificial Sequence
  chemically synthesized
gcatttgttgctgttttagt

SEQ ID NO: 393913 - DNA, 20 bp, Artificial Sequence
  chemically synthesized
agcatttgttgctgttttag

SEQ ID NO: 393914 - DNA, 20 bp, Artificial Sequence
  chemically synthesized
accagcatttgttgctgttt

SEQ ID NO: 393915 - DNA, 20 bp, Artificial Sequence
  chemically synthesized
actaaaacagcaacaaatgc

SEQ ID NO: 393916 - DNA, 20 bp, Artificial Sequence
  chemically synthesized
gtttattcctgcattattac

SEQ ID NO: 393917 - DNA, 20 bp, Artificial Sequence
  chemically synthesized
aacaaatgctggtaataatg

SEQ ID NO: 393918 - DNA, 20 bp, Artificial Sequence
  chemically synthesized
acaaatgctggtaataatgc

SEQ ID NO: 393919 - DNA, 20 bp, Artificial Sequence
  chemically synthesized
aataatgcaggaataaaccc

SEQ ID NO: 393920 - DNA, 20 bp, Artificial Sequence
  chemically synthesized
actaccttcagagttatctt

SEQ ID NO: 393921 - DNA, 20 bp, Artificial Sequence
  chemically synthesized
gactaccttcagagttatct

SEQ ID NO: 393922 - DNA, 20 bp, Artificial Sequence
  chemically synthesized
ataaacccaagataactctg

SEQ ID NO: 393923 - DNA, 20 bp, Artificial Sequence
  chemically synthesized
taaacccaagataactctga

SEQ ID NO: 393924 - DNA, 20 bp, Artificial Sequence
  chemically synthesized
acccaagataactctgaagg

SEQ ID NO: 393925 - DNA, 20 bp, Artificial Sequence
  chemically synthesized
tcttcttctgactaccttca

SEQ ID NO: 393926 - DNA, 20 bp, Artificial Sequence
  chemically synthesized
cgtcttcttctgactacctt

SEQ ID NO: 393927 - DNA, 20 bp, Artificial Sequence
  chemically synthesized
aagataactctgaaggtagt

SEQ ID NO: 393928 - DNA, 20 bp, Artificial Sequence
  chemically synthesized
ataactctgaaggtagtcag

SEQ ID NO: 393929 - DNA, 20 bp, Artificial Sequence
  chemically synthesized
actctgaaggtagtcagaag

SEQ ID NO: 393930 - DNA, 20 bp, Artificial Sequence
  chemically synthesized
aggtagtcagaagaagacga

SEQ ID NO: 393931 - DNA, 20 bp, Artificial Sequence
  chemically synthesized
gtagtcagaagaagacgacg

SEQ ID NO: 393932 - DNA, 20 bp, Artificial Sequence
  chemically synthesized
agaagaagacgacggagttt

SEQ ID NO: 393933 - DNA, 20 bp, Artificial Sequence
  chemically synthesized
acgacggagttttggtttac

SEQ ID NO: 393934 - DNA, 20 bp, Artificial Sequence
  chemically synthesized
cgacggagttttggtttact

SEQ ID NO: 393935 - DNA, 20 bp, Artificial Sequence
  chemically synthesized
gagttttggtttactgggtc

SEQ ID NO: 393936 - DNA, 20 bp, Artificial Sequence
  chemically synthesized
gttttggtttactgggtctg

SEQ ID NO: 393937 - DNA, 20 bp, Artificial Sequence
  chemically synthesized
ctcaacttctgctccagacc

SEQ ID NO: 393938 - DNA, 20 bp, Artificial Sequence
  chemically synthesized
ttggtttactgggtctggag

SEQ ID NO: 393939 - DNA, 20 bp, Artificial Sequence
  chemically synthesized
gtttactgggtctggagcag

SEQ ID NO: 393940 - DNA, 20 bp, Artificial Sequence
  chemically synthesized
aagtcactcaacttctgctc

SEQ ID NO: 393941 - DNA, 20 bp, Artificial Sequence
  chemically synthesized
ctgggtctggagcagaagtt

SEQ ID NO: 393942 - DNA, 20 bp, Artificial Sequence
  chemically synthesized
tctattaagtgaaaagatgt

SEQ ID NO: 393943 - DNA, 20 bp, Artificial Sequence
  chemically synthesized
acttgcttctattaagtgaa

SEQ ID NO: 393944 - DNA, 20 bp, Artificial Sequence
  chemically synthesized
acttacatcttttcacttaa

SEQ ID NO: 393945 - DNA, 20 bp, Artificial Sequence
  chemically synthesized
tacatcttttcacttaatag

SEQ ID NO: 393946 - DNA, 20 bp, Artificial Sequence
  chemically synthesized
ctgggtcacttgcttctatt

SEQ ID NO: 393947 - DNA, 20 bp, Artificial Sequence
  chemically synthesized
tcttttcacttaatagaagc

SEQ ID NO: 393948 - DNA, 20 bp, Artificial Sequence
  chemically synthesized
cttaatagaagcaagtgacc

SEQ ID NO: 393949 - DNA, 20 bp, Artificial Sequence
  chemically synthesized
ggtctcgaaatggtgagtct

SEQ ID NO: 393950 - DNA, 20 bp, Artificial Sequence
  chemically synthesized
gggtctcgaaatggtgagtc

SEQ ID NO: 393951 - DNA, 20 bp, Artificial Sequence
  chemically synthesized
gttgtgggtctcgaaatggt

SEQ ID NO: 393952 - DNA, 20 bp, Artificial Sequence
  chemically synthesized
tgacccagactcaccatttc

SEQ ID NO: 393953 - DNA, 20 bp, Artificial Sequence
  chemically synthesized
gctggttgtgggtctcgaaa

SEQ ID NO: 393954 - DNA, 20 bp, Artificial Sequence
  chemically synthesized
accatttcgagacccacaac

SEQ ID NO: 393955 - DNA, 20 bp, Artificial Sequence
  chemically synthesized
tgctttcgactgctggttgt

SEQ ID NO: 393956 - DNA, 20 bp, Artificial Sequence
  chemically synthesized
atttcgagacccacaaccag

SEQ ID NO: 393957 - DNA, 20 bp, Artificial Sequence
  chemically synthesized
ctgctttcgactgctggttg

SEQ ID NO: 393958 - DNA, 20 bp, Artificial Sequence
  chemically synthesized
tctaggctgctttcgactgc

SEQ ID NO: 393959 - DNA, 20 bp, Artificial Sequence
  chemically synthesized
gacccacaaccagcagtcga

SEQ ID NO: 393960 - DNA, 20 bp, Artificial Sequence
  chemically synthesized
ccacaaccagcagtcgaaag

SEQ ID NO: 393961 - DNA, 20 bp, Artificial Sequence
  chemically synthesized
accagcagtcgaaagcagcc

SEQ ID NO: 393962 - DNA, 20 bp, Artificial Sequence
  chemically synthesized
gcagtcgaaagcagcctaga

SEQ ID NO: 393963 - DNA, 20 bp, Artificial Sequence
  chemically synthesized
cagtcgaaagcagcctagaa

SEQ ID NO: 393964 - DNA, 20 bp, Artificial Sequence
  chemically synthesized
gtggagagataagcctttct

SEQ ID NO: 393965 - DNA, 20 bp, Artificial Sequence
  chemically synthesized
tgtggagagataagcctttc

SEQ ID NO: 393966 - DNA, 20 bp, Artificial Sequence
  chemically synthesized
cctcttagatgtggagagat

SEQ ID NO: 393967 - DNA, 20 bp, Artificial Sequence
  chemically synthesized
ggaatcctcttagatgtgga

SEQ ID NO: 393968 - DNA, 20 bp, Artificial Sequence
  chemically synthesized
aggcttatctctccacatct

SEQ ID NO: 393969 - DNA, 20 bp, Artificial Sequence
  chemically synthesized
agggaatcctcttagatgtg

SEQ ID NO: 393970 - DNA, 20 bp, Artificial Sequence
  chemically synthesized
gcttatctctccacatctaa

SEQ ID NO: 393971 - DNA, 20 bp, Artificial Sequence
  chemically synthesized
tcagggaatcctcttagatg

SEQ ID NO: 393972 - DNA, 20 bp, Artificial Sequence
  chemically synthesized
cttatctctccacatctaag

SEQ ID NO: 393973 - DNA, 20 bp, Artificial Sequence
  chemically synthesized
gttgtctcagggaatcctct

SEQ ID NO: 393974 - DNA, 20 bp, Artificial Sequence
  chemically synthesized
cacatctaagaggattccct

SEQ ID NO: 393975 - DNA, 20 bp, Artificial Sequence
  chemically synthesized
gagaacctgatgttgtctca

SEQ ID NO: 393976 - DNA, 20 bp, Artificial Sequence
  chemically synthesized
ggagaacctgatgttgtctc

SEQ ID NO: 393977 - DNA, 20 bp, Artificial Sequence
  chemically synthesized
aggagaacctgatgttgtct

SEQ ID NO: 393978 - DNA, 20 bp, Artificial Sequence
  chemically synthesized
aggattccctgagacaacat

SEQ ID NO: 393979 - DNA, 20 bp, Artificial Sequence
  chemically synthesized
ggattccctgagacaacatc

SEQ ID NO: 393980 - DNA, 20 bp, Artificial Sequence
  chemically synthesized
cctgtcctagaaagtgtcag

SEQ ID NO: 393981 - DNA, 20 bp, Artificial Sequence
  chemically synthesized
atcctgtcctagaaagtgtc

SEQ ID NO: 393982 - DNA, 20 bp, Artificial Sequence
  chemically synthesized
catcctgtcctagaaagtgt

SEQ ID NO: 393983 - DNA, 20 bp, Artificial Sequence
  chemically synthesized
caggttctcctgacactttc

SEQ ID NO: 393984 - DNA, 20 bp, Artificial Sequence
  chemically synthesized
aggttctcctgacactttct

SEQ ID NO: 393985 - DNA, 20 bp, Artificial Sequence
  chemically synthesized
tctcctgacactttctagga

SEQ ID NO: 393986 - DNA, 20 bp, Artificial Sequence
  chemically synthesized
tctacccatcctgtcctaga

SEQ ID NO: 393987 - DNA, 20 bp, Artificial Sequence
  chemically synthesized
ctcctgacactttctaggac

SEQ ID NO: 393988 - DNA, 20 bp, Artificial Sequence
  chemically synthesized
tgcatctacccatcctgtcc

SEQ ID NO: 393989 - DNA, 20 bp, Artificial Sequence
  chemically synthesized
tgacactttctaggacagga

SEQ ID NO: 393990 - DNA, 20 bp, Artificial Sequence
  chemically synthesized
gacactttctaggacaggat

SEQ ID NO: 393991 - DNA, 20 bp, Artificial Sequence
  chemically synthesized
actttctaggacaggatggg

SEQ ID NO: 393992 - DNA, 20 bp, Artificial Sequence
  chemically synthesized
caggatgggtagatgcaatc

SEQ ID NO: 393993 - DNA, 20 bp, Artificial Sequence
  chemically synthesized
ggatgggtagatgcaatcca

SEQ ID NO: 393994 - DNA, 20 bp, Artificial Sequence
  chemically synthesized
ccttactgttggcaattctc

SEQ ID NO: 393995 - DNA, 20 bp, Artificial Sequence
  chemically synthesized
gcaatccagagaattgccaa

SEQ ID NO: 393996 - DNA, 20 bp, Artificial Sequence
  chemically synthesized
tccagagaattgccaacagt

SEQ ID NO: 393997 - DNA, 20 bp, Artificial Sequence
  chemically synthesized
ccagagaattgccaacagta

SEQ ID NO: 393998 - DNA, 20 bp, Artificial Sequence
  chemically synthesized
cagagaattgccaacagtaa

SEQ ID NO: 393999 - DNA, 20 bp, Artificial Sequence
  chemically synthesized
agagtgtttccccttactgt

SEQ ID NO: 394000 - DNA, 20 bp, Artificial Sequence
  chemically synthesized
agagaattgccaacagtaag

SEQ ID NO: 394001 - DNA, 20 bp, Artificial Sequence
  chemically synthesized
gcaggcccaccaggaacaga

SEQ ID NO: 394002 - DNA, 20 bp, Artificial Sequence
  chemically synthesized
ggggaaacactctctgttcc

SEQ ID NO: 394003 - DNA, 20 bp, Artificial Sequence
  chemically synthesized
aagcaggcccaccaggaaca

SEQ ID NO: 394004 - DNA, 20 bp, Artificial Sequence
  chemically synthesized
gaaacactctctgttcctgg

SEQ ID NO: 394005 - DNA, 20 bp, Artificial Sequence
  chemically synthesized
tgaagcaggcccaccaggaa

SEQ ID NO: 394006 - DNA, 20 bp, Artificial Sequence
  chemically synthesized
aaacactctctgttcctggt

SEQ ID NO: 394007 - DNA, 20 bp, Artificial Sequence
  chemically synthesized
agagctgaagcaggcccacc

SEQ ID NO: 394008 - DNA, 20 bp, Artificial Sequence
  chemically synthesized
gagagctgaagcaggcccac

SEQ ID NO: 394009 - DNA, 20 bp, Artificial Sequence
  chemically synthesized
tgttcctggtgggcctgctt

SEQ ID NO: 394010 - DNA, 20 bp, Artificial Sequence
  chemically synthesized
ctgtggatgagagctgaagc

SEQ ID NO: 394011 - DNA, 20 bp, Artificial Sequence
  chemically synthesized
tctgtggatgagagctgaag

SEQ ID NO: 394012 - DNA, 20 bp, Artificial Sequence
  chemically synthesized
gtatctgtggatgagagctg

SEQ ID NO: 394013 - DNA, 20 bp, Artificial Sequence
  chemically synthesized
cctgcttcagctctcatcca

SEQ ID NO: 394014 - DNA, 20 bp, Artificial Sequence
  chemically synthesized
tcacaggtatctgtggatga

SEQ ID NO: 394015 - DNA, 20 bp, Artificial Sequence
  chemically synthesized
cttcacaggtatctgtggat

SEQ ID NO: 394016 - DNA, 20 bp, Artificial Sequence
  chemically synthesized
tactccttcacaggtatctg

SEQ ID NO: 394017 - DNA, 20 bp, Artificial Sequence
  chemically synthesized
ctcatccacagatacctgtg

SEQ ID NO: 394018 - DNA, 20 bp, Artificial Sequence
  chemically synthesized
tcatccacagatacctgtga

SEQ ID NO: 394019 - DNA, 20 bp, Artificial Sequence
  chemically synthesized
atccacagatacctgtgaag

SEQ ID NO: 394020 - DNA, 20 bp, Artificial Sequence
  chemically synthesized
aacatcctttactccttcac

SEQ ID NO: 394021 - DNA, 20 bp, Artificial Sequence
  chemically synthesized
gaacatcctttactccttca

SEQ ID NO: 394022 - DNA, 20 bp, Artificial Sequence
  chemically synthesized
cagatacctgtgaaggagta

SEQ ID NO: 394023 - DNA, 20 bp, Artificial Sequence
  chemically synthesized
agatacctgtgaaggagtaa

SEQ ID NO: 394024 - DNA, 20 bp, Artificial Sequence
  chemically synthesized
caatctggcatatttgggga

SEQ ID NO: 394025 - DNA, 20 bp, Artificial Sequence
  chemically synthesized
ataccaatctggcatatttg

SEQ ID NO: 394026 - DNA, 20 bp, Artificial Sequence
  chemically synthesized
cataccaatctggcatattt

SEQ ID NO: 394027 - DNA, 20 bp, Artificial Sequence
  chemically synthesized
tgttccatccccaaatatgc

SEQ ID NO: 394028 - DNA, 20 bp, Artificial Sequence
  chemically synthesized
acataccaatctggcatatt

SEQ ID NO: 394029 - DNA, 20 bp, Artificial Sequence
  chemically synthesized
catccccaaatatgccagat

SEQ ID NO: 394030 - DNA, 20 bp, Artificial Sequence
  chemically synthesized
aaatagccaacataccaatc

SEQ ID NO: 394031 - DNA, 20 bp, Artificial Sequence
  chemically synthesized
aatatgccagattggtatgt

SEQ ID NO: 394032 - DNA, 20 bp, Artificial Sequence
  chemically synthesized
attggtatgttggctatttt

SEQ ID NO: 394033 - DNA, 20 bp, Artificial Sequence
  chemically synthesized
ccaaagtttccaactgaaaa

SEQ ID NO: 394034 - DNA, 20 bp, Artificial Sequence
  chemically synthesized
gtatgttggctattttcagt

SEQ ID NO: 394035 - DNA, 20 bp, Artificial Sequence
  chemically synthesized
ctattttcagttggaaactt

SEQ ID NO: 394036 - DNA, 20 bp, Artificial Sequence
  chemically synthesized
attttcagttggaaactttg

SEQ ID NO: 394037 - DNA, 20 bp, Artificial Sequence
  chemically synthesized
ctgaaactacaatttctcca

SEQ ID NO: 394038 - DNA, 20 bp, Artificial Sequence
  chemically synthesized
tggaaactttggagaaattg

SEQ ID NO: 394039 - DNA, 20 bp, Artificial Sequence
  chemically synthesized
ctttggagaaattgtagttt

SEQ ID NO: 394040 - DNA, 20 bp, Artificial Sequence
  chemically synthesized
ggagaaattgtagtttcaga

SEQ ID NO: 394041 - DNA, 20 bp, Artificial Sequence
  chemically synthesized
agaaattgtagtttcagaaa

SEQ ID NO: 394042 - DNA, 20 bp, Artificial Sequence
  chemically synthesized
attgtagtttcagaaagagt

SEQ ID NO: 394043 - DNA, 20 bp, Artificial Sequence
  chemically synthesized
gcatgtaggaagagacaggt

SEQ ID NO: 394044 - DNA, 20 bp, Artificial Sequence
  chemically synthesized
tgctgcatgtaggaagagac

SEQ ID NO: 394045 - DNA, 20 bp, Artificial Sequence
  chemically synthesized
ttgctgcatgtaggaagaga

SEQ ID NO: 394046 - DNA, 20 bp, Artificial Sequence
  chemically synthesized
tggtttgctgcatgtaggaa

SEQ ID NO: 394047 - DNA, 20 bp, Artificial Sequence
  chemically synthesized
tatggtttgctgcatgtagg

SEQ ID NO: 394048 - DNA, 20 bp, Artificial Sequence
  chemically synthesized
cacctgtctcttcctacatg

SEQ ID NO: 394049 - DNA, 20 bp, Artificial Sequence
  chemically synthesized
ctttatggtttgctgcatgt

SEQ ID NO: 394050 - DNA, 20 bp, Artificial Sequence
  chemically synthesized
tctttatggtttgctgcatg

SEQ ID NO: 394051 - DNA, 20 bp, Artificial Sequence
  chemically synthesized
cctacatgcagcaaaccata

SEQ ID NO: 394052 - DNA, 20 bp, Artificial Sequence
  chemically synthesized
ccctcccagaggaatcttta

SEQ ID NO: 394053 - DNA, 20 bp, Artificial Sequence
  chemically synthesized
gcaaaccataaagattcctc

SEQ ID NO: 394054 - DNA, 20 bp, Artificial Sequence
  chemically synthesized
caaaccataaagattcctct

SEQ ID NO: 394055 - DNA, 20 bp, Artificial Sequence
  chemically synthesized
aaccataaagattcctctgg

SEQ ID NO: 394056 - DNA, 20 bp, Artificial Sequence
  chemically synthesized
accataaagattcctctggg

SEQ ID NO: 394057 - DNA, 20 bp, Artificial Sequence
  chemically synthesized
ccataaagattcctctggga

SEQ ID NO: 394058 - DNA, 20 bp, Artificial Sequence
  chemically synthesized
cataaagattcctctgggag

SEQ ID NO: 394059 - DNA, 20 bp, Artificial Sequence
  chemically synthesized
tgtgagggtgcccctcccag

SEQ ID NO: 394060 - DNA, 20 bp, Artificial Sequence
  chemically synthesized
ctgtgagggtgcccctccca

SEQ ID NO: 394061 - DNA, 20 bp, Artificial Sequence
  chemically synthesized
tcctgtgagggtgcccctcc

SEQ ID NO: 394062 - DNA, 20 bp, Artificial Sequence
  chemically synthesized
ctctgggaggggcaccctca

SEQ ID NO: 394063 - DNA, 20 bp, Artificial Sequence
  chemically synthesized
tctgggaggggcaccctcac

SEQ ID NO: 394064 - DNA, 20 bp, Artificial Sequence
  chemically synthesized
ttctcactctggtcctgtga

SEQ ID NO: 394065 - DNA, 20 bp, Artificial Sequence
  chemically synthesized
tttctcactctggtcctgtg

SEQ ID NO: 394066 - DNA, 20 bp, Artificial Sequence
  chemically synthesized
gaggggcaccctcacaggac

SEQ ID NO: 394067 - DNA, 20 bp, Artificial Sequence
  chemically synthesized
ttttctcactctggtcctgt

SEQ ID NO: 394068 - DNA, 20 bp, Artificial Sequence
  chemically synthesized
ggggcaccctcacaggacca

SEQ ID NO: 394069 - DNA, 20 bp, Artificial Sequence
  chemically synthesized
caccctcacaggaccagagt

SEQ ID NO: 394070 - DNA, 20 bp, Artificial Sequence
  chemically synthesized
taagggctattttctcactc

SEQ ID NO: 394071 - DNA, 20 bp, Artificial Sequence
  chemically synthesized
acaggaccagagtgagaaaa

SEQ ID NO: 394072 - DNA, 20 bp, Artificial Sequence
  chemically synthesized
gagaaaatagcccttattac

SEQ ID NO: 394073 - DNA, 20 bp, Artificial Sequence
  chemically synthesized
ttctaagtctctggtaataa

SEQ ID NO: 394074 - DNA, 20 bp, Artificial Sequence
  chemically synthesized
attctaagtctctggtaata

SEQ ID NO: 394075 - DNA, 20 bp, Artificial Sequence
  chemically synthesized
gaaaatagcccttattacca

SEQ ID NO: 394076 - DNA, 20 bp, Artificial Sequence
  chemically synthesized
aattctaagtctctggtaat

SEQ ID NO: 394077 - DNA, 20 bp, Artificial Sequence
  chemically synthesized
agcccttattaccagagact

SEQ ID NO: 394078 - DNA, 20 bp, Artificial Sequence
  chemically synthesized
agcctccaattctaagtctc

SEQ ID NO: 394079 - DNA, 20 bp, Artificial Sequence
  chemically synthesized
tattaccagagacttagaat

SEQ ID NO: 394080 - DNA, 20 bp, Artificial Sequence
  chemically synthesized
ttaccagagacttagaattg

SEQ ID NO: 394081 - DNA, 20 bp, Artificial Sequence
  chemically synthesized
ccattgaagcctccaattct

SEQ ID NO: 394082 - DNA, 20 bp, Artificial Sequence
  chemically synthesized
taccagagacttagaattgg

SEQ ID NO: 394083 - DNA, 20 bp, Artificial Sequence
  chemically synthesized
cttagaattggaggcttcaa

SEQ ID NO: 394084 - DNA, 20 bp, Artificial Sequence
  chemically synthesized
atatttattcaggtccattg

SEQ ID NO: 394085 - DNA, 20 bp, Artificial Sequence
  chemically synthesized
ttcagtaaatatatttattc

SEQ ID NO: 394086 - DNA, 20 bp, Artificial Sequence
  chemically synthesized
cttcagtaaatatatttatt

SEQ ID NO: 394087 - DNA, 20 bp, Artificial Sequence
  chemically synthesized
ctgaataaatatatttactg

SEQ ID NO: 394088 - DNA, 20 bp, Artificial Sequence
  chemically synthesized
gtgaaagataagggttactt

SEQ ID NO: 394089 - DNA, 20 bp, Artificial Sequence
  chemically synthesized
ataaaactagtgaaagataa

SEQ ID NO: 394090 - DNA, 20 bp, Artificial Sequence
  chemically synthesized
tataaaactagtgaaagata

SEQ ID NO: 394091 - DNA, 20 bp, Artificial Sequence
  chemically synthesized
gtataaaactagtgaaagat

SEQ ID NO: 394092 - DNA, 20 bp, Artificial Sequence
  chemically synthesized
aagtaacccttatctttcac

SEQ ID NO: 394093 - DNA, 20 bp, Artificial Sequence
  chemically synthesized
agtgggtataaaactagtga

SEQ ID NO: 394094 - DNA, 20 bp, Artificial Sequence
  chemically synthesized
atagatagtgggtataaaac

SEQ ID NO: 394095 - DNA, 20 bp, Artificial Sequence
  chemically synthesized
gtcactaggagatagatagt

SEQ ID NO: 394096 - DNA, 20 bp, Artificial Sequence
  chemically synthesized
agtcactaggagatagatag

SEQ ID NO: 394097 - DNA, 20 bp, Artificial Sequence
  chemically synthesized
gggagtcactaggagataga

SEQ ID NO: 394098 - DNA, 20 bp, Artificial Sequence
  chemically synthesized
tatacccactatctatctcc

SEQ ID NO: 394099 - DNA, 20 bp, Artificial Sequence
  chemically synthesized
ctaggggagtcactaggaga

SEQ ID NO: 394100 - DNA, 20 bp, Artificial Sequence
  chemically synthesized
ttctctaggggagtcactag

SEQ ID NO: 394101 - DNA, 20 bp, Artificial Sequence
  chemically synthesized
ttttctctaggggagtcact

SEQ ID NO: 394102 - DNA, 20 bp, Artificial Sequence
  chemically synthesized
attttctctaggggagtcac

SEQ ID NO: 394103 - DNA, 20 bp, Artificial Sequence
  chemically synthesized
ctatctcctagtgactcccc

SEQ ID NO: 394104 - DNA, 20 bp, Artificial Sequence
  chemically synthesized
atctcctagtgactccccta

SEQ ID NO: 394105 - DNA, 20 bp, Artificial Sequence
  chemically synthesized
acagtaaattttctctaggg

SEQ ID NO: 394106 - DNA, 20 bp, Artificial Sequence
  chemically synthesized
ggacagtaaattttctctag

SEQ ID NO: 394107 - DNA, 20 bp, Artificial Sequence
  chemically synthesized
gggacagtaaattttctcta

SEQ ID NO: 394108 - DNA, 20 bp, Artificial Sequence
  chemically synthesized
agggacagtaaattttctct

SEQ ID NO: 394109 - DNA, 20 bp, Artificial Sequence
  chemically synthesized
tagggacagtaaattttctc

SEQ ID NO: 394110 - DNA, 20 bp, Artificial Sequence
  chemically synthesized
tagagaaaatttactgtccc

SEQ ID NO: 394111 - DNA, 20 bp, Artificial Sequence
  chemically synthesized
aaagagaatctggctaggga

SEQ ID NO: 394112 - DNA, 20 bp, Artificial Sequence
  chemically synthesized
gaaaatttactgtccctagc

SEQ ID NO: 394113 - DNA, 20 bp, Artificial Sequence
  chemically synthesized
ggataaagagaatctggcta

SEQ ID NO: 394114 - DNA, 20 bp, Artificial Sequence
  chemically synthesized
aggataaagagaatctggct

SEQ ID NO: 394115 - DNA, 20 bp, Artificial Sequence
  chemically synthesized
caggataaagagaatctggc

SEQ ID NO: 394116 - DNA, 20 bp, Artificial Sequence
  chemically synthesized
atgacaggataaagagaatc

SEQ ID NO: 394117 - DNA, 20 bp, Artificial Sequence
  chemically synthesized
gaaagcaatgacaggataaa

SEQ ID NO: 394118 - DNA, 20 bp, Artificial Sequence
  chemically synthesized
tggaaagcaatgacaggata

SEQ ID NO: 394119 - DNA, 20 bp, Artificial Sequence
  chemically synthesized
tgaatttggaaagcaatgac

SEQ ID NO: 394120 - DNA, 20 bp, Artificial Sequence
  chemically synthesized
atgaatttggaaagcaatga

SEQ ID NO: 394121 - DNA, 20 bp, Artificial Sequence
  chemically synthesized
atgaatttgatgaatttgga

SEQ ID NO: 394122 - DNA, 20 bp, Artificial Sequence
  chemically synthesized
aatgatgaatttgatgaatt

SEQ ID NO: 394123 - DNA, 20 bp, Artificial Sequence
  chemically synthesized
aattcatcattcatcattaa

SEQ ID NO: 394124 - DNA, 20 bp, Artificial Sequence
  chemically synthesized
cctgaagaagtagtcaaagc

SEQ ID NO: 394125 - DNA, 20 bp, Artificial Sequence
  chemically synthesized
gaagcctgaagaagtagtca

SEQ ID NO: 394126 - DNA, 20 bp, Artificial Sequence
  chemically synthesized
tcttgctttgactacttctt

SEQ ID NO: 394127 - DNA, 20 bp, Artificial Sequence
  chemically synthesized
cttgctttgactacttcttc

SEQ ID NO: 394128 - DNA, 20 bp, Artificial Sequence
  chemically synthesized
gaaagtgaagcctgaagaag

SEQ ID NO: 394129 - DNA, 20 bp, Artificial Sequence
  chemically synthesized
caagaaagtgaagcctgaag

SEQ ID NO: 394130 - DNA, 20 bp, Artificial Sequence
  chemically synthesized
tcacaagaaagtgaagcctg

SEQ ID NO: 394131 - DNA, 20 bp, Artificial Sequence
  chemically synthesized
gagatcatcacaagaaagtg

SEQ ID NO: 394132 - DNA, 20 bp, Artificial Sequence
  chemically synthesized
acgtggagatcatcacaaga

SEQ ID NO: 394133 - DNA, 20 bp, Artificial Sequence
  chemically synthesized
atgtacgtggagatcatcac

SEQ ID NO: 394134 - DNA, 20 bp, Artificial Sequence
  chemically synthesized
attacttatacatgtacgtg

SEQ ID NO: 394135 - DNA, 20 bp, Artificial Sequence
  chemically synthesized
gtattacttatacatgtacg

SEQ ID NO: 394136 - DNA, 20 bp, Artificial Sequence
  chemically synthesized
tgatctccacgtacatgtat

SEQ ID NO: 394137 - DNA, 20 bp, Artificial Sequence
  chemically synthesized
tcaggcagaaaacaaaagaa

SEQ ID NO: 394138 - DNA, 20 bp, Artificial Sequence
  chemically synthesized
cgacatcaggcagaaaacaa

SEQ ID NO: 394139 - DNA, 20 bp, Artificial Sequence
  chemically synthesized
gaaaccaaatcgacatcagg

SEQ ID NO: 394140 - DNA, 20 bp, Artificial Sequence
  chemically synthesized
ctagaaaccaaatcgacatc

SEQ ID NO: 394141 - DNA, 20 bp, Artificial Sequence
  chemically synthesized
tctagaaaccaaatcgacat

SEQ ID NO: 394142 - DNA, 20 bp, Artificial Sequence
  chemically synthesized
ttttctgcctgatgtcgatt

SEQ ID NO: 394143 - DNA, 20 bp, Artificial Sequence
  chemically synthesized
cctgatgtcgatttggtttc

SEQ ID NO: 394144 - DNA, 20 bp, Artificial Sequence
  chemically synthesized
gtaggctcttcagttggatc

SEQ ID NO: 394145 - DNA, 20 bp, Artificial Sequence
  chemically synthesized
ttggtttctagatccaactg

SEQ ID NO: 394146 - DNA, 20 bp, Artificial Sequence
  chemically synthesized
ggtttctagatccaactgaa

SEQ ID NO: 394147 - DNA, 20 bp, Artificial Sequence
  chemically synthesized
ttcttagtaggctcttcagt

SEQ ID NO: 394148 - DNA, 20 bp, Artificial Sequence
  chemically synthesized
ttagttcttagtaggctctt

SEQ ID NO: 394149 - DNA, 20 bp, Artificial Sequence
  chemically synthesized
atccaactgaagagcctact

SEQ ID NO: 394150 - DNA, 20 bp, Artificial Sequence
  chemically synthesized
tcccccttttagttcttagt

SEQ ID NO: 394151 - DNA, 20 bp, Artificial Sequence
  chemically synthesized
atcccccttttagttcttag

SEQ ID NO: 394152 - DNA, 20 bp, Artificial Sequence
  chemically synthesized
ccaatcccccttttagttct

SEQ ID NO: 394153 - DNA, 20 bp, Artificial Sequence
  chemically synthesized
aagagcctactaagaactaa

SEQ ID NO: 394154 - DNA, 20 bp, Artificial Sequence
  chemically synthesized
agagcctactaagaactaaa

SEQ ID NO: 394155 - DNA, 20 bp, Artificial Sequence
  chemically synthesized
gagcctactaagaactaaaa

SEQ ID NO: 394156 - DNA, 20 bp, Artificial Sequence
  chemically synthesized
agcctactaagaactaaaag

SEQ ID NO: 394157 - DNA, 20 bp, Artificial Sequence
  chemically synthesized
gcctactaagaactaaaagg

SEQ ID NO: 394158 - DNA, 20 bp, Artificial Sequence
  chemically synthesized
atcacctccaatcccccttt

SEQ ID NO: 394159 - DNA, 20 bp, Artificial Sequence
  chemically synthesized
ctaagaactaaaagggggat

SEQ ID NO: 394160 - DNA, 20 bp, Artificial Sequence
  chemically synthesized
aagaactaaaagggggattg

SEQ ID NO: 394161 - DNA, 20 bp, Artificial Sequence
  chemically synthesized
agaactaaaagggggattgg

SEQ ID NO: 394162 - DNA, 20 bp, Artificial Sequence
  chemically synthesized
atgtgcaggtgtaggggaat

SEQ ID NO: 394163 - DNA, 20 bp, Artificial Sequence
  chemically synthesized
catcacatgtgcaggtgtag

SEQ ID NO: 394164 - DNA, 20 bp, Artificial Sequence
  chemically synthesized
tcatcacatgtgcaggtgta

SEQ ID NO: 394165 - DNA, 20 bp, Artificial Sequence
  chemically synthesized
ttcatcacatgtgcaggtgt

SEQ ID NO: 394166 - DNA, 20 bp, Artificial Sequence
  chemically synthesized
tttcatcacatgtgcaggtg

SEQ ID NO: 394167 - DNA, 20 bp, Artificial Sequence
  chemically synthesized
tacagtttcatcacatgtgc

SEQ ID NO: 394168 - DNA, 20 bp, Artificial Sequence
  chemically synthesized
gtacagtttcatcacatgtg

SEQ ID NO: 394169 - DNA, 20 bp, Artificial Sequence
  chemically synthesized
gcacatgtgatgaaactgta

SEQ ID NO: 394170 - DNA, 20 bp, Artificial Sequence
  chemically synthesized
tgtgtgtatttagttctgta

SEQ ID NO: 394171 - DNA, 20 bp, Artificial Sequence
  chemically synthesized
tgtgtgtgtgtgtgtgtatt

SEQ ID NO: 394172 - DNA, 20 bp, Artificial Sequence
  chemically synthesized
cacacacacacacacacata

SEQ ID NO: 394173 - DNA, 20 bp, Artificial Sequence
  chemically synthesized
acacacacacacacacatat

SEQ ID NO: 394174 - DNA, 20 bp, Artificial Sequence
  chemically synthesized
cacacacatataggaacacc

SEQ ID NO: 394175 - DNA, 20 bp, Artificial Sequence
  chemically synthesized
cacacatataggaacaccga

SEQ ID NO: 394176 - DNA, 20 bp, Artificial Sequence
  chemically synthesized
caattttattcagtttctct

SEQ ID NO: 394177 - DNA, 20 bp, Artificial Sequence
  chemically synthesized
tacaattcagcaattttatt

SEQ ID NO: 394178 - DNA, 20 bp, Artificial Sequence
  chemically synthesized
tgaataaaattgctgaattg

SEQ ID NO: 394179 - DNA, 20 bp, Artificial Sequence
  chemically synthesized
atattgacattactacaatt

SEQ ID NO: 394180 - DNA, 20 bp, Artificial Sequence
  chemically synthesized
ttgtagtaatgtcaatattc

SEQ ID NO: 394181 - DNA, 20 bp, Artificial Sequence
  chemically synthesized
ctataatataatatcacagc

SEQ ID NO: 394182 - DNA, 20 bp, Artificial Sequence
  chemically synthesized
aaaactataatataatatca

SEQ ID NO: 394183 - DNA, 20 bp, Artificial Sequence
  chemically synthesized
ctggctgtgatattatatta

SEQ ID NO: 394184 - DNA, 20 bp, Artificial Sequence
  chemically synthesized
gttttgcaaaatattaactt

SEQ ID NO: 394185 - DNA, 20 bp, Artificial Sequence
  chemically synthesized
ttttgcaaaatattaacttt

SEQ ID NO: 394186 - DNA, 20 bp, Artificial Sequence
  chemically synthesized
tttgcaaaatattaacttta

SEQ ID NO: 394187 - DNA, 20 bp, Artificial Sequence
  chemically synthesized
actttaccattttttcccta

SEQ ID NO: 394188 - DNA, 20 bp, Artificial Sequence
  chemically synthesized
tattaactttagggaaaaaa

SEQ ID NO: 394189 - DNA, 20 bp, Artificial Sequence
  chemically synthesized
actttagggaaaaaatggta

SEQ ID NO: 394190 - DNA, 20 bp, Artificial Sequence
  chemically synthesized
aaaaaatggtaaagtgtaca

SEQ ID NO: 394191 - DNA, 20 bp, Artificial Sequence
  chemically synthesized
aaaaatggtaaagtgtacat

SEQ ID NO: 394192 - DNA, 20 bp, Artificial Sequence
  chemically synthesized
acagttaataagaaataata

SEQ ID NO: 394193 - DNA, 20 bp, Artificial Sequence
  chemically synthesized
tagatacatatacagttaat

SEQ ID NO: 394194 - DNA, 20 bp, Artificial Sequence
  chemically synthesized
gataattgtagatacatata

SEQ ID NO: 394195 - DNA, 20 bp, Artificial Sequence
  chemically synthesized
acattttatggagataattg

SEQ ID NO: 394196 - DNA, 20 bp, Artificial Sequence
  chemically synthesized
aaaaaaattgacattttatg

SEQ ID NO: 394197 - DNA, 20 bp, Artificial Sequence
  chemically synthesized
ttaaaaaaattgacatttta

SEQ ID NO: 394198 - DNA, 20 bp, Artificial Sequence
  chemically synthesized
taaaatgtcaatttttttaa

SEQ ID NO: 394199 - DNA, 20 bp, Artificial Sequence
  chemically synthesized
tgatttttttattttctgtt

SEQ ID NO: 394200 - DNA, 20 bp, Artificial Sequence
  chemically synthesized
aacatctagtgaaatccaaa

SEQ ID NO: 394201 - DNA, 20 bp, Artificial Sequence
  chemically synthesized
attttctgtttggatttcac

SEQ ID NO: 394202 - DNA, 20 bp, Artificial Sequence
  chemically synthesized
ataaaatcaataagaacatc

SEQ ID NO: 394203 - DNA, 20 bp, Artificial Sequence
  chemically synthesized
atatagtgaataaaatcaat

SEQ ID NO: 394204 - DNA, 20 bp, Artificial Sequence
  chemically synthesized
attttattcactatataatt

SEQ ID NO: 394205 - DNA, 20 bp, Artificial Sequence
  chemically synthesized
caagatgattctcaattata

SEQ ID NO: 394206 - DNA, 20 bp, Artificial Sequence
  chemically synthesized
gctctgagtaaacacagagc

SEQ ID NO: 394207 - DNA, 20 bp, Artificial Sequence
  chemically synthesized
gcttgctctgagtaaacaca

SEQ ID NO: 394208 - DNA, 20 bp, Artificial Sequence
  chemically synthesized
cagcttgctctgagtaaaca

SEQ ID NO: 394209 - DNA, 20 bp, Artificial Sequence
  chemically synthesized
catcttgctctgtgtttact

SEQ ID NO: 394210 - DNA, 20 bp, Artificial Sequence
  chemically synthesized
tcttgctctgtgtttactca

SEQ ID NO: 394211 - DNA, 20 bp, Artificial Sequence
  chemically synthesized
gctctgtgtttactcagagc

SEQ ID NO: 394212 - DNA, 20 bp, Artificial Sequence
  chemically synthesized
ctgaaagttcagcttgctct

SEQ ID NO: 394213 - DNA, 20 bp, Artificial Sequence
  chemically synthesized
ctcagagcaagctgaacttt

SEQ ID NO: 394214 - DNA, 20 bp, Artificial Sequence
  chemically synthesized
aaataagattgctgaaagtt

SEQ ID NO: 394215 - DNA, 20 bp, Artificial Sequence
  chemically synthesized
tttaaaaataagattgctga

SEQ ID NO: 394216 - DNA, 20 bp, Artificial Sequence
  chemically synthesized
atgtagcattttttaaaaat

SEQ ID NO: 394217 - DNA, 20 bp, Artificial Sequence
  chemically synthesized
gctgataaggtcatatcatg

SEQ ID NO: 394218 - DNA, 20 bp, Artificial Sequence
  chemically synthesized
gctacatgatatgaccttat

SEQ ID NO: 394219 - DNA, 20 bp, Artificial Sequence
  chemically synthesized
aacttagtaaattgctgata

SEQ ID NO: 394220 - DNA, 20 bp, Artificial Sequence
  chemically synthesized
taacttagtaaattgctgat

SEQ ID NO: 394221 - DNA, 20 bp, Artificial Sequence
  chemically synthesized
gaccttatcagcaatttact

SEQ ID NO: 394222 - DNA, 20 bp, Artificial Sequence
  chemically synthesized
taaagtccattcaaataact

SEQ ID NO: 394223 - DNA, 20 bp, Artificial Sequence
  chemically synthesized
aatttactaagttatttgaa

SEQ ID NO: 394224 - DNA, 20 bp, Artificial Sequence
  chemically synthesized
agttatttgaatggacttta

SEQ ID NO: 394225 - DNA, 20 bp, Artificial Sequence
  chemically synthesized
aagataagttcatgtccata

SEQ ID NO: 394226 - DNA, 20 bp, Artificial Sequence
  chemically synthesized
tggacatgaacttatcttca

SEQ ID NO: 394227 - DNA, 20 bp, Artificial Sequence
  chemically synthesized
agaaaagacgctttgaagat

SEQ ID NO: 394228 - DNA, 20 bp, Artificial Sequence
  chemically synthesized
taaacagaaaagacgctttg

SEQ ID NO: 394229 - DNA, 20 bp, Artificial Sequence
  chemically synthesized
ggacatagctttaaacagaa

SEQ ID NO: 394230 - DNA, 20 bp, Artificial Sequence
  chemically synthesized
caaagcgtcttttctgttta

SEQ ID NO: 394231 - DNA, 20 bp, Artificial Sequence
  chemically synthesized
gtaaaggacatagctttaaa

SEQ ID NO: 394232 - DNA, 20 bp, Artificial Sequence
  chemically synthesized
aaaaaaaacggtaaaggaca

SEQ ID NO: 394233 - DNA, 20 bp, Artificial Sequence
  chemically synthesized
cagtttaaaaaaaacggtaa

SEQ ID NO: 394234 - DNA, 20 bp, Artificial Sequence
  chemically synthesized
ccagtttaaaaaaaacggta

SEQ ID NO: 394235 - DNA, 20 bp, Artificial Sequence
  chemically synthesized
tgcttccagtttaaaaaaaa

SEQ ID NO: 394236 - DNA, 20 bp, Artificial Sequence
  chemically synthesized
ctttaccgttttttttaaac

SEQ ID NO: 394237 - DNA, 20 bp, Artificial Sequence
  chemically synthesized
taccgttttttttaaactgg

SEQ ID NO: 394238 - DNA, 20 bp, Artificial Sequence
  chemically synthesized
tggcagggaaggaatgcttc

SEQ ID NO: 394239 - DNA, 20 bp, Artificial Sequence
  chemically synthesized
tggaagcattccttccctgc

SEQ ID NO: 394240 - DNA, 20 bp, Artificial Sequence
  chemically synthesized
ttttctttagctggcaggga

SEQ ID NO: 394241 - DNA, 20 bp, Artificial Sequence
  chemically synthesized
attttctttagctggcaggg

SEQ ID NO: 394242 - DNA, 20 bp, Artificial Sequence
  chemically synthesized
ggaattttctttagctggca

SEQ ID NO: 394243 - DNA, 20 bp, Artificial Sequence
  chemically synthesized
tggaattttctttagctggc

SEQ ID NO: 394244 - DNA, 20 bp, Artificial Sequence
  chemically synthesized
cattccttccctgccagcta

SEQ ID NO: 394245 - DNA, 20 bp, Artificial Sequence
  chemically synthesized
atggaattttctttagctgg

SEQ ID NO: 394246 - DNA, 20 bp, Artificial Sequence
  chemically synthesized
aacatggaattttctttagc

SEQ ID NO: 394247 - DNA, 20 bp, Artificial Sequence
  chemically synthesized
taataacatggaattttctt

SEQ ID NO: 394248 - DNA, 20 bp, Artificial Sequence
  chemically synthesized
aaccaccatttttaataaca

SEQ ID NO: 394249 - DNA, 20 bp, Artificial Sequence
  chemically synthesized
aaattccatgttattaaaaa

SEQ ID NO: 394250 - DNA, 20 bp, Artificial Sequence
  chemically synthesized
ttccatgttattaaaaatgg

SEQ ID NO: 394251 - DNA, 20 bp, Artificial Sequence
  chemically synthesized
ttattaaaaatggtggttct

SEQ ID NO: 394252 - DNA, 20 bp, Artificial Sequence
  chemically synthesized
tatgtgtattaattatggct

SEQ ID NO: 394253 - DNA, 20 bp, Artificial Sequence
  chemically synthesized
tgaactatgtgtattaatta

SEQ ID NO: 394254 - DNA, 20 bp, Artificial Sequence
  chemically synthesized
tcagccataattaatacaca

SEQ ID NO: 394255 - DNA, 20 bp, Artificial Sequence
  chemically synthesized
acacattaccaattttaaat

SEQ ID NO: 394256 - DNA, 20 bp, Artificial Sequence
  chemically synthesized
aacacattaccaattttaaa

SEQ ID NO: 394257 - DNA, 20 bp, Artificial Sequence
  chemically synthesized
tcataacacccatttaaaat

SEQ ID NO: 394258 - DNA, 20 bp, Artificial Sequence
  chemically synthesized
aaaattggtaatgtgtttat

SEQ ID NO: 394259 - DNA, 20 bp, Artificial Sequence
  chemically synthesized
aattggtaatgtgtttataa

SEQ ID NO: 394260 - DNA, 20 bp, Artificial Sequence
  chemically synthesized
ttggtaatgtgtttataaga

SEQ ID NO: 394261 - DNA, 20 bp, Artificial Sequence
  chemically synthesized
tggtaatgtgtttataagag

SEQ ID NO: 394262 - DNA, 20 bp, Artificial Sequence
  chemically synthesized
aatgtgtttataagagaggt

SEQ ID NO: 394263 - DNA, 20 bp, Artificial Sequence
  chemically synthesized
ataagagaggtgagacatgc

SEQ ID NO: 394264 - DNA, 20 bp, Artificial Sequence
  chemically synthesized
agaggtgagacatgcaagaa

SEQ ID NO: 394265 - DNA, 20 bp, Artificial Sequence
  chemically synthesized
ggtgagacatgcaagaaaag

SEQ ID NO: 394266 - DNA, 20 bp, Artificial Sequence
  chemically synthesized
gagacatgcaagaaaagaag

SEQ ID NO: 394267 - DNA, 20 bp, Artificial Sequence
  chemically synthesized
gcaagaaaagaagtggtacc

SEQ ID NO: 394268 - DNA, 20 bp, Artificial Sequence
  chemically synthesized
atgtgtctctggtgatcact

SEQ ID NO: 394269 - DNA, 20 bp, Artificial Sequence
  chemically synthesized
aagtggtaccaagtgatcac

SEQ ID NO: 394270 - DNA, 20 bp, Artificial Sequence
  chemically synthesized
gtggtaccaagtgatcacca

SEQ ID NO: 394271 - DNA, 20 bp, Artificial Sequence
  chemically synthesized
tcacacactccatgtgtctc

SEQ ID NO: 394272 - DNA, 20 bp, Artificial Sequence
  chemically synthesized
aagtgatcaccagagacaca

SEQ ID NO: 394273 - DNA, 20 bp, Artificial Sequence
  chemically synthesized
gtgatcaccagagacacatg

SEQ ID NO: 394274 - DNA, 20 bp, Artificial Sequence
  chemically synthesized
cagagacacatggagtgtgt

SEQ ID NO: 394275 - DNA, 20 bp, Artificial Sequence
  chemically synthesized
acacatggagtgtgtgagtg

SEQ ID NO: 394276 - DNA, 20 bp, Artificial Sequence
  chemically synthesized
cacatggagtgtgtgagtgt

SEQ ID NO: 394277 - DNA, 20 bp, Artificial Sequence
  chemically synthesized
catggagtgtgtgagtgtag

SEQ ID NO: 394278 - DNA, 20 bp, Artificial Sequence
  chemically synthesized
tggagtgtgtgagtgtagga

SEQ ID NO: 394279 - DNA, 20 bp, Artificial Sequence
  chemically synthesized
taaataaataaatagcacag

SEQ ID NO: 394280 - DNA, 20 bp, Artificial Sequence
  chemically synthesized
gtaaataaataaatagcaca

SEQ ID NO: 394281 - DNA, 20 bp, Artificial Sequence
  chemically synthesized
aagtaaataaataaatagca

SEQ ID NO: 394282 - DNA, 20 bp, Artificial Sequence
  chemically synthesized
caaataagtaaataaataaa

SEQ ID NO: 394283 - DNA, 20 bp, Artificial Sequence
  chemically synthesized
atttatttatttacttattt

SEQ ID NO: 394284 - DNA, 20 bp, Artificial Sequence
  chemically synthesized
aaggaaactccatctcaaat

SEQ ID NO: 394285 - DNA, 20 bp, Artificial Sequence
  chemically synthesized
atttatttacttatttgaga

SEQ ID NO: 394286 - DNA, 20 bp, Artificial Sequence
  chemically synthesized
ttatttacttatttgagatg

SEQ ID NO: 394287 - DNA, 20 bp, Artificial Sequence
  chemically synthesized
ctccagcctggggaacagga

SEQ ID NO: 394288 - DNA, 20 bp, Artificial Sequence
  chemically synthesized
gctccagcctggggaacagg

SEQ ID NO: 394289 - DNA, 20 bp, Artificial Sequence
  chemically synthesized
ggagtttccttcctgttccc

SEQ ID NO: 394290 - DNA, 20 bp, Artificial Sequence
  chemically synthesized
gagtttccttcctgttcccc

SEQ ID NO: 394291 - DNA, 20 bp, Artificial Sequence
  chemically synthesized
tgcgctccagcctggggaac

SEQ ID NO: 394292 - DNA, 20 bp, Artificial Sequence
  chemically synthesized
ttgcgctccagcctggggaa

SEQ ID NO: 394293 - DNA, 20 bp, Artificial Sequence
  chemically synthesized
ttccttcctgttccccaggc

SEQ ID NO: 394294 - DNA, 20 bp, Artificial Sequence
  chemically synthesized
ccttcctgttccccaggctg

SEQ ID NO: 394295 - DNA, 20 bp, Artificial Sequence
  chemically synthesized
cgccattgcgctccagcctg

SEQ ID NO: 394296 - DNA, 20 bp, Artificial Sequence
  chemically synthesized
gcgccattgcgctccagcct

SEQ ID NO: 394297 - DNA, 20 bp, Artificial Sequence
  chemically synthesized
ggcgccattgcgctccagcc

SEQ ID NO: 394298 - DNA, 20 bp, Artificial Sequence
  chemically synthesized
gagatggcgccattgcgctc

SEQ ID NO: 394299 - DNA, 20 bp, Artificial Sequence
  chemically synthesized
ttccccaggctggagcgcaa

SEQ ID NO: 394300 - DNA, 20 bp, Artificial Sequence
  chemically synthesized
ggagcgcaatggcgccatct

SEQ ID NO: 394301 - DNA, 20 bp, Artificial Sequence
  chemically synthesized
gaagttgcagtgagccgaga

SEQ ID NO: 394302 - DNA, 20 bp, Artificial Sequence
  chemically synthesized
ggcggaagttgcagtgagcc

SEQ ID NO: 394303 - DNA, 20 bp, Artificial Sequence
  chemically synthesized
tgggaggcggaagttgcagt

SEQ ID NO: 394304 - DNA, 20 bp, Artificial Sequence
  chemically synthesized
aacctgggaggcggaagttg

SEQ ID NO: 394305 - DNA, 20 bp, Artificial Sequence
  chemically synthesized
cgcttgaacctgggaggcgg

SEQ ID NO: 394306 - DNA, 20 bp, Artificial Sequence
  chemically synthesized
tcactgcaacttccgcctcc

SEQ ID NO: 394307 - DNA, 20 bp, Artificial Sequence
  chemically synthesized
cactgcaacttccgcctccc

SEQ ID NO: 394308 - DNA, 20 bp, Artificial Sequence
  chemically synthesized
aatcgcttgaacctgggagg

SEQ ID NO: 394309 - DNA, 20 bp, Artificial Sequence
  chemically synthesized
gagaatcgcttgaacctggg

SEQ ID NO: 394310 - DNA, 20 bp, Artificial Sequence
  chemically synthesized
ggagaatcgcttgaacctgg

SEQ ID NO: 394311 - DNA, 20 bp, Artificial Sequence
  chemically synthesized
aacttccgcctcccaggttc

SEQ ID NO: 394312 - DNA, 20 bp, Artificial Sequence
  chemically synthesized
caggagaatcgcttgaacct

SEQ ID NO: 394313 - DNA, 20 bp, Artificial Sequence
  chemically synthesized
gcaggagaatcgcttgaacc

SEQ ID NO: 394314 - DNA, 20 bp, Artificial Sequence
  chemically synthesized
ttcaagcgattctcctgcct

SEQ ID NO: 394315 - DNA, 20 bp, Artificial Sequence
  chemically synthesized
tacttgggaggctgaggcag

SEQ ID NO: 394316 - DNA, 20 bp, Artificial Sequence
  chemically synthesized
gctacttgggaggctgaggc

SEQ ID NO: 394317 - DNA, 20 bp, Artificial Sequence
  chemically synthesized
agctacttgggaggctgagg

SEQ ID NO: 394318 - DNA, 20 bp, Artificial Sequence
  chemically synthesized
cccagctacttgggaggctg

SEQ ID NO: 394319 - DNA, 20 bp, Artificial Sequence
  chemically synthesized
tcccagctacttgggaggct

SEQ ID NO: 394320 - DNA, 20 bp, Artificial Sequence
  chemically synthesized
ttctcctgcctcagcctccc

SEQ ID NO: 394321 - DNA, 20 bp, Artificial Sequence
  chemically synthesized
tcctgcctcagcctcccaag

SEQ ID NO: 394322 - DNA, 20 bp, Artificial Sequence
  chemically synthesized
tgtaatcccagctacttggg

SEQ ID NO: 394323 - DNA, 20 bp, Artificial Sequence
  chemically synthesized
ctgtaatcccagctacttgg

SEQ ID NO: 394324 - DNA, 20 bp, Artificial Sequence
  chemically synthesized
gcctcagcctcccaagtagc

SEQ ID NO: 394325 - DNA, 20 bp, Artificial Sequence
  chemically synthesized
gcctgtaatcccagctactt

SEQ ID NO: 394326 - DNA, 20 bp, Artificial Sequence
  chemically synthesized
cctcagcctcccaagtagct

SEQ ID NO: 394327 - DNA, 20 bp, Artificial Sequence
  chemically synthesized
tgcctgtaatcccagctact

SEQ ID NO: 394328 - DNA, 20 bp, Artificial Sequence
  chemically synthesized
ctcccaagtagctgggatta

SEQ ID NO: 394329 - DNA, 20 bp, Artificial Sequence
  chemically synthesized
tcccaagtagctgggattac

SEQ ID NO: 394330 - DNA, 20 bp, Artificial Sequence
  chemically synthesized
gtggtgggtgcctgtaatcc

SEQ ID NO: 394331 - DNA, 20 bp, Artificial Sequence
  chemically synthesized
aattagccgggtgtggtggt

SEQ ID NO: 394332 - DNA, 20 bp, Artificial Sequence
  chemically synthesized
aaattagccgggtgtggtgg

SEQ ID NO: 394333 - DNA, 20 bp, Artificial Sequence
  chemically synthesized
caggcacccaccaccacacc

SEQ ID NO: 394334 - DNA, 20 bp, Artificial Sequence
  chemically synthesized
caaaaattagccgggtgtgg

SEQ ID NO: 394335 - DNA, 20 bp, Artificial Sequence
  chemically synthesized
atacaaaaattagccgggtg

SEQ ID NO: 394336 - DNA, 20 bp, Artificial Sequence
  chemically synthesized
taaaaatacaaaaattagcc

SEQ ID NO: 394337 - DNA, 20 bp, Artificial Sequence
  chemically synthesized
ctaaaaatacaaaaattagc

SEQ ID NO: 394338 - DNA, 20 bp, Artificial Sequence
  chemically synthesized
tctactaaaaatacaaaaat

SEQ ID NO: 394339 - DNA, 20 bp, Artificial Sequence
  chemically synthesized
ccggctaatttttgtatttt

SEQ ID NO: 394340 - DNA, 20 bp, Artificial Sequence
  chemically synthesized
gctaatttttgtatttttag

SEQ ID NO: 394341 - DNA, 20 bp, Artificial Sequence
  chemically synthesized
taatttttgtatttttagta

SEQ ID NO: 394342 - DNA, 20 bp, Artificial Sequence
  chemically synthesized
ttttgtatttttagtagaga

SEQ ID NO: 394343 - DNA, 20 bp, Artificial Sequence
  chemically synthesized
tttgtatttttagtagagac

SEQ ID NO: 394344 - DNA, 20 bp, Artificial Sequence
  chemically synthesized
ttgtatttttagtagagaca

SEQ ID NO: 394345 - DNA, 20 bp, Artificial Sequence
  chemically synthesized
gagacagggttttgtcatgt

SEQ ID NO: 394346 - DNA, 20 bp, Artificial Sequence
  chemically synthesized
cagggttttgtcatgttggc

SEQ ID NO: 394347 - DNA, 20 bp, Artificial Sequence
  chemically synthesized
agggttttgtcatgttggcc

SEQ ID NO: 394348 - DNA, 20 bp, Artificial Sequence
  chemically synthesized
ttttgtcatgttggccaggc

SEQ ID NO: 394349 - DNA, 20 bp, Artificial Sequence
  chemically synthesized
tcaagagtttgagaccagcc

SEQ ID NO: 394350 - DNA, 20 bp, Artificial Sequence
  chemically synthesized
tgaggtcaagagtttgagac

SEQ ID NO: 394351 - DNA, 20 bp, Artificial Sequence
  chemically synthesized
tcacctgaggtcaagagttt

SEQ ID NO: 394352 - DNA, 20 bp, Artificial Sequence
  chemically synthesized
tggtctcaaactcttgacct

SEQ ID NO: 394353 - DNA, 20 bp, Artificial Sequence
  chemically synthesized
ggtggatcacctgaggtcaa

SEQ ID NO: 394354 - DNA, 20 bp, Artificial Sequence
  chemically synthesized
ggtctcaaactcttgacctc

SEQ ID NO: 394355 - DNA, 20 bp, Artificial Sequence
  chemically synthesized
cgggtggatcacctgaggtc

SEQ ID NO: 394356 - DNA, 20 bp, Artificial Sequence
  chemically synthesized
caaagcgggtggatcacctg

SEQ ID NO: 394357 - DNA, 20 bp, Artificial Sequence
  chemically synthesized
ccaaagcgggtggatcacct

SEQ ID NO: 394358 - DNA, 20 bp, Artificial Sequence
  chemically synthesized
ctcaggtgatccacccgctt

SEQ ID NO: 394359 - DNA, 20 bp, Artificial Sequence
  chemically synthesized
ctttgggcggccaaagcggg

SEQ ID NO: 394360 - DNA, 20 bp, Artificial Sequence
  chemically synthesized
gcactttgggcggccaaagc

SEQ ID NO: 394361 - DNA, 20 bp, Artificial Sequence
  chemically synthesized
agcactttgggcggccaaag

SEQ ID NO: 394362 - DNA, 20 bp, Artificial Sequence
  chemically synthesized
cccagcactttgggcggcca

SEQ ID NO: 394363 - DNA, 20 bp, Artificial Sequence
  chemically synthesized
ccacccgctttggccgccca

SEQ ID NO: 394364 - DNA, 20 bp, Artificial Sequence
  chemically synthesized
tacaatcccagcactttggg

SEQ ID NO: 394365 - DNA, 20 bp, Artificial Sequence
  chemically synthesized
gctttggccgcccaaagtgc

SEQ ID NO: 394366 - DNA, 20 bp, Artificial Sequence
  chemically synthesized
tcctacaatcccagcacttt

SEQ ID NO: 394367 - DNA, 20 bp, Artificial Sequence
  chemically synthesized
ctttggccgcccaaagtgct

SEQ ID NO: 394368 - DNA, 20 bp, Artificial Sequence
  chemically synthesized
ctcctacaatcccagcactt

SEQ ID NO: 394369 - DNA, 20 bp, Artificial Sequence
  chemically synthesized
cgcccaaagtgctgggattg

SEQ ID NO: 394370 - DNA, 20 bp, Artificial Sequence
  chemically synthesized
gcccaaagtgctgggattgt

SEQ ID NO: 394371 - DNA, 20 bp, Artificial Sequence
  chemically synthesized
gtggctcactcctacaatcc

SEQ ID NO: 394372 - DNA, 20 bp, Artificial Sequence
  chemically synthesized
ccaaagtgctgggattgtag

SEQ ID NO: 394373 - DNA, 20 bp, Artificial Sequence
  chemically synthesized
agtgctgggattgtaggagt

SEQ ID NO: 394374 - DNA, 20 bp, Artificial Sequence
  chemically synthesized
taggagtgagccaccgtgcc

SEQ ID NO: 394375 - DNA, 20 bp, Artificial Sequence
  chemically synthesized
cagaggtgggccgggcacgg

SEQ ID NO: 394376 - DNA, 20 bp, Artificial Sequence
  chemically synthesized
acacagaggtgggccgggca

SEQ ID NO: 394377 - DNA, 20 bp, Artificial Sequence
  chemically synthesized
gtaaaacacagaggtgggcc

SEQ ID NO: 394378 - DNA, 20 bp, Artificial Sequence
  chemically synthesized
agtaaaacacagaggtgggc

SEQ ID NO: 394379 - DNA, 20 bp, Artificial Sequence
  chemically synthesized
ggaaagtaaaacacagaggt

SEQ ID NO: 394380 - DNA, 20 bp, Artificial Sequence
  chemically synthesized
gggaaagtaaaacacagagg

SEQ ID NO: 394381 - DNA, 20 bp, Artificial Sequence
  chemically synthesized
atagggaaagtaaaacacag

SEQ ID NO: 394382 - DNA, 20 bp, Artificial Sequence
  chemically synthesized
gatagggaaagtaaaacaca

SEQ ID NO: 394383 - DNA, 20 bp, Artificial Sequence
  chemically synthesized
tagatagggaaagtaaaaca

SEQ ID NO: 394384 - DNA, 20 bp, Artificial Sequence
  chemically synthesized
tccctttttatagataggga

SEQ ID NO: 394385 - DNA, 20 bp, Artificial Sequence
  chemically synthesized
tacttccctttttatagata

SEQ ID NO: 394386 - DNA, 20 bp, Artificial Sequence
  chemically synthesized
ttacttccctttttatagat

SEQ ID NO: 394387 - DNA, 20 bp, Artificial Sequence
  chemically synthesized
tttacttccctttttataga

SEQ ID NO: 394388 - DNA, 20 bp, Artificial Sequence
  chemically synthesized
ttactttccctatctataaa

SEQ ID NO: 394389 - DNA, 20 bp, Artificial Sequence
  chemically synthesized
tactttccctatctataaaa

SEQ ID NO: 394390 - DNA, 20 bp, Artificial Sequence
  chemically synthesized
actttccctatctataaaaa

SEQ ID NO: 394391 - DNA, 20 bp, Artificial Sequence
  chemically synthesized
tatttttacttcccttttta

SEQ ID NO: 394392 - DNA, 20 bp, Artificial Sequence
  chemically synthesized
ttccctatctataaaaaggg

SEQ ID NO: 394393 - DNA, 20 bp, Artificial Sequence
  chemically synthesized
tataaaaagggaagtaaaaa

SEQ ID NO: 394394 - DNA, 20 bp, Artificial Sequence
  chemically synthesized
taaaaatagtatcttctact

SEQ ID NO: 394395 - DNA, 20 bp, Artificial Sequence
  chemically synthesized
aaaaatagtatcttctactt

SEQ ID NO: 394396 - DNA, 20 bp, Artificial Sequence
  chemically synthesized
cacataactatcctaagtag

SEQ ID NO: 394397 - DNA, 20 bp, Artificial Sequence
  chemically synthesized
atagtatcttctacttagga

SEQ ID NO: 394398 - DNA, 20 bp, Artificial Sequence
  chemically synthesized
tagcacataactatcctaag

SEQ ID NO: 394399 - DNA, 20 bp, Artificial Sequence
  chemically synthesized
ttatagcacataactatcct

SEQ ID NO: 394400 - DNA, 20 bp, Artificial Sequence
  chemically synthesized
aataagggcttcacatatta

SEQ ID NO: 394401 - DNA, 20 bp, Artificial Sequence
  chemically synthesized
gttatgtgctataatatgtg

SEQ ID NO: 394402 - DNA, 20 bp, Artificial Sequence
  chemically synthesized
aatatgtgaagcccttattt

SEQ ID NO: 394403 - DNA, 20 bp, Artificial Sequence
  chemically synthesized
tatgcttggctctgaaataa

SEQ ID NO: 394404 - DNA, 20 bp, Artificial Sequence
  chemically synthesized
tatgtgaagcccttatttca

SEQ ID NO: 394405 - DNA, 20 bp, Artificial Sequence
  chemically synthesized
atatgcttggctctgaaata

SEQ ID NO: 394406 - DNA, 20 bp, Artificial Sequence
  chemically synthesized
tatatgcttggctctgaaat

SEQ ID NO: 394407 - DNA, 20 bp, Artificial Sequence
  chemically synthesized
gaagcccttatttcagagcc

SEQ ID NO: 394408 - DNA, 20 bp, Artificial Sequence
  chemically synthesized
ttatttcagagccaagcata

SEQ ID NO: 394409 - DNA, 20 bp, Artificial Sequence
  chemically synthesized
ggaagtgcttactatatgct

SEQ ID NO: 394410 - DNA, 20 bp, Artificial Sequence
  chemically synthesized
ttcagagccaagcatatagt

SEQ ID NO: 394411 - DNA, 20 bp, Artificial Sequence
  chemically synthesized
ataataattaatatttatgg

SEQ ID NO: 394412 - DNA, 20 bp, Artificial Sequence
  chemically synthesized
ataataataattaatattta

SEQ ID NO: 394413 - DNA, 20 bp, Artificial Sequence
  chemically synthesized
ttaattattattattactca

SEQ ID NO: 394414 - DNA, 20 bp, Artificial Sequence
  chemically synthesized
gggaatcaattatgttccat

SEQ ID NO: 394415 - DNA, 20 bp, Artificial Sequence
  chemically synthesized
ggaacataattgattcccat

SEQ ID NO: 394416 - DNA, 20 bp, Artificial Sequence
  chemically synthesized
ttactcctacaaattctaat

SEQ ID NO: 394417 - DNA, 20 bp, Artificial Sequence
  chemically synthesized
cttactcctacaaattctaa

SEQ ID NO: 394418 - DNA, 20 bp, Artificial Sequence
  chemically synthesized
ttgattcccattagaatttg

SEQ ID NO: 394419 - DNA, 20 bp, Artificial Sequence
  chemically synthesized
tgattcccattagaatttgt

SEQ ID NO: 394420 - DNA, 20 bp, Artificial Sequence
  chemically synthesized
attcccattagaatttgtag

SEQ ID NO: 394421 - DNA, 20 bp, Artificial Sequence
  chemically synthesized
ccattagaatttgtaggagt

SEQ ID NO: 394422 - DNA, 20 bp, Artificial Sequence
  chemically synthesized
cattagaatttgtaggagta

SEQ ID NO: 394423 - DNA, 20 bp, Artificial Sequence
  chemically synthesized
ttagaatttgtaggagtaag

SEQ ID NO: 394424 - DNA, 20 bp, Artificial Sequence
  chemically synthesized
tagaatttgtaggagtaagg

SEQ ID NO: 394425 - DNA, 20 bp, Artificial Sequence
  chemically synthesized
ctctgaacaaagtagattta

SEQ ID NO: 394426 - DNA, 20 bp, Artificial Sequence
  chemically synthesized
cactttaaatctactttgtt

SEQ ID NO: 394427 - DNA, 20 bp, Artificial Sequence
  chemically synthesized
agaagcagctctgaacaaag

SEQ ID NO: 394428 - DNA, 20 bp, Artificial Sequence
  chemically synthesized
ctttaaatctactttgttca

SEQ ID NO: 394429 - DNA, 20 bp, Artificial Sequence
  chemically synthesized
gcgagaagcagctctgaaca

SEQ ID NO: 394430 - DNA, 20 bp, Artificial Sequence
  chemically synthesized
aaaaggtttccagcgagaag

SEQ ID NO: 394431 - DNA, 20 bp, Artificial Sequence
  chemically synthesized
tgttcagagctgcttctcgc

SEQ ID NO: 394432 - DNA, 20 bp, Artificial Sequence
  chemically synthesized
cttaaaaggtttccagcgag

SEQ ID NO: 394433 - DNA, 20 bp, Artificial Sequence
  chemically synthesized
ctacttaaaaggtttccagc

SEQ ID NO: 394434 - DNA, 20 bp, Artificial Sequence
  chemically synthesized
aacactacttaaaaggtttc

SEQ ID NO: 394435 - DNA, 20 bp, Artificial Sequence
  chemically synthesized
cttctcgctggaaacctttt

SEQ ID NO: 394436 - DNA, 20 bp, Artificial Sequence
  chemically synthesized
ctcgctggaaaccttttaag

SEQ ID NO: 394437 - DNA, 20 bp, Artificial Sequence
  chemically synthesized
tgatacaaacactacttaaa

SEQ ID NO: 394438 - DNA, 20 bp, Artificial Sequence
  chemically synthesized
gtgatacaaacactacttaa

SEQ ID NO: 394439 - DNA, 20 bp, Artificial Sequence
  chemically synthesized
gtttgtatcaccttttctcc

SEQ ID NO: 394440 - DNA, 20 bp, Artificial Sequence
  chemically synthesized
tatgtaagtgctaggagaaa

SEQ ID NO: 394441 - DNA, 20 bp, Artificial Sequence
  chemically synthesized
ctatgtaagtgctaggagaa

SEQ ID NO: 394442 - DNA, 20 bp, Artificial Sequence
  chemically synthesized
gtacactatgtaagtgctag

SEQ ID NO: 394443 - DNA, 20 bp, Artificial Sequence
  chemically synthesized
cagtacactatgtaagtgct

SEQ ID NO: 394444 - DNA, 20 bp, Artificial Sequence
  chemically synthesized
gcagtacactatgtaagtgc

SEQ ID NO: 394445 - DNA, 20 bp, Artificial Sequence
  chemically synthesized
cttttctcctagcacttaca

SEQ ID NO: 394446 - DNA, 20 bp, Artificial Sequence
  chemically synthesized
acacaagcagtacactatgt

SEQ ID NO: 394447 - DNA, 20 bp, Artificial Sequence
  chemically synthesized
catggagttaattacacaag

SEQ ID NO: 394448 - DNA, 20 bp, Artificial Sequence
  chemically synthesized
atccatggagttaattacac

SEQ ID NO: 394449 - DNA, 20 bp, Artificial Sequence
  chemically synthesized
tgcttgtgtaattaactcca

SEQ ID NO: 394450 - DNA, 20 bp, Artificial Sequence
  chemically synthesized
aggatatttctttatccatg

SEQ ID NO: 394451 - DNA, 20 bp, Artificial Sequence
  chemically synthesized
tgtaattaactccatggata

SEQ ID NO: 394452 - DNA, 20 bp, Artificial Sequence
  chemically synthesized
gaaggatatttctttatcca

SEQ ID NO: 394453 - DNA, 20 bp, Artificial Sequence
  chemically synthesized
agctagtaaatggaagggga

SEQ ID NO: 394454 - DNA, 20 bp, Artificial Sequence
  chemically synthesized
aagctagtaaatggaagggg

SEQ ID NO: 394455 - DNA, 20 bp, Artificial Sequence
  chemically synthesized
aaaaagctagtaaatggaag

SEQ ID NO: 394456 - DNA, 20 bp, Artificial Sequence
  chemically synthesized
taaaaagctagtaaatggaa

SEQ ID NO: 394457 - DNA, 20 bp, Artificial Sequence
  chemically synthesized
ttaaaaagctagtaaatgga

SEQ ID NO: 394458 - DNA, 20 bp, Artificial Sequence
  chemically synthesized
attaaaaagctagtaaatgg

SEQ ID NO: 394459 - DNA, 20 bp, Artificial Sequence
  chemically synthesized
atccttccccttccatttac

SEQ ID NO: 394460 - DNA, 20 bp, Artificial Sequence
  chemically synthesized
actattaaaaagctagtaaa

SEQ ID NO: 394461 - DNA, 20 bp, Artificial Sequence
  chemically synthesized
aagctgcactattaaaaagc

SEQ ID NO: 394462 - DNA, 20 bp, Artificial Sequence
  chemically synthesized
tccatttactagctttttaa

SEQ ID NO: 394463 - DNA, 20 bp, Artificial Sequence
  chemically synthesized
cctgaagctgcactattaaa

SEQ ID NO: 394464 - DNA, 20 bp, Artificial Sequence
  chemically synthesized
ttactagctttttaatagtg

SEQ ID NO: 394465 - DNA, 20 bp, Artificial Sequence
  chemically synthesized
gctttttaatagtgcagctt

SEQ ID NO: 394466 - DNA, 20 bp, Artificial Sequence
  chemically synthesized
ctttttaatagtgcagcttc

SEQ ID NO: 394467 - DNA, 20 bp, Artificial Sequence
  chemically synthesized
tatttctagtggaagacctg

SEQ ID NO: 394468 - DNA, 20 bp, Artificial Sequence
  chemically synthesized
tgcagcttcaggtcttccac

SEQ ID NO: 394469 - DNA, 20 bp, Artificial Sequence
  chemically synthesized
aattctaatatttctagtgg

SEQ ID NO: 394470 - DNA, 20 bp, Artificial Sequence
  chemically synthesized
gacaattctaatatttctag

SEQ ID NO: 394471 - DNA, 20 bp, Artificial Sequence
  chemically synthesized
aggtcttccactagaaatat

SEQ ID NO: 394472 - DNA, 20 bp, Artificial Sequence
  chemically synthesized
agtgacaattctaatatttc

SEQ ID NO: 394473 - DNA, 20 bp, Artificial Sequence
  chemically synthesized
atatcgggaggttgaaaatt

SEQ ID NO: 394474 - DNA, 20 bp, Artificial Sequence
  chemically synthesized
tctttcaattaaatatcggg

SEQ ID NO: 394475 - DNA, 20 bp, Artificial Sequence
  chemically synthesized
atctttcaattaaatatcgg

SEQ ID NO: 394476 - DNA, 20 bp, Artificial Sequence
  chemically synthesized
acatctttcaattaaatatc

SEQ ID NO: 394477 - DNA, 20 bp, Artificial Sequence
  chemically synthesized
tacatctttcaattaaatat

SEQ ID NO: 394478 - DNA, 20 bp, Artificial Sequence
  chemically synthesized
acctcccgatatttaattga

SEQ ID NO: 394479 - DNA, 20 bp, Artificial Sequence
  chemically synthesized
agatgtacaatataatttaa

SEQ ID NO: 394480 - DNA, 20 bp, Artificial Sequence
  chemically synthesized
gatgtacaatataatttaaa

SEQ ID NO: 394481 - DNA, 20 bp, Artificial Sequence
  chemically synthesized
atttaaaaggtacctaccca

SEQ ID NO: 394482 - DNA, 20 bp, Artificial Sequence
  chemically synthesized
tttaaaaggtacctacccat

SEQ ID NO: 394483 - DNA, 20 bp, Artificial Sequence
  chemically synthesized
ttaaaaggtacctacccata

SEQ ID NO: 394484 - DNA, 20 bp, Artificial Sequence
  chemically synthesized
gaattagttgccctatgggt

SEQ ID NO: 394485 - DNA, 20 bp, Artificial Sequence
  chemically synthesized
agaattagttgccctatggg

SEQ ID NO: 394486 - DNA, 20 bp, Artificial Sequence
  chemically synthesized
ttcagaattagttgccctat

SEQ ID NO: 394487 - DNA, 20 bp, Artificial Sequence
  chemically synthesized
tttcagaattagttgcccta

SEQ ID NO: 394488 - DNA, 20 bp, Artificial Sequence
  chemically synthesized
ttatcacccgttttcagaat

SEQ ID NO: 394489 - DNA, 20 bp, Artificial Sequence
  chemically synthesized
agggcaactaattctgaaaa

SEQ ID NO: 394490 - DNA, 20 bp, Artificial Sequence
  chemically synthesized
gggcaactaattctgaaaac

SEQ ID NO: 394491 - DNA, 20 bp, Artificial Sequence
  chemically synthesized
attcacttatcacccgtttt

SEQ ID NO: 394492 - DNA, 20 bp, Artificial Sequence
  chemically synthesized
taattctgaaaacgggtgat

SEQ ID NO: 394493 - DNA, 20 bp, Artificial Sequence
  chemically synthesized
aaacgggtgataagtgaata

SEQ ID NO: 394494 - DNA, 20 bp, Artificial Sequence
  chemically synthesized
aacgggtgataagtgaataa

SEQ ID NO: 394495 - DNA, 20 bp, Artificial Sequence
  chemically synthesized
gggtgataagtgaataaagg

SEQ ID NO: 394496 - DNA, 20 bp, Artificial Sequence
  chemically synthesized
gaaagcatgaaaatgaaatt

SEQ ID NO: 394497 - DNA, 20 bp, Artificial Sequence
  chemically synthesized
atttcattttcatgctttcg

SEQ ID NO: 394498 - DNA, 20 bp, Artificial Sequence
  chemically synthesized
atataagatagaaactgcga

SEQ ID NO: 394499 - DNA, 20 bp, Artificial Sequence
  chemically synthesized
atttctttatcaatataaga

SEQ ID NO: 394500 - DNA, 20 bp, Artificial Sequence
  chemically synthesized
taggatttctttatcaatat

SEQ ID NO: 394501 - DNA, 20 bp, Artificial Sequence
  chemically synthesized
gtttctatcttatattgata

SEQ ID NO: 394502 - DNA, 20 bp, Artificial Sequence
  chemically synthesized
tatattgataaagaaatcct

SEQ ID NO: 394503 - DNA, 20 bp, Artificial Sequence
  chemically synthesized
cttatacagatgtagagctt

SEQ ID NO: 394504 - DNA, 20 bp, Artificial Sequence
  chemically synthesized
tcttatacagatgtagagct

SEQ ID NO: 394505 - DNA, 20 bp, Artificial Sequence
  chemically synthesized
tacattcttatacagatgta

SEQ ID NO: 394506 - DNA, 20 bp, Artificial Sequence
  chemically synthesized
gatacattcttatacagatg

SEQ ID NO: 394507 - DNA, 20 bp, Artificial Sequence
  chemically synthesized
cctaagctctacatctgtat

SEQ ID NO: 394508 - DNA, 20 bp, Artificial Sequence
  chemically synthesized
aaggatgatacattcttata

SEQ ID NO: 394509 - DNA, 20 bp, Artificial Sequence
  chemically synthesized
atagatacaagtatattgaa

SEQ ID NO: 394510 - DNA, 20 bp, Artificial Sequence
  chemically synthesized
tatagatacaagtatattga

SEQ ID NO: 394511 - DNA, 20 bp, Artificial Sequence
  chemically synthesized
tctgcattttatatagatac

SEQ ID NO: 394512 - DNA, 20 bp, Artificial Sequence
  chemically synthesized
atacacatctgcattttata

SEQ ID NO: 394513 - DNA, 20 bp, Artificial Sequence
  chemically synthesized
acttgtatctatataaaatg

SEQ ID NO: 394514 - DNA, 20 bp, Artificial Sequence
  chemically synthesized
gcatgtgtgtatgcacacac

SEQ ID NO: 394515 - DNA, 20 bp, Artificial Sequence
  chemically synthesized
tgtgtgcatacacacatgca

SEQ ID NO: 394516 - DNA, 20 bp, Artificial Sequence
  chemically synthesized
catacacacatgcacagcta

SEQ ID NO: 394517 - DNA, 20 bp, Artificial Sequence
  chemically synthesized
acatgcacagctatagaata

SEQ ID NO: 394518 - DNA, 20 bp, Artificial Sequence
  chemically synthesized
attaaaatatctatattcta

SEQ ID NO: 394519 - DNA, 20 bp, Artificial Sequence
  chemically synthesized
agaatatagatattttaatt

SEQ ID NO: 394520 - DNA, 20 bp, Artificial Sequence
  chemically synthesized
tattttaatttagataattt

SEQ ID NO: 394521 - DNA, 20 bp, Artificial Sequence
  chemically synthesized
attttaatttagataatttt

SEQ ID NO: 394522 - DNA, 20 bp, Artificial Sequence
  chemically synthesized
tatgtgattcattttatgta

SEQ ID NO: 394523 - DNA, 20 bp, Artificial Sequence
  chemically synthesized
cattggggaaaacatcataa

SEQ ID NO: 394524 - DNA, 20 bp, Artificial Sequence
  chemically synthesized
tatgatgttttccccaatgc

SEQ ID NO: 394525 - DNA, 20 bp, Artificial Sequence
  chemically synthesized
gaaaatattatcttgcattg

SEQ ID NO: 394526 - DNA, 20 bp, Artificial Sequence
  chemically synthesized
agaaaatattatcttgcatt

SEQ ID NO: 394527 - DNA, 20 bp, Artificial Sequence
  chemically synthesized
tagaaaatattatcttgcat

SEQ ID NO: 394528 - DNA, 20 bp, Artificial Sequence
  chemically synthesized
aatgcaagataatattttct

SEQ ID NO: 394529 - DNA, 20 bp, Artificial Sequence
  chemically synthesized
gataatattttctaagattt

SEQ ID NO: 394530 - DNA, 20 bp, Artificial Sequence
  chemically synthesized
acatcttatgtctaaaatct

SEQ ID NO: 394531 - DNA, 20 bp, Artificial Sequence
  chemically synthesized
ttttctaagattttagacat

SEQ ID NO: 394532 - DNA, 20 bp, Artificial Sequence
  chemically synthesized
tggaaacttggtaagtttta

SEQ ID NO: 394533 - DNA, 20 bp, Artificial Sequence
  chemically synthesized
aatggaaacttggtaagttt

SEQ ID NO: 394534 - DNA, 20 bp, Artificial Sequence
  chemically synthesized
aatgcactctaaaacttacc

SEQ ID NO: 394535 - DNA, 20 bp, Artificial Sequence
  chemically synthesized
cttgtaaatggaaacttggt

SEQ ID NO: 394536 - DNA, 20 bp, Artificial Sequence
  chemically synthesized
ttcccttgtaaatggaaact

SEQ ID NO: 394537 - DNA, 20 bp, Artificial Sequence
  chemically synthesized
cttaccaagtttccatttac

SEQ ID NO: 394538 - DNA, 20 bp, Artificial Sequence
  chemically synthesized
ttaccaagtttccatttaca

SEQ ID NO: 394539 - DNA, 20 bp, Artificial Sequence
  chemically synthesized
taccaagtttccatttacaa

SEQ ID NO: 394540 - DNA, 20 bp, Artificial Sequence
  chemically synthesized
taatcgttttcccttgtaaa

SEQ ID NO: 394541 - DNA, 20 bp, Artificial Sequence
  chemically synthesized
ctcttaactatagcaatttg

SEQ ID NO: 394542 - DNA, 20 bp, Artificial Sequence
  chemically synthesized
attaaaaccacaaattgcta

SEQ ID NO: 394543 - DNA, 20 bp, Artificial Sequence
  chemically synthesized
aaccacaaattgctatagtt

SEQ ID NO: 394544 - DNA, 20 bp, Artificial Sequence
  chemically synthesized
ccacaaattgctatagttaa

SEQ ID NO: 394545 - DNA, 20 bp, Artificial Sequence
  chemically synthesized
taatcccaaactcttaacta

SEQ ID NO: 394546 - DNA, 20 bp, Artificial Sequence
  chemically synthesized
aattgctatagttaagagtt

SEQ ID NO: 394547 - DNA, 20 bp, Artificial Sequence
  chemically synthesized
attgctatagttaagagttt

SEQ ID NO: 394548 - DNA, 20 bp, Artificial Sequence
  chemically synthesized
ttttattttattttacaaat

SEQ ID NO: 394549 - DNA, 20 bp, Artificial Sequence
  chemically synthesized
ttattttattttacaaatga

SEQ ID NO: 394550 - DNA, 20 bp, Artificial Sequence
  chemically synthesized
catgtgttatggtaggtatt

SEQ ID NO: 394551 - DNA, 20 bp, Artificial Sequence
  chemically synthesized
atgtatgcatgtgttatggt

SEQ ID NO: 394552 - DNA, 20 bp, Artificial Sequence
  chemically synthesized
gatgtatgcatgtgttatgg

SEQ ID NO: 394553 - DNA, 20 bp, Artificial Sequence
  chemically synthesized
acagatgtatgcatgtgtta

SEQ ID NO: 394554 - DNA, 20 bp, Artificial Sequence
  chemically synthesized
taacacatgcatacatctgt

SEQ ID NO: 394555 - DNA, 20 bp, Artificial Sequence
  chemically synthesized
atatgattttttttttctga

SEQ ID NO: 394556 - DNA, 20 bp, Artificial Sequence
  chemically synthesized
cagaaaaaaaaaatcatatt

SEQ ID NO: 394557 - DNA, 20 bp, Artificial Sequence
  chemically synthesized
aaaaatcatatttagaatcc

SEQ ID NO: 394558 - DNA, 20 bp, Artificial Sequence
  chemically synthesized
aggttctccgggagtaaact

SEQ ID NO: 394559 - DNA, 20 bp, Artificial Sequence
  chemically synthesized
ttagaatccaagtttactcc

SEQ ID NO: 394560 - DNA, 20 bp, Artificial Sequence
  chemically synthesized
agaatccaagtttactcccg

SEQ ID NO: 394561 - DNA, 20 bp, Artificial Sequence
  chemically synthesized
aataggttaaggttctccgg

SEQ ID NO: 394562 - DNA, 20 bp, Artificial Sequence
  chemically synthesized
gaaataggttaaggttctcc

SEQ ID NO: 394563 - DNA, 20 bp, Artificial Sequence
  chemically synthesized
tgaaataggttaaggttctc

SEQ ID NO: 394564 - DNA, 20 bp, Artificial Sequence
  chemically synthesized
gatgtttttgaaataggtta

SEQ ID NO: 394565 - DNA, 20 bp, Artificial Sequence
  chemically synthesized
agatgtttttgaaataggtt

SEQ ID NO: 394566 - DNA, 20 bp, Artificial Sequence
  chemically synthesized
cccaaagatgtttttgaaat

SEQ ID NO: 394567 - DNA, 20 bp, Artificial Sequence
  chemically synthesized
tcccaaagatgtttttgaaa

SEQ ID NO: 394568 - DNA, 20 bp, Artificial Sequence
  chemically synthesized
acctatttcaaaaacatctt

SEQ ID NO: 394569 - DNA, 20 bp, Artificial Sequence
  chemically synthesized
cctatttcaaaaacatcttt

SEQ ID NO: 394570 - DNA, 20 bp, Artificial Sequence
  chemically synthesized
atttcaaaaacatctttggg

SEQ ID NO: 394571 - DNA, 20 bp, Artificial Sequence
  chemically synthesized
aaattcctgacatcttccca

SEQ ID NO: 394572 - DNA, 20 bp, Artificial Sequence
  chemically synthesized
aaacatctttgggaagatgt

SEQ ID NO: 394573 - DNA, 20 bp, Artificial Sequence
  chemically synthesized
aacatctttgggaagatgtc

SEQ ID NO: 394574 - DNA, 20 bp, Artificial Sequence
  chemically synthesized
ctcaaatcagaagagtgtaa

SEQ ID NO: 394575 - DNA, 20 bp, Artificial Sequence
  chemically synthesized
ttctttgactcaaatcagaa

SEQ ID NO: 394576 - DNA, 20 bp, Artificial Sequence
  chemically synthesized
ctattacactcttctgattt

SEQ ID NO: 394577 - DNA, 20 bp, Artificial Sequence
  chemically synthesized
ttttctttgactcaaatcag

SEQ ID NO: 394578 - DNA, 20 bp, Artificial Sequence
  chemically synthesized
ttattttctttgactcaaat

SEQ ID NO: 394579 - DNA, 20 bp, Artificial Sequence
  chemically synthesized
cactcttctgatttgagtca

SEQ ID NO: 394580 - DNA, 20 bp, Artificial Sequence
  chemically synthesized
gaaaataattttcaacataa

SEQ ID NO: 394581 - DNA, 20 bp, Artificial Sequence
  chemically synthesized
aaaataattttcaacataat

SEQ ID NO: 394582 - DNA, 20 bp, Artificial Sequence
  chemically synthesized
taattttcaacataatagga

SEQ ID NO: 394583 - DNA, 20 bp, Artificial Sequence
  chemically synthesized
ttcaacataataggacagcc

SEQ ID NO: 394584 - DNA, 20 bp, Artificial Sequence
  chemically synthesized
tcaacataataggacagccc

SEQ ID NO: 394585 - DNA, 20 bp, Artificial Sequence
  chemically synthesized
caacataataggacagccca

SEQ ID NO: 394586 - DNA, 20 bp, Artificial Sequence
  chemically synthesized
acataataggacagcccagg

SEQ ID NO: 394587 - DNA, 20 bp, Artificial Sequence
  chemically synthesized
cataataggacagcccaggg

SEQ ID NO: 394588 - DNA, 20 bp, Artificial Sequence
  chemically synthesized
tggctgaaactcgcctccct

SEQ ID NO: 394589 - DNA, 20 bp, Artificial Sequence
  chemically synthesized
ataggacagcccagggaggc

SEQ ID NO: 394590 - DNA, 20 bp, Artificial Sequence
  chemically synthesized
ctggctgaaactcgcctccc

SEQ ID NO: 394591 - DNA, 20 bp, Artificial Sequence
  chemically synthesized
cagcccagggaggcgagttt

SEQ ID NO: 394592 - DNA, 20 bp, Artificial Sequence
  chemically synthesized
ccagggaggcgagtttcagc

SEQ ID NO: 394593 - DNA, 20 bp, Artificial Sequence
  chemically synthesized
cgagtttcagccagttgctg

SEQ ID NO: 394594 - DNA, 20 bp, Artificial Sequence
  chemically synthesized
tctggtttttccacagcaac

SEQ ID NO: 394595 - DNA, 20 bp, Artificial Sequence
  chemically synthesized
gactgcctctggtttttcca

SEQ ID NO: 394596 - DNA, 20 bp, Artificial Sequence
  chemically synthesized
gccagttgctgtggaaaaac

SEQ ID NO: 394597 - DNA, 20 bp, Artificial Sequence
  chemically synthesized
cagttgctgtggaaaaacca

SEQ ID NO: 394598 - DNA, 20 bp, Artificial Sequence
  chemically synthesized
agttgctgtggaaaaaccag

SEQ ID NO: 394599 - DNA, 20 bp, Artificial Sequence
  chemically synthesized
tgctgtggaaaaaccagagg

SEQ ID NO: 394600 - DNA, 20 bp, Artificial Sequence
  chemically synthesized
tgcatgacagcgactgcctc

SEQ ID NO: 394601 - DNA, 20 bp, Artificial Sequence
  chemically synthesized
cagaggcagtcgctgtcatg

SEQ ID NO: 394602 - DNA, 20 bp, Artificial Sequence
  chemically synthesized
tggtgttggcagctgcatga

SEQ ID NO: 394603 - DNA, 20 bp, Artificial Sequence
  chemically synthesized
gcccccaactgtggtgttgg

SEQ ID NO: 394604 - DNA, 20 bp, Artificial Sequence
  chemically synthesized
tcatgcagctgccaacacca

SEQ ID NO: 394605 - DNA, 20 bp, Artificial Sequence
  chemically synthesized
aaggcccccaactgtggtgt

SEQ ID NO: 394606 - DNA, 20 bp, Artificial Sequence
  chemically synthesized
gcagctgccaacaccacagt

SEQ ID NO: 394607 - DNA, 20 bp, Artificial Sequence
  chemically synthesized
cagctgccaacaccacagtt

SEQ ID NO: 394608 - DNA, 20 bp, Artificial Sequence
  chemically synthesized
agctgccaacaccacagttg

SEQ ID NO: 394609 - DNA, 20 bp, Artificial Sequence
  chemically synthesized
gctgccaacaccacagttgg

SEQ ID NO: 394610 - DNA, 20 bp, Artificial Sequence
  chemically synthesized
cttggcaaggcccccaactg

SEQ ID NO: 394611 - DNA, 20 bp, Artificial Sequence
  chemically synthesized
ccacagttgggggccttgcc

SEQ ID NO: 394612 - DNA, 20 bp, Artificial Sequence
  chemically synthesized
cagttgggggccttgccaag

SEQ ID NO: 394613 - DNA, 20 bp, Artificial Sequence
  chemically synthesized
tggcatctgtctacttggca

SEQ ID NO: 394614 - DNA, 20 bp, Artificial Sequence
  chemically synthesized
ttggcatctgtctacttggc

SEQ ID NO: 394615 - DNA, 20 bp, Artificial Sequence
  chemically synthesized
tgggggccttgccaagtaga

SEQ ID NO: 394616 - DNA, 20 bp, Artificial Sequence
  chemically synthesized
tgttttggcatctgtctact

SEQ ID NO: 394617 - DNA, 20 bp, Artificial Sequence
  chemically synthesized
caagtagacagatgccaaaa

SEQ ID NO: 394618 - DNA, 20 bp, Artificial Sequence
  chemically synthesized
ataagctattttttctgttt

SEQ ID NO: 394619 - DNA, 20 bp, Artificial Sequence
  chemically synthesized
agatgccaaaacagaaaaaa

SEQ ID NO: 394620 - DNA, 20 bp, Artificial Sequence
  chemically synthesized
tttcaacaattaattggaat

SEQ ID NO: 394621 - DNA, 20 bp, Artificial Sequence
  chemically synthesized
tataggtttcaacaattaat

SEQ ID NO: 394622 - DNA, 20 bp, Artificial Sequence
  chemically synthesized
attaattgttgaaacctata

SEQ ID NO: 394623 - DNA, 20 bp, Artificial Sequence
  chemically synthesized
ttaattgttgaaacctataa

SEQ ID NO: 394624 - DNA, 20 bp, Artificial Sequence
  chemically synthesized
atgaagtgttttacctttat

SEQ ID NO: 394625 - DNA, 20 bp, Artificial Sequence
  chemically synthesized
catgaagtgttttaccttta

SEQ ID NO: 394626 - DNA, 20 bp, Artificial Sequence
  chemically synthesized
aaggtaaaacacttcatgtg

SEQ ID NO: 394627 - DNA, 20 bp, Artificial Sequence
  chemically synthesized
aggtaaaacacttcatgtgt

SEQ ID NO: 394628 - DNA, 20 bp, Artificial Sequence
  chemically synthesized
tgtagtcaggcccacacatg

SEQ ID NO: 394629 - DNA, 20 bp, Artificial Sequence
  chemically synthesized
ttcatgtgtgggcctgacta

SEQ ID NO: 394630 - DNA, 20 bp, Artificial Sequence
  chemically synthesized
gacaaagcagttctgtagtc

SEQ ID NO: 394631 - DNA, 20 bp, Artificial Sequence
  chemically synthesized
ggacaaagcagttctgtagt

SEQ ID NO: 394632 - DNA, 20 bp, Artificial Sequence
  chemically synthesized
tgggggacaaagcagttctg

SEQ ID NO: 394633 - DNA, 20 bp, Artificial Sequence
  chemically synthesized
gatgcctttgggggacaaag

SEQ ID NO: 394634 - DNA, 20 bp, Artificial Sequence
  chemically synthesized
cacgatgcctttgggggaca

SEQ ID NO: 394635 - DNA, 20 bp, Artificial Sequence
  chemically synthesized
cagaactgctttgtccccca

SEQ ID NO: 394636 - DNA, 20 bp, Artificial Sequence
  chemically synthesized
agaactgctttgtcccccaa

SEQ ID NO: 394637 - DNA, 20 bp, Artificial Sequence
  chemically synthesized
caaatacacgatgcctttgg

SEQ ID NO: 394638 - DNA, 20 bp, Artificial Sequence
  chemically synthesized
gcaaatacacgatgcctttg

SEQ ID NO: 394639 - DNA, 20 bp, Artificial Sequence
  chemically synthesized
agcaaatacacgatgccttt

SEQ ID NO: 394640 - DNA, 20 bp, Artificial Sequence
  chemically synthesized
aagcaaatacacgatgcctt

SEQ ID NO: 394641 - DNA, 20 bp, Artificial Sequence
  chemically synthesized
cgtgtatttgcttttcattg

SEQ ID NO: 394642 - DNA, 20 bp, Artificial Sequence
  chemically synthesized
ctagcaacccccacaatgaa

SEQ ID NO: 394643 - DNA, 20 bp, Artificial Sequence
  chemically synthesized
gtgtatttgcttttcattgt

SEQ ID NO: 394644 - DNA, 20 bp, Artificial Sequence
  chemically synthesized
tgtatttgcttttcattgtg

SEQ ID NO: 394645 - DNA, 20 bp, Artificial Sequence
  chemically synthesized
gtatttgcttttcattgtgg

SEQ ID NO: 394646 - DNA, 20 bp, Artificial Sequence
  chemically synthesized
cttttcattgtgggggttgc

SEQ ID NO: 394647 - DNA, 20 bp, Artificial Sequence
  chemically synthesized
tgtgggggttgctagaaaca

SEQ ID NO: 394648 - DNA, 20 bp, Artificial Sequence
  chemically synthesized
taatattatttctatgtttc

SEQ ID NO: 394649 - DNA, 20 bp, Artificial Sequence
  chemically synthesized
acatagaaataatattatta

SEQ ID NO: 394650 - DNA, 20 bp, Artificial Sequence
  chemically synthesized
gaaataatattattaaagta

SEQ ID NO: 394651 - DNA, 20 bp, Artificial Sequence
  chemically synthesized
ataatattattaaagtatag

SEQ ID NO: 394652 - DNA, 20 bp, Artificial Sequence
  chemically synthesized
ttaaagtatagaagatgtcc

SEQ ID NO: 394653 - DNA, 20 bp, Artificial Sequence
  chemically synthesized
taaagtatagaagatgtcca

SEQ ID NO: 394654 - DNA, 20 bp, Artificial Sequence
  chemically synthesized
gaggaaagatgcatgttcct

SEQ ID NO: 394655 - DNA, 20 bp, Artificial Sequence
  chemically synthesized
aggaacatgcatctttcctc

SEQ ID NO: 394656 - DNA, 20 bp, Artificial Sequence
  chemically synthesized
aattattctttgctagagga

SEQ ID NO: 394657 - DNA, 20 bp, Artificial Sequence
  chemically synthesized
catgcatctttcctctagca

SEQ ID NO: 394658 - DNA, 20 bp, Artificial Sequence
  chemically synthesized
tttaaattattctttgctag

SEQ ID NO: 394659 - DNA, 20 bp, Artificial Sequence
  chemically synthesized
ttttaaattattctttgcta

SEQ ID NO: 394660 - DNA, 20 bp, Artificial Sequence
  chemically synthesized
aattttaaattattctttgc

SEQ ID NO: 394661 - DNA, 20 bp, Artificial Sequence
  chemically synthesized
gaataatttaaaattaaaat

SEQ ID NO: 394662 - DNA, 20 bp, Artificial Sequence
  chemically synthesized
tcgcaatttagaaaagtaat

SEQ ID NO: 394663 - DNA, 20 bp, Artificial Sequence
  chemically synthesized
agagaagtcgcaatttagaa

SEQ ID NO: 394664 - DNA, 20 bp, Artificial Sequence
  chemically synthesized
catggagagaagtcgcaatt

SEQ ID NO: 394665 - DNA, 20 bp, Artificial Sequence
  chemically synthesized
ggaaagtgaggcatggagag

SEQ ID NO: 394666 - DNA, 20 bp, Artificial Sequence
  chemically synthesized
gagggaaagtgaggcatgga

SEQ ID NO: 394667 - DNA, 20 bp, Artificial Sequence
  chemically synthesized
gagagggaaagtgaggcatg

SEQ ID NO: 394668 - DNA, 20 bp, Artificial Sequence
  chemically synthesized
cagagagggaaagtgaggca

SEQ ID NO: 394669 - DNA, 20 bp, Artificial Sequence
  chemically synthesized
ttttacagagagggaaagtg

SEQ ID NO: 394670 - DNA, 20 bp, Artificial Sequence
  chemically synthesized
attttacagagagggaaagt

SEQ ID NO: 394671 - DNA, 20 bp, Artificial Sequence
  chemically synthesized
ctccattttacagagaggga

SEQ ID NO: 394672 - DNA, 20 bp, Artificial Sequence
  chemically synthesized
ttatctccattttacagaga

SEQ ID NO: 394673 - DNA, 20 bp, Artificial Sequence
  chemically synthesized
attatctccattttacagag

SEQ ID NO: 394674 - DNA, 20 bp, Artificial Sequence
  chemically synthesized
tattatctccattttacaga

SEQ ID NO: 394675 - DNA, 20 bp, Artificial Sequence
  chemically synthesized
cactttccctctctgtaaaa

SEQ ID NO: 394676 - DNA, 20 bp, Artificial Sequence
  chemically synthesized
gctattatctccattttaca

SEQ ID NO: 394677 - DNA, 20 bp, Artificial Sequence
  chemically synthesized
ctttccctctctgtaaaatg

SEQ ID NO: 394678 - DNA, 20 bp, Artificial Sequence
  chemically synthesized
atgctattatctccatttta

SEQ ID NO: 394679 - DNA, 20 bp, Artificial Sequence
  chemically synthesized
tctctgtaaaatggagataa

SEQ ID NO: 394680 - DNA, 20 bp, Artificial Sequence
  chemically synthesized
cacttttctcattaaaatag

SEQ ID NO: 394681 - DNA, 20 bp, Artificial Sequence
  chemically synthesized
catcacactgctattttaat

SEQ ID NO: 394682 - DNA, 20 bp, Artificial Sequence
  chemically synthesized
tttcacttttctcattaaaa

SEQ ID NO: 394683 - DNA, 20 bp, Artificial Sequence
  chemically synthesized
cactgctattttaatgagaa

SEQ ID NO: 394684 - DNA, 20 bp, Artificial Sequence
  chemically synthesized
aatacatgtgatgtacttaa

SEQ ID NO: 394685 - DNA, 20 bp, Artificial Sequence
  chemically synthesized
gctaactacttggcaccatt

SEQ ID NO: 394686 - DNA, 20 bp, Artificial Sequence
  chemically synthesized
gtgatgtacttaatggtgcc

SEQ ID NO: 394687 - DNA, 20 bp, Artificial Sequence
  chemically synthesized
atgtacttaatggtgccaag

SEQ ID NO: 394688 - DNA, 20 bp, Artificial Sequence
  chemically synthesized
acttaatggtgccaagtagt

SEQ ID NO: 394689 - DNA, 20 bp, Artificial Sequence
  chemically synthesized
tttgatgtatgctaactact

SEQ ID NO: 394690 - DNA, 20 bp, Artificial Sequence
  chemically synthesized
agttagcatacatcaaacat

SEQ ID NO: 394691 - DNA, 20 bp, Artificial Sequence
  chemically synthesized
aactaacttggtataataat

SEQ ID NO: 394692 - DNA, 20 bp, Artificial Sequence
  chemically synthesized
taactaacttggtataataa

SEQ ID NO: 394693 - DNA, 20 bp, Artificial Sequence
  chemically synthesized
attattcctattattatacc

SEQ ID NO: 394694 - DNA, 20 bp, Artificial Sequence
  chemically synthesized
ttcctattattataccaagt

SEQ ID NO: 394695 - DNA, 20 bp, Artificial Sequence
  chemically synthesized
taatacaagtttaactaact

SEQ ID NO: 394696 - DNA, 20 bp, Artificial Sequence
  chemically synthesized
tattagtagtaaaataatac

SEQ ID NO: 394697 - DNA, 20 bp, Artificial Sequence
  chemically synthesized
tgcagtaatacaaatattag

SEQ ID NO: 394698 - DNA, 20 bp, Artificial Sequence
  chemically synthesized
tagtgcagtaatacaaatat

SEQ ID NO: 394699 - DNA, 20 bp, Artificial Sequence
  chemically synthesized
aatatttgtattactgcact

SEQ ID NO: 394700 - DNA, 20 bp, Artificial Sequence
  chemically synthesized
ttgatttatctaacttagtg

SEQ ID NO: 394701 - DNA, 20 bp, Artificial Sequence
  chemically synthesized
tttgtattactgcactaagt

SEQ ID NO: 394702 - DNA, 20 bp, Artificial Sequence
  chemically synthesized
tggttttgatttatctaact

SEQ ID NO: 394703 - DNA, 20 bp, Artificial Sequence
  chemically synthesized
ataaatcaaaaccattgtta

SEQ ID NO: 394704 - DNA, 20 bp, Artificial Sequence
  chemically synthesized
ttctagatcagctttaacaa

SEQ ID NO: 394705 - DNA, 20 bp, Artificial Sequence
  chemically synthesized
aaccattgttaaagctgatc

SEQ ID NO: 394706 - DNA, 20 bp, Artificial Sequence
  chemically synthesized
cattgttaaagctgatctag

SEQ ID NO: 394707 - DNA, 20 bp, Artificial Sequence
  chemically synthesized
ctaataacttacttctagat

SEQ ID NO: 394708 - DNA, 20 bp, Artificial Sequence
  chemically synthesized
gttaaagctgatctagaagt

SEQ ID NO: 394709 - DNA, 20 bp, Artificial Sequence
  chemically synthesized
aatgtctaataacttacttc

SEQ ID NO: 394710 - DNA, 20 bp, Artificial Sequence
  chemically synthesized
ctgatctagaagtaagttat

SEQ ID NO: 394711 - DNA, 20 bp, Artificial Sequence
  chemically synthesized
agttattagacatttctgtt

SEQ ID NO: 394712 - DNA, 20 bp, Artificial Sequence
  chemically synthesized
gttattagacatttctgttt

SEQ ID NO: 394713 - DNA, 20 bp, Artificial Sequence
  chemically synthesized
tattagacatttctgtttag

SEQ ID NO: 394714 - DNA, 20 bp, Artificial Sequence
  chemically synthesized
agtaactgatatctcctaaa

SEQ ID NO: 394715 - DNA, 20 bp, Artificial Sequence
  chemically synthesized
catttctgtttaggagatat

SEQ ID NO: 394716 - DNA, 20 bp, Artificial Sequence
  chemically synthesized
tttaggagatatcagttact

SEQ ID NO: 394717 - DNA, 20 bp, Artificial Sequence
  chemically synthesized
atatcagttacttagaaatt

SEQ ID NO: 394718 - DNA, 20 bp, Artificial Sequence
  chemically synthesized
tttatagtaactaaatttct

SEQ ID NO: 394719 - DNA, 20 bp, Artificial Sequence
  chemically synthesized
gaaatttagttactataaat

SEQ ID NO: 394720 - DNA, 20 bp, Artificial Sequence
  chemically synthesized
ctatatgtaagacttattta

SEQ ID NO: 394721 - DNA, 20 bp, Artificial Sequence
  chemically synthesized
ctataaataagtcttacata

SEQ ID NO: 394722 - DNA, 20 bp, Artificial Sequence
  chemically synthesized
aaaggtaattttctatatgt

SEQ ID NO: 394723 - DNA, 20 bp, Artificial Sequence
  chemically synthesized
tatagaaaattacctttttt

SEQ ID NO: 394724 - DNA, 20 bp, Artificial Sequence
  chemically synthesized
tttctaaagtcaccaaaaaa

SEQ ID NO: 394725 - DNA, 20 bp, Artificial Sequence
  chemically synthesized
atttctaaagtcaccaaaaa

SEQ ID NO: 394726 - DNA, 20 bp, Artificial Sequence
  chemically synthesized
ttacctttttttggtgactt

SEQ ID NO: 394727 - DNA, 20 bp, Artificial Sequence
  chemically synthesized
tcttacgccctaaatttcta

SEQ ID NO: 394728 - DNA, 20 bp, Artificial Sequence
  chemically synthesized
ttttggtgactttagaaatt

SEQ ID NO: 394729 - DNA, 20 bp, Artificial Sequence
  chemically synthesized
tttggtgactttagaaattt

SEQ ID NO: 394730 - DNA, 20 bp, Artificial Sequence
  chemically synthesized
ttggtgactttagaaattta

SEQ ID NO: 394731 - DNA, 20 bp, Artificial Sequence
  chemically synthesized
actttagaaatttagggcgt

SEQ ID NO: 394732 - DNA, 20 bp, Artificial Sequence
  chemically synthesized
gcgtaagaaataacttttca

SEQ ID NO: 394733 - DNA, 20 bp, Artificial Sequence
  chemically synthesized
acataatttttttctttgaa

SEQ ID NO: 394734 - DNA, 20 bp, Artificial Sequence
  chemically synthesized
aaaattatgtcatcatttta

SEQ ID NO: 394735 - DNA, 20 bp, Artificial Sequence
  chemically synthesized
aattatgtcatcattttaaa

SEQ ID NO: 394736 - DNA, 20 bp, Artificial Sequence
  chemically synthesized
atcattttaaagagctctct

SEQ ID NO: 394737 - DNA, 20 bp, Artificial Sequence
  chemically synthesized
ttttaaagagctctctcagt

SEQ ID NO: 394738 - DNA, 20 bp, Artificial Sequence
  chemically synthesized
acaattaatactcactgaga

SEQ ID NO: 394739 - DNA, 20 bp, Artificial Sequence
  chemically synthesized
acacaattaatactcactga

SEQ ID NO: 394740 - DNA, 20 bp, Artificial Sequence
  chemically synthesized
gaacacaattaatactcact

SEQ ID NO: 394741 - DNA, 20 bp, Artificial Sequence
  chemically synthesized
gtgagtattaattgtgttca

SEQ ID NO: 394742 - DNA, 20 bp, Artificial Sequence
  chemically synthesized
gtattaattgtgttcatagc

SEQ ID NO: 394743 - DNA, 20 bp, Artificial Sequence
  chemically synthesized
tgtgtgtgcacacatttatc

SEQ ID NO: 394744 - DNA, 20 bp, Artificial Sequence
  chemically synthesized
tgtgcacacacaacacatta

SEQ ID NO: 394745 - DNA, 20 bp, Artificial Sequence
  chemically synthesized
cattgttttaaaatttgaat

SEQ ID NO: 394746 - DNA, 20 bp, Artificial Sequence
  chemically synthesized
attttaaaacaatgccatta

SEQ ID NO: 394747 - DNA, 20 bp, Artificial Sequence
  chemically synthesized
ttaaaacaatgccattatag

SEQ ID NO: 394748 - DNA, 20 bp, Artificial Sequence
  chemically synthesized
aggatgaaattccactataa

SEQ ID NO: 394749 - DNA, 20 bp, Artificial Sequence
  chemically synthesized
gctttgatcccatacagaat

SEQ ID NO: 394750 - DNA, 20 bp, Artificial Sequence
  chemically synthesized
gaatttcatcctattctgta

SEQ ID NO: 394751 - DNA, 20 bp, Artificial Sequence
  chemically synthesized
tgctttgatcccatacagaa

SEQ ID NO: 394752 - DNA, 20 bp, Artificial Sequence
  chemically synthesized
aatttcatcctattctgtat

SEQ ID NO: 394753 - DNA, 20 bp, Artificial Sequence
  chemically synthesized
ctggatgctttgatcccata

SEQ ID NO: 394754 - DNA, 20 bp, Artificial Sequence
  chemically synthesized
tcctattctgtatgggatca

SEQ ID NO: 394755 - DNA, 20 bp, Artificial Sequence
  chemically synthesized
ctgtatgggatcaaagcatc

SEQ ID NO: 394756 - DNA, 20 bp, Artificial Sequence
  chemically synthesized
gtatgggatcaaagcatcca

SEQ ID NO: 394757 - DNA, 20 bp, Artificial Sequence
  chemically synthesized
tatgggatcaaagcatccag

SEQ ID NO: 394758 - DNA, 20 bp, Artificial Sequence
  chemically synthesized
tttaatgttttttagacctc

SEQ ID NO: 394759 - DNA, 20 bp, Artificial Sequence
  chemically synthesized
ttggttattttaatgttttt

SEQ ID NO: 394760 - DNA, 20 bp, Artificial Sequence
  chemically synthesized
cattaaaataaccaatcctc

SEQ ID NO: 394761 - DNA, 20 bp, Artificial Sequence
  chemically synthesized
attaaaataaccaatcctct

SEQ ID NO: 394762 - DNA, 20 bp, Artificial Sequence
  chemically synthesized
ttaaaaagcacctagaggat

SEQ ID NO: 394763 - DNA, 20 bp, Artificial Sequence
  chemically synthesized
aaaacttaaaaagcacctag

SEQ ID NO: 394764 - DNA, 20 bp, Artificial Sequence
  chemically synthesized
gaaaacttaaaaagcaccta

SEQ ID NO: 394765 - DNA, 20 bp, Artificial Sequence
  chemically synthesized
ctgaaaacttaaaaagcacc

SEQ ID NO: 394766 - DNA, 20 bp, Artificial Sequence
  chemically synthesized
caatcctctaggtgcttttt

SEQ ID NO: 394767 - DNA, 20 bp, Artificial Sequence
  chemically synthesized
aaattaactgaaaacttaaa

SEQ ID NO: 394768 - DNA, 20 bp, Artificial Sequence
  chemically synthesized
ctaggtgctttttaagtttt

SEQ ID NO: 394769 - DNA, 20 bp, Artificial Sequence
  chemically synthesized
ttgtttgcttcaatgtagat

SEQ ID NO: 394770 - DNA, 20 bp, Artificial Sequence
  chemically synthesized
aatttgtcttatctacattg

SEQ ID NO: 394771 - DNA, 20 bp, Artificial Sequence
  chemically synthesized
ttagattgtttgcttcaatg

SEQ ID NO: 394772 - DNA, 20 bp, Artificial Sequence
  chemically synthesized
cagatatccattgcaagttt

SEQ ID NO: 394773 - DNA, 20 bp, Artificial Sequence
  chemically synthesized
aaacaatctaaaacttgcaa

SEQ ID NO: 394774 - DNA, 20 bp, Artificial Sequence
  chemically synthesized
gcttcacagatatccattgc

SEQ ID NO: 394775 - DNA, 20 bp, Artificial Sequence
  chemically synthesized
acttgcaatggatatctgtg

SEQ ID NO: 394776 - DNA, 20 bp, Artificial Sequence
  chemically synthesized
ttcttttgatgtatgcttca

SEQ ID NO: 394777 - DNA, 20 bp, Artificial Sequence
  chemically synthesized
atctgtgaagcatacatcaa

SEQ ID NO: 394778 - DNA, 20 bp, Artificial Sequence
  chemically synthesized
tgaagcatacatcaaaagaa

SEQ ID NO: 394779 - DNA, 20 bp, Artificial Sequence
  chemically synthesized
catacatcaaaagaaaagta

SEQ ID NO: 394780 - DNA, 20 bp, Artificial Sequence
  chemically synthesized
acatcaaaagaaaagtatag

SEQ ID NO: 394781 - DNA, 20 bp, Artificial Sequence
  chemically synthesized
aagaaaagtatagtagctgt

SEQ ID NO: 394782 - DNA, 20 bp, Artificial Sequence
  chemically synthesized
agtatagtagctgttagttc

SEQ ID NO: 394783 - DNA, 20 bp, Artificial Sequence
  chemically synthesized
cattcagttccttgaactaa

SEQ ID NO: 394784 - DNA, 20 bp, Artificial Sequence
  chemically synthesized
gtatagtagctgttagttca

SEQ ID NO: 394785 - DNA, 20 bp, Artificial Sequence
  chemically synthesized
tagttcaaggaactgaatga

SEQ ID NO: 394786 - DNA, 20 bp, Artificial Sequence
  chemically synthesized
gttcaaggaactgaatgata

SEQ ID NO: 394787 - DNA, 20 bp, Artificial Sequence
  chemically synthesized
taattggaagctctatcatt

SEQ ID NO: 394788 - DNA, 20 bp, Artificial Sequence
  chemically synthesized
atgtgtgtatttttaattgg

SEQ ID NO: 394789 - DNA, 20 bp, Artificial Sequence
  chemically synthesized
cacatgtgtgtatttttaat

SEQ ID NO: 394790 - DNA, 20 bp, Artificial Sequence
  chemically synthesized
atgtgttgtttatcttattt

SEQ ID NO: 394791 - DNA, 20 bp, Artificial Sequence
  chemically synthesized
accttttagttcactgaaat

SEQ ID NO: 394792 - DNA, 20 bp, Artificial Sequence
  chemically synthesized
atcttatttcagtgaactaa

SEQ ID NO: 394793 - DNA, 20 bp, Artificial Sequence
  chemically synthesized
tcttatttcagtgaactaaa

SEQ ID NO: 394794 - DNA, 20 bp, Artificial Sequence
  chemically synthesized
aagaaatgcaaataaccttt

SEQ ID NO: 394795 - DNA, 20 bp, Artificial Sequence
  chemically synthesized
ggttatttgcatttcttgta

SEQ ID NO: 394796 - DNA, 20 bp, Artificial Sequence
  chemically synthesized
aagggatgagcacactttac

SEQ ID NO: 394797 - DNA, 20 bp, Artificial Sequence
  chemically synthesized
tcactgaaacttaaagggat

SEQ ID NO: 394798 - DNA, 20 bp, Artificial Sequence
  chemically synthesized
taaagtgtgctcatcccttt

SEQ ID NO: 394799 - DNA, 20 bp, Artificial Sequence
  chemically synthesized
acagttcactgaaacttaaa

SEQ ID NO: 394800 - DNA, 20 bp, Artificial Sequence
  chemically synthesized
aacagttcactgaaacttaa

SEQ ID NO: 394801 - DNA, 20 bp, Artificial Sequence
  chemically synthesized
gtgctcatccctttaagttt

SEQ ID NO: 394802 - DNA, 20 bp, Artificial Sequence
  chemically synthesized
aaacagttcactgaaactta

SEQ ID NO: 394803 - DNA, 20 bp, Artificial Sequence
  chemically synthesized
taagtttcagtgaactgttt

SEQ ID NO: 394804 - DNA, 20 bp, Artificial Sequence
  chemically synthesized
gtttcagtgaactgtttgag

SEQ ID NO: 394805 - DNA, 20 bp, Artificial Sequence
  chemically synthesized
attccctatgtcttctcaaa

SEQ ID NO: 394806 - DNA, 20 bp, Artificial Sequence
  chemically synthesized
gtgaactgtttgagaagaca

SEQ ID NO: 394807 - DNA, 20 bp, Artificial Sequence
  chemically synthesized
tgaactgtttgagaagacat

SEQ ID NO: 394808 - DNA, 20 bp, Artificial Sequence
  chemically synthesized
gaactgtttgagaagacata

SEQ ID NO: 394809 - DNA, 20 bp, Artificial Sequence
  chemically synthesized
gtttgagaagacatagggaa

SEQ ID NO: 394810 - DNA, 20 bp, Artificial Sequence
  chemically synthesized
tttgagaagacatagggaat

SEQ ID NO: 394811 - DNA, 20 bp, Artificial Sequence
  chemically synthesized
atctttccaaataaagggaa

SEQ ID NO: 394812 - DNA, 20 bp, Artificial Sequence
  chemically synthesized
aatctttccaaataaaggga

SEQ ID NO: 394813 - DNA, 20 bp, Artificial Sequence
  chemically synthesized
ttacaacctttccctttatt

SEQ ID NO: 394814 - DNA, 20 bp, Artificial Sequence
  chemically synthesized
gaataatctttccaaataaa

SEQ ID NO: 394815 - DNA, 20 bp, Artificial Sequence
  chemically synthesized
cgaataatctttccaaataa

SEQ ID NO: 394816 - DNA, 20 bp, Artificial Sequence
  chemically synthesized
ccgaataatctttccaaata

SEQ ID NO: 394817 - DNA, 20 bp, Artificial Sequence
  chemically synthesized
aacctttccctttatttgga

SEQ ID NO: 394818 - DNA, 20 bp, Artificial Sequence
  chemically synthesized
ctttatttggaaagattatt

SEQ ID NO: 394819 - DNA, 20 bp, Artificial Sequence
  chemically synthesized
tatttggaaagattattcgg

SEQ ID NO: 394820 - DNA, 20 bp, Artificial Sequence
  chemically synthesized
agtactagacatttcagaaa

SEQ ID NO: 394821 - DNA, 20 bp, Artificial Sequence
  chemically synthesized
gtagctgtttctgaaatgtc

SEQ ID NO: 394822 - DNA, 20 bp, Artificial Sequence
  chemically synthesized
cacagtagtactagacattt

SEQ ID NO: 394823 - DNA, 20 bp, Artificial Sequence
  chemically synthesized
ctagtttttcacagtagtac

SEQ ID NO: 394824 - DNA, 20 bp, Artificial Sequence
  chemically synthesized
tgggtactagtttttcacag

SEQ ID NO: 394825 - DNA, 20 bp, Artificial Sequence
  chemically synthesized
ttgtgggtactagtttttca

SEQ ID NO: 394826 - DNA, 20 bp, Artificial Sequence
  chemically synthesized
ctagtactactgtgaaaaac

SEQ ID NO: 394827 - DNA, 20 bp, Artificial Sequence
  chemically synthesized
tagaactatattgtgggtac

SEQ ID NO: 394828 - DNA, 20 bp, Artificial Sequence
  chemically synthesized
aaaaactagtacccacaata

SEQ ID NO: 394829 - DNA, 20 bp, Artificial Sequence
  chemically synthesized
tgtttctagaactatattgt

SEQ ID NO: 394830 - DNA, 20 bp, Artificial Sequence
  chemically synthesized
ctgtttctagaactatattg

SEQ ID NO: 394831 - DNA, 20 bp, Artificial Sequence
  chemically synthesized
tagtacccacaatatagttc

SEQ ID NO: 394832 - DNA, 20 bp, Artificial Sequence
  chemically synthesized
ccacaatatagttctagaaa

SEQ ID NO: 394833 - DNA, 20 bp, Artificial Sequence
  chemically synthesized
aactttgtctattctgtttc

SEQ ID NO: 394834 - DNA, 20 bp, Artificial Sequence
  chemically synthesized
atatagttctagaaacagaa

SEQ ID NO: 394835 - DNA, 20 bp, Artificial Sequence
  chemically synthesized
ttctagaaacagaatagaca

SEQ ID NO: 394836 - DNA, 20 bp, Artificial Sequence
  chemically synthesized
agtagacagaaagatatcag

SEQ ID NO: 394837 - DNA, 20 bp, Artificial Sequence
  chemically synthesized
actagtagacagaaagatat

SEQ ID NO: 394838 - DNA, 20 bp, Artificial Sequence
  chemically synthesized
attcctgactagtagacaga

SEQ ID NO: 394839 - DNA, 20 bp, Artificial Sequence
  chemically synthesized
tctgatatctttctgtctac

SEQ ID NO: 394840 - DNA, 20 bp, Artificial Sequence
  chemically synthesized
ttgcattcctgactagtaga

SEQ ID NO: 394841 - DNA, 20 bp, Artificial Sequence
  chemically synthesized
atatctttctgtctactagt

SEQ ID NO: 394842 - DNA, 20 bp, Artificial Sequence
  chemically synthesized
tatctttctgtctactagtc

SEQ ID NO: 394843 - DNA, 20 bp, Artificial Sequence
  chemically synthesized
tgtcttgcattcctgactag

SEQ ID NO: 394844 - DNA, 20 bp, Artificial Sequence
  chemically synthesized
aattgtcttgcattcctgac

SEQ ID NO: 394845 - DNA, 20 bp, Artificial Sequence
  chemically synthesized
tgtctactagtcaggaatgc

SEQ ID NO: 394846 - DNA, 20 bp, Artificial Sequence
  chemically synthesized
tcaggaatgcaagacaattt

SEQ ID NO: 394847 - DNA, 20 bp, Artificial Sequence
  chemically synthesized
ccatgacttttgatagtaga

SEQ ID NO: 394848 - DNA, 20 bp, Artificial Sequence
  chemically synthesized
cccatgacttttgatagtag

SEQ ID NO: 394849 - DNA, 20 bp, Artificial Sequence
  chemically synthesized
aatgatccttctactatcaa

SEQ ID NO: 394850 - DNA, 20 bp, Artificial Sequence
  chemically synthesized
ggtcccatgacttttgatag

SEQ ID NO: 394851 - DNA, 20 bp, Artificial Sequence
  chemically synthesized
ttaggtcccatgacttttga

SEQ ID NO: 394852 - DNA, 20 bp, Artificial Sequence
  chemically synthesized
ccttctactatcaaaagtca

SEQ ID NO: 394853 - DNA, 20 bp, Artificial Sequence
  chemically synthesized
cttctactatcaaaagtcat

SEQ ID NO: 394854 - DNA, 20 bp, Artificial Sequence
  chemically synthesized
tatcaaaagtcatgggacct

SEQ ID NO: 394855 - DNA, 20 bp, Artificial Sequence
  chemically synthesized
atcaaaagtcatgggaccta

SEQ ID NO: 394856 - DNA, 20 bp, Artificial Sequence
  chemically synthesized
agtcatgggacctaaggatc

SEQ ID NO: 394857 - DNA, 20 bp, Artificial Sequence
  chemically synthesized
taaaagtgatcttgatcctt

SEQ ID NO: 394858 - DNA, 20 bp, Artificial Sequence
  chemically synthesized
ataaaagtgatcttgatcct

SEQ ID NO: 394859 - DNA, 20 bp, Artificial Sequence
  chemically synthesized
ttcaaatggagcaaaaataa

SEQ ID NO: 394860 - DNA, 20 bp, Artificial Sequence
  chemically synthesized
ttgcctggataattcaaatg

SEQ ID NO: 394861 - DNA, 20 bp, Artificial Sequence
  chemically synthesized
ttttgcctggataattcaaa

SEQ ID NO: 394862 - DNA, 20 bp, Artificial Sequence
  chemically synthesized
tttgctccatttgaattatc

SEQ ID NO: 394863 - DNA, 20 bp, Artificial Sequence
  chemically synthesized
ttgctccatttgaattatcc

SEQ ID NO: 394864 - DNA, 20 bp, Artificial Sequence
  chemically synthesized
tttatgtcattggttttgcc

SEQ ID NO: 394865 - DNA, 20 bp, Artificial Sequence
  chemically synthesized
taaggcctcatttatgtcat

SEQ ID NO: 394866 - DNA, 20 bp, Artificial Sequence
  chemically synthesized
gcaaaaccaatgacataaat

SEQ ID NO: 394867 - DNA, 20 bp, Artificial Sequence
  chemically synthesized
caaaaccaatgacataaatg

SEQ ID NO: 394868 - DNA, 20 bp, Artificial Sequence
  chemically synthesized
tagggatgtcaggtcacgta

SEQ ID NO: 394869 - DNA, 20 bp, Artificial Sequence
  chemically synthesized
atagggatgtcaggtcacgt

SEQ ID NO: 394870 - DNA, 20 bp, Artificial Sequence
  chemically synthesized
agatcaggcatagggatgtc

SEQ ID NO: 394871 - DNA, 20 bp, Artificial Sequence
  chemically synthesized
tagatcaggcatagggatgt

SEQ ID NO: 394872 - DNA, 20 bp, Artificial Sequence
  chemically synthesized
gtcctgctagatcaggcata

SEQ ID NO: 394873 - DNA, 20 bp, Artificial Sequence
  chemically synthesized
agtcctgctagatcaggcat

SEQ ID NO: 394874 - DNA, 20 bp, Artificial Sequence
  chemically synthesized
cagtcctgctagatcaggca

SEQ ID NO: 394875 - DNA, 20 bp, Artificial Sequence
  chemically synthesized
tgacatccctatgcctgatc

SEQ ID NO: 394876 - DNA, 20 bp, Artificial Sequence
  chemically synthesized
catccctatgcctgatctag

SEQ ID NO: 394877 - DNA, 20 bp, Artificial Sequence
  chemically synthesized
tgtcacagtcctgctagatc

SEQ ID NO: 394878 - DNA, 20 bp, Artificial Sequence
  chemically synthesized
atccctatgcctgatctagc

SEQ ID NO: 394879 - DNA, 20 bp, Artificial Sequence
  chemically synthesized
atgtcacagtcctgctagat

SEQ ID NO: 394880 - DNA, 20 bp, Artificial Sequence
  chemically synthesized
tgttgatgtcacagtcctgc

SEQ ID NO: 394881 - DNA, 20 bp, Artificial Sequence
  chemically synthesized
tagctttactgttgatgtca

SEQ ID NO: 394882 - DNA, 20 bp, Artificial Sequence
  chemically synthesized
tagcaggactgtgacatcaa

SEQ ID NO: 394883 - DNA, 20 bp, Artificial Sequence
  chemically synthesized
ggactgtgacatcaacagta

SEQ ID NO: 394884 - DNA, 20 bp, Artificial Sequence
  chemically synthesized
tgtgacatcaacagtaaagc

SEQ ID NO: 394885 - DNA, 20 bp, Artificial Sequence
  chemically synthesized
acatcaacagtaaagctaga

SEQ ID NO: 394886 - DNA, 20 bp, Artificial Sequence
  chemically synthesized
gaggcaccttttgatccgtc

SEQ ID NO: 394887 - DNA, 20 bp, Artificial Sequence
  chemically synthesized
agtaaagctagacggatcaa

SEQ ID NO: 394888 - DNA, 20 bp, Artificial Sequence
  chemically synthesized
gtaaagctagacggatcaaa

SEQ ID NO: 394889 - DNA, 20 bp, Artificial Sequence
  chemically synthesized
gacgctgacacgggcattgg

SEQ ID NO: 394890 - DNA, 20 bp, Artificial Sequence
  chemically synthesized
tgacgctgacacgggcattg

SEQ ID NO: 394891 - DNA, 20 bp, Artificial Sequence
  chemically synthesized
gctgacgctgacacgggcat

SEQ ID NO: 394892 - DNA, 20 bp, Artificial Sequence
  chemically synthesized
ggtgcctccaatgcccgtgt

SEQ ID NO: 394893 - DNA, 20 bp, Artificial Sequence
  chemically synthesized
gctgaagctgacgctgacac

SEQ ID NO: 394894 - DNA, 20 bp, Artificial Sequence
  chemically synthesized
tgctgaagctgacgctgaca

SEQ ID NO: 394895 - DNA, 20 bp, Artificial Sequence
  chemically synthesized
tccaatgcccgtgtcagcgt

SEQ ID NO: 394896 - DNA, 20 bp, Artificial Sequence
  chemically synthesized
gcccgtgtcagcgtcagctt

SEQ ID NO: 394897 - DNA, 20 bp, Artificial Sequence
  chemically synthesized
cgtgtcagcgtcagcttcag

SEQ ID NO: 394898 - DNA, 20 bp, Artificial Sequence
  chemically synthesized
gtcagcgtcagcttcagcag

SEQ ID NO: 394899 - DNA, 20 bp, Artificial Sequence
  chemically synthesized
caagtggggagcttctgctg

SEQ ID NO: 394900 - DNA, 20 bp, Artificial Sequence
  chemically synthesized
ttcagcagaagctccccact

SEQ ID NO: 394901 - DNA, 20 bp, Artificial Sequence
  chemically synthesized
aagcaggaatgccaagtggg

SEQ ID NO: 394902 - DNA, 20 bp, Artificial Sequence
  chemically synthesized
tcaagcaggaatgccaagtg

SEQ ID NO: 394903 - DNA, 20 bp, Artificial Sequence
  chemically synthesized
ctcaagcaggaatgccaagt

SEQ ID NO: 394904 - DNA, 20 bp, Artificial Sequence
  chemically synthesized
actcaagcaggaatgccaag

SEQ ID NO: 394905 - DNA, 20 bp, Artificial Sequence
  chemically synthesized
agcactcaagcaggaatgcc

SEQ ID NO: 394906 - DNA, 20 bp, Artificial Sequence
  chemically synthesized
cccacttggcattcctgctt

SEQ ID NO: 394907 - DNA, 20 bp, Artificial Sequence
  chemically synthesized
ggactgcaaagcactcaagc

SEQ ID NO: 394908 - DNA, 20 bp, Artificial Sequence
  chemically synthesized
aggactgcaaagcactcaag

SEQ ID NO: 394909 - DNA, 20 bp, Artificial Sequence
  chemically synthesized
gccaggactgcaaagcactc

SEQ ID NO: 394910 - DNA, 20 bp, Artificial Sequence
  chemically synthesized
attcctgcttgagtgctttg

SEQ ID NO: 394911 - DNA, 20 bp, Artificial Sequence
  chemically synthesized
ggtgacatgccaggactgca

SEQ ID NO: 394912 - DNA, 20 bp, Artificial Sequence
  chemically synthesized
gcttgagtgctttgcagtcc

SEQ ID NO: 394913 - DNA, 20 bp, Artificial Sequence
  chemically synthesized
agccagttaggtgacatgcc

SEQ ID NO: 394914 - DNA, 20 bp, Artificial Sequence
  chemically synthesized
cagccagttaggtgacatgc

SEQ ID NO: 394915 - DNA, 20 bp, Artificial Sequence
  chemically synthesized
gtcctggcatgtcacctaac

SEQ ID NO: 394916 - DNA, 20 bp, Artificial Sequence
  chemically synthesized
tggcatgtcacctaactggc

SEQ ID NO: 394917 - DNA, 20 bp, Artificial Sequence
  chemically synthesized
ttaggaagcaccagccagtt

SEQ ID NO: 394918 - DNA, 20 bp, Artificial Sequence
  chemically synthesized
attaggaagcaccagccagt

SEQ ID NO: 394919 - DNA, 20 bp, Artificial Sequence
  chemically synthesized
gcctattaggaagcaccagc

SEQ ID NO: 394920 - DNA, 20 bp, Artificial Sequence
  chemically synthesized
tagggcctattaggaagcac

SEQ ID NO: 394921 - DNA, 20 bp, Artificial Sequence
  chemically synthesized
aactggctggtgcttcctaa

SEQ ID NO: 394922 - DNA, 20 bp, Artificial Sequence
  chemically synthesized
actggctggtgcttcctaat

SEQ ID NO: 394923 - DNA, 20 bp, Artificial Sequence
  chemically synthesized
gtggtgtagggcctattagg

SEQ ID NO: 394924 - DNA, 20 bp, Artificial Sequence
  chemically synthesized
gaagtggtgtagggcctatt

SEQ ID NO: 394925 - DNA, 20 bp, Artificial Sequence
  chemically synthesized
agaagtggtgtagggcctat

SEQ ID NO: 394926 - DNA, 20 bp, Artificial Sequence
  chemically synthesized
catcaatcagaagtggtgta

SEQ ID NO: 394927 - DNA, 20 bp, Artificial Sequence
  chemically synthesized
acatcaatcagaagtggtgt

SEQ ID NO: 394928 - DNA, 20 bp, Artificial Sequence
  chemically synthesized
cacatcaatcagaagtggtg

SEQ ID NO: 394929 - DNA, 20 bp, Artificial Sequence
  chemically synthesized
attcacacatcaatcagaag

SEQ ID NO: 394930 - DNA, 20 bp, Artificial Sequence
  chemically synthesized
catattcacacatcaatcag

SEQ ID NO: 394931 - DNA, 20 bp, Artificial Sequence
  chemically synthesized
ttgcatattcacacatcaat

SEQ ID NO: 394932 - DNA, 20 bp, Artificial Sequence
  chemically synthesized
tgtgaatatgcaaaccttac

SEQ ID NO: 394933 - DNA, 20 bp, Artificial Sequence
  chemically synthesized
ctggctcctggattccagta

SEQ ID NO: 394934 - DNA, 20 bp, Artificial Sequence
  chemically synthesized
tctggctcctggattccagt

SEQ ID NO: 394935 - DNA, 20 bp, Artificial Sequence
  chemically synthesized
atgcaaaccttactggaatc

SEQ ID NO: 394936 - DNA, 20 bp, Artificial Sequence
  chemically synthesized
tgcaaaccttactggaatcc

SEQ ID NO: 394937 - DNA, 20 bp, Artificial Sequence
  chemically synthesized
gccatctggctcctggattc

SEQ ID NO: 394938 - DNA, 20 bp, Artificial Sequence
  chemically synthesized
caaaccttactggaatccag

SEQ ID NO: 394939 - DNA, 20 bp, Artificial Sequence
  chemically synthesized
ccttactggaatccaggagc

SEQ ID NO: 394940 - DNA, 20 bp, Artificial Sequence
  chemically synthesized
tatgtgggccatctggctcc

SEQ ID NO: 394941 - DNA, 20 bp, Artificial Sequence
  chemically synthesized
actggaatccaggagccaga

SEQ ID NO: 394942 - DNA, 20 bp, Artificial Sequence
  chemically synthesized
tacttggtatgtgggccatc

SEQ ID NO: 394943 - DNA, 20 bp, Artificial Sequence
  chemically synthesized
agccagatggcccacatacc

SEQ ID NO: 394944 - DNA, 20 bp, Artificial Sequence
  chemically synthesized
ggctgctatacttggtatgt

SEQ ID NO: 394945 - DNA, 20 bp, Artificial Sequence
  chemically synthesized
tggctgctatacttggtatg

SEQ ID NO: 394946 - DNA, 20 bp, Artificial Sequence
  chemically synthesized
gatggcccacataccaagta

SEQ ID NO: 394947 - DNA, 20 bp, Artificial Sequence
  chemically synthesized
ggcccacataccaagtatag

SEQ ID NO: 394948 - DNA, 20 bp, Artificial Sequence
  chemically synthesized
ttttgtctggctgctatact

SEQ ID NO: 394949 - DNA, 20 bp, Artificial Sequence
  chemically synthesized
cacataccaagtatagcagc

SEQ ID NO: 394950 - DNA, 20 bp, Artificial Sequence
  chemically synthesized
agtatagcagccagacaaaa

SEQ ID NO: 394951 - DNA, 20 bp, Artificial Sequence
  chemically synthesized
gaatctgcctctgttttgtc

SEQ ID NO: 394952 - DNA, 20 bp, Artificial Sequence
  chemically synthesized
tatagcagccagacaaaaca

SEQ ID NO: 394953 - DNA, 20 bp, Artificial Sequence
  chemically synthesized
atagcagccagacaaaacag

SEQ ID NO: 394954 - DNA, 20 bp, Artificial Sequence
  chemically synthesized
gcagccagacaaaacagagg

SEQ ID NO: 394955 - DNA, 20 bp, Artificial Sequence
  chemically synthesized
agacaaaacagaggcagatt

SEQ ID NO: 394956 - DNA, 20 bp, Artificial Sequence
  chemically synthesized
aggcagattcagcaaactgt

SEQ ID NO: 394957 - DNA, 20 bp, Artificial Sequence
  chemically synthesized
gcagattcagcaaactgttg

SEQ ID NO: 394958 - DNA, 20 bp, Artificial Sequence
  chemically synthesized
agattcagcaaactgttgga

SEQ ID NO: 394959 - DNA, 20 bp, Artificial Sequence
  chemically synthesized
ccaaaaatgtaactctccaa

SEQ ID NO: 394960 - DNA, 20 bp, Artificial Sequence
  chemically synthesized
ctgttggagagttacatttt

SEQ ID NO: 394961 - DNA, 20 bp, Artificial Sequence
  chemically synthesized
tacatttttggtgattccta

SEQ ID NO: 394962 - DNA, 20 bp, Artificial Sequence
  chemically synthesized
atgtatacttaggtgtctgt

SEQ ID NO: 394963 - DNA, 20 bp, Artificial Sequence
  chemically synthesized
tatgtatacttaggtgtctg

SEQ ID NO: 394964 - DNA, 20 bp, Artificial Sequence
  chemically synthesized
ggtgattcctacagacacct

SEQ ID NO: 394965 - DNA, 20 bp, Artificial Sequence
  chemically synthesized
aaataggactatgtatactt

SEQ ID NO: 394966 - DNA, 20 bp, Artificial Sequence
  chemically synthesized
taaataggactatgtatact

SEQ ID NO: 394967 - DNA, 20 bp, Artificial Sequence
  chemically synthesized
tacagacacctaagtataca

SEQ ID NO: 394968 - DNA, 20 bp, Artificial Sequence
  chemically synthesized
tggaatgaaatcaattaaat

SEQ ID NO: 394969 - DNA, 20 bp, Artificial Sequence
  chemically synthesized
atggaatgaaatcaattaaa

SEQ ID NO: 394970 - DNA, 20 bp, Artificial Sequence
  chemically synthesized
actattgttgtgggttaaca

SEQ ID NO: 394971 - DNA, 20 bp, Artificial Sequence
  chemically synthesized
tccatgttaacccacaacaa

SEQ ID NO: 394972 - DNA, 20 bp, Artificial Sequence
  chemically synthesized
gacagaggcactattgttgt

SEQ ID NO: 394973 - DNA, 20 bp, Artificial Sequence
  chemically synthesized
tgacagaggcactattgttg

SEQ ID NO: 394974 - DNA, 20 bp, Artificial Sequence
  chemically synthesized
atgtggcagtttaatgacag

SEQ ID NO: 394975 - DNA, 20 bp, Artificial Sequence
  chemically synthesized
aatgtggcagtttaatgaca

SEQ ID NO: 394976 - DNA, 20 bp, Artificial Sequence
  chemically synthesized
agaatgtggcagtttaatga

SEQ ID NO: 394977 - DNA, 20 bp, Artificial Sequence
  chemically synthesized
ctcctttaattagaatgtgg

SEQ ID NO: 394978 - DNA, 20 bp, Artificial Sequence
  chemically synthesized
tttctcctttaattagaatg

SEQ ID NO: 394979 - DNA, 20 bp, Artificial Sequence
  chemically synthesized
aaactgccacattctaatta

SEQ ID NO: 394980 - DNA, 20 bp, Artificial Sequence
  chemically synthesized
aactgccacattctaattaa

SEQ ID NO: 394981 - DNA, 20 bp, Artificial Sequence
  chemically synthesized
ctgccacattctaattaaag

SEQ ID NO: 394982 - DNA, 20 bp, Artificial Sequence
  chemically synthesized
aaagaattttctcctttaat

SEQ ID NO: 394983 - DNA, 20 bp, Artificial Sequence
  chemically synthesized
taaatggaaaggagaaaaga

SEQ ID NO: 394984 - DNA, 20 bp, Artificial Sequence
  chemically synthesized
atgctaaatggaaaggagaa

SEQ ID NO: 394985 - DNA, 20 bp, Artificial Sequence
  chemically synthesized
atttcatgctaaatggaaag

SEQ ID NO: 394986 - DNA, 20 bp, Artificial Sequence
  chemically synthesized
tttcttttctcctttccatt

SEQ ID NO: 394987 - DNA, 20 bp, Artificial Sequence
  chemically synthesized
tcatttcatgctaaatggaa

SEQ ID NO: 394988 - DNA, 20 bp, Artificial Sequence
  chemically synthesized
ttcatttcatgctaaatgga

SEQ ID NO: 394989 - DNA, 20 bp, Artificial Sequence
  chemically synthesized
agccttcatttcatgctaaa

SEQ ID NO: 394990 - DNA, 20 bp, Artificial Sequence
  chemically synthesized
tttccatttagcatgaaatg

SEQ ID NO: 394991 - DNA, 20 bp, Artificial Sequence
  chemically synthesized
ttccatttagcatgaaatga

SEQ ID NO: 394992 - DNA, 20 bp, Artificial Sequence
  chemically synthesized
tagaatcaggttgattataa

SEQ ID NO: 394993 - DNA, 20 bp, Artificial Sequence
  chemically synthesized
acaagtagcagggtagaatc

SEQ ID NO: 394994 - DNA, 20 bp, Artificial Sequence
  chemically synthesized
tacaagtagcagggtagaat

SEQ ID NO: 394995 - DNA, 20 bp, Artificial Sequence
  chemically synthesized
agcctctacaagtagcaggg

SEQ ID NO: 394996 - DNA, 20 bp, Artificial Sequence
  chemically synthesized
gacagcctctacaagtagca

SEQ ID NO: 394997 - DNA, 20 bp, Artificial Sequence
  chemically synthesized
tgacagcctctacaagtagc

SEQ ID NO: 394998 - DNA, 20 bp, Artificial Sequence
  chemically synthesized
tgattctaccctgctacttg

SEQ ID NO: 394999 - DNA, 20 bp, Artificial Sequence
  chemically synthesized
atgacagcctctacaagtag

SEQ ID NO: 395000 - DNA, 20 bp, Artificial Sequence
  chemically synthesized
attctaccctgctacttgta

SEQ ID NO: 395001 - DNA, 20 bp, Artificial Sequence
  chemically synthesized
ttctaccctgctacttgtag

SEQ ID NO: 395002 - DNA, 20 bp, Artificial Sequence
  chemically synthesized
tacatgacagcctctacaag

SEQ ID NO: 395003 - DNA, 20 bp, Artificial Sequence
  chemically synthesized
gactacatgacagcctctac

SEQ ID NO: 395004 - DNA, 20 bp, Artificial Sequence
  chemically synthesized
tacttgtagaggctgtcatg

SEQ ID NO: 395005 - DNA, 20 bp, Artificial Sequence
  chemically synthesized
tgcctttagagactacatga

SEQ ID NO: 395006 - DNA, 20 bp, Artificial Sequence
  chemically synthesized
aggctgtcatgtagtctcta

SEQ ID NO: 395007 - DNA, 20 bp, Artificial Sequence
  chemically synthesized
ggctgtcatgtagtctctaa

SEQ ID NO: 395008 - DNA, 20 bp, Artificial Sequence
  chemically synthesized
tttgttcacctgtgccttta

SEQ ID NO: 395009 - DNA, 20 bp, Artificial Sequence
  chemically synthesized
tcatgtagtctctaaaggca

SEQ ID NO: 395010 - DNA, 20 bp, Artificial Sequence
  chemically synthesized
catgtagtctctaaaggcac

SEQ ID NO: 395011 - DNA, 20 bp, Artificial Sequence
  chemically synthesized
attttgttcacctgtgcctt

SEQ ID NO: 395012 - DNA, 20 bp, Artificial Sequence
  chemically synthesized
tatcctagagaagcagcaaa

SEQ ID NO: 395013 - DNA, 20 bp, Artificial Sequence
  chemically synthesized
tttatcctagagaagcagca

SEQ ID NO: 395014 - DNA, 20 bp, Artificial Sequence
  chemically synthesized
aaatctctttgctgcttctc

SEQ ID NO: 395015 - DNA, 20 bp, Artificial Sequence
  chemically synthesized
aatctctttgctgcttctct

SEQ ID NO: 395016 - DNA, 20 bp, Artificial Sequence
  chemically synthesized
actgctttatcctagagaag

SEQ ID NO: 395017 - DNA, 20 bp, Artificial Sequence
  chemically synthesized
gtgactgctttatcctagag

SEQ ID NO: 395018 - DNA, 20 bp, Artificial Sequence
  chemically synthesized
tttgctgcttctctaggata

SEQ ID NO: 395019 - DNA, 20 bp, Artificial Sequence
  chemically synthesized
taagtgactgctttatccta

SEQ ID NO: 395020 - DNA, 20 bp, Artificial Sequence
  chemically synthesized
aataagtgactgctttatcc

SEQ ID NO: 395021 - DNA, 20 bp, Artificial Sequence
  chemically synthesized
gctgcttctctaggataaag

SEQ ID NO: 395022 - DNA, 20 bp, Artificial Sequence
  chemically synthesized
ctaagtttaatgaaagaaat

SEQ ID NO: 395023 - DNA, 20 bp, Artificial Sequence
  chemically synthesized
aattcatctaagtttaatga

SEQ ID NO: 395024 - DNA, 20 bp, Artificial Sequence
  chemically synthesized
cttatttctttcattaaact

SEQ ID NO: 395025 - DNA, 20 bp, Artificial Sequence
  chemically synthesized
ttgttttaaataattcatct

SEQ ID NO: 395026 - DNA, 20 bp, Artificial Sequence
  chemically synthesized
agatgaattatttaaaacaa

SEQ ID NO: 395027 - DNA, 20 bp, Artificial Sequence
  chemically synthesized
gcactcttttatacaagtta

SEQ ID NO: 395028 - DNA, 20 bp, Artificial Sequence
  chemically synthesized
aaaagccataacttgtataa

SEQ ID NO: 395029 - DNA, 20 bp, Artificial Sequence
  chemically synthesized
atctgggcactcttttatac

SEQ ID NO: 395030 - DNA, 20 bp, Artificial Sequence
  chemically synthesized
aagccataacttgtataaaa

SEQ ID NO: 395031 - DNA, 20 bp, Artificial Sequence
  chemically synthesized
aacttgtataaaagagtgcc

SEQ ID NO: 395032 - DNA, 20 bp, Artificial Sequence
  chemically synthesized
gtataaaagagtgcccagat

SEQ ID NO: 395033 - DNA, 20 bp, Artificial Sequence
  chemically synthesized
tataaaagagtgcccagatg

SEQ ID NO: 395034 - DNA, 20 bp, Artificial Sequence
  chemically synthesized
ataaaagagtgcccagatga

SEQ ID NO: 395035 - DNA, 20 bp, Artificial Sequence
  chemically synthesized
gggaggatacaccctcatct

SEQ ID NO: 395036 - DNA, 20 bp, Artificial Sequence
  chemically synthesized
agggaggatacaccctcatc

SEQ ID NO: 395037 - DNA, 20 bp, Artificial Sequence
  chemically synthesized
gatgagggtgtatcctccct

SEQ ID NO: 395038 - DNA, 20 bp, Artificial Sequence
  chemically synthesized
tagatattactcactcaggg

SEQ ID NO: 395039 - DNA, 20 bp, Artificial Sequence
  chemically synthesized
agggtgtatcctccctgagt

SEQ ID NO: 395040 - DNA, 20 bp, Artificial Sequence
  chemically synthesized
ctagatattactcactcagg

SEQ ID NO: 395041 - DNA, 20 bp, Artificial Sequence
  chemically synthesized
tactagatattactcactca

SEQ ID NO: 395042 - DNA, 20 bp, Artificial Sequence
  chemically synthesized
atactagatattactcactc

SEQ ID NO: 395043 - DNA, 20 bp, Artificial Sequence
  chemically synthesized
tatactagatattactcact

SEQ ID NO: 395044 - DNA, 20 bp, Artificial Sequence
  chemically synthesized
ctccctgagtgagtaatatc

SEQ ID NO: 395045 - DNA, 20 bp, Artificial Sequence
  chemically synthesized
attgtgtggctgatatatac

SEQ ID NO: 395046 - DNA, 20 bp, Artificial Sequence
  chemically synthesized
gagtaatatctagtatatat

SEQ ID NO: 395047 - DNA, 20 bp, Artificial Sequence
  chemically synthesized
tttcatcattttttattgtg

SEQ ID NO: 395048 - DNA, 20 bp, Artificial Sequence
  chemically synthesized
acaataaaaaatgatgaaaa

SEQ ID NO: 395049 - DNA, 20 bp, Artificial Sequence
  chemically synthesized
aaaaaatgattaacaaaaca

SEQ ID NO: 395050 - DNA, 20 bp, Artificial Sequence
  chemically synthesized
aaaaatgattaacaaaacac

SEQ ID NO: 395051 - DNA, 20 bp, Artificial Sequence
  chemically synthesized
tatatatataaaatcacaca

SEQ ID NO: 395052 - DNA, 20 bp, Artificial Sequence
  chemically synthesized
taacttctacttttcattat

SEQ ID NO: 395053 - DNA, 20 bp, Artificial Sequence
  chemically synthesized
acagcatgtctcataatgaa

SEQ ID NO: 395054 - DNA, 20 bp, Artificial Sequence
  chemically synthesized
gcatgtctcataatgaaaag

SEQ ID NO: 395055 - DNA, 20 bp, Artificial Sequence
  chemically synthesized
tgtctcataatgaaaagtag

SEQ ID NO: 395056 - DNA, 20 bp, Artificial Sequence
  chemically synthesized
aagtagaagttacttaatat

SEQ ID NO: 395057 - DNA, 20 bp, Artificial Sequence
  chemically synthesized
aaaaaaagaaaaccgatatt

SEQ ID NO: 395058 - DNA, 20 bp, Artificial Sequence
  chemically synthesized
atattttacatatgtaaaaa

SEQ ID NO: 395059 - DNA, 20 bp, Artificial Sequence
  chemically synthesized
catatgtaaaatatcattca

SEQ ID NO: 395060 - DNA, 20 bp, Artificial Sequence
  chemically synthesized
atatgtaaaatatcattcat

SEQ ID NO: 395061 - DNA, 20 bp, Artificial Sequence
  chemically synthesized
atgtggttgtgcacacacac

SEQ ID NO: 395062 - DNA, 20 bp, Artificial Sequence
  chemically synthesized
gtgtgcacaaccacattgaa

SEQ ID NO: 395063 - DNA, 20 bp, Artificial Sequence
  chemically synthesized
tgaaatgtctccattcaatg

SEQ ID NO: 395064 - DNA, 20 bp, Artificial Sequence
  chemically synthesized
gtgcacaaccacattgaatg

SEQ ID NO: 395065 - DNA, 20 bp, Artificial Sequence
  chemically synthesized
ttgaatggagacatttcaat

SEQ ID NO: 395066 - DNA, 20 bp, Artificial Sequence
  chemically synthesized
ttcaattagaacttctccga

SEQ ID NO: 395067 - DNA, 20 bp, Artificial Sequence
  chemically synthesized
ttaaatttcttctatcggag

SEQ ID NO: 395068 - DNA, 20 bp, Artificial Sequence
  chemically synthesized
aattagaacttctccgatag

SEQ ID NO: 395069 - DNA, 20 bp, Artificial Sequence
  chemically synthesized
ggattaaatttcttctatcg

SEQ ID NO: 395070 - DNA, 20 bp, Artificial Sequence
  chemically synthesized
gtggattaaatttcttctat

SEQ ID NO: 395071 - DNA, 20 bp, Artificial Sequence
  chemically synthesized
gaagaaatttaatccacaaa

SEQ ID NO: 395072 - DNA, 20 bp, Artificial Sequence
  chemically synthesized
aagaaatttaatccacaaat

SEQ ID NO: 395073 - DNA, 20 bp, Artificial Sequence
  chemically synthesized
tatactgcttttcctatttg

SEQ ID NO: 395074 - DNA, 20 bp, Artificial Sequence
  chemically synthesized
atttaatccacaaataggaa

SEQ ID NO: 395075 - DNA, 20 bp, Artificial Sequence
  chemically synthesized
taatccacaaataggaaaag

SEQ ID NO: 395076 - DNA, 20 bp, Artificial Sequence
  chemically synthesized
ataggaaaagcagtatatct

SEQ ID NO: 395077 - DNA, 20 bp, Artificial Sequence
  chemically synthesized
aggcataagtgattaacgct

SEQ ID NO: 395078 - DNA, 20 bp, Artificial Sequence
  chemically synthesized
catgattatttttaaggcat

SEQ ID NO: 395079 - DNA, 20 bp, Artificial Sequence
  chemically synthesized
tgctatcatgattattttta

SEQ ID NO: 395080 - DNA, 20 bp, Artificial Sequence
  chemically synthesized
ttgctatcatgattattttt

SEQ ID NO: 395081 - DNA, 20 bp, Artificial Sequence
  chemically synthesized
tgccttaaaaataatcatga

SEQ ID NO: 395082 - DNA, 20 bp, Artificial Sequence
  chemically synthesized
tcagattccagaaagaattt

SEQ ID NO: 395083 - DNA, 20 bp, Artificial Sequence
  chemically synthesized
atagcaaccaaaattctttc

SEQ ID NO: 395084 - DNA, 20 bp, Artificial Sequence
  chemically synthesized
tggctgattcagattccaga

SEQ ID NO: 395085 - DNA, 20 bp, Artificial Sequence
  chemically synthesized
tgtgtggctgattcagattc

SEQ ID NO: 395086 - DNA, 20 bp, Artificial Sequence
  chemically synthesized
attctttctggaatctgaat

SEQ ID NO: 395087 - DNA, 20 bp, Artificial Sequence
  chemically synthesized
acacatgtgtgtggctgatt

SEQ ID NO: 395088 - DNA, 20 bp, Artificial Sequence
  chemically synthesized
aagtcagaaacacatgtgtg

SEQ ID NO: 395089 - DNA, 20 bp, Artificial Sequence
  chemically synthesized
ctaatcttaatgaataaagt

SEQ ID NO: 395090 - DNA, 20 bp, Artificial Sequence
  chemically synthesized
gctgctaatcttaatgaata

SEQ ID NO: 395091 - DNA, 20 bp, Artificial Sequence
  chemically synthesized
tgtttctgactttattcatt

SEQ ID NO: 395092 - DNA, 20 bp, Artificial Sequence
  chemically synthesized
ctgactttattcattaagat

SEQ ID NO: 395093 - DNA, 20 bp, Artificial Sequence
  chemically synthesized
actttattcattaagattag

SEQ ID NO: 395094 - DNA, 20 bp, Artificial Sequence
  chemically synthesized
cattaagattagcagccttc

SEQ ID NO: 395095 - DNA, 20 bp, Artificial Sequence
  chemically synthesized
ccattttagtgatttctgga

SEQ ID NO: 395096 - DNA, 20 bp, Artificial Sequence
  chemically synthesized
tccattttagtgatttctgg

SEQ ID NO: 395097 - DNA, 20 bp, Artificial Sequence
  chemically synthesized
gattccattttagtgatttc

SEQ ID NO: 395098 - DNA, 20 bp, Artificial Sequence
  chemically synthesized
ccttccagaaatcactaaaa

SEQ ID NO: 395099 - DNA, 20 bp, Artificial Sequence
  chemically synthesized
agcttttgaagattccattt

SEQ ID NO: 395100 - DNA, 20 bp, Artificial Sequence
  chemically synthesized
cactaaaatggaatcttcaa

SEQ ID NO: 395101 - DNA, 20 bp, Artificial Sequence
  chemically synthesized
atcttgaactggagcttttg

SEQ ID NO: 395102 - DNA, 20 bp, Artificial Sequence
  chemically synthesized
aatggaatcttcaaaagctc

SEQ ID NO: 395103 - DNA, 20 bp, Artificial Sequence
  chemically synthesized
atcttcaaaagctccagttc

SEQ ID NO: 395104 - DNA, 20 bp, Artificial Sequence
  chemically synthesized
tatctccagatcttgaactg

SEQ ID NO: 395105 - DNA, 20 bp, Artificial Sequence
  chemically synthesized
tttatctccagatcttgaac

SEQ ID NO: 395106 - DNA, 20 bp, Artificial Sequence
  chemically synthesized
aaaagctccagttcaagatc

SEQ ID NO: 395107 - DNA, 20 bp, Artificial Sequence
  chemically synthesized
aagctccagttcaagatctg

SEQ ID NO: 395108 - DNA, 20 bp, Artificial Sequence
  chemically synthesized
ccagactttcattttatctc

SEQ ID NO: 395109 - DNA, 20 bp, Artificial Sequence
  chemically synthesized
aagatctggagataaaatga

SEQ ID NO: 395110 - DNA, 20 bp, Artificial Sequence
  chemically synthesized
ctggagataaaatgaaagtc

SEQ ID NO: 395111 - DNA, 20 bp, Artificial Sequence
  chemically synthesized
gagtctatggaaaggatcac

SEQ ID NO: 395112 - DNA, 20 bp, Artificial Sequence
  chemically synthesized
aagtctggtgatcctttcca

SEQ ID NO: 395113 - DNA, 20 bp, Artificial Sequence
  chemically synthesized
agtcctcagagtctatggaa

SEQ ID NO: 395114 - DNA, 20 bp, Artificial Sequence
  chemically synthesized
aagtcctcagagtctatgga

SEQ ID NO: 395115 - DNA, 20 bp, Artificial Sequence
  chemically synthesized
aagaaagtcctcagagtcta

SEQ ID NO: 395116 - DNA, 20 bp, Artificial Sequence
  chemically synthesized
tgatcctttccatagactct

SEQ ID NO: 395117 - DNA, 20 bp, Artificial Sequence
  chemically synthesized
gatcctttccatagactctg

SEQ ID NO: 395118 - DNA, 20 bp, Artificial Sequence
  chemically synthesized
gacggtaaagaaagtcctca

SEQ ID NO: 395119 - DNA, 20 bp, Artificial Sequence
  chemically synthesized
aagacggtaaagaaagtcct

SEQ ID NO: 395120 - DNA, 20 bp, Artificial Sequence
  chemically synthesized
agacattaagacggtaaaga

SEQ ID NO: 395121 - DNA, 20 bp, Artificial Sequence
  chemically synthesized
ttgaagacattaagacggta

SEQ ID NO: 395122 - DNA, 20 bp, Artificial Sequence
  chemically synthesized
ttccattgaagacattaaga

SEQ ID NO: 395123 - DNA, 20 bp, Artificial Sequence
  chemically synthesized
gtttttccattgaagacatt

SEQ ID NO: 395124 - DNA, 20 bp, Artificial Sequence
  chemically synthesized
taccgtcttaatgtcttcaa

SEQ ID NO: 395125 - DNA, 20 bp, Artificial Sequence
  chemically synthesized
acacggtcgtttttccattg

SEQ ID NO: 395126 - DNA, 20 bp, Artificial Sequence
  chemically synthesized
acttattattttgtcataca

SEQ ID NO: 395127 - DNA, 20 bp, Artificial Sequence
  chemically synthesized
accgtgtatgacaaaataat

SEQ ID NO: 395128 - DNA, 20 bp, Artificial Sequence
  chemically synthesized
aaataataagtttgcttcct

SEQ ID NO: 395129 - DNA, 20 bp, Artificial Sequence
  chemically synthesized
ccattcatttcaagctcagg

SEQ ID NO: 395130 - DNA, 20 bp, Artificial Sequence
  chemically synthesized
cagccattcatttcaagctc

SEQ ID NO: 395131 - DNA, 20 bp, Artificial Sequence
  chemically synthesized
gcagccattcatttcaagct

SEQ ID NO: 395132 - DNA, 20 bp, Artificial Sequence
  chemically synthesized
gataggcagccattcatttc

SEQ ID NO: 395133 - DNA, 20 bp, Artificial Sequence
  chemically synthesized
cttcctgagcttgaaatgaa

SEQ ID NO: 395134 - DNA, 20 bp, Artificial Sequence
  chemically synthesized
tgaaatgaatggctgcctat

SEQ ID NO: 395135 - DNA, 20 bp, Artificial Sequence
  chemically synthesized
ctcagagtggatctgatagg

SEQ ID NO: 395136 - DNA, 20 bp, Artificial Sequence
  chemically synthesized
atgctcagagtggatctgat

SEQ ID NO: 395137 - DNA, 20 bp, Artificial Sequence
  chemically synthesized
tatgctcagagtggatctga

SEQ ID NO: 395138 - DNA, 20 bp, Artificial Sequence
  chemically synthesized
ctgcctatcagatccactct

SEQ ID NO: 395139 - DNA, 20 bp, Artificial Sequence
  chemically synthesized
ctgaagtgatatgctcagag

SEQ ID NO: 395140 - DNA, 20 bp, Artificial Sequence
  chemically synthesized
agcctgaagtgatatgctca

SEQ ID NO: 395141 - DNA, 20 bp, Artificial Sequence
  chemically synthesized
acagcctgaagtgatatgct

SEQ ID NO: 395142 - DNA, 20 bp, Artificial Sequence
  chemically synthesized
ccactctgagcatatcactt

SEQ ID NO: 395143 - DNA, 20 bp, Artificial Sequence
  chemically synthesized
cactctgagcatatcacttc

SEQ ID NO: 395144 - DNA, 20 bp, Artificial Sequence
  chemically synthesized
gtggctggcctgacagcctg

SEQ ID NO: 395145 - DNA, 20 bp, Artificial Sequence
  chemically synthesized
agcatatcacttcaggctgt

SEQ ID NO: 395146 - DNA, 20 bp, Artificial Sequence
  chemically synthesized
gcatatcacttcaggctgtc

SEQ ID NO: 395147 - DNA, 20 bp, Artificial Sequence
  chemically synthesized
atcacttcaggctgtcaggc

SEQ ID NO: 395148 - DNA, 20 bp, Artificial Sequence
  chemically synthesized
gagcaatgtggctggcctga

SEQ ID NO: 395149 - DNA, 20 bp, Artificial Sequence
  chemically synthesized
gaaattgtgagcaatgtggc

SEQ ID NO: 395150 - DNA, 20 bp, Artificial Sequence
  chemically synthesized
aagggaaattgtgagcaatg

SEQ ID NO: 395151 - DNA, 20 bp, Artificial Sequence
  chemically synthesized
ttatcccaaagggaaattgt

SEQ ID NO: 395152 - DNA, 20 bp, Artificial Sequence
  chemically synthesized
cattgctcacaatttccctt

SEQ ID NO: 395153 - DNA, 20 bp, Artificial Sequence
  chemically synthesized
attgctcacaatttcccttt

SEQ ID NO: 395154 - DNA, 20 bp, Artificial Sequence
  chemically synthesized
taggattagcttatcccaaa

SEQ ID NO: 395155 - DNA, 20 bp, Artificial Sequence
  chemically synthesized
tcacaatttccctttgggat

SEQ ID NO: 395156 - DNA, 20 bp, Artificial Sequence
  chemically synthesized
ttaggattagcttatcccaa

SEQ ID NO: 395157 - DNA, 20 bp, Artificial Sequence
  chemically synthesized
tttaggattagcttatccca

SEQ ID NO: 395158 - DNA, 20 bp, Artificial Sequence
  chemically synthesized
ctataaaatgattttaggat

SEQ ID NO: 395159 - DNA, 20 bp, Artificial Sequence
  chemically synthesized
ccaaactataaaatgatttt

SEQ ID NO: 395160 - DNA, 20 bp, Artificial Sequence
  chemically synthesized
tccaaactataaaatgattt

SEQ ID NO: 395161 - DNA, 20 bp, Artificial Sequence
  chemically synthesized
ctaatcctaaaatcatttta

SEQ ID NO: 395162 - DNA, 20 bp, Artificial Sequence
  chemically synthesized
cctaaaatcattttatagtt

SEQ ID NO: 395163 - DNA, 20 bp, Artificial Sequence
  chemically synthesized
aaatcattttatagtttgga

SEQ ID NO: 395164 - DNA, 20 bp, Artificial Sequence
  chemically synthesized
ttttatagtttggatagttt

SEQ ID NO: 395165 - DNA, 20 bp, Artificial Sequence
  chemically synthesized
agtttggatagtttcagcat

SEQ ID NO: 395166 - DNA, 20 bp, Artificial Sequence
  chemically synthesized
atgagatattgatgtctttg

SEQ ID NO: 395167 - DNA, 20 bp, Artificial Sequence
  chemically synthesized
agatattgatgtctttgtag

SEQ ID NO: 395168 - DNA, 20 bp, Artificial Sequence
  chemically synthesized
tatgcaatagaacttctaca

SEQ ID NO: 395169 - DNA, 20 bp, Artificial Sequence
  chemically synthesized
tccatgtatatgttatgcaa

SEQ ID NO: 395170 - DNA, 20 bp, Artificial Sequence
  chemically synthesized
tctattgcataacatataca

SEQ ID NO: 395171 - DNA, 20 bp, Artificial Sequence
  chemically synthesized
attgcataacatatacatgg

SEQ ID NO: 395172 - DNA, 20 bp, Artificial Sequence
  chemically synthesized
aacatatacatggaagactc

SEQ ID NO: 395173 - DNA, 20 bp, Artificial Sequence
  chemically synthesized
catacatatccgtataactt

SEQ ID NO: 395174 - DNA, 20 bp, Artificial Sequence
  chemically synthesized
catggaagactcaagttata

SEQ ID NO: 395175 - DNA, 20 bp, Artificial Sequence
  chemically synthesized
gtcacactacacaattagtg

SEQ ID NO: 395176 - DNA, 20 bp, Artificial Sequence
  chemically synthesized
tatgtactacactaattgtg

SEQ ID NO: 395177 - DNA, 20 bp, Artificial Sequence
  chemically synthesized
acatagtcacactacacaat

SEQ ID NO: 395178 - DNA, 20 bp, Artificial Sequence
  chemically synthesized
taaaattcttaatgcataca

SEQ ID NO: 395179 - DNA, 20 bp, Artificial Sequence
  chemically synthesized
agtgtgactatgtatgcatt

SEQ ID NO: 395180 - DNA, 20 bp, Artificial Sequence
  chemically synthesized
gaattttaatcaattgtgta

SEQ ID NO: 395181 - DNA, 20 bp, Artificial Sequence
  chemically synthesized
aattttaatcaattgtgtaa

SEQ ID NO: 395182 - DNA, 20 bp, Artificial Sequence
  chemically synthesized
attttaatcaattgtgtaaa

SEQ ID NO: 395183 - DNA, 20 bp, Artificial Sequence
  chemically synthesized
ttaatcaattgtgtaaaggg

SEQ ID NO: 395184 - DNA, 20 bp, Artificial Sequence
  chemically synthesized
aactattggttgagatatga

SEQ ID NO: 395185 - DNA, 20 bp, Artificial Sequence
  chemically synthesized
atctttcatatctcaaccaa

SEQ ID NO: 395186 - DNA, 20 bp, Artificial Sequence
  chemically synthesized
gagaaccaaaactattggtt

SEQ ID NO: 395187 - DNA, 20 bp, Artificial Sequence
  chemically synthesized
catatctcaaccaatagttt

SEQ ID NO: 395188 - DNA, 20 bp, Artificial Sequence
  chemically synthesized
tccatgagaaccaaaactat

SEQ ID NO: 395189 - DNA, 20 bp, Artificial Sequence
  chemically synthesized
accaatagttttggttctca

SEQ ID NO: 395190 - DNA, 20 bp, Artificial Sequence
  chemically synthesized
aggtaatgtttgatttccat

SEQ ID NO: 395191 - DNA, 20 bp, Artificial Sequence
  chemically synthesized
acactgattttattacaaaa

SEQ ID NO: 395192 - DNA, 20 bp, Artificial Sequence
  chemically synthesized
aacactgattttattacaaa

SEQ ID NO: 395193 - DNA, 20 bp, Artificial Sequence
  chemically synthesized
ttacctttttgtaataaaat

SEQ ID NO: 395194 - DNA, 20 bp, Artificial Sequence
  chemically synthesized
taataaaatcagtgtttcaa

SEQ ID NO: 395195 - DNA, 20 bp, Artificial Sequence
  chemically synthesized
ttagatggtcattataaaca

SEQ ID NO: 395196 - DNA, 20 bp, Artificial Sequence
  chemically synthesized
tttagatggtcattataaac

SEQ ID NO: 395197 - DNA, 20 bp, Artificial Sequence
  chemically synthesized
tctcttaaagaaattttaga

SEQ ID NO: 395198 - DNA, 20 bp, Artificial Sequence
  chemically synthesized
cccatctcttaaagaaattt

SEQ ID NO: 395199 - DNA, 20 bp, Artificial Sequence
  chemically synthesized
tgaccatctaaaatttcttt

SEQ ID NO: 395200 - DNA, 20 bp, Artificial Sequence
  chemically synthesized
accatctaaaatttctttaa

SEQ ID NO: 395201 - DNA, 20 bp, Artificial Sequence
  chemically synthesized
tctaaaatttctttaagaga

SEQ ID NO: 395202 - DNA, 20 bp, Artificial Sequence
  chemically synthesized
cctgtaatgcccatctctta

SEQ ID NO: 395203 - DNA, 20 bp, Artificial Sequence
  chemically synthesized
ctaaaatttctttaagagat

SEQ ID NO: 395204 - DNA, 20 bp, Artificial Sequence
  chemically synthesized
tctttaagagatgggcatta

SEQ ID NO: 395205 - DNA, 20 bp, Artificial Sequence
  chemically synthesized
ctttaagagatgggcattac

SEQ ID NO: 395206 - DNA, 20 bp, Artificial Sequence
  chemically synthesized
gagatgggcattacaggtca

SEQ ID NO: 395207 - DNA, 20 bp, Artificial Sequence
  chemically synthesized
tcttatgtatttttttcata

SEQ ID NO: 395208 - DNA, 20 bp, Artificial Sequence
  chemically synthesized
tctgtatgaaaaaaatacat

SEQ ID NO: 395209 - DNA, 20 bp, Artificial Sequence
  chemically synthesized
acataagatattataaaatg

SEQ ID NO: 395210 - DNA, 20 bp, Artificial Sequence
  chemically synthesized
ttcctaatacacaacagttt

SEQ ID NO: 395211 - DNA, 20 bp, Artificial Sequence
  chemically synthesized
aaatttttcctaatacacaa

SEQ ID NO: 395212 - DNA, 20 bp, Artificial Sequence
  chemically synthesized
tagcttaaactgttgtgtat

SEQ ID NO: 395213 - DNA, 20 bp, Artificial Sequence
  chemically synthesized
agcttaaactgttgtgtatt

SEQ ID NO: 395214 - DNA, 20 bp, Artificial Sequence
  chemically synthesized
attttctttttgaattatag

SEQ ID NO: 395215 - DNA, 20 bp, Artificial Sequence
  chemically synthesized
attattttctttttgaatta

SEQ ID NO: 395216 - DNA, 20 bp, Artificial Sequence
  chemically synthesized
aaattctgctataattcaaa

SEQ ID NO: 395217 - DNA, 20 bp, Artificial Sequence
  chemically synthesized
aattcaaaaagaaaataatg

SEQ ID NO: 395218 - DNA, 20 bp, Artificial Sequence
  chemically synthesized
attcaaaaagaaaataatga

SEQ ID NO: 395219 - DNA, 20 bp, Artificial Sequence
  chemically synthesized
ttcaaaaagaaaataatgaa

SEQ ID NO: 395220 - DNA, 20 bp, Artificial Sequence
  chemically synthesized
aaaataatgaagggaaataa

SEQ ID NO: 395221 - DNA, 20 bp, Artificial Sequence
  chemically synthesized
aatgaagggaaataaaagaa

SEQ ID NO: 395222 - DNA, 20 bp, Artificial Sequence
  chemically synthesized
ggaaataaaagaaaagaata

SEQ ID NO: 395223 - DNA, 20 bp, Artificial Sequence
  chemically synthesized
aataaaagaaaagaataaag

SEQ ID NO: 395224 - DNA, 20 bp, Artificial Sequence
  chemically synthesized
tcacataaaacaacatatac

SEQ ID NO: 395225 - DNA, 20 bp, Artificial Sequence
  chemically synthesized
cacataaaacaacatatacc

SEQ ID NO: 395226 - DNA, 20 bp, Artificial Sequence
  chemically synthesized
acataaaacaacatatacca

SEQ ID NO: 395227 - DNA, 20 bp, Artificial Sequence
  chemically synthesized
taaaacaacatataccaggg

SEQ ID NO: 395228 - DNA, 20 bp, Artificial Sequence
  chemically synthesized
aaaacaacatataccagggt

SEQ ID NO: 395229 - DNA, 20 bp, Artificial Sequence
  chemically synthesized
aaacaacatataccagggta

SEQ ID NO: 395230 - DNA, 20 bp, Artificial Sequence
  chemically synthesized
aactttatagtaccctaccc

SEQ ID NO: 395231 - DNA, 20 bp, Artificial Sequence
  chemically synthesized
taccagggtagggtactata

SEQ ID NO: 395232 - DNA, 20 bp, Artificial Sequence
  chemically synthesized
gctgtagaaataaaacttta

SEQ ID NO: 395233 - DNA, 20 bp, Artificial Sequence
  chemically synthesized
actataaagttttatttcta

SEQ ID NO: 395234 - DNA, 20 bp, Artificial Sequence
  chemically synthesized
tttagcttctttcaaagctg

SEQ ID NO: 395235 - DNA, 20 bp, Artificial Sequence
  chemically synthesized
ttttatttctacagctttga

SEQ ID NO: 395236 - DNA, 20 bp, Artificial Sequence
  chemically synthesized
tatttctacagctttgaaag

SEQ ID NO: 395237 - DNA, 20 bp, Artificial Sequence
  chemically synthesized
tgagtttttagcttctttca

SEQ ID NO: 395238 - DNA, 20 bp, Artificial Sequence
  chemically synthesized
cagagtcacaagtgagtttt

SEQ ID NO: 395239 - DNA, 20 bp, Artificial Sequence
  chemically synthesized
tgagctacagagtcacaagt

SEQ ID NO: 395240 - DNA, 20 bp, Artificial Sequence
  chemically synthesized
ctcatgagctacagagtcac

SEQ ID NO: 395241 - DNA, 20 bp, Artificial Sequence
  chemically synthesized
aaaactcacttgtgactctg

SEQ ID NO: 395242 - DNA, 20 bp, Artificial Sequence
  chemically synthesized
cacattactcatgagctaca

SEQ ID NO: 395243 - DNA, 20 bp, Artificial Sequence
  chemically synthesized
accacattactcatgagcta

SEQ ID NO: 395244 - DNA, 20 bp, Artificial Sequence
  chemically synthesized
cttgtgactctgtagctcat

SEQ ID NO: 395245 - DNA, 20 bp, Artificial Sequence
  chemically synthesized
gaaatgaccacattactcat

SEQ ID NO: 395246 - DNA, 20 bp, Artificial Sequence
  chemically synthesized
tctgtagctcatgagtaatg

SEQ ID NO: 395247 - DNA, 20 bp, Artificial Sequence
  chemically synthesized
atgtggtcatttcaaactta

SEQ ID NO: 395248 - DNA, 20 bp, Artificial Sequence
  chemically synthesized
ccataaagttttatcaccat

SEQ ID NO: 395249 - DNA, 20 bp, Artificial Sequence
  chemically synthesized
cttatggtgataaaacttta

SEQ ID NO: 395250 - DNA, 20 bp, Artificial Sequence
  chemically synthesized
ttctgaactagagtgccata

SEQ ID NO: 395251 - DNA, 20 bp, Artificial Sequence
  chemically synthesized
gataaaactttatggcactc

SEQ ID NO: 395252 - DNA, 20 bp, Artificial Sequence
  chemically synthesized
aactttatggcactctagtt

SEQ ID NO: 395253 - DNA, 20 bp, Artificial Sequence
  chemically synthesized
ttgacatatgttctgaacta

SEQ ID NO: 395254 - DNA, 20 bp, Artificial Sequence
  chemically synthesized
gtttgacatatgttctgaac

SEQ ID NO: 395255 - DNA, 20 bp, Artificial Sequence
  chemically synthesized
agttcagaacatatgtcaaa

SEQ ID NO: 395256 - DNA, 20 bp, Artificial Sequence
  chemically synthesized
ttcagaacatatgtcaaaca

SEQ ID NO: 395257 - DNA, 20 bp, Artificial Sequence
  chemically synthesized
catatgtcaaacagagaaaa

SEQ ID NO: 395258 - DNA, 20 bp, Artificial Sequence
  chemically synthesized
gtcagatgagaagggttttg

SEQ ID NO: 395259 - DNA, 20 bp, Artificial Sequence
  chemically synthesized
atagtggtgtcagatgagaa

SEQ ID NO: 395260 - DNA, 20 bp, Artificial Sequence
  chemically synthesized
aatagtggtgtcagatgaga

SEQ ID NO: 395261 - DNA, 20 bp, Artificial Sequence
  chemically synthesized
gaatagtggtgtcagatgag

SEQ ID NO: 395262 - DNA, 20 bp, Artificial Sequence
  chemically synthesized
ccagaatagtggtgtcagat

SEQ ID NO: 395263 - DNA, 20 bp, Artificial Sequence
  chemically synthesized
caaaaccagaatagtggtgt

SEQ ID NO: 395264 - DNA, 20 bp, Artificial Sequence
  chemically synthesized
ctcatctgacaccactattc

SEQ ID NO: 395265 - DNA, 20 bp, Artificial Sequence
  chemically synthesized
cccagacaaaaccagaatag

SEQ ID NO: 395266 - DNA, 20 bp, Artificial Sequence
  chemically synthesized
attcccagacaaaaccagaa

SEQ ID NO: 395267 - DNA, 20 bp, Artificial Sequence
  chemically synthesized
caccgattcccagacaaaac

SEQ ID NO: 395268 - DNA, 20 bp, Artificial Sequence
  chemically synthesized
accactattctggttttgtc

SEQ ID NO: 395269 - DNA, 20 bp, Artificial Sequence
  chemically synthesized
ccactattctggttttgtct

SEQ ID NO: 395270 - DNA, 20 bp, Artificial Sequence
  chemically synthesized
ttctggttttgtctgggaat

SEQ ID NO: 395271 - DNA, 20 bp, Artificial Sequence
  chemically synthesized
tgaaattgaccaccgattcc

SEQ ID NO: 395272 - DNA, 20 bp, Artificial Sequence
  chemically synthesized
tggttttgtctgggaatcgg

SEQ ID NO: 395273 - DNA, 20 bp, Artificial Sequence
  chemically synthesized
tcattttgaaatttctgtct

SEQ ID NO: 395274 - DNA, 20 bp, Artificial Sequence
  chemically synthesized
attttgaaatttctgtctca

SEQ ID NO: 395275 - DNA, 20 bp, Artificial Sequence
  chemically synthesized
gttgctacatgactctgaga

SEQ ID NO: 395276 - DNA, 20 bp, Artificial Sequence
  chemically synthesized
ttaagttgctacatgactct

SEQ ID NO: 395277 - DNA, 20 bp, Artificial Sequence
  chemically synthesized
atttctgtctcagagtcatg

SEQ ID NO: 395278 - DNA, 20 bp, Artificial Sequence
  chemically synthesized
gctaatcagagcagtcattt

SEQ ID NO: 395279 - DNA, 20 bp, Artificial Sequence
  chemically synthesized
acttaaatgactgctctgat

SEQ ID NO: 395280 - DNA, 20 bp, Artificial Sequence
  chemically synthesized
tactttgatgctaatcagag

SEQ ID NO: 395281 - DNA, 20 bp, Artificial Sequence
  chemically synthesized
acttactttgatgctaatca

SEQ ID NO: 395282 - DNA, 20 bp, Artificial Sequence
  chemically synthesized
acacttactttgatgctaat

SEQ ID NO: 395283 - DNA, 20 bp, Artificial Sequence
  chemically synthesized
gactgctctgattagcatca

SEQ ID NO: 395284 - DNA, 20 bp, Artificial Sequence
  chemically synthesized
gctctgattagcatcaaagt

SEQ ID NO: 395285 - DNA, 20 bp, Artificial Sequence
  chemically synthesized
gattagcatcaaagtaagtg

SEQ ID NO: 395286 - DNA, 20 bp, Artificial Sequence
  chemically synthesized
tgttaacaccatcatgatga

SEQ ID NO: 395287 - DNA, 20 bp, Artificial Sequence
  chemically synthesized
atgatttgctttcatcatga

SEQ ID NO: 395288 - DNA, 20 bp, Artificial Sequence
  chemically synthesized
ggtgttaacaatatgtactt

SEQ ID NO: 395289 - DNA, 20 bp, Artificial Sequence
  chemically synthesized
actaacgatgacattttctg

SEQ ID NO: 395290 - DNA, 20 bp, Artificial Sequence
  chemically synthesized
acttcagaaaatgtcatcgt

SEQ ID NO: 395291 - DNA, 20 bp, Artificial Sequence
  chemically synthesized
tgtcatcgttagtgttgcta

SEQ ID NO: 395292 - DNA, 20 bp, Artificial Sequence
  chemically synthesized
atcgttagtgttgctaaagt

SEQ ID NO: 395293 - DNA, 20 bp, Artificial Sequence
  chemically synthesized
ttatgcttctgttcttactt

SEQ ID NO: 395294 - DNA, 20 bp, Artificial Sequence
  chemically synthesized
tagtgttgctaaagtaagaa

SEQ ID NO: 395295 - DNA, 20 bp, Artificial Sequence
  chemically synthesized
tgttgctaaagtaagaacag

SEQ ID NO: 395296 - DNA, 20 bp, Artificial Sequence
  chemically synthesized
gaacagaagcataattcctg

SEQ ID NO: 395297 - DNA, 20 bp, Artificial Sequence
  chemically synthesized
ttagattggaatttaactgc

SEQ ID NO: 395298 - DNA, 20 bp, Artificial Sequence
  chemically synthesized
cttagattggaatttaactg

SEQ ID NO: 395299 - DNA, 20 bp, Artificial Sequence
  chemically synthesized
ctgcagttaaattccaatct

SEQ ID NO: 395300 - DNA, 20 bp, Artificial Sequence
  chemically synthesized
gaaggtcaaatatcttagat

SEQ ID NO: 395301 - DNA, 20 bp, Artificial Sequence
  chemically synthesized
cgtgtgaaggtcaaatatct

SEQ ID NO: 395302 - DNA, 20 bp, Artificial Sequence
  chemically synthesized
tcttcattcttttcgtgtga

SEQ ID NO: 395303 - DNA, 20 bp, Artificial Sequence
  chemically synthesized
gtcttcattcttttcgtgtg

SEQ ID NO: 395304 - DNA, 20 bp, Artificial Sequence
  chemically synthesized
atatttgaccttcacacgaa

SEQ ID NO: 395305 - DNA, 20 bp, Artificial Sequence
  chemically synthesized
accttcacacgaaaagaatg

SEQ ID NO: 395306 - DNA, 20 bp, Artificial Sequence
  chemically synthesized
acacgaaaagaatgaagaca

SEQ ID NO: 395307 - DNA, 20 bp, Artificial Sequence
  chemically synthesized
aaatagtttttaaaagagaa

SEQ ID NO: 395308 - DNA, 20 bp, Artificial Sequence
  chemically synthesized
aaaatagtttttaaaagaga

SEQ ID NO: 395309 - DNA, 20 bp, Artificial Sequence
  chemically synthesized
cataaaaatagtttttaaaa

SEQ ID NO: 395310 - DNA, 20 bp, Artificial Sequence
  chemically synthesized
tccataaaaatagtttttaa

SEQ ID NO: 395311 - DNA, 20 bp, Artificial Sequence
  chemically synthesized
tcttttaaaaactattttta

SEQ ID NO: 395312 - DNA, 20 bp, Artificial Sequence
  chemically synthesized
attaatatattccataaaaa

SEQ ID NO: 395313 - DNA, 20 bp, Artificial Sequence
  chemically synthesized
tttatggaatatattaattt

SEQ ID NO: 395314 - DNA, 20 bp, Artificial Sequence
  chemically synthesized
tatggaatatattaatttta

SEQ ID NO: 395315 - DNA, 20 bp, Artificial Sequence
  chemically synthesized
aaatgtcatgtctttacaat

SEQ ID NO: 395316 - DNA, 20 bp, Artificial Sequence
  chemically synthesized
aatattgagctctcattgta

SEQ ID NO: 395317 - DNA, 20 bp, Artificial Sequence
  chemically synthesized
atgtcatgtctttacaatga

SEQ ID NO: 395318 - DNA, 20 bp, Artificial Sequence
  chemically synthesized
ccacatcatttgaaaatatt

SEQ ID NO: 395319 - DNA, 20 bp, Artificial Sequence
  chemically synthesized
ctcaatattttcaaatgatg

SEQ ID NO: 395320 - DNA, 20 bp, Artificial Sequence
  chemically synthesized
aataccaaaaatttaatggt

SEQ ID NO: 395321 - DNA, 20 bp, Artificial Sequence
  chemically synthesized
aactaataccaaaaatttaa

SEQ ID NO: 395322 - DNA, 20 bp, Artificial Sequence
  chemically synthesized
ttttcttaccattaaatttt

SEQ ID NO: 395323 - DNA, 20 bp, Artificial Sequence
  chemically synthesized
taccattaaatttttggtat

SEQ ID NO: 395324 - DNA, 20 bp, Artificial Sequence
  chemically synthesized
taaatttttggtattagttc

SEQ ID NO: 395325 - DNA, 20 bp, Artificial Sequence
  chemically synthesized
aaatttttggtattagttct

SEQ ID NO: 395326 - DNA, 20 bp, Artificial Sequence
  chemically synthesized
atttttggtattagttctgg

SEQ ID NO: 395327 - DNA, 20 bp, Artificial Sequence
  chemically synthesized
tttttggtattagttctggg

SEQ ID NO: 395328 - DNA, 20 bp, Artificial Sequence
  chemically synthesized
gtagaaaaattatggcctcc

SEQ ID NO: 395329 - DNA, 20 bp, Artificial Sequence
  chemically synthesized
aaatttaagtagaaaaatta

SEQ ID NO: 395330 - DNA, 20 bp, Artificial Sequence
  chemically synthesized
tatacaggcaaaaatttaag

SEQ ID NO: 395331 - DNA, 20 bp, Artificial Sequence
  chemically synthesized
ttatatacaggcaaaaattt

SEQ ID NO: 395332 - DNA, 20 bp, Artificial Sequence
  chemically synthesized
acaaagtactttttatatac

SEQ ID NO: 395333 - DNA, 20 bp, Artificial Sequence
  chemically synthesized
cacaaagtactttttatata

SEQ ID NO: 395334 - DNA, 20 bp, Artificial Sequence
  chemically synthesized
aatttttgcctgtatataaa

SEQ ID NO: 395335 - DNA, 20 bp, Artificial Sequence
  chemically synthesized
aattggactctatttacaca

SEQ ID NO: 395336 - DNA, 20 bp, Artificial Sequence
  chemically synthesized
taaaaagtactttgtgtaaa

SEQ ID NO: 395337 - DNA, 20 bp, Artificial Sequence
  chemically synthesized
aaaagtactttgtgtaaata

SEQ ID NO: 395338 - DNA, 20 bp, Artificial Sequence
  chemically synthesized
ctaataaactaaagtcaaat

SEQ ID NO: 395339 - DNA, 20 bp, Artificial Sequence
  chemically synthesized
aatagagtccaatttgactt

SEQ ID NO: 395340 - DNA, 20 bp, Artificial Sequence
  chemically synthesized
taattaatactaataaacta

SEQ ID NO: 395341 - DNA, 20 bp, Artificial Sequence
  chemically synthesized
ccaatttgactttagtttat

SEQ ID NO: 395342 - DNA, 20 bp, Artificial Sequence
  chemically synthesized
tttagtttattagtattaat

SEQ ID NO: 395343 - DNA, 20 bp, Artificial Sequence
  chemically synthesized
attagttgtattttgtcact

SEQ ID NO: 395344 - DNA, 20 bp, Artificial Sequence
  chemically synthesized
caaagttttgcaagttgtcc

SEQ ID NO: 395345 - DNA, 20 bp, Artificial Sequence
  chemically synthesized
gaataacaccaaagttttgc

SEQ ID NO: 395346 - DNA, 20 bp, Artificial Sequence
  chemically synthesized
ttggacaacttgcaaaactt

SEQ ID NO: 395347 - DNA, 20 bp, Artificial Sequence
  chemically synthesized
tgacaatcagaataacacca

SEQ ID NO: 395348 - DNA, 20 bp, Artificial Sequence
  chemically synthesized
taagaaaatggagtgacaat

SEQ ID NO: 395349 - DNA, 20 bp, Artificial Sequence
  chemically synthesized
gccctacagctaagaaaatg

SEQ ID NO: 395350 - DNA, 20 bp, Artificial Sequence
  chemically synthesized
tgattgtcactccattttct

SEQ ID NO: 395351 - DNA, 20 bp, Artificial Sequence
  chemically synthesized
tggccctacagctaagaaaa

SEQ ID NO: 395352 - DNA, 20 bp, Artificial Sequence
  chemically synthesized
tcactccattttcttagctg

SEQ ID NO: 395353 - DNA, 20 bp, Artificial Sequence
  chemically synthesized
cactccattttcttagctgt

SEQ ID NO: 395354 - DNA, 20 bp, Artificial Sequence
  chemically synthesized
actccattttcttagctgta

SEQ ID NO: 395355 - DNA, 20 bp, Artificial Sequence
  chemically synthesized
tagattctggccctacagct

SEQ ID NO: 395356 - DNA, 20 bp, Artificial Sequence
  chemically synthesized
cattttcttagctgtagggc

SEQ ID NO: 395357 - DNA, 20 bp, Artificial Sequence
  chemically synthesized
ttaattagattctggcccta

SEQ ID NO: 395358 - DNA, 20 bp, Artificial Sequence
  chemically synthesized
taataggattaattagattc

SEQ ID NO: 395359 - DNA, 20 bp, Artificial Sequence
  chemically synthesized
ctattaataataggattaat

SEQ ID NO: 395360 - DNA, 20 bp, Artificial Sequence
  chemically synthesized
attagacaactattaataat

SEQ ID NO: 395361 - DNA, 20 bp, Artificial Sequence
  chemically synthesized
ctaattaatcctattattaa

SEQ ID NO: 395362 - DNA, 20 bp, Artificial Sequence
  chemically synthesized
aattagacaactattaataa

SEQ ID NO: 395363 - DNA, 20 bp, Artificial Sequence
  chemically synthesized
ggaacagaatagtgagaaat

SEQ ID NO: 395364 - DNA, 20 bp, Artificial Sequence
  chemically synthesized
aggctaaggaacagaatagt

SEQ ID NO: 395365 - DNA, 20 bp, Artificial Sequence
  chemically synthesized
ctttaggctaaggaacagaa

SEQ ID NO: 395366 - DNA, 20 bp, Artificial Sequence
  chemically synthesized
tttctcactattctgttcct

SEQ ID NO: 395367 - DNA, 20 bp, Artificial Sequence
  chemically synthesized
gaaacctttaggctaaggaa

SEQ ID NO: 395368 - DNA, 20 bp, Artificial Sequence
  chemically synthesized
ctattctgttccttagccta

SEQ ID NO: 395369 - DNA, 20 bp, Artificial Sequence
  chemically synthesized
gttatgaaacctttaggcta

SEQ ID NO: 395370 - DNA, 20 bp, Artificial Sequence
  chemically synthesized
tattctgttccttagcctaa

SEQ ID NO: 395371 - DNA, 20 bp, Artificial Sequence
  chemically synthesized
agttatgaaacctttaggct

SEQ ID NO: 395372 - DNA, 20 bp, Artificial Sequence
  chemically synthesized
tacagagttatgaaaccttt

SEQ ID NO: 395373 - DNA, 20 bp, Artificial Sequence
  chemically synthesized
atacagagttatgaaacctt

SEQ ID NO: 395374 - DNA, 20 bp, Artificial Sequence
  chemically synthesized
ggttttctcattttcataca

SEQ ID NO: 395375 - DNA, 20 bp, Artificial Sequence
  chemically synthesized
caggttttctcattttcata

SEQ ID NO: 395376 - DNA, 20 bp, Artificial Sequence
  chemically synthesized
tcataactctgtatgaaaat

SEQ ID NO: 395377 - DNA, 20 bp, Artificial Sequence
  chemically synthesized
aacatatattaatcaatgac

SEQ ID NO: 395378 - DNA, 20 bp, Artificial Sequence
  chemically synthesized
aaacatatattaatcaatga

SEQ ID NO: 395379 - DNA, 20 bp, Artificial Sequence
  chemically synthesized
ttctatgtgcagtaacattg

SEQ ID NO: 395380 - DNA, 20 bp, Artificial Sequence
  chemically synthesized
aactgcaatgttactgcaca

SEQ ID NO: 395381 - DNA, 20 bp, Artificial Sequence
  chemically synthesized
aggagttacatttctatgtg

SEQ ID NO: 395382 - DNA, 20 bp, Artificial Sequence
  chemically synthesized
agaaatgtaactccttgatt

SEQ ID NO: 395383 - DNA, 20 bp, Artificial Sequence
  chemically synthesized
caatgtgctcctcaatcaag

SEQ ID NO: 395384 - DNA, 20 bp, Artificial Sequence
  chemically synthesized
gaaatgtaactccttgattg

SEQ ID NO: 395385 - DNA, 20 bp, Artificial Sequence
  chemically synthesized
ggcaatgtgctcctcaatca

SEQ ID NO: 395386 - DNA, 20 bp, Artificial Sequence
  chemically synthesized
aatgtaactccttgattgag

SEQ ID NO: 395387 - DNA, 20 bp, Artificial Sequence
  chemically synthesized
tggcaatgtgctcctcaatc

SEQ ID NO: 395388 - DNA, 20 bp, Artificial Sequence
  chemically synthesized
gaggagcacattgccacaca

SEQ ID NO: 395389 - DNA, 20 bp, Artificial Sequence
  chemically synthesized
cattttggagattccatgtg

SEQ ID NO: 395390 - DNA, 20 bp, Artificial Sequence
  chemically synthesized
gattttcacttggcattttg

SEQ ID NO: 395391 - DNA, 20 bp, Artificial Sequence
  chemically synthesized
catggaatctccaaaatgcc

SEQ ID NO: 395392 - DNA, 20 bp, Artificial Sequence
  chemically synthesized
gtgattttcacttggcattt

SEQ ID NO: 395393 - DNA, 20 bp, Artificial Sequence
  chemically synthesized
taagagtggtgattttcact

SEQ ID NO: 395394 - DNA, 20 bp, Artificial Sequence
  chemically synthesized
aagtgaaaatcaccactctt

SEQ ID NO: 395395 - DNA, 20 bp, Artificial Sequence
  chemically synthesized
gtgaaaatcaccactcttaa

SEQ ID NO: 395396 - DNA, 20 bp, Artificial Sequence
  chemically synthesized
ctgaaataaactcttaagag

SEQ ID NO: 395397 - DNA, 20 bp, Artificial Sequence
  chemically synthesized
actctgaaataaactcttaa

SEQ ID NO: 395398 - DNA, 20 bp, Artificial Sequence
  chemically synthesized
acactctgaaataaactctt

SEQ ID NO: 395399 - DNA, 20 bp, Artificial Sequence
  chemically synthesized
ccactcttaagagtttattt

SEQ ID NO: 395400 - DNA, 20 bp, Artificial Sequence
  chemically synthesized
actcttaagagtttatttca

SEQ ID NO: 395401 - DNA, 20 bp, Artificial Sequence
  chemically synthesized
agagtgttgactaaattgtt

SEQ ID NO: 395402 - DNA, 20 bp, Artificial Sequence
  chemically synthesized
aaagaagtccccaaacaatt

SEQ ID NO: 395403 - DNA, 20 bp, Artificial Sequence
  chemically synthesized
gagtgttgactaaattgttt

SEQ ID NO: 395404 - DNA, 20 bp, Artificial Sequence
  chemically synthesized
agtgttgactaaattgtttg

SEQ ID NO: 395405 - DNA, 20 bp, Artificial Sequence
  chemically synthesized
agtttatgttataggcaaag

SEQ ID NO: 395406 - DNA, 20 bp, Artificial Sequence
  chemically synthesized
ttaagtttatgttataggca

SEQ ID NO: 395407 - DNA, 20 bp, Artificial Sequence
  chemically synthesized
aactcttaagtttatgttat

SEQ ID NO: 395408 - DNA, 20 bp, Artificial Sequence
  chemically synthesized
aaactcttaagtttatgtta

SEQ ID NO: 395409 - DNA, 20 bp, Artificial Sequence
  chemically synthesized
tttgcctataacataaactt

SEQ ID NO: 395410 - DNA, 20 bp, Artificial Sequence
  chemically synthesized
tgcctataacataaacttaa

SEQ ID NO: 395411 - DNA, 20 bp, Artificial Sequence
  chemically synthesized
caagtacctcaaaaactctt

SEQ ID NO: 395412 - DNA, 20 bp, Artificial Sequence
  chemically synthesized
acataaacttaagagttttt

SEQ ID NO: 395413 - DNA, 20 bp, Artificial Sequence
  chemically synthesized
cataaacttaagagtttttg

SEQ ID NO: 395414 - DNA, 20 bp, Artificial Sequence
  chemically synthesized
tatttgattaaaaggaaaac

SEQ ID NO: 395415 - DNA, 20 bp, Artificial Sequence
  chemically synthesized
tccctaagtatttgattaaa

SEQ ID NO: 395416 - DNA, 20 bp, Artificial Sequence
  chemically synthesized
ttccctaagtatttgattaa

SEQ ID NO: 395417 - DNA, 20 bp, Artificial Sequence
  chemically synthesized
tttccttttaatcaaatact

SEQ ID NO: 395418 - DNA, 20 bp, Artificial Sequence
  chemically synthesized
ttccttttaatcaaatactt

SEQ ID NO: 395419 - DNA, 20 bp, Artificial Sequence
  chemically synthesized
tccttttaatcaaatactta

SEQ ID NO: 395420 - DNA, 20 bp, Artificial Sequence
  chemically synthesized
gaagacacttataattccct

SEQ ID NO: 395421 - DNA, 20 bp, Artificial Sequence
  chemically synthesized
tcaaatacttagggaattat

SEQ ID NO: 395422 - DNA, 20 bp, Artificial Sequence
  chemically synthesized
gggaattataagtgtcttct

SEQ ID NO: 395423 - DNA, 20 bp, Artificial Sequence
  chemically synthesized
gaattataagtgtcttctta

SEQ ID NO: 395424 - DNA, 20 bp, Artificial Sequence
  chemically synthesized
atgaaagcatggtctctaag

SEQ ID NO: 395425 - DNA, 20 bp, Artificial Sequence
  chemically synthesized
ggcatgaaagcatggtctct

SEQ ID NO: 395426 - DNA, 20 bp, Artificial Sequence
  chemically synthesized
tgtagctaggcatgaaagca

SEQ ID NO: 395427 - DNA, 20 bp, Artificial Sequence
  chemically synthesized
agagaccatgctttcatgcc

SEQ ID NO: 395428 - DNA, 20 bp, Artificial Sequence
  chemically synthesized
tcaactgtagctaggcatga

SEQ ID NO: 395429 - DNA, 20 bp, Artificial Sequence
  chemically synthesized
catgctttcatgcctagcta

SEQ ID NO: 395430 - DNA, 20 bp, Artificial Sequence
  chemically synthesized
agagttggtcaactgtagct

SEQ ID NO: 395431 - DNA, 20 bp, Artificial Sequence
  chemically synthesized
aagagttggtcaactgtagc

SEQ ID NO: 395432 - DNA, 20 bp, Artificial Sequence
  chemically synthesized
ttaaaagagttggtcaactg

SEQ ID NO: 395433 - DNA, 20 bp, Artificial Sequence
  chemically synthesized
acaaagctttttaaaagagt

SEQ ID NO: 395434 - DNA, 20 bp, Artificial Sequence
  chemically synthesized
agttgaccaactcttttaaa

SEQ ID NO: 395435 - DNA, 20 bp, Artificial Sequence
  chemically synthesized
ggagacaaagctttttaaaa

SEQ ID NO: 395436 - DNA, 20 bp, Artificial Sequence
  chemically synthesized
caggagacaaagctttttaa

SEQ ID NO: 395437 - DNA, 20 bp, Artificial Sequence
  chemically synthesized
tattattatttcaggagaca

SEQ ID NO: 395438 - DNA, 20 bp, Artificial Sequence
  chemically synthesized
tgttcctattattatttcag

SEQ ID NO: 395439 - DNA, 20 bp, Artificial Sequence
  chemically synthesized
tttgttcctattattatttc

SEQ ID NO: 395440 - DNA, 20 bp, Artificial Sequence
  chemically synthesized
gtttgttcctattattattt

SEQ ID NO: 395441 - DNA, 20 bp, Artificial Sequence
  chemically synthesized
tttgtctcctgaaataataa

SEQ ID NO: 395442 - DNA, 20 bp, Artificial Sequence
  chemically synthesized
ttgtctcctgaaataataat

SEQ ID NO: 395443 - DNA, 20 bp, Artificial Sequence
  chemically synthesized
cttcttctcttagaaatgtt

SEQ ID NO: 395444 - DNA, 20 bp, Artificial Sequence
  chemically synthesized
ggaacaaactcaacatttct

SEQ ID NO: 395445 - DNA, 20 bp, Artificial Sequence
  chemically synthesized
aacaaactcaacatttctaa

SEQ ID NO: 395446 - DNA, 20 bp, Artificial Sequence
  chemically synthesized
aaactcaacatttctaagag

SEQ ID NO: 395447 - DNA, 20 bp, Artificial Sequence
  chemically synthesized
ctcaacatttctaagagaag

SEQ ID NO: 395448 - DNA, 20 bp, Artificial Sequence
  chemically synthesized
ataacggtgtcttcttctct

SEQ ID NO: 395449 - DNA, 20 bp, Artificial Sequence
  chemically synthesized
acactgcactcagttgataa

SEQ ID NO: 395450 - DNA, 20 bp, Artificial Sequence
  chemically synthesized
agaagacaccgttatcaact

SEQ ID NO: 395451 - DNA, 20 bp, Artificial Sequence
  chemically synthesized
acaccgttatcaactgagtg

SEQ ID NO: 395452 - DNA, 20 bp, Artificial Sequence
  chemically synthesized
ctgatgaattacactgcact

SEQ ID NO: 395453 - DNA, 20 bp, Artificial Sequence
  chemically synthesized
ctgagtgcagtgtaattcat

SEQ ID NO: 395454 - DNA, 20 bp, Artificial Sequence
  chemically synthesized
tcattgataaaatcatattc

SEQ ID NO: 395455 - DNA, 20 bp, Artificial Sequence
  chemically synthesized
gaatgaatcctggattaatc

SEQ ID NO: 395456 - DNA, 20 bp, Artificial Sequence
  chemically synthesized
aatcatattctagattaatc

SEQ ID NO: 395457 - DNA, 20 bp, Artificial Sequence
  chemically synthesized
atcatattctagattaatcc

SEQ ID NO: 395458 - DNA, 20 bp, Artificial Sequence
  chemically synthesized
agaaataattgaatgaatcc

SEQ ID NO: 395459 - DNA, 20 bp, Artificial Sequence
  chemically synthesized
ttgaagggaaagagatttgg

SEQ ID NO: 395460 - DNA, 20 bp, Artificial Sequence
  chemically synthesized
ctcttgaagggaaagagatt

SEQ ID NO: 395461 - DNA, 20 bp, Artificial Sequence
  chemically synthesized
ctccctctcttgaagggaaa

SEQ ID NO: 395462 - DNA, 20 bp, Artificial Sequence
  chemically synthesized
taccaaatctctttcccttc

SEQ ID NO: 395463 - DNA, 20 bp, Artificial Sequence
  chemically synthesized
cactccctctcttgaaggga

SEQ ID NO: 395464 - DNA, 20 bp, Artificial Sequence
  chemically synthesized
ccaaatctctttcccttcaa

SEQ ID NO: 395465 - DNA, 20 bp, Artificial Sequence
  chemically synthesized
aaatctctttcccttcaaga

SEQ ID NO: 395466 - DNA, 20 bp, Artificial Sequence
  chemically synthesized
actccactccctctcttgaa

SEQ ID NO: 395467 - DNA, 20 bp, Artificial Sequence
  chemically synthesized
aatctctttcccttcaagag

SEQ ID NO: 395468 - DNA, 20 bp, Artificial Sequence
  chemically synthesized
aactccactccctctcttga

SEQ ID NO: 395469 - DNA, 20 bp, Artificial Sequence
  chemically synthesized
atctctttcccttcaagaga

SEQ ID NO: 395470 - DNA, 20 bp, Artificial Sequence
  chemically synthesized
taactccactccctctcttg

SEQ ID NO: 395471 - DNA, 20 bp, Artificial Sequence
  chemically synthesized
ctctttcccttcaagagagg

SEQ ID NO: 395472 - DNA, 20 bp, Artificial Sequence
  chemically synthesized
tttcccttcaagagagggag

SEQ ID NO: 395473 - DNA, 20 bp, Artificial Sequence
  chemically synthesized
tcccttcaagagagggagtg

SEQ ID NO: 395474 - DNA, 20 bp, Artificial Sequence
  chemically synthesized
ttcaagagagggagtggagt

SEQ ID NO: 395475 - DNA, 20 bp, Artificial Sequence
  chemically synthesized
attattttggattagcattt

SEQ ID NO: 395476 - DNA, 20 bp, Artificial Sequence
  chemically synthesized
tggcccttattattttggat

SEQ ID NO: 395477 - DNA, 20 bp, Artificial Sequence
  chemically synthesized
aaatgctaatccaaaataat

SEQ ID NO: 395478 - DNA, 20 bp, Artificial Sequence
  chemically synthesized
ttaaatggcccttattattt

SEQ ID NO: 395479 - DNA, 20 bp, Artificial Sequence
  chemically synthesized
aatgctaatccaaaataata

SEQ ID NO: 395480 - DNA, 20 bp, Artificial Sequence
  chemically synthesized
atgctaatccaaaataataa

SEQ ID NO: 395481 - DNA, 20 bp, Artificial Sequence
  chemically synthesized
caaaataataagggccattt

SEQ ID NO: 395482 - DNA, 20 bp, Artificial Sequence
  chemically synthesized
aaataataagggccatttaa

SEQ ID NO: 395483 - DNA, 20 bp, Artificial Sequence
  chemically synthesized
actcaataacttctcttaaa

SEQ ID NO: 395484 - DNA, 20 bp, Artificial Sequence
  chemically synthesized
taataagggccatttaagag

SEQ ID NO: 395485 - DNA, 20 bp, Artificial Sequence
  chemically synthesized
gccatttaagagaagttatt

SEQ ID NO: 395486 - DNA, 20 bp, Artificial Sequence
  chemically synthesized
gagaagttattgagttgctt

SEQ ID NO: 395487 - DNA, 20 bp, Artificial Sequence
  chemically synthesized
catagaatctacaagttcta

SEQ ID NO: 395488 - DNA, 20 bp, Artificial Sequence
  chemically synthesized
ttgagttgctttagaacttg

SEQ ID NO: 395489 - DNA, 20 bp, Artificial Sequence
  chemically synthesized
cagcatagcatagaatctac

SEQ ID NO: 395490 - DNA, 20 bp, Artificial Sequence
  chemically synthesized
cttacagtgacagcatagca

SEQ ID NO: 395491 - DNA, 20 bp, Artificial Sequence
  chemically synthesized
tgctacttacagtgacagca

SEQ ID NO: 395492 - DNA, 20 bp, Artificial Sequence
  chemically synthesized
ctatgctatgctgtcactgt

SEQ ID NO: 395493 - DNA, 20 bp, Artificial Sequence
  chemically synthesized
aataatgctacttacagtga

SEQ ID NO: 395494 - DNA, 20 bp, Artificial Sequence
  chemically synthesized
tgctatgctgtcactgtaag

SEQ ID NO: 395495 - DNA, 20 bp, Artificial Sequence
  chemically synthesized
ttctaaaataatgctactta

SEQ ID NO: 395496 - DNA, 20 bp, Artificial Sequence
  chemically synthesized
cactgtaagtagcattattt

SEQ ID NO: 395497 - DNA, 20 bp, Artificial Sequence
  chemically synthesized
catgttaaattaaggtttag

SEQ ID NO: 395498 - DNA, 20 bp, Artificial Sequence
  chemically synthesized
tcatgttaaattaaggttta

SEQ ID NO: 395499 - DNA, 20 bp, Artificial Sequence
  chemically synthesized
ttcatgttaaattaaggttt

SEQ ID NO: 395500 - DNA, 20 bp, Artificial Sequence
  chemically synthesized
tttcatgttaaattaaggtt

SEQ ID NO: 395501 - DNA, 20 bp, Artificial Sequence
  chemically synthesized
aaccatttcatgttaaatta

SEQ ID NO: 395502 - DNA, 20 bp, Artificial Sequence
  chemically synthesized
gaaccatttcatgttaaatt

SEQ ID NO: 395503 - DNA, 20 bp, Artificial Sequence
  chemically synthesized
aaccttaatttaacatgaaa

SEQ ID NO: 395504 - DNA, 20 bp, Artificial Sequence
  chemically synthesized
gatcacagttcaggtggttg

SEQ ID NO: 395505 - DNA, 20 bp, Artificial Sequence
  chemically synthesized
tgatttgatcacagttcagg

SEQ ID NO: 395506 - DNA, 20 bp, Artificial Sequence
  chemically synthesized
acatgatttgatcacagttc

SEQ ID NO: 395507 - DNA, 20 bp, Artificial Sequence
  chemically synthesized
gacatgatttgatcacagtt

SEQ ID NO: 395508 - DNA, 20 bp, Artificial Sequence
  chemically synthesized
taagtgacatgatttgatca

SEQ ID NO: 395509 - DNA, 20 bp, Artificial Sequence
  chemically synthesized
tgtgatcaaatcatgtcact

SEQ ID NO: 395510 - DNA, 20 bp, Artificial Sequence
  chemically synthesized
gtactgctttacatggatct

SEQ ID NO: 395511 - DNA, 20 bp, Artificial Sequence
  chemically synthesized
atgtcacttagatccatgta

SEQ ID NO: 395512 - DNA, 20 bp, Artificial Sequence
  chemically synthesized
tcacttagatccatgtaaag

SEQ ID NO: 395513 - DNA, 20 bp, Artificial Sequence
  chemically synthesized
gtagtaagtactgctttaca

SEQ ID NO: 395514 - DNA, 20 bp, Artificial Sequence
  chemically synthesized
ccaggtgagaggggtgtagt

SEQ ID NO: 395515 - DNA, 20 bp, Artificial Sequence
  chemically synthesized
ctctccaggtgagaggggtg

SEQ ID NO: 395516 - DNA, 20 bp, Artificial Sequence
  chemically synthesized
gtaaactctccaggtgagag

SEQ ID NO: 395517 - DNA, 20 bp, Artificial Sequence
  chemically synthesized
cttactacacccctctcacc

SEQ ID NO: 395518 - DNA, 20 bp, Artificial Sequence
  chemically synthesized
agtaaactctccaggtgaga

SEQ ID NO: 395519 - DNA, 20 bp, Artificial Sequence
  chemically synthesized
cagtaaactctccaggtgag

SEQ ID NO: 395520 - DNA, 20 bp, Artificial Sequence
  chemically synthesized
tactacacccctctcacctg

SEQ ID NO: 395521 - DNA, 20 bp, Artificial Sequence
  chemically synthesized
tcagtaaactctccaggtga

SEQ ID NO: 395522 - DNA, 20 bp, Artificial Sequence
  chemically synthesized
ctacacccctctcacctgga

SEQ ID NO: 395523 - DNA, 20 bp, Artificial Sequence
  chemically synthesized
tttcagtaaactctccaggt

SEQ ID NO: 395524 - DNA, 20 bp, Artificial Sequence
  chemically synthesized
tgcctttcagtaaactctcc

SEQ ID NO: 395525 - DNA, 20 bp, Artificial Sequence
  chemically synthesized
atgcctttcagtaaactctc

SEQ ID NO: 395526 - DNA, 20 bp, Artificial Sequence
  chemically synthesized
tcacctggagagtttactga

SEQ ID NO: 395527 - DNA, 20 bp, Artificial Sequence
  chemically synthesized
cacctggagagtttactgaa

SEQ ID NO: 395528 - DNA, 20 bp, Artificial Sequence
  chemically synthesized
ttttccctaggtatgccttt

SEQ ID NO: 395529 - DNA, 20 bp, Artificial Sequence
  chemically synthesized
agtttactgaaaggcatacc

SEQ ID NO: 395530 - DNA, 20 bp, Artificial Sequence
  chemically synthesized
gtttactgaaaggcatacct

SEQ ID NO: 395531 - DNA, 20 bp, Artificial Sequence
  chemically synthesized
tttactgaaaggcataccta

SEQ ID NO: 395532 - DNA, 20 bp, Artificial Sequence
  chemically synthesized
tgaaaggcatacctagggaa

SEQ ID NO: 395533 - DNA, 20 bp, Artificial Sequence
  chemically synthesized
gaaaggcatacctagggaaa

SEQ ID NO: 395534 - DNA, 20 bp, Artificial Sequence
  chemically synthesized
tagatgaatgccttttccct

SEQ ID NO: 395535 - DNA, 20 bp, Artificial Sequence
  chemically synthesized
ctagatgaatgccttttccc

SEQ ID NO: 395536 - DNA, 20 bp, Artificial Sequence
  chemically synthesized
ctagggaaaaggcattcatc

SEQ ID NO: 395537 - DNA, 20 bp, Artificial Sequence
  chemically synthesized
ctttcaaactggggcagcac

SEQ ID NO: 395538 - DNA, 20 bp, Artificial Sequence
  chemically synthesized
gcattcatctagtgctgccc

SEQ ID NO: 395539 - DNA, 20 bp, Artificial Sequence
  chemically synthesized
ggtacgctttcaaactgggg

SEQ ID NO: 395540 - DNA, 20 bp, Artificial Sequence
  chemically synthesized
tttggtacgctttcaaactg

SEQ ID NO: 395541 - DNA, 20 bp, Artificial Sequence
  chemically synthesized
ctagtgctgccccagtttga

SEQ ID NO: 395542 - DNA, 20 bp, Artificial Sequence
  chemically synthesized
ttttggtacgctttcaaact

SEQ ID NO: 395543 - DNA, 20 bp, Artificial Sequence
  chemically synthesized
tttttggtacgctttcaaac

SEQ ID NO: 395544 - DNA, 20 bp, Artificial Sequence
  chemically synthesized
cagtttgaaagcgtaccaaa

SEQ ID NO: 395545 - DNA, 20 bp, Artificial Sequence
  chemically synthesized
aaccttgtgtgaatactttt

SEQ ID NO: 395546 - DNA, 20 bp, Artificial Sequence
  chemically synthesized
gtaccaaaaagtattcacac

SEQ ID NO: 395547 - DNA, 20 bp, Artificial Sequence
  chemically synthesized
taccaaaaagtattcacaca

SEQ ID NO: 395548 - DNA, 20 bp, Artificial Sequence
  chemically synthesized
acacaaggtttgtgtcacac

SEQ ID NO: 395549 - DNA, 20 bp, Artificial Sequence
  chemically synthesized
cacaaggtttgtgtcacaca

SEQ ID NO: 395550 - DNA, 20 bp, Artificial Sequence
  chemically synthesized
caaggtttgtgtcacacaag

SEQ ID NO: 395551 - DNA, 20 bp, Artificial Sequence
  chemically synthesized
gtttcaagaacaggcacata

SEQ ID NO: 395552 - DNA, 20 bp, Artificial Sequence
  chemically synthesized
ctgctgtgggtttcaagaac

SEQ ID NO: 395553 - DNA, 20 bp, Artificial Sequence
  chemically synthesized
actgctgtgggtttcaagaa

SEQ ID NO: 395554 - DNA, 20 bp, Artificial Sequence
  chemically synthesized
ccattactgctgtgggtttc

SEQ ID NO: 395555 - DNA, 20 bp, Artificial Sequence
  chemically synthesized
gtgcctgttcttgaaaccca

SEQ ID NO: 395556 - DNA, 20 bp, Artificial Sequence
  chemically synthesized
cctgttcttgaaacccacag

SEQ ID NO: 395557 - DNA, 20 bp, Artificial Sequence
  chemically synthesized
tctgttaccattactgctgt

SEQ ID NO: 395558 - DNA, 20 bp, Artificial Sequence
  chemically synthesized
ttctgttaccattactgctg

SEQ ID NO: 395559 - DNA, 20 bp, Artificial Sequence
  chemically synthesized
cttgaaacccacagcagtaa

SEQ ID NO: 395560 - DNA, 20 bp, Artificial Sequence
  chemically synthesized
acccacagcagtaatggtaa

SEQ ID NO: 395561 - DNA, 20 bp, Artificial Sequence
  chemically synthesized
cacagcagtaatggtaacag

SEQ ID NO: 395562 - DNA, 20 bp, Artificial Sequence
  chemically synthesized
aatggtaacagaagaataac

SEQ ID NO: 395563 - DNA, 20 bp, Artificial Sequence
  chemically synthesized
aaagcttggtatatggaatc

SEQ ID NO: 395564 - DNA, 20 bp, Artificial Sequence
  chemically synthesized
atatcttgattccatatacc

SEQ ID NO: 395565 - DNA, 20 bp, Artificial Sequence
  chemically synthesized
ctaggataaagcttggtata

SEQ ID NO: 395566 - DNA, 20 bp, Artificial Sequence
  chemically synthesized
accttttctaggataaagct

SEQ ID NO: 395567 - DNA, 20 bp, Artificial Sequence
  chemically synthesized
ccatataccaagctttatcc

SEQ ID NO: 395568 - DNA, 20 bp, Artificial Sequence
  chemically synthesized
tcccaaccttttctaggata

SEQ ID NO: 395569 - DNA, 20 bp, Artificial Sequence
  chemically synthesized
taccaagctttatcctagaa

SEQ ID NO: 395570 - DNA, 20 bp, Artificial Sequence
  chemically synthesized
accaagctttatcctagaaa

SEQ ID NO: 395571 - DNA, 20 bp, Artificial Sequence
  chemically synthesized
cagtaatcccaaccttttct

SEQ ID NO: 395572 - DNA, 20 bp, Artificial Sequence
  chemically synthesized
ccagtaatcccaaccttttc

SEQ ID NO: 395573 - DNA, 20 bp, Artificial Sequence
  chemically synthesized
agctttatcctagaaaaggt

SEQ ID NO: 395574 - DNA, 20 bp, Artificial Sequence
  chemically synthesized
gctttatcctagaaaaggtt

SEQ ID NO: 395575 - DNA, 20 bp, Artificial Sequence
  chemically synthesized
ctagaaaaggttgggattac

SEQ ID NO: 395576 - DNA, 20 bp, Artificial Sequence
  chemically synthesized
gttgggattactggacttaa

SEQ ID NO: 395577 - DNA, 20 bp, Artificial Sequence
  chemically synthesized
ataccatgttcttttaagtc

SEQ ID NO: 395578 - DNA, 20 bp, Artificial Sequence
  chemically synthesized
acggaataccatgttctttt

SEQ ID NO: 395579 - DNA, 20 bp, Artificial Sequence
  chemically synthesized
ttactggacttaaaagaaca

SEQ ID NO: 395580 - DNA, 20 bp, Artificial Sequence
  chemically synthesized
agaacatggtattccgtaat

SEQ ID NO: 395581 - DNA, 20 bp, Artificial Sequence
  chemically synthesized
aaattaaggttgtctgatta

SEQ ID NO: 395582 - DNA, 20 bp, Artificial Sequence
  chemically synthesized
gtaatcagacaaccttaatt

SEQ ID NO: 395583 - DNA, 20 bp, Artificial Sequence
  chemically synthesized
taatcagacaaccttaattt

SEQ ID NO: 395584 - DNA, 20 bp, Artificial Sequence
  chemically synthesized
tccagaatggtcccaaatta

SEQ ID NO: 395585 - DNA, 20 bp, Artificial Sequence
  chemically synthesized
ctccagaatggtcccaaatt

SEQ ID NO: 395586 - DNA, 20 bp, Artificial Sequence
  chemically synthesized
accttaatttgggaccattc

SEQ ID NO: 395587 - DNA, 20 bp, Artificial Sequence
  chemically synthesized
cttaatttgggaccattctg

SEQ ID NO: 395588 - DNA, 20 bp, Artificial Sequence
  chemically synthesized
gtggtaagcagtctccagaa

SEQ ID NO: 395589 - DNA, 20 bp, Artificial Sequence
  chemically synthesized
tcactgtggtaagcagtctc

SEQ ID NO: 395590 - DNA, 20 bp, Artificial Sequence
  chemically synthesized
attctggagactgcttacca

SEQ ID NO: 395591 - DNA, 20 bp, Artificial Sequence
  chemically synthesized
ataattatcactgtggtaag

SEQ ID NO: 395592 - DNA, 20 bp, Artificial Sequence
  chemically synthesized
ggtataattatcactgtggt

SEQ ID NO: 395593 - DNA, 20 bp, Artificial Sequence
  chemically synthesized
attaggtataattatcactg

SEQ ID NO: 395594 - DNA, 20 bp, Artificial Sequence
  chemically synthesized
aaaatgaattttaacaaatt

SEQ ID NO: 395595 - DNA, 20 bp, Artificial Sequence
  chemically synthesized
aaaaatgaattttaacaaat

SEQ ID NO: 395596 - DNA, 20 bp, Artificial Sequence
  chemically synthesized
tttctaattattattataat

SEQ ID NO: 395597 - DNA, 20 bp, Artificial Sequence
  chemically synthesized
tttccaattataataataat

SEQ ID NO: 395598 - DNA, 20 bp, Artificial Sequence
  chemically synthesized
taataattagaaaactataa

SEQ ID NO: 395599 - DNA, 20 bp, Artificial Sequence
  chemically synthesized
actgcatttgtatactttta

SEQ ID NO: 395600 - DNA, 20 bp, Artificial Sequence
  chemically synthesized
actataaaagtatacaaatg

SEQ ID NO: 395601 - DNA, 20 bp, Artificial Sequence
  chemically synthesized
aaatgcagtacgttttatct

SEQ ID NO: 395602 - DNA, 20 bp, Artificial Sequence
  chemically synthesized
ttttgaagtagaagaaaact

SEQ ID NO: 395603 - DNA, 20 bp, Artificial Sequence
  chemically synthesized
tatatataattttgaagtag

SEQ ID NO: 395604 - DNA, 20 bp, Artificial Sequence
  chemically synthesized
taatatatataattttgaag

SEQ ID NO: 395605 - DNA, 20 bp, Artificial Sequence
  chemically synthesized
agataatatatataattttg

SEQ ID NO: 395606 - DNA, 20 bp, Artificial Sequence
  chemically synthesized
ctgaaaagaaaaacaaattt

SEQ ID NO: 395607 - DNA, 20 bp, Artificial Sequence
  chemically synthesized
ctaaaatttgtttttctttt

SEQ ID NO: 395608 - DNA, 20 bp, Artificial Sequence
  chemically synthesized
taaaatttgtttttcttttc

SEQ ID NO: 395609 - DNA, 20 bp, Artificial Sequence
  chemically synthesized
taccttagaaataacctgaa

SEQ ID NO: 395610 - DNA, 20 bp, Artificial Sequence
  chemically synthesized
tttcttttcaggttatttct

SEQ ID NO: 395611 - DNA, 20 bp, Artificial Sequence
  chemically synthesized
ttcttttcaggttatttcta

SEQ ID NO: 395612 - DNA, 20 bp, Artificial Sequence
  chemically synthesized
taacaaaaatcaaagtacct

SEQ ID NO: 395613 - DNA, 20 bp, Artificial Sequence
  chemically synthesized
gaattatttaacaaaaatca

SEQ ID NO: 395614 - DNA, 20 bp, Artificial Sequence
  chemically synthesized
ttgatttttgttaaataatt

SEQ ID NO: 395615 - DNA, 20 bp, Artificial Sequence
  chemically synthesized
tttttttctacataaaaacg

SEQ ID NO: 395616 - DNA, 20 bp, Artificial Sequence
  chemically synthesized
ttaaattccacgtttttatg

SEQ ID NO: 395617 - DNA, 20 bp, Artificial Sequence
  chemically synthesized
tttttatgtagaaaaaaatc

SEQ ID NO: 395618 - DNA, 20 bp, Artificial Sequence
  chemically synthesized
ttttatgtagaaaaaaatca

SEQ ID NO: 395619 - DNA, 20 bp, Artificial Sequence
  chemically synthesized
gattgcacttttgaatataa

SEQ ID NO: 395620 - DNA, 20 bp, Artificial Sequence
  chemically synthesized
acgattgcacttttgaatat

SEQ ID NO: 395621 - DNA, 20 bp, Artificial Sequence
  chemically synthesized
ttgatttctcttatattcaa

SEQ ID NO: 395622 - DNA, 20 bp, Artificial Sequence
  chemically synthesized
tactttcatctcaatgtaga

SEQ ID NO: 395623 - DNA, 20 bp, Artificial Sequence
  chemically synthesized
aatcgttttctttctacatt

SEQ ID NO: 395624 - DNA, 20 bp, Artificial Sequence
  chemically synthesized
aaaatactttcatctcaatg

SEQ ID NO: 395625 - DNA, 20 bp, Artificial Sequence
  chemically synthesized
ttctttctacattgagatga

SEQ ID NO: 395626 - DNA, 20 bp, Artificial Sequence
  chemically synthesized
acattgagatgaaagtattt

SEQ ID NO: 395627 - DNA, 20 bp, Artificial Sequence
  chemically synthesized
attgagatgaaagtattttg

SEQ ID NO: 395628 - DNA, 20 bp, Artificial Sequence
  chemically synthesized
aaaagctatttgcaattatt

SEQ ID NO: 395629 - DNA, 20 bp, Artificial Sequence
  chemically synthesized
acacgctaaataattgcaaa

SEQ ID NO: 395630 - DNA, 20 bp, Artificial Sequence
  chemically synthesized
ataattgcaaatagctttta

SEQ ID NO: 395631 - DNA, 20 bp, Artificial Sequence
  chemically synthesized
taattgcaaatagcttttaa

SEQ ID NO: 395632 - DNA, 20 bp, Artificial Sequence
  chemically synthesized
ttgcaaactttagcctttaa

SEQ ID NO: 395633 - DNA, 20 bp, Artificial Sequence
  chemically synthesized
caaatagcttttaaaggcta

SEQ ID NO: 395634 - DNA, 20 bp, Artificial Sequence
  chemically synthesized
ctcttcagtattgcaaactt

SEQ ID NO: 395635 - DNA, 20 bp, Artificial Sequence
  chemically synthesized
ggctaaagtttgcaatactg

SEQ ID NO: 395636 - DNA, 20 bp, Artificial Sequence
  chemically synthesized
ctaaagtttgcaatactgaa

SEQ ID NO: 395637 - DNA, 20 bp, Artificial Sequence
  chemically synthesized
acaatgctggtttagctctt

SEQ ID NO: 395638 - DNA, 20 bp, Artificial Sequence
  chemically synthesized
gcaatactgaagagctaaac

SEQ ID NO: 395639 - DNA, 20 bp, Artificial Sequence
  chemically synthesized
tctaatggacaatgctggtt

SEQ ID NO: 395640 - DNA, 20 bp, Artificial Sequence
  chemically synthesized
aaaattctaatggacaatgc

SEQ ID NO: 395641 - DNA, 20 bp, Artificial Sequence
  chemically synthesized
gctaaaccagcattgtccat

SEQ ID NO: 395642 - DNA, 20 bp, Artificial Sequence
  chemically synthesized
atcaccaccaaaaattctaa

SEQ ID NO: 395643 - DNA, 20 bp, Artificial Sequence
  chemically synthesized
gcattgtccattagaatttt

SEQ ID NO: 395644 - DNA, 20 bp, Artificial Sequence
  chemically synthesized
ttgtccattagaatttttgg

SEQ ID NO: 395645 - DNA, 20 bp, Artificial Sequence
  chemically synthesized
cgtgttatgtagtgcatgta

SEQ ID NO: 395646 - DNA, 20 bp, Artificial Sequence
  chemically synthesized
ttagtggccatcgtgttatg

SEQ ID NO: 395647 - DNA, 20 bp, Artificial Sequence
  chemically synthesized
acatgcactacataacacga

SEQ ID NO: 395648 - DNA, 20 bp, Artificial Sequence
  chemically synthesized
cagtagtcacatggttttag

SEQ ID NO: 395649 - DNA, 20 bp, Artificial Sequence
  chemically synthesized
gctcagtagtcacatggttt

SEQ ID NO: 395650 - DNA, 20 bp, Artificial Sequence
  chemically synthesized
tgaagtgctcagtagtcaca

SEQ ID NO: 395651 - DNA, 20 bp, Artificial Sequence
  chemically synthesized
actaaaaccatgtgactact

SEQ ID NO: 395652 - DNA, 20 bp, Artificial Sequence
  chemically synthesized
gctacatttgaagtgctcag

SEQ ID NO: 395653 - DNA, 20 bp, Artificial Sequence
  chemically synthesized
ctagctacatttgaagtgct

SEQ ID NO: 395654 - DNA, 20 bp, Artificial Sequence
  chemically synthesized
actactgagcacttcaaatg

SEQ ID NO: 395655 - DNA, 20 bp, Artificial Sequence
  chemically synthesized
cattttgctagctacatttg

SEQ ID NO: 395656 - DNA, 20 bp, Artificial Sequence
  chemically synthesized
ctgagcacttcaaatgtagc

SEQ ID NO: 395657 - DNA, 20 bp, Artificial Sequence
  chemically synthesized
ttcaaatgtagctagcaaaa

SEQ ID NO: 395658 - DNA, 20 bp, Artificial Sequence
  chemically synthesized
atgttgttcctccattttgc

SEQ ID NO: 395659 - DNA, 20 bp, Artificial Sequence
  chemically synthesized
caaatgtagctagcaaaatg

SEQ ID NO: 395660 - DNA, 20 bp, Artificial Sequence
  chemically synthesized
aaatgtagctagcaaaatgg

SEQ ID NO: 395661 - DNA, 20 bp, Artificial Sequence
  chemically synthesized
agcaaaatggaggaacaaca

SEQ ID NO: 395662 - DNA, 20 bp, Artificial Sequence
  chemically synthesized
atttaaattagtgaaagtaa

SEQ ID NO: 395663 - DNA, 20 bp, Artificial Sequence
  chemically synthesized
ttttgaatttaaattagtga

SEQ ID NO: 395664 - DNA, 20 bp, Artificial Sequence
  chemically synthesized
aaattattttgaatttaaat

SEQ ID NO: 395665 - DNA, 20 bp, Artificial Sequence
  chemically synthesized
atttggtagccattagacaa

SEQ ID NO: 395666 - DNA, 20 bp, Artificial Sequence
  chemically synthesized
aattttttgccattgtctaa

SEQ ID NO: 395667 - DNA, 20 bp, Artificial Sequence
  chemically synthesized
ctgtccaatttggtagccat

SEQ ID NO: 395668 - DNA, 20 bp, Artificial Sequence
  chemically synthesized
ttgtctaatggctaccaaat

SEQ ID NO: 395669 - DNA, 20 bp, Artificial Sequence
  chemically synthesized
acttgtgctgtccaatttgg

SEQ ID NO: 395670 - DNA, 20 bp, Artificial Sequence
  chemically synthesized
ctaatggctaccaaattgga

SEQ ID NO: 395671 - DNA, 20 bp, Artificial Sequence
  chemically synthesized
tagacttgtgctgtccaatt

SEQ ID NO: 395672 - DNA, 20 bp, Artificial Sequence
  chemically synthesized
gctaccaaattggacagcac

SEQ ID NO: 395673 - DNA, 20 bp, Artificial Sequence
  chemically synthesized
caaattggacagcacaagtc

SEQ ID NO: 395674 - DNA, 20 bp, Artificial Sequence
  chemically synthesized
atgtattagtaattaaattc

SEQ ID NO: 395675 - DNA, 20 bp, Artificial Sequence
  chemically synthesized
taaaaaaagtatacatgtat

SEQ ID NO: 395676 - DNA, 20 bp, Artificial Sequence
  chemically synthesized
tacatgtatactttttttat

SEQ ID NO: 395677 - DNA, 20 bp, Artificial Sequence
  chemically synthesized
gacatatgtaccaataaaaa

SEQ ID NO: 395678 - DNA, 20 bp, Artificial Sequence
  chemically synthesized
tattggtacatatgtcatat

SEQ ID NO: 395679 - DNA, 20 bp, Artificial Sequence
  chemically synthesized
attggtacatatgtcatata

SEQ ID NO: 395680 - DNA, 20 bp, Artificial Sequence
  chemically synthesized
gtcatataaggttgtatgcg

SEQ ID NO: 395681 - DNA, 20 bp, Artificial Sequence
  chemically synthesized
atataaggttgtatgcgcag

SEQ ID NO: 395682 - DNA, 20 bp, Artificial Sequence
  chemically synthesized
gttgtatgcgcagaagcata

SEQ ID NO: 395683 - DNA, 20 bp, Artificial Sequence
  chemically synthesized
cgcagaagcatacagataaa

SEQ ID NO: 395684 - DNA, 20 bp, Artificial Sequence
  chemically synthesized
gcttttagatagtaacaaga

SEQ ID NO: 395685 - DNA, 20 bp, Artificial Sequence
  chemically synthesized
gttggcttttagatagtaac

SEQ ID NO: 395686 - DNA, 20 bp, Artificial Sequence
  chemically synthesized
gccatcttgttactatctaa

SEQ ID NO: 395687 - DNA, 20 bp, Artificial Sequence
  chemically synthesized
tttgtatgttggcttttaga

SEQ ID NO: 395688 - DNA, 20 bp, Artificial Sequence
  chemically synthesized
aacatttgtatgttggcttt

SEQ ID NO: 395689 - DNA, 20 bp, Artificial Sequence
  chemically synthesized
gtcataaaacatttgtatgt

SEQ ID NO: 395690 - DNA, 20 bp, Artificial Sequence
  chemically synthesized
agaatctgtggcattttttt

SEQ ID NO: 395691 - DNA, 20 bp, Artificial Sequence
  chemically synthesized
tatgacttaaaaaaatgcca

SEQ ID NO: 395692 - DNA, 20 bp, Artificial Sequence
  chemically synthesized
taaagtgaagcaagaatctg

SEQ ID NO: 395693 - DNA, 20 bp, Artificial Sequence
  chemically synthesized
tcctcacattaaagtgaagc

SEQ ID NO: 395694 - DNA, 20 bp, Artificial Sequence
  chemically synthesized
gagttcctcacattaaagtg

SEQ ID NO: 395695 - DNA, 20 bp, Artificial Sequence
  chemically synthesized
ttcttgcttcactttaatgt

SEQ ID NO: 395696 - DNA, 20 bp, Artificial Sequence
  chemically synthesized
tcttgcttcactttaatgtg

SEQ ID NO: 395697 - DNA, 20 bp, Artificial Sequence
  chemically synthesized
tatctgagttcctcacatta

SEQ ID NO: 395698 - DNA, 20 bp, Artificial Sequence
  chemically synthesized
tcactttaatgtgaggaact

SEQ ID NO: 395699 - DNA, 20 bp, Artificial Sequence
  chemically synthesized
aattatgttaataaatatct

SEQ ID NO: 395700 - DNA, 20 bp, Artificial Sequence
  chemically synthesized
attaacataattttgaccaa

SEQ ID NO: 395701 - DNA, 20 bp, Artificial Sequence
  chemically synthesized
aacataattttgaccaaaag

SEQ ID NO: 395702 - DNA, 20 bp, Artificial Sequence
  chemically synthesized
tttggtatggaggctacttt

SEQ ID NO: 395703 - DNA, 20 bp, Artificial Sequence
  chemically synthesized
aataattgcatttggtatgg

SEQ ID NO: 395704 - DNA, 20 bp, Artificial Sequence
  chemically synthesized
aaataattgcatttggtatg

SEQ ID NO: 395705 - DNA, 20 bp, Artificial Sequence
  chemically synthesized
ctaaataattgcatttggta

SEQ ID NO: 395706 - DNA, 20 bp, Artificial Sequence
  chemically synthesized
aatggctaaataattgcatt

SEQ ID NO: 395707 - DNA, 20 bp, Artificial Sequence
  chemically synthesized
ccataccaaatgcaattatt

SEQ ID NO: 395708 - DNA, 20 bp, Artificial Sequence
  chemically synthesized
aattatttagccatttctgc

SEQ ID NO: 395709 - DNA, 20 bp, Artificial Sequence
  chemically synthesized
aatctccagtcttgcagaaa

SEQ ID NO: 395710 - DNA, 20 bp, Artificial Sequence
  chemically synthesized
tttagccatttctgcaagac

SEQ ID NO: 395711 - DNA, 20 bp, Artificial Sequence
  chemically synthesized
ggaaaaaatctccagtcttg

SEQ ID NO: 395712 - DNA, 20 bp, Artificial Sequence
  chemically synthesized
tagccatttctgcaagactg

SEQ ID NO: 395713 - DNA, 20 bp, Artificial Sequence
  chemically synthesized
gtttttggggaaaaaatctc

SEQ ID NO: 395714 - DNA, 20 bp, Artificial Sequence
  chemically synthesized
atttttctagttagtttttg

SEQ ID NO: 395715 - DNA, 20 bp, Artificial Sequence
  chemically synthesized
tatttttctagttagttttt

SEQ ID NO: 395716 - DNA, 20 bp, Artificial Sequence
  chemically synthesized
ttatttttctagttagtttt

SEQ ID NO: 395717 - DNA, 20 bp, Artificial Sequence
  chemically synthesized
ttttttccccaaaaactaac

SEQ ID NO: 395718 - DNA, 20 bp, Artificial Sequence
  chemically synthesized
gattaagttatttttctagt

SEQ ID NO: 395719 - DNA, 20 bp, Artificial Sequence
  chemically synthesized
agaggattaagttatttttc

SEQ ID NO: 395720 - DNA, 20 bp, Artificial Sequence
  chemically synthesized
gcatattaaaacagaggatt

SEQ ID NO: 395721 - DNA, 20 bp, Artificial Sequence
  chemically synthesized
gaaatggcatattaaaacag

SEQ ID NO: 395722 - DNA, 20 bp, Artificial Sequence
  chemically synthesized
tgaaatggcatattaaaaca

SEQ ID NO: 395723 - DNA, 20 bp, Artificial Sequence
  chemically synthesized
tgtgaaatggcatattaaaa

SEQ ID NO: 395724 - DNA, 20 bp, Artificial Sequence
  chemically synthesized
tgttttaatatgccatttca

SEQ ID NO: 395725 - DNA, 20 bp, Artificial Sequence
  chemically synthesized
agcaattgcaagctgtgaaa

SEQ ID NO: 395726 - DNA, 20 bp, Artificial Sequence
  chemically synthesized
cattcacaataagcaattgc

SEQ ID NO: 395727 - DNA, 20 bp, Artificial Sequence
  chemically synthesized
gaaataggagcattcacaat

SEQ ID NO: 395728 - DNA, 20 bp, Artificial Sequence
  chemically synthesized
agtttcaagaaaagaaatag

SEQ ID NO: 395729 - DNA, 20 bp, Artificial Sequence
  chemically synthesized
aaagtttcaagaaaagaaat

SEQ ID NO: 395730 - DNA, 20 bp, Artificial Sequence
  chemically synthesized
caaagtttcaagaaaagaaa

SEQ ID NO: 395731 - DNA, 20 bp, Artificial Sequence
  chemically synthesized
ttttgccaaagtttcaagaa

SEQ ID NO: 395732 - DNA, 20 bp, Artificial Sequence
  chemically synthesized
tatttcttttcttgaaactt

SEQ ID NO: 395733 - DNA, 20 bp, Artificial Sequence
  chemically synthesized
aatagttttgccaaagtttc

SEQ ID NO: 395734 - DNA, 20 bp, Artificial Sequence
  chemically synthesized
ctggcataatagttttgcca

SEQ ID NO: 395735 - DNA, 20 bp, Artificial Sequence
  chemically synthesized
ctttggcaaaactattatgc

SEQ ID NO: 395736 - DNA, 20 bp, Artificial Sequence
  chemically synthesized
taaatcatgttctggcataa

SEQ ID NO: 395737 - DNA, 20 bp, Artificial Sequence
  chemically synthesized
acaaaatgtaaatcatgttc

SEQ ID NO: 395738 - DNA, 20 bp, Artificial Sequence
  chemically synthesized
tttgtcattcatttaaaatt

SEQ ID NO: 395739 - DNA, 20 bp, Artificial Sequence
  chemically synthesized
cattcatttaaaattcagaa

SEQ ID NO: 395740 - DNA, 20 bp, Artificial Sequence
  chemically synthesized
aatagacttaatggcataaa

SEQ ID NO: 395741 - DNA, 20 bp, Artificial Sequence
  chemically synthesized
gaatggctttttatgccatt

SEQ ID NO: 395742 - DNA, 20 bp, Artificial Sequence
  chemically synthesized
atgtaaataaatagacttaa

SEQ ID NO: 395743 - DNA, 20 bp, Artificial Sequence
  chemically synthesized
ttgtctttaatgtaaataaa

SEQ ID NO: 395744 - DNA, 20 bp, Artificial Sequence
  chemically synthesized
aagtctatttatttacatta

SEQ ID NO: 395745 - DNA, 20 bp, Artificial Sequence
  chemically synthesized
caaatgcatacttaacaatt

SEQ ID NO: 395746 - DNA, 20 bp, Artificial Sequence
  chemically synthesized
attgttttctccaaattgtt

SEQ ID NO: 395747 - DNA, 20 bp, Artificial Sequence
  chemically synthesized
aatgcatacttaacaatttg

SEQ ID NO: 395748 - DNA, 20 bp, Artificial Sequence
  chemically synthesized
aatttggagaaaacaatcaa

SEQ ID NO: 395749 - DNA, 20 bp, Artificial Sequence
  chemically synthesized
caccaattagaatgattcaa

SEQ ID NO: 395750 - DNA, 20 bp, Artificial Sequence
  chemically synthesized
agcttttgaatcattctaat

SEQ ID NO: 395751 - DNA, 20 bp, Artificial Sequence
  chemically synthesized
tttgaatcattctaattggt

SEQ ID NO: 395752 - DNA, 20 bp, Artificial Sequence
  chemically synthesized
ttgaatcattctaattggtg

SEQ ID NO: 395753 - DNA, 20 bp, Artificial Sequence
  chemically synthesized
aagaataagccctcaccaat

SEQ ID NO: 395754 - DNA, 20 bp, Artificial Sequence
  chemically synthesized
tgaatcattctaattggtga

SEQ ID NO: 395755 - DNA, 20 bp, Artificial Sequence
  chemically synthesized
gatgttactttttaaagaat

SEQ ID NO: 395756 - DNA, 20 bp, Artificial Sequence
  chemically synthesized
gtgagggcttattctttaaa

SEQ ID NO: 395757 - DNA, 20 bp, Artificial Sequence
  chemically synthesized
caaatagatgttacttttta

SEQ ID NO: 395758 - DNA, 20 bp, Artificial Sequence
  chemically synthesized
aaagtaacatctatttgatg

SEQ ID NO: 395759 - DNA, 20 bp, Artificial Sequence
  chemically synthesized
gatcacagatctacatcaaa

SEQ ID NO: 395760 - DNA, 20 bp, Artificial Sequence
  chemically synthesized
attagttttctgtcagatca

SEQ ID NO: 395761 - DNA, 20 bp, Artificial Sequence
  chemically synthesized
gatgtagatctgtgatctga

SEQ ID NO: 395762 - DNA, 20 bp, Artificial Sequence
  chemically synthesized
taaaacaattagttttctgt

SEQ ID NO: 395763 - DNA, 20 bp, Artificial Sequence
  chemically synthesized
ttacaaatacttaaaacaat

SEQ ID NO: 395764 - DNA, 20 bp, Artificial Sequence
  chemically synthesized
gacagaaaactaattgtttt

SEQ ID NO: 395765 - DNA, 20 bp, Artificial Sequence
  chemically synthesized
gttttaagtatttgtaatcc

SEQ ID NO: 395766 - DNA, 20 bp, Artificial Sequence
  chemically synthesized
ttaagtatttgtaatccaag

SEQ ID NO: 395767 - DNA, 20 bp, Artificial Sequence
  chemically synthesized
agtatttgtaatccaagcag

SEQ ID NO: 395768 - DNA, 20 bp, Artificial Sequence
  chemically synthesized
tcatttgcatcactgctgct

SEQ ID NO: 395769 - DNA, 20 bp, Artificial Sequence
  chemically synthesized
atgcaaatgaatttaattat

SEQ ID NO: 395770 - DNA, 20 bp, Artificial Sequence
  chemically synthesized
cagtttaaaaatccaaacaa

SEQ ID NO: 395771 - DNA, 20 bp, Artificial Sequence
  chemically synthesized
agtttaaaaatccaaacaat

SEQ ID NO: 395772 - DNA, 20 bp, Artificial Sequence
  chemically synthesized
ttgtcttacttcccattgtt

SEQ ID NO: 395773 - DNA, 20 bp, Artificial Sequence
  chemically synthesized
ttaaaaatccaaacaatggg

SEQ ID NO: 395774 - DNA, 20 bp, Artificial Sequence
  chemically synthesized
aaatccaaacaatgggaagt

SEQ ID NO: 395775 - DNA, 20 bp, Artificial Sequence
  chemically synthesized
aagacaacacgctgccttca

SEQ ID NO: 395776 - DNA, 20 bp, Artificial Sequence
  chemically synthesized
tattactatagctttgaagg

SEQ ID NO: 395777 - DNA, 20 bp, Artificial Sequence
  chemically synthesized
ttttattactatagctttga

SEQ ID NO: 395778 - DNA, 20 bp, Artificial Sequence
  chemically synthesized
cttttattactatagctttg

SEQ ID NO: 395779 - DNA, 20 bp, Artificial Sequence
  chemically synthesized
acacgctgccttcaaagcta

SEQ ID NO: 395780 - DNA, 20 bp, Artificial Sequence
  chemically synthesized
tagcacttcttttattacta

SEQ ID NO: 395781 - DNA, 20 bp, Artificial Sequence
  chemically synthesized
cttcaaagctatagtaataa

SEQ ID NO: 395782 - DNA, 20 bp, Artificial Sequence
  chemically synthesized
caaagctatagtaataaaag

SEQ ID NO: 395783 - DNA, 20 bp, Artificial Sequence
  chemically synthesized
tatagtaataaaagaagtgc

SEQ ID NO: 395784 - DNA, 20 bp, Artificial Sequence
  chemically synthesized
aggtacatgaggaaatgtac

SEQ ID NO: 395785 - DNA, 20 bp, Artificial Sequence
  chemically synthesized
cactcatttccaggtacatg

SEQ ID NO: 395786 - DNA, 20 bp, Artificial Sequence
  chemically synthesized
agtacatttcctcatgtacc

SEQ ID NO: 395787 - DNA, 20 bp, Artificial Sequence
  chemically synthesized
ccactcatttccaggtacat

SEQ ID NO: 395788 - DNA, 20 bp, Artificial Sequence
  chemically synthesized
ttcctcatgtacctggaaat

SEQ ID NO: 395789 - DNA, 20 bp, Artificial Sequence
  chemically synthesized
aatctgggccactcatttcc

SEQ ID NO: 395790 - DNA, 20 bp, Artificial Sequence
  chemically synthesized
aaatctgggccactcatttc

SEQ ID NO: 395791 - DNA, 20 bp, Artificial Sequence
  chemically synthesized
ctcatgtacctggaaatgag

SEQ ID NO: 395792 - DNA, 20 bp, Artificial Sequence
  chemically synthesized
gtacctggaaatgagtggcc

SEQ ID NO: 395793 - DNA, 20 bp, Artificial Sequence
  chemically synthesized
actttagtgcaagcaaatct

SEQ ID NO: 395794 - DNA, 20 bp, Artificial Sequence
  chemically synthesized
gactttagtgcaagcaaatc

SEQ ID NO: 395795 - DNA, 20 bp, Artificial Sequence
  chemically synthesized
gcccagatttgcttgcacta

SEQ ID NO: 395796 - DNA, 20 bp, Artificial Sequence
  chemically synthesized
aggcatgtagactttagtgc

SEQ ID NO: 395797 - DNA, 20 bp, Artificial Sequence
  chemically synthesized
aaaattaggcatgtagactt

SEQ ID NO: 395798 - DNA, 20 bp, Artificial Sequence
  chemically synthesized
aatgattaaaattaggcatg

SEQ ID NO: 395799 - DNA, 20 bp, Artificial Sequence
  chemically synthesized
caatcaaaatgattaaaatt

SEQ ID NO: 395800 - DNA, 20 bp, Artificial Sequence
  chemically synthesized
acaatcaaaatgattaaaat

SEQ ID NO: 395801 - DNA, 20 bp, Artificial Sequence
  chemically synthesized
attgtataatcaacttcccc

SEQ ID NO: 395802 - DNA, 20 bp, Artificial Sequence
  chemically synthesized
tctttagaaatgactggggg

SEQ ID NO: 395803 - DNA, 20 bp, Artificial Sequence
  chemically synthesized
ttatctttagaaatgactgg

SEQ ID NO: 395804 - DNA, 20 bp, Artificial Sequence
  chemically synthesized
tttatctttagaaatgactg

SEQ ID NO: 395805 - DNA, 20 bp, Artificial Sequence
  chemically synthesized
atttatctttagaaatgact

SEQ ID NO: 395806 - DNA, 20 bp, Artificial Sequence
  chemically synthesized
aatttatctttagaaatgac

SEQ ID NO: 395807 - DNA, 20 bp, Artificial Sequence
  chemically synthesized
acttcccccagtcatttcta

SEQ ID NO: 395808 - DNA, 20 bp, Artificial Sequence
  chemically synthesized
catgcatcttaatttatctt

SEQ ID NO: 395809 - DNA, 20 bp, Artificial Sequence
  chemically synthesized
gtcatttctaaagataaatt

SEQ ID NO: 395810 - DNA, 20 bp, Artificial Sequence
  chemically synthesized
ttaagatgcatgctttcatt

SEQ ID NO: 395811 - DNA, 20 bp, Artificial Sequence
  chemically synthesized
gggtgttttattcttaatga

SEQ ID NO: 395812 - DNA, 20 bp, Artificial Sequence
  chemically synthesized
ttagaaatatgaagaaatca

SEQ ID NO: 395813 - DNA, 20 bp, Artificial Sequence
  chemically synthesized
tttagaaatatgaagaaatc

SEQ ID NO: 395814 - DNA, 20 bp, Artificial Sequence
  chemically synthesized
atttagaaatatgaagaaat

SEQ ID NO: 395815 - DNA, 20 bp, Artificial Sequence
  chemically synthesized
gcaagttatttagaaatatg

SEQ ID NO: 395816 - DNA, 20 bp, Artificial Sequence
  chemically synthesized
cctggaaaaggcaagttatt

SEQ ID NO: 395817 - DNA, 20 bp, Artificial Sequence
  chemically synthesized
tcagaaaacctggaaaaggc

SEQ ID NO: 395818 - DNA, 20 bp, Artificial Sequence
  chemically synthesized
tctaaataacttgccttttc

SEQ ID NO: 395819 - DNA, 20 bp, Artificial Sequence
  chemically synthesized
ctaaataacttgccttttcc

SEQ ID NO: 395820 - DNA, 20 bp, Artificial Sequence
  chemically synthesized
tacctcagaaaacctggaaa

SEQ ID NO: 395821 - DNA, 20 bp, Artificial Sequence
  chemically synthesized
ttacctcagaaaacctggaa

SEQ ID NO: 395822 - DNA, 20 bp, Artificial Sequence
  chemically synthesized
aattcttacctcagaaaacc

SEQ ID NO: 395823 - DNA, 20 bp, Artificial Sequence
  chemically synthesized
ttgccttttccaggttttct

SEQ ID NO: 395824 - DNA, 20 bp, Artificial Sequence
  chemically synthesized
tgccttttccaggttttctg

SEQ ID NO: 395825 - DNA, 20 bp, Artificial Sequence
  chemically synthesized
ttttccaggttttctgaggt

SEQ ID NO: 395826 - DNA, 20 bp, Artificial Sequence
  chemically synthesized
tcattcaggaattcttacct

SEQ ID NO: 395827 - DNA, 20 bp, Artificial Sequence
  chemically synthesized
tacttttgtgagtatcattc

SEQ ID NO: 395828 - DNA, 20 bp, Artificial Sequence
  chemically synthesized
ttacttttgtgagtatcatt

SEQ ID NO: 395829 - DNA, 20 bp, Artificial Sequence
  chemically synthesized
ttcctgaatgatactcacaa

SEQ ID NO: 395830 - DNA, 20 bp, Artificial Sequence
  chemically synthesized
agtgtacattttacttttgt

SEQ ID NO: 395831 - DNA, 20 bp, Artificial Sequence
  chemically synthesized
agtaaaatgtacactgaatc

SEQ ID NO: 395832 - DNA, 20 bp, Artificial Sequence
  chemically synthesized
ataaatataattactagatt

SEQ ID NO: 395833 - DNA, 20 bp, Artificial Sequence
  chemically synthesized
attaaaataaatataattac

SEQ ID NO: 395834 - DNA, 20 bp, Artificial Sequence
  chemically synthesized
tattttaattttctttcttt

SEQ ID NO: 395835 - DNA, 20 bp, Artificial Sequence
  chemically synthesized
caacagtctgttcttaaaga

SEQ ID NO: 395836 - DNA, 20 bp, Artificial Sequence
  chemically synthesized
taattttctttctttaagaa

SEQ ID NO: 395837 - DNA, 20 bp, Artificial Sequence
  chemically synthesized
tggccaacagtctgttctta

SEQ ID NO: 395838 - DNA, 20 bp, Artificial Sequence
  chemically synthesized
tttctttaagaacagactgt

SEQ ID NO: 395839 - DNA, 20 bp, Artificial Sequence
  chemically synthesized
tttaagaacagactgttggc

SEQ ID NO: 395840 - DNA, 20 bp, Artificial Sequence
  chemically synthesized
ttaagaacagactgttggcc

SEQ ID NO: 395841 - DNA, 20 bp, Artificial Sequence
  chemically synthesized
agattaccccacctggccaa

SEQ ID NO: 395842 - DNA, 20 bp, Artificial Sequence
  chemically synthesized
agaacagactgttggccagg

SEQ ID NO: 395843 - DNA, 20 bp, Artificial Sequence
  chemically synthesized
gaacagactgttggccaggt

SEQ ID NO: 395844 - DNA, 20 bp, Artificial Sequence
  chemically synthesized
aacagactgttggccaggtg

SEQ ID NO: 395845 - DNA, 20 bp, Artificial Sequence
  chemically synthesized
aatactgagattaccccacc

SEQ ID NO: 395846 - DNA, 20 bp, Artificial Sequence
  chemically synthesized
ttggccaggtggggtaatct

SEQ ID NO: 395847 - DNA, 20 bp, Artificial Sequence
  chemically synthesized
gtggggtaatctcagtattt

SEQ ID NO: 395848 - DNA, 20 bp, Artificial Sequence
  chemically synthesized
catcggcctcccaaaatact

SEQ ID NO: 395849 - DNA, 20 bp, Artificial Sequence
  chemically synthesized
tggggtaatctcagtatttt

SEQ ID NO: 395850 - DNA, 20 bp, Artificial Sequence
  chemically synthesized
gggtaatctcagtattttgg

SEQ ID NO: 395851 - DNA, 20 bp, Artificial Sequence
  chemically synthesized
ggtaatctcagtattttggg

SEQ ID NO: 395852 - DNA, 20 bp, Artificial Sequence
  chemically synthesized
tcagtattttgggaggccga

SEQ ID NO: 395853 - DNA, 20 bp, Artificial Sequence
  chemically synthesized
cagtattttgggaggccgat

SEQ ID NO: 395854 - DNA, 20 bp, Artificial Sequence
  chemically synthesized
agtattttgggaggccgatg

SEQ ID NO: 395855 - DNA, 20 bp, Artificial Sequence
  chemically synthesized
gtattttgggaggccgatgg

SEQ ID NO: 395856 - DNA, 20 bp, Artificial Sequence
  chemically synthesized
ttttgggaggccgatggggg

SEQ ID NO: 395857 - DNA, 20 bp, Artificial Sequence
  chemically synthesized
ctcaggtgatccgcccccat

SEQ ID NO: 395858 - DNA, 20 bp, Artificial Sequence
  chemically synthesized
ccgatgggggcggatcacct

SEQ ID NO: 395859 - DNA, 20 bp, Artificial Sequence
  chemically synthesized
cgatgggggcggatcacctg

SEQ ID NO: 395860 - DNA, 20 bp, Artificial Sequence
  chemically synthesized
ggtcttgaactcatgacctc

SEQ ID NO: 395861 - DNA, 20 bp, Artificial Sequence
  chemically synthesized
ggcggatcacctgaggtcat

SEQ ID NO: 395862 - DNA, 20 bp, Artificial Sequence
  chemically synthesized
tggtcttgaactcatgacct

SEQ ID NO: 395863 - DNA, 20 bp, Artificial Sequence
  chemically synthesized
tcacctgaggtcatgagttc

SEQ ID NO: 395864 - DNA, 20 bp, Artificial Sequence
  chemically synthesized
tgaggtcatgagttcaagac

SEQ ID NO: 395865 - DNA, 20 bp, Artificial Sequence
  chemically synthesized
tcatgagttcaagaccagcc

SEQ ID NO: 395866 - DNA, 20 bp, Artificial Sequence
  chemically synthesized
tttcaccatgttgaccaggc

SEQ ID NO: 395867 - DNA, 20 bp, Artificial Sequence
  chemically synthesized
ggggtttcaccatgttgacc

SEQ ID NO: 395868 - DNA, 20 bp, Artificial Sequence
  chemically synthesized
caagaccagcctggtcaaca

SEQ ID NO: 395869 - DNA, 20 bp, Artificial Sequence
  chemically synthesized
cggggtttcaccatgttgac

SEQ ID NO: 395870 - DNA, 20 bp, Artificial Sequence
  chemically synthesized
tttgtattttagtagagacg

SEQ ID NO: 395871 - DNA, 20 bp, Artificial Sequence
  chemically synthesized
ttttgtattttagtagagac

SEQ ID NO: 395872 - DNA, 20 bp, Artificial Sequence
  chemically synthesized
tttttgtattttagtagaga

SEQ ID NO: 395873 - DNA, 20 bp, Artificial Sequence
  chemically synthesized
ctaatttttgtattttagta

SEQ ID NO: 395874 - DNA, 20 bp, Artificial Sequence
  chemically synthesized
agctaatttttgtattttag

SEQ ID NO: 395875 - DNA, 20 bp, Artificial Sequence
  chemically synthesized
cccagctaatttttgtattt

SEQ ID NO: 395876 - DNA, 20 bp, Artificial Sequence
  chemically synthesized
ctctactaaaatacaaaaat

SEQ ID NO: 395877 - DNA, 20 bp, Artificial Sequence
  chemically synthesized
actaaaatacaaaaattagc

SEQ ID NO: 395878 - DNA, 20 bp, Artificial Sequence
  chemically synthesized
ctaaaatacaaaaattagct

SEQ ID NO: 395879 - DNA, 20 bp, Artificial Sequence
  chemically synthesized
atacaaaaattagctgggca

SEQ ID NO: 395880 - DNA, 20 bp, Artificial Sequence
  chemically synthesized
caaaaattagctgggcatgg

SEQ ID NO: 395881 - DNA, 20 bp, Artificial Sequence
  chemically synthesized
caggcacctgccaccatgcc

SEQ ID NO: 395882 - DNA, 20 bp, Artificial Sequence
  chemically synthesized
aaattagctgggcatggtgg

SEQ ID NO: 395883 - DNA, 20 bp, Artificial Sequence
  chemically synthesized
aattagctgggcatggtggc

SEQ ID NO: 395884 - DNA, 20 bp, Artificial Sequence
  chemically synthesized
tcccaagtagttgggattac

SEQ ID NO: 395885 - DNA, 20 bp, Artificial Sequence
  chemically synthesized
ctcccaagtagttgggatta

SEQ ID NO: 395886 - DNA, 20 bp, Artificial Sequence
  chemically synthesized
tgcctgtaatcccaactact

SEQ ID NO: 395887 - DNA, 20 bp, Artificial Sequence
  chemically synthesized
cctcagcctcccaagtagtt

SEQ ID NO: 395888 - DNA, 20 bp, Artificial Sequence
  chemically synthesized
gcctgtaatcccaactactt

SEQ ID NO: 395889 - DNA, 20 bp, Artificial Sequence
  chemically synthesized
tcctcagcctcccaagtagt

SEQ ID NO: 395890 - DNA, 20 bp, Artificial Sequence
  chemically synthesized
ctgtaatcccaactacttgg

SEQ ID NO: 395891 - DNA, 20 bp, Artificial Sequence
  chemically synthesized
tgtaatcccaactacttggg

SEQ ID NO: 395892 - DNA, 20 bp, Artificial Sequence
  chemically synthesized
tccttcctcagcctcccaag

SEQ ID NO: 395893 - DNA, 20 bp, Artificial Sequence
  chemically synthesized
ttgtccttcctcagcctccc

SEQ ID NO: 395894 - DNA, 20 bp, Artificial Sequence
  chemically synthesized
tcccaactacttgggaggct

SEQ ID NO: 395895 - DNA, 20 bp, Artificial Sequence
  chemically synthesized
cccaactacttgggaggctg

SEQ ID NO: 395896 - DNA, 20 bp, Artificial Sequence
  chemically synthesized
aactacttgggaggctgagg

SEQ ID NO: 395897 - DNA, 20 bp, Artificial Sequence
  chemically synthesized
actacttgggaggctgagga

SEQ ID NO: 395898 - DNA, 20 bp, Artificial Sequence
  chemically synthesized
ttcaagcgattgtccttcct

SEQ ID NO: 395899 - DNA, 20 bp, Artificial Sequence
  chemically synthesized
gaaggacaatcgcttgaacc

SEQ ID NO: 395900 - DNA, 20 bp, Artificial Sequence
  chemically synthesized
aaggacaatcgcttgaaccc

SEQ ID NO: 395901 - DNA, 20 bp, Artificial Sequence
  chemically synthesized
aacctctgcctcctgggttc

SEQ ID NO: 395902 - DNA, 20 bp, Artificial Sequence
  chemically synthesized
ggacaatcgcttgaacccag

SEQ ID NO: 395903 - DNA, 20 bp, Artificial Sequence
  chemically synthesized
gacaatcgcttgaacccagg

SEQ ID NO: 395904 - DNA, 20 bp, Artificial Sequence
  chemically synthesized
aatcgcttgaacccaggagg

SEQ ID NO: 395905 - DNA, 20 bp, Artificial Sequence
  chemically synthesized
cactgcaacctctgcctcct

SEQ ID NO: 395906 - DNA, 20 bp, Artificial Sequence
  chemically synthesized
tcgcttgaacccaggaggca

SEQ ID NO: 395907 - DNA, 20 bp, Artificial Sequence
  chemically synthesized
tcactgcaacctctgcctcc

SEQ ID NO: 395908 - DNA, 20 bp, Artificial Sequence
  chemically synthesized
cgcttgaacccaggaggcag

SEQ ID NO: 395909 - DNA, 20 bp, Artificial Sequence
  chemically synthesized
aacccaggaggcagaggttg

SEQ ID NO: 395910 - DNA, 20 bp, Artificial Sequence
  chemically synthesized
caggaggcagaggttgcagt

SEQ ID NO: 395911 - DNA, 20 bp, Artificial Sequence
  chemically synthesized
ggcagaggttgcagtgagcc

SEQ ID NO: 395912 - DNA, 20 bp, Artificial Sequence
  chemically synthesized
ggagtgcaatggcgtggtct

SEQ ID NO: 395913 - DNA, 20 bp, Artificial Sequence
  chemically synthesized
caggctggagtgcaatggcg

SEQ ID NO: 395914 - DNA, 20 bp, Artificial Sequence
  chemically synthesized
ttgcccaggctggagtgcaa

SEQ ID NO: 395915 - DNA, 20 bp, Artificial Sequence
  chemically synthesized
aagaccacgccattgcactc

SEQ ID NO: 395916 - DNA, 20 bp, Artificial Sequence
  chemically synthesized
cacgccattgcactccagcc

SEQ ID NO: 395917 - DNA, 20 bp, Artificial Sequence
  chemically synthesized
acgccattgcactccagcct

SEQ ID NO: 395918 - DNA, 20 bp, Artificial Sequence
  chemically synthesized
ggcttttgttgcccaggctg

SEQ ID NO: 395919 - DNA, 20 bp, Artificial Sequence
  chemically synthesized
ttggcttttgttgcccaggc

SEQ ID NO: 395920 - DNA, 20 bp, Artificial Sequence
  chemically synthesized
gagcttggcttttgttgccc

SEQ ID NO: 395921 - DNA, 20 bp, Artificial Sequence
  chemically synthesized
agagcttggcttttgttgcc

SEQ ID NO: 395922 - DNA, 20 bp, Artificial Sequence
  chemically synthesized
cactccagcctgggcaacaa

SEQ ID NO: 395923 - DNA, 20 bp, Artificial Sequence
  chemically synthesized
cagcctgggcaacaaaagcc

SEQ ID NO: 395924 - DNA, 20 bp, Artificial Sequence
  chemically synthesized
tttttttttgagacagagct

SEQ ID NO: 395925 - DNA, 20 bp, Artificial Sequence
  chemically synthesized
ttttttttttttttgagaca

SEQ ID NO: 395926 - DNA, 20 bp, Artificial Sequence
  chemically synthesized
ttttttttttttttttgaga

SEQ ID NO: 395927 - DNA, 20 bp, Artificial Sequence
  chemically synthesized
tttttttttttttttttttt

SEQ ID NO: 395928 - DNA, 20 bp, Artificial Sequence
  chemically synthesized
caaattcaatataaaataga

SEQ ID NO: 395929 - DNA, 20 bp, Artificial Sequence
  chemically synthesized
tactcaaattcaatataaaa

SEQ ID NO: 395930 - DNA, 20 bp, Artificial Sequence
  chemically synthesized
gtctattttatattgaattt

SEQ ID NO: 395931 - DNA, 20 bp, Artificial Sequence
  chemically synthesized
tgagtaaaatgcaaaatatg

SEQ ID NO: 395932 - DNA, 20 bp, Artificial Sequence
  chemically synthesized
tcagtaaaatacattgattt

SEQ ID NO: 395933 - DNA, 20 bp, Artificial Sequence
  chemically synthesized
caatgtattttactgaatat

SEQ ID NO: 395934 - DNA, 20 bp, Artificial Sequence
  chemically synthesized
caatgcgttggtctaatatt

SEQ ID NO: 395935 - DNA, 20 bp, Artificial Sequence
  chemically synthesized
aatccccaactacaatgcgt

SEQ ID NO: 395936 - DNA, 20 bp, Artificial Sequence
  chemically synthesized
aatattagaccaacgcattg

SEQ ID NO: 395937 - DNA, 20 bp, Artificial Sequence
  chemically synthesized
ttagaccaacgcattgtagt

SEQ ID NO: 395938 - DNA, 20 bp, Artificial Sequence
  chemically synthesized
tagaccaacgcattgtagtt

SEQ ID NO: 395939 - DNA, 20 bp, Artificial Sequence
  chemically synthesized
agaccaacgcattgtagttg

SEQ ID NO: 395940 - DNA, 20 bp, Artificial Sequence
  chemically synthesized
gtagttggggattgcccctt

SEQ ID NO: 395941 - DNA, 20 bp, Artificial Sequence
  chemically synthesized
aaatgggagctttgccaaag

SEQ ID NO: 395942 - DNA, 20 bp, Artificial Sequence
  chemically synthesized
tggggattgcccctttggca

SEQ ID NO: 395943 - DNA, 20 bp, Artificial Sequence
  chemically synthesized
taaatgggagctttgccaaa

SEQ ID NO: 395944 - DNA, 20 bp, Artificial Sequence
  chemically synthesized
ctaaatgggagctttgccaa

SEQ ID NO: 395945 - DNA, 20 bp, Artificial Sequence
  chemically synthesized
actaaatgggagctttgcca

SEQ ID NO: 395946 - DNA, 20 bp, Artificial Sequence
  chemically synthesized
cctttggcaaagctcccatt

SEQ ID NO: 395947 - DNA, 20 bp, Artificial Sequence
  chemically synthesized
aatagttgggaactaaatgg

SEQ ID NO: 395948 - DNA, 20 bp, Artificial Sequence
  chemically synthesized
agaatagttgggaactaaat

SEQ ID NO: 395949 - DNA, 20 bp, Artificial Sequence
  chemically synthesized
cagaatagttgggaactaaa

SEQ ID NO: 395950 - DNA, 20 bp, Artificial Sequence
  chemically synthesized
agctataaatcagaatagtt

SEQ ID NO: 395951 - DNA, 20 bp, Artificial Sequence
  chemically synthesized
tagctataaatcagaatagt

SEQ ID NO: 395952 - DNA, 20 bp, Artificial Sequence
  chemically synthesized
atattagctataaatcagaa

SEQ ID NO: 395953 - DNA, 20 bp, Artificial Sequence
  chemically synthesized
ttcccaactattctgattta

SEQ ID NO: 395954 - DNA, 20 bp, Artificial Sequence
  chemically synthesized
tctccatattagctataaat

SEQ ID NO: 395955 - DNA, 20 bp, Artificial Sequence
  chemically synthesized
attctgatttatagctaata

SEQ ID NO: 395956 - DNA, 20 bp, Artificial Sequence
  chemically synthesized
tctgatttatagctaatatg

SEQ ID NO: 395957 - DNA, 20 bp, Artificial Sequence
  chemically synthesized
ttcctaacttttctccatat

SEQ ID NO: 395958 - DNA, 20 bp, Artificial Sequence
  chemically synthesized
tttatagctaatatggagaa

SEQ ID NO: 395959 - DNA, 20 bp, Artificial Sequence
  chemically synthesized
tagctaatatggagaaaagt

SEQ ID NO: 395960 - DNA, 20 bp, Artificial Sequence
  chemically synthesized
agctaatatggagaaaagtt

SEQ ID NO: 395961 - DNA, 20 bp, Artificial Sequence
  chemically synthesized
tggagaaaagttaggaaatg

SEQ ID NO: 395962 - DNA, 20 bp, Artificial Sequence
  chemically synthesized
gttaggaaatgaagaatttt

SEQ ID NO: 395963 - DNA, 20 bp, Artificial Sequence
  chemically synthesized
tcttggttttataattgtgt

SEQ ID NO: 395964 - DNA, 20 bp, Artificial Sequence
  chemically synthesized
actgacacaattataaaacc

SEQ ID NO: 395965 - DNA, 20 bp, Artificial Sequence
  chemically synthesized
tgacacaattataaaaccaa

SEQ ID NO: 395966 - DNA, 20 bp, Artificial Sequence
  chemically synthesized
gacacaattataaaaccaag

SEQ ID NO: 395967 - DNA, 20 bp, Artificial Sequence
  chemically synthesized
aactgtaggctttttcctct

SEQ ID NO: 395968 - DNA, 20 bp, Artificial Sequence
  chemically synthesized
attataaaaccaagaggaaa

SEQ ID NO: 395969 - DNA, 20 bp, Artificial Sequence
  chemically synthesized
aaccaagaggaaaaagccta

SEQ ID NO: 395970 - DNA, 20 bp, Artificial Sequence
  chemically synthesized
ttttttggtttaaaaactgt

SEQ ID NO: 395971 - DNA, 20 bp, Artificial Sequence
  chemically synthesized
gttttttggtttaaaaactg

SEQ ID NO: 395972 - DNA, 20 bp, Artificial Sequence
  chemically synthesized
ggttctaaagttaggttttt

SEQ ID NO: 395973 - DNA, 20 bp, Artificial Sequence
  chemically synthesized
taaaccaaaaaacctaactt

SEQ ID NO: 395974 - DNA, 20 bp, Artificial Sequence
  chemically synthesized
caaatccgggttctaaagtt

SEQ ID NO: 395975 - DNA, 20 bp, Artificial Sequence
  chemically synthesized
acaaatccgggttctaaagt

SEQ ID NO: 395976 - DNA, 20 bp, Artificial Sequence
  chemically synthesized
aaaaacctaactttagaacc

SEQ ID NO: 395977 - DNA, 20 bp, Artificial Sequence
  chemically synthesized
actcacaaatccgggttcta

SEQ ID NO: 395978 - DNA, 20 bp, Artificial Sequence
  chemically synthesized
aactacttactcacaaatcc

SEQ ID NO: 395979 - DNA, 20 bp, Artificial Sequence
  chemically synthesized
actttagaacccggatttgt

SEQ ID NO: 395980 - DNA, 20 bp, Artificial Sequence
  chemically synthesized
aaactacttactcacaaatc

SEQ ID NO: 395981 - DNA, 20 bp, Artificial Sequence
  chemically synthesized
tagaacccggatttgtgagt

SEQ ID NO: 395982 - DNA, 20 bp, Artificial Sequence
  chemically synthesized
aacccggatttgtgagtaag

SEQ ID NO: 395983 - DNA, 20 bp, Artificial Sequence
  chemically synthesized
gatttgtgagtaagtagttt

SEQ ID NO: 395984 - DNA, 20 bp, Artificial Sequence
  chemically synthesized
tgtgagtaagtagtttgagc

SEQ ID NO: 395985 - DNA, 20 bp, Artificial Sequence
  chemically synthesized
agtagtttgagcaagtcatt

SEQ ID NO: 395986 - DNA, 20 bp, Artificial Sequence
  chemically synthesized
catttagacaaatgctcttc

SEQ ID NO: 395987 - DNA, 20 bp, Artificial Sequence
  chemically synthesized
gtcttgacctatagcttgaa

SEQ ID NO: 395988 - DNA, 20 bp, Artificial Sequence
  chemically synthesized
gacaaatgctcttcaagcta

SEQ ID NO: 395989 - DNA, 20 bp, Artificial Sequence
  chemically synthesized
atgtcttgacctatagcttg

SEQ ID NO: 395990 - DNA, 20 bp, Artificial Sequence
  chemically synthesized
acaaatgctcttcaagctat

SEQ ID NO: 395991 - DNA, 20 bp, Artificial Sequence
  chemically synthesized
tgctcttcaagctataggtc

SEQ ID NO: 395992 - DNA, 20 bp, Artificial Sequence
  chemically synthesized
ctcacaaatgtcttgaccta

SEQ ID NO: 395993 - DNA, 20 bp, Artificial Sequence
  chemically synthesized
ctataggtcaagacatttgt

SEQ ID NO: 395994 - DNA, 20 bp, Artificial Sequence
  chemically synthesized
tgacacataaacgggttgta

SEQ ID NO: 395995 - DNA, 20 bp, Artificial Sequence
  chemically synthesized
ggcagttatgacacataaac

SEQ ID NO: 395996 - DNA, 20 bp, Artificial Sequence
  chemically synthesized
tggcagttatgacacataaa

SEQ ID NO: 395997 - DNA, 20 bp, Artificial Sequence
  chemically synthesized
ttgattttttacattaatgg

SEQ ID NO: 395998 - DNA, 20 bp, Artificial Sequence
  chemically synthesized
tatttgattttttacattaa

SEQ ID NO: 395999 - DNA, 20 bp, Artificial Sequence
  chemically synthesized
cattaatgtaaaaaatcaaa

SEQ ID NO: 396000 - DNA, 20 bp, Artificial Sequence
  chemically synthesized
taatgtaaaaaatcaaatag

SEQ ID NO: 396001 - DNA, 20 bp, Artificial Sequence
  chemically synthesized
aatgtaaaaaatcaaataga

SEQ ID NO: 396002 - DNA, 20 bp, Artificial Sequence
  chemically synthesized
taaaaaatcaaatagaaggc

SEQ ID NO: 396003 - DNA, 20 bp, Artificial Sequence
  chemically synthesized
aatcaaatagaaggctggtg

SEQ ID NO: 396004 - DNA, 20 bp, Artificial Sequence
  chemically synthesized
acaggcatgagcgaccgcac

SEQ ID NO: 396005 - DNA, 20 bp, Artificial Sequence
  chemically synthesized
agtgctaggattacaggcat

SEQ ID NO: 396006 - DNA, 20 bp, Artificial Sequence
  chemically synthesized
gtcgctcatgcctgtaatcc

SEQ ID NO: 396007 - DNA, 20 bp, Artificial Sequence
  chemically synthesized
tcccaaagtgctaggattac

SEQ ID NO: 396008 - DNA, 20 bp, Artificial Sequence
  chemically synthesized
ctcccaaagtgctaggatta

SEQ ID NO: 396009 - DNA, 20 bp, Artificial Sequence
  chemically synthesized
tgcctgtaatcctagcactt

SEQ ID NO: 396010 - DNA, 20 bp, Artificial Sequence
  chemically synthesized
cctcagcctcccaaagtgct

SEQ ID NO: 396011 - DNA, 20 bp, Artificial Sequence
  chemically synthesized
gcctgtaatcctagcacttt

SEQ ID NO: 396012 - DNA, 20 bp, Artificial Sequence
  chemically synthesized
gcctcagcctcccaaagtgc

SEQ ID NO: 396013 - DNA, 20 bp, Artificial Sequence
  chemically synthesized
ctgtaatcctagcactttgg

SEQ ID NO: 396014 - DNA, 20 bp, Artificial Sequence
  chemically synthesized
tgtaatcctagcactttggg

SEQ ID NO: 396015 - DNA, 20 bp, Artificial Sequence
  chemically synthesized
ccgcccgcctcagcctccca

SEQ ID NO: 396016 - DNA, 20 bp, Artificial Sequence
  chemically synthesized
tcctagcactttgggaggct

SEQ ID NO: 396017 - DNA, 20 bp, Artificial Sequence
  chemically synthesized
cctagcactttgggaggctg

SEQ ID NO: 396018 - DNA, 20 bp, Artificial Sequence
  chemically synthesized
agcactttgggaggctgagg

SEQ ID NO: 396019 - DNA, 20 bp, Artificial Sequence
  chemically synthesized
gcactttgggaggctgaggc

SEQ ID NO: 396020 - DNA, 20 bp, Artificial Sequence
  chemically synthesized
ctttgggaggctgaggcggg

SEQ ID NO: 396021 - DNA, 20 bp, Artificial Sequence
  chemically synthesized
gtcaggcagtccgcccgcct

SEQ ID NO: 396022 - DNA, 20 bp, Artificial Sequence
  chemically synthesized
cttgaactcctgaggtcagg

SEQ ID NO: 396023 - DNA, 20 bp, Artificial Sequence
  chemically synthesized
gcgggcggactgcctgacct

SEQ ID NO: 396024 - DNA, 20 bp, Artificial Sequence
  chemically synthesized
cgggcggactgcctgacctc

SEQ ID NO: 396025 - DNA, 20 bp, Artificial Sequence
  chemically synthesized
ggtcttgaactcctgaggtc

SEQ ID NO: 396026 - DNA, 20 bp, Artificial Sequence
  chemically synthesized
ggcggactgcctgacctcag

SEQ ID NO: 396027 - DNA, 20 bp, Artificial Sequence
  chemically synthesized
tggtcttgaactcctgaggt

SEQ ID NO: 396028 - DNA, 20 bp, Artificial Sequence
  chemically synthesized
aggctggtcttgaactcctg

SEQ ID NO: 396029 - DNA, 20 bp, Artificial Sequence
  chemically synthesized
caggctggtcttgaactcct

SEQ ID NO: 396030 - DNA, 20 bp, Artificial Sequence
  chemically synthesized
ctgcctgacctcaggagttc

SEQ ID NO: 396031 - DNA, 20 bp, Artificial Sequence
  chemically synthesized
tgacctcaggagttcaagac

SEQ ID NO: 396032 - DNA, 20 bp, Artificial Sequence
  chemically synthesized
tcaggagttcaagaccagcc

SEQ ID NO: 396033 - DNA, 20 bp, Artificial Sequence
  chemically synthesized
caggagttcaagaccagcct

SEQ ID NO: 396034 - DNA, 20 bp, Artificial Sequence
  chemically synthesized
tttcaccgtgttgcccaggc

SEQ ID NO: 396035 - DNA, 20 bp, Artificial Sequence
  chemically synthesized
ggggtttcaccgtgttgccc

SEQ ID NO: 396036 - DNA, 20 bp, Artificial Sequence
  chemically synthesized
caagaccagcctgggcaaca

SEQ ID NO: 396037 - DNA, 20 bp, Artificial Sequence
  chemically synthesized
cggggtttcaccgtgttgcc

SEQ ID NO: 396038 - DNA, 20 bp, Artificial Sequence
  chemically synthesized
attgtattttagtagagacg

SEQ ID NO: 396039 - DNA, 20 bp, Artificial Sequence
  chemically synthesized
tattgtattttagtagagac

SEQ ID NO: 396040 - DNA, 20 bp, Artificial Sequence
  chemically synthesized
ttattgtattttagtagaga

SEQ ID NO: 396041 - DNA, 20 bp, Artificial Sequence
  chemically synthesized
ctaattattgtattttagta

SEQ ID NO: 396042 - DNA, 20 bp, Artificial Sequence
  chemically synthesized
ggctaattattgtattttag

SEQ ID NO: 396043 - DNA, 20 bp, Artificial Sequence
  chemically synthesized
cctggctaattattgtattt

SEQ ID NO: 396044 - DNA, 20 bp, Artificial Sequence
  chemically synthesized
ctctactaaaatacaataat

SEQ ID NO: 396045 - DNA, 20 bp, Artificial Sequence
  chemically synthesized
actaaaatacaataattagc

SEQ ID NO: 396046 - DNA, 20 bp, Artificial Sequence
  chemically synthesized
ctaaaatacaataattagcc

SEQ ID NO: 396047 - DNA, 20 bp, Artificial Sequence
  chemically synthesized
atacaataattagccaggca

SEQ ID NO: 396048 - DNA, 20 bp, Artificial Sequence
  chemically synthesized
caataattagccaggcatgg

SEQ ID NO: 396049 - DNA, 20 bp, Artificial Sequence
  chemically synthesized
caggcacacaccaccatgcc

SEQ ID NO: 396050 - DNA, 20 bp, Artificial Sequence
  chemically synthesized
ggcatggtggtgtgtgcctg

SEQ ID NO: 396051 - DNA, 20 bp, Artificial Sequence
  chemically synthesized
gtggtgtgtgcctgtagtcc

SEQ ID NO: 396052 - DNA, 20 bp, Artificial Sequence
  chemically synthesized
tcccaagtagctgggactac

SEQ ID NO: 396053 - DNA, 20 bp, Artificial Sequence
  chemically synthesized
ctcccaagtagctgggacta

SEQ ID NO: 396054 - DNA, 20 bp, Artificial Sequence
  chemically synthesized
tgcctgtagtcccagctact

SEQ ID NO: 396055 - DNA, 20 bp, Artificial Sequence
  chemically synthesized
ccacagcctcccaagtagct

SEQ ID NO: 396056 - DNA, 20 bp, Artificial Sequence
  chemically synthesized
gcctgtagtcccagctactt

SEQ ID NO: 396057 - DNA, 20 bp, Artificial Sequence
  chemically synthesized
gccacagcctcccaagtagc

SEQ ID NO: 396058 - DNA, 20 bp, Artificial Sequence
  chemically synthesized
ctgtagtcccagctacttgg

SEQ ID NO: 396059 - DNA, 20 bp, Artificial Sequence
  chemically synthesized
tgtagtcccagctacttggg

SEQ ID NO: 396060 - DNA, 20 bp, Artificial Sequence
  chemically synthesized
tcctgccacagcctcccaag

SEQ ID NO: 396061 - DNA, 20 bp, Artificial Sequence
  chemically synthesized
ttctcctgccacagcctccc

SEQ ID NO: 396062 - DNA, 20 bp, Artificial Sequence
  chemically synthesized
cccagctacttgggaggctg

SEQ ID NO: 396063 - DNA, 20 bp, Artificial Sequence
  chemically synthesized
agctacttgggaggctgtgg

SEQ ID NO: 396064 - DNA, 20 bp, Artificial Sequence
  chemically synthesized
gctacttgggaggctgtggc

SEQ ID NO: 396065 - DNA, 20 bp, Artificial Sequence
  chemically synthesized
tacttgggaggctgtggcag

SEQ ID NO: 396066 - DNA, 20 bp, Artificial Sequence
  chemically synthesized
ttcaagcaattctcctgcca

SEQ ID NO: 396067 - DNA, 20 bp, Artificial Sequence
  chemically synthesized
gcaggagaattgcttgaacc

SEQ ID NO: 396068 - DNA, 20 bp, Artificial Sequence
  chemically synthesized
caggagaattgcttgaaccc

SEQ ID NO: 396069 - DNA, 20 bp, Artificial Sequence
  chemically synthesized
aacctctgcctcctgggttc

SEQ ID NO: 396070 - DNA, 20 bp, Artificial Sequence
  chemically synthesized
ggagaattgcttgaacccag

SEQ ID NO: 396071 - DNA, 20 bp, Artificial Sequence
  chemically synthesized
gagaattgcttgaacccagg

SEQ ID NO: 396072 - DNA, 20 bp, Artificial Sequence
  chemically synthesized
aattgcttgaacccaggagg

SEQ ID NO: 396073 - DNA, 20 bp, Artificial Sequence
  chemically synthesized
cactgcaacctctgcctcct

SEQ ID NO: 396074 - DNA, 20 bp, Artificial Sequence
  chemically synthesized
ttgcttgaacccaggaggca

SEQ ID NO: 396075 - DNA, 20 bp, Artificial Sequence
  chemically synthesized
tcactgcaacctctgcctcc

SEQ ID NO: 396076 - DNA, 20 bp, Artificial Sequence
  chemically synthesized
tgcttgaacccaggaggcag

SEQ ID NO: 396077 - DNA, 20 bp, Artificial Sequence
  chemically synthesized
aacccaggaggcagaggttg

SEQ ID NO: 396078 - DNA, 20 bp, Artificial Sequence
  chemically synthesized
caggaggcagaggttgcagt

SEQ ID NO: 396079 - DNA, 20 bp, Artificial Sequence
  chemically synthesized
ggagtgcagtggcatgatat

SEQ ID NO: 396080 - DNA, 20 bp, Artificial Sequence
  chemically synthesized
ttgctcaggctggagtgcag

SEQ ID NO: 396081 - DNA, 20 bp, Artificial Sequence
  chemically synthesized
gatatcatgccactgcactc

SEQ ID NO: 396082 - DNA, 20 bp, Artificial Sequence
  chemically synthesized
ctgttgctcaggctggagtg

SEQ ID NO: 396083 - DNA, 20 bp, Artificial Sequence
  chemically synthesized
atgccactgcactccagcct

SEQ ID NO: 396084 - DNA, 20 bp, Artificial Sequence
  chemically synthesized
agtctctgttgctcaggctg

SEQ ID NO: 396085 - DNA, 20 bp, Artificial Sequence
  chemically synthesized
ggagtctctgttgctcaggc

SEQ ID NO: 396086 - DNA, 20 bp, Artificial Sequence
  chemically synthesized
ctgcactccagcctgagcaa

SEQ ID NO: 396087 - DNA, 20 bp, Artificial Sequence
  chemically synthesized
agatggagtctctgttgctc

SEQ ID NO: 396088 - DNA, 20 bp, Artificial Sequence
  chemically synthesized
gcactccagcctgagcaaca

SEQ ID NO: 396089 - DNA, 20 bp, Artificial Sequence
  chemically synthesized
gagatggagtctctgttgct

SEQ ID NO: 396090 - DNA, 20 bp, Artificial Sequence
  chemically synthesized
tttttcctttttttgagatg

SEQ ID NO: 396091 - DNA, 20 bp, Artificial Sequence
  chemically synthesized
tttttttcctttttttgaga

SEQ ID NO: 396092 - DNA, 20 bp, Artificial Sequence
  chemically synthesized
cagagactccatctcaaaaa

SEQ ID NO: 396093 - DNA, 20 bp, Artificial Sequence
  chemically synthesized
agagactccatctcaaaaaa

SEQ ID NO: 396094 - DNA, 20 bp, Artificial Sequence
  chemically synthesized
tttttttttttccttttttt

SEQ ID NO: 396095 - DNA, 20 bp, Artificial Sequence
  chemically synthesized
aaaggaaaaaaaaaaacaaa

SEQ ID NO: 396096 - DNA, 20 bp, Artificial Sequence
  chemically synthesized
aaaaaaaaaaacaaatagaa

SEQ ID NO: 396097 - DNA, 20 bp, Artificial Sequence
  chemically synthesized
agaatgaaataaaattatta

SEQ ID NO: 396098 - DNA, 20 bp, Artificial Sequence
  chemically synthesized
gaaataaaattattaaagtg

SEQ ID NO: 396099 - DNA, 20 bp, Artificial Sequence
  chemically synthesized
ggtggcatttttagtatatg

SEQ ID NO: 396100 - DNA, 20 bp, Artificial Sequence
  chemically synthesized
tttataaaaggtggcatttt

SEQ ID NO: 396101 - DNA, 20 bp, Artificial Sequence
  chemically synthesized
aacaaaagttttataaaagg

SEQ ID NO: 396102 - DNA, 20 bp, Artificial Sequence
  chemically synthesized
taaaacaaaagttttataaa

SEQ ID NO: 396103 - DNA, 20 bp, Artificial Sequence
  chemically synthesized
ataaaacaaaagttttataa

SEQ ID NO: 396104 - DNA, 20 bp, Artificial Sequence
  chemically synthesized
cacatgcagaaataaaacaa

SEQ ID NO: 396105 - DNA, 20 bp, Artificial Sequence
  chemically synthesized
ccaaaacacacagacacatg

SEQ ID NO: 396106 - DNA, 20 bp, Artificial Sequence
  chemically synthesized
ctgcatgtgtctgtgtgttt

SEQ ID NO: 396107 - DNA, 20 bp, Artificial Sequence
  chemically synthesized
ccagtaccccccaaaacaca

SEQ ID NO: 396108 - DNA, 20 bp, Artificial Sequence
  chemically synthesized
tgcatgtgtctgtgtgtttt

SEQ ID NO: 396109 - DNA, 20 bp, Artificial Sequence
  chemically synthesized
gcatgtgtctgtgtgttttg

SEQ ID NO: 396110 - DNA, 20 bp, Artificial Sequence
  chemically synthesized
catgtgtctgtgtgttttgg

SEQ ID NO: 396111 - DNA, 20 bp, Artificial Sequence
  chemically synthesized
atgtgtctgtgtgttttggg

SEQ ID NO: 396112 - DNA, 20 bp, Artificial Sequence
  chemically synthesized
ctgtgtgttttggggggtac

SEQ ID NO: 396113 - DNA, 20 bp, Artificial Sequence
  chemically synthesized
ttggggggtactggatcatc

SEQ ID NO: 396114 - DNA, 20 bp, Artificial Sequence
  chemically synthesized
agtgagcactcttgatgatc

SEQ ID NO: 396115 - DNA, 20 bp, Artificial Sequence
  chemically synthesized
ggggggtactggatcatcaa

SEQ ID NO: 396116 - DNA, 20 bp, Artificial Sequence
  chemically synthesized
tccaatttaagagaaaaagt

SEQ ID NO: 396117 - DNA, 20 bp, Artificial Sequence
  chemically synthesized
acaatccaatttaagagaaa

SEQ ID NO: 396118 - DNA, 20 bp, Artificial Sequence
  chemically synthesized
gctcactttttctcttaaat

SEQ ID NO: 396119 - DNA, 20 bp, Artificial Sequence
  chemically synthesized
ttgttcacaatccaatttaa

SEQ ID NO: 396120 - DNA, 20 bp, Artificial Sequence
  chemically synthesized
cattgttcacaatccaattt

SEQ ID NO: 396121 - DNA, 20 bp, Artificial Sequence
  chemically synthesized
aaattggattgtgaacaatg

SEQ ID NO: 396122 - DNA, 20 bp, Artificial Sequence
  chemically synthesized
aattggattgtgaacaatgt

SEQ ID NO: 396123 - DNA, 20 bp, Artificial Sequence
  chemically synthesized
attggattgtgaacaatgta

SEQ ID NO: 396124 - DNA, 20 bp, Artificial Sequence
  chemically synthesized
ttggattgtgaacaatgtag

SEQ ID NO: 396125 - DNA, 20 bp, Artificial Sequence
  chemically synthesized
ggattgtgaacaatgtaggg

SEQ ID NO: 396126 - DNA, 20 bp, Artificial Sequence
  chemically synthesized
tatgaaccttgtgataggcg

SEQ ID NO: 396127 - DNA, 20 bp, Artificial Sequence
  chemically synthesized
ctatgaaccttgtgataggc

SEQ ID NO: 396128 - DNA, 20 bp, Artificial Sequence
  chemically synthesized
ttgatttcctcgcctatcac

SEQ ID NO: 396129 - DNA, 20 bp, Artificial Sequence
  chemically synthesized
tgatttcctcgcctatcaca

SEQ ID NO: 396130 - DNA, 20 bp, Artificial Sequence
  chemically synthesized
tcagctatgaaccttgtgat

SEQ ID NO: 396131 - DNA, 20 bp, Artificial Sequence
  chemically synthesized
ctcagctatgaaccttgtga

SEQ ID NO: 396132 - DNA, 20 bp, Artificial Sequence
  chemically synthesized
ctcgcctatcacaaggttca

SEQ ID NO: 396133 - DNA, 20 bp, Artificial Sequence
  chemically synthesized
ctatcacaaggttcatagct

SEQ ID NO: 396134 - DNA, 20 bp, Artificial Sequence
  chemically synthesized
ttcttttgctataggggtct

SEQ ID NO: 396135 - DNA, 20 bp, Artificial Sequence
  chemically synthesized
gttcatagctgagaccccta

SEQ ID NO: 396136 - DNA, 20 bp, Artificial Sequence
  chemically synthesized
taacctttcttttgctatag

SEQ ID NO: 396137 - DNA, 20 bp, Artificial Sequence
  chemically synthesized
ttaacctttcttttgctata

SEQ ID NO: 396138 - DNA, 20 bp, Artificial Sequence
  chemically synthesized
agctgagacccctatagcaa

SEQ ID NO: 396139 - DNA, 20 bp, Artificial Sequence
  chemically synthesized
gttaacctttcttttgctat

SEQ ID NO: 396140 - DNA, 20 bp, Artificial Sequence
  chemically synthesized
tgttaacctttcttttgcta

SEQ ID NO: 396141 - DNA, 20 bp, Artificial Sequence
  chemically synthesized
gagacccctatagcaaaaga

SEQ ID NO: 396142 - DNA, 20 bp, Artificial Sequence
  chemically synthesized
agacccctatagcaaaagaa

SEQ ID NO: 396143 - DNA, 20 bp, Artificial Sequence
  chemically synthesized
atagcaaaagaaaggttaac

SEQ ID NO: 396144 - DNA, 20 bp, Artificial Sequence
  chemically synthesized
agcaaaagaaaggttaacaa

SEQ ID NO: 396145 - DNA, 20 bp, Artificial Sequence
  chemically synthesized
aagaaaggttaacaagagaa

SEQ ID NO: 396146 - DNA, 20 bp, Artificial Sequence
  chemically synthesized
ataaattttacaaatgatac

SEQ ID NO: 396147 - DNA, 20 bp, Artificial Sequence
  chemically synthesized
taaattttacaaatgatacc

SEQ ID NO: 396148 - DNA, 20 bp, Artificial Sequence
  chemically synthesized
ttacaaatgataccaggaca

SEQ ID NO: 396149 - DNA, 20 bp, Artificial Sequence
  chemically synthesized
tacaaatgataccaggacac

SEQ ID NO: 396150 - DNA, 20 bp, Artificial Sequence
  chemically synthesized
ttctgaatgctcctgtgtcc

SEQ ID NO: 396151 - DNA, 20 bp, Artificial Sequence
  chemically synthesized
caaatgataccaggacacag

SEQ ID NO: 396152 - DNA, 20 bp, Artificial Sequence
  chemically synthesized
taccaggacacaggagcatt

SEQ ID NO: 396153 - DNA, 20 bp, Artificial Sequence
  chemically synthesized
cattcagaaatgaataccta

SEQ ID NO: 396154 - DNA, 20 bp, Artificial Sequence
  chemically synthesized
gaaatgaatacctaaagaaa

SEQ ID NO: 396155 - DNA, 20 bp, Artificial Sequence
  chemically synthesized
caggtctcccctttttcttt

SEQ ID NO: 396156 - DNA, 20 bp, Artificial Sequence
  chemically synthesized
aaatgaatacctaaagaaaa

SEQ ID NO: 396157 - DNA, 20 bp, Artificial Sequence
  chemically synthesized
acaggtctcccctttttctt

SEQ ID NO: 396158 - DNA, 20 bp, Artificial Sequence
  chemically synthesized
aatgaatacctaaagaaaaa

SEQ ID NO: 396159 - DNA, 20 bp, Artificial Sequence
  chemically synthesized
atgaatacctaaagaaaaag

SEQ ID NO: 396160 - DNA, 20 bp, Artificial Sequence
  chemically synthesized
gaatacctaaagaaaaaggg

SEQ ID NO: 396161 - DNA, 20 bp, Artificial Sequence
  chemically synthesized
aatttagcataaaaatacac

SEQ ID NO: 396162 - DNA, 20 bp, Artificial Sequence
  chemically synthesized
aaatttagcataaaaataca

SEQ ID NO: 396163 - DNA, 20 bp, Artificial Sequence
  chemically synthesized
tgtccactcttcatcaaatt

SEQ ID NO: 396164 - DNA, 20 bp, Artificial Sequence
  chemically synthesized
tttttatgctaaatttgatg

SEQ ID NO: 396165 - DNA, 20 bp, Artificial Sequence
  chemically synthesized
tttatgctaaatttgatgaa

SEQ ID NO: 396166 - DNA, 20 bp, Artificial Sequence
  chemically synthesized
atgctaaatttgatgaagag

SEQ ID NO: 396167 - DNA, 20 bp, Artificial Sequence
  chemically synthesized
ttgatgaagagtggacaacc

SEQ ID NO: 396168 - DNA, 20 bp, Artificial Sequence
  chemically synthesized
atgaagagtggacaacctgg

SEQ ID NO: 396169 - DNA, 20 bp, Artificial Sequence
  chemically synthesized
aagagtggacaacctggcag

SEQ ID NO: 396170 - DNA, 20 bp, Artificial Sequence
  chemically synthesized
tctccaatcatacttctgcc

SEQ ID NO: 396171 - DNA, 20 bp, Artificial Sequence
  chemically synthesized
ttctccaatcatacttctgc

SEQ ID NO: 396172 - DNA, 20 bp, Artificial Sequence
  chemically synthesized
caacctggcagaagtatgat

SEQ ID NO: 396173 - DNA, 20 bp, Artificial Sequence
  chemically synthesized
acctggcagaagtatgattg

SEQ ID NO: 396174 - DNA, 20 bp, Artificial Sequence
  chemically synthesized
gaagtatgattggagaacaa

SEQ ID NO: 396175 - DNA, 20 bp, Artificial Sequence
  chemically synthesized
aagtatgattggagaacaaa

SEQ ID NO: 396176 - DNA, 20 bp, Artificial Sequence
  chemically synthesized
agtatgattggagaacaaaa

SEQ ID NO: 396177 - DNA, 20 bp, Artificial Sequence
  chemically synthesized
aacaaaagggtgtaatctaa

SEQ ID NO: 396178 - DNA, 20 bp, Artificial Sequence
  chemically synthesized
caccccaactttattaccat

SEQ ID NO: 396179 - DNA, 20 bp, Artificial Sequence
  chemically synthesized
ggtgtaatctaatggtaata

SEQ ID NO: 396180 - DNA, 20 bp, Artificial Sequence
  chemically synthesized
taatctaatggtaataaagt

SEQ ID NO: 396181 - DNA, 20 bp, Artificial Sequence
  chemically synthesized
aatctaatggtaataaagtt

SEQ ID NO: 396182 - DNA, 20 bp, Artificial Sequence
  chemically synthesized
atctaatggtaataaagttg

SEQ ID NO: 396183 - DNA, 20 bp, Artificial Sequence
  chemically synthesized
taatggtaataaagttgggg

SEQ ID NO: 396184 - DNA, 20 bp, Artificial Sequence
  chemically synthesized
aatggtaataaagttggggt

SEQ ID NO: 396185 - DNA, 20 bp, Artificial Sequence
  chemically synthesized
atggtaataaagttggggtg

SEQ ID NO: 396186 - DNA, 20 bp, Artificial Sequence
  chemically synthesized
tggtaataaagttggggtgg

SEQ ID NO: 396187 - DNA, 20 bp, Artificial Sequence
  chemically synthesized
ggtaataaagttggggtggg

SEQ ID NO: 396188 - DNA, 20 bp, Artificial Sequence
  chemically synthesized
gtaataaagttggggtgggg

SEQ ID NO: 396189 - DNA, 20 bp, Artificial Sequence
  chemically synthesized
agttggggtgggggggaatg

SEQ ID NO: 396190 - DNA, 20 bp, Artificial Sequence
  chemically synthesized
gggtgggggggaatgtagca

SEQ ID NO: 396191 - DNA, 20 bp, Artificial Sequence
  chemically synthesized
tgtagcaaagcctgtttgtt

SEQ ID NO: 396192 - DNA, 20 bp, Artificial Sequence
  chemically synthesized
acagagaagactgaacaaac

SEQ ID NO: 396193 - DNA, 20 bp, Artificial Sequence
  chemically synthesized
cacagagaagactgaacaaa

SEQ ID NO: 396194 - DNA, 20 bp, Artificial Sequence
  chemically synthesized
tgtcacactgggacacagag

SEQ ID NO: 396195 - DNA, 20 bp, Artificial Sequence
  chemically synthesized
gttcagtcttctctgtgtcc

SEQ ID NO: 396196 - DNA, 20 bp, Artificial Sequence
  chemically synthesized
gaatgtcacactgggacaca

SEQ ID NO: 396197 - DNA, 20 bp, Artificial Sequence
  chemically synthesized
aggaatgtcacactgggaca

SEQ ID NO: 396198 - DNA, 20 bp, Artificial Sequence
  chemically synthesized
aaggaaaggaatgtcacact

SEQ ID NO: 396199 - DNA, 20 bp, Artificial Sequence
  chemically synthesized
aaaggaaaggaatgtcacac

SEQ ID NO: 396200 - DNA, 20 bp, Artificial Sequence
  chemically synthesized
agtgtgacattcctttcctt

SEQ ID NO: 396201 - DNA, 20 bp, Artificial Sequence
  chemically synthesized
gtgtgacattcctttccttt

SEQ ID NO: 396202 - DNA, 20 bp, Artificial Sequence
  chemically synthesized
gtgtcccatacctaaaggaa

SEQ ID NO: 396203 - DNA, 20 bp, Artificial Sequence
  chemically synthesized
tgtgtcccatacctaaagga

SEQ ID NO: 396204 - DNA, 20 bp, Artificial Sequence
  chemically synthesized
acattcctttcctttaggta

SEQ ID NO: 396205 - DNA, 20 bp, Artificial Sequence
  chemically synthesized
ctcatgtgtcccatacctaa

SEQ ID NO: 396206 - DNA, 20 bp, Artificial Sequence
  chemically synthesized
cattcctttcctttaggtat

SEQ ID NO: 396207 - DNA, 20 bp, Artificial Sequence
  chemically synthesized
cctcatgtgtcccataccta

SEQ ID NO: 396208 - DNA, 20 bp, Artificial Sequence
  chemically synthesized
cctttaggtatgggacacat

SEQ ID NO: 396209 - DNA, 20 bp, Artificial Sequence
  chemically synthesized
ctttaggtatgggacacatg

SEQ ID NO: 396210 - DNA, 20 bp, Artificial Sequence
  chemically synthesized
tttaggtatgggacacatga

SEQ ID NO: 396211 - DNA, 20 bp, Artificial Sequence
  chemically synthesized
ttaggtatgggacacatgag

SEQ ID NO: 396212 - DNA, 20 bp, Artificial Sequence
  chemically synthesized
gggacacatgaggggtctta

SEQ ID NO: 396213 - DNA, 20 bp, Artificial Sequence
  chemically synthesized
cttgctctgaagtaggccat

SEQ ID NO: 396214 - DNA, 20 bp, Artificial Sequence
  chemically synthesized
aggggtcttatggcctactt

SEQ ID NO: 396215 - DNA, 20 bp, Artificial Sequence
  chemically synthesized
gggtcttatggcctacttca

SEQ ID NO: 396216 - DNA, 20 bp, Artificial Sequence
  chemically synthesized
atctggccttgctctgaagt

SEQ ID NO: 396217 - DNA, 20 bp, Artificial Sequence
  chemically synthesized
tatctggccttgctctgaag

SEQ ID NO: 396218 - DNA, 20 bp, Artificial Sequence
  chemically synthesized
cttatggcctacttcagagc

SEQ ID NO: 396219 - DNA, 20 bp, Artificial Sequence
  chemically synthesized
ttatggcctacttcagagca

SEQ ID NO: 396220 - DNA, 20 bp, Artificial Sequence
  chemically synthesized
aattatctggccttgctctg

SEQ ID NO: 396221 - DNA, 20 bp, Artificial Sequence
  chemically synthesized
ggcctacttcagagcaaggc

SEQ ID NO: 396222 - DNA, 20 bp, Artificial Sequence
  chemically synthesized
cagatcagaaaagaattatc

SEQ ID NO: 396223 - DNA, 20 bp, Artificial Sequence
  chemically synthesized
tcctctgaagcagatcagaa

SEQ ID NO: 396224 - DNA, 20 bp, Artificial Sequence
  chemically synthesized
cattttcctctgaagcagat

SEQ ID NO: 396225 - DNA, 20 bp, Artificial Sequence
  chemically synthesized
aattcttttctgatctgctt

SEQ ID NO: 396226 - DNA, 20 bp, Artificial Sequence
  chemically synthesized
ttcttttctgatctgcttca

SEQ ID NO: 396227 - DNA, 20 bp, Artificial Sequence
  chemically synthesized
tcttttctgatctgcttcag

SEQ ID NO: 396228 - DNA, 20 bp, Artificial Sequence
  chemically synthesized
gccaccattttcctctgaag

SEQ ID NO: 396229 - DNA, 20 bp, Artificial Sequence
  chemically synthesized
tctgccaccattttcctctg

SEQ ID NO: 396230 - DNA, 20 bp, Artificial Sequence
  chemically synthesized
tgatctgcttcagaggaaaa

SEQ ID NO: 396231 - DNA, 20 bp, Artificial Sequence
  chemically synthesized
tctgcttcagaggaaaatgg

SEQ ID NO: 396232 - DNA, 20 bp, Artificial Sequence
  chemically synthesized
gcttcagaggaaaatggtgg

SEQ ID NO: 396233 - DNA, 20 bp, Artificial Sequence
  chemically synthesized
tcagaggaaaatggtggcag

SEQ ID NO: 396234 - DNA, 20 bp, Artificial Sequence
  chemically synthesized
cagaggaaaatggtggcaga

SEQ ID NO: 396235 - DNA, 20 bp, Artificial Sequence
  chemically synthesized
ggaaaatggtggcagaaggt

SEQ ID NO: 396236 - DNA, 20 bp, Artificial Sequence
  chemically synthesized
aaaatggtggcagaaggtca

SEQ ID NO: 396237 - DNA, 20 bp, Artificial Sequence
  chemically synthesized
gggaaacagcggaagtgaga

SEQ ID NO: 396238 - DNA, 20 bp, Artificial Sequence
  chemically synthesized
tttcgggaaacagcggaagt

SEQ ID NO: 396239 - DNA, 20 bp, Artificial Sequence
  chemically synthesized
ggcatttcgggaaacagcgg

SEQ ID NO: 396240 - DNA, 20 bp, Artificial Sequence
  chemically synthesized
cttggcatttcgggaaacag

SEQ ID NO: 396241 - DNA, 20 bp, Artificial Sequence
  chemically synthesized
caccttggcatttcgggaaa

SEQ ID NO: 396242 - DNA, 20 bp, Artificial Sequence
  chemically synthesized
atatggcaccttggcatttc

SEQ ID NO: 396243 - DNA, 20 bp, Artificial Sequence
  chemically synthesized
ccgctgtttcccgaaatgcc

SEQ ID NO: 396244 - DNA, 20 bp, Artificial Sequence
  chemically synthesized
aatatggcaccttggcattt

SEQ ID NO: 396245 - DNA, 20 bp, Artificial Sequence
  chemically synthesized
cgctgtttcccgaaatgcca

SEQ ID NO: 396246 - DNA, 20 bp, Artificial Sequence
  chemically synthesized
catccccaaatatggcacct

SEQ ID NO: 396247 - DNA, 20 bp, Artificial Sequence
  chemically synthesized
aaatgccaaggtgccatatt

SEQ ID NO: 396248 - DNA, 20 bp, Artificial Sequence
  chemically synthesized
aatgccaaggtgccatattt

SEQ ID NO: 396249 - DNA, 20 bp, Artificial Sequence
  chemically synthesized
atgccaaggtgccatatttg

SEQ ID NO: 396250 - DNA, 20 bp, Artificial Sequence
  chemically synthesized
ggacatatcatccccaaata

SEQ ID NO: 396251 - DNA, 20 bp, Artificial Sequence
  chemically synthesized
atttgttgttagtgggattt

SEQ ID NO: 396252 - DNA, 20 bp, Artificial Sequence
  chemically synthesized
tatttgttgttagtgggatt

SEQ ID NO: 396253 - DNA, 20 bp, Artificial Sequence
  chemically synthesized
tttttatatttgttgttagt

SEQ ID NO: 396254 - DNA, 20 bp, Artificial Sequence
  chemically synthesized
ttttttatatttgttgttag

SEQ ID NO: 396255 - DNA, 20 bp, Artificial Sequence
  chemically synthesized
accttttttatatttgttgt

SEQ ID NO: 396256 - DNA, 20 bp, Artificial Sequence
  chemically synthesized
cactaacaacaaatataaaa

SEQ ID NO: 396257 - DNA, 20 bp, Artificial Sequence
  chemically synthesized
actaacaacaaatataaaaa

SEQ ID NO: 396258 - DNA, 20 bp, Artificial Sequence
  chemically synthesized
aacaacaaatataaaaaagg

SEQ ID NO: 396259 - DNA, 20 bp, Artificial Sequence
  chemically synthesized
aacaaatataaaaaaggtgg

SEQ ID NO: 396260 - DNA, 20 bp, Artificial Sequence
  chemically synthesized
tttttttttttttaaattgg

SEQ ID NO: 396261 - DNA, 20 bp, Artificial Sequence
  chemically synthesized
ttttttttttttttaaattg

SEQ ID NO: 396262 - DNA, 20 bp, Artificial Sequence
  chemically synthesized
tttttttttttttttaaatt

SEQ ID NO: 396263 - DNA, 20 bp, Artificial Sequence
  chemically synthesized
ttttttttttttttttaaat

SEQ ID NO: 396264 - DNA, 20 bp, Artificial Sequence
  chemically synthesized
atttaaaaaaaaaaaaaaaa

SEQ ID NO: 396265 - DNA, 20 bp, Artificial Sequence
  chemically synthesized
attgtttaatcatttgaact

SEQ ID NO: 396266 - DNA, 20 bp, Artificial Sequence
  chemically synthesized
ttgtttaatcatttgaactt

SEQ ID NO: 396267 - DNA, 20 bp, Artificial Sequence
  chemically synthesized
ttaatattttcaagattccc

SEQ ID NO: 396268 - DNA, 20 bp, Artificial Sequence
  chemically synthesized
ggattctttttaatattttc

SEQ ID NO: 396269 - DNA, 20 bp, Artificial Sequence
  chemically synthesized
ggaatcttgaaaatattaaa

SEQ ID NO: 396270 - DNA, 20 bp, Artificial Sequence
  chemically synthesized
ggctaaacggagaaagaatc

SEQ ID NO: 396271 - DNA, 20 bp, Artificial Sequence
  chemically synthesized
aggctaaacggagaaagaat

SEQ ID NO: 396272 - DNA, 20 bp, Artificial Sequence
  chemically synthesized
tgttcaaggctaaacggaga

SEQ ID NO: 396273 - DNA, 20 bp, Artificial Sequence
  chemically synthesized
atcctgattctttctccgtt

SEQ ID NO: 396274 - DNA, 20 bp, Artificial Sequence
  chemically synthesized
aacttgttcaaggctaaacg

SEQ ID NO: 396275 - DNA, 20 bp, Artificial Sequence
  chemically synthesized
ataacttgttcaaggctaaa

SEQ ID NO: 396276 - DNA, 20 bp, Artificial Sequence
  chemically synthesized
ttctccgtttagccttgaac

SEQ ID NO: 396277 - DNA, 20 bp, Artificial Sequence
  chemically synthesized
atagttaaataacttgttca

SEQ ID NO: 396278 - DNA, 20 bp, Artificial Sequence
  chemically synthesized
aatagttaaataacttgttc

SEQ ID NO: 396279 - DNA, 20 bp, Artificial Sequence
  chemically synthesized
gacagaaccaaagcagagaa

SEQ ID NO: 396280 - DNA, 20 bp, Artificial Sequence
  chemically synthesized
tatttaactattctctgctt

SEQ ID NO: 396281 - DNA, 20 bp, Artificial Sequence
  chemically synthesized
catatgacagaaccaaagca

SEQ ID NO: 396282 - DNA, 20 bp, Artificial Sequence
  chemically synthesized
tacatatgacagaaccaaag

SEQ ID NO: 396283 - DNA, 20 bp, Artificial Sequence
  chemically synthesized
ttttacatatgacagaacca

SEQ ID NO: 396284 - DNA, 20 bp, Artificial Sequence
  chemically synthesized
tatcctcattttacatatga

SEQ ID NO: 396285 - DNA, 20 bp, Artificial Sequence
  chemically synthesized
ggttctgtcatatgtaaaat

SEQ ID NO: 396286 - DNA, 20 bp, Artificial Sequence
  chemically synthesized
gttctgtcatatgtaaaatg

SEQ ID NO: 396287 - DNA, 20 bp, Artificial Sequence
  chemically synthesized
cgtactgagatagacattat

SEQ ID NO: 396288 - DNA, 20 bp, Artificial Sequence
  chemically synthesized
gatactaataatgtctatct

SEQ ID NO: 396289 - DNA, 20 bp, Artificial Sequence
  chemically synthesized
cttaaagcaacgtactgaga

SEQ ID NO: 396290 - DNA, 20 bp, Artificial Sequence
  chemically synthesized
aattcttaaagcaacgtact

SEQ ID NO: 396291 - DNA, 20 bp, Artificial Sequence
  chemically synthesized
ctatctcagtacgttgcttt

SEQ ID NO: 396292 - DNA, 20 bp, Artificial Sequence
  chemically synthesized
gcactctcagttaattctta

SEQ ID NO: 396293 - DNA, 20 bp, Artificial Sequence
  chemically synthesized
cgttgctttaagaattaact

SEQ ID NO: 396294 - DNA, 20 bp, Artificial Sequence
  chemically synthesized
ttgctttaagaattaactga

SEQ ID NO: 396295 - DNA, 20 bp, Artificial Sequence
  chemically synthesized
caaagatatatgtgcactct

SEQ ID NO: 396296 - DNA, 20 bp, Artificial Sequence
  chemically synthesized
gtattttaattgatttgtca

SEQ ID NO: 396297 - DNA, 20 bp, Artificial Sequence
  chemically synthesized
caaatcaattaaaatacctt

SEQ ID NO: 396298 - DNA, 20 bp, Artificial Sequence
  chemically synthesized
acttctggatatatatccaa

SEQ ID NO: 396299 - DNA, 20 bp, Artificial Sequence
  chemically synthesized
tacttctggatatatatcca

SEQ ID NO: 396300 - DNA, 20 bp, Artificial Sequence
  chemically synthesized
aatacctttggatatatatc

SEQ ID NO: 396301 - DNA, 20 bp, Artificial Sequence
  chemically synthesized
acctttggatatatatccag

SEQ ID NO: 396302 - DNA, 20 bp, Artificial Sequence
  chemically synthesized
tttggatatatatccagaag

SEQ ID NO: 396303 - DNA, 20 bp, Artificial Sequence
  chemically synthesized
ttggatatatatccagaagt

SEQ ID NO: 396304 - DNA, 20 bp, Artificial Sequence
  chemically synthesized
tgatccaactttcctacttc

SEQ ID NO: 396305 - DNA, 20 bp, Artificial Sequence
  chemically synthesized
atatatatccagaagtagga

SEQ ID NO: 396306 - DNA, 20 bp, Artificial Sequence
  chemically synthesized
atatccagaagtaggaaagt

SEQ ID NO: 396307 - DNA, 20 bp, Artificial Sequence
  chemically synthesized
agtaggaaagttggatcata

SEQ ID NO: 396308 - DNA, 20 bp, Artificial Sequence
  chemically synthesized
tcatatggtaattccatttt

SEQ ID NO: 396309 - DNA, 20 bp, Artificial Sequence
  chemically synthesized
catatggtaattccattttt

SEQ ID NO: 396310 - DNA, 20 bp, Artificial Sequence
  chemically synthesized
attcctcaaaaacctaaaaa

SEQ ID NO: 396311 - DNA, 20 bp, Artificial Sequence
  chemically synthesized
aattccatttttaggttttt

SEQ ID NO: 396312 - DNA, 20 bp, Artificial Sequence
  chemically synthesized
attccatttttaggtttttg

SEQ ID NO: 396313 - DNA, 20 bp, Artificial Sequence
  chemically synthesized
tcattttggaaaataatatg

SEQ ID NO: 396314 - DNA, 20 bp, Artificial Sequence
  chemically synthesized
ggtcattttggaaaataata

SEQ ID NO: 396315 - DNA, 20 bp, Artificial Sequence
  chemically synthesized
gtaaattagtatggtcattt

SEQ ID NO: 396316 - DNA, 20 bp, Artificial Sequence
  chemically synthesized
ggtgggaatgtaaattagta

SEQ ID NO: 396317 - DNA, 20 bp, Artificial Sequence
  chemically synthesized
ctcttggtgggaatgtaaat

SEQ ID NO: 396318 - DNA, 20 bp, Artificial Sequence
  chemically synthesized
tactaatttacattcccacc

SEQ ID NO: 396319 - DNA, 20 bp, Artificial Sequence
  chemically synthesized
ctaatttacattcccaccaa

SEQ ID NO: 396320 - DNA, 20 bp, Artificial Sequence
  chemically synthesized
gaatgttgtctactcttggt

SEQ ID NO: 396321 - DNA, 20 bp, Artificial Sequence
  chemically synthesized
atttacattcccaccaagag

SEQ ID NO: 396322 - DNA, 20 bp, Artificial Sequence
  chemically synthesized
agaatgttgtctactcttgg

SEQ ID NO: 396323 - DNA, 20 bp, Artificial Sequence
  chemically synthesized
gtcagaatgttgtctactct

SEQ ID NO: 396324 - DNA, 20 bp, Artificial Sequence
  chemically synthesized
actaacttatgttttgtggt

SEQ ID NO: 396325 - DNA, 20 bp, Artificial Sequence
  chemically synthesized
cctcactaacttatgttttg

SEQ ID NO: 396326 - DNA, 20 bp, Artificial Sequence
  chemically synthesized
acattctgaccacaaaacat

SEQ ID NO: 396327 - DNA, 20 bp, Artificial Sequence
  chemically synthesized
tctgaccacaaaacataagt

SEQ ID NO: 396328 - DNA, 20 bp, Artificial Sequence
  chemically synthesized
accacaaaacataagttagt

SEQ ID NO: 396329 - DNA, 20 bp, Artificial Sequence
  chemically synthesized
ccacaaaacataagttagtg

SEQ ID NO: 396330 - DNA, 20 bp, Artificial Sequence
  chemically synthesized
aacataagttagtgaggtga

SEQ ID NO: 396331 - DNA, 20 bp, Artificial Sequence
  chemically synthesized
gaggtgatagatatgttaat

SEQ ID NO: 396332 - DNA, 20 bp, Artificial Sequence
  chemically synthesized
tattacagaaacattcaatc

SEQ ID NO: 396333 - DNA, 20 bp, Artificial Sequence
  chemically synthesized
tttaatctatgaatatatta

SEQ ID NO: 396334 - DNA, 20 bp, Artificial Sequence
  chemically synthesized
atgtttctgtaatatattca

SEQ ID NO: 396335 - DNA, 20 bp, Artificial Sequence
  chemically synthesized
agtaacagttgagtaattta

SEQ ID NO: 396336 - DNA, 20 bp, Artificial Sequence
  chemically synthesized
ttaatgaacaagtaacagtt

SEQ ID NO: 396337 - DNA, 20 bp, Artificial Sequence
  chemically synthesized
tatttttaatgaacaagtaa

SEQ ID NO: 396338 - DNA, 20 bp, Artificial Sequence
  chemically synthesized
tttatttatttttaatgaac

SEQ ID NO: 396339 - DNA, 20 bp, Artificial Sequence
  chemically synthesized
ttcattaaaaataaataaat

SEQ ID NO: 396340 - DNA, 20 bp, Artificial Sequence
  chemically synthesized
tcattaaaaataaataaata

SEQ ID NO: 396341 - DNA, 20 bp, Artificial Sequence
  chemically synthesized
taaaaataaataaataaggt

SEQ ID NO: 396342 - DNA, 20 bp, Artificial Sequence
  chemically synthesized
ataaataaggtcagtcaccg

SEQ ID NO: 396343 - DNA, 20 bp, Artificial Sequence
  chemically synthesized
caaagtgctggcgtgagcca

SEQ ID NO: 396344 - DNA, 20 bp, Artificial Sequence
  chemically synthesized
tcagtcaccgtggctcacgc

SEQ ID NO: 396345 - DNA, 20 bp, Artificial Sequence
  chemically synthesized
gcctctcaaagtgctggcgt

SEQ ID NO: 396346 - DNA, 20 bp, Artificial Sequence
  chemically synthesized
gtggctcacgccagcacttt

SEQ ID NO: 396347 - DNA, 20 bp, Artificial Sequence
  chemically synthesized
gctttagcctctcaaagtgc

SEQ ID NO: 396348 - DNA, 20 bp, Artificial Sequence
  chemically synthesized
ggctcacgccagcactttga

SEQ ID NO: 396349 - DNA, 20 bp, Artificial Sequence
  chemically synthesized
gctcacgccagcactttgag

SEQ ID NO: 396350 - DNA, 20 bp, Artificial Sequence
  chemically synthesized
ctacctgctttagcctctca

SEQ ID NO: 396351 - DNA, 20 bp, Artificial Sequence
  chemically synthesized
gccagcactttgagaggcta

SEQ ID NO: 396352 - DNA, 20 bp, Artificial Sequence
  chemically synthesized
agcactttgagaggctaaag

SEQ ID NO: 396353 - DNA, 20 bp, Artificial Sequence
  chemically synthesized
gcactttgagaggctaaagc

SEQ ID NO: 396354 - DNA, 20 bp, Artificial Sequence
  chemically synthesized
ctttgagaggctaaagcagg

SEQ ID NO: 396355 - DNA, 20 bp, Artificial Sequence
  chemically synthesized
ctcaggtgatctacctgctt

SEQ ID NO: 396356 - DNA, 20 bp, Artificial Sequence
  chemically synthesized
ctaaagcaggtagatcacct

SEQ ID NO: 396357 - DNA, 20 bp, Artificial Sequence
  chemically synthesized
caggtagatcacctgagcta

SEQ ID NO: 396358 - DNA, 20 bp, Artificial Sequence
  chemically synthesized
ggtctcagactccatagctc

SEQ ID NO: 396359 - DNA, 20 bp, Artificial Sequence
  chemically synthesized
ggtagatcacctgagctatg

SEQ ID NO: 396360 - DNA, 20 bp, Artificial Sequence
  chemically synthesized
tggtctcagactccatagct

SEQ ID NO: 396361 - DNA, 20 bp, Artificial Sequence
  chemically synthesized
caggctggtctcagactcca

SEQ ID NO: 396362 - DNA, 20 bp, Artificial Sequence
  chemically synthesized
tcacctgagctatggagtct

SEQ ID NO: 396363 - DNA, 20 bp, Artificial Sequence
  chemically synthesized
tgagctatggagtctgagac

SEQ ID NO: 396364 - DNA, 20 bp, Artificial Sequence
  chemically synthesized
tatgttgcccaggctggtct

SEQ ID NO: 396365 - DNA, 20 bp, Artificial Sequence
  chemically synthesized
tatggagtctgagaccagcc

SEQ ID NO: 396366 - DNA, 20 bp, Artificial Sequence
  chemically synthesized
atggagtctgagaccagcct

SEQ ID NO: 396367 - DNA, 20 bp, Artificial Sequence
  chemically synthesized
gtcccctatgttgcccaggc

SEQ ID NO: 396368 - DNA, 20 bp, Artificial Sequence
  chemically synthesized
gggggtcccctatgttgccc

SEQ ID NO: 396369 - DNA, 20 bp, Artificial Sequence
  chemically synthesized
tgagaccagcctgggcaaca

SEQ ID NO: 396370 - DNA, 20 bp, Artificial Sequence
  chemically synthesized
tgggggtcccctatgttgcc

SEQ ID NO: 396371 - DNA, 20 bp, Artificial Sequence
  chemically synthesized
gagaccagcctgggcaacat

SEQ ID NO: 396372 - DNA, 20 bp, Artificial Sequence
  chemically synthesized
agaccagcctgggcaacata

SEQ ID NO: 396373 - DNA, 20 bp, Artificial Sequence
  chemically synthesized
gaccagcctgggcaacatag

SEQ ID NO: 396374 - DNA, 20 bp, Artificial Sequence
  chemically synthesized
cctattttttgtagagatgg

SEQ ID NO: 396375 - DNA, 20 bp, Artificial Sequence
  chemically synthesized
tcctattttttgtagagatg

SEQ ID NO: 396376 - DNA, 20 bp, Artificial Sequence
  chemically synthesized
ttcctattttttgtagagat

SEQ ID NO: 396377 - DNA, 20 bp, Artificial Sequence
  chemically synthesized
gttcctattttttgtagaga

SEQ ID NO: 396378 - DNA, 20 bp, Artificial Sequence
  chemically synthesized
taatgttcctattttttgta

SEQ ID NO: 396379 - DNA, 20 bp, Artificial Sequence
  chemically synthesized
acccccatctctacaaaaaa

SEQ ID NO: 396380 - DNA, 20 bp, Artificial Sequence
  chemically synthesized
gctaatgttcctattttttg

SEQ ID NO: 396381 - DNA, 20 bp, Artificial Sequence
  chemically synthesized
cccccatctctacaaaaaat

SEQ ID NO: 396382 - DNA, 20 bp, Artificial Sequence
  chemically synthesized
tctacaaaaaataggaacat

SEQ ID NO: 396383 - DNA, 20 bp, Artificial Sequence
  chemically synthesized
aaaaaataggaacattagct

SEQ ID NO: 396384 - DNA, 20 bp, Artificial Sequence
  chemically synthesized
ataggaacattagctgagca

SEQ ID NO: 396385 - DNA, 20 bp, Artificial Sequence
  chemically synthesized
ggaacattagctgagcatgg

SEQ ID NO: 396386 - DNA, 20 bp, Artificial Sequence
  chemically synthesized
caggtgtcccccaccatgct

SEQ ID NO: 396387 - DNA, 20 bp, Artificial Sequence
  chemically synthesized
gaacattagctgagcatggt

SEQ ID NO: 396388 - DNA, 20 bp, Artificial Sequence
  chemically synthesized
aacattagctgagcatggtg

SEQ ID NO: 396389 - DNA, 20 bp, Artificial Sequence
  chemically synthesized
acattagctgagcatggtgg

SEQ ID NO: 396390 - DNA, 20 bp, Artificial Sequence
  chemically synthesized
agcatggtgggggacacctg

SEQ ID NO: 396391 - DNA, 20 bp, Artificial Sequence
  chemically synthesized
gtgggggacacctgtagtcc

SEQ ID NO: 396392 - DNA, 20 bp, Artificial Sequence
  chemically synthesized
ccccaagtagctgggactac

SEQ ID NO: 396393 - DNA, 20 bp, Artificial Sequence
  chemically synthesized
cccccaagtagctgggacta

SEQ ID NO: 396394 - DNA, 20 bp, Artificial Sequence
  chemically synthesized
cacctgtagtcccagctact

SEQ ID NO: 396395 - DNA, 20 bp, Artificial Sequence
  chemically synthesized
acctgaacccccaagtagct

SEQ ID NO: 396396 - DNA, 20 bp, Artificial Sequence
  chemically synthesized
acctgtagtcccagctactt

SEQ ID NO: 396397 - DNA, 20 bp, Artificial Sequence
  chemically synthesized
tacctgaacccccaagtagc

SEQ ID NO: 396398 - DNA, 20 bp, Artificial Sequence
  chemically synthesized
cctgtagtcccagctacttg

SEQ ID NO: 396399 - DNA, 20 bp, Artificial Sequence
  chemically synthesized
ctgtagtcccagctacttgg

SEQ ID NO: 396400 - DNA, 20 bp, Artificial Sequence
  chemically synthesized
ctcctacctgaacccccaag

SEQ ID NO: 396401 - DNA, 20 bp, Artificial Sequence
  chemically synthesized
gtcccagctacttgggggtt

SEQ ID NO: 396402 - DNA, 20 bp, Artificial Sequence
  chemically synthesized
atcctcctacctgaaccccc

SEQ ID NO: 396403 - DNA, 20 bp, Artificial Sequence
  chemically synthesized
tcccagctacttgggggttc

SEQ ID NO: 396404 - DNA, 20 bp, Artificial Sequence
  chemically synthesized
cagctacttgggggttcagg

SEQ ID NO: 396405 - DNA, 20 bp, Artificial Sequence
  chemically synthesized
agctacttgggggttcaggt

SEQ ID NO: 396406 - DNA, 20 bp, Artificial Sequence
  chemically synthesized
ctacttgggggttcaggtag

SEQ ID NO: 396407 - DNA, 20 bp, Artificial Sequence
  chemically synthesized
tacttgggggttcaggtagg

SEQ ID NO: 396408 - DNA, 20 bp, Artificial Sequence
  chemically synthesized
tgggggttcaggtaggagga

SEQ ID NO: 396409 - DNA, 20 bp, Artificial Sequence
  chemically synthesized
gttcaggtaggaggatggct

SEQ ID NO: 396410 - DNA, 20 bp, Artificial Sequence
  chemically synthesized
tcaggtaggaggatggcttg

SEQ ID NO: 396411 - DNA, 20 bp, Artificial Sequence
  chemically synthesized
caggtaggaggatggcttgg

SEQ ID NO: 396412 - DNA, 20 bp, Artificial Sequence
  chemically synthesized
aggaggatggcttggaggtc

SEQ ID NO: 396413 - DNA, 20 bp, Artificial Sequence
  chemically synthesized
tcattgcagccttgacctcc

SEQ ID NO: 396414 - DNA, 20 bp, Artificial Sequence
  chemically synthesized
ggaggatggcttggaggtca

SEQ ID NO: 396415 - DNA, 20 bp, Artificial Sequence
  chemically synthesized
ttggaggtcaaggctgcaat

SEQ ID NO: 396416 - DNA, 20 bp, Artificial Sequence
  chemically synthesized
ggagtcattgcggctcattg

SEQ ID NO: 396417 - DNA, 20 bp, Artificial Sequence
  chemically synthesized
ggagtgcagtggagtcattg

SEQ ID NO: 396418 - DNA, 20 bp, Artificial Sequence
  chemically synthesized
actcaggttggagtgcagtg

SEQ ID NO: 396419 - DNA, 20 bp, Artificial Sequence
  chemically synthesized
tcactcaggttggagtgcag

SEQ ID NO: 396420 - DNA, 20 bp, Artificial Sequence
  chemically synthesized
tcgtcactcaggttggagtg

SEQ ID NO: 396421 - DNA, 20 bp, Artificial Sequence
  chemically synthesized
actccactgcactccaacct

SEQ ID NO: 396422 - DNA, 20 bp, Artificial Sequence
  chemically synthesized
tcacttcgtcactcaggttg

SEQ ID NO: 396423 - DNA, 20 bp, Artificial Sequence
  chemically synthesized
tctcacttcgtcactcaggt

SEQ ID NO: 396424 - DNA, 20 bp, Artificial Sequence
  chemically synthesized
aagatctcacttcgtcactc

SEQ ID NO: 396425 - DNA, 20 bp, Artificial Sequence
  chemically synthesized
gcactccaacctgagtgacg

SEQ ID NO: 396426 - DNA, 20 bp, Artificial Sequence
  chemically synthesized
caagatctcacttcgtcact

SEQ ID NO: 396427 - DNA, 20 bp, Artificial Sequence
  chemically synthesized
tccaacctgagtgacgaagt

SEQ ID NO: 396428 - DNA, 20 bp, Artificial Sequence
  chemically synthesized
tttggtttggtttttgagac

SEQ ID NO: 396429 - DNA, 20 bp, Artificial Sequence
  chemically synthesized
cttgttttggtttggttttt

SEQ ID NO: 396430 - DNA, 20 bp, Artificial Sequence
  chemically synthesized
ttatttatcttgttttggtt

SEQ ID NO: 396431 - DNA, 20 bp, Artificial Sequence
  chemically synthesized
ctcaaaaaccaaaccaaaac

SEQ ID NO: 396432 - DNA, 20 bp, Artificial Sequence
  chemically synthesized
tgcatttatttatcttgttt

SEQ ID NO: 396433 - DNA, 20 bp, Artificial Sequence
  chemically synthesized
aagataaataaatgcaatta

SEQ ID NO: 396434 - DNA, 20 bp, Artificial Sequence
  chemically synthesized
ttgttataatggatttgcat

SEQ ID NO: 396435 - DNA, 20 bp, Artificial Sequence
  chemically synthesized
agtgtcaagcattgttataa

SEQ ID NO: 396436 - DNA, 20 bp, Artificial Sequence
  chemically synthesized
gctagcctttattaagtgtc

SEQ ID NO: 396437 - DNA, 20 bp, Artificial Sequence
  chemically synthesized
acaatgcttgacacttaata

SEQ ID NO: 396438 - DNA, 20 bp, Artificial Sequence
  chemically synthesized
caatgcttgacacttaataa

SEQ ID NO: 396439 - DNA, 20 bp, Artificial Sequence
  chemically synthesized
acagatggctagcctttatt

SEQ ID NO: 396440 - DNA, 20 bp, Artificial Sequence
  chemically synthesized
gcttgacacttaataaaggc

SEQ ID NO: 396441 - DNA, 20 bp, Artificial Sequence
  chemically synthesized
agagatgtcatacagatggc

SEQ ID NO: 396442 - DNA, 20 bp, Artificial Sequence
  chemically synthesized
gaacagagatgtcatacaga

SEQ ID NO: 396443 - DNA, 20 bp, Artificial Sequence
  chemically synthesized
catagaacagagatgtcata

SEQ ID NO: 396444 - DNA, 20 bp, Artificial Sequence
  chemically synthesized
aactaaaaagtcatagaaca

SEQ ID NO: 396445 - DNA, 20 bp, Artificial Sequence
  chemically synthesized
gtaactaaaaagtcatagaa

SEQ ID NO: 396446 - DNA, 20 bp, Artificial Sequence
  chemically synthesized
taaaagtaactaaaaagtca

SEQ ID NO: 396447 - DNA, 20 bp, Artificial Sequence
  chemically synthesized
atctctgttctatgactttt

SEQ ID NO: 396448 - DNA, 20 bp, Artificial Sequence
  chemically synthesized
taaacctaaaagtaactaaa

SEQ ID NO: 396449 - DNA, 20 bp, Artificial Sequence
  chemically synthesized
tatgactttttagttacttt

SEQ ID NO: 396450 - DNA, 20 bp, Artificial Sequence
  chemically synthesized
atgactttttagttactttt

SEQ ID NO: 396451 - DNA, 20 bp, Artificial Sequence
  chemically synthesized
aacattcacattaaacctaa

SEQ ID NO: 396452 - DNA, 20 bp, Artificial Sequence
  chemically synthesized
cggcatttaagttaaaaaga

SEQ ID NO: 396453 - DNA, 20 bp, Artificial Sequence
  chemically synthesized
tatacggcatttaagttaaa

SEQ ID NO: 396454 - DNA, 20 bp, Artificial Sequence
  chemically synthesized
gagtgctttatacggcattt

SEQ ID NO: 396455 - DNA, 20 bp, Artificial Sequence
  chemically synthesized
tttaacttaaatgccgtata

SEQ ID NO: 396456 - DNA, 20 bp, Artificial Sequence
  chemically synthesized
atttaaaagagtgctttata

SEQ ID NO: 396457 - DNA, 20 bp, Artificial Sequence
  chemically synthesized
tctatgtacattatttaaaa

SEQ ID NO: 396458 - DNA, 20 bp, Artificial Sequence
  chemically synthesized
tttctatgtacattatttaa

SEQ ID NO: 396459 - DNA, 20 bp, Artificial Sequence
  chemically synthesized
actcttttaaataatgtaca

SEQ ID NO: 396460 - DNA, 20 bp, Artificial Sequence
  chemically synthesized
ataactaggaattttagata

SEQ ID NO: 396461 - DNA, 20 bp, Artificial Sequence
  chemically synthesized
gaaactttatctaaaattcc

SEQ ID NO: 396462 - DNA, 20 bp, Artificial Sequence
  chemically synthesized
aatcacataactaggaattt

SEQ ID NO: 396463 - DNA, 20 bp, Artificial Sequence
  chemically synthesized
gttagcaaaatcacataact

SEQ ID NO: 396464 - DNA, 20 bp, Artificial Sequence
  chemically synthesized
tgttagcaaaatcacataac

SEQ ID NO: 396465 - DNA, 20 bp, Artificial Sequence
  chemically synthesized
tagttatgtgattttgctaa

SEQ ID NO: 396466 - DNA, 20 bp, Artificial Sequence
  chemically synthesized
agttatgtgattttgctaac

SEQ ID NO: 396467 - DNA, 20 bp, Artificial Sequence
  chemically synthesized
tccatgaaaaatatgcctgt

SEQ ID NO: 396468 - DNA, 20 bp, Artificial Sequence
  chemically synthesized
gctaacaggcatatttttca

SEQ ID NO: 396469 - DNA, 20 bp, Artificial Sequence
  chemically synthesized
catatttttcatggaacaaa

SEQ ID NO: 396470 - DNA, 20 bp, Artificial Sequence
  chemically synthesized
tttcatggaacaaaaagtca

SEQ ID NO: 396471 - DNA, 20 bp, Artificial Sequence
  chemically synthesized
aacaaaaagtcacggacaac

SEQ ID NO: 396472 - DNA, 20 bp, Artificial Sequence
  chemically synthesized
atgagaaaaatggacaatga

SEQ ID NO: 396473 - DNA, 20 bp, Artificial Sequence
  chemically synthesized
tatgagaaaaatggacaatg

SEQ ID NO: 396474 - DNA, 20 bp, Artificial Sequence
  chemically synthesized
atatgagaaaaatggacaat

SEQ ID NO: 396475 - DNA, 20 bp, Artificial Sequence
  chemically synthesized
agaaattcatatgagaaaaa

SEQ ID NO: 396476 - DNA, 20 bp, Artificial Sequence
  chemically synthesized
aagtacagagaaattcatat

SEQ ID NO: 396477 - DNA, 20 bp, Artificial Sequence
  chemically synthesized
acagtaacatttcaagtaca

SEQ ID NO: 396478 - DNA, 20 bp, Artificial Sequence
  chemically synthesized
tgacagtaacatttcaagta

SEQ ID NO: 396479 - DNA, 20 bp, Artificial Sequence
  chemically synthesized
agtcctgacagtaacatttc

SEQ ID NO: 396480 - DNA, 20 bp, Artificial Sequence
  chemically synthesized
tgtacttgaaatgttactgt

SEQ ID NO: 396481 - DNA, 20 bp, Artificial Sequence
  chemically synthesized
gtacttgaaatgttactgtc

SEQ ID NO: 396482 - DNA, 20 bp, Artificial Sequence
  chemically synthesized
agggcagagccaagtcctga

SEQ ID NO: 396483 - DNA, 20 bp, Artificial Sequence
  chemically synthesized
gaaatgttactgtcaggact

SEQ ID NO: 396484 - DNA, 20 bp, Artificial Sequence
  chemically synthesized
gatagaagcagggcagagcc

SEQ ID NO: 396485 - DNA, 20 bp, Artificial Sequence
  chemically synthesized
ggcatgatagaagcagggca

SEQ ID NO: 396486 - DNA, 20 bp, Artificial Sequence
  chemically synthesized
caggcatgatagaagcaggg

SEQ ID NO: 396487 - DNA, 20 bp, Artificial Sequence
  chemically synthesized
tgacaggcatgatagaagca

SEQ ID NO: 396488 - DNA, 20 bp, Artificial Sequence
  chemically synthesized
gtgacaggcatgatagaagc

SEQ ID NO: 396489 - DNA, 20 bp, Artificial Sequence
  chemically synthesized
ggtgacaggcatgatagaag

SEQ ID NO: 396490 - DNA, 20 bp, Artificial Sequence
  chemically synthesized
taaggtgacaggcatgatag

SEQ ID NO: 396491 - DNA, 20 bp, Artificial Sequence
  chemically synthesized
gaataaggtgacaggcatga

SEQ ID NO: 396492 - DNA, 20 bp, Artificial Sequence
  chemically synthesized
tttctattgaataaggtgac

SEQ ID NO: 396493 - DNA, 20 bp, Artificial Sequence
  chemically synthesized
gtttctattgaataaggtga

SEQ ID NO: 396494 - DNA, 20 bp, Artificial Sequence
  chemically synthesized
atgcctgtcaccttattcaa

SEQ ID NO: 396495 - DNA, 20 bp, Artificial Sequence
  chemically synthesized
catcttgtttctattgaata

SEQ ID NO: 396496 - DNA, 20 bp, Artificial Sequence
  chemically synthesized
tcatcttgtttctattgaat

SEQ ID NO: 396497 - DNA, 20 bp, Artificial Sequence
  chemically synthesized
tcaccttattcaatagaaac

SEQ ID NO: 396498 - DNA, 20 bp, Artificial Sequence
  chemically synthesized
ttattcaatagaaacaagat

SEQ ID NO: 396499 - DNA, 20 bp, Artificial Sequence
  chemically synthesized
agaaacaagatgagtgttct

SEQ ID NO: 396500 - DNA, 20 bp, Artificial Sequence
  chemically synthesized
aagatgagtgttcttggcat

SEQ ID NO: 396501 - DNA, 20 bp, Artificial Sequence
  chemically synthesized
agatgagtgttcttggcatt

SEQ ID NO: 396502 - DNA, 20 bp, Artificial Sequence
  chemically synthesized
acttcttgcttcccaatgcc

SEQ ID NO: 396503 - DNA, 20 bp, Artificial Sequence
  chemically synthesized
tgagtgttcttggcattggg

SEQ ID NO: 396504 - DNA, 20 bp, Artificial Sequence
  chemically synthesized
tgttcttggcattgggaagc

SEQ ID NO: 396505 - DNA, 20 bp, Artificial Sequence
  chemically synthesized
tcttggcattgggaagcaag

SEQ ID NO: 396506 - DNA, 20 bp, Artificial Sequence
  chemically synthesized
ggcattgggaagcaagaagt

SEQ ID NO: 396507 - DNA, 20 bp, Artificial Sequence
  chemically synthesized
aagcaagaagttagtattgt

SEQ ID NO: 396508 - DNA, 20 bp, Artificial Sequence
  chemically synthesized
atgattatttcacacaatac

SEQ ID NO: 396509 - DNA, 20 bp, Artificial Sequence
  chemically synthesized
tgttcctcagcaacgatttc

SEQ ID NO: 396510 - DNA, 20 bp, Artificial Sequence
  chemically synthesized
caatactagaaatcgttgct

SEQ ID NO: 396511 - DNA, 20 bp, Artificial Sequence
  chemically synthesized
aatactagaaatcgttgctg

SEQ ID NO: 396512 - DNA, 20 bp, Artificial Sequence
  chemically synthesized
tagaaatcgttgctgaggaa

SEQ ID NO: 396513 - DNA, 20 bp, Artificial Sequence
  chemically synthesized
gcaatatgcaggctgttcct

SEQ ID NO: 396514 - DNA, 20 bp, Artificial Sequence
  chemically synthesized
cttcttccgtggcaatatgc

SEQ ID NO: 396515 - DNA, 20 bp, Artificial Sequence
  chemically synthesized
ccttcttccgtggcaatatg

SEQ ID NO: 396516 - DNA, 20 bp, Artificial Sequence
  chemically synthesized
gaacagcctgcatattgcca

SEQ ID NO: 396517 - DNA, 20 bp, Artificial Sequence
  chemically synthesized
cagcctgcatattgccacgg

SEQ ID NO: 396518 - DNA, 20 bp, Artificial Sequence
  chemically synthesized
cctgcatattgccacggaag

SEQ ID NO: 396519 - DNA, 20 bp, Artificial Sequence
  chemically synthesized
ctgcatattgccacggaaga

SEQ ID NO: 396520 - DNA, 20 bp, Artificial Sequence
  chemically synthesized
aggatcccagccttcttccg

SEQ ID NO: 396521 - DNA, 20 bp, Artificial Sequence
  chemically synthesized
atattgccacggaagaaggc

SEQ ID NO: 396522 - DNA, 20 bp, Artificial Sequence
  chemically synthesized
tattgccacggaagaaggct

SEQ ID NO: 396523 - DNA, 20 bp, Artificial Sequence
  chemically synthesized
tatctcagggtacaggatcc

SEQ ID NO: 396524 - DNA, 20 bp, Artificial Sequence
  chemically synthesized
aggctgggatcctgtaccct

SEQ ID NO: 396525 - DNA, 20 bp, Artificial Sequence
  chemically synthesized
cttggcctatctcagggtac

SEQ ID NO: 396526 - DNA, 20 bp, Artificial Sequence
  chemically synthesized
acttggcctatctcagggta

SEQ ID NO: 396527 - DNA, 20 bp, Artificial Sequence
  chemically synthesized
tgggatcctgtaccctgaga

SEQ ID NO: 396528 - DNA, 20 bp, Artificial Sequence
  chemically synthesized
gggatcctgtaccctgagat

SEQ ID NO: 396529 - DNA, 20 bp, Artificial Sequence
  chemically synthesized
atttcacttggcctatctca

SEQ ID NO: 396530 - DNA, 20 bp, Artificial Sequence
  chemically synthesized
tatttcacttggcctatctc

SEQ ID NO: 396531 - DNA, 20 bp, Artificial Sequence
  chemically synthesized
ttatttcacttggcctatct

SEQ ID NO: 396532 - DNA, 20 bp, Artificial Sequence
  chemically synthesized
cctgtaccctgagataggcc

SEQ ID NO: 396533 - DNA, 20 bp, Artificial Sequence
  chemically synthesized
tgaatagaccttatttcact

SEQ ID NO: 396534 - DNA, 20 bp, Artificial Sequence
  chemically synthesized
tgagataggccaagtgaaat

SEQ ID NO: 396535 - DNA, 20 bp, Artificial Sequence
  chemically synthesized
gagataggccaagtgaaata

SEQ ID NO: 396536 - DNA, 20 bp, Artificial Sequence
  chemically synthesized
agtgaaataaggtctattca

SEQ ID NO: 396537 - DNA, 20 bp, Artificial Sequence
  chemically synthesized
ctaccatacaagtctatgaa

SEQ ID NO: 396538 - DNA, 20 bp, Artificial Sequence
  chemically synthesized
ggtctattcatagacttgta

SEQ ID NO: 396539 - DNA, 20 bp, Artificial Sequence
  chemically synthesized
ctattcatagacttgtatgg

SEQ ID NO: 396540 - DNA, 20 bp, Artificial Sequence
  chemically synthesized
caatgttgtaactaccatac

SEQ ID NO: 396541 - DNA, 20 bp, Artificial Sequence
  chemically synthesized
ttgtatggtagttacaacat

SEQ ID NO: 396542 - DNA, 20 bp, Artificial Sequence
  chemically synthesized
agttacaacattggttgttt

SEQ ID NO: 396543 - DNA, 20 bp, Artificial Sequence
  chemically synthesized
ggttgttttagataataatg

SEQ ID NO: 396544 - DNA, 20 bp, Artificial Sequence
  chemically synthesized
caagtgttagatgatttatg

SEQ ID NO: 396545 - DNA, 20 bp, Artificial Sequence
  chemically synthesized
ttcataaatcatctaacact

SEQ ID NO: 396546 - DNA, 20 bp, Artificial Sequence
  chemically synthesized
acgtaatattttccaagtgt

SEQ ID NO: 396547 - DNA, 20 bp, Artificial Sequence
  chemically synthesized
tatggtacgtaatattttcc

SEQ ID NO: 396548 - DNA, 20 bp, Artificial Sequence
  chemically synthesized
ggaaaatattacgtaccata

SEQ ID NO: 396549 - DNA, 20 bp, Artificial Sequence
  chemically synthesized
tctttcaagagtttactata

SEQ ID NO: 396550 - DNA, 20 bp, Artificial Sequence
  chemically synthesized
accatatagtaaactcttga

SEQ ID NO: 396551 - DNA, 20 bp, Artificial Sequence
  chemically synthesized
catatagtaaactcttgaaa

SEQ ID NO: 396552 - DNA, 20 bp, Artificial Sequence
  chemically synthesized
gtactaaaatgctctttcaa

SEQ ID NO: 396553 - DNA, 20 bp, Artificial Sequence
  chemically synthesized
gggtactaaaatgctctttc

SEQ ID NO: 396554 - DNA, 20 bp, Artificial Sequence
  chemically synthesized
aaactcttgaaagagcattt

SEQ ID NO: 396555 - DNA, 20 bp, Artificial Sequence
  chemically synthesized
aaagagcattttagtacccc

SEQ ID NO: 396556 - DNA, 20 bp, Artificial Sequence
  chemically synthesized
attttcaagcattgttctgg

SEQ ID NO: 396557 - DNA, 20 bp, Artificial Sequence
  chemically synthesized
aattttcaagcattgttctg

SEQ ID NO: 396558 - DNA, 20 bp, Artificial Sequence
  chemically synthesized
aaattttcaagcattgttct

SEQ ID NO: 396559 - DNA, 20 bp, Artificial Sequence
  chemically synthesized
taaattttcaagcattgttc

SEQ ID NO: 396560 - DNA, 20 bp, Artificial Sequence
  chemically synthesized
gtaatttgccttaaattttc

SEQ ID NO: 396561 - DNA, 20 bp, Artificial Sequence
  chemically synthesized
agaacaatgcttgaaaattt

SEQ ID NO: 396562 - DNA, 20 bp, Artificial Sequence
  chemically synthesized
gaacaatgcttgaaaattta

SEQ ID NO: 396563 - DNA, 20 bp, Artificial Sequence
  chemically synthesized
tcaaaattgtgttgatttgg

SEQ ID NO: 396564 - DNA, 20 bp, Artificial Sequence
  chemically synthesized
cactcaaaattgtgttgatt

SEQ ID NO: 396565 - DNA, 20 bp, Artificial Sequence
  chemically synthesized
ttccaaatcaacacaatttt

SEQ ID NO: 396566 - DNA, 20 bp, Artificial Sequence
  chemically synthesized
ttttgagtgtaacttaactc

SEQ ID NO: 396567 - DNA, 20 bp, Artificial Sequence
  chemically synthesized
ccatatcaaaggccagagtt

SEQ ID NO: 396568 - DNA, 20 bp, Artificial Sequence
  chemically synthesized
gtttaccatatcaaaggcca

SEQ ID NO: 396569 - DNA, 20 bp, Artificial Sequence
  chemically synthesized
cagtttaccatatcaaaggc

SEQ ID NO: 396570 - DNA, 20 bp, Artificial Sequence
  chemically synthesized
cttaactctggcctttgata

SEQ ID NO: 396571 - DNA, 20 bp, Artificial Sequence
  chemically synthesized
ttggcagtttaccatatcaa

SEQ ID NO: 396572 - DNA, 20 bp, Artificial Sequence
  chemically synthesized
attggcagtttaccatatca

SEQ ID NO: 396573 - DNA, 20 bp, Artificial Sequence
  chemically synthesized
atatggtaaactgccaatta

SEQ ID NO: 396574 - DNA, 20 bp, Artificial Sequence
  chemically synthesized
agctagatagctataattgg

SEQ ID NO: 396575 - DNA, 20 bp, Artificial Sequence
  chemically synthesized
ccgagctagatagctataat

SEQ ID NO: 396576 - DNA, 20 bp, Artificial Sequence
  chemically synthesized
aactgccaattatagctatc

SEQ ID NO: 396577 - DNA, 20 bp, Artificial Sequence
  chemically synthesized
ccaattatagctatctagct

SEQ ID NO: 396578 - DNA, 20 bp, Artificial Sequence
  chemically synthesized
caatttaaatccgagctaga

SEQ ID NO: 396579 - DNA, 20 bp, Artificial Sequence
  chemically synthesized
aattcaatttaaatccgagc

SEQ ID NO: 396580 - DNA, 20 bp, Artificial Sequence
  chemically synthesized
atctaattcaatttaaatcc

SEQ ID NO: 396581 - DNA, 20 bp, Artificial Sequence
  chemically synthesized
agctcggatttaaattgaat

SEQ ID NO: 396582 - DNA, 20 bp, Artificial Sequence
  chemically synthesized
aattagattaaactgtgacc

SEQ ID NO: 396583 - DNA, 20 bp, Artificial Sequence
  chemically synthesized
ccagaaaaatcactgggtca

SEQ ID NO: 396584 - DNA, 20 bp, Artificial Sequence
  chemically synthesized
aagaaaccagaaaaatcact

SEQ ID NO: 396585 - DNA, 20 bp, Artificial Sequence
  chemically synthesized
taagaaaccagaaaaatcac

SEQ ID NO: 396586 - DNA, 20 bp, Artificial Sequence
  chemically synthesized
ctgtgacccagtgatttttc

SEQ ID NO: 396587 - DNA, 20 bp, Artificial Sequence
  chemically synthesized
gcactgaccacataagaaac

SEQ ID NO: 396588 - DNA, 20 bp, Artificial Sequence
  chemically synthesized
gatttttctggtttcttatg

SEQ ID NO: 396589 - DNA, 20 bp, Artificial Sequence
  chemically synthesized
tttctggtttcttatgtggt

SEQ ID NO: 396590 - DNA, 20 bp, Artificial Sequence
  chemically synthesized
actgtttgcactgaccacat

SEQ ID NO: 396591 - DNA, 20 bp, Artificial Sequence
  chemically synthesized
tcttatgtggtcagtgcaaa

SEQ ID NO: 396592 - DNA, 20 bp, Artificial Sequence
  chemically synthesized
gtgcaaacagttatatttaa

SEQ ID NO: 396593 - DNA, 20 bp, Artificial Sequence
  chemically synthesized
caaacagttatatttaatgg

SEQ ID NO: 396594 - DNA, 20 bp, Artificial Sequence
  chemically synthesized
agttatatttaatggtggta

SEQ ID NO: 396595 - DNA, 20 bp, Artificial Sequence
  chemically synthesized
tatttaatggtggtaaagct

SEQ ID NO: 396596 - DNA, 20 bp, Artificial Sequence
  chemically synthesized
tacatttaacgtttttatct

SEQ ID NO: 396597 - DNA, 20 bp, Artificial Sequence
  chemically synthesized
gagataaaaacgttaaatgt

SEQ ID NO: 396598 - DNA, 20 bp, Artificial Sequence
  chemically synthesized
gataaaaacgttaaatgtaa

SEQ ID NO: 396599 - DNA, 20 bp, Artificial Sequence
  chemically synthesized
taaatgtaagagtcaattgc

SEQ ID NO: 396600 - DNA, 20 bp, Artificial Sequence
  chemically synthesized
aaatgtaagagtcaattgca

SEQ ID NO: 396601 - DNA, 20 bp, Artificial Sequence
  chemically synthesized
tgcaaggtcattttctttcc

SEQ ID NO: 396602 - DNA, 20 bp, Artificial Sequence
  chemically synthesized
ctacgttttcattacttgga

SEQ ID NO: 396603 - DNA, 20 bp, Artificial Sequence
  chemically synthesized
agtactacgttttcattact

SEQ ID NO: 396604 - DNA, 20 bp, Artificial Sequence
  chemically synthesized
ctttccaagtaatgaaaacg

SEQ ID NO: 396605 - DNA, 20 bp, Artificial Sequence
  chemically synthesized
ctgtaattttacagcggatc

SEQ ID NO: 396606 - DNA, 20 bp, Artificial Sequence
  chemically synthesized
attagcctgtaattttacag

SEQ ID NO: 396607 - DNA, 20 bp, Artificial Sequence
  chemically synthesized
gtcattagcctgtaatttta

SEQ ID NO: 396608 - DNA, 20 bp, Artificial Sequence
  chemically synthesized
cttgatccgctgtaaaatta

SEQ ID NO: 396609 - DNA, 20 bp, Artificial Sequence
  chemically synthesized
ttgatccgctgtaaaattac

SEQ ID NO: 396610 - DNA, 20 bp, Artificial Sequence
  chemically synthesized
aaaattacaggctaatgact

SEQ ID NO: 396611 - DNA, 20 bp, Artificial Sequence
  chemically synthesized
actctgtaggactgagtcat

SEQ ID NO: 396612 - DNA, 20 bp, Artificial Sequence
  chemically synthesized
aggctaatgactcagtccta

SEQ ID NO: 396613 - DNA, 20 bp, Artificial Sequence
  chemically synthesized
gagagctactctgtaggact

SEQ ID NO: 396614 - DNA, 20 bp, Artificial Sequence
  chemically synthesized
gctaatgactcagtcctaca

SEQ ID NO: 396615 - DNA, 20 bp, Artificial Sequence
  chemically synthesized
aatgactcagtcctacagag

SEQ ID NO: 396616 - DNA, 20 bp, Artificial Sequence
  chemically synthesized
aggtttgagagctactctgt

SEQ ID NO: 396617 - DNA, 20 bp, Artificial Sequence
  chemically synthesized
aaggtttgagagctactctg

SEQ ID NO: 396618 - DNA, 20 bp, Artificial Sequence
  chemically synthesized
gtacatcgaacaaggtttga

SEQ ID NO: 396619 - DNA, 20 bp, Artificial Sequence
  chemically synthesized
gggtacatcgaacaaggttt

SEQ ID NO: 396620 - DNA, 20 bp, Artificial Sequence
  chemically synthesized
cagtgtgggtacatcgaaca

SEQ ID NO: 396621 - DNA, 20 bp, Artificial Sequence
  chemically synthesized
tcagtgtgggtacatcgaac

SEQ ID NO: 396622 - DNA, 20 bp, Artificial Sequence
  chemically synthesized
gtctttgcttaaatcagtgt

SEQ ID NO: 396623 - DNA, 20 bp, Artificial Sequence
  chemically synthesized
tgtctttgcttaaatcagtg

SEQ ID NO: 396624 - DNA, 20 bp, Artificial Sequence
  chemically synthesized
cgatgtacccacactgattt

SEQ ID NO: 396625 - DNA, 20 bp, Artificial Sequence
  chemically synthesized
tactttgtctttgcttaaat

SEQ ID NO: 396626 - DNA, 20 bp, Artificial Sequence
  chemically synthesized
tacccacactgatttaagca

SEQ ID NO: 396627 - DNA, 20 bp, Artificial Sequence
  chemically synthesized
cactgatttaagcaaagaca

SEQ ID NO: 396628 - DNA, 20 bp, Artificial Sequence
  chemically synthesized
tttgacgattaaataatgac

SEQ ID NO: 396629 - DNA, 20 bp, Artificial Sequence
  chemically synthesized
ttgacgattaaataatgaca

SEQ ID NO: 396630 - DNA, 20 bp, Artificial Sequence
  chemically synthesized
gacgattaaataatgacaag

SEQ ID NO: 396631 - DNA, 20 bp, Artificial Sequence
  chemically synthesized
aaggagcataaatcacgtct

SEQ ID NO: 396632 - DNA, 20 bp, Artificial Sequence
  chemically synthesized
agcataaatcacgtcttaga

SEQ ID NO: 396633 - DNA, 20 bp, Artificial Sequence
  chemically synthesized
tgtattttgtggcaccatct

SEQ ID NO: 396634 - DNA, 20 bp, Artificial Sequence
  chemically synthesized
cctttaaaatttgtattttg

SEQ ID NO: 396635 - DNA, 20 bp, Artificial Sequence
  chemically synthesized
gccacaaaatacaaatttta

SEQ ID NO: 396636 - DNA, 20 bp, Artificial Sequence
  chemically synthesized
ccacaaaatacaaattttaa

SEQ ID NO: 396637 - DNA, 20 bp, Artificial Sequence
  chemically synthesized
acaaattttaaaggtctcaa

SEQ ID NO: 396638 - DNA, 20 bp, Artificial Sequence
  chemically synthesized
tttatccaaaaatgtctatt

SEQ ID NO: 396639 - DNA, 20 bp, Artificial Sequence
  chemically synthesized
aaggtctcaatagacatttt

SEQ ID NO: 396640 - DNA, 20 bp, Artificial Sequence
  chemically synthesized
acatttttggataaaataat

SEQ ID NO: 396641 - DNA, 20 bp, Artificial Sequence
  chemically synthesized
gagaaaaaaatgttcaatca

SEQ ID NO: 396642 - DNA, 20 bp, Artificial Sequence
  chemically synthesized
agaaaaaaatgttcaatcaa

SEQ ID NO: 396643 - DNA, 20 bp, Artificial Sequence
  chemically synthesized
aaaaaatgttcaatcaaagg

SEQ ID NO: 396644 - DNA, 20 bp, Artificial Sequence
  chemically synthesized
aatgttcaatcaaaggtgga

SEQ ID NO: 396645 - DNA, 20 bp, Artificial Sequence
  chemically synthesized
ttttaaaaataaatatttat

SEQ ID NO: 396646 - DNA, 20 bp, Artificial Sequence
  chemically synthesized
atattacttttttaagtaat

SEQ ID NO: 396647 - DNA, 20 bp, Artificial Sequence
  chemically synthesized
tatattacttttttaagtaa

SEQ ID NO: 396648 - DNA, 20 bp, Artificial Sequence
  chemically synthesized
ataagtcctattacttaaaa

SEQ ID NO: 396649 - DNA, 20 bp, Artificial Sequence
  chemically synthesized
gtgtactatattactttttt

SEQ ID NO: 396650 - DNA, 20 bp, Artificial Sequence
  chemically synthesized
tattacttaaaaaagtaata

SEQ ID NO: 396651 - DNA, 20 bp, Artificial Sequence
  chemically synthesized
agtacacattgtaatatttt

SEQ ID NO: 396652 - DNA, 20 bp, Artificial Sequence
  chemically synthesized
cacattgtaatattttaaga

SEQ ID NO: 396653 - DNA, 20 bp, Artificial Sequence
  chemically synthesized
gtaatattttaagaaagttt

SEQ ID NO: 396654 - DNA, 20 bp, Artificial Sequence
  chemically synthesized
aagttttagtattgttttct

SEQ ID NO: 396655 - DNA, 20 bp, Artificial Sequence
  chemically synthesized
agttttagtattgttttctg

SEQ ID NO: 396656 - DNA, 20 bp, Artificial Sequence
  chemically synthesized
aaaaatggaatttgatgcct

SEQ ID NO: 396657 - DNA, 20 bp, Artificial Sequence
  chemically synthesized
ttcatgatactttcaaaaaa

SEQ ID NO: 396658 - DNA, 20 bp, Artificial Sequence
  chemically synthesized
catcaaattccattttttga

SEQ ID NO: 396659 - DNA, 20 bp, Artificial Sequence
  chemically synthesized
cattttttgaaagtatcatg

SEQ ID NO: 396660 - DNA, 20 bp, Artificial Sequence
  chemically synthesized
tttttgaaagtatcatgaag

SEQ ID NO: 396661 - DNA, 20 bp, Artificial Sequence
  chemically synthesized
ttttgaaagtatcatgaaga

SEQ ID NO: 396662 - DNA, 20 bp, Artificial Sequence
  chemically synthesized
tatcatgaagaaggatatta

SEQ ID NO: 396663 - DNA, 20 bp, Artificial Sequence
  chemically synthesized
agaaggatattaaagtactt

SEQ ID NO: 396664 - DNA, 20 bp, Artificial Sequence
  chemically synthesized
acagttggcagggcaatcta

SEQ ID NO: 396665 - DNA, 20 bp, Artificial Sequence
  chemically synthesized
tcggtctcctacagttggca

SEQ ID NO: 396666 - DNA, 20 bp, Artificial Sequence
  chemically synthesized
ttcggtctcctacagttggc

SEQ ID NO: 396667 - DNA, 20 bp, Artificial Sequence
  chemically synthesized
ttagattgccctgccaactg

SEQ ID NO: 396668 - DNA, 20 bp, Artificial Sequence
  chemically synthesized
tttcggtctcctacagttgg

SEQ ID NO: 396669 - DNA, 20 bp, Artificial Sequence
  chemically synthesized
tagattgccctgccaactgt

SEQ ID NO: 396670 - DNA, 20 bp, Artificial Sequence
  chemically synthesized
gattgccctgccaactgtag

SEQ ID NO: 396671 - DNA, 20 bp, Artificial Sequence
  chemically synthesized
atatttcggtctcctacagt

SEQ ID NO: 396672 - DNA, 20 bp, Artificial Sequence
  chemically synthesized
tggcatatttcggtctccta

SEQ ID NO: 396673 - DNA, 20 bp, Artificial Sequence
  chemically synthesized
tattttgggatggcatattt

SEQ ID NO: 396674 - DNA, 20 bp, Artificial Sequence
  chemically synthesized
ttttgtgacatattttggga

SEQ ID NO: 396675 - DNA, 20 bp, Artificial Sequence
  chemically synthesized
catattttgtgacatatttt

SEQ ID NO: 396676 - DNA, 20 bp, Artificial Sequence
  chemically synthesized
acatattttgtgacatattt

SEQ ID NO: 396677 - DNA, 20 bp, Artificial Sequence
  chemically synthesized
aatatgtcacaaaatatgtc

SEQ ID NO: 396678 - DNA, 20 bp, Artificial Sequence
  chemically synthesized
tgtcacaaaatatgtcaaga

SEQ ID NO: 396679 - DNA, 20 bp, Artificial Sequence
  chemically synthesized
cacaaaatatgtcaagaaag

SEQ ID NO: 396680 - DNA, 20 bp, Artificial Sequence
  chemically synthesized
acaaaatatgtcaagaaagc

SEQ ID NO: 396681 - DNA, 20 bp, Artificial Sequence
  chemically synthesized
tgtcaagaaagcaggcttga

SEQ ID NO: 396682 - DNA, 20 bp, Artificial Sequence
  chemically synthesized
catgagccaccgcggccatc

SEQ ID NO: 396683 - DNA, 20 bp, Artificial Sequence
  chemically synthesized
gaaagcaggcttgatggccg

SEQ ID NO: 396684 - DNA, 20 bp, Artificial Sequence
  chemically synthesized
agcaggcttgatggccgcgg

SEQ ID NO: 396685 - DNA, 20 bp, Artificial Sequence
  chemically synthesized
attacaggcatgagccaccg

SEQ ID NO: 396686 - DNA, 20 bp, Artificial Sequence
  chemically synthesized
agtgctgggattacaggcat

SEQ ID NO: 396687 - DNA, 20 bp, Artificial Sequence
  chemically synthesized
gtggctcatgcctgtaatcc

SEQ ID NO: 396688 - DNA, 20 bp, Artificial Sequence
  chemically synthesized
tcccaaagtgctgggattac

SEQ ID NO: 396689 - DNA, 20 bp, Artificial Sequence
  chemically synthesized
ctcccaaagtgctgggatta

SEQ ID NO: 396690 - DNA, 20 bp, Artificial Sequence
  chemically synthesized
tgcctgtaatcccagcactt

SEQ ID NO: 396691 - DNA, 20 bp, Artificial Sequence
  chemically synthesized
cctctgcctcccaaagtgct

SEQ ID NO: 396692 - DNA, 20 bp, Artificial Sequence
  chemically synthesized
gcctgtaatcccagcacttt

SEQ ID NO: 396693 - DNA, 20 bp, Artificial Sequence
  chemically synthesized
gcctctgcctcccaaagtgc

SEQ ID NO: 396694 - DNA, 20 bp, Artificial Sequence
  chemically synthesized
ctgtaatcccagcactttgg

SEQ ID NO: 396695 - DNA, 20 bp, Artificial Sequence
  chemically synthesized
tgtaatcccagcactttggg

SEQ ID NO: 396696 - DNA, 20 bp, Artificial Sequence
  chemically synthesized
aatcccagcactttgggagg

SEQ ID NO: 396697 - DNA, 20 bp, Artificial Sequence
  chemically synthesized
ccgcccgcctctgcctccca

SEQ ID NO: 396698 - DNA, 20 bp, Artificial Sequence
  chemically synthesized
tcccagcactttgggaggca

SEQ ID NO: 396699 - DNA, 20 bp, Artificial Sequence
  chemically synthesized
cccagcactttgggaggcag

SEQ ID NO: 396700 - DNA, 20 bp, Artificial Sequence
  chemically synthesized
agcactttgggaggcagagg

SEQ ID NO: 396701 - DNA, 20 bp, Artificial Sequence
  chemically synthesized
gcactttgggaggcagaggc

SEQ ID NO: 396702 - DNA, 20 bp, Artificial Sequence
  chemically synthesized
ctttgggaggcagaggcggg

SEQ ID NO: 396703 - DNA, 20 bp, Artificial Sequence
  chemically synthesized
tttgggaggcagaggcgggc

SEQ ID NO: 396704 - DNA, 20 bp, Artificial Sequence
  chemically synthesized
cagaggcgggcgggtcacct

SEQ ID NO: 396705 - DNA, 20 bp, Artificial Sequence
  chemically synthesized
agaggcgggcgggtcacctg

SEQ ID NO: 396706 - DNA, 20 bp, Artificial Sequence
  chemically synthesized
gcgggcgggtcacctgaggt

SEQ ID NO: 396707 - DNA, 20 bp, Artificial Sequence
  chemically synthesized
cgggcgggtcacctgaggtc

SEQ ID NO: 396708 - DNA, 20 bp, Artificial Sequence
  chemically synthesized
ggtctcgaactcctgacctc

SEQ ID NO: 396709 - DNA, 20 bp, Artificial Sequence
  chemically synthesized
ggcgggtcacctgaggtcag

SEQ ID NO: 396710 - DNA, 20 bp, Artificial Sequence
  chemically synthesized
tggtctcgaactcctgacct

SEQ ID NO: 396711 - DNA, 20 bp, Artificial Sequence
  chemically synthesized
tcacctgaggtcaggagttc

SEQ ID NO: 396712 - DNA, 20 bp, Artificial Sequence
  chemically synthesized
tgaggtcaggagttcgagac

SEQ ID NO: 396713 - DNA, 20 bp, Artificial Sequence
  chemically synthesized
gtcaggagttcgagaccagc

SEQ ID NO: 396714 - DNA, 20 bp, Artificial Sequence
  chemically synthesized
tcaggagttcgagaccagcc

SEQ ID NO: 396715 - DNA, 20 bp, Artificial Sequence
  chemically synthesized
ttttgccatgttggcccggc

SEQ ID NO: 396716 - DNA, 20 bp, Artificial Sequence
  chemically synthesized
gaggttttgccatgttggcc

SEQ ID NO: 396717 - DNA, 20 bp, Artificial Sequence
  chemically synthesized
cgagaccagccgggccaaca

SEQ ID NO: 396718 - DNA, 20 bp, Artificial Sequence
  chemically synthesized
tggtagaggttttgccatgt

SEQ ID NO: 396719 - DNA, 20 bp, Artificial Sequence
  chemically synthesized
taattttttatttttggtag

SEQ ID NO: 396720 - DNA, 20 bp, Artificial Sequence
  chemically synthesized
ctaattttttatttttggta

SEQ ID NO: 396721 - DNA, 20 bp, Artificial Sequence
  chemically synthesized
ggctaattttttatttttgg

SEQ ID NO: 396722 - DNA, 20 bp, Artificial Sequence
  chemically synthesized
cctggctaattttttatttt

SEQ ID NO: 396723 - DNA, 20 bp, Artificial Sequence
  chemically synthesized
ctctaccaaaaataaaaaat

SEQ ID NO: 396724 - DNA, 20 bp, Artificial Sequence
  chemically synthesized
accaaaaataaaaaattagc

SEQ ID NO: 396725 - DNA, 20 bp, Artificial Sequence
  chemically synthesized
ccaaaaataaaaaattagcc

SEQ ID NO: 396726 - DNA, 20 bp, Artificial Sequence
  chemically synthesized
aataaaaaattagccaggca

SEQ ID NO: 396727 - DNA, 20 bp, Artificial Sequence
  chemically synthesized
aaaaaattagccaggcatgg

SEQ ID NO: 396728 - DNA, 20 bp, Artificial Sequence
  chemically synthesized
caggtgtgtgccaccatgcc

SEQ ID NO: 396729 - DNA, 20 bp, Artificial Sequence
  chemically synthesized
ggcatggtggcacacacctg

SEQ ID NO: 396730 - DNA, 20 bp, Artificial Sequence
  chemically synthesized
gtggcacacacctgtagtcc

SEQ ID NO: 396731 - DNA, 20 bp, Artificial Sequence
  chemically synthesized
tcccaggtagctgggactac

SEQ ID NO: 396732 - DNA, 20 bp, Artificial Sequence
  chemically synthesized
ctcccaggtagctgggacta

SEQ ID NO: 396733 - DNA, 20 bp, Artificial Sequence
  chemically synthesized
cacctgtagtcccagctacc

SEQ ID NO: 396734 - DNA, 20 bp, Artificial Sequence
  chemically synthesized
cctcggcctcccaggtagct

SEQ ID NO: 396735 - DNA, 20 bp, Artificial Sequence
  chemically synthesized
acctgtagtcccagctacct

SEQ ID NO: 396736 - DNA, 20 bp, Artificial Sequence
  chemically synthesized
gcctcggcctcccaggtagc

SEQ ID NO: 396737 - DNA, 20 bp, Artificial Sequence
  chemically synthesized
ctgtagtcccagctacctgg

SEQ ID NO: 396738 - DNA, 20 bp, Artificial Sequence
  chemically synthesized
tgtagtcccagctacctggg

SEQ ID NO: 396739 - DNA, 20 bp, Artificial Sequence
  chemically synthesized
tcctgcctcggcctcccagg

SEQ ID NO: 396740 - DNA, 20 bp, Artificial Sequence
  chemically synthesized
ttctcctgcctcggcctccc

SEQ ID NO: 396741 - DNA, 20 bp, Artificial Sequence
  chemically synthesized
tcccagctacctgggaggcc

SEQ ID NO: 396742 - DNA, 20 bp, Artificial Sequence
  chemically synthesized
attctcctgcctcggcctcc

SEQ ID NO: 396743 - DNA, 20 bp, Artificial Sequence
  chemically synthesized
cccagctacctgggaggccg

SEQ ID NO: 396744 - DNA, 20 bp, Artificial Sequence
  chemically synthesized
agctacctgggaggccgagg

SEQ ID NO: 396745 - DNA, 20 bp, Artificial Sequence
  chemically synthesized
gctacctgggaggccgaggc

SEQ ID NO: 396746 - DNA, 20 bp, Artificial Sequence
  chemically synthesized
tacctgggaggccgaggcag

SEQ ID NO: 396747 - DNA, 20 bp, Artificial Sequence
  chemically synthesized
ttcaagcgattctcctgcct

SEQ ID NO: 396748 - DNA, 20 bp, Artificial Sequence
  chemically synthesized
caggagaatcgcttgaaccc

SEQ ID NO: 396749 - DNA, 20 bp, Artificial Sequence
  chemically synthesized
aaccttcacctccagggttc

SEQ ID NO: 396750 - DNA, 20 bp, Artificial Sequence
  chemically synthesized
ggagaatcgcttgaaccctg

SEQ ID NO: 396751 - DNA, 20 bp, Artificial Sequence
  chemically synthesized
gagaatcgcttgaaccctgg

SEQ ID NO: 396752 - DNA, 20 bp, Artificial Sequence
  chemically synthesized
cactgcaaccttcacctcca

SEQ ID NO: 396753 - DNA, 20 bp, Artificial Sequence
  chemically synthesized
tcgcttgaaccctggaggtg

SEQ ID NO: 396754 - DNA, 20 bp, Artificial Sequence
  chemically synthesized
tcactgcaaccttcacctcc

SEQ ID NO: 396755 - DNA, 20 bp, Artificial Sequence
  chemically synthesized
cgcttgaaccctggaggtga

SEQ ID NO: 396756 - DNA, 20 bp, Artificial Sequence
  chemically synthesized
ctcactgcaaccttcacctc

SEQ ID NO: 396757 - DNA, 20 bp, Artificial Sequence
  chemically synthesized
aaccctggaggtgaaggttg

SEQ ID NO: 396758 - DNA, 20 bp, Artificial Sequence
  chemically synthesized
ctggaggtgaaggttgcagt

SEQ ID NO: 396759 - DNA, 20 bp, Artificial Sequence
  chemically synthesized
ggtgaaggttgcagtgagcc

SEQ ID NO: 396760 - DNA, 20 bp, Artificial Sequence
  chemically synthesized
aaggttgcagtgagccgaga

SEQ ID NO: 396761 - DNA, 20 bp, Artificial Sequence
  chemically synthesized
ggagtgcaatggcactatct

SEQ ID NO: 396762 - DNA, 20 bp, Artificial Sequence
  chemically synthesized
tcgcccaaggtggagtgcaa

SEQ ID NO: 396763 - DNA, 20 bp, Artificial Sequence
  chemically synthesized
agtgccattgcactccacct

SEQ ID NO: 396764 - DNA, 20 bp, Artificial Sequence
  chemically synthesized
gtgccattgcactccacctt

SEQ ID NO: 396765 - DNA, 20 bp, Artificial Sequence
  chemically synthesized
ttgctctgtcgcccaaggtg

SEQ ID NO: 396766 - DNA, 20 bp, Artificial Sequence
  chemically synthesized
tcttgctctgtcgcccaagg

SEQ ID NO: 396767 - DNA, 20 bp, Artificial Sequence
  chemically synthesized
ttgcactccaccttgggcga

SEQ ID NO: 396768 - DNA, 20 bp, Artificial Sequence
  chemically synthesized
cagtcttgctctgtcgccca

SEQ ID NO: 396769 - DNA, 20 bp, Artificial Sequence
  chemically synthesized
acagtcttgctctgtcgccc

SEQ ID NO: 396770 - DNA, 20 bp, Artificial Sequence
  chemically synthesized
gcactccaccttgggcgaca

SEQ ID NO: 396771 - DNA, 20 bp, Artificial Sequence
  chemically synthesized
tccaccttgggcgacagagc

SEQ ID NO: 396772 - DNA, 20 bp, Artificial Sequence
  chemically synthesized
gtttttttttttttttgaaa

SEQ ID NO: 396773 - DNA, 20 bp, Artificial Sequence
  chemically synthesized
tttcaaaaaaaaaaaaaaac

SEQ ID NO: 396774 - DNA, 20 bp, Artificial Sequence
  chemically synthesized
tccagcaataaaatgcaagc

SEQ ID NO: 396775 - DNA, 20 bp, Artificial Sequence
  chemically synthesized
gaaatccagcaataaaatgc

SEQ ID NO: 396776 - DNA, 20 bp, Artificial Sequence
  chemically synthesized
actagcttgcattttattgc

SEQ ID NO: 396777 - DNA, 20 bp, Artificial Sequence
  chemically synthesized
tgagcacaacttgagaaatc

SEQ ID NO: 396778 - DNA, 20 bp, Artificial Sequence
  chemically synthesized
attttattgctggatttctc

SEQ ID NO: 396779 - DNA, 20 bp, Artificial Sequence
  chemically synthesized
gtgccctatgagcacaactt

SEQ ID NO: 396780 - DNA, 20 bp, Artificial Sequence
  chemically synthesized
gatttctcaagttgtgctca

SEQ ID NO: 396781 - DNA, 20 bp, Artificial Sequence
  chemically synthesized
atttctcaagttgtgctcat

SEQ ID NO: 396782 - DNA, 20 bp, Artificial Sequence
  chemically synthesized
tttctcaagttgtgctcata

SEQ ID NO: 396783 - DNA, 20 bp, Artificial Sequence
  chemically synthesized
ctttctccattgtgccctat

SEQ ID NO: 396784 - DNA, 20 bp, Artificial Sequence
  chemically synthesized
gttgtgctcatagggcacaa

SEQ ID NO: 396785 - DNA, 20 bp, Artificial Sequence
  chemically synthesized
tgtgctcatagggcacaatg

SEQ ID NO: 396786 - DNA, 20 bp, Artificial Sequence
  chemically synthesized
ctcatagggcacaatggaga

SEQ ID NO: 396787 - DNA, 20 bp, Artificial Sequence
  chemically synthesized
taaccttgaaaatatgttat

SEQ ID NO: 396788 - DNA, 20 bp, Artificial Sequence
  chemically synthesized
tgttctaataacatattttc

SEQ ID NO: 396789 - DNA, 20 bp, Artificial Sequence
  chemically synthesized
gttctaataacatattttca

SEQ ID NO: 396790 - DNA, 20 bp, Artificial Sequence
  chemically synthesized
taataacatattttcaaggt

SEQ ID NO: 396791 - DNA, 20 bp, Artificial Sequence
  chemically synthesized
tcaaggttagccattgtcaa

SEQ ID NO: 396792 - DNA, 20 bp, Artificial Sequence
  chemically synthesized
tgaatgaaaacttttgacaa

SEQ ID NO: 396793 - DNA, 20 bp, Artificial Sequence
  chemically synthesized
ttcattaatctgttttattt

SEQ ID NO: 396794 - DNA, 20 bp, Artificial Sequence
  chemically synthesized
tttcattcactgaaataaaa

SEQ ID NO: 396795 - DNA, 20 bp, Artificial Sequence
  chemically synthesized
aaacagattaatgaatctat

SEQ ID NO: 396796 - DNA, 20 bp, Artificial Sequence
  chemically synthesized
agattaatgaatctataaga

SEQ ID NO: 396797 - DNA, 20 bp, Artificial Sequence
  chemically synthesized
aatatacatatgctttctta

SEQ ID NO: 396798 - DNA, 20 bp, Artificial Sequence
  chemically synthesized
ataaaaataacaacagaaaa

SEQ ID NO: 396799 - DNA, 20 bp, Artificial Sequence
  chemically synthesized
tataaaaataacaacagaaa

SEQ ID NO: 396800 - DNA, 20 bp, Artificial Sequence
  chemically synthesized
taaatctataaaaataacaa

SEQ ID NO: 396801 - DNA, 20 bp, Artificial Sequence
  chemically synthesized
tttttctgttgttattttta

SEQ ID NO: 396802 - DNA, 20 bp, Artificial Sequence
  chemically synthesized
tgttgttatttttatagatt

SEQ ID NO: 396803 - DNA, 20 bp, Artificial Sequence
  chemically synthesized
gttgttatttttatagattt

SEQ ID NO: 396804 - DNA, 20 bp, Artificial Sequence
  chemically synthesized
tgttatttttatagatttag

SEQ ID NO: 396805 - DNA, 20 bp, Artificial Sequence
  chemically synthesized
gttatttttatagatttagg

SEQ ID NO: 396806 - DNA, 20 bp, Artificial Sequence
  chemically synthesized
ttttatagatttaggaggta

SEQ ID NO: 396807 - DNA, 20 bp, Artificial Sequence
  chemically synthesized
tagatttaggaggtacagtg

SEQ ID NO: 396808 - DNA, 20 bp, Artificial Sequence
  chemically synthesized
gttttgttacatgcatatgt

SEQ ID NO: 396809 - DNA, 20 bp, Artificial Sequence
  chemically synthesized
tgttacatgcatatgttgga

SEQ ID NO: 396810 - DNA, 20 bp, Artificial Sequence
  chemically synthesized
tacatgcatatgttggatag

SEQ ID NO: 396811 - DNA, 20 bp, Artificial Sequence
  chemically synthesized
tgttggatagtagtgatgtc

SEQ ID NO: 396812 - DNA, 20 bp, Artificial Sequence
  chemically synthesized
agtagtgatgtctggtcttc

SEQ ID NO: 396813 - DNA, 20 bp, Artificial Sequence
  chemically synthesized
tgatggtttcactagaagac

SEQ ID NO: 396814 - DNA, 20 bp, Artificial Sequence
  chemically synthesized
tggagtgatggtttcactag

SEQ ID NO: 396815 - DNA, 20 bp, Artificial Sequence
  chemically synthesized
tattggagtgatggtttcac

SEQ ID NO: 396816 - DNA, 20 bp, Artificial Sequence
  chemically synthesized
aatgtacactattggagtga

SEQ ID NO: 396817 - DNA, 20 bp, Artificial Sequence
  chemically synthesized
tagtgaaaccatcactccaa

SEQ ID NO: 396818 - DNA, 20 bp, Artificial Sequence
  chemically synthesized
aggtacaatgtacactattg

SEQ ID NO: 396819 - DNA, 20 bp, Artificial Sequence
  chemically synthesized
ttaggtacaatgtacactat

SEQ ID NO: 396820 - DNA, 20 bp, Artificial Sequence
  chemically synthesized
atagtgtacattgtacctaa

SEQ ID NO: 396821 - DNA, 20 bp, Artificial Sequence
  chemically synthesized
tagtgtacattgtacctaat

SEQ ID NO: 396822 - DNA, 20 bp, Artificial Sequence
  chemically synthesized
ggagtgagaaattacctatt

SEQ ID NO: 396823 - DNA, 20 bp, Artificial Sequence
  chemically synthesized
aggagtgagaaattacctat

SEQ ID NO: 396824 - DNA, 20 bp, Artificial Sequence
  chemically synthesized
gtggcaggggagtgaggagt

SEQ ID NO: 396825 - DNA, 20 bp, Artificial Sequence
  chemically synthesized
gattgtggcaggggagtgag

SEQ ID NO: 396826 - DNA, 20 bp, Artificial Sequence
  chemically synthesized
gagattgtggcaggggagtg

SEQ ID NO: 396827 - DNA, 20 bp, Artificial Sequence
  chemically synthesized
tgagattgtggcaggggagt

SEQ ID NO: 396828 - DNA, 20 bp, Artificial Sequence
  chemically synthesized
aaggtgagattgtggcaggg

SEQ ID NO: 396829 - DNA, 20 bp, Artificial Sequence
  chemically synthesized
aaaaggtgagattgtggcag

SEQ ID NO: 396830 - DNA, 20 bp, Artificial Sequence
  chemically synthesized
taaaaggtgagattgtggca

SEQ ID NO: 396831 - DNA, 20 bp, Artificial Sequence
  chemically synthesized
ttaaaaggtgagattgtggc

SEQ ID NO: 396832 - DNA, 20 bp, Artificial Sequence
  chemically synthesized
tttaaaaggtgagattgtgg

SEQ ID NO: 396833 - DNA, 20 bp, Artificial Sequence
  chemically synthesized
ttttttaaaaggtgagattg

SEQ ID NO: 396834 - DNA, 20 bp, Artificial Sequence
  chemically synthesized
tacaaaattttttaaaaggt

SEQ ID NO: 396835 - DNA, 20 bp, Artificial Sequence
  chemically synthesized
aaaatacaaaattttttaaa

SEQ ID NO: 396836 - DNA, 20 bp, Artificial Sequence
  chemically synthesized
aaaaatacaaaattttttaa

SEQ ID NO: 396837 - DNA, 20 bp, Artificial Sequence
  chemically synthesized
ttttgtatttttaatttttg

SEQ ID NO: 396838 - DNA, 20 bp, Artificial Sequence
  chemically synthesized
tttgtatttttaatttttgt

SEQ ID NO: 396839 - DNA, 20 bp, Artificial Sequence
  chemically synthesized
taatttttgtgggtacactg

SEQ ID NO: 396840 - DNA, 20 bp, Artificial Sequence
  chemically synthesized
aatttttgtgggtacactgt

SEQ ID NO: 396841 - DNA, 20 bp, Artificial Sequence
  chemically synthesized
cccagaaatttatacaccta

SEQ ID NO: 396842 - DNA, 20 bp, Artificial Sequence
  chemically synthesized
actgtaggtgtataaatttc

SEQ ID NO: 396843 - DNA, 20 bp, Artificial Sequence
  chemically synthesized
ctgtaggtgtataaatttct

SEQ ID NO: 396844 - DNA, 20 bp, Artificial Sequence
  chemically synthesized
tgtaggtgtataaatttctg

SEQ ID NO: 396845 - DNA, 20 bp, Artificial Sequence
  chemically synthesized
cgggaggctctcatgtaccc

SEQ ID NO: 396846 - DNA, 20 bp, Artificial Sequence
  chemically synthesized
tataaatttctggggtacat

SEQ ID NO: 396847 - DNA, 20 bp, Artificial Sequence
  chemically synthesized
taaatttctggggtacatga

SEQ ID NO: 396848 - DNA, 20 bp, Artificial Sequence
  chemically synthesized
aaaaaaaaaaaaatggcggg

SEQ ID NO: 396849 - DNA, 20 bp, Artificial Sequence
  chemically synthesized
aaaaaaaaaaaaaatggcgg

SEQ ID NO: 396850 - DNA, 20 bp, Artificial Sequence
  chemically synthesized
tcaaaaaaaaaaaaaatggc

SEQ ID NO: 396851 - DNA, 20 bp, Artificial Sequence
  chemically synthesized
ctcaaaaaaaaaaaaaatgg

SEQ ID NO: 396852 - DNA, 20 bp, Artificial Sequence
  chemically synthesized
catctcaaaaaaaaaaaaaa

SEQ ID NO: 396853 - DNA, 20 bp, Artificial Sequence
  chemically synthesized
ccgccatttttttttttttt

SEQ ID NO: 396854 - DNA, 20 bp, Artificial Sequence
  chemically synthesized
cattttttttttttttgaga

SEQ ID NO: 396855 - DNA, 20 bp, Artificial Sequence
  chemically synthesized
ttttttttttttttgagatg

SEQ ID NO: 396856 - DNA, 20 bp, Artificial Sequence
  chemically synthesized
ccagcctgggtgcacagggc

SEQ ID NO: 396857 - DNA, 20 bp, Artificial Sequence
  chemically synthesized
cactccagcctgggtgcaca

SEQ ID NO: 396858 - DNA, 20 bp, Artificial Sequence
  chemically synthesized
ggagtctcgccctgtgcacc

SEQ ID NO: 396859 - DNA, 20 bp, Artificial Sequence
  chemically synthesized
gcactccagcctgggtgcac

SEQ ID NO: 396860 - DNA, 20 bp, Artificial Sequence
  chemically synthesized
gagtctcgccctgtgcaccc

SEQ ID NO: 396861 - DNA, 20 bp, Artificial Sequence
  chemically synthesized
tgcactccagcctgggtgca

SEQ ID NO: 396862 - DNA, 20 bp, Artificial Sequence
  chemically synthesized
ctcgccctgtgcacccaggc

SEQ ID NO: 396863 - DNA, 20 bp, Artificial Sequence
  chemically synthesized
cgccctgtgcacccaggctg

SEQ ID NO: 396864 - DNA, 20 bp, Artificial Sequence
  chemically synthesized
gcgccactgcactccagcct

SEQ ID NO: 396865 - DNA, 20 bp, Artificial Sequence
  chemically synthesized
cgcgccactgcactccagcc

SEQ ID NO: 396866 - DNA, 20 bp, Artificial Sequence
  chemically synthesized
tgtgcacccaggctggagtg

SEQ ID NO: 396867 - DNA, 20 bp, Artificial Sequence
  chemically synthesized
gagatcgcgccactgcactc

SEQ ID NO: 396868 - DNA, 20 bp, Artificial Sequence
  chemically synthesized
gcacccaggctggagtgcag

SEQ ID NO: 396869 - DNA, 20 bp, Artificial Sequence
  chemically synthesized
ggagtgcagtggcgcgatct

SEQ ID NO: 396870 - DNA, 20 bp, Artificial Sequence
  chemically synthesized
ggcggaggttgcagtgagcc

SEQ ID NO: 396871 - DNA, 20 bp, Artificial Sequence
  chemically synthesized
caggaggcggaggttgcagt

SEQ ID NO: 396872 - DNA, 20 bp, Artificial Sequence
  chemically synthesized
aacccaggaggcggaggttg

SEQ ID NO: 396873 - DNA, 20 bp, Artificial Sequence
  chemically synthesized
tgattgaacccaggaggcgg

SEQ ID NO: 396874 - DNA, 20 bp, Artificial Sequence
  chemically synthesized
tcactgcaacctccgcctcc

SEQ ID NO: 396875 - DNA, 20 bp, Artificial Sequence
  chemically synthesized
ttgattgaacccaggaggcg

SEQ ID NO: 396876 - DNA, 20 bp, Artificial Sequence
  chemically synthesized
cactgcaacctccgcctcct

SEQ ID NO: 396877 - DNA, 20 bp, Artificial Sequence
  chemically synthesized
aattgattgaacccaggagg

SEQ ID NO: 396878 - DNA, 20 bp, Artificial Sequence
  chemically synthesized
gagaattgattgaacccagg

SEQ ID NO: 396879 - DNA, 20 bp, Artificial Sequence
  chemically synthesized
ggagaattgattgaacccag

SEQ ID NO: 396880 - DNA, 20 bp, Artificial Sequence
  chemically synthesized
caggagaattgattgaaccc

SEQ ID NO: 396881 - DNA, 20 bp, Artificial Sequence
  chemically synthesized
gcaggagaattgattgaacc

SEQ ID NO: 396882 - DNA, 20 bp, Artificial Sequence
  chemically synthesized
ttcaatcaattctcctgcct

SEQ ID NO: 396883 - DNA, 20 bp, Artificial Sequence
  chemically synthesized
tattcaggagaccgaggcag

SEQ ID NO: 396884 - DNA, 20 bp, Artificial Sequence
  chemically synthesized
gctattcaggagaccgaggc

SEQ ID NO: 396885 - DNA, 20 bp, Artificial Sequence
  chemically synthesized
agctattcaggagaccgagg

SEQ ID NO: 396886 - DNA, 20 bp, Artificial Sequence
  chemically synthesized
cccagctattcaggagaccg

SEQ ID NO: 396887 - DNA, 20 bp, Artificial Sequence
  chemically synthesized
tcccagctattcaggagacc

SEQ ID NO: 396888 - DNA, 20 bp, Artificial Sequence
  chemically synthesized
tcctgcctcggtctcctgaa

SEQ ID NO: 396889 - DNA, 20 bp, Artificial Sequence
  chemically synthesized
ctgtaatcccagctattcag

SEQ ID NO: 396890 - DNA, 20 bp, Artificial Sequence
  chemically synthesized
gcctcggtctcctgaatagc

SEQ ID NO: 396891 - DNA, 20 bp, Artificial Sequence
  chemically synthesized
gcctgtaatcccagctattc

SEQ ID NO: 396892 - DNA, 20 bp, Artificial Sequence
  chemically synthesized
cctcggtctcctgaatagct

SEQ ID NO: 396893 - DNA, 20 bp, Artificial Sequence
  chemically synthesized
tgcctgtaatcccagctatt

SEQ ID NO: 396894 - DNA, 20 bp, Artificial Sequence
  chemically synthesized
ctcctgaatagctgggatta

SEQ ID NO: 396895 - DNA, 20 bp, Artificial Sequence
  chemically synthesized
tcctgaatagctgggattac

SEQ ID NO: 396896 - DNA, 20 bp, Artificial Sequence
  chemically synthesized
gtggcgcgtgcctgtaatcc

SEQ ID NO: 396897 - DNA, 20 bp, Artificial Sequence
  chemically synthesized
caaaaatcagtcgggcatgg

SEQ ID NO: 396898 - DNA, 20 bp, Artificial Sequence
  chemically synthesized
atacaaaaatcagtcgggca

SEQ ID NO: 396899 - DNA, 20 bp, Artificial Sequence
  chemically synthesized
taaaaatacaaaaatcagtc

SEQ ID NO: 396900 - DNA, 20 bp, Artificial Sequence
  chemically synthesized
ctaaaaatacaaaaatcagt

SEQ ID NO: 396901 - DNA, 20 bp, Artificial Sequence
  chemically synthesized
tctactaaaaatacaaaaat

SEQ ID NO: 396902 - DNA, 20 bp, Artificial Sequence
  chemically synthesized
ccgactgatttttgtatttt

SEQ ID NO: 396903 - DNA, 20 bp, Artificial Sequence
  chemically synthesized
actgatttttgtatttttag

SEQ ID NO: 396904 - DNA, 20 bp, Artificial Sequence
  chemically synthesized
tgatttttgtatttttagta

SEQ ID NO: 396905 - DNA, 20 bp, Artificial Sequence
  chemically synthesized
ttttgtatttttagtagaga

SEQ ID NO: 396906 - DNA, 20 bp, Artificial Sequence
  chemically synthesized
tttgtatttttagtagagac

SEQ ID NO: 396907 - DNA, 20 bp, Artificial Sequence
  chemically synthesized
ttgtatttttagtagagaca

SEQ ID NO: 396908 - DNA, 20 bp, Artificial Sequence
  chemically synthesized
gagacagggtttaaccatgt

SEQ ID NO: 396909 - DNA, 20 bp, Artificial Sequence
  chemically synthesized
cagggtttaaccatgttggt

SEQ ID NO: 396910 - DNA, 20 bp, Artificial Sequence
  chemically synthesized
cgagaccagcctgaccaaca

SEQ ID NO: 396911 - DNA, 20 bp, Artificial Sequence
  chemically synthesized
agggtttaaccatgttggtc

SEQ ID NO: 396912 - DNA, 20 bp, Artificial Sequence
  chemically synthesized
tttaaccatgttggtcaggc

SEQ ID NO: 396913 - DNA, 20 bp, Artificial Sequence
  chemically synthesized
cgaggtcaggagttcgagac

SEQ ID NO: 396914 - DNA, 20 bp, Artificial Sequence
  chemically synthesized
gatcacgaggtcaggagttc

SEQ ID NO: 396915 - DNA, 20 bp, Artificial Sequence
  chemically synthesized
caggcagatcacgaggtcag

SEQ ID NO: 396916 - DNA, 20 bp, Artificial Sequence
  chemically synthesized
ggcaggcagatcacgaggtc

SEQ ID NO: 396917 - DNA, 20 bp, Artificial Sequence
  chemically synthesized
aggcaggcagatcacgaggt

SEQ ID NO: 396918 - DNA, 20 bp, Artificial Sequence
  chemically synthesized
gctgaggcaggcagatcacg

SEQ ID NO: 396919 - DNA, 20 bp, Artificial Sequence
  chemically synthesized
ggctgaggcaggcagatcac

SEQ ID NO: 396920 - DNA, 20 bp, Artificial Sequence
  chemically synthesized
acctcgtgatctgcctgcct

SEQ ID NO: 396921 - DNA, 20 bp, Artificial Sequence
  chemically synthesized
ctttgggaggctgaggcagg

SEQ ID NO: 396922 - DNA, 20 bp, Artificial Sequence
  chemically synthesized
gaactttgggaggctgaggc

SEQ ID NO: 396923 - DNA, 20 bp, Artificial Sequence
  chemically synthesized
agaactttgggaggctgagg

SEQ ID NO: 396924 - DNA, 20 bp, Artificial Sequence
  chemically synthesized
cccagaactttgggaggctg

SEQ ID NO: 396925 - DNA, 20 bp, Artificial Sequence
  chemically synthesized
ccccagaactttgggaggct

SEQ ID NO: 396926 - DNA, 20 bp, Artificial Sequence
  chemically synthesized
ctgcctgcctcagcctccca

SEQ ID NO: 396927 - DNA, 20 bp, Artificial Sequence
  chemically synthesized
tataaccccagaactttggg

SEQ ID NO: 396928 - DNA, 20 bp, Artificial Sequence
  chemically synthesized
ctataaccccagaactttgg

SEQ ID NO: 396929 - DNA, 20 bp, Artificial Sequence
  chemically synthesized
gcctcagcctcccaaagttc

SEQ ID NO: 396930 - DNA, 20 bp, Artificial Sequence
  chemically synthesized
gcctataaccccagaacttt

SEQ ID NO: 396931 - DNA, 20 bp, Artificial Sequence
  chemically synthesized
cctcagcctcccaaagttct

SEQ ID NO: 396932 - DNA, 20 bp, Artificial Sequence
  chemically synthesized
cgcctataaccccagaactt

SEQ ID NO: 396933 - DNA, 20 bp, Artificial Sequence
  chemically synthesized
ctcagcctcccaaagttctg

SEQ ID NO: 396934 - DNA, 20 bp, Artificial Sequence
  chemically synthesized
ctcccaaagttctggggtta

SEQ ID NO: 396935 - DNA, 20 bp, Artificial Sequence
  chemically synthesized
tcccaaagttctggggttat

SEQ ID NO: 396936 - DNA, 20 bp, Artificial Sequence
  chemically synthesized
gtggctcacgcctataaccc

SEQ ID NO: 396937 - DNA, 20 bp, Artificial Sequence
  chemically synthesized
agttctggggttataggcgt

SEQ ID NO: 396938 - DNA, 20 bp, Artificial Sequence
  chemically synthesized
taggcgtgagccaccgcacc

SEQ ID NO: 396939 - DNA, 20 bp, Artificial Sequence
  chemically synthesized
gtgagaggggccgggtgcgg

SEQ ID NO: 396940 - DNA, 20 bp, Artificial Sequence
  chemically synthesized
aaggtgagaggggccgggtg

SEQ ID NO: 396941 - DNA, 20 bp, Artificial Sequence
  chemically synthesized
ttcaaaaggtgagaggggcc

SEQ ID NO: 396942 - DNA, 20 bp, Artificial Sequence
  chemically synthesized
cttcaaaaggtgagaggggc

SEQ ID NO: 396943 - DNA, 20 bp, Artificial Sequence
  chemically synthesized
gagacttcaaaaggtgagag

SEQ ID NO: 396944 - DNA, 20 bp, Artificial Sequence
  chemically synthesized
ggagacttcaaaaggtgaga

SEQ ID NO: 396945 - DNA, 20 bp, Artificial Sequence
  chemically synthesized
tggagacttcaaaaggtgag

SEQ ID NO: 396946 - DNA, 20 bp, Artificial Sequence
  chemically synthesized
ttggagacttcaaaaggtga

SEQ ID NO: 396947 - DNA, 20 bp, Artificial Sequence
  chemically synthesized
cattggagacttcaaaaggt

SEQ ID NO: 396948 - DNA, 20 bp, Artificial Sequence
  chemically synthesized
ccggcccctctcaccttttg

SEQ ID NO: 396949 - DNA, 20 bp, Artificial Sequence
  chemically synthesized
tagacattggagacttcaaa

SEQ ID NO: 396950 - DNA, 20 bp, Artificial Sequence
  chemically synthesized
atagacattggagacttcaa

SEQ ID NO: 396951 - DNA, 20 bp, Artificial Sequence
  chemically synthesized
gaatggaataatagacattg

SEQ ID NO: 396952 - DNA, 20 bp, Artificial Sequence
  chemically synthesized
gagaatggaataatagacat

SEQ ID NO: 396953 - DNA, 20 bp, Artificial Sequence
  chemically synthesized
gaacatagagaatggaataa

SEQ ID NO: 396954 - DNA, 20 bp, Artificial Sequence
  chemically synthesized
attttcatgaacatagagaa

SEQ ID NO: 396955 - DNA, 20 bp, Artificial Sequence
  chemically synthesized
ggcatattttcatgaacata

SEQ ID NO: 396956 - DNA, 20 bp, Artificial Sequence
  chemically synthesized
gtggcatattttcatgaaca

SEQ ID NO: 396957 - DNA, 20 bp, Artificial Sequence
  chemically synthesized
aaaatagtcctgtgtcaaag

SEQ ID NO: 396958 - DNA, 20 bp, Artificial Sequence
  chemically synthesized
gaaaatatgccactttgaca

SEQ ID NO: 396959 - DNA, 20 bp, Artificial Sequence
  chemically synthesized
aaaatatgccactttgacac

SEQ ID NO: 396960 - DNA, 20 bp, Artificial Sequence
  chemically synthesized
ctcaaaatagtcctgtgtca

SEQ ID NO: 396961 - DNA, 20 bp, Artificial Sequence
  chemically synthesized
ctttgacacaggactatttt

SEQ ID NO: 396962 - DNA, 20 bp, Artificial Sequence
  chemically synthesized
gaattgcctttagctcaaaa

SEQ ID NO: 396963 - DNA, 20 bp, Artificial Sequence
  chemically synthesized
cacaggactattttgagcta

SEQ ID NO: 396964 - DNA, 20 bp, Artificial Sequence
  chemically synthesized
acaggactattttgagctaa

SEQ ID NO: 396965 - DNA, 20 bp, Artificial Sequence
  chemically synthesized
tgcttcttctgaattgcctt

SEQ ID NO: 396966 - DNA, 20 bp, Artificial Sequence
  chemically synthesized
attttgagctaaaggcaatt

SEQ ID NO: 396967 - DNA, 20 bp, Artificial Sequence
  chemically synthesized
ttgagctaaaggcaattcag

SEQ ID NO: 396968 - DNA, 20 bp, Artificial Sequence
  chemically synthesized
agctaaaggcaattcagaag

SEQ ID NO: 396969 - DNA, 20 bp, Artificial Sequence
  chemically synthesized
taaaggcaattcagaagaag

SEQ ID NO: 396970 - DNA, 20 bp, Artificial Sequence
  chemically synthesized
aattcagaagaagcagatat

SEQ ID NO: 396971 - DNA, 20 bp, Artificial Sequence
  chemically synthesized
aggcaaatagtgggagggca

SEQ ID NO: 396972 - DNA, 20 bp, Artificial Sequence
  chemically synthesized
tcaggcaaatagtgggaggg

SEQ ID NO: 396973 - DNA, 20 bp, Artificial Sequence
  chemically synthesized
ttttcaggcaaatagtggga

SEQ ID NO: 396974 - DNA, 20 bp, Artificial Sequence
  chemically synthesized
gttttcaggcaaatagtggg

SEQ ID NO: 396975 - DNA, 20 bp, Artificial Sequence
  chemically synthesized
tgttttcaggcaaatagtgg

SEQ ID NO: 396976 - DNA, 20 bp, Artificial Sequence
  chemically synthesized
actgttttcaggcaaatagt

SEQ ID NO: 396977 - DNA, 20 bp, Artificial Sequence
  chemically synthesized
tactgttttcaggcaaatag

SEQ ID NO: 396978 - DNA, 20 bp, Artificial Sequence
  chemically synthesized
atgtactgttttcaggcaaa

SEQ ID NO: 396979 - DNA, 20 bp, Artificial Sequence
  chemically synthesized
tcccactatttgcctgaaaa

SEQ ID NO: 396980 - DNA, 20 bp, Artificial Sequence
  chemically synthesized
caaatgtatgtactgttttc

SEQ ID NO: 396981 - DNA, 20 bp, Artificial Sequence
  chemically synthesized
gcaaatgtatgtactgtttt

SEQ ID NO: 396982 - DNA, 20 bp, Artificial Sequence
  chemically synthesized
aaacagtacatacatttgca

SEQ ID NO: 396983 - DNA, 20 bp, Artificial Sequence
  chemically synthesized
aacagtacatacatttgcaa

SEQ ID NO: 396984 - DNA, 20 bp, Artificial Sequence
  chemically synthesized
ttctgatagagaggagagga

SEQ ID NO: 396985 - DNA, 20 bp, Artificial Sequence
  chemically synthesized
tcctttctgatagagaggag

SEQ ID NO: 396986 - DNA, 20 bp, Artificial Sequence
  chemically synthesized
gtcctttctgatagagagga

SEQ ID NO: 396987 - DNA, 20 bp, Artificial Sequence
  chemically synthesized
ttgtcctttctgatagagag

SEQ ID NO: 396988 - DNA, 20 bp, Artificial Sequence
  chemically synthesized
gtccatcctctcctctctat

SEQ ID NO: 396989 - DNA, 20 bp, Artificial Sequence
  chemically synthesized
ctttgtcctttctgatagag

SEQ ID NO: 396990 - DNA, 20 bp, Artificial Sequence
  chemically synthesized
actttgtcctttctgataga

SEQ ID NO: 396991 - DNA, 20 bp, Artificial Sequence
  chemically synthesized
atcctctcctctctatcaga

SEQ ID NO: 396992 - DNA, 20 bp, Artificial Sequence
  chemically synthesized
aaactttgtcctttctgata

SEQ ID NO: 396993 - DNA, 20 bp, Artificial Sequence
  chemically synthesized
tcctctcctctctatcagaa

SEQ ID NO: 396994 - DNA, 20 bp, Artificial Sequence
  chemically synthesized
tcaaactttgtcctttctga

SEQ ID NO: 396995 - DNA, 20 bp, Artificial Sequence
  chemically synthesized
cctctctatcagaaaggaca

SEQ ID NO: 396996 - DNA, 20 bp, Artificial Sequence
  chemically synthesized
taaagatctaaagttgtcat

SEQ ID NO: 396997 - DNA, 20 bp, Artificial Sequence
  chemically synthesized
ttgatcaccaatgacaactt

SEQ ID NO: 396998 - DNA, 20 bp, Artificial Sequence
  chemically synthesized
tccgggctgataaagatcta

SEQ ID NO: 396999 - DNA, 20 bp, Artificial Sequence
  chemically synthesized
tgacaactttagatctttat

SEQ ID NO: 397000 - DNA, 20 bp, Artificial Sequence
  chemically synthesized
atgcagtctccgggctgata

SEQ ID NO: 397001 - DNA, 20 bp, Artificial Sequence
  chemically synthesized
actttagatctttatcagcc

SEQ ID NO: 397002 - DNA, 20 bp, Artificial Sequence
  chemically synthesized
tttagatctttatcagcccg

SEQ ID NO: 397003 - DNA, 20 bp, Artificial Sequence
  chemically synthesized
attcctctgatgcagtctcc

SEQ ID NO: 397004 - DNA, 20 bp, Artificial Sequence
  chemically synthesized
gattcctctgatgcagtctc

SEQ ID NO: 397005 - DNA, 20 bp, Artificial Sequence
  chemically synthesized
tatcagcccggagactgcat

SEQ ID NO: 397006 - DNA, 20 bp, Artificial Sequence
  chemically synthesized
tcagcccggagactgcatca

SEQ ID NO: 397007 - DNA, 20 bp, Artificial Sequence
  chemically synthesized
cagcccggagactgcatcag

SEQ ID NO: 397008 - DNA, 20 bp, Artificial Sequence
  chemically synthesized
ttatgtagattcctctgatg

SEQ ID NO: 397009 - DNA, 20 bp, Artificial Sequence
  chemically synthesized
agttaagaaaatttattatg

SEQ ID NO: 397010 - DNA, 20 bp, Artificial Sequence
  chemically synthesized
acataataaattttcttaac

SEQ ID NO: 397011 - DNA, 20 bp, Artificial Sequence
  chemically synthesized
atggtagataaaggctagtt

SEQ ID NO: 397012 - DNA, 20 bp, Artificial Sequence
  chemically synthesized
aactgatggtagataaaggc

SEQ ID NO: 397013 - DNA, 20 bp, Artificial Sequence
  chemically synthesized
gggaaactgatggtagataa

SEQ ID NO: 397014 - DNA, 20 bp, Artificial Sequence
  chemically synthesized
tgggaaactgatggtagata

SEQ ID NO: 397015 - DNA, 20 bp, Artificial Sequence
  chemically synthesized
aactagcctttatctaccat

SEQ ID NO: 397016 - DNA, 20 bp, Artificial Sequence
  chemically synthesized
aatatatgggaaactgatgg

SEQ ID NO: 397017 - DNA, 20 bp, Artificial Sequence
  chemically synthesized
gcaaatatatgggaaactga

SEQ ID NO: 397018 - DNA, 20 bp, Artificial Sequence
  chemically synthesized
tttcaggaaggcaaatatat

SEQ ID NO: 397019 - DNA, 20 bp, Artificial Sequence
  chemically synthesized
atttcaggaaggcaaatata

SEQ ID NO: 397020 - DNA, 20 bp, Artificial Sequence
  chemically synthesized
atgagtggccaatttcagga

SEQ ID NO: 397021 - DNA, 20 bp, Artificial Sequence
  chemically synthesized
tatgagtggccaatttcagg

SEQ ID NO: 397022 - DNA, 20 bp, Artificial Sequence
  chemically synthesized
tatatttgccttcctgaaat

SEQ ID NO: 397023 - DNA, 20 bp, Artificial Sequence
  chemically synthesized
ctctatgagtggccaatttc

SEQ ID NO: 397024 - DNA, 20 bp, Artificial Sequence
  chemically synthesized
tctctatgagtggccaattt

SEQ ID NO: 397025 - DNA, 20 bp, Artificial Sequence
  chemically synthesized
ttcctgaaattggccactca

SEQ ID NO: 397026 - DNA, 20 bp, Artificial Sequence
  chemically synthesized
cctgaaattggccactcata

SEQ ID NO: 397027 - DNA, 20 bp, Artificial Sequence
  chemically synthesized
ggaccctgagtctctatgag

SEQ ID NO: 397028 - DNA, 20 bp, Artificial Sequence
  chemically synthesized
aaaggaccctgagtctctat

SEQ ID NO: 397029 - DNA, 20 bp, Artificial Sequence
  chemically synthesized
attggccactcatagagact

SEQ ID NO: 397030 - DNA, 20 bp, Artificial Sequence
  chemically synthesized
ttggccactcatagagactc

SEQ ID NO: 397031 - DNA, 20 bp, Artificial Sequence
  chemically synthesized
tggccactcatagagactca

SEQ ID NO: 397032 - DNA, 20 bp, Artificial Sequence
  chemically synthesized
agacaagggaaaaggaccct

SEQ ID NO: 397033 - DNA, 20 bp, Artificial Sequence
  chemically synthesized
aagtaacaagacaagggaaa

SEQ ID NO: 397034 - DNA, 20 bp, Artificial Sequence
  chemically synthesized
gaagtaacaagacaagggaa

SEQ ID NO: 397035 - DNA, 20 bp, Artificial Sequence
  chemically synthesized
tttgagaagtaacaagacaa

SEQ ID NO: 397036 - DNA, 20 bp, Artificial Sequence
  chemically synthesized
ttttgagaagtaacaagaca

SEQ ID NO: 397037 - DNA, 20 bp, Artificial Sequence
  chemically synthesized
tttttgagaagtaacaagac

SEQ ID NO: 397038 - DNA, 20 bp, Artificial Sequence
  chemically synthesized
tacgttttttgagaagtaac

SEQ ID NO: 397039 - DNA, 20 bp, Artificial Sequence
  chemically synthesized
agaacaatacgttttttgag

SEQ ID NO: 397040 - DNA, 20 bp, Artificial Sequence
  chemically synthesized
caaagaacaatacgtttttt

SEQ ID NO: 397041 - DNA, 20 bp, Artificial Sequence
  chemically synthesized
aaaaacgtattgttctttgt

SEQ ID NO: 397042 - DNA, 20 bp, Artificial Sequence
  chemically synthesized
aaacgtattgttctttgtca

SEQ ID NO: 397043 - DNA, 20 bp, Artificial Sequence
  chemically synthesized
atgaataaatttctctgaca

SEQ ID NO: 397044 - DNA, 20 bp, Artificial Sequence
  chemically synthesized
gtatacatgaaagatatata

SEQ ID NO: 397045 - DNA, 20 bp, Artificial Sequence
  chemically synthesized
tgtatacatgaaagatatat

SEQ ID NO: 397046 - DNA, 20 bp, Artificial Sequence
  chemically synthesized
cacacctcatgtatacatga

SEQ ID NO: 397047 - DNA, 20 bp, Artificial Sequence
  chemically synthesized
tatatctttcatgtatacat

SEQ ID NO: 397048 - DNA, 20 bp, Artificial Sequence
  chemically synthesized
atatctttcatgtatacatg

SEQ ID NO: 397049 - DNA, 20 bp, Artificial Sequence
  chemically synthesized
tatacatgaggtgtgtatgt

SEQ ID NO: 397050 - DNA, 20 bp, Artificial Sequence
  chemically synthesized
tcaacaagaaaaaaacaata

SEQ ID NO: 397051 - DNA, 20 bp, Artificial Sequence
  chemically synthesized
ataacaaaagagatatcaac

SEQ ID NO: 397052 - DNA, 20 bp, Artificial Sequence
  chemically synthesized
ctgggactcctataacaaaa

SEQ ID NO: 397053 - DNA, 20 bp, Artificial Sequence
  chemically synthesized
tgttgatatctcttttgtta

SEQ ID NO: 397054 - DNA, 20 bp, Artificial Sequence
  chemically synthesized
gttgatatctcttttgttat

SEQ ID NO: 397055 - DNA, 20 bp, Artificial Sequence
  chemically synthesized
aactgggactcctataacaa

SEQ ID NO: 397056 - DNA, 20 bp, Artificial Sequence
  chemically synthesized
tgatatctcttttgttatag

SEQ ID NO: 397057 - DNA, 20 bp, Artificial Sequence
  chemically synthesized
ctcttttgttataggagtcc

SEQ ID NO: 397058 - DNA, 20 bp, Artificial Sequence
  chemically synthesized
ttgttataggagtcccagtt

SEQ ID NO: 397059 - DNA, 20 bp, Artificial Sequence
  chemically synthesized
tctacctttatttcttaact

SEQ ID NO: 397060 - DNA, 20 bp, Artificial Sequence
  chemically synthesized
ctctacctttatttcttaac

SEQ ID NO: 397061 - DNA, 20 bp, Artificial Sequence
  chemically synthesized
ggagtcccagttaagaaata

SEQ ID NO: 397062 - DNA, 20 bp, Artificial Sequence
  chemically synthesized
gagtcccagttaagaaataa

SEQ ID NO: 397063 - DNA, 20 bp, Artificial Sequence
  chemically synthesized
tcccagttaagaaataaagg

SEQ ID NO: 397064 - DNA, 20 bp, Artificial Sequence
  chemically synthesized
ccagttaagaaataaaggta

SEQ ID NO: 397065 - DNA, 20 bp, Artificial Sequence
  chemically synthesized
cagttaagaaataaaggtag

SEQ ID NO: 397066 - DNA, 20 bp, Artificial Sequence
  chemically synthesized
taagaaataaaggtagaggc

SEQ ID NO: 397067 - DNA, 20 bp, Artificial Sequence
  chemically synthesized
ataaaggtagaggctagatg

SEQ ID NO: 397068 - DNA, 20 bp, Artificial Sequence
  chemically synthesized
aaggtagaggctagatgcgg

SEQ ID NO: 397069 - DNA, 20 bp, Artificial Sequence
  chemically synthesized
caggtgtgagccaccgcatc

SEQ ID NO: 397070 - DNA, 20 bp, Artificial Sequence
  chemically synthesized
agagctgggattacaggtgt

SEQ ID NO: 397071 - DNA, 20 bp, Artificial Sequence
  chemically synthesized
gtggctcacacctgtaatcc

SEQ ID NO: 397072 - DNA, 20 bp, Artificial Sequence
  chemically synthesized
tcccaaagagctgggattac

SEQ ID NO: 397073 - DNA, 20 bp, Artificial Sequence
  chemically synthesized
ctcccaaagagctgggatta

SEQ ID NO: 397074 - DNA, 20 bp, Artificial Sequence
  chemically synthesized
cacctgtaatcccagctctt

SEQ ID NO: 397075 - DNA, 20 bp, Artificial Sequence
  chemically synthesized
tctcagcctcccaaagagct

SEQ ID NO: 397076 - DNA, 20 bp, Artificial Sequence
  chemically synthesized
acctgtaatcccagctcttt

SEQ ID NO: 397077 - DNA, 20 bp, Artificial Sequence
  chemically synthesized
gtctcagcctcccaaagagc

SEQ ID NO: 397078 - DNA, 20 bp, Artificial Sequence
  chemically synthesized
ctgtaatcccagctctttgg

SEQ ID NO: 397079 - DNA, 20 bp, Artificial Sequence
  chemically synthesized
tgtaatcccagctctttggg

SEQ ID NO: 397080 - DNA, 20 bp, Artificial Sequence
  chemically synthesized
ttcagtctcagcctcccaaa

SEQ ID NO: 397081 - DNA, 20 bp, Artificial Sequence
  chemically synthesized
ccttcagtctcagcctccca

SEQ ID NO: 397082 - DNA, 20 bp, Artificial Sequence
  chemically synthesized
tcccagctctttgggaggct

SEQ ID NO: 397083 - DNA, 20 bp, Artificial Sequence
  chemically synthesized
tctttgggaggctgagactg

SEQ ID NO: 397084 - DNA, 20 bp, Artificial Sequence
  chemically synthesized
ctttgggaggctgagactga

SEQ ID NO: 397085 - DNA, 20 bp, Artificial Sequence
  chemically synthesized
ctcaagtgatccttcagtct

SEQ ID NO: 397086 - DNA, 20 bp, Artificial Sequence
  chemically synthesized
cttgagctcaagtgatcctt

SEQ ID NO: 397087 - DNA, 20 bp, Artificial Sequence
  chemically synthesized
ctgagactgaaggatcactt

SEQ ID NO: 397088 - DNA, 20 bp, Artificial Sequence
  chemically synthesized
ctgaaggatcacttgagctc

SEQ ID NO: 397089 - DNA, 20 bp, Artificial Sequence
  chemically synthesized
ggtcttgaatgcttgagctc

SEQ ID NO: 397090 - DNA, 20 bp, Artificial Sequence
  chemically synthesized
aaggctggtcttgaatgctt

SEQ ID NO: 397091 - DNA, 20 bp, Artificial Sequence
  chemically synthesized
tcacttgagctcaagcattc

SEQ ID NO: 397092 - DNA, 20 bp, Artificial Sequence
  chemically synthesized
tgagctcaagcattcaagac

SEQ ID NO: 397093 - DNA, 20 bp, Artificial Sequence
  chemically synthesized
caagcattcaagaccagcct

SEQ ID NO: 397094 - DNA, 20 bp, Artificial Sequence
  chemically synthesized
tcttgctatgttgccaaggc

SEQ ID NO: 397095 - DNA, 20 bp, Artificial Sequence
  chemically synthesized
agggtcttgctatgttgcca

SEQ ID NO: 397096 - DNA, 20 bp, Artificial Sequence
  chemically synthesized
caagaccagccttggcaaca

SEQ ID NO: 397097 - DNA, 20 bp, Artificial Sequence
  chemically synthesized
gagggtcttgctatgttgcc

SEQ ID NO: 397098 - DNA, 20 bp, Artificial Sequence
  chemically synthesized
accagccttggcaacatagc

SEQ ID NO: 397099 - DNA, 20 bp, Artificial Sequence
  chemically synthesized
tttactttttggagaaatga

SEQ ID NO: 397100 - DNA, 20 bp, Artificial Sequence
  chemically synthesized
ttttactttttggagaaatg

SEQ ID NO: 397101 - DNA, 20 bp, Artificial Sequence
  chemically synthesized
tttttactttttggagaaat

SEQ ID NO: 397102 - DNA, 20 bp, Artificial Sequence
  chemically synthesized
aagaccctcatttctccaaa

SEQ ID NO: 397103 - DNA, 20 bp, Artificial Sequence
  chemically synthesized
attattttttttactttttg

SEQ ID NO: 397104 - DNA, 20 bp, Artificial Sequence
  chemically synthesized
ttattattttttttactttt

SEQ ID NO: 397105 - DNA, 20 bp, Artificial Sequence
  chemically synthesized
aagtaaaaaaaataataaat

SEQ ID NO: 397106 - DNA, 20 bp, Artificial Sequence
  chemically synthesized
aaaaaaataataaattagcc

SEQ ID NO: 397107 - DNA, 20 bp, Artificial Sequence
  chemically synthesized
aataataaattagcccggca

SEQ ID NO: 397108 - DNA, 20 bp, Artificial Sequence
  chemically synthesized
aataaattagcccggcatgg

SEQ ID NO: 397109 - DNA, 20 bp, Artificial Sequence
  chemically synthesized
caggcatgcaccaccatgcc

SEQ ID NO: 397110 - DNA, 20 bp, Artificial Sequence
  chemically synthesized
acaggcatgcaccaccatgc

SEQ ID NO: 397111 - DNA, 20 bp, Artificial Sequence
  chemically synthesized
ggcatggtggtgcatgcctg

SEQ ID NO: 397112 - DNA, 20 bp, Artificial Sequence
  chemically synthesized
ggtggtgcatgcctgtagct

SEQ ID NO: 397113 - DNA, 20 bp, Artificial Sequence
  chemically synthesized
ctccccggtagcttagctac

SEQ ID NO: 397114 - DNA, 20 bp, Artificial Sequence
  chemically synthesized
cctccccggtagcttagcta

SEQ ID NO: 397115 - DNA, 20 bp, Artificial Sequence
  chemically synthesized
catgcctgtagctaagctac

SEQ ID NO: 397116 - DNA, 20 bp, Artificial Sequence
  chemically synthesized
atgcctgtagctaagctacc

SEQ ID NO: 397117 - DNA, 20 bp, Artificial Sequence
  chemically synthesized
cctcagcctccccggtagct

SEQ ID NO: 397118 - DNA, 20 bp, Artificial Sequence
  chemically synthesized
tgcctgtagctaagctaccg

SEQ ID NO: 397119 - DNA, 20 bp, Artificial Sequence
  chemically synthesized
cctgtagctaagctaccggg

SEQ ID NO: 397120 - DNA, 20 bp, Artificial Sequence
  chemically synthesized
ctgtagctaagctaccgggg

SEQ ID NO: 397121 - DNA, 20 bp, Artificial Sequence
  chemically synthesized
ttccacctcagcctccccgg

SEQ ID NO: 397122 - DNA, 20 bp, Artificial Sequence
  chemically synthesized
tccttccacctcagcctccc

SEQ ID NO: 397123 - DNA, 20 bp, Artificial Sequence
  chemically synthesized
gctaagctaccggggaggct

SEQ ID NO: 397124 - DNA, 20 bp, Artificial Sequence
  chemically synthesized
ctaagctaccggggaggctg

SEQ ID NO: 397125 - DNA, 20 bp, Artificial Sequence
  chemically synthesized
agctaccggggaggctgagg

SEQ ID NO: 397126 - DNA, 20 bp, Artificial Sequence
  chemically synthesized
taccggggaggctgaggtgg

SEQ ID NO: 397127 - DNA, 20 bp, Artificial Sequence
  chemically synthesized
accggggaggctgaggtgga

SEQ ID NO: 397128 - DNA, 20 bp, Artificial Sequence
  chemically synthesized
tttgagccatccttccacct

SEQ ID NO: 397129 - DNA, 20 bp, Artificial Sequence
  chemically synthesized
gggaggctgaggtggaagga

SEQ ID NO: 397130 - DNA, 20 bp, Artificial Sequence
  chemically synthesized
gtggaaggatggctcaaacc

SEQ ID NO: 397131 - DNA, 20 bp, Artificial Sequence
  chemically synthesized
tggaaggatggctcaaaccc

SEQ ID NO: 397132 - DNA, 20 bp, Artificial Sequence
  chemically synthesized
agcttcaacctcccgggttt

SEQ ID NO: 397133 - DNA, 20 bp, Artificial Sequence
  chemically synthesized
gaaggatggctcaaacccgg

SEQ ID NO: 397134 - DNA, 20 bp, Artificial Sequence
  chemically synthesized
aaggatggctcaaacccggg

SEQ ID NO: 397135 - DNA, 20 bp, Artificial Sequence
  chemically synthesized
cactatagcttcaacctccc

SEQ ID NO: 397136 - DNA, 20 bp, Artificial Sequence
  chemically synthesized
tcactatagcttcaacctcc

SEQ ID NO: 397137 - DNA, 20 bp, Artificial Sequence
  chemically synthesized
ggctcaaacccgggaggttg

SEQ ID NO: 397138 - DNA, 20 bp, Artificial Sequence
  chemically synthesized
aacccgggaggttgaagcta

SEQ ID NO: 397139 - DNA, 20 bp, Artificial Sequence
  chemically synthesized
cgggaggttgaagctatagt

SEQ ID NO: 397140 - DNA, 20 bp, Artificial Sequence
  chemically synthesized
aatgcaatcttgtctcacta

SEQ ID NO: 397141 - DNA, 20 bp, Artificial Sequence
  chemically synthesized
ggttgaagctatagtgagac

SEQ ID NO: 397142 - DNA, 20 bp, Artificial Sequence
  chemically synthesized
aagattgcattaccacactc

SEQ ID NO: 397143 - DNA, 20 bp, Artificial Sequence
  chemically synthesized
ttgtggcccaggctggagtg

SEQ ID NO: 397144 - DNA, 20 bp, Artificial Sequence
  chemically synthesized
tgcattaccacactccagcc

SEQ ID NO: 397145 - DNA, 20 bp, Artificial Sequence
  chemically synthesized
gcattaccacactccagcct

SEQ ID NO: 397146 - DNA, 20 bp, Artificial Sequence
  chemically synthesized
tcactttgtggcccaggctg

SEQ ID NO: 397147 - DNA, 20 bp, Artificial Sequence
  chemically synthesized
tctcactttgtggcccaggc

SEQ ID NO: 397148 - DNA, 20 bp, Artificial Sequence
  chemically synthesized
tgggtctcactttgtggccc

SEQ ID NO: 397149 - DNA, 20 bp, Artificial Sequence
  chemically synthesized
acactccagcctgggccaca

SEQ ID NO: 397150 - DNA, 20 bp, Artificial Sequence
  chemically synthesized
ctgggtctcactttgtggcc

SEQ ID NO: 397151 - DNA, 20 bp, Artificial Sequence
  chemically synthesized
tccagcctgggccacaaagt

SEQ ID NO: 397152 - DNA, 20 bp, Artificial Sequence
  chemically synthesized
tgacactgggtctcactttg

SEQ ID NO: 397153 - DNA, 20 bp, Artificial Sequence
  chemically synthesized
ctgggccacaaagtgagacc

SEQ ID NO: 397154 - DNA, 20 bp, Artificial Sequence
  chemically synthesized
ttttttttttttttgacact

SEQ ID NO: 397155 - DNA, 20 bp, Artificial Sequence
  chemically synthesized
tttttttttttttttgacac

SEQ ID NO: 397156 - DNA, 20 bp, Artificial Sequence
  chemically synthesized
aaaaaaaaaaaaaaaaaatc

SEQ ID NO: 397157 - DNA, 20 bp, Artificial Sequence
  chemically synthesized
aaaaaaaaaaaaaaaaatca

SEQ ID NO: 397158 - DNA, 20 bp, Artificial Sequence
  chemically synthesized
aaaaaaaaaaaaaatcaagg

SEQ ID NO: 397159 - DNA, 20 bp, Artificial Sequence
  chemically synthesized
aaaaaaaaaaaatcaaggta

SEQ ID NO: 397160 - DNA, 20 bp, Artificial Sequence
  chemically synthesized
aaaaaaaaaaatcaaggtag

SEQ ID NO: 397161 - DNA, 20 bp, Artificial Sequence
  chemically synthesized
agaaacacattgcatagggg

SEQ ID NO: 397162 - DNA, 20 bp, Artificial Sequence
  chemically synthesized
aaaagaaacacattgcatag

SEQ ID NO: 397163 - DNA, 20 bp, Artificial Sequence
  chemically synthesized
taaaagaaacacattgcata

SEQ ID NO: 397164 - DNA, 20 bp, Artificial Sequence
  chemically synthesized
ataaaagaaacacattgcat

SEQ ID NO: 397165 - DNA, 20 bp, Artificial Sequence
  chemically synthesized
aataaaagaaacacattgca

SEQ ID NO: 397166 - DNA, 20 bp, Artificial Sequence
  chemically synthesized
ctaaataaacatttaaataa

SEQ ID NO: 397167 - DNA, 20 bp, Artificial Sequence
  chemically synthesized
cttttatttaaatgtttatt

SEQ ID NO: 397168 - DNA, 20 bp, Artificial Sequence
  chemically synthesized
tctcagattagttgttcatc

SEQ ID NO: 397169 - DNA, 20 bp, Artificial Sequence
  chemically synthesized
ctctcagattagttgttcat

SEQ ID NO: 397170 - DNA, 20 bp, Artificial Sequence
  chemically synthesized
acctgatgaacaactaatct

SEQ ID NO: 397171 - DNA, 20 bp, Artificial Sequence
  chemically synthesized
ctgatgaacaactaatctga

SEQ ID NO: 397172 - DNA, 20 bp, Artificial Sequence
  chemically synthesized
catactactcactctcagat

SEQ ID NO: 397173 - DNA, 20 bp, Artificial Sequence
  chemically synthesized
tgaacaactaatctgagagt

SEQ ID NO: 397174 - DNA, 20 bp, Artificial Sequence
  chemically synthesized
ttgctcatactactcactct

SEQ ID NO: 397175 - DNA, 20 bp, Artificial Sequence
  chemically synthesized
acaactaatctgagagtgag

SEQ ID NO: 397176 - DNA, 20 bp, Artificial Sequence
  chemically synthesized
aatctgagagtgagtagtat

SEQ ID NO: 397177 - DNA, 20 bp, Artificial Sequence
  chemically synthesized
gagtgagtagtatgagcaaa

SEQ ID NO: 397178 - DNA, 20 bp, Artificial Sequence
  chemically synthesized
atgagcaaatggcttttgta

SEQ ID NO: 397179 - DNA, 20 bp, Artificial Sequence
  chemically synthesized
atttgagaaaatctttacaa

SEQ ID NO: 397180 - DNA, 20 bp, Artificial Sequence
  chemically synthesized
agctcaagtcaggtaaattt

SEQ ID NO: 397181 - DNA, 20 bp, Artificial Sequence
  chemically synthesized
ttctcaaatttacctgactt

SEQ ID NO: 397182 - DNA, 20 bp, Artificial Sequence
  chemically synthesized
gaatgtggttagctcaagtc

SEQ ID NO: 397183 - DNA, 20 bp, Artificial Sequence
  chemically synthesized
tgaatgtggttagctcaagt

SEQ ID NO: 397184 - DNA, 20 bp, Artificial Sequence
  chemically synthesized
aatctgaatgtggttagctc

SEQ ID NO: 397185 - DNA, 20 bp, Artificial Sequence
  chemically synthesized
aattaaaatctgaatgtggt

SEQ ID NO: 397186 - DNA, 20 bp, Artificial Sequence
  chemically synthesized
tgacttgagctaaccacatt

SEQ ID NO: 397187 - DNA, 20 bp, Artificial Sequence
  chemically synthesized
aagtaattaaaatctgaatg

SEQ ID NO: 397188 - DNA, 20 bp, Artificial Sequence
  chemically synthesized
ttcagattttaattacttta

SEQ ID NO: 397189 - DNA, 20 bp, Artificial Sequence
  chemically synthesized
taaataggtagagaacttta

SEQ ID NO: 397190 - DNA, 20 bp, Artificial Sequence
  chemically synthesized
tatatatatataaataggta

SEQ ID NO: 397191 - DNA, 20 bp, Artificial Sequence
  chemically synthesized
tatatatatatataaatagg

SEQ ID NO: 397192 - DNA, 20 bp, Artificial Sequence
  chemically synthesized
gtgtatatatatatataaat

SEQ ID NO: 397193 - DNA, 20 bp, Artificial Sequence
  chemically synthesized
tgtgtatatatatatataaa

SEQ ID NO: 397194 - DNA, 20 bp, Artificial Sequence
  chemically synthesized
aaacaattagaatatatatg

SEQ ID NO: 397195 - DNA, 20 bp, Artificial Sequence
  chemically synthesized
cagaaaatgaataaaacaat

SEQ ID NO: 397196 - DNA, 20 bp, Artificial Sequence
  chemically synthesized
aataagttagttaaaataca

SEQ ID NO: 397197 - DNA, 20 bp, Artificial Sequence
  chemically synthesized
tgtattttaactaacttatt

SEQ ID NO: 397198 - DNA, 20 bp, Artificial Sequence
  chemically synthesized
gttcaagcatctcaataagt

SEQ ID NO: 397199 - DNA, 20 bp, Artificial Sequence
  chemically synthesized
atttgttcaagcatctcaat

SEQ ID NO: 397200 - DNA, 20 bp, Artificial Sequence
  chemically synthesized
aaaagcatttcaatttgttc

SEQ ID NO: 397201 - DNA, 20 bp, Artificial Sequence
  chemically synthesized
atttttaaaagcattataaa

SEQ ID NO: 397202 - DNA, 20 bp, Artificial Sequence
  chemically synthesized
tatgtagtgattatttttaa

SEQ ID NO: 397203 - DNA, 20 bp, Artificial Sequence
  chemically synthesized
actggagaatatgttatatg

SEQ ID NO: 397204 - DNA, 20 bp, Artificial Sequence
  chemically synthesized
actacatataacatattctc

SEQ ID NO: 397205 - DNA, 20 bp, Artificial Sequence
  chemically synthesized
acatataacatattctccag

SEQ ID NO: 397206 - DNA, 20 bp, Artificial Sequence
  chemically synthesized
tttacattgttcaactactg

SEQ ID NO: 397207 - DNA, 20 bp, Artificial Sequence
  chemically synthesized
tctttacattgttcaactac

SEQ ID NO: 397208 - DNA, 20 bp, Artificial Sequence
  chemically synthesized
tccagtagttgaacaatgta

SEQ ID NO: 397209 - DNA, 20 bp, Artificial Sequence
  chemically synthesized
tagaataaagtcatacatat

SEQ ID NO: 397210 - DNA, 20 bp, Artificial Sequence
  chemically synthesized
gaaatatgaatgttagaata

SEQ ID NO: 397211 - DNA, 20 bp, Artificial Sequence
  chemically synthesized
tacccaagaaatatgaatgt

SEQ ID NO: 397212 - DNA, 20 bp, Artificial Sequence
  chemically synthesized
attctaacattcatatttct

SEQ ID NO: 397213 - DNA, 20 bp, Artificial Sequence
  chemically synthesized
ttctaacattcatatttctt

SEQ ID NO: 397214 - DNA, 20 bp, Artificial Sequence
  chemically synthesized
ctaacatttagtaagtaccc

SEQ ID NO: 397215 - DNA, 20 bp, Artificial Sequence
  chemically synthesized
gtgagtgcctaacatttagt

SEQ ID NO: 397216 - DNA, 20 bp, Artificial Sequence
  chemically synthesized
cttgggtacttactaaatgt

SEQ ID NO: 397217 - DNA, 20 bp, Artificial Sequence
  chemically synthesized
ttgggtacttactaaatgtt

SEQ ID NO: 397218 - DNA, 20 bp, Artificial Sequence
  chemically synthesized
agctgtgagtgcctaacatt

SEQ ID NO: 397219 - DNA, 20 bp, Artificial Sequence
  chemically synthesized
tactaaatgttaggcactca

SEQ ID NO: 397220 - DNA, 20 bp, Artificial Sequence
  chemically synthesized
aaatgttaggcactcacagc

SEQ ID NO: 397221 - DNA, 20 bp, Artificial Sequence
  chemically synthesized
cattttacattactagctgt

SEQ ID NO: 397222 - DNA, 20 bp, Artificial Sequence
  chemically synthesized
tgcccaccattttacattac

SEQ ID NO: 397223 - DNA, 20 bp, Artificial Sequence
  chemically synthesized
tcacagctagtaatgtaaaa

SEQ ID NO: 397224 - DNA, 20 bp, Artificial Sequence
  chemically synthesized
cagctagtaatgtaaaatgg

SEQ ID NO: 397225 - DNA, 20 bp, Artificial Sequence
  chemically synthesized
agctagtaatgtaaaatggt

SEQ ID NO: 397226 - DNA, 20 bp, Artificial Sequence
  chemically synthesized
gtaatgtaaaatggtgggca

SEQ ID NO: 397227 - DNA, 20 bp, Artificial Sequence
  chemically synthesized
tataaactatagttttggaa

SEQ ID NO: 397228 - DNA, 20 bp, Artificial Sequence
  chemically synthesized
cctataaactatagttttgg

SEQ ID NO: 397229 - DNA, 20 bp, Artificial Sequence
  chemically synthesized
caaagtctcttccaaaacta

SEQ ID NO: 397230 - DNA, 20 bp, Artificial Sequence
  chemically synthesized
tagcctataaactatagttt

SEQ ID NO: 397231 - DNA, 20 bp, Artificial Sequence
  chemically synthesized
tcttccaaaactatagttta

SEQ ID NO: 397232 - DNA, 20 bp, Artificial Sequence
  chemically synthesized
cattattagcctataaacta

SEQ ID NO: 397233 - DNA, 20 bp, Artificial Sequence
  chemically synthesized
cttccaaaactatagtttat

SEQ ID NO: 397234 - DNA, 20 bp, Artificial Sequence
  chemically synthesized
tatagtttataggctaataa

SEQ ID NO: 397235 - DNA, 20 bp, Artificial Sequence
  chemically synthesized
agtttataggctaataatgg

SEQ ID NO: 397236 - DNA, 20 bp, Artificial Sequence
  chemically synthesized
tgtcctaaagcttccattat

SEQ ID NO: 397237 - DNA, 20 bp, Artificial Sequence
  chemically synthesized
taggctaataatggaagctt

SEQ ID NO: 397238 - DNA, 20 bp, Artificial Sequence
  chemically synthesized
aggctaataatggaagcttt

SEQ ID NO: 397239 - DNA, 20 bp, Artificial Sequence
  chemically synthesized
attattggaaaagtgtccta

SEQ ID NO: 397240 - DNA, 20 bp, Artificial Sequence
  chemically synthesized
atgttgtgtaattattggaa

SEQ ID NO: 397241 - DNA, 20 bp, Artificial Sequence
  chemically synthesized
ataacatgttgtgtaattat

SEQ ID NO: 397242 - DNA, 20 bp, Artificial Sequence
  chemically synthesized
aataattacacaacatgtta

SEQ ID NO: 397243 - DNA, 20 bp, Artificial Sequence
  chemically synthesized
acacaacatgttatagtttg

SEQ ID NO: 397244 - DNA, 20 bp, Artificial Sequence
  chemically synthesized
tgaagtgtgaaccttcgaaa

SEQ ID NO: 397245 - DNA, 20 bp, Artificial Sequence
  chemically synthesized
tccagcaacttctgtttcga

SEQ ID NO: 397246 - DNA, 20 bp, Artificial Sequence
  chemically synthesized
ttccagcaacttctgtttcg

SEQ ID NO: 397247 - DNA, 20 bp, Artificial Sequence
  chemically synthesized
agtgtgaaccttcgaaacag

SEQ ID NO: 397248 - DNA, 20 bp, Artificial Sequence
  chemically synthesized
accttcgaaacagaagttgc

SEQ ID NO: 397249 - DNA, 20 bp, Artificial Sequence
  chemically synthesized
aacagaagttgctggaaatt

SEQ ID NO: 397250 - DNA, 20 bp, Artificial Sequence
  chemically synthesized
gtgtaaggacactgaatttc

SEQ ID NO: 397251 - DNA, 20 bp, Artificial Sequence
  chemically synthesized
taaatccttcgaatagtgta

SEQ ID NO: 397252 - DNA, 20 bp, Artificial Sequence
  chemically synthesized
ataaatccttcgaatagtgt

SEQ ID NO: 397253 - DNA, 20 bp, Artificial Sequence
  chemically synthesized
cagtgtccttacactattcg

SEQ ID NO: 397254 - DNA, 20 bp, Artificial Sequence
  chemically synthesized
agtgtccttacactattcga

SEQ ID NO: 397255 - DNA, 20 bp, Artificial Sequence
  chemically synthesized
gcatgtataaatccttcgaa

SEQ ID NO: 397256 - DNA, 20 bp, Artificial Sequence
  chemically synthesized
attcgaaggatttatacatg

SEQ ID NO: 397257 - DNA, 20 bp, Artificial Sequence
  chemically synthesized
aggatttatacatgcagaac

SEQ ID NO: 397258 - DNA, 20 bp, Artificial Sequence
  chemically synthesized
atttttgtttgtttgttttc

SEQ ID NO: 397259 - DNA, 20 bp, Artificial Sequence
  chemically synthesized
acaaacaaacaaaaatatct

SEQ ID NO: 397260 - DNA, 20 bp, Artificial Sequence
  chemically synthesized
tgaagtgactgattttaact

SEQ ID NO: 397261 - DNA, 20 bp, Artificial Sequence
  chemically synthesized
aaaaatatctcagttaaaat

SEQ ID NO: 397262 - DNA, 20 bp, Artificial Sequence
  chemically synthesized
tcagttaaaatcagtcactt

SEQ ID NO: 397263 - DNA, 20 bp, Artificial Sequence
  chemically synthesized
agttaaaatcagtcacttca

SEQ ID NO: 397264 - DNA, 20 bp, Artificial Sequence
  chemically synthesized
gttaaaatcagtcacttcag

SEQ ID NO: 397265 - DNA, 20 bp, Artificial Sequence
  chemically synthesized
cgatcaatttgtttcctctg

SEQ ID NO: 397266 - DNA, 20 bp, Artificial Sequence
  chemically synthesized
aggaaacaaattgatcgcga

SEQ ID NO: 397267 - DNA, 20 bp, Artificial Sequence
  chemically synthesized
aaacaaattgatcgcgatag

SEQ ID NO: 397268 - DNA, 20 bp, Artificial Sequence
  chemically synthesized
caaattgatcgcgatagcag

SEQ ID NO: 397269 - DNA, 20 bp, Artificial Sequence
  chemically synthesized
aaattgatcgcgatagcagt

SEQ ID NO: 397270 - DNA, 20 bp, Artificial Sequence
  chemically synthesized
aattgatcgcgatagcagta

SEQ ID NO: 397271 - DNA, 20 bp, Artificial Sequence
  chemically synthesized
gatagcagtagggaaaattt

SEQ ID NO: 397272 - DNA, 20 bp, Artificial Sequence
  chemically synthesized
tagcagtagggaaaattttg

SEQ ID NO: 397273 - DNA, 20 bp, Artificial Sequence
  chemically synthesized
aaattttggagaaaaaatgt

SEQ ID NO: 397274 - DNA, 20 bp, Artificial Sequence
  chemically synthesized
gagaaaaaatgttagctttg

SEQ ID NO: 397275 - DNA, 20 bp, Artificial Sequence
  chemically synthesized
aaaaatgttagctttgaagc

SEQ ID NO: 397276 - DNA, 20 bp, Artificial Sequence
  chemically synthesized
ggttggacaagcttgcttca

SEQ ID NO: 397277 - DNA, 20 bp, Artificial Sequence
  chemically synthesized
ctgtaggctgcgggttggac

SEQ ID NO: 397278 - DNA, 20 bp, Artificial Sequence
  chemically synthesized
aagcaagcttgtccaacccg

SEQ ID NO: 397279 - DNA, 20 bp, Artificial Sequence
  chemically synthesized
gcagcctgtaggctgcgggt

SEQ ID NO: 397280 - DNA, 20 bp, Artificial Sequence
  chemically synthesized
tcatgcagcctgtaggctgc

SEQ ID NO: 397281 - DNA, 20 bp, Artificial Sequence
  chemically synthesized
cttgtccaacccgcagccta

SEQ ID NO: 397282 - DNA, 20 bp, Artificial Sequence
  chemically synthesized
ctcatgcagcctgtaggctg

SEQ ID NO: 397283 - DNA, 20 bp, Artificial Sequence
  chemically synthesized
ttgtccaacccgcagcctac

SEQ ID NO: 397284 - DNA, 20 bp, Artificial Sequence
  chemically synthesized
ctgggcctcatgcagcctgt

SEQ ID NO: 397285 - DNA, 20 bp, Artificial Sequence
  chemically synthesized
cctgggcctcatgcagcctg

SEQ ID NO: 397286 - DNA, 20 bp, Artificial Sequence
  chemically synthesized
ccgcagcctacaggctgcat

SEQ ID NO: 397287 - DNA, 20 bp, Artificial Sequence
  chemically synthesized
cgcagcctacaggctgcatg

SEQ ID NO: 397288 - DNA, 20 bp, Artificial Sequence
  chemically synthesized
aagctgtcctgggcctcatg

SEQ ID NO: 397289 - DNA, 20 bp, Artificial Sequence
  chemically synthesized
cctacaggctgcatgaggcc

SEQ ID NO: 397290 - DNA, 20 bp, Artificial Sequence
  chemically synthesized
ctacaggctgcatgaggccc

SEQ ID NO: 397291 - DNA, 20 bp, Artificial Sequence
  chemically synthesized
aggctgcatgaggcccagga

SEQ ID NO: 397292 - DNA, 20 bp, Artificial Sequence
  chemically synthesized
gctgcattcaaagctgtcct

SEQ ID NO: 397293 - DNA, 20 bp, Artificial Sequence
  chemically synthesized
ggctgcattcaaagctgtcc

SEQ ID NO: 397294 - DNA, 20 bp, Artificial Sequence
  chemically synthesized
gcccaggacagctttgaatg

SEQ ID NO: 397295 - DNA, 20 bp, Artificial Sequence
  chemically synthesized
tttgtgttgggctgcattca

SEQ ID NO: 397296 - DNA, 20 bp, Artificial Sequence
  chemically synthesized
aaagtttacaaatttgtgtt

SEQ ID NO: 397297 - DNA, 20 bp, Artificial Sequence
  chemically synthesized
gaaagtttacaaatttgtgt

SEQ ID NO: 397298 - DNA, 20 bp, Artificial Sequence
  chemically synthesized
tatctcatgatgtttcaaga

SEQ ID NO: 397299 - DNA, 20 bp, Artificial Sequence
  chemically synthesized
aaaatatctcatgatgtttc

SEQ ID NO: 397300 - DNA, 20 bp, Artificial Sequence
  chemically synthesized
aaactttcttgaaacatcat

SEQ ID NO: 397301 - DNA, 20 bp, Artificial Sequence
  chemically synthesized
aaacatcatgagatattttt

SEQ ID NO: 397302 - DNA, 20 bp, Artificial Sequence
  chemically synthesized
ttttttagatttattttttt

SEQ ID NO: 397303 - DNA, 20 bp, Artificial Sequence
  chemically synthesized
taacactaatgatagatgat

SEQ ID NO: 397304 - DNA, 20 bp, Artificial Sequence
  chemically synthesized
tttagctcatcatctatcat

SEQ ID NO: 397305 - DNA, 20 bp, Artificial Sequence
  chemically synthesized
aaatacagtaacactaatga

SEQ ID NO: 397306 - DNA, 20 bp, Artificial Sequence
  chemically synthesized
cttgggccacacattaaata

SEQ ID NO: 397307 - DNA, 20 bp, Artificial Sequence
  chemically synthesized
gtgttactgtatttaatgtg

SEQ ID NO: 397308 - DNA, 20 bp, Artificial Sequence
  chemically synthesized
ctgtatttaatgtgtggccc

SEQ ID NO: 397309 - DNA, 20 bp, Artificial Sequence
  chemically synthesized
cacactgggagaattgtctt

SEQ ID NO: 397310 - DNA, 20 bp, Artificial Sequence
  chemically synthesized
ccacactgggagaattgtct

SEQ ID NO: 397311 - DNA, 20 bp, Artificial Sequence
  chemically synthesized
gtggcccaagacaattctcc

SEQ ID NO: 397312 - DNA, 20 bp, Artificial Sequence
  chemically synthesized
ccaagacaattctcccagtg

SEQ ID NO: 397313 - DNA, 20 bp, Artificial Sequence
  chemically synthesized
gcttccctgggccacactgg

SEQ ID NO: 397314 - DNA, 20 bp, Artificial Sequence
  chemically synthesized
tagcttccctgggccacact

SEQ ID NO: 397315 - DNA, 20 bp, Artificial Sequence
  chemically synthesized
ttagcttccctgggccacac

SEQ ID NO: 397316 - DNA, 20 bp, Artificial Sequence
  chemically synthesized
acaattctcccagtgtggcc

SEQ ID NO: 397317 - DNA, 20 bp, Artificial Sequence
  chemically synthesized
caattctcccagtgtggccc

SEQ ID NO: 397318 - DNA, 20 bp, Artificial Sequence
  chemically synthesized
aattctcccagtgtggccca

SEQ ID NO: 397319 - DNA, 20 bp, Artificial Sequence
  chemically synthesized
tctcccagtgtggcccaggg

SEQ ID NO: 397320 - DNA, 20 bp, Artificial Sequence
  chemically synthesized
tcagaacttttagcttccct

SEQ ID NO: 397321 - DNA, 20 bp, Artificial Sequence
  chemically synthesized
gtcagaacttttagcttccc

SEQ ID NO: 397322 - DNA, 20 bp, Artificial Sequence
  chemically synthesized
gtgtggcccagggaagctaa

SEQ ID NO: 397323 - DNA, 20 bp, Artificial Sequence
  chemically synthesized
agcagaattgtcagaacttt

SEQ ID NO: 397324 - DNA, 20 bp, Artificial Sequence
  chemically synthesized
agtcttcaaagcagaattgt

SEQ ID NO: 397325 - DNA, 20 bp, Artificial Sequence
  chemically synthesized
gttctgacaattctgctttg

SEQ ID NO: 397326 - DNA, 20 bp, Artificial Sequence
  chemically synthesized
ttaaaagggagtcttcaaag

SEQ ID NO: 397327 - DNA, 20 bp, Artificial Sequence
  chemically synthesized
aacttaaaagggagtcttca

SEQ ID NO: 397328 - DNA, 20 bp, Artificial Sequence
  chemically synthesized
tgctttgaagactccctttt

SEQ ID NO: 397329 - DNA, 20 bp, Artificial Sequence
  chemically synthesized
ttcattgccaacttaaaagg

SEQ ID NO: 397330 - DNA, 20 bp, Artificial Sequence
  chemically synthesized
cattcattgccaacttaaaa

SEQ ID NO: 397331 - DNA, 20 bp, Artificial Sequence
  chemically synthesized
ttgaagactcccttttaagt

SEQ ID NO: 397332 - DNA, 20 bp, Artificial Sequence
  chemically synthesized
acattcattgccaacttaaa

SEQ ID NO: 397333 - DNA, 20 bp, Artificial Sequence
  chemically synthesized
tacattcattgccaacttaa

SEQ ID NO: 397334 - DNA, 20 bp, Artificial Sequence
  chemically synthesized
caatacctacataatcatgt

SEQ ID NO: 397335 - DNA, 20 bp, Artificial Sequence
  chemically synthesized
aatgtacttacatgattatg

SEQ ID NO: 397336 - DNA, 20 bp, Artificial Sequence
  chemically synthesized
atgtacttacatgattatgt

SEQ ID NO: 397337 - DNA, 20 bp, Artificial Sequence
  chemically synthesized
aaacgtaacatgttacattt

SEQ ID NO: 397338 - DNA, 20 bp, Artificial Sequence
  chemically synthesized
ttaaacattgatgaccaacg

SEQ ID NO: 397339 - DNA, 20 bp, Artificial Sequence
  chemically synthesized
aaagtgctgagattctgcgt

SEQ ID NO: 397340 - DNA, 20 bp, Artificial Sequence
  chemically synthesized
tgatgaccaacgcagaatct

SEQ ID NO: 397341 - DNA, 20 bp, Artificial Sequence
  chemically synthesized
aacgcagaatctcagcactt

SEQ ID NO: 397342 - DNA, 20 bp, Artificial Sequence
  chemically synthesized
cctcagcctcccaaagtgct

SEQ ID NO: 397343 - DNA, 20 bp, Artificial Sequence
  chemically synthesized
acgcagaatctcagcacttt

SEQ ID NO: 397344 - DNA, 20 bp, Artificial Sequence
  chemically synthesized
gcagaatctcagcactttgg

SEQ ID NO: 397345 - DNA, 20 bp, Artificial Sequence
  chemically synthesized
cagaatctcagcactttggg

SEQ ID NO: 397346 - DNA, 20 bp, Artificial Sequence
  chemically synthesized
ctgcccgcctcagcctccca

SEQ ID NO: 397347 - DNA, 20 bp, Artificial Sequence
  chemically synthesized
tctcagcactttgggaggct

SEQ ID NO: 397348 - DNA, 20 bp, Artificial Sequence
  chemically synthesized
ctcagcactttgggaggctg

SEQ ID NO: 397349 - DNA, 20 bp, Artificial Sequence
  chemically synthesized
agcactttgggaggctgagg

SEQ ID NO: 397350 - DNA, 20 bp, Artificial Sequence
  chemically synthesized
gcactttgggaggctgaggc

SEQ ID NO: 397351 - DNA, 20 bp, Artificial Sequence
  chemically synthesized
ctttgggaggctgaggcggg

SEQ ID NO: 397352 - DNA, 20 bp, Artificial Sequence
  chemically synthesized
acctcgtgatctgcccgcct

SEQ ID NO: 397353 - DNA, 20 bp, Artificial Sequence
  chemically synthesized
ggctgaggcgggcagatcac

SEQ ID NO: 397354 - DNA, 20 bp, Artificial Sequence
  chemically synthesized
gctgaggcgggcagatcacg

SEQ ID NO: 397355 - DNA, 20 bp, Artificial Sequence
  chemically synthesized
aggcgggcagatcacgaggt

SEQ ID NO: 397356 - DNA, 20 bp, Artificial Sequence
  chemically synthesized
ggcgggcagatcacgaggtc

SEQ ID NO: 397357 - DNA, 20 bp, Artificial Sequence
  chemically synthesized
cgggcagatcacgaggtcag

SEQ ID NO: 397358 - DNA, 20 bp, Artificial Sequence
  chemically synthesized
gatcacgaggtcaggagatt

SEQ ID NO: 397359 - DNA, 20 bp, Artificial Sequence
  chemically synthesized
gtcaggagattgagccatcc

SEQ ID NO: 397360 - DNA, 20 bp, Artificial Sequence
  chemically synthesized
tttcaccatgttagccagga

SEQ ID NO: 397361 - DNA, 20 bp, Artificial Sequence
  chemically synthesized
ggggtttcaccatgttagcc

SEQ ID NO: 397362 - DNA, 20 bp, Artificial Sequence
  chemically synthesized
ttgagccatcctggctaaca

SEQ ID NO: 397363 - DNA, 20 bp, Artificial Sequence
  chemically synthesized
cggggtttcaccatgttagc

SEQ ID NO: 397364 - DNA, 20 bp, Artificial Sequence
  chemically synthesized
gaggcggggtttcaccatgt

SEQ ID NO: 397365 - DNA, 20 bp, Artificial Sequence
  chemically synthesized
ttgtatttttagtagaggcg

SEQ ID NO: 397366 - DNA, 20 bp, Artificial Sequence
  chemically synthesized
tttgtatttttagtagaggc

SEQ ID NO: 397367 - DNA, 20 bp, Artificial Sequence
  chemically synthesized
ttttgtatttttagtagagg

SEQ ID NO: 397368 - DNA, 20 bp, Artificial Sequence
  chemically synthesized
aatttttgtatttttagtag

SEQ ID NO: 397369 - DNA, 20 bp, Artificial Sequence
  chemically synthesized
taatttttgtatttttagta

SEQ ID NO: 397370 - DNA, 20 bp, Artificial Sequence
  chemically synthesized
gctaatttttgtatttttag

SEQ ID NO: 397371 - DNA, 20 bp, Artificial Sequence
  chemically synthesized
ccggctaatttttgtatttt

SEQ ID NO: 397372 - DNA, 20 bp, Artificial Sequence
  chemically synthesized
tctactaaaaatacaaaaat

SEQ ID NO: 397373 - DNA, 20 bp, Artificial Sequence
  chemically synthesized
ctaaaaatacaaaaattagc

SEQ ID NO: 397374 - DNA, 20 bp, Artificial Sequence
  chemically synthesized
taaaaatacaaaaattagcc

SEQ ID NO: 397375 - DNA, 20 bp, Artificial Sequence
  chemically synthesized
atacaaaaattagccgggtg

SEQ ID NO: 397376 - DNA, 20 bp, Artificial Sequence
  chemically synthesized
caaaaattagccgggtgtgg

SEQ ID NO: 397377 - DNA, 20 bp, Artificial Sequence
  chemically synthesized
caggcacgtgccaccacacc

SEQ ID NO: 397378 - DNA, 20 bp, Artificial Sequence
  chemically synthesized
ggtgtggtggcacgtgcctg

SEQ ID NO: 397379 - DNA, 20 bp, Artificial Sequence
  chemically synthesized
gtggcacgtgcctgtagtcc

SEQ ID NO: 397380 - DNA, 20 bp, Artificial Sequence
  chemically synthesized
tcctgagtagctgggactac

SEQ ID NO: 397381 - DNA, 20 bp, Artificial Sequence
  chemically synthesized
ctcctgagtagctgggacta

SEQ ID NO: 397382 - DNA, 20 bp, Artificial Sequence
  chemically synthesized
tgcctgtagtcccagctact

SEQ ID NO: 397383 - DNA, 20 bp, Artificial Sequence
  chemically synthesized
cctcagcctcctgagtagct

SEQ ID NO: 397384 - DNA, 20 bp, Artificial Sequence
  chemically synthesized
gcctgtagtcccagctactc

SEQ ID NO: 397385 - DNA, 20 bp, Artificial Sequence
  chemically synthesized
gcctcagcctcctgagtagc

SEQ ID NO: 397386 - DNA, 20 bp, Artificial Sequence
  chemically synthesized
ctgtagtcccagctactcag

SEQ ID NO: 397387 - DNA, 20 bp, Artificial Sequence
  chemically synthesized
tgtagtcccagctactcagg

SEQ ID NO: 397388 - DNA, 20 bp, Artificial Sequence
  chemically synthesized
tcctgcctcagcctcctgag

SEQ ID NO: 397389 - DNA, 20 bp, Artificial Sequence
  chemically synthesized
ttctcctgcctcagcctcct

SEQ ID NO: 397390 - DNA, 20 bp, Artificial Sequence
  chemically synthesized
tcccagctactcaggaggct

SEQ ID NO: 397391 - DNA, 20 bp, Artificial Sequence
  chemically synthesized
cccagctactcaggaggctg

SEQ ID NO: 397392 - DNA, 20 bp, Artificial Sequence
  chemically synthesized
agctactcaggaggctgagg

SEQ ID NO: 397393 - DNA, 20 bp, Artificial Sequence
  chemically synthesized
gctactcaggaggctgaggc

SEQ ID NO: 397394 - DNA, 20 bp, Artificial Sequence
  chemically synthesized
tactcaggaggctgaggcag

SEQ ID NO: 397395 - DNA, 20 bp, Artificial Sequence
  chemically synthesized
ttcaagcgattctcctgcct

SEQ ID NO: 397396 - DNA, 20 bp, Artificial Sequence
  chemically synthesized
ggcaggagaatcgcttgaac

SEQ ID NO: 397397 - DNA, 20 bp, Artificial Sequence
  chemically synthesized
gcaggagaatcgcttgaact

SEQ ID NO: 397398 - DNA, 20 bp, Artificial Sequence
  chemically synthesized
caggagaatcgcttgaacta

SEQ ID NO: 397399 - DNA, 20 bp, Artificial Sequence
  chemically synthesized
aacctccgactccctagttc

SEQ ID NO: 397400 - DNA, 20 bp, Artificial Sequence
  chemically synthesized
ggagaatcgcttgaactagg

SEQ ID NO: 397401 - DNA, 20 bp, Artificial Sequence
  chemically synthesized
aatcgcttgaactagggagt

SEQ ID NO: 397402 - DNA, 20 bp, Artificial Sequence
  chemically synthesized
cactgcaacctccgactccc

SEQ ID NO: 397403 - DNA, 20 bp, Artificial Sequence
  chemically synthesized
tcgcttgaactagggagtcg

SEQ ID NO: 397404 - DNA, 20 bp, Artificial Sequence
  chemically synthesized
cgcttgaactagggagtcgg

SEQ ID NO: 397405 - DNA, 20 bp, Artificial Sequence
  chemically synthesized
aactagggagtcggaggttg

SEQ ID NO: 397406 - DNA, 20 bp, Artificial Sequence
  chemically synthesized
agggagtcggaggttgcagt

SEQ ID NO: 397407 - DNA, 20 bp, Artificial Sequence
  chemically synthesized
gtcggaggttgcagtgagcc

SEQ ID NO: 397408 - DNA, 20 bp, Artificial Sequence
  chemically synthesized
cggaggttgcagtgagccaa

SEQ ID NO: 397409 - DNA, 20 bp, Artificial Sequence
  chemically synthesized
ggagtgcagtggcacactct

SEQ ID NO: 397410 - DNA, 20 bp, Artificial Sequence
  chemically synthesized
tcacccaggctggagtgcag

SEQ ID NO: 397411 - DNA, 20 bp, Artificial Sequence
  chemically synthesized
aagagtgtgccactgcactc

SEQ ID NO: 397412 - DNA, 20 bp, Artificial Sequence
  chemically synthesized
ctgtcacccaggctggagtg

SEQ ID NO: 397413 - DNA, 20 bp, Artificial Sequence
  chemically synthesized
tgtgccactgcactccagcc

SEQ ID NO: 397414 - DNA, 20 bp, Artificial Sequence
  chemically synthesized
gtgccactgcactccagcct

SEQ ID NO: 397415 - DNA, 20 bp, Artificial Sequence
  chemically synthesized
tcgctctgtcacccaggctg

SEQ ID NO: 397416 - DNA, 20 bp, Artificial Sequence
  chemically synthesized
tctcgctctgtcacccaggc

SEQ ID NO: 397417 - DNA, 20 bp, Artificial Sequence
  chemically synthesized
ctgcactccagcctgggtga

SEQ ID NO: 397418 - DNA, 20 bp, Artificial Sequence
  chemically synthesized
ggagtctcgctctgtcaccc

SEQ ID NO: 397419 - DNA, 20 bp, Artificial Sequence
  chemically synthesized
gcactccagcctgggtgaca

SEQ ID NO: 397420 - DNA, 20 bp, Artificial Sequence
  chemically synthesized
tggagtctcgctctgtcacc

SEQ ID NO: 397421 - DNA, 20 bp, Artificial Sequence
  chemically synthesized
tccagcctgggtgacagagc

SEQ ID NO: 397422 - DNA, 20 bp, Artificial Sequence
  chemically synthesized
ttgtttttgtttttgagatg

SEQ ID NO: 397423 - DNA, 20 bp, Artificial Sequence
  chemically synthesized
ttttgtttttgtttttgaga

SEQ ID NO: 397424 - DNA, 20 bp, Artificial Sequence
  chemically synthesized
ttgtttttgtttttgttttt

SEQ ID NO: 397425 - DNA, 20 bp, Artificial Sequence
  chemically synthesized
aaaaaaaaaaccgaaaaaac

SEQ ID NO: 397426 - DNA, 20 bp, Artificial Sequence
  chemically synthesized
gaagacatttcttgtttttt

SEQ ID NO: 397427 - DNA, 20 bp, Artificial Sequence
  chemically synthesized
cagaaacagaaattggtcag

SEQ ID NO: 397428 - DNA, 20 bp, Artificial Sequence
  chemically synthesized
gaccagaaacagaaattggt

SEQ ID NO: 397429 - DNA, 20 bp, Artificial Sequence
  chemically synthesized
cacagaccagaaacagaaat

SEQ ID NO: 397430 - DNA, 20 bp, Artificial Sequence
  chemically synthesized
ttctgaccaatttctgtttc

SEQ ID NO: 397431 - DNA, 20 bp, Artificial Sequence
  chemically synthesized
tcaaatgcacagaccagaaa

SEQ ID NO: 397432 - DNA, 20 bp, Artificial Sequence
  chemically synthesized
ctcaagtcaaatgcacagac

SEQ ID NO: 397433 - DNA, 20 bp, Artificial Sequence
  chemically synthesized
ctgtgctcaagtcaaatgca

SEQ ID NO: 397434 - DNA, 20 bp, Artificial Sequence
  chemically synthesized
ctggtctgtgcatttgactt

SEQ ID NO: 397435 - DNA, 20 bp, Artificial Sequence
  chemically synthesized
ctgtgcatttgacttgagca

SEQ ID NO: 397436 - DNA, 20 bp, Artificial Sequence
  chemically synthesized
gcaacaatggatctgtgctc

SEQ ID NO: 397437 - DNA, 20 bp, Artificial Sequence
  chemically synthesized
acgcttcaagtatgcaacaa

SEQ ID NO: 397438 - DNA, 20 bp, Artificial Sequence
  chemically synthesized
gatccattgttgcatacttg

SEQ ID NO: 397439 - DNA, 20 bp, Artificial Sequence
  chemically synthesized
acacgtgtacgtgacgcttc

SEQ ID NO: 397440 - DNA, 20 bp, Artificial Sequence
  chemically synthesized
aagcgtcacgtacacgtgtt

SEQ ID NO: 397441 - DNA, 20 bp, Artificial Sequence
  chemically synthesized
tcacgtacacgtgttgagtt

SEQ ID NO: 397442 - DNA, 20 bp, Artificial Sequence
  chemically synthesized
cacgtacacgtgttgagtta

SEQ ID NO: 397443 - DNA, 20 bp, Artificial Sequence
  chemically synthesized
cgtgttgagttaaggaaaaa

SEQ ID NO: 397444 - DNA, 20 bp, Artificial Sequence
  chemically synthesized
ttacatgggagagtgatcaa

SEQ ID NO: 397445 - DNA, 20 bp, Artificial Sequence
  chemically synthesized
ttcaacgaagttacatggga

SEQ ID NO: 397446 - DNA, 20 bp, Artificial Sequence
  chemically synthesized
ctttcaacgaagttacatgg

SEQ ID NO: 397447 - DNA, 20 bp, Artificial Sequence
  chemically synthesized
aactttcaacgaagttacat

SEQ ID NO: 397448 - DNA, 20 bp, Artificial Sequence
  chemically synthesized
taactttcaacgaagttaca

SEQ ID NO: 397449 - DNA, 20 bp, Artificial Sequence
  chemically synthesized
ctcccatgtaacttcgttga

SEQ ID NO: 397450 - DNA, 20 bp, Artificial Sequence
  chemically synthesized
atgaaaggtaactttcaacg

SEQ ID NO: 397451 - DNA, 20 bp, Artificial Sequence
  chemically synthesized
gatatggaaaaaggaatgaa

SEQ ID NO: 397452 - DNA, 20 bp, Artificial Sequence
  chemically synthesized
tgatatggaaaaaggaatga

SEQ ID NO: 397453 - DNA, 20 bp, Artificial Sequence
  chemically synthesized
ccaggaaatgatatggaaaa

SEQ ID NO: 397454 - DNA, 20 bp, Artificial Sequence
  chemically synthesized
cccaggaaatgatatggaaa

SEQ ID NO: 397455 - DNA, 20 bp, Artificial Sequence
  chemically synthesized
gactagcccaggaaatgata

SEQ ID NO: 397456 - DNA, 20 bp, Artificial Sequence
  chemically synthesized
cctttttccatatcatttcc

SEQ ID NO: 397457 - DNA, 20 bp, Artificial Sequence
  chemically synthesized
ctttttccatatcatttcct

SEQ ID NO: 397458 - DNA, 20 bp, Artificial Sequence
  chemically synthesized
ttccatatcatttcctgggc

SEQ ID NO: 397459 - DNA, 20 bp, Artificial Sequence
  chemically synthesized
acattatgtaagactagccc

SEQ ID NO: 397460 - DNA, 20 bp, Artificial Sequence
  chemically synthesized
aacattatgtaagactagcc

SEQ ID NO: 397461 - DNA, 20 bp, Artificial Sequence
  chemically synthesized
gtttgaacattatgtaagac

SEQ ID NO: 397462 - DNA, 20 bp, Artificial Sequence
  chemically synthesized
tccctgtttgaacattatgt

SEQ ID NO: 397463 - DNA, 20 bp, Artificial Sequence
  chemically synthesized
agtcttacataatgttcaaa

SEQ ID NO: 397464 - DNA, 20 bp, Artificial Sequence
  chemically synthesized
gtcttacataatgttcaaac

SEQ ID NO: 397465 - DNA, 20 bp, Artificial Sequence
  chemically synthesized
tcttacataatgttcaaaca

SEQ ID NO: 397466 - DNA, 20 bp, Artificial Sequence
  chemically synthesized
tcatgtaacgaattccatat

SEQ ID NO: 397467 - DNA, 20 bp, Artificial Sequence
  chemically synthesized
gtctagcttataaactgata

SEQ ID NO: 397468 - DNA, 20 bp, Artificial Sequence
  chemically synthesized
cgaattccatatcagtttat

SEQ ID NO: 397469 - DNA, 20 bp, Artificial Sequence
  chemically synthesized
ttccatatcagtttataagc

SEQ ID NO: 397470 - DNA, 20 bp, Artificial Sequence
  chemically synthesized
agtttataagctagactatt

SEQ ID NO: 397471 - DNA, 20 bp, Artificial Sequence
  chemically synthesized
atttaccaatcttaatagtc

SEQ ID NO: 397472 - DNA, 20 bp, Artificial Sequence
  chemically synthesized
ataagctagactattaagat

SEQ ID NO: 397473 - DNA, 20 bp, Artificial Sequence
  chemically synthesized
tatacatttaccaatcttaa

SEQ ID NO: 397474 - DNA, 20 bp, Artificial Sequence
  chemically synthesized
tgttttttttcttactgctt

SEQ ID NO: 397475 - DNA, 20 bp, Artificial Sequence
  chemically synthesized
tttcaatactccaaagcagt

SEQ ID NO: 397476 - DNA, 20 bp, Artificial Sequence
  chemically synthesized
ttttttttcttactgctttg

SEQ ID NO: 397477 - DNA, 20 bp, Artificial Sequence
  chemically synthesized
ctcctttcaatactccaaag

SEQ ID NO: 397478 - DNA, 20 bp, Artificial Sequence
  chemically synthesized
aaactcctttcaatactcca

SEQ ID NO: 397479 - DNA, 20 bp, Artificial Sequence
  chemically synthesized
ttactgctttggagtattga

SEQ ID NO: 397480 - DNA, 20 bp, Artificial Sequence
  chemically synthesized
tactgctttggagtattgaa

SEQ ID NO: 397481 - DNA, 20 bp, Artificial Sequence
  chemically synthesized
ctgctttggagtattgaaag

SEQ ID NO: 397482 - DNA, 20 bp, Artificial Sequence
  chemically synthesized
tggagtattgaaaggagttt

SEQ ID NO: 397483 - DNA, 20 bp, Artificial Sequence
  chemically synthesized
tattgaaaggagttttagta

SEQ ID NO: 397484 - DNA, 20 bp, Artificial Sequence
  chemically synthesized
attgaaaggagttttagtat

SEQ ID NO: 397485 - DNA, 20 bp, Artificial Sequence
  chemically synthesized
ttgaaaggagttttagtata

SEQ ID NO: 397486 - DNA, 20 bp, Artificial Sequence
  chemically synthesized
tgaaaggagttttagtatag

SEQ ID NO: 397487 - DNA, 20 bp, Artificial Sequence
  chemically synthesized
tatgtaaactaaagtatgtt

SEQ ID NO: 397488 - DNA, 20 bp, Artificial Sequence
  chemically synthesized
tttttatactaaacatactt

SEQ ID NO: 397489 - DNA, 20 bp, Artificial Sequence
  chemically synthesized
acactctattatgtaaacta

SEQ ID NO: 397490 - DNA, 20 bp, Artificial Sequence
  chemically synthesized
acatactttagtttacataa

SEQ ID NO: 397491 - DNA, 20 bp, Artificial Sequence
  chemically synthesized
atactttagtttacataata

SEQ ID NO: 397492 - DNA, 20 bp, Artificial Sequence
  chemically synthesized
tgaattgaataaaatatgta

SEQ ID NO: 397493 - DNA, 20 bp, Artificial Sequence
  chemically synthesized
tgaacactattgaacaaagc

SEQ ID NO: 397494 - DNA, 20 bp, Artificial Sequence
  chemically synthesized
ttaaatcttgctttgttcaa

SEQ ID NO: 397495 - DNA, 20 bp, Artificial Sequence
  chemically synthesized
ataatgaacactattgaaca

SEQ ID NO: 397496 - DNA, 20 bp, Artificial Sequence
  chemically synthesized
cattatatacactttgaacc

SEQ ID NO: 397497 - DNA, 20 bp, Artificial Sequence
  chemically synthesized
tatttttgaagccaggttca

SEQ ID NO: 397498 - DNA, 20 bp, Artificial Sequence
  chemically synthesized
gatgtactatttttgaagcc

SEQ ID NO: 397499 - DNA, 20 bp, Artificial Sequence
  chemically synthesized
ggatgtactatttttgaagc

SEQ ID NO: 397500 - DNA, 20 bp, Artificial Sequence
  chemically synthesized
tttgaacctggcttcaaaaa

SEQ ID NO: 397501 - DNA, 20 bp, Artificial Sequence
  chemically synthesized
agaaggatgtactatttttg

SEQ ID NO: 397502 - DNA, 20 bp, Artificial Sequence
  chemically synthesized
taaaatgcataaaatagaga

SEQ ID NO: 397503 - DNA, 20 bp, Artificial Sequence
  chemically synthesized
ataaaatgcataaaatagag

SEQ ID NO: 397504 - DNA, 20 bp, Artificial Sequence
  chemically synthesized
gatataaaatgcataaaata

SEQ ID NO: 397505 - DNA, 20 bp, Artificial Sequence
  chemically synthesized
ttgatataaaatgcataaaa

SEQ ID NO: 397506 - DNA, 20 bp, Artificial Sequence
  chemically synthesized
taatttgaaacaattacata

SEQ ID NO: 397507 - DNA, 20 bp, Artificial Sequence
  chemically synthesized
atatgtaattgtttcaaatt

SEQ ID NO: 397508 - DNA, 20 bp, Artificial Sequence
  chemically synthesized
attgtttcaaattaagattt

SEQ ID NO: 397509 - DNA, 20 bp, Artificial Sequence
  chemically synthesized
caacctaagtgtaatgtgac

SEQ ID NO: 397510 - DNA, 20 bp, Artificial Sequence
  chemically synthesized
acaacctaagtgtaatgtga

SEQ ID NO: 397511 - DNA, 20 bp, Artificial Sequence
  chemically synthesized
atatcctgtcacattacact

SEQ ID NO: 397512 - DNA, 20 bp, Artificial Sequence
  chemically synthesized
tatcctgtcacattacactt

SEQ ID NO: 397513 - DNA, 20 bp, Artificial Sequence
  chemically synthesized
aactattggtcagacaacct

SEQ ID NO: 397514 - DNA, 20 bp, Artificial Sequence
  chemically synthesized
cacttaggttgtctgaccaa

SEQ ID NO: 397515 - DNA, 20 bp, Artificial Sequence
  chemically synthesized
atctttaagaaactattggt

SEQ ID NO: 397516 - DNA, 20 bp, Artificial Sequence
  chemically synthesized
aggaatctttaagaaactat

SEQ ID NO: 397517 - DNA, 20 bp, Artificial Sequence
  chemically synthesized
gtctgaccaatagtttctta

SEQ ID NO: 397518 - DNA, 20 bp, Artificial Sequence
  chemically synthesized
gtaactatagaggaatcttt

SEQ ID NO: 397519 - DNA, 20 bp, Artificial Sequence
  chemically synthesized
gtttcttaaagattcctcta

SEQ ID NO: 397520 - DNA, 20 bp, Artificial Sequence
  chemically synthesized
actagaaaatgtaactatag

SEQ ID NO: 397521 - DNA, 20 bp, Artificial Sequence
  chemically synthesized
aactagaaaatgtaactata

SEQ ID NO: 397522 - DNA, 20 bp, Artificial Sequence
  chemically synthesized
gaaactagaaaatgtaacta

SEQ ID NO: 397523 - DNA, 20 bp, Artificial Sequence
  chemically synthesized
tcctctatagttacattttc

SEQ ID NO: 397524 - DNA, 20 bp, Artificial Sequence
  chemically synthesized
aacttaattgcaaaggaaac

SEQ ID NO: 397525 - DNA, 20 bp, Artificial Sequence
  chemically synthesized
atggctaaacttaattgcaa

SEQ ID NO: 397526 - DNA, 20 bp, Artificial Sequence
  chemically synthesized
ttctagtttcctttgcaatt

SEQ ID NO: 397527 - DNA, 20 bp, Artificial Sequence
  chemically synthesized
tatggctaaacttaattgca

SEQ ID NO: 397528 - DNA, 20 bp, Artificial Sequence
  chemically synthesized
gtttcctttgcaattaagtt

SEQ ID NO: 397529 - DNA, 20 bp, Artificial Sequence
  chemically synthesized
attaagtttagccatataac

SEQ ID NO: 397530 - DNA, 20 bp, Artificial Sequence
  chemically synthesized
ttaagtttagccatataact

SEQ ID NO: 397531 - DNA, 20 bp, Artificial Sequence
  chemically synthesized
tgggtcagaacccagttata

SEQ ID NO: 397532 - DNA, 20 bp, Artificial Sequence
  chemically synthesized
acatcccatgggtcagaacc

SEQ ID NO: 397533 - DNA, 20 bp, Artificial Sequence
  chemically synthesized
tataactgggttctgaccca

SEQ ID NO: 397534 - DNA, 20 bp, Artificial Sequence
  chemically synthesized
ataactgggttctgacccat

SEQ ID NO: 397535 - DNA, 20 bp, Artificial Sequence
  chemically synthesized
tccaccaacatcccatgggt

SEQ ID NO: 397536 - DNA, 20 bp, Artificial Sequence
  chemically synthesized
cacctccaccaacatcccat

SEQ ID NO: 397537 - DNA, 20 bp, Artificial Sequence
  chemically synthesized
tcacctccaccaacatccca

SEQ ID NO: 397538 - DNA, 20 bp, Artificial Sequence
  chemically synthesized
ggttctgacccatgggatgt

SEQ ID NO: 397539 - DNA, 20 bp, Artificial Sequence
  chemically synthesized
tctgacccatgggatgttgg

SEQ ID NO: 397540 - DNA, 20 bp, Artificial Sequence
  chemically synthesized
tgacccatgggatgttggtg

SEQ ID NO: 397541 - DNA, 20 bp, Artificial Sequence
  chemically synthesized
gacccatgggatgttggtgg

SEQ ID NO: 397542 - DNA, 20 bp, Artificial Sequence
  chemically synthesized
gatgttggtggaggtgacaa

SEQ ID NO: 397543 - DNA, 20 bp, Artificial Sequence
  chemically synthesized
tattctgactaagtcaggaa

SEQ ID NO: 397544 - DNA, 20 bp, Artificial Sequence
  chemically synthesized
atattctgactaagtcagga

SEQ ID NO: 397545 - DNA, 20 bp, Artificial Sequence
  chemically synthesized
acaaaagtcccttcctgact

SEQ ID NO: 397546 - DNA, 20 bp, Artificial Sequence
  chemically synthesized
aatattctgactaagtcagg

SEQ ID NO: 397547 - DNA, 20 bp, Artificial Sequence
  chemically synthesized
tagaatattctgactaagtc

SEQ ID NO: 397548 - DNA, 20 bp, Artificial Sequence
  chemically synthesized
aagtcccttcctgacttagt

SEQ ID NO: 397549 - DNA, 20 bp, Artificial Sequence
  chemically synthesized
ttagaatattctgactaagt

SEQ ID NO: 397550 - DNA, 20 bp, Artificial Sequence
  chemically synthesized
ggtcttagaatattctgact

SEQ ID NO: 397551 - DNA, 20 bp, Artificial Sequence
  chemically synthesized
tgacttagtcagaatattct

SEQ ID NO: 397552 - DNA, 20 bp, Artificial Sequence
  chemically synthesized
gcatagctatagaggggtct

SEQ ID NO: 397553 - DNA, 20 bp, Artificial Sequence
  chemically synthesized
aatattctaagacccctcta

SEQ ID NO: 397554 - DNA, 20 bp, Artificial Sequence
  chemically synthesized
tacacagcatagctatagag

SEQ ID NO: 397555 - DNA, 20 bp, Artificial Sequence
  chemically synthesized
ttacacagcatagctataga

SEQ ID NO: 397556 - DNA, 20 bp, Artificial Sequence
  chemically synthesized
attacacagcatagctatag

SEQ ID NO: 397557 - DNA, 20 bp, Artificial Sequence
  chemically synthesized
cattacacagcatagctata

SEQ ID NO: 397558 - DNA, 20 bp, Artificial Sequence
  chemically synthesized
cacattacacagcatagcta

SEQ ID NO: 397559 - DNA, 20 bp, Artificial Sequence
  chemically synthesized
ggctaccacattacacagca

SEQ ID NO: 397560 - DNA, 20 bp, Artificial Sequence
  chemically synthesized
tatagctatgctgtgtaatg

SEQ ID NO: 397561 - DNA, 20 bp, Artificial Sequence
  chemically synthesized
ctagtggctaccacattaca

SEQ ID NO: 397562 - DNA, 20 bp, Artificial Sequence
  chemically synthesized
agctatgctgtgtaatgtgg

SEQ ID NO: 397563 - DNA, 20 bp, Artificial Sequence
  chemically synthesized
ctgtgtaatgtggtagccac

SEQ ID NO: 397564 - DNA, 20 bp, Artificial Sequence
  chemically synthesized
ccaaagccacatgtggctag

SEQ ID NO: 397565 - DNA, 20 bp, Artificial Sequence
  chemically synthesized
gctccaaagccacatgtggc

SEQ ID NO: 397566 - DNA, 20 bp, Artificial Sequence
  chemically synthesized
tggtagccactagccacatg

SEQ ID NO: 397567 - DNA, 20 bp, Artificial Sequence
  chemically synthesized
aggtgctccaaagccacatg

SEQ ID NO: 397568 - DNA, 20 bp, Artificial Sequence
  chemically synthesized
ccactagccacatgtggctt

SEQ ID NO: 397569 - DNA, 20 bp, Artificial Sequence
  chemically synthesized
actagccacatgtggctttg

SEQ ID NO: 397570 - DNA, 20 bp, Artificial Sequence
  chemically synthesized
gccactattcaggtgctcca

SEQ ID NO: 397571 - DNA, 20 bp, Artificial Sequence
  chemically synthesized
gtggctttggagcacctgaa

SEQ ID NO: 397572 - DNA, 20 bp, Artificial Sequence
  chemically synthesized
gctttggagcacctgaatag

SEQ ID NO: 397573 - DNA, 20 bp, Artificial Sequence
  chemically synthesized
acacgggatagccactattc

SEQ ID NO: 397574 - DNA, 20 bp, Artificial Sequence
  chemically synthesized
aacacgggatagccactatt

SEQ ID NO: 397575 - DNA, 20 bp, Artificial Sequence
  chemically synthesized
caaatctcagcaacacggga

SEQ ID NO: 397576 - DNA, 20 bp, Artificial Sequence
  chemically synthesized
ccagcaaatctcagcaacac

SEQ ID NO: 397577 - DNA, 20 bp, Artificial Sequence
  chemically synthesized
agtggctatcccgtgttgct

SEQ ID NO: 397578 - DNA, 20 bp, Artificial Sequence
  chemically synthesized
tccagcaaatctcagcaaca

SEQ ID NO: 397579 - DNA, 20 bp, Artificial Sequence
  chemically synthesized
tttacacttccagcaaatct

SEQ ID NO: 397580 - DNA, 20 bp, Artificial Sequence
  chemically synthesized
cccgtgttgctgagatttgc

SEQ ID NO: 397581 - DNA, 20 bp, Artificial Sequence
  chemically synthesized
gtgttgctgagatttgctgg

SEQ ID NO: 397582 - DNA, 20 bp, Artificial Sequence
  chemically synthesized
cgttgtgaattttacacttc

SEQ ID NO: 397583 - DNA, 20 bp, Artificial Sequence
  chemically synthesized
tggaagtgtaaaattcacaa

SEQ ID NO: 397584 - DNA, 20 bp, Artificial Sequence
  chemically synthesized
gtaaaattcacaacggaatt

SEQ ID NO: 397585 - DNA, 20 bp, Artificial Sequence
  chemically synthesized
aaaattcacaacggaattta

SEQ ID NO: 397586 - DNA, 20 bp, Artificial Sequence
  chemically synthesized
aattcacaacggaatttaga

SEQ ID NO: 397587 - DNA, 20 bp, Artificial Sequence
  chemically synthesized
attcacaacggaatttagag

SEQ ID NO: 397588 - DNA, 20 bp, Artificial Sequence
  chemically synthesized
cacaacggaatttagagagg

SEQ ID NO: 397589 - DNA, 20 bp, Artificial Sequence
  chemically synthesized
ataaataatactaattgata

SEQ ID NO: 397590 - DNA, 20 bp, Artificial Sequence
  chemically synthesized
caggtaatcactatatcaat

SEQ ID NO: 397591 - DNA, 20 bp, Artificial Sequence
  chemically synthesized
gatatagtgattacctgttg

SEQ ID NO: 397592 - DNA, 20 bp, Artificial Sequence
  chemically synthesized
aaaaatattatttcttcaac

SEQ ID NO: 397593 - DNA, 20 bp, Artificial Sequence
  chemically synthesized
caaaaatattatttcttcaa

SEQ ID NO: 397594 - DNA, 20 bp, Artificial Sequence
  chemically synthesized
taatatttttgttttacata

SEQ ID NO: 397595 - DNA, 20 bp, Artificial Sequence
  chemically synthesized
aaactgagaagaaacaggtg

SEQ ID NO: 397596 - DNA, 20 bp, Artificial Sequence
  chemically synthesized
tttaaaaactgagaagaaac

SEQ ID NO: 397597 - DNA, 20 bp, Artificial Sequence
  chemically synthesized
atttaaaaactgagaagaaa

SEQ ID NO: 397598 - DNA, 20 bp, Artificial Sequence
  chemically synthesized
ttacttcacctgtttcttct

SEQ ID NO: 397599 - DNA, 20 bp, Artificial Sequence
  chemically synthesized
agcctcatttaaaaactgag

SEQ ID NO: 397600 - DNA, 20 bp, Artificial Sequence
  chemically synthesized
tatagcctcatttaaaaact

SEQ ID NO: 397601 - DNA, 20 bp, Artificial Sequence
  chemically synthesized
tttcttctcagtttttaaat

SEQ ID NO: 397602 - DNA, 20 bp, Artificial Sequence
  chemically synthesized
ttcttctcagtttttaaatg

SEQ ID NO: 397603 - DNA, 20 bp, Artificial Sequence
  chemically synthesized
cagtttttaaatgaggctat

SEQ ID NO: 397604 - DNA, 20 bp, Artificial Sequence
  chemically synthesized
tatagtatttacatttctta

SEQ ID NO: 397605 - DNA, 20 bp, Artificial Sequence
  chemically synthesized
tgtattgcaaaaagtttata

SEQ ID NO: 397606 - DNA, 20 bp, Artificial Sequence
  chemically synthesized
caatagaaatgtattgcaaa

SEQ ID NO: 397607 - DNA, 20 bp, Artificial Sequence
  chemically synthesized
tttttgcaatacatttctat

SEQ ID NO: 397608 - DNA, 20 bp, Artificial Sequence
  chemically synthesized
aagtttggcagcacatccaa

SEQ ID NO: 397609 - DNA, 20 bp, Artificial Sequence
  chemically synthesized
aggaatcctgagaagtttgg

SEQ ID NO: 397610 - DNA, 20 bp, Artificial Sequence
  chemically synthesized
ggatgtgctgccaaacttct

SEQ ID NO: 397611 - DNA, 20 bp, Artificial Sequence
  chemically synthesized
tataggaatcctgagaagtt

SEQ ID NO: 397612 - DNA, 20 bp, Artificial Sequence
  chemically synthesized
gatgtgctgccaaacttctc

SEQ ID NO: 397613 - DNA, 20 bp, Artificial Sequence
  chemically synthesized
agatatataggaatcctgag

SEQ ID NO: 397614 - DNA, 20 bp, Artificial Sequence
  chemically synthesized
gaaagatatataggaatcct

SEQ ID NO: 397615 - DNA, 20 bp, Artificial Sequence
  chemically synthesized
agtagaatagaaagatatat

SEQ ID NO: 397616 - DNA, 20 bp, Artificial Sequence
  chemically synthesized
tagtagaatagaaagatata

SEQ ID NO: 397617 - DNA, 20 bp, Artificial Sequence
  chemically synthesized
ggtagatgtagtagaataga

SEQ ID NO: 397618 - DNA, 20 bp, Artificial Sequence
  chemically synthesized
gaatggtagatgtagtagaa

SEQ ID NO: 397619 - DNA, 20 bp, Artificial Sequence
  chemically synthesized
gaaatgaatggtagatgtag

SEQ ID NO: 397620 - DNA, 20 bp, Artificial Sequence
  chemically synthesized
gaagaaatgaatggtagatg

SEQ ID NO: 397621 - DNA, 20 bp, Artificial Sequence
  chemically synthesized
aatgatgaagaaatgaatgg

SEQ ID NO: 397622 - DNA, 20 bp, Artificial Sequence
  chemically synthesized
attaatgatgaagaaatgaa

SEQ ID NO: 397623 - DNA, 20 bp, Artificial Sequence
  chemically synthesized
atatagaataattaatgatg

SEQ ID NO: 397624 - DNA, 20 bp, Artificial Sequence
  chemically synthesized
taaatttataataaaaaata

SEQ ID NO: 397625 - DNA, 20 bp, Artificial Sequence
  chemically synthesized
attataaatttactgtgcgc

SEQ ID NO: 397626 - DNA, 20 bp, Artificial Sequence
  chemically synthesized
ttataaatttactgtgcgct

SEQ ID NO: 397627 - DNA, 20 bp, Artificial Sequence
  chemically synthesized
taattagagtgcctagcgca

SEQ ID NO: 397628 - DNA, 20 bp, Artificial Sequence
  chemically synthesized
aatggaataattagagtgcc

SEQ ID NO: 397629 - DNA, 20 bp, Artificial Sequence
  chemically synthesized
aataaacaatggaataatta

SEQ ID NO: 397630 - DNA, 20 bp, Artificial Sequence
  chemically synthesized
ataataaacaatggaataat

SEQ ID NO: 397631 - DNA, 20 bp, Artificial Sequence
  chemically synthesized
agtagatttataataaacaa

SEQ ID NO: 397632 - DNA, 20 bp, Artificial Sequence
  chemically synthesized
gaagagtagctggcacacag

SEQ ID NO: 397633 - DNA, 20 bp, Artificial Sequence
  chemically synthesized
attataaatctactgtgtgc

SEQ ID NO: 397634 - DNA, 20 bp, Artificial Sequence
  chemically synthesized
ttagaagagtagctggcaca

SEQ ID NO: 397635 - DNA, 20 bp, Artificial Sequence
  chemically synthesized
gtgattattagaagagtagc

SEQ ID NO: 397636 - DNA, 20 bp, Artificial Sequence
  chemically synthesized
gtaggtgattattagaagag

SEQ ID NO: 397637 - DNA, 20 bp, Artificial Sequence
  chemically synthesized
acagtaggtgattattagaa

SEQ ID NO: 397638 - DNA, 20 bp, Artificial Sequence
  chemically synthesized
taacagtaggtgattattag

SEQ ID NO: 397639 - DNA, 20 bp, Artificial Sequence
  chemically synthesized
tcttaacagtaggtgattat

SEQ ID NO: 397640 - DNA, 20 bp, Artificial Sequence
  chemically synthesized
tctaataatcacctactgtt

SEQ ID NO: 397641 - DNA, 20 bp, Artificial Sequence
  chemically synthesized
ccatcctgtgtcttaacagt

SEQ ID NO: 397642 - DNA, 20 bp, Artificial Sequence
  chemically synthesized
cccatcctgtgtcttaacag

SEQ ID NO: 397643 - DNA, 20 bp, Artificial Sequence
  chemically synthesized
tgtcccatcctgtgtcttaa

SEQ ID NO: 397644 - DNA, 20 bp, Artificial Sequence
  chemically synthesized
aatcacctactgttaagaca

SEQ ID NO: 397645 - DNA, 20 bp, Artificial Sequence
  chemically synthesized
atcacctactgttaagacac

SEQ ID NO: 397646 - DNA, 20 bp, Artificial Sequence
  chemically synthesized
cctactgttaagacacagga

SEQ ID NO: 397647 - DNA, 20 bp, Artificial Sequence
  chemically synthesized
ctactgttaagacacaggat

SEQ ID NO: 397648 - DNA, 20 bp, Artificial Sequence
  chemically synthesized
gtttccccctttttatcatg

SEQ ID NO: 397649 - DNA, 20 bp, Artificial Sequence
  chemically synthesized
acatgtgacttcatgataaa

SEQ ID NO: 397650 - DNA, 20 bp, Artificial Sequence
  chemically synthesized
catgtgacttcatgataaaa

SEQ ID NO: 397651 - DNA, 20 bp, Artificial Sequence
  chemically synthesized
atgtgacttcatgataaaaa

SEQ ID NO: 397652 - DNA, 20 bp, Artificial Sequence
  chemically synthesized
tgtgacttcatgataaaaag

SEQ ID NO: 397653 - DNA, 20 bp, Artificial Sequence
  chemically synthesized
gtgacttcatgataaaaagg

SEQ ID NO: 397654 - DNA, 20 bp, Artificial Sequence
  chemically synthesized
aagggggaaacaccctgata

SEQ ID NO: 397655 - DNA, 20 bp, Artificial Sequence
  chemically synthesized
agggggaaacaccctgatat

SEQ ID NO: 397656 - DNA, 20 bp, Artificial Sequence
  chemically synthesized
aaaattcagttcctatatca

SEQ ID NO: 397657 - DNA, 20 bp, Artificial Sequence
  chemically synthesized
taaaattcagttcctatatc

SEQ ID NO: 397658 - DNA, 20 bp, Artificial Sequence
  chemically synthesized
gtaaaattcagttcctatat

SEQ ID NO: 397659 - DNA, 20 bp, Artificial Sequence
  chemically synthesized
acaaaaaatcttgtaaaatt

SEQ ID NO: 397660 - DNA, 20 bp, Artificial Sequence
  chemically synthesized
atataggaactgaattttac

SEQ ID NO: 397661 - DNA, 20 bp, Artificial Sequence
  chemically synthesized
gattttttgtgctccaactt

SEQ ID NO: 397662 - DNA, 20 bp, Artificial Sequence
  chemically synthesized
tctggcagggactgaagttg

SEQ ID NO: 397663 - DNA, 20 bp, Artificial Sequence
  chemically synthesized
gttctggcagggactgaagt

SEQ ID NO: 397664 - DNA, 20 bp, Artificial Sequence
  chemically synthesized
gcttgttctggcagggactg

SEQ ID NO: 397665 - DNA, 20 bp, Artificial Sequence
  chemically synthesized
gctccaacttcagtccctgc

SEQ ID NO: 397666 - DNA, 20 bp, Artificial Sequence
  chemically synthesized
tccttttgcttgttctggca

SEQ ID NO: 397667 - DNA, 20 bp, Artificial Sequence
  chemically synthesized
ctccttttgcttgttctggc

SEQ ID NO: 397668 - DNA, 20 bp, Artificial Sequence
  chemically synthesized
acttcagtccctgccagaac

SEQ ID NO: 397669 - DNA, 20 bp, Artificial Sequence
  chemically synthesized
actccttttgcttgttctgg

SEQ ID NO: 397670 - DNA, 20 bp, Artificial Sequence
  chemically synthesized
gtcactccttttgcttgttc

SEQ ID NO: 397671 - DNA, 20 bp, Artificial Sequence
  chemically synthesized
gtccctgccagaacaagcaa

SEQ ID NO: 397672 - DNA, 20 bp, Artificial Sequence
  chemically synthesized
tccctgccagaacaagcaaa

SEQ ID NO: 397673 - DNA, 20 bp, Artificial Sequence
  chemically synthesized
cctgccagaacaagcaaaag

SEQ ID NO: 397674 - DNA, 20 bp, Artificial Sequence
  chemically synthesized
ccatttagaaagtcacattg

SEQ ID NO: 397675 - DNA, 20 bp, Artificial Sequence
  chemically synthesized
ctacaatgtgactttctaaa

SEQ ID NO: 397676 - DNA, 20 bp, Artificial Sequence
  chemically synthesized
cctcaatacaaccatttaga

SEQ ID NO: 397677 - DNA, 20 bp, Artificial Sequence
  chemically synthesized
tggtcctcaatacaaccatt

SEQ ID NO: 397678 - DNA, 20 bp, Artificial Sequence
  chemically synthesized
actttctaaatggttgtatt

SEQ ID NO: 397679 - DNA, 20 bp, Artificial Sequence
  chemically synthesized
ctttctaaatggttgtattg

SEQ ID NO: 397680 - DNA, 20 bp, Artificial Sequence
  chemically synthesized
aatggttgtattgaggacca

SEQ ID NO: 397681 - DNA, 20 bp, Artificial Sequence
  chemically synthesized
gtattgaggaccacagatgc

SEQ ID NO: 397682 - DNA, 20 bp, Artificial Sequence
  chemically synthesized
taggcaggacccagcatctg

SEQ ID NO: 397683 - DNA, 20 bp, Artificial Sequence
  chemically synthesized
tattgaggaccacagatgct

SEQ ID NO: 397684 - DNA, 20 bp, Artificial Sequence
  chemically synthesized
tcttcctaataggcaggacc

SEQ ID NO: 397685 - DNA, 20 bp, Artificial Sequence
  chemically synthesized
agatgctgggtcctgcctat

SEQ ID NO: 397686 - DNA, 20 bp, Artificial Sequence
  chemically synthesized
gatgctgggtcctgcctatt

SEQ ID NO: 397687 - DNA, 20 bp, Artificial Sequence
  chemically synthesized
gcccattcttcctaataggc

SEQ ID NO: 397688 - DNA, 20 bp, Artificial Sequence
  chemically synthesized
tgcccattcttcctaatagg

SEQ ID NO: 397689 - DNA, 20 bp, Artificial Sequence
  chemically synthesized
gctgggtcctgcctattagg

SEQ ID NO: 397690 - DNA, 20 bp, Artificial Sequence
  chemically synthesized
gtgtgcccattcttcctaat

SEQ ID NO: 397691 - DNA, 20 bp, Artificial Sequence
  chemically synthesized
agtgtgcccattcttcctaa

SEQ ID NO: 397692 - DNA, 20 bp, Artificial Sequence
  chemically synthesized
gtcctgcctattaggaagaa

SEQ ID NO: 397693 - DNA, 20 bp, Artificial Sequence
  chemically synthesized
tcctgcctattaggaagaat

SEQ ID NO: 397694 - DNA, 20 bp, Artificial Sequence
  chemically synthesized
ttaggaagaatgggcacact

SEQ ID NO: 397695 - DNA, 20 bp, Artificial Sequence
  chemically synthesized
tcttttatcatttcataact

SEQ ID NO: 397696 - DNA, 20 bp, Artificial Sequence
  chemically synthesized
actgagttatgaaatgataa

SEQ ID NO: 397697 - DNA, 20 bp, Artificial Sequence
  chemically synthesized
ggccaaagaatgagacacag

SEQ ID NO: 397698 - DNA, 20 bp, Artificial Sequence
  chemically synthesized
aaggccaaagaatgagacac

SEQ ID NO: 397699 - DNA, 20 bp, Artificial Sequence
  chemically synthesized
gaaggccaaagaatgagaca

SEQ ID NO: 397700 - DNA, 20 bp, Artificial Sequence
  chemically synthesized
gactcctgtgtctcattctt

SEQ ID NO: 397701 - DNA, 20 bp, Artificial Sequence
  chemically synthesized
gtccctgaaggccaaagaat

SEQ ID NO: 397702 - DNA, 20 bp, Artificial Sequence
  chemically synthesized
gtgtctcattctttggcctt

SEQ ID NO: 397703 - DNA, 20 bp, Artificial Sequence
  chemically synthesized
accacagtccctgaaggcca

SEQ ID NO: 397704 - DNA, 20 bp, Artificial Sequence
  chemically synthesized
tgtctcattctttggccttc

SEQ ID NO: 397705 - DNA, 20 bp, Artificial Sequence
  chemically synthesized
gtctcattctttggccttca

SEQ ID NO: 397706 - DNA, 20 bp, Artificial Sequence
  chemically synthesized
aaaatcaccacagtccctga

SEQ ID NO: 397707 - DNA, 20 bp, Artificial Sequence
  chemically synthesized
caaaatcaccacagtccctg

SEQ ID NO: 397708 - DNA, 20 bp, Artificial Sequence
  chemically synthesized
tctttggccttcagggactg

SEQ ID NO: 397709 - DNA, 20 bp, Artificial Sequence
  chemically synthesized
cagacattgcaaaatcacca

SEQ ID NO: 397710 - DNA, 20 bp, Artificial Sequence
  chemically synthesized
ctgaagccctgggcaattca

SEQ ID NO: 397711 - DNA, 20 bp, Artificial Sequence
  chemically synthesized
tgcaatgtctgtgaattgcc

SEQ ID NO: 397712 - DNA, 20 bp, Artificial Sequence
  chemically synthesized
gcaatgtctgtgaattgccc

SEQ ID NO: 397713 - DNA, 20 bp, Artificial Sequence
  chemically synthesized
caatgtctgtgaattgccca

SEQ ID NO: 397714 - DNA, 20 bp, Artificial Sequence
  chemically synthesized
ctgtgaattgcccagggctt

SEQ ID NO: 397715 - DNA, 20 bp, Artificial Sequence
  chemically synthesized
accacagtcactgaagccct

SEQ ID NO: 397716 - DNA, 20 bp, Artificial Sequence
  chemically synthesized
caccacagtcactgaagccc

SEQ ID NO: 397717 - DNA, 20 bp, Artificial Sequence
  chemically synthesized
aactatcaccacagtcactg

SEQ ID NO: 397718 - DNA, 20 bp, Artificial Sequence
  chemically synthesized
gcccagggcttcagtgactg

SEQ ID NO: 397719 - DNA, 20 bp, Artificial Sequence
  chemically synthesized
ggcttcagtgactgtggtga

SEQ ID NO: 397720 - DNA, 20 bp, Artificial Sequence
  chemically synthesized
ctgttttagaactatcacca

SEQ ID NO: 397721 - DNA, 20 bp, Artificial Sequence
  chemically synthesized
ctgtggtgatagttctaaaa

SEQ ID NO: 397722 - DNA, 20 bp, Artificial Sequence
  chemically synthesized
tgtggtgatagttctaaaac

SEQ ID NO: 397723 - DNA, 20 bp, Artificial Sequence
  chemically synthesized
gtggtgatagttctaaaaca

SEQ ID NO: 397724 - DNA, 20 bp, Artificial Sequence
  chemically synthesized
aaagctgtgtgtccctgttt

SEQ ID NO: 397725 - DNA, 20 bp, Artificial Sequence
  chemically synthesized
agttctaaaacagggacaca

SEQ ID NO: 397726 - DNA, 20 bp, Artificial Sequence
  chemically synthesized
aaaacagggacacacagctt

SEQ ID NO: 397727 - DNA, 20 bp, Artificial Sequence
  chemically synthesized
aaacagggacacacagcttt

SEQ ID NO: 397728 - DNA, 20 bp, Artificial Sequence
  chemically synthesized
gggacacacagctttaggaa

SEQ ID NO: 397729 - DNA, 20 bp, Artificial Sequence
  chemically synthesized
atagactgaaactgttccta

SEQ ID NO: 397730 - DNA, 20 bp, Artificial Sequence
  chemically synthesized
cacagctttaggaacagttt

SEQ ID NO: 397731 - DNA, 20 bp, Artificial Sequence
  chemically synthesized
taggaacagtttcagtctat

SEQ ID NO: 397732 - DNA, 20 bp, Artificial Sequence
  chemically synthesized
agtacatatagtcagactta

SEQ ID NO: 397733 - DNA, 20 bp, Artificial Sequence
  chemically synthesized
caacaggaagtacatatagt

SEQ ID NO: 397734 - DNA, 20 bp, Artificial Sequence
  chemically synthesized
ttatcaacaggaagtacata

SEQ ID NO: 397735 - DNA, 20 bp, Artificial Sequence
  chemically synthesized
agcatgagtttatcaacagg

SEQ ID NO: 397736 - DNA, 20 bp, Artificial Sequence
  chemically synthesized
aaaagcatgagtttatcaac

SEQ ID NO: 397737 - DNA, 20 bp, Artificial Sequence
  chemically synthesized
caaaagcatgagtttatcaa

SEQ ID NO: 397738 - DNA, 20 bp, Artificial Sequence
  chemically synthesized
caaaagactgacaaaagcat

SEQ ID NO: 397739 - DNA, 20 bp, Artificial Sequence
  chemically synthesized
tgataaactcatgcttttgt

SEQ ID NO: 397740 - DNA, 20 bp, Artificial Sequence
  chemically synthesized
tattagcaaaagactgacaa

SEQ ID NO: 397741 - DNA, 20 bp, Artificial Sequence
  chemically synthesized
gtgtttttcagtattagcaa

SEQ ID NO: 397742 - DNA, 20 bp, Artificial Sequence
  chemically synthesized
tcatgagtgtttttcagtat

SEQ ID NO: 397743 - DNA, 20 bp, Artificial Sequence
  chemically synthesized
gatggttcatgagtgttttt

SEQ ID NO: 397744 - DNA, 20 bp, Artificial Sequence
  chemically synthesized
ggaaatggaggatggttcat

SEQ ID NO: 397745 - DNA, 20 bp, Artificial Sequence
  chemically synthesized
taataatgggaaatggagga

SEQ ID NO: 397746 - DNA, 20 bp, Artificial Sequence
  chemically synthesized
tgaataataatgggaaatgg

SEQ ID NO: 397747 - DNA, 20 bp, Artificial Sequence
  chemically synthesized
ttgaataataatgggaaatg

SEQ ID NO: 397748 - DNA, 20 bp, Artificial Sequence
  chemically synthesized
ccttgaataataatgggaaa

SEQ ID NO: 397749 - DNA, 20 bp, Artificial Sequence
  chemically synthesized
taaagtccttgaataataat

SEQ ID NO: 397750 - DNA, 20 bp, Artificial Sequence
  chemically synthesized
ctaaagtccttgaataataa

SEQ ID NO: 397751 - DNA, 20 bp, Artificial Sequence
  chemically synthesized
tccatttcccattattattc

SEQ ID NO: 397752 - DNA, 20 bp, Artificial Sequence
  chemically synthesized
ccatttcccattattattca

SEQ ID NO: 397753 - DNA, 20 bp, Artificial Sequence
  chemically synthesized
ccattattattcaaggactt

SEQ ID NO: 397754 - DNA, 20 bp, Artificial Sequence
  chemically synthesized
ctgagaactctgaatgtcta

SEQ ID NO: 397755 - DNA, 20 bp, Artificial Sequence
  chemically synthesized
attcaaggactttagacatt

SEQ ID NO: 397756 - DNA, 20 bp, Artificial Sequence
  chemically synthesized
tcaaggactttagacattca

SEQ ID NO: 397757 - DNA, 20 bp, Artificial Sequence
  chemically synthesized
ctttagacattcagagttct

SEQ ID NO: 397758 - DNA, 20 bp, Artificial Sequence
  chemically synthesized
ttcaaaagaaaaaattgtct

SEQ ID NO: 397759 - DNA, 20 bp, Artificial Sequence
  chemically synthesized
tcagacaattttttcttttg

SEQ ID NO: 397760 - DNA, 20 bp, Artificial Sequence
  chemically synthesized
agacaattttttcttttgaa

SEQ ID NO: 397761 - DNA, 20 bp, Artificial Sequence
  chemically synthesized
cacccacattttctcttcaa

SEQ ID NO: 397762 - DNA, 20 bp, Artificial Sequence
  chemically synthesized
tttcttttgaagagaaaatg

SEQ ID NO: 397763 - DNA, 20 bp, Artificial Sequence
  chemically synthesized
ttcttttgaagagaaaatgt

SEQ ID NO: 397764 - DNA, 20 bp, Artificial Sequence
  chemically synthesized
ttttgaagagaaaatgtggg

SEQ ID NO: 397765 - DNA, 20 bp, Artificial Sequence
  chemically synthesized
cacaaaacaaaaaagttgta

SEQ ID NO: 397766 - DNA, 20 bp, Artificial Sequence
  chemically synthesized
taataatacacaaaacaaaa

SEQ ID NO: 397767 - DNA, 20 bp, Artificial Sequence
  chemically synthesized
tttgttttgtgtattattat

SEQ ID NO: 397768 - DNA, 20 bp, Artificial Sequence
  chemically synthesized
cttttctatgtaacattaga

SEQ ID NO: 397769 - DNA, 20 bp, Artificial Sequence
  chemically synthesized
aattcttttctatgtaacat

SEQ ID NO: 397770 - DNA, 20 bp, Artificial Sequence
  chemically synthesized
agacactgtctaatgttaca

SEQ ID NO: 397771 - DNA, 20 bp, Artificial Sequence
  chemically synthesized
ctgtctaatgttacatagaa

SEQ ID NO: 397772 - DNA, 20 bp, Artificial Sequence
  chemically synthesized
aatgttacatagaaaagaat

SEQ ID NO: 397773 - DNA, 20 bp, Artificial Sequence
  chemically synthesized
acatagaaaagaattggttg

SEQ ID NO: 397774 - DNA, 20 bp, Artificial Sequence
  chemically synthesized
gaaaagaattggttgaagac

SEQ ID NO: 397775 - DNA, 20 bp, Artificial Sequence
  chemically synthesized
agaattggttgaagacaaga

SEQ ID NO: 397776 - DNA, 20 bp, Artificial Sequence
  chemically synthesized
ttggttgaagacaagaaaga

SEQ ID NO: 397777 - DNA, 20 bp, Artificial Sequence
  chemically synthesized
acaagaaagacagcgtctaa

SEQ ID NO: 397778 - DNA, 20 bp, Artificial Sequence
  chemically synthesized
ttctttattttatattctgt

SEQ ID NO: 397779 - DNA, 20 bp, Artificial Sequence
  chemically synthesized
gtctaacagaatataaaata

SEQ ID NO: 397780 - DNA, 20 bp, Artificial Sequence
  chemically synthesized
aataaagaaaaacaaaacca

SEQ ID NO: 397781 - DNA, 20 bp, Artificial Sequence
  chemically synthesized
tattaattatttgaatgctt

SEQ ID NO: 397782 - DNA, 20 bp, Artificial Sequence
  chemically synthesized
ttcaaataattaatatgaat

SEQ ID NO: 397783 - DNA, 20 bp, Artificial Sequence
  chemically synthesized
aataattaatatgaatgaga

SEQ ID NO: 397784 - DNA, 20 bp, Artificial Sequence
  chemically synthesized
ataattaatatgaatgagaa

SEQ ID NO: 397785 - DNA, 20 bp, Artificial Sequence
  chemically synthesized
tgaatgagaaaggtatcatt

SEQ ID NO: 397786 - DNA, 20 bp, Artificial Sequence
  chemically synthesized
atttggtttcgtttctactt

SEQ ID NO: 397787 - DNA, 20 bp, Artificial Sequence
  chemically synthesized
ggtttcgtttctactttggc

SEQ ID NO: 397788 - DNA, 20 bp, Artificial Sequence
  chemically synthesized
ctgaaactgtctagccaaag

SEQ ID NO: 397789 - DNA, 20 bp, Artificial Sequence
  chemically synthesized
gtactgaaactgtctagcca

SEQ ID NO: 397790 - DNA, 20 bp, Artificial Sequence
  chemically synthesized
tcgtttctactttggctaga

SEQ ID NO: 397791 - DNA, 20 bp, Artificial Sequence
  chemically synthesized
tcagaagtactgaaactgtc

SEQ ID NO: 397792 - DNA, 20 bp, Artificial Sequence
  chemically synthesized
ctactttggctagacagttt

SEQ ID NO: 397793 - DNA, 20 bp, Artificial Sequence
  chemically synthesized
agacttatgagaaaagtcag

SEQ ID NO: 397794 - DNA, 20 bp, Artificial Sequence
  chemically synthesized
aaaagacttatgagaaaagt

SEQ ID NO: 397795 - DNA, 20 bp, Artificial Sequence
  chemically synthesized
gtacttctgacttttctcat

SEQ ID NO: 397796 - DNA, 20 bp, Artificial Sequence
  chemically synthesized
gaaaaaaagacttatgagaa

SEQ ID NO: 397797 - DNA, 20 bp, Artificial Sequence
  chemically synthesized
tattagaaaaaaagacttat

SEQ ID NO: 397798 - DNA, 20 bp, Artificial Sequence
  chemically synthesized
tgcttaaaatattagaaaaa

SEQ ID NO: 397799 - DNA, 20 bp, Artificial Sequence
  chemically synthesized
gtctttttttctaatatttt

SEQ ID NO: 397800 - DNA, 20 bp, Artificial Sequence
  chemically synthesized
agaaacaatgcttaaaatat

SEQ ID NO: 397801 - DNA, 20 bp, Artificial Sequence
  chemically synthesized
agattaagtaagataatgaa

SEQ ID NO: 397802 - DNA, 20 bp, Artificial Sequence
  chemically synthesized
ttagattaagtaagataatg

SEQ ID NO: 397803 - DNA, 20 bp, Artificial Sequence
  chemically synthesized
ggaactgttttagattaagt

SEQ ID NO: 397804 - DNA, 20 bp, Artificial Sequence
  chemically synthesized
tgagggaactgttttagatt

SEQ ID NO: 397805 - DNA, 20 bp, Artificial Sequence
  chemically synthesized
ttatcttacttaatctaaaa

SEQ ID NO: 397806 - DNA, 20 bp, Artificial Sequence
  chemically synthesized
aggttttgagggaactgttt

SEQ ID NO: 397807 - DNA, 20 bp, Artificial Sequence
  chemically synthesized
gagaattaaaaaggttttga

SEQ ID NO: 397808 - DNA, 20 bp, Artificial Sequence
  chemically synthesized
agagaattaaaaaggttttg

SEQ ID NO: 397809 - DNA, 20 bp, Artificial Sequence
  chemically synthesized
aagagaattaaaaaggtttt

SEQ ID NO: 397810 - DNA, 20 bp, Artificial Sequence
  chemically synthesized
attttaaaagagaattaaaa

SEQ ID NO: 397811 - DNA, 20 bp, Artificial Sequence
  chemically synthesized
gattttaaaagagaattaaa

SEQ ID NO: 397812 - DNA, 20 bp, Artificial Sequence
  chemically synthesized
taaaagtagagattttaaaa

SEQ ID NO: 397813 - DNA, 20 bp, Artificial Sequence
  chemically synthesized
tataaaagtagagattttaa

SEQ ID NO: 397814 - DNA, 20 bp, Artificial Sequence
  chemically synthesized
ttttaaaagatataaaagta

SEQ ID NO: 397815 - DNA, 20 bp, Artificial Sequence
  chemically synthesized
atttttaaaagatataaaag

SEQ ID NO: 397816 - DNA, 20 bp, Artificial Sequence
  chemically synthesized
tatatttttaaaagatataa

SEQ ID NO: 397817 - DNA, 20 bp, Artificial Sequence
  chemically synthesized
gttgatgcctatatttttaa

SEQ ID NO: 397818 - DNA, 20 bp, Artificial Sequence
  chemically synthesized
ttttatatcttttaaaaata

SEQ ID NO: 397819 - DNA, 20 bp, Artificial Sequence
  chemically synthesized
tttatatcttttaaaaatat

SEQ ID NO: 397820 - DNA, 20 bp, Artificial Sequence
  chemically synthesized
agtaaaatttgttagtatta

SEQ ID NO: 397821 - DNA, 20 bp, Artificial Sequence
  chemically synthesized
ttttctatagtaaaatttgt

SEQ ID NO: 397822 - DNA, 20 bp, Artificial Sequence
  chemically synthesized
aatactaacaaattttacta

SEQ ID NO: 397823 - DNA, 20 bp, Artificial Sequence
  chemically synthesized
ggttctttcacaattttcta

SEQ ID NO: 397824 - DNA, 20 bp, Artificial Sequence
  chemically synthesized
tttactatagaaaattgtga

SEQ ID NO: 397825 - DNA, 20 bp, Artificial Sequence
  chemically synthesized
ttgtgaaagaaccaaaacaa

SEQ ID NO: 397826 - DNA, 20 bp, Artificial Sequence
  chemically synthesized
caacaagaggactgttgttt

SEQ ID NO: 397827 - DNA, 20 bp, Artificial Sequence
  chemically synthesized
gctcttgtggttacaacaag

SEQ ID NO: 397828 - DNA, 20 bp, Artificial Sequence
  chemically synthesized
agctcttgtggttacaacaa

SEQ ID NO: 397829 - DNA, 20 bp, Artificial Sequence
  chemically synthesized
taagctcttgtggttacaac

SEQ ID NO: 397830 - DNA, 20 bp, Artificial Sequence
  chemically synthesized
agtcctcttgttgtaaccac

SEQ ID NO: 397831 - DNA, 20 bp, Artificial Sequence
  chemically synthesized
tcctcttgttgtaaccacaa

SEQ ID NO: 397832 - DNA, 20 bp, Artificial Sequence
  chemically synthesized
aatgaattagtaagctcttg

SEQ ID NO: 397833 - DNA, 20 bp, Artificial Sequence
  chemically synthesized
tcttttaaaaatgaattagt

SEQ ID NO: 397834 - DNA, 20 bp, Artificial Sequence
  chemically synthesized
aatttcttttaaaaatgaat

SEQ ID NO: 397835 - DNA, 20 bp, Artificial Sequence
  chemically synthesized
gcttactaattcatttttaa

SEQ ID NO: 397836 - DNA, 20 bp, Artificial Sequence
  chemically synthesized
taaccaaaaggggaatgaat

SEQ ID NO: 397837 - DNA, 20 bp, Artificial Sequence
  chemically synthesized
gtaaccaaaaggggaatgaa

SEQ ID NO: 397838 - DNA, 20 bp, Artificial Sequence
  chemically synthesized
ttgcctattcattccccttt

SEQ ID NO: 397839 - DNA, 20 bp, Artificial Sequence
  chemically synthesized
agcaagaaggtaaccaaaag

SEQ ID NO: 397840 - DNA, 20 bp, Artificial Sequence
  chemically synthesized
gagcaagaaggtaaccaaaa

SEQ ID NO: 397841 - DNA, 20 bp, Artificial Sequence
  chemically synthesized
tgagcaagaaggtaaccaaa

SEQ ID NO: 397842 - DNA, 20 bp, Artificial Sequence
  chemically synthesized
ttgagcaagaaggtaaccaa

SEQ ID NO: 397843 - DNA, 20 bp, Artificial Sequence
  chemically synthesized
accttacttcttgagcaaga

SEQ ID NO: 397844 - DNA, 20 bp, Artificial Sequence
  chemically synthesized
ttttggttaccttcttgctc

SEQ ID NO: 397845 - DNA, 20 bp, Artificial Sequence
  chemically synthesized
taccttacttcttgagcaag

SEQ ID NO: 397846 - DNA, 20 bp, Artificial Sequence
  chemically synthesized
tggttaccttcttgctcaag

SEQ ID NO: 397847 - DNA, 20 bp, Artificial Sequence
  chemically synthesized
aagtaccttacttcttgagc

SEQ ID NO: 397848 - DNA, 20 bp, Artificial Sequence
  chemically synthesized
taccttcttgctcaagaagt

SEQ ID NO: 397849 - DNA, 20 bp, Artificial Sequence
  chemically synthesized
tgcaaagtaccttacttctt

SEQ ID NO: 397850 - DNA, 20 bp, Artificial Sequence
  chemically synthesized
accttcttgctcaagaagta

SEQ ID NO: 397851 - DNA, 20 bp, Artificial Sequence
  chemically synthesized
gaagtaaggtactttgcaaa

SEQ ID NO: 397852 - DNA, 20 bp, Artificial Sequence
  chemically synthesized
gatcaactatgccatttgca

SEQ ID NO: 397853 - DNA, 20 bp, Artificial Sequence
  chemically synthesized
aaggtactttgcaaatggca

SEQ ID NO: 397854 - DNA, 20 bp, Artificial Sequence
  chemically synthesized
gcaaatggcatagttgatcc

SEQ ID NO: 397855 - DNA, 20 bp, Artificial Sequence
  chemically synthesized
gcatagttgatcccagcacc

SEQ ID NO: 397856 - DNA, 20 bp, Artificial Sequence
  chemically synthesized
gatgtatatatctaggtgct

SEQ ID NO: 397857 - DNA, 20 bp, Artificial Sequence
  chemically synthesized
agatgtatatatctaggtgc

SEQ ID NO: 397858 - DNA, 20 bp, Artificial Sequence
  chemically synthesized
gattagagatgtatatatct

SEQ ID NO: 397859 - DNA, 20 bp, Artificial Sequence
  chemically synthesized
tgattagagatgtatatatc

SEQ ID NO: 397860 - DNA, 20 bp, Artificial Sequence
  chemically synthesized
agatatatacatctctaatc

SEQ ID NO: 397861 - DNA, 20 bp, Artificial Sequence
  chemically synthesized
atagaaaaggcacttgatta

SEQ ID NO: 397862 - DNA, 20 bp, Artificial Sequence
  chemically synthesized
gaatagaaaaggcacttgat

SEQ ID NO: 397863 - DNA, 20 bp, Artificial Sequence
  chemically synthesized
ttttaccttctgaatagaaa

SEQ ID NO: 397864 - DNA, 20 bp, Artificial Sequence
  chemically synthesized
aatcaagtgccttttctatt

SEQ ID NO: 397865 - DNA, 20 bp, Artificial Sequence
  chemically synthesized
cttttaccttctgaatagaa

SEQ ID NO: 397866 - DNA, 20 bp, Artificial Sequence
  chemically synthesized
caagtgccttttctattcag

SEQ ID NO: 397867 - DNA, 20 bp, Artificial Sequence
  chemically synthesized
aagtgccttttctattcaga

SEQ ID NO: 397868 - DNA, 20 bp, Artificial Sequence
  chemically synthesized
ctacacttttaccttctgaa

SEQ ID NO: 397869 - DNA, 20 bp, Artificial Sequence
  chemically synthesized
cttttctattcagaaggtaa

SEQ ID NO: 397870 - DNA, 20 bp, Artificial Sequence
  chemically synthesized
ctattcagaaggtaaaagtg

SEQ ID NO: 397871 - DNA, 20 bp, Artificial Sequence
  chemically synthesized
tattcagaaggtaaaagtgt

SEQ ID NO: 397872 - DNA, 20 bp, Artificial Sequence
  chemically synthesized
taaaagtgtaggtgaattat

SEQ ID NO: 397873 - DNA, 20 bp, Artificial Sequence
  chemically synthesized
tgataagatcttattatatt

SEQ ID NO: 397874 - DNA, 20 bp, Artificial Sequence
  chemically synthesized
aattatcagcccaatataat

SEQ ID NO: 397875 - DNA, 20 bp, Artificial Sequence
  chemically synthesized
ctgataagatcttattatat

SEQ ID NO: 397876 - DNA, 20 bp, Artificial Sequence
  chemically synthesized
ccaatataataagatcttat

SEQ ID NO: 397877 - DNA, 20 bp, Artificial Sequence
  chemically synthesized
tccactagtgacacactgat

SEQ ID NO: 397878 - DNA, 20 bp, Artificial Sequence
  chemically synthesized
agatcttatcagtgtgtcac

SEQ ID NO: 397879 - DNA, 20 bp, Artificial Sequence
  chemically synthesized
tcttatcagtgtgtcactag

SEQ ID NO: 397880 - DNA, 20 bp, Artificial Sequence
  chemically synthesized
ttatcagtgtgtcactagtg

SEQ ID NO: 397881 - DNA, 20 bp, Artificial Sequence
  chemically synthesized
tatcagtgtgtcactagtgg

SEQ ID NO: 397882 - DNA, 20 bp, Artificial Sequence
  chemically synthesized
atcagtgtgtcactagtgga

SEQ ID NO: 397883 - DNA, 20 bp, Artificial Sequence
  chemically synthesized
agaacctgggcaccctccac

SEQ ID NO: 397884 - DNA, 20 bp, Artificial Sequence
  chemically synthesized
tgtcactagtggagggtgcc

SEQ ID NO: 397885 - DNA, 20 bp, Artificial Sequence
  chemically synthesized
gtcactagtggagggtgccc

SEQ ID NO: 397886 - DNA, 20 bp, Artificial Sequence
  chemically synthesized
gtggagggtgcccaggttct

SEQ ID NO: 397887 - DNA, 20 bp, Artificial Sequence
  chemically synthesized
gatcaagacaccaagaacct

SEQ ID NO: 397888 - DNA, 20 bp, Artificial Sequence
  chemically synthesized
tgatcaagacaccaagaacc

SEQ ID NO: 397889 - DNA, 20 bp, Artificial Sequence
  chemically synthesized
aattctttgatcaagacacc

SEQ ID NO: 397890 - DNA, 20 bp, Artificial Sequence
  chemically synthesized
ggttcttggtgtcttgatca

SEQ ID NO: 397891 - DNA, 20 bp, Artificial Sequence
  chemically synthesized
ttttgtccaattctttgatc

SEQ ID NO: 397892 - DNA, 20 bp, Artificial Sequence
  chemically synthesized
tggtgtcttgatcaaagaat

SEQ ID NO: 397893 - DNA, 20 bp, Artificial Sequence
  chemically synthesized
ttggacaaaatgcacaaaca

SEQ ID NO: 397894 - DNA, 20 bp, Artificial Sequence
  chemically synthesized
acaaaatgcacaaacaaagc

SEQ ID NO: 397895 - DNA, 20 bp, Artificial Sequence
  chemically synthesized
caaaatgcacaaacaaagca

SEQ ID NO: 397896 - DNA, 20 bp, Artificial Sequence
  chemically synthesized
aatgcacaaacaaagcaagg

SEQ ID NO: 397897 - DNA, 20 bp, Artificial Sequence
  chemically synthesized
atgcacaaacaaagcaagga

SEQ ID NO: 397898 - DNA, 20 bp, Artificial Sequence
  chemically synthesized
aacaaagcaaggaaggaatg

SEQ ID NO: 397899 - DNA, 20 bp, Artificial Sequence
  chemically synthesized
acaaagcaaggaaggaatga

SEQ ID NO: 397900 - DNA, 20 bp, Artificial Sequence
  chemically synthesized
caaagcaaggaaggaatgaa

SEQ ID NO: 397901 - DNA, 20 bp, Artificial Sequence
  chemically synthesized
agggatttatttaaaatgaa

SEQ ID NO: 397902 - DNA, 20 bp, Artificial Sequence
  chemically synthesized
aaaatgaaaagtacatgcca

SEQ ID NO: 397903 - DNA, 20 bp, Artificial Sequence
  chemically synthesized
aaaagtacatgccatagtgt

SEQ ID NO: 397904 - DNA, 20 bp, Artificial Sequence
  chemically synthesized
ctcagcccgctctcacacta

SEQ ID NO: 397905 - DNA, 20 bp, Artificial Sequence
  chemically synthesized
aagtacatgccatagtgtga

SEQ ID NO: 397906 - DNA, 20 bp, Artificial Sequence
  chemically synthesized
tacatgccatagtgtgagag

SEQ ID NO: 397907 - DNA, 20 bp, Artificial Sequence
  chemically synthesized
acatgccatagtgtgagagc

SEQ ID NO: 397908 - DNA, 20 bp, Artificial Sequence
  chemically synthesized
ccatagtgtgagagcgggct

SEQ ID NO: 397909 - DNA, 20 bp, Artificial Sequence
  chemically synthesized
tagtgtgagagcgggctgag

SEQ ID NO: 397910 - DNA, 20 bp, Artificial Sequence
  chemically synthesized
tgtgagagcgggctgagcag

SEQ ID NO: 397911 - DNA, 20 bp, Artificial Sequence
  chemically synthesized
tgggcacttgagccgctgct

SEQ ID NO: 397912 - DNA, 20 bp, Artificial Sequence
  chemically synthesized
agcgggctgagcagcggctc

SEQ ID NO: 397913 - DNA, 20 bp, Artificial Sequence
  chemically synthesized
tgagcagcggctcaagtgcc

SEQ ID NO: 397914 - DNA, 20 bp, Artificial Sequence
  chemically synthesized
ttttctttatctgggcactt

SEQ ID NO: 397915 - DNA, 20 bp, Artificial Sequence
  chemically synthesized
gcggctcaagtgcccagata

SEQ ID NO: 397916 - DNA, 20 bp, Artificial Sequence
  chemically synthesized
ccagaagattttctttatct

SEQ ID NO: 397917 - DNA, 20 bp, Artificial Sequence
  chemically synthesized
cccagaagattttctttatc

SEQ ID NO: 397918 - DNA, 20 bp, Artificial Sequence
  chemically synthesized
cccagataaagaaaatcttc

SEQ ID NO: 397919 - DNA, 20 bp, Artificial Sequence
  chemically synthesized
ccagataaagaaaatcttct

SEQ ID NO: 397920 - DNA, 20 bp, Artificial Sequence
  chemically synthesized
cagataaagaaaatcttctg

SEQ ID NO: 397921 - DNA, 20 bp, Artificial Sequence
  chemically synthesized
agagggtatttggaccccag

SEQ ID NO: 397922 - DNA, 20 bp, Artificial Sequence
  chemically synthesized
tgtagagggtatttggaccc

SEQ ID NO: 397923 - DNA, 20 bp, Artificial Sequence
  chemically synthesized
ggaaacctgtagagggtatt

SEQ ID NO: 397924 - DNA, 20 bp, Artificial Sequence
  chemically synthesized
tggggtccaaataccctcta

SEQ ID NO: 397925 - DNA, 20 bp, Artificial Sequence
  chemically synthesized
ggggtccaaataccctctac

SEQ ID NO: 397926 - DNA, 20 bp, Artificial Sequence
  chemically synthesized
gccaatgggaaacctgtaga

SEQ ID NO: 397927 - DNA, 20 bp, Artificial Sequence
  chemically synthesized
ggccaatgggaaacctgtag

SEQ ID NO: 397928 - DNA, 20 bp, Artificial Sequence
  chemically synthesized
tggccaatgggaaacctgta

SEQ ID NO: 397929 - DNA, 20 bp, Artificial Sequence
  chemically synthesized
agtggccaatgggaaacctg

SEQ ID NO: 397930 - DNA, 20 bp, Artificial Sequence
  chemically synthesized
accctctacaggtttcccat

SEQ ID NO: 397931 - DNA, 20 bp, Artificial Sequence
  chemically synthesized
gtgagcatgaagtggccaat

SEQ ID NO: 397932 - DNA, 20 bp, Artificial Sequence
  chemically synthesized
ggtgagcatgaagtggccaa

SEQ ID NO: 397933 - DNA, 20 bp, Artificial Sequence
  chemically synthesized
tacgtggggtgagcatgaag

SEQ ID NO: 397934 - DNA, 20 bp, Artificial Sequence
  chemically synthesized
atttacgtggggtgagcatg

SEQ ID NO: 397935 - DNA, 20 bp, Artificial Sequence
  chemically synthesized
ccacttcatttacgtggggt

SEQ ID NO: 397936 - DNA, 20 bp, Artificial Sequence
  chemically synthesized
gccaccacttcatttacgtg

SEQ ID NO: 397937 - DNA, 20 bp, Artificial Sequence
  chemically synthesized
ggccaccacttcatttacgt

SEQ ID NO: 397938 - DNA, 20 bp, Artificial Sequence
  chemically synthesized
aggccaccacttcatttacg

SEQ ID NO: 397939 - DNA, 20 bp, Artificial Sequence
  chemically synthesized
atgctcaccccacgtaaatg

SEQ ID NO: 397940 - DNA, 20 bp, Artificial Sequence
  chemically synthesized
ctcaccccacgtaaatgaag

SEQ ID NO: 397941 - DNA, 20 bp, Artificial Sequence
  chemically synthesized
accccacgtaaatgaagtgg

SEQ ID NO: 397942 - DNA, 20 bp, Artificial Sequence
  chemically synthesized
atgaagtggtggcctgcaat

SEQ ID NO: 397943 - DNA, 20 bp, Artificial Sequence
  chemically synthesized
caaccaatcagaccaattgc

SEQ ID NO: 397944 - DNA, 20 bp, Artificial Sequence
  chemically synthesized
acaaccaatcagaccaattg

SEQ ID NO: 397945 - DNA, 20 bp, Artificial Sequence
  chemically synthesized
tggcctgcaattggtctgat

SEQ ID NO: 397946 - DNA, 20 bp, Artificial Sequence
  chemically synthesized
ggttgctttccacaaccaat

SEQ ID NO: 397947 - DNA, 20 bp, Artificial Sequence
  chemically synthesized
gcaattggtctgattggttg

SEQ ID NO: 397948 - DNA, 20 bp, Artificial Sequence
  chemically synthesized
ttggtctgattggttgtgga

SEQ ID NO: 397949 - DNA, 20 bp, Artificial Sequence
  chemically synthesized
ggttgtggaaagcaaccaat

SEQ ID NO: 397950 - DNA, 20 bp, Artificial Sequence
  chemically synthesized
ttgtggaaagcaaccaatca

SEQ ID NO: 397951 - DNA, 20 bp, Artificial Sequence
  chemically synthesized
tgtggaaagcaaccaatcag

SEQ ID NO: 397952 - DNA, 20 bp, Artificial Sequence
  chemically synthesized
actctacttcagcctctgat

SEQ ID NO: 397953 - DNA, 20 bp, Artificial Sequence
  chemically synthesized
aagcaaccaatcagaggctg

SEQ ID NO: 397954 - DNA, 20 bp, Artificial Sequence
  chemically synthesized
caaccaatcagaggctgaag

SEQ ID NO: 397955 - DNA, 20 bp, Artificial Sequence
  chemically synthesized
accaatcagaggctgaagta

SEQ ID NO: 397956 - DNA, 20 bp, Artificial Sequence
  chemically synthesized
tgtcctatgtaactctactt

SEQ ID NO: 397957 - DNA, 20 bp, Artificial Sequence
  chemically synthesized
gaggctgaagtagagttaca

SEQ ID NO: 397958 - DNA, 20 bp, Artificial Sequence
  chemically synthesized
aggctgaagtagagttacat

SEQ ID NO: 397959 - DNA, 20 bp, Artificial Sequence
  chemically synthesized
aatcagatgtttgcacagga

SEQ ID NO: 397960 - DNA, 20 bp, Artificial Sequence
  chemically synthesized
ccaatcagatgtttgcacag

SEQ ID NO: 397961 - DNA, 20 bp, Artificial Sequence
  chemically synthesized
aaccaatcagatgtttgcac

SEQ ID NO: 397962 - DNA, 20 bp, Artificial Sequence
  chemically synthesized
caaccaatcagatgtttgca

SEQ ID NO: 397963 - DNA, 20 bp, Artificial Sequence
  chemically synthesized
ctcctgtgcaaacatctgat

SEQ ID NO: 397964 - DNA, 20 bp, Artificial Sequence
  chemically synthesized
ggttgctttttgcaaccaat

SEQ ID NO: 397965 - DNA, 20 bp, Artificial Sequence
  chemically synthesized
aacatctgattggttgcaaa

SEQ ID NO: 397966 - DNA, 20 bp, Artificial Sequence
  chemically synthesized
ggttgcaaaaagcaaccaat

SEQ ID NO: 397967 - DNA, 20 bp, Artificial Sequence
  chemically synthesized
ttgcaaaaagcaaccaatca

SEQ ID NO: 397968 - DNA, 20 bp, Artificial Sequence
  chemically synthesized
tgcaaaaagcaaccaatcag

SEQ ID NO: 397969 - DNA, 20 bp, Artificial Sequence
  chemically synthesized
acttcaccttagcctctgat

SEQ ID NO: 397970 - DNA, 20 bp, Artificial Sequence
  chemically synthesized
aaagcaaccaatcagaggct

SEQ ID NO: 397971 - DNA, 20 bp, Artificial Sequence
  chemically synthesized
aagcaaccaatcagaggcta

SEQ ID NO: 397972 - DNA, 20 bp, Artificial Sequence
  chemically synthesized
accaatcagaggctaaggtg

SEQ ID NO: 397973 - DNA, 20 bp, Artificial Sequence
  chemically synthesized
gcaactttgtaacttcacct

SEQ ID NO: 397974 - DNA, 20 bp, Artificial Sequence
  chemically synthesized
gaggctaaggtgaagttaca

SEQ ID NO: 397975 - DNA, 20 bp, Artificial Sequence
  chemically synthesized
caaagttgcacttctgtgca

SEQ ID NO: 397976 - DNA, 20 bp, Artificial Sequence
  chemically synthesized
cgggcccagtctttgcacag

SEQ ID NO: 397977 - DNA, 20 bp, Artificial Sequence
  chemically synthesized
ttgcgggcccagtctttgca

SEQ ID NO: 397978 - DNA, 20 bp, Artificial Sequence
  chemically synthesized
ttgcacttctgtgcaaagac

SEQ ID NO: 397979 - DNA, 20 bp, Artificial Sequence
  chemically synthesized
tgcacttctgtgcaaagact

SEQ ID NO: 397980 - DNA, 20 bp, Artificial Sequence
  chemically synthesized
aatcagactgattgcgggcc

SEQ ID NO: 397981 - DNA, 20 bp, Artificial Sequence
  chemically synthesized
gcaaagactgggcccgcaat

SEQ ID NO: 397982 - DNA, 20 bp, Artificial Sequence
  chemically synthesized
caaccaatcagactgattgc

SEQ ID NO: 397983 - DNA, 20 bp, Artificial Sequence
  chemically synthesized
ccaaccaatcagactgattg

SEQ ID NO: 397984 - DNA, 20 bp, Artificial Sequence
  chemically synthesized
gggcccgcaatcagtctgat

SEQ ID NO: 397985 - DNA, 20 bp, Artificial Sequence
  chemically synthesized
ccgcaatcagtctgattggt

SEQ ID NO: 397986 - DNA, 20 bp, Artificial Sequence
  chemically synthesized
cgcaatcagtctgattggtt

SEQ ID NO: 397987 - DNA, 20 bp, Artificial Sequence
  chemically synthesized
attggctgttcccaaccaat

SEQ ID NO: 397988 - DNA, 20 bp, Artificial Sequence
  chemically synthesized
tcagtctgattggttgggaa

SEQ ID NO: 397989 - DNA, 20 bp, Artificial Sequence
  chemically synthesized
ctgtgtagcagatgggaaat

SEQ ID NO: 397990 - DNA, 20 bp, Artificial Sequence
  chemically synthesized
accttttctgtgtagcagat

SEQ ID NO: 397991 - DNA, 20 bp, Artificial Sequence
  chemically synthesized
caccttttctgtgtagcaga

SEQ ID NO: 397992 - DNA, 20 bp, Artificial Sequence
  chemically synthesized
ccaatttcccatctgctaca

SEQ ID NO: 397993 - DNA, 20 bp, Artificial Sequence
  chemically synthesized
ctcccaccttttctgtgtag

SEQ ID NO: 397994 - DNA, 20 bp, Artificial Sequence
  chemically synthesized
ttcccatctgctacacagaa

SEQ ID NO: 397995 - DNA, 20 bp, Artificial Sequence
  chemically synthesized
aacctcccaccttttctgtg

SEQ ID NO: 397996 - DNA, 20 bp, Artificial Sequence
  chemically synthesized
tcccatctgctacacagaaa

SEQ ID NO: 397997 - DNA, 20 bp, Artificial Sequence
  chemically synthesized
catctgctacacagaaaagg

SEQ ID NO: 397998 - DNA, 20 bp, Artificial Sequence
  chemically synthesized
atctgctacacagaaaaggt

SEQ ID NO: 397999 - DNA, 20 bp, Artificial Sequence
  chemically synthesized
ctgctacacagaaaaggtgg

SEQ ID NO: 398000 - DNA, 20 bp, Artificial Sequence
  chemically synthesized
tgctacacagaaaaggtggg

SEQ ID NO: 398001 - DNA, 20 bp, Artificial Sequence
  chemically synthesized
gaaaaggtgggaggtttgca

SEQ ID NO: 398002 - DNA, 20 bp, Artificial Sequence
  chemically synthesized
aaaaggtgggaggtttgcaa

SEQ ID NO: 398003 - DNA, 20 bp, Artificial Sequence
  chemically synthesized
aaaggtgggaggtttgcaaa

SEQ ID NO: 398004 - DNA, 20 bp, Artificial Sequence
  chemically synthesized
aggtgggaggtttgcaaagg

SEQ ID NO: 398005 - DNA, 20 bp, Artificial Sequence
  chemically synthesized
tgggaggtttgcaaagggag

SEQ ID NO: 398006 - DNA, 20 bp, Artificial Sequence
  chemically synthesized
tttgcaaagggagtagcctc

SEQ ID NO: 398007 - DNA, 20 bp, Artificial Sequence
  chemically synthesized
ctaagtaacataaggaccag

SEQ ID NO: 398008 - DNA, 20 bp, Artificial Sequence
  chemically synthesized
cctaagtaacataaggacca

SEQ ID NO: 398009 - DNA, 20 bp, Artificial Sequence
  chemically synthesized
cccctaagtaacataaggac

SEQ ID NO: 398010 - DNA, 20 bp, Artificial Sequence
  chemically synthesized
ttccacccctaagtaacata

SEQ ID NO: 398011 - DNA, 20 bp, Artificial Sequence
  chemically synthesized
tttccacccctaagtaacat

SEQ ID NO: 398012 - DNA, 20 bp, Artificial Sequence
  chemically synthesized
cctctggtccttatgttact

SEQ ID NO: 398013 - DNA, 20 bp, Artificial Sequence
  chemically synthesized
ctctggtccttatgttactt

SEQ ID NO: 398014 - DNA, 20 bp, Artificial Sequence
  chemically synthesized
tctggtccttatgttactta

SEQ ID NO: 398015 - DNA, 20 bp, Artificial Sequence
  chemically synthesized
ctggtccttatgttacttag

SEQ ID NO: 398016 - DNA, 20 bp, Artificial Sequence
  chemically synthesized
gtccttatgttacttagggg

SEQ ID NO: 398017 - DNA, 20 bp, Artificial Sequence
  chemically synthesized
aaccctaactttccacccct

SEQ ID NO: 398018 - DNA, 20 bp, Artificial Sequence
  chemically synthesized
ttatgttacttaggggtgga

SEQ ID NO: 398019 - DNA, 20 bp, Artificial Sequence
  chemically synthesized
gttacttaggggtggaaagt

SEQ ID NO: 398020 - DNA, 20 bp, Artificial Sequence
  chemically synthesized
ttacttaggggtggaaagtt

SEQ ID NO: 398021 - DNA, 20 bp, Artificial Sequence
  chemically synthesized
tacttaggggtggaaagtta

SEQ ID NO: 398022 - DNA, 20 bp, Artificial Sequence
  chemically synthesized
gaaagttagggttttgcctt

SEQ ID NO: 398023 - DNA, 20 bp, Artificial Sequence
  chemically synthesized
ttagggttttgccttcagtt

SEQ ID NO: 398024 - DNA, 20 bp, Artificial Sequence
  chemically synthesized
cttccctaggactaaactga

SEQ ID NO: 398025 - DNA, 20 bp, Artificial Sequence
  chemically synthesized
acttccctaggactaaactg

SEQ ID NO: 398026 - DNA, 20 bp, Artificial Sequence
  chemically synthesized
ttttgccttcagtttagtcc

SEQ ID NO: 398027 - DNA, 20 bp, Artificial Sequence
  chemically synthesized
tttgccttcagtttagtcct

SEQ ID NO: 398028 - DNA, 20 bp, Artificial Sequence
  chemically synthesized
ttgccttcagtttagtccta

SEQ ID NO: 398029 - DNA, 20 bp, Artificial Sequence
  chemically synthesized
ccttcagtttagtcctaggg

SEQ ID NO: 398030 - DNA, 20 bp, Artificial Sequence
  chemically synthesized
catttcacgctgacttccct

SEQ ID NO: 398031 - DNA, 20 bp, Artificial Sequence
  chemically synthesized
cagtttagtcctagggaagt

SEQ ID NO: 398032 - DNA, 20 bp, Artificial Sequence
  chemically synthesized
ccatttcacgctgacttccc

SEQ ID NO: 398033 - DNA, 20 bp, Artificial Sequence
  chemically synthesized
ctagggaagtcagcgtgaaa

SEQ ID NO: 398034 - DNA, 20 bp, Artificial Sequence
  chemically synthesized
aagtcagcgtgaaatggcct

SEQ ID NO: 398035 - DNA, 20 bp, Artificial Sequence
  chemically synthesized
agtcagcgtgaaatggcctt

SEQ ID NO: 398036 - DNA, 20 bp, Artificial Sequence
  chemically synthesized
gtctggaggaagggaaccta

SEQ ID NO: 398037 - DNA, 20 bp, Artificial Sequence
  chemically synthesized
ggtctggaggaagggaacct

SEQ ID NO: 398038 - DNA, 20 bp, Artificial Sequence
  chemically synthesized
ggccttaggttcccttcctc

SEQ ID NO: 398039 - DNA, 20 bp, Artificial Sequence
  chemically synthesized
gagaatagggtctggaggaa

SEQ ID NO: 398040 - DNA, 20 bp, Artificial Sequence
  chemically synthesized
ggagaatagggtctggagga

SEQ ID NO: 398041 - DNA, 20 bp, Artificial Sequence
  chemically synthesized
aggagaatagggtctggagg

SEQ ID NO: 398042 - DNA, 20 bp, Artificial Sequence
  chemically synthesized
ggcaggagaatagggtctgg

SEQ ID NO: 398043 - DNA, 20 bp, Artificial Sequence
  chemically synthesized
aggcaggagaatagggtctg

SEQ ID NO: 398044 - DNA, 20 bp, Artificial Sequence
  chemically synthesized
tgaggcaggagaatagggtc

SEQ ID NO: 398045 - DNA, 20 bp, Artificial Sequence
  chemically synthesized
acatttgaggcaggagaata

SEQ ID NO: 398046 - DNA, 20 bp, Artificial Sequence
  chemically synthesized
cacatttgaggcaggagaat

SEQ ID NO: 398047 - DNA, 20 bp, Artificial Sequence
  chemically synthesized
acacatttgaggcaggagaa

SEQ ID NO: 398048 - DNA, 20 bp, Artificial Sequence
  chemically synthesized
atatcacacatttgaggcag

SEQ ID NO: 398049 - DNA, 20 bp, Artificial Sequence
  chemically synthesized
aaatatcacacatttgaggc

SEQ ID NO: 398050 - DNA, 20 bp, Artificial Sequence
  chemically synthesized
aaaatatcacacatttgagg

SEQ ID NO: 398051 - DNA, 20 bp, Artificial Sequence
  chemically synthesized
aaaaaaatatcacacatttg

SEQ ID NO: 398052 - DNA, 20 bp, Artificial Sequence
  chemically synthesized
gaaaaaaatatcacacattt

SEQ ID NO: 398053 - DNA, 20 bp, Artificial Sequence
  chemically synthesized
tttttttttttttttttttc

SEQ ID NO: 398054 - DNA, 20 bp, Artificial Sequence
  chemically synthesized
aaaaaaaaaaaaaaaaaaaa

SEQ ID NO: 398055 - DNA, 20 bp, Artificial Sequence
  chemically synthesized
aaaaaaaaaaaaaaaaaaag

SEQ ID NO: 398056 - DNA, 20 bp, Artificial Sequence
  chemically synthesized
aaaaaaaaaaaaaaaagaag

SEQ ID NO: 398057 - DNA, 20 bp, Artificial Sequence
  chemically synthesized
aaaaaaaaagaagaagaaaa

SEQ ID NO: 398058 - DNA, 20 bp, Artificial Sequence
  chemically synthesized
aagaagaagaaaaaagaaaa

SEQ ID NO: 398059 - DNA, 20 bp, Artificial Sequence
  chemically synthesized
aagaaaaaagaaaaaagaaa

SEQ ID NO: 398060 - DNA, 20 bp, Artificial Sequence
  chemically synthesized
aagaaaaagaaaaaattcct

SEQ ID NO: 398061 - DNA, 20 bp, Artificial Sequence
  chemically synthesized
agaaaaagaaaaaattcctc

SEQ ID NO: 398062 - DNA, 20 bp, Artificial Sequence
  chemically synthesized
gaaaaagaaaaaattcctca

SEQ ID NO: 398063 - DNA, 20 bp, Artificial Sequence
  chemically synthesized
acctggtgcagaggtccctg

SEQ ID NO: 398064 - DNA, 20 bp, Artificial Sequence
  chemically synthesized
cacctggtgcagaggtccct

SEQ ID NO: 398065 - DNA, 20 bp, Artificial Sequence
  chemically synthesized
ttcctcagggacctctgcac

SEQ ID NO: 398066 - DNA, 20 bp, Artificial Sequence
  chemically synthesized
tcctcagggacctctgcacc

SEQ ID NO: 398067 - DNA, 20 bp, Artificial Sequence
  chemically synthesized
ttttagcacacctggtgcag

SEQ ID NO: 398068 - DNA, 20 bp, Artificial Sequence
  chemically synthesized
gttttagcacacctggtgca

SEQ ID NO: 398069 - DNA, 20 bp, Artificial Sequence
  chemically synthesized
ctgttttagcacacctggtg

SEQ ID NO: 398070 - DNA, 20 bp, Artificial Sequence
  chemically synthesized
ttgctctgttttagcacacc

SEQ ID NO: 398071 - DNA, 20 bp, Artificial Sequence
  chemically synthesized
ctgcaccaggtgtgctaaaa

SEQ ID NO: 398072 - DNA, 20 bp, Artificial Sequence
  chemically synthesized
gcaccaggtgtgctaaaaca

SEQ ID NO: 398073 - DNA, 20 bp, Artificial Sequence
  chemically synthesized
tttcatgtgttgctctgttt

SEQ ID NO: 398074 - DNA, 20 bp, Artificial Sequence
  chemically synthesized
tttgaaaaattaggaaaagg

SEQ ID NO: 398075 - DNA, 20 bp, Artificial Sequence
  chemically synthesized
aattttgaaaaattaggaaa

SEQ ID NO: 398076 - DNA, 20 bp, Artificial Sequence
  chemically synthesized
aaattttgaaaaattaggaa

SEQ ID NO: 398077 - DNA, 20 bp, Artificial Sequence
  chemically synthesized
atttaaaattttgaaaaatt

SEQ ID NO: 398078 - DNA, 20 bp, Artificial Sequence
  chemically synthesized
aatttaaaattttgaaaaat

SEQ ID NO: 398079 - DNA, 20 bp, Artificial Sequence
  chemically synthesized
tttttttattttaatacttt

SEQ ID NO: 398080 - DNA, 20 bp, Artificial Sequence
  chemically synthesized
ttttttattttaatactttt

SEQ ID NO: 398081 - DNA, 20 bp, Artificial Sequence
  chemically synthesized
tttttattttaatacttttg

SEQ ID NO: 398082 - DNA, 20 bp, Artificial Sequence
  chemically synthesized
ttttattttaatacttttgg

SEQ ID NO: 398083 - DNA, 20 bp, Artificial Sequence
  chemically synthesized
aaaaccacctgttcccccaa

SEQ ID NO: 398084 - DNA, 20 bp, Artificial Sequence
  chemically synthesized
ttttaatacttttgggggaa

SEQ ID NO: 398085 - DNA, 20 bp, Artificial Sequence
  chemically synthesized
tttaatacttttgggggaac

SEQ ID NO: 398086 - DNA, 20 bp, Artificial Sequence
  chemically synthesized
aatacttttgggggaacagg

SEQ ID NO: 398087 - DNA, 20 bp, Artificial Sequence
  chemically synthesized
ttgggggaacaggtggtttt

SEQ ID NO: 398088 - DNA, 20 bp, Artificial Sequence
  chemically synthesized
acaggtggtttttggttacc

SEQ ID NO: 398089 - DNA, 20 bp, Artificial Sequence
  chemically synthesized
caggtggtttttggttacct

SEQ ID NO: 398090 - DNA, 20 bp, Artificial Sequence
  chemically synthesized
tggtttttggttacctgggt

SEQ ID NO: 398091 - DNA, 20 bp, Artificial Sequence
  chemically synthesized
caccactaaagaacttaccc

SEQ ID NO: 398092 - DNA, 20 bp, Artificial Sequence
  chemically synthesized
tcaccactaaagaacttacc

SEQ ID NO: 398093 - DNA, 20 bp, Artificial Sequence
  chemically synthesized
ggttacctgggtaagttctt

SEQ ID NO: 398094 - DNA, 20 bp, Artificial Sequence
  chemically synthesized
tacctgggtaagttctttag

SEQ ID NO: 398095 - DNA, 20 bp, Artificial Sequence
  chemically synthesized
aatctcggaaatcaccacta

SEQ ID NO: 398096 - DNA, 20 bp, Artificial Sequence
  chemically synthesized
gttctttagtggtgatttcc

SEQ ID NO: 398097 - DNA, 20 bp, Artificial Sequence
  chemically synthesized
agtggtgatttccgagattt

SEQ ID NO: 398098 - DNA, 20 bp, Artificial Sequence
  chemically synthesized
tgatgggtgcaccaaaatct

SEQ ID NO: 398099 - DNA, 20 bp, Artificial Sequence
  chemically synthesized
ttttggtgcacccatcacct

SEQ ID NO: 398100 - DNA, 20 bp, Artificial Sequence
  chemically synthesized
gtgtatacttctcaggtgat

SEQ ID NO: 398101 - DNA, 20 bp, Artificial Sequence
  chemically synthesized
ggtgtatacttctcaggtga

SEQ ID NO: 398102 - DNA, 20 bp, Artificial Sequence
  chemically synthesized
tggtgcacccatcacctgag

SEQ ID NO: 398103 - DNA, 20 bp, Artificial Sequence
  chemically synthesized
gggtacggtgtatacttctc

SEQ ID NO: 398104 - DNA, 20 bp, Artificial Sequence
  chemically synthesized
tgggtacggtgtatacttct

SEQ ID NO: 398105 - DNA, 20 bp, Artificial Sequence
  chemically synthesized
aaaagcctacatattgggta

SEQ ID NO: 398106 - DNA, 20 bp, Artificial Sequence
  chemically synthesized
tatacaccgtacccaatatg

SEQ ID NO: 398107 - DNA, 20 bp, Artificial Sequence
  chemically synthesized
atacaccgtacccaatatgt

SEQ ID NO: 398108 - DNA, 20 bp, Artificial Sequence
  chemically synthesized
gagataaaagcctacatatt

SEQ ID NO: 398109 - DNA, 20 bp, Artificial Sequence
  chemically synthesized
agagataaaagcctacatat

SEQ ID NO: 398110 - DNA, 20 bp, Artificial Sequence
  chemically synthesized
aggagatgggtgagagataa

SEQ ID NO: 398111 - DNA, 20 bp, Artificial Sequence
  chemically synthesized
gaagggtaggagatgggtga

SEQ ID NO: 398112 - DNA, 20 bp, Artificial Sequence
  chemically synthesized
gggaagggtaggagatgggt

SEQ ID NO: 398113 - DNA, 20 bp, Artificial Sequence
  chemically synthesized
cagggggaagggtaggagat

SEQ ID NO: 398114 - DNA, 20 bp, Artificial Sequence
  chemically synthesized
gcagggggaagggtaggaga

SEQ ID NO: 398115 - DNA, 20 bp, Artificial Sequence
  chemically synthesized
cagagcagggggaagggtag

SEQ ID NO: 398116 - DNA, 20 bp, Artificial Sequence
  chemically synthesized
ctcagagcagggggaagggt

SEQ ID NO: 398117 - DNA, 20 bp, Artificial Sequence
  chemically synthesized
actcagagcagggggaaggg

SEQ ID NO: 398118 - DNA, 20 bp, Artificial Sequence
  chemically synthesized
gggactcagagcagggggaa

SEQ ID NO: 398119 - DNA, 20 bp, Artificial Sequence
  chemically synthesized
agggactcagagcaggggga

SEQ ID NO: 398120 - DNA, 20 bp, Artificial Sequence
  chemically synthesized
tagggactcagagcaggggg

SEQ ID NO: 398121 - DNA, 20 bp, Artificial Sequence
  chemically synthesized
ctctagggactcagagcagg

SEQ ID NO: 398122 - DNA, 20 bp, Artificial Sequence
  chemically synthesized
cctacccttccccctgctct

SEQ ID NO: 398123 - DNA, 20 bp, Artificial Sequence
  chemically synthesized
actctagggactcagagcag

SEQ ID NO: 398124 - DNA, 20 bp, Artificial Sequence
  chemically synthesized
gactctagggactcagagca

SEQ ID NO: 398125 - DNA, 20 bp, Artificial Sequence
  chemically synthesized
ggactctagggactcagagc

SEQ ID NO: 398126 - DNA, 20 bp, Artificial Sequence
  chemically synthesized
tggactctagggactcagag

SEQ ID NO: 398127 - DNA, 20 bp, Artificial Sequence
  chemically synthesized
taatggactctagggactca

SEQ ID NO: 398128 - DNA, 20 bp, Artificial Sequence
  chemically synthesized
ttccccctgctctgagtccc

SEQ ID NO: 398129 - DNA, 20 bp, Artificial Sequence
  chemically synthesized
tataatggactctagggact

SEQ ID NO: 398130 - DNA, 20 bp, Artificial Sequence
  chemically synthesized
ccccctgctctgagtcccta

SEQ ID NO: 398131 - DNA, 20 bp, Artificial Sequence
  chemically synthesized
gaatgatataatggactcta

SEQ ID NO: 398132 - DNA, 20 bp, Artificial Sequence
  chemically synthesized
agaatgatataatggactct

SEQ ID NO: 398133 - DNA, 20 bp, Artificial Sequence
  chemically synthesized
aagaatgatataatggactc

SEQ ID NO: 398134 - DNA, 20 bp, Artificial Sequence
  chemically synthesized
aaggcataagaatgatataa

SEQ ID NO: 398135 - DNA, 20 bp, Artificial Sequence
  chemically synthesized
ctatgaggatgcaaaggcat

SEQ ID NO: 398136 - DNA, 20 bp, Artificial Sequence
  chemically synthesized
gctcaactatgaggatgcaa

SEQ ID NO: 398137 - DNA, 20 bp, Artificial Sequence
  chemically synthesized
agctcaactatgaggatgca

SEQ ID NO: 398138 - DNA, 20 bp, Artificial Sequence
  chemically synthesized
cttatgcctttgcatcctca

SEQ ID NO: 398139 - DNA, 20 bp, Artificial Sequence
  chemically synthesized
gcctttgcatcctcatagtt

SEQ ID NO: 398140 - DNA, 20 bp, Artificial Sequence
  chemically synthesized
taagtgggagctcaactatg

SEQ ID NO: 398141 - DNA, 20 bp, Artificial Sequence
  chemically synthesized
ataagtgggagctcaactat

SEQ ID NO: 398142 - DNA, 20 bp, Artificial Sequence
  chemically synthesized
atgttctcactcataagtgg

SEQ ID NO: 398143 - DNA, 20 bp, Artificial Sequence
  chemically synthesized
atagttgagctcccacttat

SEQ ID NO: 398144 - DNA, 20 bp, Artificial Sequence
  chemically synthesized
gtatgttctcactcataagt

SEQ ID NO: 398145 - DNA, 20 bp, Artificial Sequence
  chemically synthesized
cgtatgttctcactcataag

SEQ ID NO: 398146 - DNA, 20 bp, Artificial Sequence
  chemically synthesized
ttgagctcccacttatgagt

SEQ ID NO: 398147 - DNA, 20 bp, Artificial Sequence
  chemically synthesized
caccgtatgttctcactcat

SEQ ID NO: 398148 - DNA, 20 bp, Artificial Sequence
  chemically synthesized
cacttatgagtgagaacata

SEQ ID NO: 398149 - DNA, 20 bp, Artificial Sequence
  chemically synthesized
gagtgagaacatacggtgtt

SEQ ID NO: 398150 - DNA, 20 bp, Artificial Sequence
  chemically synthesized
taagtaaagtaattcaggaa

SEQ ID NO: 398151 - DNA, 20 bp, Artificial Sequence
  chemically synthesized
tattctaagtaaagtaattc

SEQ ID NO: 398152 - DNA, 20 bp, Artificial Sequence
  chemically synthesized
ttattctaagtaaagtaatt

SEQ ID NO: 398153 - DNA, 20 bp, Artificial Sequence
  chemically synthesized
cattcctgaattactttact

SEQ ID NO: 398154 - DNA, 20 bp, Artificial Sequence
  chemically synthesized
ggaggccattattctaagta

SEQ ID NO: 398155 - DNA, 20 bp, Artificial Sequence
  chemically synthesized
aattactttacttagaataa

SEQ ID NO: 398156 - DNA, 20 bp, Artificial Sequence
  chemically synthesized
gaactggaggccattattct

SEQ ID NO: 398157 - DNA, 20 bp, Artificial Sequence
  chemically synthesized
ttacttagaataatggcctc

SEQ ID NO: 398158 - DNA, 20 bp, Artificial Sequence
  chemically synthesized
aacaacttggatagaactgg

SEQ ID NO: 398159 - DNA, 20 bp, Artificial Sequence
  chemically synthesized
caacaacttggatagaactg

SEQ ID NO: 398160 - DNA, 20 bp, Artificial Sequence
  chemically synthesized
tgcaacaacttggatagaac

SEQ ID NO: 398161 - DNA, 20 bp, Artificial Sequence
  chemically synthesized
aatggcctccagttctatcc

SEQ ID NO: 398162 - DNA, 20 bp, Artificial Sequence
  chemically synthesized
gtattttgcaacaacttgga

SEQ ID NO: 398163 - DNA, 20 bp, Artificial Sequence
  chemically synthesized
taatgtattttgcaacaact

SEQ ID NO: 398164 - DNA, 20 bp, Artificial Sequence
  chemically synthesized
tgtggttgaaagggaagtac

SEQ ID NO: 398165 - DNA, 20 bp, Artificial Sequence
  chemically synthesized
ctgtggttgaaagggaagta

SEQ ID NO: 398166 - DNA, 20 bp, Artificial Sequence
  chemically synthesized
gttttctgtggttgaaaggg

SEQ ID NO: 398167 - DNA, 20 bp, Artificial Sequence
  chemically synthesized
tttgttttctgtggttgaaa

SEQ ID NO: 398168 - DNA, 20 bp, Artificial Sequence
  chemically synthesized
gtttgttttctgtggttgaa

SEQ ID NO: 398169 - DNA, 20 bp, Artificial Sequence
  chemically synthesized
ctgtacttccctttcaacca

SEQ ID NO: 398170 - DNA, 20 bp, Artificial Sequence
  chemically synthesized
tgtttgttttctgtggttga

SEQ ID NO: 398171 - DNA, 20 bp, Artificial Sequence
  chemically synthesized
catttgttgtttgttttctg

SEQ ID NO: 398172 - DNA, 20 bp, Artificial Sequence
  chemically synthesized
aacaaatgttatcatttatg

SEQ ID NO: 398173 - DNA, 20 bp, Artificial Sequence
  chemically synthesized
ttccactccccaaaatacac

SEQ ID NO: 398174 - DNA, 20 bp, Artificial Sequence
  chemically synthesized
gaataaaatcttgtgtattt

SEQ ID NO: 398175 - DNA, 20 bp, Artificial Sequence
  chemically synthesized
aataaaatcttgtgtatttt

SEQ ID NO: 398176 - DNA, 20 bp, Artificial Sequence
  chemically synthesized
ataaaatcttgtgtattttg

SEQ ID NO: 398177 - DNA, 20 bp, Artificial Sequence
  chemically synthesized
aaaatcttgtgtattttggg

SEQ ID NO: 398178 - DNA, 20 bp, Artificial Sequence
  chemically synthesized
atcttgtgtattttggggag

SEQ ID NO: 398179 - DNA, 20 bp, Artificial Sequence
  chemically synthesized
ttgtgtattttggggagtgg

SEQ ID NO: 398180 - DNA, 20 bp, Artificial Sequence
  chemically synthesized
gtattttggggagtggaaga

SEQ ID NO: 398181 - DNA, 20 bp, Artificial Sequence
  chemically synthesized
tattttggggagtggaagaa

SEQ ID NO: 398182 - DNA, 20 bp, Artificial Sequence
  chemically synthesized
tttggggagtggaagaaagg

SEQ ID NO: 398183 - DNA, 20 bp, Artificial Sequence
  chemically synthesized
aaaggtagcacttcttttat

SEQ ID NO: 398184 - DNA, 20 bp, Artificial Sequence
  chemically synthesized
atagcactaacttataaaag

SEQ ID NO: 398185 - DNA, 20 bp, Artificial Sequence
  chemically synthesized
ataatagcactaacttataa

SEQ ID NO: 398186 - DNA, 20 bp, Artificial Sequence
  chemically synthesized
gtagcacttcttttataagt

SEQ ID NO: 398187 - DNA, 20 bp, Artificial Sequence
  chemically synthesized
tgtctcaagttataaaataa

SEQ ID NO: 398188 - DNA, 20 bp, Artificial Sequence
  chemically synthesized
gtgctattattttataactt

SEQ ID NO: 398189 - DNA, 20 bp, Artificial Sequence
  chemically synthesized
gtaagctaatcagatgtctc

SEQ ID NO: 398190 - DNA, 20 bp, Artificial Sequence
  chemically synthesized
tataacttgagacatctgat

SEQ ID NO: 398191 - DNA, 20 bp, Artificial Sequence
  chemically synthesized
tttgttataggtaagctaat

SEQ ID NO: 398192 - DNA, 20 bp, Artificial Sequence
  chemically synthesized
atttccactttgttataggt

SEQ ID NO: 398193 - DNA, 20 bp, Artificial Sequence
  chemically synthesized
tgattagcttacctataaca

SEQ ID NO: 398194 - DNA, 20 bp, Artificial Sequence
  chemically synthesized
ttctatttccactttgttat

SEQ ID NO: 398195 - DNA, 20 bp, Artificial Sequence
  chemically synthesized
tttctatttccactttgtta

SEQ ID NO: 398196 - DNA, 20 bp, Artificial Sequence
  chemically synthesized
ttagcttacctataacaaag

SEQ ID NO: 398197 - DNA, 20 bp, Artificial Sequence
  chemically synthesized
tacctataacaaagtggaaa

SEQ ID NO: 398198 - DNA, 20 bp, Artificial Sequence
  chemically synthesized
aatagaaaatatataatata

SEQ ID NO: 398199 - DNA, 20 bp, Artificial Sequence
  chemically synthesized
aaacagttacattatatgaa

SEQ ID NO: 398200 - DNA, 20 bp, Artificial Sequence
  chemically synthesized
attcatataatgtaactgtt

SEQ ID NO: 398201 - DNA, 20 bp, Artificial Sequence
  chemically synthesized
ctgatagttaagattctaaa

SEQ ID NO: 398202 - DNA, 20 bp, Artificial Sequence
  chemically synthesized
ctgtttagaatcttaactat

SEQ ID NO: 398203 - DNA, 20 bp, Artificial Sequence
  chemically synthesized
tgtttagaatcttaactatc

SEQ ID NO: 398204 - DNA, 20 bp, Artificial Sequence
  chemically synthesized
aaatacactgcctgatagtt

SEQ ID NO: 398205 - DNA, 20 bp, Artificial Sequence
  chemically synthesized
ttagaatcttaactatcagg

SEQ ID NO: 398206 - DNA, 20 bp, Artificial Sequence
  chemically synthesized
tcattaaatacactgcctga

SEQ ID NO: 398207 - DNA, 20 bp, Artificial Sequence
  chemically synthesized
agtgtatttaatgatctttc

SEQ ID NO: 398208 - DNA, 20 bp, Artificial Sequence
  chemically synthesized
gaaaatacgaagcaacttga

SEQ ID NO: 398209 - DNA, 20 bp, Artificial Sequence
  chemically synthesized
acggacaaaaagaaaatacg

SEQ ID NO: 398210 - DNA, 20 bp, Artificial Sequence
  chemically synthesized
gaattaaaaaaacggacaaa

SEQ ID NO: 398211 - DNA, 20 bp, Artificial Sequence
  chemically synthesized
aataatttgaattaaaaaaa

SEQ ID NO: 398212 - DNA, 20 bp, Artificial Sequence
  chemically synthesized
gtttttttaattcaaattat

SEQ ID NO: 398213 - DNA, 20 bp, Artificial Sequence
  chemically synthesized
aaattattggtttactgact

SEQ ID NO: 398214 - DNA, 20 bp, Artificial Sequence
  chemically synthesized
aacaaacctatcatctaagt

SEQ ID NO: 398215 - DNA, 20 bp, Artificial Sequence
  chemically synthesized
tggtttactgacttagatga

SEQ ID NO: 398216 - DNA, 20 bp, Artificial Sequence
  chemically synthesized
ggtttactgacttagatgat

SEQ ID NO: 398217 - DNA, 20 bp, Artificial Sequence
  chemically synthesized
aaagaacaaacctatcatct

SEQ ID NO: 398218 - DNA, 20 bp, Artificial Sequence
  chemically synthesized
tagatgataggtttgttctt

SEQ ID NO: 398219 - DNA, 20 bp, Artificial Sequence
  chemically synthesized
atgataggtttgttctttag

SEQ ID NO: 398220 - DNA, 20 bp, Artificial Sequence
  chemically synthesized
acatttcagcatatctgcta

SEQ ID NO: 398221 - DNA, 20 bp, Artificial Sequence
  chemically synthesized
actatttatataagacattt

SEQ ID NO: 398222 - DNA, 20 bp, Artificial Sequence
  chemically synthesized
gctgaaatgtcttatataaa

SEQ ID NO: 398223 - DNA, 20 bp, Artificial Sequence
  chemically synthesized
tattcagagactatttatat

SEQ ID NO: 398224 - DNA, 20 bp, Artificial Sequence
  chemically synthesized
tgatattgtgattttattca

SEQ ID NO: 398225 - DNA, 20 bp, Artificial Sequence
  chemically synthesized
gctgatattgtgattttatt

SEQ ID NO: 398226 - DNA, 20 bp, Artificial Sequence
  chemically synthesized
tctgaataaaatcacaatat

SEQ ID NO: 398227 - DNA, 20 bp, Artificial Sequence
  chemically synthesized
atgtaagtagagttttatga

SEQ ID NO: 398228 - DNA, 20 bp, Artificial Sequence
  chemically synthesized
ttaaacgagctatgtaagta

SEQ ID NO: 398229 - DNA, 20 bp, Artificial Sequence
  chemically synthesized
atcataaaactctacttaca

SEQ ID NO: 398230 - DNA, 20 bp, Artificial Sequence
  chemically synthesized
tattaaacgagctatgtaag

SEQ ID NO: 398231 - DNA, 20 bp, Artificial Sequence
  chemically synthesized
atatattaaacgagctatgt

SEQ ID NO: 398232 - DNA, 20 bp, Artificial Sequence
  chemically synthesized
tttctaataatatattaaac

SEQ ID NO: 398233 - DNA, 20 bp, Artificial Sequence
  chemically synthesized
tagctcgtttaatatattat

SEQ ID NO: 398234 - DNA, 20 bp, Artificial Sequence
  chemically synthesized
gtttaatatattattagaaa

SEQ ID NO: 398235 - DNA, 20 bp, Artificial Sequence
  chemically synthesized
tggaagaagcatttaaaatg

SEQ ID NO: 398236 - DNA, 20 bp, Artificial Sequence
  chemically synthesized
ttcattttaaatgcttcttc

SEQ ID NO: 398237 - DNA, 20 bp, Artificial Sequence
  chemically synthesized
atgtgcatacattctggaag

SEQ ID NO: 398238 - DNA, 20 bp, Artificial Sequence
  chemically synthesized
aatatgtgcatacattctgg

SEQ ID NO: 398239 - DNA, 20 bp, Artificial Sequence
  chemically synthesized
tataatatgtgcatacattc

SEQ ID NO: 398240 - DNA, 20 bp, Artificial Sequence
  chemically synthesized
gaatgtatgcacatattata

SEQ ID NO: 398241 - DNA, 20 bp, Artificial Sequence
  chemically synthesized
gtatgcacatattatatagt

SEQ ID NO: 398242 - DNA, 20 bp, Artificial Sequence
  chemically synthesized
tatgcacatattatatagtg

SEQ ID NO: 398243 - DNA, 20 bp, Artificial Sequence
  chemically synthesized
gcaatgtcctgttaatattt

SEQ ID NO: 398244 - DNA, 20 bp, Artificial Sequence
  chemically synthesized
gaggcatacttaaatattaa

SEQ ID NO: 398245 - DNA, 20 bp, Artificial Sequence
  chemically synthesized
aggcatacttaaatattaac

SEQ ID NO: 398246 - DNA, 20 bp, Artificial Sequence
  chemically synthesized
cgaatacaattttggaaggt

SEQ ID NO: 398247 - DNA, 20 bp, Artificial Sequence
  chemically synthesized
acatcgaatacaattttgga

SEQ ID NO: 398248 - DNA, 20 bp, Artificial Sequence
  chemically synthesized
aacatcgaatacaattttgg

SEQ ID NO: 398249 - DNA, 20 bp, Artificial Sequence
  chemically synthesized
tgaaacatcgaatacaattt

SEQ ID NO: 398250 - DNA, 20 bp, Artificial Sequence
  chemically synthesized
caaaattgtattcgatgttt

SEQ ID NO: 398251 - DNA, 20 bp, Artificial Sequence
  chemically synthesized
aattgtattcgatgtttcag

SEQ ID NO: 398252 - DNA, 20 bp, Artificial Sequence
  chemically synthesized
gtattcgatgtttcagaagt

SEQ ID NO: 398253 - DNA, 20 bp, Artificial Sequence
  chemically synthesized
gtaagttatgatactacaat

SEQ ID NO: 398254 - DNA, 20 bp, Artificial Sequence
  chemically synthesized
atgctttatattactgattg

SEQ ID NO: 398255 - DNA, 20 bp, Artificial Sequence
  chemically synthesized
atactacaatcagtaatata

SEQ ID NO: 398256 - DNA, 20 bp, Artificial Sequence
  chemically synthesized
ttttaagaataaagtcatag

SEQ ID NO: 398257 - DNA, 20 bp, Artificial Sequence
  chemically synthesized
ctcttttaagaataaagtca

SEQ ID NO: 398258 - DNA, 20 bp, Artificial Sequence
  chemically synthesized
gtttctctcttttaagaata

SEQ ID NO: 398259 - DNA, 20 bp, Artificial Sequence
  chemically synthesized
tgctatgactttattcttaa

SEQ ID NO: 398260 - DNA, 20 bp, Artificial Sequence
  chemically synthesized
ctatgactttattcttaaaa

SEQ ID NO: 398261 - DNA, 20 bp, Artificial Sequence
  chemically synthesized
atgactttattcttaaaaga

SEQ ID NO: 398262 - DNA, 20 bp, Artificial Sequence
  chemically synthesized
tgatttagtttctctctttt

SEQ ID NO: 398263 - DNA, 20 bp, Artificial Sequence
  chemically synthesized
gttttcaagtaaatgtgatt

SEQ ID NO: 398264 - DNA, 20 bp, Artificial Sequence
  chemically synthesized
aatcacatttacttgaaaac

SEQ ID NO: 398265 - DNA, 20 bp, Artificial Sequence
  chemically synthesized
atttcaatatgccagttttc

SEQ ID NO: 398266 - DNA, 20 bp, Artificial Sequence
  chemically synthesized
aatgtttcatttcaatatgc

SEQ ID NO: 398267 - DNA, 20 bp, Artificial Sequence
  chemically synthesized
tgaaacatttccatcctttg

SEQ ID NO: 398268 - DNA, 20 bp, Artificial Sequence
  chemically synthesized
ttctctatctccacaaagga

SEQ ID NO: 398269 - DNA, 20 bp, Artificial Sequence
  chemically synthesized
aaacatttccatcctttgtg

SEQ ID NO: 398270 - DNA, 20 bp, Artificial Sequence
  chemically synthesized
agcgttctctatctccacaa

SEQ ID NO: 398271 - DNA, 20 bp, Artificial Sequence
  chemically synthesized
gagcgttctctatctccaca

SEQ ID NO: 398272 - DNA, 20 bp, Artificial Sequence
  chemically synthesized
atttccatcctttgtggaga

SEQ ID NO: 398273 - DNA, 20 bp, Artificial Sequence
  chemically synthesized
ttccatcctttgtggagata

SEQ ID NO: 398274 - DNA, 20 bp, Artificial Sequence
  chemically synthesized
tgtggagatagagaacgctc

SEQ ID NO: 398275 - DNA, 20 bp, Artificial Sequence
  chemically synthesized
atggtctcttcaagaatctg

SEQ ID NO: 398276 - DNA, 20 bp, Artificial Sequence
  chemically synthesized
tgatggtctcttcaagaatc

SEQ ID NO: 398277 - DNA, 20 bp, Artificial Sequence
  chemically synthesized
gagaacgctccagattcttg

SEQ ID NO: 398278 - DNA, 20 bp, Artificial Sequence
  chemically synthesized
gaacgctccagattcttgaa

SEQ ID NO: 398279 - DNA, 20 bp, Artificial Sequence
  chemically synthesized
ttttctctgatggtctcttc

SEQ ID NO: 398280 - DNA, 20 bp, Artificial Sequence
  chemically synthesized
cagattcttgaagagaccat

SEQ ID NO: 398281 - DNA, 20 bp, Artificial Sequence
  chemically synthesized
gattcttgaagagaccatca

SEQ ID NO: 398282 - DNA, 20 bp, Artificial Sequence
  chemically synthesized
ttggcctagattttctctga

SEQ ID NO: 398283 - DNA, 20 bp, Artificial Sequence
  chemically synthesized
agagaccatcagagaaaatc

SEQ ID NO: 398284 - DNA, 20 bp, Artificial Sequence
  chemically synthesized
gagaccatcagagaaaatct

SEQ ID NO: 398285 - DNA, 20 bp, Artificial Sequence
  chemically synthesized
agtaacaataaatgttggcc

SEQ ID NO: 398286 - DNA, 20 bp, Artificial Sequence
  chemically synthesized
catttagtaacaataaatgt

SEQ ID NO: 398287 - DNA, 20 bp, Artificial Sequence
  chemically synthesized
gaaagagaaatttatgcatt

SEQ ID NO: 398288 - DNA, 20 bp, Artificial Sequence
  chemically synthesized
aaatgcataaatttctcttt

SEQ ID NO: 398289 - DNA, 20 bp, Artificial Sequence
  chemically synthesized
atattttcctgatactgaaa

SEQ ID NO: 398290 - DNA, 20 bp, Artificial Sequence
  chemically synthesized
ataaatttctctttcagtat

SEQ ID NO: 398291 - DNA, 20 bp, Artificial Sequence
  chemically synthesized
atatattttcctgatactga

SEQ ID NO: 398292 - DNA, 20 bp, Artificial Sequence
  chemically synthesized
taaatttctctttcagtatc

SEQ ID NO: 398293 - DNA, 20 bp, Artificial Sequence
  chemically synthesized
tcagtatcaggaaaatatat

SEQ ID NO: 398294 - DNA, 20 bp, Artificial Sequence
  chemically synthesized
taatttttaaaacatattta

SEQ ID NO: 398295 - DNA, 20 bp, Artificial Sequence
  chemically synthesized
tatgttttaaaaattatttg

SEQ ID NO: 398296 - DNA, 20 bp, Artificial Sequence
  chemically synthesized
ttcctgtcattttattggaa

SEQ ID NO: 398297 - DNA, 20 bp, Artificial Sequence
  chemically synthesized
cttcctgtcattttattgga

SEQ ID NO: 398298 - DNA, 20 bp, Artificial Sequence
  chemically synthesized
ttttcttcctgtcattttat

SEQ ID NO: 398299 - DNA, 20 bp, Artificial Sequence
  chemically synthesized
aagcctttccaataaaatga

SEQ ID NO: 398300 - DNA, 20 bp, Artificial Sequence
  chemically synthesized
agcctttccaataaaatgac

SEQ ID NO: 398301 - DNA, 20 bp, Artificial Sequence
  chemically synthesized
ctttccaataaaatgacagg

SEQ ID NO: 398302 - DNA, 20 bp, Artificial Sequence
  chemically synthesized
caggaagaaaaccttttaaa

SEQ ID NO: 398303 - DNA, 20 bp, Artificial Sequence
  chemically synthesized
aggaagaaaaccttttaaaa

SEQ ID NO: 398304 - DNA, 20 bp, Artificial Sequence
  chemically synthesized
tagagttacacctttttaaa

SEQ ID NO: 398305 - DNA, 20 bp, Artificial Sequence
  chemically synthesized
gtagagttacacctttttaa

SEQ ID NO: 398306 - DNA, 20 bp, Artificial Sequence
  chemically synthesized
ttaaaaaggtgtaactctac

SEQ ID NO: 398307 - DNA, 20 bp, Artificial Sequence
  chemically synthesized
ctgttttctttatgcttgta

SEQ ID NO: 398308 - DNA, 20 bp, Artificial Sequence
  chemically synthesized
tcctgttttctttatgcttg

SEQ ID NO: 398309 - DNA, 20 bp, Artificial Sequence
  chemically synthesized
ggtgtaactctacaagcata

SEQ ID NO: 398310 - DNA, 20 bp, Artificial Sequence
  chemically synthesized
ctctacaagcataaagaaaa

SEQ ID NO: 398311 - DNA, 20 bp, Artificial Sequence
  chemically synthesized
tctacaagcataaagaaaac

SEQ ID NO: 398312 - DNA, 20 bp, Artificial Sequence
  chemically synthesized
tacaagcataaagaaaacag

SEQ ID NO: 398313 - DNA, 20 bp, Artificial Sequence
  chemically synthesized
aagcataaagaaaacaggag

SEQ ID NO: 398314 - DNA, 20 bp, Artificial Sequence
  chemically synthesized
agaagaaaaatgaacaactc

SEQ ID NO: 398315 - DNA, 20 bp, Artificial Sequence
  chemically synthesized
aaatgaacaactcaagatgt

SEQ ID NO: 398316 - DNA, 20 bp, Artificial Sequence
  chemically synthesized
ccaaaatttgctaacatctt

SEQ ID NO: 398317 - DNA, 20 bp, Artificial Sequence
  chemically synthesized
ctcaagatgttagcaaattt

SEQ ID NO: 398318 - DNA, 20 bp, Artificial Sequence
  chemically synthesized
tcaagatgttagcaaatttt

SEQ ID NO: 398319 - DNA, 20 bp, Artificial Sequence
  chemically synthesized
agatgttagcaaattttggg

SEQ ID NO: 398320 - DNA, 20 bp, Artificial Sequence
  chemically synthesized
gttagagccataaggcaagg

SEQ ID NO: 398321 - DNA, 20 bp, Artificial Sequence
  chemically synthesized
ggaagtacttccttgcctta

SEQ ID NO: 398322 - DNA, 20 bp, Artificial Sequence
  chemically synthesized
tttgttagagccataaggca

SEQ ID NO: 398323 - DNA, 20 bp, Artificial Sequence
  chemically synthesized
ctttgttagagccataaggc

SEQ ID NO: 398324 - DNA, 20 bp, Artificial Sequence
  chemically synthesized
cagcctttgttagagccata

SEQ ID NO: 398325 - DNA, 20 bp, Artificial Sequence
  chemically synthesized
gcagcctttgttagagccat

SEQ ID NO: 398326 - DNA, 20 bp, Artificial Sequence
  chemically synthesized
cttgccttatggctctaaca

SEQ ID NO: 398327 - DNA, 20 bp, Artificial Sequence
  chemically synthesized
ttgccttatggctctaacaa

SEQ ID NO: 398328 - DNA, 20 bp, Artificial Sequence
  chemically synthesized
tgagcctgcagcctttgtta

SEQ ID NO: 398329 - DNA, 20 bp, Artificial Sequence
  chemically synthesized
ggtgagcctgcagcctttgt

SEQ ID NO: 398330 - DNA, 20 bp, Artificial Sequence
  chemically synthesized
tatggctctaacaaaggctg

SEQ ID NO: 398331 - DNA, 20 bp, Artificial Sequence
  chemically synthesized
atggctctaacaaaggctgc

SEQ ID NO: 398332 - DNA, 20 bp, Artificial Sequence
  chemically synthesized
gaacatagtgggtgagcctg

SEQ ID NO: 398333 - DNA, 20 bp, Artificial Sequence
  chemically synthesized
ggccaaggaacatagtgggt

SEQ ID NO: 398334 - DNA, 20 bp, Artificial Sequence
  chemically synthesized
tcctggccaaggaacatagt

SEQ ID NO: 398335 - DNA, 20 bp, Artificial Sequence
  chemically synthesized
atcctggccaaggaacatag

SEQ ID NO: 398336 - DNA, 20 bp, Artificial Sequence
  chemically synthesized
ggctcacccactatgttcct

SEQ ID NO: 398337 - DNA, 20 bp, Artificial Sequence
  chemically synthesized
ttcatcctggccaaggaaca

SEQ ID NO: 398338 - DNA, 20 bp, Artificial Sequence
  chemically synthesized
cacccactatgttccttggc

SEQ ID NO: 398339 - DNA, 20 bp, Artificial Sequence
  chemically synthesized
acccactatgttccttggcc

SEQ ID NO: 398340 - DNA, 20 bp, Artificial Sequence
  chemically synthesized
atgatacttcatcctggcca

SEQ ID NO: 398341 - DNA, 20 bp, Artificial Sequence
  chemically synthesized
tatgatacttcatcctggcc

SEQ ID NO: 398342 - DNA, 20 bp, Artificial Sequence
  chemically synthesized
tatgttccttggccaggatg

SEQ ID NO: 398343 - DNA, 20 bp, Artificial Sequence
  chemically synthesized
gaatatatgatacttcatcc

SEQ ID NO: 398344 - DNA, 20 bp, Artificial Sequence
  chemically synthesized
gtatcatatattcttctaat

SEQ ID NO: 398345 - DNA, 20 bp, Artificial Sequence
  chemically synthesized
aagaagtcacagctcattag

SEQ ID NO: 398346 - DNA, 20 bp, Artificial Sequence
  chemically synthesized
tgaaagaagtcacagctcat

SEQ ID NO: 398347 - DNA, 20 bp, Artificial Sequence
  chemically synthesized
ttccacactgaaagaagtca

SEQ ID NO: 398348 - DNA, 20 bp, Artificial Sequence
  chemically synthesized
taatgagctgtgacttcttt

SEQ ID NO: 398349 - DNA, 20 bp, Artificial Sequence
  chemically synthesized
gtctcattccacactgaaag

SEQ ID NO: 398350 - DNA, 20 bp, Artificial Sequence
  chemically synthesized
agctgtgacttctttcagtg

SEQ ID NO: 398351 - DNA, 20 bp, Artificial Sequence
  chemically synthesized
taagtctcattccacactga

SEQ ID NO: 398352 - DNA, 20 bp, Artificial Sequence
  chemically synthesized
gacttctttcagtgtggaat

SEQ ID NO: 398353 - DNA, 20 bp, Artificial Sequence
  chemically synthesized
gcatgcagatattcattggt

SEQ ID NO: 398354 - DNA, 20 bp, Artificial Sequence
  chemically synthesized
cctagcatgcagatattcat

SEQ ID NO: 398355 - DNA, 20 bp, Artificial Sequence
  chemically synthesized
accaatgaatatctgcatgc

SEQ ID NO: 398356 - DNA, 20 bp, Artificial Sequence
  chemically synthesized
ccaatgaatatctgcatgct

SEQ ID NO: 398357 - DNA, 20 bp, Artificial Sequence
  chemically synthesized
taatgagtatacctagcatg

SEQ ID NO: 398358 - DNA, 20 bp, Artificial Sequence
  chemically synthesized
ctggtagtaatgagtatacc

SEQ ID NO: 398359 - DNA, 20 bp, Artificial Sequence
  chemically synthesized
tgggaaggtctggtagtaat

SEQ ID NO: 398360 - DNA, 20 bp, Artificial Sequence
  chemically synthesized
ctaggtatactcattactac

SEQ ID NO: 398361 - DNA, 20 bp, Artificial Sequence
  chemically synthesized
tatcagctgggaaggtctgg

SEQ ID NO: 398362 - DNA, 20 bp, Artificial Sequence
  chemically synthesized
ttctatcagctgggaaggtc

SEQ ID NO: 398363 - DNA, 20 bp, Artificial Sequence
  chemically synthesized
tcattactaccagaccttcc

SEQ ID NO: 398364 - DNA, 20 bp, Artificial Sequence
  chemically synthesized
tatatttctatcagctggga

SEQ ID NO: 398365 - DNA, 20 bp, Artificial Sequence
  chemically synthesized
atatatttctatcagctggg

SEQ ID NO: 398366 - DNA, 20 bp, Artificial Sequence
  chemically synthesized
taccagaccttcccagctga

SEQ ID NO: 398367 - DNA, 20 bp, Artificial Sequence
  chemically synthesized
aaaatatatttctatcagct

SEQ ID NO: 398368 - DNA, 20 bp, Artificial Sequence
  chemically synthesized
aaaaatatatttctatcagc

SEQ ID NO: 398369 - DNA, 20 bp, Artificial Sequence
  chemically synthesized
ttgtaaaaatatatttctat

SEQ ID NO: 398370 - DNA, 20 bp, Artificial Sequence
  chemically synthesized
aacacattttaacaaattgt

SEQ ID NO: 398371 - DNA, 20 bp, Artificial Sequence
  chemically synthesized
aaaatttatatttaatatga

SEQ ID NO: 398372 - DNA, 20 bp, Artificial Sequence
  chemically synthesized
ttaatatgatagttttccct

SEQ ID NO: 398373 - DNA, 20 bp, Artificial Sequence
  chemically synthesized
aaattataaattaaaactta

SEQ ID NO: 398374 - DNA, 20 bp, Artificial Sequence
  chemically synthesized
aaaattataaattaaaactt

SEQ ID NO: 398375 - DNA, 20 bp, Artificial Sequence
  chemically synthesized
taaaattataaattaaaact

SEQ ID NO: 398376 - DNA, 20 bp, Artificial Sequence
  chemically synthesized
taaatatcgatgaagggata

SEQ ID NO: 398377 - DNA, 20 bp, Artificial Sequence
  chemically synthesized
ataaatatcgatgaagggat

SEQ ID NO: 398378 - DNA, 20 bp, Artificial Sequence
  chemically synthesized
aataaatatcgatgaaggga

SEQ ID NO: 398379 - DNA, 20 bp, Artificial Sequence
  chemically synthesized
taaaaataaatatcgatgaa

SEQ ID NO: 398380 - DNA, 20 bp, Artificial Sequence
  chemically synthesized
ctaaaaataaatatcgatga

SEQ ID NO: 398381 - DNA, 20 bp, Artificial Sequence
  chemically synthesized
actaaaaataaatatcgatg

SEQ ID NO: 398382 - DNA, 20 bp, Artificial Sequence
  chemically synthesized
ccttcatcgatatttatttt

SEQ ID NO: 398383 - DNA, 20 bp, Artificial Sequence
  chemically synthesized
atttatttttagtgtttttc

SEQ ID NO: 398384 - DNA, 20 bp, Artificial Sequence
  chemically synthesized
aatacacaagtaaaaataac

SEQ ID NO: 398385 - DNA, 20 bp, Artificial Sequence
  chemically synthesized
ctttttataaaaaaatacac

SEQ ID NO: 398386 - DNA, 20 bp, Artificial Sequence
  chemically synthesized
cttgtgtatttttttataaa

SEQ ID NO: 398387 - DNA, 20 bp, Artificial Sequence
  chemically synthesized
ataatcaatttatccaactc

SEQ ID NO: 398388 - DNA, 20 bp, Artificial Sequence
  chemically synthesized
gtagtatttttttctggagt

SEQ ID NO: 398389 - DNA, 20 bp, Artificial Sequence
  chemically synthesized
ataagtagtatttttttctg

SEQ ID NO: 398390 - DNA, 20 bp, Artificial Sequence
  chemically synthesized
taataagtagtatttttttc

SEQ ID NO: 398391 - DNA, 20 bp, Artificial Sequence
  chemically synthesized
aggcattccaatataataag

SEQ ID NO: 398392 - DNA, 20 bp, Artificial Sequence
  chemically synthesized
aaaaatactacttattatat

SEQ ID NO: 398393 - DNA, 20 bp, Artificial Sequence
  chemically synthesized
taaaggcattccaatataat

SEQ ID NO: 398394 - DNA, 20 bp, Artificial Sequence
  chemically synthesized
taagttaatgtgtaaattaa

SEQ ID NO: 398395 - DNA, 20 bp, Artificial Sequence
  chemically synthesized
ttaagttaatgtgtaaatta

SEQ ID NO: 398396 - DNA, 20 bp, Artificial Sequence
  chemically synthesized
taaagtaaactattgttttt

SEQ ID NO: 398397 - DNA, 20 bp, Artificial Sequence
  chemically synthesized
acacattaacttaaaaacaa

SEQ ID NO: 398398 - DNA, 20 bp, Artificial Sequence
  chemically synthesized
aagcatggcttaacattata

SEQ ID NO: 398399 - DNA, 20 bp, Artificial Sequence
  chemically synthesized
atagtttactttataatgtt

SEQ ID NO: 398400 - DNA, 20 bp, Artificial Sequence
  chemically synthesized
taatgttaagccatgctttt

SEQ ID NO: 398401 - DNA, 20 bp, Artificial Sequence
  chemically synthesized
ctccttgttcctgaaaagca

SEQ ID NO: 398402 - DNA, 20 bp, Artificial Sequence
  chemically synthesized
aatgttaagccatgcttttc

SEQ ID NO: 398403 - DNA, 20 bp, Artificial Sequence
  chemically synthesized
agatgctccttgttcctgaa

SEQ ID NO: 398404 - DNA, 20 bp, Artificial Sequence
  chemically synthesized
aagccatgcttttcaggaac

SEQ ID NO: 398405 - DNA, 20 bp, Artificial Sequence
  chemically synthesized
agccatgcttttcaggaaca

SEQ ID NO: 398406 - DNA, 20 bp, Artificial Sequence
  chemically synthesized
ccatgcttttcaggaacaag

SEQ ID NO: 398407 - DNA, 20 bp, Artificial Sequence
  chemically synthesized
ccaaaaggaaatcaaggaga

SEQ ID NO: 398408 - DNA, 20 bp, Artificial Sequence
  chemically synthesized
caacccaaaaggaaatcaag

SEQ ID NO: 398409 - DNA, 20 bp, Artificial Sequence
  chemically synthesized
aacaacccaaaaggaaatca

SEQ ID NO: 398410 - DNA, 20 bp, Artificial Sequence
  chemically synthesized
gaacaacccaaaaggaaatc

SEQ ID NO: 398411 - DNA, 20 bp, Artificial Sequence
  chemically synthesized
ctttctccttgatttccttt

SEQ ID NO: 398412 - DNA, 20 bp, Artificial Sequence
  chemically synthesized
tttctccttgatttcctttt

SEQ ID NO: 398413 - DNA, 20 bp, Artificial Sequence
  chemically synthesized
actctcctgaacaacccaaa

SEQ ID NO: 398414 - DNA, 20 bp, Artificial Sequence
  chemically synthesized
aactctcctgaacaacccaa

SEQ ID NO: 398415 - DNA, 20 bp, Artificial Sequence
  chemically synthesized
tgatttccttttgggttgtt

SEQ ID NO: 398416 - DNA, 20 bp, Artificial Sequence
  chemically synthesized
gatttccttttgggttgttc

SEQ ID NO: 398417 - DNA, 20 bp, Artificial Sequence
  chemically synthesized
tttccttttgggttgttcag

SEQ ID NO: 398418 - DNA, 20 bp, Artificial Sequence
  chemically synthesized
tccttttgggttgttcagga

SEQ ID NO: 398419 - DNA, 20 bp, Artificial Sequence
  chemically synthesized
gttcaggagagttttaaaca

SEQ ID NO: 398420 - DNA, 20 bp, Artificial Sequence
  chemically synthesized
ttcaggagagttttaaacat

SEQ ID NO: 398421 - DNA, 20 bp, Artificial Sequence
  chemically synthesized
acacatttaacaagaaattt

SEQ ID NO: 398422 - DNA, 20 bp, Artificial Sequence
  chemically synthesized
aaacaagaaacacatttaac

SEQ ID NO: 398423 - DNA, 20 bp, Artificial Sequence
  chemically synthesized
atagcaacaacagcaaaaac

SEQ ID NO: 398424 - DNA, 20 bp, Artificial Sequence
  chemically synthesized
atttgcaacaatagcaacaa

SEQ ID NO: 398425 - DNA, 20 bp, Artificial Sequence
  chemically synthesized
tgcacacccatttgcaacaa

SEQ ID NO: 398426 - DNA, 20 bp, Artificial Sequence
  chemically synthesized
gttgttgctattgttgcaaa

SEQ ID NO: 398427 - DNA, 20 bp, Artificial Sequence
  chemically synthesized
ttgttgctattgttgcaaat

SEQ ID NO: 398428 - DNA, 20 bp, Artificial Sequence
  chemically synthesized
gagctagaagtttttatgga

SEQ ID NO: 398429 - DNA, 20 bp, Artificial Sequence
  chemically synthesized
taatgagctagaagttttta

SEQ ID NO: 398430 - DNA, 20 bp, Artificial Sequence
  chemically synthesized
gcaccatccataaaaacttc

SEQ ID NO: 398431 - DNA, 20 bp, Artificial Sequence
  chemically synthesized
ttttataggtaatgagctag

SEQ ID NO: 398432 - DNA, 20 bp, Artificial Sequence
  chemically synthesized
tcattttataggtaatgagc

SEQ ID NO: 398433 - DNA, 20 bp, Artificial Sequence
  chemically synthesized
aaattcattttataggtaat

SEQ ID NO: 398434 - DNA, 20 bp, Artificial Sequence
  chemically synthesized
atcagtaaaattcattttat

SEQ ID NO: 398435 - DNA, 20 bp, Artificial Sequence
  chemically synthesized
aatcagtaaaattcatttta

SEQ ID NO: 398436 - DNA, 20 bp, Artificial Sequence
  chemically synthesized
ataaaatttacaggcaaaat

SEQ ID NO: 398437 - DNA, 20 bp, Artificial Sequence
  chemically synthesized
tagcagactataaaatttac

SEQ ID NO: 398438 - DNA, 20 bp, Artificial Sequence
  chemically synthesized
ttagcagactataaaattta

SEQ ID NO: 398439 - DNA, 20 bp, Artificial Sequence
  chemically synthesized
gattttgcctgtaaatttta

SEQ ID NO: 398440 - DNA, 20 bp, Artificial Sequence
  chemically synthesized
aaaataatttagtaagttag

SEQ ID NO: 398441 - DNA, 20 bp, Artificial Sequence
  chemically synthesized
aataaaataatttagtaagt

SEQ ID NO: 398442 - DNA, 20 bp, Artificial Sequence
  chemically synthesized
taccaataaaataatttagt

SEQ ID NO: 398443 - DNA, 20 bp, Artificial Sequence
  chemically synthesized
caaataccaataaaataatt

SEQ ID NO: 398444 - DNA, 20 bp, Artificial Sequence
  chemically synthesized
aacttactaaattattttat

SEQ ID NO: 398445 - DNA, 20 bp, Artificial Sequence
  chemically synthesized
attgttttgtgtgatctctt

SEQ ID NO: 398446 - DNA, 20 bp, Artificial Sequence
  chemically synthesized
ttgttttgtgtgatctcttg

SEQ ID NO: 398447 - DNA, 20 bp, Artificial Sequence
  chemically synthesized
gatagaattgtttacctcaa

SEQ ID NO: 398448 - DNA, 20 bp, Artificial Sequence
  chemically synthesized
cagatagaattgtttacctc

SEQ ID NO: 398449 - DNA, 20 bp, Artificial Sequence
  chemically synthesized
atgggatcccaatttacaga

SEQ ID NO: 398450 - DNA, 20 bp, Artificial Sequence
  chemically synthesized
aaacaattctatctgtaaat

SEQ ID NO: 398451 - DNA, 20 bp, Artificial Sequence
  chemically synthesized
aacaattctatctgtaaatt

SEQ ID NO: 398452 - DNA, 20 bp, Artificial Sequence
  chemically synthesized
ggtaatgggatcccaattta

SEQ ID NO: 398453 - DNA, 20 bp, Artificial Sequence
  chemically synthesized
caattgcaagcagtggtaat

SEQ ID NO: 398454 - DNA, 20 bp, Artificial Sequence
  chemically synthesized
acaattgcaagcagtggtaa

SEQ ID NO: 398455 - DNA, 20 bp, Artificial Sequence
  chemically synthesized
ggcaaaacaattgcaagcag

SEQ ID NO: 398456 - DNA, 20 bp, Artificial Sequence
  chemically synthesized
cgaggcaaaacaattgcaag

SEQ ID NO: 398457 - DNA, 20 bp, Artificial Sequence
  chemically synthesized
attcgaggcaaaacaattgc

SEQ ID NO: 398458 - DNA, 20 bp, Artificial Sequence
  chemically synthesized
gcaattgttttgcctcgaat

SEQ ID NO: 398459 - DNA, 20 bp, Artificial Sequence
  chemically synthesized
agacaagataaaccaattcg

SEQ ID NO: 398460 - DNA, 20 bp, Artificial Sequence
  chemically synthesized
cagacaagataaaccaattc

SEQ ID NO: 398461 - DNA, 20 bp, Artificial Sequence
  chemically synthesized
tcgaattggtttatcttgtc

SEQ ID NO: 398462 - DNA, 20 bp, Artificial Sequence
  chemically synthesized
attagccattgcaaccagac

SEQ ID NO: 398463 - DNA, 20 bp, Artificial Sequence
  chemically synthesized
tttatcttgtctggttgcaa

SEQ ID NO: 398464 - DNA, 20 bp, Artificial Sequence
  chemically synthesized
aaaatattagccattgcaac

SEQ ID NO: 398465 - DNA, 20 bp, Artificial Sequence
  chemically synthesized
taacattgtgttgaaaatat

SEQ ID NO: 398466 - DNA, 20 bp, Artificial Sequence
  chemically synthesized
aatattttcaacacaatgtt

SEQ ID NO: 398467 - DNA, 20 bp, Artificial Sequence
  chemically synthesized
aacacaatgttaagtattaa

SEQ ID NO: 398468 - DNA, 20 bp, Artificial Sequence
  chemically synthesized
cacaatgttaagtattaatg

SEQ ID NO: 398469 - DNA, 20 bp, Artificial Sequence
  chemically synthesized
acaatgttaagtattaatgg

SEQ ID NO: 398470 - DNA, 20 bp, Artificial Sequence
  chemically synthesized
atgttaagtattaatggagg

SEQ ID NO: 398471 - DNA, 20 bp, Artificial Sequence
  chemically synthesized
agtattaatggaggtagctg

SEQ ID NO: 398472 - DNA, 20 bp, Artificial Sequence
  chemically synthesized
ggaaaaccatatgagtacta

SEQ ID NO: 398473 - DNA, 20 bp, Artificial Sequence
  chemically synthesized
aggtagctgtagtactcata

SEQ ID NO: 398474 - DNA, 20 bp, Artificial Sequence
  chemically synthesized
taaagacaggaaaaccatat

SEQ ID NO: 398475 - DNA, 20 bp, Artificial Sequence
  chemically synthesized
gatgcattctggataaagac

SEQ ID NO: 398476 - DNA, 20 bp, Artificial Sequence
  chemically synthesized
tgatgcattctggataaaga

SEQ ID NO: 398477 - DNA, 20 bp, Artificial Sequence
  chemically synthesized
atggttttcctgtctttatc

SEQ ID NO: 398478 - DNA, 20 bp, Artificial Sequence
  chemically synthesized
catctgatgcattctggata

SEQ ID NO: 398479 - DNA, 20 bp, Artificial Sequence
  chemically synthesized
aagaaacatctgatgcattc

SEQ ID NO: 398480 - DNA, 20 bp, Artificial Sequence
  chemically synthesized
tgtctttatccagaatgcat

SEQ ID NO: 398481 - DNA, 20 bp, Artificial Sequence
  chemically synthesized
gcatcagatgtttcttcttt

SEQ ID NO: 398482 - DNA, 20 bp, Artificial Sequence
  chemically synthesized
agtttgtacattacttaaag

SEQ ID NO: 398483 - DNA, 20 bp, Artificial Sequence
  chemically synthesized
aaaagtttgtacattactta

SEQ ID NO: 398484 - DNA, 20 bp, Artificial Sequence
  chemically synthesized
ttaagtaatgtacaaacttt

SEQ ID NO: 398485 - DNA, 20 bp, Artificial Sequence
  chemically synthesized
tgtgtgtgtgtaaagtccaa

SEQ ID NO: 398486 - DNA, 20 bp, Artificial Sequence
  chemically synthesized
tgtgtgtttgtgtgtgtgta

SEQ ID NO: 398487 - DNA, 20 bp, Artificial Sequence
  chemically synthesized
aaagtacatttaatataaaa

SEQ ID NO: 398488 - DNA, 20 bp, Artificial Sequence
  chemically synthesized
taaaatctatttcatgatta

SEQ ID NO: 398489 - DNA, 20 bp, Artificial Sequence
  chemically synthesized
aatgtactttaatcatgaaa

SEQ ID NO: 398490 - DNA, 20 bp, Artificial Sequence
  chemically synthesized
attttaattttatcaaatgt

SEQ ID NO: 398491 - DNA, 20 bp, Artificial Sequence
  chemically synthesized
tttggtttatatttaagtgt

SEQ ID NO: 398492 - DNA, 20 bp, Artificial Sequence
  chemically synthesized
ttagcttttggtttatattt

SEQ ID NO: 398493 - DNA, 20 bp, Artificial Sequence
  chemically synthesized
cacacttaaatataaaccaa

SEQ ID NO: 398494 - DNA, 20 bp, Artificial Sequence
  chemically synthesized
ttaaatataaaccaaaagct

SEQ ID NO: 398495 - DNA, 20 bp, Artificial Sequence
  chemically synthesized
ttacaagtgatcttagcttt

SEQ ID NO: 398496 - DNA, 20 bp, Artificial Sequence
  chemically synthesized
cctcaaattacaagtgatct

SEQ ID NO: 398497 - DNA, 20 bp, Artificial Sequence
  chemically synthesized
gctaagatcacttgtaattt

SEQ ID NO: 398498 - DNA, 20 bp, Artificial Sequence
  chemically synthesized
gaagtcattcctcaaattac

SEQ ID NO: 398499 - DNA, 20 bp, Artificial Sequence
  chemically synthesized
ctaagatcacttgtaatttg

SEQ ID NO: 398500 - DNA, 20 bp, Artificial Sequence
  chemically synthesized
tgaggaatgacttcaataat

SEQ ID NO: 398501 - DNA, 20 bp, Artificial Sequence
  chemically synthesized
ggaactgtttctcattattg

SEQ ID NO: 398502 - DNA, 20 bp, Artificial Sequence
  chemically synthesized
atgacttcaataatgagaaa

SEQ ID NO: 398503 - DNA, 20 bp, Artificial Sequence
  chemically synthesized
agaaacagttcctcaaaata

SEQ ID NO: 398504 - DNA, 20 bp, Artificial Sequence
  chemically synthesized
ttcttatttgctttattttg

SEQ ID NO: 398505 - DNA, 20 bp, Artificial Sequence
  chemically synthesized
gttcttatttgctttatttt

SEQ ID NO: 398506 - DNA, 20 bp, Artificial Sequence
  chemically synthesized
ttcctcaaaataaagcaaat

SEQ ID NO: 398507 - DNA, 20 bp, Artificial Sequence
  chemically synthesized
ataaagcaaataagaacaaa

SEQ ID NO: 398508 - DNA, 20 bp, Artificial Sequence
  chemically synthesized
taaagcaaataagaacaaat

SEQ ID NO: 398509 - DNA, 20 bp, Artificial Sequence
  chemically synthesized
agcaaataagaacaaatggg

SEQ ID NO: 398510 - DNA, 20 bp, Artificial Sequence
  chemically synthesized
aaataagaacaaatgggaag

SEQ ID NO: 398511 - DNA, 20 bp, Artificial Sequence
  chemically synthesized
aagaacaaatgggaagaaga

SEQ ID NO: 398512 - DNA, 20 bp, Artificial Sequence
  chemically synthesized
gggaagaagacagaaaacat

SEQ ID NO: 398513 - DNA, 20 bp, Artificial Sequence
  chemically synthesized
acagaaaacatgagcaatgc

SEQ ID NO: 398514 - DNA, 20 bp, Artificial Sequence
  chemically synthesized
gaaaacatgagcaatgcaag

SEQ ID NO: 398515 - DNA, 20 bp, Artificial Sequence
  chemically synthesized
aacatgagcaatgcaagcag

SEQ ID NO: 398516 - DNA, 20 bp, Artificial Sequence
  chemically synthesized
catgagcaatgcaagcagaa

SEQ ID NO: 398517 - DNA, 20 bp, Artificial Sequence
  chemically synthesized
atgcaagcagaagagaatta

SEQ ID NO: 398518 - DNA, 20 bp, Artificial Sequence
  chemically synthesized
tgcaagcagaagagaattat

SEQ ID NO: 398519 - DNA, 20 bp, Artificial Sequence
  chemically synthesized
attatgggaaaattataatt

SEQ ID NO: 398520 - DNA, 20 bp, Artificial Sequence
  chemically synthesized
ttatgggaaaattataattg

SEQ ID NO: 398521 - DNA, 20 bp, Artificial Sequence
  chemically synthesized
aaaattataattgaggtcca

SEQ ID NO: 398522 - DNA, 20 bp, Artificial Sequence
  chemically synthesized
ttataattgaggtccacaga

SEQ ID NO: 398523 - DNA, 20 bp, Artificial Sequence
  chemically synthesized
atttctctcctaactttctg

SEQ ID NO: 398524 - DNA, 20 bp, Artificial Sequence
  chemically synthesized
aattgaggtccacagaaagt

SEQ ID NO: 398525 - DNA, 20 bp, Artificial Sequence
  chemically synthesized
attgaggtccacagaaagtt

SEQ ID NO: 398526 - DNA, 20 bp, Artificial Sequence
  chemically synthesized
tgaggtccacagaaagttag

SEQ ID NO: 398527 - DNA, 20 bp, Artificial Sequence
  chemically synthesized
aggtccacagaaagttagga

SEQ ID NO: 398528 - DNA, 20 bp, Artificial Sequence
  chemically synthesized
ataattgtattttataaaac

SEQ ID NO: 398529 - DNA, 20 bp, Artificial Sequence
  chemically synthesized
taattgtattttataaaaca

SEQ ID NO: 398530 - DNA, 20 bp, Artificial Sequence
  chemically synthesized
ctaaataggatgtcaattat

SEQ ID NO: 398531 - DNA, 20 bp, Artificial Sequence
  chemically synthesized
actaaataggatgtcaatta

SEQ ID NO: 398532 - DNA, 20 bp, Artificial Sequence
  chemically synthesized
cctataattgacatcctatt

SEQ ID NO: 398533 - DNA, 20 bp, Artificial Sequence
  chemically synthesized
ataattgacatcctatttag

SEQ ID NO: 398534 - DNA, 20 bp, Artificial Sequence
  chemically synthesized
tcattttctcaccactaaat

SEQ ID NO: 398535 - DNA, 20 bp, Artificial Sequence
  chemically synthesized
ttcattttctcaccactaaa

SEQ ID NO: 398536 - DNA, 20 bp, Artificial Sequence
  chemically synthesized
ttgacatcctatttagtggt

SEQ ID NO: 398537 - DNA, 20 bp, Artificial Sequence
  chemically synthesized
tgagaaaatgaaaactttct

SEQ ID NO: 398538 - DNA, 20 bp, Artificial Sequence
  chemically synthesized
gagaaaatgaaaactttctc

SEQ ID NO: 398539 - DNA, 20 bp, Artificial Sequence
  chemically synthesized
aaaatgaaaactttctcagg

SEQ ID NO: 398540 - DNA, 20 bp, Artificial Sequence
  chemically synthesized
tgttcctgatcttcctgaga

SEQ ID NO: 398541 - DNA, 20 bp, Artificial Sequence
  chemically synthesized
gtcttgttcctgatcttcct

SEQ ID NO: 398542 - DNA, 20 bp, Artificial Sequence
  chemically synthesized
gaaaactttctcaggaagat

SEQ ID NO: 398543 - DNA, 20 bp, Artificial Sequence
  chemically synthesized
aaaactttctcaggaagatc

SEQ ID NO: 398544 - DNA, 20 bp, Artificial Sequence
  chemically synthesized
ttctcaggaagatcaggaac

SEQ ID NO: 398545 - DNA, 20 bp, Artificial Sequence
  chemically synthesized
gttgaaaaagagtggtaaga

SEQ ID NO: 398546 - DNA, 20 bp, Artificial Sequence
  chemically synthesized
atgttgaaaaagagtggtaa

SEQ ID NO: 398547 - DNA, 20 bp, Artificial Sequence
  chemically synthesized
tgatgttgaaaaagagtggt

SEQ ID NO: 398548 - DNA, 20 bp, Artificial Sequence
  chemically synthesized
aatatgatgttgaaaaagag

SEQ ID NO: 398549 - DNA, 20 bp, Artificial Sequence
  chemically synthesized
tccaatatgatgttgaaaaa

SEQ ID NO: 398550 - DNA, 20 bp, Artificial Sequence
  chemically synthesized
cttccaatatgatgttgaaa

SEQ ID NO: 398551 - DNA, 20 bp, Artificial Sequence
  chemically synthesized
actctttttcaacatcatat

SEQ ID NO: 398552 - DNA, 20 bp, Artificial Sequence
  chemically synthesized
ctttttcaacatcatattgg

SEQ ID NO: 398553 - DNA, 20 bp, Artificial Sequence
  chemically synthesized
caacatcatattggaagtcc

SEQ ID NO: 398554 - DNA, 20 bp, Artificial Sequence
  chemically synthesized
tttgtcttattgcattagct

SEQ ID NO: 398555 - DNA, 20 bp, Artificial Sequence
  chemically synthesized
ctttgtcttattgcattagc

SEQ ID NO: 398556 - DNA, 20 bp, Artificial Sequence
  chemically synthesized
gaagtcctagctaatgcaat

SEQ ID NO: 398557 - DNA, 20 bp, Artificial Sequence
  chemically synthesized
ttttctttgtcttattgcat

SEQ ID NO: 398558 - DNA, 20 bp, Artificial Sequence
  chemically synthesized
ctagctaatgcaataagaca

SEQ ID NO: 398559 - DNA, 20 bp, Artificial Sequence
  chemically synthesized
atgcaataagacaaagaaaa

SEQ ID NO: 398560 - DNA, 20 bp, Artificial Sequence
  chemically synthesized
aagaaaatagacatatctat

SEQ ID NO: 398561 - DNA, 20 bp, Artificial Sequence
  chemically synthesized
gcttcatttctacattccaa

SEQ ID NO: 398562 - DNA, 20 bp, Artificial Sequence
  chemically synthesized
tagacatatctattggaatg

SEQ ID NO: 398563 - DNA, 20 bp, Artificial Sequence
  chemically synthesized
tctattggaatgtagaaatg

SEQ ID NO: 398564 - DNA, 20 bp, Artificial Sequence
  chemically synthesized
atgtcatctatgaagaaata

SEQ ID NO: 398565 - DNA, 20 bp, Artificial Sequence
  chemically synthesized
aatgaagctgtatttcttca

SEQ ID NO: 398566 - DNA, 20 bp, Artificial Sequence
  chemically synthesized
agatggtcatgtcatctatg

SEQ ID NO: 398567 - DNA, 20 bp, Artificial Sequence
  chemically synthesized
agatgacatgaccatctatg

SEQ ID NO: 398568 - DNA, 20 bp, Artificial Sequence
  chemically synthesized
tttcagattttctacataga

SEQ ID NO: 398569 - DNA, 20 bp, Artificial Sequence
  chemically synthesized
attctttcagattttctaca

SEQ ID NO: 398570 - DNA, 20 bp, Artificial Sequence
  chemically synthesized
catctatgtagaaaatctga

SEQ ID NO: 398571 - DNA, 20 bp, Artificial Sequence
  chemically synthesized
gggttatttttcgattcttt

SEQ ID NO: 398572 - DNA, 20 bp, Artificial Sequence
  chemically synthesized
aaagaatcgaaaaataaccc

SEQ ID NO: 398573 - DNA, 20 bp, Artificial Sequence
  chemically synthesized
acaattgcttattatttcca

SEQ ID NO: 398574 - DNA, 20 bp, Artificial Sequence
  chemically synthesized
tacaattgcttattatttcc

SEQ ID NO: 398575 - DNA, 20 bp, Artificial Sequence
  chemically synthesized
ctacaattgcttattatttc

SEQ ID NO: 398576 - DNA, 20 bp, Artificial Sequence
  chemically synthesized
aaaataaccctggaaataat

SEQ ID NO: 398577 - DNA, 20 bp, Artificial Sequence
  chemically synthesized
ctggaaataataagcaattg

SEQ ID NO: 398578 - DNA, 20 bp, Artificial Sequence
  chemically synthesized
aataataagcaattgtagca

SEQ ID NO: 398579 - DNA, 20 bp, Artificial Sequence
  chemically synthesized
aagcaattgtagcaaagttg

SEQ ID NO: 398580 - DNA, 20 bp, Artificial Sequence
  chemically synthesized
agcaattgtagcaaagttgc

SEQ ID NO: 398581 - DNA, 20 bp, Artificial Sequence
  chemically synthesized
gtagcaaagttgcaggacac

SEQ ID NO: 398582 - DNA, 20 bp, Artificial Sequence
  chemically synthesized
ttcaattgtttcttacacac

SEQ ID NO: 398583 - DNA, 20 bp, Artificial Sequence
  chemically synthesized
cttgttcactgctggtgtgt

SEQ ID NO: 398584 - DNA, 20 bp, Artificial Sequence
  chemically synthesized
aattgtttcttacacaccag

SEQ ID NO: 398585 - DNA, 20 bp, Artificial Sequence
  chemically synthesized
aaattccacttgttcactgc

SEQ ID NO: 398586 - DNA, 20 bp, Artificial Sequence
  chemically synthesized
cttacacaccagcagtgaac

SEQ ID NO: 398587 - DNA, 20 bp, Artificial Sequence
  chemically synthesized
acacaccagcagtgaacaag

SEQ ID NO: 398588 - DNA, 20 bp, Artificial Sequence
  chemically synthesized
aatttgaaatgtaaaacaca

SEQ ID NO: 398589 - DNA, 20 bp, Artificial Sequence
  chemically synthesized
tttgaaaatgttagtggaaa

SEQ ID NO: 398590 - DNA, 20 bp, Artificial Sequence
  chemically synthesized
tttatttttgaaaatgttag

SEQ ID NO: 398591 - DNA, 20 bp, Artificial Sequence
  chemically synthesized
tattttatttttgaaaatgt

SEQ ID NO: 398592 - DNA, 20 bp, Artificial Sequence
  chemically synthesized
attttcaaaaataaaatact

SEQ ID NO: 398593 - DNA, 20 bp, Artificial Sequence
  chemically synthesized
ttttcaaaaataaaatactg

SEQ ID NO: 398594 - DNA, 20 bp, Artificial Sequence
  chemically synthesized
tattttttagatttattcct

SEQ ID NO: 398595 - DNA, 20 bp, Artificial Sequence
  chemically synthesized
taaagatcttgtatattttt

SEQ ID NO: 398596 - DNA, 20 bp, Artificial Sequence
  chemically synthesized
aataaatctaaaaaatatac

SEQ ID NO: 398597 - DNA, 20 bp, Artificial Sequence
  chemically synthesized
aaaatatacaagatctttac

SEQ ID NO: 398598 - DNA, 20 bp, Artificial Sequence
  chemically synthesized
agttttgtagttttcttgta

SEQ ID NO: 398599 - DNA, 20 bp, Artificial Sequence
  chemically synthesized
taactttcatcagagttttg

SEQ ID NO: 398600 - DNA, 20 bp, Artificial Sequence
  chemically synthesized
aaactacaaaactctgatga

SEQ ID NO: 398601 - DNA, 20 bp, Artificial Sequence
  chemically synthesized
tcctctgataactttcatca

SEQ ID NO: 398602 - DNA, 20 bp, Artificial Sequence
  chemically synthesized
gttcctctgataactttcat

SEQ ID NO: 398603 - DNA, 20 bp, Artificial Sequence
  chemically synthesized
aaaactctgatgaaagttat

SEQ ID NO: 398604 - DNA, 20 bp, Artificial Sequence
  chemically synthesized
aactctgatgaaagttatca

SEQ ID NO: 398605 - DNA, 20 bp, Artificial Sequence
  chemically synthesized
actctgatgaaagttatcag

SEQ ID NO: 398606 - DNA, 20 bp, Artificial Sequence
  chemically synthesized
tatcagaggaactaaatgaa

SEQ ID NO: 398607 - DNA, 20 bp, Artificial Sequence
  chemically synthesized
tgaatatttcaccattcatt

SEQ ID NO: 398608 - DNA, 20 bp, Artificial Sequence
  chemically synthesized
taaatgaatggtgaaatatt

SEQ ID NO: 398609 - DNA, 20 bp, Artificial Sequence
  chemically synthesized
ggtgaaatattcagtgttca

SEQ ID NO: 398610 - DNA, 20 bp, Artificial Sequence
  chemically synthesized
aaatattcagtgttcatgga

SEQ ID NO: 398611 - DNA, 20 bp, Artificial Sequence
  chemically synthesized
attcagtgttcatggataga

SEQ ID NO: 398612 - DNA, 20 bp, Artificial Sequence
  chemically synthesized
actgacttctttacaatatt

SEQ ID NO: 398613 - DNA, 20 bp, Artificial Sequence
  chemically synthesized
tagaaagactcaatattgta

SEQ ID NO: 398614 - DNA, 20 bp, Artificial Sequence
  chemically synthesized
aaagactcaatattgtaaag

SEQ ID NO: 398615 - DNA, 20 bp, Artificial Sequence
  chemically synthesized
actcaatattgtaaagaagt

SEQ ID NO: 398616 - DNA, 20 bp, Artificial Sequence
  chemically synthesized
taaagaagtcagttctcctc

SEQ ID NO: 398617 - DNA, 20 bp, Artificial Sequence
  chemically synthesized
aatctgtagatcaacttgag

SEQ ID NO: 398618 - DNA, 20 bp, Artificial Sequence
  chemically synthesized
taaatctgtagatcaacttg

SEQ ID NO: 398619 - DNA, 20 bp, Artificial Sequence
  chemically synthesized
ttaaatctgtagatcaactt

SEQ ID NO: 398620 - DNA, 20 bp, Artificial Sequence
  chemically synthesized
gttctcctcaagttgatcta

SEQ ID NO: 398621 - DNA, 20 bp, Artificial Sequence
  chemically synthesized
ttgggattgcgttaaatctg

SEQ ID NO: 398622 - DNA, 20 bp, Artificial Sequence
  chemically synthesized
aacttgctgtgattttgatt

SEQ ID NO: 398623 - DNA, 20 bp, Artificial Sequence
  chemically synthesized
taacttgctgtgattttgat

SEQ ID NO: 398624 - DNA, 20 bp, Artificial Sequence
  chemically synthesized
cgcaatcccaatcaaaatca

SEQ ID NO: 398625 - DNA, 20 bp, Artificial Sequence
  chemically synthesized
atcccaatcaaaatcacagc

SEQ ID NO: 398626 - DNA, 20 bp, Artificial Sequence
  chemically synthesized
cggtttgtctatataaggca

SEQ ID NO: 398627 - DNA, 20 bp, Artificial Sequence
  chemically synthesized
acggtttgtctatataaggc

SEQ ID NO: 398628 - DNA, 20 bp, Artificial Sequence
  chemically synthesized
gcaagttaccttgccttata

SEQ ID NO: 398629 - DNA, 20 bp, Artificial Sequence
  chemically synthesized
agaaacggtttgtctatata

SEQ ID NO: 398630 - DNA, 20 bp, Artificial Sequence
  chemically synthesized
tagaaacggtttgtctatat

SEQ ID NO: 398631 - DNA, 20 bp, Artificial Sequence
  chemically synthesized
atatagacaaaccgtttcta

SEQ ID NO: 398632 - DNA, 20 bp, Artificial Sequence
  chemically synthesized
tttcatataaactttagaaa

SEQ ID NO: 398633 - DNA, 20 bp, Artificial Sequence
  chemically synthesized
tttgcctttcatataaactt

SEQ ID NO: 398634 - DNA, 20 bp, Artificial Sequence
  chemically synthesized
cgtttctaaagtttatatga

SEQ ID NO: 398635 - DNA, 20 bp, Artificial Sequence
  chemically synthesized
gtttctaaagtttatatgaa

SEQ ID NO: 398636 - DNA, 20 bp, Artificial Sequence
  chemically synthesized
aaagtttatatgaaaggcaa

SEQ ID NO: 398637 - DNA, 20 bp, Artificial Sequence
  chemically synthesized
tatatgaaaggcaaaagacc

SEQ ID NO: 398638 - DNA, 20 bp, Artificial Sequence
  chemically synthesized
aatattgtgtgggttattct

SEQ ID NO: 398639 - DNA, 20 bp, Artificial Sequence
  chemically synthesized
caatattgtgtgggttattc

SEQ ID NO: 398640 - DNA, 20 bp, Artificial Sequence
  chemically synthesized
cttctccttcaatattgtgt

SEQ ID NO: 398641 - DNA, 20 bp, Artificial Sequence
  chemically synthesized
tcttctccttcaatattgtg

SEQ ID NO: 398642 - DNA, 20 bp, Artificial Sequence
  chemically synthesized
gaataacccacacaatattg

SEQ ID NO: 398643 - DNA, 20 bp, Artificial Sequence
  chemically synthesized
aataacccacacaatattga

SEQ ID NO: 398644 - DNA, 20 bp, Artificial Sequence
  chemically synthesized
taacccacacaatattgaag

SEQ ID NO: 398645 - DNA, 20 bp, Artificial Sequence
  chemically synthesized
cccacacaatattgaaggag

SEQ ID NO: 398646 - DNA, 20 bp, Artificial Sequence
  chemically synthesized
aatattgaaggagaagaaca

SEQ ID NO: 398647 - DNA, 20 bp, Artificial Sequence
  chemically synthesized
ttgaaggagaagaacaaagt

SEQ ID NO: 398648 - DNA, 20 bp, Artificial Sequence
  chemically synthesized
gtcttgtagtcagatagtgt

SEQ ID NO: 398649 - DNA, 20 bp, Artificial Sequence
  chemically synthesized
tagtaagtcttgtagtcaga

SEQ ID NO: 398650 - DNA, 20 bp, Artificial Sequence
  chemically synthesized
aactgacactatctgactac

SEQ ID NO: 398651 - DNA, 20 bp, Artificial Sequence
  chemically synthesized
ttcatagtaagtcttgtagt

SEQ ID NO: 398652 - DNA, 20 bp, Artificial Sequence
  chemically synthesized
tcatttcatagtaagtcttg

SEQ ID NO: 398653 - DNA, 20 bp, Artificial Sequence
  chemically synthesized
gattactgtcatttcatagt

SEQ ID NO: 398654 - DNA, 20 bp, Artificial Sequence
  chemically synthesized
tcttgattactgtcatttca

SEQ ID NO: 398655 - DNA, 20 bp, Artificial Sequence
  chemically synthesized
caagacttactatgaaatga

SEQ ID NO: 398656 - DNA, 20 bp, Artificial Sequence
  chemically synthesized
actatgaaatgacagtaatc

SEQ ID NO: 398657 - DNA, 20 bp, Artificial Sequence
  chemically synthesized
tgaaatgacagtaatcaaga

SEQ ID NO: 398658 - DNA, 20 bp, Artificial Sequence
  chemically synthesized
cagtaatcaagacagtgtat

SEQ ID NO: 398659 - DNA, 20 bp, Artificial Sequence
  chemically synthesized
acagtgtattggcaaaataa

SEQ ID NO: 398660 - DNA, 20 bp, Artificial Sequence
  chemically synthesized
ataatagacaaatacatcaa

SEQ ID NO: 398661 - DNA, 20 bp, Artificial Sequence
  chemically synthesized
agacaaatacatcaatagaa

SEQ ID NO: 398662 - DNA, 20 bp, Artificial Sequence
  chemically synthesized
aatacatcaatagaacagaa

SEQ ID NO: 398663 - DNA, 20 bp, Artificial Sequence
  chemically synthesized
atcaatagaacagaatagtg

SEQ ID NO: 398664 - DNA, 20 bp, Artificial Sequence
  chemically synthesized
agaacagaatagtgtggaaa

SEQ ID NO: 398665 - DNA, 20 bp, Artificial Sequence
  chemically synthesized
tcagtaaactgtattcatgt

SEQ ID NO: 398666 - DNA, 20 bp, Artificial Sequence
  chemically synthesized
atcagtaaactgtattcatg

SEQ ID NO: 398667 - DNA, 20 bp, Artificial Sequence
  chemically synthesized
gaaatagacccacatgaata

SEQ ID NO: 398668 - DNA, 20 bp, Artificial Sequence
  chemically synthesized
attgctcgtttgtcaaagat

SEQ ID NO: 398669 - DNA, 20 bp, Artificial Sequence
  chemically synthesized
ttgccattgctcgtttgtca

SEQ ID NO: 398670 - DNA, 20 bp, Artificial Sequence
  chemically synthesized
tttactgatctttgacaaac

SEQ ID NO: 398671 - DNA, 20 bp, Artificial Sequence
  chemically synthesized
gatctttgacaaacgagcaa

SEQ ID NO: 398672 - DNA, 20 bp, Artificial Sequence
  chemically synthesized
tgacaaacgagcaatggcaa

SEQ ID NO: 398673 - DNA, 20 bp, Artificial Sequence
  chemically synthesized
aacgagcaatggcaatagaa

SEQ ID NO: 398674 - DNA, 20 bp, Artificial Sequence
  chemically synthesized
cgagcaatggcaatagaatg

SEQ ID NO: 398675 - DNA, 20 bp, Artificial Sequence
  chemically synthesized
aatggcaatagaatggagca

SEQ ID NO: 398676 - DNA, 20 bp, Artificial Sequence
  chemically synthesized
gcaatagaatggagcaaaga

SEQ ID NO: 398677 - DNA, 20 bp, Artificial Sequence
  chemically synthesized
ttcagcattatttgttgaaa

SEQ ID NO: 398678 - DNA, 20 bp, Artificial Sequence
  chemically synthesized
tttcagcattatttgttgaa

SEQ ID NO: 398679 - DNA, 20 bp, Artificial Sequence
  chemically synthesized
acaaataatgctgaaacaac

SEQ ID NO: 398680 - DNA, 20 bp, Artificial Sequence
  chemically synthesized
atgtagatgtccagttgttt

SEQ ID NO: 398681 - DNA, 20 bp, Artificial Sequence
  chemically synthesized
tttttttgcatgtagatgtc

SEQ ID NO: 398682 - DNA, 20 bp, Artificial Sequence
  chemically synthesized
tacattcatttttttgcatg

SEQ ID NO: 398683 - DNA, 20 bp, Artificial Sequence
  chemically synthesized
tacatgcaaaaaaatgaatg

SEQ ID NO: 398684 - DNA, 20 bp, Artificial Sequence
  chemically synthesized
caaaaaaatgaatgtagaca

SEQ ID NO: 398685 - DNA, 20 bp, Artificial Sequence
  chemically synthesized
ttctgatctgatagagtgca

SEQ ID NO: 398686 - DNA, 20 bp, Artificial Sequence
  chemically synthesized
cttctgatctgatagagtgc

SEQ ID NO: 398687 - DNA, 20 bp, Artificial Sequence
  chemically synthesized
acatagaccttgcactctat

SEQ ID NO: 398688 - DNA, 20 bp, Artificial Sequence
  chemically synthesized
gtctctcttctgatctgata

SEQ ID NO: 398689 - DNA, 20 bp, Artificial Sequence
  chemically synthesized
gaccttgcactctatcagat

SEQ ID NO: 398690 - DNA, 20 bp, Artificial Sequence
  chemically synthesized
ttgtctctcttctgatctga

SEQ ID NO: 398691 - DNA, 20 bp, Artificial Sequence
  chemically synthesized
cttgcactctatcagatcag

SEQ ID NO: 398692 - DNA, 20 bp, Artificial Sequence
  chemically synthesized
tgcactctatcagatcagaa

SEQ ID NO: 398693 - DNA, 20 bp, Artificial Sequence
  chemically synthesized
cactctatcagatcagaaga

SEQ ID NO: 398694 - DNA, 20 bp, Artificial Sequence
  chemically synthesized
atcagatcagaagagagaca

SEQ ID NO: 398695 - DNA, 20 bp, Artificial Sequence
  chemically synthesized
tcagaagagagacaaagatc

SEQ ID NO: 398696 - DNA, 20 bp, Artificial Sequence
  chemically synthesized
aaagatcaagttactgctac

SEQ ID NO: 398697 - DNA, 20 bp, Artificial Sequence
  chemically synthesized
ttaacttgtaaatccagtag

SEQ ID NO: 398698 - DNA, 20 bp, Artificial Sequence
  chemically synthesized
acgttaacttgtaaatccag

SEQ ID NO: 398699 - DNA, 20 bp, Artificial Sequence
  chemically synthesized
gttactgctactggatttac

SEQ ID NO: 398700 - DNA, 20 bp, Artificial Sequence
  chemically synthesized
tgaacgttaacttgtaaatc

SEQ ID NO: 398701 - DNA, 20 bp, Artificial Sequence
  chemically synthesized
atttacaagttaacgttcac

SEQ ID NO: 398702 - DNA, 20 bp, Artificial Sequence
  chemically synthesized
attgtatgagtgtgtacaac

SEQ ID NO: 398703 - DNA, 20 bp, Artificial Sequence
  chemically synthesized
aagtgcctctagcattgtat

SEQ ID NO: 398704 - DNA, 20 bp, Artificial Sequence
  chemically synthesized
tgtacacactcatacaatgc

SEQ ID NO: 398705 - DNA, 20 bp, Artificial Sequence
  chemically synthesized
tacacactcatacaatgcta

SEQ ID NO: 398706 - DNA, 20 bp, Artificial Sequence
  chemically synthesized
acacactcatacaatgctag

SEQ ID NO: 398707 - DNA, 20 bp, Artificial Sequence
  chemically synthesized
agagatgatacaagtgcctc

SEQ ID NO: 398708 - DNA, 20 bp, Artificial Sequence
  chemically synthesized
ggaacaatgagagatgatac

SEQ ID NO: 398709 - DNA, 20 bp, Artificial Sequence
  chemically synthesized
taaaaaataaggaacaatga

SEQ ID NO: 398710 - DNA, 20 bp, Artificial Sequence
  chemically synthesized
attaaaaaataaggaacaat

SEQ ID NO: 398711 - DNA, 20 bp, Artificial Sequence
  chemically synthesized
tttatctctattaaaaaata

SEQ ID NO: 398712 - DNA, 20 bp, Artificial Sequence
  chemically synthesized
atttatctctattaaaaaat

SEQ ID NO: 398713 - DNA, 20 bp, Artificial Sequence
  chemically synthesized
cattgttccttattttttaa

SEQ ID NO: 398714 - DNA, 20 bp, Artificial Sequence
  chemically synthesized
ttgttccttattttttaata

SEQ ID NO: 398715 - DNA, 20 bp, Artificial Sequence
  chemically synthesized
atgtatttattcttgttctt

SEQ ID NO: 398716 - DNA, 20 bp, Artificial Sequence
  chemically synthesized
tgtatttattcttgttcttg

SEQ ID NO: 398717 - DNA, 20 bp, Artificial Sequence
  chemically synthesized
taaaatttatcctcaagaac

SEQ ID NO: 398718 - DNA, 20 bp, Artificial Sequence
  chemically synthesized
aactcctaaaatttatcctc

SEQ ID NO: 398719 - DNA, 20 bp, Artificial Sequence
  chemically synthesized
ttgttcttgaggataaattt

SEQ ID NO: 398720 - DNA, 20 bp, Artificial Sequence
  chemically synthesized
tgttcttgaggataaatttt

SEQ ID NO: 398721 - DNA, 20 bp, Artificial Sequence
  chemically synthesized
ttcttgaggataaattttag

SEQ ID NO: 398722 - DNA, 20 bp, Artificial Sequence
  chemically synthesized
ttagtatgtttttatggaag

SEQ ID NO: 398723 - DNA, 20 bp, Artificial Sequence
  chemically synthesized
ttttagtatgtttttatgga

SEQ ID NO: 398724 - DNA, 20 bp, Artificial Sequence
  chemically synthesized
gttttagtatgtttttatgg

SEQ ID NO: 398725 - DNA, 20 bp, Artificial Sequence
  chemically synthesized
ttagttttagtatgttttta

SEQ ID NO: 398726 - DNA, 20 bp, Artificial Sequence
  chemically synthesized
attgaaaataattttagttt

SEQ ID NO: 398727 - DNA, 20 bp, Artificial Sequence
  chemically synthesized
aaaatcattgaaaataattt

SEQ ID NO: 398728 - DNA, 20 bp, Artificial Sequence
  chemically synthesized
ttattttcaatgattttcca

SEQ ID NO: 398729 - DNA, 20 bp, Artificial Sequence
  chemically synthesized
tattttcaatgattttccat

SEQ ID NO: 398730 - DNA, 20 bp, Artificial Sequence
  chemically synthesized
aagtataggtaaatttccca

SEQ ID NO: 398731 - DNA, 20 bp, Artificial Sequence
  chemically synthesized
agagtttggtggcaaagtat

SEQ ID NO: 398732 - DNA, 20 bp, Artificial Sequence
  chemically synthesized
gagagtttggtggcaaagta

SEQ ID NO: 398733 - DNA, 20 bp, Artificial Sequence
  chemically synthesized
caagagagagtttggtggca

SEQ ID NO: 398734 - DNA, 20 bp, Artificial Sequence
  chemically synthesized
tattgcaagagagagtttgg

SEQ ID NO: 398735 - DNA, 20 bp, Artificial Sequence
  chemically synthesized
gactattgcaagagagagtt

SEQ ID NO: 398736 - DNA, 20 bp, Artificial Sequence
  chemically synthesized
agaaagactattgcaagaga

SEQ ID NO: 398737 - DNA, 20 bp, Artificial Sequence
  chemically synthesized
taagaaagactattgcaaga

SEQ ID NO: 398738 - DNA, 20 bp, Artificial Sequence
  chemically synthesized
caccaaactctctcttgcaa

SEQ ID NO: 398739 - DNA, 20 bp, Artificial Sequence
  chemically synthesized
gataagaaagactattgcaa

SEQ ID NO: 398740 - DNA, 20 bp, Artificial Sequence
  chemically synthesized
gggataagaaagactattgc

SEQ ID NO: 398741 - DNA, 20 bp, Artificial Sequence
  chemically synthesized
ggttatttactgggataaga

SEQ ID NO: 398742 - DNA, 20 bp, Artificial Sequence
  chemically synthesized
tgcaatagtctttcttatcc

SEQ ID NO: 398743 - DNA, 20 bp, Artificial Sequence
  chemically synthesized
ggatggttatttactgggat

SEQ ID NO: 398744 - DNA, 20 bp, Artificial Sequence
  chemically synthesized
ggatgggatggttatttact

SEQ ID NO: 398745 - DNA, 20 bp, Artificial Sequence
  chemically synthesized
aggatgggatggttatttac

SEQ ID NO: 398746 - DNA, 20 bp, Artificial Sequence
  chemically synthesized
gagcaaaaggaaggatggga

SEQ ID NO: 398747 - DNA, 20 bp, Artificial Sequence
  chemically synthesized
gcttgagcaaaaggaaggat

SEQ ID NO: 398748 - DNA, 20 bp, Artificial Sequence
  chemically synthesized
agcttgagcaaaaggaagga

SEQ ID NO: 398749 - DNA, 20 bp, Artificial Sequence
  chemically synthesized
ttttagcttgagcaaaagga

SEQ ID NO: 398750 - DNA, 20 bp, Artificial Sequence
  chemically synthesized
gttttagcttgagcaaaagg

SEQ ID NO: 398751 - DNA, 20 bp, Artificial Sequence
  chemically synthesized
tcccatccttccttttgctc

SEQ ID NO: 398752 - DNA, 20 bp, Artificial Sequence
  chemically synthesized
acagttttagcttgagcaaa

SEQ ID NO: 398753 - DNA, 20 bp, Artificial Sequence
  chemically synthesized
aacagttttagcttgagcaa

SEQ ID NO: 398754 - DNA, 20 bp, Artificial Sequence
  chemically synthesized
gagaaaaacagttttagctt

SEQ ID NO: 398755 - DNA, 20 bp, Artificial Sequence
  chemically synthesized
agagtggagaaaaacagttt

SEQ ID NO: 398756 - DNA, 20 bp, Artificial Sequence
  chemically synthesized
attgagagagtggagaaaaa

SEQ ID NO: 398757 - DNA, 20 bp, Artificial Sequence
  chemically synthesized
aaatggagattgagagagtg

SEQ ID NO: 398758 - DNA, 20 bp, Artificial Sequence
  chemically synthesized
aaaaatggagattgagagag

SEQ ID NO: 398759 - DNA, 20 bp, Artificial Sequence
  chemically synthesized
actaaaaatggagattgaga

SEQ ID NO: 398760 - DNA, 20 bp, Artificial Sequence
  chemically synthesized
ggactaaaaatggagattga

SEQ ID NO: 398761 - DNA, 20 bp, Artificial Sequence
  chemically synthesized
gtggactaaaaatggagatt

SEQ ID NO: 398762 - DNA, 20 bp, Artificial Sequence
  chemically synthesized
actctctcaatctccatttt

SEQ ID NO: 398763 - DNA, 20 bp, Artificial Sequence
  chemically synthesized
ttgctggtggactaaaaatg

SEQ ID NO: 398764 - DNA, 20 bp, Artificial Sequence
  chemically synthesized
atttgctggtggactaaaaa

SEQ ID NO: 398765 - DNA, 20 bp, Artificial Sequence
  chemically synthesized
aatctccatttttagtccac

SEQ ID NO: 398766 - DNA, 20 bp, Artificial Sequence
  chemically synthesized
gatgtaacaggatttgctgg

SEQ ID NO: 398767 - DNA, 20 bp, Artificial Sequence
  chemically synthesized
gtagatgtaacaggatttgc

SEQ ID NO: 398768 - DNA, 20 bp, Artificial Sequence
  chemically synthesized
attttgaaagtagatgtaac

SEQ ID NO: 398769 - DNA, 20 bp, Artificial Sequence
  chemically synthesized
cattttgaaagtagatgtaa

SEQ ID NO: 398770 - DNA, 20 bp, Artificial Sequence
  chemically synthesized
ttttggatacattttgaaag

SEQ ID NO: 398771 - DNA, 20 bp, Artificial Sequence
  chemically synthesized
gaattttggatacattttga

SEQ ID NO: 398772 - DNA, 20 bp, Artificial Sequence
  chemically synthesized
ggggagaaatgatcgaattt

SEQ ID NO: 398773 - DNA, 20 bp, Artificial Sequence
  chemically synthesized
aaaattcgatcatttctccc

SEQ ID NO: 398774 - DNA, 20 bp, Artificial Sequence
  chemically synthesized
ttgatgtccatggatctggg

SEQ ID NO: 398775 - DNA, 20 bp, Artificial Sequence
  chemically synthesized
ggttgatgtccatggatctg

SEQ ID NO: 398776 - DNA, 20 bp, Artificial Sequence
  chemically synthesized
atcatttctccccagatcca

SEQ ID NO: 398777 - DNA, 20 bp, Artificial Sequence
  chemically synthesized
aggttgatgtccatggatct

SEQ ID NO: 398778 - DNA, 20 bp, Artificial Sequence
  chemically synthesized
taggttgatgtccatggatc

SEQ ID NO: 398779 - DNA, 20 bp, Artificial Sequence
  chemically synthesized
taggattaggttgatgtcca

SEQ ID NO: 398780 - DNA, 20 bp, Artificial Sequence
  chemically synthesized
catggacatcaacctaatcc

SEQ ID NO: 398781 - DNA, 20 bp, Artificial Sequence
  chemically synthesized
gtgtgcgtgtggctaggatt

SEQ ID NO: 398782 - DNA, 20 bp, Artificial Sequence
  chemically synthesized
tgtgtgcgtgtggctaggat

SEQ ID NO: 398783 - DNA, 20 bp, Artificial Sequence
  chemically synthesized
ctgggtgtgtgcgtgtggct

SEQ ID NO: 398784 - DNA, 20 bp, Artificial Sequence
  chemically synthesized
gctgggtgtgtgcgtgtggc

SEQ ID NO: 398785 - DNA, 20 bp, Artificial Sequence
  chemically synthesized
gaaggctgggtgtgtgcgtg

SEQ ID NO: 398786 - DNA, 20 bp, Artificial Sequence
  chemically synthesized
cctagccacacgcacacacc

SEQ ID NO: 398787 - DNA, 20 bp, Artificial Sequence
  chemically synthesized
ataatgtagtaatgaaggct

SEQ ID NO: 398788 - DNA, 20 bp, Artificial Sequence
  chemically synthesized
gataatgtagtaatgaaggc

SEQ ID NO: 398789 - DNA, 20 bp, Artificial Sequence
  chemically synthesized
agaggataatgtagtaatga

SEQ ID NO: 398790 - DNA, 20 bp, Artificial Sequence
  chemically synthesized
tagaggataatgtagtaatg

SEQ ID NO: 398791 - DNA, 20 bp, Artificial Sequence
  chemically synthesized
agatgagttagaggataatg

SEQ ID NO: 398792 - DNA, 20 bp, Artificial Sequence
  chemically synthesized
gaagtagagagatgagttag

SEQ ID NO: 398793 - DNA, 20 bp, Artificial Sequence
  chemically synthesized
agaagtagagagatgagtta

SEQ ID NO: 398794 - DNA, 20 bp, Artificial Sequence
  chemically synthesized
gtagaagtagagagatgagt

SEQ ID NO: 398795 - DNA, 20 bp, Artificial Sequence
  chemically synthesized
aaaggtagaagtagagagat

SEQ ID NO: 398796 - DNA, 20 bp, Artificial Sequence
  chemically synthesized
gatgtaaaggtagaagtaga

SEQ ID NO: 398797 - DNA, 20 bp, Artificial Sequence
  chemically synthesized
aggatgtaaaggtagaagta

SEQ ID NO: 398798 - DNA, 20 bp, Artificial Sequence
  chemically synthesized
gtaggatgtaaaggtagaag

SEQ ID NO: 398799 - DNA, 20 bp, Artificial Sequence
  chemically synthesized
aatgtaggatgtaaaggtag

SEQ ID NO: 398800 - DNA, 20 bp, Artificial Sequence
  chemically synthesized
tagaatgtaggatgtaaagg

SEQ ID NO: 398801 - DNA, 20 bp, Artificial Sequence
  chemically synthesized
agttagaatgtaggatgtaa

SEQ ID NO: 398802 - DNA, 20 bp, Artificial Sequence
  chemically synthesized
aagttagaatgtaggatgta

SEQ ID NO: 398803 - DNA, 20 bp, Artificial Sequence
  chemically synthesized
aataatgtaagttagaatgt

SEQ ID NO: 398804 - DNA, 20 bp, Artificial Sequence
  chemically synthesized
aaataatgtaagttagaatg

SEQ ID NO: 398805 - DNA, 20 bp, Artificial Sequence
  chemically synthesized
tagccagaaataatgtaagt

SEQ ID NO: 398806 - DNA, 20 bp, Artificial Sequence
  chemically synthesized
acagtagccagaaataatgt

SEQ ID NO: 398807 - DNA, 20 bp, Artificial Sequence
  chemically synthesized
attctaacttacattatttc

SEQ ID NO: 398808 - DNA, 20 bp, Artificial Sequence
  chemically synthesized
tgagagttctgaacagtagc

SEQ ID NO: 398809 - DNA, 20 bp, Artificial Sequence
  chemically synthesized
cattatttctggctactgtt

SEQ ID NO: 398810 - DNA, 20 bp, Artificial Sequence
  chemically synthesized
attttgagagttctgaacag

SEQ ID NO: 398811 - DNA, 20 bp, Artificial Sequence
  chemically synthesized
gagattttgagagttctgaa

SEQ ID NO: 398812 - DNA, 20 bp, Artificial Sequence
  chemically synthesized
gggagattaggagattttga

SEQ ID NO: 398813 - DNA, 20 bp, Artificial Sequence
  chemically synthesized
gtgggagattaggagatttt

SEQ ID NO: 398814 - DNA, 20 bp, Artificial Sequence
  chemically synthesized
tgtacattgtgggagattag

SEQ ID NO: 398815 - DNA, 20 bp, Artificial Sequence
  chemically synthesized
cttgtacattgtgggagatt

SEQ ID NO: 398816 - DNA, 20 bp, Artificial Sequence
  chemically synthesized
gcttgtacattgtgggagat

SEQ ID NO: 398817 - DNA, 20 bp, Artificial Sequence
  chemically synthesized
tcttggcttgtacattgtgg

SEQ ID NO: 398818 - DNA, 20 bp, Artificial Sequence
  chemically synthesized
ggtcttggcttgtacattgt

SEQ ID NO: 398819 - DNA, 20 bp, Artificial Sequence
  chemically synthesized
aggtcttggcttgtacattg

SEQ ID NO: 398820 - DNA, 20 bp, Artificial Sequence
  chemically synthesized
cctaatctcccacaatgtac

SEQ ID NO: 398821 - DNA, 20 bp, Artificial Sequence
  chemically synthesized
tctcccacaatgtacaagcc

SEQ ID NO: 398822 - DNA, 20 bp, Artificial Sequence
  chemically synthesized
attgaccattgtaaaggtct

SEQ ID NO: 398823 - DNA, 20 bp, Artificial Sequence
  chemically synthesized
acaagccaagacctttacaa

SEQ ID NO: 398824 - DNA, 20 bp, Artificial Sequence
  chemically synthesized
ggccttattgaccattgtaa

SEQ ID NO: 398825 - DNA, 20 bp, Artificial Sequence
  chemically synthesized
gggccttattgaccattgta

SEQ ID NO: 398826 - DNA, 20 bp, Artificial Sequence
  chemically synthesized
agacctttacaatggtcaat

SEQ ID NO: 398827 - DNA, 20 bp, Artificial Sequence
  chemically synthesized
gacctttacaatggtcaata

SEQ ID NO: 398828 - DNA, 20 bp, Artificial Sequence
  chemically synthesized
ttagaaggacaaatcagata

SEQ ID NO: 398829 - DNA, 20 bp, Artificial Sequence
  chemically synthesized
attagaaggacaaatcagat

SEQ ID NO: 398830 - DNA, 20 bp, Artificial Sequence
  chemically synthesized
tattagaaggacaaatcaga

SEQ ID NO: 398831 - DNA, 20 bp, Artificial Sequence
  chemically synthesized
gtggtattagaaggacaaat

SEQ ID NO: 398832 - DNA, 20 bp, Artificial Sequence
  chemically synthesized
gcaagtggagtggtattaga

SEQ ID NO: 398833 - DNA, 20 bp, Artificial Sequence
  chemically synthesized
tgcaagtggagtggtattag

SEQ ID NO: 398834 - DNA, 20 bp, Artificial Sequence
  chemically synthesized
atctgcaagtggagtggtat

SEQ ID NO: 398835 - DNA, 20 bp, Artificial Sequence
  chemically synthesized
ggtaggatctgcaagtggag

SEQ ID NO: 398836 - DNA, 20 bp, Artificial Sequence
  chemically synthesized
ttctaataccactccacttg

SEQ ID NO: 398837 - DNA, 20 bp, Artificial Sequence
  chemically synthesized
agcggtaggatctgcaagtg

SEQ ID NO: 398838 - DNA, 20 bp, Artificial Sequence
  chemically synthesized
agagcggtaggatctgcaag

SEQ ID NO: 398839 - DNA, 20 bp, Artificial Sequence
  chemically synthesized
ggaagagcggtaggatctgc

SEQ ID NO: 398840 - DNA, 20 bp, Artificial Sequence
  chemically synthesized
agtgactgaggaagagcggt

SEQ ID NO: 398841 - DNA, 20 bp, Artificial Sequence
  chemically synthesized
gagtgactgaggaagagcgg

SEQ ID NO: 398842 - DNA, 20 bp, Artificial Sequence
  chemically synthesized
gcagagtgactgaggaagag

SEQ ID NO: 398843 - DNA, 20 bp, Artificial Sequence
  chemically synthesized
cagatcctaccgctcttcct

SEQ ID NO: 398844 - DNA, 20 bp, Artificial Sequence
  chemically synthesized
ggtgcagagtgactgaggaa

SEQ ID NO: 398845 - DNA, 20 bp, Artificial Sequence
  chemically synthesized
ctggtgcagagtgactgagg

SEQ ID NO: 398846 - DNA, 20 bp, Artificial Sequence
  chemically synthesized
tggctggtgcagagtgactg

SEQ ID NO: 398847 - DNA, 20 bp, Artificial Sequence
  chemically synthesized
atggctggtgcagagtgact

SEQ ID NO: 398848 - DNA, 20 bp, Artificial Sequence
  chemically synthesized
cttcctcagtcactctgcac

SEQ ID NO: 398849 - DNA, 20 bp, Artificial Sequence
  chemically synthesized
gagtcaagatggctggtgca

SEQ ID NO: 398850 - DNA, 20 bp, Artificial Sequence
  chemically synthesized
gggagtcaagatggctggtg

SEQ ID NO: 398851 - DNA, 20 bp, Artificial Sequence
  chemically synthesized
aacaagggagtcaagatggc

SEQ ID NO: 398852 - DNA, 20 bp, Artificial Sequence
  chemically synthesized
ggataacaagggagtcaaga

SEQ ID NO: 398853 - DNA, 20 bp, Artificial Sequence
  chemically synthesized
tgtgggataacaagggagtc

SEQ ID NO: 398854 - DNA, 20 bp, Artificial Sequence
  chemically synthesized
gtgtttgtgggataacaagg

SEQ ID NO: 398855 - DNA, 20 bp, Artificial Sequence
  chemically synthesized
gcgtgtttgtgggataacaa

SEQ ID NO: 398856 - DNA, 20 bp, Artificial Sequence
  chemically synthesized
tgcgtgtttgtgggataaca

SEQ ID NO: 398857 - DNA, 20 bp, Artificial Sequence
  chemically synthesized
gtgcgtgtttgtgggataac

SEQ ID NO: 398858 - DNA, 20 bp, Artificial Sequence
  chemically synthesized
aggagggagtgcgtgtttgt

SEQ ID NO: 398859 - DNA, 20 bp, Artificial Sequence
  chemically synthesized
gaggagggagtgcgtgtttg

SEQ ID NO: 398860 - DNA, 20 bp, Artificial Sequence
  chemically synthesized
acaaacacgcactccctcct

SEQ ID NO: 398861 - DNA, 20 bp, Artificial Sequence
  chemically synthesized
atatgtacactctgaggagg

SEQ ID NO: 398862 - DNA, 20 bp, Artificial Sequence
  chemically synthesized
aaacacgcactccctcctca

SEQ ID NO: 398863 - DNA, 20 bp, Artificial Sequence
  chemically synthesized
gaatatgtacactctgagga

SEQ ID NO: 398864 - DNA, 20 bp, Artificial Sequence
  chemically synthesized
agaatatgtacactctgagg

SEQ ID NO: 398865 - DNA, 20 bp, Artificial Sequence
  chemically synthesized
aagaatatgtacactctgag

SEQ ID NO: 398866 - DNA, 20 bp, Artificial Sequence
  chemically synthesized
ggaagaatatgtacactctg

SEQ ID NO: 398867 - DNA, 20 bp, Artificial Sequence
  chemically synthesized
gggaagaatatgtacactct

SEQ ID NO: 398868 - DNA, 20 bp, Artificial Sequence
  chemically synthesized
agagagttctaggcagaggg

SEQ ID NO: 398869 - DNA, 20 bp, Artificial Sequence
  chemically synthesized
tacatattcttccctctgcc

SEQ ID NO: 398870 - DNA, 20 bp, Artificial Sequence
  chemically synthesized
agaagagagttctaggcaga

SEQ ID NO: 398871 - DNA, 20 bp, Artificial Sequence
  chemically synthesized
gagaagagagttctaggcag

SEQ ID NO: 398872 - DNA, 20 bp, Artificial Sequence
  chemically synthesized
ggagaagagagttctaggca

SEQ ID NO: 398873 - DNA, 20 bp, Artificial Sequence
  chemically synthesized
ttggagaagagagttctagg

SEQ ID NO: 398874 - DNA, 20 bp, Artificial Sequence
  chemically synthesized
gtcttggagaagagagttct

SEQ ID NO: 398875 - DNA, 20 bp, Artificial Sequence
  chemically synthesized
tgtcttggagaagagagttc

SEQ ID NO: 398876 - DNA, 20 bp, Artificial Sequence
  chemically synthesized
tgcaggtgtcttggagaaga

SEQ ID NO: 398877 - DNA, 20 bp, Artificial Sequence
  chemically synthesized
tgcctagaactctcttctcc

SEQ ID NO: 398878 - DNA, 20 bp, Artificial Sequence
  chemically synthesized
cttgcaggtgtcttggagaa

SEQ ID NO: 398879 - DNA, 20 bp, Artificial Sequence
  chemically synthesized
atcttgcaggtgtcttggag

SEQ ID NO: 398880 - DNA, 20 bp, Artificial Sequence
  chemically synthesized
ggcatcttgcaggtgtcttg

SEQ ID NO: 398881 - DNA, 20 bp, Artificial Sequence
  chemically synthesized
agggcatcttgcaggtgtct

SEQ ID NO: 398882 - DNA, 20 bp, Artificial Sequence
  chemically synthesized
ctcttctccaagacacctgc

SEQ ID NO: 398883 - DNA, 20 bp, Artificial Sequence
  chemically synthesized
aggaaaggagggcatcttgc

SEQ ID NO: 398884 - DNA, 20 bp, Artificial Sequence
  chemically synthesized
aaggaaaggagggcatcttg

SEQ ID NO: 398885 - DNA, 20 bp, Artificial Sequence
  chemically synthesized
aacctgaaggaaggaaagga

SEQ ID NO: 398886 - DNA, 20 bp, Artificial Sequence
  chemically synthesized
aaacctgaaggaaggaaagg

SEQ ID NO: 398887 - DNA, 20 bp, Artificial Sequence
  chemically synthesized
aaaacctgaaggaaggaaag

SEQ ID NO: 398888 - DNA, 20 bp, Artificial Sequence
  chemically synthesized
aaaaaacctgaaggaaggaa

SEQ ID NO: 398889 - DNA, 20 bp, Artificial Sequence
  chemically synthesized
caaaaaacctgaaggaagga

SEQ ID NO: 398890 - DNA, 20 bp, Artificial Sequence
  chemically synthesized
atgccctcctttccttcctt

SEQ ID NO: 398891 - DNA, 20 bp, Artificial Sequence
  chemically synthesized
tgccctcctttccttccttc

SEQ ID NO: 398892 - DNA, 20 bp, Artificial Sequence
  chemically synthesized
catacaaaaaacctgaagga

SEQ ID NO: 398893 - DNA, 20 bp, Artificial Sequence
  chemically synthesized
gcatacaaaaaacctgaagg

SEQ ID NO: 398894 - DNA, 20 bp, Artificial Sequence
  chemically synthesized
gaggcatacaaaaaacctga

SEQ ID NO: 398895 - DNA, 20 bp, Artificial Sequence
  chemically synthesized
agaggcatacaaaaaacctg

SEQ ID NO: 398896 - DNA, 20 bp, Artificial Sequence
  chemically synthesized
aggttttttgtatgcctctt

SEQ ID NO: 398897 - DNA, 20 bp, Artificial Sequence
  chemically synthesized
tttttgtatgcctcttaagt

SEQ ID NO: 398898 - DNA, 20 bp, Artificial Sequence
  chemically synthesized
ctggaaaagcctcacttaag

SEQ ID NO: 398899 - DNA, 20 bp, Artificial Sequence
  chemically synthesized
ttttgtatgcctcttaagtg

SEQ ID NO: 398900 - DNA, 20 bp, Artificial Sequence
  chemically synthesized
cctggaaaagcctcacttaa

SEQ ID NO: 398901 - DNA, 20 bp, Artificial Sequence
  chemically synthesized
gtcctggaaaagcctcactt

SEQ ID NO: 398902 - DNA, 20 bp, Artificial Sequence
  chemically synthesized
cctcttaagtgaggcttttc

SEQ ID NO: 398903 - DNA, 20 bp, Artificial Sequence
  chemically synthesized
ctcttaagtgaggcttttcc

SEQ ID NO: 398904 - DNA, 20 bp, Artificial Sequence
  chemically synthesized
ttatgtagtgggtcctggaa

SEQ ID NO: 398905 - DNA, 20 bp, Artificial Sequence
  chemically synthesized
ccattttatgtagtgggtcc

SEQ ID NO: 398906 - DNA, 20 bp, Artificial Sequence
  chemically synthesized
aggttgccattttatgtagt

SEQ ID NO: 398907 - DNA, 20 bp, Artificial Sequence
  chemically synthesized
taggttgccattttatgtag

SEQ ID NO: 398908 - DNA, 20 bp, Artificial Sequence
  chemically synthesized
ccaggacccactacataaaa

SEQ ID NO: 398909 - DNA, 20 bp, Artificial Sequence
  chemically synthesized
gggtaggttgccattttatg

SEQ ID NO: 398910 - DNA, 20 bp, Artificial Sequence
  chemically synthesized
atagggatatttcaaagggt

SEQ ID NO: 398911 - DNA, 20 bp, Artificial Sequence
  chemically synthesized
aatagggatatttcaaaggg

SEQ ID NO: 398912 - DNA, 20 bp, Artificial Sequence
  chemically synthesized
tagaatagggatatttcaaa

SEQ ID NO: 398913 - DNA, 20 bp, Artificial Sequence
  chemically synthesized
gtagaatagggatatttcaa

SEQ ID NO: 398914 - DNA, 20 bp, Artificial Sequence
  chemically synthesized
ggtagaatagggatatttca

SEQ ID NO: 398915 - DNA, 20 bp, Artificial Sequence
  chemically synthesized
agcaggataagggtagaata

SEQ ID NO: 398916 - DNA, 20 bp, Artificial Sequence
  chemically synthesized
aagcaggataagggtagaat

SEQ ID NO: 398917 - DNA, 20 bp, Artificial Sequence
  chemically synthesized
aaagcaggataagggtagaa

SEQ ID NO: 398918 - DNA, 20 bp, Artificial Sequence
  chemically synthesized
aaaataaagcaggataaggg

SEQ ID NO: 398919 - DNA, 20 bp, Artificial Sequence
  chemically synthesized
gaaaaaataaagcaggataa

SEQ ID NO: 398920 - DNA, 20 bp, Artificial Sequence
  chemically synthesized
agaaaaaataaagcaggata

SEQ ID NO: 398921 - DNA, 20 bp, Artificial Sequence
  chemically synthesized
gagaaaaaataaagcaggat

SEQ ID NO: 398922 - DNA, 20 bp, Artificial Sequence
  chemically synthesized
gctaagagaaaaaataaagc

SEQ ID NO: 398923 - DNA, 20 bp, Artificial Sequence
  chemically synthesized
tgctaagagaaaaaataaag

SEQ ID NO: 398924 - DNA, 20 bp, Artificial Sequence
  chemically synthesized
aagtgctaagagaaaaaata

SEQ ID NO: 398925 - DNA, 20 bp, Artificial Sequence
  chemically synthesized
tcctgctttattttttctct

SEQ ID NO: 398926 - DNA, 20 bp, Artificial Sequence
  chemically synthesized
cagagagtgacaagtgctaa

SEQ ID NO: 398927 - DNA, 20 bp, Artificial Sequence
  chemically synthesized
ttcagagagtgacaagtgct

SEQ ID NO: 398928 - DNA, 20 bp, Artificial Sequence
  chemically synthesized
atagaatttcagagagtgac

SEQ ID NO: 398929 - DNA, 20 bp, Artificial Sequence
  chemically synthesized
gtagaatatagaatttcaga

SEQ ID NO: 398930 - DNA, 20 bp, Artificial Sequence
  chemically synthesized
aagtagaatatagaatttca

SEQ ID NO: 398931 - DNA, 20 bp, Artificial Sequence
  chemically synthesized
gcaagtagaatatagaattt

SEQ ID NO: 398932 - DNA, 20 bp, Artificial Sequence
  chemically synthesized
ttctctctgcaagtagaata

SEQ ID NO: 398933 - DNA, 20 bp, Artificial Sequence
  chemically synthesized
gaaattctatattctacttg

SEQ ID NO: 398934 - DNA, 20 bp, Artificial Sequence
  chemically synthesized
aattctatattctacttgca

SEQ ID NO: 398935 - DNA, 20 bp, Artificial Sequence
  chemically synthesized
ttgttttttctctctgcaag

SEQ ID NO: 398936 - DNA, 20 bp, Artificial Sequence
  chemically synthesized
ttctatattctacttgcaga

SEQ ID NO: 398937 - DNA, 20 bp, Artificial Sequence
  chemically synthesized
tgtttgttttttctctctgc

SEQ ID NO: 398938 - DNA, 20 bp, Artificial Sequence
  chemically synthesized
tgcagagagaaaaaacaaac

SEQ ID NO: 398939 - DNA, 20 bp, Artificial Sequence
  chemically synthesized
aacaagttgacaaacaaata

SEQ ID NO: 398940 - DNA, 20 bp, Artificial Sequence
  chemically synthesized
caagttgacaaacaaatata

SEQ ID NO: 398941 - DNA, 20 bp, Artificial Sequence
  chemically synthesized
caaacaaatatagagaacgt

SEQ ID NO: 398942 - DNA, 20 bp, Artificial Sequence
  chemically synthesized
caaatatagagaacgtcaga

SEQ ID NO: 398943 - DNA, 20 bp, Artificial Sequence
  chemically synthesized
aaaccaaagagggaaacatt

SEQ ID NO: 398944 - DNA, 20 bp, Artificial Sequence
  chemically synthesized
ttgctaaatgtttccctctt

SEQ ID NO: 398945 - DNA, 20 bp, Artificial Sequence
  chemically synthesized
ctagcgagctaaaccaaaga

SEQ ID NO: 398946 - DNA, 20 bp, Artificial Sequence
  chemically synthesized
gctagcgagctaaaccaaag

SEQ ID NO: 398947 - DNA, 20 bp, Artificial Sequence
  chemically synthesized
aaatgtttccctctttggtt

SEQ ID NO: 398948 - DNA, 20 bp, Artificial Sequence
  chemically synthesized
agctagcgagctaaaccaaa

SEQ ID NO: 398949 - DNA, 20 bp, Artificial Sequence
  chemically synthesized
ttagctagcgagctaaacca

SEQ ID NO: 398950 - DNA, 20 bp, Artificial Sequence
  chemically synthesized
ccctctttggtttagctcgc

SEQ ID NO: 398951 - DNA, 20 bp, Artificial Sequence
  chemically synthesized
ataaggccctgttagctagc

SEQ ID NO: 398952 - DNA, 20 bp, Artificial Sequence
  chemically synthesized
tggtttagctcgctagctaa

SEQ ID NO: 398953 - DNA, 20 bp, Artificial Sequence
  chemically synthesized
ggtttagctcgctagctaac

SEQ ID NO: 398954 - DNA, 20 bp, Artificial Sequence
  chemically synthesized
gtttagctcgctagctaaca

SEQ ID NO: 398955 - DNA, 20 bp, Artificial Sequence
  chemically synthesized
aatcataaggccctgttagc

SEQ ID NO: 398956 - DNA, 20 bp, Artificial Sequence
  chemically synthesized
ctttaatcataaggccctgt

SEQ ID NO: 398957 - DNA, 20 bp, Artificial Sequence
  chemically synthesized
atcaagtccctttaatcata

SEQ ID NO: 398958 - DNA, 20 bp, Artificial Sequence
  chemically synthesized
ctaacagggccttatgatta

SEQ ID NO: 398959 - DNA, 20 bp, Artificial Sequence
  chemically synthesized
gatcaagtccctttaatcat

SEQ ID NO: 398960 - DNA, 20 bp, Artificial Sequence
  chemically synthesized
taacagggccttatgattaa

SEQ ID NO: 398961 - DNA, 20 bp, Artificial Sequence
  chemically synthesized
aacagggccttatgattaaa

SEQ ID NO: 398962 - DNA, 20 bp, Artificial Sequence
  chemically synthesized
aatataacagttaagagatc

SEQ ID NO: 398963 - DNA, 20 bp, Artificial Sequence
  chemically synthesized
gttttgaatataacagttaa

SEQ ID NO: 398964 - DNA, 20 bp, Artificial Sequence
  chemically synthesized
gtgttttgaatataacagtt

SEQ ID NO: 398965 - DNA, 20 bp, Artificial Sequence
  chemically synthesized
ctctagtgttttgaatataa

SEQ ID NO: 398966 - DNA, 20 bp, Artificial Sequence
  chemically synthesized
aactgttatattcaaaacac

SEQ ID NO: 398967 - DNA, 20 bp, Artificial Sequence
  chemically synthesized
ctgttatattcaaaacacta

SEQ ID NO: 398968 - DNA, 20 bp, Artificial Sequence
  chemically synthesized
ctatttcatatcaggtgctc

SEQ ID NO: 398969 - DNA, 20 bp, Artificial Sequence
  chemically synthesized
ttctctatctatttcatatc

SEQ ID NO: 398970 - DNA, 20 bp, Artificial Sequence
  chemically synthesized
attctctatctatttcatat

SEQ ID NO: 398971 - DNA, 20 bp, Artificial Sequence
  chemically synthesized
ctagagcacctgatatgaaa

SEQ ID NO: 398972 - DNA, 20 bp, Artificial Sequence
  chemically synthesized
agcacctgatatgaaataga

SEQ ID NO: 398973 - DNA, 20 bp, Artificial Sequence
  chemically synthesized
cacctgatatgaaatagata

SEQ ID NO: 398974 - DNA, 20 bp, Artificial Sequence
  chemically synthesized
tatgaaatagatagagaatg

SEQ ID NO: 398975 - DNA, 20 bp, Artificial Sequence
  chemically synthesized
ctttgacagaaatacacatg

SEQ ID NO: 398976 - DNA, 20 bp, Artificial Sequence
  chemically synthesized
cttcatgtgtatttctgtca

SEQ ID NO: 398977 - DNA, 20 bp, Artificial Sequence
  chemically synthesized
tttaaggaaacatgctttga

SEQ ID NO: 398978 - DNA, 20 bp, Artificial Sequence
  chemically synthesized
ttacaaataatttatattta

SEQ ID NO: 398979 - DNA, 20 bp, Artificial Sequence
  chemically synthesized
tttacaaataatttatattt

SEQ ID NO: 398980 - DNA, 20 bp, Artificial Sequence
  chemically synthesized
ttaaatataaattatttgta

SEQ ID NO: 398981 - DNA, 20 bp, Artificial Sequence
  chemically synthesized
taaatataaattatttgtaa

SEQ ID NO: 398982 - DNA, 20 bp, Artificial Sequence
  chemically synthesized
ataaattatttgtaaaggat

SEQ ID NO: 398983 - DNA, 20 bp, Artificial Sequence
  chemically synthesized
ttgtaaaggataagaacttc

SEQ ID NO: 398984 - DNA, 20 bp, Artificial Sequence
  chemically synthesized
aaggataagaacttcaagta

SEQ ID NO: 398985 - DNA, 20 bp, Artificial Sequence
  chemically synthesized
gagtatcatatctgtacttg

SEQ ID NO: 398986 - DNA, 20 bp, Artificial Sequence
  chemically synthesized
agtcagagaataaatatttt

SEQ ID NO: 398987 - DNA, 20 bp, Artificial Sequence
  chemically synthesized
tgcagttattatgtcagtca

SEQ ID NO: 398988 - DNA, 20 bp, Artificial Sequence
  chemically synthesized
cctgcagttattatgtcagt

SEQ ID NO: 398989 - DNA, 20 bp, Artificial Sequence
  chemically synthesized
attacctgcagttattatgt

SEQ ID NO: 398990 - DNA, 20 bp, Artificial Sequence
  chemically synthesized
tctgactgacataataactg

SEQ ID NO: 398991 - DNA, 20 bp, Artificial Sequence
  chemically synthesized
ctgactgacataataactgc

SEQ ID NO: 398992 - DNA, 20 bp, Artificial Sequence
  chemically synthesized
agtcctattaaaattacctg

SEQ ID NO: 398993 - DNA, 20 bp, Artificial Sequence
  chemically synthesized
ataactgcaggtaattttaa

SEQ ID NO: 398994 - DNA, 20 bp, Artificial Sequence
  chemically synthesized
taactgcaggtaattttaat

SEQ ID NO: 398995 - DNA, 20 bp, Artificial Sequence
  chemically synthesized
gcaggtaattttaataggac

SEQ ID NO: 398996 - DNA, 20 bp, Artificial Sequence
  chemically synthesized
agagtacttttcataggaac

SEQ ID NO: 398997 - DNA, 20 bp, Artificial Sequence
  chemically synthesized
ataggactagttcctatgaa

SEQ ID NO: 398998 - DNA, 20 bp, Artificial Sequence
  chemically synthesized
ctacggagagtacttttcat

SEQ ID NO: 398999 - DNA, 20 bp, Artificial Sequence
  chemically synthesized
tctacggagagtacttttca

SEQ ID NO: 399000 - DNA, 20 bp, Artificial Sequence
  chemically synthesized
cctatgaaaagtactctccg

SEQ ID NO: 399001 - DNA, 20 bp, Artificial Sequence
  chemically synthesized
cgatctacaaggtctacgga

SEQ ID NO: 399002 - DNA, 20 bp, Artificial Sequence
  chemically synthesized
ttcgatctacaaggtctacg

SEQ ID NO: 399003 - DNA, 20 bp, Artificial Sequence
  chemically synthesized
tcttcgatctacaaggtcta

SEQ ID NO: 399004 - DNA, 20 bp, Artificial Sequence
  chemically synthesized
agtactctccgtagaccttg

SEQ ID NO: 399005 - DNA, 20 bp, Artificial Sequence
  chemically synthesized
aaaaatgtcttcgatctaca

SEQ ID NO: 399006 - DNA, 20 bp, Artificial Sequence
  chemically synthesized
aaaaaatgtcttcgatctac

SEQ ID NO: 399007 - DNA, 20 bp, Artificial Sequence
  chemically synthesized
tccgtagaccttgtagatcg

SEQ ID NO: 399008 - DNA, 20 bp, Artificial Sequence
  chemically synthesized
cgaagacatttttttttctt

SEQ ID NO: 399009 - DNA, 20 bp, Artificial Sequence
  chemically synthesized
gaagacatttttttttcttc

SEQ ID NO: 399010 - DNA, 20 bp, Artificial Sequence
  chemically synthesized
acatttttttttcttcaggc

SEQ ID NO: 399011 - DNA, 20 bp, Artificial Sequence
  chemically synthesized
catttttttttcttcaggcc

SEQ ID NO: 399012 - DNA, 20 bp, Artificial Sequence
  chemically synthesized
gatttagtttacctggcctg

SEQ ID NO: 399013 - DNA, 20 bp, Artificial Sequence
  chemically synthesized
tttctttgatttagtttacc

SEQ ID NO: 399014 - DNA, 20 bp, Artificial Sequence
  chemically synthesized
aggccaggtaaactaaatca

SEQ ID NO: 399015 - DNA, 20 bp, Artificial Sequence
  chemically synthesized
aaatgtttctttctttgatt

SEQ ID NO: 399016 - DNA, 20 bp, Artificial Sequence
  chemically synthesized
caggtaaactaaatcaaaga

SEQ ID NO: 399017 - DNA, 20 bp, Artificial Sequence
  chemically synthesized
aaatcaaagaaagaaacatt

SEQ ID NO: 399018 - DNA, 20 bp, Artificial Sequence
  chemically synthesized
atgagaacaaatgagagttg

SEQ ID NO: 399019 - DNA, 20 bp, Artificial Sequence
  chemically synthesized
cttttaatgagaacaaatga

SEQ ID NO: 399020 - DNA, 20 bp, Artificial Sequence
  chemically synthesized
gtcttttaatgagaacaaat

SEQ ID NO: 399021 - DNA, 20 bp, Artificial Sequence
  chemically synthesized
ctctcatttgttctcattaa

SEQ ID NO: 399022 - DNA, 20 bp, Artificial Sequence
  chemically synthesized
agcattagctgtcttttaat

SEQ ID NO: 399023 - DNA, 20 bp, Artificial Sequence
  chemically synthesized
catttgttctcattaaaaga

SEQ ID NO: 399024 - DNA, 20 bp, Artificial Sequence
  chemically synthesized
gttactctttggtttagcat

SEQ ID NO: 399025 - DNA, 20 bp, Artificial Sequence
  chemically synthesized
agacagctaatgctaaacca

SEQ ID NO: 399026 - DNA, 20 bp, Artificial Sequence
  chemically synthesized
acagctaatgctaaaccaaa

SEQ ID NO: 399027 - DNA, 20 bp, Artificial Sequence
  chemically synthesized
tgtgaagttactctttggtt

SEQ ID NO: 399028 - DNA, 20 bp, Artificial Sequence
  chemically synthesized
aaatgtgtgaagttactctt

SEQ ID NO: 399029 - DNA, 20 bp, Artificial Sequence
  chemically synthesized
cttttcattagaaatgtgtg

SEQ ID NO: 399030 - DNA, 20 bp, Artificial Sequence
  chemically synthesized
cttcacacatttctaatgaa

SEQ ID NO: 399031 - DNA, 20 bp, Artificial Sequence
  chemically synthesized
ttcacacatttctaatgaaa

SEQ ID NO: 399032 - DNA, 20 bp, Artificial Sequence
  chemically synthesized
aaactaagagaccttttcat

SEQ ID NO: 399033 - DNA, 20 bp, Artificial Sequence
  chemically synthesized
tttctaatgaaaaggtctct

SEQ ID NO: 399034 - DNA, 20 bp, Artificial Sequence
  chemically synthesized
aggtgatgagtgcaaactaa

SEQ ID NO: 399035 - DNA, 20 bp, Artificial Sequence
  chemically synthesized
ccaggtgatgagtgcaaact

SEQ ID NO: 399036 - DNA, 20 bp, Artificial Sequence
  chemically synthesized
cttagtttgcactcatcacc

SEQ ID NO: 399037 - DNA, 20 bp, Artificial Sequence
  chemically synthesized
cagaattgtggccaggtgat

SEQ ID NO: 399038 - DNA, 20 bp, Artificial Sequence
  chemically synthesized
tcttgtccagaattgtggcc

SEQ ID NO: 399039 - DNA, 20 bp, Artificial Sequence
  chemically synthesized
gtcttgtccagaattgtggc

SEQ ID NO: 399040 - DNA, 20 bp, Artificial Sequence
  chemically synthesized
tcatcacctggccacaattc

SEQ ID NO: 399041 - DNA, 20 bp, Artificial Sequence
  chemically synthesized
ttcggtcttgtccagaattg

SEQ ID NO: 399042 - DNA, 20 bp, Artificial Sequence
  chemically synthesized
acctggccacaattctggac

SEQ ID NO: 399043 - DNA, 20 bp, Artificial Sequence
  chemically synthesized
tgatcactttcggtcttgtc

SEQ ID NO: 399044 - DNA, 20 bp, Artificial Sequence
  chemically synthesized
acaattctggacaagaccga

SEQ ID NO: 399045 - DNA, 20 bp, Artificial Sequence
  chemically synthesized
aataaacaagtgatcacttt

SEQ ID NO: 399046 - DNA, 20 bp, Artificial Sequence
  chemically synthesized
acaaaaagtgatcaataaac

SEQ ID NO: 399047 - DNA, 20 bp, Artificial Sequence
  chemically synthesized
taatagtaaaaatggacaaa

SEQ ID NO: 399048 - DNA, 20 bp, Artificial Sequence
  chemically synthesized
gagataagtaatagtaaaaa

SEQ ID NO: 399049 - DNA, 20 bp, Artificial Sequence
  chemically synthesized
ctatatgcagagataagtaa

SEQ ID NO: 399050 - DNA, 20 bp, Artificial Sequence
  chemically synthesized
ccagttctatatgcagagat

SEQ ID NO: 399051 - DNA, 20 bp, Artificial Sequence
  chemically synthesized
ctattacttatctctgcata

SEQ ID NO: 399052 - DNA, 20 bp, Artificial Sequence
  chemically synthesized
ctatgccagttctatatgca

SEQ ID NO: 399053 - DNA, 20 bp, Artificial Sequence
  chemically synthesized
cactatgccagttctatatg

SEQ ID NO: 399054 - DNA, 20 bp, Artificial Sequence
  chemically synthesized
cttatctctgcatatagaac

SEQ ID NO: 399055 - DNA, 20 bp, Artificial Sequence
  chemically synthesized
ctctgcatatagaactggca

SEQ ID NO: 399056 - DNA, 20 bp, Artificial Sequence
  chemically synthesized
tttagctaatttcactatgc

SEQ ID NO: 399057 - DNA, 20 bp, Artificial Sequence
  chemically synthesized
tagaactggcatagtgaaat

SEQ ID NO: 399058 - DNA, 20 bp, Artificial Sequence
  chemically synthesized
catagtgaaattagctaaat

SEQ ID NO: 399059 - DNA, 20 bp, Artificial Sequence
  chemically synthesized
atagtgaaattagctaaatt

SEQ ID NO: 399060 - DNA, 20 bp, Artificial Sequence
  chemically synthesized
tgcttatttgtatcctaatt

SEQ ID NO: 399061 - DNA, 20 bp, Artificial Sequence
  chemically synthesized
agctaaattaggatacaaat

SEQ ID NO: 399062 - DNA, 20 bp, Artificial Sequence
  chemically synthesized
aattaggatacaaataagca

SEQ ID NO: 399063 - DNA, 20 bp, Artificial Sequence
  chemically synthesized
gcagagtatggtttttaaaa

SEQ ID NO: 399064 - DNA, 20 bp, Artificial Sequence
  chemically synthesized
ggcagagtatggtttttaaa

SEQ ID NO: 399065 - DNA, 20 bp, Artificial Sequence
  chemically synthesized
aggcagagtatggtttttaa

SEQ ID NO: 399066 - DNA, 20 bp, Artificial Sequence
  chemically synthesized
ggaacataaaaggcagagta

SEQ ID NO: 399067 - DNA, 20 bp, Artificial Sequence
  chemically synthesized
atcttggaacataaaaggca

SEQ ID NO: 399068 - DNA, 20 bp, Artificial Sequence
  chemically synthesized
gtatcttggaacataaaagg

SEQ ID NO: 399069 - DNA, 20 bp, Artificial Sequence
  chemically synthesized
tatgtatcttggaacataaa

SEQ ID NO: 399070 - DNA, 20 bp, Artificial Sequence
  chemically synthesized
gtatgtatcttggaacataa

SEQ ID NO: 399071 - DNA, 20 bp, Artificial Sequence
  chemically synthesized
tactctgccttttatgttcc

SEQ ID NO: 399072 - DNA, 20 bp, Artificial Sequence
  chemically synthesized
gggcagacttgtatgtatct

SEQ ID NO: 399073 - DNA, 20 bp, Artificial Sequence
  chemically synthesized
ttatgttccaagatacatac

SEQ ID NO: 399074 - DNA, 20 bp, Artificial Sequence
  chemically synthesized
cttgtaatgcacatggaggg

SEQ ID NO: 399075 - DNA, 20 bp, Artificial Sequence
  chemically synthesized
tttcttgtaatgcacatgga

SEQ ID NO: 399076 - DNA, 20 bp, Artificial Sequence
  chemically synthesized
ctttcttgtaatgcacatgg

SEQ ID NO: 399077 - DNA, 20 bp, Artificial Sequence
  chemically synthesized
cctttcttgtaatgcacatg

SEQ ID NO: 399078 - DNA, 20 bp, Artificial Sequence
  chemically synthesized
aacctttcttgtaatgcaca

SEQ ID NO: 399079 - DNA, 20 bp, Artificial Sequence
  chemically synthesized
ctgccctccatgtgcattac

SEQ ID NO: 399080 - DNA, 20 bp, Artificial Sequence
  chemically synthesized
cctccatgtgcattacaaga

SEQ ID NO: 399081 - DNA, 20 bp, Artificial Sequence
  chemically synthesized
ctccatgtgcattacaagaa

SEQ ID NO: 399082 - DNA, 20 bp, Artificial Sequence
  chemically synthesized
cattacaagaaaggtttcta

SEQ ID NO: 399083 - DNA, 20 bp, Artificial Sequence
  chemically synthesized
aagaaaggtttctacagtta

SEQ ID NO: 399084 - DNA, 20 bp, Artificial Sequence
  chemically synthesized
tactgatataactttaactg

SEQ ID NO: 399085 - DNA, 20 bp, Artificial Sequence
  chemically synthesized
ttctacagttaaagttatat

SEQ ID NO: 399086 - DNA, 20 bp, Artificial Sequence
  chemically synthesized
ttatatcagtacattactgt

SEQ ID NO: 399087 - DNA, 20 bp, Artificial Sequence
  chemically synthesized
atatcagtacattactgtca

SEQ ID NO: 399088 - DNA, 20 bp, Artificial Sequence
  chemically synthesized
tcagtacattactgtcagag

SEQ ID NO: 399089 - DNA, 20 bp, Artificial Sequence
  chemically synthesized
agaattaagatctactctga

SEQ ID NO: 399090 - DNA, 20 bp, Artificial Sequence
  chemically synthesized
tagccagaacacaaagaatt

SEQ ID NO: 399091 - DNA, 20 bp, Artificial Sequence
  chemically synthesized
gatcttaattctttgtgttc

SEQ ID NO: 399092 - DNA, 20 bp, Artificial Sequence
  chemically synthesized
atcatggtagccagaacaca

SEQ ID NO: 399093 - DNA, 20 bp, Artificial Sequence
  chemically synthesized
caaattatgatcatggtagc

SEQ ID NO: 399094 - DNA, 20 bp, Artificial Sequence
  chemically synthesized
atttcaaattatgatcatgg

SEQ ID NO: 399095 - DNA, 20 bp, Artificial Sequence
  chemically synthesized
tatatttcaaattatgatca

SEQ ID NO: 399096 - DNA, 20 bp, Artificial Sequence
  chemically synthesized
cataatttgaaatataattc

SEQ ID NO: 399097 - DNA, 20 bp, Artificial Sequence
  chemically synthesized
ataatttgaaatataattct

SEQ ID NO: 399098 - DNA, 20 bp, Artificial Sequence
  chemically synthesized
ccaagattcctatggattcc

SEQ ID NO: 399099 - DNA, 20 bp, Artificial Sequence
  chemically synthesized
aatataattctaggaatcca

SEQ ID NO: 399100 - DNA, 20 bp, Artificial Sequence
  chemically synthesized
atataattctaggaatccat

SEQ ID NO: 399101 - DNA, 20 bp, Artificial Sequence
  chemically synthesized
taaccttaccaagattccta

SEQ ID NO: 399102 - DNA, 20 bp, Artificial Sequence
  chemically synthesized
ctaggaatccataggaatct

SEQ ID NO: 399103 - DNA, 20 bp, Artificial Sequence
  chemically synthesized
gaatccataggaatcttggt

SEQ ID NO: 399104 - DNA, 20 bp, Artificial Sequence
  chemically synthesized
aatccataggaatcttggta

SEQ ID NO: 399105 - DNA, 20 bp, Artificial Sequence
  chemically synthesized
gttgcatttttaaccttacc

SEQ ID NO: 399106 - DNA, 20 bp, Artificial Sequence
  chemically synthesized
gttaaaaatgcaacaccctt

SEQ ID NO: 399107 - DNA, 20 bp, Artificial Sequence
  chemically synthesized
aaatgcaacacccttaagtg

SEQ ID NO: 399108 - DNA, 20 bp, Artificial Sequence
  chemically synthesized
ttcctctgtgcttcacttaa

SEQ ID NO: 399109 - DNA, 20 bp, Artificial Sequence
  chemically synthesized
cttcctctgtgcttcactta

SEQ ID NO: 399110 - DNA, 20 bp, Artificial Sequence
  chemically synthesized
tcttcctctgtgcttcactt

SEQ ID NO: 399111 - DNA, 20 bp, Artificial Sequence
  chemically synthesized
caacacccttaagtgaagca

SEQ ID NO: 399112 - DNA, 20 bp, Artificial Sequence
  chemically synthesized
acacccttaagtgaagcaca

SEQ ID NO: 399113 - DNA, 20 bp, Artificial Sequence
  chemically synthesized
cacccttaagtgaagcacag

SEQ ID NO: 399114 - DNA, 20 bp, Artificial Sequence
  chemically synthesized
ccttaagtgaagcacagagg

SEQ ID NO: 399115 - DNA, 20 bp, Artificial Sequence
  chemically synthesized
gaagcacagaggaagacctt

SEQ ID NO: 399116 - DNA, 20 bp, Artificial Sequence
  chemically synthesized
agcacagaggaagaccttca

SEQ ID NO: 399117 - DNA, 20 bp, Artificial Sequence
  chemically synthesized
tcattttagtgacactctga

SEQ ID NO: 399118 - DNA, 20 bp, Artificial Sequence
  chemically synthesized
ttcattttagtgacactctg

SEQ ID NO: 399119 - DNA, 20 bp, Artificial Sequence
  chemically synthesized
tcagcagaaggatttcattt

SEQ ID NO: 399120 - DNA, 20 bp, Artificial Sequence
  chemically synthesized
aaaatgaaatccttctgctg

SEQ ID NO: 399121 - DNA, 20 bp, Artificial Sequence
  chemically synthesized
ctttactttgcttcagcaga

SEQ ID NO: 399122 - DNA, 20 bp, Artificial Sequence
  chemically synthesized
gctttactttgcttcagcag

SEQ ID NO: 399123 - DNA, 20 bp, Artificial Sequence
  chemically synthesized
tgtgctttactttgcttcag

SEQ ID NO: 399124 - DNA, 20 bp, Artificial Sequence
  chemically synthesized
gaaatccttctgctgaagca

SEQ ID NO: 399125 - DNA, 20 bp, Artificial Sequence
  chemically synthesized
ttttgtgctttactttgctt

SEQ ID NO: 399126 - DNA, 20 bp, Artificial Sequence
  chemically synthesized
ccttctgctgaagcaaagta

SEQ ID NO: 399127 - DNA, 20 bp, Artificial Sequence
  chemically synthesized
tgaagcaaagtaaagcacaa

SEQ ID NO: 399128 - DNA, 20 bp, Artificial Sequence
  chemically synthesized
aagcaaagtaaagcacaaaa

SEQ ID NO: 399129 - DNA, 20 bp, Artificial Sequence
  chemically synthesized
gcaaagtaaagcacaaaaga

SEQ ID NO: 399130 - DNA, 20 bp, Artificial Sequence
  chemically synthesized
aagcacaaaagagagattga

SEQ ID NO: 399131 - DNA, 20 bp, Artificial Sequence
  chemically synthesized
agagagattgaaagactctg

SEQ ID NO: 399132 - DNA, 20 bp, Artificial Sequence
  chemically synthesized
gagagattgaaagactctgt

SEQ ID NO: 399133 - DNA, 20 bp, Artificial Sequence
  chemically synthesized
acatttccaattgacctaca

SEQ ID NO: 399134 - DNA, 20 bp, Artificial Sequence
  chemically synthesized
aaacatttccaattgaccta

SEQ ID NO: 399135 - DNA, 20 bp, Artificial Sequence
  chemically synthesized
gaaagactctgtaggtcaat

SEQ ID NO: 399136 - DNA, 20 bp, Artificial Sequence
  chemically synthesized
attggaaatgttttattctt

SEQ ID NO: 399137 - DNA, 20 bp, Artificial Sequence
  chemically synthesized
ggctactatatatttttctt

SEQ ID NO: 399138 - DNA, 20 bp, Artificial Sequence
  chemically synthesized
ttattcttaagaaaaatata

SEQ ID NO: 399139 - DNA, 20 bp, Artificial Sequence
  chemically synthesized
ttcttaagaaaaatatatag

SEQ ID NO: 399140 - DNA, 20 bp, Artificial Sequence
  chemically synthesized
aaatatatagtagcccatga

SEQ ID NO: 399141 - DNA, 20 bp, Artificial Sequence
  chemically synthesized
aatatatagtagcccatgaa

SEQ ID NO: 399142 - DNA, 20 bp, Artificial Sequence
  chemically synthesized
tttcactgcaatcctttcat

SEQ ID NO: 399143 - DNA, 20 bp, Artificial Sequence
  chemically synthesized
ctttcactgcaatcctttca

SEQ ID NO: 399144 - DNA, 20 bp, Artificial Sequence
  chemically synthesized
agtagcccatgaaaggattg

SEQ ID NO: 399145 - DNA, 20 bp, Artificial Sequence
  chemically synthesized
ccatgaaaggattgcagtga

SEQ ID NO: 399146 - DNA, 20 bp, Artificial Sequence
  chemically synthesized
attgcagtgaaagaaatttg

SEQ ID NO: 399147 - DNA, 20 bp, Artificial Sequence
  chemically synthesized
gtgaaagaaatttgcggata

SEQ ID NO: 399148 - DNA, 20 bp, Artificial Sequence
  chemically synthesized
aaatttgcggatacagtcaa

SEQ ID NO: 399149 - DNA, 20 bp, Artificial Sequence
  chemically synthesized
tagaaaaaaacagttcgttg

SEQ ID NO: 399150 - DNA, 20 bp, Artificial Sequence
  chemically synthesized
gttcaaaggttagaaaaaaa

SEQ ID NO: 399151 - DNA, 20 bp, Artificial Sequence
  chemically synthesized
atataattgtgttcaaaggt

SEQ ID NO: 399152 - DNA, 20 bp, Artificial Sequence
  chemically synthesized
attaatataattgtgttcaa

SEQ ID NO: 399153 - DNA, 20 bp, Artificial Sequence
  chemically synthesized
tattaatataattgtgttca

SEQ ID NO: 399154 - DNA, 20 bp, Artificial Sequence
  chemically synthesized
gggcagataggtgatgaata

SEQ ID NO: 399155 - DNA, 20 bp, Artificial Sequence
  chemically synthesized
ttttgtgtttcagggcagat

SEQ ID NO: 399156 - DNA, 20 bp, Artificial Sequence
  chemically synthesized
attttgtgtttcagggcaga

SEQ ID NO: 399157 - DNA, 20 bp, Artificial Sequence
  chemically synthesized
agttattttgtgtttcaggg

SEQ ID NO: 399158 - DNA, 20 bp, Artificial Sequence
  chemically synthesized
cctagttattttgtgtttca

SEQ ID NO: 399159 - DNA, 20 bp, Artificial Sequence
  chemically synthesized
tcctagttattttgtgtttc

SEQ ID NO: 399160 - DNA, 20 bp, Artificial Sequence
  chemically synthesized
atcctagttattttgtgttt

SEQ ID NO: 399161 - DNA, 20 bp, Artificial Sequence
  chemically synthesized
gccctgaaacacaaaataac

SEQ ID NO: 399162 - DNA, 20 bp, Artificial Sequence
  chemically synthesized
ccctgaaacacaaaataact

SEQ ID NO: 399163 - DNA, 20 bp, Artificial Sequence
  chemically synthesized
atatatatttttaacaatcc

SEQ ID NO: 399164 - DNA, 20 bp, Artificial Sequence
  chemically synthesized
ttaaaaatatatatatacat

SEQ ID NO: 399165 - DNA, 20 bp, Artificial Sequence
  chemically synthesized
aatatatatatacatcagat

SEQ ID NO: 399166 - DNA, 20 bp, Artificial Sequence
  chemically synthesized
tacatcagataagtattttt

SEQ ID NO: 399167 - DNA, 20 bp, Artificial Sequence
  chemically synthesized
atatagttgttttaggttat

SEQ ID NO: 399168 - DNA, 20 bp, Artificial Sequence
  chemically synthesized
tacgtatatatagttgtttt

SEQ ID NO: 399169 - DNA, 20 bp, Artificial Sequence
  chemically synthesized
atacgtatatatagttgttt

SEQ ID NO: 399170 - DNA, 20 bp, Artificial Sequence
  chemically synthesized
tacgtatatatacgtatata

SEQ ID NO: 399171 - DNA, 20 bp, Artificial Sequence
  chemically synthesized
acacgtatatatacatatat

SEQ ID NO: 399172 - DNA, 20 bp, Artificial Sequence
  chemically synthesized
acatgtatatatacatatat

SEQ ID NO: 399173 - DNA, 20 bp, Artificial Sequence
  chemically synthesized
atacacacgtatatatacat

SEQ ID NO: 399174 - DNA, 20 bp, Artificial Sequence
  chemically synthesized
tgtatatgtgtgtatgcata

SEQ ID NO: 399175 - DNA, 20 bp, Artificial Sequence
  chemically synthesized
aatgtgtatatatatatata

SEQ ID NO: 399176 - DNA, 20 bp, Artificial Sequence
  chemically synthesized
tatacacattttttaaaaaa

SEQ ID NO: 399177 - DNA, 20 bp, Artificial Sequence
  chemically synthesized
atacacattttttaaaaaat

SEQ ID NO: 399178 - DNA, 20 bp, Artificial Sequence
  chemically synthesized
cattttttaaaaaataggta

SEQ ID NO: 399179 - DNA, 20 bp, Artificial Sequence
  chemically synthesized
attttttaaaaaataggtat

SEQ ID NO: 399180 - DNA, 20 bp, Artificial Sequence
  chemically synthesized
ttaaaaaataggtataggtt

SEQ ID NO: 399181 - DNA, 20 bp, Artificial Sequence
  chemically synthesized
ttgggatttttggatttgag

SEQ ID NO: 399182 - DNA, 20 bp, Artificial Sequence
  chemically synthesized
tttgggatttttggatttga

SEQ ID NO: 399183 - DNA, 20 bp, Artificial Sequence
  chemically synthesized
gatttgggatttttggattt

SEQ ID NO: 399184 - DNA, 20 bp, Artificial Sequence
  chemically synthesized
cattttggatttgggatttt

SEQ ID NO: 399185 - DNA, 20 bp, Artificial Sequence
  chemically synthesized
tttgggagcattttggattt

SEQ ID NO: 399186 - DNA, 20 bp, Artificial Sequence
  chemically synthesized
atttgggagcattttggatt

SEQ ID NO: 399187 - DNA, 20 bp, Artificial Sequence
  chemically synthesized
tttctgatttgggagcattt

SEQ ID NO: 399188 - DNA, 20 bp, Artificial Sequence
  chemically synthesized
aatccaaaatgctcccaaat

SEQ ID NO: 399189 - DNA, 20 bp, Artificial Sequence
  chemically synthesized
tcaaaaggtttctgatttgg

SEQ ID NO: 399190 - DNA, 20 bp, Artificial Sequence
  chemically synthesized
cctcaaaaggtttctgattt

SEQ ID NO: 399191 - DNA, 20 bp, Artificial Sequence
  chemically synthesized
ccctcaaaaggtttctgatt

SEQ ID NO: 399192 - DNA, 20 bp, Artificial Sequence
  chemically synthesized
tcccaaatcagaaacctttt

SEQ ID NO: 399193 - DNA, 20 bp, Artificial Sequence
  chemically synthesized
cccaaatcagaaaccttttg

SEQ ID NO: 399194 - DNA, 20 bp, Artificial Sequence
  chemically synthesized
ccaaatcagaaaccttttga

SEQ ID NO: 399195 - DNA, 20 bp, Artificial Sequence
  chemically synthesized
gtgtcatgtcagccctcaaa

SEQ ID NO: 399196 - DNA, 20 bp, Artificial Sequence
  chemically synthesized
tgtgtcatgtcagccctcaa

SEQ ID NO: 399197 - DNA, 20 bp, Artificial Sequence
  chemically synthesized
atttcctttgtgtgtcatgt

SEQ ID NO: 399198 - DNA, 20 bp, Artificial Sequence
  chemically synthesized
gagggctgacatgacacaca

SEQ ID NO: 399199 - DNA, 20 bp, Artificial Sequence
  chemically synthesized
agggctgacatgacacacaa

SEQ ID NO: 399200 - DNA, 20 bp, Artificial Sequence
  chemically synthesized
cacacaaaggaaatgctcat

SEQ ID NO: 399201 - DNA, 20 bp, Artificial Sequence
  chemically synthesized
cacaaaggaaatgctcattg

SEQ ID NO: 399202 - DNA, 20 bp, Artificial Sequence
  chemically synthesized
gaaatccagaatgctccaat

SEQ ID NO: 399203 - DNA, 20 bp, Artificial Sequence
  chemically synthesized
aaatgctcattggagcattc

SEQ ID NO: 399204 - DNA, 20 bp, Artificial Sequence
  chemically synthesized
cattggagcattctggattt

SEQ ID NO: 399205 - DNA, 20 bp, Artificial Sequence
  chemically synthesized
aagtccaaaaatctgaaatc

SEQ ID NO: 399206 - DNA, 20 bp, Artificial Sequence
  chemically synthesized
cattctggatttcagatttt

SEQ ID NO: 399207 - DNA, 20 bp, Artificial Sequence
  chemically synthesized
gatttcagatttttggactt

SEQ ID NO: 399208 - DNA, 20 bp, Artificial Sequence
  chemically synthesized
acttactggctgagcatctc

SEQ ID NO: 399209 - DNA, 20 bp, Artificial Sequence
  chemically synthesized
atttttggacttgagatgct

SEQ ID NO: 399210 - DNA, 20 bp, Artificial Sequence
  chemically synthesized
ttggacttgagatgctcagc

SEQ ID NO: 399211 - DNA, 20 bp, Artificial Sequence
  chemically synthesized
acttgagatgctcagccagt

SEQ ID NO: 399212 - DNA, 20 bp, Artificial Sequence
  chemically synthesized
ttgcattatacttactggct

SEQ ID NO: 399213 - DNA, 20 bp, Artificial Sequence
  chemically synthesized
aatatttgcattatacttac

SEQ ID NO: 399214 - DNA, 20 bp, Artificial Sequence
  chemically synthesized
tcaaattttggattttcgtt

SEQ ID NO: 399215 - DNA, 20 bp, Artificial Sequence
  chemically synthesized
aatagaaatgtttcaaattt

SEQ ID NO: 399216 - DNA, 20 bp, Artificial Sequence
  chemically synthesized
tcgtccaaaacgtttgaaaa

SEQ ID NO: 399217 - DNA, 20 bp, Artificial Sequence
  chemically synthesized
atttctattttcaaacgttt

SEQ ID NO: 399218 - DNA, 20 bp, Artificial Sequence
  chemically synthesized
attttcaaacgttttggacg

SEQ ID NO: 399219 - DNA, 20 bp, Artificial Sequence
  chemically synthesized
ttggacgaagaatgctcaat

SEQ ID NO: 399220 - DNA, 20 bp, Artificial Sequence
  chemically synthesized
caatcaatctgatactgatt

SEQ ID NO: 399221 - DNA, 20 bp, Artificial Sequence
  chemically synthesized
gaagaatgctcaatcagtat

SEQ ID NO: 399222 - DNA, 20 bp, Artificial Sequence
  chemically synthesized
gtatcagattgattgatttt

SEQ ID NO: 399223 - DNA, 20 bp, Artificial Sequence
  chemically synthesized
tcaaaaactgaatgagttaa

SEQ ID NO: 399224 - DNA, 20 bp, Artificial Sequence
  chemically synthesized
tttgagtcttttaactcatt

SEQ ID NO: 399225 - DNA, 20 bp, Artificial Sequence
  chemically synthesized
actatactcaaaaactgaat

SEQ ID NO: 399226 - DNA, 20 bp, Artificial Sequence
  chemically synthesized
ttttaactcattcagttttt

SEQ ID NO: 399227 - DNA, 20 bp, Artificial Sequence
  chemically synthesized
actcattcagtttttgagta

SEQ ID NO: 399228 - DNA, 20 bp, Artificial Sequence
  chemically synthesized
aaattgggatttattttgtg

SEQ ID NO: 399229 - DNA, 20 bp, Artificial Sequence
  chemically synthesized
taaattgggatttattttgt

SEQ ID NO: 399230 - DNA, 20 bp, Artificial Sequence
  chemically synthesized
ttaaattgggatttattttg

SEQ ID NO: 399231 - DNA, 20 bp, Artificial Sequence
  chemically synthesized
gcaagtacttgatttaaatt

SEQ ID NO: 399232 - DNA, 20 bp, Artificial Sequence
  chemically synthesized
tgcaagtacttgatttaaat

SEQ ID NO: 399233 - DNA, 20 bp, Artificial Sequence
  chemically synthesized
aataaatcccaatttaaatc

SEQ ID NO: 399234 - DNA, 20 bp, Artificial Sequence
  chemically synthesized
ttccagttgagaatcaatgc

SEQ ID NO: 399235 - DNA, 20 bp, Artificial Sequence
  chemically synthesized
tacttgcattgattctcaac

SEQ ID NO: 399236 - DNA, 20 bp, Artificial Sequence
  chemically synthesized
ggaatgacctttttccagtt

SEQ ID NO: 399237 - DNA, 20 bp, Artificial Sequence
  chemically synthesized
cattgattctcaactggaaa

SEQ ID NO: 399238 - DNA, 20 bp, Artificial Sequence
  chemically synthesized
attgattctcaactggaaaa

SEQ ID NO: 399239 - DNA, 20 bp, Artificial Sequence
  chemically synthesized
aaaggggaatgacctttttc

SEQ ID NO: 399240 - DNA, 20 bp, Artificial Sequence
  chemically synthesized
gaaaaaggtcattccccttt

SEQ ID NO: 399241 - DNA, 20 bp, Artificial Sequence
  chemically synthesized
aaaaaggtcattcccctttg

SEQ ID NO: 399242 - DNA, 20 bp, Artificial Sequence
  chemically synthesized
aaaaggtcattcccctttga

SEQ ID NO: 399243 - DNA, 20 bp, Artificial Sequence
  chemically synthesized
aatttattgaaccctcaaag

SEQ ID NO: 399244 - DNA, 20 bp, Artificial Sequence
  chemically synthesized
gaatttattgaaccctcaaa

SEQ ID NO: 399245 - DNA, 20 bp, Artificial Sequence
  chemically synthesized
ggaatttattgaaccctcaa

SEQ ID NO: 399246 - DNA, 20 bp, Artificial Sequence
  chemically synthesized
aggaatttattgaaccctca

SEQ ID NO: 399247 - DNA, 20 bp, Artificial Sequence
  chemically synthesized
tgagggttcaataaattcct

SEQ ID NO: 399248 - DNA, 20 bp, Artificial Sequence
  chemically synthesized
gggttcaataaattcctcag

SEQ ID NO: 399249 - DNA, 20 bp, Artificial Sequence
  chemically synthesized
ggttcaataaattcctcagt

SEQ ID NO: 399250 - DNA, 20 bp, Artificial Sequence
  chemically synthesized
gttcaataaattcctcagtg

SEQ ID NO: 399251 - DNA, 20 bp, Artificial Sequence
  chemically synthesized
tgttggaggaaaccccactg

SEQ ID NO: 399252 - DNA, 20 bp, Artificial Sequence
  chemically synthesized
atgttggaggaaaccccact

SEQ ID NO: 399253 - DNA, 20 bp, Artificial Sequence
  chemically synthesized
tctgtagtagagaatgttgg

SEQ ID NO: 399254 - DNA, 20 bp, Artificial Sequence
  chemically synthesized
gtctgtagtagagaatgttg

SEQ ID NO: 399255 - DNA, 20 bp, Artificial Sequence
  chemically synthesized
aggtctgtagtagagaatgt

SEQ ID NO: 399256 - DNA, 20 bp, Artificial Sequence
  chemically synthesized
tcctccaacattctctacta

SEQ ID NO: 399257 - DNA, 20 bp, Artificial Sequence
  chemically synthesized
atttaatcaggtctgtagta

SEQ ID NO: 399258 - DNA, 20 bp, Artificial Sequence
  chemically synthesized
taatttaatcaggtctgtag

SEQ ID NO: 399259 - DNA, 20 bp, Artificial Sequence
  chemically synthesized
cagtaatttaatcaggtctg

SEQ ID NO: 399260 - DNA, 20 bp, Artificial Sequence
  chemically synthesized
agaatttcagtaatttaatc

SEQ ID NO: 399261 - DNA, 20 bp, Artificial Sequence
  chemically synthesized
tagaatttcagtaatttaat

SEQ ID NO: 399262 - DNA, 20 bp, Artificial Sequence
  chemically synthesized
gaaccacagtgttagaattt

SEQ ID NO: 399263 - DNA, 20 bp, Artificial Sequence
  chemically synthesized
ttactgaaattctaacactg

SEQ ID NO: 399264 - DNA, 20 bp, Artificial Sequence
  chemically synthesized
cactttgagaaccacagtgt

SEQ ID NO: 399265 - DNA, 20 bp, Artificial Sequence
  chemically synthesized
gaaccacactttgagaacca

SEQ ID NO: 399266 - DNA, 20 bp, Artificial Sequence
  chemically synthesized
ttctaacactgtggttctca

SEQ ID NO: 399267 - DNA, 20 bp, Artificial Sequence
  chemically synthesized
acactgtggttctcaaagtg

SEQ ID NO: 399268 - DNA, 20 bp, Artificial Sequence
  chemically synthesized
cggccaaagaaccacacttt

SEQ ID NO: 399269 - DNA, 20 bp, Artificial Sequence
  chemically synthesized
gttctcaaagtgtggttctt

SEQ ID NO: 399270 - DNA, 20 bp, Artificial Sequence
  chemically synthesized
aagtgtggttctttggccgt

SEQ ID NO: 399271 - DNA, 20 bp, Artificial Sequence
  chemically synthesized
gatgctgatgctgacggcca

SEQ ID NO: 399272 - DNA, 20 bp, Artificial Sequence
  chemically synthesized
ggttctttggccgtcagcat

SEQ ID NO: 399273 - DNA, 20 bp, Artificial Sequence
  chemically synthesized
tcaggtgatgctgatgctga

SEQ ID NO: 399274 - DNA, 20 bp, Artificial Sequence
  chemically synthesized
cgtcagcatcagcatcacct

SEQ ID NO: 399275 - DNA, 20 bp, Artificial Sequence
  chemically synthesized
gtcagcatcagcatcacctg

SEQ ID NO: 399276 - DNA, 20 bp, Artificial Sequence
  chemically synthesized
cggatttctaacaggtcctc

SEQ ID NO: 399277 - DNA, 20 bp, Artificial Sequence
  chemically synthesized
ccggatttctaacaggtcct

SEQ ID NO: 399278 - DNA, 20 bp, Artificial Sequence
  chemically synthesized
agcatcacctgaggacctgt

SEQ ID NO: 399279 - DNA, 20 bp, Artificial Sequence
  chemically synthesized
caggaatccggatttctaac

SEQ ID NO: 399280 - DNA, 20 bp, Artificial Sequence
  chemically synthesized
ccaggaatccggatttctaa

SEQ ID NO: 399281 - DNA, 20 bp, Artificial Sequence
  chemically synthesized
ctgaggacctgttagaaatc

SEQ ID NO: 399282 - DNA, 20 bp, Artificial Sequence
  chemically synthesized
ctgttagaaatccggattcc

SEQ ID NO: 399283 - DNA, 20 bp, Artificial Sequence
  chemically synthesized
tgttagaaatccggattcct

SEQ ID NO: 399284 - DNA, 20 bp, Artificial Sequence
  chemically synthesized
tagggtgggacccaggaatc

SEQ ID NO: 399285 - DNA, 20 bp, Artificial Sequence
  chemically synthesized
ataggtctagggtgggaccc

SEQ ID NO: 399286 - DNA, 20 bp, Artificial Sequence
  chemically synthesized
cataggtctagggtgggacc

SEQ ID NO: 399287 - DNA, 20 bp, Artificial Sequence
  chemically synthesized
cggattcctgggtcccaccc

SEQ ID NO: 399288 - DNA, 20 bp, Artificial Sequence
  chemically synthesized
taattccataggtctagggt

SEQ ID NO: 399289 - DNA, 20 bp, Artificial Sequence
  chemically synthesized
ctaattccataggtctaggg

SEQ ID NO: 399290 - DNA, 20 bp, Artificial Sequence
  chemically synthesized
tttctaattccataggtcta

SEQ ID NO: 399291 - DNA, 20 bp, Artificial Sequence
  chemically synthesized
tgggtcccaccctagaccta

SEQ ID NO: 399292 - DNA, 20 bp, Artificial Sequence
  chemically synthesized
gtttctaattccataggtct

SEQ ID NO: 399293 - DNA, 20 bp, Artificial Sequence
  chemically synthesized
agtttctaattccataggtc

SEQ ID NO: 399294 - DNA, 20 bp, Artificial Sequence
  chemically synthesized
ccaccctagacctatggaat

SEQ ID NO: 399295 - DNA, 20 bp, Artificial Sequence
  chemically synthesized
gtcagagtttctaattccat

SEQ ID NO: 399296 - DNA, 20 bp, Artificial Sequence
  chemically synthesized
agtcagagtttctaattcca

SEQ ID NO: 399297 - DNA, 20 bp, Artificial Sequence
  chemically synthesized
ggaattagaaactctgacta

SEQ ID NO: 399298 - DNA, 20 bp, Artificial Sequence
  chemically synthesized
gaattagaaactctgactat

SEQ ID NO: 399299 - DNA, 20 bp, Artificial Sequence
  chemically synthesized
attgctgaggcccatagtca

SEQ ID NO: 399300 - DNA, 20 bp, Artificial Sequence
  chemically synthesized
ggattgctgaggcccatagt

SEQ ID NO: 399301 - DNA, 20 bp, Artificial Sequence
  chemically synthesized
gaaactctgactatgggcct

SEQ ID NO: 399302 - DNA, 20 bp, Artificial Sequence
  chemically synthesized
acatggattgctgaggccca

SEQ ID NO: 399303 - DNA, 20 bp, Artificial Sequence
  chemically synthesized
tgttaaaacatggattgctg

SEQ ID NO: 399304 - DNA, 20 bp, Artificial Sequence
  chemically synthesized
gtgttaaaacatggattgct

SEQ ID NO: 399305 - DNA, 20 bp, Artificial Sequence
  chemically synthesized
ctagaaaatgtgttaaaaca

SEQ ID NO: 399306 - DNA, 20 bp, Artificial Sequence
  chemically synthesized
ccatgttttaacacattttc

SEQ ID NO: 399307 - DNA, 20 bp, Artificial Sequence
  chemically synthesized
catgttttaacacattttct

SEQ ID NO: 399308 - DNA, 20 bp, Artificial Sequence
  chemically synthesized
caaaacgcattggaattacc

SEQ ID NO: 399309 - DNA, 20 bp, Artificial Sequence
  chemically synthesized
aacgatgcagcaaaacgcat

SEQ ID NO: 399310 - DNA, 20 bp, Artificial Sequence
  chemically synthesized
atgcacactccaaaacgatg

SEQ ID NO: 399311 - DNA, 20 bp, Artificial Sequence
  chemically synthesized
tgcgttttgctgcatcgttt

SEQ ID NO: 399312 - DNA, 20 bp, Artificial Sequence
  chemically synthesized
cgttttgctgcatcgttttg

SEQ ID NO: 399313 - DNA, 20 bp, Artificial Sequence
  chemically synthesized
gcatcgttttggagtgtgca

SEQ ID NO: 399314 - DNA, 20 bp, Artificial Sequence
  chemically synthesized
agcaggctaccatttttgta

SEQ ID NO: 399315 - DNA, 20 bp, Artificial Sequence
  chemically synthesized
atcaaacaactctacaaaaa

SEQ ID NO: 399316 - DNA, 20 bp, Artificial Sequence
  chemically synthesized
caagcaggctaccatttttg

SEQ ID NO: 399317 - DNA, 20 bp, Artificial Sequence
  chemically synthesized
aaacaactctacaaaaatgg

SEQ ID NO: 399318 - DNA, 20 bp, Artificial Sequence
  chemically synthesized
cctaaaatggaaaagcaagc

SEQ ID NO: 399319 - DNA, 20 bp, Artificial Sequence
  chemically synthesized
acctaaaatggaaaagcaag

SEQ ID NO: 399320 - DNA, 20 bp, Artificial Sequence
  chemically synthesized
gagacctaaaatggaaaagc

SEQ ID NO: 399321 - DNA, 20 bp, Artificial Sequence
  chemically synthesized
catagagacctaaaatggaa

SEQ ID NO: 399322 - DNA, 20 bp, Artificial Sequence
  chemically synthesized
gcctgcttgcttttccattt

SEQ ID NO: 399323 - DNA, 20 bp, Artificial Sequence
  chemically synthesized
cctgcttgcttttccatttt

SEQ ID NO: 399324 - DNA, 20 bp, Artificial Sequence
  chemically synthesized
atagacatagagacctaaaa

SEQ ID NO: 399325 - DNA, 20 bp, Artificial Sequence
  chemically synthesized
tacatttggcaatagacata

SEQ ID NO: 399326 - DNA, 20 bp, Artificial Sequence
  chemically synthesized
tttacatttggcaatagaca

SEQ ID NO: 399327 - DNA, 20 bp, Artificial Sequence
  chemically synthesized
ctaccctttacatttggcaa

SEQ ID NO: 399328 - DNA, 20 bp, Artificial Sequence
  chemically synthesized
tatgtctattgccaaatgta

SEQ ID NO: 399329 - DNA, 20 bp, Artificial Sequence
  chemically synthesized
atgtctattgccaaatgtaa

SEQ ID NO: 399330 - DNA, 20 bp, Artificial Sequence
  chemically synthesized
tgaagtctaccctttacatt

SEQ ID NO: 399331 - DNA, 20 bp, Artificial Sequence
  chemically synthesized
tgtctattgccaaatgtaaa

SEQ ID NO: 399332 - DNA, 20 bp, Artificial Sequence
  chemically synthesized
ctattgccaaatgtaaaggg

SEQ ID NO: 399333 - DNA, 20 bp, Artificial Sequence
  chemically synthesized
caaatgtaaagggtagactt

SEQ ID NO: 399334 - DNA, 20 bp, Artificial Sequence
  chemically synthesized
ttcatgcaaaatttggtctg

SEQ ID NO: 399335 - DNA, 20 bp, Artificial Sequence
  chemically synthesized
ctaatgcttcatgcaaaatt

SEQ ID NO: 399336 - DNA, 20 bp, Artificial Sequence
  chemically synthesized
ttcagaccaaattttgcatg

SEQ ID NO: 399337 - DNA, 20 bp, Artificial Sequence
  chemically synthesized
ccaaattttgcatgaagcat

SEQ ID NO: 399338 - DNA, 20 bp, Artificial Sequence
  chemically synthesized
aattttgcatgaagcattag

SEQ ID NO: 399339 - DNA, 20 bp, Artificial Sequence
  chemically synthesized
tttgcatgaagcattagtgg

SEQ ID NO: 399340 - DNA, 20 bp, Artificial Sequence
  chemically synthesized
gcatgaagcattagtggtgg

SEQ ID NO: 399341 - DNA, 20 bp, Artificial Sequence
  chemically synthesized
catgaagcattagtggtggt

SEQ ID NO: 399342 - DNA, 20 bp, Artificial Sequence
  chemically synthesized
atgaagcattagtggtggtg

SEQ ID NO: 399343 - DNA, 20 bp, Artificial Sequence
  chemically synthesized
aagcattagtggtggtgggg

SEQ ID NO: 399344 - DNA, 20 bp, Artificial Sequence
  chemically synthesized
acaggcaatgatagaagaat

SEQ ID NO: 399345 - DNA, 20 bp, Artificial Sequence
  chemically synthesized
aaaacaacaggcaatgatag

SEQ ID NO: 399346 - DNA, 20 bp, Artificial Sequence
  chemically synthesized
tctaaaacaacaggcaatga

SEQ ID NO: 399347 - DNA, 20 bp, Artificial Sequence
  chemically synthesized
tctatcattgcctgttgttt

SEQ ID NO: 399348 - DNA, 20 bp, Artificial Sequence
  chemically synthesized
ctgtgaagctctaaaacaac

SEQ ID NO: 399349 - DNA, 20 bp, Artificial Sequence
  chemically synthesized
actgtgaagctctaaaacaa

SEQ ID NO: 399350 - DNA, 20 bp, Artificial Sequence
  chemically synthesized
tatcattgcctgttgtttta

SEQ ID NO: 399351 - DNA, 20 bp, Artificial Sequence
  chemically synthesized
cctgttgttttagagcttca

SEQ ID NO: 399352 - DNA, 20 bp, Artificial Sequence
  chemically synthesized
acttctgattgaagactgtg

SEQ ID NO: 399353 - DNA, 20 bp, Artificial Sequence
  chemically synthesized
agagcttcacagtcttcaat

SEQ ID NO: 399354 - DNA, 20 bp, Artificial Sequence
  chemically synthesized
gcttcacagtcttcaatcag

SEQ ID NO: 399355 - DNA, 20 bp, Artificial Sequence
  chemically synthesized
taatttgcaacttctgattg

SEQ ID NO: 399356 - DNA, 20 bp, Artificial Sequence
  chemically synthesized
agttgcaaattaacatgact

SEQ ID NO: 399357 - DNA, 20 bp, Artificial Sequence
  chemically synthesized
ccaacaataagataatggct

SEQ ID NO: 399358 - DNA, 20 bp, Artificial Sequence
  chemically synthesized
ttgagccaacaataagataa

SEQ ID NO: 399359 - DNA, 20 bp, Artificial Sequence
  chemically synthesized
ctaagccattatcttattgt

SEQ ID NO: 399360 - DNA, 20 bp, Artificial Sequence
  chemically synthesized
gggctggttgagccaacaat

SEQ ID NO: 399361 - DNA, 20 bp, Artificial Sequence
  chemically synthesized
tatcttattgttggctcaac

SEQ ID NO: 399362 - DNA, 20 bp, Artificial Sequence
  chemically synthesized
atattgttgtggggctggtt

SEQ ID NO: 399363 - DNA, 20 bp, Artificial Sequence
  chemically synthesized
gaattatattgttgtggggc

SEQ ID NO: 399364 - DNA, 20 bp, Artificial Sequence
  chemically synthesized
tgaagaattatattgttgtg

SEQ ID NO: 399365 - DNA, 20 bp, Artificial Sequence
  chemically synthesized
ttgaagaattatattgttgt

SEQ ID NO: 399366 - DNA, 20 bp, Artificial Sequence
  chemically synthesized
cttgaagaattatattgttg

SEQ ID NO: 399367 - DNA, 20 bp, Artificial Sequence
  chemically synthesized
ccacaacaatataattcttc

SEQ ID NO: 399368 - DNA, 20 bp, Artificial Sequence
  chemically synthesized
acaatataattcttcaagaa

SEQ ID NO: 399369 - DNA, 20 bp, Artificial Sequence
  chemically synthesized
ggcatataatgccattcttg

SEQ ID NO: 399370 - DNA, 20 bp, Artificial Sequence
  chemically synthesized
gaagaagagaggttgtgaga

SEQ ID NO: 399371 - DNA, 20 bp, Artificial Sequence
  chemically synthesized
tgaagaagagaggttgtgag

SEQ ID NO: 399372 - DNA, 20 bp, Artificial Sequence
  chemically synthesized
gtgaagaagagaggttgtga

SEQ ID NO: 399373 - DNA, 20 bp, Artificial Sequence
  chemically synthesized
gagtgaagaagagaggttgt

SEQ ID NO: 399374 - DNA, 20 bp, Artificial Sequence
  chemically synthesized
tctttaggagtgaagaagag

SEQ ID NO: 399375 - DNA, 20 bp, Artificial Sequence
  chemically synthesized
atctttaggagtgaagaaga

SEQ ID NO: 399376 - DNA, 20 bp, Artificial Sequence
  chemically synthesized
agatctttaggagtgaagaa

SEQ ID NO: 399377 - DNA, 20 bp, Artificial Sequence
  chemically synthesized
ggagatctttaggagtgaag

SEQ ID NO: 399378 - DNA, 20 bp, Artificial Sequence
  chemically synthesized
aagggagatctttaggagtg

SEQ ID NO: 399379 - DNA, 20 bp, Artificial Sequence
  chemically synthesized
acctctcttcttcactccta

SEQ ID NO: 399380 - DNA, 20 bp, Artificial Sequence
  chemically synthesized
gtagcaagggagatctttag

SEQ ID NO: 399381 - DNA, 20 bp, Artificial Sequence
  chemically synthesized
tagtagcaagggagatcttt

SEQ ID NO: 399382 - DNA, 20 bp, Artificial Sequence
  chemically synthesized
gtagtagcaagggagatctt

SEQ ID NO: 399383 - DNA, 20 bp, Artificial Sequence
  chemically synthesized
tcaggtgagtagtagcaagg

SEQ ID NO: 399384 - DNA, 20 bp, Artificial Sequence
  chemically synthesized
tgtcaggtgagtagtagcaa

SEQ ID NO: 399385 - DNA, 20 bp, Artificial Sequence
  chemically synthesized
ttgtcaggtgagtagtagca

SEQ ID NO: 399386 - DNA, 20 bp, Artificial Sequence
  chemically synthesized
cttgtcaggtgagtagtagc

SEQ ID NO: 399387 - DNA, 20 bp, Artificial Sequence
  chemically synthesized
atgacttgtcaggtgagtag

SEQ ID NO: 399388 - DNA, 20 bp, Artificial Sequence
  chemically synthesized
agtatgacttgtcaggtgag

SEQ ID NO: 399389 - DNA, 20 bp, Artificial Sequence
  chemically synthesized
cttgctactactcacctgac

SEQ ID NO: 399390 - DNA, 20 bp, Artificial Sequence
  chemically synthesized
agaagtatgacttgtcaggt

SEQ ID NO: 399391 - DNA, 20 bp, Artificial Sequence
  chemically synthesized
tcaaagaagtatgacttgtc

SEQ ID NO: 399392 - DNA, 20 bp, Artificial Sequence
  chemically synthesized
atcaaagaagtatgacttgt

SEQ ID NO: 399393 - DNA, 20 bp, Artificial Sequence
  chemically synthesized
gaaatgtgtaataatcaaag

SEQ ID NO: 399394 - DNA, 20 bp, Artificial Sequence
  chemically synthesized
gtagaaatgtgtaataatca

SEQ ID NO: 399395 - DNA, 20 bp, Artificial Sequence
  chemically synthesized
aaggcagaaggaattgcatg

SEQ ID NO: 399396 - DNA, 20 bp, Artificial Sequence
  chemically synthesized
tcaagaaagatgaaggcaga

SEQ ID NO: 399397 - DNA, 20 bp, Artificial Sequence
  chemically synthesized
ttcaagaaagatgaaggcag

SEQ ID NO: 399398 - DNA, 20 bp, Artificial Sequence
  chemically synthesized
aatttcaagaaagatgaagg

SEQ ID NO: 399399 - DNA, 20 bp, Artificial Sequence
  chemically synthesized
gacaatttcaagaaagatga

SEQ ID NO: 399400 - DNA, 20 bp, Artificial Sequence
  chemically synthesized
agacaatttcaagaaagatg

SEQ ID NO: 399401 - DNA, 20 bp, Artificial Sequence
  chemically synthesized
acgcagagacaatttcaaga

SEQ ID NO: 399402 - DNA, 20 bp, Artificial Sequence
  chemically synthesized
gtctacgcagagacaatttc

SEQ ID NO: 399403 - DNA, 20 bp, Artificial Sequence
  chemically synthesized
ttcttgaaattgtctctgcg

SEQ ID NO: 399404 - DNA, 20 bp, Artificial Sequence
  chemically synthesized
agtctggtgttgtctacgca

SEQ ID NO: 399405 - DNA, 20 bp, Artificial Sequence
  chemically synthesized
ttagtctggtgttgtctacg

SEQ ID NO: 399406 - DNA, 20 bp, Artificial Sequence
  chemically synthesized
tgtctctgcgtagacaacac

SEQ ID NO: 399407 - DNA, 20 bp, Artificial Sequence
  chemically synthesized
aaatatggtgacatttagtc

SEQ ID NO: 399408 - DNA, 20 bp, Artificial Sequence
  chemically synthesized
ttttaaaatatggtgacatt

SEQ ID NO: 399409 - DNA, 20 bp, Artificial Sequence
  chemically synthesized
gataatagctttttaaaata

SEQ ID NO: 399410 - DNA, 20 bp, Artificial Sequence
  chemically synthesized
aaatgtcaccatattttaaa

SEQ ID NO: 399411 - DNA, 20 bp, Artificial Sequence
  chemically synthesized
taattgcttggagaggataa

SEQ ID NO: 399412 - DNA, 20 bp, Artificial Sequence
  chemically synthesized
aaaaagctattatcctctcc

SEQ ID NO: 399413 - DNA, 20 bp, Artificial Sequence
  chemically synthesized
gaatgactaattgcttggag

SEQ ID NO: 399414 - DNA, 20 bp, Artificial Sequence
  chemically synthesized
agaatgactaattgcttgga

SEQ ID NO: 399415 - DNA, 20 bp, Artificial Sequence
  chemically synthesized
acagaatgactaattgcttg

SEQ ID NO: 399416 - DNA, 20 bp, Artificial Sequence
  chemically synthesized
tattatcctctccaagcaat

SEQ ID NO: 399417 - DNA, 20 bp, Artificial Sequence
  chemically synthesized
agacagaatgactaattgct

SEQ ID NO: 399418 - DNA, 20 bp, Artificial Sequence
  chemically synthesized
tgctgtgggaacatagaaga

SEQ ID NO: 399419 - DNA, 20 bp, Artificial Sequence
  chemically synthesized
gaaatgctgtgggaacatag

SEQ ID NO: 399420 - DNA, 20 bp, Artificial Sequence
  chemically synthesized
atagaaatgctgtgggaaca

SEQ ID NO: 399421 - DNA, 20 bp, Artificial Sequence
  chemically synthesized
ttctgtcttctatgttccca

SEQ ID NO: 399422 - DNA, 20 bp, Artificial Sequence
  chemically synthesized
taatgcaatagaaatgctgt

SEQ ID NO: 399423 - DNA, 20 bp, Artificial Sequence
  chemically synthesized
ttaatgcaatagaaatgctg

SEQ ID NO: 399424 - DNA, 20 bp, Artificial Sequence
  chemically synthesized
aaacataatctttaatgcaa

SEQ ID NO: 399425 - DNA, 20 bp, Artificial Sequence
  chemically synthesized
acagcatttctattgcatta

SEQ ID NO: 399426 - DNA, 20 bp, Artificial Sequence
  chemically synthesized
gatgcaattgtttcctttct

SEQ ID NO: 399427 - DNA, 20 bp, Artificial Sequence
  chemically synthesized
aagagattatcatctgagaa

SEQ ID NO: 399428 - DNA, 20 bp, Artificial Sequence
  chemically synthesized
caagagattatcatctgaga

SEQ ID NO: 399429 - DNA, 20 bp, Artificial Sequence
  chemically synthesized
tctccaagagattatcatct

SEQ ID NO: 399430 - DNA, 20 bp, Artificial Sequence
  chemically synthesized
tttctcagatgataatctct

SEQ ID NO: 399431 - DNA, 20 bp, Artificial Sequence
  chemically synthesized
tctcagatgataatctcttg

SEQ ID NO: 399432 - DNA, 20 bp, Artificial Sequence
  chemically synthesized
tcagatgataatctcttgga

SEQ ID NO: 399433 - DNA, 20 bp, Artificial Sequence
  chemically synthesized
cagatgataatctcttggag

SEQ ID NO: 399434 - DNA, 20 bp, Artificial Sequence
  chemically synthesized
agatgataatctcttggaga

SEQ ID NO: 399435 - DNA, 20 bp, Artificial Sequence
  chemically synthesized
acatggttttccctctccaa

SEQ ID NO: 399436 - DNA, 20 bp, Artificial Sequence
  chemically synthesized
caacatggttttccctctcc

SEQ ID NO: 399437 - DNA, 20 bp, Artificial Sequence
  chemically synthesized
ttggagagggaaaaccatgt

SEQ ID NO: 399438 - DNA, 20 bp, Artificial Sequence
  chemically synthesized
tggagagggaaaaccatgtt

SEQ ID NO: 399439 - DNA, 20 bp, Artificial Sequence
  chemically synthesized
gatgaaggcataacccaaca

SEQ ID NO: 399440 - DNA, 20 bp, Artificial Sequence
  chemically synthesized
atactgtcatacagtgatga

SEQ ID NO: 399441 - DNA, 20 bp, Artificial Sequence
  chemically synthesized
catactgtcatacagtgatg

SEQ ID NO: 399442 - DNA, 20 bp, Artificial Sequence
  chemically synthesized
atgccttcatcactgtatga

SEQ ID NO: 399443 - DNA, 20 bp, Artificial Sequence
  chemically synthesized
gtgctaatcatactgtcata

SEQ ID NO: 399444 - DNA, 20 bp, Artificial Sequence
  chemically synthesized
tcactgtatgacagtatgat

SEQ ID NO: 399445 - DNA, 20 bp, Artificial Sequence
  chemically synthesized
atgacagtatgattagcaca

SEQ ID NO: 399446 - DNA, 20 bp, Artificial Sequence
  chemically synthesized
cagtatgattagcacatagc

SEQ ID NO: 399447 - DNA, 20 bp, Artificial Sequence
  chemically synthesized
aacaaatacttattgaatgc

SEQ ID NO: 399448 - DNA, 20 bp, Artificial Sequence
  chemically synthesized
gcacatagctggcattcaat

SEQ ID NO: 399449 - DNA, 20 bp, Artificial Sequence
  chemically synthesized
aagtatttgttaaatgttga

SEQ ID NO: 399450 - DNA, 20 bp, Artificial Sequence
  chemically synthesized
agtatttgttaaatgttgaa

SEQ ID NO: 399451 - DNA, 20 bp, Artificial Sequence
  chemically synthesized
taaatgttgaaaggttattt

SEQ ID NO: 399452 - DNA, 20 bp, Artificial Sequence
  chemically synthesized
tagtaaacatatatctctga

SEQ ID NO: 399453 - DNA, 20 bp, Artificial Sequence
  chemically synthesized
agtaaacatatatctctgat

SEQ ID NO: 399454 - DNA, 20 bp, Artificial Sequence
  chemically synthesized
actctggtaccatcctatca

SEQ ID NO: 399455 - DNA, 20 bp, Artificial Sequence
  chemically synthesized
aacatatatctctgatagga

SEQ ID NO: 399456 - DNA, 20 bp, Artificial Sequence
  chemically synthesized
acactctggtaccatcctat

SEQ ID NO: 399457 - DNA, 20 bp, Artificial Sequence
  chemically synthesized
tatctctgataggatggtac

SEQ ID NO: 399458 - DNA, 20 bp, Artificial Sequence
  chemically synthesized
tctctgataggatggtacca

SEQ ID NO: 399459 - DNA, 20 bp, Artificial Sequence
  chemically synthesized
gaaaagaacaattgacactc

SEQ ID NO: 399460 - DNA, 20 bp, Artificial Sequence
  chemically synthesized
tgaagcatttttatttagaa

SEQ ID NO: 399461 - DNA, 20 bp, Artificial Sequence
  chemically synthesized
attagtgaagcatttttatt

SEQ ID NO: 399462 - DNA, 20 bp, Artificial Sequence
  chemically synthesized
aacatacatggacattagtg

SEQ ID NO: 399463 - DNA, 20 bp, Artificial Sequence
  chemically synthesized
aaaacaacatacatggacat

SEQ ID NO: 399464 - DNA, 20 bp, Artificial Sequence
  chemically synthesized
ttctagcaaaacaacataca

SEQ ID NO: 399465 - DNA, 20 bp, Artificial Sequence
  chemically synthesized
gtccatgtatgttgttttgc

SEQ ID NO: 399466 - DNA, 20 bp, Artificial Sequence
  chemically synthesized
atgtatgttgttttgctaga

SEQ ID NO: 399467 - DNA, 20 bp, Artificial Sequence
  chemically synthesized
tctgattttattttgctttc

SEQ ID NO: 399468 - DNA, 20 bp, Artificial Sequence
  chemically synthesized
gctagaaagcaaaataaaat

SEQ ID NO: 399469 - DNA, 20 bp, Artificial Sequence
  chemically synthesized
aaataaaatcagataaataa

SEQ ID NO: 399470 - DNA, 20 bp, Artificial Sequence
  chemically synthesized
aaaatcagataaataatgga

SEQ ID NO: 399471 - DNA, 20 bp, Artificial Sequence
  chemically synthesized
aaatcagataaataatggat

SEQ ID NO: 399472 - DNA, 20 bp, Artificial Sequence
  chemically synthesized
taaataatggataggcccat

SEQ ID NO: 399473 - DNA, 20 bp, Artificial Sequence
  chemically synthesized
accaattctttatggctgat

SEQ ID NO: 399474 - DNA, 20 bp, Artificial Sequence
  chemically synthesized
aaccaattctttatggctga

SEQ ID NO: 399475 - DNA, 20 bp, Artificial Sequence
  chemically synthesized
ggataggcccatcagccata

SEQ ID NO: 399476 - DNA, 20 bp, Artificial Sequence
  chemically synthesized
gcaaaaaaaccaattcttta

SEQ ID NO: 399477 - DNA, 20 bp, Artificial Sequence
  chemically synthesized
gcccatcagccataaagaat

SEQ ID NO: 399478 - DNA, 20 bp, Artificial Sequence
  chemically synthesized
taaagaattggtttttttgc

SEQ ID NO: 399479 - DNA, 20 bp, Artificial Sequence
  chemically synthesized
ccaattagcatgatagttgc

SEQ ID NO: 399480 - DNA, 20 bp, Artificial Sequence
  chemically synthesized
atatttaccaattagcatga

SEQ ID NO: 399481 - DNA, 20 bp, Artificial Sequence
  chemically synthesized
ctagcaactatcatgctaat

SEQ ID NO: 399482 - DNA, 20 bp, Artificial Sequence
  chemically synthesized
atatgtaaatatttaccaat

SEQ ID NO: 399483 - DNA, 20 bp, Artificial Sequence
  chemically synthesized
tggtaaatatttacatatgc

SEQ ID NO: 399484 - DNA, 20 bp, Artificial Sequence
  chemically synthesized
gtctcagtgccaagcatatt

SEQ ID NO: 399485 - DNA, 20 bp, Artificial Sequence
  chemically synthesized
atatgcaagctaaatatgct

SEQ ID NO: 399486 - DNA, 20 bp, Artificial Sequence
  chemically synthesized
agctaaatatgcttggcact

SEQ ID NO: 399487 - DNA, 20 bp, Artificial Sequence
  chemically synthesized
tctggagtggtctcagtgcc

SEQ ID NO: 399488 - DNA, 20 bp, Artificial Sequence
  chemically synthesized
tatattctctggagtggtct

SEQ ID NO: 399489 - DNA, 20 bp, Artificial Sequence
  chemically synthesized
gcttggcactgagaccactc

SEQ ID NO: 399490 - DNA, 20 bp, Artificial Sequence
  chemically synthesized
ttggcactgagaccactcca

SEQ ID NO: 399491 - DNA, 20 bp, Artificial Sequence
  chemically synthesized
tacacctatattctctggag

SEQ ID NO: 399492 - DNA, 20 bp, Artificial Sequence
  chemically synthesized
gattacacctatattctctg

SEQ ID NO: 399493 - DNA, 20 bp, Artificial Sequence
  chemically synthesized
tgagaccactccagagaata

SEQ ID NO: 399494 - DNA, 20 bp, Artificial Sequence
  chemically synthesized
ttgattacacctatattctc

SEQ ID NO: 399495 - DNA, 20 bp, Artificial Sequence
  chemically synthesized
gagaccactccagagaatat

SEQ ID NO: 399496 - DNA, 20 bp, Artificial Sequence
  chemically synthesized
atgtcctgatacaagaaaat

SEQ ID NO: 399497 - DNA, 20 bp, Artificial Sequence
  chemically synthesized
taattccaattttcttgtat

SEQ ID NO: 399498 - DNA, 20 bp, Artificial Sequence
  chemically synthesized
aattccaattttcttgtatc

SEQ ID NO: 399499 - DNA, 20 bp, Artificial Sequence
  chemically synthesized
aggttatcatgtcctgatac

SEQ ID NO: 399500 - DNA, 20 bp, Artificial Sequence
  chemically synthesized
tgtatcaggacatgataacc

SEQ ID NO: 399501 - DNA, 20 bp, Artificial Sequence
  chemically synthesized
tatcaggacatgataaccta

SEQ ID NO: 399502 - DNA, 20 bp, Artificial Sequence
  chemically synthesized
aggtaaatgttttggtctct

SEQ ID NO: 399503 - DNA, 20 bp, Artificial Sequence
  chemically synthesized
aaggtaaatgttttggtctc

SEQ ID NO: 399504 - DNA, 20 bp, Artificial Sequence
  chemically synthesized
cttttagaaggtaaatgttt

SEQ ID NO: 399505 - DNA, 20 bp, Artificial Sequence
  chemically synthesized
ccaaaacatttaccttctaa

SEQ ID NO: 399506 - DNA, 20 bp, Artificial Sequence
  chemically synthesized
caaaacatttaccttctaaa

SEQ ID NO: 399507 - DNA, 20 bp, Artificial Sequence
  chemically synthesized
tcttgacaattccttttaga

SEQ ID NO: 399508 - DNA, 20 bp, Artificial Sequence
  chemically synthesized
atcttgacaattccttttag

SEQ ID NO: 399509 - DNA, 20 bp, Artificial Sequence
  chemically synthesized
gagatcttgacaattccttt

SEQ ID NO: 399510 - DNA, 20 bp, Artificial Sequence
  chemically synthesized
accttctaaaaggaattgtc

SEQ ID NO: 399511 - DNA, 20 bp, Artificial Sequence
  chemically synthesized
aaaaggaattgtcaagatct

SEQ ID NO: 399512 - DNA, 20 bp, Artificial Sequence
  chemically synthesized
tttatcaacccagtgttact

SEQ ID NO: 399513 - DNA, 20 bp, Artificial Sequence
  chemically synthesized
tgtcaagatctcagtaacac

SEQ ID NO: 399514 - DNA, 20 bp, Artificial Sequence
  chemically synthesized
gtcaagatctcagtaacact

SEQ ID NO: 399515 - DNA, 20 bp, Artificial Sequence
  chemically synthesized
tatgttgctgtttatcaacc

SEQ ID NO: 399516 - DNA, 20 bp, Artificial Sequence
  chemically synthesized
agtaacactgggttgataaa

SEQ ID NO: 399517 - DNA, 20 bp, Artificial Sequence
  chemically synthesized
ataaacagcaacatatttct

SEQ ID NO: 399518 - DNA, 20 bp, Artificial Sequence
  chemically synthesized
ttaatagtaaagaagtttct

SEQ ID NO: 399519 - DNA, 20 bp, Artificial Sequence
  chemically synthesized
acttattgttaatagtaaag

SEQ ID NO: 399520 - DNA, 20 bp, Artificial Sequence
  chemically synthesized
atcacttattgttaatagta

SEQ ID NO: 399521 - DNA, 20 bp, Artificial Sequence
  chemically synthesized
gacaaatcacttattgttaa

SEQ ID NO: 399522 - DNA, 20 bp, Artificial Sequence
  chemically synthesized
acttctttactattaacaat

SEQ ID NO: 399523 - DNA, 20 bp, Artificial Sequence
  chemically synthesized
ggtctcactgttttcaaaga

SEQ ID NO: 399524 - DNA, 20 bp, Artificial Sequence
  chemically synthesized
gatttgtctttctttgaaaa

SEQ ID NO: 399525 - DNA, 20 bp, Artificial Sequence
  chemically synthesized
gataggtctcactgttttca

SEQ ID NO: 399526 - DNA, 20 bp, Artificial Sequence
  chemically synthesized
tgtctttctttgaaaacagt

SEQ ID NO: 399527 - DNA, 20 bp, Artificial Sequence
  chemically synthesized
agacaaaaatggattgtgat

SEQ ID NO: 399528 - DNA, 20 bp, Artificial Sequence
  chemically synthesized
gagacaaaaatggattgtga

SEQ ID NO: 399529 - DNA, 20 bp, Artificial Sequence
  chemically synthesized
ctcagttagtgagacaaaaa

SEQ ID NO: 399530 - DNA, 20 bp, Artificial Sequence
  chemically synthesized
ccatttttgtctcactaact

SEQ ID NO: 399531 - DNA, 20 bp, Artificial Sequence
  chemically synthesized
aaggatattactcagttagt

SEQ ID NO: 399532 - DNA, 20 bp, Artificial Sequence
  chemically synthesized
aacaaaggatattactcagt

SEQ ID NO: 399533 - DNA, 20 bp, Artificial Sequence
  chemically synthesized
aagtaacaaaggatattact

SEQ ID NO: 399534 - DNA, 20 bp, Artificial Sequence
  chemically synthesized
gcaaagtacctaagtaacaa

SEQ ID NO: 399535 - DNA, 20 bp, Artificial Sequence
  chemically synthesized
gagtaatatcctttgttact

SEQ ID NO: 399536 - DNA, 20 bp, Artificial Sequence
  chemically synthesized
tgcaaagtacctaagtaaca

SEQ ID NO: 399537 - DNA, 20 bp, Artificial Sequence
  chemically synthesized
agtaatatcctttgttactt

SEQ ID NO: 399538 - DNA, 20 bp, Artificial Sequence
  chemically synthesized
acaatctttgcaaagtacct

SEQ ID NO: 399539 - DNA, 20 bp, Artificial Sequence
  chemically synthesized
tgttacttaggtactttgca

SEQ ID NO: 399540 - DNA, 20 bp, Artificial Sequence
  chemically synthesized
ttcctgaaacaatctttgca

SEQ ID NO: 399541 - DNA, 20 bp, Artificial Sequence
  chemically synthesized
gtactttgcaaagattgttt

SEQ ID NO: 399542 - DNA, 20 bp, Artificial Sequence
  chemically synthesized
tactttgcaaagattgtttc

SEQ ID NO: 399543 - DNA, 20 bp, Artificial Sequence
  chemically synthesized
attgtttcaggaaaacattc

SEQ ID NO: 399544 - DNA, 20 bp, Artificial Sequence
  chemically synthesized
ttgtttcaggaaaacattca

SEQ ID NO: 399545 - DNA, 20 bp, Artificial Sequence
  chemically synthesized
tgtttcaggaaaacattcaa

SEQ ID NO: 399546 - DNA, 20 bp, Artificial Sequence
  chemically synthesized
caggaaaacattcaagggaa

SEQ ID NO: 399547 - DNA, 20 bp, Artificial Sequence
  chemically synthesized
acattcaagggaatggttct

SEQ ID NO: 399548 - DNA, 20 bp, Artificial Sequence
  chemically synthesized
ttcaagggaatggttctcag

SEQ ID NO: 399549 - DNA, 20 bp, Artificial Sequence
  chemically synthesized
actaaatggtttaatctact

SEQ ID NO: 399550 - DNA, 20 bp, Artificial Sequence
  chemically synthesized
tctcagtagattaaaccatt

SEQ ID NO: 399551 - DNA, 20 bp, Artificial Sequence
  chemically synthesized
atcaagatgattatactaaa

SEQ ID NO: 399552 - DNA, 20 bp, Artificial Sequence
  chemically synthesized
atgtgtttgtgtttggaatc

SEQ ID NO: 399553 - DNA, 20 bp, Artificial Sequence
  chemically synthesized
tcgaatgatgtgtttgtgtt

SEQ ID NO: 399554 - DNA, 20 bp, Artificial Sequence
  chemically synthesized
acacaaacacatcattcgac

SEQ ID NO: 399555 - DNA, 20 bp, Artificial Sequence
  chemically synthesized
cgacaagtcatcttaacacc

SEQ ID NO: 399556 - DNA, 20 bp, Artificial Sequence
  chemically synthesized
taacatctacacttggtgtt

SEQ ID NO: 399557 - DNA, 20 bp, Artificial Sequence
  chemically synthesized
agtcatcttaacaccaagtg

SEQ ID NO: 399558 - DNA, 20 bp, Artificial Sequence
  chemically synthesized
aactccctaacatctacact

SEQ ID NO: 399559 - DNA, 20 bp, Artificial Sequence
  chemically synthesized
ttaacaccaagtgtagatgt

SEQ ID NO: 399560 - DNA, 20 bp, Artificial Sequence
  chemically synthesized
taacaccaagtgtagatgtt

SEQ ID NO: 399561 - DNA, 20 bp, Artificial Sequence
  chemically synthesized
aacaccaagtgtagatgtta

SEQ ID NO: 399562 - DNA, 20 bp, Artificial Sequence
  chemically synthesized
caccaagtgtagatgttagg

SEQ ID NO: 399563 - DNA, 20 bp, Artificial Sequence
  chemically synthesized
atgttagggagttcacatgc

SEQ ID NO: 399564 - DNA, 20 bp, Artificial Sequence
  chemically synthesized
agggagttcacatgccagta

SEQ ID NO: 399565 - DNA, 20 bp, Artificial Sequence
  chemically synthesized
gagttcacatgccagtaaag

SEQ ID NO: 399566 - DNA, 20 bp, Artificial Sequence
  chemically synthesized
aattcaaaataccactttac

SEQ ID NO: 399567 - DNA, 20 bp, Artificial Sequence
  chemically synthesized
atttcgtataaaactgtttt

SEQ ID NO: 399568 - DNA, 20 bp, Artificial Sequence
  chemically synthesized
atttgaatattaacttaaaa

SEQ ID NO: 399569 - DNA, 20 bp, Artificial Sequence
  chemically synthesized
aaacacaataatttgtttat

SEQ ID NO: 399570 - DNA, 20 bp, Artificial Sequence
  chemically synthesized
cacaataatttgtttatgag

SEQ ID NO: 399571 - DNA, 20 bp, Artificial Sequence
  chemically synthesized
aataatttgtttatgagtag

SEQ ID NO: 399572 - DNA, 20 bp, Artificial Sequence
  chemically synthesized
ttatgagtagtagaaataaa

SEQ ID NO: 399573 - DNA, 20 bp, Artificial Sequence
  chemically synthesized
tgaaaatgacaatatcactt

SEQ ID NO: 399574 - DNA, 20 bp, Artificial Sequence
  chemically synthesized
gtttgcagtagagttatcta

SEQ ID NO: 399575 - DNA, 20 bp, Artificial Sequence
  chemically synthesized
agtaaacttagtttgcagta

SEQ ID NO: 399576 - DNA, 20 bp, Artificial Sequence
  chemically synthesized
gaagtaaacttagtttgcag

SEQ ID NO: 399577 - DNA, 20 bp, Artificial Sequence
  chemically synthesized
agataactctactgcaaact

SEQ ID NO: 399578 - DNA, 20 bp, Artificial Sequence
  chemically synthesized
agtgaagtaaacttagtttg

SEQ ID NO: 399579 - DNA, 20 bp, Artificial Sequence
  chemically synthesized
tttggtgagtgaagtaaact

SEQ ID NO: 399580 - DNA, 20 bp, Artificial Sequence
  chemically synthesized
atactgcgttttggtgagtg

SEQ ID NO: 399581 - DNA, 20 bp, Artificial Sequence
  chemically synthesized
tttacatactgcgttttggt

SEQ ID NO: 399582 - DNA, 20 bp, Artificial Sequence
  chemically synthesized
ttacttcactcaccaaaacg

SEQ ID NO: 399583 - DNA, 20 bp, Artificial Sequence
  chemically synthesized
attttttacatactgcgttt

SEQ ID NO: 399584 - DNA, 20 bp, Artificial Sequence
  chemically synthesized
gtaaaaaatattaacattta

SEQ ID NO: 399585 - DNA, 20 bp, Artificial Sequence
  chemically synthesized
attaacatttaaagtacaaa

SEQ ID NO: 399586 - DNA, 20 bp, Artificial Sequence
  chemically synthesized
gtacaaacagttctcgactt

SEQ ID NO: 399587 - DNA, 20 bp, Artificial Sequence
  chemically synthesized
aggtcaaaatatcttaagtc

SEQ ID NO: 399588 - DNA, 20 bp, Artificial Sequence
  chemically synthesized
ttataaggtcaaaatatctt

SEQ ID NO: 399589 - DNA, 20 bp, Artificial Sequence
  chemically synthesized
aagatattttgaccttataa

SEQ ID NO: 399590 - DNA, 20 bp, Artificial Sequence
  chemically synthesized
tatcaccttacactattata

SEQ ID NO: 399591 - DNA, 20 bp, Artificial Sequence
  chemically synthesized
gtatcaccttacactattat

SEQ ID NO: 399592 - DNA, 20 bp, Artificial Sequence
  chemically synthesized
ttttgaccttataatagtgt

SEQ ID NO: 399593 - DNA, 20 bp, Artificial Sequence
  chemically synthesized
tttgaccttataatagtgta

SEQ ID NO: 399594 - DNA, 20 bp, Artificial Sequence
  chemically synthesized
agtgtaaggtgatactcatt

SEQ ID NO: 399595 - DNA, 20 bp, Artificial Sequence
  chemically synthesized
gtaaggtgatactcatttag

SEQ ID NO: 399596 - DNA, 20 bp, Artificial Sequence
  chemically synthesized
aaatacggtttctactaaat

SEQ ID NO: 399597 - DNA, 20 bp, Artificial Sequence
  chemically synthesized
tttagtagaaaccgtatttt

SEQ ID NO: 399598 - DNA, 20 bp, Artificial Sequence
  chemically synthesized
atgtatgggtactcaaaata

SEQ ID NO: 399599 - DNA, 20 bp, Artificial Sequence
  chemically synthesized
gaaaaacagaatgcatgtat

SEQ ID NO: 399600 - DNA, 20 bp, Artificial Sequence
  chemically synthesized
tgaaaaacagaatgcatgta

SEQ ID NO: 399601 - DNA, 20 bp, Artificial Sequence
  chemically synthesized
actgtactgaaagtgaaaaa

SEQ ID NO: 399602 - DNA, 20 bp, Artificial Sequence
  chemically synthesized
tgcattctgtttttcacttt

SEQ ID NO: 399603 - DNA, 20 bp, Artificial Sequence
  chemically synthesized
tctgtttttcactttcagta

SEQ ID NO: 399604 - DNA, 20 bp, Artificial Sequence
  chemically synthesized
ttgattgaatactgtactga

SEQ ID NO: 399605 - DNA, 20 bp, Artificial Sequence
  chemically synthesized
cagtattcaatcaattacat

SEQ ID NO: 399606 - DNA, 20 bp, Artificial Sequence
  chemically synthesized
attcaatcaattacatgagc

SEQ ID NO: 399607 - DNA, 20 bp, Artificial Sequence
  chemically synthesized
aacctattttataataaagc

SEQ ID NO: 399608 - DNA, 20 bp, Artificial Sequence
  chemically synthesized
cacaaacctattttataata

SEQ ID NO: 399609 - DNA, 20 bp, Artificial Sequence
  chemically synthesized
gagctagctttattataaaa

SEQ ID NO: 399610 - DNA, 20 bp, Artificial Sequence
  chemically synthesized
agctagctttattataaaat

SEQ ID NO: 399611 - DNA, 20 bp, Artificial Sequence
  chemically synthesized
ttgtgtgaaatgattttgcc

SEQ ID NO: 399612 - DNA, 20 bp, Artificial Sequence
  chemically synthesized
gaaatgattttgcccagctc

SEQ ID NO: 399613 - DNA, 20 bp, Artificial Sequence
  chemically synthesized
aaatgattttgcccagctct

SEQ ID NO: 399614 - DNA, 20 bp, Artificial Sequence
  chemically synthesized
cttaacactatcctagagct

SEQ ID NO: 399615 - DNA, 20 bp, Artificial Sequence
  chemically synthesized
gcttaacactatcctagagc

SEQ ID NO: 399616 - DNA, 20 bp, Artificial Sequence
  chemically synthesized
gattttgcccagctctagga

SEQ ID NO: 399617 - DNA, 20 bp, Artificial Sequence
  chemically synthesized
gctggcttaacactatccta

SEQ ID NO: 399618 - DNA, 20 bp, Artificial Sequence
  chemically synthesized
gtgctggcttaacactatcc

SEQ ID NO: 399619 - DNA, 20 bp, Artificial Sequence
  chemically synthesized
cccagctctaggatagtgtt

SEQ ID NO: 399620 - DNA, 20 bp, Artificial Sequence
  chemically synthesized
gctctaggatagtgttaagc

SEQ ID NO: 399621 - DNA, 20 bp, Artificial Sequence
  chemically synthesized
ctaccctactttaaatgtgc

SEQ ID NO: 399622 - DNA, 20 bp, Artificial Sequence
  chemically synthesized
gtgttaagccagcacattta

SEQ ID NO: 399623 - DNA, 20 bp, Artificial Sequence
  chemically synthesized
ttaagccagcacatttaaag

SEQ ID NO: 399624 - DNA, 20 bp, Artificial Sequence
  chemically synthesized
taagccagcacatttaaagt

SEQ ID NO: 399625 - DNA, 20 bp, Artificial Sequence
  chemically synthesized
aagccagcacatttaaagta

SEQ ID NO: 399626 - DNA, 20 bp, Artificial Sequence
  chemically synthesized
ccagcacatttaaagtaggg

SEQ ID NO: 399627 - DNA, 20 bp, Artificial Sequence
  chemically synthesized
cagcacatttaaagtagggt

SEQ ID NO: 399628 - DNA, 20 bp, Artificial Sequence
  chemically synthesized
catttaaagtagggtaggct

SEQ ID NO: 399629 - DNA, 20 bp, Artificial Sequence
  chemically synthesized
accttcgaaacaacatagct

SEQ ID NO: 399630 - DNA, 20 bp, Artificial Sequence
  chemically synthesized
acctaaccttcgaaacaaca

SEQ ID NO: 399631 - DNA, 20 bp, Artificial Sequence
  chemically synthesized
ggctaagctatgttgtttcg

SEQ ID NO: 399632 - DNA, 20 bp, Artificial Sequence
  chemically synthesized
gctaagctatgttgtttcga

SEQ ID NO: 399633 - DNA, 20 bp, Artificial Sequence
  chemically synthesized
agctatgttgtttcgaaggt

SEQ ID NO: 399634 - DNA, 20 bp, Artificial Sequence
  chemically synthesized
gctatgttgtttcgaaggtt

SEQ ID NO: 399635 - DNA, 20 bp, Artificial Sequence
  chemically synthesized
ttcgaaggttaggtatatta

SEQ ID NO: 399636 - DNA, 20 bp, Artificial Sequence
  chemically synthesized
tcgaaggttaggtatattaa

SEQ ID NO: 399637 - DNA, 20 bp, Artificial Sequence
  chemically synthesized
tcataagttgaaaatatcac

SEQ ID NO: 399638 - DNA, 20 bp, Artificial Sequence
  chemically synthesized
gtgatattttcaacttatga

SEQ ID NO: 399639 - DNA, 20 bp, Artificial Sequence
  chemically synthesized
tgatattttcaacttatgat

SEQ ID NO: 399640 - DNA, 20 bp, Artificial Sequence
  chemically synthesized
ggtccctataaacccatcat

SEQ ID NO: 399641 - DNA, 20 bp, Artificial Sequence
  chemically synthesized
ttcaacttatgatgggttta

SEQ ID NO: 399642 - DNA, 20 bp, Artificial Sequence
  chemically synthesized
tcaacttatgatgggtttat

SEQ ID NO: 399643 - DNA, 20 bp, Artificial Sequence
  chemically synthesized
caacttatgatgggtttata

SEQ ID NO: 399644 - DNA, 20 bp, Artificial Sequence
  chemically synthesized
gcccctcaacttgtgtggtt

SEQ ID NO: 399645 - DNA, 20 bp, Artificial Sequence
  chemically synthesized
ttatagggacctaaccacac

SEQ ID NO: 399646 - DNA, 20 bp, Artificial Sequence
  chemically synthesized
tgcccctcaacttgtgtggt

SEQ ID NO: 399647 - DNA, 20 bp, Artificial Sequence
  chemically synthesized
caaatgcccctcaacttgtg

SEQ ID NO: 399648 - DNA, 20 bp, Artificial Sequence
  chemically synthesized
gggacctaaccacacaagtt

SEQ ID NO: 399649 - DNA, 20 bp, Artificial Sequence
  chemically synthesized
ggacctaaccacacaagttg

SEQ ID NO: 399650 - DNA, 20 bp, Artificial Sequence
  chemically synthesized
gacctaaccacacaagttga

SEQ ID NO: 399651 - DNA, 20 bp, Artificial Sequence
  chemically synthesized
acctaaccacacaagttgag

SEQ ID NO: 399652 - DNA, 20 bp, Artificial Sequence
  chemically synthesized
aagttgaggggcatttgtat

SEQ ID NO: 399653 - DNA, 20 bp, Artificial Sequence
  chemically synthesized
catttgtattagaaatcatt

SEQ ID NO: 399654 - DNA, 20 bp, Artificial Sequence
  chemically synthesized
tgtattagaaatcattcaga

SEQ ID NO: 399655 - DNA, 20 bp, Artificial Sequence
  chemically synthesized
ccattgtttaggaagttttt

SEQ ID NO: 399656 - DNA, 20 bp, Artificial Sequence
  chemically synthesized
aaatgcaaccattgtttagg

SEQ ID NO: 399657 - DNA, 20 bp, Artificial Sequence
  chemically synthesized
ctaaaaaacttcctaaacaa

SEQ ID NO: 399658 - DNA, 20 bp, Artificial Sequence
  chemically synthesized
ccaaaatgcaaccattgttt

SEQ ID NO: 399659 - DNA, 20 bp, Artificial Sequence
  chemically synthesized
cccaaaatgcaaccattgtt

SEQ ID NO: 399660 - DNA, 20 bp, Artificial Sequence
  chemically synthesized
cctaaacaatggttgcattt

SEQ ID NO: 399661 - DNA, 20 bp, Artificial Sequence
  chemically synthesized
ctaaacaatggttgcatttt

SEQ ID NO: 399662 - DNA, 20 bp, Artificial Sequence
  chemically synthesized
taaacaatggttgcattttg

SEQ ID NO: 399663 - DNA, 20 bp, Artificial Sequence
  chemically synthesized
ttaatctacctttgaatgtt

SEQ ID NO: 399664 - DNA, 20 bp, Artificial Sequence
  chemically synthesized
ttggggttactaaacattca

SEQ ID NO: 399665 - DNA, 20 bp, Artificial Sequence
  chemically synthesized
tggggttactaaacattcaa

SEQ ID NO: 399666 - DNA, 20 bp, Artificial Sequence
  chemically synthesized
ggttactaaacattcaaagg

SEQ ID NO: 399667 - DNA, 20 bp, Artificial Sequence
  chemically synthesized
aggtagattaaatcctctgt

SEQ ID NO: 399668 - DNA, 20 bp, Artificial Sequence
  chemically synthesized
aaatgctcgcttactcacag

SEQ ID NO: 399669 - DNA, 20 bp, Artificial Sequence
  chemically synthesized
agattaaatcctctgtgagt

SEQ ID NO: 399670 - DNA, 20 bp, Artificial Sequence
  chemically synthesized
taaatgctcgcttactcaca

SEQ ID NO: 399671 - DNA, 20 bp, Artificial Sequence
  chemically synthesized
attaaatgctcgcttactca

SEQ ID NO: 399672 - DNA, 20 bp, Artificial Sequence
  chemically synthesized
taaatcctctgtgagtaagc

SEQ ID NO: 399673 - DNA, 20 bp, Artificial Sequence
  chemically synthesized
agtgaagactcaataacagg

SEQ ID NO: 399674 - DNA, 20 bp, Artificial Sequence
  chemically synthesized
atttaataccacctgttatt

SEQ ID NO: 399675 - DNA, 20 bp, Artificial Sequence
  chemically synthesized
gacagtgaagactcaataac

SEQ ID NO: 399676 - DNA, 20 bp, Artificial Sequence
  chemically synthesized
agacagtgaagactcaataa

SEQ ID NO: 399677 - DNA, 20 bp, Artificial Sequence
  chemically synthesized
caggggggttggagacagtg

SEQ ID NO: 399678 - DNA, 20 bp, Artificial Sequence
  chemically synthesized
gcaggcaggggggttggaga

SEQ ID NO: 399679 - DNA, 20 bp, Artificial Sequence
  chemically synthesized
agaagcaggcaggggggttg

SEQ ID NO: 399680 - DNA, 20 bp, Artificial Sequence
  chemically synthesized
tgagaagcaggcaggggggt

SEQ ID NO: 399681 - DNA, 20 bp, Artificial Sequence
  chemically synthesized
cctatgagaagcaggcaggg

SEQ ID NO: 399682 - DNA, 20 bp, Artificial Sequence
  chemically synthesized
tcctatgagaagcaggcagg

SEQ ID NO: 399683 - DNA, 20 bp, Artificial Sequence
  chemically synthesized
gtcctatgagaagcaggcag

SEQ ID NO: 399684 - DNA, 20 bp, Artificial Sequence
  chemically synthesized
agtcctatgagaagcaggca

SEQ ID NO: 399685 - DNA, 20 bp, Artificial Sequence
  chemically synthesized
aagtcctatgagaagcaggc

SEQ ID NO: 399686 - DNA, 20 bp, Artificial Sequence
  chemically synthesized
taagtcctatgagaagcagg

SEQ ID NO: 399687 - DNA, 20 bp, Artificial Sequence
  chemically synthesized
tgataagtcctatgagaagc

SEQ ID NO: 399688 - DNA, 20 bp, Artificial Sequence
  chemically synthesized
acccccctgcctgcttctca

SEQ ID NO: 399689 - DNA, 20 bp, Artificial Sequence
  chemically synthesized
ttgataagtcctatgagaag

SEQ ID NO: 399690 - DNA, 20 bp, Artificial Sequence
  chemically synthesized
cccccctgcctgcttctcat

SEQ ID NO: 399691 - DNA, 20 bp, Artificial Sequence
  chemically synthesized
aaattgataagtcctatgag

SEQ ID NO: 399692 - DNA, 20 bp, Artificial Sequence
  chemically synthesized
atcaaattgataagtcctat

SEQ ID NO: 399693 - DNA, 20 bp, Artificial Sequence
  chemically synthesized
ggacaaatcatcaaattgat

SEQ ID NO: 399694 - DNA, 20 bp, Artificial Sequence
  chemically synthesized
ctacccaataatgcattttt

SEQ ID NO: 399695 - DNA, 20 bp, Artificial Sequence
  chemically synthesized
cctacccaataatgcatttt

SEQ ID NO: 399696 - DNA, 20 bp, Artificial Sequence
  chemically synthesized
ttgtcccaaaaatgcattat

SEQ ID NO: 399697 - DNA, 20 bp, Artificial Sequence
  chemically synthesized
tgtcccaaaaatgcattatt

SEQ ID NO: 399698 - DNA, 20 bp, Artificial Sequence
  chemically synthesized
cccaaaaatgcattattggg

SEQ ID NO: 399699 - DNA, 20 bp, Artificial Sequence
  chemically synthesized
ccaaaaatgcattattgggt

SEQ ID NO: 399700 - DNA, 20 bp, Artificial Sequence
  chemically synthesized
aaaatgcattattgggtagg

SEQ ID NO: 399701 - DNA, 20 bp, Artificial Sequence
  chemically synthesized
tttccatacctattattgtt

SEQ ID NO: 399702 - DNA, 20 bp, Artificial Sequence
  chemically synthesized
aatttttgtcccaacaataa

SEQ ID NO: 399703 - DNA, 20 bp, Artificial Sequence
  chemically synthesized
atttccatacctattattgt

SEQ ID NO: 399704 - DNA, 20 bp, Artificial Sequence
  chemically synthesized
atttttgtcccaacaataat

SEQ ID NO: 399705 - DNA, 20 bp, Artificial Sequence
  chemically synthesized
tgtcccaacaataataggta

SEQ ID NO: 399706 - DNA, 20 bp, Artificial Sequence
  chemically synthesized
aataggtatggaaatatcat

SEQ ID NO: 399707 - DNA, 20 bp, Artificial Sequence
  chemically synthesized
tatggaaatatcatgagttt

SEQ ID NO: 399708 - DNA, 20 bp, Artificial Sequence
  chemically synthesized
tggaaatatcatgagtttta

SEQ ID NO: 399709 - DNA, 20 bp, Artificial Sequence
  chemically synthesized
agttttagagtccattttct

SEQ ID NO: 399710 - DNA, 20 bp, Artificial Sequence
  chemically synthesized
gttttagagtccattttctt

SEQ ID NO: 399711 - DNA, 20 bp, Artificial Sequence
  chemically synthesized
gaagctaggacccaagaaaa

SEQ ID NO: 399712 - DNA, 20 bp, Artificial Sequence
  chemically synthesized
gagtccattttcttgggtcc

SEQ ID NO: 399713 - DNA, 20 bp, Artificial Sequence
  chemically synthesized
gagagatgaagctaggaccc

SEQ ID NO: 399714 - DNA, 20 bp, Artificial Sequence
  chemically synthesized
taaataggagagatgaagct

SEQ ID NO: 399715 - DNA, 20 bp, Artificial Sequence
  chemically synthesized
gtaaataggagagatgaagc

SEQ ID NO: 399716 - DNA, 20 bp, Artificial Sequence
  chemically synthesized
cacagtaaataggagagatg

SEQ ID NO: 399717 - DNA, 20 bp, Artificial Sequence
  chemically synthesized
cttgctcacagtaaatagga

SEQ ID NO: 399718 - DNA, 20 bp, Artificial Sequence
  chemically synthesized
ggcttgctcacagtaaatag

SEQ ID NO: 399719 - DNA, 20 bp, Artificial Sequence
  chemically synthesized
gtggcttgctcacagtaaat

SEQ ID NO: 399720 - DNA, 20 bp, Artificial Sequence
  chemically synthesized
tgtggcttgctcacagtaaa

SEQ ID NO: 399721 - DNA, 20 bp, Artificial Sequence
  chemically synthesized
tcatctctcctatttactgt

SEQ ID NO: 399722 - DNA, 20 bp, Artificial Sequence
  chemically synthesized
ctctcctatttactgtgagc

SEQ ID NO: 399723 - DNA, 20 bp, Artificial Sequence
  chemically synthesized
gaatttatgtggcttgctca

SEQ ID NO: 399724 - DNA, 20 bp, Artificial Sequence
  chemically synthesized
gagtaaaatgtgaatttatg

SEQ ID NO: 399725 - DNA, 20 bp, Artificial Sequence
  chemically synthesized
atgatacaagtattcaagat

SEQ ID NO: 399726 - DNA, 20 bp, Artificial Sequence
  chemically synthesized
atcatatgatacaagtattc

SEQ ID NO: 399727 - DNA, 20 bp, Artificial Sequence
  chemically synthesized
ctccaataatcatatgatac

SEQ ID NO: 399728 - DNA, 20 bp, Artificial Sequence
  chemically synthesized
tacttgtatcatatgattat

SEQ ID NO: 399729 - DNA, 20 bp, Artificial Sequence
  chemically synthesized
cttgtatcatatgattattg

SEQ ID NO: 399730 - DNA, 20 bp, Artificial Sequence
  chemically synthesized
gaaaattatatgtatatggt

SEQ ID NO: 399731 - DNA, 20 bp, Artificial Sequence
  chemically synthesized
tactgaaaattatatgtata

SEQ ID NO: 399732 - DNA, 20 bp, Artificial Sequence
  chemically synthesized
aaccatatacatataatttt

SEQ ID NO: 399733 - DNA, 20 bp, Artificial Sequence
  chemically synthesized
catatacatataattttcag

SEQ ID NO: 399734 - DNA, 20 bp, Artificial Sequence
  chemically synthesized
atatacatataattttcagt

SEQ ID NO: 399735 - DNA, 20 bp, Artificial Sequence
  chemically synthesized
cagtaggattattaacatca

SEQ ID NO: 399736 - DNA, 20 bp, Artificial Sequence
  chemically synthesized
tcatggtatacataaacaaa

SEQ ID NO: 399737 - DNA, 20 bp, Artificial Sequence
  chemically synthesized
tttcagaaatagtgaggatt

SEQ ID NO: 399738 - DNA, 20 bp, Artificial Sequence
  chemically synthesized
gtttcagaaatagtgaggat

SEQ ID NO: 399739 - DNA, 20 bp, Artificial Sequence
  chemically synthesized
tcctcgtttcagaaatagtg

SEQ ID NO: 399740 - DNA, 20 bp, Artificial Sequence
  chemically synthesized
atcctcgtttcagaaatagt

SEQ ID NO: 399741 - DNA, 20 bp, Artificial Sequence
  chemically synthesized
ggaaatcctcgtttcagaaa

SEQ ID NO: 399742 - DNA, 20 bp, Artificial Sequence
  chemically synthesized
atcctcactatttctgaaac

SEQ ID NO: 399743 - DNA, 20 bp, Artificial Sequence
  chemically synthesized
tcctcactatttctgaaacg

SEQ ID NO: 399744 - DNA, 20 bp, Artificial Sequence
  chemically synthesized
acttacggaaatcctcgttt

SEQ ID NO: 399745 - DNA, 20 bp, Artificial Sequence
  chemically synthesized
tctgaaacgaggatttccgt

SEQ ID NO: 399746 - DNA, 20 bp, Artificial Sequence
  chemically synthesized
atattgatacaggaaactta

SEQ ID NO: 399747 - DNA, 20 bp, Artificial Sequence
  chemically synthesized
ggagagatgaatattgatac

SEQ ID NO: 399748 - DNA, 20 bp, Artificial Sequence
  chemically synthesized
tggagagatgaatattgata

SEQ ID NO: 399749 - DNA, 20 bp, Artificial Sequence
  chemically synthesized
tttagtgcaattattttgga

SEQ ID NO: 399750 - DNA, 20 bp, Artificial Sequence
  chemically synthesized
tatttagtgcaattattttg

SEQ ID NO: 399751 - DNA, 20 bp, Artificial Sequence
  chemically synthesized
attatttagtgcaattattt

SEQ ID NO: 399752 - DNA, 20 bp, Artificial Sequence
  chemically synthesized
ttggtaacaattgaattatt

SEQ ID NO: 399753 - DNA, 20 bp, Artificial Sequence
  chemically synthesized
aaataattcaattgttacca

SEQ ID NO: 399754 - DNA, 20 bp, Artificial Sequence
  chemically synthesized
gagcagcctgcacaagactt

SEQ ID NO: 399755 - DNA, 20 bp, Artificial Sequence
  chemically synthesized
attgttaccaaagtcttgtg

SEQ ID NO: 399756 - DNA, 20 bp, Artificial Sequence
  chemically synthesized
ttgttaccaaagtcttgtgc

SEQ ID NO: 399757 - DNA, 20 bp, Artificial Sequence
  chemically synthesized
tgctgatgagcagcctgcac

SEQ ID NO: 399758 - DNA, 20 bp, Artificial Sequence
  chemically synthesized
gtcttgtgcaggctgctcat

SEQ ID NO: 399759 - DNA, 20 bp, Artificial Sequence
  chemically synthesized
tgtctctggatgctgatgag

SEQ ID NO: 399760 - DNA, 20 bp, Artificial Sequence
  chemically synthesized
ctatgtctctggatgctgat

SEQ ID NO: 399761 - DNA, 20 bp, Artificial Sequence
  chemically synthesized
gcaggctgctcatcagcatc

SEQ ID NO: 399762 - DNA, 20 bp, Artificial Sequence
  chemically synthesized
aggctgctcatcagcatcca

SEQ ID NO: 399763 - DNA, 20 bp, Artificial Sequence
  chemically synthesized
ctcatcagcatccagagaca

SEQ ID NO: 399764 - DNA, 20 bp, Artificial Sequence
  chemically synthesized
cgtacagtgaactatgtctc

SEQ ID NO: 399765 - DNA, 20 bp, Artificial Sequence
  chemically synthesized
tcattagagcagatgacgta

SEQ ID NO: 399766 - DNA, 20 bp, Artificial Sequence
  chemically synthesized
gaagaattaaatcattagag

SEQ ID NO: 399767 - DNA, 20 bp, Artificial Sequence
  chemically synthesized
taggaagaattaaatcatta

SEQ ID NO: 399768 - DNA, 20 bp, Artificial Sequence
  chemically synthesized
aataggaagaattaaatcat

SEQ ID NO: 399769 - DNA, 20 bp, Artificial Sequence
  chemically synthesized
tgtttttatctgataatagg

SEQ ID NO: 399770 - DNA, 20 bp, Artificial Sequence
  chemically synthesized
gatttaattcttcctattat

SEQ ID NO: 399771 - DNA, 20 bp, Artificial Sequence
  chemically synthesized
gtttgtttttatctgataat

SEQ ID NO: 399772 - DNA, 20 bp, Artificial Sequence
  chemically synthesized
tgtttgtttttatctgataa

SEQ ID NO: 399773 - DNA, 20 bp, Artificial Sequence
  chemically synthesized
tattatcagataaaaacaaa

SEQ ID NO: 399774 - DNA, 20 bp, Artificial Sequence
  chemically synthesized
attatcagataaaaacaaac

SEQ ID NO: 399775 - DNA, 20 bp, Artificial Sequence
  chemically synthesized
atcagataaaaacaaacagg

SEQ ID NO: 399776 - DNA, 20 bp, Artificial Sequence
  chemically synthesized
gataaaaacaaacaggaagc

SEQ ID NO: 399777 - DNA, 20 bp, Artificial Sequence
  chemically synthesized
ataaaaacaaacaggaagcc

SEQ ID NO: 399778 - DNA, 20 bp, Artificial Sequence
  chemically synthesized
taaaaacaaacaggaagcca

SEQ ID NO: 399779 - DNA, 20 bp, Artificial Sequence
  chemically synthesized
aaaaacaaacaggaagccag

SEQ ID NO: 399780 - DNA, 20 bp, Artificial Sequence
  chemically synthesized
caaacaggaagccaggggca

SEQ ID NO: 399781 - DNA, 20 bp, Artificial Sequence
  chemically synthesized
aaacaggaagccaggggcac

SEQ ID NO: 399782 - DNA, 20 bp, Artificial Sequence
  chemically synthesized
taaaatggctcctgtgcccc

SEQ ID NO: 399783 - DNA, 20 bp, Artificial Sequence
  chemically synthesized
acaggaagccaggggcacag

SEQ ID NO: 399784 - DNA, 20 bp, Artificial Sequence
  chemically synthesized
caggggcacaggagccattt

SEQ ID NO: 399785 - DNA, 20 bp, Artificial Sequence
  chemically synthesized
ggttttacatagatctaaaa

SEQ ID NO: 399786 - DNA, 20 bp, Artificial Sequence
  chemically synthesized
gtgccatggaaggttttaca

SEQ ID NO: 399787 - DNA, 20 bp, Artificial Sequence
  chemically synthesized
gatctatgtaaaaccttcca

SEQ ID NO: 399788 - DNA, 20 bp, Artificial Sequence
  chemically synthesized
cagagctattgtgccatgga

SEQ ID NO: 399789 - DNA, 20 bp, Artificial Sequence
  chemically synthesized
gcagagctattgtgccatgg

SEQ ID NO: 399790 - DNA, 20 bp, Artificial Sequence
  chemically synthesized
cgagcagagctattgtgcca

SEQ ID NO: 399791 - DNA, 20 bp, Artificial Sequence
  chemically synthesized
taaaaccttccatggcacaa

SEQ ID NO: 399792 - DNA, 20 bp, Artificial Sequence
  chemically synthesized
ttaacagaagtaatcgagca

SEQ ID NO: 399793 - DNA, 20 bp, Artificial Sequence
  chemically synthesized
ctttaacagaagtaatcgag

SEQ ID NO: 399794 - DNA, 20 bp, Artificial Sequence
  chemically synthesized
ctgctttaacagaagtaatc

SEQ ID NO: 399795 - DNA, 20 bp, Artificial Sequence
  chemically synthesized
ctgctcgattacttctgtta

SEQ ID NO: 399796 - DNA, 20 bp, Artificial Sequence
  chemically synthesized
caatgtgcctgctttaacag

SEQ ID NO: 399797 - DNA, 20 bp, Artificial Sequence
  chemically synthesized
ctcgattacttctgttaaag

SEQ ID NO: 399798 - DNA, 20 bp, Artificial Sequence
  chemically synthesized
tcgattacttctgttaaagc

SEQ ID NO: 399799 - DNA, 20 bp, Artificial Sequence
  chemically synthesized
gtgcaatgtgcctgctttaa

SEQ ID NO: 399800 - DNA, 20 bp, Artificial Sequence
  chemically synthesized
aaagcaggcacattgcacaa

SEQ ID NO: 399801 - DNA, 20 bp, Artificial Sequence
  chemically synthesized
atagttatatataaatgtgt

SEQ ID NO: 399802 - DNA, 20 bp, Artificial Sequence
  chemically synthesized
ataaatgtgttagctatata

SEQ ID NO: 399803 - DNA, 20 bp, Artificial Sequence
  chemically synthesized
gtgaattctaaatctgtata

SEQ ID NO: 399804 - DNA, 20 bp, Artificial Sequence
  chemically synthesized
gtgttagctatatacagatt

SEQ ID NO: 399805 - DNA, 20 bp, Artificial Sequence
  chemically synthesized
tttagaattcacttacacaa

SEQ ID NO: 399806 - DNA, 20 bp, Artificial Sequence
  chemically synthesized
tatgtacctttccattgtgt

SEQ ID NO: 399807 - DNA, 20 bp, Artificial Sequence
  chemically synthesized
gaattcacttacacaatgga

SEQ ID NO: 399808 - DNA, 20 bp, Artificial Sequence
  chemically synthesized
aattcacttacacaatggaa

SEQ ID NO: 399809 - DNA, 20 bp, Artificial Sequence
  chemically synthesized
aaacattatttcagtgaagg

SEQ ID NO: 399810 - DNA, 20 bp, Artificial Sequence
  chemically synthesized
aaaacattatttcagtgaag

SEQ ID NO: 399811 - DNA, 20 bp, Artificial Sequence
  chemically synthesized
gcaaaacattatttcagtga

SEQ ID NO: 399812 - DNA, 20 bp, Artificial Sequence
  chemically synthesized
ggcaaaacattatttcagtg

SEQ ID NO: 399813 - DNA, 20 bp, Artificial Sequence
  chemically synthesized
aaagtggcaaaacattattt

SEQ ID NO: 399814 - DNA, 20 bp, Artificial Sequence
  chemically synthesized
aggatgatactgggacaaag

SEQ ID NO: 399815 - DNA, 20 bp, Artificial Sequence
  chemically synthesized
aatgttttgccactttgtcc

SEQ ID NO: 399816 - DNA, 20 bp, Artificial Sequence
  chemically synthesized
aaaaggatgatactgggaca

SEQ ID NO: 399817 - DNA, 20 bp, Artificial Sequence
  chemically synthesized
ttttaaaaaaggatgatact

SEQ ID NO: 399818 - DNA, 20 bp, Artificial Sequence
  chemically synthesized
tttttaaaaaaggatgatac

SEQ ID NO: 399819 - DNA, 20 bp, Artificial Sequence
  chemically synthesized
agcttagaagtttttaaaaa

SEQ ID NO: 399820 - DNA, 20 bp, Artificial Sequence
  chemically synthesized
gagcttagaagtttttaaaa

SEQ ID NO: 399821 - DNA, 20 bp, Artificial Sequence
  chemically synthesized
atccttttttaaaaacttct

SEQ ID NO: 399822 - DNA, 20 bp, Artificial Sequence
  chemically synthesized
tatatttaaaatgagcttag

SEQ ID NO: 399823 - DNA, 20 bp, Artificial Sequence
  chemically synthesized
ttctatatttaaaatgagct

SEQ ID NO: 399824 - DNA, 20 bp, Artificial Sequence
  chemically synthesized
acatattctatatttaaaat

SEQ ID NO: 399825 - DNA, 20 bp, Artificial Sequence
  chemically synthesized
ttctaagctcattttaaata

SEQ ID NO: 399826 - DNA, 20 bp, Artificial Sequence
  chemically synthesized
taaatatagaatatgtttac

SEQ ID NO: 399827 - DNA, 20 bp, Artificial Sequence
  chemically synthesized
aaatatagaatatgtttact

SEQ ID NO: 399828 - DNA, 20 bp, Artificial Sequence
  chemically synthesized
cacatacatatacacacacc

SEQ ID NO: 399829 - DNA, 20 bp, Artificial Sequence
  chemically synthesized
tgtgtttgtgtgtacgtgtt

SEQ ID NO: 399830 - DNA, 20 bp, Artificial Sequence
  chemically synthesized
gtgtttgtgtgtacgtgttg

SEQ ID NO: 399831 - DNA, 20 bp, Artificial Sequence
  chemically synthesized
tacgtgttgaggacatgaat

SEQ ID NO: 399832 - DNA, 20 bp, Artificial Sequence
  chemically synthesized
tgaggacatgaattggcata

SEQ ID NO: 399833 - DNA, 20 bp, Artificial Sequence
  chemically synthesized
aggacatgaattggcataca

SEQ ID NO: 399834 - DNA, 20 bp, Artificial Sequence
  chemically synthesized
aattggcatacagagtgtaa

SEQ ID NO: 399835 - DNA, 20 bp, Artificial Sequence
  chemically synthesized
attggcatacagagtgtaat

SEQ ID NO: 399836 - DNA, 20 bp, Artificial Sequence
  chemically synthesized
gcatacagagtgtaatagga

SEQ ID NO: 399837 - DNA, 20 bp, Artificial Sequence
  chemically synthesized
ggcatcaaacagggaaaaca

SEQ ID NO: 399838 - DNA, 20 bp, Artificial Sequence
  chemically synthesized
ttggcatcaaacagggaaaa

SEQ ID NO: 399839 - DNA, 20 bp, Artificial Sequence
  chemically synthesized
taccttcttggcatcaaaca

SEQ ID NO: 399840 - DNA, 20 bp, Artificial Sequence
  chemically synthesized
ctaccttcttggcatcaaac

SEQ ID NO: 399841 - DNA, 20 bp, Artificial Sequence
  chemically synthesized
gctaccttcttggcatcaaa

SEQ ID NO: 399842 - DNA, 20 bp, Artificial Sequence
  chemically synthesized
tgttttccctgtttgatgcc

SEQ ID NO: 399843 - DNA, 20 bp, Artificial Sequence
  chemically synthesized
tttccctgtttgatgccaag

SEQ ID NO: 399844 - DNA, 20 bp, Artificial Sequence
  chemically synthesized
ttccctgtttgatgccaaga

SEQ ID NO: 399845 - DNA, 20 bp, Artificial Sequence
  chemically synthesized
cctgtttgatgccaagaagg

SEQ ID NO: 399846 - DNA, 20 bp, Artificial Sequence
  chemically synthesized
tatggttttggctaccttct

SEQ ID NO: 399847 - DNA, 20 bp, Artificial Sequence
  chemically synthesized
ttctttattgattatggttt

SEQ ID NO: 399848 - DNA, 20 bp, Artificial Sequence
  chemically synthesized
gttcatttctttattgatta

SEQ ID NO: 399849 - DNA, 20 bp, Artificial Sequence
  chemically synthesized
agccaaaaccataatcaata

SEQ ID NO: 399850 - DNA, 20 bp, Artificial Sequence
  chemically synthesized
taatcaataaagaaatgaac

SEQ ID NO: 399851 - DNA, 20 bp, Artificial Sequence
  chemically synthesized
taaagaaatgaacaagtatc

SEQ ID NO: 399852 - DNA, 20 bp, Artificial Sequence
  chemically synthesized
aagaaatgaacaagtatcca

SEQ ID NO: 399853 - DNA, 20 bp, Artificial Sequence
  chemically synthesized
agaaatgaacaagtatccag

SEQ ID NO: 399854 - DNA, 20 bp, Artificial Sequence
  chemically synthesized
tttgaagggtgattttcctc

SEQ ID NO: 399855 - DNA, 20 bp, Artificial Sequence
  chemically synthesized
tcagaactaaagtttttgaa

SEQ ID NO: 399856 - DNA, 20 bp, Artificial Sequence
  chemically synthesized
ttcagaactaaagtttttga

SEQ ID NO: 399857 - DNA, 20 bp, Artificial Sequence
  chemically synthesized
tttcagaactaaagtttttg

SEQ ID NO: 399858 - DNA, 20 bp, Artificial Sequence
  chemically synthesized
aaatcacccttcaaaaactt

SEQ ID NO: 399859 - DNA, 20 bp, Artificial Sequence
  chemically synthesized
aatctagattttcagaacta

SEQ ID NO: 399860 - DNA, 20 bp, Artificial Sequence
  chemically synthesized
aaactttagttctgaaaatc

SEQ ID NO: 399861 - DNA, 20 bp, Artificial Sequence
  chemically synthesized
ttaacatgaatctagatttt

SEQ ID NO: 399862 - DNA, 20 bp, Artificial Sequence
  chemically synthesized
atcaatccttaacatgaatc

SEQ ID NO: 399863 - DNA, 20 bp, Artificial Sequence
  chemically synthesized
tgaaaatctagattcatgtt

SEQ ID NO: 399864 - DNA, 20 bp, Artificial Sequence
  chemically synthesized
gaaaatctagattcatgtta

SEQ ID NO: 399865 - DNA, 20 bp, Artificial Sequence
  chemically synthesized
gatatattgtcccaactgaa

SEQ ID NO: 399866 - DNA, 20 bp, Artificial Sequence
  chemically synthesized
tcccaatagcctgttcagtt

SEQ ID NO: 399867 - DNA, 20 bp, Artificial Sequence
  chemically synthesized
atatattgtcccaactgaac

SEQ ID NO: 399868 - DNA, 20 bp, Artificial Sequence
  chemically synthesized
atcccaatagcctgttcagt

SEQ ID NO: 399869 - DNA, 20 bp, Artificial Sequence
  chemically synthesized
ccatatcccaatagcctgtt

SEQ ID NO: 399870 - DNA, 20 bp, Artificial Sequence
  chemically synthesized
gtcccaactgaacaggctat

SEQ ID NO: 399871 - DNA, 20 bp, Artificial Sequence
  chemically synthesized
tcccaactgaacaggctatt

SEQ ID NO: 399872 - DNA, 20 bp, Artificial Sequence
  chemically synthesized
tcttaactcccatatcccaa

SEQ ID NO: 399873 - DNA, 20 bp, Artificial Sequence
  chemically synthesized
ctgaacaggctattgggata

SEQ ID NO: 399874 - DNA, 20 bp, Artificial Sequence
  chemically synthesized
tgaacaggctattgggatat

SEQ ID NO: 399875 - DNA, 20 bp, Artificial Sequence
  chemically synthesized
aacaggctattgggatatgg

SEQ ID NO: 399876 - DNA, 20 bp, Artificial Sequence
  chemically synthesized
gctattgggatatgggagtt

SEQ ID NO: 399877 - DNA, 20 bp, Artificial Sequence
  chemically synthesized
gggatatgggagttaagatt

SEQ ID NO: 399878 - DNA, 20 bp, Artificial Sequence
  chemically synthesized
ggatatgggagttaagattc

SEQ ID NO: 399879 - DNA, 20 bp, Artificial Sequence
  chemically synthesized
gatatgggagttaagattcg

SEQ ID NO: 399880 - DNA, 20 bp, Artificial Sequence
  chemically synthesized
tgggagttaagattcgggga

SEQ ID NO: 399881 - DNA, 20 bp, Artificial Sequence
  chemically synthesized
gagttaagattcggggacag

SEQ ID NO: 399882 - DNA, 20 bp, Artificial Sequence
  chemically synthesized
ggacagtggaaatttgcaat

SEQ ID NO: 399883 - DNA, 20 bp, Artificial Sequence
  chemically synthesized
agtggaaatttgcaatcagt

SEQ ID NO: 399884 - DNA, 20 bp, Artificial Sequence
  chemically synthesized
atttgcaatcagtcagatta

SEQ ID NO: 399885 - DNA, 20 bp, Artificial Sequence
  chemically synthesized
ttgcaatcagtcagattaaa

SEQ ID NO: 399886 - DNA, 20 bp, Artificial Sequence
  chemically synthesized
gcaatcagtcagattaaaga

SEQ ID NO: 399887 - DNA, 20 bp, Artificial Sequence
  chemically synthesized
caatcagtcagattaaagag

SEQ ID NO: 399888 - DNA, 20 bp, Artificial Sequence
  chemically synthesized
agattaaagagaggtttaat

SEQ ID NO: 399889 - DNA, 20 bp, Artificial Sequence
  chemically synthesized
ccctttccctgtgtttgagg

SEQ ID NO: 399890 - DNA, 20 bp, Artificial Sequence
  chemically synthesized
ttaatgagcttcctcaaaca

SEQ ID NO: 399891 - DNA, 20 bp, Artificial Sequence
  chemically synthesized
taatgagcttcctcaaacac

SEQ ID NO: 399892 - DNA, 20 bp, Artificial Sequence
  chemically synthesized
catccctttccctgtgtttg

SEQ ID NO: 399893 - DNA, 20 bp, Artificial Sequence
  chemically synthesized
aatgagcttcctcaaacaca

SEQ ID NO: 399894 - DNA, 20 bp, Artificial Sequence
  chemically synthesized
tcatccctttccctgtgttt

SEQ ID NO: 399895 - DNA, 20 bp, Artificial Sequence
  chemically synthesized
agcttcctcaaacacaggga

SEQ ID NO: 399896 - DNA, 20 bp, Artificial Sequence
  chemically synthesized
gcttcctcaaacacagggaa

SEQ ID NO: 399897 - DNA, 20 bp, Artificial Sequence
  chemically synthesized
cttcctcaaacacagggaaa

SEQ ID NO: 399898 - DNA, 20 bp, Artificial Sequence
  chemically synthesized
caaacacagggaaagggatg

SEQ ID NO: 399899 - DNA, 20 bp, Artificial Sequence
  chemically synthesized
gggaaagggatgaagttgtg

SEQ ID NO: 399900 - DNA, 20 bp, Artificial Sequence
  chemically synthesized
ggaaagggatgaagttgtga

SEQ ID NO: 399901 - DNA, 20 bp, Artificial Sequence
  chemically synthesized
ctgtaaagggagtaggatgt

SEQ ID NO: 399902 - DNA, 20 bp, Artificial Sequence
  chemically synthesized
ggaaactctgtaaagggagt

SEQ ID NO: 399903 - DNA, 20 bp, Artificial Sequence
  chemically synthesized
tggaaactctgtaaagggag

SEQ ID NO: 399904 - DNA, 20 bp, Artificial Sequence
  chemically synthesized
ccaacatcctactcccttta

SEQ ID NO: 399905 - DNA, 20 bp, Artificial Sequence
  chemically synthesized
atttggaaactctgtaaagg

SEQ ID NO: 399906 - DNA, 20 bp, Artificial Sequence
  chemically synthesized
aacatcctactccctttaca

SEQ ID NO: 399907 - DNA, 20 bp, Artificial Sequence
  chemically synthesized
acatttggaaactctgtaaa

SEQ ID NO: 399908 - DNA, 20 bp, Artificial Sequence
  chemically synthesized
aacatttggaaactctgtaa

SEQ ID NO: 399909 - DNA, 20 bp, Artificial Sequence
  chemically synthesized
caacatttggaaactctgta

SEQ ID NO: 399910 - DNA, 20 bp, Artificial Sequence
  chemically synthesized
ggttgtctcagcacaacatt

SEQ ID NO: 399911 - DNA, 20 bp, Artificial Sequence
  chemically synthesized
gagtttccaaatgttgtgct

SEQ ID NO: 399912 - DNA, 20 bp, Artificial Sequence
  chemically synthesized
gccatttaagtaggttgtct

SEQ ID NO: 399913 - DNA, 20 bp, Artificial Sequence
  chemically synthesized
gctgagacaacctacttaaa

SEQ ID NO: 399914 - DNA, 20 bp, Artificial Sequence
  chemically synthesized
gcctctacagccatttaagt

SEQ ID NO: 399915 - DNA, 20 bp, Artificial Sequence
  chemically synthesized
ggcctctacagccatttaag

SEQ ID NO: 399916 - DNA, 20 bp, Artificial Sequence
  chemically synthesized
tctggcctctacagccattt

SEQ ID NO: 399917 - DNA, 20 bp, Artificial Sequence
  chemically synthesized
acaacctacttaaatggctg

SEQ ID NO: 399918 - DNA, 20 bp, Artificial Sequence
  chemically synthesized
aacctacttaaatggctgta

SEQ ID NO: 399919 - DNA, 20 bp, Artificial Sequence
  chemically synthesized
acctacttaaatggctgtag

SEQ ID NO: 399920 - DNA, 20 bp, Artificial Sequence
  chemically synthesized
acttaaatggctgtagaggc

SEQ ID NO: 399921 - DNA, 20 bp, Artificial Sequence
  chemically synthesized
tgcttggtatctggcctcta

SEQ ID NO: 399922 - DNA, 20 bp, Artificial Sequence
  chemically synthesized
ggctgtagaggccagatacc

SEQ ID NO: 399923 - DNA, 20 bp, Artificial Sequence
  chemically synthesized
gatgctctgtgcttggtatc

SEQ ID NO: 399924 - DNA, 20 bp, Artificial Sequence
  chemically synthesized
tagaggccagataccaagca

SEQ ID NO: 399925 - DNA, 20 bp, Artificial Sequence
  chemically synthesized
gaggccagataccaagcaca

SEQ ID NO: 399926 - DNA, 20 bp, Artificial Sequence
  chemically synthesized
tgctgatgatgctctgtgct

SEQ ID NO: 399927 - DNA, 20 bp, Artificial Sequence
  chemically synthesized
taccaagcacagagcatcat

SEQ ID NO: 399928 - DNA, 20 bp, Artificial Sequence
  chemically synthesized
ctgccttgcttgaacacgga

SEQ ID NO: 399929 - DNA, 20 bp, Artificial Sequence
  chemically synthesized
cctgccttgcttgaacacgg

SEQ ID NO: 399930 - DNA, 20 bp, Artificial Sequence
  chemically synthesized
cagcaaaaccttccgtgttc

SEQ ID NO: 399931 - DNA, 20 bp, Artificial Sequence
  chemically synthesized
tgccctgccttgcttgaaca

SEQ ID NO: 399932 - DNA, 20 bp, Artificial Sequence
  chemically synthesized
aaaaccttccgtgttcaagc

SEQ ID NO: 399933 - DNA, 20 bp, Artificial Sequence
  chemically synthesized
aaaccttccgtgttcaagca

SEQ ID NO: 399934 - DNA, 20 bp, Artificial Sequence
  chemically synthesized
ccttccgtgttcaagcaagg

SEQ ID NO: 399935 - DNA, 20 bp, Artificial Sequence
  chemically synthesized
cttccgtgttcaagcaaggc

SEQ ID NO: 399936 - DNA, 20 bp, Artificial Sequence
  chemically synthesized
ttccgtgttcaagcaaggca

SEQ ID NO: 399937 - DNA, 20 bp, Artificial Sequence
  chemically synthesized
tcaagcaaggcagggcattg

SEQ ID NO: 399938 - DNA, 20 bp, Artificial Sequence
  chemically synthesized
caaggcagggcattgtggac

SEQ ID NO: 399939 - DNA, 20 bp, Artificial Sequence
  chemically synthesized
aaacatgactacataaagga

SEQ ID NO: 399940 - DNA, 20 bp, Artificial Sequence
  chemically synthesized
tggacaagctgtcctttatg

SEQ ID NO: 399941 - DNA, 20 bp, Artificial Sequence
  chemically synthesized
aagtaaacatgactacataa

SEQ ID NO: 399942 - DNA, 20 bp, Artificial Sequence
  chemically synthesized
caagtaaacatgactacata

SEQ ID NO: 399943 - DNA, 20 bp, Artificial Sequence
  chemically synthesized
tttatgtagtcatgtttact

SEQ ID NO: 399944 - DNA, 20 bp, Artificial Sequence
  chemically synthesized
gtcatgtttacttggctatt

SEQ ID NO: 399945 - DNA, 20 bp, Artificial Sequence
  chemically synthesized
agctgatatgcttaatagcc

SEQ ID NO: 399946 - DNA, 20 bp, Artificial Sequence
  chemically synthesized
gtcatagctgatatgcttaa

SEQ ID NO: 399947 - DNA, 20 bp, Artificial Sequence
  chemically synthesized
tacttggctattaagcatat

SEQ ID NO: 399948 - DNA, 20 bp, Artificial Sequence
  chemically synthesized
ttttcagtgcattttggtca

SEQ ID NO: 399949 - DNA, 20 bp, Artificial Sequence
  chemically synthesized
tcctggttttcagtgcattt

SEQ ID NO: 399950 - DNA, 20 bp, Artificial Sequence
  chemically synthesized
gaccaaaatgcactgaaaac

SEQ ID NO: 399951 - DNA, 20 bp, Artificial Sequence
  chemically synthesized
accaaaatgcactgaaaacc

SEQ ID NO: 399952 - DNA, 20 bp, Artificial Sequence
  chemically synthesized
actgtaagtgtcctggtttt

SEQ ID NO: 399953 - DNA, 20 bp, Artificial Sequence
  chemically synthesized
ccagaatactgtaagtgtcc

SEQ ID NO: 399954 - DNA, 20 bp, Artificial Sequence
  chemically synthesized
actgaaaaccaggacactta

SEQ ID NO: 399955 - DNA, 20 bp, Artificial Sequence
  chemically synthesized
ggtagagtccagaatactgt

SEQ ID NO: 399956 - DNA, 20 bp, Artificial Sequence
  chemically synthesized
ccaggacacttacagtattc

SEQ ID NO: 399957 - DNA, 20 bp, Artificial Sequence
  chemically synthesized
ccaaagggccaggtagagtc

SEQ ID NO: 399958 - DNA, 20 bp, Artificial Sequence
  chemically synthesized
acagtattctggactctacc

SEQ ID NO: 399959 - DNA, 20 bp, Artificial Sequence
  chemically synthesized
ccattccaaagggccaggta

SEQ ID NO: 399960 - DNA, 20 bp, Artificial Sequence
  chemically synthesized
ttccattccaaagggccagg

SEQ ID NO: 399961 - DNA, 20 bp, Artificial Sequence
  chemically synthesized
ctggactctacctggccctt

SEQ ID NO: 399962 - DNA, 20 bp, Artificial Sequence
  chemically synthesized
cacttccattccaaagggcc

SEQ ID NO: 399963 - DNA, 20 bp, Artificial Sequence
  chemically synthesized
ccacttccattccaaagggc

SEQ ID NO: 399964 - DNA, 20 bp, Artificial Sequence
  chemically synthesized
ctctacctggccctttggaa

SEQ ID NO: 399965 - DNA, 20 bp, Artificial Sequence
  chemically synthesized
cttcccacttccattccaaa

SEQ ID NO: 399966 - DNA, 20 bp, Artificial Sequence
  chemically synthesized
tcttcccacttccattccaa

SEQ ID NO: 399967 - DNA, 20 bp, Artificial Sequence
  chemically synthesized
ttcttcccacttccattcca

SEQ ID NO: 399968 - DNA, 20 bp, Artificial Sequence
  chemically synthesized
tacctggccctttggaatgg

SEQ ID NO: 399969 - DNA, 20 bp, Artificial Sequence
  chemically synthesized
ctggccctttggaatggaag

SEQ ID NO: 399970 - DNA, 20 bp, Artificial Sequence
  chemically synthesized
tggccctttggaatggaagt

SEQ ID NO: 399971 - DNA, 20 bp, Artificial Sequence
  chemically synthesized
ccctttggaatggaagtggg

SEQ ID NO: 399972 - DNA, 20 bp, Artificial Sequence
  chemically synthesized
tttggaatggaagtgggaag

SEQ ID NO: 399973 - DNA, 20 bp, Artificial Sequence
  chemically synthesized
ggaatggaagtgggaagaag

SEQ ID NO: 399974 - DNA, 20 bp, Artificial Sequence
  chemically synthesized
atggaagtgggaagaagtag

SEQ ID NO: 399975 - DNA, 20 bp, Artificial Sequence
  chemically synthesized
tagaagaatgcaaaatgtta

SEQ ID NO: 399976 - DNA, 20 bp, Artificial Sequence
  chemically synthesized
gaagaatgcaaaatgttacg

SEQ ID NO: 399977 - DNA, 20 bp, Artificial Sequence
  chemically synthesized
acggagattgaatttctcac

SEQ ID NO: 399978 - DNA, 20 bp, Artificial Sequence
  chemically synthesized
agattgaatttctcaccagt

SEQ ID NO: 399979 - DNA, 20 bp, Artificial Sequence
  chemically synthesized
accccaacaatctgactggt

SEQ ID NO: 399980 - DNA, 20 bp, Artificial Sequence
  chemically synthesized
agtaaccccaacaatctgac

SEQ ID NO: 399981 - DNA, 20 bp, Artificial Sequence
  chemically synthesized
tttctcaccagtcagattgt

SEQ ID NO: 399982 - DNA, 20 bp, Artificial Sequence
  chemically synthesized
ttctcaccagtcagattgtt

SEQ ID NO: 399983 - DNA, 20 bp, Artificial Sequence
  chemically synthesized
tctcaccagtcagattgttg

SEQ ID NO: 399984 - DNA, 20 bp, Artificial Sequence
  chemically synthesized
agtcagattgttggggttac

SEQ ID NO: 399985 - DNA, 20 bp, Artificial Sequence
  chemically synthesized
gttggggttactagttgctg

SEQ ID NO: 399986 - DNA, 20 bp, Artificial Sequence
  chemically synthesized
gaatctgttcctgcagcaac

SEQ ID NO: 399987 - DNA, 20 bp, Artificial Sequence
  chemically synthesized
ttggggttactagttgctgc

SEQ ID NO: 399988 - DNA, 20 bp, Artificial Sequence
  chemically synthesized
gttactagttgctgcaggaa

SEQ ID NO: 399989 - DNA, 20 bp, Artificial Sequence
  chemically synthesized
attggttgaatctgttcctg

SEQ ID NO: 399990 - DNA, 20 bp, Artificial Sequence
  chemically synthesized
aggaacagattcaaccaatg

SEQ ID NO: 399991 - DNA, 20 bp, Artificial Sequence
  chemically synthesized
gaacagattcaaccaatgta

SEQ ID NO: 399992 - DNA, 20 bp, Artificial Sequence
  chemically synthesized
atttccttgtttctctacat

SEQ ID NO: 399993 - DNA, 20 bp, Artificial Sequence
  chemically synthesized
ttcaaccaatgtagagaaac

SEQ ID NO: 399994 - DNA, 20 bp, Artificial Sequence
  chemically synthesized
tcaaccaatgtagagaaaca

SEQ ID NO: 399995 - DNA, 20 bp, Artificial Sequence
  chemically synthesized
tgtagagaaacaaggaaata

SEQ ID NO: 399996 - DNA, 20 bp, Artificial Sequence
  chemically synthesized
tctataacctagtttgtaat

SEQ ID NO: 399997 - DNA, 20 bp, Artificial Sequence
  chemically synthesized
aaatatggcttattacaaac

SEQ ID NO: 399998 - DNA, 20 bp, Artificial Sequence
  chemically synthesized
aatatggcttattacaaact

SEQ ID NO: 399999 - DNA, 20 bp, Artificial Sequence
  chemically synthesized
gcttattacaaactaggtta

SEQ ID NO: 400000 - DNA, 20 bp, Artificial Sequence
  chemically synthesized
tgaattttgattctataacc

SEQ ID NO: 400001 - DNA, 20 bp, Artificial Sequence
  chemically synthesized
aaaattcatgtgcatttcaa

SEQ ID NO: 400002 - DNA, 20 bp, Artificial Sequence
  chemically synthesized
tcaatagcatcatgaaatta

SEQ ID NO: 400003 - DNA, 20 bp, Artificial Sequence
  chemically synthesized
aatagcatcatgaaattatg

SEQ ID NO: 400004 - DNA, 20 bp, Artificial Sequence
  chemically synthesized
gcatcatgaaattatggagt

SEQ ID NO: 400005 - DNA, 20 bp, Artificial Sequence
  chemically synthesized
catcatgaaattatggagtt

SEQ ID NO: 400006 - DNA, 20 bp, Artificial Sequence
  chemically synthesized
aattaaaatatcatgttctc

SEQ ID NO: 400007 - DNA, 20 bp, Artificial Sequence
  chemically synthesized
taaaatatcatgttctcaag

SEQ ID NO: 400008 - DNA, 20 bp, Artificial Sequence
  chemically synthesized
tgatgttacctggtcttctt

SEQ ID NO: 400009 - DNA, 20 bp, Artificial Sequence
  chemically synthesized
tatcatgttctcaagaagac

SEQ ID NO: 400010 - DNA, 20 bp, Artificial Sequence
  chemically synthesized
atcatgttctcaagaagacc

SEQ ID NO: 400011 - DNA, 20 bp, Artificial Sequence
  chemically synthesized
ttcttttccatgatgttacc

SEQ ID NO: 400012 - DNA, 20 bp, Artificial Sequence
  chemically synthesized
aagaagaccaggtaacatca

SEQ ID NO: 400013 - DNA, 20 bp, Artificial Sequence
  chemically synthesized
gaccaggtaacatcatggaa

SEQ ID NO: 400014 - DNA, 20 bp, Artificial Sequence
  chemically synthesized
ggtaacatcatggaaaagaa

SEQ ID NO: 400015 - DNA, 20 bp, Artificial Sequence
  chemically synthesized
aacatcatggaaaagaatag

SEQ ID NO: 400016 - DNA, 20 bp, Artificial Sequence
  chemically synthesized
ggaaaagaatagaagtaaat

SEQ ID NO: 400017 - DNA, 20 bp, Artificial Sequence
  chemically synthesized
aaagaatagaagtaaataag

SEQ ID NO: 400018 - DNA, 20 bp, Artificial Sequence
  chemically synthesized
aagaatagaagtaaataaga

SEQ ID NO: 400019 - DNA, 20 bp, Artificial Sequence
  chemically synthesized
gaatagaagtaaataagaag

SEQ ID NO: 400020 - DNA, 20 bp, Artificial Sequence
  chemically synthesized
atagaagtaaataagaagga

SEQ ID NO: 400021 - DNA, 20 bp, Artificial Sequence
  chemically synthesized
gtaaataagaaggagagatt

SEQ ID NO: 400022 - DNA, 20 bp, Artificial Sequence
  chemically synthesized
aataagaaggagagattcag

SEQ ID NO: 400023 - DNA, 20 bp, Artificial Sequence
  chemically synthesized
atgcatttttcaattcaatt

SEQ ID NO: 400024 - DNA, 20 bp, Artificial Sequence
  chemically synthesized
acattacataatgacaaaaa

SEQ ID NO: 400025 - DNA, 20 bp, Artificial Sequence
  chemically synthesized
cattacataatgacaaaaat

SEQ ID NO: 400026 - DNA, 20 bp, Artificial Sequence
  chemically synthesized
taataaaagggcattataaa

SEQ ID NO: 400027 - DNA, 20 bp, Artificial Sequence
  chemically synthesized
taacaaaacatataataaaa

SEQ ID NO: 400028 - DNA, 20 bp, Artificial Sequence
  chemically synthesized
gtaacaaaacatataataaa

SEQ ID NO: 400029 - DNA, 20 bp, Artificial Sequence
  chemically synthesized
tgtaacaaaacatataataa

SEQ ID NO: 400030 - DNA, 20 bp, Artificial Sequence
  chemically synthesized
tttattatatgttttgttac

SEQ ID NO: 400031 - DNA, 20 bp, Artificial Sequence
  chemically synthesized
attatatgttttgttacaag

SEQ ID NO: 400032 - DNA, 20 bp, Artificial Sequence
  chemically synthesized
ttatatgttttgttacaagt

SEQ ID NO: 400033 - DNA, 20 bp, Artificial Sequence
  chemically synthesized
atgttttgttacaagtaggc

SEQ ID NO: 400034 - DNA, 20 bp, Artificial Sequence
  chemically synthesized
acaagtaggcaagaacatat

SEQ ID NO: 400035 - DNA, 20 bp, Artificial Sequence
  chemically synthesized
caagaacatataagaaaaat

SEQ ID NO: 400036 - DNA, 20 bp, Artificial Sequence
  chemically synthesized
catataagaaaaataagact

SEQ ID NO: 400037 - DNA, 20 bp, Artificial Sequence
  chemically synthesized
tataagaaaaataagactca

SEQ ID NO: 400038 - DNA, 20 bp, Artificial Sequence
  chemically synthesized
atataaaattgaaattctct

SEQ ID NO: 400039 - DNA, 20 bp, Artificial Sequence
  chemically synthesized
tttaatttatttgaaaagaa

SEQ ID NO: 400040 - DNA, 20 bp, Artificial Sequence
  chemically synthesized
ctttaatttatttgaaaaga

SEQ ID NO: 400041 - DNA, 20 bp, Artificial Sequence
  chemically synthesized
catactttaatttatttgaa

SEQ ID NO: 400042 - DNA, 20 bp, Artificial Sequence
  chemically synthesized
ctttcttttcaaataaatta

SEQ ID NO: 400043 - DNA, 20 bp, Artificial Sequence
  chemically synthesized
ttttcaaataaattaaagta

SEQ ID NO: 400044 - DNA, 20 bp, Artificial Sequence
  chemically synthesized
tggatataacgttttctcct

SEQ ID NO: 400045 - DNA, 20 bp, Artificial Sequence
  chemically synthesized
ggatataacgttttctccta

SEQ ID NO: 400046 - DNA, 20 bp, Artificial Sequence
  chemically synthesized
tataacgttttctcctaagg

SEQ ID NO: 400047 - DNA, 20 bp, Artificial Sequence
  chemically synthesized
cacactactctctaccttag

SEQ ID NO: 400048 - DNA, 20 bp, Artificial Sequence
  chemically synthesized
taacgttttctcctaaggta

SEQ ID NO: 400049 - DNA, 20 bp, Artificial Sequence
  chemically synthesized
ttcacactactctctacctt

SEQ ID NO: 400050 - DNA, 20 bp, Artificial Sequence
  chemically synthesized
acgttttctcctaaggtaga

SEQ ID NO: 400051 - DNA, 20 bp, Artificial Sequence
  chemically synthesized
cttcacactactctctacct

SEQ ID NO: 400052 - DNA, 20 bp, Artificial Sequence
  chemically synthesized
ttttctcctaaggtagagag

SEQ ID NO: 400053 - DNA, 20 bp, Artificial Sequence
  chemically synthesized
ctaaggtagagagtagtgtg

SEQ ID NO: 400054 - DNA, 20 bp, Artificial Sequence
  chemically synthesized
aggtagagagtagtgtgaag

SEQ ID NO: 400055 - DNA, 20 bp, Artificial Sequence
  chemically synthesized
acgttattttttgataaagc

SEQ ID NO: 400056 - DNA, 20 bp, Artificial Sequence
  chemically synthesized
cacgttattttttgataaag

SEQ ID NO: 400057 - DNA, 20 bp, Artificial Sequence
  chemically synthesized
cagcacgttattttttgata

SEQ ID NO: 400058 - DNA, 20 bp, Artificial Sequence
  chemically synthesized
tttatcaaaaaataacgtgc

SEQ ID NO: 400059 - DNA, 20 bp, Artificial Sequence
  chemically synthesized
atcaaaaaataacgtgctgg

SEQ ID NO: 400060 - DNA, 20 bp, Artificial Sequence
  chemically synthesized
tcaaaaaataacgtgctggt

SEQ ID NO: 400061 - DNA, 20 bp, Artificial Sequence
  chemically synthesized
caaaaaataacgtgctggtg

SEQ ID NO: 400062 - DNA, 20 bp, Artificial Sequence
  chemically synthesized
cattttctccgcagccccac

SEQ ID NO: 400063 - DNA, 20 bp, Artificial Sequence
  chemically synthesized
ataacgtgctggtggggctg

SEQ ID NO: 400064 - DNA, 20 bp, Artificial Sequence
  chemically synthesized
aacgtgctggtggggctgcg

SEQ ID NO: 400065 - DNA, 20 bp, Artificial Sequence
  chemically synthesized
taagtgttccattttctccg

SEQ ID NO: 400066 - DNA, 20 bp, Artificial Sequence
  chemically synthesized
tggtggggctgcggagaaaa

SEQ ID NO: 400067 - DNA, 20 bp, Artificial Sequence
  chemically synthesized
ctctcccaccaacagtgtat

SEQ ID NO: 400068 - DNA, 20 bp, Artificial Sequence
  chemically synthesized
atggaacacttatacactgt

SEQ ID NO: 400069 - DNA, 20 bp, Artificial Sequence
  chemically synthesized
gaacacttatacactgttgg

SEQ ID NO: 400070 - DNA, 20 bp, Artificial Sequence
  chemically synthesized
aacacttatacactgttggt

SEQ ID NO: 400071 - DNA, 20 bp, Artificial Sequence
  chemically synthesized
cacttatacactgttggtgg

SEQ ID NO: 400072 - DNA, 20 bp, Artificial Sequence
  chemically synthesized
ctcatttactctcccaccaa

SEQ ID NO: 400073 - DNA, 20 bp, Artificial Sequence
  chemically synthesized
cttatacactgttggtggga

SEQ ID NO: 400074 - DNA, 20 bp, Artificial Sequence
  chemically synthesized
ctgttggtgggagagtaaat

SEQ ID NO: 400075 - DNA, 20 bp, Artificial Sequence
  chemically synthesized
gtaaatgagttaaaccattg

SEQ ID NO: 400076 - DNA, 20 bp, Artificial Sequence
  chemically synthesized
aatgagttaaaccattgtgg

SEQ ID NO: 400077 - DNA, 20 bp, Artificial Sequence
  chemically synthesized
cactacactgacttccacaa

SEQ ID NO: 400078 - DNA, 20 bp, Artificial Sequence
  chemically synthesized
agttaaaccattgtggaagt

SEQ ID NO: 400079 - DNA, 20 bp, Artificial Sequence
  chemically synthesized
aaccattgtggaagtcagtg

SEQ ID NO: 400080 - DNA, 20 bp, Artificial Sequence
  chemically synthesized
gtcagtgtagtgattcctca

SEQ ID NO: 400081 - DNA, 20 bp, Artificial Sequence
  chemically synthesized
cagtgtagtgattcctcaaa

SEQ ID NO: 400082 - DNA, 20 bp, Artificial Sequence
  chemically synthesized
gttctgtttttagctctttg

SEQ ID NO: 400083 - DNA, 20 bp, Artificial Sequence
  chemically synthesized
agttctgtttttagctcttt

SEQ ID NO: 400084 - DNA, 20 bp, Artificial Sequence
  chemically synthesized
attcctcaaagagctaaaaa

SEQ ID NO: 400085 - DNA, 20 bp, Artificial Sequence
  chemically synthesized
ttgaatggtagttctgtttt

SEQ ID NO: 400086 - DNA, 20 bp, Artificial Sequence
  chemically synthesized
gggattgctaggttgaatgg

SEQ ID NO: 400087 - DNA, 20 bp, Artificial Sequence
  chemically synthesized
aacagaactaccattcaacc

SEQ ID NO: 400088 - DNA, 20 bp, Artificial Sequence
  chemically synthesized
aatgggattgctaggttgaa

SEQ ID NO: 400089 - DNA, 20 bp, Artificial Sequence
  chemically synthesized
tgcccagtaatgggattgct

SEQ ID NO: 400090 - DNA, 20 bp, Artificial Sequence
  chemically synthesized
atgcccagtaatgggattgc

SEQ ID NO: 400091 - DNA, 20 bp, Artificial Sequence
  chemically synthesized
caacctagcaatcccattac

SEQ ID NO: 400092 - DNA, 20 bp, Artificial Sequence
  chemically synthesized
aacctagcaatcccattact

SEQ ID NO: 400093 - DNA, 20 bp, Artificial Sequence
  chemically synthesized
ctgggtacatgcccagtaat

SEQ ID NO: 400094 - DNA, 20 bp, Artificial Sequence
  chemically synthesized
tctgggtacatgcccagtaa

SEQ ID NO: 400095 - DNA, 20 bp, Artificial Sequence
  chemically synthesized
tatttctctgggtacatgcc

SEQ ID NO: 400096 - DNA, 20 bp, Artificial Sequence
  chemically synthesized
cccattactgggcatgtacc

SEQ ID NO: 400097 - DNA, 20 bp, Artificial Sequence
  chemically synthesized
cattactgggcatgtaccca

SEQ ID NO: 400098 - DNA, 20 bp, Artificial Sequence
  chemically synthesized
agaatgatttatatttctct

SEQ ID NO: 400099 - DNA, 20 bp, Artificial Sequence
  chemically synthesized
tagaatgatttatatttctc

SEQ ID NO: 400100 - DNA, 20 bp, Artificial Sequence
  chemically synthesized
aatataaatcattctattat

SEQ ID NO: 400101 - DNA, 20 bp, Artificial Sequence
  chemically synthesized
tatgtatgcgtgtcttataa

SEQ ID NO: 400102 - DNA, 20 bp, Artificial Sequence
  chemically synthesized
acgcatacatatgttcattg

SEQ ID NO: 400103 - DNA, 20 bp, Artificial Sequence
  chemically synthesized
cattgcagcactatttacaa

SEQ ID NO: 400104 - DNA, 20 bp, Artificial Sequence
  chemically synthesized
cacgtctttgctattgtaaa

SEQ ID NO: 400105 - DNA, 20 bp, Artificial Sequence
  chemically synthesized
cagcactatttacaatagca

SEQ ID NO: 400106 - DNA, 20 bp, Artificial Sequence
  chemically synthesized
tatttacaatagcaaagacg

SEQ ID NO: 400107 - DNA, 20 bp, Artificial Sequence
  chemically synthesized
tctatcattgacgggcattt

SEQ ID NO: 400108 - DNA, 20 bp, Artificial Sequence
  chemically synthesized
tggtccagtctatcattgac

SEQ ID NO: 400109 - DNA, 20 bp, Artificial Sequence
  chemically synthesized
actcaaatgcccgtcaatga

SEQ ID NO: 400110 - DNA, 20 bp, Artificial Sequence
  chemically synthesized
ttggtccagtctatcattga

SEQ ID NO: 400111 - DNA, 20 bp, Artificial Sequence
  chemically synthesized
aatgcccgtcaatgatagac

SEQ ID NO: 400112 - DNA, 20 bp, Artificial Sequence
  chemically synthesized
cgtcaatgatagactggacc

SEQ ID NO: 400113 - DNA, 20 bp, Artificial Sequence
  chemically synthesized
tgtaccacattttcttggtc

SEQ ID NO: 400114 - DNA, 20 bp, Artificial Sequence
  chemically synthesized
gtatatgtaccacattttct

SEQ ID NO: 400115 - DNA, 20 bp, Artificial Sequence
  chemically synthesized
tagactggaccaagaaaatg

SEQ ID NO: 400116 - DNA, 20 bp, Artificial Sequence
  chemically synthesized
aatgtggtacatatacacca

SEQ ID NO: 400117 - DNA, 20 bp, Artificial Sequence
  chemically synthesized
tatggctacatagtattcca

SEQ ID NO: 400118 - DNA, 20 bp, Artificial Sequence
  chemically synthesized
atacaccatggaatactatg

SEQ ID NO: 400119 - DNA, 20 bp, Artificial Sequence
  chemically synthesized
cattctttcttatggctaca

SEQ ID NO: 400120 - DNA, 20 bp, Artificial Sequence
  chemically synthesized
atggaatactatgtagccat

SEQ ID NO: 400121 - DNA, 20 bp, Artificial Sequence
  chemically synthesized
aatactatgtagccataaga

SEQ ID NO: 400122 - DNA, 20 bp, Artificial Sequence
  chemically synthesized
catgatctcattctttctta

SEQ ID NO: 400123 - DNA, 20 bp, Artificial Sequence
  chemically synthesized
atgtagccataagaaagaat

SEQ ID NO: 400124 - DNA, 20 bp, Artificial Sequence
  chemically synthesized
gaatgagatcatgtcctttg

SEQ ID NO: 400125 - DNA, 20 bp, Artificial Sequence
  chemically synthesized
aatgagatcatgtcctttgc

SEQ ID NO: 400126 - DNA, 20 bp, Artificial Sequence
  chemically synthesized
atgagatcatgtcctttgca

SEQ ID NO: 400127 - DNA, 20 bp, Artificial Sequence
  chemically synthesized
ctccatccatgtccctgcaa

SEQ ID NO: 400128 - DNA, 20 bp, Artificial Sequence
  chemically synthesized
actccatccatgtccctgca

SEQ ID NO: 400129 - DNA, 20 bp, Artificial Sequence
  chemically synthesized
tcatgtcctttgcagggaca

SEQ ID NO: 400130 - DNA, 20 bp, Artificial Sequence
  chemically synthesized
gtcctttgcagggacatgga

SEQ ID NO: 400131 - DNA, 20 bp, Artificial Sequence
  chemically synthesized
cctttgcagggacatggatg

SEQ ID NO: 400132 - DNA, 20 bp, Artificial Sequence
  chemically synthesized
tgcagggacatggatggagt

SEQ ID NO: 400133 - DNA, 20 bp, Artificial Sequence
  chemically synthesized
cagggacatggatggagttg

SEQ ID NO: 400134 - DNA, 20 bp, Artificial Sequence
  chemically synthesized
agggacatggatggagttgg

SEQ ID NO: 400135 - DNA, 20 bp, Artificial Sequence
  chemically synthesized
gagttggaggccattatcct

SEQ ID NO: 400136 - DNA, 20 bp, Artificial Sequence
  chemically synthesized
catcattttgctaaggataa

SEQ ID NO: 400137 - DNA, 20 bp, Artificial Sequence
  chemically synthesized
gttcctgcatcattttgcta

SEQ ID NO: 400138 - DNA, 20 bp, Artificial Sequence
  chemically synthesized
tgttcctgcatcattttgct

SEQ ID NO: 400139 - DNA, 20 bp, Artificial Sequence
  chemically synthesized
ttatccttagcaaaatgatg

SEQ ID NO: 400140 - DNA, 20 bp, Artificial Sequence
  chemically synthesized
tatccttagcaaaatgatgc

SEQ ID NO: 400141 - DNA, 20 bp, Artificial Sequence
  chemically synthesized
ttagcaaaatgatgcaggaa

SEQ ID NO: 400142 - DNA, 20 bp, Artificial Sequence
  chemically synthesized
tgatgcaggaacagaaaacc

SEQ ID NO: 400143 - DNA, 20 bp, Artificial Sequence
  chemically synthesized
aagtgagaacatgcagtact

SEQ ID NO: 400144 - DNA, 20 bp, Artificial Sequence
  chemically synthesized
cacctataagtgagaacatg

SEQ ID NO: 400145 - DNA, 20 bp, Artificial Sequence
  chemically synthesized
gtactgcatgttctcactta

SEQ ID NO: 400146 - DNA, 20 bp, Artificial Sequence
  chemically synthesized
tactgcatgttctcacttat

SEQ ID NO: 400147 - DNA, 20 bp, Artificial Sequence
  chemically synthesized
tttagctcccacctataagt

SEQ ID NO: 400148 - DNA, 20 bp, Artificial Sequence
  chemically synthesized
tgcatgttctcacttatagg

SEQ ID NO: 400149 - DNA, 20 bp, Artificial Sequence
  chemically synthesized
gcatgttctcacttataggt

SEQ ID NO: 400150 - DNA, 20 bp, Artificial Sequence
  chemically synthesized
atcatttagctcccacctat

SEQ ID NO: 400151 - DNA, 20 bp, Artificial Sequence
  chemically synthesized
atgttctcacttataggtgg

SEQ ID NO: 400152 - DNA, 20 bp, Artificial Sequence
  chemically synthesized
ataggtgggagctaaatgat

SEQ ID NO: 400153 - DNA, 20 bp, Artificial Sequence
  chemically synthesized
gtccgtgtgttctcatcatt

SEQ ID NO: 400154 - DNA, 20 bp, Artificial Sequence
  chemically synthesized
agctaaatgatgagaacaca

SEQ ID NO: 400155 - DNA, 20 bp, Artificial Sequence
  chemically synthesized
gatgagaacacacggacaca

SEQ ID NO: 400156 - DNA, 20 bp, Artificial Sequence
  chemically synthesized
tgagaacacacggacacata

SEQ ID NO: 400157 - DNA, 20 bp, Artificial Sequence
  chemically synthesized
gagaacacacggacacatag

SEQ ID NO: 400158 - DNA, 20 bp, Artificial Sequence
  chemically synthesized
agaacacacggacacataga

SEQ ID NO: 400159 - DNA, 20 bp, Artificial Sequence
  chemically synthesized
gaacacacggacacatagag

SEQ ID NO: 400160 - DNA, 20 bp, Artificial Sequence
  chemically synthesized
tagaggggaacaacacacac

SEQ ID NO: 400161 - DNA, 20 bp, Artificial Sequence
  chemically synthesized
gaggggaacaacacacactg

SEQ ID NO: 400162 - DNA, 20 bp, Artificial Sequence
  chemically synthesized
ctccaccttccgataagctc

SEQ ID NO: 400163 - DNA, 20 bp, Artificial Sequence
  chemically synthesized
caacacacactggagcttat

SEQ ID NO: 400164 - DNA, 20 bp, Artificial Sequence
  chemically synthesized
cacacactggagcttatcgg

SEQ ID NO: 400165 - DNA, 20 bp, Artificial Sequence
  chemically synthesized
acacactggagcttatcgga

SEQ ID NO: 400166 - DNA, 20 bp, Artificial Sequence
  chemically synthesized
cccaccctccaccttccgat

SEQ ID NO: 400167 - DNA, 20 bp, Artificial Sequence
  chemically synthesized
cactggagcttatcggaagg

SEQ ID NO: 400168 - DNA, 20 bp, Artificial Sequence
  chemically synthesized
ctggagcttatcggaaggtg

SEQ ID NO: 400169 - DNA, 20 bp, Artificial Sequence
  chemically synthesized
tggagcttatcggaaggtgg

SEQ ID NO: 400170 - DNA, 20 bp, Artificial Sequence
  chemically synthesized
ggagcttatcggaaggtgga

SEQ ID NO: 400171 - DNA, 20 bp, Artificial Sequence
  chemically synthesized
gcttatcggaaggtggaggg

SEQ ID NO: 400172 - DNA, 20 bp, Artificial Sequence
  chemically synthesized
cttatcggaaggtggagggt

SEQ ID NO: 400173 - DNA, 20 bp, Artificial Sequence
  chemically synthesized
tatcggaaggtggagggtgg

SEQ ID NO: 400174 - DNA, 20 bp, Artificial Sequence
  chemically synthesized
atcggaaggtggagggtggg

SEQ ID NO: 400175 - DNA, 20 bp, Artificial Sequence
  chemically synthesized
cggaaggtggagggtgggag

SEQ ID NO: 400176 - DNA, 20 bp, Artificial Sequence
  chemically synthesized
ggaaggtggagggtgggagg

SEQ ID NO: 400177 - DNA, 20 bp, Artificial Sequence
  chemically synthesized
gaaggtggagggtgggagga

SEQ ID NO: 400178 - DNA, 20 bp, Artificial Sequence
  chemically synthesized
aggtggagggtgggaggagg

SEQ ID NO: 400179 - DNA, 20 bp, Artificial Sequence
  chemically synthesized
gtggagggtgggaggaggga

SEQ ID NO: 400180 - DNA, 20 bp, Artificial Sequence
  chemically synthesized
tggagggtgggaggagggag

SEQ ID NO: 400181 - DNA, 20 bp, Artificial Sequence
  chemically synthesized
ggtgggaggagggagaggat

SEQ ID NO: 400182 - DNA, 20 bp, Artificial Sequence
  chemically synthesized
gtgggaggagggagaggatc

SEQ ID NO: 400183 - DNA, 20 bp, Artificial Sequence
  chemically synthesized
ggatcaggaaaaataattaa

SEQ ID NO: 400184 - DNA, 20 bp, Artificial Sequence
  chemically synthesized
gatcaggaaaaataattaat

SEQ ID NO: 400185 - DNA, 20 bp, Artificial Sequence
  chemically synthesized
gaaaaataattaatgggtac

SEQ ID NO: 400186 - DNA, 20 bp, Artificial Sequence
  chemically synthesized
aaaaataattaatgggtact

SEQ ID NO: 400187 - DNA, 20 bp, Artificial Sequence
  chemically synthesized
catcacccagatattaggcc

SEQ ID NO: 400188 - DNA, 20 bp, Artificial Sequence
  chemically synthesized
tgggtactaggcctaatatc

SEQ ID NO: 400189 - DNA, 20 bp, Artificial Sequence
  chemically synthesized
gggtactaggcctaatatct

SEQ ID NO: 400190 - DNA, 20 bp, Artificial Sequence
  chemically synthesized
tatttcatcacccagatatt

SEQ ID NO: 400191 - DNA, 20 bp, Artificial Sequence
  chemically synthesized
ttatttcatcacccagatat

SEQ ID NO: 400192 - DNA, 20 bp, Artificial Sequence
  chemically synthesized
gtacagattatttcatcacc

SEQ ID NO: 400193 - DNA, 20 bp, Artificial Sequence
  chemically synthesized
tgtcacgggggttggttgta

SEQ ID NO: 400194 - DNA, 20 bp, Artificial Sequence
  chemically synthesized
taaacttgtgtcacgggggt

SEQ ID NO: 400195 - DNA, 20 bp, Artificial Sequence
  chemically synthesized
taggtaaacttgtgtcacgg

SEQ ID NO: 400196 - DNA, 20 bp, Artificial Sequence
  chemically synthesized
ataggtaaacttgtgtcacg

SEQ ID NO: 400197 - DNA, 20 bp, Artificial Sequence
  chemically synthesized
acaaccaacccccgtgacac

SEQ ID NO: 400198 - DNA, 20 bp, Artificial Sequence
  chemically synthesized
tataggtaaacttgtgtcac

SEQ ID NO: 400199 - DNA, 20 bp, Artificial Sequence
  chemically synthesized
atataggtaaacttgtgtca

SEQ ID NO: 400200 - DNA, 20 bp, Artificial Sequence
  chemically synthesized
catgtgcaggtttgttatat

SEQ ID NO: 400201 - DNA, 20 bp, Artificial Sequence
  chemically synthesized
acatgtgcaggtttgttata

SEQ ID NO: 400202 - DNA, 20 bp, Artificial Sequence
  chemically synthesized
aagttcaggggtacatgtgc

SEQ ID NO: 400203 - DNA, 20 bp, Artificial Sequence
  chemically synthesized
taagttcaggggtacatgtg

SEQ ID NO: 400204 - DNA, 20 bp, Artificial Sequence
  chemically synthesized
aacttttattttaagttcag

SEQ ID NO: 400205 - DNA, 20 bp, Artificial Sequence
  chemically synthesized
taacttttattttaagttca

SEQ ID NO: 400206 - DNA, 20 bp, Artificial Sequence
  chemically synthesized
ttaacttttattttaagttc

SEQ ID NO: 400207 - DNA, 20 bp, Artificial Sequence
  chemically synthesized
tttaacttttattttaagtt

SEQ ID NO: 400208 - DNA, 20 bp, Artificial Sequence
  chemically synthesized
tacccctgaacttaaaataa

SEQ ID NO: 400209 - DNA, 20 bp, Artificial Sequence
  chemically synthesized
ctttttttaacttttatttt

SEQ ID NO: 400210 - DNA, 20 bp, Artificial Sequence
  chemically synthesized
cttaaaataaaagttaaaaa

SEQ ID NO: 400211 - DNA, 20 bp, Artificial Sequence
  chemically synthesized
aaataaaagttaaaaaaaga

SEQ ID NO: 400212 - DNA, 20 bp, Artificial Sequence
  chemically synthesized
aataaaagttaaaaaaagaa

SEQ ID NO: 400213 - DNA, 20 bp, Artificial Sequence
  chemically synthesized
aaacttttgagtcagtaagg

SEQ ID NO: 400214 - DNA, 20 bp, Artificial Sequence
  chemically synthesized
actaaacttttgagtcagta

SEQ ID NO: 400215 - DNA, 20 bp, Artificial Sequence
  chemically synthesized
cactaaacttttgagtcagt

SEQ ID NO: 400216 - DNA, 20 bp, Artificial Sequence
  chemically synthesized
aggctaccttactgactcaa

SEQ ID NO: 400217 - DNA, 20 bp, Artificial Sequence
  chemically synthesized
ttaacactaaacttttgagt

SEQ ID NO: 400218 - DNA, 20 bp, Artificial Sequence
  chemically synthesized
accttactgactcaaaagtt

SEQ ID NO: 400219 - DNA, 20 bp, Artificial Sequence
  chemically synthesized
taaattaacactaaactttt

SEQ ID NO: 400220 - DNA, 20 bp, Artificial Sequence
  chemically synthesized
agcatgataagcatgatgta

SEQ ID NO: 400221 - DNA, 20 bp, Artificial Sequence
  chemically synthesized
cagcatgataagcatgatgt

SEQ ID NO: 400222 - DNA, 20 bp, Artificial Sequence
  chemically synthesized
ccagcatgataagcatgatg

SEQ ID NO: 400223 - DNA, 20 bp, Artificial Sequence
  chemically synthesized
ctacatcatgcttatcatgc

SEQ ID NO: 400224 - DNA, 20 bp, Artificial Sequence
  chemically synthesized
taccttttagccagcatgat

SEQ ID NO: 400225 - DNA, 20 bp, Artificial Sequence
  chemically synthesized
atgcttatcatgctggctaa

SEQ ID NO: 400226 - DNA, 20 bp, Artificial Sequence
  chemically synthesized
tgcttatcatgctggctaaa

SEQ ID NO: 400227 - DNA, 20 bp, Artificial Sequence
  chemically synthesized
tttttaatttaccttttagc

SEQ ID NO: 400228 - DNA, 20 bp, Artificial Sequence
  chemically synthesized
tttctttttaatttaccttt

SEQ ID NO: 400229 - DNA, 20 bp, Artificial Sequence
  chemically synthesized
tggctaaaaggtaaattaaa

SEQ ID NO: 400230 - DNA, 20 bp, Artificial Sequence
  chemically synthesized
aaattaaaaagaaatcttgc

SEQ ID NO: 400231 - DNA, 20 bp, Artificial Sequence
  chemically synthesized
ttaaaaagaaatcttgcaag

SEQ ID NO: 400232 - DNA, 20 bp, Artificial Sequence
  chemically synthesized
tgatatgacatacttcttgc

SEQ ID NO: 400233 - DNA, 20 bp, Artificial Sequence
  chemically synthesized
ttatcacatgatattgccca

SEQ ID NO: 400234 - DNA, 20 bp, Artificial Sequence
  chemically synthesized
atcacatgatattgcccaaa

SEQ ID NO: 400235 - DNA, 20 bp, Artificial Sequence
  chemically synthesized
tcacatgatattgcccaaag

SEQ ID NO: 400236 - DNA, 20 bp, Artificial Sequence
  chemically synthesized
cacatgatattgcccaaaga

SEQ ID NO: 400237 - DNA, 20 bp, Artificial Sequence
  chemically synthesized
atccaggactcaccctcttt

SEQ ID NO: 400238 - DNA, 20 bp, Artificial Sequence
  chemically synthesized
aatccaggactcaccctctt

SEQ ID NO: 400239 - DNA, 20 bp, Artificial Sequence
  chemically synthesized
tgatattgcccaaagagggt

SEQ ID NO: 400240 - DNA, 20 bp, Artificial Sequence
  chemically synthesized
tgcccaaagagggtgagtcc

SEQ ID NO: 400241 - DNA, 20 bp, Artificial Sequence
  chemically synthesized
tatgtccacattaaaaatcc

SEQ ID NO: 400242 - DNA, 20 bp, Artificial Sequence
  chemically synthesized
atatgtccacattaaaaatc

SEQ ID NO: 400243 - DNA, 20 bp, Artificial Sequence
  chemically synthesized
tgagtcctggatttttaatg

SEQ ID NO: 400244 - DNA, 20 bp, Artificial Sequence
  chemically synthesized
taatgtggacatatatgttg

SEQ ID NO: 400245 - DNA, 20 bp, Artificial Sequence
  chemically synthesized
acatatatgttgcggcaatg

SEQ ID NO: 400246 - DNA, 20 bp, Artificial Sequence
  chemically synthesized
atatatgttgcggcaatgaa

SEQ ID NO: 400247 - DNA, 20 bp, Artificial Sequence
  chemically synthesized
tatatgttgcggcaatgaag

SEQ ID NO: 400248 - DNA, 20 bp, Artificial Sequence
  chemically synthesized
aagaggtaaatgaactattg

SEQ ID NO: 400249 - DNA, 20 bp, Artificial Sequence
  chemically synthesized
aggtaaatgaactattgtgg

SEQ ID NO: 400250 - DNA, 20 bp, Artificial Sequence
  chemically synthesized
ggtaaatgaactattgtggc

SEQ ID NO: 400251 - DNA, 20 bp, Artificial Sequence
  chemically synthesized
tgagacctggcctgccacaa

SEQ ID NO: 400252 - DNA, 20 bp, Artificial Sequence
  chemically synthesized
aatgaactattgtggcaggc

SEQ ID NO: 400253 - DNA, 20 bp, Artificial Sequence
  chemically synthesized
atgaactattgtggcaggcc

SEQ ID NO: 400254 - DNA, 20 bp, Artificial Sequence
  chemically synthesized
aggcctgcattagtgagacc

SEQ ID NO: 400255 - DNA, 20 bp, Artificial Sequence
  chemically synthesized
caggccaggtctcactaatg

SEQ ID NO: 400256 - DNA, 20 bp, Artificial Sequence
  chemically synthesized
ttgtggaggcctgcattagt

SEQ ID NO: 400257 - DNA, 20 bp, Artificial Sequence
  chemically synthesized
aggccaggtctcactaatgc

SEQ ID NO: 400258 - DNA, 20 bp, Artificial Sequence
  chemically synthesized
gttgttgtggaggcctgcat

SEQ ID NO: 400259 - DNA, 20 bp, Artificial Sequence
  chemically synthesized
tgctgaaacagttgttgtgg

SEQ ID NO: 400260 - DNA, 20 bp, Artificial Sequence
  chemically synthesized
gtgctgaaacagttgttgtg

SEQ ID NO: 400261 - DNA, 20 bp, Artificial Sequence
  chemically synthesized
cagtgctgaaacagttgttg

SEQ ID NO: 400262 - DNA, 20 bp, Artificial Sequence
  chemically synthesized
ggcctccacaacaactgttt

SEQ ID NO: 400263 - DNA, 20 bp, Artificial Sequence
  chemically synthesized
ccactcagtcagtgctgaaa

SEQ ID NO: 400264 - DNA, 20 bp, Artificial Sequence
  chemically synthesized
caactgtttcagcactgact

SEQ ID NO: 400265 - DNA, 20 bp, Artificial Sequence
  chemically synthesized
ctgtttcagcactgactgag

SEQ ID NO: 400266 - DNA, 20 bp, Artificial Sequence
  chemically synthesized
atgtaactttaccactcagt

SEQ ID NO: 400267 - DNA, 20 bp, Artificial Sequence
  chemically synthesized
tcagcactgactgagtggta

SEQ ID NO: 400268 - DNA, 20 bp, Artificial Sequence
  chemically synthesized
taatatgtaactttaccact

SEQ ID NO: 400269 - DNA, 20 bp, Artificial Sequence
  chemically synthesized
gtggtaaagttacatattaa

SEQ ID NO: 400270 - DNA, 20 bp, Artificial Sequence
  chemically synthesized
agttacatattaaaagctga

SEQ ID NO: 400271 - DNA, 20 bp, Artificial Sequence
  chemically synthesized
ttacatattaaaagctgata

SEQ ID NO: 400272 - DNA, 20 bp, Artificial Sequence
  chemically synthesized
atattaaaagctgatagagc

SEQ ID NO: 400273 - DNA, 20 bp, Artificial Sequence
  chemically synthesized
tttaagggcgctggctctat

SEQ ID NO: 400274 - DNA, 20 bp, Artificial Sequence
  chemically synthesized
cagcctttgtttaagggcgc

SEQ ID NO: 400275 - DNA, 20 bp, Artificial Sequence
  chemically synthesized
agagccagcgcccttaaaca

SEQ ID NO: 400276 - DNA, 20 bp, Artificial Sequence
  chemically synthesized
accgtccagcctttgtttaa

SEQ ID NO: 400277 - DNA, 20 bp, Artificial Sequence
  chemically synthesized
gagccagcgcccttaaacaa

SEQ ID NO: 400278 - DNA, 20 bp, Artificial Sequence
  chemically synthesized
taccgtccagcctttgttta

SEQ ID NO: 400279 - DNA, 20 bp, Artificial Sequence
  chemically synthesized
ttaccgtccagcctttgttt

SEQ ID NO: 400280 - DNA, 20 bp, Artificial Sequence
  chemically synthesized
cagcgcccttaaacaaaggc

SEQ ID NO: 400281 - DNA, 20 bp, Artificial Sequence
  chemically synthesized
gcccttaaacaaaggctgga

SEQ ID NO: 400282 - DNA, 20 bp, Artificial Sequence
  chemically synthesized
ggtgggcttttgttaccgtc

SEQ ID NO: 400283 - DNA, 20 bp, Artificial Sequence
  chemically synthesized
caaaggctggacggtaacaa

SEQ ID NO: 400284 - DNA, 20 bp, Artificial Sequence
  chemically synthesized
gacggtaacaaaagcccacc

SEQ ID NO: 400285 - DNA, 20 bp, Artificial Sequence
  chemically synthesized
cggtaacaaaagcccaccaa

SEQ ID NO: 400286 - DNA, 20 bp, Artificial Sequence
  chemically synthesized
gcctgggcaaaactcttggt

SEQ ID NO: 400287 - DNA, 20 bp, Artificial Sequence
  chemically synthesized
ggcctgggcaaaactcttgg

SEQ ID NO: 400288 - DNA, 20 bp, Artificial Sequence
  chemically synthesized
aaaggcctgggcaaaactct

SEQ ID NO: 400289 - DNA, 20 bp, Artificial Sequence
  chemically synthesized
agcccaccaagagttttgcc

SEQ ID NO: 400290 - DNA, 20 bp, Artificial Sequence
  chemically synthesized
gcccaccaagagttttgccc

SEQ ID NO: 400291 - DNA, 20 bp, Artificial Sequence
  chemically synthesized
tcaaggcccaggaaaggcct

SEQ ID NO: 400292 - DNA, 20 bp, Artificial Sequence
  chemically synthesized
ttcaaggcccaggaaaggcc

SEQ ID NO: 400293 - DNA, 20 bp, Artificial Sequence
  chemically synthesized
agttttgcccaggcctttcc

SEQ ID NO: 400294 - DNA, 20 bp, Artificial Sequence
  chemically synthesized
gttttgcccaggcctttcct

SEQ ID NO: 400295 - DNA, 20 bp, Artificial Sequence
  chemically synthesized
catgcttcaaggcccaggaa

SEQ ID NO: 400296 - DNA, 20 bp, Artificial Sequence
  chemically synthesized
tcatgcttcaaggcccagga

SEQ ID NO: 400297 - DNA, 20 bp, Artificial Sequence
  chemically synthesized
cttgtcatgcttcaaggccc

SEQ ID NO: 400298 - DNA, 20 bp, Artificial Sequence
  chemically synthesized
caggcctttcctgggccttg

SEQ ID NO: 400299 - DNA, 20 bp, Artificial Sequence
  chemically synthesized
tcttgtcatgcttcaaggcc

SEQ ID NO: 400300 - DNA, 20 bp, Artificial Sequence
  chemically synthesized
cattatcttgtcatgcttca

SEQ ID NO: 400301 - DNA, 20 bp, Artificial Sequence
  chemically synthesized
tcattatcttgtcatgcttc

SEQ ID NO: 400302 - DNA, 20 bp, Artificial Sequence
  chemically synthesized
cctgggccttgaagcatgac

SEQ ID NO: 400303 - DNA, 20 bp, Artificial Sequence
  chemically synthesized
tgaagcatgacaagataatg

SEQ ID NO: 400304 - DNA, 20 bp, Artificial Sequence
  chemically synthesized
gaagcatgacaagataatga

SEQ ID NO: 400305 - DNA, 20 bp, Artificial Sequence
  chemically synthesized
gataatgaaggaattcttaa

SEQ ID NO: 400306 - DNA, 20 bp, Artificial Sequence
  chemically synthesized
ataatgaaggaattcttaac

SEQ ID NO: 400307 - DNA, 20 bp, Artificial Sequence
  chemically synthesized
aattctaaaagggtcctgtt

SEQ ID NO: 400308 - DNA, 20 bp, Artificial Sequence
  chemically synthesized
aattcttaacaggacccttt

SEQ ID NO: 400309 - DNA, 20 bp, Artificial Sequence
  chemically synthesized
aagcttttttaattctaaaa

SEQ ID NO: 400310 - DNA, 20 bp, Artificial Sequence
  chemically synthesized
aaagcttttttaattctaaa

SEQ ID NO: 400311 - DNA, 20 bp, Artificial Sequence
  chemically synthesized
taaagcttttttaattctaa

SEQ ID NO: 400312 - DNA, 20 bp, Artificial Sequence
  chemically synthesized
ggacccttttagaattaaaa

SEQ ID NO: 400313 - DNA, 20 bp, Artificial Sequence
  chemically synthesized
tagaattaaaaaagctttat

SEQ ID NO: 400314 - DNA, 20 bp, Artificial Sequence
  chemically synthesized
agaattaaaaaagctttatt

SEQ ID NO: 400315 - DNA, 20 bp, Artificial Sequence
  chemically synthesized
gaattaaaaaagctttattg

SEQ ID NO: 400316 - DNA, 20 bp, Artificial Sequence
  chemically synthesized
aattaaaaaagctttattgg

SEQ ID NO: 400317 - DNA, 20 bp, Artificial Sequence
  chemically synthesized
gtttcttcagacccccaata

SEQ ID NO: 400318 - DNA, 20 bp, Artificial Sequence
  chemically synthesized
aaagctttattgggggtctg

SEQ ID NO: 400319 - DNA, 20 bp, Artificial Sequence
  chemically synthesized
ggagtcctggggagtttctt

SEQ ID NO: 400320 - DNA, 20 bp, Artificial Sequence
  chemically synthesized
gggggtctgaagaaactccc

SEQ ID NO: 400321 - DNA, 20 bp, Artificial Sequence
  chemically synthesized
ggggtctgaagaaactcccc

SEQ ID NO: 400322 - DNA, 20 bp, Artificial Sequence
  chemically synthesized
cttgtttgtggagtcctggg

SEQ ID NO: 400323 - DNA, 20 bp, Artificial Sequence
  chemically synthesized
aacttgtttgtggagtcctg

SEQ ID NO: 400324 - DNA, 20 bp, Artificial Sequence
  chemically synthesized
aaacttgtttgtggagtcct

SEQ ID NO: 400325 - DNA, 20 bp, Artificial Sequence
  chemically synthesized
taaacttgtttgtggagtcc

SEQ ID NO: 400326 - DNA, 20 bp, Artificial Sequence
  chemically synthesized
ctccccaggactccacaaac

SEQ ID NO: 400327 - DNA, 20 bp, Artificial Sequence
  chemically synthesized
gcccagtaaacttgtttgtg

SEQ ID NO: 400328 - DNA, 20 bp, Artificial Sequence
  chemically synthesized
atgcccagtaaacttgtttg

SEQ ID NO: 400329 - DNA, 20 bp, Artificial Sequence
  chemically synthesized
gactccacaaacaagtttac

SEQ ID NO: 400330 - DNA, 20 bp, Artificial Sequence
  chemically synthesized
actccacaaacaagtttact

SEQ ID NO: 400331 - DNA, 20 bp, Artificial Sequence
  chemically synthesized
ggggagttccttcagatgcc

SEQ ID NO: 400332 - DNA, 20 bp, Artificial Sequence
  chemically synthesized
acaagtttactgggcatctg

SEQ ID NO: 400333 - DNA, 20 bp, Artificial Sequence
  chemically synthesized
caagtttactgggcatctga

SEQ ID NO: 400334 - DNA, 20 bp, Artificial Sequence
  chemically synthesized
ggagtttgggggagttcctt

SEQ ID NO: 400335 - DNA, 20 bp, Artificial Sequence
  chemically synthesized
ctaaatcatggagtttgggg

SEQ ID NO: 400336 - DNA, 20 bp, Artificial Sequence
  chemically synthesized
ggctaaatcatggagtttgg

SEQ ID NO: 400337 - DNA, 20 bp, Artificial Sequence
  chemically synthesized
cggctaaatcatggagtttg

SEQ ID NO: 400338 - DNA, 20 bp, Artificial Sequence
  chemically synthesized
ccggctaaatcatggagttt

SEQ ID NO: 400339 - DNA, 20 bp, Artificial Sequence
  chemically synthesized
tccggctaaatcatggagtt

SEQ ID NO: 400340 - DNA, 20 bp, Artificial Sequence
  chemically synthesized
ctcccccaaactccatgatt

SEQ ID NO: 400341 - DNA, 20 bp, Artificial Sequence
  chemically synthesized
ttatctccggctaaatcatg

SEQ ID NO: 400342 - DNA, 20 bp, Artificial Sequence
  chemically synthesized
tcttatctccggctaaatca

SEQ ID NO: 400343 - DNA, 20 bp, Artificial Sequence
  chemically synthesized
cccaaactccatgatttagc

SEQ ID NO: 400344 - DNA, 20 bp, Artificial Sequence
  chemically synthesized
caaactccatgatttagccg

SEQ ID NO: 400345 - DNA, 20 bp, Artificial Sequence
  chemically synthesized
tccatgatttagccggagat

SEQ ID NO: 400346 - DNA, 20 bp, Artificial Sequence
  chemically synthesized
gattacccttatcttatctc

SEQ ID NO: 400347 - DNA, 20 bp, Artificial Sequence
  chemically synthesized
gatttagccggagataagat

SEQ ID NO: 400348 - DNA, 20 bp, Artificial Sequence
  chemically synthesized
atttagccggagataagata

SEQ ID NO: 400349 - DNA, 20 bp, Artificial Sequence
  chemically synthesized
tttagccggagataagataa

SEQ ID NO: 400350 - DNA, 20 bp, Artificial Sequence
  chemically synthesized
taagataagggtaatcatcc

SEQ ID NO: 400351 - DNA, 20 bp, Artificial Sequence
  chemically synthesized
agggtaatcatcccagcacc

SEQ ID NO: 400352 - DNA, 20 bp, Artificial Sequence
  chemically synthesized
tctaaatgggtccaggtgct

SEQ ID NO: 400353 - DNA, 20 bp, Artificial Sequence
  chemically synthesized
atctaaatgggtccaggtgc

SEQ ID NO: 400354 - DNA, 20 bp, Artificial Sequence
  chemically synthesized
tactttatctaaatgggtcc

SEQ ID NO: 400355 - DNA, 20 bp, Artificial Sequence
  chemically synthesized
ttactttatctaaatgggtc

SEQ ID NO: 400356 - DNA, 20 bp, Artificial Sequence
  chemically synthesized
tcccagcacctggacccatt

SEQ ID NO: 400357 - DNA, 20 bp, Artificial Sequence
  chemically synthesized
taaatttactttatctaaat

SEQ ID NO: 400358 - DNA, 20 bp, Artificial Sequence
  chemically synthesized
gtaaatttactttatctaaa

SEQ ID NO: 400359 - DNA, 20 bp, Artificial Sequence
  chemically synthesized
cacctggacccatttagata

SEQ ID NO: 400360 - DNA, 20 bp, Artificial Sequence
  chemically synthesized
ttagataaagtaaatttact

SEQ ID NO: 400361 - DNA, 20 bp, Artificial Sequence
  chemically synthesized
tagataaagtaaatttactg

SEQ ID NO: 400362 - DNA, 20 bp, Artificial Sequence
  chemically synthesized
aagtaaatttactgaggctc

SEQ ID NO: 400363 - DNA, 20 bp, Artificial Sequence
  chemically synthesized
aagacattcctctggagcct

SEQ ID NO: 400364 - DNA, 20 bp, Artificial Sequence
  chemically synthesized
gtaaatttactgaggctcca

SEQ ID NO: 400365 - DNA, 20 bp, Artificial Sequence
  chemically synthesized
taaatttactgaggctccag

SEQ ID NO: 400366 - DNA, 20 bp, Artificial Sequence
  chemically synthesized
ttcctgaagacattcctctg

SEQ ID NO: 400367 - DNA, 20 bp, Artificial Sequence
  chemically synthesized
gattcctgaagacattcctc

SEQ ID NO: 400368 - DNA, 20 bp, Artificial Sequence
  chemically synthesized
aggctccagaggaatgtctt

SEQ ID NO: 400369 - DNA, 20 bp, Artificial Sequence
  chemically synthesized
ggctccagaggaatgtcttc

SEQ ID NO: 400370 - DNA, 20 bp, Artificial Sequence
  chemically synthesized
agaggaatgtcttcaggaat

SEQ ID NO: 400371 - DNA, 20 bp, Artificial Sequence
  chemically synthesized
taactaagatctgattcctg

SEQ ID NO: 400372 - DNA, 20 bp, Artificial Sequence
  chemically synthesized
tgtcttcaggaatcagatct

SEQ ID NO: 400373 - DNA, 20 bp, Artificial Sequence
  chemically synthesized
caggaatcagatcttagtta

SEQ ID NO: 400374 - DNA, 20 bp, Artificial Sequence
  chemically synthesized
acttcttctgatctgtaact

SEQ ID NO: 400375 - DNA, 20 bp, Artificial Sequence
  chemically synthesized
atcagatcttagttacagat

SEQ ID NO: 400376 - DNA, 20 bp, Artificial Sequence
  chemically synthesized
agatcttagttacagatcag

SEQ ID NO: 400377 - DNA, 20 bp, Artificial Sequence
  chemically synthesized
tcttagttacagatcagaag

SEQ ID NO: 400378 - DNA, 20 bp, Artificial Sequence
  chemically synthesized
aagttaatcatttatgtctt

SEQ ID NO: 400379 - DNA, 20 bp, Artificial Sequence
  chemically synthesized
taatcatttatgtctttaga

SEQ ID NO: 400380 - DNA, 20 bp, Artificial Sequence
  chemically synthesized
tgtaagtgtgtatccatcta

SEQ ID NO: 400381 - DNA, 20 bp, Artificial Sequence
  chemically synthesized
gatggatacacacttacatg

SEQ ID NO: 400382 - DNA, 20 bp, Artificial Sequence
  chemically synthesized
tacgctgtatgtctacatgt

SEQ ID NO: 400383 - DNA, 20 bp, Artificial Sequence
  chemically synthesized
cacacttacatgtagacata

SEQ ID NO: 400384 - DNA, 20 bp, Artificial Sequence
  chemically synthesized
ttacatgtagacatacagcg

SEQ ID NO: 400385 - DNA, 20 bp, Artificial Sequence
  chemically synthesized
catgtagacatacagcgtag

SEQ ID NO: 400386 - DNA, 20 bp, Artificial Sequence
  chemically synthesized
atgtagacatacagcgtaga

SEQ ID NO: 400387 - DNA, 20 bp, Artificial Sequence
  chemically synthesized
atacagcgtagaaggtatat

SEQ ID NO: 400388 - DNA, 20 bp, Artificial Sequence
  chemically synthesized
cgtagaaggtatataagctc

SEQ ID NO: 400389 - DNA, 20 bp, Artificial Sequence
  chemically synthesized
caaaactataaagttttcca

SEQ ID NO: 400390 - DNA, 20 bp, Artificial Sequence
  chemically synthesized
ctcaaaactataaagttttc

SEQ ID NO: 400391 - DNA, 20 bp, Artificial Sequence
  chemically synthesized
ataagctctggaaaacttta

SEQ ID NO: 400392 - DNA, 20 bp, Artificial Sequence
  chemically synthesized
cagaccaactcaaaactata

SEQ ID NO: 400393 - DNA, 20 bp, Artificial Sequence
  chemically synthesized
ctggaaaactttatagtttt

SEQ ID NO: 400394 - DNA, 20 bp, Artificial Sequence
  chemically synthesized
aaaactttatagttttgagt

SEQ ID NO: 400395 - DNA, 20 bp, Artificial Sequence
  chemically synthesized
tttatagttttgagttggtc

SEQ ID NO: 400396 - DNA, 20 bp, Artificial Sequence
  chemically synthesized
ttatagttttgagttggtct

SEQ ID NO: 400397 - DNA, 20 bp, Artificial Sequence
  chemically synthesized
tatagttttgagttggtctg

SEQ ID NO: 400398 - DNA, 20 bp, Artificial Sequence
  chemically synthesized
gaagacctggaaattatccc

SEQ ID NO: 400399 - DNA, 20 bp, Artificial Sequence
  chemically synthesized
gttggtctggggataatttc

SEQ ID NO: 400400 - DNA, 20 bp, Artificial Sequence
  chemically synthesized
ttggtctggggataatttcc

SEQ ID NO: 400401 - DNA, 20 bp, Artificial Sequence
  chemically synthesized
gtggttacagggagaagacc

SEQ ID NO: 400402 - DNA, 20 bp, Artificial Sequence
  chemically synthesized
ctgtaagtggttacagggag

SEQ ID NO: 400403 - DNA, 20 bp, Artificial Sequence
  chemically synthesized
tttctgtaagtggttacagg

SEQ ID NO: 400404 - DNA, 20 bp, Artificial Sequence
  chemically synthesized
tatttctgtaagtggttaca

SEQ ID NO: 400405 - DNA, 20 bp, Artificial Sequence
  chemically synthesized
ttatttctgtaagtggttac

SEQ ID NO: 400406 - DNA, 20 bp, Artificial Sequence
  chemically synthesized
tttatttctgtaagtggtta

SEQ ID NO: 400407 - DNA, 20 bp, Artificial Sequence
  chemically synthesized
cttctccctgtaaccactta

SEQ ID NO: 400408 - DNA, 20 bp, Artificial Sequence
  chemically synthesized
agagtttttatttctgtaag

SEQ ID NO: 400409 - DNA, 20 bp, Artificial Sequence
  chemically synthesized
gagagagtttttatttctgt

SEQ ID NO: 400410 - DNA, 20 bp, Artificial Sequence
  chemically synthesized
agatgaacgggaaaaggaga

SEQ ID NO: 400411 - DNA, 20 bp, Artificial Sequence
  chemically synthesized
gcagatgaacgggaaaagga

SEQ ID NO: 400412 - DNA, 20 bp, Artificial Sequence
  chemically synthesized
atgcagatgaacgggaaaag

SEQ ID NO: 400413 - DNA, 20 bp, Artificial Sequence
  chemically synthesized
agatgcagatgaacgggaaa

SEQ ID NO: 400414 - DNA, 20 bp, Artificial Sequence
  chemically synthesized
gagatgcagatgaacgggaa

SEQ ID NO: 400415 - DNA, 20 bp, Artificial Sequence
  chemically synthesized
ataacgagatgcagatgaac

SEQ ID NO: 400416 - DNA, 20 bp, Artificial Sequence
  chemically synthesized
aataacgagatgcagatgaa

SEQ ID NO: 400417 - DNA, 20 bp, Artificial Sequence
  chemically synthesized
tgtggcccaataacgagatg

SEQ ID NO: 400418 - DNA, 20 bp, Artificial Sequence
  chemically synthesized
gttcatctgcatctcgttat

SEQ ID NO: 400419 - DNA, 20 bp, Artificial Sequence
  chemically synthesized
ttcatctgcatctcgttatt

SEQ ID NO: 400420 - DNA, 20 bp, Artificial Sequence
  chemically synthesized
tattcttgtggcccaataac

SEQ ID NO: 400421 - DNA, 20 bp, Artificial Sequence
  chemically synthesized
gcatctcgttattgggccac

SEQ ID NO: 400422 - DNA, 20 bp, Artificial Sequence
  chemically synthesized
cgttattgggccacaagaat

SEQ ID NO: 400423 - DNA, 20 bp, Artificial Sequence
  chemically synthesized
gattgggctgcttattcttg

SEQ ID NO: 400424 - DNA, 20 bp, Artificial Sequence
  chemically synthesized
tattgggccacaagaataag

SEQ ID NO: 400425 - DNA, 20 bp, Artificial Sequence
  chemically synthesized
agaataagcagcccaatcct

SEQ ID NO: 400426 - DNA, 20 bp, Artificial Sequence
  chemically synthesized
cctggaccaaactgaggatt

SEQ ID NO: 400427 - DNA, 20 bp, Artificial Sequence
  chemically synthesized
tcctggaccaaactgaggat

SEQ ID NO: 400428 - DNA, 20 bp, Artificial Sequence
  chemically synthesized
aagcagcccaatcctcagtt

SEQ ID NO: 400429 - DNA, 20 bp, Artificial Sequence
  chemically synthesized
agtgttcctggaccaaactg

SEQ ID NO: 400430 - DNA, 20 bp, Artificial Sequence
  chemically synthesized
tagtgttcctggaccaaact

SEQ ID NO: 400431 - DNA, 20 bp, Artificial Sequence
  chemically synthesized
gcccaatcctcagtttggtc

SEQ ID NO: 400432 - DNA, 20 bp, Artificial Sequence
  chemically synthesized
cccaatcctcagtttggtcc

SEQ ID NO: 400433 - DNA, 20 bp, Artificial Sequence
  chemically synthesized
ccatgatatgatagtgttcc

SEQ ID NO: 400434 - DNA, 20 bp, Artificial Sequence
  chemically synthesized
cacaaaagcccatgatatga

SEQ ID NO: 400435 - DNA, 20 bp, Artificial Sequence
  chemically synthesized
ccaggaacactatcatatca

SEQ ID NO: 400436 - DNA, 20 bp, Artificial Sequence
  chemically synthesized
caggaacactatcatatcat

SEQ ID NO: 400437 - DNA, 20 bp, Artificial Sequence
  chemically synthesized
tcatatcatgggcttttgtg

SEQ ID NO: 400438 - DNA, 20 bp, Artificial Sequence
  chemically synthesized
tttgtctaatgtcttcacaa

SEQ ID NO: 400439 - DNA, 20 bp, Artificial Sequence
  chemically synthesized
atgggcttttgtgaagacat

SEQ ID NO: 400440 - DNA, 20 bp, Artificial Sequence
  chemically synthesized
atgaagtagaaatgcataat

SEQ ID NO: 400441 - DNA, 20 bp, Artificial Sequence
  chemically synthesized
catgtttgacttaaatgaag

SEQ ID NO: 400442 - DNA, 20 bp, Artificial Sequence
  chemically synthesized
tatgcatttctacttcattt

SEQ ID NO: 400443 - DNA, 20 bp, Artificial Sequence
  chemically synthesized
atgcatgtttgacttaaatg

SEQ ID NO: 400444 - DNA, 20 bp, Artificial Sequence
  chemically synthesized
gtcaaacatgcatactatgt

SEQ ID NO: 400445 - DNA, 20 bp, Artificial Sequence
  chemically synthesized
tgtctgatttttttccaaca

SEQ ID NO: 400446 - DNA, 20 bp, Artificial Sequence
  chemically synthesized
atactatgttggaaaaaaat

SEQ ID NO: 400447 - DNA, 20 bp, Artificial Sequence
  chemically synthesized
tatgttggaaaaaaatcaga

SEQ ID NO: 400448 - DNA, 20 bp, Artificial Sequence
  chemically synthesized
gttggaaaaaaatcagacag

SEQ ID NO: 400449 - DNA, 20 bp, Artificial Sequence
  chemically synthesized
tggaaaaaaatcagacagaa

SEQ ID NO: 400450 - DNA, 20 bp, Artificial Sequence
  chemically synthesized
aaaaaatcagacagaagagt

SEQ ID NO: 400451 - DNA, 20 bp, Artificial Sequence
  chemically synthesized
atcagacagaagagtgagta

SEQ ID NO: 400452 - DNA, 20 bp, Artificial Sequence
  chemically synthesized
gaagagtgagtatggaaata

SEQ ID NO: 400453 - DNA, 20 bp, Artificial Sequence
  chemically synthesized
ataaagatgattactaaatt

SEQ ID NO: 400454 - DNA, 20 bp, Artificial Sequence
  chemically synthesized
ttttgatcctatactgaatt

SEQ ID NO: 400455 - DNA, 20 bp, Artificial Sequence
  chemically synthesized
gatgattactaaattcagta

SEQ ID NO: 400456 - DNA, 20 bp, Artificial Sequence
  chemically synthesized
atgattactaaattcagtat

SEQ ID NO: 400457 - DNA, 20 bp, Artificial Sequence
  chemically synthesized
tctcccaatgagtgatatga

SEQ ID NO: 400458 - DNA, 20 bp, Artificial Sequence
  chemically synthesized
aaaaccatcatatcactcat

SEQ ID NO: 400459 - DNA, 20 bp, Artificial Sequence
  chemically synthesized
aaaccatcatatcactcatt

SEQ ID NO: 400460 - DNA, 20 bp, Artificial Sequence
  chemically synthesized
accatcatatcactcattgg

SEQ ID NO: 400461 - DNA, 20 bp, Artificial Sequence
  chemically synthesized
gagataaactatctcccaat

SEQ ID NO: 400462 - DNA, 20 bp, Artificial Sequence
  chemically synthesized
tcatatcactcattgggaga

SEQ ID NO: 400463 - DNA, 20 bp, Artificial Sequence
  chemically synthesized
tactgccagctcaattgaga

SEQ ID NO: 400464 - DNA, 20 bp, Artificial Sequence
  chemically synthesized
atagtttatctctctcaatt

SEQ ID NO: 400465 - DNA, 20 bp, Artificial Sequence
  chemically synthesized
tttactgccagctcaattga

SEQ ID NO: 400466 - DNA, 20 bp, Artificial Sequence
  chemically synthesized
tatttactgccagctcaatt

SEQ ID NO: 400467 - DNA, 20 bp, Artificial Sequence
  chemically synthesized
tttatctctctcaattgagc

SEQ ID NO: 400468 - DNA, 20 bp, Artificial Sequence
  chemically synthesized
atctctctcaattgagctgg

SEQ ID NO: 400469 - DNA, 20 bp, Artificial Sequence
  chemically synthesized
tgggaaaaaatatttactgc

SEQ ID NO: 400470 - DNA, 20 bp, Artificial Sequence
  chemically synthesized
tgtttgagaaaaaattttat

SEQ ID NO: 400471 - DNA, 20 bp, Artificial Sequence
  chemically synthesized
gtgtttgagaaaaaatttta

SEQ ID NO: 400472 - DNA, 20 bp, Artificial Sequence
  chemically synthesized
tgtgcttgatgtttgtgttt

SEQ ID NO: 400473 - DNA, 20 bp, Artificial Sequence
  chemically synthesized
ttttctcaaacacaaacatc

SEQ ID NO: 400474 - DNA, 20 bp, Artificial Sequence
  chemically synthesized
ttttatgacaaaattatttt

SEQ ID NO: 400475 - DNA, 20 bp, Artificial Sequence
  chemically synthesized
cggcttaataaagggaagta

SEQ ID NO: 400476 - DNA, 20 bp, Artificial Sequence
  chemically synthesized
catgccggcttaataaaggg

SEQ ID NO: 400477 - DNA, 20 bp, Artificial Sequence
  chemically synthesized
aaactgtacttccctttatt

SEQ ID NO: 400478 - DNA, 20 bp, Artificial Sequence
  chemically synthesized
atccatgccggcttaataaa

SEQ ID NO: 400479 - DNA, 20 bp, Artificial Sequence
  chemically synthesized
catccatgccggcttaataa

SEQ ID NO: 400480 - DNA, 20 bp, Artificial Sequence
  chemically synthesized
tcatccatgccggcttaata

SEQ ID NO: 400481 - DNA, 20 bp, Artificial Sequence
  chemically synthesized
tgtacttccctttattaagc

SEQ ID NO: 400482 - DNA, 20 bp, Artificial Sequence
  chemically synthesized
ttccctttattaagccggca

SEQ ID NO: 400483 - DNA, 20 bp, Artificial Sequence
  chemically synthesized
aaaatcttgctcatccatgc

SEQ ID NO: 400484 - DNA, 20 bp, Artificial Sequence
  chemically synthesized
tttattaagccggcatggat

SEQ ID NO: 400485 - DNA, 20 bp, Artificial Sequence
  chemically synthesized
ttaagccggcatggatgagc

SEQ ID NO: 400486 - DNA, 20 bp, Artificial Sequence
  chemically synthesized
aatgcgaatcatatttgtca

SEQ ID NO: 400487 - DNA, 20 bp, Artificial Sequence
  chemically synthesized
tgcgaatcatatttgtcata

SEQ ID NO: 400488 - DNA, 20 bp, Artificial Sequence
  chemically synthesized
atttgtcatagagtatacac

SEQ ID NO: 400489 - DNA, 20 bp, Artificial Sequence
  chemically synthesized
tttgtcatagagtatacacg

SEQ ID NO: 400490 - DNA, 20 bp, Artificial Sequence
  chemically synthesized
agtatacacgaggcttttta

SEQ ID NO: 400491 - DNA, 20 bp, Artificial Sequence
  chemically synthesized
gtatacacgaggctttttaa

SEQ ID NO: 400492 - DNA, 20 bp, Artificial Sequence
  chemically synthesized
atatgttataatcctttaaa

SEQ ID NO: 400493 - DNA, 20 bp, Artificial Sequence
  chemically synthesized
taacatatcaataaattaca

SEQ ID NO: 400494 - DNA, 20 bp, Artificial Sequence
  chemically synthesized
atatcaataaattacatgga

SEQ ID NO: 400495 - DNA, 20 bp, Artificial Sequence
  chemically synthesized
ttctagataagattaattca

SEQ ID NO: 400496 - DNA, 20 bp, Artificial Sequence
  chemically synthesized
atttctagataagattaatt

SEQ ID NO: 400497 - DNA, 20 bp, Artificial Sequence
  chemically synthesized
tactctgaattaatcttatc

SEQ ID NO: 400498 - DNA, 20 bp, Artificial Sequence
  chemically synthesized
acacaaaaccatttctagat

SEQ ID NO: 400499 - DNA, 20 bp, Artificial Sequence
  chemically synthesized
gaattaatcttatctagaaa

SEQ ID NO: 400500 - DNA, 20 bp, Artificial Sequence
  chemically synthesized
cataaacacaaaaccatttc

SEQ ID NO: 400501 - DNA, 20 bp, Artificial Sequence
  chemically synthesized
gaaatggttttgtgtttatg

SEQ ID NO: 400502 - DNA, 20 bp, Artificial Sequence
  chemically synthesized
aatggttttgtgtttatgtg

SEQ ID NO: 400503 - DNA, 20 bp, Artificial Sequence
  chemically synthesized
atgtggagataaatattgtt

SEQ ID NO: 400504 - DNA, 20 bp, Artificial Sequence
  chemically synthesized
gttcagttatctctatataa

SEQ ID NO: 400505 - DNA, 20 bp, Artificial Sequence
  chemically synthesized
tttatcacatctattatata

SEQ ID NO: 400506 - DNA, 20 bp, Artificial Sequence
  chemically synthesized
gatttatcacatctattata

SEQ ID NO: 400507 - DNA, 20 bp, Artificial Sequence
  chemically synthesized
agatgtgataaatcacattc

SEQ ID NO: 400508 - DNA, 20 bp, Artificial Sequence
  chemically synthesized
tgtgataaatcacattctag

SEQ ID NO: 400509 - DNA, 20 bp, Artificial Sequence
  chemically synthesized
ttgattccaaaaaattctac

SEQ ID NO: 400510 - DNA, 20 bp, Artificial Sequence
  chemically synthesized
cacattctagtagaattttt

SEQ ID NO: 400511 - DNA, 20 bp, Artificial Sequence
  chemically synthesized
agtagaattttttggaatca

SEQ ID NO: 400512 - DNA, 20 bp, Artificial Sequence
  chemically synthesized
ttttttggaatcaaagttaa

SEQ ID NO: 400513 - DNA, 20 bp, Artificial Sequence
  chemically synthesized
tttggaatcaaagttaatag

SEQ ID NO: 400514 - DNA, 20 bp, Artificial Sequence
  chemically synthesized
gccctatctctttttaaaat

SEQ ID NO: 400515 - DNA, 20 bp, Artificial Sequence
  chemically synthesized
aatagaagacttattttaaa

SEQ ID NO: 400516 - DNA, 20 bp, Artificial Sequence
  chemically synthesized
tagaagacttattttaaaaa

SEQ ID NO: 400517 - DNA, 20 bp, Artificial Sequence
  chemically synthesized
agacttattttaaaaagaga

SEQ ID NO: 400518 - DNA, 20 bp, Artificial Sequence
  chemically synthesized
gacttattttaaaaagagat

SEQ ID NO: 400519 - DNA, 20 bp, Artificial Sequence
  chemically synthesized
acttattttaaaaagagata

SEQ ID NO: 400520 - DNA, 20 bp, Artificial Sequence
  chemically synthesized
cctggtaccattttaaaaat

SEQ ID NO: 400521 - DNA, 20 bp, Artificial Sequence
  chemically synthesized
gatagggcttatttttaaaa

SEQ ID NO: 400522 - DNA, 20 bp, Artificial Sequence
  chemically synthesized
gcttatttttaaaatggtac

SEQ ID NO: 400523 - DNA, 20 bp, Artificial Sequence
  chemically synthesized
cttatttttaaaatggtacc

SEQ ID NO: 400524 - DNA, 20 bp, Artificial Sequence
  chemically synthesized
tttttaaaatggtaccagga

SEQ ID NO: 400525 - DNA, 20 bp, Artificial Sequence
  chemically synthesized
ttaaaatggtaccaggaaag

SEQ ID NO: 400526 - DNA, 20 bp, Artificial Sequence
  chemically synthesized
taactgattttccactttcc

SEQ ID NO: 400527 - DNA, 20 bp, Artificial Sequence
  chemically synthesized
gtaccaggaaagtggaaaat

SEQ ID NO: 400528 - DNA, 20 bp, Artificial Sequence
  chemically synthesized
caggaaagtggaaaatcagt

SEQ ID NO: 400529 - DNA, 20 bp, Artificial Sequence
  chemically synthesized
aatcagttagatttactgca

SEQ ID NO: 400530 - DNA, 20 bp, Artificial Sequence
  chemically synthesized
tgaagccaaatgtgtctttg

SEQ ID NO: 400531 - DNA, 20 bp, Artificial Sequence
  chemically synthesized
atttactgcaaagacacatt

SEQ ID NO: 400532 - DNA, 20 bp, Artificial Sequence
  chemically synthesized
tgttgttgtggcgtcatttg

SEQ ID NO: 400533 - DNA, 20 bp, Artificial Sequence
  chemically synthesized
tcaaatgacgccacaacaac

SEQ ID NO: 400534 - DNA, 20 bp, Artificial Sequence
  chemically synthesized
taaatgtatccttgttgttg

SEQ ID NO: 400535 - DNA, 20 bp, Artificial Sequence
  chemically synthesized
caaatgacgccacaacaaca

SEQ ID NO: 400536 - DNA, 20 bp, Artificial Sequence
  chemically synthesized
gctacggaagggatatttaa

SEQ ID NO: 400537 - DNA, 20 bp, Artificial Sequence
  chemically synthesized
agctacggaagggatattta

SEQ ID NO: 400538 - DNA, 20 bp, Artificial Sequence
  chemically synthesized
tcctttaaatatcccttccg

SEQ ID NO: 400539 - DNA, 20 bp, Artificial Sequence
  chemically synthesized
tattttgtaaagctacggaa

SEQ ID NO: 400540 - DNA, 20 bp, Artificial Sequence
  chemically synthesized
ttattttgtaaagctacgga

SEQ ID NO: 400541 - DNA, 20 bp, Artificial Sequence
  chemically synthesized
gttattttgtaaagctacgg

SEQ ID NO: 400542 - DNA, 20 bp, Artificial Sequence
  chemically synthesized
cttgttattttgtaaagcta

SEQ ID NO: 400543 - DNA, 20 bp, Artificial Sequence
  chemically synthesized
tatttccttgttattttgta

SEQ ID NO: 400544 - DNA, 20 bp, Artificial Sequence
  chemically synthesized
ccgtagctttacaaaataac

SEQ ID NO: 400545 - DNA, 20 bp, Artificial Sequence
  chemically synthesized
cgtagctttacaaaataaca

SEQ ID NO: 400546 - DNA, 20 bp, Artificial Sequence
  chemically synthesized
taatatttgtaaattataga

SEQ ID NO: 400547 - DNA, 20 bp, Artificial Sequence
  chemically synthesized
tataatatttgtaaattata

SEQ ID NO: 400548 - DNA, 20 bp, Artificial Sequence
  chemically synthesized
tatataatatttgtaaatta

SEQ ID NO: 400549 - DNA, 20 bp, Artificial Sequence
  chemically synthesized
ttatataaatgtgtgtataa

SEQ ID NO: 400550 - DNA, 20 bp, Artificial Sequence
  chemically synthesized
tatataaatgtgtgtataaa

SEQ ID NO: 400551 - DNA, 20 bp, Artificial Sequence
  chemically synthesized
aaaattatcatctgtctgtg

SEQ ID NO: 400552 - DNA, 20 bp, Artificial Sequence
  chemically synthesized
tgtctactttaccacacaga

SEQ ID NO: 400553 - DNA, 20 bp, Artificial Sequence
  chemically synthesized
tatcatctgtctgtgtggta

SEQ ID NO: 400554 - DNA, 20 bp, Artificial Sequence
  chemically synthesized
tctgtgtctactttaccaca

SEQ ID NO: 400555 - DNA, 20 bp, Artificial Sequence
  chemically synthesized
catctgtctgtgtggtaaag

SEQ ID NO: 400556 - DNA, 20 bp, Artificial Sequence
  chemically synthesized
tctgtgtggtaaagtagaca

SEQ ID NO: 400557 - DNA, 20 bp, Artificial Sequence
  chemically synthesized
tgtggtaaagtagacacaga

SEQ ID NO: 400558 - DNA, 20 bp, Artificial Sequence
  chemically synthesized
ctaactcatattcattttta

SEQ ID NO: 400559 - DNA, 20 bp, Artificial Sequence
  chemically synthesized
acgactataaaaatgaatat

SEQ ID NO: 400560 - DNA, 20 bp, Artificial Sequence
  chemically synthesized
ctataaaaatgaatatgagt

SEQ ID NO: 400561 - DNA, 20 bp, Artificial Sequence
  chemically synthesized
tgaatatgagttagatttat

SEQ ID NO: 400562 - DNA, 20 bp, Artificial Sequence
  chemically synthesized
tatgagttagatttattagt

SEQ ID NO: 400563 - DNA, 20 bp, Artificial Sequence
  chemically synthesized
atgagttagatttattagtg

SEQ ID NO: 400564 - DNA, 20 bp, Artificial Sequence
  chemically synthesized
ttattagtgaggcattttta

SEQ ID NO: 400565 - DNA, 20 bp, Artificial Sequence
  chemically synthesized
ctgtgtggtaaattagacac

SEQ ID NO: 400566 - DNA, 20 bp, Artificial Sequence
  chemically synthesized
tctgtgtggtaaattagaca

SEQ ID NO: 400567 - DNA, 20 bp, Artificial Sequence
  chemically synthesized
attctgtctgtgtggtaaat

SEQ ID NO: 400568 - DNA, 20 bp, Artificial Sequence
  chemically synthesized
cctgtgtctaatttaccaca

SEQ ID NO: 400569 - DNA, 20 bp, Artificial Sequence
  chemically synthesized
tgtctaatttaccacacaga

SEQ ID NO: 400570 - DNA, 20 bp, Artificial Sequence
  chemically synthesized
aatgaaaaattctgtctgtg

SEQ ID NO: 400571 - DNA, 20 bp, Artificial Sequence
  chemically synthesized
gactttaaaaagagaaaaaa

SEQ ID NO: 400572 - DNA, 20 bp, Artificial Sequence
  chemically synthesized
aagactttaaaaagagaaaa

SEQ ID NO: 400573 - DNA, 20 bp, Artificial Sequence
  chemically synthesized
ttctcttttttctcttttta

SEQ ID NO: 400574 - DNA, 20 bp, Artificial Sequence
  chemically synthesized
gttgaagaagactttaaaaa

SEQ ID NO: 400575 - DNA, 20 bp, Artificial Sequence
  chemically synthesized
gtgttgaagaagactttaaa

SEQ ID NO: 400576 - DNA, 20 bp, Artificial Sequence
  chemically synthesized
gtggaaaaattgtgttgaag

SEQ ID NO: 400577 - DNA, 20 bp, Artificial Sequence
  chemically synthesized
tgggtggaaaaattgtgttg

SEQ ID NO: 400578 - DNA, 20 bp, Artificial Sequence
  chemically synthesized
ttcaacacaatttttccacc

SEQ ID NO: 400579 - DNA, 20 bp, Artificial Sequence
  chemically synthesized
gaaacagaagaaaaactggg

SEQ ID NO: 400580 - DNA, 20 bp, Artificial Sequence
  chemically synthesized
gtagaaacagaagaaaaact

SEQ ID NO: 400581 - DNA, 20 bp, Artificial Sequence
  chemically synthesized
tgtagaaacagaagaaaaac

SEQ ID NO: 400582 - DNA, 20 bp, Artificial Sequence
  chemically synthesized
tatgctaactgtagaaacag

SEQ ID NO: 400583 - DNA, 20 bp, Artificial Sequence
  chemically synthesized
cagtttttcttctgtttcta

SEQ ID NO: 400584 - DNA, 20 bp, Artificial Sequence
  chemically synthesized
atctatgctaactgtagaaa

SEQ ID NO: 400585 - DNA, 20 bp, Artificial Sequence
  chemically synthesized
ttttcttctgtttctacagt

SEQ ID NO: 400586 - DNA, 20 bp, Artificial Sequence
  chemically synthesized
cattaaatctatgctaactg

SEQ ID NO: 400587 - DNA, 20 bp, Artificial Sequence
  chemically synthesized
ttctgtttctacagttagca

SEQ ID NO: 400588 - DNA, 20 bp, Artificial Sequence
  chemically synthesized
aatgatttgtactactgacc

SEQ ID NO: 400589 - DNA, 20 bp, Artificial Sequence
  chemically synthesized
taataaatatactaggtcag

SEQ ID NO: 400590 - DNA, 20 bp, Artificial Sequence
  chemically synthesized
atataataaatatactaggt

SEQ ID NO: 400591 - DNA, 20 bp, Artificial Sequence
  chemically synthesized
ataaatataataaatatact

SEQ ID NO: 400592 - DNA, 20 bp, Artificial Sequence
  chemically synthesized
tataaatataataaatatac

SEQ ID NO: 400593 - DNA, 20 bp, Artificial Sequence
  chemically synthesized
gtatatttattatatttata

SEQ ID NO: 400594 - DNA, 20 bp, Artificial Sequence
  chemically synthesized
attatatttatatagtgtac

SEQ ID NO: 400595 - DNA, 20 bp, Artificial Sequence
  chemically synthesized
ataatctcattgtttattac

SEQ ID NO: 400596 - DNA, 20 bp, Artificial Sequence
  chemically synthesized
gtgtactagtaataaacaat

SEQ ID NO: 400597 - DNA, 20 bp, Artificial Sequence
  chemically synthesized
taataaacaatgagattata

SEQ ID NO: 400598 - DNA, 20 bp, Artificial Sequence
  chemically synthesized
taaacaatgagattatatag

SEQ ID NO: 400599 - DNA, 20 bp, Artificial Sequence
  chemically synthesized
aatgtgagcccatcaaaggc

SEQ ID NO: 400600 - DNA, 20 bp, Artificial Sequence
  chemically synthesized
atatacattcctgcctttga

SEQ ID NO: 400601 - DNA, 20 bp, Artificial Sequence
  chemically synthesized
aaatgtgagcccatcaaagg

SEQ ID NO: 400602 - DNA, 20 bp, Artificial Sequence
  chemically synthesized
tatacattcctgcctttgat

SEQ ID NO: 400603 - DNA, 20 bp, Artificial Sequence
  chemically synthesized
ctaaaatgtgagcccatcaa

SEQ ID NO: 400604 - DNA, 20 bp, Artificial Sequence
  chemically synthesized
tctaaaatgtgagcccatca

SEQ ID NO: 400605 - DNA, 20 bp, Artificial Sequence
  chemically synthesized
cctttgatgggctcacattt

SEQ ID NO: 400606 - DNA, 20 bp, Artificial Sequence
  chemically synthesized
tgaagaaagctctaaaatgt

SEQ ID NO: 400607 - DNA, 20 bp, Artificial Sequence
  chemically synthesized
tttgatgggctcacatttta

SEQ ID NO: 400608 - DNA, 20 bp, Artificial Sequence
  chemically synthesized
tctggtaacctttatgaaga

SEQ ID NO: 400609 - DNA, 20 bp, Artificial Sequence
  chemically synthesized
attttagagctttcttcata

SEQ ID NO: 400610 - DNA, 20 bp, Artificial Sequence
  chemically synthesized
ttttagagctttcttcataa

SEQ ID NO: 400611 - DNA, 20 bp, Artificial Sequence
  chemically synthesized
ggaatctggtaacctttatg

SEQ ID NO: 400612 - DNA, 20 bp, Artificial Sequence
  chemically synthesized
gctttcttcataaaggttac

SEQ ID NO: 400613 - DNA, 20 bp, Artificial Sequence
  chemically synthesized
aatctgagctagagggaatc

SEQ ID NO: 400614 - DNA, 20 bp, Artificial Sequence
  chemically synthesized
aaaggttaccagattccctc

SEQ ID NO: 400615 - DNA, 20 bp, Artificial Sequence
  chemically synthesized
ttaccagattccctctagct

SEQ ID NO: 400616 - DNA, 20 bp, Artificial Sequence
  chemically synthesized
aggcagtaatctgagctaga

SEQ ID NO: 400617 - DNA, 20 bp, Artificial Sequence
  chemically synthesized
aaggcagtaatctgagctag

SEQ ID NO: 400618 - DNA, 20 bp, Artificial Sequence
  chemically synthesized
gaaggcagtaatctgagcta

SEQ ID NO: 400619 - DNA, 20 bp, Artificial Sequence
  chemically synthesized
gagaaggcagtaatctgagc

SEQ ID NO: 400620 - DNA, 20 bp, Artificial Sequence
  chemically synthesized
gtctgagaaggcagtaatct

SEQ ID NO: 400621 - DNA, 20 bp, Artificial Sequence
  chemically synthesized
agctcagattactgccttct

SEQ ID NO: 400622 - DNA, 20 bp, Artificial Sequence
  chemically synthesized
gtgtgggtggtctgagaagg

SEQ ID NO: 400623 - DNA, 20 bp, Artificial Sequence
  chemically synthesized
tcagtgtgggtggtctgaga

SEQ ID NO: 400624 - DNA, 20 bp, Artificial Sequence
  chemically synthesized
ctcagtgtgggtggtctgag

SEQ ID NO: 400625 - DNA, 20 bp, Artificial Sequence
  chemically synthesized
gggctcagtgtgggtggtct

SEQ ID NO: 400626 - DNA, 20 bp, Artificial Sequence
  chemically synthesized
ctgagtgggctcagtgtggg

SEQ ID NO: 400627 - DNA, 20 bp, Artificial Sequence
  chemically synthesized
cttctcagaccacccacact

SEQ ID NO: 400628 - DNA, 20 bp, Artificial Sequence
  chemically synthesized
gaactgagtgggctcagtgt

SEQ ID NO: 400629 - DNA, 20 bp, Artificial Sequence
  chemically synthesized
agaactgagtgggctcagtg

SEQ ID NO: 400630 - DNA, 20 bp, Artificial Sequence
  chemically synthesized
gagttagaactgagtgggct

SEQ ID NO: 400631 - DNA, 20 bp, Artificial Sequence
  chemically synthesized
ccacccacactgagcccact

SEQ ID NO: 400632 - DNA, 20 bp, Artificial Sequence
  chemically synthesized
aaatggagttagaactgagt

SEQ ID NO: 400633 - DNA, 20 bp, Artificial Sequence
  chemically synthesized
taaatggagttagaactgag

SEQ ID NO: 400634 - DNA, 20 bp, Artificial Sequence
  chemically synthesized
tgataaatggagttagaact

SEQ ID NO: 400635 - DNA, 20 bp, Artificial Sequence
  chemically synthesized
ggttaattgataaatggagt

SEQ ID NO: 400636 - DNA, 20 bp, Artificial Sequence
  chemically synthesized
ttttggttaattgataaatg

SEQ ID NO: 400637 - DNA, 20 bp, Artificial Sequence
  chemically synthesized
gtttttggttaattgataaa

SEQ ID NO: 400638 - DNA, 20 bp, Artificial Sequence
  chemically synthesized
cacagttatttgggagtttt

SEQ ID NO: 400639 - DNA, 20 bp, Artificial Sequence
  chemically synthesized
gaacctacacagttatttgg

SEQ ID NO: 400640 - DNA, 20 bp, Artificial Sequence
  chemically synthesized
tggaacctacacagttattt

SEQ ID NO: 400641 - DNA, 20 bp, Artificial Sequence
  chemically synthesized
atggaacctacacagttatt

SEQ ID NO: 400642 - DNA, 20 bp, Artificial Sequence
  chemically synthesized
aaaactcccaaataactgtg

SEQ ID NO: 400643 - DNA, 20 bp, Artificial Sequence
  chemically synthesized
aaactcccaaataactgtgt

SEQ ID NO: 400644 - DNA, 20 bp, Artificial Sequence
  chemically synthesized
ctgaactcatggaacctaca

SEQ ID NO: 400645 - DNA, 20 bp, Artificial Sequence
  chemically synthesized
aataactgtgtaggttccat

SEQ ID NO: 400646 - DNA, 20 bp, Artificial Sequence
  chemically synthesized
ctgtgtaggttccatgagtt

SEQ ID NO: 400647 - DNA, 20 bp, Artificial Sequence
  chemically synthesized
tgtgtaggttccatgagttc

SEQ ID NO: 400648 - DNA, 20 bp, Artificial Sequence
  chemically synthesized
agtggaatctcctgaactca

SEQ ID NO: 400649 - DNA, 20 bp, Artificial Sequence
  chemically synthesized
tgtaggttccatgagttcag

SEQ ID NO: 400650 - DNA, 20 bp, Artificial Sequence
  chemically synthesized
gatacacagattagttgaag

SEQ ID NO: 400651 - DNA, 20 bp, Artificial Sequence
  chemically synthesized
taggatacacagattagttg

SEQ ID NO: 400652 - DNA, 20 bp, Artificial Sequence
  chemically synthesized
gccctgtaggatacacagat

SEQ ID NO: 400653 - DNA, 20 bp, Artificial Sequence
  chemically synthesized
ttctagccctgtaggataca

SEQ ID NO: 400654 - DNA, 20 bp, Artificial Sequence
  chemically synthesized
caactaatctgtgtatccta

SEQ ID NO: 400655 - DNA, 20 bp, Artificial Sequence
  chemically synthesized
aactaatctgtgtatcctac

SEQ ID NO: 400656 - DNA, 20 bp, Artificial Sequence
  chemically synthesized
actaatctgtgtatcctaca

SEQ ID NO: 400657 - DNA, 20 bp, Artificial Sequence
  chemically synthesized
atctgtgtatcctacagggc

SEQ ID NO: 400658 - DNA, 20 bp, Artificial Sequence
  chemically synthesized
cagcagaattctagccctgt

SEQ ID NO: 400659 - DNA, 20 bp, Artificial Sequence
  chemically synthesized
tcagcagaattctagccctg

SEQ ID NO: 400660 - DNA, 20 bp, Artificial Sequence
  chemically synthesized
catgcctttcagcagaattc

SEQ ID NO: 400661 - DNA, 20 bp, Artificial Sequence
  chemically synthesized
cagggctagaattctgctga

SEQ ID NO: 400662 - DNA, 20 bp, Artificial Sequence
  chemically synthesized
agggctagaattctgctgaa

SEQ ID NO: 400663 - DNA, 20 bp, Artificial Sequence
  chemically synthesized
catcgctgcatgcctttcag

SEQ ID NO: 400664 - DNA, 20 bp, Artificial Sequence
  chemically synthesized
ttgcatcgctgcatgccttt

SEQ ID NO: 400665 - DNA, 20 bp, Artificial Sequence
  chemically synthesized
gaattctgctgaaaggcatg

SEQ ID NO: 400666 - DNA, 20 bp, Artificial Sequence
  chemically synthesized
attgtgatatatatatcatt

SEQ ID NO: 400667 - DNA, 20 bp, Artificial Sequence
  chemically synthesized
tcacaattatgtttatcttt

SEQ ID NO: 400668 - DNA, 20 bp, Artificial Sequence
  chemically synthesized
aagccacttggtgaaaccaa

SEQ ID NO: 400669 - DNA, 20 bp, Artificial Sequence
  chemically synthesized
gtttatcttttggtttcacc

SEQ ID NO: 400670 - DNA, 20 bp, Artificial Sequence
  chemically synthesized
tatcttttggtttcaccaag

SEQ ID NO: 400671 - DNA, 20 bp, Artificial Sequence
  chemically synthesized
ttgattcagtttaagccact

SEQ ID NO: 400672 - DNA, 20 bp, Artificial Sequence
  chemically synthesized
gaagctagttgattcagttt

SEQ ID NO: 400673 - DNA, 20 bp, Artificial Sequence
  chemically synthesized
gtggcttaaactgaatcaac

SEQ ID NO: 400674 - DNA, 20 bp, Artificial Sequence
  chemically synthesized
ttagaggaagctagttgatt

SEQ ID NO: 400675 - DNA, 20 bp, Artificial Sequence
  chemically synthesized
gatgggaatttagaggaagc

SEQ ID NO: 400676 - DNA, 20 bp, Artificial Sequence
  chemically synthesized
agaagatgggaatttagagg

SEQ ID NO: 400677 - DNA, 20 bp, Artificial Sequence
  chemically synthesized
tgaagaagatgggaatttag

SEQ ID NO: 400678 - DNA, 20 bp, Artificial Sequence
  chemically synthesized
ttgaagaagatgggaattta

SEQ ID NO: 400679 - DNA, 20 bp, Artificial Sequence
  chemically synthesized
ttttgaagaagatgggaatt

SEQ ID NO: 400680 - DNA, 20 bp, Artificial Sequence
  chemically synthesized
tagacacttttgaagaagat

SEQ ID NO: 400681 - DNA, 20 bp, Artificial Sequence
  chemically synthesized
ttagacacttttgaagaaga

SEQ ID NO: 400682 - DNA, 20 bp, Artificial Sequence
  chemically synthesized
taaattcccatcttcttcaa

SEQ ID NO: 400683 - DNA, 20 bp, Artificial Sequence
  chemically synthesized
tcttttagacacttttgaag

SEQ ID NO: 400684 - DNA, 20 bp, Artificial Sequence
  chemically synthesized
cattcttttagacacttttg

SEQ ID NO: 400685 - DNA, 20 bp, Artificial Sequence
  chemically synthesized
tcttcttcaaaagtgtctaa

SEQ ID NO: 400686 - DNA, 20 bp, Artificial Sequence
  chemically synthesized
gctaagtgactgcattcttt

SEQ ID NO: 400687 - DNA, 20 bp, Artificial Sequence
  chemically synthesized
caaaagtgtctaaaagaatg

SEQ ID NO: 400688 - DNA, 20 bp, Artificial Sequence
  chemically synthesized
tctaaaagaatgcagtcact

SEQ ID NO: 400689 - DNA, 20 bp, Artificial Sequence
  chemically synthesized
aagaatgcagtcacttagct

SEQ ID NO: 400690 - DNA, 20 bp, Artificial Sequence
  chemically synthesized
ttttctgtcaaaacttagct

SEQ ID NO: 400691 - DNA, 20 bp, Artificial Sequence
  chemically synthesized
tattcttttctgtcaaaact

SEQ ID NO: 400692 - DNA, 20 bp, Artificial Sequence
  chemically synthesized
gtcacttagctaagttttga

SEQ ID NO: 400693 - DNA, 20 bp, Artificial Sequence
  chemically synthesized
ttagctaagttttgacagaa

SEQ ID NO: 400694 - DNA, 20 bp, Artificial Sequence
  chemically synthesized
aagttttgacagaaaagaat

SEQ ID NO: 400695 - DNA, 20 bp, Artificial Sequence
  chemically synthesized
ttgacagaaaagaataagaa

SEQ ID NO: 400696 - DNA, 20 bp, Artificial Sequence
  chemically synthesized
gacagaaaagaataagaaaa

SEQ ID NO: 400697 - DNA, 20 bp, Artificial Sequence
  chemically synthesized
acagaaaagaataagaaaag

SEQ ID NO: 400698 - DNA, 20 bp, Artificial Sequence
  chemically synthesized
aagaataagaaaagaggaaa

SEQ ID NO: 400699 - DNA, 20 bp, Artificial Sequence
  chemically synthesized
agaggaaaaagattctttgc

SEQ ID NO: 400700 - DNA, 20 bp, Artificial Sequence
  chemically synthesized
tctaattttgagaacttgca

SEQ ID NO: 400701 - DNA, 20 bp, Artificial Sequence
  chemically synthesized
tctttgcaagttctcaaaat

SEQ ID NO: 400702 - DNA, 20 bp, Artificial Sequence
  chemically synthesized
gtgcactaacttctaatttt

SEQ ID NO: 400703 - DNA, 20 bp, Artificial Sequence
  chemically synthesized
ttgcaagttctcaaaattag

SEQ ID NO: 400704 - DNA, 20 bp, Artificial Sequence
  chemically synthesized
aagttctcaaaattagaagt

SEQ ID NO: 400705 - DNA, 20 bp, Artificial Sequence
  chemically synthesized
caaaattagaagttagtgca

SEQ ID NO: 400706 - DNA, 20 bp, Artificial Sequence
  chemically synthesized
aaaattagaagttagtgcac

SEQ ID NO: 400707 - DNA, 20 bp, Artificial Sequence
  chemically synthesized
tatacattttacctttaaat

SEQ ID NO: 400708 - DNA, 20 bp, Artificial Sequence
  chemically synthesized
agaggagaaaacttatttaa

SEQ ID NO: 400709 - DNA, 20 bp, Artificial Sequence
  chemically synthesized
cagaggagaaaacttattta

SEQ ID NO: 400710 - DNA, 20 bp, Artificial Sequence
  chemically synthesized
aaaagtttacaaagacagag

SEQ ID NO: 400711 - DNA, 20 bp, Artificial Sequence
  chemically synthesized
ataaaagtttacaaagacag

SEQ ID NO: 400712 - DNA, 20 bp, Artificial Sequence
  chemically synthesized
aataaaagtttacaaagaca

SEQ ID NO: 400713 - DNA, 20 bp, Artificial Sequence
  chemically synthesized
gaaataaaagtttacaaaga

SEQ ID NO: 400714 - DNA, 20 bp, Artificial Sequence
  chemically synthesized
aatagaaataaaagtttaca

SEQ ID NO: 400715 - DNA, 20 bp, Artificial Sequence
  chemically synthesized
ggtgtcaggaatagaaataa

SEQ ID NO: 400716 - DNA, 20 bp, Artificial Sequence
  chemically synthesized
catatcctaggtgtcaggaa

SEQ ID NO: 400717 - DNA, 20 bp, Artificial Sequence
  chemically synthesized
ttatttctattcctgacacc

SEQ ID NO: 400718 - DNA, 20 bp, Artificial Sequence
  chemically synthesized
tatttctattcctgacacct

SEQ ID NO: 400719 - DNA, 20 bp, Artificial Sequence
  chemically synthesized
tcaagcatatcctaggtgtc

SEQ ID NO: 400720 - DNA, 20 bp, Artificial Sequence
  chemically synthesized
atcaagcatatcctaggtgt

SEQ ID NO: 400721 - DNA, 20 bp, Artificial Sequence
  chemically synthesized
tctattatcaagcatatcct

SEQ ID NO: 400722 - DNA, 20 bp, Artificial Sequence
  chemically synthesized
ttctattatcaagcatatcc

SEQ ID NO: 400723 - DNA, 20 bp, Artificial Sequence
  chemically synthesized
acctaggatatgcttgataa

SEQ ID NO: 400724 - DNA, 20 bp, Artificial Sequence
  chemically synthesized
agtacagaaattctattatc

SEQ ID NO: 400725 - DNA, 20 bp, Artificial Sequence
  chemically synthesized
aatagaatttctgtacttga

SEQ ID NO: 400726 - DNA, 20 bp, Artificial Sequence
  chemically synthesized
agtcaccattctttcaagta

SEQ ID NO: 400727 - DNA, 20 bp, Artificial Sequence
  chemically synthesized
aatttctgtacttgaaagaa

SEQ ID NO: 400728 - DNA, 20 bp, Artificial Sequence
  chemically synthesized
aggagagtcaccattctttc

SEQ ID NO: 400729 - DNA, 20 bp, Artificial Sequence
  chemically synthesized
agaatggtgactctcctgat

SEQ ID NO: 400730 - DNA, 20 bp, Artificial Sequence
  chemically synthesized
tctgttataactgatcagga

SEQ ID NO: 400731 - DNA, 20 bp, Artificial Sequence
  chemically synthesized
agtctgttataactgatcag

SEQ ID NO: 400732 - DNA, 20 bp, Artificial Sequence
  chemically synthesized
taagtctgttataactgatc

SEQ ID NO: 400733 - DNA, 20 bp, Artificial Sequence
  chemically synthesized
ctaagtctgttataactgat

SEQ ID NO: 400734 - DNA, 20 bp, Artificial Sequence
  chemically synthesized
actctcctgatcagttataa

SEQ ID NO: 400735 - DNA, 20 bp, Artificial Sequence
  chemically synthesized
ctgatcagttataacagact

SEQ ID NO: 400736 - DNA, 20 bp, Artificial Sequence
  chemically synthesized
tgatcagttataacagactt

SEQ ID NO: 400737 - DNA, 20 bp, Artificial Sequence
  chemically synthesized
gatcagttataacagactta

SEQ ID NO: 400738 - DNA, 20 bp, Artificial Sequence
  chemically synthesized
tcagttataacagacttagg

SEQ ID NO: 400739 - DNA, 20 bp, Artificial Sequence
  chemically synthesized
atattacaaatgttctccct

SEQ ID NO: 400740 - DNA, 20 bp, Artificial Sequence
  chemically synthesized
acatttgtaatataaatgaa

SEQ ID NO: 400741 - DNA, 20 bp, Artificial Sequence
  chemically synthesized
gtaatataaatgaaaagtgt

SEQ ID NO: 400742 - DNA, 20 bp, Artificial Sequence
  chemically synthesized
ataaatgaaaagtgtgagtt

SEQ ID NO: 400743 - DNA, 20 bp, Artificial Sequence
  chemically synthesized
atgaaaagtgtgagttgagt

SEQ ID NO: 400744 - DNA, 20 bp, Artificial Sequence
  chemically synthesized
gaaaagtgtgagttgagtta

SEQ ID NO: 400745 - DNA, 20 bp, Artificial Sequence
  chemically synthesized
aaaagtgtgagttgagttag

SEQ ID NO: 400746 - DNA, 20 bp, Artificial Sequence
  chemically synthesized
gttagaggatgcaaatattt

SEQ ID NO: 400747 - DNA, 20 bp, Artificial Sequence
  chemically synthesized
agaggatgcaaatattttgg

SEQ ID NO: 400748 - DNA, 20 bp, Artificial Sequence
  chemically synthesized
tgtaaaatattcacatatat

SEQ ID NO: 400749 - DNA, 20 bp, Artificial Sequence
  chemically synthesized
tcatatatgtgaatatttta

SEQ ID NO: 400750 - DNA, 20 bp, Artificial Sequence
  chemically synthesized
tgtgaatattttacagtttt

SEQ ID NO: 400751 - DNA, 20 bp, Artificial Sequence
  chemically synthesized
tattttacagttttaagata

SEQ ID NO: 400752 - DNA, 20 bp, Artificial Sequence
  chemically synthesized
attttacagttttaagatat

SEQ ID NO: 400753 - DNA, 20 bp, Artificial Sequence
  chemically synthesized
tttaagatatgggcattcat

SEQ ID NO: 400754 - DNA, 20 bp, Artificial Sequence
  chemically synthesized
ttaagatatgggcattcata

SEQ ID NO: 400755 - DNA, 20 bp, Artificial Sequence
  chemically synthesized
gatatgggcattcataagga

SEQ ID NO: 400756 - DNA, 20 bp, Artificial Sequence
  chemically synthesized
agcactgcctcagagcaatt

SEQ ID NO: 400757 - DNA, 20 bp, Artificial Sequence
  chemically synthesized
aaaatataccgaattgctct

SEQ ID NO: 400758 - DNA, 20 bp, Artificial Sequence
  chemically synthesized
aaatataccgaattgctctg

SEQ ID NO: 400759 - DNA, 20 bp, Artificial Sequence
  chemically synthesized
tataccgaattgctctgagg

SEQ ID NO: 400760 - DNA, 20 bp, Artificial Sequence
  chemically synthesized
atattgttagcactgcctca

SEQ ID NO: 400761 - DNA, 20 bp, Artificial Sequence
  chemically synthesized
atatattgttagcactgcct

SEQ ID NO: 400762 - DNA, 20 bp, Artificial Sequence
  chemically synthesized
atcctctatttatatattgt

SEQ ID NO: 400763 - DNA, 20 bp, Artificial Sequence
  chemically synthesized
cagtgctaacaatatataaa

SEQ ID NO: 400764 - DNA, 20 bp, Artificial Sequence
  chemically synthesized
gtgctaacaatatataaata

SEQ ID NO: 400765 - DNA, 20 bp, Artificial Sequence
  chemically synthesized
tgctaacaatatataaatag

SEQ ID NO: 400766 - DNA, 20 bp, Artificial Sequence
  chemically synthesized
aacaatatataaatagagga

SEQ ID NO: 400767 - DNA, 20 bp, Artificial Sequence
  chemically synthesized
tatataaatagaggatggat

SEQ ID NO: 400768 - DNA, 20 bp, Artificial Sequence
  chemically synthesized
tagaggatggattggatatc

SEQ ID NO: 400769 - DNA, 20 bp, Artificial Sequence
  chemically synthesized
acctgttaatatagaaatca

SEQ ID NO: 400770 - DNA, 20 bp, Artificial Sequence
  chemically synthesized
agctttgatttctatattaa

SEQ ID NO: 400771 - DNA, 20 bp, Artificial Sequence
  chemically synthesized
gctttgatttctatattaac

SEQ ID NO: 400772 - DNA, 20 bp, Artificial Sequence
  chemically synthesized
tcacaactcacctgttaata

SEQ ID NO: 400773 - DNA, 20 bp, Artificial Sequence
  chemically synthesized
tgatttctatattaacaggt

SEQ ID NO: 400774 - DNA, 20 bp, Artificial Sequence
  chemically synthesized
tgagttgtgataaatgataa

SEQ ID NO: 400775 - DNA, 20 bp, Artificial Sequence
  chemically synthesized
tgtgataaatgataatggaa

SEQ ID NO: 400776 - DNA, 20 bp, Artificial Sequence
  chemically synthesized
gtgataaatgataatggaaa

SEQ ID NO: 400777 - DNA, 20 bp, Artificial Sequence
  chemically synthesized
taatggaaaaggttaatgca

SEQ ID NO: 400778 - DNA, 20 bp, Artificial Sequence
  chemically synthesized
atggaaaaggttaatgcaca

SEQ ID NO: 400779 - DNA, 20 bp, Artificial Sequence
  chemically synthesized
aaaggttaatgcacagagcg

SEQ ID NO: 400780 - DNA, 20 bp, Artificial Sequence
  chemically synthesized
ctcattcccgcaagttgaaa

SEQ ID NO: 400781 - DNA, 20 bp, Artificial Sequence
  chemically synthesized
cgaagatctatttcaacttg

SEQ ID NO: 400782 - DNA, 20 bp, Artificial Sequence
  chemically synthesized
gaagatctatttcaacttgc

SEQ ID NO: 400783 - DNA, 20 bp, Artificial Sequence
  chemically synthesized
ctgtgtatcctcattcccgc

SEQ ID NO: 400784 - DNA, 20 bp, Artificial Sequence
  chemically synthesized
ctatttcaacttgcgggaat

SEQ ID NO: 400785 - DNA, 20 bp, Artificial Sequence
  chemically synthesized
tatttcaacttgcgggaatg

SEQ ID NO: 400786 - DNA, 20 bp, Artificial Sequence
  chemically synthesized
cttgcgggaatgaggataca

SEQ ID NO: 400787 - DNA, 20 bp, Artificial Sequence
  chemically synthesized
aaaaggtgtgtaaacatgac

SEQ ID NO: 400788 - DNA, 20 bp, Artificial Sequence
  chemically synthesized
gaactagagtaatttttaaa

SEQ ID NO: 400789 - DNA, 20 bp, Artificial Sequence
  chemically synthesized
tgaactagagtaatttttaa

SEQ ID NO: 400790 - DNA, 20 bp, Artificial Sequence
  chemically synthesized
acaccttttaaaaattactc

SEQ ID NO: 400791 - DNA, 20 bp, Artificial Sequence
  chemically synthesized
tgaatctttgaattgaacta

SEQ ID NO: 400792 - DNA, 20 bp, Artificial Sequence
  chemically synthesized
tctgaatctttgaattgaac

SEQ ID NO: 400793 - DNA, 20 bp, Artificial Sequence
  chemically synthesized
aattactctagttcaattca

SEQ ID NO: 400794 - DNA, 20 bp, Artificial Sequence
  chemically synthesized
tctagttcaattcaaagatt

SEQ ID NO: 400795 - DNA, 20 bp, Artificial Sequence
  chemically synthesized
tagttcaattcaaagattca

SEQ ID NO: 400796 - DNA, 20 bp, Artificial Sequence
  chemically synthesized
tattgttacatttactattt

SEQ ID NO: 400797 - DNA, 20 bp, Artificial Sequence
  chemically synthesized
tgtgaagaaattttctgaaa

SEQ ID NO: 400798 - DNA, 20 bp, Artificial Sequence
  chemically synthesized
acagacaaatcagaattgtg

SEQ ID NO: 400799 - DNA, 20 bp, Artificial Sequence
  chemically synthesized
aaacaaacatacagacaaat

SEQ ID NO: 400800 - DNA, 20 bp, Artificial Sequence
  chemically synthesized
catattttcaaacaaacata

SEQ ID NO: 400801 - DNA, 20 bp, Artificial Sequence
  chemically synthesized
tggaattctgaagcagacaa

SEQ ID NO: 400802 - DNA, 20 bp, Artificial Sequence
  chemically synthesized
tttggaattctgaagcagac

SEQ ID NO: 400803 - DNA, 20 bp, Artificial Sequence
  chemically synthesized
aatatgtctcttgtctgctt

SEQ ID NO: 400804 - DNA, 20 bp, Artificial Sequence
  chemically synthesized
taagttttggaattctgaag

SEQ ID NO: 400805 - DNA, 20 bp, Artificial Sequence
  chemically synthesized
ttttaagttttggaattctg

SEQ ID NO: 400806 - DNA, 20 bp, Artificial Sequence
  chemically synthesized
tcattgacatttttaagttt

SEQ ID NO: 400807 - DNA, 20 bp, Artificial Sequence
  chemically synthesized
ctggcatcattgacattttt

SEQ ID NO: 400808 - DNA, 20 bp, Artificial Sequence
  chemically synthesized
cttaaaaatgtcaatgatgc

SEQ ID NO: 400809 - DNA, 20 bp, Artificial Sequence
  chemically synthesized
gtcaatgatgccagtatata

SEQ ID NO: 400810 - DNA, 20 bp, Artificial Sequence
  chemically synthesized
agtttaattgctgtatatac

SEQ ID NO: 400811 - DNA, 20 bp, Artificial Sequence
  chemically synthesized
atttataagatggttatata

SEQ ID NO: 400812 - DNA, 20 bp, Artificial Sequence
  chemically synthesized
ttctccgaatatttataaga

SEQ ID NO: 400813 - DNA, 20 bp, Artificial Sequence
  chemically synthesized
ataattctccgaatatttat

SEQ ID NO: 400814 - DNA, 20 bp, Artificial Sequence
  chemically synthesized
ataaccatcttataaatatt

SEQ ID NO: 400815 - DNA, 20 bp, Artificial Sequence
  chemically synthesized
aaccatcttataaatattcg

SEQ ID NO: 400816 - DNA, 20 bp, Artificial Sequence
  chemically synthesized
taaacctaggatatttagga

SEQ ID NO: 400817 - DNA, 20 bp, Artificial Sequence
  chemically synthesized
aaagtaaacctaggatattt

SEQ ID NO: 400818 - DNA, 20 bp, Artificial Sequence
  chemically synthesized
aataactttcctaaatatcc

SEQ ID NO: 400819 - DNA, 20 bp, Artificial Sequence
  chemically synthesized
aaaagtaaacctaggatatt

SEQ ID NO: 400820 - DNA, 20 bp, Artificial Sequence
  chemically synthesized
ataactttcctaaatatcct

SEQ ID NO: 400821 - DNA, 20 bp, Artificial Sequence
  chemically synthesized
aataaataaaaagtaaacct

SEQ ID NO: 400822 - DNA, 20 bp, Artificial Sequence
  chemically synthesized
gaataaataaaaagtaaacc

SEQ ID NO: 400823 - DNA, 20 bp, Artificial Sequence
  chemically synthesized
aatatagaagaataaataaa

SEQ ID NO: 400824 - DNA, 20 bp, Artificial Sequence
  chemically synthesized
atataacaacacaaatatag

SEQ ID NO: 400825 - DNA, 20 bp, Artificial Sequence
  chemically synthesized
aaaatataacaacacaaata

SEQ ID NO: 400826 - DNA, 20 bp, Artificial Sequence
  chemically synthesized
ttgttatattttatttcact

SEQ ID NO: 400827 - DNA, 20 bp, Artificial Sequence
  chemically synthesized
atcctcaactttttttagct

SEQ ID NO: 400828 - DNA, 20 bp, Artificial Sequence
  chemically synthesized
ttatttcacttagctaaaaa

SEQ ID NO: 400829 - DNA, 20 bp, Artificial Sequence
  chemically synthesized
tttaaatcctcaactttttt

SEQ ID NO: 400830 - DNA, 20 bp, Artificial Sequence
  chemically synthesized
tcacttagctaaaaaaagtt

SEQ ID NO: 400831 - DNA, 20 bp, Artificial Sequence
  chemically synthesized
cacttagctaaaaaaagttg

SEQ ID NO: 400832 - DNA, 20 bp, Artificial Sequence
  chemically synthesized
atttctattacagacgtaaa

SEQ ID NO: 400833 - DNA, 20 bp, Artificial Sequence
  chemically synthesized
gtttctgtttacgtctgtaa

SEQ ID NO: 400834 - DNA, 20 bp, Artificial Sequence
  chemically synthesized
taattaacaaatttctatta

SEQ ID NO: 400835 - DNA, 20 bp, Artificial Sequence
  chemically synthesized
atagaaatttgttaattatt

SEQ ID NO: 400836 - DNA, 20 bp, Artificial Sequence
  chemically synthesized
aaatttgttaattattcagc

SEQ ID NO: 400837 - DNA, 20 bp, Artificial Sequence
  chemically synthesized
taaataaaatgaacttttat

SEQ ID NO: 400838 - DNA, 20 bp, Artificial Sequence
  chemically synthesized
tactgaattttaactaataa

SEQ ID NO: 400839 - DNA, 20 bp, Artificial Sequence
  chemically synthesized
aacttttattagttaaaatt

SEQ ID NO: 400840 - DNA, 20 bp, Artificial Sequence
  chemically synthesized
tttattagttaaaattcagt

SEQ ID NO: 400841 - DNA, 20 bp, Artificial Sequence
  chemically synthesized
aaattcagtaagttaaatta

SEQ ID NO: 400842 - DNA, 20 bp, Artificial Sequence
  chemically synthesized
attcagtaagttaaattaaa

SEQ ID NO: 400843 - DNA, 20 bp, Artificial Sequence
  chemically synthesized
aagttaaattaaagagtaca

SEQ ID NO: 400844 - DNA, 20 bp, Artificial Sequence
  chemically synthesized
ttctttgtggtatttggtag

SEQ ID NO: 400845 - DNA, 20 bp, Artificial Sequence
  chemically synthesized
ctattctttgtggtatttgg

SEQ ID NO: 400846 - DNA, 20 bp, Artificial Sequence
  chemically synthesized
cgtctattctttgtggtatt

SEQ ID NO: 400847 - DNA, 20 bp, Artificial Sequence
  chemically synthesized
ttctactaccaaataccaca

SEQ ID NO: 400848 - DNA, 20 bp, Artificial Sequence
  chemically synthesized
ctaccaaataccacaaagaa

SEQ ID NO: 400849 - DNA, 20 bp, Artificial Sequence
  chemically synthesized
agaatatcgtctattctttg

SEQ ID NO: 400850 - DNA, 20 bp, Artificial Sequence
  chemically synthesized
ttttctatgacaaacatttt

SEQ ID NO: 400851 - DNA, 20 bp, Artificial Sequence
  chemically synthesized
tattctaaaaatgtttgtca

SEQ ID NO: 400852 - DNA, 20 bp, Artificial Sequence
  chemically synthesized
taaaaatgtttgtcatagaa

SEQ ID NO: 400853 - DNA, 20 bp, Artificial Sequence
  chemically synthesized
aaaaatgtttgtcatagaaa

SEQ ID NO: 400854 - DNA, 20 bp, Artificial Sequence
  chemically synthesized
aaaatgtttgtcatagaaaa

SEQ ID NO: 400855 - DNA, 20 bp, Artificial Sequence
  chemically synthesized
aatgtttgtcatagaaaagg

SEQ ID NO: 400856 - DNA, 20 bp, Artificial Sequence
  chemically synthesized
atagaaaagggagaactttt

SEQ ID NO: 400857 - DNA, 20 bp, Artificial Sequence
  chemically synthesized
aaagggagaacttttgagat

SEQ ID NO: 400858 - DNA, 20 bp, Artificial Sequence
  chemically synthesized
actaggagatccaatctcaa

SEQ ID NO: 400859 - DNA, 20 bp, Artificial Sequence
  chemically synthesized
acttttgagattggatctcc

SEQ ID NO: 400860 - DNA, 20 bp, Artificial Sequence
  chemically synthesized
tttgagattggatctcctag

SEQ ID NO: 400861 - DNA, 20 bp, Artificial Sequence
  chemically synthesized
gagccaaaacaatccactag

SEQ ID NO: 400862 - DNA, 20 bp, Artificial Sequence
  chemically synthesized
tggagccaaaacaatccact

SEQ ID NO: 400863 - DNA, 20 bp, Artificial Sequence
  chemically synthesized
atggagccaaaacaatccac

SEQ ID NO: 400864 - DNA, 20 bp, Artificial Sequence
  chemically synthesized
gatctcctagtggattgttt

SEQ ID NO: 400865 - DNA, 20 bp, Artificial Sequence
  chemically synthesized
ttgtaaaattcatgataatg

SEQ ID NO: 400866 - DNA, 20 bp, Artificial Sequence
  chemically synthesized
ttttgtaaaattcatgataa

SEQ ID NO: 400867 - DNA, 20 bp, Artificial Sequence
  chemically synthesized
tatcatgaattttacaaaat

SEQ ID NO: 400868 - DNA, 20 bp, Artificial Sequence
  chemically synthesized
attttacaaaatcagaccca

SEQ ID NO: 400869 - DNA, 20 bp, Artificial Sequence
  chemically synthesized
tttacaaaatcagacccata

SEQ ID NO: 400870 - DNA, 20 bp, Artificial Sequence
  chemically synthesized
ttacaaaatcagacccatag

SEQ ID NO: 400871 - DNA, 20 bp, Artificial Sequence
  chemically synthesized
tacaaaatcagacccataga

SEQ ID NO: 400872 - DNA, 20 bp, Artificial Sequence
  chemically synthesized
caaaatcagacccatagagg

SEQ ID NO: 400873 - DNA, 20 bp, Artificial Sequence
  chemically synthesized
ctatgaattactccctctat

SEQ ID NO: 400874 - DNA, 20 bp, Artificial Sequence
  chemically synthesized
gctatgaattactccctcta

SEQ ID NO: 400875 - DNA, 20 bp, Artificial Sequence
  chemically synthesized
cccatagagggagtaattca

SEQ ID NO: 400876 - DNA, 20 bp, Artificial Sequence
  chemically synthesized
gggagtaattcatagctatt

SEQ ID NO: 400877 - DNA, 20 bp, Artificial Sequence
  chemically synthesized
gagtaattcatagctattaa

SEQ ID NO: 400878 - DNA, 20 bp, Artificial Sequence
  chemically synthesized
aaaatgcctgaaactcttaa

SEQ ID NO: 400879 - DNA, 20 bp, Artificial Sequence
  chemically synthesized
ttcatagctattaagagttt

SEQ ID NO: 400880 - DNA, 20 bp, Artificial Sequence
  chemically synthesized
tcatagctattaagagtttc

SEQ ID NO: 400881 - DNA, 20 bp, Artificial Sequence
  chemically synthesized
attaagagtttcaggcattt

SEQ ID NO: 400882 - DNA, 20 bp, Artificial Sequence
  chemically synthesized
aagagtttcaggcattttag

SEQ ID NO: 400883 - DNA, 20 bp, Artificial Sequence
  chemically synthesized
ttagtagaaattttcacttt

SEQ ID NO: 400884 - DNA, 20 bp, Artificial Sequence
  chemically synthesized
atgatttaaagagtcactaa

SEQ ID NO: 400885 - DNA, 20 bp, Artificial Sequence
  chemically synthesized
tcttattgtaatgatttaaa

SEQ ID NO: 400886 - DNA, 20 bp, Artificial Sequence
  chemically synthesized
tttcttattgtaatgattta

SEQ ID NO: 400887 - DNA, 20 bp, Artificial Sequence
  chemically synthesized
actctttaaatcattacaat

SEQ ID NO: 400888 - DNA, 20 bp, Artificial Sequence
  chemically synthesized
gagtggcatagttttgatag

SEQ ID NO: 400889 - DNA, 20 bp, Artificial Sequence
  chemically synthesized
taagagtggcatagttttga

SEQ ID NO: 400890 - DNA, 20 bp, Artificial Sequence
  chemically synthesized
ccaaggctttaagagtggca

SEQ ID NO: 400891 - DNA, 20 bp, Artificial Sequence
  chemically synthesized
tcaaaactatgccactctta

SEQ ID NO: 400892 - DNA, 20 bp, Artificial Sequence
  chemically synthesized
taaacccaaggctttaagag

SEQ ID NO: 400893 - DNA, 20 bp, Artificial Sequence
  chemically synthesized
ccttaaacccaaggctttaa

SEQ ID NO: 400894 - DNA, 20 bp, Artificial Sequence
  chemically synthesized
ctatgccactcttaaagcct

SEQ ID NO: 400895 - DNA, 20 bp, Artificial Sequence
  chemically synthesized
gcccttaaacccaaggcttt

SEQ ID NO: 400896 - DNA, 20 bp, Artificial Sequence
  chemically synthesized
tatgccactcttaaagcctt

SEQ ID NO: 400897 - DNA, 20 bp, Artificial Sequence
  chemically synthesized
actcttaaagccttgggttt

SEQ ID NO: 400898 - DNA, 20 bp, Artificial Sequence
  chemically synthesized
aaatatggcccttaaaccca

SEQ ID NO: 400899 - DNA, 20 bp, Artificial Sequence
  chemically synthesized
ctcttaaagccttgggttta

SEQ ID NO: 400900 - DNA, 20 bp, Artificial Sequence
  chemically synthesized
aaaatatggcccttaaaccc

SEQ ID NO: 400901 - DNA, 20 bp, Artificial Sequence
  chemically synthesized
tcttaaagccttgggtttaa

SEQ ID NO: 400902 - DNA, 20 bp, Artificial Sequence
  chemically synthesized
aaaataaagctaataaaata

SEQ ID NO: 400903 - DNA, 20 bp, Artificial Sequence
  chemically synthesized
gtttaagggccatattttat

SEQ ID NO: 400904 - DNA, 20 bp, Artificial Sequence
  chemically synthesized
atctagataatggaaaaata

SEQ ID NO: 400905 - DNA, 20 bp, Artificial Sequence
  chemically synthesized
agctttatttttccattatc

SEQ ID NO: 400906 - DNA, 20 bp, Artificial Sequence
  chemically synthesized
gagacatcaaatctagataa

SEQ ID NO: 400907 - DNA, 20 bp, Artificial Sequence
  chemically synthesized
cttaattgagacatcaaatc

SEQ ID NO: 400908 - DNA, 20 bp, Artificial Sequence
  chemically synthesized
ctagatttgatgtctcaatt

SEQ ID NO: 400909 - DNA, 20 bp, Artificial Sequence
  chemically synthesized
tatatattgattgcttaatt

SEQ ID NO: 400910 - DNA, 20 bp, Artificial Sequence
  chemically synthesized
acatatacaaacattcatga

SEQ ID NO: 400911 - DNA, 20 bp, Artificial Sequence
  chemically synthesized
aacattcatgatggaaacat

SEQ ID NO: 400912 - DNA, 20 bp, Artificial Sequence
  chemically synthesized
caatcaaatgtttggtgagt

SEQ ID NO: 400913 - DNA, 20 bp, Artificial Sequence
  chemically synthesized
aaatcaatcaaatgtttggt

SEQ ID NO: 400914 - DNA, 20 bp, Artificial Sequence
  chemically synthesized
gggtaaatcaatcaaatgtt

SEQ ID NO: 400915 - DNA, 20 bp, Artificial Sequence
  chemically synthesized
ttgattgatttacccaaatc

SEQ ID NO: 400916 - DNA, 20 bp, Artificial Sequence
  chemically synthesized
ttaattattattctcgattt

SEQ ID NO: 400917 - DNA, 20 bp, Artificial Sequence
  chemically synthesized
tttaattattattctcgatt

SEQ ID NO: 400918 - DNA, 20 bp, Artificial Sequence
  chemically synthesized
gagaataataattaaaatgc

SEQ ID NO: 400919 - DNA, 20 bp, Artificial Sequence
  chemically synthesized
attgggatgtcaaagtttaa

SEQ ID NO: 400920 - DNA, 20 bp, Artificial Sequence
  chemically synthesized
ggaggtttattgggatgtca

SEQ ID NO: 400921 - DNA, 20 bp, Artificial Sequence
  chemically synthesized
gcaatatatggaggtttatt

SEQ ID NO: 400922 - DNA, 20 bp, Artificial Sequence
  chemically synthesized
tgcaatatatggaggtttat

SEQ ID NO: 400923 - DNA, 20 bp, Artificial Sequence
  chemically synthesized
attaggaatgcaatatatgg

SEQ ID NO: 400924 - DNA, 20 bp, Artificial Sequence
  chemically synthesized
tattaggaatgcaatatatg

SEQ ID NO: 400925 - DNA, 20 bp, Artificial Sequence
  chemically synthesized
agtattaggaatgcaatata

SEQ ID NO: 400926 - DNA, 20 bp, Artificial Sequence
  chemically synthesized
atatattgcattcctaatac

SEQ ID NO: 400927 - DNA, 20 bp, Artificial Sequence
  chemically synthesized
ttaccttgaaaactagtatt

SEQ ID NO: 400928 - DNA, 20 bp, Artificial Sequence
  chemically synthesized
cttaccttgaaaactagtat

SEQ ID NO: 400929 - DNA, 20 bp, Artificial Sequence
  chemically synthesized
cattcctaatactagttttc

SEQ ID NO: 400930 - DNA, 20 bp, Artificial Sequence
  chemically synthesized
attcctaatactagttttca

SEQ ID NO: 400931 - DNA, 20 bp, Artificial Sequence
  chemically synthesized
gatattcttaccttgaaaac

SEQ ID NO: 400932 - DNA, 20 bp, Artificial Sequence
  chemically synthesized
ctaatactagttttcaaggt

SEQ ID NO: 400933 - DNA, 20 bp, Artificial Sequence
  chemically synthesized
attataggtggacacagagc

SEQ ID NO: 400934 - DNA, 20 bp, Artificial Sequence
  chemically synthesized
gatgattataggtggacaca

SEQ ID NO: 400935 - DNA, 20 bp, Artificial Sequence
  chemically synthesized
tagatgattataggtggaca

SEQ ID NO: 400936 - DNA, 20 bp, Artificial Sequence
  chemically synthesized
tgactctagatgattatagg

SEQ ID NO: 400937 - DNA, 20 bp, Artificial Sequence
  chemically synthesized
gcgtgactctagatgattat

SEQ ID NO: 400938 - DNA, 20 bp, Artificial Sequence
  chemically synthesized
agcgtgactctagatgatta

SEQ ID NO: 400939 - DNA, 20 bp, Artificial Sequence
  chemically synthesized
tgtgtccacctataatcatc

SEQ ID NO: 400940 - DNA, 20 bp, Artificial Sequence
  chemically synthesized
tgtccacctataatcatcta

SEQ ID NO: 400941 - DNA, 20 bp, Artificial Sequence
  chemically synthesized
tttaatcaatagcgtgactc

SEQ ID NO: 400942 - DNA, 20 bp, Artificial Sequence
  chemically synthesized
acaactcaatttttaatcaa

SEQ ID NO: 400943 - DNA, 20 bp, Artificial Sequence
  chemically synthesized
cacgctattgattaaaaatt

SEQ ID NO: 400944 - DNA, 20 bp, Artificial Sequence
  chemically synthesized
ttgagttgtatttgcaaatt

SEQ ID NO: 400945 - DNA, 20 bp, Artificial Sequence
  chemically synthesized
ttgcaaattaagtaaatatt

SEQ ID NO: 400946 - DNA, 20 bp, Artificial Sequence
  chemically synthesized
gcaaattaagtaaatattaa

SEQ ID NO: 400947 - DNA, 20 bp, Artificial Sequence
  chemically synthesized
ttaagtaaatattaagagta

SEQ ID NO: 400948 - DNA, 20 bp, Artificial Sequence
  chemically synthesized
aatattaagagtatggattg

SEQ ID NO: 400949 - DNA, 20 bp, Artificial Sequence
  chemically synthesized
agttcatcttgtttttgtgc

SEQ ID NO: 400950 - DNA, 20 bp, Artificial Sequence
  chemically synthesized
aagttcatcttgtttttgtg

SEQ ID NO: 400951 - DNA, 20 bp, Artificial Sequence
  chemically synthesized
attgaagcctgcacaaaaac

SEQ ID NO: 400952 - DNA, 20 bp, Artificial Sequence
  chemically synthesized
ttcaaatgattaaagacaat

SEQ ID NO: 400953 - DNA, 20 bp, Artificial Sequence
  chemically synthesized
gagcatatttcaaatgatta

SEQ ID NO: 400954 - DNA, 20 bp, Artificial Sequence
  chemically synthesized
ttgaaatatgctctaaacta

SEQ ID NO: 400955 - DNA, 20 bp, Artificial Sequence
  chemically synthesized
tattcagccactatagttta

SEQ ID NO: 400956 - DNA, 20 bp, Artificial Sequence
  chemically synthesized
tgtattcagccactatagtt

SEQ ID NO: 400957 - DNA, 20 bp, Artificial Sequence
  chemically synthesized
aaatatgctctaaactatag

SEQ ID NO: 400958 - DNA, 20 bp, Artificial Sequence
  chemically synthesized
ttgggtgtattcagccacta

SEQ ID NO: 400959 - DNA, 20 bp, Artificial Sequence
  chemically synthesized
ataattgctttgggtgtatt

SEQ ID NO: 400960 - DNA, 20 bp, Artificial Sequence
  chemically synthesized
atagtggctgaatacaccca

SEQ ID NO: 400961 - DNA, 20 bp, Artificial Sequence
  chemically synthesized
aaaagcaatataattgcttt

SEQ ID NO: 400962 - DNA, 20 bp, Artificial Sequence
  chemically synthesized
gaaaagcaatataattgctt

SEQ ID NO: 400963 - DNA, 20 bp, Artificial Sequence
  chemically synthesized
gtctttaccaagttcaagaa

SEQ ID NO: 400964 - DNA, 20 bp, Artificial Sequence
  chemically synthesized
tatattgcttttcttgaact

SEQ ID NO: 400965 - DNA, 20 bp, Artificial Sequence
  chemically synthesized
tcttggtctttaccaagttc

SEQ ID NO: 400966 - DNA, 20 bp, Artificial Sequence
  chemically synthesized
tgcttttcttgaacttggta

SEQ ID NO: 400967 - DNA, 20 bp, Artificial Sequence
  chemically synthesized
tgtccctcttggtctttacc

SEQ ID NO: 400968 - DNA, 20 bp, Artificial Sequence
  chemically synthesized
tcttgaacttggtaaagacc

SEQ ID NO: 400969 - DNA, 20 bp, Artificial Sequence
  chemically synthesized
ttgaacttggtaaagaccaa

SEQ ID NO: 400970 - DNA, 20 bp, Artificial Sequence
  chemically synthesized
tgaacttggtaaagaccaag

SEQ ID NO: 400971 - DNA, 20 bp, Artificial Sequence
  chemically synthesized
gaacttggtaaagaccaaga

SEQ ID NO: 400972 - DNA, 20 bp, Artificial Sequence
  chemically synthesized
tatcatttttttgtccctct

SEQ ID NO: 400973 - DNA, 20 bp, Artificial Sequence
  chemically synthesized
cccagcagaagaagatatga

SEQ ID NO: 400974 - DNA, 20 bp, Artificial Sequence
  chemically synthesized
acccagcagaagaagatatg

SEQ ID NO: 400975 - DNA, 20 bp, Artificial Sequence
  chemically synthesized
cacccagcagaagaagatat

SEQ ID NO: 400976 - DNA, 20 bp, Artificial Sequence
  chemically synthesized
tccctcatatcttcttctgc

SEQ ID NO: 400977 - DNA, 20 bp, Artificial Sequence
  chemically synthesized
aatatgtcacccagcagaag

SEQ ID NO: 400978 - DNA, 20 bp, Artificial Sequence
  chemically synthesized
ccctcatatcttcttctgct

SEQ ID NO: 400979 - DNA, 20 bp, Artificial Sequence
  chemically synthesized
tagaatatgtcacccagcag

SEQ ID NO: 400980 - DNA, 20 bp, Artificial Sequence
  chemically synthesized
agctagaatatgtcacccag

SEQ ID NO: 400981 - DNA, 20 bp, Artificial Sequence
  chemically synthesized
agtagctagaatatgtcacc

SEQ ID NO: 400982 - DNA, 20 bp, Artificial Sequence
  chemically synthesized
ttctgctgggtgacatattc

SEQ ID NO: 400983 - DNA, 20 bp, Artificial Sequence
  chemically synthesized
gcaatcttccatcaagtagc

SEQ ID NO: 400984 - DNA, 20 bp, Artificial Sequence
  chemically synthesized
gacatattctagctacttga

SEQ ID NO: 400985 - DNA, 20 bp, Artificial Sequence
  chemically synthesized
agctgcaatcttccatcaag

SEQ ID NO: 400986 - DNA, 20 bp, Artificial Sequence
  chemically synthesized
atattctagctacttgatgg

SEQ ID NO: 400987 - DNA, 20 bp, Artificial Sequence
  chemically synthesized
tatagctgcaatcttccatc

SEQ ID NO: 400988 - DNA, 20 bp, Artificial Sequence
  chemically synthesized
agctacttgatggaagattg

SEQ ID NO: 400989 - DNA, 20 bp, Artificial Sequence
  chemically synthesized
acatgagtcctcagagttta

SEQ ID NO: 400990 - DNA, 20 bp, Artificial Sequence
  chemically synthesized
agattgcagctataaactct

SEQ ID NO: 400991 - DNA, 20 bp, Artificial Sequence
  chemically synthesized
gattgcagctataaactctg

SEQ ID NO: 400992 - DNA, 20 bp, Artificial Sequence
  chemically synthesized
tttaatgacatgagtcctca

SEQ ID NO: 400993 - DNA, 20 bp, Artificial Sequence
  chemically synthesized
tctttaatgacatgagtcct

SEQ ID NO: 400994 - DNA, 20 bp, Artificial Sequence
  chemically synthesized
gtgagtttctttaatgacat

SEQ ID NO: 400995 - DNA, 20 bp, Artificial Sequence
  chemically synthesized
tctgaggactcatgtcatta

SEQ ID NO: 400996 - DNA, 20 bp, Artificial Sequence
  chemically synthesized
ttgattcttcttgacaatgt

SEQ ID NO: 400997 - DNA, 20 bp, Artificial Sequence
  chemically synthesized
ttaaagaaactcacattgtc

SEQ ID NO: 400998 - DNA, 20 bp, Artificial Sequence
  chemically synthesized
aagaaactcacattgtcaag

SEQ ID NO: 400999 - DNA, 20 bp, Artificial Sequence
  chemically synthesized
cacattgtcaagaagaatca

SEQ ID NO: 401000 - DNA, 20 bp, Artificial Sequence
  chemically synthesized
atacattttatataattaaa

SEQ ID NO: 401001 - DNA, 20 bp, Artificial Sequence
  chemically synthesized
aagcagcagaagatatggca

SEQ ID NO: 401002 - DNA, 20 bp, Artificial Sequence
  chemically synthesized
ggagtaagcagcagaagata

SEQ ID NO: 401003 - DNA, 20 bp, Artificial Sequence
  chemically synthesized
atttaaggagtaagcagcag

SEQ ID NO: 401004 - DNA, 20 bp, Artificial Sequence
  chemically synthesized
cttatttaaggagtaagcag

SEQ ID NO: 401005 - DNA, 20 bp, Artificial Sequence
  chemically synthesized
actcttatttaaggagtaag

SEQ ID NO: 401006 - DNA, 20 bp, Artificial Sequence
  chemically synthesized
ttcactcttatttaaggagt

SEQ ID NO: 401007 - DNA, 20 bp, Artificial Sequence
  chemically synthesized
ctgctgcttactccttaaat

SEQ ID NO: 401008 - DNA, 20 bp, Artificial Sequence
  chemically synthesized
tatgttcactcttatttaag

SEQ ID NO: 401009 - DNA, 20 bp, Artificial Sequence
  chemically synthesized
gctgcttactccttaaataa

SEQ ID NO: 401010 - DNA, 20 bp, Artificial Sequence
  chemically synthesized
attatgttcactcttattta

SEQ ID NO: 401011 - DNA, 20 bp, Artificial Sequence
  chemically synthesized
tattatgttcactcttattt

SEQ ID NO: 401012 - DNA, 20 bp, Artificial Sequence
  chemically synthesized
aagagtgaacataatatttc

SEQ ID NO: 401013 - DNA, 20 bp, Artificial Sequence
  chemically synthesized
ttattttagctgtgcaaatc

SEQ ID NO: 401014 - DNA, 20 bp, Artificial Sequence
  chemically synthesized
ataatatttccagatttgca

SEQ ID NO: 401015 - DNA, 20 bp, Artificial Sequence
  chemically synthesized
ctcatagtgtcattttattt

SEQ ID NO: 401016 - DNA, 20 bp, Artificial Sequence
  chemically synthesized
ctaaaataaaatgacactat

SEQ ID NO: 401017 - DNA, 20 bp, Artificial Sequence
  chemically synthesized
aaaataaaatgacactatga

SEQ ID NO: 401018 - DNA, 20 bp, Artificial Sequence
  chemically synthesized
aatccgttttatttctctca

SEQ ID NO: 401019 - DNA, 20 bp, Artificial Sequence
  chemically synthesized
acactatgagagaaataaaa

SEQ ID NO: 401020 - DNA, 20 bp, Artificial Sequence
  chemically synthesized
gagaaataaaacggattttt

SEQ ID NO: 401021 - DNA, 20 bp, Artificial Sequence
  chemically synthesized
aaacggatttttaagataca

SEQ ID NO: 401022 - DNA, 20 bp, Artificial Sequence
  chemically synthesized
aacggatttttaagatacac

SEQ ID NO: 401023 - DNA, 20 bp, Artificial Sequence
  chemically synthesized
ttttaagatacacaggtaca

SEQ ID NO: 401024 - DNA, 20 bp, Artificial Sequence
  chemically synthesized
aagttgtgaaattttcaaaa

SEQ ID NO: 401025 - DNA, 20 bp, Artificial Sequence
  chemically synthesized
attttgaaaatttcacaact

SEQ ID NO: 401026 - DNA, 20 bp, Artificial Sequence
  chemically synthesized
ttactttacttttaagatct

SEQ ID NO: 401027 - DNA, 20 bp, Artificial Sequence
  chemically synthesized
tttcacaacttagatcttaa

SEQ ID NO: 401028 - DNA, 20 bp, Artificial Sequence
  chemically synthesized
caacttagatcttaaaagta

SEQ ID NO: 401029 - DNA, 20 bp, Artificial Sequence
  chemically synthesized
tggtttgttactttactttt

SEQ ID NO: 401030 - DNA, 20 bp, Artificial Sequence
  chemically synthesized
acaattttctaaggtaagaa

SEQ ID NO: 401031 - DNA, 20 bp, Artificial Sequence
  chemically synthesized
gtaacaaaccattcttacct

SEQ ID NO: 401032 - DNA, 20 bp, Artificial Sequence
  chemically synthesized
aatgcacaattttctaaggt

SEQ ID NO: 401033 - DNA, 20 bp, Artificial Sequence
  chemically synthesized
ggtaaatgcacaattttcta

SEQ ID NO: 401034 - DNA, 20 bp, Artificial Sequence
  chemically synthesized
gggtaaatgcacaattttct

SEQ ID NO: 401035 - DNA, 20 bp, Artificial Sequence
  chemically synthesized
aaagaaaacattcacaaaat

SEQ ID NO: 401036 - DNA, 20 bp, Artificial Sequence
  chemically synthesized
aaaagaaaacattcacaaaa

SEQ ID NO: 401037 - DNA, 20 bp, Artificial Sequence
  chemically synthesized
atgaaagagaagatgttcaa

SEQ ID NO: 401038 - DNA, 20 bp, Artificial Sequence
  chemically synthesized
ttgcattttagatgaaagag

SEQ ID NO: 401039 - DNA, 20 bp, Artificial Sequence
  chemically synthesized
attttgcattttagatgaaa

SEQ ID NO: 401040 - DNA, 20 bp, Artificial Sequence
  chemically synthesized
ttattttgcattttagatga

SEQ ID NO: 401041 - DNA, 20 bp, Artificial Sequence
  chemically synthesized
tatttttttattttgcattt

SEQ ID NO: 401042 - DNA, 20 bp, Artificial Sequence
  chemically synthesized
aatgcaaaataaaaaaataa

SEQ ID NO: 401043 - DNA, 20 bp, Artificial Sequence
  chemically synthesized
caaaataaaaaaataaaagt

SEQ ID NO: 401044 - DNA, 20 bp, Artificial Sequence
  chemically synthesized
aaaataaaaaaataaaagtt

SEQ ID NO: 401045 - DNA, 20 bp, Artificial Sequence
  chemically synthesized
ataaaaaaataaaagttagg

SEQ ID NO: 401046 - DNA, 20 bp, Artificial Sequence
  chemically synthesized
taaaatatgaattatattta

SEQ ID NO: 401047 - DNA, 20 bp, Artificial Sequence
  chemically synthesized
taattcatattttacaacca

SEQ ID NO: 401048 - DNA, 20 bp, Artificial Sequence
  chemically synthesized
atcataatggaaagttactt

SEQ ID NO: 401049 - DNA, 20 bp, Artificial Sequence
  chemically synthesized
cactaacacatcataatgga

SEQ ID NO: 401050 - DNA, 20 bp, Artificial Sequence
  chemically synthesized
aaaacactaacacatcataa

SEQ ID NO: 401051 - DNA, 20 bp, Artificial Sequence
  chemically synthesized
aactttccattatgatgtgt

SEQ ID NO: 401052 - DNA, 20 bp, Artificial Sequence
  chemically synthesized
tgttagtgtttttttacatt

SEQ ID NO: 401053 - DNA, 20 bp, Artificial Sequence
  chemically synthesized
gtattacattcattgataaa

SEQ ID NO: 401054 - DNA, 20 bp, Artificial Sequence
  chemically synthesized
tgataaatggaattaaacat

SEQ ID NO: 401055 - DNA, 20 bp, Artificial Sequence
  chemically synthesized
gaattaaacatgagtgatgc

SEQ ID NO: 401056 - DNA, 20 bp, Artificial Sequence
  chemically synthesized
aaacatgagtgatgctggtt

SEQ ID NO: 401057 - DNA, 20 bp, Artificial Sequence
  chemically synthesized
aacatgagtgatgctggttt

SEQ ID NO: 401058 - DNA, 20 bp, Artificial Sequence
  chemically synthesized
acatgagtgatgctggtttg

SEQ ID NO: 401059 - DNA, 20 bp, Artificial Sequence
  chemically synthesized
ttaatttggatgccccaaac

SEQ ID NO: 401060 - DNA, 20 bp, Artificial Sequence
  chemically synthesized
tttcagaagtaattttaatt

SEQ ID NO: 401061 - DNA, 20 bp, Artificial Sequence
  chemically synthesized
cgcgcctggccatttttcag

SEQ ID NO: 401062 - DNA, 20 bp, Artificial Sequence
  chemically synthesized
ttaaaattacttctgaaaaa

SEQ ID NO: 401063 - DNA, 20 bp, Artificial Sequence
  chemically synthesized
caccgcgcctggccattttt

SEQ ID NO: 401064 - DNA, 20 bp, Artificial Sequence
  chemically synthesized
aattacttctgaaaaatggc

SEQ ID NO: 401065 - DNA, 20 bp, Artificial Sequence
  chemically synthesized
attacttctgaaaaatggcc

SEQ ID NO: 401066 - DNA, 20 bp, Artificial Sequence
  chemically synthesized
ttctgaaaaatggccaggcg

SEQ ID NO: 401067 - DNA, 20 bp, Artificial Sequence
  chemically synthesized
tgaaaaatggccaggcgcgg

SEQ ID NO: 401068 - DNA, 20 bp, Artificial Sequence
  chemically synthesized
caggcgtgagccaccgcgcc

SEQ ID NO: 401069 - DNA, 20 bp, Artificial Sequence
  chemically synthesized
actgttgggatcacaggcgt

SEQ ID NO: 401070 - DNA, 20 bp, Artificial Sequence
  chemically synthesized
tcccaaactgttgggatcac

SEQ ID NO: 401071 - DNA, 20 bp, Artificial Sequence
  chemically synthesized
ctcccaaactgttgggatca

SEQ ID NO: 401072 - DNA, 20 bp, Artificial Sequence
  chemically synthesized
gctcacgcctgtgatcccaa

SEQ ID NO: 401073 - DNA, 20 bp, Artificial Sequence
  chemically synthesized
cgcctgtgatcccaacagtt

SEQ ID NO: 401074 - DNA, 20 bp, Artificial Sequence
  chemically synthesized
cactggcctcccaaactgtt

SEQ ID NO: 401075 - DNA, 20 bp, Artificial Sequence
  chemically synthesized
gcctgtgatcccaacagttt

SEQ ID NO: 401076 - DNA, 20 bp, Artificial Sequence
  chemically synthesized
tcactggcctcccaaactgt

SEQ ID NO: 401077 - DNA, 20 bp, Artificial Sequence
  chemically synthesized
ctgtgatcccaacagtttgg

SEQ ID NO: 401078 - DNA, 20 bp, Artificial Sequence
  chemically synthesized
tgtgatcccaacagtttggg

SEQ ID NO: 401079 - DNA, 20 bp, Artificial Sequence
  chemically synthesized
atcccaacagtttgggaggc

SEQ ID NO: 401080 - DNA, 20 bp, Artificial Sequence
  chemically synthesized
caacagtttgggaggccagt

SEQ ID NO: 401081 - DNA, 20 bp, Artificial Sequence
  chemically synthesized
aacagtttgggaggccagtg

SEQ ID NO: 401082 - DNA, 20 bp, Artificial Sequence
  chemically synthesized
gtttgggaggccagtgagga

SEQ ID NO: 401083 - DNA, 20 bp, Artificial Sequence
  chemically synthesized
ctcaagtgatccgtcctcac

SEQ ID NO: 401084 - DNA, 20 bp, Artificial Sequence
  chemically synthesized
ccagtgaggacggatcactt

SEQ ID NO: 401085 - DNA, 20 bp, Artificial Sequence
  chemically synthesized
cagtgaggacggatcacttg

SEQ ID NO: 401086 - DNA, 20 bp, Artificial Sequence
  chemically synthesized
gaggacggatcacttgaggc

SEQ ID NO: 401087 - DNA, 20 bp, Artificial Sequence
  chemically synthesized
ggtctcaaactactggcctc

SEQ ID NO: 401088 - DNA, 20 bp, Artificial Sequence
  chemically synthesized
gacggatcacttgaggccag

SEQ ID NO: 401089 - DNA, 20 bp, Artificial Sequence
  chemically synthesized
tcacttgaggccagtagttt

SEQ ID NO: 401090 - DNA, 20 bp, Artificial Sequence
  chemically synthesized
cctggctggtctcaaactac

SEQ ID NO: 401091 - DNA, 20 bp, Artificial Sequence
  chemically synthesized
tgaggccagtagtttgagac

SEQ ID NO: 401092 - DNA, 20 bp, Artificial Sequence
  chemically synthesized
gccagtagtttgagaccagc

SEQ ID NO: 401093 - DNA, 20 bp, Artificial Sequence
  chemically synthesized
ccagtagtttgagaccagcc

SEQ ID NO: 401094 - DNA, 20 bp, Artificial Sequence
  chemically synthesized
tttcgccatgttggcctggc

SEQ ID NO: 401095 - DNA, 20 bp, Artificial Sequence
  chemically synthesized
ggggtttcgccatgttggcc

SEQ ID NO: 401096 - DNA, 20 bp, Artificial Sequence
  chemically synthesized
tgagaccagccaggccaaca

SEQ ID NO: 401097 - DNA, 20 bp, Artificial Sequence
  chemically synthesized
gagatggggtttcgccatgt

SEQ ID NO: 401098 - DNA, 20 bp, Artificial Sequence
  chemically synthesized
ttgtattttcagtagagatg

SEQ ID NO: 401099 - DNA, 20 bp, Artificial Sequence
  chemically synthesized
tttgtattttcagtagagat

SEQ ID NO: 401100 - DNA, 20 bp, Artificial Sequence
  chemically synthesized
ttttgtattttcagtagaga

SEQ ID NO: 401101 - DNA, 20 bp, Artificial Sequence
  chemically synthesized
taatttttgtattttcagta

SEQ ID NO: 401102 - DNA, 20 bp, Artificial Sequence
  chemically synthesized
gctaatttttgtattttcag

SEQ ID NO: 401103 - DNA, 20 bp, Artificial Sequence
  chemically synthesized
ctggctaatttttgtatttt

SEQ ID NO: 401104 - DNA, 20 bp, Artificial Sequence
  chemically synthesized
tctactgaaaatacaaaaat

SEQ ID NO: 401105 - DNA, 20 bp, Artificial Sequence
  chemically synthesized
ctgaaaatacaaaaattagc

SEQ ID NO: 401106 - DNA, 20 bp, Artificial Sequence
  chemically synthesized
tgaaaatacaaaaattagcc

SEQ ID NO: 401107 - DNA, 20 bp, Artificial Sequence
  chemically synthesized
atacaaaaattagccaggca

SEQ ID NO: 401108 - DNA, 20 bp, Artificial Sequence
  chemically synthesized
caaaaattagccaggcatgg

SEQ ID NO: 401109 - DNA, 20 bp, Artificial Sequence
  chemically synthesized
caggtgcatgccaccatgcc

SEQ ID NO: 401110 - DNA, 20 bp, Artificial Sequence
  chemically synthesized
gtggcatgcacctgtaatcc

SEQ ID NO: 401111 - DNA, 20 bp, Artificial Sequence
  chemically synthesized
tcccaagtagctgggattac

SEQ ID NO: 401112 - DNA, 20 bp, Artificial Sequence
  chemically synthesized
ctcccaagtagctgggatta

SEQ ID NO: 401113 - DNA, 20 bp, Artificial Sequence
  chemically synthesized
cacctgtaatcccagctact

SEQ ID NO: 401114 - DNA, 20 bp, Artificial Sequence
  chemically synthesized
cctcagcctcccaagtagct

SEQ ID NO: 401115 - DNA, 20 bp, Artificial Sequence
  chemically synthesized
acctgtaatcccagctactt

SEQ ID NO: 401116 - DNA, 20 bp, Artificial Sequence
  chemically synthesized
gcctcagcctcccaagtagc

SEQ ID NO: 401117 - DNA, 20 bp, Artificial Sequence
  chemically synthesized
ctgtaatcccagctacttgg

SEQ ID NO: 401118 - DNA, 20 bp, Artificial Sequence
  chemically synthesized
tgtaatcccagctacttggg

SEQ ID NO: 401119 - DNA, 20 bp, Artificial Sequence
  chemically synthesized
tcctgcctcagcctcccaag

SEQ ID NO: 401120 - DNA, 20 bp, Artificial Sequence
  chemically synthesized
ttctcctgcctcagcctccc

SEQ ID NO: 401121 - DNA, 20 bp, Artificial Sequence
  chemically synthesized
tcccagctacttgggaggct

SEQ ID NO: 401122 - DNA, 20 bp, Artificial Sequence
  chemically synthesized
cccagctacttgggaggctg

SEQ ID NO: 401123 - DNA, 20 bp, Artificial Sequence
  chemically synthesized
agctacttgggaggctgagg

SEQ ID NO: 401124 - DNA, 20 bp, Artificial Sequence
  chemically synthesized
gctacttgggaggctgaggc

SEQ ID NO: 401125 - DNA, 20 bp, Artificial Sequence
  chemically synthesized
tacttgggaggctgaggcag

SEQ ID NO: 401126 - DNA, 20 bp, Artificial Sequence
  chemically synthesized
ttcaaatgattctcctgcct

SEQ ID NO: 401127 - DNA, 20 bp, Artificial Sequence
  chemically synthesized
gcaggagaatcatttgaatc

SEQ ID NO: 401128 - DNA, 20 bp, Artificial Sequence
  chemically synthesized
caggagaatcatttgaatcc

SEQ ID NO: 401129 - DNA, 20 bp, Artificial Sequence
  chemically synthesized
ggagaatcatttgaatccag

SEQ ID NO: 401130 - DNA, 20 bp, Artificial Sequence
  chemically synthesized
gagaatcatttgaatccagg

SEQ ID NO: 401131 - DNA, 20 bp, Artificial Sequence
  chemically synthesized
aatcatttgaatccaggagg

SEQ ID NO: 401132 - DNA, 20 bp, Artificial Sequence
  chemically synthesized
tcatttgaatccaggaggtg

SEQ ID NO: 401133 - DNA, 20 bp, Artificial Sequence
  chemically synthesized
tcactgcaacctccacctcc

SEQ ID NO: 401134 - DNA, 20 bp, Artificial Sequence
  chemically synthesized
catttgaatccaggaggtgg

SEQ ID NO: 401135 - DNA, 20 bp, Artificial Sequence
  chemically synthesized
aatccaggaggtggaggttg

SEQ ID NO: 401136 - DNA, 20 bp, Artificial Sequence
  chemically synthesized
caggaggtggaggttgcagt

SEQ ID NO: 401137 - DNA, 20 bp, Artificial Sequence
  chemically synthesized
ggtggaggttgcagtgagcc

SEQ ID NO: 401138 - DNA, 20 bp, Artificial Sequence
  chemically synthesized
gttgcagtgagccgagatca

SEQ ID NO: 401139 - DNA, 20 bp, Artificial Sequence
  chemically synthesized
ggagtgcagtgccatgatct

SEQ ID NO: 401140 - DNA, 20 bp, Artificial Sequence
  chemically synthesized
gagatcatggcactgcactc

SEQ ID NO: 401141 - DNA, 20 bp, Artificial Sequence
  chemically synthesized
ctgtcgcccacgctggagtg

SEQ ID NO: 401142 - DNA, 20 bp, Artificial Sequence
  chemically synthesized
catggcactgcactccagcg

SEQ ID NO: 401143 - DNA, 20 bp, Artificial Sequence
  chemically synthesized
atggcactgcactccagcgt

SEQ ID NO: 401144 - DNA, 20 bp, Artificial Sequence
  chemically synthesized
ttgctctgtcgcccacgctg

SEQ ID NO: 401145 - DNA, 20 bp, Artificial Sequence
  chemically synthesized
tcttgctctgtcgcccacgc

SEQ ID NO: 401146 - DNA, 20 bp, Artificial Sequence
  chemically synthesized
ctgcactccagcgtgggcga

SEQ ID NO: 401147 - DNA, 20 bp, Artificial Sequence
  chemically synthesized
gcactccagcgtgggcgaca

SEQ ID NO: 401148 - DNA, 20 bp, Artificial Sequence
  chemically synthesized
tccagcgtgggcgacagagc

SEQ ID NO: 401149 - DNA, 20 bp, Artificial Sequence
  chemically synthesized
gacagagcaagatcccgcct

SEQ ID NO: 401150 - DNA, 20 bp, Artificial Sequence
  chemically synthesized
agatattacaaatctgaggc

SEQ ID NO: 401151 - DNA, 20 bp, Artificial Sequence
  chemically synthesized
cagatattacaaatctgagg

SEQ ID NO: 401152 - DNA, 20 bp, Artificial Sequence
  chemically synthesized
tttcagatattacaaatctg

SEQ ID NO: 401153 - DNA, 20 bp, Artificial Sequence
  chemically synthesized
ttttcagatattacaaatct

SEQ ID NO: 401154 - DNA, 20 bp, Artificial Sequence
  chemically synthesized
tggtcatattaattgttttt

SEQ ID NO: 401155 - DNA, 20 bp, Artificial Sequence
  chemically synthesized
aattaatatgaccaaaccca

SEQ ID NO: 401156 - DNA, 20 bp, Artificial Sequence
  chemically synthesized
tatttgaacgactatgggtt

SEQ ID NO: 401157 - DNA, 20 bp, Artificial Sequence
  chemically synthesized
tacagtatttgaacgactat

SEQ ID NO: 401158 - DNA, 20 bp, Artificial Sequence
  chemically synthesized
atacagtatttgaacgacta

SEQ ID NO: 401159 - DNA, 20 bp, Artificial Sequence
  chemically synthesized
actatttttttataatcata

SEQ ID NO: 401160 - DNA, 20 bp, Artificial Sequence
  chemically synthesized
actgtatgattataaaaaaa

SEQ ID NO: 401161 - DNA, 20 bp, Artificial Sequence
  chemically synthesized
ataaatactgttattcagag

SEQ ID NO: 401162 - DNA, 20 bp, Artificial Sequence
  chemically synthesized
gaataaatactgttattcag

SEQ ID NO: 401163 - DNA, 20 bp, Artificial Sequence
  chemically synthesized
aaatagtctcctctgaataa

SEQ ID NO: 401164 - DNA, 20 bp, Artificial Sequence
  chemically synthesized
cgaataaatactgttattca

SEQ ID NO: 401165 - DNA, 20 bp, Artificial Sequence
  chemically synthesized
ggcgaataaatactgttatt

SEQ ID NO: 401166 - DNA, 20 bp, Artificial Sequence
  chemically synthesized
gaataacagtatttattcgc

SEQ ID NO: 401167 - DNA, 20 bp, Artificial Sequence
  chemically synthesized
ctggagtatctattcataac

SEQ ID NO: 401168 - DNA, 20 bp, Artificial Sequence
  chemically synthesized
atttattcgccagttatgaa

SEQ ID NO: 401169 - DNA, 20 bp, Artificial Sequence
  chemically synthesized
ccagttatgaatagatactc

SEQ ID NO: 401170 - DNA, 20 bp, Artificial Sequence
  chemically synthesized
agtttcttttaattatactg

SEQ ID NO: 401171 - DNA, 20 bp, Artificial Sequence
  chemically synthesized
agagtttcttttaattatac

SEQ ID NO: 401172 - DNA, 20 bp, Artificial Sequence
  chemically synthesized
agatactccagtataattaa

SEQ ID NO: 401173 - DNA, 20 bp, Artificial Sequence
  chemically synthesized
gtataattaaaagaaactct

SEQ ID NO: 401174 - DNA, 20 bp, Artificial Sequence
  chemically synthesized
tcggagtaaatgacagctga

SEQ ID NO: 401175 - DNA, 20 bp, Artificial Sequence
  chemically synthesized
tttcggagtaaatgacagct

SEQ ID NO: 401176 - DNA, 20 bp, Artificial Sequence
  chemically synthesized
tagtttttcggagtaaatga

SEQ ID NO: 401177 - DNA, 20 bp, Artificial Sequence
  chemically synthesized
ggctccgaaatagtttttcg

SEQ ID NO: 401178 - DNA, 20 bp, Artificial Sequence
  chemically synthesized
aaggctccgaaatagttttt

SEQ ID NO: 401179 - DNA, 20 bp, Artificial Sequence
  chemically synthesized
tttactccgaaaaactattt

SEQ ID NO: 401180 - DNA, 20 bp, Artificial Sequence
  chemically synthesized
tactccgaaaaactatttcg

SEQ ID NO: 401181 - DNA, 20 bp, Artificial Sequence
  chemically synthesized
catggggaaaggctccgaaa

SEQ ID NO: 401182 - DNA, 20 bp, Artificial Sequence
  chemically synthesized
tgggtggatggcatggggaa

SEQ ID NO: 401183 - DNA, 20 bp, Artificial Sequence
  chemically synthesized
ttgggtggatggcatgggga

SEQ ID NO: 401184 - DNA, 20 bp, Artificial Sequence
  chemically synthesized
atggttgggtggatggcatg

SEQ ID NO: 401185 - DNA, 20 bp, Artificial Sequence
  chemically synthesized
catggttgggtggatggcat

SEQ ID NO: 401186 - DNA, 20 bp, Artificial Sequence
  chemically synthesized
ccatggttgggtggatggca

SEQ ID NO: 401187 - DNA, 20 bp, Artificial Sequence
  chemically synthesized
tttctccatggttgggtgga

SEQ ID NO: 401188 - DNA, 20 bp, Artificial Sequence
  chemically synthesized
atcatttctccatggttggg

SEQ ID NO: 401189 - DNA, 20 bp, Artificial Sequence
  chemically synthesized
ccatgccatccacccaacca

SEQ ID NO: 401190 - DNA, 20 bp, Artificial Sequence
  chemically synthesized
atgccatccacccaaccatg

SEQ ID NO: 401191 - DNA, 20 bp, Artificial Sequence
  chemically synthesized
ataatcatttctccatggtt

SEQ ID NO: 401192 - DNA, 20 bp, Artificial Sequence
  chemically synthesized
aataatcatttctccatggt

SEQ ID NO: 401193 - DNA, 20 bp, Artificial Sequence
  chemically synthesized
aaggaataatcatttctcca

SEQ ID NO: 401194 - DNA, 20 bp, Artificial Sequence
  chemically synthesized
aatgattattccttcctttg

SEQ ID NO: 401195 - DNA, 20 bp, Artificial Sequence
  chemically synthesized
tatgtagatgctgcaaagga

SEQ ID NO: 401196 - DNA, 20 bp, Artificial Sequence
  chemically synthesized
gtatgtagatgctgcaaagg

SEQ ID NO: 401197 - DNA, 20 bp, Artificial Sequence
  chemically synthesized
agagtatgtagatgctgcaa

SEQ ID NO: 401198 - DNA, 20 bp, Artificial Sequence
  chemically synthesized
tagagtatgtagatgctgca

SEQ ID NO: 401199 - DNA, 20 bp, Artificial Sequence
  chemically synthesized
caggcccatgttagagtatg

SEQ ID NO: 401200 - DNA, 20 bp, Artificial Sequence
  chemically synthesized
agcatctacatactctaaca

SEQ ID NO: 401201 - DNA, 20 bp, Artificial Sequence
  chemically synthesized
gcatctacatactctaacat

SEQ ID NO: 401202 - DNA, 20 bp, Artificial Sequence
  chemically synthesized
gtgagatcaggcccatgtta

SEQ ID NO: 401203 - DNA, 20 bp, Artificial Sequence
  chemically synthesized
tagtgagatcaggcccatgt

SEQ ID NO: 401204 - DNA, 20 bp, Artificial Sequence
  chemically synthesized
acctcttccatagtgagatc

SEQ ID NO: 401205 - DNA, 20 bp, Artificial Sequence
  chemically synthesized
aacctcttccatagtgagat

SEQ ID NO: 401206 - DNA, 20 bp, Artificial Sequence
  chemically synthesized
acatgggcctgatctcacta

SEQ ID NO: 401207 - DNA, 20 bp, Artificial Sequence
  chemically synthesized
tgggcctgatctcactatgg

SEQ ID NO: 401208 - DNA, 20 bp, Artificial Sequence
  chemically synthesized
caggaaacctcttccatagt

SEQ ID NO: 401209 - DNA, 20 bp, Artificial Sequence
  chemically synthesized
ggcctgatctcactatggaa

SEQ ID NO: 401210 - DNA, 20 bp, Artificial Sequence
  chemically synthesized
gcctgatctcactatggaag

SEQ ID NO: 401211 - DNA, 20 bp, Artificial Sequence
  chemically synthesized
tcatcaggaaacctcttcca

SEQ ID NO: 401212 - DNA, 20 bp, Artificial Sequence
  chemically synthesized
tatggaagaggtttcctgat

SEQ ID NO: 401213 - DNA, 20 bp, Artificial Sequence
  chemically synthesized
ggaagaggtttcctgatgag

SEQ ID NO: 401214 - DNA, 20 bp, Artificial Sequence
  chemically synthesized
gaagaggtttcctgatgagc

SEQ ID NO: 401215 - DNA, 20 bp, Artificial Sequence
  chemically synthesized
aaaccatgctcctgctcatc

SEQ ID NO: 401216 - DNA, 20 bp, Artificial Sequence
  chemically synthesized
taaaccatgctcctgctcat

SEQ ID NO: 401217 - DNA, 20 bp, Artificial Sequence
  chemically synthesized
agaggtttcctgatgagcag

SEQ ID NO: 401218 - DNA, 20 bp, Artificial Sequence
  chemically synthesized
tttcctgatgagcaggagca

SEQ ID NO: 401219 - DNA, 20 bp, Artificial Sequence
  chemically synthesized
tgatgagcaggagcatggtt

SEQ ID NO: 401220 - DNA, 20 bp, Artificial Sequence
  chemically synthesized
gtttagttatctttgcttcc

SEQ ID NO: 401221 - DNA, 20 bp, Artificial Sequence
  chemically synthesized
gtgctaagttctgggaagca

SEQ ID NO: 401222 - DNA, 20 bp, Artificial Sequence
  chemically synthesized
acagtgtgctaagttctggg

SEQ ID NO: 401223 - DNA, 20 bp, Artificial Sequence
  chemically synthesized
tatctttgcttcccagaact

SEQ ID NO: 401224 - DNA, 20 bp, Artificial Sequence
  chemically synthesized
cagacagtgtgctaagttct

SEQ ID NO: 401225 - DNA, 20 bp, Artificial Sequence
  chemically synthesized
tcagacagtgtgctaagttc

SEQ ID NO: 401226 - DNA, 20 bp, Artificial Sequence
  chemically synthesized
atttgttcagacagtgtgct

SEQ ID NO: 401227 - DNA, 20 bp, Artificial Sequence
  chemically synthesized
gagctcttaatttgttcaga

SEQ ID NO: 401228 - DNA, 20 bp, Artificial Sequence
  chemically synthesized
ttctgagctcttaatttgtt

SEQ ID NO: 401229 - DNA, 20 bp, Artificial Sequence
  chemically synthesized
gcacactgtctgaacaaatt

SEQ ID NO: 401230 - DNA, 20 bp, Artificial Sequence
  chemically synthesized
acactgtctgaacaaattaa

SEQ ID NO: 401231 - DNA, 20 bp, Artificial Sequence
  chemically synthesized
gtctgaacaaattaagagct

SEQ ID NO: 401232 - DNA, 20 bp, Artificial Sequence
  chemically synthesized
atttgtcagatgtattttct

SEQ ID NO: 401233 - DNA, 20 bp, Artificial Sequence
  chemically synthesized
taaagcatgcacgtatttgt

SEQ ID NO: 401234 - DNA, 20 bp, Artificial Sequence
  chemically synthesized
gacaaatacgtgcatgcttt

SEQ ID NO: 401235 - DNA, 20 bp, Artificial Sequence
  chemically synthesized
acaaatacgtgcatgcttta

SEQ ID NO: 401236 - DNA, 20 bp, Artificial Sequence
  chemically synthesized
aatacgtgcatgctttaagg

SEQ ID NO: 401237 - DNA, 20 bp, Artificial Sequence
  chemically synthesized
atacgtgcatgctttaagga

SEQ ID NO: 401238 - DNA, 20 bp, Artificial Sequence
  chemically synthesized
tacgtgcatgctttaaggaa

SEQ ID NO: 401239 - DNA, 20 bp, Artificial Sequence
  chemically synthesized
gtagaatctccccttcctta

SEQ ID NO: 401240 - DNA, 20 bp, Artificial Sequence
  chemically synthesized
acgtgcatgctttaaggaag

SEQ ID NO: 401241 - DNA, 20 bp, Artificial Sequence
  chemically synthesized
gtgcatgctttaaggaaggg

SEQ ID NO: 401242 - DNA, 20 bp, Artificial Sequence
  chemically synthesized
tcctagaaattttagagttg

SEQ ID NO: 401243 - DNA, 20 bp, Artificial Sequence
  chemically synthesized
aagaggtcctagaaatttta

SEQ ID NO: 401244 - DNA, 20 bp, Artificial Sequence
  chemically synthesized
ttctacaactctaaaatttc

SEQ ID NO: 401245 - DNA, 20 bp, Artificial Sequence
  chemically synthesized
aaaagaggtcctagaaattt

SEQ ID NO: 401246 - DNA, 20 bp, Artificial Sequence
  chemically synthesized
tctacaactctaaaatttct

SEQ ID NO: 401247 - DNA, 20 bp, Artificial Sequence
  chemically synthesized
ttttagatgaaaagaggtcc

SEQ ID NO: 401248 - DNA, 20 bp, Artificial Sequence
  chemically synthesized
tctgacttttagatgaaaag

SEQ ID NO: 401249 - DNA, 20 bp, Artificial Sequence
  chemically synthesized
ttctgacttttagatgaaaa

SEQ ID NO: 401250 - DNA, 20 bp, Artificial Sequence
  chemically synthesized
tgttctgacttttagatgaa

SEQ ID NO: 401251 - DNA, 20 bp, Artificial Sequence
  chemically synthesized
taggacctcttttcatctaa

SEQ ID NO: 401252 - DNA, 20 bp, Artificial Sequence
  chemically synthesized
acctcttttcatctaaaagt

SEQ ID NO: 401253 - DNA, 20 bp, Artificial Sequence
  chemically synthesized
atttgaaatgttctgacttt

SEQ ID NO: 401254 - DNA, 20 bp, Artificial Sequence
  chemically synthesized
atttatatgtaaggcatgaa

SEQ ID NO: 401255 - DNA, 20 bp, Artificial Sequence
  chemically synthesized
gtatttatatgtaaggcatg

SEQ ID NO: 401256 - DNA, 20 bp, Artificial Sequence
  chemically synthesized
tctttgagtatttatatgta

SEQ ID NO: 401257 - DNA, 20 bp, Artificial Sequence
  chemically synthesized
ttctttgagtatttatatgt

SEQ ID NO: 401258 - DNA, 20 bp, Artificial Sequence
  chemically synthesized
gccttacatataaatactca

SEQ ID NO: 401259 - DNA, 20 bp, Artificial Sequence
  chemically synthesized
ctttggggacttttttcttt

SEQ ID NO: 401260 - DNA, 20 bp, Artificial Sequence
  chemically synthesized
atataaatactcaaagaaaa

SEQ ID NO: 401261 - DNA, 20 bp, Artificial Sequence
  chemically synthesized
ctcaaagaaaaaagtcccca

SEQ ID NO: 401262 - DNA, 20 bp, Artificial Sequence
  chemically synthesized
tcccttagtataaatctttg

SEQ ID NO: 401263 - DNA, 20 bp, Artificial Sequence
  chemically synthesized
atcccttagtataaatcttt

SEQ ID NO: 401264 - DNA, 20 bp, Artificial Sequence
  chemically synthesized
aatcccttagtataaatctt

SEQ ID NO: 401265 - DNA, 20 bp, Artificial Sequence
  chemically synthesized
agtccccaaagatttatact

SEQ ID NO: 401266 - DNA, 20 bp, Artificial Sequence
  chemically synthesized
gtccccaaagatttatacta

SEQ ID NO: 401267 - DNA, 20 bp, Artificial Sequence
  chemically synthesized
tccccaaagatttatactaa

SEQ ID NO: 401268 - DNA, 20 bp, Artificial Sequence
  chemically synthesized
aaagatttatactaagggat

SEQ ID NO: 401269 - DNA, 20 bp, Artificial Sequence
  chemically synthesized
aagatttatactaagggatt

SEQ ID NO: 401270 - DNA, 20 bp, Artificial Sequence
  chemically synthesized
aatttttctccctaatccct

SEQ ID NO: 401271 - DNA, 20 bp, Artificial Sequence
  chemically synthesized
agatttatactaagggatta

SEQ ID NO: 401272 - DNA, 20 bp, Artificial Sequence
  chemically synthesized
atttatactaagggattagg

SEQ ID NO: 401273 - DNA, 20 bp, Artificial Sequence
  chemically synthesized
ggagaaaaattattaaaaaa

SEQ ID NO: 401274 - DNA, 20 bp, Artificial Sequence
  chemically synthesized
gtagaagcatgaattcagtg

SEQ ID NO: 401275 - DNA, 20 bp, Artificial Sequence
  chemically synthesized
catttgtagaagcatgaatt

SEQ ID NO: 401276 - DNA, 20 bp, Artificial Sequence
  chemically synthesized
ggcaaaaagatcatttgtag

SEQ ID NO: 401277 - DNA, 20 bp, Artificial Sequence
  chemically synthesized
aggggcaaaaagatcatttg

SEQ ID NO: 401278 - DNA, 20 bp, Artificial Sequence
  chemically synthesized
atttccagtttaggggcaaa

SEQ ID NO: 401279 - DNA, 20 bp, Artificial Sequence
  chemically synthesized
tgatctttttgcccctaaac

SEQ ID NO: 401280 - DNA, 20 bp, Artificial Sequence
  chemically synthesized
aatactaatttccagtttag

SEQ ID NO: 401281 - DNA, 20 bp, Artificial Sequence
  chemically synthesized
taatactaatttccagttta

SEQ ID NO: 401282 - DNA, 20 bp, Artificial Sequence
  chemically synthesized
ttaatactaatttccagttt

SEQ ID NO: 401283 - DNA, 20 bp, Artificial Sequence
  chemically synthesized
cttaatactaatttccagtt

SEQ ID NO: 401284 - DNA, 20 bp, Artificial Sequence
  chemically synthesized
tttgcccctaaactggaaat

SEQ ID NO: 401285 - DNA, 20 bp, Artificial Sequence
  chemically synthesized
tttgacttaatactaatttc

SEQ ID NO: 401286 - DNA, 20 bp, Artificial Sequence
  chemically synthesized
ctaaactggaaattagtatt

SEQ ID NO: 401287 - DNA, 20 bp, Artificial Sequence
  chemically synthesized
gaaattagtattaagtcaaa

SEQ ID NO: 401288 - DNA, 20 bp, Artificial Sequence
  chemically synthesized
ttagtattaagtcaaatgga

SEQ ID NO: 401289 - DNA, 20 bp, Artificial Sequence
  chemically synthesized
gaaaaacattttaatatatc

SEQ ID NO: 401290 - DNA, 20 bp, Artificial Sequence
  chemically synthesized
atattaaaatgtttttctcc

SEQ ID NO: 401291 - DNA, 20 bp, Artificial Sequence
  chemically synthesized
aaatgtttttctccaagcaa

SEQ ID NO: 401292 - DNA, 20 bp, Artificial Sequence
  chemically synthesized
aaaaaatagtcttttgcttg

SEQ ID NO: 401293 - DNA, 20 bp, Artificial Sequence
  chemically synthesized
taaaaaaatagtcttttgct

SEQ ID NO: 401294 - DNA, 20 bp, Artificial Sequence
  chemically synthesized
atttacaataattaaaaaaa

SEQ ID NO: 401295 - DNA, 20 bp, Artificial Sequence
  chemically synthesized
tattgtaaatataatcatat

SEQ ID NO: 401296 - DNA, 20 bp, Artificial Sequence
  chemically synthesized
taatcatattagttaatgtt

SEQ ID NO: 401297 - DNA, 20 bp, Artificial Sequence
  chemically synthesized
ttcagtaaatgaatgcatct

SEQ ID NO: 401298 - DNA, 20 bp, Artificial Sequence
  chemically synthesized
cagtaaatgaatgcatctga

SEQ ID NO: 401299 - DNA, 20 bp, Artificial Sequence
  chemically synthesized
tatcaattttaaatatctct

SEQ ID NO: 401300 - DNA, 20 bp, Artificial Sequence
  chemically synthesized
aattttatattttatctact

SEQ ID NO: 401301 - DNA, 20 bp, Artificial Sequence
  chemically synthesized
aacggttcttttaatccaag

SEQ ID NO: 401302 - DNA, 20 bp, Artificial Sequence
  chemically synthesized
attttatctacttggattaa

SEQ ID NO: 401303 - DNA, 20 bp, Artificial Sequence
  chemically synthesized
aataacggttcttttaatcc

SEQ ID NO: 401304 - DNA, 20 bp, Artificial Sequence
  chemically synthesized
tgtaaagggcattttaataa

SEQ ID NO: 401305 - DNA, 20 bp, Artificial Sequence
  chemically synthesized
ttattaaaatgccctttaca

SEQ ID NO: 401306 - DNA, 20 bp, Artificial Sequence
  chemically synthesized
aaatatgattactttgtaaa

SEQ ID NO: 401307 - DNA, 20 bp, Artificial Sequence
  chemically synthesized
caaatatgattactttgtaa

SEQ ID NO: 401308 - DNA, 20 bp, Artificial Sequence
  chemically synthesized
gcaaatatgattactttgta

SEQ ID NO: 401309 - DNA, 20 bp, Artificial Sequence
  chemically synthesized
tactactgaaaaatatatga

SEQ ID NO: 401310 - DNA, 20 bp, Artificial Sequence
  chemically synthesized
tttactactgaaaaatatat

SEQ ID NO: 401311 - DNA, 20 bp, Artificial Sequence
  chemically synthesized
atttgctctcatatattttt

SEQ ID NO: 401312 - DNA, 20 bp, Artificial Sequence
  chemically synthesized
tgctctcatatatttttcag

SEQ ID NO: 401313 - DNA, 20 bp, Artificial Sequence
  chemically synthesized
tgtttttaagagaagcaacg

SEQ ID NO: 401314 - DNA, 20 bp, Artificial Sequence
  chemically synthesized
tatgtttttaagagaagcaa

SEQ ID NO: 401315 - DNA, 20 bp, Artificial Sequence
  chemically synthesized
attccttatgtttttaagag

SEQ ID NO: 401316 - DNA, 20 bp, Artificial Sequence
  chemically synthesized
gtgattccttatgtttttaa

SEQ ID NO: 401317 - DNA, 20 bp, Artificial Sequence
  chemically synthesized
aagtgattccttatgttttt

SEQ ID NO: 401318 - DNA, 20 bp, Artificial Sequence
  chemically synthesized
gttgcttctcttaaaaacat

SEQ ID NO: 401319 - DNA, 20 bp, Artificial Sequence
  chemically synthesized
ttgcttctcttaaaaacata

SEQ ID NO: 401320 - DNA, 20 bp, Artificial Sequence
  chemically synthesized
tgcatatatttgttatgcga

SEQ ID NO: 401321 - DNA, 20 bp, Artificial Sequence
  chemically synthesized
taaagataaacagatatttt

SEQ ID NO: 401322 - DNA, 20 bp, Artificial Sequence
  chemically synthesized
tattgtgatttaaagataaa

SEQ ID NO: 401323 - DNA, 20 bp, Artificial Sequence
  chemically synthesized
tagattagtattgtgattta

SEQ ID NO: 401324 - DNA, 20 bp, Artificial Sequence
  chemically synthesized
aaatcacaatactaatctat

SEQ ID NO: 401325 - DNA, 20 bp, Artificial Sequence
  chemically synthesized
aaaggaatctacttatagat

SEQ ID NO: 401326 - DNA, 20 bp, Artificial Sequence
  chemically synthesized
tcacaatactaatctataag

SEQ ID NO: 401327 - DNA, 20 bp, Artificial Sequence
  chemically synthesized
tgactaaaggaatctactta

SEQ ID NO: 401328 - DNA, 20 bp, Artificial Sequence
  chemically synthesized
aatctataagtagattcctt

SEQ ID NO: 401329 - DNA, 20 bp, Artificial Sequence
  chemically synthesized
ttatttctcatattgactaa

SEQ ID NO: 401330 - DNA, 20 bp, Artificial Sequence
  chemically synthesized
gttatttctcatattgacta

SEQ ID NO: 401331 - DNA, 20 bp, Artificial Sequence
  chemically synthesized
tagattcctttagtcaatat

SEQ ID NO: 401332 - DNA, 20 bp, Artificial Sequence
  chemically synthesized
ttagtcaatatgagaaataa

SEQ ID NO: 401333 - DNA, 20 bp, Artificial Sequence
  chemically synthesized
taaatttcaaactgtcatct

SEQ ID NO: 401334 - DNA, 20 bp, Artificial Sequence
  chemically synthesized
aaatttcaaactgtcatctt

SEQ ID NO: 401335 - DNA, 20 bp, Artificial Sequence
  chemically synthesized
aaatttctcacctaagatga

SEQ ID NO: 401336 - DNA, 20 bp, Artificial Sequence
  chemically synthesized
ttcaaactgtcatcttaggt

SEQ ID NO: 401337 - DNA, 20 bp, Artificial Sequence
  chemically synthesized
ctaaataaaatttctcacct

SEQ ID NO: 401338 - DNA, 20 bp, Artificial Sequence
  chemically synthesized
cttaggtgagaaattttatt

SEQ ID NO: 401339 - DNA, 20 bp, Artificial Sequence
  chemically synthesized
tgtgaataacataattaaat

SEQ ID NO: 401340 - DNA, 20 bp, Artificial Sequence
  chemically synthesized
tttaattatgttattcacac

SEQ ID NO: 401341 - DNA, 20 bp, Artificial Sequence
  chemically synthesized
gatattgaacatacatatag

SEQ ID NO: 401342 - DNA, 20 bp, Artificial Sequence
  chemically synthesized
gttgatattgaacatacata

SEQ ID NO: 401343 - DNA, 20 bp, Artificial Sequence
  chemically synthesized
caatatcaacattattcata

SEQ ID NO: 401344 - DNA, 20 bp, Artificial Sequence
  chemically synthesized
atatggtatatgataaatct

SEQ ID NO: 401345 - DNA, 20 bp, Artificial Sequence
  chemically synthesized
aatacttccatattgtagct

SEQ ID NO: 401346 - DNA, 20 bp, Artificial Sequence
  chemically synthesized
gataaatcttagctacaata

SEQ ID NO: 401347 - DNA, 20 bp, Artificial Sequence
  chemically synthesized
aaggaaatacttccatattg

SEQ ID NO: 401348 - DNA, 20 bp, Artificial Sequence
  chemically synthesized
aaatcttagctacaatatgg

SEQ ID NO: 401349 - DNA, 20 bp, Artificial Sequence
  chemically synthesized
ttattcacccttgtcaacaa

SEQ ID NO: 401350 - DNA, 20 bp, Artificial Sequence
  chemically synthesized
gaagtatttcctttgttgac

SEQ ID NO: 401351 - DNA, 20 bp, Artificial Sequence
  chemically synthesized
tttattcacccttgtcaaca

SEQ ID NO: 401352 - DNA, 20 bp, Artificial Sequence
  chemically synthesized
aagtatttcctttgttgaca

SEQ ID NO: 401353 - DNA, 20 bp, Artificial Sequence
  chemically synthesized
agtatttcctttgttgacaa

SEQ ID NO: 401354 - DNA, 20 bp, Artificial Sequence
  chemically synthesized
caagggtgaataaataaaaa

SEQ ID NO: 401355 - DNA, 20 bp, Artificial Sequence
  chemically synthesized
ggtgaataaataaaaacaga

SEQ ID NO: 401356 - DNA, 20 bp, Artificial Sequence
  chemically synthesized
taaataaaaacagatagtaa

SEQ ID NO: 401357 - DNA, 20 bp, Artificial Sequence
  chemically synthesized
aatagttttcaaacctattc

SEQ ID NO: 401358 - DNA, 20 bp, Artificial Sequence
  chemically synthesized
gatttgaaggaggctagaat

SEQ ID NO: 401359 - DNA, 20 bp, Artificial Sequence
  chemically synthesized
agatttgaaggaggctagaa

SEQ ID NO: 401360 - DNA, 20 bp, Artificial Sequence
  chemically synthesized
agtaaagatttgaaggaggc

SEQ ID NO: 401361 - DNA, 20 bp, Artificial Sequence
  chemically synthesized
tgaaagtaaagatttgaagg

SEQ ID NO: 401362 - DNA, 20 bp, Artificial Sequence
  chemically synthesized
atgaaagtaaagatttgaag

SEQ ID NO: 401363 - DNA, 20 bp, Artificial Sequence
  chemically synthesized
ttatgaaagtaaagatttga

SEQ ID NO: 401364 - DNA, 20 bp, Artificial Sequence
  chemically synthesized
tttatgaaagtaaagatttg

SEQ ID NO: 401365 - DNA, 20 bp, Artificial Sequence
  chemically synthesized
gtattaattttatgaaagta

SEQ ID NO: 401366 - DNA, 20 bp, Artificial Sequence
  chemically synthesized
ggctagtattaattttatga

SEQ ID NO: 401367 - DNA, 20 bp, Artificial Sequence
  chemically synthesized
tactttcataaaattaatac

SEQ ID NO: 401368 - DNA, 20 bp, Artificial Sequence
  chemically synthesized
taaaattattttggaagggc

SEQ ID NO: 401369 - DNA, 20 bp, Artificial Sequence
  chemically synthesized
tttttaaaattattttggaa

SEQ ID NO: 401370 - DNA, 20 bp, Artificial Sequence
  chemically synthesized
ctttttaaaattattttgga

SEQ ID NO: 401371 - DNA, 20 bp, Artificial Sequence
  chemically synthesized
tctttttaaaattattttgg

SEQ ID NO: 401372 - DNA, 20 bp, Artificial Sequence
  chemically synthesized
atttctttttaaaattattt

SEQ ID NO: 401373 - DNA, 20 bp, Artificial Sequence
  chemically synthesized
ccttccaaaataattttaaa

SEQ ID NO: 401374 - DNA, 20 bp, Artificial Sequence
  chemically synthesized
aaaataattttaaaaagaaa

SEQ ID NO: 401375 - DNA, 20 bp, Artificial Sequence
  chemically synthesized
aagaaatggaacatttcaaa

SEQ ID NO: 401376 - DNA, 20 bp, Artificial Sequence
  chemically synthesized
tcaaaattaaaccatcttca

SEQ ID NO: 401377 - DNA, 20 bp, Artificial Sequence
  chemically synthesized
ctccataaagtctatgaaga

SEQ ID NO: 401378 - DNA, 20 bp, Artificial Sequence
  chemically synthesized
cttcctccataaagtctatg

SEQ ID NO: 401379 - DNA, 20 bp, Artificial Sequence
  chemically synthesized
aaccatcttcatagacttta

SEQ ID NO: 401380 - DNA, 20 bp, Artificial Sequence
  chemically synthesized
ccatcttcatagactttatg

SEQ ID NO: 401381 - DNA, 20 bp, Artificial Sequence
  chemically synthesized
catcttcatagactttatgg

SEQ ID NO: 401382 - DNA, 20 bp, Artificial Sequence
  chemically synthesized
ttgaccaatcttcctccata

SEQ ID NO: 401383 - DNA, 20 bp, Artificial Sequence
  chemically synthesized
cttcatagactttatggagg

SEQ ID NO: 401384 - DNA, 20 bp, Artificial Sequence
  chemically synthesized
tagactttatggaggaagat

SEQ ID NO: 401385 - DNA, 20 bp, Artificial Sequence
  chemically synthesized
ttggtcaacgcatcatttat

SEQ ID NO: 401386 - DNA, 20 bp, Artificial Sequence
  chemically synthesized
gtcaacgcatcatttatcag

SEQ ID NO: 401387 - DNA, 20 bp, Artificial Sequence
  chemically synthesized
gtatatacatatattcctaa

SEQ ID NO: 401388 - DNA, 20 bp, Artificial Sequence
  chemically synthesized
aaataaggtcatttactttt

SEQ ID NO: 401389 - DNA, 20 bp, Artificial Sequence
  chemically synthesized
caaataaggtcatttacttt

SEQ ID NO: 401390 - DNA, 20 bp, Artificial Sequence
  chemically synthesized
tataagtggaattgcaaata

SEQ ID NO: 401391 - DNA, 20 bp, Artificial Sequence
  chemically synthesized
atataagtggaattgcaaat

SEQ ID NO: 401392 - DNA, 20 bp, Artificial Sequence
  chemically synthesized
gcacatgtaggaaatataag

SEQ ID NO: 401393 - DNA, 20 bp, Artificial Sequence
  chemically synthesized
catgcacatgtaggaaatat

SEQ ID NO: 401394 - DNA, 20 bp, Artificial Sequence
  chemically synthesized
gaaagtacgcatgcacatgt

SEQ ID NO: 401395 - DNA, 20 bp, Artificial Sequence
  chemically synthesized
agaaagtacgcatgcacatg

SEQ ID NO: 401396 - DNA, 20 bp, Artificial Sequence
  chemically synthesized
tgtgcatgcgtactttctgt

SEQ ID NO: 401397 - DNA, 20 bp, Artificial Sequence
  chemically synthesized
actctctgctttctgacaga

SEQ ID NO: 401398 - DNA, 20 bp, Artificial Sequence
  chemically synthesized
catgcgtactttctgtcaga

SEQ ID NO: 401399 - DNA, 20 bp, Artificial Sequence
  chemically synthesized
atttactctctgctttctga

SEQ ID NO: 401400 - DNA, 20 bp, Artificial Sequence
  chemically synthesized
gcgtactttctgtcagaaag

SEQ ID NO: 401401 - DNA, 20 bp, Artificial Sequence
  chemically synthesized
gtactttctgtcagaaagca

SEQ ID NO: 401402 - DNA, 20 bp, Artificial Sequence
  chemically synthesized
actttctgtcagaaagcaga

SEQ ID NO: 401403 - DNA, 20 bp, Artificial Sequence
  chemically synthesized
tcagaaagcagagagtaaat

SEQ ID NO: 401404 - DNA, 20 bp, Artificial Sequence
  chemically synthesized
aaagcagagagtaaatgagt

SEQ ID NO: 401405 - DNA, 20 bp, Artificial Sequence
  chemically synthesized
agagtaaatgagtcagttga

SEQ ID NO: 401406 - DNA, 20 bp, Artificial Sequence
  chemically synthesized
gtcagttgaaagcatacatt

SEQ ID NO: 401407 - DNA, 20 bp, Artificial Sequence
  chemically synthesized
agggttttgggtatgtttca

SEQ ID NO: 401408 - DNA, 20 bp, Artificial Sequence
  chemically synthesized
agcttttggcagagggtttt

SEQ ID NO: 401409 - DNA, 20 bp, Artificial Sequence
  chemically synthesized
gagcttttggcagagggttt

SEQ ID NO: 401410 - DNA, 20 bp, Artificial Sequence
  chemically synthesized
catattgagcttttggcaga

SEQ ID NO: 401411 - DNA, 20 bp, Artificial Sequence
  chemically synthesized
tacccaaaaccctctgccaa

SEQ ID NO: 401412 - DNA, 20 bp, Artificial Sequence
  chemically synthesized
tcatattgagcttttggcag

SEQ ID NO: 401413 - DNA, 20 bp, Artificial Sequence
  chemically synthesized
ctcatattgagcttttggca

SEQ ID NO: 401414 - DNA, 20 bp, Artificial Sequence
  chemically synthesized
acctcatattgagcttttgg

SEQ ID NO: 401415 - DNA, 20 bp, Artificial Sequence
  chemically synthesized
aagacctcatattgagcttt

SEQ ID NO: 401416 - DNA, 20 bp, Artificial Sequence
  chemically synthesized
ctctgccaaaagctcaatat

SEQ ID NO: 401417 - DNA, 20 bp, Artificial Sequence
  chemically synthesized
tctgccaaaagctcaatatg

SEQ ID NO: 401418 - DNA, 20 bp, Artificial Sequence
  chemically synthesized
acttcaaaagacctcatatt

SEQ ID NO: 401419 - DNA, 20 bp, Artificial Sequence
  chemically synthesized
gctcaatatgaggtcttttg

SEQ ID NO: 401420 - DNA, 20 bp, Artificial Sequence
  chemically synthesized
tctagattaaatcacttcaa

SEQ ID NO: 401421 - DNA, 20 bp, Artificial Sequence
  chemically synthesized
tcttttgaagtgatttaatc

SEQ ID NO: 401422 - DNA, 20 bp, Artificial Sequence
  chemically synthesized
ttttgaagtgatttaatcta

SEQ ID NO: 401423 - DNA, 20 bp, Artificial Sequence
  chemically synthesized
tttgaagtgatttaatctag

SEQ ID NO: 401424 - DNA, 20 bp, Artificial Sequence
  chemically synthesized
atttttcacttaaaagcctc

SEQ ID NO: 401425 - DNA, 20 bp, Artificial Sequence
  chemically synthesized
gatttaatctagaggctttt

SEQ ID NO: 401426 - DNA, 20 bp, Artificial Sequence
  chemically synthesized
actacgtatttttcacttaa

SEQ ID NO: 401427 - DNA, 20 bp, Artificial Sequence
  chemically synthesized
gcttttaagtgaaaaatacg

SEQ ID NO: 401428 - DNA, 20 bp, Artificial Sequence
  chemically synthesized
tttaagtgaaaaatacgtag

SEQ ID NO: 401429 - DNA, 20 bp, Artificial Sequence
  chemically synthesized
tccttgtccatataattgaa

SEQ ID NO: 401430 - DNA, 20 bp, Artificial Sequence
  chemically synthesized
ttttattcttttcaattata

SEQ ID NO: 401431 - DNA, 20 bp, Artificial Sequence
  chemically synthesized
ttcttttcaattatatggac

SEQ ID NO: 401432 - DNA, 20 bp, Artificial Sequence
  chemically synthesized
tcttttcaattatatggaca

SEQ ID NO: 401433 - DNA, 20 bp, Artificial Sequence
  chemically synthesized
ttttcaattatatggacaag

SEQ ID NO: 401434 - DNA, 20 bp, Artificial Sequence
  chemically synthesized
tatggacaaggagtaatttt

SEQ ID NO: 401435 - DNA, 20 bp, Artificial Sequence
  chemically synthesized
atggacaaggagtaattttt

SEQ ID NO: 401436 - DNA, 20 bp, Artificial Sequence
  chemically synthesized
acaaggagtaatttttaggt

SEQ ID NO: 401437 - DNA, 20 bp, Artificial Sequence
  chemically synthesized
taatttttaggtaagcatcg

SEQ ID NO: 401438 - DNA, 20 bp, Artificial Sequence
  chemically synthesized
aatttttaggtaagcatcga

SEQ ID NO: 401439 - DNA, 20 bp, Artificial Sequence
  chemically synthesized
ttttaggtaagcatcgaagg

SEQ ID NO: 401440 - DNA, 20 bp, Artificial Sequence
  chemically synthesized
acactttgcacataatgtca

SEQ ID NO: 401441 - DNA, 20 bp, Artificial Sequence
  chemically synthesized
aacactttgcacataatgtc

SEQ ID NO: 401442 - DNA, 20 bp, Artificial Sequence
  chemically synthesized
aaaccttgacattatgtgca

SEQ ID NO: 401443 - DNA, 20 bp, Artificial Sequence
  chemically synthesized
gtgttatttacacagtaaat

SEQ ID NO: 401444 - DNA, 20 bp, Artificial Sequence
  chemically synthesized
cacatttagtgttatttaca

SEQ ID NO: 401445 - DNA, 20 bp, Artificial Sequence
  chemically synthesized
gtgtaaataacactaaatgt

SEQ ID NO: 401446 - DNA, 20 bp, Artificial Sequence
  chemically synthesized
tatatgttgaagctcacatt

SEQ ID NO: 401447 - DNA, 20 bp, Artificial Sequence
  chemically synthesized
gcaaagatgtttatatgttg

SEQ ID NO: 401448 - DNA, 20 bp, Artificial Sequence
  chemically synthesized
caacatataaacatctttgc

SEQ ID NO: 401449 - DNA, 20 bp, Artificial Sequence
  chemically synthesized
gtgagagaggacaactagca

SEQ ID NO: 401450 - DNA, 20 bp, Artificial Sequence
  chemically synthesized
tagaggtgagagaggacaac

SEQ ID NO: 401451 - DNA, 20 bp, Artificial Sequence
  chemically synthesized
taaagacgtagaggtgagag

SEQ ID NO: 401452 - DNA, 20 bp, Artificial Sequence
  chemically synthesized
ttaaagacgtagaggtgaga

SEQ ID NO: 401453 - DNA, 20 bp, Artificial Sequence
  chemically synthesized
tattaaagacgtagaggtga

SEQ ID NO: 401454 - DNA, 20 bp, Artificial Sequence
  chemically synthesized
tgtattaaagacgtagaggt

SEQ ID NO: 401455 - DNA, 20 bp, Artificial Sequence
  chemically synthesized
ttcttgtattaaagacgtag

SEQ ID NO: 401456 - DNA, 20 bp, Artificial Sequence
  chemically synthesized
tttcttgtattaaagacgta

SEQ ID NO: 401457 - DNA, 20 bp, Artificial Sequence
  chemically synthesized
tttttcttgtattaaagacg

SEQ ID NO: 401458 - DNA, 20 bp, Artificial Sequence
  chemically synthesized
cacctctacgtctttaatac

SEQ ID NO: 401459 - DNA, 20 bp, Artificial Sequence
  chemically synthesized
aagacatttttcttgtatta

SEQ ID NO: 401460 - DNA, 20 bp, Artificial Sequence
  chemically synthesized
aataagacaataattcattg

SEQ ID NO: 401461 - DNA, 20 bp, Artificial Sequence
  chemically synthesized
aatgaattattgtcttattt

SEQ ID NO: 401462 - DNA, 20 bp, Artificial Sequence
  chemically synthesized
atatgctactataccaaaat

SEQ ID NO: 401463 - DNA, 20 bp, Artificial Sequence
  chemically synthesized
attattgtcttattttggta

SEQ ID NO: 401464 - DNA, 20 bp, Artificial Sequence
  chemically synthesized
attgtcttattttggtatag

SEQ ID NO: 401465 - DNA, 20 bp, Artificial Sequence
  chemically synthesized
tattaataattattatgttg

SEQ ID NO: 401466 - DNA, 20 bp, Artificial Sequence
  chemically synthesized
ataaaatacataacaattct

SEQ ID NO: 401467 - DNA, 20 bp, Artificial Sequence
  chemically synthesized
cttatgaatagtaaggcact

SEQ ID NO: 401468 - DNA, 20 bp, Artificial Sequence
  chemically synthesized
aaacaaacttatgaatagta

SEQ ID NO: 401469 - DNA, 20 bp, Artificial Sequence
  chemically synthesized
aaaacaaacttatgaatagt

SEQ ID NO: 401470 - DNA, 20 bp, Artificial Sequence
  chemically synthesized
cttagtgccttactattcat

SEQ ID NO: 401471 - DNA, 20 bp, Artificial Sequence
  chemically synthesized
aattaaaacaaacttatgaa

SEQ ID NO: 401472 - DNA, 20 bp, Artificial Sequence
  chemically synthesized
taaattacatacagattgag

SEQ ID NO: 401473 - DNA, 20 bp, Artificial Sequence
  chemically synthesized
tagtaaattacatacagatt

SEQ ID NO: 401474 - DNA, 20 bp, Artificial Sequence
  chemically synthesized
ataaagtagtaaattacata

SEQ ID NO: 401475 - DNA, 20 bp, Artificial Sequence
  chemically synthesized
gcttgtgtttatgtataaag

SEQ ID NO: 401476 - DNA, 20 bp, Artificial Sequence
  chemically synthesized
tcagcttgtgtttatgtata

SEQ ID NO: 401477 - DNA, 20 bp, Artificial Sequence
  chemically synthesized
actactttatacataaacac

SEQ ID NO: 401478 - DNA, 20 bp, Artificial Sequence
  chemically synthesized
tttatacataaacacaagct

SEQ ID NO: 401479 - DNA, 20 bp, Artificial Sequence
  chemically synthesized
atacataaacacaagctgag

SEQ ID NO: 401480 - DNA, 20 bp, Artificial Sequence
  chemically synthesized
tacataaacacaagctgaga

SEQ ID NO: 401481 - DNA, 20 bp, Artificial Sequence
  chemically synthesized
ttaatagctttattccttct

SEQ ID NO: 401482 - DNA, 20 bp, Artificial Sequence
  chemically synthesized
acacaagctgagaaggaata

SEQ ID NO: 401483 - DNA, 20 bp, Artificial Sequence
  chemically synthesized
tgagaaggaataaagctatt

SEQ ID NO: 401484 - DNA, 20 bp, Artificial Sequence
  chemically synthesized
agttcatttctgtcacttaa

SEQ ID NO: 401485 - DNA, 20 bp, Artificial Sequence
  chemically synthesized
ggaataaagctattaagtga

SEQ ID NO: 401486 - DNA, 20 bp, Artificial Sequence
  chemically synthesized
tgacagaaatgaacttgata

SEQ ID NO: 401487 - DNA, 20 bp, Artificial Sequence
  chemically synthesized
tgattcagaaaatctgtatc

SEQ ID NO: 401488 - DNA, 20 bp, Artificial Sequence
  chemically synthesized
gatacagattttctgaatca

SEQ ID NO: 401489 - DNA, 20 bp, Artificial Sequence
  chemically synthesized
aaaagccatggactttgatt

SEQ ID NO: 401490 - DNA, 20 bp, Artificial Sequence
  chemically synthesized
attttctgaatcaaagtcca

SEQ ID NO: 401491 - DNA, 20 bp, Artificial Sequence
  chemically synthesized
ctggtcaatgtgaaaagcca

SEQ ID NO: 401492 - DNA, 20 bp, Artificial Sequence
  chemically synthesized
agatatctggtcaatgtgaa

SEQ ID NO: 401493 - DNA, 20 bp, Artificial Sequence
  chemically synthesized
ccatggcttttcacattgac

SEQ ID NO: 401494 - DNA, 20 bp, Artificial Sequence
  chemically synthesized
taatgtaaatgatagatatc

SEQ ID NO: 401495 - DNA, 20 bp, Artificial Sequence
  chemically synthesized
tgcaattataatgtaaatga

SEQ ID NO: 401496 - DNA, 20 bp, Artificial Sequence
  chemically synthesized
taattgcataattaacaata

SEQ ID NO: 401497 - DNA, 20 bp, Artificial Sequence
  chemically synthesized
ttaacaatacagaataccat

SEQ ID NO: 401498 - DNA, 20 bp, Artificial Sequence
  chemically synthesized
ttgtgactctgattatctta

SEQ ID NO: 401499 - DNA, 20 bp, Artificial Sequence
  chemically synthesized
acagaataccataagataat

SEQ ID NO: 401500 - DNA, 20 bp, Artificial Sequence
  chemically synthesized
agaataccataagataatca

SEQ ID NO: 401501 - DNA, 20 bp, Artificial Sequence
  chemically synthesized
taagataatcagagtcacaa

SEQ ID NO: 401502 - DNA, 20 bp, Artificial Sequence
  chemically synthesized
aagataatcagagtcacaaa

SEQ ID NO: 401503 - DNA, 20 bp, Artificial Sequence
  chemically synthesized
atgcaaaacaaccatgaaat

SEQ ID NO: 401504 - DNA, 20 bp, Artificial Sequence
  chemically synthesized
aaatagaagctctgatttca

SEQ ID NO: 401505 - DNA, 20 bp, Artificial Sequence
  chemically synthesized
gcaaaacaaccatgaaatca

SEQ ID NO: 401506 - DNA, 20 bp, Artificial Sequence
  chemically synthesized
ccttgagttgttcaaaatag

SEQ ID NO: 401507 - DNA, 20 bp, Artificial Sequence
  chemically synthesized
cctccttgagttgttcaaaa

SEQ ID NO: 401508 - DNA, 20 bp, Artificial Sequence
  chemically synthesized
gcttctattttgaacaactc

SEQ ID NO: 401509 - DNA, 20 bp, Artificial Sequence
  chemically synthesized
cttctattttgaacaactca

SEQ ID NO: 401510 - DNA, 20 bp, Artificial Sequence
  chemically synthesized
tctattttgaacaactcaag

SEQ ID NO: 401511 - DNA, 20 bp, Artificial Sequence
  chemically synthesized
ctattttgaacaactcaagg

SEQ ID NO: 401512 - DNA, 20 bp, Artificial Sequence
  chemically synthesized
aacatacatggaacctcctt

SEQ ID NO: 401513 - DNA, 20 bp, Artificial Sequence
  chemically synthesized
cacataggttacaacataca

SEQ ID NO: 401514 - DNA, 20 bp, Artificial Sequence
  chemically synthesized
tatgttgtaacctatgtgaa

SEQ ID NO: 401515 - DNA, 20 bp, Artificial Sequence
  chemically synthesized
ttccaggacgctattcacat

SEQ ID NO: 401516 - DNA, 20 bp, Artificial Sequence
  chemically synthesized
attccaggacgctattcaca

SEQ ID NO: 401517 - DNA, 20 bp, Artificial Sequence
  chemically synthesized
aacctatgtgaatagcgtcc

SEQ ID NO: 401518 - DNA, 20 bp, Artificial Sequence
  chemically synthesized
gtgaatagcgtcctggaatt

SEQ ID NO: 401519 - DNA, 20 bp, Artificial Sequence
  chemically synthesized
gttatgcattgccaaattcc

SEQ ID NO: 401520 - DNA, 20 bp, Artificial Sequence
  chemically synthesized
agttatgcattgccaaattc

SEQ ID NO: 401521 - DNA, 20 bp, Artificial Sequence
  chemically synthesized
atcagttcatacagacaaat

SEQ ID NO: 401522 - DNA, 20 bp, Artificial Sequence
  chemically synthesized
cagttctagatcagttcata

SEQ ID NO: 401523 - DNA, 20 bp, Artificial Sequence
  chemically synthesized
tttgtctgtatgaactgatc

SEQ ID NO: 401524 - DNA, 20 bp, Artificial Sequence
  chemically synthesized
ctcattattcagttctagat

SEQ ID NO: 401525 - DNA, 20 bp, Artificial Sequence
  chemically synthesized
gaaggctcattattcagttc

SEQ ID NO: 401526 - DNA, 20 bp, Artificial Sequence
  chemically synthesized
ctgatctagaactgaataat

SEQ ID NO: 401527 - DNA, 20 bp, Artificial Sequence
  chemically synthesized
attaaagaaggctcattatt

SEQ ID NO: 401528 - DNA, 20 bp, Artificial Sequence
  chemically synthesized
gaataatgagccttctttaa

SEQ ID NO: 401529 - DNA, 20 bp, Artificial Sequence
  chemically synthesized
tcatccagcaccattaaaga

SEQ ID NO: 401530 - DNA, 20 bp, Artificial Sequence
  chemically synthesized
atcatccagcaccattaaag

SEQ ID NO: 401531 - DNA, 20 bp, Artificial Sequence
  chemically synthesized
catatcatccagcaccatta

SEQ ID NO: 401532 - DNA, 20 bp, Artificial Sequence
  chemically synthesized
tgagccttctttaatggtgc

SEQ ID NO: 401533 - DNA, 20 bp, Artificial Sequence
  chemically synthesized
tttaatggtgctggatgata

SEQ ID NO: 401534 - DNA, 20 bp, Artificial Sequence
  chemically synthesized
gtattaacaaccatatcatc

SEQ ID NO: 401535 - DNA, 20 bp, Artificial Sequence
  chemically synthesized
tgtaaaagcattattatttg

SEQ ID NO: 401536 - DNA, 20 bp, Artificial Sequence
  chemically synthesized
atatcaattagtaaatgtaa

SEQ ID NO: 401537 - DNA, 20 bp, Artificial Sequence
  chemically synthesized
ttgaaataccaaatatcaat

SEQ ID NO: 401538 - DNA, 20 bp, Artificial Sequence
  chemically synthesized
tacatttactaattgatatt

SEQ ID NO: 401539 - DNA, 20 bp, Artificial Sequence
  chemically synthesized
atgtttccataatgatatat

SEQ ID NO: 401540 - DNA, 20 bp, Artificial Sequence
  chemically synthesized
tttcgtcttatatatcatta

SEQ ID NO: 401541 - DNA, 20 bp, Artificial Sequence
  chemically synthesized
caaaaattttgattgatttt

SEQ ID NO: 401542 - DNA, 20 bp, Artificial Sequence
  chemically synthesized
ttatggggaatttaaaagtg

SEQ ID NO: 401543 - DNA, 20 bp, Artificial Sequence
  chemically synthesized
tgtatttatggggaatttaa

SEQ ID NO: 401544 - DNA, 20 bp, Artificial Sequence
  chemically synthesized
ataagaaatatgtatttatg

SEQ ID NO: 401545 - DNA, 20 bp, Artificial Sequence
  chemically synthesized
tataagaaatatgtatttat

SEQ ID NO: 401546 - DNA, 20 bp, Artificial Sequence
  chemically synthesized
ttataagaaatatgtattta

SEQ ID NO: 401547 - DNA, 20 bp, Artificial Sequence
  chemically synthesized
aagaatattattttggttat

SEQ ID NO: 401548 - DNA, 20 bp, Artificial Sequence
  chemically synthesized
aaaaagaaagaatattattt

SEQ ID NO: 401549 - DNA, 20 bp, Artificial Sequence
  chemically synthesized
gataaaataagtgaaaaaga

SEQ ID NO: 401550 - DNA, 20 bp, Artificial Sequence
  chemically synthesized
ttatgataaaataagtgaaa

SEQ ID NO: 401551 - DNA, 20 bp, Artificial Sequence
  chemically synthesized
tatgagatttatgataaaat

SEQ ID NO: 401552 - DNA, 20 bp, Artificial Sequence
  chemically synthesized
ttttatcataaatctcatat

SEQ ID NO: 401553 - DNA, 20 bp, Artificial Sequence
  chemically synthesized
aaggaaagagcagcttatat

SEQ ID NO: 401554 - DNA, 20 bp, Artificial Sequence
  chemically synthesized
tagcaaacaaaaggaaagag

SEQ ID NO: 401555 - DNA, 20 bp, Artificial Sequence
  chemically synthesized
taatagcaaacaaaaggaaa

SEQ ID NO: 401556 - DNA, 20 bp, Artificial Sequence
  chemically synthesized
tctaatagcaaacaaaagga

SEQ ID NO: 401557 - DNA, 20 bp, Artificial Sequence
  chemically synthesized
agtctctaatagcaaacaaa

SEQ ID NO: 401558 - DNA, 20 bp, Artificial Sequence
  chemically synthesized
tagtctctaatagcaaacaa

SEQ ID NO: 401559 - DNA, 20 bp, Artificial Sequence
  chemically synthesized
tctttccttttgtttgctat

SEQ ID NO: 401560 - DNA, 20 bp, Artificial Sequence
  chemically synthesized
tttccttttgtttgctatta

SEQ ID NO: 401561 - DNA, 20 bp, Artificial Sequence
  chemically synthesized
tattgtgatttagtctctaa

SEQ ID NO: 401562 - DNA, 20 bp, Artificial Sequence
  chemically synthesized
tgagcatgtttattgtgatt

SEQ ID NO: 401563 - DNA, 20 bp, Artificial Sequence
  chemically synthesized
caaaaaagaagtgagtgcat

SEQ ID NO: 401564 - DNA, 20 bp, Artificial Sequence
  chemically synthesized
tataaaaacaaaaaagaagt

SEQ ID NO: 401565 - DNA, 20 bp, Artificial Sequence
  chemically synthesized
caattataaaaacaaaaaag

SEQ ID NO: 401566 - DNA, 20 bp, Artificial Sequence
  chemically synthesized
agacaattataaaaacaaaa

SEQ ID NO: 401567 - DNA, 20 bp, Artificial Sequence
  chemically synthesized
ttgaactgataattttttcg

SEQ ID NO: 401568 - DNA, 20 bp, Artificial Sequence
  chemically synthesized
attgtcttcgaaaaaattat

SEQ ID NO: 401569 - DNA, 20 bp, Artificial Sequence
  chemically synthesized
atatttagcaaaagtcataa

SEQ ID NO: 401570 - DNA, 20 bp, Artificial Sequence
  chemically synthesized
gatatttagcaaaagtcata

SEQ ID NO: 401571 - DNA, 20 bp, Artificial Sequence
  chemically synthesized
attataaagatatttagcaa

SEQ ID NO: 401572 - DNA, 20 bp, Artificial Sequence
  chemically synthesized
gaaagtattataaagatatt

SEQ ID NO: 401573 - DNA, 20 bp, Artificial Sequence
  chemically synthesized
atcacttggaaagtattata

SEQ ID NO: 401574 - DNA, 20 bp, Artificial Sequence
  chemically synthesized
atatctttataatactttcc

SEQ ID NO: 401575 - DNA, 20 bp, Artificial Sequence
  chemically synthesized
agtgggtgtgatcacttgga

SEQ ID NO: 401576 - DNA, 20 bp, Artificial Sequence
  chemically synthesized
tagaagtgggtgtgatcact

SEQ ID NO: 401577 - DNA, 20 bp, Artificial Sequence
  chemically synthesized
tttctgctaccagtagaagt

SEQ ID NO: 401578 - DNA, 20 bp, Artificial Sequence
  chemically synthesized
gtgatcacacccacttctac

SEQ ID NO: 401579 - DNA, 20 bp, Artificial Sequence
  chemically synthesized
ctttctgctaccagtagaag

SEQ ID NO: 401580 - DNA, 20 bp, Artificial Sequence
  chemically synthesized
atcacacccacttctactgg

SEQ ID NO: 401581 - DNA, 20 bp, Artificial Sequence
  chemically synthesized
attctttctgctaccagtag

SEQ ID NO: 401582 - DNA, 20 bp, Artificial Sequence
  chemically synthesized
acacccacttctactggtag

SEQ ID NO: 401583 - DNA, 20 bp, Artificial Sequence
  chemically synthesized
ctcattctttctgctaccag

SEQ ID NO: 401584 - DNA, 20 bp, Artificial Sequence
  chemically synthesized
aacctcattctttctgctac

SEQ ID NO: 401585 - DNA, 20 bp, Artificial Sequence
  chemically synthesized
ccacttctactggtagcaga

SEQ ID NO: 401586 - DNA, 20 bp, Artificial Sequence
  chemically synthesized
ctactggtagcagaaagaat

SEQ ID NO: 401587 - DNA, 20 bp, Artificial Sequence
  chemically synthesized
tactggtagcagaaagaatg

SEQ ID NO: 401588 - DNA, 20 bp, Artificial Sequence
  chemically synthesized
ggtagcagaaagaatgaggt

SEQ ID NO: 401589 - DNA, 20 bp, Artificial Sequence
  chemically synthesized
gtagcagaaagaatgaggtt

SEQ ID NO: 401590 - DNA, 20 bp, Artificial Sequence
  chemically synthesized
gaggttgggaattatcatct

SEQ ID NO: 401591 - DNA, 20 bp, Artificial Sequence
  chemically synthesized
gggaattatcatctcagccg

SEQ ID NO: 401592 - DNA, 20 bp, Artificial Sequence
  chemically synthesized
ggaattatcatctcagccgc

SEQ ID NO: 401593 - DNA, 20 bp, Artificial Sequence
  chemically synthesized
tgaatgacatacctgcggct

SEQ ID NO: 401594 - DNA, 20 bp, Artificial Sequence
  chemically synthesized
tcctatgaatgacatacctg

SEQ ID NO: 401595 - DNA, 20 bp, Artificial Sequence
  chemically synthesized
agccgcaggtatgtcattca

SEQ ID NO: 401596 - DNA, 20 bp, Artificial Sequence
  chemically synthesized
gccgcaggtatgtcattcat

SEQ ID NO: 401597 - DNA, 20 bp, Artificial Sequence
  chemically synthesized
cgcaggtatgtcattcatag

SEQ ID NO: 401598 - DNA, 20 bp, Artificial Sequence
  chemically synthesized
tcataggagtttcgttgctt

SEQ ID NO: 401599 - DNA, 20 bp, Artificial Sequence
  chemically synthesized
agcaataccgtaaaagacta

SEQ ID NO: 401600 - DNA, 20 bp, Artificial Sequence
  chemically synthesized
ttcgttgctttagtctttta

SEQ ID NO: 401601 - DNA, 20 bp, Artificial Sequence
  chemically synthesized
acaaagcagcaataccgtaa

SEQ ID NO: 401602 - DNA, 20 bp, Artificial Sequence
  chemically synthesized
tacggtattgctgctttgtt

SEQ ID NO: 401603 - DNA, 20 bp, Artificial Sequence
  chemically synthesized
ctccttacatctaaacaaag

SEQ ID NO: 401604 - DNA, 20 bp, Artificial Sequence
  chemically synthesized
gatctccttacatctaaaca

SEQ ID NO: 401605 - DNA, 20 bp, Artificial Sequence
  chemically synthesized
ttgctgctttgtttagatgt

SEQ ID NO: 401606 - DNA, 20 bp, Artificial Sequence
  chemically synthesized
tgctgctttgtttagatgta

SEQ ID NO: 401607 - DNA, 20 bp, Artificial Sequence
  chemically synthesized
ctgctttgtttagatgtaag

SEQ ID NO: 401608 - DNA, 20 bp, Artificial Sequence
  chemically synthesized
tatgattaaagcaaacatca

SEQ ID NO: 401609 - DNA, 20 bp, Artificial Sequence
  chemically synthesized
ttatgattaaagcaaacatc

SEQ ID NO: 401610 - DNA, 20 bp, Artificial Sequence
  chemically synthesized
aatcaaattaattatgatta

SEQ ID NO: 401611 - DNA, 20 bp, Artificial Sequence
  chemically synthesized
aattaatttgattactaatg

SEQ ID NO: 401612 - DNA, 20 bp, Artificial Sequence
  chemically synthesized
taatttgattactaatgaag

SEQ ID NO: 401613 - DNA, 20 bp, Artificial Sequence
  chemically synthesized
tgaaacatcttctacttcat

SEQ ID NO: 401614 - DNA, 20 bp, Artificial Sequence
  chemically synthesized
tttgattactaatgaagtag

SEQ ID NO: 401615 - DNA, 20 bp, Artificial Sequence
  chemically synthesized
ttgacaaaaataggaacata

SEQ ID NO: 401616 - DNA, 20 bp, Artificial Sequence
  chemically synthesized
acaagtattttgacaaaaat

SEQ ID NO: 401617 - DNA, 20 bp, Artificial Sequence
  chemically synthesized
aacaagtattttgacaaaaa

SEQ ID NO: 401618 - DNA, 20 bp, Artificial Sequence
  chemically synthesized
aaatgagccaggatgtaaac

SEQ ID NO: 401619 - DNA, 20 bp, Artificial Sequence
  chemically synthesized
caaaatacttgtttacatcc

SEQ ID NO: 401620 - DNA, 20 bp, Artificial Sequence
  chemically synthesized
gctcaatagataaatgagcc

SEQ ID NO: 401621 - DNA, 20 bp, Artificial Sequence
  chemically synthesized
tgctcaatagataaatgagc

SEQ ID NO: 401622 - DNA, 20 bp, Artificial Sequence
  chemically synthesized
taaatgctcaatagataaat

SEQ ID NO: 401623 - DNA, 20 bp, Artificial Sequence
  chemically synthesized
tcctggctcatttatctatt

SEQ ID NO: 401624 - DNA, 20 bp, Artificial Sequence
  chemically synthesized
ttaaaatattaaatgctcaa

SEQ ID NO: 401625 - DNA, 20 bp, Artificial Sequence
  chemically synthesized
tttaatattttaaaattaat

SEQ ID NO: 401626 - DNA, 20 bp, Artificial Sequence
  chemically synthesized
attttaaaattaattggaat

SEQ ID NO: 401627 - DNA, 20 bp, Artificial Sequence
  chemically synthesized
ggaatgagataattatatat

SEQ ID NO: 401628 - DNA, 20 bp, Artificial Sequence
  chemically synthesized
gcccatgacttgaaatgttt

SEQ ID NO: 401629 - DNA, 20 bp, Artificial Sequence
  chemically synthesized
tggtaattcttaaacatttc

SEQ ID NO: 401630 - DNA, 20 bp, Artificial Sequence
  chemically synthesized
ttcttaaacatttcaagtca

SEQ ID NO: 401631 - DNA, 20 bp, Artificial Sequence
  chemically synthesized
tcttaaacatttcaagtcat

SEQ ID NO: 401632 - DNA, 20 bp, Artificial Sequence
  chemically synthesized
tttcatcagataatcaaatg

SEQ ID NO: 401633 - DNA, 20 bp, Artificial Sequence
  chemically synthesized
attttcatcagataatcaaa

SEQ ID NO: 401634 - DNA, 20 bp, Artificial Sequence
  chemically synthesized
agaaggttcattattttcat

SEQ ID NO: 401635 - DNA, 20 bp, Artificial Sequence
  chemically synthesized
aaaataatgaaccttctcta

SEQ ID NO: 401636 - DNA, 20 bp, Artificial Sequence
  chemically synthesized
tagacatttttctatagaga

SEQ ID NO: 401637 - DNA, 20 bp, Artificial Sequence
  chemically synthesized
gtagacatttttctatagag

SEQ ID NO: 401638 - DNA, 20 bp, Artificial Sequence
  chemically synthesized
tgtgtagacatttttctata

SEQ ID NO: 401639 - DNA, 20 bp, Artificial Sequence
  chemically synthesized
tatgtgtagacatttttcta

SEQ ID NO: 401640 - DNA, 20 bp, Artificial Sequence
  chemically synthesized
tatatgcaaatatgtatgtg

SEQ ID NO: 401641 - DNA, 20 bp, Artificial Sequence
  chemically synthesized
tacacatacatatttgcata

SEQ ID NO: 401642 - DNA, 20 bp, Artificial Sequence
  chemically synthesized
catatttgcatatagtttca

SEQ ID NO: 401643 - DNA, 20 bp, Artificial Sequence
  chemically synthesized
tatttgcatatagtttcata

SEQ ID NO: 401644 - DNA, 20 bp, Artificial Sequence
  chemically synthesized
ggagttttctgcaaggaggt

SEQ ID NO: 401645 - DNA, 20 bp, Artificial Sequence
  chemically synthesized
agagttcactgacctccttg

SEQ ID NO: 401646 - DNA, 20 bp, Artificial Sequence
  chemically synthesized
tataggagttttctgcaagg

SEQ ID NO: 401647 - DNA, 20 bp, Artificial Sequence
  chemically synthesized
ttataggagttttctgcaag

SEQ ID NO: 401648 - DNA, 20 bp, Artificial Sequence
  chemically synthesized
ggttataggagttttctgca

SEQ ID NO: 401649 - DNA, 20 bp, Artificial Sequence
  chemically synthesized
tggttataggagttttctgc

SEQ ID NO: 401650 - DNA, 20 bp, Artificial Sequence
  chemically synthesized
cttggattttatggttatag

SEQ ID NO: 401651 - DNA, 20 bp, Artificial Sequence
  chemically synthesized
aacttggattttatggttat

SEQ ID NO: 401652 - DNA, 20 bp, Artificial Sequence
  chemically synthesized
taacttggattttatggtta

SEQ ID NO: 401653 - DNA, 20 bp, Artificial Sequence
  chemically synthesized
gatcgttaacttggatttta

SEQ ID NO: 401654 - DNA, 20 bp, Artificial Sequence
  chemically synthesized
ctcctataaccataaaatcc

SEQ ID NO: 401655 - DNA, 20 bp, Artificial Sequence
  chemically synthesized
cttaattttgatcgttaact

SEQ ID NO: 401656 - DNA, 20 bp, Artificial Sequence
  chemically synthesized
ccaagttaacgatcaaaatt

SEQ ID NO: 401657 - DNA, 20 bp, Artificial Sequence
  chemically synthesized
attcactgactaaaagtgag

SEQ ID NO: 401658 - DNA, 20 bp, Artificial Sequence
  chemically synthesized
aaaattaagctactcacttt

SEQ ID NO: 401659 - DNA, 20 bp, Artificial Sequence
  chemically synthesized
tccattcactgactaaaagt

SEQ ID NO: 401660 - DNA, 20 bp, Artificial Sequence
  chemically synthesized
ttaagctactcacttttagt

SEQ ID NO: 401661 - DNA, 20 bp, Artificial Sequence
  chemically synthesized
tatgtccattcactgactaa

SEQ ID NO: 401662 - DNA, 20 bp, Artificial Sequence
  chemically synthesized
actcacttttagtcagtgaa

SEQ ID NO: 401663 - DNA, 20 bp, Artificial Sequence
  chemically synthesized
gtgaatggacatattttccc

SEQ ID NO: 401664 - DNA, 20 bp, Artificial Sequence
  chemically synthesized
aatggacatattttcccaag

SEQ ID NO: 401665 - DNA, 20 bp, Artificial Sequence
  chemically synthesized
taaaaggcatatgaccactt

SEQ ID NO: 401666 - DNA, 20 bp, Artificial Sequence
  chemically synthesized
ttaaaaggcatatgaccact

SEQ ID NO: 401667 - DNA, 20 bp, Artificial Sequence
  chemically synthesized
atactaaaataaaaattaaa

SEQ ID NO: 401668 - DNA, 20 bp, Artificial Sequence
  chemically synthesized
catactaaaataaaaattaa

SEQ ID NO: 401669 - DNA, 20 bp, Artificial Sequence
  chemically synthesized
atgccttttaatttttattt

SEQ ID NO: 401670 - DNA, 20 bp, Artificial Sequence
  chemically synthesized
agtaaatacgtataaaattt

SEQ ID NO: 401671 - DNA, 20 bp, Artificial Sequence
  chemically synthesized
caataaaaatatatcaattc

SEQ ID NO: 401672 - DNA, 20 bp, Artificial Sequence
  chemically synthesized
cttttaagcaatatgacaaa

SEQ ID NO: 401673 - DNA, 20 bp, Artificial Sequence
  chemically synthesized
ctatttgtcatattgcttaa

SEQ ID NO: 401674 - DNA, 20 bp, Artificial Sequence
  chemically synthesized
gcttaaaatagtcaactttt

SEQ ID NO: 401675 - DNA, 20 bp, Artificial Sequence
  chemically synthesized
gcttaaaagttgactatttt

SEQ ID NO: 401676 - DNA, 20 bp, Artificial Sequence
  chemically synthesized
taagggtatacagcttaaaa

SEQ ID NO: 401677 - DNA, 20 bp, Artificial Sequence
  chemically synthesized
ttaggttaactaagggtata

SEQ ID NO: 401678 - DNA, 20 bp, Artificial Sequence
  chemically synthesized
tattttaagctgtataccct

SEQ ID NO: 401679 - DNA, 20 bp, Artificial Sequence
  chemically synthesized
ggtggctttaggttaactaa

SEQ ID NO: 401680 - DNA, 20 bp, Artificial Sequence
  chemically synthesized
tggtggctttaggttaacta

SEQ ID NO: 401681 - DNA, 20 bp, Artificial Sequence
  chemically synthesized
atggtggctttaggttaact

SEQ ID NO: 401682 - DNA, 20 bp, Artificial Sequence
  chemically synthesized
gtatacccttagttaaccta

SEQ ID NO: 401683 - DNA, 20 bp, Artificial Sequence
  chemically synthesized
tgtgtatgtatggtggcttt

SEQ ID NO: 401684 - DNA, 20 bp, Artificial Sequence
  chemically synthesized
atgtgtatgtatggtggctt

SEQ ID NO: 401685 - DNA, 20 bp, Artificial Sequence
  chemically synthesized
tgtgtgatgtgtatgtatgg

SEQ ID NO: 401686 - DNA, 20 bp, Artificial Sequence
  chemically synthesized
atatgtgtgatgtgtatgta

SEQ ID NO: 401687 - DNA, 20 bp, Artificial Sequence
  chemically synthesized
cacacatatataaattgttc

SEQ ID NO: 401688 - DNA, 20 bp, Artificial Sequence
  chemically synthesized
taacgtatcaaaatagtttc

SEQ ID NO: 401689 - DNA, 20 bp, Artificial Sequence
  chemically synthesized
atcatgttaacgtatcaaaa

SEQ ID NO: 401690 - DNA, 20 bp, Artificial Sequence
  chemically synthesized
taacatgatgtctatttctg

SEQ ID NO: 401691 - DNA, 20 bp, Artificial Sequence
  chemically synthesized
agactatgtgactacagaaa

SEQ ID NO: 401692 - DNA, 20 bp, Artificial Sequence
  chemically synthesized
tactatagactatgtgacta

SEQ ID NO: 401693 - DNA, 20 bp, Artificial Sequence
  chemically synthesized
tgtctatttctgtagtcaca

SEQ ID NO: 401694 - DNA, 20 bp, Artificial Sequence
  chemically synthesized
ttctgtagtcacatagtcta

SEQ ID NO: 401695 - DNA, 20 bp, Artificial Sequence
  chemically synthesized
cacattaatatgttttacta

SEQ ID NO: 401696 - DNA, 20 bp, Artificial Sequence
  chemically synthesized
aaaacatattaatgtgcaat

SEQ ID NO: 401697 - DNA, 20 bp, Artificial Sequence
  chemically synthesized
ttaatgtgcaatcagcaaca

SEQ ID NO: 401698 - DNA, 20 bp, Artificial Sequence
  chemically synthesized
caatcagcaacaaagcaaat

SEQ ID NO: 401699 - DNA, 20 bp, Artificial Sequence
  chemically synthesized
agcaacaaagcaaatgagaa

SEQ ID NO: 401700 - DNA, 20 bp, Artificial Sequence
  chemically synthesized
aagcaaatgagaaaagaata

SEQ ID NO: 401701 - DNA, 20 bp, Artificial Sequence
  chemically synthesized
atgagaaaagaataaagtga

SEQ ID NO: 401702 - DNA, 20 bp, Artificial Sequence
  chemically synthesized
ataatcattttgtaataaaa

SEQ ID NO: 401703 - DNA, 20 bp, Artificial Sequence
  chemically synthesized
aatgattatatgctcctgtt

SEQ ID NO: 401704 - DNA, 20 bp, Artificial Sequence
  chemically synthesized
tgcttgaaatgactaaacag

SEQ ID NO: 401705 - DNA, 20 bp, Artificial Sequence
  chemically synthesized
gctgcttgaaatgactaaac

SEQ ID NO: 401706 - DNA, 20 bp, Artificial Sequence
  chemically synthesized
tgctgcttgaaatgactaaa

SEQ ID NO: 401707 - DNA, 20 bp, Artificial Sequence
  chemically synthesized
tgctcctgtttagtcatttc

SEQ ID NO: 401708 - DNA, 20 bp, Artificial Sequence
  chemically synthesized
tcctgtttagtcatttcaag

SEQ ID NO: 401709 - DNA, 20 bp, Artificial Sequence
  chemically synthesized
aaaccctaaaggaaatgaaa

SEQ ID NO: 401710 - DNA, 20 bp, Artificial Sequence
  chemically synthesized
atattctatttcatttcctt

SEQ ID NO: 401711 - DNA, 20 bp, Artificial Sequence
  chemically synthesized
tattctatttcatttccttt

SEQ ID NO: 401712 - DNA, 20 bp, Artificial Sequence
  chemically synthesized
attctatttcatttccttta

SEQ ID NO: 401713 - DNA, 20 bp, Artificial Sequence
  chemically synthesized
cagttataaacaaaccctaa

SEQ ID NO: 401714 - DNA, 20 bp, Artificial Sequence
  chemically synthesized
tcagttataaacaaacccta

SEQ ID NO: 401715 - DNA, 20 bp, Artificial Sequence
  chemically synthesized
ttttattagtaaaataaaat

SEQ ID NO: 401716 - DNA, 20 bp, Artificial Sequence
  chemically synthesized
atgcacatgcatgtttttat

SEQ ID NO: 401717 - DNA, 20 bp, Artificial Sequence
  chemically synthesized
acatgcatgtgcatattaat

SEQ ID NO: 401718 - DNA, 20 bp, Artificial Sequence
  chemically synthesized
atgcatgtgcatattaataa

SEQ ID NO: 401719 - DNA, 20 bp, Artificial Sequence
  chemically synthesized
gcatgtgcatattaataaga

SEQ ID NO: 401720 - DNA, 20 bp, Artificial Sequence
  chemically synthesized
catgtgcatattaataagag

SEQ ID NO: 401721 - DNA, 20 bp, Artificial Sequence
  chemically synthesized
gcatattaataagagaggca

SEQ ID NO: 401722 - DNA, 20 bp, Artificial Sequence
  chemically synthesized
tattaataagagaggcaaag

SEQ ID NO: 401723 - DNA, 20 bp, Artificial Sequence
  chemically synthesized
gcaaagaagaaaatctctct

SEQ ID NO: 401724 - DNA, 20 bp, Artificial Sequence
  chemically synthesized
caaagaagaaaatctctctt

SEQ ID NO: 401725 - DNA, 20 bp, Artificial Sequence
  chemically synthesized
tcaagtaaattttcctaaga

SEQ ID NO: 401726 - DNA, 20 bp, Artificial Sequence
  chemically synthesized
tttcaagtaaattttcctaa

SEQ ID NO: 401727 - DNA, 20 bp, Artificial Sequence
  chemically synthesized
gttttcaagtaaattttcct

SEQ ID NO: 401728 - DNA, 20 bp, Artificial Sequence
  chemically synthesized
atctccagggaacagttttc

SEQ ID NO: 401729 - DNA, 20 bp, Artificial Sequence
  chemically synthesized
tttacttgaaaactgttccc

SEQ ID NO: 401730 - DNA, 20 bp, Artificial Sequence
  chemically synthesized
tacttgaaaactgttccctg

SEQ ID NO: 401731 - DNA, 20 bp, Artificial Sequence
  chemically synthesized
ttcttgacatctccagggaa

SEQ ID NO: 401732 - DNA, 20 bp, Artificial Sequence
  chemically synthesized
ttcacttcttgacatctcca

SEQ ID NO: 401733 - DNA, 20 bp, Artificial Sequence
  chemically synthesized
cttcacttcttgacatctcc

SEQ ID NO: 401734 - DNA, 20 bp, Artificial Sequence
  chemically synthesized
tcttcacttcttgacatctc

SEQ ID NO: 401735 - DNA, 20 bp, Artificial Sequence
  chemically synthesized
aactgttccctggagatgtc

SEQ ID NO: 401736 - DNA, 20 bp, Artificial Sequence
  chemically synthesized
tgttccctggagatgtcaag

SEQ ID NO: 401737 - DNA, 20 bp, Artificial Sequence
  chemically synthesized
cctggagatgtcaagaagtg

SEQ ID NO: 401738 - DNA, 20 bp, Artificial Sequence
  chemically synthesized
ttttgcaatttatgaagtag

SEQ ID NO: 401739 - DNA, 20 bp, Artificial Sequence
  chemically synthesized
agtttttgcaatttatgaag

SEQ ID NO: 401740 - DNA, 20 bp, Artificial Sequence
  chemically synthesized
gtcagtttttgcaatttatg

SEQ ID NO: 401741 - DNA, 20 bp, Artificial Sequence
  chemically synthesized
gaataaaataaaacgttggt

SEQ ID NO: 401742 - DNA, 20 bp, Artificial Sequence
  chemically synthesized
gagagaataaaataaaacgt

SEQ ID NO: 401743 - DNA, 20 bp, Artificial Sequence
  chemically synthesized
gttttattttattctctcta

SEQ ID NO: 401744 - DNA, 20 bp, Artificial Sequence
  chemically synthesized
ttttattttattctctctac

SEQ ID NO: 401745 - DNA, 20 bp, Artificial Sequence
  chemically synthesized
tttattttattctctctacg

SEQ ID NO: 401746 - DNA, 20 bp, Artificial Sequence
  chemically synthesized
atatgggatttccccgtaga

SEQ ID NO: 401747 - DNA, 20 bp, Artificial Sequence
  chemically synthesized
ttatatgggatttccccgta

SEQ ID NO: 401748 - DNA, 20 bp, Artificial Sequence
  chemically synthesized
ttttatatgggatttccccg

SEQ ID NO: 401749 - DNA, 20 bp, Artificial Sequence
  chemically synthesized
ttagaaagctaattttatat

SEQ ID NO: 401750 - DNA, 20 bp, Artificial Sequence
  chemically synthesized
gttagaaagctaattttata

SEQ ID NO: 401751 - DNA, 20 bp, Artificial Sequence
  chemically synthesized
ggggaaatcccatataaaat

SEQ ID NO: 401752 - DNA, 20 bp, Artificial Sequence
  chemically synthesized
aatttttatgtcatgttaga

SEQ ID NO: 401753 - DNA, 20 bp, Artificial Sequence
  chemically synthesized
atacaatttttatgtcatgt

SEQ ID NO: 401754 - DNA, 20 bp, Artificial Sequence
  chemically synthesized
ataaaaattgtatttcctct

SEQ ID NO: 401755 - DNA, 20 bp, Artificial Sequence
  chemically synthesized
aggggttaaagattactgag

SEQ ID NO: 401756 - DNA, 20 bp, Artificial Sequence
  chemically synthesized
aaggggttaaagattactga

SEQ ID NO: 401757 - DNA, 20 bp, Artificial Sequence
  chemically synthesized
agaaggggttaaagattact

SEQ ID NO: 401758 - DNA, 20 bp, Artificial Sequence
  chemically synthesized
aactttattagaaggggtta

SEQ ID NO: 401759 - DNA, 20 bp, Artificial Sequence
  chemically synthesized
aaaaataactttattagaag

SEQ ID NO: 401760 - DNA, 20 bp, Artificial Sequence
  chemically synthesized
taaaaataactttattagaa

SEQ ID NO: 401761 - DNA, 20 bp, Artificial Sequence
  chemically synthesized
atctttaaccccttctaata

SEQ ID NO: 401762 - DNA, 20 bp, Artificial Sequence
  chemically synthesized
ataaaaataactttattaga

SEQ ID NO: 401763 - DNA, 20 bp, Artificial Sequence
  chemically synthesized
aataaaaataactttattag

SEQ ID NO: 401764 - DNA, 20 bp, Artificial Sequence
  chemically synthesized
ctgaataaaaataactttat

SEQ ID NO: 401765 - DNA, 20 bp, Artificial Sequence
  chemically synthesized
ctaataaagttatttttatt

SEQ ID NO: 401766 - DNA, 20 bp, Artificial Sequence
  chemically synthesized
ttatttttattcagtatatg

SEQ ID NO: 401767 - DNA, 20 bp, Artificial Sequence
  chemically synthesized
ctaatcttaaaaaatatgaa

SEQ ID NO: 401768 - DNA, 20 bp, Artificial Sequence
  chemically synthesized
actaatcttaaaaaatatga

SEQ ID NO: 401769 - DNA, 20 bp, Artificial Sequence
  chemically synthesized
tgtggcctttcatatttttt

SEQ ID NO: 401770 - DNA, 20 bp, Artificial Sequence
  chemically synthesized
cctttcatattttttaagat

SEQ ID NO: 401771 - DNA, 20 bp, Artificial Sequence
  chemically synthesized
aaaagttaataacagggtaa

SEQ ID NO: 401772 - DNA, 20 bp, Artificial Sequence
  chemically synthesized
gaatataaaagttaataaca

SEQ ID NO: 401773 - DNA, 20 bp, Artificial Sequence
  chemically synthesized
ggaatataaaagttaataac

SEQ ID NO: 401774 - DNA, 20 bp, Artificial Sequence
  chemically synthesized
aggaatataaaagttaataa

SEQ ID NO: 401775 - DNA, 20 bp, Artificial Sequence
  chemically synthesized
tgagggactaaggaatataa

SEQ ID NO: 401776 - DNA, 20 bp, Artificial Sequence
  chemically synthesized
ttattaacttttatattcct

SEQ ID NO: 401777 - DNA, 20 bp, Artificial Sequence
  chemically synthesized
tttatattcctgagggacta

SEQ ID NO: 401778 - DNA, 20 bp, Artificial Sequence
  chemically synthesized
ttttatattccttagtccct

SEQ ID NO: 401779 - DNA, 20 bp, Artificial Sequence
  chemically synthesized
atttatattcctgagggact

SEQ ID NO: 401780 - DNA, 20 bp, Artificial Sequence
  chemically synthesized
tttatattccttagtccctc

SEQ ID NO: 401781 - DNA, 20 bp, Artificial Sequence
  chemically synthesized
tcccacatttatattcctga

SEQ ID NO: 401782 - DNA, 20 bp, Artificial Sequence
  chemically synthesized
atcccacatttatattcctg

SEQ ID NO: 401783 - DNA, 20 bp, Artificial Sequence
  chemically synthesized
tatcccacatttatattcct

SEQ ID NO: 401784 - DNA, 20 bp, Artificial Sequence
  chemically synthesized
gtccctcaggaatataaatg

SEQ ID NO: 401785 - DNA, 20 bp, Artificial Sequence
  chemically synthesized
tccctcaggaatataaatgt

SEQ ID NO: 401786 - DNA, 20 bp, Artificial Sequence
  chemically synthesized
ttgcaatattcttgattcac

SEQ ID NO: 401787 - DNA, 20 bp, Artificial Sequence
  chemically synthesized
gtaacttgctcttgtgaatc

SEQ ID NO: 401788 - DNA, 20 bp, Artificial Sequence
  chemically synthesized
gcaatattcttgattcacaa

SEQ ID NO: 401789 - DNA, 20 bp, Artificial Sequence
  chemically synthesized
tattcttgattcacaagagc

SEQ ID NO: 401790 - DNA, 20 bp, Artificial Sequence
  chemically synthesized
ttcacaagagcaagttactg

SEQ ID NO: 401791 - DNA, 20 bp, Artificial Sequence
  chemically synthesized
acaagagcaagttactgcag

SEQ ID NO: 401792 - DNA, 20 bp, Artificial Sequence
  chemically synthesized
tgcccagtatcattcttctg

SEQ ID NO: 401793 - DNA, 20 bp, Artificial Sequence
  chemically synthesized
ttactgcagaagaatgatac

SEQ ID NO: 401794 - DNA, 20 bp, Artificial Sequence
  chemically synthesized
tactgcagaagaatgatact

SEQ ID NO: 401795 - DNA, 20 bp, Artificial Sequence
  chemically synthesized
taatgttccctcagtttgcc

SEQ ID NO: 401796 - DNA, 20 bp, Artificial Sequence
  chemically synthesized
agaatgatactgggcaaact

SEQ ID NO: 401797 - DNA, 20 bp, Artificial Sequence
  chemically synthesized
gaatgatactgggcaaactg

SEQ ID NO: 401798 - DNA, 20 bp, Artificial Sequence
  chemically synthesized
aatgatactgggcaaactga

SEQ ID NO: 401799 - DNA, 20 bp, Artificial Sequence
  chemically synthesized
ccacagatttaatgttccct

SEQ ID NO: 401800 - DNA, 20 bp, Artificial Sequence
  chemically synthesized
ctgagggaacattaaatctg

SEQ ID NO: 401801 - DNA, 20 bp, Artificial Sequence
  chemically synthesized
gaacattaaatctgtggaac

SEQ ID NO: 401802 - DNA, 20 bp, Artificial Sequence
  chemically synthesized
gccactggaagccagttcca

SEQ ID NO: 401803 - DNA, 20 bp, Artificial Sequence
  chemically synthesized
aaatctgtggaactggcttc

SEQ ID NO: 401804 - DNA, 20 bp, Artificial Sequence
  chemically synthesized
cctgcaaagccactggaagc

SEQ ID NO: 401805 - DNA, 20 bp, Artificial Sequence
  chemically synthesized
tctgtggaactggcttccag

SEQ ID NO: 401806 - DNA, 20 bp, Artificial Sequence
  chemically synthesized
aagtcctgcaaagccactgg

SEQ ID NO: 401807 - DNA, 20 bp, Artificial Sequence
  chemically synthesized
aataagtcctgcaaagccac

SEQ ID NO: 401808 - DNA, 20 bp, Artificial Sequence
  chemically synthesized
actggcttccagtggctttg

SEQ ID NO: 401809 - DNA, 20 bp, Artificial Sequence
  chemically synthesized
ctggcttccagtggctttgc

SEQ ID NO: 401810 - DNA, 20 bp, Artificial Sequence
  chemically synthesized
caattctaataagtcctgca

SEQ ID NO: 401811 - DNA, 20 bp, Artificial Sequence
  chemically synthesized
agtggctttgcaggacttat

SEQ ID NO: 401812 - DNA, 20 bp, Artificial Sequence
  chemically synthesized
tttaaggccacaattctaat

SEQ ID NO: 401813 - DNA, 20 bp, Artificial Sequence
  chemically synthesized
tgcaggacttattagaattg

SEQ ID NO: 401814 - DNA, 20 bp, Artificial Sequence
  chemically synthesized
gctaaggcttggcaatttta

SEQ ID NO: 401815 - DNA, 20 bp, Artificial Sequence
  chemically synthesized
cgctaaggcttggcaatttt

SEQ ID NO: 401816 - DNA, 20 bp, Artificial Sequence
  chemically synthesized
attgtggccttaaaattgcc

SEQ ID NO: 401817 - DNA, 20 bp, Artificial Sequence
  chemically synthesized
gccttaaaattgccaagcct

SEQ ID NO: 401818 - DNA, 20 bp, Artificial Sequence
  chemically synthesized
cagttaaagacgctaaggct

SEQ ID NO: 401819 - DNA, 20 bp, Artificial Sequence
  chemically synthesized
tttcacagttaaagacgcta

SEQ ID NO: 401820 - DNA, 20 bp, Artificial Sequence
  chemically synthesized
atttcacagttaaagacgct

SEQ ID NO: 401821 - DNA, 20 bp, Artificial Sequence
  chemically synthesized
atattctcatttcacagtta

SEQ ID NO: 401822 - DNA, 20 bp, Artificial Sequence
  chemically synthesized
agcgtctttaactgtgaaat

SEQ ID NO: 401823 - DNA, 20 bp, Artificial Sequence
  chemically synthesized
caattaatattctcatttca

SEQ ID NO: 401824 - DNA, 20 bp, Artificial Sequence
  chemically synthesized
caatagctccatgagttaaa

SEQ ID NO: 401825 - DNA, 20 bp, Artificial Sequence
  chemically synthesized
attaattgctctttaactca

SEQ ID NO: 401826 - DNA, 20 bp, Artificial Sequence
  chemically synthesized
gtcaatagctccatgagtta

SEQ ID NO: 401827 - DNA, 20 bp, Artificial Sequence
  chemically synthesized
taattgctctttaactcatg

SEQ ID NO: 401828 - DNA, 20 bp, Artificial Sequence
  chemically synthesized
tatcctgtcaatagctccat

SEQ ID NO: 401829 - DNA, 20 bp, Artificial Sequence
  chemically synthesized
ttaactcatggagctattga

SEQ ID NO: 401830 - DNA, 20 bp, Artificial Sequence
  chemically synthesized
taactcatggagctattgac

SEQ ID NO: 401831 - DNA, 20 bp, Artificial Sequence
  chemically synthesized
atctcattatatcctgtcaa

SEQ ID NO: 401832 - DNA, 20 bp, Artificial Sequence
  chemically synthesized
agctattgacaggatataat

SEQ ID NO: 401833 - DNA, 20 bp, Artificial Sequence
  chemically synthesized
tattttataaattattacac

SEQ ID NO: 401834 - DNA, 20 bp, Artificial Sequence
  chemically synthesized
atttataaaataaatattta

SEQ ID NO: 401835 - DNA, 20 bp, Artificial Sequence
  chemically synthesized
tgcaatgtccaggtcatagt

SEQ ID NO: 401836 - DNA, 20 bp, Artificial Sequence
  chemically synthesized
acagaatgcttactatgacc

SEQ ID NO: 401837 - DNA, 20 bp, Artificial Sequence
  chemically synthesized
ctagtgcaatgtccaggtca

SEQ ID NO: 401838 - DNA, 20 bp, Artificial Sequence
  chemically synthesized
cagtaactagtgcaatgtcc

SEQ ID NO: 401839 - DNA, 20 bp, Artificial Sequence
  chemically synthesized
tcagtaactagtgcaatgtc

SEQ ID NO: 401840 - DNA, 20 bp, Artificial Sequence
  chemically synthesized
ctatgacctggacattgcac

SEQ ID NO: 401841 - DNA, 20 bp, Artificial Sequence
  chemically synthesized
ttgtttatattttcagtaac

SEQ ID NO: 401842 - DNA, 20 bp, Artificial Sequence
  chemically synthesized
ctgaatcttgtttatatttt

SEQ ID NO: 401843 - DNA, 20 bp, Artificial Sequence
  chemically synthesized
tagttactgaaaatataaac

SEQ ID NO: 401844 - DNA, 20 bp, Artificial Sequence
  chemically synthesized
ctgaaaatataaacaagatt

SEQ ID NO: 401845 - DNA, 20 bp, Artificial Sequence
  chemically synthesized
aatataaacaagattcagtc

SEQ ID NO: 401846 - DNA, 20 bp, Artificial Sequence
  chemically synthesized
atataaacaagattcagtct

SEQ ID NO: 401847 - DNA, 20 bp, Artificial Sequence
  chemically synthesized
ataaacaagattcagtctgg

SEQ ID NO: 401848 - DNA, 20 bp, Artificial Sequence
  chemically synthesized
aaacaagattcagtctggga

SEQ ID NO: 401849 - DNA, 20 bp, Artificial Sequence
  chemically synthesized
tactaggctaagagctctcc

SEQ ID NO: 401850 - DNA, 20 bp, Artificial Sequence
  chemically synthesized
attcagtctgggagagctct

SEQ ID NO: 401851 - DNA, 20 bp, Artificial Sequence
  chemically synthesized
gtctgggagagctcttagcc

SEQ ID NO: 401852 - DNA, 20 bp, Artificial Sequence
  chemically synthesized
tctattatctactaggctaa

SEQ ID NO: 401853 - DNA, 20 bp, Artificial Sequence
  chemically synthesized
tgggagagctcttagcctag

SEQ ID NO: 401854 - DNA, 20 bp, Artificial Sequence
  chemically synthesized
tgtctattatctactaggct

SEQ ID NO: 401855 - DNA, 20 bp, Artificial Sequence
  chemically synthesized
tgatgtgtctattatctact

SEQ ID NO: 401856 - DNA, 20 bp, Artificial Sequence
  chemically synthesized
atgatgtgtctattatctac

SEQ ID NO: 401857 - DNA, 20 bp, Artificial Sequence
  chemically synthesized
gctcttagcctagtagataa

SEQ ID NO: 401858 - DNA, 20 bp, Artificial Sequence
  chemically synthesized
agtagataatagacacatca

SEQ ID NO: 401859 - DNA, 20 bp, Artificial Sequence
  chemically synthesized
caaaaatatatataaattta

SEQ ID NO: 401860 - DNA, 20 bp, Artificial Sequence
  chemically synthesized
tataaatttaaagcgtatta

SEQ ID NO: 401861 - DNA, 20 bp, Artificial Sequence
  chemically synthesized
ataaatttaaagcgtattat

SEQ ID NO: 401862 - DNA, 20 bp, Artificial Sequence
  chemically synthesized
aaatttaaagcgtattatag

SEQ ID NO: 401863 - DNA, 20 bp, Artificial Sequence
  chemically synthesized
taaagcgtattataggagca

SEQ ID NO: 401864 - DNA, 20 bp, Artificial Sequence
  chemically synthesized
aagcgtattataggagcatg

SEQ ID NO: 401865 - DNA, 20 bp, Artificial Sequence
  chemically synthesized
gtattataggagcatggaga

SEQ ID NO: 401866 - DNA, 20 bp, Artificial Sequence
  chemically synthesized
tattataggagcatggagaa

SEQ ID NO: 401867 - DNA, 20 bp, Artificial Sequence
  chemically synthesized
agcatggagaaaggaatatg

SEQ ID NO: 401868 - DNA, 20 bp, Artificial Sequence
  chemically synthesized
gaaaggaatatgtagccaca

SEQ ID NO: 401869 - DNA, 20 bp, Artificial Sequence
  chemically synthesized
aaaggaatatgtagccacat

SEQ ID NO: 401870 - DNA, 20 bp, Artificial Sequence
  chemically synthesized
tatcttttctaacacccatg

SEQ ID NO: 401871 - DNA, 20 bp, Artificial Sequence
  chemically synthesized
atatgtagccacatgggtgt

SEQ ID NO: 401872 - DNA, 20 bp, Artificial Sequence
  chemically synthesized
tagccacatgggtgttagaa

SEQ ID NO: 401873 - DNA, 20 bp, Artificial Sequence
  chemically synthesized
gggtgttagaaaagatattt

SEQ ID NO: 401874 - DNA, 20 bp, Artificial Sequence
  chemically synthesized
gtgttagaaaagatattttg

SEQ ID NO: 401875 - DNA, 20 bp, Artificial Sequence
  chemically synthesized
ttagaaaagatattttggag

SEQ ID NO: 401876 - DNA, 20 bp, Artificial Sequence
  chemically synthesized
tagaaaagatattttggaga

SEQ ID NO: 401877 - DNA, 20 bp, Artificial Sequence
  chemically synthesized
agatattttggagaaggtaa

SEQ ID NO: 401878 - DNA, 20 bp, Artificial Sequence
  chemically synthesized
gatattttggagaaggtaat

SEQ ID NO: 401879 - DNA, 20 bp, Artificial Sequence
  chemically synthesized
attttggagaaggtaatggg

SEQ ID NO: 401880 - DNA, 20 bp, Artificial Sequence
  chemically synthesized
ttttggagaaggtaatgggt

SEQ ID NO: 401881 - DNA, 20 bp, Artificial Sequence
  chemically synthesized
gagaaggtaatgggtaggtt

SEQ ID NO: 401882 - DNA, 20 bp, Artificial Sequence
  chemically synthesized
ggtaatgggtaggttgagtt

SEQ ID NO: 401883 - DNA, 20 bp, Artificial Sequence
  chemically synthesized
aatgggtaggttgagttcag

SEQ ID NO: 401884 - DNA, 20 bp, Artificial Sequence
  chemically synthesized
atgggtaggttgagttcaga

SEQ ID NO: 401885 - DNA, 20 bp, Artificial Sequence
  chemically synthesized
taggttgagttcagaaggat

SEQ ID NO: 401886 - DNA, 20 bp, Artificial Sequence
  chemically synthesized
ggttgagttcagaaggatga

SEQ ID NO: 401887 - DNA, 20 bp, Artificial Sequence
  chemically synthesized
gagttcagaaggatgagaga

SEQ ID NO: 401888 - DNA, 20 bp, Artificial Sequence
  chemically synthesized
cagaaggatgagagaaagta

SEQ ID NO: 401889 - DNA, 20 bp, Artificial Sequence
  chemically synthesized
aaggatgagagaaagtaaag

SEQ ID NO: 401890 - DNA, 20 bp, Artificial Sequence
  chemically synthesized
aggatgagagaaagtaaaga

SEQ ID NO: 401891 - DNA, 20 bp, Artificial Sequence
  chemically synthesized
gagaaagtaaagaaggaata

SEQ ID NO: 401892 - DNA, 20 bp, Artificial Sequence
  chemically synthesized
agaaagtaaagaaggaataa

SEQ ID NO: 401893 - DNA, 20 bp, Artificial Sequence
  chemically synthesized
aagtaaagaaggaataaagg

SEQ ID NO: 401894 - DNA, 20 bp, Artificial Sequence
  chemically synthesized
agtaaagaaggaataaaggt

SEQ ID NO: 401895 - DNA, 20 bp, Artificial Sequence
  chemically synthesized
taaagaaggaataaaggtag

SEQ ID NO: 401896 - DNA, 20 bp, Artificial Sequence
  chemically synthesized
aaagaaggaataaaggtagg

SEQ ID NO: 401897 - DNA, 20 bp, Artificial Sequence
  chemically synthesized
agaaggaataaaggtaggag

SEQ ID NO: 401898 - DNA, 20 bp, Artificial Sequence
  chemically synthesized
gaaggaataaaggtaggagg

SEQ ID NO: 401899 - DNA, 20 bp, Artificial Sequence
  chemically synthesized
ataaaggtaggaggaggata

SEQ ID NO: 401900 - DNA, 20 bp, Artificial Sequence
  chemically synthesized
ggataaagatgaatctcact

SEQ ID NO: 401901 - DNA, 20 bp, Artificial Sequence
  chemically synthesized
taaagatgaatctcactgag

SEQ ID NO: 401902 - DNA, 20 bp, Artificial Sequence
  chemically synthesized
gtccttactgtctgctcagt

SEQ ID NO: 401903 - DNA, 20 bp, Artificial Sequence
  chemically synthesized
gatgaatctcactgagcaga

SEQ ID NO: 401904 - DNA, 20 bp, Artificial Sequence
  chemically synthesized
ccttgtccttactgtctgct

SEQ ID NO: 401905 - DNA, 20 bp, Artificial Sequence
  chemically synthesized
aatctcactgagcagacagt

SEQ ID NO: 401906 - DNA, 20 bp, Artificial Sequence
  chemically synthesized
atctcactgagcagacagta

SEQ ID NO: 401907 - DNA, 20 bp, Artificial Sequence
  chemically synthesized
actgagcagacagtaaggac

SEQ ID NO: 401908 - DNA, 20 bp, Artificial Sequence
  chemically synthesized
ctgagcagacagtaaggaca

SEQ ID NO: 401909 - DNA, 20 bp, Artificial Sequence
  chemically synthesized
gcagacagtaaggacaagga

SEQ ID NO: 401910 - DNA, 20 bp, Artificial Sequence
  chemically synthesized
agacagtaaggacaaggaca

SEQ ID NO: 401911 - DNA, 20 bp, Artificial Sequence
  chemically synthesized
aaggacaaggacagagtgat

SEQ ID NO: 401912 - DNA, 20 bp, Artificial Sequence
  chemically synthesized
acagagtgataagaaactga

SEQ ID NO: 401913 - DNA, 20 bp, Artificial Sequence
  chemically synthesized
aatgaatgagcgtgtacttt

SEQ ID NO: 401914 - DNA, 20 bp, Artificial Sequence
  chemically synthesized
aacagaattgcataatgaat

SEQ ID NO: 401915 - DNA, 20 bp, Artificial Sequence
  chemically synthesized
cattttagagtgcaacaaaa

SEQ ID NO: 401916 - DNA, 20 bp, Artificial Sequence
  chemically synthesized
actccctttctcacatttta

SEQ ID NO: 401917 - DNA, 20 bp, Artificial Sequence
  chemically synthesized
tttgttgcactctaaaatgt

SEQ ID NO: 401918 - DNA, 20 bp, Artificial Sequence
  chemically synthesized
ccactccctttctcacattt

SEQ ID NO: 401919 - DNA, 20 bp, Artificial Sequence
  chemically synthesized
ttgcactctaaaatgtgaga

SEQ ID NO: 401920 - DNA, 20 bp, Artificial Sequence
  chemically synthesized
tgcactctaaaatgtgagaa

SEQ ID NO: 401921 - DNA, 20 bp, Artificial Sequence
  chemically synthesized
gcactctaaaatgtgagaaa

SEQ ID NO: 401922 - DNA, 20 bp, Artificial Sequence
  chemically synthesized
actctaaaatgtgagaaagg

SEQ ID NO: 401923 - DNA, 20 bp, Artificial Sequence
  chemically synthesized
ctaaaatgtgagaaagggag

SEQ ID NO: 401924 - DNA, 20 bp, Artificial Sequence
  chemically synthesized
atgtgagaaagggagtggca

SEQ ID NO: 401925 - DNA, 20 bp, Artificial Sequence
  chemically synthesized
gcatggaatgaaattgcaat

SEQ ID NO: 401926 - DNA, 20 bp, Artificial Sequence
  chemically synthesized
atggaatgaaattgcaatga

SEQ ID NO: 401927 - DNA, 20 bp, Artificial Sequence
  chemically synthesized
aatgaaattgcaatgagagt

SEQ ID NO: 401928 - DNA, 20 bp, Artificial Sequence
  chemically synthesized
atgaaattgcaatgagagtt

SEQ ID NO: 401929 - DNA, 20 bp, Artificial Sequence
  chemically synthesized
gaaattgcaatgagagttag

SEQ ID NO: 401930 - DNA, 20 bp, Artificial Sequence
  chemically synthesized
ttgcaatgagagttaggagc

SEQ ID NO: 401931 - DNA, 20 bp, Artificial Sequence
  chemically synthesized
gagagttaggagcgagatgc

SEQ ID NO: 401932 - DNA, 20 bp, Artificial Sequence
  chemically synthesized
gagttaggagcgagatgctg

SEQ ID NO: 401933 - DNA, 20 bp, Artificial Sequence
  chemically synthesized
gttaggagcgagatgctgga

SEQ ID NO: 401934 - DNA, 20 bp, Artificial Sequence
  chemically synthesized
gaggtcttaaggaggctctc

SEQ ID NO: 401935 - DNA, 20 bp, Artificial Sequence
  chemically synthesized
agatgctggagagcctcctt

SEQ ID NO: 401936 - DNA, 20 bp, Artificial Sequence
  chemically synthesized
gcagagaagaggtcttaagg

SEQ ID NO: 401937 - DNA, 20 bp, Artificial Sequence
  chemically synthesized
ggcagagaagaggtcttaag

SEQ ID NO: 401938 - DNA, 20 bp, Artificial Sequence
  chemically synthesized
atggcagagaagaggtctta

SEQ ID NO: 401939 - DNA, 20 bp, Artificial Sequence
  chemically synthesized
gatggcagagaagaggtctt

SEQ ID NO: 401940 - DNA, 20 bp, Artificial Sequence
  chemically synthesized
tttatctgatggcagagaag

SEQ ID NO: 401941 - DNA, 20 bp, Artificial Sequence
  chemically synthesized
gtttatctgatggcagagaa

SEQ ID NO: 401942 - DNA, 20 bp, Artificial Sequence
  chemically synthesized
ttgtttatctgatggcagag

SEQ ID NO: 401943 - DNA, 20 bp, Artificial Sequence
  chemically synthesized
taagacctcttctctgccat

SEQ ID NO: 401944 - DNA, 20 bp, Artificial Sequence
  chemically synthesized
acattgtttatctgatggca

SEQ ID NO: 401945 - DNA, 20 bp, Artificial Sequence
  chemically synthesized
ttacattgtttatctgatgg

SEQ ID NO: 401946 - DNA, 20 bp, Artificial Sequence
  chemically synthesized
cacttacattgtttatctga

SEQ ID NO: 401947 - DNA, 20 bp, Artificial Sequence
  chemically synthesized
tgccatcagataaacaatgt

SEQ ID NO: 401948 - DNA, 20 bp, Artificial Sequence
  chemically synthesized
cagataaacaatgtaagtga

SEQ ID NO: 401949 - DNA, 20 bp, Artificial Sequence
  chemically synthesized
aagtgaaagcatttaaaaac

SEQ ID NO: 401950 - DNA, 20 bp, Artificial Sequence
  chemically synthesized
agtgaaagcatttaaaaact

SEQ ID NO: 401951 - DNA, 20 bp, Artificial Sequence
  chemically synthesized
gtgaaagcatttaaaaactg

SEQ ID NO: 401952 - DNA, 20 bp, Artificial Sequence
  chemically synthesized
tgaaagcatttaaaaactgg

SEQ ID NO: 401953 - DNA, 20 bp, Artificial Sequence
  chemically synthesized
ttctgtttttttttttcccc

SEQ ID NO: 401954 - DNA, 20 bp, Artificial Sequence
  chemically synthesized
aactgggggaaaaaaaaaaa

SEQ ID NO: 401955 - DNA, 20 bp, Artificial Sequence
  chemically synthesized
gaaaaaaaaaaacagaaaaa

SEQ ID NO: 401956 - DNA, 20 bp, Artificial Sequence
  chemically synthesized
ggaataattgttagtgttta

SEQ ID NO: 401957 - DNA, 20 bp, Artificial Sequence
  chemically synthesized
tgtgtaatgggaataattgt

SEQ ID NO: 401958 - DNA, 20 bp, Artificial Sequence
  chemically synthesized
ggttaattgctttgtgtaat

SEQ ID NO: 401959 - DNA, 20 bp, Artificial Sequence
  chemically synthesized
acaattattcccattacaca

SEQ ID NO: 401960 - DNA, 20 bp, Artificial Sequence
  chemically synthesized
tggttaattgctttgtgtaa

SEQ ID NO: 401961 - DNA, 20 bp, Artificial Sequence
  chemically synthesized
ttattttcttgtacagatta

SEQ ID NO: 401962 - DNA, 20 bp, Artificial Sequence
  chemically synthesized
caattaaccataatctgtac

SEQ ID NO: 401963 - DNA, 20 bp, Artificial Sequence
  chemically synthesized
aaaaattttattttcttgta

SEQ ID NO: 401964 - DNA, 20 bp, Artificial Sequence
  chemically synthesized
aaataaaatttttttgacac

SEQ ID NO: 401965 - DNA, 20 bp, Artificial Sequence
  chemically synthesized
aataaaatttttttgacaca

SEQ ID NO: 401966 - DNA, 20 bp, Artificial Sequence
  chemically synthesized
tccagcctggggaacagagc

SEQ ID NO: 401967 - DNA, 20 bp, Artificial Sequence
  chemically synthesized
caaggtctcgctctgttccc

SEQ ID NO: 401968 - DNA, 20 bp, Artificial Sequence
  chemically synthesized
gcactccagcctggggaaca

SEQ ID NO: 401969 - DNA, 20 bp, Artificial Sequence
  chemically synthesized
aaggtctcgctctgttcccc

SEQ ID NO: 401970 - DNA, 20 bp, Artificial Sequence
  chemically synthesized
atgcactccagcctggggaa

SEQ ID NO: 401971 - DNA, 20 bp, Artificial Sequence
  chemically synthesized
tctcgctctgttccccaggc

SEQ ID NO: 401972 - DNA, 20 bp, Artificial Sequence
  chemically synthesized
tcgctctgttccccaggctg

SEQ ID NO: 401973 - DNA, 20 bp, Artificial Sequence
  chemically synthesized
ttccaatgcactccagcctg

SEQ ID NO: 401974 - DNA, 20 bp, Artificial Sequence
  chemically synthesized
gttccaatgcactccagcct

SEQ ID NO: 401975 - DNA, 20 bp, Artificial Sequence
  chemically synthesized
ggttccaatgcactccagcc

SEQ ID NO: 401976 - DNA, 20 bp, Artificial Sequence
  chemically synthesized
gtgatggttccaatgcactc

SEQ ID NO: 401977 - DNA, 20 bp, Artificial Sequence
  chemically synthesized
ttccccaggctggagtgcat

SEQ ID NO: 401978 - DNA, 20 bp, Artificial Sequence
  chemically synthesized
ggagtgcattggaaccatca

SEQ ID NO: 401979 - DNA, 20 bp, Artificial Sequence
  chemically synthesized
gaagttacagtgagctgtga

SEQ ID NO: 401980 - DNA, 20 bp, Artificial Sequence
  chemically synthesized
caggggtctgaagttacagt

SEQ ID NO: 401981 - DNA, 20 bp, Artificial Sequence
  chemically synthesized
atcacagctcactgtaactt

SEQ ID NO: 401982 - DNA, 20 bp, Artificial Sequence
  chemically synthesized
agcccaggggtctgaagtta

SEQ ID NO: 401983 - DNA, 20 bp, Artificial Sequence
  chemically synthesized
tgcttgagcccaggggtctg

SEQ ID NO: 401984 - DNA, 20 bp, Artificial Sequence
  chemically synthesized
tcactgtaacttcagacccc

SEQ ID NO: 401985 - DNA, 20 bp, Artificial Sequence
  chemically synthesized
cactgtaacttcagacccct

SEQ ID NO: 401986 - DNA, 20 bp, Artificial Sequence
  chemically synthesized
agagaattgcttgagcccag

SEQ ID NO: 401987 - DNA, 20 bp, Artificial Sequence
  chemically synthesized
aacttcagacccctgggctc

SEQ ID NO: 401988 - DNA, 20 bp, Artificial Sequence
  chemically synthesized
gagagaattgcttgagccca

SEQ ID NO: 401989 - DNA, 20 bp, Artificial Sequence
  chemically synthesized
tgagagaattgcttgagccc

SEQ ID NO: 401990 - DNA, 20 bp, Artificial Sequence
  chemically synthesized
gtgagagaattgcttgagcc

SEQ ID NO: 401991 - DNA, 20 bp, Artificial Sequence
  chemically synthesized
cagaggtgagagaattgctt

SEQ ID NO: 401992 - DNA, 20 bp, Artificial Sequence
  chemically synthesized
tactgaggaggcagaggtga

SEQ ID NO: 401993 - DNA, 20 bp, Artificial Sequence
  chemically synthesized
gctactgaggaggcagaggt

SEQ ID NO: 401994 - DNA, 20 bp, Artificial Sequence
  chemically synthesized
cctagctactgaggaggcag

SEQ ID NO: 401995 - DNA, 20 bp, Artificial Sequence
  chemically synthesized
tcctagctactgaggaggca

SEQ ID NO: 401996 - DNA, 20 bp, Artificial Sequence
  chemically synthesized
ttctctcacctctgcctcct

SEQ ID NO: 401997 - DNA, 20 bp, Artificial Sequence
  chemically synthesized
agtcctagctactgaggagg

SEQ ID NO: 401998 - DNA, 20 bp, Artificial Sequence
  chemically synthesized
tctcacctctgcctcctcag

SEQ ID NO: 401999 - DNA, 20 bp, Artificial Sequence
  chemically synthesized
tagagtcctagctactgagg

SEQ ID NO: 402000 - DNA, 20 bp, Artificial Sequence
  chemically synthesized
ctagagtcctagctactgag

SEQ ID NO: 402001 - DNA, 20 bp, Artificial Sequence
  chemically synthesized
acctctgcctcctcagtagc

SEQ ID NO: 402002 - DNA, 20 bp, Artificial Sequence
  chemically synthesized
gcctagagtcctagctactg

SEQ ID NO: 402003 - DNA, 20 bp, Artificial Sequence
  chemically synthesized
cctctgcctcctcagtagct

SEQ ID NO: 402004 - DNA, 20 bp, Artificial Sequence
  chemically synthesized
tgcctagagtcctagctact

SEQ ID NO: 402005 - DNA, 20 bp, Artificial Sequence
  chemically synthesized
ctcctcagtagctaggactc

SEQ ID NO: 402006 - DNA, 20 bp, Artificial Sequence
  chemically synthesized
tcctcagtagctaggactct

SEQ ID NO: 402007 - DNA, 20 bp, Artificial Sequence
  chemically synthesized
gtgatgtgtgcctagagtcc

SEQ ID NO: 402008 - DNA, 20 bp, Artificial Sequence
  chemically synthesized
gatgtggtgatgtgtgccta

SEQ ID NO: 402009 - DNA, 20 bp, Artificial Sequence
  chemically synthesized
cagatgtggtgatgtgtgcc

SEQ ID NO: 402010 - DNA, 20 bp, Artificial Sequence
  chemically synthesized
aattaaaaattagacagatg

SEQ ID NO: 402011 - DNA, 20 bp, Artificial Sequence
  chemically synthesized
aaaaaaaattaaaaattaga

SEQ ID NO: 402012 - DNA, 20 bp, Artificial Sequence
  chemically synthesized
aaagaaaaaaaattaaaaat

SEQ ID NO: 402013 - DNA, 20 bp, Artificial Sequence
  chemically synthesized
ttaattttttttcttttgta

SEQ ID NO: 402014 - DNA, 20 bp, Artificial Sequence
  chemically synthesized
gggagaccccatctttacaa

SEQ ID NO: 402015 - DNA, 20 bp, Artificial Sequence
  chemically synthesized
ttttttttcttttgtaaaga

SEQ ID NO: 402016 - DNA, 20 bp, Artificial Sequence
  chemically synthesized
tttttttcttttgtaaagat

SEQ ID NO: 402017 - DNA, 20 bp, Artificial Sequence
  chemically synthesized
ttttttcttttgtaaagatg

SEQ ID NO: 402018 - DNA, 20 bp, Artificial Sequence
  chemically synthesized
accagcctgggcaacatggg

SEQ ID NO: 402019 - DNA, 20 bp, Artificial Sequence
  chemically synthesized
agaccagcctgggcaacatg

SEQ ID NO: 402020 - DNA, 20 bp, Artificial Sequence
  chemically synthesized
gagaccagcctgggcaacat

SEQ ID NO: 402021 - DNA, 20 bp, Artificial Sequence
  chemically synthesized
tggggtctccccatgttgcc

SEQ ID NO: 402022 - DNA, 20 bp, Artificial Sequence
  chemically synthesized
tgagaccagcctgggcaaca

SEQ ID NO: 402023 - DNA, 20 bp, Artificial Sequence
  chemically synthesized
ggggtctccccatgttgccc

SEQ ID NO: 402024 - DNA, 20 bp, Artificial Sequence
  chemically synthesized
tctccccatgttgcccaggc

SEQ ID NO: 402025 - DNA, 20 bp, Artificial Sequence
  chemically synthesized
caggagtttgagaccagcct

SEQ ID NO: 402026 - DNA, 20 bp, Artificial Sequence
  chemically synthesized
ccaggagtttgagaccagcc

SEQ ID NO: 402027 - DNA, 20 bp, Artificial Sequence
  chemically synthesized
ggagtccaggagtttgagac

SEQ ID NO: 402028 - DNA, 20 bp, Artificial Sequence
  chemically synthesized
ccaggctggtctcaaactcc

SEQ ID NO: 402029 - DNA, 20 bp, Artificial Sequence
  chemically synthesized
ttgatggagtccaggagttt

SEQ ID NO: 402030 - DNA, 20 bp, Artificial Sequence
  chemically synthesized
gaaggattgatggagtccag

SEQ ID NO: 402031 - DNA, 20 bp, Artificial Sequence
  chemically synthesized
cagaaggattgatggagtcc

SEQ ID NO: 402032 - DNA, 20 bp, Artificial Sequence
  chemically synthesized
acagaaggattgatggagtc

SEQ ID NO: 402033 - DNA, 20 bp, Artificial Sequence
  chemically synthesized
ctgagacagaaggattgatg

SEQ ID NO: 402034 - DNA, 20 bp, Artificial Sequence
  chemically synthesized
ggctgagacagaaggattga

SEQ ID NO: 402035 - DNA, 20 bp, Artificial Sequence
  chemically synthesized
ctccatcaatccttctgtct

SEQ ID NO: 402036 - DNA, 20 bp, Artificial Sequence
  chemically synthesized
ctttgggaggctgagacaga

SEQ ID NO: 402037 - DNA, 20 bp, Artificial Sequence
  chemically synthesized
actttgggaggctgagacag

SEQ ID NO: 402038 - DNA, 20 bp, Artificial Sequence
  chemically synthesized
agcactttgggaggctgaga

SEQ ID NO: 402039 - DNA, 20 bp, Artificial Sequence
  chemically synthesized
tcctagcactttgggaggct

SEQ ID NO: 402040 - DNA, 20 bp, Artificial Sequence
  chemically synthesized
ccttctgtctcagcctccca

SEQ ID NO: 402041 - DNA, 20 bp, Artificial Sequence
  chemically synthesized
tgtagtcctagcactttggg

SEQ ID NO: 402042 - DNA, 20 bp, Artificial Sequence
  chemically synthesized
ctgtagtcctagcactttgg

SEQ ID NO: 402043 - DNA, 20 bp, Artificial Sequence
  chemically synthesized
gtctcagcctcccaaagtgc

SEQ ID NO: 402044 - DNA, 20 bp, Artificial Sequence
  chemically synthesized
gcctgtagtcctagcacttt

SEQ ID NO: 402045 - DNA, 20 bp, Artificial Sequence
  chemically synthesized
tctcagcctcccaaagtgct

SEQ ID NO: 402046 - DNA, 20 bp, Artificial Sequence
  chemically synthesized
tgcctgtagtcctagcactt

SEQ ID NO: 402047 - DNA, 20 bp, Artificial Sequence
  chemically synthesized
ctcccaaagtgctaggacta

SEQ ID NO: 402048 - DNA, 20 bp, Artificial Sequence
  chemically synthesized
tcccaaagtgctaggactac

SEQ ID NO: 402049 - DNA, 20 bp, Artificial Sequence
  chemically synthesized
gtggctcatgcctgtagtcc

SEQ ID NO: 402050 - DNA, 20 bp, Artificial Sequence
  chemically synthesized
agtgctaggactacaggcat

SEQ ID NO: 402051 - DNA, 20 bp, Artificial Sequence
  chemically synthesized
aatgtggtggctcatgcctg

SEQ ID NO: 402052 - DNA, 20 bp, Artificial Sequence
  chemically synthesized
caggcatgagccaccacatt

SEQ ID NO: 402053 - DNA, 20 bp, Artificial Sequence
  chemically synthesized
tttttctaggccgaatgtgg

SEQ ID NO: 402054 - DNA, 20 bp, Artificial Sequence
  chemically synthesized
atgtttttctaggccgaatg

SEQ ID NO: 402055 - DNA, 20 bp, Artificial Sequence
  chemically synthesized
atgagccaccacattcggcc

SEQ ID NO: 402056 - DNA, 20 bp, Artificial Sequence
  chemically synthesized
catttaaaaaatgtttttct

SEQ ID NO: 402057 - DNA, 20 bp, Artificial Sequence
  chemically synthesized
tcatttaaaaaatgtttttc

SEQ ID NO: 402058 - DNA, 20 bp, Artificial Sequence
  chemically synthesized
ttttttaaatgatatttcct

SEQ ID NO: 402059 - DNA, 20 bp, Artificial Sequence
  chemically synthesized
tttttaaatgatatttcctt

SEQ ID NO: 402060 - DNA, 20 bp, Artificial Sequence
  chemically synthesized
ttttaaatgatatttccttg

SEQ ID NO: 402061 - DNA, 20 bp, Artificial Sequence
  chemically synthesized
tttaaatgatatttccttgg

SEQ ID NO: 402062 - DNA, 20 bp, Artificial Sequence
  chemically synthesized
aatgatatttccttgggggc

SEQ ID NO: 402063 - DNA, 20 bp, Artificial Sequence
  chemically synthesized
aacatattaactagccccca

SEQ ID NO: 402064 - DNA, 20 bp, Artificial Sequence
  chemically synthesized
taacatattaactagccccc

SEQ ID NO: 402065 - DNA, 20 bp, Artificial Sequence
  chemically synthesized
tcttcaattaacatattaac

SEQ ID NO: 402066 - DNA, 20 bp, Artificial Sequence
  chemically synthesized
gctagttaatatgttaattg

SEQ ID NO: 402067 - DNA, 20 bp, Artificial Sequence
  chemically synthesized
tctgtgtcacattagggatg

SEQ ID NO: 402068 - DNA, 20 bp, Artificial Sequence
  chemically synthesized
acattttctgtgtcacatta

SEQ ID NO: 402069 - DNA, 20 bp, Artificial Sequence
  chemically synthesized
tacattttctgtgtcacatt

SEQ ID NO: 402070 - DNA, 20 bp, Artificial Sequence
  chemically synthesized
atacattttctgtgtcacat

SEQ ID NO: 402071 - DNA, 20 bp, Artificial Sequence
  chemically synthesized
tcttcatccctaatgtgaca

SEQ ID NO: 402072 - DNA, 20 bp, Artificial Sequence
  chemically synthesized
cacagaaaatgtatctttaa

SEQ ID NO: 402073 - DNA, 20 bp, Artificial Sequence
  chemically synthesized
acagaaaatgtatctttaaa

SEQ ID NO: 402074 - DNA, 20 bp, Artificial Sequence
  chemically synthesized
cagaaaatgtatctttaaaa

SEQ ID NO: 402075 - DNA, 20 bp, Artificial Sequence
  chemically synthesized
agaaaatgtatctttaaaag

SEQ ID NO: 402076 - DNA, 20 bp, Artificial Sequence
  chemically synthesized
aatattcccttcccctttta

SEQ ID NO: 402077 - DNA, 20 bp, Artificial Sequence
  chemically synthesized
aaatgtatctttaaaagggg

SEQ ID NO: 402078 - DNA, 20 bp, Artificial Sequence
  chemically synthesized
aatgtatctttaaaagggga

SEQ ID NO: 402079 - DNA, 20 bp, Artificial Sequence
  chemically synthesized
atgtatctttaaaaggggaa

SEQ ID NO: 402080 - DNA, 20 bp, Artificial Sequence
  chemically synthesized
aaaaggggaagggaatatta

SEQ ID NO: 402081 - DNA, 20 bp, Artificial Sequence
  chemically synthesized
gggaatattaaagttgatac

SEQ ID NO: 402082 - DNA, 20 bp, Artificial Sequence
  chemically synthesized
tattaaagttgataccagtt

SEQ ID NO: 402083 - DNA, 20 bp, Artificial Sequence
  chemically synthesized
cactacgtgagtttctaaac

SEQ ID NO: 402084 - DNA, 20 bp, Artificial Sequence
  chemically synthesized
taccagtttagaaactcacg

SEQ ID NO: 402085 - DNA, 20 bp, Artificial Sequence
  chemically synthesized
attgcatttcttcactacgt

SEQ ID NO: 402086 - DNA, 20 bp, Artificial Sequence
  chemically synthesized
gtttagaaactcacgtagtg

SEQ ID NO: 402087 - DNA, 20 bp, Artificial Sequence
  chemically synthesized
cacgtagtgaagaaatgcaa

SEQ ID NO: 402088 - DNA, 20 bp, Artificial Sequence
  chemically synthesized
acgtagtgaagaaatgcaat

SEQ ID NO: 402089 - DNA, 20 bp, Artificial Sequence
  chemically synthesized
gtgaagaaatgcaatgggat

SEQ ID NO: 402090 - DNA, 20 bp, Artificial Sequence
  chemically synthesized
ggatgagttaatttcactta

SEQ ID NO: 402091 - DNA, 20 bp, Artificial Sequence
  chemically synthesized
gagttaatttcacttaaaga

SEQ ID NO: 402092 - DNA, 20 bp, Artificial Sequence
  chemically synthesized
ggcttcatagttctttcttt

SEQ ID NO: 402093 - DNA, 20 bp, Artificial Sequence
  chemically synthesized
cacttaaagaaagaactatg

SEQ ID NO: 402094 - DNA, 20 bp, Artificial Sequence
  chemically synthesized
taaagaaagaactatgaagc

SEQ ID NO: 402095 - DNA, 20 bp, Artificial Sequence
  chemically synthesized
aaagaaagaactatgaagcc

SEQ ID NO: 402096 - DNA, 20 bp, Artificial Sequence
  chemically synthesized
agccactgcgcccggcttca

SEQ ID NO: 402097 - DNA, 20 bp, Artificial Sequence
  chemically synthesized
aagaactatgaagccgggcg

SEQ ID NO: 402098 - DNA, 20 bp, Artificial Sequence
  chemically synthesized
aactatgaagccgggcgcag

SEQ ID NO: 402099 - DNA, 20 bp, Artificial Sequence
  chemically synthesized
caggcgtgagccactgcgcc

SEQ ID NO: 402100 - DNA, 20 bp, Artificial Sequence
  chemically synthesized
agtgctgggattacaggcgt

SEQ ID NO: 402101 - DNA, 20 bp, Artificial Sequence
  chemically synthesized
gtggctcacgcctgtaatcc

SEQ ID NO: 402102 - DNA, 20 bp, Artificial Sequence
  chemically synthesized
tcccaaagtgctgggattac

SEQ ID NO: 402103 - DNA, 20 bp, Artificial Sequence
  chemically synthesized
ctcccaaagtgctgggatta

SEQ ID NO: 402104 - DNA, 20 bp, Artificial Sequence
  chemically synthesized
cgcctgtaatcccagcactt

SEQ ID NO: 402105 - DNA, 20 bp, Artificial Sequence
  chemically synthesized
cctcggcctcccaaagtgct

SEQ ID NO: 402106 - DNA, 20 bp, Artificial Sequence
  chemically synthesized
gcctgtaatcccagcacttt

SEQ ID NO: 402107 - DNA, 20 bp, Artificial Sequence
  chemically synthesized
acctcggcctcccaaagtgc

SEQ ID NO: 402108 - DNA, 20 bp, Artificial Sequence
  chemically synthesized
ctgtaatcccagcactttgg

SEQ ID NO: 402109 - DNA, 20 bp, Artificial Sequence
  chemically synthesized
tgtaatcccagcactttggg

SEQ ID NO: 402110 - DNA, 20 bp, Artificial Sequence
  chemically synthesized
ccgcccacctcggcctccca

SEQ ID NO: 402111 - DNA, 20 bp, Artificial Sequence
  chemically synthesized
tcccagcactttgggaggcc

SEQ ID NO: 402112 - DNA, 20 bp, Artificial Sequence
  chemically synthesized
cccagcactttgggaggccg

SEQ ID NO: 402113 - DNA, 20 bp, Artificial Sequence
  chemically synthesized
agcactttgggaggccgagg

SEQ ID NO: 402114 - DNA, 20 bp, Artificial Sequence
  chemically synthesized
gcactttgggaggccgaggt

SEQ ID NO: 402115 - DNA, 20 bp, Artificial Sequence
  chemically synthesized
ctttgggaggccgaggtggg

SEQ ID NO: 402116 - DNA, 20 bp, Artificial Sequence
  chemically synthesized
acctcatgatccgcccacct

SEQ ID NO: 402117 - DNA, 20 bp, Artificial Sequence
  chemically synthesized
ggccgaggtgggcggatcat

SEQ ID NO: 402118 - DNA, 20 bp, Artificial Sequence
  chemically synthesized
gccgaggtgggcggatcatg

SEQ ID NO: 402119 - DNA, 20 bp, Artificial Sequence
  chemically synthesized
aggtgggcggatcatgaggt

SEQ ID NO: 402120 - DNA, 20 bp, Artificial Sequence
  chemically synthesized
ggtgggcggatcatgaggtc

SEQ ID NO: 402121 - DNA, 20 bp, Artificial Sequence
  chemically synthesized
tgggcggatcatgaggtcag

SEQ ID NO: 402122 - DNA, 20 bp, Artificial Sequence
  chemically synthesized
gatcatgaggtcaggagatc

SEQ ID NO: 402123 - DNA, 20 bp, Artificial Sequence
  chemically synthesized
tcaggagatcaagaccatcc

SEQ ID NO: 402124 - DNA, 20 bp, Artificial Sequence
  chemically synthesized
tttcaccgtgttagccagga

SEQ ID NO: 402125 - DNA, 20 bp, Artificial Sequence
  chemically synthesized
ggggtttcaccgtgttagcc

SEQ ID NO: 402126 - DNA, 20 bp, Artificial Sequence
  chemically synthesized
caagaccatcctggctaaca

SEQ ID NO: 402127 - DNA, 20 bp, Artificial Sequence
  chemically synthesized
cggggtttcaccgtgttagc

SEQ ID NO: 402128 - DNA, 20 bp, Artificial Sequence
  chemically synthesized
gagacggggtttcaccgtgt

SEQ ID NO: 402129 - DNA, 20 bp, Artificial Sequence
  chemically synthesized
ttgtatttttagtagagacg

SEQ ID NO: 402130 - DNA, 20 bp, Artificial Sequence
  chemically synthesized
tttgtatttttagtagagac

SEQ ID NO: 402131 - DNA, 20 bp, Artificial Sequence
  chemically synthesized
ttttgtatttttagtagaga

SEQ ID NO: 402132 - DNA, 20 bp, Artificial Sequence
  chemically synthesized
aattttttgtatttttagta

SEQ ID NO: 402133 - DNA, 20 bp, Artificial Sequence
  chemically synthesized
ctaattttttgtatttttag

SEQ ID NO: 402134 - DNA, 20 bp, Artificial Sequence
  chemically synthesized
cggctaattttttgtatttt

SEQ ID NO: 402135 - DNA, 20 bp, Artificial Sequence
  chemically synthesized
ctactaaaaatacaaaaaat

SEQ ID NO: 402136 - DNA, 20 bp, Artificial Sequence
  chemically synthesized
taaaaatacaaaaaattagc

SEQ ID NO: 402137 - DNA, 20 bp, Artificial Sequence
  chemically synthesized
aaaaatacaaaaaattagcc

SEQ ID NO: 402138 - DNA, 20 bp, Artificial Sequence
  chemically synthesized
tacaaaaaattagccgggcg

SEQ ID NO: 402139 - DNA, 20 bp, Artificial Sequence
  chemically synthesized
aaaaaattagccgggcgtgg

SEQ ID NO: 402140 - DNA, 20 bp, Artificial Sequence
  chemically synthesized
caggcgcccgccaccacgcc

SEQ ID NO: 402141 - DNA, 20 bp, Artificial Sequence
  chemically synthesized
aaattagccgggcgtggtgg

SEQ ID NO: 402142 - DNA, 20 bp, Artificial Sequence
  chemically synthesized
aattagccgggcgtggtggc

SEQ ID NO: 402143 - DNA, 20 bp, Artificial Sequence
  chemically synthesized
ggcgtggtggcgggcgcctg

SEQ ID NO: 402144 - DNA, 20 bp, Artificial Sequence
  chemically synthesized
gtggcgggcgcctgtagtcc

SEQ ID NO: 402145 - DNA, 20 bp, Artificial Sequence
  chemically synthesized
gccccagtagctgggactac

SEQ ID NO: 402146 - DNA, 20 bp, Artificial Sequence
  chemically synthesized
cgccccagtagctgggacta

SEQ ID NO: 402147 - DNA, 20 bp, Artificial Sequence
  chemically synthesized
gcgcctgtagtcccagctac

SEQ ID NO: 402148 - DNA, 20 bp, Artificial Sequence
  chemically synthesized
cgcctgtagtcccagctact

SEQ ID NO: 402149 - DNA, 20 bp, Artificial Sequence
  chemically synthesized
aggttcacgccccagtagct

SEQ ID NO: 402150 - DNA, 20 bp, Artificial Sequence
  chemically synthesized
gcctgtagtcccagctactg

SEQ ID NO: 402151 - DNA, 20 bp, Artificial Sequence
  chemically synthesized
caggttcacgccccagtagc

SEQ ID NO: 402152 - DNA, 20 bp, Artificial Sequence
  chemically synthesized
ctcccaggttcacgccccag

SEQ ID NO: 402153 - DNA, 20 bp, Artificial Sequence
  chemically synthesized
cgcctcccaggttcacgccc

SEQ ID NO: 402154 - DNA, 20 bp, Artificial Sequence
  chemically synthesized
cagctactggggcgtgaacc

SEQ ID NO: 402155 - DNA, 20 bp, Artificial Sequence
  chemically synthesized
agctactggggcgtgaacct

SEQ ID NO: 402156 - DNA, 20 bp, Artificial Sequence
  chemically synthesized
ctactggggcgtgaacctgg

SEQ ID NO: 402157 - DNA, 20 bp, Artificial Sequence
  chemically synthesized
tactggggcgtgaacctggg

SEQ ID NO: 402158 - DNA, 20 bp, Artificial Sequence
  chemically synthesized
cactgcaagttgcgcctccc

SEQ ID NO: 402159 - DNA, 20 bp, Artificial Sequence
  chemically synthesized
tcactgcaagttgcgcctcc

SEQ ID NO: 402160 - DNA, 20 bp, Artificial Sequence
  chemically synthesized
aacctgggaggcgcaacttg

SEQ ID NO: 402161 - DNA, 20 bp, Artificial Sequence
  chemically synthesized
tgggaggcgcaacttgcagt

SEQ ID NO: 402162 - DNA, 20 bp, Artificial Sequence
  chemically synthesized
gcacgatcttggctcactgc

SEQ ID NO: 402163 - DNA, 20 bp, Artificial Sequence
  chemically synthesized
ggcgcaacttgcagtgagcc

SEQ ID NO: 402164 - DNA, 20 bp, Artificial Sequence
  chemically synthesized
ggagcgcagtggcacgatct

SEQ ID NO: 402165 - DNA, 20 bp, Artificial Sequence
  chemically synthesized
tcccccaggccggagcgcag

SEQ ID NO: 402166 - DNA, 20 bp, Artificial Sequence
  chemically synthesized
aagatcgtgccactgcgctc

SEQ ID NO: 402167 - DNA, 20 bp, Artificial Sequence
  chemically synthesized
ctgtcccccaggccggagcg

SEQ ID NO: 402168 - DNA, 20 bp, Artificial Sequence
  chemically synthesized
cgtgccactgcgctccggcc

SEQ ID NO: 402169 - DNA, 20 bp, Artificial Sequence
  chemically synthesized
gtgccactgcgctccggcct

SEQ ID NO: 402170 - DNA, 20 bp, Artificial Sequence
  chemically synthesized
tgccactgcgctccggcctg

SEQ ID NO: 402171 - DNA, 20 bp, Artificial Sequence
  chemically synthesized
ctcctctgtcccccaggccg

SEQ ID NO: 402172 - DNA, 20 bp, Artificial Sequence
  chemically synthesized
gccactgcgctccggcctgg

SEQ ID NO: 402173 - DNA, 20 bp, Artificial Sequence
  chemically synthesized
gtctcctctgtcccccaggc

SEQ ID NO: 402174 - DNA, 20 bp, Artificial Sequence
  chemically synthesized
ctgcgctccggcctggggga

SEQ ID NO: 402175 - DNA, 20 bp, Artificial Sequence
  chemically synthesized
cggagtctcctctgtccccc

SEQ ID NO: 402176 - DNA, 20 bp, Artificial Sequence
  chemically synthesized
gcgctccggcctgggggaca

SEQ ID NO: 402177 - DNA, 20 bp, Artificial Sequence
  chemically synthesized
acggagtctcctctgtcccc

SEQ ID NO: 402178 - DNA, 20 bp, Artificial Sequence
  chemically synthesized
cgctccggcctgggggacag

SEQ ID NO: 402179 - DNA, 20 bp, Artificial Sequence
  chemically synthesized
ctccggcctgggggacagag

SEQ ID NO: 402180 - DNA, 20 bp, Artificial Sequence
  chemically synthesized
ttttttttttttttgagacg

SEQ ID NO: 402181 - DNA, 20 bp, Artificial Sequence
  chemically synthesized
ttttttttttttttttgaga

SEQ ID NO: 402182 - DNA, 20 bp, Artificial Sequence
  chemically synthesized
tttttttttttttttttttt

SEQ ID NO: 402183 - DNA, 20 bp, Artificial Sequence
  chemically synthesized
aaaaaaaaaaaaaaaaaaaa

SEQ ID NO: 402184 - DNA, 20 bp, Artificial Sequence
  chemically synthesized
aaaaaaaaaaaaaaaaaaga

SEQ ID NO: 402185 - DNA, 20 bp, Artificial Sequence
  chemically synthesized
aaaaaaaaaaaaagaaagaa

SEQ ID NO: 402186 - DNA, 20 bp, Artificial Sequence
  chemically synthesized
aaaagaaagaaaagaaaata

SEQ ID NO: 402187 - DNA, 20 bp, Artificial Sequence
  chemically synthesized
aaagaaaataaagaactatg

SEQ ID NO: 402188 - DNA, 20 bp, Artificial Sequence
  chemically synthesized
tgctctcccatattacttca

SEQ ID NO: 402189 - DNA, 20 bp, Artificial Sequence
  chemically synthesized
taaagaactatgaagtaata

SEQ ID NO: 402190 - DNA, 20 bp, Artificial Sequence
  chemically synthesized
aaagaactatgaagtaatat

SEQ ID NO: 402191 - DNA, 20 bp, Artificial Sequence
  chemically synthesized
agaactatgaagtaatatgg

SEQ ID NO: 402192 - DNA, 20 bp, Artificial Sequence
  chemically synthesized
aactatgaagtaatatggga

SEQ ID NO: 402193 - DNA, 20 bp, Artificial Sequence
  chemically synthesized
agtaatatgggagagcaatt

SEQ ID NO: 402194 - DNA, 20 bp, Artificial Sequence
  chemically synthesized
tatgggagagcaattaagtt

SEQ ID NO: 402195 - DNA, 20 bp, Artificial Sequence
  chemically synthesized
tgtttgatggaagcagagaa

SEQ ID NO: 402196 - DNA, 20 bp, Artificial Sequence
  chemically synthesized
tctcatgtttgatggaagca

SEQ ID NO: 402197 - DNA, 20 bp, Artificial Sequence
  chemically synthesized
tttctcatgtttgatggaag

SEQ ID NO: 402198 - DNA, 20 bp, Artificial Sequence
  chemically synthesized
ttttttctcatgtttgatgg

SEQ ID NO: 402199 - DNA, 20 bp, Artificial Sequence
  chemically synthesized
catttttttctcatgtttga

SEQ ID NO: 402200 - DNA, 20 bp, Artificial Sequence
  chemically synthesized
tctctgcttccatcaaacat

SEQ ID NO: 402201 - DNA, 20 bp, Artificial Sequence
  chemically synthesized
tgagaaaaaaatgaaaaata

SEQ ID NO: 402202 - DNA, 20 bp, Artificial Sequence
  chemically synthesized
gaaaaaaatgaaaaatatgg

SEQ ID NO: 402203 - DNA, 20 bp, Artificial Sequence
  chemically synthesized
ggaagattaatgataaacat

SEQ ID NO: 402204 - DNA, 20 bp, Artificial Sequence
  chemically synthesized
attaatgataaacattagat

SEQ ID NO: 402205 - DNA, 20 bp, Artificial Sequence
  chemically synthesized
ttaatgataaacattagata

SEQ ID NO: 402206 - DNA, 20 bp, Artificial Sequence
  chemically synthesized
gataaggttatgtgatattt

SEQ ID NO: 402207 - DNA, 20 bp, Artificial Sequence
  chemically synthesized
taaggttatgtgatattttg

SEQ ID NO: 402208 - DNA, 20 bp, Artificial Sequence
  chemically synthesized
tgatattttggagcattata

SEQ ID NO: 402209 - DNA, 20 bp, Artificial Sequence
  chemically synthesized
gatattttggagcattataa

SEQ ID NO: 402210 - DNA, 20 bp, Artificial Sequence
  chemically synthesized
attttggagcattataaagg

SEQ ID NO: 402211 - DNA, 20 bp, Artificial Sequence
  chemically synthesized
ttttggagcattataaagga

SEQ ID NO: 402212 - DNA, 20 bp, Artificial Sequence
  chemically synthesized
ataaaggaaggaaacaaatt

SEQ ID NO: 402213 - DNA, 20 bp, Artificial Sequence
  chemically synthesized
taaaggaaggaaacaaattt

SEQ ID NO: 402214 - DNA, 20 bp, Artificial Sequence
  chemically synthesized
aaacaaatttaggacatatt

SEQ ID NO: 402215 - DNA, 20 bp, Artificial Sequence
  chemically synthesized
aaatttaggacatatttaga

SEQ ID NO: 402216 - DNA, 20 bp, Artificial Sequence
  chemically synthesized
tttaggacatatttagaaag

SEQ ID NO: 402217 - DNA, 20 bp, Artificial Sequence
  chemically synthesized
attttgtaatattaatggca

SEQ ID NO: 402218 - DNA, 20 bp, Artificial Sequence
  chemically synthesized
ctgccattttgtaatattaa

SEQ ID NO: 402219 - DNA, 20 bp, Artificial Sequence
  chemically synthesized
gtgccattaatattacaaaa

SEQ ID NO: 402220 - DNA, 20 bp, Artificial Sequence
  chemically synthesized
ccattaatattacaaaatgg

SEQ ID NO: 402221 - DNA, 20 bp, Artificial Sequence
  chemically synthesized
aatattacaaaatggcagtg

SEQ ID NO: 402222 - DNA, 20 bp, Artificial Sequence
  chemically synthesized
tattacaaaatggcagtgca

SEQ ID NO: 402223 - DNA, 20 bp, Artificial Sequence
  chemically synthesized
tacaaaatggcagtgcagag

SEQ ID NO: 402224 - DNA, 20 bp, Artificial Sequence
  chemically synthesized
caaaatggcagtgcagagtg

SEQ ID NO: 402225 - DNA, 20 bp, Artificial Sequence
  chemically synthesized
aaaatggcagtgcagagtgg

SEQ ID NO: 402226 - DNA, 20 bp, Artificial Sequence
  chemically synthesized
aatggcagtgcagagtggag

SEQ ID NO: 402227 - DNA, 20 bp, Artificial Sequence
  chemically synthesized
atggcagtgcagagtggagg

SEQ ID NO: 402228 - DNA, 20 bp, Artificial Sequence
  chemically synthesized
cagagtggaggaggctgcaa

SEQ ID NO: 402229 - DNA, 20 bp, Artificial Sequence
  chemically synthesized
tttcataccattttccattg

SEQ ID NO: 402230 - DNA, 20 bp, Artificial Sequence
  chemically synthesized
gaggaggctgcaatggaaaa

SEQ ID NO: 402231 - DNA, 20 bp, Artificial Sequence
  chemically synthesized
tattactcagatttaataga

SEQ ID NO: 402232 - DNA, 20 bp, Artificial Sequence
  chemically synthesized
agactattactcagatttaa

SEQ ID NO: 402233 - DNA, 20 bp, Artificial Sequence
  chemically synthesized
aaatgctttctattaaatct

SEQ ID NO: 402234 - DNA, 20 bp, Artificial Sequence
  chemically synthesized
tttctattaaatctgagtaa

SEQ ID NO: 402235 - DNA, 20 bp, Artificial Sequence
  chemically synthesized
cataatcaaagactattact

SEQ ID NO: 402236 - DNA, 20 bp, Artificial Sequence
  chemically synthesized
tgagtaatagtctttgatta

SEQ ID NO: 402237 - DNA, 20 bp, Artificial Sequence
  chemically synthesized
gagtaatagtctttgattat

SEQ ID NO: 402238 - DNA, 20 bp, Artificial Sequence
  chemically synthesized
gtagaaaaatcccataatca

SEQ ID NO: 402239 - DNA, 20 bp, Artificial Sequence
  chemically synthesized
atgggatttttctaccgcct

SEQ ID NO: 402240 - DNA, 20 bp, Artificial Sequence
  chemically synthesized
tgggatttttctaccgcctg

SEQ ID NO: 402241 - DNA, 20 bp, Artificial Sequence
  chemically synthesized
actaacgtcacctcaggcgg

SEQ ID NO: 402242 - DNA, 20 bp, Artificial Sequence
  chemically synthesized
accactaacgtcacctcagg

SEQ ID NO: 402243 - DNA, 20 bp, Artificial Sequence
  chemically synthesized
ctgaccactaacgtcacctc

SEQ ID NO: 402244 - DNA, 20 bp, Artificial Sequence
  chemically synthesized
gctgaccactaacgtcacct

SEQ ID NO: 402245 - DNA, 20 bp, Artificial Sequence
  chemically synthesized
tctaccgcctgaggtgacgt

SEQ ID NO: 402246 - DNA, 20 bp, Artificial Sequence
  chemically synthesized
accgcctgaggtgacgttag

SEQ ID NO: 402247 - DNA, 20 bp, Artificial Sequence
  chemically synthesized
cctgaggtgacgttagtggt

SEQ ID NO: 402248 - DNA, 20 bp, Artificial Sequence
  chemically synthesized
gttagtggtcagcttacaat

SEQ ID NO: 402249 - DNA, 20 bp, Artificial Sequence
  chemically synthesized
ttagtggtcagcttacaatg

SEQ ID NO: 402250 - DNA, 20 bp, Artificial Sequence
  chemically synthesized
attttagacctcctcattgt

SEQ ID NO: 402251 - DNA, 20 bp, Artificial Sequence
  chemically synthesized
agtggtcagcttacaatgag

SEQ ID NO: 402252 - DNA, 20 bp, Artificial Sequence
  chemically synthesized
gtggtcagcttacaatgagg

SEQ ID NO: 402253 - DNA, 20 bp, Artificial Sequence
  chemically synthesized
gtgcagaagtttaattattt

SEQ ID NO: 402254 - DNA, 20 bp, Artificial Sequence
  chemically synthesized
aataattaaacttctgcacg

SEQ ID NO: 402255 - DNA, 20 bp, Artificial Sequence
  chemically synthesized
cttttctgttcttcgtgcag

SEQ ID NO: 402256 - DNA, 20 bp, Artificial Sequence
  chemically synthesized
cagcttttctgttcttcgtg

SEQ ID NO: 402257 - DNA, 20 bp, Artificial Sequence
  chemically synthesized
ttaaacttctgcacgaagaa

SEQ ID NO: 402258 - DNA, 20 bp, Artificial Sequence
  chemically synthesized
cttctgcacgaagaacagaa

SEQ ID NO: 402259 - DNA, 20 bp, Artificial Sequence
  chemically synthesized
agaaatatctttgacatgaa

SEQ ID NO: 402260 - DNA, 20 bp, Artificial Sequence
  chemically synthesized
cagaaaagctgttcatgtca

SEQ ID NO: 402261 - DNA, 20 bp, Artificial Sequence
  chemically synthesized
tgtaaagcgaatgggaaata

SEQ ID NO: 402262 - DNA, 20 bp, Artificial Sequence
  chemically synthesized
acattgactgtaaagcgaat

SEQ ID NO: 402263 - DNA, 20 bp, Artificial Sequence
  chemically synthesized
tacattgactgtaaagcgaa

SEQ ID NO: 402264 - DNA, 20 bp, Artificial Sequence
  chemically synthesized
tttatttcccattcgcttta

SEQ ID NO: 402265 - DNA, 20 bp, Artificial Sequence
  chemically synthesized
actgcattacattgactgta

SEQ ID NO: 402266 - DNA, 20 bp, Artificial Sequence
  chemically synthesized
gctttacagtcaatgtaatg

SEQ ID NO: 402267 - DNA, 20 bp, Artificial Sequence
  chemically synthesized
ttgtaggatgatgagcagtg

SEQ ID NO: 402268 - DNA, 20 bp, Artificial Sequence
  chemically synthesized
aacttttgtaggatgatgag

SEQ ID NO: 402269 - DNA, 20 bp, Artificial Sequence
  chemically synthesized
aacaacttttgtaggatgat

SEQ ID NO: 402270 - DNA, 20 bp, Artificial Sequence
  chemically synthesized
cactgctcatcatcctacaa

SEQ ID NO: 402271 - DNA, 20 bp, Artificial Sequence
  chemically synthesized
ttattaagaacaacttttgt

SEQ ID NO: 402272 - DNA, 20 bp, Artificial Sequence
  chemically synthesized
gttattaagaacaacttttg

SEQ ID NO: 402273 - DNA, 20 bp, Artificial Sequence
  chemically synthesized
aggatgtaggtgatgttatt

SEQ ID NO: 402274 - DNA, 20 bp, Artificial Sequence
  chemically synthesized
ttggaaatgagaaaggatgt

SEQ ID NO: 402275 - DNA, 20 bp, Artificial Sequence
  chemically synthesized
cttggaaatgagaaaggatg

SEQ ID NO: 402276 - DNA, 20 bp, Artificial Sequence
  chemically synthesized
cactctcttggaaatgagaa

SEQ ID NO: 402277 - DNA, 20 bp, Artificial Sequence
  chemically synthesized
tcactctcttggaaatgaga

SEQ ID NO: 402278 - DNA, 20 bp, Artificial Sequence
  chemically synthesized
ctacatcctttctcatttcc

SEQ ID NO: 402279 - DNA, 20 bp, Artificial Sequence
  chemically synthesized
acagtcactctcttggaaat

SEQ ID NO: 402280 - DNA, 20 bp, Artificial Sequence
  chemically synthesized
acatcctttctcatttccaa

SEQ ID NO: 402281 - DNA, 20 bp, Artificial Sequence
  chemically synthesized
atcctttctcatttccaaga

SEQ ID NO: 402282 - DNA, 20 bp, Artificial Sequence
  chemically synthesized
gatccagacagtcactctct

SEQ ID NO: 402283 - DNA, 20 bp, Artificial Sequence
  chemically synthesized
tttccaagagagtgactgtc

SEQ ID NO: 402284 - DNA, 20 bp, Artificial Sequence
  chemically synthesized
aagagagtgactgtctggat

SEQ ID NO: 402285 - DNA, 20 bp, Artificial Sequence
  chemically synthesized
gattacagctctgatccaga

SEQ ID NO: 402286 - DNA, 20 bp, Artificial Sequence
  chemically synthesized
gagagtgactgtctggatca

SEQ ID NO: 402287 - DNA, 20 bp, Artificial Sequence
  chemically synthesized
ctgggattacagctctgatc

SEQ ID NO: 402288 - DNA, 20 bp, Artificial Sequence
  chemically synthesized
ctggatcagagctgtaatcc

SEQ ID NO: 402289 - DNA, 20 bp, Artificial Sequence
  chemically synthesized
tatgctaagtgctgggatta

SEQ ID NO: 402290 - DNA, 20 bp, Artificial Sequence
  chemically synthesized
agagctgtaatcccagcact

SEQ ID NO: 402291 - DNA, 20 bp, Artificial Sequence
  chemically synthesized
cacattctatgctaagtgct

SEQ ID NO: 402292 - DNA, 20 bp, Artificial Sequence
  chemically synthesized
acacattctatgctaagtgc

SEQ ID NO: 402293 - DNA, 20 bp, Artificial Sequence
  chemically synthesized
tgtaatcccagcacttagca

SEQ ID NO: 402294 - DNA, 20 bp, Artificial Sequence
  chemically synthesized
tatgtaacacattctatgct

SEQ ID NO: 402295 - DNA, 20 bp, Artificial Sequence
  chemically synthesized
ttagcatagaatgtgttaca

SEQ ID NO: 402296 - DNA, 20 bp, Artificial Sequence
  chemically synthesized
gcatagaatgtgttacatag

SEQ ID NO: 402297 - DNA, 20 bp, Artificial Sequence
  chemically synthesized
ttacatagtagtgctcaata

SEQ ID NO: 402298 - DNA, 20 bp, Artificial Sequence
  chemically synthesized
tacatagtagtgctcaataa

SEQ ID NO: 402299 - DNA, 20 bp, Artificial Sequence
  chemically synthesized
taacttaaaacacctttatt

SEQ ID NO: 402300 - DNA, 20 bp, Artificial Sequence
  chemically synthesized
gtgctcaataaaggtgtttt

SEQ ID NO: 402301 - DNA, 20 bp, Artificial Sequence
  chemically synthesized
aaaggtgttttaagttaacg

SEQ ID NO: 402302 - DNA, 20 bp, Artificial Sequence
  chemically synthesized
tgttttaagttaacgaagac

SEQ ID NO: 402303 - DNA, 20 bp, Artificial Sequence
  chemically synthesized
agaggactaaaaagtaaatc

SEQ ID NO: 402304 - DNA, 20 bp, Artificial Sequence
  chemically synthesized
cgaagaccagatttactttt

SEQ ID NO: 402305 - DNA, 20 bp, Artificial Sequence
  chemically synthesized
aaaatgagaagaggactaaa

SEQ ID NO: 402306 - DNA, 20 bp, Artificial Sequence
  chemically synthesized
cagaggagaaaaatgagaag

SEQ ID NO: 402307 - DNA, 20 bp, Artificial Sequence
  chemically synthesized
gcagaggagaaaaatgagaa

SEQ ID NO: 402308 - DNA, 20 bp, Artificial Sequence
  chemically synthesized
ctgcagaggagaaaaatgag

SEQ ID NO: 402309 - DNA, 20 bp, Artificial Sequence
  chemically synthesized
tatctgcagaggagaaaaat

SEQ ID NO: 402310 - DNA, 20 bp, Artificial Sequence
  chemically synthesized
cttctcatttttctcctctg

SEQ ID NO: 402311 - DNA, 20 bp, Artificial Sequence
  chemically synthesized
tagaattaatatctgcagag

SEQ ID NO: 402312 - DNA, 20 bp, Artificial Sequence
  chemically synthesized
aatagaattaatatctgcag

SEQ ID NO: 402313 - DNA, 20 bp, Artificial Sequence
  chemically synthesized
taatagaattaatatctgca

SEQ ID NO: 402314 - DNA, 20 bp, Artificial Sequence
  chemically synthesized
tttaatagaattaatatctg

SEQ ID NO: 402315 - DNA, 20 bp, Artificial Sequence
  chemically synthesized
ttctgcctaccagagtttaa

SEQ ID NO: 402316 - DNA, 20 bp, Artificial Sequence
  chemically synthesized
atattaattctattaaactc

SEQ ID NO: 402317 - DNA, 20 bp, Artificial Sequence
  chemically synthesized
ttaattctattaaactctgg

SEQ ID NO: 402318 - DNA, 20 bp, Artificial Sequence
  chemically synthesized
taattctattaaactctggt

SEQ ID NO: 402319 - DNA, 20 bp, Artificial Sequence
  chemically synthesized
ttctattaaactctggtagg

SEQ ID NO: 402320 - DNA, 20 bp, Artificial Sequence
  chemically synthesized
aggcattattctgcctacca

SEQ ID NO: 402321 - DNA, 20 bp, Artificial Sequence
  chemically synthesized
ggaggcattattctgcctac

SEQ ID NO: 402322 - DNA, 20 bp, Artificial Sequence
  chemically synthesized
gcacgtggccatttttgagg

SEQ ID NO: 402323 - DNA, 20 bp, Artificial Sequence
  chemically synthesized
agcacgtggccatttttgag

SEQ ID NO: 402324 - DNA, 20 bp, Artificial Sequence
  chemically synthesized
gaataatgcctcctcaaaaa

SEQ ID NO: 402325 - DNA, 20 bp, Artificial Sequence
  chemically synthesized
ttagcacgtggccatttttg

SEQ ID NO: 402326 - DNA, 20 bp, Artificial Sequence
  chemically synthesized
attagcacgtggccattttt

SEQ ID NO: 402327 - DNA, 20 bp, Artificial Sequence
  chemically synthesized
agatgtcagggattagcacg

SEQ ID NO: 402328 - DNA, 20 bp, Artificial Sequence
  chemically synthesized
tattcacagatgtcagggat

SEQ ID NO: 402329 - DNA, 20 bp, Artificial Sequence
  chemically synthesized
taatttattcacagatgtca

SEQ ID NO: 402330 - DNA, 20 bp, Artificial Sequence
  chemically synthesized
ataatttattcacagatgtc

SEQ ID NO: 402331 - DNA, 20 bp, Artificial Sequence
  chemically synthesized
cataatttattcacagatgt

SEQ ID NO: 402332 - DNA, 20 bp, Artificial Sequence
  chemically synthesized
catgtaacataatttattca

SEQ ID NO: 402333 - DNA, 20 bp, Artificial Sequence
  chemically synthesized
tgtgaataaattatgttaca

SEQ ID NO: 402334 - DNA, 20 bp, Artificial Sequence
  chemically synthesized
ataaattatgttacatggca

SEQ ID NO: 402335 - DNA, 20 bp, Artificial Sequence
  chemically synthesized
aattatgttacatggcaaag

SEQ ID NO: 402336 - DNA, 20 bp, Artificial Sequence
  chemically synthesized
atggcaaagtggaattattg

SEQ ID NO: 402337 - DNA, 20 bp, Artificial Sequence
  chemically synthesized
caaagtggaattattgcaga

SEQ ID NO: 402338 - DNA, 20 bp, Artificial Sequence
  chemically synthesized
ggaattattgcagatagaat

SEQ ID NO: 402339 - DNA, 20 bp, Artificial Sequence
  chemically synthesized
atagaattagactttctaat

SEQ ID NO: 402340 - DNA, 20 bp, Artificial Sequence
  chemically synthesized
tcaaaagttagctaattaga

SEQ ID NO: 402341 - DNA, 20 bp, Artificial Sequence
  chemically synthesized
cctatcaaaagttagctaat

SEQ ID NO: 402342 - DNA, 20 bp, Artificial Sequence
  chemically synthesized
ataatctccctatcaaaagt

SEQ ID NO: 402343 - DNA, 20 bp, Artificial Sequence
  chemically synthesized
tctaattagctaacttttga

SEQ ID NO: 402344 - DNA, 20 bp, Artificial Sequence
  chemically synthesized
ctaattagctaacttttgat

SEQ ID NO: 402345 - DNA, 20 bp, Artificial Sequence
  chemically synthesized
taattagctaacttttgata

SEQ ID NO: 402346 - DNA, 20 bp, Artificial Sequence
  chemically synthesized
tgggataatctccctatcaa

SEQ ID NO: 402347 - DNA, 20 bp, Artificial Sequence
  chemically synthesized
attagctaacttttgatagg

SEQ ID NO: 402348 - DNA, 20 bp, Artificial Sequence
  chemically synthesized
ttttgatagggagattatcc

SEQ ID NO: 402349 - DNA, 20 bp, Artificial Sequence
  chemically synthesized
cctgcccactcagataatct

SEQ ID NO: 402350 - DNA, 20 bp, Artificial Sequence
  chemically synthesized
tcctgcccactcagataatc

SEQ ID NO: 402351 - DNA, 20 bp, Artificial Sequence
  chemically synthesized
gagattatcccagattatct

SEQ ID NO: 402352 - DNA, 20 bp, Artificial Sequence
  chemically synthesized
attatcccagattatctgag

SEQ ID NO: 402353 - DNA, 20 bp, Artificial Sequence
  chemically synthesized
ttatcccagattatctgagt

SEQ ID NO: 402354 - DNA, 20 bp, Artificial Sequence
  chemically synthesized
tcccagattatctgagtggg

SEQ ID NO: 402355 - DNA, 20 bp, Artificial Sequence
  chemically synthesized
cccagattatctgagtgggc

SEQ ID NO: 402356 - DNA, 20 bp, Artificial Sequence
  chemically synthesized
gtgattaaatcctgcccact

SEQ ID NO: 402357 - DNA, 20 bp, Artificial Sequence
  chemically synthesized
gagtgggcaggatttaatca

SEQ ID NO: 402358 - DNA, 20 bp, Artificial Sequence
  chemically synthesized
agtgggcaggatttaatcac

SEQ ID NO: 402359 - DNA, 20 bp, Artificial Sequence
  chemically synthesized
gtgggcaggatttaatcaca

SEQ ID NO: 402360 - DNA, 20 bp, Artificial Sequence
  chemically synthesized
tgggcaggatttaatcacag

SEQ ID NO: 402361 - DNA, 20 bp, Artificial Sequence
  chemically synthesized
ttaatcacaggggtccttaa

SEQ ID NO: 402362 - DNA, 20 bp, Artificial Sequence
  chemically synthesized
taatcacaggggtccttaaa

SEQ ID NO: 402363 - DNA, 20 bp, Artificial Sequence
  chemically synthesized
aatcacaggggtccttaaaa

SEQ ID NO: 402364 - DNA, 20 bp, Artificial Sequence
  chemically synthesized
atcacaggggtccttaaaag

SEQ ID NO: 402365 - DNA, 20 bp, Artificial Sequence
  chemically synthesized
tcacaggggtccttaaaagg

SEQ ID NO: 402366 - DNA, 20 bp, Artificial Sequence
  chemically synthesized
ccaacatttcccccctttta

SEQ ID NO: 402367 - DNA, 20 bp, Artificial Sequence
  chemically synthesized
cacaggggtccttaaaaggg

SEQ ID NO: 402368 - DNA, 20 bp, Artificial Sequence
  chemically synthesized
gccaacatttcccccctttt

SEQ ID NO: 402369 - DNA, 20 bp, Artificial Sequence
  chemically synthesized
ccttaaaaggggggaaatgt

SEQ ID NO: 402370 - DNA, 20 bp, Artificial Sequence
  chemically synthesized
aaggggggaaatgttggcat

SEQ ID NO: 402371 - DNA, 20 bp, Artificial Sequence
  chemically synthesized
aggggggaaatgttggcata

SEQ ID NO: 402372 - DNA, 20 bp, Artificial Sequence
  chemically synthesized
ggggggaaatgttggcataa

SEQ ID NO: 402373 - DNA, 20 bp, Artificial Sequence
  chemically synthesized
gggggaaatgttggcataag

SEQ ID NO: 402374 - DNA, 20 bp, Artificial Sequence
  chemically synthesized
gggaaatgttggcataaggg

SEQ ID NO: 402375 - DNA, 20 bp, Artificial Sequence
  chemically synthesized
tgttggcataaggggagaat

SEQ ID NO: 402376 - DNA, 20 bp, Artificial Sequence
  chemically synthesized
ggcataaggggagaattaga

SEQ ID NO: 402377 - DNA, 20 bp, Artificial Sequence
  chemically synthesized
ggagaattagaaagcactat

SEQ ID NO: 402378 - DNA, 20 bp, Artificial Sequence
  chemically synthesized
gaattagaaagcactatgag

SEQ ID NO: 402379 - DNA, 20 bp, Artificial Sequence
  chemically synthesized
aattagaaagcactatgaga

SEQ ID NO: 402380 - DNA, 20 bp, Artificial Sequence
  chemically synthesized
ctcggaccaagtccttctca

SEQ ID NO: 402381 - DNA, 20 bp, Artificial Sequence
  chemically synthesized
aaagcactatgagaaggact

SEQ ID NO: 402382 - DNA, 20 bp, Artificial Sequence
  chemically synthesized
ctatgagaaggacttggtcc

SEQ ID NO: 402383 - DNA, 20 bp, Artificial Sequence
  chemically synthesized
tatgagaaggacttggtccg

SEQ ID NO: 402384 - DNA, 20 bp, Artificial Sequence
  chemically synthesized
aaaaccagccacctcggacc

SEQ ID NO: 402385 - DNA, 20 bp, Artificial Sequence
  chemically synthesized
gagaaggacttggtccgagg

SEQ ID NO: 402386 - DNA, 20 bp, Artificial Sequence
  chemically synthesized
aggacttggtccgaggtggc

SEQ ID NO: 402387 - DNA, 20 bp, Artificial Sequence
  chemically synthesized
atcttcaaaaccagccacct

SEQ ID NO: 402388 - DNA, 20 bp, Artificial Sequence
  chemically synthesized
gtccgaggtggctggttttg

SEQ ID NO: 402389 - DNA, 20 bp, Artificial Sequence
  chemically synthesized
tcttcgtacatcttcaaaac

SEQ ID NO: 402390 - DNA, 20 bp, Artificial Sequence
  chemically synthesized
gctggttttgaagatgtacg

SEQ ID NO: 402391 - DNA, 20 bp, Artificial Sequence
  chemically synthesized
ggttttgaagatgtacgaag

SEQ ID NO: 402392 - DNA, 20 bp, Artificial Sequence
  chemically synthesized
gttttgaagatgtacgaaga

SEQ ID NO: 402393 - DNA, 20 bp, Artificial Sequence
  chemically synthesized
agatgtacgaagaaggccgt

SEQ ID NO: 402394 - DNA, 20 bp, Artificial Sequence
  chemically synthesized
ttcccacgttatttggctca

SEQ ID NO: 402395 - DNA, 20 bp, Artificial Sequence
  chemically synthesized
aggccgtgagccaaataacg

SEQ ID NO: 402396 - DNA, 20 bp, Artificial Sequence
  chemically synthesized
tagagaattcccacgttatt

SEQ ID NO: 402397 - DNA, 20 bp, Artificial Sequence
  chemically synthesized
ggccgtgagccaaataacgt

SEQ ID NO: 402398 - DNA, 20 bp, Artificial Sequence
  chemically synthesized
caaataacgtgggaattctc

SEQ ID NO: 402399 - DNA, 20 bp, Artificial Sequence
  chemically synthesized
cgtgggaattctctagaaaa

SEQ ID NO: 402400 - DNA, 20 bp, Artificial Sequence
  chemically synthesized
cttgccttttccattttcta

SEQ ID NO: 402401 - DNA, 20 bp, Artificial Sequence
  chemically synthesized
tccttgccttttccattttc

SEQ ID NO: 402402 - DNA, 20 bp, Artificial Sequence
  chemically synthesized
gaattctctagaaaatggaa

SEQ ID NO: 402403 - DNA, 20 bp, Artificial Sequence
  chemically synthesized
aattctctagaaaatggaaa

SEQ ID NO: 402404 - DNA, 20 bp, Artificial Sequence
  chemically synthesized
ctctagaaaatggaaaaggc

SEQ ID NO: 402405 - DNA, 20 bp, Artificial Sequence
  chemically synthesized
tctagaaaatggaaaaggca

SEQ ID NO: 402406 - DNA, 20 bp, Artificial Sequence
  chemically synthesized
tagaaaatggaaaaggcaag

SEQ ID NO: 402407 - DNA, 20 bp, Artificial Sequence
  chemically synthesized
aaatggaaaaggcaaggaga

SEQ ID NO: 402408 - DNA, 20 bp, Artificial Sequence
  chemically synthesized
caaggagacagattctcccc

SEQ ID NO: 402409 - DNA, 20 bp, Artificial Sequence
  chemically synthesized
aggagacagattctcccctg

SEQ ID NO: 402410 - DNA, 20 bp, Artificial Sequence
  chemically synthesized
tacttttggatgctccaggg

SEQ ID NO: 402411 - DNA, 20 bp, Artificial Sequence
  chemically synthesized
tgtacttttggatgctccag

SEQ ID NO: 402412 - DNA, 20 bp, Artificial Sequence
  chemically synthesized
gtgtacttttggatgctcca

SEQ ID NO: 402413 - DNA, 20 bp, Artificial Sequence
  chemically synthesized
tgtgtacttttggatgctcc

SEQ ID NO: 402414 - DNA, 20 bp, Artificial Sequence
  chemically synthesized
ctgtgtacttttggatgctc

SEQ ID NO: 402415 - DNA, 20 bp, Artificial Sequence
  chemically synthesized
ttctcccctggagcatccaa

SEQ ID NO: 402416 - DNA, 20 bp, Artificial Sequence
  chemically synthesized
ccagaagggctgtgtacttt

SEQ ID NO: 402417 - DNA, 20 bp, Artificial Sequence
  chemically synthesized
ctggagcatccaaaagtaca

SEQ ID NO: 402418 - DNA, 20 bp, Artificial Sequence
  chemically synthesized
ccaaaagtacacagcccttc

SEQ ID NO: 402419 - DNA, 20 bp, Artificial Sequence
  chemically synthesized
ctcaaatcatgatgccagaa

SEQ ID NO: 402420 - DNA, 20 bp, Artificial Sequence
  chemically synthesized
actcaaatcatgatgccaga

SEQ ID NO: 402421 - DNA, 20 bp, Artificial Sequence
  chemically synthesized
gactcaaatcatgatgccag

SEQ ID NO: 402422 - DNA, 20 bp, Artificial Sequence
  chemically synthesized
ctggactcaaatcatgatgc

SEQ ID NO: 402423 - DNA, 20 bp, Artificial Sequence
  chemically synthesized
cccttctggcatcatgattt

SEQ ID NO: 402424 - DNA, 20 bp, Artificial Sequence
  chemically synthesized
ctggcatcatgatttgagtc

SEQ ID NO: 402425 - DNA, 20 bp, Artificial Sequence
  chemically synthesized
catcatgatttgagtccagt

SEQ ID NO: 402426 - DNA, 20 bp, Artificial Sequence
  chemically synthesized
aaatccaaactggaacttac

SEQ ID NO: 402427 - DNA, 20 bp, Artificial Sequence
  chemically synthesized
gatttgagtccagtaagttc

SEQ ID NO: 402428 - DNA, 20 bp, Artificial Sequence
  chemically synthesized
gagtccagtaagttccagtt

SEQ ID NO: 402429 - DNA, 20 bp, Artificial Sequence
  chemically synthesized
tgcaggtcagaaatccaaac

SEQ ID NO: 402430 - DNA, 20 bp, Artificial Sequence
  chemically synthesized
cagtttggatttctgacctg

SEQ ID NO: 402431 - DNA, 20 bp, Artificial Sequence
  chemically synthesized
tctcagacagttctgcaggt

SEQ ID NO: 402432 - DNA, 20 bp, Artificial Sequence
  chemically synthesized
ttattctcagacagttctgc

SEQ ID NO: 402433 - DNA, 20 bp, Artificial Sequence
  chemically synthesized
tttattctcagacagttctg

SEQ ID NO: 402434 - DNA, 20 bp, Artificial Sequence
  chemically synthesized
tctgacctgcagaactgtct

SEQ ID NO: 402435 - DNA, 20 bp, Artificial Sequence
  chemically synthesized
tatatacatttattctcaga

SEQ ID NO: 402436 - DNA, 20 bp, Artificial Sequence
  chemically synthesized
aaattatatacatttattct

SEQ ID NO: 402437 - DNA, 20 bp, Artificial Sequence
  chemically synthesized
gaataaatgtatataatttt

SEQ ID NO: 402438 - DNA, 20 bp, Artificial Sequence
  chemically synthesized
taaaattaccacaaatttag

SEQ ID NO: 402439 - DNA, 20 bp, Artificial Sequence
  chemically synthesized
attttaagccactaaatttg

SEQ ID NO: 402440 - DNA, 20 bp, Artificial Sequence
  chemically synthesized
ctataaaattaccacaaatt

SEQ ID NO: 402441 - DNA, 20 bp, Artificial Sequence
  chemically synthesized
ctaaatttgtggtaatttta

SEQ ID NO: 402442 - DNA, 20 bp, Artificial Sequence
  chemically synthesized
aatttgtggtaattttatag

SEQ ID NO: 402443 - DNA, 20 bp, Artificial Sequence
  chemically synthesized
tggtaattttatagcagcaa

SEQ ID NO: 402444 - DNA, 20 bp, Artificial Sequence
  chemically synthesized
ggtaattttatagcagcaat

SEQ ID NO: 402445 - DNA, 20 bp, Artificial Sequence
  chemically synthesized
aaatatgaaatgtaatttat

SEQ ID NO: 402446 - DNA, 20 bp, Artificial Sequence
  chemically synthesized
ataaattacatttcatattt

SEQ ID NO: 402447 - DNA, 20 bp, Artificial Sequence
  chemically synthesized
taaattacatttcatattta

SEQ ID NO: 402448 - DNA, 20 bp, Artificial Sequence
  chemically synthesized
atttcatatttaaggctatt

SEQ ID NO: 402449 - DNA, 20 bp, Artificial Sequence
  chemically synthesized
agtacacatttgtcacttaa

SEQ ID NO: 402450 - DNA, 20 bp, Artificial Sequence
  chemically synthesized
ttctaccacctagtaggtgt

SEQ ID NO: 402451 - DNA, 20 bp, Artificial Sequence
  chemically synthesized
aaatgtgtactgacacctac

SEQ ID NO: 402452 - DNA, 20 bp, Artificial Sequence
  chemically synthesized
aatgtgtactgacacctact

SEQ ID NO: 402453 - DNA, 20 bp, Artificial Sequence
  chemically synthesized
gtgtactgacacctactagg

SEQ ID NO: 402454 - DNA, 20 bp, Artificial Sequence
  chemically synthesized
ttgtttttctaccacctagt

SEQ ID NO: 402455 - DNA, 20 bp, Artificial Sequence
  chemically synthesized
gttgtttttctaccacctag

SEQ ID NO: 402456 - DNA, 20 bp, Artificial Sequence
  chemically synthesized
tactgacacctactaggtgg

SEQ ID NO: 402457 - DNA, 20 bp, Artificial Sequence
  chemically synthesized
acagttgtttttctaccacc

SEQ ID NO: 402458 - DNA, 20 bp, Artificial Sequence
  chemically synthesized
ggtggtagaaaaacaactgt

SEQ ID NO: 402459 - DNA, 20 bp, Artificial Sequence
  chemically synthesized
gtagaaaaacaactgtgaga

SEQ ID NO: 402460 - DNA, 20 bp, Artificial Sequence
  chemically synthesized
tagaaaaacaactgtgagaa

SEQ ID NO: 402461 - DNA, 20 bp, Artificial Sequence
  chemically synthesized
tagagacactgcctttctca

SEQ ID NO: 402462 - DNA, 20 bp, Artificial Sequence
  chemically synthesized
aaaaacaactgtgagaaagg

SEQ ID NO: 402463 - DNA, 20 bp, Artificial Sequence
  chemically synthesized
tgtgagaaaggcagtgtctc

SEQ ID NO: 402464 - DNA, 20 bp, Artificial Sequence
  chemically synthesized
agctagaaggaaaaaagcta

SEQ ID NO: 402465 - DNA, 20 bp, Artificial Sequence
  chemically synthesized
taagctagaaggaaaaaagc

SEQ ID NO: 402466 - DNA, 20 bp, Artificial Sequence
  chemically synthesized
tcactaagctagaaggaaaa

SEQ ID NO: 402467 - DNA, 20 bp, Artificial Sequence
  chemically synthesized
gtctctagcttttttccttc

SEQ ID NO: 402468 - DNA, 20 bp, Artificial Sequence
  chemically synthesized
tagcttttttccttctagct

SEQ ID NO: 402469 - DNA, 20 bp, Artificial Sequence
  chemically synthesized
gcttctctcactaagctaga

SEQ ID NO: 402470 - DNA, 20 bp, Artificial Sequence
  chemically synthesized
tgcttctctcactaagctag

SEQ ID NO: 402471 - DNA, 20 bp, Artificial Sequence
  chemically synthesized
ttttttccttctagcttagt

SEQ ID NO: 402472 - DNA, 20 bp, Artificial Sequence
  chemically synthesized
gtctgcttctctcactaagc

SEQ ID NO: 402473 - DNA, 20 bp, Artificial Sequence
  chemically synthesized
ttttccttctagcttagtga

SEQ ID NO: 402474 - DNA, 20 bp, Artificial Sequence
  chemically synthesized
ttgtgtctgcttctctcact

SEQ ID NO: 402475 - DNA, 20 bp, Artificial Sequence
  chemically synthesized
tccttctagcttagtgagag

SEQ ID NO: 402476 - DNA, 20 bp, Artificial Sequence
  chemically synthesized
ttctagcttagtgagagaag

SEQ ID NO: 402477 - DNA, 20 bp, Artificial Sequence
  chemically synthesized
gagagaagcagacacaacaa

SEQ ID NO: 402478 - DNA, 20 bp, Artificial Sequence
  chemically synthesized
agagaagcagacacaacaaa

SEQ ID NO: 402479 - DNA, 20 bp, Artificial Sequence
  chemically synthesized
gagaagcagacacaacaaaa

SEQ ID NO: 402480 - DNA, 20 bp, Artificial Sequence
  chemically synthesized
ggtatgttgatacaaatata

SEQ ID NO: 402481 - DNA, 20 bp, Artificial Sequence
  chemically synthesized
gttgatacaaatatacagat

SEQ ID NO: 402482 - DNA, 20 bp, Artificial Sequence
  chemically synthesized
tacagataagttgcctgatg

SEQ ID NO: 402483 - DNA, 20 bp, Artificial Sequence
  chemically synthesized
atgactgtagtttcttcatc

SEQ ID NO: 402484 - DNA, 20 bp, Artificial Sequence
  chemically synthesized
catgactgtagtttcttcat

SEQ ID NO: 402485 - DNA, 20 bp, Artificial Sequence
  chemically synthesized
gttgcctgatgaagaaacta

SEQ ID NO: 402486 - DNA, 20 bp, Artificial Sequence
  chemically synthesized
atatgattgtcacatgactg

SEQ ID NO: 402487 - DNA, 20 bp, Artificial Sequence
  chemically synthesized
tcatgtgacaatcatatatt

SEQ ID NO: 402488 - DNA, 20 bp, Artificial Sequence
  chemically synthesized
catgtgacaatcatatatta

SEQ ID NO: 402489 - DNA, 20 bp, Artificial Sequence
  chemically synthesized
aagctctggatttttcaagg

SEQ ID NO: 402490 - DNA, 20 bp, Artificial Sequence
  chemically synthesized
aggaagctctggatttttca

SEQ ID NO: 402491 - DNA, 20 bp, Artificial Sequence
  chemically synthesized
aaggaagctctggatttttc

SEQ ID NO: 402492 - DNA, 20 bp, Artificial Sequence
  chemically synthesized
ggaaactaccttgaaaaatc

SEQ ID NO: 402493 - DNA, 20 bp, Artificial Sequence
  chemically synthesized
aaactaccttgaaaaatcca

SEQ ID NO: 402494 - DNA, 20 bp, Artificial Sequence
  chemically synthesized
tcacttcatcaaggaagctc

SEQ ID NO: 402495 - DNA, 20 bp, Artificial Sequence
  chemically synthesized
gagatgtcacttcatcaagg

SEQ ID NO: 402496 - DNA, 20 bp, Artificial Sequence
  chemically synthesized
aatccagagcttccttgatg

SEQ ID NO: 402497 - DNA, 20 bp, Artificial Sequence
  chemically synthesized
gctgagatgtcacttcatca

SEQ ID NO: 402498 - DNA, 20 bp, Artificial Sequence
  chemically synthesized
agctgagatgtcacttcatc

SEQ ID NO: 402499 - DNA, 20 bp, Artificial Sequence
  chemically synthesized
tccttgatgaagtgacatct

SEQ ID NO: 402500 - DNA, 20 bp, Artificial Sequence
  chemically synthesized
gatgaagtgacatctcagct

SEQ ID NO: 402501 - DNA, 20 bp, Artificial Sequence
  chemically synthesized
ttaactttcaaaactcagct

SEQ ID NO: 402502 - DNA, 20 bp, Artificial Sequence
  chemically synthesized
cttaattaactttcaaaact

SEQ ID NO: 402503 - DNA, 20 bp, Artificial Sequence
  chemically synthesized
acatctcagctgagttttga

SEQ ID NO: 402504 - DNA, 20 bp, Artificial Sequence
  chemically synthesized
ctgagttttgaaagttaatt

SEQ ID NO: 402505 - DNA, 20 bp, Artificial Sequence
  chemically synthesized
gagttttgaaagttaattaa

SEQ ID NO: 402506 - DNA, 20 bp, Artificial Sequence
  chemically synthesized
ttttgaaagttaattaagag

SEQ ID NO: 402507 - DNA, 20 bp, Artificial Sequence
  chemically synthesized
ttgaaagttaattaagagca

SEQ ID NO: 402508 - DNA, 20 bp, Artificial Sequence
  chemically synthesized
gaaagttaattaagagcaga

SEQ ID NO: 402509 - DNA, 20 bp, Artificial Sequence
  chemically synthesized
ttaattaagagcagagagac

SEQ ID NO: 402510 - DNA, 20 bp, Artificial Sequence
  chemically synthesized
attaagagcagagagacaag

SEQ ID NO: 402511 - DNA, 20 bp, Artificial Sequence
  chemically synthesized
aagagcagagagacaagtgg

SEQ ID NO: 402512 - DNA, 20 bp, Artificial Sequence
  chemically synthesized
cagagagacaagtggtagaa

SEQ ID NO: 402513 - DNA, 20 bp, Artificial Sequence
  chemically synthesized
gagagacaagtggtagaaaa

SEQ ID NO: 402514 - DNA, 20 bp, Artificial Sequence
  chemically synthesized
agtggtagaaaagagaactc

SEQ ID NO: 402515 - DNA, 20 bp, Artificial Sequence
  chemically synthesized
cctgctcttttgattttctg

SEQ ID NO: 402516 - DNA, 20 bp, Artificial Sequence
  chemically synthesized
cacctgctcttttgattttc

SEQ ID NO: 402517 - DNA, 20 bp, Artificial Sequence
  chemically synthesized
agagaactccagaaaatcaa

SEQ ID NO: 402518 - DNA, 20 bp, Artificial Sequence
  chemically synthesized
agaactccagaaaatcaaaa

SEQ ID NO: 402519 - DNA, 20 bp, Artificial Sequence
  chemically synthesized
actccagaaaatcaaaagag

SEQ ID NO: 402520 - DNA, 20 bp, Artificial Sequence
  chemically synthesized
ctccagaaaatcaaaagagc

SEQ ID NO: 402521 - DNA, 20 bp, Artificial Sequence
  chemically synthesized
aaaatcaaaagagcaggtga

SEQ ID NO: 402522 - DNA, 20 bp, Artificial Sequence
  chemically synthesized
aaaagagcaggtgaaagtgt

SEQ ID NO: 402523 - DNA, 20 bp, Artificial Sequence
  chemically synthesized
aaagagcaggtgaaagtgtc

SEQ ID NO: 402524 - DNA, 20 bp, Artificial Sequence
  chemically synthesized
aggtgaaagtgtcaggatgt

SEQ ID NO: 402525 - DNA, 20 bp, Artificial Sequence
  chemically synthesized
gtgaaagtgtcaggatgtga

SEQ ID NO: 402526 - DNA, 20 bp, Artificial Sequence
  chemically synthesized
aagtgtcaggatgtgagaga

SEQ ID NO: 402527 - DNA, 20 bp, Artificial Sequence
  chemically synthesized
gtgtcaggatgtgagagaaa

SEQ ID NO: 402528 - DNA, 20 bp, Artificial Sequence
  chemically synthesized
aggatgtgagagaaagagta

SEQ ID NO: 402529 - DNA, 20 bp, Artificial Sequence
  chemically synthesized
gaaagagtatggtcctttcc

SEQ ID NO: 402530 - DNA, 20 bp, Artificial Sequence
  chemically synthesized
accatctctaggtctgggaa

SEQ ID NO: 402531 - DNA, 20 bp, Artificial Sequence
  chemically synthesized
caccatctctaggtctggga

SEQ ID NO: 402532 - DNA, 20 bp, Artificial Sequence
  chemically synthesized
gtatggtcctttcccagacc

SEQ ID NO: 402533 - DNA, 20 bp, Artificial Sequence
  chemically synthesized
atggtcctttcccagaccta

SEQ ID NO: 402534 - DNA, 20 bp, Artificial Sequence
  chemically synthesized
cctccaccatctctaggtct

SEQ ID NO: 402535 - DNA, 20 bp, Artificial Sequence
  chemically synthesized
tcctccaccatctctaggtc

SEQ ID NO: 402536 - DNA, 20 bp, Artificial Sequence
  chemically synthesized
tcctttcccagacctagaga

SEQ ID NO: 402537 - DNA, 20 bp, Artificial Sequence
  chemically synthesized
tatcctcctccaccatctct

SEQ ID NO: 402538 - DNA, 20 bp, Artificial Sequence
  chemically synthesized
tttcccagacctagagatgg

SEQ ID NO: 402539 - DNA, 20 bp, Artificial Sequence
  chemically synthesized
ttatcctcctccaccatctc

SEQ ID NO: 402540 - DNA, 20 bp, Artificial Sequence
  chemically synthesized
tcccagacctagagatggtg

SEQ ID NO: 402541 - DNA, 20 bp, Artificial Sequence
  chemically synthesized
cccagacctagagatggtgg

SEQ ID NO: 402542 - DNA, 20 bp, Artificial Sequence
  chemically synthesized
cagacctagagatggtggag

SEQ ID NO: 402543 - DNA, 20 bp, Artificial Sequence
  chemically synthesized
agacctagagatggtggagg

SEQ ID NO: 402544 - DNA, 20 bp, Artificial Sequence
  chemically synthesized
atggtggaggaggataaaaa

SEQ ID NO: 402545 - DNA, 20 bp, Artificial Sequence
  chemically synthesized
gtggaggaggataaaaatgg

SEQ ID NO: 402546 - DNA, 20 bp, Artificial Sequence
  chemically synthesized
ggaggaggataaaaatggca

SEQ ID NO: 402547 - DNA, 20 bp, Artificial Sequence
  chemically synthesized
aaaaatggcagagatgaccc

SEQ ID NO: 402548 - DNA, 20 bp, Artificial Sequence
  chemically synthesized
ggcagagatgaccctagaaa

SEQ ID NO: 402549 - DNA, 20 bp, Artificial Sequence
  chemically synthesized
tgataatttcactttttcta

SEQ ID NO: 402550 - DNA, 20 bp, Artificial Sequence
  chemically synthesized
atgataatttcactttttct

SEQ ID NO: 402551 - DNA, 20 bp, Artificial Sequence
  chemically synthesized
gatgataatttcactttttc

SEQ ID NO: 402552 - DNA, 20 bp, Artificial Sequence
  chemically synthesized
ttatcatcaacctatttatg

SEQ ID NO: 402553 - DNA, 20 bp, Artificial Sequence
  chemically synthesized
ttttcaggctcttcataaat

SEQ ID NO: 402554 - DNA, 20 bp, Artificial Sequence
  chemically synthesized
attttcaggctcttcataaa

SEQ ID NO: 402555 - DNA, 20 bp, Artificial Sequence
  chemically synthesized
atcatcaacctatttatgaa

SEQ ID NO: 402556 - DNA, 20 bp, Artificial Sequence
  chemically synthesized
ttatgaagagcctgaaaata

SEQ ID NO: 402557 - DNA, 20 bp, Artificial Sequence
  chemically synthesized
tgccctctggctatattttc

SEQ ID NO: 402558 - DNA, 20 bp, Artificial Sequence
  chemically synthesized
ctgccctctggctatatttt

SEQ ID NO: 402559 - DNA, 20 bp, Artificial Sequence
  chemically synthesized
gaagagcctgaaaatatagc

SEQ ID NO: 402560 - DNA, 20 bp, Artificial Sequence
  chemically synthesized
agagcctgaaaatatagcca

SEQ ID NO: 402561 - DNA, 20 bp, Artificial Sequence
  chemically synthesized
gagcctgaaaatatagccag

SEQ ID NO: 402562 - DNA, 20 bp, Artificial Sequence
  chemically synthesized
agcctgaaaatatagccaga

SEQ ID NO: 402563 - DNA, 20 bp, Artificial Sequence
  chemically synthesized
ctgaaaatatagccagaggg

SEQ ID NO: 402564 - DNA, 20 bp, Artificial Sequence
  chemically synthesized
tttgatttcgaactgccctc

SEQ ID NO: 402565 - DNA, 20 bp, Artificial Sequence
  chemically synthesized
cagagggcagttcgaaatca

SEQ ID NO: 402566 - DNA, 20 bp, Artificial Sequence
  chemically synthesized
agggcagttcgaaatcaaag

SEQ ID NO: 402567 - DNA, 20 bp, Artificial Sequence
  chemically synthesized
cgaaatcaaagcagaatttt

SEQ ID NO: 402568 - DNA, 20 bp, Artificial Sequence
  chemically synthesized
aatcaaagcagaattttaag

SEQ ID NO: 402569 - DNA, 20 bp, Artificial Sequence
  chemically synthesized
atcaaagcagaattttaagt

SEQ ID NO: 402570 - DNA, 20 bp, Artificial Sequence
  chemically synthesized
tcaaagcagaattttaagta

SEQ ID NO: 402571 - DNA, 20 bp, Artificial Sequence
  chemically synthesized
cagaattttaagtagggaaa

SEQ ID NO: 402572 - DNA, 20 bp, Artificial Sequence
  chemically synthesized
aagtagggaaatagcaatgt

SEQ ID NO: 402573 - DNA, 20 bp, Artificial Sequence
  chemically synthesized
agtagggaaatagcaatgtc

SEQ ID NO: 402574 - DNA, 20 bp, Artificial Sequence
  chemically synthesized
ggaaatagcaatgtcaggct

SEQ ID NO: 402575 - DNA, 20 bp, Artificial Sequence
  chemically synthesized
gcaatgtcaggcttggcttt

SEQ ID NO: 402576 - DNA, 20 bp, Artificial Sequence
  chemically synthesized
gaaatttatttctaaaagcc

SEQ ID NO: 402577 - DNA, 20 bp, Artificial Sequence
  chemically synthesized
actgtgaaatttatttctaa

SEQ ID NO: 402578 - DNA, 20 bp, Artificial Sequence
  chemically synthesized
gcttttagaaataaatttca

SEQ ID NO: 402579 - DNA, 20 bp, Artificial Sequence
  chemically synthesized
tagaaataaatttcacagtg

SEQ ID NO: 402580 - DNA, 20 bp, Artificial Sequence
  chemically synthesized
gaaataaatttcacagtgta

SEQ ID NO: 402581 - DNA, 20 bp, Artificial Sequence
  chemically synthesized
ttcacagtgtagagaatatt

SEQ ID NO: 402582 - DNA, 20 bp, Artificial Sequence
  chemically synthesized
tcacagtgtagagaatattt

SEQ ID NO: 402583 - DNA, 20 bp, Artificial Sequence
  chemically synthesized
cacagtgtagagaatatttg

SEQ ID NO: 402584 - DNA, 20 bp, Artificial Sequence
  chemically synthesized
tttggggataaactgtaaat

SEQ ID NO: 402585 - DNA, 20 bp, Artificial Sequence
  chemically synthesized
ctcatgtgtcttcttattta

SEQ ID NO: 402586 - DNA, 20 bp, Artificial Sequence
  chemically synthesized
ggggataaactgtaaataag

SEQ ID NO: 402587 - DNA, 20 bp, Artificial Sequence
  chemically synthesized
ctgtaaataagaagacacat

SEQ ID NO: 402588 - DNA, 20 bp, Artificial Sequence
  chemically synthesized
acgtggattataggtataat

SEQ ID NO: 402589 - DNA, 20 bp, Artificial Sequence
  chemically synthesized
ttacttctcacgtggattat

SEQ ID NO: 402590 - DNA, 20 bp, Artificial Sequence
  chemically synthesized
cttacttctcacgtggatta

SEQ ID NO: 402591 - DNA, 20 bp, Artificial Sequence
  chemically synthesized
attatacctataatccacgt

SEQ ID NO: 402592 - DNA, 20 bp, Artificial Sequence
  chemically synthesized
atacctataatccacgtgag

SEQ ID NO: 402593 - DNA, 20 bp, Artificial Sequence
  chemically synthesized
agtcatgcttacttctcacg

SEQ ID NO: 402594 - DNA, 20 bp, Artificial Sequence
  chemically synthesized
ctataatccacgtgagaagt

SEQ ID NO: 402595 - DNA, 20 bp, Artificial Sequence
  chemically synthesized
ccactgccattcattaatgc

SEQ ID NO: 402596 - DNA, 20 bp, Artificial Sequence
  chemically synthesized
gcatgacttgcattaatgaa

SEQ ID NO: 402597 - DNA, 20 bp, Artificial Sequence
  chemically synthesized
tgacttgcattaatgaatgg

SEQ ID NO: 402598 - DNA, 20 bp, Artificial Sequence
  chemically synthesized
cttgcattaatgaatggcag

SEQ ID NO: 402599 - DNA, 20 bp, Artificial Sequence
  chemically synthesized
ttgcattaatgaatggcagt

SEQ ID NO: 402600 - DNA, 20 bp, Artificial Sequence
  chemically synthesized
tgcattaatgaatggcagtg

SEQ ID NO: 402601 - DNA, 20 bp, Artificial Sequence
  chemically synthesized
ttaatgaatggcagtggggc

SEQ ID NO: 402602 - DNA, 20 bp, Artificial Sequence
  chemically synthesized
gaatggcagtggggctggaa

SEQ ID NO: 402603 - DNA, 20 bp, Artificial Sequence
  chemically synthesized
aatggcagtggggctggaaa

SEQ ID NO: 402604 - DNA, 20 bp, Artificial Sequence
  chemically synthesized
tggcagtggggctggaaaag

SEQ ID NO: 402605 - DNA, 20 bp, Artificial Sequence
  chemically synthesized
gaatgcacctactccttttc

SEQ ID NO: 402606 - DNA, 20 bp, Artificial Sequence
  chemically synthesized
cagtggggctggaaaaggag

SEQ ID NO: 402607 - DNA, 20 bp, Artificial Sequence
  chemically synthesized
agtggggctggaaaaggagt

SEQ ID NO: 402608 - DNA, 20 bp, Artificial Sequence
  chemically synthesized
gaaaaggagtaggtgcattc

SEQ ID NO: 402609 - DNA, 20 bp, Artificial Sequence
  chemically synthesized
gtgcattcaagatgtgttta

SEQ ID NO: 402610 - DNA, 20 bp, Artificial Sequence
  chemically synthesized
tgcattcaagatgtgtttac

SEQ ID NO: 402611 - DNA, 20 bp, Artificial Sequence
  chemically synthesized
gcattcaagatgtgtttacg

SEQ ID NO: 402612 - DNA, 20 bp, Artificial Sequence
  chemically synthesized
ttcaagatgtgtttacgggg

SEQ ID NO: 402613 - DNA, 20 bp, Artificial Sequence
  chemically synthesized
atgtgtttacggggtagtat

SEQ ID NO: 402614 - DNA, 20 bp, Artificial Sequence
  chemically synthesized
gtttacggggtagtattggt

SEQ ID NO: 402615 - DNA, 20 bp, Artificial Sequence
  chemically synthesized
ctccacatataattaataat

SEQ ID NO: 402616 - DNA, 20 bp, Artificial Sequence
  chemically synthesized
tactaattattaattatatg

SEQ ID NO: 402617 - DNA, 20 bp, Artificial Sequence
  chemically synthesized
ctaattattaattatatgtg

SEQ ID NO: 402618 - DNA, 20 bp, Artificial Sequence
  chemically synthesized
ttattaattatatgtggagt

SEQ ID NO: 402619 - DNA, 20 bp, Artificial Sequence
  chemically synthesized
tattaattatatgtggagtt

SEQ ID NO: 402620 - DNA, 20 bp, Artificial Sequence
  chemically synthesized
attaattatatgtggagtta

SEQ ID NO: 402621 - DNA, 20 bp, Artificial Sequence
  chemically synthesized
ttaattatatgtggagttag

SEQ ID NO: 402622 - DNA, 20 bp, Artificial Sequence
  chemically synthesized
aattatatgtggagttaggg

SEQ ID NO: 402623 - DNA, 20 bp, Artificial Sequence
  chemically synthesized
atatgtggagttaggggagt

SEQ ID NO: 402624 - DNA, 20 bp, Artificial Sequence
  chemically synthesized
gagttaggggagttggatca

SEQ ID NO: 402625 - DNA, 20 bp, Artificial Sequence
  chemically synthesized
atcatggataatcaatgata

SEQ ID NO: 402626 - DNA, 20 bp, Artificial Sequence
  chemically synthesized
agtttctccatcagggaatt

SEQ ID NO: 402627 - DNA, 20 bp, Artificial Sequence
  chemically synthesized
gataaagctaaattccctga

SEQ ID NO: 402628 - DNA, 20 bp, Artificial Sequence
  chemically synthesized
taaagctaaattccctgatg

SEQ ID NO: 402629 - DNA, 20 bp, Artificial Sequence
  chemically synthesized
gaactgtagtttctccatca

SEQ ID NO: 402630 - DNA, 20 bp, Artificial Sequence
  chemically synthesized
agaactgtagtttctccatc

SEQ ID NO: 402631 - DNA, 20 bp, Artificial Sequence
  chemically synthesized
cagaactgtagtttctccat

SEQ ID NO: 402632 - DNA, 20 bp, Artificial Sequence
  chemically synthesized
attccctgatggagaaacta

SEQ ID NO: 402633 - DNA, 20 bp, Artificial Sequence
  chemically synthesized
atatgattgtaacagaactg

SEQ ID NO: 402634 - DNA, 20 bp, Artificial Sequence
  chemically synthesized
ctcttaatatatgattgtaa

SEQ ID NO: 402635 - DNA, 20 bp, Artificial Sequence
  chemically synthesized
ttctgttacaatcatatatt

SEQ ID NO: 402636 - DNA, 20 bp, Artificial Sequence
  chemically synthesized
ctgttacaatcatatattaa

SEQ ID NO: 402637 - DNA, 20 bp, Artificial Sequence
  chemically synthesized
aagctctggatttttcaagt

SEQ ID NO: 402638 - DNA, 20 bp, Artificial Sequence
  chemically synthesized
agagaagctctggatttttc

SEQ ID NO: 402639 - DNA, 20 bp, Artificial Sequence
  chemically synthesized
gagaactaacttgaaaaatc

SEQ ID NO: 402640 - DNA, 20 bp, Artificial Sequence
  chemically synthesized
gaactaacttgaaaaatcca

SEQ ID NO: 402641 - DNA, 20 bp, Artificial Sequence
  chemically synthesized
taacctcatcagagaagctc

SEQ ID NO: 402642 - DNA, 20 bp, Artificial Sequence
  chemically synthesized
aaatccagagcttctctgat

SEQ ID NO: 402643 - DNA, 20 bp, Artificial Sequence
  chemically synthesized
agcctgtaacctcatcagag

SEQ ID NO: 402644 - DNA, 20 bp, Artificial Sequence
  chemically synthesized
aatccagagcttctctgatg

SEQ ID NO: 402645 - DNA, 20 bp, Artificial Sequence
  chemically synthesized
tctagcctgtaacctcatca

SEQ ID NO: 402646 - DNA, 20 bp, Artificial Sequence
  chemically synthesized
aatctagcctgtaacctcat

SEQ ID NO: 402647 - DNA, 20 bp, Artificial Sequence
  chemically synthesized
gagcttctctgatgaggtta

SEQ ID NO: 402648 - DNA, 20 bp, Artificial Sequence
  chemically synthesized
agcttctctgatgaggttac

SEQ ID NO: 402649 - DNA, 20 bp, Artificial Sequence
  chemically synthesized
tctctgatgaggttacaggc

SEQ ID NO: 402650 - DNA, 20 bp, Artificial Sequence
  chemically synthesized
aggttacaggctagattatt

SEQ ID NO: 402651 - DNA, 20 bp, Artificial Sequence
  chemically synthesized
atatgccattctgaataatc

SEQ ID NO: 402652 - DNA, 20 bp, Artificial Sequence
  chemically synthesized
acaggctagattattcagaa

SEQ ID NO: 402653 - DNA, 20 bp, Artificial Sequence
  chemically synthesized
gattattcagaatggcatat

SEQ ID NO: 402654 - DNA, 20 bp, Artificial Sequence
  chemically synthesized
attattcagaatggcatata

SEQ ID NO: 402655 - DNA, 20 bp, Artificial Sequence
  chemically synthesized
ttattcagaatggcatataa

SEQ ID NO: 402656 - DNA, 20 bp, Artificial Sequence
  chemically synthesized
acactggagtcaaattgtga

SEQ ID NO: 402657 - DNA, 20 bp, Artificial Sequence
  chemically synthesized
tacactggagtcaaattgtg

SEQ ID NO: 402658 - DNA, 20 bp, Artificial Sequence
  chemically synthesized
gggccttcacaatttgactc

SEQ ID NO: 402659 - DNA, 20 bp, Artificial Sequence
  chemically synthesized
atgtttagaggagtacactg

SEQ ID NO: 402660 - DNA, 20 bp, Artificial Sequence
  chemically synthesized
atatgtttagaggagtacac

SEQ ID NO: 402661 - DNA, 20 bp, Artificial Sequence
  chemically synthesized
aatcgataatatgtttagag

SEQ ID NO: 402662 - DNA, 20 bp, Artificial Sequence
  chemically synthesized
ctaatcgataatatgtttag

SEQ ID NO: 402663 - DNA, 20 bp, Artificial Sequence
  chemically synthesized
cctaatcgataatatgttta

SEQ ID NO: 402664 - DNA, 20 bp, Artificial Sequence
  chemically synthesized
ggcctaatcgataatatgtt

SEQ ID NO: 402665 - DNA, 20 bp, Artificial Sequence
  chemically synthesized
cctctaaacatattatcgat

SEQ ID NO: 402666 - DNA, 20 bp, Artificial Sequence
  chemically synthesized
ctctaaacatattatcgatt

SEQ ID NO: 402667 - DNA, 20 bp, Artificial Sequence
  chemically synthesized
atattatcgattaggcctgt

SEQ ID NO: 402668 - DNA, 20 bp, Artificial Sequence
  chemically synthesized
ttatcgattaggcctgttgg

SEQ ID NO: 402669 - DNA, 20 bp, Artificial Sequence
  chemically synthesized
ggatatgggtgactgccaac

SEQ ID NO: 402670 - DNA, 20 bp, Artificial Sequence
  chemically synthesized
gggatatgggtgactgccaa

SEQ ID NO: 402671 - DNA, 20 bp, Artificial Sequence
  chemically synthesized
gtatataaggtttgggatat

SEQ ID NO: 402672 - DNA, 20 bp, Artificial Sequence
  chemically synthesized
tgtatataaggtttgggata

SEQ ID NO: 402673 - DNA, 20 bp, Artificial Sequence
  chemically synthesized
ggtagatgtatataaggttt

SEQ ID NO: 402674 - DNA, 20 bp, Artificial Sequence
  chemically synthesized
tggtagatgtatataaggtt

SEQ ID NO: 402675 - DNA, 20 bp, Artificial Sequence
  chemically synthesized
agacctggtagatgtatata

SEQ ID NO: 402676 - DNA, 20 bp, Artificial Sequence
  chemically synthesized
cagacctggtagatgtatat

SEQ ID NO: 402677 - DNA, 20 bp, Artificial Sequence
  chemically synthesized
caaaccttatatacatctac

SEQ ID NO: 402678 - DNA, 20 bp, Artificial Sequence
  chemically synthesized
aaaccttatatacatctacc

SEQ ID NO: 402679 - DNA, 20 bp, Artificial Sequence
  chemically synthesized
tgtgactaaggcagacctgg

SEQ ID NO: 402680 - DNA, 20 bp, Artificial Sequence
  chemically synthesized
ttgtgtgactaaggcagacc

SEQ ID NO: 402681 - DNA, 20 bp, Artificial Sequence
  chemically synthesized
tacatctaccaggtctgcct

SEQ ID NO: 402682 - DNA, 20 bp, Artificial Sequence
  chemically synthesized
tttggcttgtgtgactaagg

SEQ ID NO: 402683 - DNA, 20 bp, Artificial Sequence
  chemically synthesized
aaatttggcttgtgtgacta

SEQ ID NO: 402684 - DNA, 20 bp, Artificial Sequence
  chemically synthesized
gaaatttggcttgtgtgact

SEQ ID NO: 402685 - DNA, 20 bp, Artificial Sequence
  chemically synthesized
caggtctgccttagtcacac

SEQ ID NO: 402686 - DNA, 20 bp, Artificial Sequence
  chemically synthesized
gatttatttatggagaaatt

SEQ ID NO: 402687 - DNA, 20 bp, Artificial Sequence
  chemically synthesized
aagcatatgatttatttatg

SEQ ID NO: 402688 - DNA, 20 bp, Artificial Sequence
  chemically synthesized
gaaagcatatgatttattta

SEQ ID NO: 402689 - DNA, 20 bp, Artificial Sequence
  chemically synthesized
aacaaaggactaaagcaaga

SEQ ID NO: 402690 - DNA, 20 bp, Artificial Sequence
  chemically synthesized
aatcatatgctttcttgctt

SEQ ID NO: 402691 - DNA, 20 bp, Artificial Sequence
  chemically synthesized
catgaacaaaggactaaagc

SEQ ID NO: 402692 - DNA, 20 bp, Artificial Sequence
  chemically synthesized
agtgcatgaacaaaggacta

SEQ ID NO: 402693 - DNA, 20 bp, Artificial Sequence
  chemically synthesized
tctagggagtgcatgaacaa

SEQ ID NO: 402694 - DNA, 20 bp, Artificial Sequence
  chemically synthesized
ttctagggagtgcatgaaca

SEQ ID NO: 402695 - DNA, 20 bp, Artificial Sequence
  chemically synthesized
tcctttgttcatgcactccc

SEQ ID NO: 402696 - DNA, 20 bp, Artificial Sequence
  chemically synthesized
gtgagtgtcctcattctagg

SEQ ID NO: 402697 - DNA, 20 bp, Artificial Sequence
  chemically synthesized
gttcatgcactccctagaat

SEQ ID NO: 402698 - DNA, 20 bp, Artificial Sequence
  chemically synthesized
ttcatgcactccctagaatg

SEQ ID NO: 402699 - DNA, 20 bp, Artificial Sequence
  chemically synthesized
tagtgagtgtcctcattcta

SEQ ID NO: 402700 - DNA, 20 bp, Artificial Sequence
  chemically synthesized
atagtgagtgtcctcattct

SEQ ID NO: 402701 - DNA, 20 bp, Artificial Sequence
  chemically synthesized
aatagtgagtgtcctcattc

SEQ ID NO: 402702 - DNA, 20 bp, Artificial Sequence
  chemically synthesized
gaatgaggacactcactatt

SEQ ID NO: 402703 - DNA, 20 bp, Artificial Sequence
  chemically synthesized
tcgacctagatcttaatagt

SEQ ID NO: 402704 - DNA, 20 bp, Artificial Sequence
  chemically synthesized
acattcgacctagatcttaa

SEQ ID NO: 402705 - DNA, 20 bp, Artificial Sequence
  chemically synthesized
ggacactcactattaagatc

SEQ ID NO: 402706 - DNA, 20 bp, Artificial Sequence
  chemically synthesized
gacactcactattaagatct

SEQ ID NO: 402707 - DNA, 20 bp, Artificial Sequence
  chemically synthesized
gaaaaccctcacattcgacc

SEQ ID NO: 402708 - DNA, 20 bp, Artificial Sequence
  chemically synthesized
ttaagatctaggtcgaatgt

SEQ ID NO: 402709 - DNA, 20 bp, Artificial Sequence
  chemically synthesized
taagatctaggtcgaatgtg

SEQ ID NO: 402710 - DNA, 20 bp, Artificial Sequence
  chemically synthesized
aagatctaggtcgaatgtga

SEQ ID NO: 402711 - DNA, 20 bp, Artificial Sequence
  chemically synthesized
cacaatcacacttatctccc

SEQ ID NO: 402712 - DNA, 20 bp, Artificial Sequence
  chemically synthesized
ataagttatgccagggagat

SEQ ID NO: 402713 - DNA, 20 bp, Artificial Sequence
  chemically synthesized
gattgataagttatgccagg

SEQ ID NO: 402714 - DNA, 20 bp, Artificial Sequence
  chemically synthesized
ttgattgataagttatgcca

SEQ ID NO: 402715 - DNA, 20 bp, Artificial Sequence
  chemically synthesized
attgattgataagttatgcc

SEQ ID NO: 402716 - DNA, 20 bp, Artificial Sequence
  chemically synthesized
gattgattgataagttatgc

SEQ ID NO: 402717 - DNA, 20 bp, Artificial Sequence
  chemically synthesized
tatcagaaggattgattgat

SEQ ID NO: 402718 - DNA, 20 bp, Artificial Sequence
  chemically synthesized
acacatatgtatatatcaga

SEQ ID NO: 402719 - DNA, 20 bp, Artificial Sequence
  chemically synthesized
tacacatatgtatatatcag

SEQ ID NO: 402720 - DNA, 20 bp, Artificial Sequence
  chemically synthesized
gcctacacatatgtatatat

SEQ ID NO: 402721 - DNA, 20 bp, Artificial Sequence
  chemically synthesized
ttctgatatatacatatgtg

SEQ ID NO: 402722 - DNA, 20 bp, Artificial Sequence
  chemically synthesized
tctgatatatacatatgtgt

SEQ ID NO: 402723 - DNA, 20 bp, Artificial Sequence
  chemically synthesized
acatatgcataattagaaaa

SEQ ID NO: 402724 - DNA, 20 bp, Artificial Sequence
  chemically synthesized
gtgtaacacatatgcataat

SEQ ID NO: 402725 - DNA, 20 bp, Artificial Sequence
  chemically synthesized
tgtccatacacatacagtta

SEQ ID NO: 402726 - DNA, 20 bp, Artificial Sequence
  chemically synthesized
tctgtgtgtccatacacata

SEQ ID NO: 402727 - DNA, 20 bp, Artificial Sequence
  chemically synthesized
atactttaactgtatgtgta

SEQ ID NO: 402728 - DNA, 20 bp, Artificial Sequence
  chemically synthesized
actgtatgtgtatggacaca

SEQ ID NO: 402729 - DNA, 20 bp, Artificial Sequence
  chemically synthesized
ttataatgcacacacaatta

SEQ ID NO: 402730 - DNA, 20 bp, Artificial Sequence
  chemically synthesized
tgtgtgcattataatttata

SEQ ID NO: 402731 - DNA, 20 bp, Artificial Sequence
  chemically synthesized
tgtgtgagtgtaagcaagat

SEQ ID NO: 402732 - DNA, 20 bp, Artificial Sequence
  chemically synthesized
gtgtatgtgtgagtgtaagc

SEQ ID NO: 402733 - DNA, 20 bp, Artificial Sequence
  chemically synthesized
atgtgtgtatgtgtgagtgt

SEQ ID NO: 402734 - DNA, 20 bp, Artificial Sequence
  chemically synthesized
gtgtgtatgtgtgtatgtgt

SEQ ID NO: 402735 - DNA, 20 bp, Artificial Sequence
  chemically synthesized
cacacatacacacacacaaa

SEQ ID NO: 402736 - DNA, 20 bp, Artificial Sequence
  chemically synthesized
cacacacacaaacagaaaat

SEQ ID NO: 402737 - DNA, 20 bp, Artificial Sequence
  chemically synthesized
gatttgggctgcattattgg

SEQ ID NO: 402738 - DNA, 20 bp, Artificial Sequence
  chemically synthesized
tttgttgtcttccaataatg

SEQ ID NO: 402739 - DNA, 20 bp, Artificial Sequence
  chemically synthesized
tgggatttgggctgcattat

SEQ ID NO: 402740 - DNA, 20 bp, Artificial Sequence
  chemically synthesized
ggaggtaatgagtgggattt

SEQ ID NO: 402741 - DNA, 20 bp, Artificial Sequence
  chemically synthesized
aggaggtaatgagtgggatt

SEQ ID NO: 402742 - DNA, 20 bp, Artificial Sequence
  chemically synthesized
acatttaggaggtaatgagt

SEQ ID NO: 402743 - DNA, 20 bp, Artificial Sequence
  chemically synthesized
cacatttaggaggtaatgag

SEQ ID NO: 402744 - DNA, 20 bp, Artificial Sequence
  chemically synthesized
ggtcacatttaggaggtaat

SEQ ID NO: 402745 - DNA, 20 bp, Artificial Sequence
  chemically synthesized
taagtgtggtcacatttagg

SEQ ID NO: 402746 - DNA, 20 bp, Artificial Sequence
  chemically synthesized
ctaagtgtggtcacatttag

SEQ ID NO: 402747 - DNA, 20 bp, Artificial Sequence
  chemically synthesized
atctaagtgtggtcacattt

SEQ ID NO: 402748 - DNA, 20 bp, Artificial Sequence
  chemically synthesized
catctaagtgtggtcacatt

SEQ ID NO: 402749 - DNA, 20 bp, Artificial Sequence
  chemically synthesized
ctcctaaatgtgaccacact

SEQ ID NO: 402750 - DNA, 20 bp, Artificial Sequence
  chemically synthesized
ataattctcccatctaagtg

SEQ ID NO: 402751 - DNA, 20 bp, Artificial Sequence
  chemically synthesized
taaatgtgaccacacttaga

SEQ ID NO: 402752 - DNA, 20 bp, Artificial Sequence
  chemically synthesized
aaatgtgaccacacttagat

SEQ ID NO: 402753 - DNA, 20 bp, Artificial Sequence
  chemically synthesized
atgtgaccacacttagatgg

SEQ ID NO: 402754 - DNA, 20 bp, Artificial Sequence
  chemically synthesized
acataataattctcccatct

SEQ ID NO: 402755 - DNA, 20 bp, Artificial Sequence
  chemically synthesized
gtttggtgccaggagttgca

SEQ ID NO: 402756 - DNA, 20 bp, Artificial Sequence
  chemically synthesized
tattatgtctttgcaactcc

SEQ ID NO: 402757 - DNA, 20 bp, Artificial Sequence
  chemically synthesized
tataccatgtttggtgccag

SEQ ID NO: 402758 - DNA, 20 bp, Artificial Sequence
  chemically synthesized
agtataccatgtttggtgcc

SEQ ID NO: 402759 - DNA, 20 bp, Artificial Sequence
  chemically synthesized
cagtataccatgtttggtgc

SEQ ID NO: 402760 - DNA, 20 bp, Artificial Sequence
  chemically synthesized
gcaactcctggcaccaaaca

SEQ ID NO: 402761 - DNA, 20 bp, Artificial Sequence
  chemically synthesized
ctgcttcagtataccatgtt

SEQ ID NO: 402762 - DNA, 20 bp, Artificial Sequence
  chemically synthesized
gcaccaaacatggtatactg

SEQ ID NO: 402763 - DNA, 20 bp, Artificial Sequence
  chemically synthesized
ccaaacatggtatactgaag

SEQ ID NO: 402764 - DNA, 20 bp, Artificial Sequence
  chemically synthesized
ctaagtacctatttctgctt

SEQ ID NO: 402765 - DNA, 20 bp, Artificial Sequence
  chemically synthesized
atggtatactgaagcagaaa

SEQ ID NO: 402766 - DNA, 20 bp, Artificial Sequence
  chemically synthesized
tggtatactgaagcagaaat

SEQ ID NO: 402767 - DNA, 20 bp, Artificial Sequence
  chemically synthesized
ctgaagcagaaataggtact

SEQ ID NO: 402768 - DNA, 20 bp, Artificial Sequence
  chemically synthesized
agcagaaataggtacttagt

SEQ ID NO: 402769 - DNA, 20 bp, Artificial Sequence
  chemically synthesized
gcagaaataggtacttagta

SEQ ID NO: 402770 - DNA, 20 bp, Artificial Sequence
  chemically synthesized
cagaaataggtacttagtaa

SEQ ID NO: 402771 - DNA, 20 bp, Artificial Sequence
  chemically synthesized
ttattcaacaaacccttact

SEQ ID NO: 402772 - DNA, 20 bp, Artificial Sequence
  chemically synthesized
aagggtttgttgaataaatc

SEQ ID NO: 402773 - DNA, 20 bp, Artificial Sequence
  chemically synthesized
gatttaattacagtattgat

SEQ ID NO: 402774 - DNA, 20 bp, Artificial Sequence
  chemically synthesized
gtagatctgagatttaatta

SEQ ID NO: 402775 - DNA, 20 bp, Artificial Sequence
  chemically synthesized
tcaatactgtaattaaatct

SEQ ID NO: 402776 - DNA, 20 bp, Artificial Sequence
  chemically synthesized
gtctaggacttagtagatct

SEQ ID NO: 402777 - DNA, 20 bp, Artificial Sequence
  chemically synthesized
aattaaatctcagatctact

SEQ ID NO: 402778 - DNA, 20 bp, Artificial Sequence
  chemically synthesized
agcattggtctaggacttag

SEQ ID NO: 402779 - DNA, 20 bp, Artificial Sequence
  chemically synthesized
atctcagatctactaagtcc

SEQ ID NO: 402780 - DNA, 20 bp, Artificial Sequence
  chemically synthesized
gaaagcattggtctaggact

SEQ ID NO: 402781 - DNA, 20 bp, Artificial Sequence
  chemically synthesized
cagggggaaagcattggtct

SEQ ID NO: 402782 - DNA, 20 bp, Artificial Sequence
  chemically synthesized
gcagggggaaagcattggtc

SEQ ID NO: 402783 - DNA, 20 bp, Artificial Sequence
  chemically synthesized
gaagtgcagggggaaagcat

SEQ ID NO: 402784 - DNA, 20 bp, Artificial Sequence
  chemically synthesized
tatgatgaagtgcaggggga

SEQ ID NO: 402785 - DNA, 20 bp, Artificial Sequence
  chemically synthesized
gcagtatgatgaagtgcagg

SEQ ID NO: 402786 - DNA, 20 bp, Artificial Sequence
  chemically synthesized
agcagtatgatgaagtgcag

SEQ ID NO: 402787 - DNA, 20 bp, Artificial Sequence
  chemically synthesized
gagcagtatgatgaagtgca

SEQ ID NO: 402788 - DNA, 20 bp, Artificial Sequence
  chemically synthesized
tgagcagtatgatgaagtgc

SEQ ID NO: 402789 - DNA, 20 bp, Artificial Sequence
  chemically synthesized
ttgagcagtatgatgaagtg

SEQ ID NO: 402790 - DNA, 20 bp, Artificial Sequence
  chemically synthesized
gtagtttgagcagtatgatg

SEQ ID NO: 402791 - DNA, 20 bp, Artificial Sequence
  chemically synthesized
aattaacagagtagtttgag

SEQ ID NO: 402792 - DNA, 20 bp, Artificial Sequence
  chemically synthesized
tataattaacagagtagttt

SEQ ID NO: 402793 - DNA, 20 bp, Artificial Sequence
  chemically synthesized
aaggtctataattaacagag

SEQ ID NO: 402794 - DNA, 20 bp, Artificial Sequence
  chemically synthesized
cagaaggtctataattaaca

SEQ ID NO: 402795 - DNA, 20 bp, Artificial Sequence
  chemically synthesized
tcaaactactctgttaatta

SEQ ID NO: 402796 - DNA, 20 bp, Artificial Sequence
  chemically synthesized
gacagaaggtctataattaa

SEQ ID NO: 402797 - DNA, 20 bp, Artificial Sequence
  chemically synthesized
ggaaatgaattggtgacaga

SEQ ID NO: 402798 - DNA, 20 bp, Artificial Sequence
  chemically synthesized
aggaaatgaattggtgacag

SEQ ID NO: 402799 - DNA, 20 bp, Artificial Sequence
  chemically synthesized
tttaggaaatgaattggtga

SEQ ID NO: 402800 - DNA, 20 bp, Artificial Sequence
  chemically synthesized
ggataatttaggaaatgaat

SEQ ID NO: 402801 - DNA, 20 bp, Artificial Sequence
  chemically synthesized
gggtgctcaatggataattt

SEQ ID NO: 402802 - DNA, 20 bp, Artificial Sequence
  chemically synthesized
tgggtgctcaatggataatt

SEQ ID NO: 402803 - DNA, 20 bp, Artificial Sequence
  chemically synthesized
catttcctaaattatccatt

SEQ ID NO: 402804 - DNA, 20 bp, Artificial Sequence
  chemically synthesized
tatgtctaatgggtgctcaa

SEQ ID NO: 402805 - DNA, 20 bp, Artificial Sequence
  chemically synthesized
attatccattgagcacccat

SEQ ID NO: 402806 - DNA, 20 bp, Artificial Sequence
  chemically synthesized
aagttagttttatgtctaat

SEQ ID NO: 402807 - DNA, 20 bp, Artificial Sequence
  chemically synthesized
aaagttagttttatgtctaa

SEQ ID NO: 402808 - DNA, 20 bp, Artificial Sequence
  chemically synthesized
ggggagaagtcattgaaagt

SEQ ID NO: 402809 - DNA, 20 bp, Artificial Sequence
  chemically synthesized
ttttggggagaagtcattga

SEQ ID NO: 402810 - DNA, 20 bp, Artificial Sequence
  chemically synthesized
caaggctaaattttggggag

SEQ ID NO: 402811 - DNA, 20 bp, Artificial Sequence
  chemically synthesized
ttccaaggctaaattttggg

SEQ ID NO: 402812 - DNA, 20 bp, Artificial Sequence
  chemically synthesized
aatgacttctccccaaaatt

SEQ ID NO: 402813 - DNA, 20 bp, Artificial Sequence
  chemically synthesized
agttccaaggctaaattttg

SEQ ID NO: 402814 - DNA, 20 bp, Artificial Sequence
  chemically synthesized
cagttccaaggctaaatttt

SEQ ID NO: 402815 - DNA, 20 bp, Artificial Sequence
  chemically synthesized
tcagttccaaggctaaattt

SEQ ID NO: 402816 - DNA, 20 bp, Artificial Sequence
  chemically synthesized
ttctccccaaaatttagcct

SEQ ID NO: 402817 - DNA, 20 bp, Artificial Sequence
  chemically synthesized
gtagcaatatttcagttcca

SEQ ID NO: 402818 - DNA, 20 bp, Artificial Sequence
  chemically synthesized
agtagcaatatttcagttcc

SEQ ID NO: 402819 - DNA, 20 bp, Artificial Sequence
  chemically synthesized
gaaaataagtagcaatattt

SEQ ID NO: 402820 - DNA, 20 bp, Artificial Sequence
  chemically synthesized
attgtagtgatgaaaataag

SEQ ID NO: 402821 - DNA, 20 bp, Artificial Sequence
  chemically synthesized
ttcattgtagtgatgaaaat

SEQ ID NO: 402822 - DNA, 20 bp, Artificial Sequence
  chemically synthesized
tcttaattttttattcattg

SEQ ID NO: 402823 - DNA, 20 bp, Artificial Sequence
  chemically synthesized
actacaatgaataaaaaatt

SEQ ID NO: 402824 - DNA, 20 bp, Artificial Sequence
  chemically synthesized
tacaatgaataaaaaattaa

SEQ ID NO: 402825 - DNA, 20 bp, Artificial Sequence
  chemically synthesized
atgaataaaaaattaagaga

SEQ ID NO: 402826 - DNA, 20 bp, Artificial Sequence
  chemically synthesized
aataaaggcagattgtttgc

SEQ ID NO: 402827 - DNA, 20 bp, Artificial Sequence
  chemically synthesized
ttcacctagagaaataaagg

SEQ ID NO: 402828 - DNA, 20 bp, Artificial Sequence
  chemically synthesized
aaattcacctagagaaataa

SEQ ID NO: 402829 - DNA, 20 bp, Artificial Sequence
  chemically synthesized
gaaattcacctagagaaata

SEQ ID NO: 402830 - DNA, 20 bp, Artificial Sequence
  chemically synthesized
acaatctgcctttatttctc

SEQ ID NO: 402831 - DNA, 20 bp, Artificial Sequence
  chemically synthesized
caatctgcctttatttctct

SEQ ID NO: 402832 - DNA, 20 bp, Artificial Sequence
  chemically synthesized
tacagagtgaaattcaccta

SEQ ID NO: 402833 - DNA, 20 bp, Artificial Sequence
  chemically synthesized
attacagagtgaaattcacc

SEQ ID NO: 402834 - DNA, 20 bp, Artificial Sequence
  chemically synthesized
ggcaattatatcatattaca

SEQ ID NO: 402835 - DNA, 20 bp, Artificial Sequence
  chemically synthesized
agggcaattatatcatatta

SEQ ID NO: 402836 - DNA, 20 bp, Artificial Sequence
  chemically synthesized
gtcatgaaagatgaagtaaa

SEQ ID NO: 402837 - DNA, 20 bp, Artificial Sequence
  chemically synthesized
agtcatgaaagatgaagtaa

SEQ ID NO: 402838 - DNA, 20 bp, Artificial Sequence
  chemically synthesized
cagtcatgaaagatgaagta

SEQ ID NO: 402839 - DNA, 20 bp, Artificial Sequence
  chemically synthesized
catgacagtcatgaaagatg

SEQ ID NO: 402840 - DNA, 20 bp, Artificial Sequence
  chemically synthesized
cagaagcatgacagtcatga

SEQ ID NO: 402841 - DNA, 20 bp, Artificial Sequence
  chemically synthesized
acattgtgtcagaagcatga

SEQ ID NO: 402842 - DNA, 20 bp, Artificial Sequence
  chemically synthesized
agcattttacattgtgtcag

SEQ ID NO: 402843 - DNA, 20 bp, Artificial Sequence
  chemically synthesized
catagcattttacattgtgt

SEQ ID NO: 402844 - DNA, 20 bp, Artificial Sequence
  chemically synthesized
tgacacaatgtaaaatgcta

SEQ ID NO: 402845 - DNA, 20 bp, Artificial Sequence
  chemically synthesized
aggaacagacaggtcatcca

SEQ ID NO: 402846 - DNA, 20 bp, Artificial Sequence
  chemically synthesized
gtggaggcaaaggaacagac

SEQ ID NO: 402847 - DNA, 20 bp, Artificial Sequence
  chemically synthesized
agtggaggcaaaggaacaga

SEQ ID NO: 402848 - DNA, 20 bp, Artificial Sequence
  chemically synthesized
ttgcagtggaggcaaaggaa

SEQ ID NO: 402849 - DNA, 20 bp, Artificial Sequence
  chemically synthesized
ggcgtttgcagtggaggcaa

SEQ ID NO: 402850 - DNA, 20 bp, Artificial Sequence
  chemically synthesized
tggcgtttgcagtggaggca

SEQ ID NO: 402851 - DNA, 20 bp, Artificial Sequence
  chemically synthesized
agaagtggcgtttgcagtgg

SEQ ID NO: 402852 - DNA, 20 bp, Artificial Sequence
  chemically synthesized
aagaagtggcgtttgcagtg

SEQ ID NO: 402853 - DNA, 20 bp, Artificial Sequence
  chemically synthesized
gaaagaagtggcgtttgcag

SEQ ID NO: 402854 - DNA, 20 bp, Artificial Sequence
  chemically synthesized
tgagaaagaagtggcgtttg

SEQ ID NO: 402855 - DNA, 20 bp, Artificial Sequence
  chemically synthesized
tgacctacctgagaaagaag

SEQ ID NO: 402856 - DNA, 20 bp, Artificial Sequence
  chemically synthesized
tgcaaacgccacttctttct

SEQ ID NO: 402857 - DNA, 20 bp, Artificial Sequence
  chemically synthesized
gcaaacgccacttctttctc

SEQ ID NO: 402858 - DNA, 20 bp, Artificial Sequence
  chemically synthesized
aattgacctacctgagaaag

SEQ ID NO: 402859 - DNA, 20 bp, Artificial Sequence
  chemically synthesized
aacgccacttctttctcagg

SEQ ID NO: 402860 - DNA, 20 bp, Artificial Sequence
  chemically synthesized
agcaattgacctacctgaga

SEQ ID NO: 402861 - DNA, 20 bp, Artificial Sequence
  chemically synthesized
acgccacttctttctcaggt

SEQ ID NO: 402862 - DNA, 20 bp, Artificial Sequence
  chemically synthesized
aaaaagcaattgacctacct

SEQ ID NO: 402863 - DNA, 20 bp, Artificial Sequence
  chemically synthesized
aacaactccctacaataaaa

SEQ ID NO: 402864 - DNA, 20 bp, Artificial Sequence
  chemically synthesized
ggtcaattgcttttttattg

SEQ ID NO: 402865 - DNA, 20 bp, Artificial Sequence
  chemically synthesized
gtcaattgcttttttattgt

SEQ ID NO: 402866 - DNA, 20 bp, Artificial Sequence
  chemically synthesized
tcaattgcttttttattgta

SEQ ID NO: 402867 - DNA, 20 bp, Artificial Sequence
  chemically synthesized
aattgcttttttattgtagg

SEQ ID NO: 402868 - DNA, 20 bp, Artificial Sequence
  chemically synthesized
tttttattgtagggagttgt

SEQ ID NO: 402869 - DNA, 20 bp, Artificial Sequence
  chemically synthesized
ttgtagggagttgttggact

SEQ ID NO: 402870 - DNA, 20 bp, Artificial Sequence
  chemically synthesized
gagttgttggactcagaaac

SEQ ID NO: 402871 - DNA, 20 bp, Artificial Sequence
  chemically synthesized
ggctttccaatctggtttct

SEQ ID NO: 402872 - DNA, 20 bp, Artificial Sequence
  chemically synthesized
gttggactcagaaaccagat

SEQ ID NO: 402873 - DNA, 20 bp, Artificial Sequence
  chemically synthesized
gactcagaaaccagattgga

SEQ ID NO: 402874 - DNA, 20 bp, Artificial Sequence
  chemically synthesized
gctgacatggctttccaatc

SEQ ID NO: 402875 - DNA, 20 bp, Artificial Sequence
  chemically synthesized
accagattggaaagccatgt

SEQ ID NO: 402876 - DNA, 20 bp, Artificial Sequence
  chemically synthesized
ttattcaatatgagctgaca

SEQ ID NO: 402877 - DNA, 20 bp, Artificial Sequence
  chemically synthesized
agagaacttttattcaatat

SEQ ID NO: 402878 - DNA, 20 bp, Artificial Sequence
  chemically synthesized
tgtcagctcatattgaataa

SEQ ID NO: 402879 - DNA, 20 bp, Artificial Sequence
  chemically synthesized
ttaagtggcagggaatggga

SEQ ID NO: 402880 - DNA, 20 bp, Artificial Sequence
  chemically synthesized
gattaagtggcagggaatgg

SEQ ID NO: 402881 - DNA, 20 bp, Artificial Sequence
  chemically synthesized
gtgattaagtggcagggaat

SEQ ID NO: 402882 - DNA, 20 bp, Artificial Sequence
  chemically synthesized
tgtgattaagtggcagggaa

SEQ ID NO: 402883 - DNA, 20 bp, Artificial Sequence
  chemically synthesized
aattctgtgattaagtggca

SEQ ID NO: 402884 - DNA, 20 bp, Artificial Sequence
  chemically synthesized
aaattctgtgattaagtggc

SEQ ID NO: 402885 - DNA, 20 bp, Artificial Sequence
  chemically synthesized
taaattctgtgattaagtgg

SEQ ID NO: 402886 - DNA, 20 bp, Artificial Sequence
  chemically synthesized
gcataaattctgtgattaag

SEQ ID NO: 402887 - DNA, 20 bp, Artificial Sequence
  chemically synthesized
cattccctgccacttaatca

SEQ ID NO: 402888 - DNA, 20 bp, Artificial Sequence
  chemically synthesized
ggagcataaattctgtgatt

SEQ ID NO: 402889 - DNA, 20 bp, Artificial Sequence
  chemically synthesized
tcacagaatttatgctccat

SEQ ID NO: 402890 - DNA, 20 bp, Artificial Sequence
  chemically synthesized
ataactccaatttgctaatg

SEQ ID NO: 402891 - DNA, 20 bp, Artificial Sequence
  chemically synthesized
ccataactccaatttgctaa

SEQ ID NO: 402892 - DNA, 20 bp, Artificial Sequence
  chemically synthesized
tttatgctccattagcaaat

SEQ ID NO: 402893 - DNA, 20 bp, Artificial Sequence
  chemically synthesized
tatgctccattagcaaattg

SEQ ID NO: 402894 - DNA, 20 bp, Artificial Sequence
  chemically synthesized
ccattagcaaattggagtta

SEQ ID NO: 402895 - DNA, 20 bp, Artificial Sequence
  chemically synthesized
tagcaaattggagttatggt

SEQ ID NO: 402896 - DNA, 20 bp, Artificial Sequence
  chemically synthesized
tacaactatgcgattatgtt

SEQ ID NO: 402897 - DNA, 20 bp, Artificial Sequence
  chemically synthesized
atacaactatgcgattatgt

SEQ ID NO: 402898 - DNA, 20 bp, Artificial Sequence
  chemically synthesized
gagaacctaacataatcgca

SEQ ID NO: 402899 - DNA, 20 bp, Artificial Sequence
  chemically synthesized
aattgcaatgctctatacat

SEQ ID NO: 402900 - DNA, 20 bp, Artificial Sequence
  chemically synthesized
tgctatgtttccaatgtata

SEQ ID NO: 402901 - DNA, 20 bp, Artificial Sequence
  chemically synthesized
tgtgctatgtttccaatgta

SEQ ID NO: 402902 - DNA, 20 bp, Artificial Sequence
  chemically synthesized
tgctctatacattggaaaca

SEQ ID NO: 402903 - DNA, 20 bp, Artificial Sequence
  chemically synthesized
atacattggaaacatagcac

SEQ ID NO: 402904 - DNA, 20 bp, Artificial Sequence
  chemically synthesized
gaaacatagcacaagtattg

SEQ ID NO: 402905 - DNA, 20 bp, Artificial Sequence
  chemically synthesized
attgtagaaatatacttgtg

SEQ ID NO: 402906 - DNA, 20 bp, Artificial Sequence
  chemically synthesized
aacttcgattaattcttcac

SEQ ID NO: 402907 - DNA, 20 bp, Artificial Sequence
  chemically synthesized
tacttgtgaagaattaatcg

SEQ ID NO: 402908 - DNA, 20 bp, Artificial Sequence
  chemically synthesized
gaattaatcgaagttgcatg

SEQ ID NO: 402909 - DNA, 20 bp, Artificial Sequence
  chemically synthesized
ttaatcgaagttgcatgaag

SEQ ID NO: 402910 - DNA, 20 bp, Artificial Sequence
  chemically synthesized
taatcgaagttgcatgaagt

SEQ ID NO: 402911 - DNA, 20 bp, Artificial Sequence
  chemically synthesized
aagtaggacataatgacaat

SEQ ID NO: 402912 - DNA, 20 bp, Artificial Sequence
  chemically synthesized
acataatgacaatgagattg

SEQ ID NO: 402913 - DNA, 20 bp, Artificial Sequence
  chemically synthesized
atgagattgaagaaatgtat

SEQ ID NO: 402914 - DNA, 20 bp, Artificial Sequence
  chemically synthesized
gagattgaagaaatgtatta

SEQ ID NO: 402915 - DNA, 20 bp, Artificial Sequence
  chemically synthesized
attgaagaaatgtattagag

SEQ ID NO: 402916 - DNA, 20 bp, Artificial Sequence
  chemically synthesized
gaagaaatgtattagagtgg

SEQ ID NO: 402917 - DNA, 20 bp, Artificial Sequence
  chemically synthesized
tattagagtggaagaatgat

SEQ ID NO: 402918 - DNA, 20 bp, Artificial Sequence
  chemically synthesized
ggaagaatgatcagaactcc

SEQ ID NO: 402919 - DNA, 20 bp, Artificial Sequence
  chemically synthesized
aagaatgatcagaactccaa

SEQ ID NO: 402920 - DNA, 20 bp, Artificial Sequence
  chemically synthesized
caccttttcatatactcttg

SEQ ID NO: 402921 - DNA, 20 bp, Artificial Sequence
  chemically synthesized
aacaccttttcatatactct

SEQ ID NO: 402922 - DNA, 20 bp, Artificial Sequence
  chemically synthesized
gaactccaagagtatatgaa

SEQ ID NO: 402923 - DNA, 20 bp, Artificial Sequence
  chemically synthesized
aactccaagagtatatgaaa

SEQ ID NO: 402924 - DNA, 20 bp, Artificial Sequence
  chemically synthesized
agagtatatgaaaaggtgtt

SEQ ID NO: 402925 - DNA, 20 bp, Artificial Sequence
  chemically synthesized
gtatatgaaaaggtgttaag

SEQ ID NO: 402926 - DNA, 20 bp, Artificial Sequence
  chemically synthesized
gaaaaggtgttaagtggtct

SEQ ID NO: 402927 - DNA, 20 bp, Artificial Sequence
  chemically synthesized
aggtgttaagtggtctcagt

SEQ ID NO: 402928 - DNA, 20 bp, Artificial Sequence
  chemically synthesized
atggcactgtttttccaact

SEQ ID NO: 402929 - DNA, 20 bp, Artificial Sequence
  chemically synthesized
agtggtctcagttggaaaaa

SEQ ID NO: 402930 - DNA, 20 bp, Artificial Sequence
  chemically synthesized
gttggaaaaacagtgccatc

SEQ ID NO: 402931 - DNA, 20 bp, Artificial Sequence
  chemically synthesized
ggaaaaacagtgccatctgg

SEQ ID NO: 402932 - DNA, 20 bp, Artificial Sequence
  chemically synthesized
tgtttgcacaatctaccaga

SEQ ID NO: 402933 - DNA, 20 bp, Artificial Sequence
  chemically synthesized
taactgtttgcacaatctac

SEQ ID NO: 402934 - DNA, 20 bp, Artificial Sequence
  chemically synthesized
catctggtagattgtgcaaa

SEQ ID NO: 402935 - DNA, 20 bp, Artificial Sequence
  chemically synthesized
acatgcaattttaagaggat

SEQ ID NO: 402936 - DNA, 20 bp, Artificial Sequence
  chemically synthesized
ctaacacatgcaattttaag

SEQ ID NO: 402937 - DNA, 20 bp, Artificial Sequence
  chemically synthesized
tctaacacatgcaattttaa

SEQ ID NO: 402938 - DNA, 20 bp, Artificial Sequence
  chemically synthesized
tatctaacacatgcaatttt

SEQ ID NO: 402939 - DNA, 20 bp, Artificial Sequence
  chemically synthesized
cctcttaaaattgcatgtgt

SEQ ID NO: 402940 - DNA, 20 bp, Artificial Sequence
  chemically synthesized
tgcatgtgttagatacaatg

SEQ ID NO: 402941 - DNA, 20 bp, Artificial Sequence
  chemically synthesized
gcatgtgttagatacaatgc

SEQ ID NO: 402942 - DNA, 20 bp, Artificial Sequence
  chemically synthesized
gtgttagatacaatgcaggc

SEQ ID NO: 402943 - DNA, 20 bp, Artificial Sequence
  chemically synthesized
tgttagatacaatgcaggcc

SEQ ID NO: 402944 - DNA, 20 bp, Artificial Sequence
  chemically synthesized
gttagatacaatgcaggccg

SEQ ID NO: 402945 - DNA, 20 bp, Artificial Sequence
  chemically synthesized
atgagtgtatgatgtaaccc

SEQ ID NO: 402946 - DNA, 20 bp, Artificial Sequence
  chemically synthesized
gttacatcatacactcattt

SEQ ID NO: 402947 - DNA, 20 bp, Artificial Sequence
  chemically synthesized
tacatcatacactcatttca

SEQ ID NO: 402948 - DNA, 20 bp, Artificial Sequence
  chemically synthesized
aggttatttgactctgaaat

SEQ ID NO: 402949 - DNA, 20 bp, Artificial Sequence
  chemically synthesized
atttcagagtcaaataacct

SEQ ID NO: 402950 - DNA, 20 bp, Artificial Sequence
  chemically synthesized
tgaaactggagttggaactc

SEQ ID NO: 402951 - DNA, 20 bp, Artificial Sequence
  chemically synthesized
gtgaaactggagttggaact

SEQ ID NO: 402952 - DNA, 20 bp, Artificial Sequence
  chemically synthesized
aataacctgagttccaactc

SEQ ID NO: 402953 - DNA, 20 bp, Artificial Sequence
  chemically synthesized
atgagatgtgaaactggagt

SEQ ID NO: 402954 - DNA, 20 bp, Artificial Sequence
  chemically synthesized
gataatgagatgtgaaactg

SEQ ID NO: 402955 - DNA, 20 bp, Artificial Sequence
  chemically synthesized
gagataatgagatgtgaaac

SEQ ID NO: 402956 - DNA, 20 bp, Artificial Sequence
  chemically synthesized
ctcaaggccacagagataat

SEQ ID NO: 402957 - DNA, 20 bp, Artificial Sequence
  chemically synthesized
ttcacatctcattatctctg

SEQ ID NO: 402958 - DNA, 20 bp, Artificial Sequence
  chemically synthesized
gtaacttactcaaggccaca

SEQ ID NO: 402959 - DNA, 20 bp, Artificial Sequence
  chemically synthesized
ctcattatctctgtggcctt

SEQ ID NO: 402960 - DNA, 20 bp, Artificial Sequence
  chemically synthesized
aagtaacttactcaaggcca

SEQ ID NO: 402961 - DNA, 20 bp, Artificial Sequence
  chemically synthesized
ttatctctgtggccttgagt

SEQ ID NO: 402962 - DNA, 20 bp, Artificial Sequence
  chemically synthesized
gaggttaagtaacttactca

SEQ ID NO: 402963 - DNA, 20 bp, Artificial Sequence
  chemically synthesized
agaggttaagtaacttactc

SEQ ID NO: 402964 - DNA, 20 bp, Artificial Sequence
  chemically synthesized
caatgagacacagagaggtt

SEQ ID NO: 402965 - DNA, 20 bp, Artificial Sequence
  chemically synthesized
agaggcaatgagacacagag

SEQ ID NO: 402966 - DNA, 20 bp, Artificial Sequence
  chemically synthesized
tagaggcaatgagacacaga

SEQ ID NO: 402967 - DNA, 20 bp, Artificial Sequence
  chemically synthesized
aatagaggcaatgagacaca

SEQ ID NO: 402968 - DNA, 20 bp, Artificial Sequence
  chemically synthesized
caaatagaggcaatgagaca

SEQ ID NO: 402969 - DNA, 20 bp, Artificial Sequence
  chemically synthesized
atgaaacaaatagaggcaat

SEQ ID NO: 402970 - DNA, 20 bp, Artificial Sequence
  chemically synthesized
tattaccatgaaacaaatag

SEQ ID NO: 402971 - DNA, 20 bp, Artificial Sequence
  chemically synthesized
ctattaccatgaaacaaata

SEQ ID NO: 402972 - DNA, 20 bp, Artificial Sequence
  chemically synthesized
tactattaccatgaaacaaa

SEQ ID NO: 402973 - DNA, 20 bp, Artificial Sequence
  chemically synthesized
cattgcctctatttgtttca

SEQ ID NO: 402974 - DNA, 20 bp, Artificial Sequence
  chemically synthesized
ctctatttgtttcatggtaa

SEQ ID NO: 402975 - DNA, 20 bp, Artificial Sequence
  chemically synthesized
gtttcatggtaatagtaata

SEQ ID NO: 402976 - DNA, 20 bp, Artificial Sequence
  chemically synthesized
aataaagatactgaattgtg

SEQ ID NO: 402977 - DNA, 20 bp, Artificial Sequence
  chemically synthesized
cacatttagtcttcacaatt

SEQ ID NO: 402978 - DNA, 20 bp, Artificial Sequence
  chemically synthesized
tgtcatacatgtgtcacatt

SEQ ID NO: 402979 - DNA, 20 bp, Artificial Sequence
  chemically synthesized
atgtatgacatattaatgct

SEQ ID NO: 402980 - DNA, 20 bp, Artificial Sequence
  chemically synthesized
atgacatattaatgctgaga

SEQ ID NO: 402981 - DNA, 20 bp, Artificial Sequence
  chemically synthesized
gacatattaatgctgagaaa

SEQ ID NO: 402982 - DNA, 20 bp, Artificial Sequence
  chemically synthesized
gtctatttttttctctttct

SEQ ID NO: 402983 - DNA, 20 bp, Artificial Sequence
  chemically synthesized
tgctgagaaagagaaaaaaa

SEQ ID NO: 402984 - DNA, 20 bp, Artificial Sequence
  chemically synthesized
atttggaagtaaagatttat

SEQ ID NO: 402985 - DNA, 20 bp, Artificial Sequence
  chemically synthesized
tatttggaagtaaagattta

SEQ ID NO: 402986 - DNA, 20 bp, Artificial Sequence
  chemically synthesized
ttgtaatatatttggaagta

SEQ ID NO: 402987 - DNA, 20 bp, Artificial Sequence
  chemically synthesized
ggaagttgtaatatatttgg

SEQ ID NO: 402988 - DNA, 20 bp, Artificial Sequence
  chemically synthesized
acgggaagttgtaatatatt

SEQ ID NO: 402989 - DNA, 20 bp, Artificial Sequence
  chemically synthesized
aaatatattacaacttcccg

SEQ ID NO: 402990 - DNA, 20 bp, Artificial Sequence
  chemically synthesized
aatatattacaacttcccgt

SEQ ID NO: 402991 - DNA, 20 bp, Artificial Sequence
  chemically synthesized
ttatacagaagacccacggg

SEQ ID NO: 402992 - DNA, 20 bp, Artificial Sequence
  chemically synthesized
catttatacagaagacccac

SEQ ID NO: 402993 - DNA, 20 bp, Artificial Sequence
  chemically synthesized
tcatttatacagaagaccca

SEQ ID NO: 402994 - DNA, 20 bp, Artificial Sequence
  chemically synthesized
aaataatgtcatttatacag

SEQ ID NO: 402995 - DNA, 20 bp, Artificial Sequence
  chemically synthesized
atgaaataatgtcatttata

SEQ ID NO: 402996 - DNA, 20 bp, Artificial Sequence
  chemically synthesized
aatgacattatttcataaaa

SEQ ID NO: 402997 - DNA, 20 bp, Artificial Sequence
  chemically synthesized
aaatagacacgattgctacg

SEQ ID NO: 402998 - DNA, 20 bp, Artificial Sequence
  chemically synthesized
tagacacgattgctacgtgg

SEQ ID NO: 402999 - DNA, 20 bp, Artificial Sequence
  chemically synthesized
ttattaacatggctgccacg

SEQ ID NO: 403000 - DNA, 20 bp, Artificial Sequence
  chemically synthesized
aatcctactaattattaaca

SEQ ID NO: 403001 - DNA, 20 bp, Artificial Sequence
  chemically synthesized
gtggcagccatgttaataat

SEQ ID NO: 403002 - DNA, 20 bp, Artificial Sequence
  chemically synthesized
gcagccatgttaataattag

SEQ ID NO: 403003 - DNA, 20 bp, Artificial Sequence
  chemically synthesized
cagccatgttaataattagt

SEQ ID NO: 403004 - DNA, 20 bp, Artificial Sequence
  chemically synthesized
aataattagtaggattttta

SEQ ID NO: 403005 - DNA, 20 bp, Artificial Sequence
  chemically synthesized
tgtaaatatgcaaaaaattc

SEQ ID NO: 403006 - DNA, 20 bp, Artificial Sequence
  chemically synthesized
tttttatctttcaaatcgag

SEQ ID NO: 403007 - DNA, 20 bp, Artificial Sequence
  chemically synthesized
ttcaagtcttctcgatttga

SEQ ID NO: 403008 - DNA, 20 bp, Artificial Sequence
  chemically synthesized
ttgtttttatctttcaaatc

SEQ ID NO: 403009 - DNA, 20 bp, Artificial Sequence
  chemically synthesized
tcattcttttgagcatgagg

SEQ ID NO: 403010 - DNA, 20 bp, Artificial Sequence
  chemically synthesized
ttcattcttttgagcatgag

SEQ ID NO: 403011 - DNA, 20 bp, Artificial Sequence
  chemically synthesized
acttcattcttttgagcatg

SEQ ID NO: 403012 - DNA, 20 bp, Artificial Sequence
  chemically synthesized
tacttcattcttttgagcat

SEQ ID NO: 403013 - DNA, 20 bp, Artificial Sequence
  chemically synthesized
ttatacctcctcatgctcaa

SEQ ID NO: 403014 - DNA, 20 bp, Artificial Sequence
  chemically synthesized
aaaacttacttcattctttt

SEQ ID NO: 403015 - DNA, 20 bp, Artificial Sequence
  chemically synthesized
tcctcatgctcaaaagaatg

SEQ ID NO: 403016 - DNA, 20 bp, Artificial Sequence
  chemically synthesized
catgctcaaaagaatgaagt

SEQ ID NO: 403017 - DNA, 20 bp, Artificial Sequence
  chemically synthesized
aaaagaatgaagtaagtttt

SEQ ID NO: 403018 - DNA, 20 bp, Artificial Sequence
  chemically synthesized
aagtaagtttttagtaataa

SEQ ID NO: 403019 - DNA, 20 bp, Artificial Sequence
  chemically synthesized
tttagtaataatggaaataa

SEQ ID NO: 403020 - DNA, 20 bp, Artificial Sequence
  chemically synthesized
ggaaataatggatatttctg

SEQ ID NO: 403021 - DNA, 20 bp, Artificial Sequence
  chemically synthesized
ttataaattataatgcacca

SEQ ID NO: 403022 - DNA, 20 bp, Artificial Sequence
  chemically synthesized
gtggtgcattataatttata

SEQ ID NO: 403023 - DNA, 20 bp, Artificial Sequence
  chemically synthesized
tactcatgtttaaacaagat

SEQ ID NO: 403024 - DNA, 20 bp, Artificial Sequence
  chemically synthesized
ccacatactcatgtttaaac

SEQ ID NO: 403025 - DNA, 20 bp, Artificial Sequence
  chemically synthesized
atctcatcttgtttaaacat

SEQ ID NO: 403026 - DNA, 20 bp, Artificial Sequence
  chemically synthesized
cttgtttaaacatgagtatg

SEQ ID NO: 403027 - DNA, 20 bp, Artificial Sequence
  chemically synthesized
ttgtttaaacatgagtatgt

SEQ ID NO: 403028 - DNA, 20 bp, Artificial Sequence
  chemically synthesized
taaacatgagtatgtgggtg

SEQ ID NO: 403029 - DNA, 20 bp, Artificial Sequence
  chemically synthesized
gtatgtgggtgtagacttgt

SEQ ID NO: 403030 - DNA, 20 bp, Artificial Sequence
  chemically synthesized
tatgtgggtgtagacttgtt

SEQ ID NO: 403031 - DNA, 20 bp, Artificial Sequence
  chemically synthesized
tgtgggtgtagacttgttag

SEQ ID NO: 403032 - DNA, 20 bp, Artificial Sequence
  chemically synthesized
aacttatttttactcctaac

SEQ ID NO: 403033 - DNA, 20 bp, Artificial Sequence
  chemically synthesized
gacttgttaggagtaaaaat

SEQ ID NO: 403034 - DNA, 20 bp, Artificial Sequence
  chemically synthesized
aaaaataagttactattaat

SEQ ID NO: 403035 - DNA, 20 bp, Artificial Sequence
  chemically synthesized
caagtctgcatactaattaa

SEQ ID NO: 403036 - DNA, 20 bp, Artificial Sequence
  chemically synthesized
agttactattaattagtatg

SEQ ID NO: 403037 - DNA, 20 bp, Artificial Sequence
  chemically synthesized
acactaccaaagcacatttc

SEQ ID NO: 403038 - DNA, 20 bp, Artificial Sequence
  chemically synthesized
tgcagacttgaaatgtgctt

SEQ ID NO: 403039 - DNA, 20 bp, Artificial Sequence
  chemically synthesized
agacttgaaatgtgctttgg

SEQ ID NO: 403040 - DNA, 20 bp, Artificial Sequence
  chemically synthesized
ctttctcatgaacactacca

SEQ ID NO: 403041 - DNA, 20 bp, Artificial Sequence
  chemically synthesized
tgtgctttggtagtgttcat

SEQ ID NO: 403042 - DNA, 20 bp, Artificial Sequence
  chemically synthesized
ctttggtagtgttcatgaga

SEQ ID NO: 403043 - DNA, 20 bp, Artificial Sequence
  chemically synthesized
gttattactttaacaaaaat

SEQ ID NO: 403044 - DNA, 20 bp, Artificial Sequence
  chemically synthesized
aagatgacttatttttgtta

SEQ ID NO: 403045 - DNA, 20 bp, Artificial Sequence
  chemically synthesized
ttttgttaaagtaataacca

SEQ ID NO: 403046 - DNA, 20 bp, Artificial Sequence
  chemically synthesized
attctgtcataattagtcta

SEQ ID NO: 403047 - DNA, 20 bp, Artificial Sequence
  chemically synthesized
taaccatagactaattatga

SEQ ID NO: 403048 - DNA, 20 bp, Artificial Sequence
  chemically synthesized
ttgatttattctgtcataat

SEQ ID NO: 403049 - DNA, 20 bp, Artificial Sequence
  chemically synthesized
atgacagaataaatcaaaat

SEQ ID NO: 403050 - DNA, 20 bp, Artificial Sequence
  chemically synthesized
tgacagaataaatcaaaata

SEQ ID NO: 403051 - DNA, 20 bp, Artificial Sequence
  chemically synthesized
gaataaatcaaaataaggtc

SEQ ID NO: 403052 - DNA, 20 bp, Artificial Sequence
  chemically synthesized
aataaatcaaaataaggtca

SEQ ID NO: 403053 - DNA, 20 bp, Artificial Sequence
  chemically synthesized
caaaataaggtcaaggtctc

SEQ ID NO: 403054 - DNA, 20 bp, Artificial Sequence
  chemically synthesized
ttcacctctaaattacactg

SEQ ID NO: 403055 - DNA, 20 bp, Artificial Sequence
  chemically synthesized
atttcacctctaaattacac

SEQ ID NO: 403056 - DNA, 20 bp, Artificial Sequence
  chemically synthesized
tcaaggtctccagtgtaatt

SEQ ID NO: 403057 - DNA, 20 bp, Artificial Sequence
  chemically synthesized
aaggtctccagtgtaattta

SEQ ID NO: 403058 - DNA, 20 bp, Artificial Sequence
  chemically synthesized
aggtctccagtgtaatttag

SEQ ID NO: 403059 - DNA, 20 bp, Artificial Sequence
  chemically synthesized
tagaggtgaaattaactact

SEQ ID NO: 403060 - DNA, 20 bp, Artificial Sequence
  chemically synthesized
gttctgctacaatatccaag

SEQ ID NO: 403061 - DNA, 20 bp, Artificial Sequence
  chemically synthesized
gcagttctgctacaatatcc

SEQ ID NO: 403062 - DNA, 20 bp, Artificial Sequence
  chemically synthesized
aattaactacttggatattg

SEQ ID NO: 403063 - DNA, 20 bp, Artificial Sequence
  chemically synthesized
taactacttggatattgtag

SEQ ID NO: 403064 - DNA, 20 bp, Artificial Sequence
  chemically synthesized
attgtagcagaactgctaac

SEQ ID NO: 403065 - DNA, 20 bp, Artificial Sequence
  chemically synthesized
ggaaacaggcatctagttag

SEQ ID NO: 403066 - DNA, 20 bp, Artificial Sequence
  chemically synthesized
tatggaaacaggcatctagt

SEQ ID NO: 403067 - DNA, 20 bp, Artificial Sequence
  chemically synthesized
gctgtatggaaacaggcatc

SEQ ID NO: 403068 - DNA, 20 bp, Artificial Sequence
  chemically synthesized
gtaggcagctgtatggaaac

SEQ ID NO: 403069 - DNA, 20 bp, Artificial Sequence
  chemically synthesized
agtaggcagctgtatggaaa

SEQ ID NO: 403070 - DNA, 20 bp, Artificial Sequence
  chemically synthesized
actagatgcctgtttccata

SEQ ID NO: 403071 - DNA, 20 bp, Artificial Sequence
  chemically synthesized
atattgagtaggcagctgta

SEQ ID NO: 403072 - DNA, 20 bp, Artificial Sequence
  chemically synthesized
taaaagtaatattgagtagg

SEQ ID NO: 403073 - DNA, 20 bp, Artificial Sequence
  chemically synthesized
ttttaaaagtaatattgagt

SEQ ID NO: 403074 - DNA, 20 bp, Artificial Sequence
  chemically synthesized
cttttaaaagtaatattgag

SEQ ID NO: 403075 - DNA, 20 bp, Artificial Sequence
  chemically synthesized
aatcttttaaaagtaatatt

SEQ ID NO: 403076 - DNA, 20 bp, Artificial Sequence
  chemically synthesized
ctactcaatattacttttaa

SEQ ID NO: 403077 - DNA, 20 bp, Artificial Sequence
  chemically synthesized
ggagaatttgaatcttttaa

SEQ ID NO: 403078 - DNA, 20 bp, Artificial Sequence
  chemically synthesized
atttttttaaattttcaggg

SEQ ID NO: 403079 - DNA, 20 bp, Artificial Sequence
  chemically synthesized
gtatttttttaaattttcag

SEQ ID NO: 403080 - DNA, 20 bp, Artificial Sequence
  chemically synthesized
tgtatttttttaaattttca

SEQ ID NO: 403081 - DNA, 20 bp, Artificial Sequence
  chemically synthesized
atgtatttttttaaattttc

SEQ ID NO: 403082 - DNA, 20 bp, Artificial Sequence
  chemically synthesized
aatgtatttttttaaatttt

SEQ ID NO: 403083 - DNA, 20 bp, Artificial Sequence
  chemically synthesized
taaaaaaatacattgttctg

SEQ ID NO: 403084 - DNA, 20 bp, Artificial Sequence
  chemically synthesized
aaatagataaatatacacca

SEQ ID NO: 403085 - DNA, 20 bp, Artificial Sequence
  chemically synthesized
tgtatatttatctattttta

SEQ ID NO: 403086 - DNA, 20 bp, Artificial Sequence
  chemically synthesized
gtatatttatctatttttat

SEQ ID NO: 403087 - DNA, 20 bp, Artificial Sequence
  chemically synthesized
tattttgcaacccataaaaa

SEQ ID NO: 403088 - DNA, 20 bp, Artificial Sequence
  chemically synthesized
tttccttttggtttgcaaag

SEQ ID NO: 403089 - DNA, 20 bp, Artificial Sequence
  chemically synthesized
tgctttccttttggtttgca

SEQ ID NO: 403090 - DNA, 20 bp, Artificial Sequence
  chemically synthesized
aatacttctttgcaaaccaa

SEQ ID NO: 403091 - DNA, 20 bp, Artificial Sequence
  chemically synthesized
atacttctttgcaaaccaaa

SEQ ID NO: 403092 - DNA, 20 bp, Artificial Sequence
  chemically synthesized
ttctttgcaaaccaaaagga

SEQ ID NO: 403093 - DNA, 20 bp, Artificial Sequence
  chemically synthesized
ttggctgtttgctttccttt

SEQ ID NO: 403094 - DNA, 20 bp, Artificial Sequence
  chemically synthesized
caaaccaaaaggaaagcaaa

SEQ ID NO: 403095 - DNA, 20 bp, Artificial Sequence
  chemically synthesized
tgttgtgtgtcgtgcacatt

SEQ ID NO: 403096 - DNA, 20 bp, Artificial Sequence
  chemically synthesized
caaatgtgcacgacacacaa

SEQ ID NO: 403097 - DNA, 20 bp, Artificial Sequence
  chemically synthesized
attaacagtatgtttggaaa

SEQ ID NO: 403098 - DNA, 20 bp, Artificial Sequence
  chemically synthesized
catctcattaacagtatgtt

SEQ ID NO: 403099 - DNA, 20 bp, Artificial Sequence
  chemically synthesized
tttccaaacatactgttaat

SEQ ID NO: 403100 - DNA, 20 bp, Artificial Sequence
  chemically synthesized
tttctaaagcatctcattaa

SEQ ID NO: 403101 - DNA, 20 bp, Artificial Sequence
  chemically synthesized
atactgttaatgagatgctt

SEQ ID NO: 403102 - DNA, 20 bp, Artificial Sequence
  chemically synthesized
ttaatgagatgctttagaaa

SEQ ID NO: 403103 - DNA, 20 bp, Artificial Sequence
  chemically synthesized
tgaccatttgtctgtttcta

SEQ ID NO: 403104 - DNA, 20 bp, Artificial Sequence
  chemically synthesized
atgctttagaaacagacaaa

SEQ ID NO: 403105 - DNA, 20 bp, Artificial Sequence
  chemically synthesized
aacagacaaatggtcaaaca

SEQ ID NO: 403106 - DNA, 20 bp, Artificial Sequence
  chemically synthesized
acagacaaatggtcaaacac

SEQ ID NO: 403107 - DNA, 20 bp, Artificial Sequence
  chemically synthesized
cagacaaatggtcaaacaca

SEQ ID NO: 403108 - DNA, 20 bp, Artificial Sequence
  chemically synthesized
aaatggtcaaacacagggcc

SEQ ID NO: 403109 - DNA, 20 bp, Artificial Sequence
  chemically synthesized
aaacacagggcctggattat

SEQ ID NO: 403110 - DNA, 20 bp, Artificial Sequence
  chemically synthesized
taaatatccccttataatcc

SEQ ID NO: 403111 - DNA, 20 bp, Artificial Sequence
  chemically synthesized
aacacagggcctggattata

SEQ ID NO: 403112 - DNA, 20 bp, Artificial Sequence
  chemically synthesized
ttaaatatccccttataatc

SEQ ID NO: 403113 - DNA, 20 bp, Artificial Sequence
  chemically synthesized
acacagggcctggattataa

SEQ ID NO: 403114 - DNA, 20 bp, Artificial Sequence
  chemically synthesized
cacagggcctggattataag

SEQ ID NO: 403115 - DNA, 20 bp, Artificial Sequence
  chemically synthesized
taaggggatatttaaatcac

SEQ ID NO: 403116 - DNA, 20 bp, Artificial Sequence
  chemically synthesized
tttactccatagtgtaagtt

SEQ ID NO: 403117 - DNA, 20 bp, Artificial Sequence
  chemically synthesized
tatttactcaacttacacta

SEQ ID NO: 403118 - DNA, 20 bp, Artificial Sequence
  chemically synthesized
taacctttactccatagtgt

SEQ ID NO: 403119 - DNA, 20 bp, Artificial Sequence
  chemically synthesized
tttactcaacttacactatg

SEQ ID NO: 403120 - DNA, 20 bp, Artificial Sequence
  chemically synthesized
tcaacttacactatggagta

SEQ ID NO: 403121 - DNA, 20 bp, Artificial Sequence
  chemically synthesized
ttttattaacctttactcca

SEQ ID NO: 403122 - DNA, 20 bp, Artificial Sequence
  chemically synthesized
caacttacactatggagtaa

SEQ ID NO: 403123 - DNA, 20 bp, Artificial Sequence
  chemically synthesized
tggagtaaaggttaataaaa

SEQ ID NO: 403124 - DNA, 20 bp, Artificial Sequence
  chemically synthesized
taaaggttaataaaatggca

SEQ ID NO: 403125 - DNA, 20 bp, Artificial Sequence
  chemically synthesized
aggttaataaaatggcatag

SEQ ID NO: 403126 - DNA, 20 bp, Artificial Sequence
  chemically synthesized
aataaaatggcatagtagat

SEQ ID NO: 403127 - DNA, 20 bp, Artificial Sequence
  chemically synthesized
ataaaatggcatagtagatg

SEQ ID NO: 403128 - DNA, 20 bp, Artificial Sequence
  chemically synthesized
gctcggtgaaataagggatg

SEQ ID NO: 403129 - DNA, 20 bp, Artificial Sequence
  chemically synthesized
ggctcggtgaaataagggat

SEQ ID NO: 403130 - DNA, 20 bp, Artificial Sequence
  chemically synthesized
gggatggctcggtgaaataa

SEQ ID NO: 403131 - DNA, 20 bp, Artificial Sequence
  chemically synthesized
agggatggctcggtgaaata

SEQ ID NO: 403132 - DNA, 20 bp, Artificial Sequence
  chemically synthesized
cagggatggctcggtgaaat

SEQ ID NO: 403133 - DNA, 20 bp, Artificial Sequence
  chemically synthesized
gcctcatcccttatttcacc

SEQ ID NO: 403134 - DNA, 20 bp, Artificial Sequence
  chemically synthesized
aggtgaactcagggatggct

SEQ ID NO: 403135 - DNA, 20 bp, Artificial Sequence
  chemically synthesized
tatttcaccgagccatccct

SEQ ID NO: 403136 - DNA, 20 bp, Artificial Sequence
  chemically synthesized
gttataggtgaactcaggga

SEQ ID NO: 403137 - DNA, 20 bp, Artificial Sequence
  chemically synthesized
tatagttataggtgaactca

SEQ ID NO: 403138 - DNA, 20 bp, Artificial Sequence
  chemically synthesized
ctatagttataggtgaactc

SEQ ID NO: 403139 - DNA, 20 bp, Artificial Sequence
  chemically synthesized
actatagttataggtgaact

SEQ ID NO: 403140 - DNA, 20 bp, Artificial Sequence
  chemically synthesized
cctgagttcacctataacta

SEQ ID NO: 403141 - DNA, 20 bp, Artificial Sequence
  chemically synthesized
aatccgttcactatagttat

SEQ ID NO: 403142 - DNA, 20 bp, Artificial Sequence
  chemically synthesized
gaatccgttcactatagtta

SEQ ID NO: 403143 - DNA, 20 bp, Artificial Sequence
  chemically synthesized
tcacctataactatagtgaa

SEQ ID NO: 403144 - DNA, 20 bp, Artificial Sequence
  chemically synthesized
tccacagaatccgttcacta

SEQ ID NO: 403145 - DNA, 20 bp, Artificial Sequence
  chemically synthesized
actatagtgaacggattctg

SEQ ID NO: 403146 - DNA, 20 bp, Artificial Sequence
  chemically synthesized
tgaggaatcttcagcatcca

SEQ ID NO: 403147 - DNA, 20 bp, Artificial Sequence
  chemically synthesized
aacggattctgtggatgctg

SEQ ID NO: 403148 - DNA, 20 bp, Artificial Sequence
  chemically synthesized
tgcttgtggtgaggaatctt

SEQ ID NO: 403149 - DNA, 20 bp, Artificial Sequence
  chemically synthesized
tgctgaagattcctcaccac

SEQ ID NO: 403150 - DNA, 20 bp, Artificial Sequence
  chemically synthesized
agatgtggatgcttgtggtg

SEQ ID NO: 403151 - DNA, 20 bp, Artificial Sequence
  chemically synthesized
gagatgtggatgcttgtggt

SEQ ID NO: 403152 - DNA, 20 bp, Artificial Sequence
  chemically synthesized
cagagagatgtggatgcttg

SEQ ID NO: 403153 - DNA, 20 bp, Artificial Sequence
  chemically synthesized
cacaaagaaacagagagatg

SEQ ID NO: 403154 - DNA, 20 bp, Artificial Sequence
  chemically synthesized
ccttaacacaaagaaacaga

SEQ ID NO: 403155 - DNA, 20 bp, Artificial Sequence
  chemically synthesized
agccttaacacaaagaaaca

SEQ ID NO: 403156 - DNA, 20 bp, Artificial Sequence
  chemically synthesized
aaagccttaacacaaagaaa

SEQ ID NO: 403157 - DNA, 20 bp, Artificial Sequence
  chemically synthesized
tctctctgtttctttgtgtt

SEQ ID NO: 403158 - DNA, 20 bp, Artificial Sequence
  chemically synthesized
ctctctgtttctttgtgtta

SEQ ID NO: 403159 - DNA, 20 bp, Artificial Sequence
  chemically synthesized
ctgaagaaagccttaacaca

SEQ ID NO: 403160 - DNA, 20 bp, Artificial Sequence
  chemically synthesized
ctttgtgttaaggctttctt

SEQ ID NO: 403161 - DNA, 20 bp, Artificial Sequence
  chemically synthesized
aagccctcctaaactgaaga

SEQ ID NO: 403162 - DNA, 20 bp, Artificial Sequence
  chemically synthesized
tgttaaggctttcttcagtt

SEQ ID NO: 403163 - DNA, 20 bp, Artificial Sequence
  chemically synthesized
gttaaggctttcttcagttt

SEQ ID NO: 403164 - DNA, 20 bp, Artificial Sequence
  chemically synthesized
taccaagccctcctaaactg

SEQ ID NO: 403165 - DNA, 20 bp, Artificial Sequence
  chemically synthesized
taaggctttcttcagtttag

SEQ ID NO: 403166 - DNA, 20 bp, Artificial Sequence
  chemically synthesized
aaggctttcttcagtttagg

SEQ ID NO: 403167 - DNA, 20 bp, Artificial Sequence
  chemically synthesized
aggctttcttcagtttagga

SEQ ID NO: 403168 - DNA, 20 bp, Artificial Sequence
  chemically synthesized
ttcttcagtttaggagggct

SEQ ID NO: 403169 - DNA, 20 bp, Artificial Sequence
  chemically synthesized
tcagtttaggagggcttggt

SEQ ID NO: 403170 - DNA, 20 bp, Artificial Sequence
  chemically synthesized
gccctgcaaatgggcttacc

SEQ ID NO: 403171 - DNA, 20 bp, Artificial Sequence
  chemically synthesized
gggcttggtaagcccatttg

SEQ ID NO: 403172 - DNA, 20 bp, Artificial Sequence
  chemically synthesized
ggcttggtaagcccatttgc

SEQ ID NO: 403173 - DNA, 20 bp, Artificial Sequence
  chemically synthesized
gcttggtaagcccatttgca

SEQ ID NO: 403174 - DNA, 20 bp, Artificial Sequence
  chemically synthesized
ttctggactgccctgcaaat

SEQ ID NO: 403175 - DNA, 20 bp, Artificial Sequence
  chemically synthesized
cttctggactgccctgcaaa

SEQ ID NO: 403176 - DNA, 20 bp, Artificial Sequence
  chemically synthesized
tggtaagcccatttgcaggg

SEQ ID NO: 403177 - DNA, 20 bp, Artificial Sequence
  chemically synthesized
agcccatttgcagggcagtc

SEQ ID NO: 403178 - DNA, 20 bp, Artificial Sequence
  chemically synthesized
ccatttgcagggcagtccag

SEQ ID NO: 403179 - DNA, 20 bp, Artificial Sequence
  chemically synthesized
gcagggcagtccagaagtga

SEQ ID NO: 403180 - DNA, 20 bp, Artificial Sequence
  chemically synthesized
aactaaatctctatcacttc

SEQ ID NO: 403181 - DNA, 20 bp, Artificial Sequence
  chemically synthesized
agggcagtccagaagtgata

SEQ ID NO: 403182 - DNA, 20 bp, Artificial Sequence
  chemically synthesized
gtccagaagtgatagagatt

SEQ ID NO: 403183 - DNA, 20 bp, Artificial Sequence
  chemically synthesized
tgatagagatttagttctcc

SEQ ID NO: 403184 - DNA, 20 bp, Artificial Sequence
  chemically synthesized
gatagagatttagttctccc

SEQ ID NO: 403185 - DNA, 20 bp, Artificial Sequence
  chemically synthesized
atagagatttagttctccca

SEQ ID NO: 403186 - DNA, 20 bp, Artificial Sequence
  chemically synthesized
tagagatttagttctcccag

SEQ ID NO: 403187 - DNA, 20 bp, Artificial Sequence
  chemically synthesized
ttattgagggttgcccctgg

SEQ ID NO: 403188 - DNA, 20 bp, Artificial Sequence
  chemically synthesized
gtttattgagggttgcccct

SEQ ID NO: 403189 - DNA, 20 bp, Artificial Sequence
  chemically synthesized
cgtttattgagggttgcccc

SEQ ID NO: 403190 - DNA, 20 bp, Artificial Sequence
  chemically synthesized
ttctgtccctcgtttattga

SEQ ID NO: 403191 - DNA, 20 bp, Artificial Sequence
  chemically synthesized
cttctgtccctcgtttattg

SEQ ID NO: 403192 - DNA, 20 bp, Artificial Sequence
  chemically synthesized
aggggcaaccctcaataaac

SEQ ID NO: 403193 - DNA, 20 bp, Artificial Sequence
  chemically synthesized
acttctgtccctcgtttatt

SEQ ID NO: 403194 - DNA, 20 bp, Artificial Sequence
  chemically synthesized
ggggcaaccctcaataaacg

SEQ ID NO: 403195 - DNA, 20 bp, Artificial Sequence
  chemically synthesized
gggcaaccctcaataaacga

SEQ ID NO: 403196 - DNA, 20 bp, Artificial Sequence
  chemically synthesized
aaccctcaataaacgaggga

SEQ ID NO: 403197 - DNA, 20 bp, Artificial Sequence
  chemically synthesized
cctcaataaacgagggacag

SEQ ID NO: 403198 - DNA, 20 bp, Artificial Sequence
  chemically synthesized
tttttgtcctttttaataca

SEQ ID NO: 403199 - DNA, 20 bp, Artificial Sequence
  chemically synthesized
acagaagtctatgtattaaa

SEQ ID NO: 403200 - DNA, 20 bp, Artificial Sequence
  chemically synthesized
cagaagtctatgtattaaaa

SEQ ID NO: 403201 - DNA, 20 bp, Artificial Sequence
  chemically synthesized
acaaaaaaaaaaaaaaacaa

SEQ ID NO: 403202 - DNA, 20 bp, Artificial Sequence
  chemically synthesized
aaaacaatggaacaattgct

SEQ ID NO: 403203 - DNA, 20 bp, Artificial Sequence
  chemically synthesized
ggagccctacagggcatgct

SEQ ID NO: 403204 - DNA, 20 bp, Artificial Sequence
  chemically synthesized
caattgctaagcatgccctg

SEQ ID NO: 403205 - DNA, 20 bp, Artificial Sequence
  chemically synthesized
aattgctaagcatgccctgt

SEQ ID NO: 403206 - DNA, 20 bp, Artificial Sequence
  chemically synthesized
attgctaagcatgccctgta

SEQ ID NO: 403207 - DNA, 20 bp, Artificial Sequence
  chemically synthesized
aacaattgaggagccctaca

SEQ ID NO: 403208 - DNA, 20 bp, Artificial Sequence
  chemically synthesized
caacaattgaggagccctac

SEQ ID NO: 403209 - DNA, 20 bp, Artificial Sequence
  chemically synthesized
gcaacaattgaggagcccta

SEQ ID NO: 403210 - DNA, 20 bp, Artificial Sequence
  chemically synthesized
tatcccatgcaacaattgag

SEQ ID NO: 403211 - DNA, 20 bp, Artificial Sequence
  chemically synthesized
catatcccatgcaacaattg

SEQ ID NO: 403212 - DNA, 20 bp, Artificial Sequence
  chemically synthesized
acatatcccatgcaacaatt

SEQ ID NO: 403213 - DNA, 20 bp, Artificial Sequence
  chemically synthesized
agggctcctcaattgttgca

SEQ ID NO: 403214 - DNA, 20 bp, Artificial Sequence
  chemically synthesized
gggctcctcaattgttgcat

SEQ ID NO: 403215 - DNA, 20 bp, Artificial Sequence
  chemically synthesized
gttgcatgggatatgtaatc

SEQ ID NO: 403216 - DNA, 20 bp, Artificial Sequence
  chemically synthesized
atgggatatgtaatccagaa

SEQ ID NO: 403217 - DNA, 20 bp, Artificial Sequence
  chemically synthesized
gatgctcctatgggccattc

SEQ ID NO: 403218 - DNA, 20 bp, Artificial Sequence
  chemically synthesized
atgtaatccagaatggccca

SEQ ID NO: 403219 - DNA, 20 bp, Artificial Sequence
  chemically synthesized
tgtaatccagaatggcccat

SEQ ID NO: 403220 - DNA, 20 bp, Artificial Sequence
  chemically synthesized
taatccagaatggcccatag

SEQ ID NO: 403221 - DNA, 20 bp, Artificial Sequence
  chemically synthesized
gacaataacgatgctcctat

SEQ ID NO: 403222 - DNA, 20 bp, Artificial Sequence
  chemically synthesized
agacaataacgatgctccta

SEQ ID NO: 403223 - DNA, 20 bp, Artificial Sequence
  chemically synthesized
tcgttattgtctgctctctg

SEQ ID NO: 403224 - DNA, 20 bp, Artificial Sequence
  chemically synthesized
ccaaattccactacagagag

SEQ ID NO: 403225 - DNA, 20 bp, Artificial Sequence
  chemically synthesized
ttattgtctgctctctgtag

SEQ ID NO: 403226 - DNA, 20 bp, Artificial Sequence
  chemically synthesized
ggcccaaattccactacaga

SEQ ID NO: 403227 - DNA, 20 bp, Artificial Sequence
  chemically synthesized
tgggcccaaattccactaca

SEQ ID NO: 403228 - DNA, 20 bp, Artificial Sequence
  chemically synthesized
tgtgggcccaaattccacta

SEQ ID NO: 403229 - DNA, 20 bp, Artificial Sequence
  chemically synthesized
ctgctctctgtagtggaatt

SEQ ID NO: 403230 - DNA, 20 bp, Artificial Sequence
  chemically synthesized
tgctctctgtagtggaattt

SEQ ID NO: 403231 - DNA, 20 bp, Artificial Sequence
  chemically synthesized
atgatcaagccaagaaatgt

SEQ ID NO: 403232 - DNA, 20 bp, Artificial Sequence
  chemically synthesized
gaatttgggcccacatttct

SEQ ID NO: 403233 - DNA, 20 bp, Artificial Sequence
  chemically synthesized
catgatcaagccaagaaatg

SEQ ID NO: 403234 - DNA, 20 bp, Artificial Sequence
  chemically synthesized
aactagtgcatgatcaagcc

SEQ ID NO: 403235 - DNA, 20 bp, Artificial Sequence
  chemically synthesized
tgcataactagtgcatgatc

SEQ ID NO: 403236 - DNA, 20 bp, Artificial Sequence
  chemically synthesized
ttcttggcttgatcatgcac

SEQ ID NO: 403237 - DNA, 20 bp, Artificial Sequence
  chemically synthesized
ttgatcatgcactagttatg

SEQ ID NO: 403238 - DNA, 20 bp, Artificial Sequence
  chemically synthesized
cttttctaacactgcataac

SEQ ID NO: 403239 - DNA, 20 bp, Artificial Sequence
  chemically synthesized
atgcactagttatgcagtgt

SEQ ID NO: 403240 - DNA, 20 bp, Artificial Sequence
  chemically synthesized
ctagttatgcagtgttagaa

SEQ ID NO: 403241 - DNA, 20 bp, Artificial Sequence
  chemically synthesized
gcagtgttagaaaagactca

SEQ ID NO: 403242 - DNA, 20 bp, Artificial Sequence
  chemically synthesized
cagtgttagaaaagactcat

SEQ ID NO: 403243 - DNA, 20 bp, Artificial Sequence
  chemically synthesized
gttagaaaagactcataggc

SEQ ID NO: 403244 - DNA, 20 bp, Artificial Sequence
  chemically synthesized
ttagaaaagactcataggcc

SEQ ID NO: 403245 - DNA, 20 bp, Artificial Sequence
  chemically synthesized
agagactgcacccggcctat

SEQ ID NO: 403246 - DNA, 20 bp, Artificial Sequence
  chemically synthesized
aaagactcataggccgggtg

SEQ ID NO: 403247 - DNA, 20 bp, Artificial Sequence
  chemically synthesized
cagacatgagagactgcacc

SEQ ID NO: 403248 - DNA, 20 bp, Artificial Sequence
  chemically synthesized
tgctgggattacagacatga

SEQ ID NO: 403249 - DNA, 20 bp, Artificial Sequence
  chemically synthesized
agtgctgggattacagacat

SEQ ID NO: 403250 - DNA, 20 bp, Artificial Sequence
  chemically synthesized
gtctctcatgtctgtaatcc

SEQ ID NO: 403251 - DNA, 20 bp, Artificial Sequence
  chemically synthesized
ctcccaaagtgctgggatta

SEQ ID NO: 403252 - DNA, 20 bp, Artificial Sequence
  chemically synthesized
tgtctgtaatcccagcactt

SEQ ID NO: 403253 - DNA, 20 bp, Artificial Sequence
  chemically synthesized
cctgggcctcccaaagtgct

SEQ ID NO: 403254 - DNA, 20 bp, Artificial Sequence
  chemically synthesized
gtctgtaatcccagcacttt

SEQ ID NO: 403255 - DNA, 20 bp, Artificial Sequence
  chemically synthesized
acctgggcctcccaaagtgc

SEQ ID NO: 403256 - DNA, 20 bp, Artificial Sequence
  chemically synthesized
ctgtaatcccagcactttgg

SEQ ID NO: 403257 - DNA, 20 bp, Artificial Sequence
  chemically synthesized
tgtaatcccagcactttggg

SEQ ID NO: 403258 - DNA, 20 bp, Artificial Sequence
  chemically synthesized
gcgtccacctgggcctccca

SEQ ID NO: 403259 - DNA, 20 bp, Artificial Sequence
  chemically synthesized
tcccagcactttgggaggcc

SEQ ID NO: 403260 - DNA, 20 bp, Artificial Sequence
  chemically synthesized
cccagcactttgggaggccc

SEQ ID NO: 403261 - DNA, 20 bp, Artificial Sequence
  chemically synthesized
agcactttgggaggcccagg

SEQ ID NO: 403262 - DNA, 20 bp, Artificial Sequence
  chemically synthesized
acctcatgctgcgtccacct

SEQ ID NO: 403263 - DNA, 20 bp, Artificial Sequence
  chemically synthesized
gacctcatgctgcgtccacc

SEQ ID NO: 403264 - DNA, 20 bp, Artificial Sequence
  chemically synthesized
ttgggaggcccaggtggacg

SEQ ID NO: 403265 - DNA, 20 bp, Artificial Sequence
  chemically synthesized
ggcccaggtggacgcagcat

SEQ ID NO: 403266 - DNA, 20 bp, Artificial Sequence
  chemically synthesized
gcccaggtggacgcagcatg

SEQ ID NO: 403267 - DNA, 20 bp, Artificial Sequence
  chemically synthesized
aggtggacgcagcatgaggt

SEQ ID NO: 403268 - DNA, 20 bp, Artificial Sequence
  chemically synthesized
ggtggacgcagcatgaggtc

SEQ ID NO: 403269 - DNA, 20 bp, Artificial Sequence
  chemically synthesized
tggacgcagcatgaggtcag

SEQ ID NO: 403270 - DNA, 20 bp, Artificial Sequence
  chemically synthesized
cagcatgaggtcaggagttc

SEQ ID NO: 403271 - DNA, 20 bp, Artificial Sequence
  chemically synthesized
tgaggtcaggagttcgagac

SEQ ID NO: 403272 - DNA, 20 bp, Artificial Sequence
  chemically synthesized
cttcactgcgttgatcaggc

SEQ ID NO: 403273 - DNA, 20 bp, Artificial Sequence
  chemically synthesized
ggggcttcactgcgttgatc

SEQ ID NO: 403274 - DNA, 20 bp, Artificial Sequence
  chemically synthesized
cgagaccagcctgatcaacg

SEQ ID NO: 403275 - DNA, 20 bp, Artificial Sequence
  chemically synthesized
cggggcttcactgcgttgat

SEQ ID NO: 403276 - DNA, 20 bp, Artificial Sequence
  chemically synthesized
ccagcctgatcaacgcagtg

SEQ ID NO: 403277 - DNA, 20 bp, Artificial Sequence
  chemically synthesized
ttttatttttagtagagacg

SEQ ID NO: 403278 - DNA, 20 bp, Artificial Sequence
  chemically synthesized
tttttatttttagtagagac

SEQ ID NO: 403279 - DNA, 20 bp, Artificial Sequence
  chemically synthesized
ctttttatttttagtagaga

SEQ ID NO: 403280 - DNA, 20 bp, Artificial Sequence
  chemically synthesized
taatctttttatttttagta

SEQ ID NO: 403281 - DNA, 20 bp, Artificial Sequence
  chemically synthesized
gctaatctttttatttttag

SEQ ID NO: 403282 - DNA, 20 bp, Artificial Sequence
  chemically synthesized
ccggctaatctttttatttt

SEQ ID NO: 403283 - DNA, 20 bp, Artificial Sequence
  chemically synthesized
ccgtctctactaaaaataaa

SEQ ID NO: 403284 - DNA, 20 bp, Artificial Sequence
  chemically synthesized
tctactaaaaataaaaagat

SEQ ID NO: 403285 - DNA, 20 bp, Artificial Sequence
  chemically synthesized
ctaaaaataaaaagattagc

SEQ ID NO: 403286 - DNA, 20 bp, Artificial Sequence
  chemically synthesized
taaaaataaaaagattagcc

SEQ ID NO: 403287 - DNA, 20 bp, Artificial Sequence
  chemically synthesized
ataaaaagattagccgggcg

SEQ ID NO: 403288 - DNA, 20 bp, Artificial Sequence
  chemically synthesized
aaaagattagccgggcgtgg

SEQ ID NO: 403289 - DNA, 20 bp, Artificial Sequence
  chemically synthesized
caggtgtccgccaccacgcc

SEQ ID NO: 403290 - DNA, 20 bp, Artificial Sequence
  chemically synthesized
agattagccgggcgtggtgg

SEQ ID NO: 403291 - DNA, 20 bp, Artificial Sequence
  chemically synthesized
gtggcggacacctgaaatcc

SEQ ID NO: 403292 - DNA, 20 bp, Artificial Sequence
  chemically synthesized
tcccaagtagctgggatttc

SEQ ID NO: 403293 - DNA, 20 bp, Artificial Sequence
  chemically synthesized
ctcccaagtagctgggattt

SEQ ID NO: 403294 - DNA, 20 bp, Artificial Sequence
  chemically synthesized
cacctgaaatcccagctact

SEQ ID NO: 403295 - DNA, 20 bp, Artificial Sequence
  chemically synthesized
cgtcagcctcccaagtagct

SEQ ID NO: 403296 - DNA, 20 bp, Artificial Sequence
  chemically synthesized
acctgaaatcccagctactt

SEQ ID NO: 403297 - DNA, 20 bp, Artificial Sequence
  chemically synthesized
gcgtcagcctcccaagtagc

SEQ ID NO: 403298 - DNA, 20 bp, Artificial Sequence
  chemically synthesized
ctgaaatcccagctacttgg

SEQ ID NO: 403299 - DNA, 20 bp, Artificial Sequence
  chemically synthesized
tgaaatcccagctacttggg

SEQ ID NO: 403300 - DNA, 20 bp, Artificial Sequence
  chemically synthesized
tcctgcgtcagcctcccaag

SEQ ID NO: 403301 - DNA, 20 bp, Artificial Sequence
  chemically synthesized
ttctcctgcgtcagcctccc

SEQ ID NO: 403302 - DNA, 20 bp, Artificial Sequence
  chemically synthesized
agctacttgggaggctgacg

SEQ ID NO: 403303 - DNA, 20 bp, Artificial Sequence
  chemically synthesized
gctacttgggaggctgacgc

SEQ ID NO: 403304 - DNA, 20 bp, Artificial Sequence
  chemically synthesized
tacttgggaggctgacgcag

SEQ ID NO: 403305 - DNA, 20 bp, Artificial Sequence
  chemically synthesized
ttcaagtgattctcctgcgt

SEQ ID NO: 403306 - DNA, 20 bp, Artificial Sequence
  chemically synthesized
gcaggagaatcacttgaacc

SEQ ID NO: 403307 - DNA, 20 bp, Artificial Sequence
  chemically synthesized
caggagaatcacttgaacct

SEQ ID NO: 403308 - DNA, 20 bp, Artificial Sequence
  chemically synthesized
aacctcagcctcccaggttc

SEQ ID NO: 403309 - DNA, 20 bp, Artificial Sequence
  chemically synthesized
ggagaatcacttgaacctgg

SEQ ID NO: 403310 - DNA, 20 bp, Artificial Sequence
  chemically synthesized
gagaatcacttgaacctggg

SEQ ID NO: 403311 - DNA, 20 bp, Artificial Sequence
  chemically synthesized
cactgcaacctcagcctccc

SEQ ID NO: 403312 - DNA, 20 bp, Artificial Sequence
  chemically synthesized
tcacttgaacctgggaggct

SEQ ID NO: 403313 - DNA, 20 bp, Artificial Sequence
  chemically synthesized
tcactgcaacctcagcctcc

SEQ ID NO: 403314 - DNA, 20 bp, Artificial Sequence
  chemically synthesized
cacttgaacctgggaggctg

SEQ ID NO: 403315 - DNA, 20 bp, Artificial Sequence
  chemically synthesized
aacctgggaggctgaggttg

SEQ ID NO: 403316 - DNA, 20 bp, Artificial Sequence
  chemically synthesized
atcttggctcactgcaacct

SEQ ID NO: 403317 - DNA, 20 bp, Artificial Sequence
  chemically synthesized
tgggaggctgaggttgcagt

SEQ ID NO: 403318 - DNA, 20 bp, Artificial Sequence
  chemically synthesized
ggctgaggttgcagtgagcc

SEQ ID NO: 403319 - DNA, 20 bp, Artificial Sequence
  chemically synthesized
ggagtgcagtggcatgatct

SEQ ID NO: 403320 - DNA, 20 bp, Artificial Sequence
  chemically synthesized
ctgtcggggctggagtgcag

SEQ ID NO: 403321 - DNA, 20 bp, Artificial Sequence
  chemically synthesized
aagatcatgccactgcactc

SEQ ID NO: 403322 - DNA, 20 bp, Artificial Sequence
  chemically synthesized
ctcctgtcggggctggagtg

SEQ ID NO: 403323 - DNA, 20 bp, Artificial Sequence
  chemically synthesized
ttgaactcctgtcggggctg

SEQ ID NO: 403324 - DNA, 20 bp, Artificial Sequence
  chemically synthesized
ccactgcactccagccccga

SEQ ID NO: 403325 - DNA, 20 bp, Artificial Sequence
  chemically synthesized
tcttgaactcctgtcggggc

SEQ ID NO: 403326 - DNA, 20 bp, Artificial Sequence
  chemically synthesized
cactgcactccagccccgac

SEQ ID NO: 403327 - DNA, 20 bp, Artificial Sequence
  chemically synthesized
ctgcactccagccccgacag

SEQ ID NO: 403328 - DNA, 20 bp, Artificial Sequence
  chemically synthesized
ggagtcttgaactcctgtcg

SEQ ID NO: 403329 - DNA, 20 bp, Artificial Sequence
  chemically synthesized
tggagtcttgaactcctgtc

SEQ ID NO: 403330 - DNA, 20 bp, Artificial Sequence
  chemically synthesized
atggagtcttgaactcctgt

SEQ ID NO: 403331 - DNA, 20 bp, Artificial Sequence
  chemically synthesized
tccagccccgacaggagttc

SEQ ID NO: 403332 - DNA, 20 bp, Artificial Sequence
  chemically synthesized
gtttgtttgtttttgagatg

SEQ ID NO: 403333 - DNA, 20 bp, Artificial Sequence
  chemically synthesized
ttgtttgtttgtttttgaga

SEQ ID NO: 403334 - DNA, 20 bp, Artificial Sequence
  chemically synthesized
ttgtttgtttgtttgttttt

SEQ ID NO: 403335 - DNA, 20 bp, Artificial Sequence
  chemically synthesized
acaaacaaacaaacaaaaca

SEQ ID NO: 403336 - DNA, 20 bp, Artificial Sequence
  chemically synthesized
acaaacaaacaaaacaaaga

SEQ ID NO: 403337 - DNA, 20 bp, Artificial Sequence
  chemically synthesized
caaacaaaacaaagaaagaa

SEQ ID NO: 403338 - DNA, 20 bp, Artificial Sequence
  chemically synthesized
caaagaaagaaaagactcat

SEQ ID NO: 403339 - DNA, 20 bp, Artificial Sequence
  chemically synthesized
ttgggtttggtgtggcttat

SEQ ID NO: 403340 - DNA, 20 bp, Artificial Sequence
  chemically synthesized
tggaaatcttgggtttggtg

SEQ ID NO: 403341 - DNA, 20 bp, Artificial Sequence
  chemically synthesized
tcataagccacaccaaaccc

SEQ ID NO: 403342 - DNA, 20 bp, Artificial Sequence
  chemically synthesized
cagactggaaatcttgggtt

SEQ ID NO: 403343 - DNA, 20 bp, Artificial Sequence
  chemically synthesized
cttttcagactggaaatctt

SEQ ID NO: 403344 - DNA, 20 bp, Artificial Sequence
  chemically synthesized
cacaccaaacccaagatttc

SEQ ID NO: 403345 - DNA, 20 bp, Artificial Sequence
  chemically synthesized
tcttttcagactggaaatct

SEQ ID NO: 403346 - DNA, 20 bp, Artificial Sequence
  chemically synthesized
cccaagatttccagtctgaa

SEQ ID NO: 403347 - DNA, 20 bp, Artificial Sequence
  chemically synthesized
attatttcctcttttcagac

SEQ ID NO: 403348 - DNA, 20 bp, Artificial Sequence
  chemically synthesized
caagatttccagtctgaaaa

SEQ ID NO: 403349 - DNA, 20 bp, Artificial Sequence
  chemically synthesized
aagatttccagtctgaaaag

SEQ ID NO: 403350 - DNA, 20 bp, Artificial Sequence
  chemically synthesized
ccacgattatttcctctttt

SEQ ID NO: 403351 - DNA, 20 bp, Artificial Sequence
  chemically synthesized
ctgaaaagaggaaataatcg

SEQ ID NO: 403352 - DNA, 20 bp, Artificial Sequence
  chemically synthesized
aatcgtggtaaaaaaactct

SEQ ID NO: 403353 - DNA, 20 bp, Artificial Sequence
  chemically synthesized
cctcatcaaagtgaagctaa

SEQ ID NO: 403354 - DNA, 20 bp, Artificial Sequence
  chemically synthesized
tacctcatcaaagtgaagct

SEQ ID NO: 403355 - DNA, 20 bp, Artificial Sequence
  chemically synthesized
caggatacctcatcaaagtg

SEQ ID NO: 403356 - DNA, 20 bp, Artificial Sequence
  chemically synthesized
actcttagcttcactttgat

SEQ ID NO: 403357 - DNA, 20 bp, Artificial Sequence
  chemically synthesized
ctcttagcttcactttgatg

SEQ ID NO: 403358 - DNA, 20 bp, Artificial Sequence
  chemically synthesized
ctttacaggatacctcatca

SEQ ID NO: 403359 - DNA, 20 bp, Artificial Sequence
  chemically synthesized
ctttgatgaggtatcctgta

SEQ ID NO: 403360 - DNA, 20 bp, Artificial Sequence
  chemically synthesized
gactactttcgatgctttac

SEQ ID NO: 403361 - DNA, 20 bp, Artificial Sequence
  chemically synthesized
agactactttcgatgcttta

SEQ ID NO: 403362 - DNA, 20 bp, Artificial Sequence
  chemically synthesized
ggtatcctgtaaagcatcga

SEQ ID NO: 403363 - DNA, 20 bp, Artificial Sequence
  chemically synthesized
atcctgtaaagcatcgaaag

SEQ ID NO: 403364 - DNA, 20 bp, Artificial Sequence
  chemically synthesized
aaagcatcgaaagtagtctt

SEQ ID NO: 403365 - DNA, 20 bp, Artificial Sequence
  chemically synthesized
atcgaaagtagtcttaagca

SEQ ID NO: 403366 - DNA, 20 bp, Artificial Sequence
  chemically synthesized
tttgtactaagtctttgctt

SEQ ID NO: 403367 - DNA, 20 bp, Artificial Sequence
  chemically synthesized
agtagtcttaagcaaagact

SEQ ID NO: 403368 - DNA, 20 bp, Artificial Sequence
  chemically synthesized
ttaagcaaagacttagtaca

SEQ ID NO: 403369 - DNA, 20 bp, Artificial Sequence
  chemically synthesized
attggcacttactttgtact

SEQ ID NO: 403370 - DNA, 20 bp, Artificial Sequence
  chemically synthesized
gcaaagacttagtacaaagt

SEQ ID NO: 403371 - DNA, 20 bp, Artificial Sequence
  chemically synthesized
tagtacaaagtaagtgccaa

SEQ ID NO: 403372 - DNA, 20 bp, Artificial Sequence
  chemically synthesized
gtacaaagtaagtgccaata

SEQ ID NO: 403373 - DNA, 20 bp, Artificial Sequence
  chemically synthesized
ataataatactgatctctat

SEQ ID NO: 403374 - DNA, 20 bp, Artificial Sequence
  chemically synthesized
aagtaagtgccaatagagat

SEQ ID NO: 403375 - DNA, 20 bp, Artificial Sequence
  chemically synthesized
atgcaattaaatatatagtc

SEQ ID NO: 403376 - DNA, 20 bp, Artificial Sequence
  chemically synthesized
aatgcaattaaatatatagt

SEQ ID NO: 403377 - DNA, 20 bp, Artificial Sequence
  chemically synthesized
ttctaatgcaattaaatata

SEQ ID NO: 403378 - DNA, 20 bp, Artificial Sequence
  chemically synthesized
gactatatatttaattgcat

SEQ ID NO: 403379 - DNA, 20 bp, Artificial Sequence
  chemically synthesized
tgcattagaacttcttgaac

SEQ ID NO: 403380 - DNA, 20 bp, Artificial Sequence
  chemically synthesized
aaactaccaacttgttcaag

SEQ ID NO: 403381 - DNA, 20 bp, Artificial Sequence
  chemically synthesized
tgtaaactaccaacttgttc

SEQ ID NO: 403382 - DNA, 20 bp, Artificial Sequence
  chemically synthesized
ttagaacttcttgaacaagt

SEQ ID NO: 403383 - DNA, 20 bp, Artificial Sequence
  chemically synthesized
gaacttcttgaacaagttgg

SEQ ID NO: 403384 - DNA, 20 bp, Artificial Sequence
  chemically synthesized
agtttacattatttgctcat

SEQ ID NO: 403385 - DNA, 20 bp, Artificial Sequence
  chemically synthesized
aggaagaaaaagaaaccgat

SEQ ID NO: 403386 - DNA, 20 bp, Artificial Sequence
  chemically synthesized
aagtggaaaggaggaagaaa

SEQ ID NO: 403387 - DNA, 20 bp, Artificial Sequence
  chemically synthesized
catggcaagtggaaaggagg

SEQ ID NO: 403388 - DNA, 20 bp, Artificial Sequence
  chemically synthesized
aaccatggcaagtggaaagg

SEQ ID NO: 403389 - DNA, 20 bp, Artificial Sequence
  chemically synthesized
gaaccatggcaagtggaaag

SEQ ID NO: 403390 - DNA, 20 bp, Artificial Sequence
  chemically synthesized
gtgaaccatggcaagtggaa

SEQ ID NO: 403391 - DNA, 20 bp, Artificial Sequence
  chemically synthesized
ggtgaaccatggcaagtgga

SEQ ID NO: 403392 - DNA, 20 bp, Artificial Sequence
  chemically synthesized
ttcctcctttccacttgcca

SEQ ID NO: 403393 - DNA, 20 bp, Artificial Sequence
  chemically synthesized
ccatggtgaaccatggcaag

SEQ ID NO: 403394 - DNA, 20 bp, Artificial Sequence
  chemically synthesized
cacccatggtgaaccatggc

SEQ ID NO: 403395 - DNA, 20 bp, Artificial Sequence
  chemically synthesized
aatccacccatggtgaacca

SEQ ID NO: 403396 - DNA, 20 bp, Artificial Sequence
  chemically synthesized
ccacttgccatggttcacca

SEQ ID NO: 403397 - DNA, 20 bp, Artificial Sequence
  chemically synthesized
cacttgccatggttcaccat

SEQ ID NO: 403398 - DNA, 20 bp, Artificial Sequence
  chemically synthesized
ttgccatggttcaccatggg

SEQ ID NO: 403399 - DNA, 20 bp, Artificial Sequence
  chemically synthesized
tgggatgtgtaatccaccca

SEQ ID NO: 403400 - DNA, 20 bp, Artificial Sequence
  chemically synthesized
ccaaggccacatcagtgagt

SEQ ID NO: 403401 - DNA, 20 bp, Artificial Sequence
  chemically synthesized
accaaggccacatcagtgag

SEQ ID NO: 403402 - DNA, 20 bp, Artificial Sequence
  chemically synthesized
acacatcccactcactgatg

SEQ ID NO: 403403 - DNA, 20 bp, Artificial Sequence
  chemically synthesized
atgaccaaggccacatcagt

SEQ ID NO: 403404 - DNA, 20 bp, Artificial Sequence
  chemically synthesized
tcacatgaccaaggccacat

SEQ ID NO: 403405 - DNA, 20 bp, Artificial Sequence
  chemically synthesized
cccactcactgatgtggcct

SEQ ID NO: 403406 - DNA, 20 bp, Artificial Sequence
  chemically synthesized
caaggcaagtcacatgacca

SEQ ID NO: 403407 - DNA, 20 bp, Artificial Sequence
  chemically synthesized
tcaaggcaagtcacatgacc

SEQ ID NO: 403408 - DNA, 20 bp, Artificial Sequence
  chemically synthesized
tgtgttccactggtcaaggc

SEQ ID NO: 403409 - DNA, 20 bp, Artificial Sequence
  chemically synthesized
gtcatgtgacttgccttgac

SEQ ID NO: 403410 - DNA, 20 bp, Artificial Sequence
  chemically synthesized
atgtgacttgccttgaccag

SEQ ID NO: 403411 - DNA, 20 bp, Artificial Sequence
  chemically synthesized
tgactgtgttccactggtca

SEQ ID NO: 403412 - DNA, 20 bp, Artificial Sequence
  chemically synthesized
ctgactgtgttccactggtc

SEQ ID NO: 403413 - DNA, 20 bp, Artificial Sequence
  chemically synthesized
catatctgactgtgttccac

SEQ ID NO: 403414 - DNA, 20 bp, Artificial Sequence
  chemically synthesized
ttgccttgaccagtggaaca

SEQ ID NO: 403415 - DNA, 20 bp, Artificial Sequence
  chemically synthesized
cttgaccagtggaacacagt

SEQ ID NO: 403416 - DNA, 20 bp, Artificial Sequence
  chemically synthesized
agtggaacacagtcagatat

SEQ ID NO: 403417 - DNA, 20 bp, Artificial Sequence
  chemically synthesized
tggaacacagtcagatatga

SEQ ID NO: 403418 - DNA, 20 bp, Artificial Sequence
  chemically synthesized
tatgagagtgtgtcaattct

SEQ ID NO: 403419 - DNA, 20 bp, Artificial Sequence
  chemically synthesized
agagtgtgtcaattctgagc

SEQ ID NO: 403420 - DNA, 20 bp, Artificial Sequence
  chemically synthesized
gagtgtgtcaattctgagct

SEQ ID NO: 403421 - DNA, 20 bp, Artificial Sequence
  chemically synthesized
agtgtgtcaattctgagcta

SEQ ID NO: 403422 - DNA, 20 bp, Artificial Sequence
  chemically synthesized
gtgtgtcaattctgagctag

SEQ ID NO: 403423 - DNA, 20 bp, Artificial Sequence
  chemically synthesized
tgattcttaagcccctagct

SEQ ID NO: 403424 - DNA, 20 bp, Artificial Sequence
  chemically synthesized
caattctgagctaggggctt

SEQ ID NO: 403425 - DNA, 20 bp, Artificial Sequence
  chemically synthesized
ctttatgattcttaagcccc

SEQ ID NO: 403426 - DNA, 20 bp, Artificial Sequence
  chemically synthesized
gaaaacactttatgattctt

SEQ ID NO: 403427 - DNA, 20 bp, Artificial Sequence
  chemically synthesized
ctaggggcttaagaatcata

SEQ ID NO: 403428 - DNA, 20 bp, Artificial Sequence
  chemically synthesized
taaagtgttttcacttttct

SEQ ID NO: 403429 - DNA, 20 bp, Artificial Sequence
  chemically synthesized
aagggaggaaggaccaagaa

SEQ ID NO: 403430 - DNA, 20 bp, Artificial Sequence
  chemically synthesized
tgacaaagggaggaaggacc

SEQ ID NO: 403431 - DNA, 20 bp, Artificial Sequence
  chemically synthesized
ttcccctgacaaagggagga

SEQ ID NO: 403432 - DNA, 20 bp, Artificial Sequence
  chemically synthesized
cttcccctgacaaagggagg

SEQ ID NO: 403433 - DNA, 20 bp, Artificial Sequence
  chemically synthesized
gtacttcccctgacaaaggg

SEQ ID NO: 403434 - DNA, 20 bp, Artificial Sequence
  chemically synthesized
ttggtccttcctccctttgt

SEQ ID NO: 403435 - DNA, 20 bp, Artificial Sequence
  chemically synthesized
tgtacttcccctgacaaagg

SEQ ID NO: 403436 - DNA, 20 bp, Artificial Sequence
  chemically synthesized
tggtccttcctccctttgtc

SEQ ID NO: 403437 - DNA, 20 bp, Artificial Sequence
  chemically synthesized
ggtccttcctccctttgtca

SEQ ID NO: 403438 - DNA, 20 bp, Artificial Sequence
  chemically synthesized
cgtgtacttcccctgacaaa

SEQ ID NO: 403439 - DNA, 20 bp, Artificial Sequence
  chemically synthesized
gtccttcctccctttgtcag

SEQ ID NO: 403440 - DNA, 20 bp, Artificial Sequence
  chemically synthesized
gcgtgtacttcccctgacaa

SEQ ID NO: 403441 - DNA, 20 bp, Artificial Sequence
  chemically synthesized
ggcgtgtacttcccctgaca

SEQ ID NO: 403442 - DNA, 20 bp, Artificial Sequence
  chemically synthesized
cttcctccctttgtcagggg

SEQ ID NO: 403443 - DNA, 20 bp, Artificial Sequence
  chemically synthesized
gtcaggggaagtacacgcct

SEQ ID NO: 403444 - DNA, 20 bp, Artificial Sequence
  chemically synthesized
tcaggggaagtacacgcctc

SEQ ID NO: 403445 - DNA, 20 bp, Artificial Sequence
  chemically synthesized
ggggaagtacacgcctcagg

SEQ ID NO: 403446 - DNA, 20 bp, Artificial Sequence
  chemically synthesized
ttaggaacagaggctacctg

SEQ ID NO: 403447 - DNA, 20 bp, Artificial Sequence
  chemically synthesized
tttaggaacagaggctacct

SEQ ID NO: 403448 - DNA, 20 bp, Artificial Sequence
  chemically synthesized
atctctccttttaggaacag

SEQ ID NO: 403449 - DNA, 20 bp, Artificial Sequence
  chemically synthesized
catctctccttttaggaaca

SEQ ID NO: 403450 - DNA, 20 bp, Artificial Sequence
  chemically synthesized
caggtagcctctgttcctaa

SEQ ID NO: 403451 - DNA, 20 bp, Artificial Sequence
  chemically synthesized
tgcatctctccttttaggaa

SEQ ID NO: 403452 - DNA, 20 bp, Artificial Sequence
  chemically synthesized
aggtagcctctgttcctaaa

SEQ ID NO: 403453 - DNA, 20 bp, Artificial Sequence
  chemically synthesized
gtagcctctgttcctaaaag

SEQ ID NO: 403454 - DNA, 20 bp, Artificial Sequence
  chemically synthesized
agcctctgttcctaaaagga

SEQ ID NO: 403455 - DNA, 20 bp, Artificial Sequence
  chemically synthesized
ctctatgcatctctcctttt

SEQ ID NO: 403456 - DNA, 20 bp, Artificial Sequence
  chemically synthesized
gctctatgcatctctccttt

SEQ ID NO: 403457 - DNA, 20 bp, Artificial Sequence
  chemically synthesized
ttcctaaaaggagagatgca

SEQ ID NO: 403458 - DNA, 20 bp, Artificial Sequence
  chemically synthesized
cctaaaaggagagatgcata

SEQ ID NO: 403459 - DNA, 20 bp, Artificial Sequence
  chemically synthesized
attttgtattgagtacaggt

SEQ ID NO: 403460 - DNA, 20 bp, Artificial Sequence
  chemically synthesized
ttcaattttgtattgagtac

SEQ ID NO: 403461 - DNA, 20 bp, Artificial Sequence
  chemically synthesized
gttcaattttgtattgagta

SEQ ID NO: 403462 - DNA, 20 bp, Artificial Sequence
  chemically synthesized
gtcaggttcaattttgtatt

SEQ ID NO: 403463 - DNA, 20 bp, Artificial Sequence
  chemically synthesized
ttatttcttattcacatgtc

SEQ ID NO: 403464 - DNA, 20 bp, Artificial Sequence
  chemically synthesized
tttatttcttattcacatgt

SEQ ID NO: 403465 - DNA, 20 bp, Artificial Sequence
  chemically synthesized
attgaacctgacatgtgaat

SEQ ID NO: 403466 - DNA, 20 bp, Artificial Sequence
  chemically synthesized
aaataaatgtttgttcttat

SEQ ID NO: 403467 - DNA, 20 bp, Artificial Sequence
  chemically synthesized
tccaaatctcaatgacttat

SEQ ID NO: 403468 - DNA, 20 bp, Artificial Sequence
  chemically synthesized
gtttgttcttataagtcatt

SEQ ID NO: 403469 - DNA, 20 bp, Artificial Sequence
  chemically synthesized
tcttataagtcattgagatt

SEQ ID NO: 403470 - DNA, 20 bp, Artificial Sequence
  chemically synthesized
agatttggatttgtttttta

SEQ ID NO: 403471 - DNA, 20 bp, Artificial Sequence
  chemically synthesized
atttggatttgttttttaca

SEQ ID NO: 403472 - DNA, 20 bp, Artificial Sequence
  chemically synthesized
atttgttttttacagagcat

SEQ ID NO: 403473 - DNA, 20 bp, Artificial Sequence
  chemically synthesized
cagagcattagcctataata

SEQ ID NO: 403474 - DNA, 20 bp, Artificial Sequence
  chemically synthesized
atattagtcagctttattat

SEQ ID NO: 403475 - DNA, 20 bp, Artificial Sequence
  chemically synthesized
tatattagtcagctttatta

SEQ ID NO: 403476 - DNA, 20 bp, Artificial Sequence
  chemically synthesized
tataataaagctgactaata

SEQ ID NO: 403477 - DNA, 20 bp, Artificial Sequence
  chemically synthesized
tatttacctgctatattagt

SEQ ID NO: 403478 - DNA, 20 bp, Artificial Sequence
  chemically synthesized
aataaagctgactaatatag

SEQ ID NO: 403479 - DNA, 20 bp, Artificial Sequence
  chemically synthesized
ataaagctgactaatatagc

SEQ ID NO: 403480 - DNA, 20 bp, Artificial Sequence
  chemically synthesized
ttactatttacctgctatat

SEQ ID NO: 403481 - DNA, 20 bp, Artificial Sequence
  chemically synthesized
tgactaatatagcaggtaaa

SEQ ID NO: 403482 - DNA, 20 bp, Artificial Sequence
  chemically synthesized
tagcaggtaaatagtaaatg

SEQ ID NO: 403483 - DNA, 20 bp, Artificial Sequence
  chemically synthesized
taaatagtaaatgtggccca

SEQ ID NO: 403484 - DNA, 20 bp, Artificial Sequence
  chemically synthesized
attattgaattttattctat

SEQ ID NO: 403485 - DNA, 20 bp, Artificial Sequence
  chemically synthesized
cattattgaattttattcta

SEQ ID NO: 403486 - DNA, 20 bp, Artificial Sequence
  chemically synthesized
agaataaaattcaataatga

SEQ ID NO: 403487 - DNA, 20 bp, Artificial Sequence
  chemically synthesized
cctctcttttttaaatgaag

SEQ ID NO: 403488 - DNA, 20 bp, Artificial Sequence
  chemically synthesized
ccctctcttttttaaatgaa

SEQ ID NO: 403489 - DNA, 20 bp, Artificial Sequence
  chemically synthesized
aaccctctcttttttaaatg

SEQ ID NO: 403490 - DNA, 20 bp, Artificial Sequence
  chemically synthesized
tataacctcttcatttaaaa

SEQ ID NO: 403491 - DNA, 20 bp, Artificial Sequence
  chemically synthesized
taacctcttcatttaaaaaa

SEQ ID NO: 403492 - DNA, 20 bp, Artificial Sequence
  chemically synthesized
acctcttcatttaaaaaaga

SEQ ID NO: 403493 - DNA, 20 bp, Artificial Sequence
  chemically synthesized
cctcttcatttaaaaaagag

SEQ ID NO: 403494 - DNA, 20 bp, Artificial Sequence
  chemically synthesized
ctcttcatttaaaaaagaga

SEQ ID NO: 403495 - DNA, 20 bp, Artificial Sequence
  chemically synthesized
gcttattttaaatttaatga

SEQ ID NO: 403496 - DNA, 20 bp, Artificial Sequence
  chemically synthesized
tccatcattaaatttaaaat

SEQ ID NO: 403497 - DNA, 20 bp, Artificial Sequence
  chemically synthesized
attaaatttaaaataagctg

SEQ ID NO: 403498 - DNA, 20 bp, Artificial Sequence
  chemically synthesized
atttaaaataagctgaagaa

SEQ ID NO: 403499 - DNA, 20 bp, Artificial Sequence
  chemically synthesized
tttaaaataagctgaagaat

SEQ ID NO: 403500 - DNA, 20 bp, Artificial Sequence
  chemically synthesized
ttcatttaaaacccattctt

SEQ ID NO: 403501 - DNA, 20 bp, Artificial Sequence
  chemically synthesized
tgaagaatgggttttaaatg

SEQ ID NO: 403502 - DNA, 20 bp, Artificial Sequence
  chemically synthesized
ggttttaaatgaagtattaa

SEQ ID NO: 403503 - DNA, 20 bp, Artificial Sequence
  chemically synthesized
ctgaaagggcaatttttgga

SEQ ID NO: 403504 - DNA, 20 bp, Artificial Sequence
  chemically synthesized
tattctgaaagggcaatttt

SEQ ID NO: 403505 - DNA, 20 bp, Artificial Sequence
  chemically synthesized
ctttccaaaaattgcccttt

SEQ ID NO: 403506 - DNA, 20 bp, Artificial Sequence
  chemically synthesized
aaagataatatattctgaaa

SEQ ID NO: 403507 - DNA, 20 bp, Artificial Sequence
  chemically synthesized
aaaagataatatattctgaa

SEQ ID NO: 403508 - DNA, 20 bp, Artificial Sequence
  chemically synthesized
taaaagataatatattctga

SEQ ID NO: 403509 - DNA, 20 bp, Artificial Sequence
  chemically synthesized
ggagaaagaccaagatttaa

SEQ ID NO: 403510 - DNA, 20 bp, Artificial Sequence
  chemically synthesized
atatattatcttttaaatct

SEQ ID NO: 403511 - DNA, 20 bp, Artificial Sequence
  chemically synthesized
gtatggtaaggagaaagacc

SEQ ID NO: 403512 - DNA, 20 bp, Artificial Sequence
  chemically synthesized
tgaatggtatggtaaggaga

SEQ ID NO: 403513 - DNA, 20 bp, Artificial Sequence
  chemically synthesized
attttgaatggtatggtaag

SEQ ID NO: 403514 - DNA, 20 bp, Artificial Sequence
  chemically synthesized
aaattttgaatggtatggta

SEQ ID NO: 403515 - DNA, 20 bp, Artificial Sequence
  chemically synthesized
taaattttgaatggtatggt

SEQ ID NO: 403516 - DNA, 20 bp, Artificial Sequence
  chemically synthesized
tgtttaaattttgaatggta

SEQ ID NO: 403517 - DNA, 20 bp, Artificial Sequence
  chemically synthesized
tttaatgtttaaattttgaa

SEQ ID NO: 403518 - DNA, 20 bp, Artificial Sequence
  chemically synthesized
caaaatttaaacattaaaac

SEQ ID NO: 403519 - DNA, 20 bp, Artificial Sequence
  chemically synthesized
aatttaaacattaaaacaag

SEQ ID NO: 403520 - DNA, 20 bp, Artificial Sequence
  chemically synthesized
atttaaacattaaaacaagc

SEQ ID NO: 403521 - DNA, 20 bp, Artificial Sequence
  chemically synthesized
aagcaggttgttctcataca

SEQ ID NO: 403522 - DNA, 20 bp, Artificial Sequence
  chemically synthesized
gctaatacttggccatgtat

SEQ ID NO: 403523 - DNA, 20 bp, Artificial Sequence
  chemically synthesized
ggttgttctcatacatggcc

SEQ ID NO: 403524 - DNA, 20 bp, Artificial Sequence
  chemically synthesized
tctcatacatggccaagtat

SEQ ID NO: 403525 - DNA, 20 bp, Artificial Sequence
  chemically synthesized
tttctgtctgtgctaatact

SEQ ID NO: 403526 - DNA, 20 bp, Artificial Sequence
  chemically synthesized
tacatggccaagtattagca

SEQ ID NO: 403527 - DNA, 20 bp, Artificial Sequence
  chemically synthesized
tggccaagtattagcacaga

SEQ ID NO: 403528 - DNA, 20 bp, Artificial Sequence
  chemically synthesized
agcacagacagaaatcaatg

SEQ ID NO: 403529 - DNA, 20 bp, Artificial Sequence
  chemically synthesized
atcaatgtagaaaacaattt

SEQ ID NO: 403530 - DNA, 20 bp, Artificial Sequence
  chemically synthesized
aatgtagaaaacaatttaag

SEQ ID NO: 403531 - DNA, 20 bp, Artificial Sequence
  chemically synthesized
aaacaatttaagtggaaaat

SEQ ID NO: 403532 - DNA, 20 bp, Artificial Sequence
  chemically synthesized
ttaagtggaaaataagtttt

SEQ ID NO: 403533 - DNA, 20 bp, Artificial Sequence
  chemically synthesized
taagtggaaaataagtttta

SEQ ID NO: 403534 - DNA, 20 bp, Artificial Sequence
  chemically synthesized
aaataagttttaaggaaatg

SEQ ID NO: 403535 - DNA, 20 bp, Artificial Sequence
  chemically synthesized
aagttttaaggaaatgcagt

SEQ ID NO: 403536 - DNA, 20 bp, Artificial Sequence
  chemically synthesized
aatgcagtgagttattgtaa

SEQ ID NO: 403537 - DNA, 20 bp, Artificial Sequence
  chemically synthesized
gtgagttattgtaatagcaa

SEQ ID NO: 403538 - DNA, 20 bp, Artificial Sequence
  chemically synthesized
gttattgtaatagcaatggt

SEQ ID NO: 403539 - DNA, 20 bp, Artificial Sequence
  chemically synthesized
taatagcaatggtcagtact

SEQ ID NO: 403540 - DNA, 20 bp, Artificial Sequence
  chemically synthesized
aaggtggaaatgagcaggct

SEQ ID NO: 403541 - DNA, 20 bp, Artificial Sequence
  chemically synthesized
ggcacaaggtggaaatgagc

SEQ ID NO: 403542 - DNA, 20 bp, Artificial Sequence
  chemically synthesized
tggcacaaggtggaaatgag

SEQ ID NO: 403543 - DNA, 20 bp, Artificial Sequence
  chemically synthesized
atttggcacaaggtggaaat

SEQ ID NO: 403544 - DNA, 20 bp, Artificial Sequence
  chemically synthesized
tttcagtatttggcacaagg

SEQ ID NO: 403545 - DNA, 20 bp, Artificial Sequence
  chemically synthesized
tgctttcagtatttggcaca

SEQ ID NO: 403546 - DNA, 20 bp, Artificial Sequence
  chemically synthesized
gtgctttcagtatttggcac

SEQ ID NO: 403547 - DNA, 20 bp, Artificial Sequence
  chemically synthesized
ttttaagtgctttcagtatt

SEQ ID NO: 403548 - DNA, 20 bp, Artificial Sequence
  chemically synthesized
caccttgtgccaaatactga

SEQ ID NO: 403549 - DNA, 20 bp, Artificial Sequence
  chemically synthesized
atttctgttttaagtgcttt

SEQ ID NO: 403550 - DNA, 20 bp, Artificial Sequence
  chemically synthesized
aatactgaaagcacttaaaa

SEQ ID NO: 403551 - DNA, 20 bp, Artificial Sequence
  chemically synthesized
cgaaactttatttctgtttt

SEQ ID NO: 403552 - DNA, 20 bp, Artificial Sequence
  chemically synthesized
aagcacttaaaacagaaata

SEQ ID NO: 403553 - DNA, 20 bp, Artificial Sequence
  chemically synthesized
ttaaaacagaaataaagttt

SEQ ID NO: 403554 - DNA, 20 bp, Artificial Sequence
  chemically synthesized
aaaacagaaataaagtttcg

SEQ ID NO: 403555 - DNA, 20 bp, Artificial Sequence
  chemically synthesized
ttccgtatttggtgaacagg

SEQ ID NO: 403556 - DNA, 20 bp, Artificial Sequence
  chemically synthesized
acttccgtatttggtgaaca

SEQ ID NO: 403557 - DNA, 20 bp, Artificial Sequence
  chemically synthesized
gacttccgtatttggtgaac

SEQ ID NO: 403558 - DNA, 20 bp, Artificial Sequence
  chemically synthesized
agacttccgtatttggtgaa

SEQ ID NO: 403559 - DNA, 20 bp, Artificial Sequence
  chemically synthesized
cactccctgttcaccaaata

SEQ ID NO: 403560 - DNA, 20 bp, Artificial Sequence
  chemically synthesized
tccctgttcaccaaatacgg

SEQ ID NO: 403561 - DNA, 20 bp, Artificial Sequence
  chemically synthesized
tggcttaagacttccgtatt

SEQ ID NO: 403562 - DNA, 20 bp, Artificial Sequence
  chemically synthesized
tcaccaaatacggaagtctt

SEQ ID NO: 403563 - DNA, 20 bp, Artificial Sequence
  chemically synthesized
caaatacggaagtcttaagc

SEQ ID NO: 403564 - DNA, 20 bp, Artificial Sequence
  chemically synthesized
tctttcataaacactggctt

SEQ ID NO: 403565 - DNA, 20 bp, Artificial Sequence
  chemically synthesized
gcttgatctttcataaacac

SEQ ID NO: 403566 - DNA, 20 bp, Artificial Sequence
  chemically synthesized
tcttaagccagtgtttatga

SEQ ID NO: 403567 - DNA, 20 bp, Artificial Sequence
  chemically synthesized
gccagtgtttatgaaagatc

SEQ ID NO: 403568 - DNA, 20 bp, Artificial Sequence
  chemically synthesized
tcattcctatttataatttt

SEQ ID NO: 403569 - DNA, 20 bp, Artificial Sequence
  chemically synthesized
atcaagccaaaaattataaa

SEQ ID NO: 403570 - DNA, 20 bp, Artificial Sequence
  chemically synthesized
tcaagccaaaaattataaat

SEQ ID NO: 403571 - DNA, 20 bp, Artificial Sequence
  chemically synthesized
aaaaattataaataggaatg

SEQ ID NO: 403572 - DNA, 20 bp, Artificial Sequence
  chemically synthesized
aaaattataaataggaatga

SEQ ID NO: 403573 - DNA, 20 bp, Artificial Sequence
  chemically synthesized
gtcagtgctgaaaacatgtt

SEQ ID NO: 403574 - DNA, 20 bp, Artificial Sequence
  chemically synthesized
atgaaggccaaacatgtttt

SEQ ID NO: 403575 - DNA, 20 bp, Artificial Sequence
  chemically synthesized
aaacatgttttcagcactga

SEQ ID NO: 403576 - DNA, 20 bp, Artificial Sequence
  chemically synthesized
aacatgttttcagcactgac

SEQ ID NO: 403577 - DNA, 20 bp, Artificial Sequence
  chemically synthesized
ctgactgcaaagtttcccgt

SEQ ID NO: 403578 - DNA, 20 bp, Artificial Sequence
  chemically synthesized
agcactgacgggaaactttg

SEQ ID NO: 403579 - DNA, 20 bp, Artificial Sequence
  chemically synthesized
ctgacgggaaactttgcagt

SEQ ID NO: 403580 - DNA, 20 bp, Artificial Sequence
  chemically synthesized
atgttcttttactgactgca

SEQ ID NO: 403581 - DNA, 20 bp, Artificial Sequence
  chemically synthesized
ggaaactttgcagtcagtaa

SEQ ID NO: 403582 - DNA, 20 bp, Artificial Sequence
  chemically synthesized
tgcagtcagtaaaagaacat

SEQ ID NO: 403583 - DNA, 20 bp, Artificial Sequence
  chemically synthesized
cagtcagtaaaagaacatta

SEQ ID NO: 403584 - DNA, 20 bp, Artificial Sequence
  chemically synthesized
cagtaaaagaacattagagt

SEQ ID NO: 403585 - DNA, 20 bp, Artificial Sequence
  chemically synthesized
gaacattagagtcagtcttt

SEQ ID NO: 403586 - DNA, 20 bp, Artificial Sequence
  chemically synthesized
ttagagtcagtcttttagaa

SEQ ID NO: 403587 - DNA, 20 bp, Artificial Sequence
  chemically synthesized
tagagtcagtcttttagaaa

SEQ ID NO: 403588 - DNA, 20 bp, Artificial Sequence
  chemically synthesized
ttttccaaacccttttctaa

SEQ ID NO: 403589 - DNA, 20 bp, Artificial Sequence
  chemically synthesized
agagtcagtcttttagaaaa

SEQ ID NO: 403590 - DNA, 20 bp, Artificial Sequence
  chemically synthesized
cagtcttttagaaaagggtt

SEQ ID NO: 403591 - DNA, 20 bp, Artificial Sequence
  chemically synthesized
gggtttggaaaattattact

SEQ ID NO: 403592 - DNA, 20 bp, Artificial Sequence
  chemically synthesized
caggatttcttttgtattct

SEQ ID NO: 403593 - DNA, 20 bp, Artificial Sequence
  chemically synthesized
aattattactgagaatacaa

SEQ ID NO: 403594 - DNA, 20 bp, Artificial Sequence
  chemically synthesized
tgagaatacaaaagaaatcc

SEQ ID NO: 403595 - DNA, 20 bp, Artificial Sequence
  chemically synthesized
gagaatacaaaagaaatcct

SEQ ID NO: 403596 - DNA, 20 bp, Artificial Sequence
  chemically synthesized
gaatacaaaagaaatcctgg

SEQ ID NO: 403597 - DNA, 20 bp, Artificial Sequence
  chemically synthesized
tcctcttttgattagctccc

SEQ ID NO: 403598 - DNA, 20 bp, Artificial Sequence
  chemically synthesized
ctcctcttttgattagctcc

SEQ ID NO: 403599 - DNA, 20 bp, Artificial Sequence
  chemically synthesized
aaatcctgggagctaatcaa

SEQ ID NO: 403600 - DNA, 20 bp, Artificial Sequence
  chemically synthesized
atcctgggagctaatcaaaa

SEQ ID NO: 403601 - DNA, 20 bp, Artificial Sequence
  chemically synthesized
aaactgtctcctcttttgat

SEQ ID NO: 403602 - DNA, 20 bp, Artificial Sequence
  chemically synthesized
tcctgggagctaatcaaaag

SEQ ID NO: 403603 - DNA, 20 bp, Artificial Sequence
  chemically synthesized
ctgggagctaatcaaaagag

SEQ ID NO: 403604 - DNA, 20 bp, Artificial Sequence
  chemically synthesized
gagctaatcaaaagaggaga

SEQ ID NO: 403605 - DNA, 20 bp, Artificial Sequence
  chemically synthesized
tcaaaagaggagacagtttt

SEQ ID NO: 403606 - DNA, 20 bp, Artificial Sequence
  chemically synthesized
aaaagaggagacagttttga

SEQ ID NO: 403607 - DNA, 20 bp, Artificial Sequence
  chemically synthesized
agacagttttgagagttaat

SEQ ID NO: 403608 - DNA, 20 bp, Artificial Sequence
  chemically synthesized
gacagttttgagagttaatc

SEQ ID NO: 403609 - DNA, 20 bp, Artificial Sequence
  chemically synthesized
taatcaggtgccaatgctaa

SEQ ID NO: 403610 - DNA, 20 bp, Artificial Sequence
  chemically synthesized
cttggataatctattagcat

SEQ ID NO: 403611 - DNA, 20 bp, Artificial Sequence
  chemically synthesized
ctgccacttggataatctat

SEQ ID NO: 403612 - DNA, 20 bp, Artificial Sequence
  chemically synthesized
ccaatgctaatagattatcc

SEQ ID NO: 403613 - DNA, 20 bp, Artificial Sequence
  chemically synthesized
atgctaatagattatccaag

SEQ ID NO: 403614 - DNA, 20 bp, Artificial Sequence
  chemically synthesized
ctaatagattatccaagtgg

SEQ ID NO: 403615 - DNA, 20 bp, Artificial Sequence
  chemically synthesized
aatagattatccaagtggca

SEQ ID NO: 403616 - DNA, 20 bp, Artificial Sequence
  chemically synthesized
accttctttgctctgccact

SEQ ID NO: 403617 - DNA, 20 bp, Artificial Sequence
  chemically synthesized
attatccaagtggcagagca

SEQ ID NO: 403618 - DNA, 20 bp, Artificial Sequence
  chemically synthesized
atccaagtggcagagcaaag

SEQ ID NO: 403619 - DNA, 20 bp, Artificial Sequence
  chemically synthesized
tccaagtggcagagcaaaga

SEQ ID NO: 403620 - DNA, 20 bp, Artificial Sequence
  chemically synthesized
gtggcagagcaaagaaggtc

SEQ ID NO: 403621 - DNA, 20 bp, Artificial Sequence
  chemically synthesized
ggcagagcaaagaaggtcca

SEQ ID NO: 403622 - DNA, 20 bp, Artificial Sequence
  chemically synthesized
aaaaattgattgtgtgactc

SEQ ID NO: 403623 - DNA, 20 bp, Artificial Sequence
  chemically synthesized
tcacacaatcaatttttatt

SEQ ID NO: 403624 - DNA, 20 bp, Artificial Sequence
  chemically synthesized
aatcaatttttattcagctt

SEQ ID NO: 403625 - DNA, 20 bp, Artificial Sequence
  chemically synthesized
gtcatcagtattagcaactc

SEQ ID NO: 403626 - DNA, 20 bp, Artificial Sequence
  chemically synthesized
taaccacttgtcatcagtat

SEQ ID NO: 403627 - DNA, 20 bp, Artificial Sequence
  chemically synthesized
gagttgctaatactgatgac

SEQ ID NO: 403628 - DNA, 20 bp, Artificial Sequence
  chemically synthesized
agtcgttaaccacttgtcat

SEQ ID NO: 403629 - DNA, 20 bp, Artificial Sequence
  chemically synthesized
ttgctaatactgatgacaag

SEQ ID NO: 403630 - DNA, 20 bp, Artificial Sequence
  chemically synthesized
attaagaatcttggaagaag

SEQ ID NO: 403631 - DNA, 20 bp, Artificial Sequence
  chemically synthesized
ggttaacgactgcttcttcc

SEQ ID NO: 403632 - DNA, 20 bp, Artificial Sequence
  chemically synthesized
ttcattaagaatcttggaag

SEQ ID NO: 403633 - DNA, 20 bp, Artificial Sequence
  chemically synthesized
tctttcattaagaatcttgg

SEQ ID NO: 403634 - DNA, 20 bp, Artificial Sequence
  chemically synthesized
aagtctttcattaagaatct

SEQ ID NO: 403635 - DNA, 20 bp, Artificial Sequence
  chemically synthesized
tcttccaagattcttaatga

SEQ ID NO: 403636 - DNA, 20 bp, Artificial Sequence
  chemically synthesized
gaaaagagaagtctttcatt

SEQ ID NO: 403637 - DNA, 20 bp, Artificial Sequence
  chemically synthesized
taataaacctgagaaaagag

SEQ ID NO: 403638 - DNA, 20 bp, Artificial Sequence
  chemically synthesized
atgaaagacttctcttttct

SEQ ID NO: 403639 - DNA, 20 bp, Artificial Sequence
  chemically synthesized
tgaaagacttctcttttctc

SEQ ID NO: 403640 - DNA, 20 bp, Artificial Sequence
  chemically synthesized
gcataataaacctgagaaaa

SEQ ID NO: 403641 - DNA, 20 bp, Artificial Sequence
  chemically synthesized
tggcataataaacctgagaa

SEQ ID NO: 403642 - DNA, 20 bp, Artificial Sequence
  chemically synthesized
tccagtggcataataaacct

SEQ ID NO: 403643 - DNA, 20 bp, Artificial Sequence
  chemically synthesized
tctcaggtttattatgccac

SEQ ID NO: 403644 - DNA, 20 bp, Artificial Sequence
  chemically synthesized
aaataccttttttaatccag

SEQ ID NO: 403645 - DNA, 20 bp, Artificial Sequence
  chemically synthesized
aataaataccttttttaatc

SEQ ID NO: 403646 - DNA, 20 bp, Artificial Sequence
  chemically synthesized
attatgccactggattaaaa

SEQ ID NO: 403647 - DNA, 20 bp, Artificial Sequence
  chemically synthesized
ttatgccactggattaaaaa

SEQ ID NO: 403648 - DNA, 20 bp, Artificial Sequence
  chemically synthesized
aaggtatttatttctgtact

SEQ ID NO: 403649 - DNA, 20 bp, Artificial Sequence
  chemically synthesized
tcctgtcaccgatcttagta

SEQ ID NO: 403650 - DNA, 20 bp, Artificial Sequence
  chemically synthesized
atttatttctgtactaagat

SEQ ID NO: 403651 - DNA, 20 bp, Artificial Sequence
  chemically synthesized
tgtagtcctgtcaccgatct

SEQ ID NO: 403652 - DNA, 20 bp, Artificial Sequence
  chemically synthesized
ttctgtactaagatcggtga

SEQ ID NO: 403653 - DNA, 20 bp, Artificial Sequence
  chemically synthesized
tctgtactaagatcggtgac

SEQ ID NO: 403654 - DNA, 20 bp, Artificial Sequence
  chemically synthesized
atcggtgacaggactacacc

SEQ ID NO: 403655 - DNA, 20 bp, Artificial Sequence
  chemically synthesized
tgagggacgtgttctcggtg

SEQ ID NO: 403656 - DNA, 20 bp, Artificial Sequence
  chemically synthesized
tacactgagggacgtgttct

SEQ ID NO: 403657 - DNA, 20 bp, Artificial Sequence
  chemically synthesized
tacaccgagaacacgtccct

SEQ ID NO: 403658 - DNA, 20 bp, Artificial Sequence
  chemically synthesized
ctattggcaatgtacactga

SEQ ID NO: 403659 - DNA, 20 bp, Artificial Sequence
  chemically synthesized
tctattggcaatgtacactg

SEQ ID NO: 403660 - DNA, 20 bp, Artificial Sequence
  chemically synthesized
atctattggcaatgtacact

SEQ ID NO: 403661 - DNA, 20 bp, Artificial Sequence
  chemically synthesized
ccctcagtgtacattgccaa

SEQ ID NO: 403662 - DNA, 20 bp, Artificial Sequence
  chemically synthesized
agtgtacattgccaatagat

SEQ ID NO: 403663 - DNA, 20 bp, Artificial Sequence
  chemically synthesized
tatagacaaaactcatctat

SEQ ID NO: 403664 - DNA, 20 bp, Artificial Sequence
  chemically synthesized
atgattagtcaatcaagata

SEQ ID NO: 403665 - DNA, 20 bp, Artificial Sequence
  chemically synthesized
tattaaatgattagtcaatc

SEQ ID NO: 403666 - DNA, 20 bp, Artificial Sequence
  chemically synthesized
actcacatctattaaatgat

SEQ ID NO: 403667 - DNA, 20 bp, Artificial Sequence
  chemically synthesized
ttgattgactaatcatttaa

SEQ ID NO: 403668 - DNA, 20 bp, Artificial Sequence
  chemically synthesized
actaatcatttaatagatgt

SEQ ID NO: 403669 - DNA, 20 bp, Artificial Sequence
  chemically synthesized
tcatttaatagatgtgagtg

SEQ ID NO: 403670 - DNA, 20 bp, Artificial Sequence
  chemically synthesized
catttaatagatgtgagtgt

SEQ ID NO: 403671 - DNA, 20 bp, Artificial Sequence
  chemically synthesized
taatagatgtgagtgtaggt

SEQ ID NO: 403672 - DNA, 20 bp, Artificial Sequence
  chemically synthesized
tgtaggttggcatgcaaatt

SEQ ID NO: 403673 - DNA, 20 bp, Artificial Sequence
  chemically synthesized
catgcaaattaagtaacttt

SEQ ID NO: 403674 - DNA, 20 bp, Artificial Sequence
  chemically synthesized
caaattaagtaacttttggc

SEQ ID NO: 403675 - DNA, 20 bp, Artificial Sequence
  chemically synthesized
aaattaagtaacttttggcc

SEQ ID NO: 403676 - DNA, 20 bp, Artificial Sequence
  chemically synthesized
gagccaccgcgcctggccaa

SEQ ID NO: 403677 - DNA, 20 bp, Artificial Sequence
  chemically synthesized
aagtaacttttggccaggcg

SEQ ID NO: 403678 - DNA, 20 bp, Artificial Sequence
  chemically synthesized
taacttttggccaggcgcgg

SEQ ID NO: 403679 - DNA, 20 bp, Artificial Sequence
  chemically synthesized
caggcgtgagccaccgcgcc

SEQ ID NO: 403680 - DNA, 20 bp, Artificial Sequence
  chemically synthesized
agtgccgggattacaggcgt

SEQ ID NO: 403681 - DNA, 20 bp, Artificial Sequence
  chemically synthesized
gtggctcacgcctgtaatcc

SEQ ID NO: 403682 - DNA, 20 bp, Artificial Sequence
  chemically synthesized
tcccaaagtgccgggattac

SEQ ID NO: 403683 - DNA, 20 bp, Artificial Sequence
  chemically synthesized
ctcccaaagtgccgggatta

SEQ ID NO: 403684 - DNA, 20 bp, Artificial Sequence
  chemically synthesized
cgcctgtaatcccggcactt

SEQ ID NO: 403685 - DNA, 20 bp, Artificial Sequence
  chemically synthesized
cctcggcctcccaaagtgcc

SEQ ID NO: 403686 - DNA, 20 bp, Artificial Sequence
  chemically synthesized
gcctgtaatcccggcacttt

SEQ ID NO: 403687 - DNA, 20 bp, Artificial Sequence
  chemically synthesized
acctcggcctcccaaagtgc

SEQ ID NO: 403688 - DNA, 20 bp, Artificial Sequence
  chemically synthesized
ctgtaatcccggcactttgg

SEQ ID NO: 403689 - DNA, 20 bp, Artificial Sequence
  chemically synthesized
tgtaatcccggcactttggg

SEQ ID NO: 403690 - DNA, 20 bp, Artificial Sequence
  chemically synthesized
ccgcccacctcggcctccca

SEQ ID NO: 403691 - DNA, 20 bp, Artificial Sequence
  chemically synthesized
tcccggcactttgggaggcc

SEQ ID NO: 403692 - DNA, 20 bp, Artificial Sequence
  chemically synthesized
cccggcactttgggaggccg

SEQ ID NO: 403693 - DNA, 20 bp, Artificial Sequence
  chemically synthesized
ggcactttgggaggccgagg

SEQ ID NO: 403694 - DNA, 20 bp, Artificial Sequence
  chemically synthesized
gcactttgggaggccgaggt

SEQ ID NO: 403695 - DNA, 20 bp, Artificial Sequence
  chemically synthesized
ctttgggaggccgaggtggg

SEQ ID NO: 403696 - DNA, 20 bp, Artificial Sequence
  chemically synthesized
accttgtgatccgcccacct

SEQ ID NO: 403697 - DNA, 20 bp, Artificial Sequence
  chemically synthesized
ggccgaggtgggcggatcac

SEQ ID NO: 403698 - DNA, 20 bp, Artificial Sequence
  chemically synthesized
gccgaggtgggcggatcaca

SEQ ID NO: 403699 - DNA, 20 bp, Artificial Sequence
  chemically synthesized
aggtgggcggatcacaaggt

SEQ ID NO: 403700 - DNA, 20 bp, Artificial Sequence
  chemically synthesized
ggtgggcggatcacaaggtc

SEQ ID NO: 403701 - DNA, 20 bp, Artificial Sequence
  chemically synthesized
tgggcggatcacaaggtcag

SEQ ID NO: 403702 - DNA, 20 bp, Artificial Sequence
  chemically synthesized
gatcacaaggtcaggagatc

SEQ ID NO: 403703 - DNA, 20 bp, Artificial Sequence
  chemically synthesized
tcaggagatcgagaccctcc

SEQ ID NO: 403704 - DNA, 20 bp, Artificial Sequence
  chemically synthesized
tttcaccgtgtttgccagga

SEQ ID NO: 403705 - DNA, 20 bp, Artificial Sequence
  chemically synthesized
gtttcaccgtgtttgccagg

SEQ ID NO: 403706 - DNA, 20 bp, Artificial Sequence
  chemically synthesized
ggtttcaccgtgtttgccag

SEQ ID NO: 403707 - DNA, 20 bp, Artificial Sequence
  chemically synthesized
ggggtttcaccgtgtttgcc

SEQ ID NO: 403708 - DNA, 20 bp, Artificial Sequence
  chemically synthesized
cgagaccctcctggcaaaca

SEQ ID NO: 403709 - DNA, 20 bp, Artificial Sequence
  chemically synthesized
cggggtttcaccgtgtttgc

SEQ ID NO: 403710 - DNA, 20 bp, Artificial Sequence
  chemically synthesized
ttgtatttttagtagagacg

SEQ ID NO: 403711 - DNA, 20 bp, Artificial Sequence
  chemically synthesized
tttgtatttttagtagagac

SEQ ID NO: 403712 - DNA, 20 bp, Artificial Sequence
  chemically synthesized
ttttgtatttttagtagaga

SEQ ID NO: 403713 - DNA, 20 bp, Artificial Sequence
  chemically synthesized
ttttttttgtatttttagta

SEQ ID NO: 403714 - DNA, 20 bp, Artificial Sequence
  chemically synthesized
ttttttttttgtatttttag

SEQ ID NO: 403715 - DNA, 20 bp, Artificial Sequence
  chemically synthesized
tttttttttttttgtatttt

SEQ ID NO: 403716 - DNA, 20 bp, Artificial Sequence
  chemically synthesized
atacaaaaaaaaaaaaaaac

SEQ ID NO: 403717 - DNA, 20 bp, Artificial Sequence
  chemically synthesized
aaaaaaaaaaaaaaactagc

SEQ ID NO: 403718 - DNA, 20 bp, Artificial Sequence
  chemically synthesized
aaaaaaaaaaaaaactagcc

SEQ ID NO: 403719 - DNA, 20 bp, Artificial Sequence
  chemically synthesized
tgcccgccaccacgcccggc

SEQ ID NO: 403720 - DNA, 20 bp, Artificial Sequence
  chemically synthesized
aaaaaaaaactagccgggcg

SEQ ID NO: 403721 - DNA, 20 bp, Artificial Sequence
  chemically synthesized
aaaaaactagccgggcgtgg

SEQ ID NO: 403722 - DNA, 20 bp, Artificial Sequence
  chemically synthesized
caggtgcccgccaccacgcc

SEQ ID NO: 403723 - DNA, 20 bp, Artificial Sequence
  chemically synthesized
aaactagccgggcgtggtgg

SEQ ID NO: 403724 - DNA, 20 bp, Artificial Sequence
  chemically synthesized
aactagccgggcgtggtggc

SEQ ID NO: 403725 - DNA, 20 bp, Artificial Sequence
  chemically synthesized
ggcgtggtggcgggcacctg

SEQ ID NO: 403726 - DNA, 20 bp, Artificial Sequence
  chemically synthesized
gtggcgggcacctgtagtct

SEQ ID NO: 403727 - DNA, 20 bp, Artificial Sequence
  chemically synthesized
tcccaagtagctgagactac

SEQ ID NO: 403728 - DNA, 20 bp, Artificial Sequence
  chemically synthesized
ctcccaagtagctgagacta

SEQ ID NO: 403729 - DNA, 20 bp, Artificial Sequence
  chemically synthesized
cacctgtagtctcagctact

SEQ ID NO: 403730 - DNA, 20 bp, Artificial Sequence
  chemically synthesized
tctcagcctcccaagtagct

SEQ ID NO: 403731 - DNA, 20 bp, Artificial Sequence
  chemically synthesized
acctgtagtctcagctactt

SEQ ID NO: 403732 - DNA, 20 bp, Artificial Sequence
  chemically synthesized
ctgtagtctcagctacttgg

SEQ ID NO: 403733 - DNA, 20 bp, Artificial Sequence
  chemically synthesized
tgtagtctcagctacttggg

SEQ ID NO: 403734 - DNA, 20 bp, Artificial Sequence
  chemically synthesized
tcctgtctcagcctcccaag

SEQ ID NO: 403735 - DNA, 20 bp, Artificial Sequence
  chemically synthesized
ttctcctgtctcagcctccc

SEQ ID NO: 403736 - DNA, 20 bp, Artificial Sequence
  chemically synthesized
tctcagctacttgggaggct

SEQ ID NO: 403737 - DNA, 20 bp, Artificial Sequence
  chemically synthesized
agctacttgggaggctgaga

SEQ ID NO: 403738 - DNA, 20 bp, Artificial Sequence
  chemically synthesized
gctacttgggaggctgagac

SEQ ID NO: 403739 - DNA, 20 bp, Artificial Sequence
  chemically synthesized
tacttgggaggctgagacag

SEQ ID NO: 403740 - DNA, 20 bp, Artificial Sequence
  chemically synthesized
gttcagccattctcctgtct

SEQ ID NO: 403741 - DNA, 20 bp, Artificial Sequence
  chemically synthesized
gggaggctgagacaggagaa

SEQ ID NO: 403742 - DNA, 20 bp, Artificial Sequence
  chemically synthesized
gacaggagaatggctgaacc

SEQ ID NO: 403743 - DNA, 20 bp, Artificial Sequence
  chemically synthesized
acaggagaatggctgaaccc

SEQ ID NO: 403744 - DNA, 20 bp, Artificial Sequence
  chemically synthesized
aggagaatggctgaacccgg

SEQ ID NO: 403745 - DNA, 20 bp, Artificial Sequence
  chemically synthesized
caagctccgcctcccgggtt

SEQ ID NO: 403746 - DNA, 20 bp, Artificial Sequence
  chemically synthesized
ggagaatggctgaacccggg

SEQ ID NO: 403747 - DNA, 20 bp, Artificial Sequence
  chemically synthesized
gaatggctgaacccgggagg

SEQ ID NO: 403748 - DNA, 20 bp, Artificial Sequence
  chemically synthesized
cactgcaagctccgcctccc

SEQ ID NO: 403749 - DNA, 20 bp, Artificial Sequence
  chemically synthesized
atggctgaacccgggaggcg

SEQ ID NO: 403750 - DNA, 20 bp, Artificial Sequence
  chemically synthesized
tcactgcaagctccgcctcc

SEQ ID NO: 403751 - DNA, 20 bp, Artificial Sequence
  chemically synthesized
aacccgggaggcggagcttg

SEQ ID NO: 403752 - DNA, 20 bp, Artificial Sequence
  chemically synthesized
cgggaggcggagcttgcagt

SEQ ID NO: 403753 - DNA, 20 bp, Artificial Sequence
  chemically synthesized
gcgcgatctcggctcactgc

SEQ ID NO: 403754 - DNA, 20 bp, Artificial Sequence
  chemically synthesized
ggcggagcttgcagtgagcc

SEQ ID NO: 403755 - DNA, 20 bp, Artificial Sequence
  chemically synthesized
ggagtgcagtggcgcgatct

SEQ ID NO: 403756 - DNA, 20 bp, Artificial Sequence
  chemically synthesized
tcgcccaggctggagtgcag

SEQ ID NO: 403757 - DNA, 20 bp, Artificial Sequence
  chemically synthesized
gagatcgcgccactgcactc

SEQ ID NO: 403758 - DNA, 20 bp, Artificial Sequence
  chemically synthesized
ctgtcgcccaggctggagtg

SEQ ID NO: 403759 - DNA, 20 bp, Artificial Sequence
  chemically synthesized
cgcgccactgcactccagcc

SEQ ID NO: 403760 - DNA, 20 bp, Artificial Sequence
  chemically synthesized
gcgccactgcactccagcct

SEQ ID NO: 403761 - DNA, 20 bp, Artificial Sequence
  chemically synthesized
tcgctctgtcgcccaggctg

SEQ ID NO: 403762 - DNA, 20 bp, Artificial Sequence
  chemically synthesized
tctcgctctgtcgcccaggc

SEQ ID NO: 403763 - DNA, 20 bp, Artificial Sequence
  chemically synthesized
ctgcactccagcctgggcga

SEQ ID NO: 403764 - DNA, 20 bp, Artificial Sequence
  chemically synthesized
ggagtctcgctctgtcgccc

SEQ ID NO: 403765 - DNA, 20 bp, Artificial Sequence
  chemically synthesized
gcactccagcctgggcgaca

SEQ ID NO: 403766 - DNA, 20 bp, Artificial Sequence
  chemically synthesized
cggagtctcgctctgtcgcc

SEQ ID NO: 403767 - DNA, 20 bp, Artificial Sequence
  chemically synthesized
tccagcctgggcgacagagc

SEQ ID NO: 403768 - DNA, 20 bp, Artificial Sequence
  chemically synthesized
agctttttttttttgagacg

SEQ ID NO: 403769 - DNA, 20 bp, Artificial Sequence
  chemically synthesized
agagctttttttttttgaga

SEQ ID NO: 403770 - DNA, 20 bp, Artificial Sequence
  chemically synthesized
tatgagagcttttttttttt

SEQ ID NO: 403771 - DNA, 20 bp, Artificial Sequence
  chemically synthesized
gactccgtctcaaaaaaaaa

SEQ ID NO: 403772 - DNA, 20 bp, Artificial Sequence
  chemically synthesized
aaaaaaaaaagctctcatac

SEQ ID NO: 403773 - DNA, 20 bp, Artificial Sequence
  chemically synthesized
aaacaataaggctagtatga

SEQ ID NO: 403774 - DNA, 20 bp, Artificial Sequence
  chemically synthesized
gcaaacaataaggctagtat

SEQ ID NO: 403775 - DNA, 20 bp, Artificial Sequence
  chemically synthesized
ctaagtgcaaacaataaggc

SEQ ID NO: 403776 - DNA, 20 bp, Artificial Sequence
  chemically synthesized
atacctaagtgcaaacaata

SEQ ID NO: 403777 - DNA, 20 bp, Artificial Sequence
  chemically synthesized
gatacctaagtgcaaacaat

SEQ ID NO: 403778 - DNA, 20 bp, Artificial Sequence
  chemically synthesized
ctagccttattgtttgcact

SEQ ID NO: 403779 - DNA, 20 bp, Artificial Sequence
  chemically synthesized
tagccttattgtttgcactt

SEQ ID NO: 403780 - DNA, 20 bp, Artificial Sequence
  chemically synthesized
agttcaactcagtgatacct

SEQ ID NO: 403781 - DNA, 20 bp, Artificial Sequence
  chemically synthesized
gtttgcacttaggtatcact

SEQ ID NO: 403782 - DNA, 20 bp, Artificial Sequence
  chemically synthesized
tttcctctacaagttcaact

SEQ ID NO: 403783 - DNA, 20 bp, Artificial Sequence
  chemically synthesized
gtatcactgagttgaacttg

SEQ ID NO: 403784 - DNA, 20 bp, Artificial Sequence
  chemically synthesized
atcactgagttgaacttgta

SEQ ID NO: 403785 - DNA, 20 bp, Artificial Sequence
  chemically synthesized
tcactgagttgaacttgtag

SEQ ID NO: 403786 - DNA, 20 bp, Artificial Sequence
  chemically synthesized
tctgttatattttcctctac

SEQ ID NO: 403787 - DNA, 20 bp, Artificial Sequence
  chemically synthesized
acttgtagaggaaaatataa

SEQ ID NO: 403788 - DNA, 20 bp, Artificial Sequence
  chemically synthesized
aaaatataacagaattacaa

SEQ ID NO: 403789 - DNA, 20 bp, Artificial Sequence
  chemically synthesized
taacagaattacaaaagatt

SEQ ID NO: 403790 - DNA, 20 bp, Artificial Sequence
  chemically synthesized
tacaaaagatttagacattg

SEQ ID NO: 403791 - DNA, 20 bp, Artificial Sequence
  chemically synthesized
tagacattgtagaaaaaatt

SEQ ID NO: 403792 - DNA, 20 bp, Artificial Sequence
  chemically synthesized
ttattatataaaacaaacaa

SEQ ID NO: 403793 - DNA, 20 bp, Artificial Sequence
  chemically synthesized
taaaacaaacaatagatttt

SEQ ID NO: 403794 - DNA, 20 bp, Artificial Sequence
  chemically synthesized
aaaacaaacaatagattttg

SEQ ID NO: 403795 - DNA, 20 bp, Artificial Sequence
  chemically synthesized
acaatagattttgaggtttt

SEQ ID NO: 403796 - DNA, 20 bp, Artificial Sequence
  chemically synthesized
caatagattttgaggtttta

SEQ ID NO: 403797 - DNA, 20 bp, Artificial Sequence
  chemically synthesized
aatagattttgaggttttaa

SEQ ID NO: 403798 - DNA, 20 bp, Artificial Sequence
  chemically synthesized
taaaatgctgtttttcgaaa

SEQ ID NO: 403799 - DNA, 20 bp, Artificial Sequence
  chemically synthesized
gaattttctgtttcgaaaaa

SEQ ID NO: 403800 - DNA, 20 bp, Artificial Sequence
  chemically synthesized
gtttcgaaaaacagcatttt

SEQ ID NO: 403801 - DNA, 20 bp, Artificial Sequence
  chemically synthesized
gaaaaacagcattttaagta

SEQ ID NO: 403802 - DNA, 20 bp, Artificial Sequence
  chemically synthesized
aataaagtttacaatttatg

SEQ ID NO: 403803 - DNA, 20 bp, Artificial Sequence
  chemically synthesized
aatgactagaatttaaaata

SEQ ID NO: 403804 - DNA, 20 bp, Artificial Sequence
  chemically synthesized
gtaaactttattttaaattc

SEQ ID NO: 403805 - DNA, 20 bp, Artificial Sequence
  chemically synthesized
ttaaagtcttttgtaatgac

SEQ ID NO: 403806 - DNA, 20 bp, Artificial Sequence
  chemically synthesized
ttaaattctagtcattacaa

SEQ ID NO: 403807 - DNA, 20 bp, Artificial Sequence
  chemically synthesized
tagtcattacaaaagacttt

SEQ ID NO: 403808 - DNA, 20 bp, Artificial Sequence
  chemically synthesized
gcaatttgccatttgactta

SEQ ID NO: 403809 - DNA, 20 bp, Artificial Sequence
  chemically synthesized
acaaaagactttaagtcaaa

SEQ ID NO: 403810 - DNA, 20 bp, Artificial Sequence
  chemically synthesized
tggcaaattgctttcctcta

SEQ ID NO: 403811 - DNA, 20 bp, Artificial Sequence
  chemically synthesized
tttaaattggctatagagga

SEQ ID NO: 403812 - DNA, 20 bp, Artificial Sequence
  chemically synthesized
acattttaaattggctatag

SEQ ID NO: 403813 - DNA, 20 bp, Artificial Sequence
  chemically synthesized
aacattttaaattggctata

SEQ ID NO: 403814 - DNA, 20 bp, Artificial Sequence
  chemically synthesized
caaacattttaaattggcta

SEQ ID NO: 403815 - DNA, 20 bp, Artificial Sequence
  chemically synthesized
accattcaaacattttaaat

SEQ ID NO: 403816 - DNA, 20 bp, Artificial Sequence
  chemically synthesized
gccaatttaaaatgtttgaa

SEQ ID NO: 403817 - DNA, 20 bp, Artificial Sequence
  chemically synthesized
cctgaatacatatgtatata

SEQ ID NO: 403818 - DNA, 20 bp, Artificial Sequence
  chemically synthesized
tctatatatacatatgtatt

SEQ ID NO: 403819 - DNA, 20 bp, Artificial Sequence
  chemically synthesized
ctatatatacatatgtattc

SEQ ID NO: 403820 - DNA, 20 bp, Artificial Sequence
  chemically synthesized
atattgttatatacatacat

SEQ ID NO: 403821 - DNA, 20 bp, Artificial Sequence
  chemically synthesized
ttatatgttatatatgtatg

SEQ ID NO: 403822 - DNA, 20 bp, Artificial Sequence
  chemically synthesized
tcatacatatataacatata

SEQ ID NO: 403823 - DNA, 20 bp, Artificial Sequence
  chemically synthesized
catgaattttatattcatat

SEQ ID NO: 403824 - DNA, 20 bp, Artificial Sequence
  chemically synthesized
aatataaaattcatgaattg

SEQ ID NO: 403825 - DNA, 20 bp, Artificial Sequence
  chemically synthesized
ttgtagcacactgaaaacat

SEQ ID NO: 403826 - DNA, 20 bp, Artificial Sequence
  chemically synthesized
taatcaaaaactaatgtttt

SEQ ID NO: 403827 - DNA, 20 bp, Artificial Sequence
  chemically synthesized
tgaaaacattagtttttgat

SEQ ID NO: 403828 - DNA, 20 bp, Artificial Sequence
  chemically synthesized
aaaacattagtttttgatta

SEQ ID NO: 403829 - DNA, 20 bp, Artificial Sequence
  chemically synthesized
agaacattaaaatgattgta

SEQ ID NO: 403830 - DNA, 20 bp, Artificial Sequence
  chemically synthesized
acattaaaatgattgtaaag

SEQ ID NO: 403831 - DNA, 20 bp, Artificial Sequence
  chemically synthesized
tgattgtaaagtagaatctc

SEQ ID NO: 403832 - DNA, 20 bp, Artificial Sequence
  chemically synthesized
tacaaactttggaaattctg

SEQ ID NO: 403833 - DNA, 20 bp, Artificial Sequence
  chemically synthesized
tttacaaactttggaaattc

SEQ ID NO: 403834 - DNA, 20 bp, Artificial Sequence
  chemically synthesized
tagaatctccagaatttcca

SEQ ID NO: 403835 - DNA, 20 bp, Artificial Sequence
  chemically synthesized
tgtcttcaatttacaaactt

SEQ ID NO: 403836 - DNA, 20 bp, Artificial Sequence
  chemically synthesized
tttccaaagtttgtaaattg

SEQ ID NO: 403837 - DNA, 20 bp, Artificial Sequence
  chemically synthesized
cattcgaattttctaattta

SEQ ID NO: 403838 - DNA, 20 bp, Artificial Sequence
  chemically synthesized
gaatgatcaaatctttaaat

SEQ ID NO: 403839 - DNA, 20 bp, Artificial Sequence
  chemically synthesized
tttaaagatttgatcattcc

SEQ ID NO: 403840 - DNA, 20 bp, Artificial Sequence
  chemically synthesized
taattcgtttagtaggcgct

SEQ ID NO: 403841 - DNA, 20 bp, Artificial Sequence
  chemically synthesized
ccctttataattcgtttagt

SEQ ID NO: 403842 - DNA, 20 bp, Artificial Sequence
  chemically synthesized
tccctttataattcgtttag

SEQ ID NO: 403843 - DNA, 20 bp, Artificial Sequence
  chemically synthesized
cattccctttataattcgtt

SEQ ID NO: 403844 - DNA, 20 bp, Artificial Sequence
  chemically synthesized
cgcctactaaacgaattata

SEQ ID NO: 403845 - DNA, 20 bp, Artificial Sequence
  chemically synthesized
gcctactaaacgaattataa

SEQ ID NO: 403846 - DNA, 20 bp, Artificial Sequence
  chemically synthesized
cctactaaacgaattataaa

SEQ ID NO: 403847 - DNA, 20 bp, Artificial Sequence
  chemically synthesized
taaacgaattataaagggaa

SEQ ID NO: 403848 - DNA, 20 bp, Artificial Sequence
  chemically synthesized
catattactgtaattcagga

SEQ ID NO: 403849 - DNA, 20 bp, Artificial Sequence
  chemically synthesized
ggaatggctttcctgaatta

SEQ ID NO: 403850 - DNA, 20 bp, Artificial Sequence
  chemically synthesized
ctaccatattactgtaattc

SEQ ID NO: 403851 - DNA, 20 bp, Artificial Sequence
  chemically synthesized
actaccatattactgtaatt

SEQ ID NO: 403852 - DNA, 20 bp, Artificial Sequence
  chemically synthesized
tttcctgaattacagtaata

SEQ ID NO: 403853 - DNA, 20 bp, Artificial Sequence
  chemically synthesized
cctgaattacagtaatatgg

SEQ ID NO: 403854 - DNA, 20 bp, Artificial Sequence
  chemically synthesized
ttacagtaatatggtagttt

SEQ ID NO: 403855 - DNA, 20 bp, Artificial Sequence
  chemically synthesized
aacccagataggcaggttca

SEQ ID NO: 403856 - DNA, 20 bp, Artificial Sequence
  chemically synthesized
tagctttgaacctgcctatc

SEQ ID NO: 403857 - DNA, 20 bp, Artificial Sequence
  chemically synthesized
cctttcgaacccagataggc

SEQ ID NO: 403858 - DNA, 20 bp, Artificial Sequence
  chemically synthesized
agctttgaacctgcctatct

SEQ ID NO: 403859 - DNA, 20 bp, Artificial Sequence
  chemically synthesized
acctttcgaacccagatagg

SEQ ID NO: 403860 - DNA, 20 bp, Artificial Sequence
  chemically synthesized
actacctttcgaacccagat

SEQ ID NO: 403861 - DNA, 20 bp, Artificial Sequence
  chemically synthesized
aactacctttcgaacccaga

SEQ ID NO: 403862 - DNA, 20 bp, Artificial Sequence
  chemically synthesized
acctgcctatctgggttcga

SEQ ID NO: 403863 - DNA, 20 bp, Artificial Sequence
  chemically synthesized
gcagaactacctttcgaacc

SEQ ID NO: 403864 - DNA, 20 bp, Artificial Sequence
  chemically synthesized
cctgcctatctgggttcgaa

SEQ ID NO: 403865 - DNA, 20 bp, Artificial Sequence
  chemically synthesized
gcctatctgggttcgaaagg

SEQ ID NO: 403866 - DNA, 20 bp, Artificial Sequence
  chemically synthesized
ggcacactgttaataagtag

SEQ ID NO: 403867 - DNA, 20 bp, Artificial Sequence
  chemically synthesized
agaggcacactgttaataag

SEQ ID NO: 403868 - DNA, 20 bp, Artificial Sequence
  chemically synthesized
gtagttctgctacttattaa

SEQ ID NO: 403869 - DNA, 20 bp, Artificial Sequence
  chemically synthesized
aacagaggcacactgttaat

SEQ ID NO: 403870 - DNA, 20 bp, Artificial Sequence
  chemically synthesized
ttctacaggtgaggaaacag

SEQ ID NO: 403871 - DNA, 20 bp, Artificial Sequence
  chemically synthesized
attctacaggtgaggaaaca

SEQ ID NO: 403872 - DNA, 20 bp, Artificial Sequence
  chemically synthesized
ttattctacaggtgaggaaa

SEQ ID NO: 403873 - DNA, 20 bp, Artificial Sequence
  chemically synthesized
tgcctctgtttcctcacctg

SEQ ID NO: 403874 - DNA, 20 bp, Artificial Sequence
  chemically synthesized
ttatcattattctacaggtg

SEQ ID NO: 403875 - DNA, 20 bp, Artificial Sequence
  chemically synthesized
attatcattattctacaggt

SEQ ID NO: 403876 - DNA, 20 bp, Artificial Sequence
  chemically synthesized
tattattatcattattctac

SEQ ID NO: 403877 - DNA, 20 bp, Artificial Sequence
  chemically synthesized
atattattatcattattcta

SEQ ID NO: 403878 - DNA, 20 bp, Artificial Sequence
  chemically synthesized
tagaataatgataataatat

SEQ ID NO: 403879 - DNA, 20 bp, Artificial Sequence
  chemically synthesized
taatgataataatatcggtg

SEQ ID NO: 403880 - DNA, 20 bp, Artificial Sequence
  chemically synthesized
tatcggtgtagctttgtcat

SEQ ID NO: 403881 - DNA, 20 bp, Artificial Sequence
  chemically synthesized
ttcatccaaagctcatgaca

SEQ ID NO: 403882 - DNA, 20 bp, Artificial Sequence
  chemically synthesized
tgtagctttgtcatgagctt

SEQ ID NO: 403883 - DNA, 20 bp, Artificial Sequence
  chemically synthesized
caagtgggaacattcatcca

SEQ ID NO: 403884 - DNA, 20 bp, Artificial Sequence
  chemically synthesized
gttagagccagggttcaagt

SEQ ID NO: 403885 - DNA, 20 bp, Artificial Sequence
  chemically synthesized
tgttagagccagggttcaag

SEQ ID NO: 403886 - DNA, 20 bp, Artificial Sequence
  chemically synthesized
gaatgttcccacttgaaccc

SEQ ID NO: 403887 - DNA, 20 bp, Artificial Sequence
  chemically synthesized
tagtgttagagccagggttc

SEQ ID NO: 403888 - DNA, 20 bp, Artificial Sequence
  chemically synthesized
gcaagttagtgttagagcca

SEQ ID NO: 403889 - DNA, 20 bp, Artificial Sequence
  chemically synthesized
agcaagttagtgttagagcc

SEQ ID NO: 403890 - DNA, 20 bp, Artificial Sequence
  chemically synthesized
gagcaagttagtgttagagc

SEQ ID NO: 403891 - DNA, 20 bp, Artificial Sequence
  chemically synthesized
catagagcaagttagtgtta

SEQ ID NO: 403892 - DNA, 20 bp, Artificial Sequence
  chemically synthesized
cccatagagcaagttagtgt

SEQ ID NO: 403893 - DNA, 20 bp, Artificial Sequence
  chemically synthesized
cagaagcccatagagcaagt

SEQ ID NO: 403894 - DNA, 20 bp, Artificial Sequence
  chemically synthesized
tctaacactaacttgctcta

SEQ ID NO: 403895 - DNA, 20 bp, Artificial Sequence
  chemically synthesized
ctaacactaacttgctctat

SEQ ID NO: 403896 - DNA, 20 bp, Artificial Sequence
  chemically synthesized
ttaacagaagcccatagagc

SEQ ID NO: 403897 - DNA, 20 bp, Artificial Sequence
  chemically synthesized
atgattaacagaagcccata

SEQ ID NO: 403898 - DNA, 20 bp, Artificial Sequence
  chemically synthesized
aaatgattaacagaagccca

SEQ ID NO: 403899 - DNA, 20 bp, Artificial Sequence
  chemically synthesized
cataattaaatgattaacag

SEQ ID NO: 403900 - DNA, 20 bp, Artificial Sequence
  chemically synthesized
ccacataattaaatgattaa

SEQ ID NO: 403901 - DNA, 20 bp, Artificial Sequence
  chemically synthesized
ctgttaatcatttaattatg

SEQ ID NO: 403902 - DNA, 20 bp, Artificial Sequence
  chemically synthesized
aattctatgttttaaagttg

SEQ ID NO: 403903 - DNA, 20 bp, Artificial Sequence
  chemically synthesized
aaattctatgttttaaagtt

SEQ ID NO: 403904 - DNA, 20 bp, Artificial Sequence
  chemically synthesized
atttcctcaactttaaaaca

SEQ ID NO: 403905 - DNA, 20 bp, Artificial Sequence
  chemically synthesized
tttccaaattctatgtttta

SEQ ID NO: 403906 - DNA, 20 bp, Artificial Sequence
  chemically synthesized
caactttaaaacatagaatt

SEQ ID NO: 403907 - DNA, 20 bp, Artificial Sequence
  chemically synthesized
ttaaaacatagaatttggaa

SEQ ID NO: 403908 - DNA, 20 bp, Artificial Sequence
  chemically synthesized
tttagaactggcggaacaca

SEQ ID NO: 403909 - DNA, 20 bp, Artificial Sequence
  chemically synthesized
ataatttctatgtgttccgc

SEQ ID NO: 403910 - DNA, 20 bp, Artificial Sequence
  chemically synthesized
tgatagagttttagaactgg

SEQ ID NO: 403911 - DNA, 20 bp, Artificial Sequence
  chemically synthesized
agatgatagagttttagaac

SEQ ID NO: 403912 - DNA, 20 bp, Artificial Sequence
  chemically synthesized
agaagcagatgatagagttt

SEQ ID NO: 403913 - DNA, 20 bp, Artificial Sequence
  chemically synthesized
gaataaagaagcagatgata

SEQ ID NO: 403914 - DNA, 20 bp, Artificial Sequence
  chemically synthesized
tagaataaagaagcagatga

SEQ ID NO: 403915 - DNA, 20 bp, Artificial Sequence
  chemically synthesized
aaaaacctagaataaagaag

SEQ ID NO: 403916 - DNA, 20 bp, Artificial Sequence
  chemically synthesized
aacaaaaacctagaataaag

SEQ ID NO: 403917 - DNA, 20 bp, Artificial Sequence
  chemically synthesized
tatcatctgcttctttattc

SEQ ID NO: 403918 - DNA, 20 bp, Artificial Sequence
  chemically synthesized
atcatctgcttctttattct

SEQ ID NO: 403919 - DNA, 20 bp, Artificial Sequence
  chemically synthesized
acaaacaaaaacctagaata

SEQ ID NO: 403920 - DNA, 20 bp, Artificial Sequence
  chemically synthesized
caaataaacaaacaaaaacc

SEQ ID NO: 403921 - DNA, 20 bp, Artificial Sequence
  chemically synthesized
tgtttgtttatttgtttctg

SEQ ID NO: 403922 - DNA, 20 bp, Artificial Sequence
  chemically synthesized
gtttgtttatttgtttctgc

SEQ ID NO: 403923 - DNA, 20 bp, Artificial Sequence
  chemically synthesized
ttatttgtttctgcaggatg

SEQ ID NO: 403924 - DNA, 20 bp, Artificial Sequence
  chemically synthesized
ggactgtaaactgcatcctg

SEQ ID NO: 403925 - DNA, 20 bp, Artificial Sequence
  chemically synthesized
tttctgcaggatgcagttta

SEQ ID NO: 403926 - DNA, 20 bp, Artificial Sequence
  chemically synthesized
atgcagtttacagtccttgt

SEQ ID NO: 403927 - DNA, 20 bp, Artificial Sequence
  chemically synthesized
gcagtttacagtccttgttg

SEQ ID NO: 403928 - DNA, 20 bp, Artificial Sequence
  chemically synthesized
ttccagagcatactccaaca

SEQ ID NO: 403929 - DNA, 20 bp, Artificial Sequence
  chemically synthesized
attccagagcatactccaac

SEQ ID NO: 403930 - DNA, 20 bp, Artificial Sequence
  chemically synthesized
gtccttgttggagtatgctc

SEQ ID NO: 403931 - DNA, 20 bp, Artificial Sequence
  chemically synthesized
atccaggccgtatgattcca

SEQ ID NO: 403932 - DNA, 20 bp, Artificial Sequence
  chemically synthesized
aaatccaggccgtatgattc

SEQ ID NO: 403933 - DNA, 20 bp, Artificial Sequence
  chemically synthesized
gagtatgctctggaatcata

SEQ ID NO: 403934 - DNA, 20 bp, Artificial Sequence
  chemically synthesized
tgctctggaatcatacggcc

SEQ ID NO: 403935 - DNA, 20 bp, Artificial Sequence
  chemically synthesized
aatcatacggcctggattta

SEQ ID NO: 403936 - DNA, 20 bp, Artificial Sequence
  chemically synthesized
caaaactggactttaaatcc

SEQ ID NO: 403937 - DNA, 20 bp, Artificial Sequence
  chemically synthesized
gcaaaactggactttaaatc

SEQ ID NO: 403938 - DNA, 20 bp, Artificial Sequence
  chemically synthesized
tacggcctggatttaaagtc

SEQ ID NO: 403939 - DNA, 20 bp, Artificial Sequence
  chemically synthesized
cagccagtaagcggcaaaac

SEQ ID NO: 403940 - DNA, 20 bp, Artificial Sequence
  chemically synthesized
agtccagttttgccgcttac

SEQ ID NO: 403941 - DNA, 20 bp, Artificial Sequence
  chemically synthesized
gagaaaactcagccagtaag

SEQ ID NO: 403942 - DNA, 20 bp, Artificial Sequence
  chemically synthesized
agttttgccgcttactggct

SEQ ID NO: 403943 - DNA, 20 bp, Artificial Sequence
  chemically synthesized
attgagaaaactcagccagt

SEQ ID NO: 403944 - DNA, 20 bp, Artificial Sequence
  chemically synthesized
ataaattgagaaaactcagc

SEQ ID NO: 403945 - DNA, 20 bp, Artificial Sequence
  chemically synthesized
gtaaataaattgagaaaact

SEQ ID NO: 403946 - DNA, 20 bp, Artificial Sequence
  chemically synthesized
aaaagttatgtaaataaatt

SEQ ID NO: 403947 - DNA, 20 bp, Artificial Sequence
  chemically synthesized
gagaaaactaaaggaaagaa

SEQ ID NO: 403948 - DNA, 20 bp, Artificial Sequence
  chemically synthesized
tacataacttttctttcctt

SEQ ID NO: 403949 - DNA, 20 bp, Artificial Sequence
  chemically synthesized
cagatgagaaaactaaagga

SEQ ID NO: 403950 - DNA, 20 bp, Artificial Sequence
  chemically synthesized
tttacagatgagaaaactaa

SEQ ID NO: 403951 - DNA, 20 bp, Artificial Sequence
  chemically synthesized
ttttacagatgagaaaacta

SEQ ID NO: 403952 - DNA, 20 bp, Artificial Sequence
  chemically synthesized
ttagtacctattttacagat

SEQ ID NO: 403953 - DNA, 20 bp, Artificial Sequence
  chemically synthesized
tagttttctcatctgtaaaa

SEQ ID NO: 403954 - DNA, 20 bp, Artificial Sequence
  chemically synthesized
agttttctcatctgtaaaat

SEQ ID NO: 403955 - DNA, 20 bp, Artificial Sequence
  chemically synthesized
ttattttagtacctatttta

SEQ ID NO: 403956 - DNA, 20 bp, Artificial Sequence
  chemically synthesized
ctatgagatagttattattt

SEQ ID NO: 403957 - DNA, 20 bp, Artificial Sequence
  chemically synthesized
ctaaaataataactatctca

SEQ ID NO: 403958 - DNA, 20 bp, Artificial Sequence
  chemically synthesized
ctcacaacgacactatgaga

SEQ ID NO: 403959 - DNA, 20 bp, Artificial Sequence
  chemically synthesized
agtcctcacaacgacactat

SEQ ID NO: 403960 - DNA, 20 bp, Artificial Sequence
  chemically synthesized
ctatctcatagtgtcgttgt

SEQ ID NO: 403961 - DNA, 20 bp, Artificial Sequence
  chemically synthesized
tatctcatagtgtcgttgtg

SEQ ID NO: 403962 - DNA, 20 bp, Artificial Sequence
  chemically synthesized
tgtcgttgtgaggactaaat

SEQ ID NO: 403963 - DNA, 20 bp, Artificial Sequence
  chemically synthesized
tataaagataatggcttatt

SEQ ID NO: 403964 - DNA, 20 bp, Artificial Sequence
  chemically synthesized
tctatgccatataaagataa

SEQ ID NO: 403965 - DNA, 20 bp, Artificial Sequence
  chemically synthesized
aataagccattatctttata

SEQ ID NO: 403966 - DNA, 20 bp, Artificial Sequence
  chemically synthesized
gacactttctatgccatata

SEQ ID NO: 403967 - DNA, 20 bp, Artificial Sequence
  chemically synthesized
gccattatctttatatggca

SEQ ID NO: 403968 - DNA, 20 bp, Artificial Sequence
  chemically synthesized
ttatctttatatggcataga

SEQ ID NO: 403969 - DNA, 20 bp, Artificial Sequence
  chemically synthesized
tatatggcatagaaagtgtc

SEQ ID NO: 403970 - DNA, 20 bp, Artificial Sequence
  chemically synthesized
gttgattactcatttggggc

SEQ ID NO: 403971 - DNA, 20 bp, Artificial Sequence
  chemically synthesized
gaaagtgtctggccccaaat

SEQ ID NO: 403972 - DNA, 20 bp, Artificial Sequence
  chemically synthesized
caatgttgattactcatttg

SEQ ID NO: 403973 - DNA, 20 bp, Artificial Sequence
  chemically synthesized
acaatgttgattactcattt

SEQ ID NO: 403974 - DNA, 20 bp, Artificial Sequence
  chemically synthesized
aacaatgttgattactcatt

SEQ ID NO: 403975 - DNA, 20 bp, Artificial Sequence
  chemically synthesized
aagcccatagatttcaggat

SEQ ID NO: 403976 - DNA, 20 bp, Artificial Sequence
  chemically synthesized
aaagcccatagatttcagga

SEQ ID NO: 403977 - DNA, 20 bp, Artificial Sequence
  chemically synthesized
attgaaagcccatagatttc

SEQ ID NO: 403978 - DNA, 20 bp, Artificial Sequence
  chemically synthesized
tattcctatcctgaaatcta

SEQ ID NO: 403979 - DNA, 20 bp, Artificial Sequence
  chemically synthesized
tattgaaagcccatagattt

SEQ ID NO: 403980 - DNA, 20 bp, Artificial Sequence
  chemically synthesized
attcctatcctgaaatctat

SEQ ID NO: 403981 - DNA, 20 bp, Artificial Sequence
  chemically synthesized
atagtcgtattgaaagccca

SEQ ID NO: 403982 - DNA, 20 bp, Artificial Sequence
  chemically synthesized
ttattccatagtcgtattga

SEQ ID NO: 403983 - DNA, 20 bp, Artificial Sequence
  chemically synthesized
atgggctttcaatacgacta

SEQ ID NO: 403984 - DNA, 20 bp, Artificial Sequence
  chemically synthesized
aattttaggggtttattcca

SEQ ID NO: 403985 - DNA, 20 bp, Artificial Sequence
  chemically synthesized
aattttgcccacaattttag

SEQ ID NO: 403986 - DNA, 20 bp, Artificial Sequence
  chemically synthesized
aaattttgcccacaatttta

SEQ ID NO: 403987 - DNA, 20 bp, Artificial Sequence
  chemically synthesized
ggaataaacccctaaaattg

SEQ ID NO: 403988 - DNA, 20 bp, Artificial Sequence
  chemically synthesized
aaaattttgcccacaatttt

SEQ ID NO: 403989 - DNA, 20 bp, Artificial Sequence
  chemically synthesized
gaataaacccctaaaattgt

SEQ ID NO: 403990 - DNA, 20 bp, Artificial Sequence
  chemically synthesized
taaaattttgcccacaattt

SEQ ID NO: 403991 - DNA, 20 bp, Artificial Sequence
  chemically synthesized
aattgtgggcaaaattttat

SEQ ID NO: 403992 - DNA, 20 bp, Artificial Sequence
  chemically synthesized
ttttatgagtgtgtatatat

SEQ ID NO: 403993 - DNA, 20 bp, Artificial Sequence
  chemically synthesized
ttatgagtgtgtatatatga

SEQ ID NO: 403994 - DNA, 20 bp, Artificial Sequence
  chemically synthesized
tgtgtatatatgagagtcca

SEQ ID NO: 403995 - DNA, 20 bp, Artificial Sequence
  chemically synthesized
atatgagagtccacagtcat

SEQ ID NO: 403996 - DNA, 20 bp, Artificial Sequence
  chemically synthesized
ttagaatctgctgatgactg

SEQ ID NO: 403997 - DNA, 20 bp, Artificial Sequence
  chemically synthesized
tgagagtccacagtcatcag

SEQ ID NO: 403998 - DNA, 20 bp, Artificial Sequence
  chemically synthesized
cagtcatcagcagattctaa

SEQ ID NO: 403999 - DNA, 20 bp, Artificial Sequence
  chemically synthesized
agtcatcagcagattctaaa

SEQ ID NO: 404000 - DNA, 20 bp, Artificial Sequence
  chemically synthesized
gtcatcagcagattctaaaa

SEQ ID NO: 404001 - DNA, 20 bp, Artificial Sequence
  chemically synthesized
ttcaaaccatggagcccttt

SEQ ID NO: 404002 - DNA, 20 bp, Artificial Sequence
  chemically synthesized
cagattctaaaagggctcca

SEQ ID NO: 404003 - DNA, 20 bp, Artificial Sequence
  chemically synthesized
ccaacatttttcaaaccatg

SEQ ID NO: 404004 - DNA, 20 bp, Artificial Sequence
  chemically synthesized
atccaacatttttcaaacca

SEQ ID NO: 404005 - DNA, 20 bp, Artificial Sequence
  chemically synthesized
ctccatggtttgaaaaatgt

SEQ ID NO: 404006 - DNA, 20 bp, Artificial Sequence
  chemically synthesized
aaaatgttggatgaaaaata

SEQ ID NO: 404007 - DNA, 20 bp, Artificial Sequence
  chemically synthesized
gaaaaatatagacattattc

SEQ ID NO: 404008 - DNA, 20 bp, Artificial Sequence
  chemically synthesized
agacattattctggctctta

SEQ ID NO: 404009 - DNA, 20 bp, Artificial Sequence
  chemically synthesized
tcattaatatccataagagc

SEQ ID NO: 404010 - DNA, 20 bp, Artificial Sequence
  chemically synthesized
gagatcattaatatccataa

SEQ ID NO: 404011 - DNA, 20 bp, Artificial Sequence
  chemically synthesized
cagagatcattaatatccat

SEQ ID NO: 404012 - DNA, 20 bp, Artificial Sequence
  chemically synthesized
ttccagaaaaaagtaaaaca

SEQ ID NO: 404013 - DNA, 20 bp, Artificial Sequence
  chemically synthesized
tgttccagaaaaaagtaaaa

SEQ ID NO: 404014 - DNA, 20 bp, Artificial Sequence
  chemically synthesized
atctctgttttacttttttc

SEQ ID NO: 404015 - DNA, 20 bp, Artificial Sequence
  chemically synthesized
aatgccactgttccagaaaa

SEQ ID NO: 404016 - DNA, 20 bp, Artificial Sequence
  chemically synthesized
tgttttacttttttctggaa

SEQ ID NO: 404017 - DNA, 20 bp, Artificial Sequence
  chemically synthesized
tttacttttttctggaacag

SEQ ID NO: 404018 - DNA, 20 bp, Artificial Sequence
  chemically synthesized
tgctgttaatgccactgttc

SEQ ID NO: 404019 - DNA, 20 bp, Artificial Sequence
  chemically synthesized
ttctggaacagtggcattaa

SEQ ID NO: 404020 - DNA, 20 bp, Artificial Sequence
  chemically synthesized
aacagtggcattaacagcaa

SEQ ID NO: 404021 - DNA, 20 bp, Artificial Sequence
  chemically synthesized
taaagaaaaataataaaaac

SEQ ID NO: 404022 - DNA, 20 bp, Artificial Sequence
  chemically synthesized
gtaaagaaaaataataaaaa

SEQ ID NO: 404023 - DNA, 20 bp, Artificial Sequence
  chemically synthesized
atgtaaaaaaaagcaaagta

SEQ ID NO: 404024 - DNA, 20 bp, Artificial Sequence
  chemically synthesized
taaacatgtaaaaaaaagca

SEQ ID NO: 404025 - DNA, 20 bp, Artificial Sequence
  chemically synthesized
ttaaataaacatgtaaaaaa

SEQ ID NO: 404026 - DNA, 20 bp, Artificial Sequence
  chemically synthesized
ttttttttacatgtttattt

SEQ ID NO: 404027 - DNA, 20 bp, Artificial Sequence
  chemically synthesized
ttttttacatgtttatttaa

SEQ ID NO: 404028 - DNA, 20 bp, Artificial Sequence
  chemically synthesized
atggtgacagagatgaagag

SEQ ID NO: 404029 - DNA, 20 bp, Artificial Sequence
  chemically synthesized
acaatggtgacagagatgaa

SEQ ID NO: 404030 - DNA, 20 bp, Artificial Sequence
  chemically synthesized
gtacaatggtgacagagatg

SEQ ID NO: 404031 - DNA, 20 bp, Artificial Sequence
  chemically synthesized
agaatggtacaatggtgaca

SEQ ID NO: 404032 - DNA, 20 bp, Artificial Sequence
  chemically synthesized
aaagaatggtacaatggtga

SEQ ID NO: 404033 - DNA, 20 bp, Artificial Sequence
  chemically synthesized
ccataaaaagaatggtacaa

SEQ ID NO: 404034 - DNA, 20 bp, Artificial Sequence
  chemically synthesized
gtgtatatccataaaaagaa

SEQ ID NO: 404035 - DNA, 20 bp, Artificial Sequence
  chemically synthesized
ccattgtaccattcttttta

SEQ ID NO: 404036 - DNA, 20 bp, Artificial Sequence
  chemically synthesized
actgtgtgtatatccataaa

SEQ ID NO: 404037 - DNA, 20 bp, Artificial Sequence
  chemically synthesized
tctttttatggatatacaca

SEQ ID NO: 404038 - DNA, 20 bp, Artificial Sequence
  chemically synthesized
atggatatacacacagtaat

SEQ ID NO: 404039 - DNA, 20 bp, Artificial Sequence
  chemically synthesized
cacacagtaattggcactga

SEQ ID NO: 404040 - DNA, 20 bp, Artificial Sequence
  chemically synthesized
cacagtaattggcactgaaa

SEQ ID NO: 404041 - DNA, 20 bp, Artificial Sequence
  chemically synthesized
acagtaattggcactgaaag

SEQ ID NO: 404042 - DNA, 20 bp, Artificial Sequence
  chemically synthesized
gtatataattatacctcttt

SEQ ID NO: 404043 - DNA, 20 bp, Artificial Sequence
  chemically synthesized
aggtataattatatacactg

SEQ ID NO: 404044 - DNA, 20 bp, Artificial Sequence
  chemically synthesized
ggctttctctggcatagctg

SEQ ID NO: 404045 - DNA, 20 bp, Artificial Sequence
  chemically synthesized
tatatacactgcagctatgc

SEQ ID NO: 404046 - DNA, 20 bp, Artificial Sequence
  chemically synthesized
tatacactgcagctatgcca

SEQ ID NO: 404047 - DNA, 20 bp, Artificial Sequence
  chemically synthesized
agccctggctttctctggca

SEQ ID NO: 404048 - DNA, 20 bp, Artificial Sequence
  chemically synthesized
cactgcagctatgccagaga

SEQ ID NO: 404049 - DNA, 20 bp, Artificial Sequence
  chemically synthesized
taaggagccctggctttctc

SEQ ID NO: 404050 - DNA, 20 bp, Artificial Sequence
  chemically synthesized
gcagctatgccagagaaagc

SEQ ID NO: 404051 - DNA, 20 bp, Artificial Sequence
  chemically synthesized
cagctatgccagagaaagcc

SEQ ID NO: 404052 - DNA, 20 bp, Artificial Sequence
  chemically synthesized
agctatgccagagaaagcca

SEQ ID NO: 404053 - DNA, 20 bp, Artificial Sequence
  chemically synthesized
ctaggccagataaggagccc

SEQ ID NO: 404054 - DNA, 20 bp, Artificial Sequence
  chemically synthesized
gaaagccagggctccttatc

SEQ ID NO: 404055 - DNA, 20 bp, Artificial Sequence
  chemically synthesized
tattccctaggccagataag

SEQ ID NO: 404056 - DNA, 20 bp, Artificial Sequence
  chemically synthesized
tttattccctaggccagata

SEQ ID NO: 404057 - DNA, 20 bp, Artificial Sequence
  chemically synthesized
atttattccctaggccagat

SEQ ID NO: 404058 - DNA, 20 bp, Artificial Sequence
  chemically synthesized
ccagggctccttatctggcc

SEQ ID NO: 404059 - DNA, 20 bp, Artificial Sequence
  chemically synthesized
cagggctccttatctggcct

SEQ ID NO: 404060 - DNA, 20 bp, Artificial Sequence
  chemically synthesized
agggctccttatctggccta

SEQ ID NO: 404061 - DNA, 20 bp, Artificial Sequence
  chemically synthesized
ccattatttattccctaggc

SEQ ID NO: 404062 - DNA, 20 bp, Artificial Sequence
  chemically synthesized
aaacccattatttattccct

SEQ ID NO: 404063 - DNA, 20 bp, Artificial Sequence
  chemically synthesized
aaaacccattatttattccc

SEQ ID NO: 404064 - DNA, 20 bp, Artificial Sequence
  chemically synthesized
ctggcctagggaataaataa

SEQ ID NO: 404065 - DNA, 20 bp, Artificial Sequence
  chemically synthesized
tggcctagggaataaataat

SEQ ID NO: 404066 - DNA, 20 bp, Artificial Sequence
  chemically synthesized
gtaatatctaagagaatatg

SEQ ID NO: 404067 - DNA, 20 bp, Artificial Sequence
  chemically synthesized
gggttttcttcatattctct

SEQ ID NO: 404068 - DNA, 20 bp, Artificial Sequence
  chemically synthesized
ggctgaagagtaatatctaa

SEQ ID NO: 404069 - DNA, 20 bp, Artificial Sequence
  chemically synthesized
gtggctgaagagtaatatct

SEQ ID NO: 404070 - DNA, 20 bp, Artificial Sequence
  chemically synthesized
ttctcttagatattactctt

SEQ ID NO: 404071 - DNA, 20 bp, Artificial Sequence
  chemically synthesized
cccaatcctaggtggctgaa

SEQ ID NO: 404072 - DNA, 20 bp, Artificial Sequence
  chemically synthesized
tgcccaatcctaggtggctg

SEQ ID NO: 404073 - DNA, 20 bp, Artificial Sequence
  chemically synthesized
gatattactcttcagccacc

SEQ ID NO: 404074 - DNA, 20 bp, Artificial Sequence
  chemically synthesized
atattactcttcagccacct

SEQ ID NO: 404075 - DNA, 20 bp, Artificial Sequence
  chemically synthesized
aaatagtgcccaatcctagg

SEQ ID NO: 404076 - DNA, 20 bp, Artificial Sequence
  chemically synthesized
actcttcagccacctaggat

SEQ ID NO: 404077 - DNA, 20 bp, Artificial Sequence
  chemically synthesized
ctcttcagccacctaggatt

SEQ ID NO: 404078 - DNA, 20 bp, Artificial Sequence
  chemically synthesized
aaaaaatagtgcccaatcct

SEQ ID NO: 404079 - DNA, 20 bp, Artificial Sequence
  chemically synthesized
aaaaaaatagtgcccaatcc

SEQ ID NO: 404080 - DNA, 20 bp, Artificial Sequence
  chemically synthesized
aactaacaacaacaaaaaaa

SEQ ID NO: 404081 - DNA, 20 bp, Artificial Sequence
  chemically synthesized
cactatttttttgttgttgt

SEQ ID NO: 404082 - DNA, 20 bp, Artificial Sequence
  chemically synthesized
atctgtgtatatggaagcac

SEQ ID NO: 404083 - DNA, 20 bp, Artificial Sequence
  chemically synthesized
aactgcatctgtgtatatgg

SEQ ID NO: 404084 - DNA, 20 bp, Artificial Sequence
  chemically synthesized
ttcttgtgcttccatataca

SEQ ID NO: 404085 - DNA, 20 bp, Artificial Sequence
  chemically synthesized
agaaactgcatctgtgtata

SEQ ID NO: 404086 - DNA, 20 bp, Artificial Sequence
  chemically synthesized
tgcttccatatacacagatg

SEQ ID NO: 404087 - DNA, 20 bp, Artificial Sequence
  chemically synthesized
attgcaatataatgggtgac

SEQ ID NO: 404088 - DNA, 20 bp, Artificial Sequence
  chemically synthesized
aaagggcattgcaatataat

SEQ ID NO: 404089 - DNA, 20 bp, Artificial Sequence
  chemically synthesized
gaaagggcattgcaatataa

SEQ ID NO: 404090 - DNA, 20 bp, Artificial Sequence
  chemically synthesized
ggctgggctcttttcagaaa

SEQ ID NO: 404091 - DNA, 20 bp, Artificial Sequence
  chemically synthesized
attgcaatgccctttctgaa

SEQ ID NO: 404092 - DNA, 20 bp, Artificial Sequence
  chemically synthesized
aggctgggctcttttcagaa

SEQ ID NO: 404093 - DNA, 20 bp, Artificial Sequence
  chemically synthesized
aaggctgggctcttttcaga

SEQ ID NO: 404094 - DNA, 20 bp, Artificial Sequence
  chemically synthesized
tgcaatgccctttctgaaaa

SEQ ID NO: 404095 - DNA, 20 bp, Artificial Sequence
  chemically synthesized
gaaaaaggctgggctctttt

SEQ ID NO: 404096 - DNA, 20 bp, Artificial Sequence
  chemically synthesized
tgccctttctgaaaagagcc

SEQ ID NO: 404097 - DNA, 20 bp, Artificial Sequence
  chemically synthesized
gtacattacagaaaaaggct

SEQ ID NO: 404098 - DNA, 20 bp, Artificial Sequence
  chemically synthesized
agtacattacagaaaaaggc

SEQ ID NO: 404099 - DNA, 20 bp, Artificial Sequence
  chemically synthesized
tcaaagtacattacagaaaa

SEQ ID NO: 404100 - DNA, 20 bp, Artificial Sequence
  chemically synthesized
gtcaaagtacattacagaaa

SEQ ID NO: 404101 - DNA, 20 bp, Artificial Sequence
  chemically synthesized
cttactgtcaaagtacatta

SEQ ID NO: 404102 - DNA, 20 bp, Artificial Sequence
  chemically synthesized
ttttctgtaatgtactttga

SEQ ID NO: 404103 - DNA, 20 bp, Artificial Sequence
  chemically synthesized
ctgtaatgtactttgacagt

SEQ ID NO: 404104 - DNA, 20 bp, Artificial Sequence
  chemically synthesized
tatgtcaatacttactgtca

SEQ ID NO: 404105 - DNA, 20 bp, Artificial Sequence
  chemically synthesized
agtattgacataatgtaata

SEQ ID NO: 404106 - DNA, 20 bp, Artificial Sequence
  chemically synthesized
acataatgtaatacagtaat

SEQ ID NO: 404107 - DNA, 20 bp, Artificial Sequence
  chemically synthesized
gtaatacagtaattggaact

SEQ ID NO: 404108 - DNA, 20 bp, Artificial Sequence
  chemically synthesized
tacagtaattggaactcaga

SEQ ID NO: 404109 - DNA, 20 bp, Artificial Sequence
  chemically synthesized
ggtagcaaacaaatctttct

SEQ ID NO: 404110 - DNA, 20 bp, Artificial Sequence
  chemically synthesized
aaatatcttaagcagtcagg

SEQ ID NO: 404111 - DNA, 20 bp, Artificial Sequence
  chemically synthesized
ttaaaatatcttaagcagtc

SEQ ID NO: 404112 - DNA, 20 bp, Artificial Sequence
  chemically synthesized
tgtttgctacctgactgctt

SEQ ID NO: 404113 - DNA, 20 bp, Artificial Sequence
  chemically synthesized
attaaaatatcttaagcagt

SEQ ID NO: 404114 - DNA, 20 bp, Artificial Sequence
  chemically synthesized
aggcattaaaatatcttaag

SEQ ID NO: 404115 - DNA, 20 bp, Artificial Sequence
  chemically synthesized
ttaaggcattaaaatatctt

SEQ ID NO: 404116 - DNA, 20 bp, Artificial Sequence
  chemically synthesized
agatattttaatgccttaat

SEQ ID NO: 404117 - DNA, 20 bp, Artificial Sequence
  chemically synthesized
taaaaatatgtgtccgatta

SEQ ID NO: 404118 - DNA, 20 bp, Artificial Sequence
  chemically synthesized
ttaaaaatatgtgtccgatt

SEQ ID NO: 404119 - DNA, 20 bp, Artificial Sequence
  chemically synthesized
ttttaatgcacatttttctt

SEQ ID NO: 404120 - DNA, 20 bp, Artificial Sequence
  chemically synthesized
aatgcacatttttctttagt

SEQ ID NO: 404121 - DNA, 20 bp, Artificial Sequence
  chemically synthesized
tgcacatttttctttagtta

SEQ ID NO: 404122 - DNA, 20 bp, Artificial Sequence
  chemically synthesized
gacatgggctgctctaacta

SEQ ID NO: 404123 - DNA, 20 bp, Artificial Sequence
  chemically synthesized
acatttttctttagttagag

SEQ ID NO: 404124 - DNA, 20 bp, Artificial Sequence
  chemically synthesized
gagtggttccttcatgacat

SEQ ID NO: 404125 - DNA, 20 bp, Artificial Sequence
  chemically synthesized
ttagagcagcccatgtcatg

SEQ ID NO: 404126 - DNA, 20 bp, Artificial Sequence
  chemically synthesized
tgagtggttccttcatgaca

SEQ ID NO: 404127 - DNA, 20 bp, Artificial Sequence
  chemically synthesized
tagagcagcccatgtcatga

SEQ ID NO: 404128 - DNA, 20 bp, Artificial Sequence
  chemically synthesized
ccatcaattccacatttgag

SEQ ID NO: 404129 - DNA, 20 bp, Artificial Sequence
  chemically synthesized
atgaaggaaccactcaaatg

SEQ ID NO: 404130 - DNA, 20 bp, Artificial Sequence
  chemically synthesized
aaaccatcaattccacattt

SEQ ID NO: 404131 - DNA, 20 bp, Artificial Sequence
  chemically synthesized
ccactcaaatgtggaattga

SEQ ID NO: 404132 - DNA, 20 bp, Artificial Sequence
  chemically synthesized
tgtggaattgatggttttca

SEQ ID NO: 404133 - DNA, 20 bp, Artificial Sequence
  chemically synthesized
gtggaattgatggttttcac

SEQ ID NO: 404134 - DNA, 20 bp, Artificial Sequence
  chemically synthesized
taaaaaacatcatgccatac

SEQ ID NO: 404135 - DNA, 20 bp, Artificial Sequence
  chemically synthesized
ggagtgatttgtttcttgta

SEQ ID NO: 404136 - DNA, 20 bp, Artificial Sequence
  chemically synthesized
cactgtatctatgcagaaag

SEQ ID NO: 404137 - DNA, 20 bp, Artificial Sequence
  chemically synthesized
acaaatcactcctttctgca

SEQ ID NO: 404138 - DNA, 20 bp, Artificial Sequence
  chemically synthesized
ttcactgtatctatgcagaa

SEQ ID NO: 404139 - DNA, 20 bp, Artificial Sequence
  chemically synthesized
attcactgtatctatgcaga

SEQ ID NO: 404140 - DNA, 20 bp, Artificial Sequence
  chemically synthesized
gtgaattcactgtatctatg

SEQ ID NO: 404141 - DNA, 20 bp, Artificial Sequence
  chemically synthesized
cactcctttctgcatagata

SEQ ID NO: 404142 - DNA, 20 bp, Artificial Sequence
  chemically synthesized
gcatagatacagtgaattca

SEQ ID NO: 404143 - DNA, 20 bp, Artificial Sequence
  chemically synthesized
gatacagtgaattcacagct

SEQ ID NO: 404144 - DNA, 20 bp, Artificial Sequence
  chemically synthesized
tgaattcacagcttggaaac

SEQ ID NO: 404145 - DNA, 20 bp, Artificial Sequence
  chemically synthesized
ctttgaaaatactggtttcc

SEQ ID NO: 404146 - DNA, 20 bp, Artificial Sequence
  chemically synthesized
ataccacgctttgaaaatac

SEQ ID NO: 404147 - DNA, 20 bp, Artificial Sequence
  chemically synthesized
cttggaaaccagtattttca

SEQ ID NO: 404148 - DNA, 20 bp, Artificial Sequence
  chemically synthesized
aaaccagtattttcaaagcg

SEQ ID NO: 404149 - DNA, 20 bp, Artificial Sequence
  chemically synthesized
attttcaaagcgtggtatga

SEQ ID NO: 404150 - DNA, 20 bp, Artificial Sequence
  chemically synthesized
agcgtggtatgaaagtgtct

SEQ ID NO: 404151 - DNA, 20 bp, Artificial Sequence
  chemically synthesized
ctctgctgagagtttattct

SEQ ID NO: 404152 - DNA, 20 bp, Artificial Sequence
  chemically synthesized
agtgtctgagaataaactct

SEQ ID NO: 404153 - DNA, 20 bp, Artificial Sequence
  chemically synthesized
gtctgagaataaactctcag

SEQ ID NO: 404154 - DNA, 20 bp, Artificial Sequence
  chemically synthesized
ctgagaataaactctcagca

SEQ ID NO: 404155 - DNA, 20 bp, Artificial Sequence
  chemically synthesized
tttctactgatctctgctga

SEQ ID NO: 404156 - DNA, 20 bp, Artificial Sequence
  chemically synthesized
tatttctactgatctctgct

SEQ ID NO: 404157 - DNA, 20 bp, Artificial Sequence
  chemically synthesized
aataaactctcagcagagat

SEQ ID NO: 404158 - DNA, 20 bp, Artificial Sequence
  chemically synthesized
aaactctcagcagagatcag

SEQ ID NO: 404159 - DNA, 20 bp, Artificial Sequence
  chemically synthesized
cagagatcagtagaaataac

SEQ ID NO: 404160 - DNA, 20 bp, Artificial Sequence
  chemically synthesized
gttcctcttttagcggttac

SEQ ID NO: 404161 - DNA, 20 bp, Artificial Sequence
  chemically synthesized
aaataaccagtaaccgctaa

SEQ ID NO: 404162 - DNA, 20 bp, Artificial Sequence
  chemically synthesized
ataaccagtaaccgctaaaa

SEQ ID NO: 404163 - DNA, 20 bp, Artificial Sequence
  chemically synthesized
taaccagtaaccgctaaaag

SEQ ID NO: 404164 - DNA, 20 bp, Artificial Sequence
  chemically synthesized
caataatgttcctcttttag

SEQ ID NO: 404165 - DNA, 20 bp, Artificial Sequence
  chemically synthesized
aatcaataatgttcctcttt

SEQ ID NO: 404166 - DNA, 20 bp, Artificial Sequence
  chemically synthesized
aaaagaggaacattattgat

SEQ ID NO: 404167 - DNA, 20 bp, Artificial Sequence
  chemically synthesized
aggaacattattgattggca

SEQ ID NO: 404168 - DNA, 20 bp, Artificial Sequence
  chemically synthesized
attggcaaagtaatccaaaa

SEQ ID NO: 404169 - DNA, 20 bp, Artificial Sequence
  chemically synthesized
tggcaaagtaatccaaaaaa

SEQ ID NO: 404170 - DNA, 20 bp, Artificial Sequence
  chemically synthesized
cacacatcttttctcttttt

SEQ ID NO: 404171 - DNA, 20 bp, Artificial Sequence
  chemically synthesized
aagtaatccaaaaaagagaa

SEQ ID NO: 404172 - DNA, 20 bp, Artificial Sequence
  chemically synthesized
acttgtctaaatttagtatt

SEQ ID NO: 404173 - DNA, 20 bp, Artificial Sequence
  chemically synthesized
tgtgaacttaatactaaatt

SEQ ID NO: 404174 - DNA, 20 bp, Artificial Sequence
  chemically synthesized
aatgaatacttgtctaaatt

SEQ ID NO: 404175 - DNA, 20 bp, Artificial Sequence
  chemically synthesized
acttaatactaaatttagac

SEQ ID NO: 404176 - DNA, 20 bp, Artificial Sequence
  chemically synthesized
ttagacaagtattcattgat

SEQ ID NO: 404177 - DNA, 20 bp, Artificial Sequence
  chemically synthesized
tagacaagtattcattgatt

SEQ ID NO: 404178 - DNA, 20 bp, Artificial Sequence
  chemically synthesized
tgattaggaaatcaaaattc

SEQ ID NO: 404179 - DNA, 20 bp, Artificial Sequence
  chemically synthesized
ggaaatcaaaattcaagata

SEQ ID NO: 404180 - DNA, 20 bp, Artificial Sequence
  chemically synthesized
tcaagataaagaaacatctt

SEQ ID NO: 404181 - DNA, 20 bp, Artificial Sequence
  chemically synthesized
aagataaagaaacatcttca

SEQ ID NO: 404182 - DNA, 20 bp, Artificial Sequence
  chemically synthesized
aagactacttttaatctctg

SEQ ID NO: 404183 - DNA, 20 bp, Artificial Sequence
  chemically synthesized
gaaacatcttcagagattaa

SEQ ID NO: 404184 - DNA, 20 bp, Artificial Sequence
  chemically synthesized
acatcttcagagattaaaag

SEQ ID NO: 404185 - DNA, 20 bp, Artificial Sequence
  chemically synthesized
ctaggttactcaaacaatga

SEQ ID NO: 404186 - DNA, 20 bp, Artificial Sequence
  chemically synthesized
aaagtagtctttcattgttt

SEQ ID NO: 404187 - DNA, 20 bp, Artificial Sequence
  chemically synthesized
ctttcattgtttgagtaacc

SEQ ID NO: 404188 - DNA, 20 bp, Artificial Sequence
  chemically synthesized
attgtttgagtaacctagct

SEQ ID NO: 404189 - DNA, 20 bp, Artificial Sequence
  chemically synthesized
ttgtttgagtaacctagctg

SEQ ID NO: 404190 - DNA, 20 bp, Artificial Sequence
  chemically synthesized
gtttgagtaacctagctgag

SEQ ID NO: 404191 - DNA, 20 bp, Artificial Sequence
  chemically synthesized
tttagtttgactcctcagct

SEQ ID NO: 404192 - DNA, 20 bp, Artificial Sequence
  chemically synthesized
ttttagtttgactcctcagc

SEQ ID NO: 404193 - DNA, 20 bp, Artificial Sequence
  chemically synthesized
ttggttttagtttgactcct

SEQ ID NO: 404194 - DNA, 20 bp, Artificial Sequence
  chemically synthesized
aggagtcaaactaaaaccaa

SEQ ID NO: 404195 - DNA, 20 bp, Artificial Sequence
  chemically synthesized
taattacaatctattggttt

SEQ ID NO: 404196 - DNA, 20 bp, Artificial Sequence
  chemically synthesized
tcatactaattacaatctat

SEQ ID NO: 404197 - DNA, 20 bp, Artificial Sequence
  chemically synthesized
taaaaccaatagattgtaat

SEQ ID NO: 404198 - DNA, 20 bp, Artificial Sequence
  chemically synthesized
ttgtaattagtatgatgctt

SEQ ID NO: 404199 - DNA, 20 bp, Artificial Sequence
  chemically synthesized
tgtaattagtatgatgcttt

SEQ ID NO: 404200 - DNA, 20 bp, Artificial Sequence
  chemically synthesized
tagtatgatgctttaggata

SEQ ID NO: 404201 - DNA, 20 bp, Artificial Sequence
  chemically synthesized
ctttattcaactttatccta

SEQ ID NO: 404202 - DNA, 20 bp, Artificial Sequence
  chemically synthesized
ctttaggataaagttgaata

SEQ ID NO: 404203 - DNA, 20 bp, Artificial Sequence
  chemically synthesized
ttaggataaagttgaataaa

SEQ ID NO: 404204 - DNA, 20 bp, Artificial Sequence
  chemically synthesized
aggataaagttgaataaaga

SEQ ID NO: 404205 - DNA, 20 bp, Artificial Sequence
  chemically synthesized
taaagttgaataaagagagc

SEQ ID NO: 404206 - DNA, 20 bp, Artificial Sequence
  chemically synthesized
aagttgaataaagagagcga

SEQ ID NO: 404207 - DNA, 20 bp, Artificial Sequence
  chemically synthesized
gttgaataaagagagcgaga

SEQ ID NO: 404208 - DNA, 20 bp, Artificial Sequence
  chemically synthesized
tgaataaagagagcgagaga

SEQ ID NO: 404209 - DNA, 20 bp, Artificial Sequence
  chemically synthesized
taaagagagcgagagagaga

SEQ ID NO: 404210 - DNA, 20 bp, Artificial Sequence
  chemically synthesized
aagagagcgagagagagaca

SEQ ID NO: 404211 - DNA, 20 bp, Artificial Sequence
  chemically synthesized
gagagcgagagagagacaga

SEQ ID NO: 404212 - DNA, 20 bp, Artificial Sequence
  chemically synthesized
gcgagagagagacagagaga

SEQ ID NO: 404213 - DNA, 20 bp, Artificial Sequence
  chemically synthesized
ttggcattgtataaacatca

SEQ ID NO: 404214 - DNA, 20 bp, Artificial Sequence
  chemically synthesized
cttggcattgtataaacatc

SEQ ID NO: 404215 - DNA, 20 bp, Artificial Sequence
  chemically synthesized
ccttggcattgtataaacat

SEQ ID NO: 404216 - DNA, 20 bp, Artificial Sequence
  chemically synthesized
cctgatgtttatacaatgcc

SEQ ID NO: 404217 - DNA, 20 bp, Artificial Sequence
  chemically synthesized
ctgatgtttatacaatgcca

SEQ ID NO: 404218 - DNA, 20 bp, Artificial Sequence
  chemically synthesized
atttataaattaattgacct

SEQ ID NO: 404219 - DNA, 20 bp, Artificial Sequence
  chemically synthesized
taaattaaatttatgtttat

SEQ ID NO: 404220 - DNA, 20 bp, Artificial Sequence
  chemically synthesized
tatgtttattagccaaattt

SEQ ID NO: 404221 - DNA, 20 bp, Artificial Sequence
  chemically synthesized
tttctctagtttctaaaatt

SEQ ID NO: 404222 - DNA, 20 bp, Artificial Sequence
  chemically synthesized
attagccaaattttagaaac

SEQ ID NO: 404223 - DNA, 20 bp, Artificial Sequence
  chemically synthesized
tagccaaattttagaaacta

SEQ ID NO: 404224 - DNA, 20 bp, Artificial Sequence
  chemically synthesized
aattttagaaactagagaaa

SEQ ID NO: 404225 - DNA, 20 bp, Artificial Sequence
  chemically synthesized
tttaatactcactttttctc

SEQ ID NO: 404226 - DNA, 20 bp, Artificial Sequence
  chemically synthesized
ttagaaactagagaaaaagt

SEQ ID NO: 404227 - DNA, 20 bp, Artificial Sequence
  chemically synthesized
agagaaaaagtgagtattaa

SEQ ID NO: 404228 - DNA, 20 bp, Artificial Sequence
  chemically synthesized
aaagtgagtattaaaagctt

SEQ ID NO: 404229 - DNA, 20 bp, Artificial Sequence
  chemically synthesized
aagtgagtattaaaagcttt

SEQ ID NO: 404230 - DNA, 20 bp, Artificial Sequence
  chemically synthesized
atatcaaactttaaatccta

SEQ ID NO: 404231 - DNA, 20 bp, Artificial Sequence
  chemically synthesized
attaaaagctttaggattta

SEQ ID NO: 404232 - DNA, 20 bp, Artificial Sequence
  chemically synthesized
attatgcaaggaaaatgcaa

SEQ ID NO: 404233 - DNA, 20 bp, Artificial Sequence
  chemically synthesized
aattatgcaaggaaaatgca

SEQ ID NO: 404234 - DNA, 20 bp, Artificial Sequence
  chemically synthesized
aatgcaattacaattatgca

SEQ ID NO: 404235 - DNA, 20 bp, Artificial Sequence
  chemically synthesized
caatgcaattacaattatgc

SEQ ID NO: 404236 - DNA, 20 bp, Artificial Sequence
  chemically synthesized
taattgtaattgcattgcac

SEQ ID NO: 404237 - DNA, 20 bp, Artificial Sequence
  chemically synthesized
ttgtaattgcattgcacaag

SEQ ID NO: 404238 - DNA, 20 bp, Artificial Sequence
  chemically synthesized
aattgcattgcacaagtagt

SEQ ID NO: 404239 - DNA, 20 bp, Artificial Sequence
  chemically synthesized
tattttaaatgaagaaagta

SEQ ID NO: 404240 - DNA, 20 bp, Artificial Sequence
  chemically synthesized
ttattttaaatgaagaaagt

SEQ ID NO: 404241 - DNA, 20 bp, Artificial Sequence
  chemically synthesized
cctgttattttaaatgaaga

SEQ ID NO: 404242 - DNA, 20 bp, Artificial Sequence
  chemically synthesized
aaaacctgttattttaaatg

SEQ ID NO: 404243 - DNA, 20 bp, Artificial Sequence
  chemically synthesized
actttcttcatttaaaataa

SEQ ID NO: 404244 - DNA, 20 bp, Artificial Sequence
  chemically synthesized
ctttcttcatttaaaataac

SEQ ID NO: 404245 - DNA, 20 bp, Artificial Sequence
  chemically synthesized
aaattgtgtttgaacaacat

SEQ ID NO: 404246 - DNA, 20 bp, Artificial Sequence
  chemically synthesized
tcaaacacaatttaaatatc

SEQ ID NO: 404247 - DNA, 20 bp, Artificial Sequence
  chemically synthesized
aacacaatttaaatatctag

SEQ ID NO: 404248 - DNA, 20 bp, Artificial Sequence
  chemically synthesized
aacaaagaagacaatgcttc

SEQ ID NO: 404249 - DNA, 20 bp, Artificial Sequence
  chemically synthesized
taatttttatgggaacaaag

SEQ ID NO: 404250 - DNA, 20 bp, Artificial Sequence
  chemically synthesized
cggtaatttttatgggaaca

SEQ ID NO: 404251 - DNA, 20 bp, Artificial Sequence
  chemically synthesized
agcagaacggtaatttttat

SEQ ID NO: 404252 - DNA, 20 bp, Artificial Sequence
  chemically synthesized
aagcagaacggtaattttta

SEQ ID NO: 404253 - DNA, 20 bp, Artificial Sequence
  chemically synthesized
ggttccaaaaaaaagcagaa

SEQ ID NO: 404254 - DNA, 20 bp, Artificial Sequence
  chemically synthesized
ttcaaggttccaaaaaaaag

SEQ ID NO: 404255 - DNA, 20 bp, Artificial Sequence
  chemically synthesized
attaccgttctgcttttttt

SEQ ID NO: 404256 - DNA, 20 bp, Artificial Sequence
  chemically synthesized
tttttcaaggttccaaaaaa

SEQ ID NO: 404257 - DNA, 20 bp, Artificial Sequence
  chemically synthesized
ttttttggaaccttgaaaaa

SEQ ID NO: 404258 - DNA, 20 bp, Artificial Sequence
  chemically synthesized
aattatgagaccatttttca

SEQ ID NO: 404259 - DNA, 20 bp, Artificial Sequence
  chemically synthesized
aaattatgagaccatttttc

SEQ ID NO: 404260 - DNA, 20 bp, Artificial Sequence
  chemically synthesized
attttaatagcaaaaattat

SEQ ID NO: 404261 - DNA, 20 bp, Artificial Sequence
  chemically synthesized
cataatttttgctattaaaa

SEQ ID NO: 404262 - DNA, 20 bp, Artificial Sequence
  chemically synthesized
taattgcaagactattttaa

SEQ ID NO: 404263 - DNA, 20 bp, Artificial Sequence
  chemically synthesized
tctatattgatagtaattgc

SEQ ID NO: 404264 - DNA, 20 bp, Artificial Sequence
  chemically synthesized
tcttgcaattactatcaata

SEQ ID NO: 404265 - DNA, 20 bp, Artificial Sequence
  chemically synthesized
ggaggctttatctatattga

SEQ ID NO: 404266 - DNA, 20 bp, Artificial Sequence
  chemically synthesized
aattactatcaatatagata

SEQ ID NO: 404267 - DNA, 20 bp, Artificial Sequence
  chemically synthesized
ataatcccacatttgggtgg

SEQ ID NO: 404268 - DNA, 20 bp, Artificial Sequence
  chemically synthesized
aataatcccacatttgggtg

SEQ ID NO: 404269 - DNA, 20 bp, Artificial Sequence
  chemically synthesized
gtaataatcccacatttggg

SEQ ID NO: 404270 - DNA, 20 bp, Artificial Sequence
  chemically synthesized
ataaagcctccacccaaatg

SEQ ID NO: 404271 - DNA, 20 bp, Artificial Sequence
  chemically synthesized
taaagcctccacccaaatgt

SEQ ID NO: 404272 - DNA, 20 bp, Artificial Sequence
  chemically synthesized
aaggtaataatcccacattt

SEQ ID NO: 404273 - DNA, 20 bp, Artificial Sequence
  chemically synthesized
taaggtaataatcccacatt

SEQ ID NO: 404274 - DNA, 20 bp, Artificial Sequence
  chemically synthesized
caaatgtgggattattacct

SEQ ID NO: 404275 - DNA, 20 bp, Artificial Sequence
  chemically synthesized
gtgggattattaccttagaa

SEQ ID NO: 404276 - DNA, 20 bp, Artificial Sequence
  chemically synthesized
gggattattaccttagaaaa

SEQ ID NO: 404277 - DNA, 20 bp, Artificial Sequence
  chemically synthesized
atttttgagactcttttcta

SEQ ID NO: 404278 - DNA, 20 bp, Artificial Sequence
  chemically synthesized
aatttttgagactcttttct

SEQ ID NO: 404279 - DNA, 20 bp, Artificial Sequence
  chemically synthesized
ctaaatccattataattttt

SEQ ID NO: 404280 - DNA, 20 bp, Artificial Sequence
  chemically synthesized
aagagtctcaaaaattataa

SEQ ID NO: 404281 - DNA, 20 bp, Artificial Sequence
  chemically synthesized
ctcaaaaattataatggatt

SEQ ID NO: 404282 - DNA, 20 bp, Artificial Sequence
  chemically synthesized
tcaaaaattataatggattt

SEQ ID NO: 404283 - DNA, 20 bp, Artificial Sequence
  chemically synthesized
aggtgaaaaatcatctccgt

SEQ ID NO: 404284 - DNA, 20 bp, Artificial Sequence
  chemically synthesized
aatatgtaccaaaacttacg

SEQ ID NO: 404285 - DNA, 20 bp, Artificial Sequence
  chemically synthesized
aaaatcatctccgtaagttt

SEQ ID NO: 404286 - DNA, 20 bp, Artificial Sequence
  chemically synthesized
aaaatatgtaccaaaactta

SEQ ID NO: 404287 - DNA, 20 bp, Artificial Sequence
  chemically synthesized
tttaatatggaatttttgag

SEQ ID NO: 404288 - DNA, 20 bp, Artificial Sequence
  chemically synthesized
tggtttaatatggaattttt

SEQ ID NO: 404289 - DNA, 20 bp, Artificial Sequence
  chemically synthesized
ggtaggaatgtggtttaata

SEQ ID NO: 404290 - DNA, 20 bp, Artificial Sequence
  chemically synthesized
atccattacaggtaggaatg

SEQ ID NO: 404291 - DNA, 20 bp, Artificial Sequence
  chemically synthesized
ccttttcatccattacaggt

SEQ ID NO: 404292 - DNA, 20 bp, Artificial Sequence
  chemically synthesized
aaccacattcctacctgtaa

SEQ ID NO: 404293 - DNA, 20 bp, Artificial Sequence
  chemically synthesized
accttttcatccattacagg

SEQ ID NO: 404294 - DNA, 20 bp, Artificial Sequence
  chemically synthesized
tagaccttttcatccattac

SEQ ID NO: 404295 - DNA, 20 bp, Artificial Sequence
  chemically synthesized
atagaccttttcatccatta

SEQ ID NO: 404296 - DNA, 20 bp, Artificial Sequence
  chemically synthesized
tcctacctgtaatggatgaa

SEQ ID NO: 404297 - DNA, 20 bp, Artificial Sequence
  chemically synthesized
cctacctgtaatggatgaaa

SEQ ID NO: 404298 - DNA, 20 bp, Artificial Sequence
  chemically synthesized
taggttacaatgcaacgtta

SEQ ID NO: 404299 - DNA, 20 bp, Artificial Sequence
  chemically synthesized
ctatttaatgtattcaatgt

SEQ ID NO: 404300 - DNA, 20 bp, Artificial Sequence
  chemically synthesized
tctatttaatgtattcaatg

SEQ ID NO: 404301 - DNA, 20 bp, Artificial Sequence
  chemically synthesized
cctacattgaatacattaaa

SEQ ID NO: 404302 - DNA, 20 bp, Artificial Sequence
  chemically synthesized
catgtttagatagacataca

SEQ ID NO: 404303 - DNA, 20 bp, Artificial Sequence
  chemically synthesized
cacatgcattcatgtttaga

SEQ ID NO: 404304 - DNA, 20 bp, Artificial Sequence
  chemically synthesized
cacacacatgcattcatgtt

SEQ ID NO: 404305 - DNA, 20 bp, Artificial Sequence
  chemically synthesized
catacatacgtatgtattta

SEQ ID NO: 404306 - DNA, 20 bp, Artificial Sequence
  chemically synthesized
acgtatgtatttaaagaatt

SEQ ID NO: 404307 - DNA, 20 bp, Artificial Sequence
  chemically synthesized
gtatttaaagaatttagact

SEQ ID NO: 404308 - DNA, 20 bp, Artificial Sequence
  chemically synthesized
tatttaaagaatttagactt

SEQ ID NO: 404309 - DNA, 20 bp, Artificial Sequence
  chemically synthesized
aagaatttagacttgggtct

SEQ ID NO: 404310 - DNA, 20 bp, Artificial Sequence
  chemically synthesized
agagcctgattctaagaccc

SEQ ID NO: 404311 - DNA, 20 bp, Artificial Sequence
  chemically synthesized
ttagacttgggtcttagaat

SEQ ID NO: 404312 - DNA, 20 bp, Artificial Sequence
  chemically synthesized
tagacttgggtcttagaatc

SEQ ID NO: 404313 - DNA, 20 bp, Artificial Sequence
  chemically synthesized
ttcagggagagcctgattct

SEQ ID NO: 404314 - DNA, 20 bp, Artificial Sequence
  chemically synthesized
gcagttgaaggattcaggga

SEQ ID NO: 404315 - DNA, 20 bp, Artificial Sequence
  chemically synthesized
tcgcagttgaaggattcagg

SEQ ID NO: 404316 - DNA, 20 bp, Artificial Sequence
  chemically synthesized
tctcgcagttgaaggattca

SEQ ID NO: 404317 - DNA, 20 bp, Artificial Sequence
  chemically synthesized
atctcgcagttgaaggattc

SEQ ID NO: 404318 - DNA, 20 bp, Artificial Sequence
  chemically synthesized
tatctcgcagttgaaggatt

SEQ ID NO: 404319 - DNA, 20 bp, Artificial Sequence
  chemically synthesized
tatttatatctcgcagttga

SEQ ID NO: 404320 - DNA, 20 bp, Artificial Sequence
  chemically synthesized
tccctgaatccttcaactgc

SEQ ID NO: 404321 - DNA, 20 bp, Artificial Sequence
  chemically synthesized
atatttatatctcgcagttg

SEQ ID NO: 404322 - DNA, 20 bp, Artificial Sequence
  chemically synthesized
tcccttatatttatatctcg

SEQ ID NO: 404323 - DNA, 20 bp, Artificial Sequence
  chemically synthesized
caactgcgagatataaatat

SEQ ID NO: 404324 - DNA, 20 bp, Artificial Sequence
  chemically synthesized
aactgcgagatataaatata

SEQ ID NO: 404325 - DNA, 20 bp, Artificial Sequence
  chemically synthesized
actgcgagatataaatataa

SEQ ID NO: 404326 - DNA, 20 bp, Artificial Sequence
  chemically synthesized
atataaatataagggaatgt

SEQ ID NO: 404327 - DNA, 20 bp, Artificial Sequence
  chemically synthesized
taagggaatgttggcaatca

SEQ ID NO: 404328 - DNA, 20 bp, Artificial Sequence
  chemically synthesized
gcaatcatggtctgctacat

SEQ ID NO: 404329 - DNA, 20 bp, Artificial Sequence
  chemically synthesized
caatcatggtctgctacatg

SEQ ID NO: 404330 - DNA, 20 bp, Artificial Sequence
  chemically synthesized
ttccgctgttcctcatgtag

SEQ ID NO: 404331 - DNA, 20 bp, Artificial Sequence
  chemically synthesized
ggcttccgctgttcctcatg

SEQ ID NO: 404332 - DNA, 20 bp, Artificial Sequence
  chemically synthesized
atggtctgctacatgaggaa

SEQ ID NO: 404333 - DNA, 20 bp, Artificial Sequence
  chemically synthesized
gtctgctacatgaggaacag

SEQ ID NO: 404334 - DNA, 20 bp, Artificial Sequence
  chemically synthesized
tgctacatgaggaacagcgg

SEQ ID NO: 404335 - DNA, 20 bp, Artificial Sequence
  chemically synthesized
ctatcttttttattgcagat

SEQ ID NO: 404336 - DNA, 20 bp, Artificial Sequence
  chemically synthesized
ctaaactatcttttttattg

SEQ ID NO: 404337 - DNA, 20 bp, Artificial Sequence
  chemically synthesized
gaagccaatctgcaataaaa

SEQ ID NO: 404338 - DNA, 20 bp, Artificial Sequence
  chemically synthesized
ccaatctgcaataaaaaaga

SEQ ID NO: 404339 - DNA, 20 bp, Artificial Sequence
  chemically synthesized
ctgcaataaaaaagatagtt

SEQ ID NO: 404340 - DNA, 20 bp, Artificial Sequence
  chemically synthesized
gcaataaaaaagatagttta

SEQ ID NO: 404341 - DNA, 20 bp, Artificial Sequence
  chemically synthesized
aataaaaaagatagtttaga

SEQ ID NO: 404342 - DNA, 20 bp, Artificial Sequence
  chemically synthesized
aaaaaagatagtttagagag

SEQ ID NO: 404343 - DNA, 20 bp, Artificial Sequence
  chemically synthesized
aaaaagatagtttagagaga

SEQ ID NO: 404344 - DNA, 20 bp, Artificial Sequence
  chemically synthesized
aaagatagtttagagagaag

SEQ ID NO: 404345 - DNA, 20 bp, Artificial Sequence
  chemically synthesized
ttagagagaaggagatgtga

SEQ ID NO: 404346 - DNA, 20 bp, Artificial Sequence
  chemically synthesized
agagagaaggagatgtgaca

SEQ ID NO: 404347 - DNA, 20 bp, Artificial Sequence
  chemically synthesized
agagaaggagatgtgacaga

SEQ ID NO: 404348 - DNA, 20 bp, Artificial Sequence
  chemically synthesized
ggagatgtgacagagagtcc

SEQ ID NO: 404349 - DNA, 20 bp, Artificial Sequence
  chemically synthesized
gatgtgacagagagtcctgg

SEQ ID NO: 404350 - DNA, 20 bp, Artificial Sequence
  chemically synthesized
atgtgacagagagtcctgga

SEQ ID NO: 404351 - DNA, 20 bp, Artificial Sequence
  chemically synthesized
aaatgcaatcaaaaccttcc

SEQ ID NO: 404352 - DNA, 20 bp, Artificial Sequence
  chemically synthesized
aaaatgcaatcaaaaccttc

SEQ ID NO: 404353 - DNA, 20 bp, Artificial Sequence
  chemically synthesized
aggttttgattgcattttct

SEQ ID NO: 404354 - DNA, 20 bp, Artificial Sequence
  chemically synthesized
ggttttgattgcattttctg

SEQ ID NO: 404355 - DNA, 20 bp, Artificial Sequence
  chemically synthesized
gggcaaattgcagtacacct

SEQ ID NO: 404356 - DNA, 20 bp, Artificial Sequence
  chemically synthesized
aggcaggttagggcaaattg

SEQ ID NO: 404357 - DNA, 20 bp, Artificial Sequence
  chemically synthesized
atgtttctcaaggcaggtta

SEQ ID NO: 404358 - DNA, 20 bp, Artificial Sequence
  chemically synthesized
aatgtttctcaaggcaggtt

SEQ ID NO: 404359 - DNA, 20 bp, Artificial Sequence
  chemically synthesized
aaatgtttctcaaggcaggt

SEQ ID NO: 404360 - DNA, 20 bp, Artificial Sequence
  chemically synthesized
aatttgccctaacctgcctt

SEQ ID NO: 404361 - DNA, 20 bp, Artificial Sequence
  chemically synthesized
attaaaatgtttctcaaggc

SEQ ID NO: 404362 - DNA, 20 bp, Artificial Sequence
  chemically synthesized
gattaaaatgtttctcaagg

SEQ ID NO: 404363 - DNA, 20 bp, Artificial Sequence
  chemically synthesized
aaggattaaaatgtttctca

SEQ ID NO: 404364 - DNA, 20 bp, Artificial Sequence
  chemically synthesized
taaggattaaaatgtttctc

SEQ ID NO: 404365 - DNA, 20 bp, Artificial Sequence
  chemically synthesized
ttgagaaacattttaatcct

SEQ ID NO: 404366 - DNA, 20 bp, Artificial Sequence
  chemically synthesized
caaaggatacgtttattcta

SEQ ID NO: 404367 - DNA, 20 bp, Artificial Sequence
  chemically synthesized
ccaaaggatacgtttattct

SEQ ID NO: 404368 - DNA, 20 bp, Artificial Sequence
  chemically synthesized
cttagaataaacgtatcctt

SEQ ID NO: 404369 - DNA, 20 bp, Artificial Sequence
  chemically synthesized
aaatgtggaatttattccaa

SEQ ID NO: 404370 - DNA, 20 bp, Artificial Sequence
  chemically synthesized
caaatgtggaatttattcca

SEQ ID NO: 404371 - DNA, 20 bp, Artificial Sequence
  chemically synthesized
tgaactatctttatcaaatg

SEQ ID NO: 404372 - DNA, 20 bp, Artificial Sequence
  chemically synthesized
aataaattccacatttgata

SEQ ID NO: 404373 - DNA, 20 bp, Artificial Sequence
  chemically synthesized
aattccacatttgataaaga

SEQ ID NO: 404374 - DNA, 20 bp, Artificial Sequence
  chemically synthesized
tgataaagatagttcaaatt

SEQ ID NO: 404375 - DNA, 20 bp, Artificial Sequence
  chemically synthesized
agatagttcaaatttggtat

SEQ ID NO: 404376 - DNA, 20 bp, Artificial Sequence
  chemically synthesized
aatttggtataagttatttg

SEQ ID NO: 404377 - DNA, 20 bp, Artificial Sequence
  chemically synthesized
ggtataagttatttgtagcc

SEQ ID NO: 404378 - DNA, 20 bp, Artificial Sequence
  chemically synthesized
tgagtattaattaggacact

SEQ ID NO: 404379 - DNA, 20 bp, Artificial Sequence
  chemically synthesized
ttattacttgagtattaatt

SEQ ID NO: 404380 - DNA, 20 bp, Artificial Sequence
  chemically synthesized
cttattacttgagtattaat

SEQ ID NO: 404381 - DNA, 20 bp, Artificial Sequence
  chemically synthesized
aagtgtcctaattaatactc

SEQ ID NO: 404382 - DNA, 20 bp, Artificial Sequence
  chemically synthesized
ctaattaatactcaagtaat

SEQ ID NO: 404383 - DNA, 20 bp, Artificial Sequence
  chemically synthesized
cagtaaactacttattactt

SEQ ID NO: 404384 - DNA, 20 bp, Artificial Sequence
  chemically synthesized
attaatactcaagtaataag

SEQ ID NO: 404385 - DNA, 20 bp, Artificial Sequence
  chemically synthesized
ataagtagtttactgcttaa

SEQ ID NO: 404386 - DNA, 20 bp, Artificial Sequence
  chemically synthesized
gaactaattctactgttaag

SEQ ID NO: 404387 - DNA, 20 bp, Artificial Sequence
  chemically synthesized
agtagtttactgcttaacag

SEQ ID NO: 404388 - DNA, 20 bp, Artificial Sequence
  chemically synthesized
atagaactaattctactgtt

SEQ ID NO: 404389 - DNA, 20 bp, Artificial Sequence
  chemically synthesized
ttactgcttaacagtagaat

SEQ ID NO: 404390 - DNA, 20 bp, Artificial Sequence
  chemically synthesized
gatggaaaaattatatgaaa

SEQ ID NO: 404391 - DNA, 20 bp, Artificial Sequence
  chemically synthesized
cttcccatctgaatgagaga

SEQ ID NO: 404392 - DNA, 20 bp, Artificial Sequence
  chemically synthesized
taatttttccatctctcatt

SEQ ID NO: 404393 - DNA, 20 bp, Artificial Sequence
  chemically synthesized
gcaacttcccatctgaatga

SEQ ID NO: 404394 - DNA, 20 bp, Artificial Sequence
  chemically synthesized
ttttccatctctcattcaga

SEQ ID NO: 404395 - DNA, 20 bp, Artificial Sequence
  chemically synthesized
gagcaacttcccatctgaat

SEQ ID NO: 404396 - DNA, 20 bp, Artificial Sequence
  chemically synthesized
tttccatctctcattcagat

SEQ ID NO: 404397 - DNA, 20 bp, Artificial Sequence
  chemically synthesized
ccatctctcattcagatggg

SEQ ID NO: 404398 - DNA, 20 bp, Artificial Sequence
  chemically synthesized
tgaccttacaagaggaagga

SEQ ID NO: 404399 - DNA, 20 bp, Artificial Sequence
  chemically synthesized
catgaccttacaagaggaag

SEQ ID NO: 404400 - DNA, 20 bp, Artificial Sequence
  chemically synthesized
atcatgaccttacaagagga

SEQ ID NO: 404401 - DNA, 20 bp, Artificial Sequence
  chemically synthesized
catcatgaccttacaagagg

SEQ ID NO: 404402 - DNA, 20 bp, Artificial Sequence
  chemically synthesized
gttgctctccttcctcttgt

SEQ ID NO: 404403 - DNA, 20 bp, Artificial Sequence
  chemically synthesized
ttgctctccttcctcttgta

SEQ ID NO: 404404 - DNA, 20 bp, Artificial Sequence
  chemically synthesized
gagcatcatgaccttacaag

SEQ ID NO: 404405 - DNA, 20 bp, Artificial Sequence
  chemically synthesized
agagcatcatgaccttacaa

SEQ ID NO: 404406 - DNA, 20 bp, Artificial Sequence
  chemically synthesized
atagagcatcatgaccttac

SEQ ID NO: 404407 - DNA, 20 bp, Artificial Sequence
  chemically synthesized
cccttgagtttgcagatata

SEQ ID NO: 404408 - DNA, 20 bp, Artificial Sequence
  chemically synthesized
ctcccttgagtttgcagata

SEQ ID NO: 404409 - DNA, 20 bp, Artificial Sequence
  chemically synthesized
tgctctatatctgcaaactc

SEQ ID NO: 404410 - DNA, 20 bp, Artificial Sequence
  chemically synthesized
ctttttctcccttgagtttg

SEQ ID NO: 404411 - DNA, 20 bp, Artificial Sequence
  chemically synthesized
gctctatatctgcaaactca

SEQ ID NO: 404412 - DNA, 20 bp, Artificial Sequence
  chemically synthesized
ctctatatctgcaaactcaa

SEQ ID NO: 404413 - DNA, 20 bp, Artificial Sequence
  chemically synthesized
ctatatctgcaaactcaagg

SEQ ID NO: 404414 - DNA, 20 bp, Artificial Sequence
  chemically synthesized
taagagactttttctccctt

SEQ ID NO: 404415 - DNA, 20 bp, Artificial Sequence
  chemically synthesized
ctgcaaactcaagggagaaa

SEQ ID NO: 404416 - DNA, 20 bp, Artificial Sequence
  chemically synthesized
cctgtatagtttcaagttaa

SEQ ID NO: 404417 - DNA, 20 bp, Artificial Sequence
  chemically synthesized
ttcctgtatagtttcaagtt

SEQ ID NO: 404418 - DNA, 20 bp, Artificial Sequence
  chemically synthesized
tttttttcctgtatagtttc

SEQ ID NO: 404419 - DNA, 20 bp, Artificial Sequence
  chemically synthesized
tctcttaacttgaaactata

SEQ ID NO: 404420 - DNA, 20 bp, Artificial Sequence
  chemically synthesized
ctcttaacttgaaactatac

SEQ ID NO: 404421 - DNA, 20 bp, Artificial Sequence
  chemically synthesized
ggttttttttttttcctgta

SEQ ID NO: 404422 - DNA, 20 bp, Artificial Sequence
  chemically synthesized
aagtactagaaatgacatca

SEQ ID NO: 404423 - DNA, 20 bp, Artificial Sequence
  chemically synthesized
taagtactagaaatgacatc

SEQ ID NO: 404424 - DNA, 20 bp, Artificial Sequence
  chemically synthesized
ttaagtactagaaatgacat

SEQ ID NO: 404425 - DNA, 20 bp, Artificial Sequence
  chemically synthesized
aaaaaccctgatgtcatttc

SEQ ID NO: 404426 - DNA, 20 bp, Artificial Sequence
  chemically synthesized
gataaataccaattaagtac

SEQ ID NO: 404427 - DNA, 20 bp, Artificial Sequence
  chemically synthesized
tgtcatttctagtacttaat

SEQ ID NO: 404428 - DNA, 20 bp, Artificial Sequence
  chemically synthesized
atggcagataaataccaatt

SEQ ID NO: 404429 - DNA, 20 bp, Artificial Sequence
  chemically synthesized
acagcttcatgtgtttatgg

SEQ ID NO: 404430 - DNA, 20 bp, Artificial Sequence
  chemically synthesized
aaaacagcttcatgtgttta

SEQ ID NO: 404431 - DNA, 20 bp, Artificial Sequence
  chemically synthesized
ttatctgccataaacacatg

SEQ ID NO: 404432 - DNA, 20 bp, Artificial Sequence
  chemically synthesized
ataaacacatgaagctgttt

SEQ ID NO: 404433 - DNA, 20 bp, Artificial Sequence
  chemically synthesized
ggtaactgaacaaaccaaaa

SEQ ID NO: 404434 - DNA, 20 bp, Artificial Sequence
  chemically synthesized
tgaagctgttttggtttgtt

SEQ ID NO: 404435 - DNA, 20 bp, Artificial Sequence
  chemically synthesized
aaatggccctatgcagacaa

SEQ ID NO: 404436 - DNA, 20 bp, Artificial Sequence
  chemically synthesized
taaatggccctatgcagaca

SEQ ID NO: 404437 - DNA, 20 bp, Artificial Sequence
  chemically synthesized
ttcagttacccttgtctgca

SEQ ID NO: 404438 - DNA, 20 bp, Artificial Sequence
  chemically synthesized
ttaaatggccctatgcagac

SEQ ID NO: 404439 - DNA, 20 bp, Artificial Sequence
  chemically synthesized
tcagttacccttgtctgcat

SEQ ID NO: 404440 - DNA, 20 bp, Artificial Sequence
  chemically synthesized
cagttacccttgtctgcata

SEQ ID NO: 404441 - DNA, 20 bp, Artificial Sequence
  chemically synthesized
tgggtttaaatggccctatg

SEQ ID NO: 404442 - DNA, 20 bp, Artificial Sequence
  chemically synthesized
aattccaatttgggtttaaa

SEQ ID NO: 404443 - DNA, 20 bp, Artificial Sequence
  chemically synthesized
agggccatttaaacccaaat

SEQ ID NO: 404444 - DNA, 20 bp, Artificial Sequence
  chemically synthesized
cccagagacaattccaattt

SEQ ID NO: 404445 - DNA, 20 bp, Artificial Sequence
  chemically synthesized
acccagagacaattccaatt

SEQ ID NO: 404446 - DNA, 20 bp, Artificial Sequence
  chemically synthesized
acccaaattggaattgtctc

SEQ ID NO: 404447 - DNA, 20 bp, Artificial Sequence
  chemically synthesized
cccaaattggaattgtctct

SEQ ID NO: 404448 - DNA, 20 bp, Artificial Sequence
  chemically synthesized
ttatcactgatagtaaccca

SEQ ID NO: 404449 - DNA, 20 bp, Artificial Sequence
  chemically synthesized
tgttatcactgatagtaacc

SEQ ID NO: 404450 - DNA, 20 bp, Artificial Sequence
  chemically synthesized
aattgtctctgggttactat

SEQ ID NO: 404451 - DNA, 20 bp, Artificial Sequence
  chemically synthesized
aaagttcttgttatcactga

SEQ ID NO: 404452 - DNA, 20 bp, Artificial Sequence
  chemically synthesized
gggttactatcagtgataac

SEQ ID NO: 404453 - DNA, 20 bp, Artificial Sequence
  chemically synthesized
ctataattggcatgaattga

SEQ ID NO: 404454 - DNA, 20 bp, Artificial Sequence
  chemically synthesized
ctttcaattcatgccaatta

SEQ ID NO: 404455 - DNA, 20 bp, Artificial Sequence
  chemically synthesized
tttcaattcatgccaattat

SEQ ID NO: 404456 - DNA, 20 bp, Artificial Sequence
  chemically synthesized
tgtttgtgaattcctataat

SEQ ID NO: 404457 - DNA, 20 bp, Artificial Sequence
  chemically synthesized
attataggaattcacaaaca

SEQ ID NO: 404458 - DNA, 20 bp, Artificial Sequence
  chemically synthesized
taggaattcacaaacacaga

SEQ ID NO: 404459 - DNA, 20 bp, Artificial Sequence
  chemically synthesized
aggaattcacaaacacagat

SEQ ID NO: 404460 - DNA, 20 bp, Artificial Sequence
  chemically synthesized
ggaattcacaaacacagata

SEQ ID NO: 404461 - DNA, 20 bp, Artificial Sequence
  chemically synthesized
gaattcacaaacacagatag

SEQ ID NO: 404462 - DNA, 20 bp, Artificial Sequence
  chemically synthesized
aaacacagataggggtgacc

SEQ ID NO: 404463 - DNA, 20 bp, Artificial Sequence
  chemically synthesized
aacacagataggggtgacca

SEQ ID NO: 404464 - DNA, 20 bp, Artificial Sequence
  chemically synthesized
aaagttctggttggattcct

SEQ ID NO: 404465 - DNA, 20 bp, Artificial Sequence
  chemically synthesized
gggtgaccaaggaatccaac

SEQ ID NO: 404466 - DNA, 20 bp, Artificial Sequence
  chemically synthesized
actaaacagaaagttctggt

SEQ ID NO: 404467 - DNA, 20 bp, Artificial Sequence
  chemically synthesized
tgaaactaaacagaaagttc

SEQ ID NO: 404468 - DNA, 20 bp, Artificial Sequence
  chemically synthesized
tccaaccagaactttctgtt

SEQ ID NO: 404469 - DNA, 20 bp, Artificial Sequence
  chemically synthesized
gtctaatgaaactaaacaga

SEQ ID NO: 404470 - DNA, 20 bp, Artificial Sequence
  chemically synthesized
ctgagtctaatgaaactaaa

SEQ ID NO: 404471 - DNA, 20 bp, Artificial Sequence
  chemically synthesized
aactttctgtttagtttcat

SEQ ID NO: 404472 - DNA, 20 bp, Artificial Sequence
  chemically synthesized
ctgtttagtttcattagact

SEQ ID NO: 404473 - DNA, 20 bp, Artificial Sequence
  chemically synthesized
ttttttttctcattaagtct

SEQ ID NO: 404474 - DNA, 20 bp, Artificial Sequence
  chemically synthesized
tcattagactcagacttaat

SEQ ID NO: 404475 - DNA, 20 bp, Artificial Sequence
  chemically synthesized
aatgatttttttttctcatt

SEQ ID NO: 404476 - DNA, 20 bp, Artificial Sequence
  chemically synthesized
taatgagaaaaaaaaatcat

SEQ ID NO: 404477 - DNA, 20 bp, Artificial Sequence
  chemically synthesized
aacaagacttacaagttttt

SEQ ID NO: 404478 - DNA, 20 bp, Artificial Sequence
  chemically synthesized
attagcactgaaaaacttgt

SEQ ID NO: 404479 - DNA, 20 bp, Artificial Sequence
  chemically synthesized
agaaactaaacaagacttac

SEQ ID NO: 404480 - DNA, 20 bp, Artificial Sequence
  chemically synthesized
aaaaacttgtaagtcttgtt

SEQ ID NO: 404481 - DNA, 20 bp, Artificial Sequence
  chemically synthesized
atttcagcaagaaactaaac

SEQ ID NO: 404482 - DNA, 20 bp, Artificial Sequence
  chemically synthesized
agtattatttaaatttcagc

SEQ ID NO: 404483 - DNA, 20 bp, Artificial Sequence
  chemically synthesized
aatcagtattatttaaattt

SEQ ID NO: 404484 - DNA, 20 bp, Artificial Sequence
  chemically synthesized
gtttccatcacagacacaat

SEQ ID NO: 404485 - DNA, 20 bp, Artificial Sequence
  chemically synthesized
aatactgattgtgtctgtga

SEQ ID NO: 404486 - DNA, 20 bp, Artificial Sequence
  chemically synthesized
ttctttaccagtttccatca

SEQ ID NO: 404487 - DNA, 20 bp, Artificial Sequence
  chemically synthesized
attgtgtctgtgatggaaac

SEQ ID NO: 404488 - DNA, 20 bp, Artificial Sequence
  chemically synthesized
gtctgtgatggaaactggta

SEQ ID NO: 404489 - DNA, 20 bp, Artificial Sequence
  chemically synthesized
atattcattttattctttac

SEQ ID NO: 404490 - DNA, 20 bp, Artificial Sequence
  chemically synthesized
aataaaatgaatatttaatt

SEQ ID NO: 404491 - DNA, 20 bp, Artificial Sequence
  chemically synthesized
aaatgaatatttaatttagt

SEQ ID NO: 404492 - DNA, 20 bp, Artificial Sequence
  chemically synthesized
aatgaatatttaatttagta

SEQ ID NO: 404493 - DNA, 20 bp, Artificial Sequence
  chemically synthesized
aggtatacaaaacaaaacat

SEQ ID NO: 404494 - DNA, 20 bp, Artificial Sequence
  chemically synthesized
gtatacaaaacaaaacatga

SEQ ID NO: 404495 - DNA, 20 bp, Artificial Sequence
  chemically synthesized
tatacaaaacaaaacatgag

SEQ ID NO: 404496 - DNA, 20 bp, Artificial Sequence
  chemically synthesized
atacaaaacaaaacatgaga

SEQ ID NO: 404497 - DNA, 20 bp, Artificial Sequence
  chemically synthesized
acaaaacaaaacatgagagg

SEQ ID NO: 404498 - DNA, 20 bp, Artificial Sequence
  chemically synthesized
acaaaacatgagagggagca

SEQ ID NO: 404499 - DNA, 20 bp, Artificial Sequence
  chemically synthesized
tttatttttccatttaggaa

SEQ ID NO: 404500 - DNA, 20 bp, Artificial Sequence
  chemically synthesized
ggagcatagctattcctaaa

SEQ ID NO: 404501 - DNA, 20 bp, Artificial Sequence
  chemically synthesized
accaatttatttttccattt

SEQ ID NO: 404502 - DNA, 20 bp, Artificial Sequence
  chemically synthesized
taccaatttatttttccatt

SEQ ID NO: 404503 - DNA, 20 bp, Artificial Sequence
  chemically synthesized
tcctaaatggaaaaataaat

SEQ ID NO: 404504 - DNA, 20 bp, Artificial Sequence
  chemically synthesized
aataaattggtatactacaa

SEQ ID NO: 404505 - DNA, 20 bp, Artificial Sequence
  chemically synthesized
ataaattggtatactacaat

SEQ ID NO: 404506 - DNA, 20 bp, Artificial Sequence
  chemically synthesized
aattggtatactacaatagg

SEQ ID NO: 404507 - DNA, 20 bp, Artificial Sequence
  chemically synthesized
ggaaatcatacttcctattg

SEQ ID NO: 404508 - DNA, 20 bp, Artificial Sequence
  chemically synthesized
tataaaacaaacatattaaa

SEQ ID NO: 404509 - DNA, 20 bp, Artificial Sequence
  chemically synthesized
ctataaaacaaacatattaa

SEQ ID NO: 404510 - DNA, 20 bp, Artificial Sequence
  chemically synthesized
cttttaatatgtttgtttta

SEQ ID NO: 404511 - DNA, 20 bp, Artificial Sequence
  chemically synthesized
ttaatatgtttgttttatag

SEQ ID NO: 404512 - DNA, 20 bp, Artificial Sequence
  chemically synthesized
tttatagaagttactaattg

SEQ ID NO: 404513 - DNA, 20 bp, Artificial Sequence
  chemically synthesized
atcaaaatggtttctgcaat

SEQ ID NO: 404514 - DNA, 20 bp, Artificial Sequence
  chemically synthesized
ttgatgatgttaaatcaaaa

SEQ ID NO: 404515 - DNA, 20 bp, Artificial Sequence
  chemically synthesized
aacaatatcattacattcga

SEQ ID NO: 404516 - DNA, 20 bp, Artificial Sequence
  chemically synthesized
agatgacatgtctaacaaaa

SEQ ID NO: 404517 - DNA, 20 bp, Artificial Sequence
  chemically synthesized
tattgatagtgccattttgt

SEQ ID NO: 404518 - DNA, 20 bp, Artificial Sequence
  chemically synthesized
tttaaatacatatatattga

SEQ ID NO: 404519 - DNA, 20 bp, Artificial Sequence
  chemically synthesized
tatcaatatatatgtattta

SEQ ID NO: 404520 - DNA, 20 bp, Artificial Sequence
  chemically synthesized
aatatatatgtatttaaaga

SEQ ID NO: 404521 - DNA, 20 bp, Artificial Sequence
  chemically synthesized
gtgtctagcaaagttaaagg

SEQ ID NO: 404522 - DNA, 20 bp, Artificial Sequence
  chemically synthesized
tggtgtctagcaaagttaaa

SEQ ID NO: 404523 - DNA, 20 bp, Artificial Sequence
  chemically synthesized
ttggtgtctagcaaagttaa

SEQ ID NO: 404524 - DNA, 20 bp, Artificial Sequence
  chemically synthesized
tttggtgtctagcaaagtta

SEQ ID NO: 404525 - DNA, 20 bp, Artificial Sequence
  chemically synthesized
cagtctccctttaactttgc

SEQ ID NO: 404526 - DNA, 20 bp, Artificial Sequence
  chemically synthesized
taaacttttggtgtctagca

SEQ ID NO: 404527 - DNA, 20 bp, Artificial Sequence
  chemically synthesized
gcatttaaacttttggtgtc

SEQ ID NO: 404528 - DNA, 20 bp, Artificial Sequence
  chemically synthesized
ttaactttgctagacaccaa

SEQ ID NO: 404529 - DNA, 20 bp, Artificial Sequence
  chemically synthesized
gcattgtgcatttaaacttt

SEQ ID NO: 404530 - DNA, 20 bp, Artificial Sequence
  chemically synthesized
aagtttaaatgcacaatgcc

SEQ ID NO: 404531 - DNA, 20 bp, Artificial Sequence
  chemically synthesized
agtttaaatgcacaatgcca

SEQ ID NO: 404532 - DNA, 20 bp, Artificial Sequence
  chemically synthesized
gtttaaatgcacaatgccaa

SEQ ID NO: 404533 - DNA, 20 bp, Artificial Sequence
  chemically synthesized
taaatgcacaatgccaaggg

SEQ ID NO: 404534 - DNA, 20 bp, Artificial Sequence
  chemically synthesized
ttttgacacttaactgccct

SEQ ID NO: 404535 - DNA, 20 bp, Artificial Sequence
  chemically synthesized
gcacaatgccaagggcagtt

SEQ ID NO: 404536 - DNA, 20 bp, Artificial Sequence
  chemically synthesized
gaagccttaaataaaatatt

SEQ ID NO: 404537 - DNA, 20 bp, Artificial Sequence
  chemically synthesized
tgtatcttaatattttattt

SEQ ID NO: 404538 - DNA, 20 bp, Artificial Sequence
  chemically synthesized
gtatcttaatattttattta

SEQ ID NO: 404539 - DNA, 20 bp, Artificial Sequence
  chemically synthesized
tgcattatttttaacaatag

SEQ ID NO: 404540 - DNA, 20 bp, Artificial Sequence
  chemically synthesized
agatgcattatttttaacaa

SEQ ID NO: 404541 - DNA, 20 bp, Artificial Sequence
  chemically synthesized
aaataccctctttattatgt

SEQ ID NO: 404542 - DNA, 20 bp, Artificial Sequence
  chemically synthesized
ataatgcatctaacataata

SEQ ID NO: 404543 - DNA, 20 bp, Artificial Sequence
  chemically synthesized
aatgcatctaacataataaa

SEQ ID NO: 404544 - DNA, 20 bp, Artificial Sequence
  chemically synthesized
atgcatctaacataataaag

SEQ ID NO: 404545 - DNA, 20 bp, Artificial Sequence
  chemically synthesized
tgcatctaacataataaaga

SEQ ID NO: 404546 - DNA, 20 bp, Artificial Sequence
  chemically synthesized
ttcatatttcaatatcccca

SEQ ID NO: 404547 - DNA, 20 bp, Artificial Sequence
  chemically synthesized
gtcttctatggcaaaccatg

SEQ ID NO: 404548 - DNA, 20 bp, Artificial Sequence
  chemically synthesized
tgtcttctatggcaaaccat

SEQ ID NO: 404549 - DNA, 20 bp, Artificial Sequence
  chemically synthesized
ttgtcttctatggcaaacca

SEQ ID NO: 404550 - DNA, 20 bp, Artificial Sequence
  chemically synthesized
aatatccccatggtttgcca

SEQ ID NO: 404551 - DNA, 20 bp, Artificial Sequence
  chemically synthesized
atccccatggtttgccatag

SEQ ID NO: 404552 - DNA, 20 bp, Artificial Sequence
  chemically synthesized
gtatttatatttgtcttcta

SEQ ID NO: 404553 - DNA, 20 bp, Artificial Sequence
  chemically synthesized
aaattgtgattttattttct

SEQ ID NO: 404554 - DNA, 20 bp, Artificial Sequence
  chemically synthesized
gctgtaaccaaaaagtaacc

SEQ ID NO: 404555 - DNA, 20 bp, Artificial Sequence
  chemically synthesized
ttattttcttggttactttt

SEQ ID NO: 404556 - DNA, 20 bp, Artificial Sequence
  chemically synthesized
agtgatgagctgtaaccaaa

SEQ ID NO: 404557 - DNA, 20 bp, Artificial Sequence
  chemically synthesized
tcttggttactttttggtta

SEQ ID NO: 404558 - DNA, 20 bp, Artificial Sequence
  chemically synthesized
atgcactaatgcaaagtgat

SEQ ID NO: 404559 - DNA, 20 bp, Artificial Sequence
  chemically synthesized
tacagctcatcactttgcat

SEQ ID NO: 404560 - DNA, 20 bp, Artificial Sequence
  chemically synthesized
tggaggtatgcactaatgca

SEQ ID NO: 404561 - DNA, 20 bp, Artificial Sequence
  chemically synthesized
tgagattattggaggtttgg

SEQ ID NO: 404562 - DNA, 20 bp, Artificial Sequence
  chemically synthesized
atgagattattggaggtttg

SEQ ID NO: 404563 - DNA, 20 bp, Artificial Sequence
  chemically synthesized
atatgagattattggaggtt

SEQ ID NO: 404564 - DNA, 20 bp, Artificial Sequence
  chemically synthesized
gatgcatatgagattattgg

SEQ ID NO: 404565 - DNA, 20 bp, Artificial Sequence
  chemically synthesized
tgatgcatatgagattattg

SEQ ID NO: 404566 - DNA, 20 bp, Artificial Sequence
  chemically synthesized
aatgatgcatatgagattat

SEQ ID NO: 404567 - DNA, 20 bp, Artificial Sequence
  chemically synthesized
ctccttataatgatgcatat

SEQ ID NO: 404568 - DNA, 20 bp, Artificial Sequence
  chemically synthesized
aatctcatatgcatcattat

SEQ ID NO: 404569 - DNA, 20 bp, Artificial Sequence
  chemically synthesized
atctcatatgcatcattata

SEQ ID NO: 404570 - DNA, 20 bp, Artificial Sequence
  chemically synthesized
ctcatatgcatcattataag

SEQ ID NO: 404571 - DNA, 20 bp, Artificial Sequence
  chemically synthesized
gcatcattataaggagatga

SEQ ID NO: 404572 - DNA, 20 bp, Artificial Sequence
  chemically synthesized
catcattataaggagatgaa

SEQ ID NO: 404573 - DNA, 20 bp, Artificial Sequence
  chemically synthesized
atcattataaggagatgaaa

SEQ ID NO: 404574 - DNA, 20 bp, Artificial Sequence
  chemically synthesized
ataaggagatgaaagggatt

SEQ ID NO: 404575 - DNA, 20 bp, Artificial Sequence
  chemically synthesized
gatgaaagggattaagaaat

SEQ ID NO: 404576 - DNA, 20 bp, Artificial Sequence
  chemically synthesized
agggattaagaaataagttt

SEQ ID NO: 404577 - DNA, 20 bp, Artificial Sequence
  chemically synthesized
attaagaaataagtttaagt

SEQ ID NO: 404578 - DNA, 20 bp, Artificial Sequence
  chemically synthesized
aataagtttaagtcagtgca

SEQ ID NO: 404579 - DNA, 20 bp, Artificial Sequence
  chemically synthesized
gtcagtgcatagaatattaa

SEQ ID NO: 404580 - DNA, 20 bp, Artificial Sequence
  chemically synthesized
tccattcatattagatgcaa

SEQ ID NO: 404581 - DNA, 20 bp, Artificial Sequence
  chemically synthesized
ttccattcatattagatgca

SEQ ID NO: 404582 - DNA, 20 bp, Artificial Sequence
  chemically synthesized
tcctttgcatctaatatgaa

SEQ ID NO: 404583 - DNA, 20 bp, Artificial Sequence
  chemically synthesized
gtaatcacttccattcatat

SEQ ID NO: 404584 - DNA, 20 bp, Artificial Sequence
  chemically synthesized
tttgcatctaatatgaatgg

SEQ ID NO: 404585 - DNA, 20 bp, Artificial Sequence
  chemically synthesized
tattattgagtttatattaa

SEQ ID NO: 404586 - DNA, 20 bp, Artificial Sequence
  chemically synthesized
catttgcttattttattatt

SEQ ID NO: 404587 - DNA, 20 bp, Artificial Sequence
  chemically synthesized
tataaactcaataataaaat

SEQ ID NO: 404588 - DNA, 20 bp, Artificial Sequence
  chemically synthesized
aattaggagaaaataaaagc

SEQ ID NO: 404589 - DNA, 20 bp, Artificial Sequence
  chemically synthesized
taattaggagaaaataaaag

SEQ ID NO: 404590 - DNA, 20 bp, Artificial Sequence
  chemically synthesized
tgttaattaggagaaaataa

SEQ ID NO: 404591 - DNA, 20 bp, Artificial Sequence
  chemically synthesized
ggattaaacttgttaattag

SEQ ID NO: 404592 - DNA, 20 bp, Artificial Sequence
  chemically synthesized
tttattttctcctaattaac

SEQ ID NO: 404593 - DNA, 20 bp, Artificial Sequence
  chemically synthesized
aaggattaaacttgttaatt

SEQ ID NO: 404594 - DNA, 20 bp, Artificial Sequence
  chemically synthesized
aaaggattaaacttgttaat

SEQ ID NO: 404595 - DNA, 20 bp, Artificial Sequence
  chemically synthesized
acaactaacattaagtgcaa

SEQ ID NO: 404596 - DNA, 20 bp, Artificial Sequence
  chemically synthesized
aacaactaacattaagtgca

SEQ ID NO: 404597 - DNA, 20 bp, Artificial Sequence
  chemically synthesized
taatcctttgcacttaatgt

SEQ ID NO: 404598 - DNA, 20 bp, Artificial Sequence
  chemically synthesized
cggggcaaacaactaacatt

SEQ ID NO: 404599 - DNA, 20 bp, Artificial Sequence
  chemically synthesized
ttaatgttagttgtttgccc

SEQ ID NO: 404600 - DNA, 20 bp, Artificial Sequence
  chemically synthesized
aatgttagttgtttgccccg

SEQ ID NO: 404601 - DNA, 20 bp, Artificial Sequence
  chemically synthesized
tagttgtttgccccggagcc

SEQ ID NO: 404602 - DNA, 20 bp, Artificial Sequence
  chemically synthesized
tctaccaatgccgggctccg

SEQ ID NO: 404603 - DNA, 20 bp, Artificial Sequence
  chemically synthesized
gtctaccaatgccgggctcc

SEQ ID NO: 404604 - DNA, 20 bp, Artificial Sequence
  chemically synthesized
tgtctaccaatgccgggctc

SEQ ID NO: 404605 - DNA, 20 bp, Artificial Sequence
  chemically synthesized
tttgccccggagcccggcat

SEQ ID NO: 404606 - DNA, 20 bp, Artificial Sequence
  chemically synthesized
gtgagatgtctaccaatgcc

SEQ ID NO: 404607 - DNA, 20 bp, Artificial Sequence
  chemically synthesized
gccccggagcccggcattgg

SEQ ID NO: 404608 - DNA, 20 bp, Artificial Sequence
  chemically synthesized
agtgagatgtctaccaatgc

SEQ ID NO: 404609 - DNA, 20 bp, Artificial Sequence
  chemically synthesized
aagaatggcccatgagcagt

SEQ ID NO: 404610 - DNA, 20 bp, Artificial Sequence
  chemically synthesized
ggtagacatctcactgctca

SEQ ID NO: 404611 - DNA, 20 bp, Artificial Sequence
  chemically synthesized
gtagacatctcactgctcat

SEQ ID NO: 404612 - DNA, 20 bp, Artificial Sequence
  chemically synthesized
tgacaagaatggcccatgag

SEQ ID NO: 404613 - DNA, 20 bp, Artificial Sequence
  chemically synthesized
aggtgacaagaatggcccat

SEQ ID NO: 404614 - DNA, 20 bp, Artificial Sequence
  chemically synthesized
gggagtcaaggtgacaagaa

SEQ ID NO: 404615 - DNA, 20 bp, Artificial Sequence
  chemically synthesized
gagctgggagtcaaggtgac

SEQ ID NO: 404616 - DNA, 20 bp, Artificial Sequence
  chemically synthesized
attcttgtcaccttgactcc

SEQ ID NO: 404617 - DNA, 20 bp, Artificial Sequence
  chemically synthesized
caaagttgagctgggagtca

SEQ ID NO: 404618 - DNA, 20 bp, Artificial Sequence
  chemically synthesized
ccaaagttgagctgggagtc

SEQ ID NO: 404619 - DNA, 20 bp, Artificial Sequence
  chemically synthesized
ccatcccaaagttgagctgg

SEQ ID NO: 404620 - DNA, 20 bp, Artificial Sequence
  chemically synthesized
atccatcccaaagttgagct

SEQ ID NO: 404621 - DNA, 20 bp, Artificial Sequence
  chemically synthesized
catccatcccaaagttgagc

SEQ ID NO: 404622 - DNA, 20 bp, Artificial Sequence
  chemically synthesized
cttgactcccagctcaactt

SEQ ID NO: 404623 - DNA, 20 bp, Artificial Sequence
  chemically synthesized
ttgactcccagctcaacttt

SEQ ID NO: 404624 - DNA, 20 bp, Artificial Sequence
  chemically synthesized
gaaacatccatcccaaagtt

SEQ ID NO: 404625 - DNA, 20 bp, Artificial Sequence
  chemically synthesized
ctcccagctcaactttggga

SEQ ID NO: 404626 - DNA, 20 bp, Artificial Sequence
  chemically synthesized
ggtttgaaacatccatccca

SEQ ID NO: 404627 - DNA, 20 bp, Artificial Sequence
  chemically synthesized
tttgaacacatcgaggcagg

SEQ ID NO: 404628 - DNA, 20 bp, Artificial Sequence
  chemically synthesized
aagtttgaacacatcgaggc

SEQ ID NO: 404629 - DNA, 20 bp, Artificial Sequence
  chemically synthesized
aaagtttgaacacatcgagg

SEQ ID NO: 404630 - DNA, 20 bp, Artificial Sequence
  chemically synthesized
cacaaagtttgaacacatcg

SEQ ID NO: 404631 - DNA, 20 bp, Artificial Sequence
  chemically synthesized
acacaaagtttgaacacatc

SEQ ID NO: 404632 - DNA, 20 bp, Artificial Sequence
  chemically synthesized
gatgtgttcaaactttgtgt

SEQ ID NO: 404633 - DNA, 20 bp, Artificial Sequence
  chemically synthesized
tgtgttcaaactttgtgtga

SEQ ID NO: 404634 - DNA, 20 bp, Artificial Sequence
  chemically synthesized
ttcaaaaatgctctcacaca

SEQ ID NO: 404635 - DNA, 20 bp, Artificial Sequence
  chemically synthesized
tttgtgtgagagcatttttg

SEQ ID NO: 404636 - DNA, 20 bp, Artificial Sequence
  chemically synthesized
ttgtgtgagagcatttttga

SEQ ID NO: 404637 - DNA, 20 bp, Artificial Sequence
  chemically synthesized
atttttgaaggaatgtaatt

SEQ ID NO: 404638 - DNA, 20 bp, Artificial Sequence
  chemically synthesized
attgagtatgaattatgtga

SEQ ID NO: 404639 - DNA, 20 bp, Artificial Sequence
  chemically synthesized
gagtatgaattatgtgacag

SEQ ID NO: 404640 - DNA, 20 bp, Artificial Sequence
  chemically synthesized
atatgtgaattttgactgaa

SEQ ID NO: 404641 - DNA, 20 bp, Artificial Sequence
  chemically synthesized
tcaagttttacaaaactttt

SEQ ID NO: 404642 - DNA, 20 bp, Artificial Sequence
  chemically synthesized
tgaaaagttttgtaaaactt

SEQ ID NO: 404643 - DNA, 20 bp, Artificial Sequence
  chemically synthesized
agccaaaaggttcatttctc

SEQ ID NO: 404644 - DNA, 20 bp, Artificial Sequence
  chemically synthesized
aacttgagaaatgaaccttt

SEQ ID NO: 404645 - DNA, 20 bp, Artificial Sequence
  chemically synthesized
tgagaaatgaaccttttggc

SEQ ID NO: 404646 - DNA, 20 bp, Artificial Sequence
  chemically synthesized
gagaaatgaaccttttggct

SEQ ID NO: 404647 - DNA, 20 bp, Artificial Sequence
  chemically synthesized
agtcaccgtgcccagccaaa

SEQ ID NO: 404648 - DNA, 20 bp, Artificial Sequence
  chemically synthesized
gagtcaccgtgcccagccaa

SEQ ID NO: 404649 - DNA, 20 bp, Artificial Sequence
  chemically synthesized
atgaaccttttggctgggca

SEQ ID NO: 404650 - DNA, 20 bp, Artificial Sequence
  chemically synthesized
cagatgtgagtcaccgtgcc

SEQ ID NO: 404651 - DNA, 20 bp, Artificial Sequence
  chemically synthesized
agtgctgggattacagatgt

SEQ ID NO: 404652 - DNA, 20 bp, Artificial Sequence
  chemically synthesized
gtgactcacatctgtaatcc

SEQ ID NO: 404653 - DNA, 20 bp, Artificial Sequence
  chemically synthesized
ctcctagagtgctgggatta

SEQ ID NO: 404654 - DNA, 20 bp, Artificial Sequence
  chemically synthesized
catctgtaatcccagcactc

SEQ ID NO: 404655 - DNA, 20 bp, Artificial Sequence
  chemically synthesized
acctcagctcctagagtgct

SEQ ID NO: 404656 - DNA, 20 bp, Artificial Sequence
  chemically synthesized
atctgtaatcccagcactct

SEQ ID NO: 404657 - DNA, 20 bp, Artificial Sequence
  chemically synthesized
cacctcagctcctagagtgc

SEQ ID NO: 404658 - DNA, 20 bp, Artificial Sequence
  chemically synthesized
ctgtaatcccagcactctag

SEQ ID NO: 404659 - DNA, 20 bp, Artificial Sequence
  chemically synthesized
ttcacccacctcagctccta

SEQ ID NO: 404660 - DNA, 20 bp, Artificial Sequence
  chemically synthesized
atcccagcactctaggagct

SEQ ID NO: 404661 - DNA, 20 bp, Artificial Sequence
  chemically synthesized
tcccagcactctaggagctg

SEQ ID NO: 404662 - DNA, 20 bp, Artificial Sequence
  chemically synthesized
gattcacccacctcagctcc

SEQ ID NO: 404663 - DNA, 20 bp, Artificial Sequence
  chemically synthesized
cagcactctaggagctgagg

SEQ ID NO: 404664 - DNA, 20 bp, Artificial Sequence
  chemically synthesized
agcactctaggagctgaggt

SEQ ID NO: 404665 - DNA, 20 bp, Artificial Sequence
  chemically synthesized
ctcaagtgattcacccacct

SEQ ID NO: 404666 - DNA, 20 bp, Artificial Sequence
  chemically synthesized
ctgaggtgggtgaatcactt

SEQ ID NO: 404667 - DNA, 20 bp, Artificial Sequence
  chemically synthesized
tgaggtgggtgaatcacttg

SEQ ID NO: 404668 - DNA, 20 bp, Artificial Sequence
  chemically synthesized
gtgggtgaatcacttgaggt

SEQ ID NO: 404669 - DNA, 20 bp, Artificial Sequence
  chemically synthesized
tgggtgaatcacttgaggtc

SEQ ID NO: 404670 - DNA, 20 bp, Artificial Sequence
  chemically synthesized
ggtctcgaactcctgacctc

SEQ ID NO: 404671 - DNA, 20 bp, Artificial Sequence
  chemically synthesized
ggtgaatcacttgaggtcag

SEQ ID NO: 404672 - DNA, 20 bp, Artificial Sequence
  chemically synthesized
tcacttgaggtcaggagttc

SEQ ID NO: 404673 - DNA, 20 bp, Artificial Sequence
  chemically synthesized
tgaggtcaggagttcgagac

SEQ ID NO: 404674 - DNA, 20 bp, Artificial Sequence
  chemically synthesized
tcaggagttcgagaccagct

SEQ ID NO: 404675 - DNA, 20 bp, Artificial Sequence
  chemically synthesized
tttcgccatgttggccaagc

SEQ ID NO: 404676 - DNA, 20 bp, Artificial Sequence
  chemically synthesized
ggggtttcgccatgttggcc

SEQ ID NO: 404677 - DNA, 20 bp, Artificial Sequence
  chemically synthesized
cgagaccagcttggccaaca

SEQ ID NO: 404678 - DNA, 20 bp, Artificial Sequence
  chemically synthesized
gagacggggtttcgccatgt

SEQ ID NO: 404679 - DNA, 20 bp, Artificial Sequence
  chemically synthesized
tgtgttttttagtagagacg

SEQ ID NO: 404680 - DNA, 20 bp, Artificial Sequence
  chemically synthesized
ttgtgttttttagtagagac

SEQ ID NO: 404681 - DNA, 20 bp, Artificial Sequence
  chemically synthesized
tttgtgttttttagtagaga

SEQ ID NO: 404682 - DNA, 20 bp, Artificial Sequence
  chemically synthesized
aatttttgtgttttttagta

SEQ ID NO: 404683 - DNA, 20 bp, Artificial Sequence
  chemically synthesized
ctaatttttgtgttttttag

SEQ ID NO: 404684 - DNA, 20 bp, Artificial Sequence
  chemically synthesized
cggctaatttttgtgttttt

SEQ ID NO: 404685 - DNA, 20 bp, Artificial Sequence
  chemically synthesized
ctactaaaaaacacaaaaat

SEQ ID NO: 404686 - DNA, 20 bp, Artificial Sequence
  chemically synthesized
taaaaaacacaaaaattagc

SEQ ID NO: 404687 - DNA, 20 bp, Artificial Sequence
  chemically synthesized
aaaaaacacaaaaattagcc

SEQ ID NO: 404688 - DNA, 20 bp, Artificial Sequence
  chemically synthesized
acacaaaaattagccgggca

SEQ ID NO: 404689 - DNA, 20 bp, Artificial Sequence
  chemically synthesized
caaaaattagccgggcatgg

SEQ ID NO: 404690 - DNA, 20 bp, Artificial Sequence
  chemically synthesized
caggtgcatgccaccatgcc

SEQ ID NO: 404691 - DNA, 20 bp, Artificial Sequence
  chemically synthesized
gtggcatgcacctgtaatcc

SEQ ID NO: 404692 - DNA, 20 bp, Artificial Sequence
  chemically synthesized
ttgcgagtagctgggattac

SEQ ID NO: 404693 - DNA, 20 bp, Artificial Sequence
  chemically synthesized
cttgcgagtagctgggatta

SEQ ID NO: 404694 - DNA, 20 bp, Artificial Sequence
  chemically synthesized
cctgagacttgcgagtagct

SEQ ID NO: 404695 - DNA, 20 bp, Artificial Sequence
  chemically synthesized
gcctgagacttgcgagtagc

SEQ ID NO: 404696 - DNA, 20 bp, Artificial Sequence
  chemically synthesized
ctgtaatcccagctactcgc

SEQ ID NO: 404697 - DNA, 20 bp, Artificial Sequence
  chemically synthesized
tcctgcctgagacttgcgag

SEQ ID NO: 404698 - DNA, 20 bp, Artificial Sequence
  chemically synthesized
ttctcctgcctgagacttgc

SEQ ID NO: 404699 - DNA, 20 bp, Artificial Sequence
  chemically synthesized
tcccagctactcgcaagtct

SEQ ID NO: 404700 - DNA, 20 bp, Artificial Sequence
  chemically synthesized
cccagctactcgcaagtctc

SEQ ID NO: 404701 - DNA, 20 bp, Artificial Sequence
  chemically synthesized
agctactcgcaagtctcagg

SEQ ID NO: 404702 - DNA, 20 bp, Artificial Sequence
  chemically synthesized
gctactcgcaagtctcaggc

SEQ ID NO: 404703 - DNA, 20 bp, Artificial Sequence
  chemically synthesized
tactcgcaagtctcaggcag

SEQ ID NO: 404704 - DNA, 20 bp, Artificial Sequence
  chemically synthesized
ttcatgcgattctcctgcct

SEQ ID NO: 404705 - DNA, 20 bp, Artificial Sequence
  chemically synthesized
gcaggagaatcgcatgaacc

SEQ ID NO: 404706 - DNA, 20 bp, Artificial Sequence
  chemically synthesized
caggagaatcgcatgaaccc

SEQ ID NO: 404707 - DNA, 20 bp, Artificial Sequence
  chemically synthesized
ggagaatcgcatgaacccag

SEQ ID NO: 404708 - DNA, 20 bp, Artificial Sequence
  chemically synthesized
gagaatcgcatgaacccagg

SEQ ID NO: 404709 - DNA, 20 bp, Artificial Sequence
  chemically synthesized
aatcgcatgaacccaggagg

SEQ ID NO: 404710 - DNA, 20 bp, Artificial Sequence
  chemically synthesized
cactgcaacttctgcctcct

SEQ ID NO: 404711 - DNA, 20 bp, Artificial Sequence
  chemically synthesized
tcactgcaacttctgcctcc

SEQ ID NO: 404712 - DNA, 20 bp, Artificial Sequence
  chemically synthesized
cgcatgaacccaggaggcag

SEQ ID NO: 404713 - DNA, 20 bp, Artificial Sequence
  chemically synthesized
aacccaggaggcagaagttg

SEQ ID NO: 404714 - DNA, 20 bp, Artificial Sequence
  chemically synthesized
caggaggcagaagttgcagt

SEQ ID NO: 404715 - DNA, 20 bp, Artificial Sequence
  chemically synthesized
ggcagaagttgcagtgagcc

SEQ ID NO: 404716 - DNA, 20 bp, Artificial Sequence
  chemically synthesized
ggagtgcagtgacgcgatct

SEQ ID NO: 404717 - DNA, 20 bp, Artificial Sequence
  chemically synthesized
aagatcgcgtcactgcactc

SEQ ID NO: 404718 - DNA, 20 bp, Artificial Sequence
  chemically synthesized
ctgtcacccaggctggagtg

SEQ ID NO: 404719 - DNA, 20 bp, Artificial Sequence
  chemically synthesized
cgcgtcactgcactccagcc

SEQ ID NO: 404720 - DNA, 20 bp, Artificial Sequence
  chemically synthesized
gcgtcactgcactccagcct

SEQ ID NO: 404721 - DNA, 20 bp, Artificial Sequence
  chemically synthesized
tcgctctgtcacccaggctg

SEQ ID NO: 404722 - DNA, 20 bp, Artificial Sequence
  chemically synthesized
cctcgctctgtcacccaggc

SEQ ID NO: 404723 - DNA, 20 bp, Artificial Sequence
  chemically synthesized
ctgcactccagcctgggtga

SEQ ID NO: 404724 - DNA, 20 bp, Artificial Sequence
  chemically synthesized
gaagcctcgctctgtcaccc

SEQ ID NO: 404725 - DNA, 20 bp, Artificial Sequence
  chemically synthesized
gcactccagcctgggtgaca

SEQ ID NO: 404726 - DNA, 20 bp, Artificial Sequence
  chemically synthesized
cgaagcctcgctctgtcacc

SEQ ID NO: 404727 - DNA, 20 bp, Artificial Sequence
  chemically synthesized
tccagcctgggtgacagagc

SEQ ID NO: 404728 - DNA, 20 bp, Artificial Sequence
  chemically synthesized
ccagcctgggtgacagagcg

SEQ ID NO: 404729 - DNA, 20 bp, Artificial Sequence
  chemically synthesized
tttttttcttttttgagacg

SEQ ID NO: 404730 - DNA, 20 bp, Artificial Sequence
  chemically synthesized
agcgaggcttcgtctcaaaa

SEQ ID NO: 404731 - DNA, 20 bp, Artificial Sequence
  chemically synthesized
ttttcttttttttctttttt

SEQ ID NO: 404732 - DNA, 20 bp, Artificial Sequence
  chemically synthesized
tcgtctcaaaaaagaaaaaa

SEQ ID NO: 404733 - DNA, 20 bp, Artificial Sequence
  chemically synthesized
cttcatttactataaaattg

SEQ ID NO: 404734 - DNA, 20 bp, Artificial Sequence
  chemically synthesized
aaattttttcttcaatttta

SEQ ID NO: 404735 - DNA, 20 bp, Artificial Sequence
  chemically synthesized
cttcaattttatagtaaatg

SEQ ID NO: 404736 - DNA, 20 bp, Artificial Sequence
  chemically synthesized
gaaaacatttcatttctccg

SEQ ID NO: 404737 - DNA, 20 bp, Artificial Sequence
  chemically synthesized
gtcaatcaaaatagtcttcg

SEQ ID NO: 404738 - DNA, 20 bp, Artificial Sequence
  chemically synthesized
gtgtcaatcaaaatagtctt

SEQ ID NO: 404739 - DNA, 20 bp, Artificial Sequence
  chemically synthesized
gctacgggtgtcaatcaaaa

SEQ ID NO: 404740 - DNA, 20 bp, Artificial Sequence
  chemically synthesized
actattttgattgacacccg

SEQ ID NO: 404741 - DNA, 20 bp, Artificial Sequence
  chemically synthesized
atgaaacccccataggctac

SEQ ID NO: 404742 - DNA, 20 bp, Artificial Sequence
  chemically synthesized
tgattgacacccgtagccta

SEQ ID NO: 404743 - DNA, 20 bp, Artificial Sequence
  chemically synthesized
tatgaaacccccataggcta

SEQ ID NO: 404744 - DNA, 20 bp, Artificial Sequence
  chemically synthesized
gattgacacccgtagcctat

SEQ ID NO: 404745 - DNA, 20 bp, Artificial Sequence
  chemically synthesized
attgacacccgtagcctatg

SEQ ID NO: 404746 - DNA, 20 bp, Artificial Sequence
  chemically synthesized
ttgacacccgtagcctatgg

SEQ ID NO: 404747 - DNA, 20 bp, Artificial Sequence
  chemically synthesized
agggaatatgaaacccccat

SEQ ID NO: 404748 - DNA, 20 bp, Artificial Sequence
  chemically synthesized
gagggaatatgaaaccccca

SEQ ID NO: 404749 - DNA, 20 bp, Artificial Sequence
  chemically synthesized
atctccaacaacggaaaaga

SEQ ID NO: 404750 - DNA, 20 bp, Artificial Sequence
  chemically synthesized
tatctccaacaacggaaaag

SEQ ID NO: 404751 - DNA, 20 bp, Artificial Sequence
  chemically synthesized
atatctccaacaacggaaaa

SEQ ID NO: 404752 - DNA, 20 bp, Artificial Sequence
  chemically synthesized
tgatatctccaacaacggaa

SEQ ID NO: 404753 - DNA, 20 bp, Artificial Sequence
  chemically synthesized
tattccctcttttccgttgt

SEQ ID NO: 404754 - DNA, 20 bp, Artificial Sequence
  chemically synthesized
ttccctcttttccgttgttg

SEQ ID NO: 404755 - DNA, 20 bp, Artificial Sequence
  chemically synthesized
aaccatgatatctccaacaa

SEQ ID NO: 404756 - DNA, 20 bp, Artificial Sequence
  chemically synthesized
ttccgttgttggagatatca

SEQ ID NO: 404757 - DNA, 20 bp, Artificial Sequence
  chemically synthesized
gatatcatggtttaaatttt

SEQ ID NO: 404758 - DNA, 20 bp, Artificial Sequence
  chemically synthesized
atatcatggtttaaattttt

SEQ ID NO: 404759 - DNA, 20 bp, Artificial Sequence
  chemically synthesized
tcatggtttaaatttttagg

SEQ ID NO: 404760 - DNA, 20 bp, Artificial Sequence
  chemically synthesized
tcacacttttatgaatgatt

SEQ ID NO: 404761 - DNA, 20 bp, Artificial Sequence
  chemically synthesized
agtatctcaatcattcataa

SEQ ID NO: 404762 - DNA, 20 bp, Artificial Sequence
  chemically synthesized
tcaatcattcataaaagtgt

SEQ ID NO: 404763 - DNA, 20 bp, Artificial Sequence
  chemically synthesized
cataaaagtgtgagtattct

SEQ ID NO: 404764 - DNA, 20 bp, Artificial Sequence
  chemically synthesized
tgtatctcattgaagtaact

SEQ ID NO: 404765 - DNA, 20 bp, Artificial Sequence
  chemically synthesized
gtattctaagttacttcaat

SEQ ID NO: 404766 - DNA, 20 bp, Artificial Sequence
  chemically synthesized
caaaattttgtatctcattg

SEQ ID NO: 404767 - DNA, 20 bp, Artificial Sequence
  chemically synthesized
ttcaatgagatacaaaattt

SEQ ID NO: 404768 - DNA, 20 bp, Artificial Sequence
  chemically synthesized
caatgagatacaaaattttg

SEQ ID NO: 404769 - DNA, 20 bp, Artificial Sequence
  chemically synthesized
gaagttgaaacatggaagca

SEQ ID NO: 404770 - DNA, 20 bp, Artificial Sequence
  chemically synthesized
tgaagttgaaacatggaagc

SEQ ID NO: 404771 - DNA, 20 bp, Artificial Sequence
  chemically synthesized
ttgaagttgaaacatggaag

SEQ ID NO: 404772 - DNA, 20 bp, Artificial Sequence
  chemically synthesized
cttttgaagttgaaacatgg

SEQ ID NO: 404773 - DNA, 20 bp, Artificial Sequence
  chemically synthesized
ctacttttgaagttgaaaca

SEQ ID NO: 404774 - DNA, 20 bp, Artificial Sequence
  chemically synthesized
cttccatgtttcaacttcaa

SEQ ID NO: 404775 - DNA, 20 bp, Artificial Sequence
  chemically synthesized
ccatgtttcaacttcaaaag

SEQ ID NO: 404776 - DNA, 20 bp, Artificial Sequence
  chemically synthesized
cgaactgacttctacttttg

SEQ ID NO: 404777 - DNA, 20 bp, Artificial Sequence
  chemically synthesized
tgtttcaacttcaaaagtag

SEQ ID NO: 404778 - DNA, 20 bp, Artificial Sequence
  chemically synthesized
tcaacttcaaaagtagaagt

SEQ ID NO: 404779 - DNA, 20 bp, Artificial Sequence
  chemically synthesized
agaagtcagttcgaactccc

SEQ ID NO: 404780 - DNA, 20 bp, Artificial Sequence
  chemically synthesized
tctcaagtgcagtcaccagg

SEQ ID NO: 404781 - DNA, 20 bp, Artificial Sequence
  chemically synthesized
attctcaagtgcagtcacca

SEQ ID NO: 404782 - DNA, 20 bp, Artificial Sequence
  chemically synthesized
tattctcaagtgcagtcacc

SEQ ID NO: 404783 - DNA, 20 bp, Artificial Sequence
  chemically synthesized
ttattctcaagtgcagtcac

SEQ ID NO: 404784 - DNA, 20 bp, Artificial Sequence
  chemically synthesized
actccctggtgactgcactt

SEQ ID NO: 404785 - DNA, 20 bp, Artificial Sequence
  chemically synthesized
tgatagtttattctcaagtg

SEQ ID NO: 404786 - DNA, 20 bp, Artificial Sequence
  chemically synthesized
ttgactgatagtttattctc

SEQ ID NO: 404787 - DNA, 20 bp, Artificial Sequence
  chemically synthesized
tgcacttgagaataaactat

SEQ ID NO: 404788 - DNA, 20 bp, Artificial Sequence
  chemically synthesized
aggagtgtggtattgactga

SEQ ID NO: 404789 - DNA, 20 bp, Artificial Sequence
  chemically synthesized
aaaagaaaagataaggagtg

SEQ ID NO: 404790 - DNA, 20 bp, Artificial Sequence
  chemically synthesized
aaggaaaaagaaaagataag

SEQ ID NO: 404791 - DNA, 20 bp, Artificial Sequence
  chemically synthesized
ggaaggaaaaagaaaagata

SEQ ID NO: 404792 - DNA, 20 bp, Artificial Sequence
  chemically synthesized
aggaaggaaaaagaaaagat

SEQ ID NO: 404793 - DNA, 20 bp, Artificial Sequence
  chemically synthesized
ggcgtaggaaggaaaaagaa

SEQ ID NO: 404794 - DNA, 20 bp, Artificial Sequence
  chemically synthesized
gggtgggcgtaggaaggaaa

SEQ ID NO: 404795 - DNA, 20 bp, Artificial Sequence
  chemically synthesized
ggggtggggtgggcgtagga

SEQ ID NO: 404796 - DNA, 20 bp, Artificial Sequence
  chemically synthesized
tggggtggggtgggcgtagg

SEQ ID NO: 404797 - DNA, 20 bp, Artificial Sequence
  chemically synthesized
gggtggggtggggtgggcgt

SEQ ID NO: 404798 - DNA, 20 bp, Artificial Sequence
  chemically synthesized
ggggtggggtggggtgggcg

SEQ ID NO: 404799 - DNA, 20 bp, Artificial Sequence
  chemically synthesized
ttggtggggtggggtggggt

SEQ ID NO: 404800 - DNA, 20 bp, Artificial Sequence
  chemically synthesized
tttggtggggtggggtgggg

SEQ ID NO: 404801 - DNA, 20 bp, Artificial Sequence
  chemically synthesized
ttgtttggtggggtggggtg

SEQ ID NO: 404802 - DNA, 20 bp, Artificial Sequence
  chemically synthesized
tttgtttggtggggtggggt

SEQ ID NO: 404803 - DNA, 20 bp, Artificial Sequence
  chemically synthesized
gtttgtttggtggggtgggg

SEQ ID NO: 404804 - DNA, 20 bp, Artificial Sequence
  chemically synthesized
tttgtttgtttggtggggtg

SEQ ID NO: 404805 - DNA, 20 bp, Artificial Sequence
  chemically synthesized
gtttgtttgtttggtggggt

SEQ ID NO: 404806 - DNA, 20 bp, Artificial Sequence
  chemically synthesized
tgtttgtttgtttggtgggg

SEQ ID NO: 404807 - DNA, 20 bp, Artificial Sequence
  chemically synthesized
ttttgtttgtttgtttggtg

SEQ ID NO: 404808 - DNA, 20 bp, Artificial Sequence
  chemically synthesized
gttttgtttgtttgtttggt

SEQ ID NO: 404809 - DNA, 20 bp, Artificial Sequence
  chemically synthesized
tgttttgtttgtttgtttgg

SEQ ID NO: 404810 - DNA, 20 bp, Artificial Sequence
  chemically synthesized
ttttgttttgtttgtttgtt

SEQ ID NO: 404811 - DNA, 20 bp, Artificial Sequence
  chemically synthesized
aaacaaacaaacaaaacaaa

SEQ ID NO: 404812 - DNA, 20 bp, Artificial Sequence
  chemically synthesized
aacaaacaaacaaaacaaaa

SEQ ID NO: 404813 - DNA, 20 bp, Artificial Sequence
  chemically synthesized
aacaaacaaaacaaaaaggc

SEQ ID NO: 404814 - DNA, 20 bp, Artificial Sequence
  chemically synthesized
acaaacaaaacaaaaaggcc

SEQ ID NO: 404815 - DNA, 20 bp, Artificial Sequence
  chemically synthesized
acaaaacaaaaaggccagga

SEQ ID NO: 404816 - DNA, 20 bp, Artificial Sequence
  chemically synthesized
aaacaaaaaggccaggacag

SEQ ID NO: 404817 - DNA, 20 bp, Artificial Sequence
  chemically synthesized
aacaaaaaggccaggacagc

SEQ ID NO: 404818 - DNA, 20 bp, Artificial Sequence
  chemically synthesized
aagtgtagaacctgctgtcc

SEQ ID NO: 404819 - DNA, 20 bp, Artificial Sequence
  chemically synthesized
caaaattgcattcaaaagtg

SEQ ID NO: 404820 - DNA, 20 bp, Artificial Sequence
  chemically synthesized
ctgtccaaaattgcattcaa

SEQ ID NO: 404821 - DNA, 20 bp, Artificial Sequence
  chemically synthesized
tacacttttgaatgcaattt

SEQ ID NO: 404822 - DNA, 20 bp, Artificial Sequence
  chemically synthesized
cttttgaatgcaattttgga

SEQ ID NO: 404823 - DNA, 20 bp, Artificial Sequence
  chemically synthesized
ttggacagtgtgccaaatct

SEQ ID NO: 404824 - DNA, 20 bp, Artificial Sequence
  chemically synthesized
gtgatgttgaaactgagatt

SEQ ID NO: 404825 - DNA, 20 bp, Artificial Sequence
  chemically synthesized
taatttgtgatgttgaaact

SEQ ID NO: 404826 - DNA, 20 bp, Artificial Sequence
  chemically synthesized
tcagtttcaacatcacaaat

SEQ ID NO: 404827 - DNA, 20 bp, Artificial Sequence
  chemically synthesized
cagtttcaacatcacaaatt

SEQ ID NO: 404828 - DNA, 20 bp, Artificial Sequence
  chemically synthesized
cacaaattaggtttcacaaa

SEQ ID NO: 404829 - DNA, 20 bp, Artificial Sequence
  chemically synthesized
tcaaaagcattttgtatatt

SEQ ID NO: 404830 - DNA, 20 bp, Artificial Sequence
  chemically synthesized
tgaatatacaaaatgctttt

SEQ ID NO: 404831 - DNA, 20 bp, Artificial Sequence
  chemically synthesized
gaagaaaaaaggtgactcaa

SEQ ID NO: 404832 - DNA, 20 bp, Artificial Sequence
  chemically synthesized
aatttaaaggtgaagaaaaa

SEQ ID NO: 404833 - DNA, 20 bp, Artificial Sequence
  chemically synthesized
taatttaaaggtgaagaaaa

SEQ ID NO: 404834 - DNA, 20 bp, Artificial Sequence
  chemically synthesized
gagcttttaatttaaaggtg

SEQ ID NO: 404835 - DNA, 20 bp, Artificial Sequence
  chemically synthesized
tttcagagcttttaatttaa

SEQ ID NO: 404836 - DNA, 20 bp, Artificial Sequence
  chemically synthesized
atttcagagcttttaattta

SEQ ID NO: 404837 - DNA, 20 bp, Artificial Sequence
  chemically synthesized
tttcttcacctttaaattaa

SEQ ID NO: 404838 - DNA, 20 bp, Artificial Sequence
  chemically synthesized
aaacacttcattgtatttca

SEQ ID NO: 404839 - DNA, 20 bp, Artificial Sequence
  chemically synthesized
gaaaacacttcattgtattt

SEQ ID NO: 404840 - DNA, 20 bp, Artificial Sequence
  chemically synthesized
aaaagctctgaaatacaatg

SEQ ID NO: 404841 - DNA, 20 bp, Artificial Sequence
  chemically synthesized
atacaatgaagtgttttctt

SEQ ID NO: 404842 - DNA, 20 bp, Artificial Sequence
  chemically synthesized
ggaaaagtcatgaaaagctg

SEQ ID NO: 404843 - DNA, 20 bp, Artificial Sequence
  chemically synthesized
ccaatgggaaaagtcatgaa

SEQ ID NO: 404844 - DNA, 20 bp, Artificial Sequence
  chemically synthesized
cttttcatgacttttcccat

SEQ ID NO: 404845 - DNA, 20 bp, Artificial Sequence
  chemically synthesized
tgtgaatcacccaatgggaa

SEQ ID NO: 404846 - DNA, 20 bp, Artificial Sequence
  chemically synthesized
ttttcatgacttttcccatt

SEQ ID NO: 404847 - DNA, 20 bp, Artificial Sequence
  chemically synthesized
ttatctgtgaatcacccaat

SEQ ID NO: 404848 - DNA, 20 bp, Artificial Sequence
  chemically synthesized
gttatctgtgaatcacccaa

SEQ ID NO: 404849 - DNA, 20 bp, Artificial Sequence
  chemically synthesized
ttttcccattgggtgattca

SEQ ID NO: 404850 - DNA, 20 bp, Artificial Sequence
  chemically synthesized
attgggtgattcacagataa

SEQ ID NO: 404851 - DNA, 20 bp, Artificial Sequence
  chemically synthesized
ttgggtgattcacagataac

SEQ ID NO: 404852 - DNA, 20 bp, Artificial Sequence
  chemically synthesized
aatttaataaaaatgtattg

SEQ ID NO: 404853 - DNA, 20 bp, Artificial Sequence
  chemically synthesized
gaatttaataaaaatgtatt

SEQ ID NO: 404854 - DNA, 20 bp, Artificial Sequence
  chemically synthesized
agagaaaggccgtagtagat

SEQ ID NO: 404855 - DNA, 20 bp, Artificial Sequence
  chemically synthesized
aaaatatcacttatctacta

SEQ ID NO: 404856 - DNA, 20 bp, Artificial Sequence
  chemically synthesized
ttattagagaaaggccgtag

SEQ ID NO: 404857 - DNA, 20 bp, Artificial Sequence
  chemically synthesized
tttttattagagaaaggccg

SEQ ID NO: 404858 - DNA, 20 bp, Artificial Sequence
  chemically synthesized
tacttatttttattagagaa

SEQ ID NO: 404859 - DNA, 20 bp, Artificial Sequence
  chemically synthesized
atacttatttttattagaga

SEQ ID NO: 404860 - DNA, 20 bp, Artificial Sequence
  chemically synthesized
aataatacttatttttatta

SEQ ID NO: 404861 - DNA, 20 bp, Artificial Sequence
  chemically synthesized
tgaataatacttatttttat

SEQ ID NO: 404862 - DNA, 20 bp, Artificial Sequence
  chemically synthesized
ggcctttctctaataaaaat

SEQ ID NO: 404863 - DNA, 20 bp, Artificial Sequence
  chemically synthesized
ttattcattgtttccatcta

SEQ ID NO: 404864 - DNA, 20 bp, Artificial Sequence
  chemically synthesized
acagttacccttactttaga

SEQ ID NO: 404865 - DNA, 20 bp, Artificial Sequence
  chemically synthesized
tcattgtttccatctaaagt

SEQ ID NO: 404866 - DNA, 20 bp, Artificial Sequence
  chemically synthesized
cattgtttccatctaaagta

SEQ ID NO: 404867 - DNA, 20 bp, Artificial Sequence
  chemically synthesized
attgtttccatctaaagtaa

SEQ ID NO: 404868 - DNA, 20 bp, Artificial Sequence
  chemically synthesized
cattacagttacccttactt

SEQ ID NO: 404869 - DNA, 20 bp, Artificial Sequence
  chemically synthesized
attcgacatgttaatcatta

SEQ ID NO: 404870 - DNA, 20 bp, Artificial Sequence
  chemically synthesized
aatgattaacatgtcgaatg

SEQ ID NO: 404871 - DNA, 20 bp, Artificial Sequence
  chemically synthesized
atgtcgaatgtggatatccc

SEQ ID NO: 404872 - DNA, 20 bp, Artificial Sequence
  chemically synthesized
gtcgaatgtggatatcccaa

SEQ ID NO: 404873 - DNA, 20 bp, Artificial Sequence
  chemically synthesized
tcgaatgtggatatcccaag

SEQ ID NO: 404874 - DNA, 20 bp, Artificial Sequence
  chemically synthesized
cgaatgtggatatcccaaga

SEQ ID NO: 404875 - DNA, 20 bp, Artificial Sequence
  chemically synthesized
cgtaagtattttaccctctt

SEQ ID NO: 404876 - DNA, 20 bp, Artificial Sequence
  chemically synthesized
gcgtaagtattttaccctct

SEQ ID NO: 404877 - DNA, 20 bp, Artificial Sequence
  chemically synthesized
ttgattatgatggaaagcgt

SEQ ID NO: 404878 - DNA, 20 bp, Artificial Sequence
  chemically synthesized
aggaacttgattatgatgga

SEQ ID NO: 404879 - DNA, 20 bp, Artificial Sequence
  chemically synthesized
gaagaggaacttgattatga

SEQ ID NO: 404880 - DNA, 20 bp, Artificial Sequence
  chemically synthesized
ttacgctttccatcataatc

SEQ ID NO: 404881 - DNA, 20 bp, Artificial Sequence
  chemically synthesized
ttttacatcctaagcagaag

SEQ ID NO: 404882 - DNA, 20 bp, Artificial Sequence
  chemically synthesized
aatcaagttcctcttctgct

SEQ ID NO: 404883 - DNA, 20 bp, Artificial Sequence
  chemically synthesized
tttttacatcctaagcagaa

SEQ ID NO: 404884 - DNA, 20 bp, Artificial Sequence
  chemically synthesized
atcaagttcctcttctgctt

SEQ ID NO: 404885 - DNA, 20 bp, Artificial Sequence
  chemically synthesized
catttttacatcctaagcag

SEQ ID NO: 404886 - DNA, 20 bp, Artificial Sequence
  chemically synthesized
tagcatttttacatcctaag

SEQ ID NO: 404887 - DNA, 20 bp, Artificial Sequence
  chemically synthesized
atatagcatttttacatcct

SEQ ID NO: 404888 - DNA, 20 bp, Artificial Sequence
  chemically synthesized
aggatgtaaaaatgctatat

SEQ ID NO: 404889 - DNA, 20 bp, Artificial Sequence
  chemically synthesized
ggtggagcaacgttcttata

SEQ ID NO: 404890 - DNA, 20 bp, Artificial Sequence
  chemically synthesized
ctgctttttctcattgggtg

SEQ ID NO: 404891 - DNA, 20 bp, Artificial Sequence
  chemically synthesized
agaacgttgctccacccaat

SEQ ID NO: 404892 - DNA, 20 bp, Artificial Sequence
  chemically synthesized
ccctgctttttctcattggg

SEQ ID NO: 404893 - DNA, 20 bp, Artificial Sequence
  chemically synthesized
tcaccctgctttttctcatt

SEQ ID NO: 404894 - DNA, 20 bp, Artificial Sequence
  chemically synthesized
atcaccctgctttttctcat

SEQ ID NO: 404895 - DNA, 20 bp, Artificial Sequence
  chemically synthesized
ttgctccacccaatgagaaa

SEQ ID NO: 404896 - DNA, 20 bp, Artificial Sequence
  chemically synthesized
ctccacccaatgagaaaaag

SEQ ID NO: 404897 - DNA, 20 bp, Artificial Sequence
  chemically synthesized
tccacccaatgagaaaaagc

SEQ ID NO: 404898 - DNA, 20 bp, Artificial Sequence
  chemically synthesized
ccacccaatgagaaaaagca

SEQ ID NO: 404899 - DNA, 20 bp, Artificial Sequence
  chemically synthesized
caaaaaataatacgttttta

SEQ ID NO: 404900 - DNA, 20 bp, Artificial Sequence
  chemically synthesized
ataaaaacgtattatttttt

SEQ ID NO: 404901 - DNA, 20 bp, Artificial Sequence
  chemically synthesized
tattttttgagccatttata

SEQ ID NO: 404902 - DNA, 20 bp, Artificial Sequence
  chemically synthesized
tgtggccacagctatataaa

SEQ ID NO: 404903 - DNA, 20 bp, Artificial Sequence
  chemically synthesized
ttgagccatttatatagctg

SEQ ID NO: 404904 - DNA, 20 bp, Artificial Sequence
  chemically synthesized
atttatatagctgtggccac

SEQ ID NO: 404905 - DNA, 20 bp, Artificial Sequence
  chemically synthesized
acctcgttgccttgtggcca

SEQ ID NO: 404906 - DNA, 20 bp, Artificial Sequence
  chemically synthesized
tttatatagctgtggccaca

SEQ ID NO: 404907 - DNA, 20 bp, Artificial Sequence
  chemically synthesized
tggctcacctcgttgccttg

SEQ ID NO: 404908 - DNA, 20 bp, Artificial Sequence
  chemically synthesized
agctgtggccacaaggcaac

SEQ ID NO: 404909 - DNA, 20 bp, Artificial Sequence
  chemically synthesized
gctgtggccacaaggcaacg

SEQ ID NO: 404910 - DNA, 20 bp, Artificial Sequence
  chemically synthesized
tggccacaaggcaacgaggt

SEQ ID NO: 404911 - DNA, 20 bp, Artificial Sequence
  chemically synthesized
caaggcaacgaggtgagcca

SEQ ID NO: 404912 - DNA, 20 bp, Artificial Sequence
  chemically synthesized
tggaggagattgaagtactt

SEQ ID NO: 404913 - DNA, 20 bp, Artificial Sequence
  chemically synthesized
tctctccttggaggagattg

SEQ ID NO: 404914 - DNA, 20 bp, Artificial Sequence
  chemically synthesized
aaagtacttcaatctcctcc

SEQ ID NO: 404915 - DNA, 20 bp, Artificial Sequence
  chemically synthesized
aagtacttcaatctcctcca

SEQ ID NO: 404916 - DNA, 20 bp, Artificial Sequence
  chemically synthesized
gtacttcaatctcctccaag

SEQ ID NO: 404917 - DNA, 20 bp, Artificial Sequence
  chemically synthesized
tatccagtctctccttggag

SEQ ID NO: 404918 - DNA, 20 bp, Artificial Sequence
  chemically synthesized
acttcaatctcctccaagga

SEQ ID NO: 404919 - DNA, 20 bp, Artificial Sequence
  chemically synthesized
tgtatccagtctctccttgg

SEQ ID NO: 404920 - DNA, 20 bp, Artificial Sequence
  chemically synthesized
atgtatccagtctctccttg

SEQ ID NO: 404921 - DNA, 20 bp, Artificial Sequence
  chemically synthesized
tcatgtatccagtctctcct

SEQ ID NO: 404922 - DNA, 20 bp, Artificial Sequence
  chemically synthesized
aatctcctccaaggagagac

SEQ ID NO: 404923 - DNA, 20 bp, Artificial Sequence
  chemically synthesized
aggtaaacctttcatgtatc

SEQ ID NO: 404924 - DNA, 20 bp, Artificial Sequence
  chemically synthesized
aggagagactggatacatga

SEQ ID NO: 404925 - DNA, 20 bp, Artificial Sequence
  chemically synthesized
ggagagactggatacatgaa

SEQ ID NO: 404926 - DNA, 20 bp, Artificial Sequence
  chemically synthesized
atacatgaaaggtttacctt

SEQ ID NO: 404927 - DNA, 20 bp, Artificial Sequence
  chemically synthesized
catgaaaggtttacctttgg

SEQ ID NO: 404928 - DNA, 20 bp, Artificial Sequence
  chemically synthesized
atgaaaggtttacctttggc

SEQ ID NO: 404929 - DNA, 20 bp, Artificial Sequence
  chemically synthesized
tgaaaggtttacctttggca

SEQ ID NO: 404930 - DNA, 20 bp, Artificial Sequence
  chemically synthesized
ttcctccagttccctgccaa

SEQ ID NO: 404931 - DNA, 20 bp, Artificial Sequence
  chemically synthesized
cttcctccagttccctgcca

SEQ ID NO: 404932 - DNA, 20 bp, Artificial Sequence
  chemically synthesized
gtttacctttggcagggaac

SEQ ID NO: 404933 - DNA, 20 bp, Artificial Sequence
  chemically synthesized
ttacctttggcagggaactg

SEQ ID NO: 404934 - DNA, 20 bp, Artificial Sequence
  chemically synthesized
tacctttggcagggaactgg

SEQ ID NO: 404935 - DNA, 20 bp, Artificial Sequence
  chemically synthesized
ctttggcagggaactggagg

SEQ ID NO: 404936 - DNA, 20 bp, Artificial Sequence
  chemically synthesized
tggcagggaactggaggaag

SEQ ID NO: 404937 - DNA, 20 bp, Artificial Sequence
  chemically synthesized
acgatgactacttcttcctc

SEQ ID NO: 404938 - DNA, 20 bp, Artificial Sequence
  chemically synthesized
cagggaactggaggaagaag

SEQ ID NO: 404939 - DNA, 20 bp, Artificial Sequence
  chemically synthesized
ggaggaagaagtagtcatcg

SEQ ID NO: 404940 - DNA, 20 bp, Artificial Sequence
  chemically synthesized
gaggaagaagtagtcatcgt

SEQ ID NO: 404941 - DNA, 20 bp, Artificial Sequence
  chemically synthesized
ggaagaagtagtcatcgtag

SEQ ID NO: 404942 - DNA, 20 bp, Artificial Sequence
  chemically synthesized
agaagtagtcatcgtaggag

SEQ ID NO: 404943 - DNA, 20 bp, Artificial Sequence
  chemically synthesized
gaagtagtcatcgtaggagc

SEQ ID NO: 404944 - DNA, 20 bp, Artificial Sequence
  chemically synthesized
gtcatcgtaggagcaggaaa

SEQ ID NO: 404945 - DNA, 20 bp, Artificial Sequence
  chemically synthesized
taggagcaggaaaaagaaaa

SEQ ID NO: 404946 - DNA, 20 bp, Artificial Sequence
  chemically synthesized
aagaaaatagctccaattgt

SEQ ID NO: 404947 - DNA, 20 bp, Artificial Sequence
  chemically synthesized
ttaagaatgccttacaattg

SEQ ID NO: 404948 - DNA, 20 bp, Artificial Sequence
  chemically synthesized
agaaaatagctccaattgta

SEQ ID NO: 404949 - DNA, 20 bp, Artificial Sequence
  chemically synthesized
ttttaagaatgccttacaat

SEQ ID NO: 404950 - DNA, 20 bp, Artificial Sequence
  chemically synthesized
caattgtaaggcattcttaa

SEQ ID NO: 404951 - DNA, 20 bp, Artificial Sequence
  chemically synthesized
tgtaaggcattcttaaaagt

SEQ ID NO: 404952 - DNA, 20 bp, Artificial Sequence
  chemically synthesized
gtaaggcattcttaaaagtc

SEQ ID NO: 404953 - DNA, 20 bp, Artificial Sequence
  chemically synthesized
ccagcccacacctgactttt

SEQ ID NO: 404954 - DNA, 20 bp, Artificial Sequence
  chemically synthesized
gcattcttaaaagtcaggtg

SEQ ID NO: 404955 - DNA, 20 bp, Artificial Sequence
  chemically synthesized
cattcttaaaagtcaggtgt

SEQ ID NO: 404956 - DNA, 20 bp, Artificial Sequence
  chemically synthesized
cttaaaagtcaggtgtgggc

SEQ ID NO: 404957 - DNA, 20 bp, Artificial Sequence
  chemically synthesized
aggatgctgaaatgtcatac

SEQ ID NO: 404958 - DNA, 20 bp, Artificial Sequence
  chemically synthesized
tgtgggctggtatgacattt

SEQ ID NO: 404959 - DNA, 20 bp, Artificial Sequence
  chemically synthesized
gtatgacatttcagcatcct

SEQ ID NO: 404960 - DNA, 20 bp, Artificial Sequence
  chemically synthesized
tccttcggtctgcatttcca

SEQ ID NO: 404961 - DNA, 20 bp, Artificial Sequence
  chemically synthesized
tttcagcatccttggaaatg

SEQ ID NO: 404962 - DNA, 20 bp, Artificial Sequence
  chemically synthesized
ctccttcggtctgcatttcc

SEQ ID NO: 404963 - DNA, 20 bp, Artificial Sequence
  chemically synthesized
atccttggaaatgcagaccg

SEQ ID NO: 404964 - DNA, 20 bp, Artificial Sequence
  chemically synthesized
tccttggaaatgcagaccga

SEQ ID NO: 404965 - DNA, 20 bp, Artificial Sequence
  chemically synthesized
cttggaaatgcagaccgaag

SEQ ID NO: 404966 - DNA, 20 bp, Artificial Sequence
  chemically synthesized
agaatgagtgcagactcctt

SEQ ID NO: 404967 - DNA, 20 bp, Artificial Sequence
  chemically synthesized
aaagaattccagaatgagtg

SEQ ID NO: 404968 - DNA, 20 bp, Artificial Sequence
  chemically synthesized
gaaggagtctgcactcattc

SEQ ID NO: 404969 - DNA, 20 bp, Artificial Sequence
  chemically synthesized
gtggaaaagaattccagaat

SEQ ID NO: 404970 - DNA, 20 bp, Artificial Sequence
  chemically synthesized
aagtttgtggaaaagaattc

SEQ ID NO: 404971 - DNA, 20 bp, Artificial Sequence
  chemically synthesized
cccaatagaagtttgtggaa

SEQ ID NO: 404972 - DNA, 20 bp, Artificial Sequence
  chemically synthesized
aagttcccaatagaagtttg

SEQ ID NO: 404973 - DNA, 20 bp, Artificial Sequence
  chemically synthesized
tcttttccacaaacttctat

SEQ ID NO: 404974 - DNA, 20 bp, Artificial Sequence
  chemically synthesized
cttttccacaaacttctatt

SEQ ID NO: 404975 - DNA, 20 bp, Artificial Sequence
  chemically synthesized
tttttgcaagttcccaatag

SEQ ID NO: 404976 - DNA, 20 bp, Artificial Sequence
  chemically synthesized
acttttttgcaagttcccaa

SEQ ID NO: 404977 - DNA, 20 bp, Artificial Sequence
  chemically synthesized
tctattgggaacttgcaaaa

SEQ ID NO: 404978 - DNA, 20 bp, Artificial Sequence
  chemically synthesized
cctacgccttacttttttgc

SEQ ID NO: 404979 - DNA, 20 bp, Artificial Sequence
  chemically synthesized
ttgggaacttgcaaaaaagt

SEQ ID NO: 404980 - DNA, 20 bp, Artificial Sequence
  chemically synthesized
tgggaacttgcaaaaaagta

SEQ ID NO: 404981 - DNA, 20 bp, Artificial Sequence
  chemically synthesized
acttgcaaaaaagtaaggcg

SEQ ID NO: 404982 - DNA, 20 bp, Artificial Sequence
  chemically synthesized
cttgcaaaaaagtaaggcgt

SEQ ID NO: 404983 - DNA, 20 bp, Artificial Sequence
  chemically synthesized
aaaaaagtaaggcgtaggac

SEQ ID NO: 404984 - DNA, 20 bp, Artificial Sequence
  chemically synthesized
aaaagtaaggcgtaggacaa

SEQ ID NO: 404985 - DNA, 20 bp, Artificial Sequence
  chemically synthesized
gtaaggcgtaggacaagaga

SEQ ID NO: 404986 - DNA, 20 bp, Artificial Sequence
  chemically synthesized
taaggcgtaggacaagagat

SEQ ID NO: 404987 - DNA, 20 bp, Artificial Sequence
  chemically synthesized
ggcgtaggacaagagatagg

SEQ ID NO: 404988 - DNA, 20 bp, Artificial Sequence
  chemically synthesized
gtaggacaagagataggaag

SEQ ID NO: 404989 - DNA, 20 bp, Artificial Sequence
  chemically synthesized
agataggaagaagctcccct

SEQ ID NO: 404990 - DNA, 20 bp, Artificial Sequence
  chemically synthesized
tgtttgtgtgtcactgaggg

SEQ ID NO: 404991 - DNA, 20 bp, Artificial Sequence
  chemically synthesized
catgtttgtgtgtcactgag

SEQ ID NO: 404992 - DNA, 20 bp, Artificial Sequence
  chemically synthesized
tcatgtttgtgtgtcactga

SEQ ID NO: 404993 - DNA, 20 bp, Artificial Sequence
  chemically synthesized
ttcatgtttgtgtgtcactg

SEQ ID NO: 404994 - DNA, 20 bp, Artificial Sequence
  chemically synthesized
cttcatgtttgtgtgtcact

SEQ ID NO: 404995 - DNA, 20 bp, Artificial Sequence
  chemically synthesized
ctcagtgacacacaaacatg

SEQ ID NO: 404996 - DNA, 20 bp, Artificial Sequence
  chemically synthesized
atgaagtcaaacccattttc

SEQ ID NO: 404997 - DNA, 20 bp, Artificial Sequence
  chemically synthesized
aagaggagggtctggaaaat

SEQ ID NO: 404998 - DNA, 20 bp, Artificial Sequence
  chemically synthesized
gaagaggagggtctggaaaa

SEQ ID NO: 404999 - DNA, 20 bp, Artificial Sequence
  chemically synthesized
ccttttagaagaggagggtc

SEQ ID NO: 405000 - DNA, 20 bp, Artificial Sequence
  chemically synthesized
ttacgccttttagaagagga

SEQ ID NO: 405001 - DNA, 20 bp, Artificial Sequence
  chemically synthesized
cttacgccttttagaagagg

SEQ ID NO: 405002 - DNA, 20 bp, Artificial Sequence
  chemically synthesized
tcttacgccttttagaagag

SEQ ID NO: 405003 - DNA, 20 bp, Artificial Sequence
  chemically synthesized
tccagaccctcctcttctaa

SEQ ID NO: 405004 - DNA, 20 bp, Artificial Sequence
  chemically synthesized
aatcttacgccttttagaag

SEQ ID NO: 405005 - DNA, 20 bp, Artificial Sequence
  chemically synthesized
ccagaccctcctcttctaaa

SEQ ID NO: 405006 - DNA, 20 bp, Artificial Sequence
  chemically synthesized
aaatcttacgccttttagaa

SEQ ID NO: 405007 - DNA, 20 bp, Artificial Sequence
  chemically synthesized
ttaaatcttacgccttttag

SEQ ID NO: 405008 - DNA, 20 bp, Artificial Sequence
  chemically synthesized
tccttaaatcttacgccttt

SEQ ID NO: 405009 - DNA, 20 bp, Artificial Sequence
  chemically synthesized
cctcctcttctaaaaggcgt

SEQ ID NO: 405010 - DNA, 20 bp, Artificial Sequence
  chemically synthesized
ttctaaaaggcgtaagattt

SEQ ID NO: 405011 - DNA, 20 bp, Artificial Sequence
  chemically synthesized
tctaaaaggcgtaagattta

SEQ ID NO: 405012 - DNA, 20 bp, Artificial Sequence
  chemically synthesized
aaaggcgtaagatttaagga

SEQ ID NO: 405013 - DNA, 20 bp, Artificial Sequence
  chemically synthesized
taaggaaagatactaaactg

SEQ ID NO: 405014 - DNA, 20 bp, Artificial Sequence
  chemically synthesized
aaggaaagatactaaactga

SEQ ID NO: 405015 - DNA, 20 bp, Artificial Sequence
  chemically synthesized
ttagtatctttccttcagtt

SEQ ID NO: 405016 - DNA, 20 bp, Artificial Sequence
  chemically synthesized
aaagatactaaactgaagga

SEQ ID NO: 405017 - DNA, 20 bp, Artificial Sequence
  chemically synthesized
agagtttagtatctttcctt

SEQ ID NO: 405018 - DNA, 20 bp, Artificial Sequence
  chemically synthesized
gtcccatgggtggtagagtt

SEQ ID NO: 405019 - DNA, 20 bp, Artificial Sequence
  chemically synthesized
ggcgggtcccatgggtggta

SEQ ID NO: 405020 - DNA, 20 bp, Artificial Sequence
  chemically synthesized
atactaaactctaccaccca

SEQ ID NO: 405021 - DNA, 20 bp, Artificial Sequence
  chemically synthesized
caggcgggtcccatgggtgg

SEQ ID NO: 405022 - DNA, 20 bp, Artificial Sequence
  chemically synthesized
tactaaactctaccacccat

SEQ ID NO: 405023 - DNA, 20 bp, Artificial Sequence
  chemically synthesized
gaacaggcgggtcccatggg

SEQ ID NO: 405024 - DNA, 20 bp, Artificial Sequence
  chemically synthesized
tctgaacaggcgggtcccat

SEQ ID NO: 405025 - DNA, 20 bp, Artificial Sequence
  chemically synthesized
ctctgaacaggcgggtccca

SEQ ID NO: 405026 - DNA, 20 bp, Artificial Sequence
  chemically synthesized
acccatgggacccgcctgtt

SEQ ID NO: 405027 - DNA, 20 bp, Artificial Sequence
  chemically synthesized
cccaacccctctgaacaggc

SEQ ID NO: 405028 - DNA, 20 bp, Artificial Sequence
  chemically synthesized
ccccaacccctctgaacagg

SEQ ID NO: 405029 - DNA, 20 bp, Artificial Sequence
  chemically synthesized
ccatgggacccgcctgttca

SEQ ID NO: 405030 - DNA, 20 bp, Artificial Sequence
  chemically synthesized
catgggacccgcctgttcag

SEQ ID NO: 405031 - DNA, 20 bp, Artificial Sequence
  chemically synthesized
atgggacccgcctgttcaga

SEQ ID NO: 405032 - DNA, 20 bp, Artificial Sequence
  chemically synthesized
cttccccaacccctctgaac

SEQ ID NO: 405033 - DNA, 20 bp, Artificial Sequence
  chemically synthesized
tgggacccgcctgttcagag

SEQ ID NO: 405034 - DNA, 20 bp, Artificial Sequence
  chemically synthesized
ccttccccaacccctctgaa

SEQ ID NO: 405035 - DNA, 20 bp, Artificial Sequence
  chemically synthesized
acccgcctgttcagaggggt

SEQ ID NO: 405036 - DNA, 20 bp, Artificial Sequence
  chemically synthesized
cccgcctgttcagaggggtt

SEQ ID NO: 405037 - DNA, 20 bp, Artificial Sequence
  chemically synthesized
ccgcctgttcagaggggttg

SEQ ID NO: 405038 - DNA, 20 bp, Artificial Sequence
  chemically synthesized
cctgttcagaggggttgggg

SEQ ID NO: 405039 - DNA, 20 bp, Artificial Sequence
  chemically synthesized
ctgttcagaggggttgggga

SEQ ID NO: 405040 - DNA, 20 bp, Artificial Sequence
  chemically synthesized
ttcagaggggttggggaagg

SEQ ID NO: 405041 - DNA, 20 bp, Artificial Sequence
  chemically synthesized
agaggggttggggaaggtag

SEQ ID NO: 405042 - DNA, 20 bp, Artificial Sequence
  chemically synthesized
tggggaaggtagaagccact

SEQ ID NO: 405043 - DNA, 20 bp, Artificial Sequence
  chemically synthesized
gggaaggtagaagccactga

SEQ ID NO: 405044 - DNA, 20 bp, Artificial Sequence
  chemically synthesized
gaaggtagaagccactgaga

SEQ ID NO: 405045 - DNA, 20 bp, Artificial Sequence
  chemically synthesized
aaggtagaagccactgagag

SEQ ID NO: 405046 - DNA, 20 bp, Artificial Sequence
  chemically synthesized
gtatcttgaccctctctcag

SEQ ID NO: 405047 - DNA, 20 bp, Artificial Sequence
  chemically synthesized
aggtagaagccactgagaga

SEQ ID NO: 405048 - DNA, 20 bp, Artificial Sequence
  chemically synthesized
agggtatcttgaccctctct

SEQ ID NO: 405049 - DNA, 20 bp, Artificial Sequence
  chemically synthesized
gaagccactgagagagggtc

SEQ ID NO: 405050 - DNA, 20 bp, Artificial Sequence
  chemically synthesized
gagggtcaagataccctctt

SEQ ID NO: 405051 - DNA, 20 bp, Artificial Sequence
  chemically synthesized
ggtcaagataccctctttgg

SEQ ID NO: 405052 - DNA, 20 bp, Artificial Sequence
  chemically synthesized
tcatactgctcttccaaaga

SEQ ID NO: 405053 - DNA, 20 bp, Artificial Sequence
  chemically synthesized
atcatactgctcttccaaag

SEQ ID NO: 405054 - DNA, 20 bp, Artificial Sequence
  chemically synthesized
tcaagataccctctttggaa

SEQ ID NO: 405055 - DNA, 20 bp, Artificial Sequence
  chemically synthesized
tatcatactgctcttccaaa

SEQ ID NO: 405056 - DNA, 20 bp, Artificial Sequence
  chemically synthesized
gttatcatactgctcttcca

SEQ ID NO: 405057 - DNA, 20 bp, Artificial Sequence
  chemically synthesized
agataccctctttggaagag

SEQ ID NO: 405058 - DNA, 20 bp, Artificial Sequence
  chemically synthesized
gagcagtatgataacctctt

SEQ ID NO: 405059 - DNA, 20 bp, Artificial Sequence
  chemically synthesized
tgcagaatcctgggccaaag

SEQ ID NO: 405060 - DNA, 20 bp, Artificial Sequence
  chemically synthesized
gtatgataacctctttggcc

SEQ ID NO: 405061 - DNA, 20 bp, Artificial Sequence
  chemically synthesized
gtgcagaatcctgggccaaa

SEQ ID NO: 405062 - DNA, 20 bp, Artificial Sequence
  chemically synthesized
tatgataacctctttggccc

SEQ ID NO: 405063 - DNA, 20 bp, Artificial Sequence
  chemically synthesized
tggtgcagaatcctgggcca

SEQ ID NO: 405064 - DNA, 20 bp, Artificial Sequence
  chemically synthesized
ttttattggtgcagaatcct

SEQ ID NO: 405065 - DNA, 20 bp, Artificial Sequence
  chemically synthesized
tttttattggtgcagaatcc

SEQ ID NO: 405066 - DNA, 20 bp, Artificial Sequence
  chemically synthesized
tcattctgtttttattggtg

SEQ ID NO: 405067 - DNA, 20 bp, Artificial Sequence
  chemically synthesized
ggattctgcaccaataaaaa

SEQ ID NO: 405068 - DNA, 20 bp, Artificial Sequence
  chemically synthesized
acagatcattctgtttttat

SEQ ID NO: 405069 - DNA, 20 bp, Artificial Sequence
  chemically synthesized
acagaatgatctgttaccac

SEQ ID NO: 405070 - DNA, 20 bp, Artificial Sequence
  chemically synthesized
tgtctctcccctagtggtaa

SEQ ID NO: 405071 - DNA, 20 bp, Artificial Sequence
  chemically synthesized
cagaatgatctgttaccact

SEQ ID NO: 405072 - DNA, 20 bp, Artificial Sequence
  chemically synthesized
agaatgatctgttaccacta

SEQ ID NO: 405073 - DNA, 20 bp, Artificial Sequence
  chemically synthesized
gaatgatctgttaccactag

SEQ ID NO: 405074 - DNA, 20 bp, Artificial Sequence
  chemically synthesized
atgatctgttaccactaggg

SEQ ID NO: 405075 - DNA, 20 bp, Artificial Sequence
  chemically synthesized
tatgcctgtctctcccctag

SEQ ID NO: 405076 - DNA, 20 bp, Artificial Sequence
  chemically synthesized
gatctgttaccactagggga

SEQ ID NO: 405077 - DNA, 20 bp, Artificial Sequence
  chemically synthesized
ttatatgcctgtctctcccc

SEQ ID NO: 405078 - DNA, 20 bp, Artificial Sequence
  chemically synthesized
tgttaccactaggggagaga

SEQ ID NO: 405079 - DNA, 20 bp, Artificial Sequence
  chemically synthesized
gttaccactaggggagagac

SEQ ID NO: 405080 - DNA, 20 bp, Artificial Sequence
  chemically synthesized
taggggagagacaggcatat

SEQ ID NO: 405081 - DNA, 20 bp, Artificial Sequence
  chemically synthesized
aggggagagacaggcatata

SEQ ID NO: 405082 - DNA, 20 bp, Artificial Sequence
  chemically synthesized
ttccatcctcagttttcagc

SEQ ID NO: 405083 - DNA, 20 bp, Artificial Sequence
  chemically synthesized
tataaggcttgctgaaaact

SEQ ID NO: 405084 - DNA, 20 bp, Artificial Sequence
  chemically synthesized
ataaggcttgctgaaaactg

SEQ ID NO: 405085 - DNA, 20 bp, Artificial Sequence
  chemically synthesized
cttgttccatcctcagtttt

SEQ ID NO: 405086 - DNA, 20 bp, Artificial Sequence
  chemically synthesized
ggcttgctgaaaactgagga

SEQ ID NO: 405087 - DNA, 20 bp, Artificial Sequence
  chemically synthesized
ctatcttcttgttccatcct

SEQ ID NO: 405088 - DNA, 20 bp, Artificial Sequence
  chemically synthesized
ctgaaaactgaggatggaac

SEQ ID NO: 405089 - DNA, 20 bp, Artificial Sequence
  chemically synthesized
aaaactgaggatggaacaag

SEQ ID NO: 405090 - DNA, 20 bp, Artificial Sequence
  chemically synthesized
ctgaggatggaacaagaaga

SEQ ID NO: 405091 - DNA, 20 bp, Artificial Sequence
  chemically synthesized
caagaagatagaaatccctt

SEQ ID NO: 405092 - DNA, 20 bp, Artificial Sequence
  chemically synthesized
aagaagatagaaatcccttt

SEQ ID NO: 405093 - DNA, 20 bp, Artificial Sequence
  chemically synthesized
atagtgtctgcggtcctaaa

SEQ ID NO: 405094 - DNA, 20 bp, Artificial Sequence
  chemically synthesized
aatagtgtctgcggtcctaa

SEQ ID NO: 405095 - DNA, 20 bp, Artificial Sequence
  chemically synthesized
taatagtgtctgcggtccta

SEQ ID NO: 405096 - DNA, 20 bp, Artificial Sequence
  chemically synthesized
tagaaatccctttaggaccg

SEQ ID NO: 405097 - DNA, 20 bp, Artificial Sequence
  chemically synthesized
gcttaatgtaatagtgtctg

SEQ ID NO: 405098 - DNA, 20 bp, Artificial Sequence
  chemically synthesized
accgcagacactattacatt

SEQ ID NO: 405099 - DNA, 20 bp, Artificial Sequence
  chemically synthesized
ctatcccgtgcttaatgtaa

SEQ ID NO: 405100 - DNA, 20 bp, Artificial Sequence
  chemically synthesized
agacactattacattaagca

SEQ ID NO: 405101 - DNA, 20 bp, Artificial Sequence
  chemically synthesized
gacactattacattaagcac

SEQ ID NO: 405102 - DNA, 20 bp, Artificial Sequence
  chemically synthesized
ctattacattaagcacggga

SEQ ID NO: 405103 - DNA, 20 bp, Artificial Sequence
  chemically synthesized
ttacattaagcacgggatag

SEQ ID NO: 405104 - DNA, 20 bp, Artificial Sequence
  chemically synthesized
cattaagcacgggatagcag

SEQ ID NO: 405105 - DNA, 20 bp, Artificial Sequence
  chemically synthesized
acgggatagcagcagcccat

SEQ ID NO: 405106 - DNA, 20 bp, Artificial Sequence
  chemically synthesized
ggatagcagcagcccatcag

SEQ ID NO: 405107 - DNA, 20 bp, Artificial Sequence
  chemically synthesized
atagcagcagcccatcagtg

SEQ ID NO: 405108 - DNA, 20 bp, Artificial Sequence
  chemically synthesized
cttcaaagacctccactgat

SEQ ID NO: 405109 - DNA, 20 bp, Artificial Sequence
  chemically synthesized
tagcagcagcccatcagtgg

SEQ ID NO: 405110 - DNA, 20 bp, Artificial Sequence
  chemically synthesized
tcttcaaagacctccactga

SEQ ID NO: 405111 - DNA, 20 bp, Artificial Sequence
  chemically synthesized
cccatcagtggaggtctttg

SEQ ID NO: 405112 - DNA, 20 bp, Artificial Sequence
  chemically synthesized
tcagaacactacagtcttca

SEQ ID NO: 405113 - DNA, 20 bp, Artificial Sequence
  chemically synthesized
gtggaggtctttgaagactg

SEQ ID NO: 405114 - DNA, 20 bp, Artificial Sequence
  chemically synthesized
tagcaaccttcagaacacta

SEQ ID NO: 405115 - DNA, 20 bp, Artificial Sequence
  chemically synthesized
ttgaagactgtagtgttctg

SEQ ID NO: 405116 - DNA, 20 bp, Artificial Sequence
  chemically synthesized
tgaagactgtagtgttctga

SEQ ID NO: 405117 - DNA, 20 bp, Artificial Sequence
  chemically synthesized
gttgttgctgtagcaacctt

SEQ ID NO: 405118 - DNA, 20 bp, Artificial Sequence
  chemically synthesized
tagtgttctgaaggttgcta

SEQ ID NO: 405119 - DNA, 20 bp, Artificial Sequence
  chemically synthesized
ggcgggggttgttgttgctg

SEQ ID NO: 405120 - DNA, 20 bp, Artificial Sequence
  chemically synthesized
gagctggtttggaggggcgg

SEQ ID NO: 405121 - DNA, 20 bp, Artificial Sequence
  chemically synthesized
tgagctggtttggaggggcg

SEQ ID NO: 405122 - DNA, 20 bp, Artificial Sequence
  chemically synthesized
ttgagctggtttggaggggc

SEQ ID NO: 405123 - DNA, 20 bp, Artificial Sequence
  chemically synthesized
attgagctggtttggagggg

SEQ ID NO: 405124 - DNA, 20 bp, Artificial Sequence
  chemically synthesized
agtattgagctggtttggag

SEQ ID NO: 405125 - DNA, 20 bp, Artificial Sequence
  chemically synthesized
caacccccgcccctccaaac

SEQ ID NO: 405126 - DNA, 20 bp, Artificial Sequence
  chemically synthesized
tagtattgagctggtttgga

SEQ ID NO: 405127 - DNA, 20 bp, Artificial Sequence
  chemically synthesized
ttagtattgagctggtttgg

SEQ ID NO: 405128 - DNA, 20 bp, Artificial Sequence
  chemically synthesized
gttagtattgagctggtttg

SEQ ID NO: 405129 - DNA, 20 bp, Artificial Sequence
  chemically synthesized
gtgttagtattgagctggtt

SEQ ID NO: 405130 - DNA, 20 bp, Artificial Sequence
  chemically synthesized
cagtggtgttagtattgagc

SEQ ID NO: 405131 - DNA, 20 bp, Artificial Sequence
  chemically synthesized
gagtcagtggtgttagtatt

SEQ ID NO: 405132 - DNA, 20 bp, Artificial Sequence
  chemically synthesized
ggggtttgagtcagtggtgt

SEQ ID NO: 405133 - DNA, 20 bp, Artificial Sequence
  chemically synthesized
tagtatggggtttgagtcag

SEQ ID NO: 405134 - DNA, 20 bp, Artificial Sequence
  chemically synthesized
tgctagtatggggtttgagt

SEQ ID NO: 405135 - DNA, 20 bp, Artificial Sequence
  chemically synthesized
atactgctagtatggggttt

SEQ ID NO: 405136 - DNA, 20 bp, Artificial Sequence
  chemically synthesized
cactgactcaaaccccatac

SEQ ID NO: 405137 - DNA, 20 bp, Artificial Sequence
  chemically synthesized
tctgtcatactgctagtatg

SEQ ID NO: 405138 - DNA, 20 bp, Artificial Sequence
  chemically synthesized
tgactcaaaccccatactag

SEQ ID NO: 405139 - DNA, 20 bp, Artificial Sequence
  chemically synthesized
ttctgtcatactgctagtat

SEQ ID NO: 405140 - DNA, 20 bp, Artificial Sequence
  chemically synthesized
tttctgtcatactgctagta

SEQ ID NO: 405141 - DNA, 20 bp, Artificial Sequence
  chemically synthesized
ctttttttctgtcatactgc

SEQ ID NO: 405142 - DNA, 20 bp, Artificial Sequence
  chemically synthesized
accccatactagcagtatga

SEQ ID NO: 405143 - DNA, 20 bp, Artificial Sequence
  chemically synthesized
ctagcagtatgacagaaaaa

SEQ ID NO: 405144 - DNA, 20 bp, Artificial Sequence
  chemically synthesized
tttaatcttggaaataggta

SEQ ID NO: 405145 - DNA, 20 bp, Artificial Sequence
  chemically synthesized
aaaaagctatacctatttcc

SEQ ID NO: 405146 - DNA, 20 bp, Artificial Sequence
  chemically synthesized
atatgtttaatcttggaaat

SEQ ID NO: 405147 - DNA, 20 bp, Artificial Sequence
  chemically synthesized
aatatgtttaatcttggaaa

SEQ ID NO: 405148 - DNA, 20 bp, Artificial Sequence
  chemically synthesized
gaggtaaatatgtttaatct

SEQ ID NO: 405149 - DNA, 20 bp, Artificial Sequence
  chemically synthesized
tagaagaaaaatagagaatg

SEQ ID NO: 405150 - DNA, 20 bp, Artificial Sequence
  chemically synthesized
atagaagaaaaatagagaat

SEQ ID NO: 405151 - DNA, 20 bp, Artificial Sequence
  chemically synthesized
tcatgtatagaagaaaaata

SEQ ID NO: 405152 - DNA, 20 bp, Artificial Sequence
  chemically synthesized
tgtcatgtatagaagaaaaa

SEQ ID NO: 405153 - DNA, 20 bp, Artificial Sequence
  chemically synthesized
atgttagatgtcatgtatag

SEQ ID NO: 405154 - DNA, 20 bp, Artificial Sequence
  chemically synthesized
tgaatgttagatgtcatgta

SEQ ID NO: 405155 - DNA, 20 bp, Artificial Sequence
  chemically synthesized
attttctttttagtgaatgt

SEQ ID NO: 405156 - DNA, 20 bp, Artificial Sequence
  chemically synthesized
gacatctaacattcactaaa

SEQ ID NO: 405157 - DNA, 20 bp, Artificial Sequence
  chemically synthesized
tgcaagtctcattttctttt

SEQ ID NO: 405158 - DNA, 20 bp, Artificial Sequence
  chemically synthesized
acattcactaaaaagaaaat

SEQ ID NO: 405159 - DNA, 20 bp, Artificial Sequence
  chemically synthesized
tagttttatttattttttgc

SEQ ID NO: 405160 - DNA, 20 bp, Artificial Sequence
  chemically synthesized
tgcaaaaaataaataaaact

SEQ ID NO: 405161 - DNA, 20 bp, Artificial Sequence
  chemically synthesized
gataatgggtgtattttgct

SEQ ID NO: 405162 - DNA, 20 bp, Artificial Sequence
  chemically synthesized
agcaaaatacacccattatc

SEQ ID NO: 405163 - DNA, 20 bp, Artificial Sequence
  chemically synthesized
tggctttacttcttgataat

SEQ ID NO: 405164 - DNA, 20 bp, Artificial Sequence
  chemically synthesized
atggctttacttcttgataa

SEQ ID NO: 405165 - DNA, 20 bp, Artificial Sequence
  chemically synthesized
aaaatacacccattatcaag

SEQ ID NO: 405166 - DNA, 20 bp, Artificial Sequence
  chemically synthesized
acacccattatcaagaagta

SEQ ID NO: 405167 - DNA, 20 bp, Artificial Sequence
  chemically synthesized
tcttagtctggttatgttga

SEQ ID NO: 405168 - DNA, 20 bp, Artificial Sequence
  chemically synthesized
agtaaagccatcaacataac

SEQ ID NO: 405169 - DNA, 20 bp, Artificial Sequence
  chemically synthesized
gccatcaacataaccagact

SEQ ID NO: 405170 - DNA, 20 bp, Artificial Sequence
  chemically synthesized
catcaacataaccagactaa

SEQ ID NO: 405171 - DNA, 20 bp, Artificial Sequence
  chemically synthesized
atataggttatctcttagtc

SEQ ID NO: 405172 - DNA, 20 bp, Artificial Sequence
  chemically synthesized
caagcatataggttatctct

SEQ ID NO: 405173 - DNA, 20 bp, Artificial Sequence
  chemically synthesized
gtctgttagttcaagcatat

SEQ ID NO: 405174 - DNA, 20 bp, Artificial Sequence
  chemically synthesized
tgtctgttagttcaagcata

SEQ ID NO: 405175 - DNA, 20 bp, Artificial Sequence
  chemically synthesized
aacctatatgcttgaactaa

SEQ ID NO: 405176 - DNA, 20 bp, Artificial Sequence
  chemically synthesized
aagtccttgtctgttagttc

SEQ ID NO: 405177 - DNA, 20 bp, Artificial Sequence
  chemically synthesized
atatgcttgaactaacagac

SEQ ID NO: 405178 - DNA, 20 bp, Artificial Sequence
  chemically synthesized
tatgcttgaactaacagaca

SEQ ID NO: 405179 - DNA, 20 bp, Artificial Sequence
  chemically synthesized
attttaaagtccttgtctgt

SEQ ID NO: 405180 - DNA, 20 bp, Artificial Sequence
  chemically synthesized
tatcagtcagagatatttta

SEQ ID NO: 405181 - DNA, 20 bp, Artificial Sequence
  chemically synthesized
attccttatcttatcagtca

SEQ ID NO: 405182 - DNA, 20 bp, Artificial Sequence
  chemically synthesized
ttaaaatatctctgactgat

SEQ ID NO: 405183 - DNA, 20 bp, Artificial Sequence
  chemically synthesized
ctattccttatcttatcagt

SEQ ID NO: 405184 - DNA, 20 bp, Artificial Sequence
  chemically synthesized
atatctctgactgataagat

SEQ ID NO: 405185 - DNA, 20 bp, Artificial Sequence
  chemically synthesized
gaatctattccttatcttat

SEQ ID NO: 405186 - DNA, 20 bp, Artificial Sequence
  chemically synthesized
tatctctgactgataagata

SEQ ID NO: 405187 - DNA, 20 bp, Artificial Sequence
  chemically synthesized
ctgactgataagataaggaa

SEQ ID NO: 405188 - DNA, 20 bp, Artificial Sequence
  chemically synthesized
agataaggaatagattcatc

SEQ ID NO: 405189 - DNA, 20 bp, Artificial Sequence
  chemically synthesized
atagattcatctagatacta

SEQ ID NO: 405190 - DNA, 20 bp, Artificial Sequence
  chemically synthesized
tggatgttttctttagtatc

SEQ ID NO: 405191 - DNA, 20 bp, Artificial Sequence
  chemically synthesized
aaagttttggatgttttctt

SEQ ID NO: 405192 - DNA, 20 bp, Artificial Sequence
  chemically synthesized
ccatctgtttgtgaaagttt

SEQ ID NO: 405193 - DNA, 20 bp, Artificial Sequence
  chemically synthesized
acatccaaaactttcacaaa

SEQ ID NO: 405194 - DNA, 20 bp, Artificial Sequence
  chemically synthesized
aacatcccatctgtttgtga

SEQ ID NO: 405195 - DNA, 20 bp, Artificial Sequence
  chemically synthesized
ccaaaactttcacaaacaga

SEQ ID NO: 405196 - DNA, 20 bp, Artificial Sequence
  chemically synthesized
caaaactttcacaaacagat

SEQ ID NO: 405197 - DNA, 20 bp, Artificial Sequence
  chemically synthesized
cacaaacagatgggatgttt

SEQ ID NO: 405198 - DNA, 20 bp, Artificial Sequence
  chemically synthesized
acagatgggatgtttcagca

SEQ ID NO: 405199 - DNA, 20 bp, Artificial Sequence
  chemically synthesized
gggatgtttcagcacagtga

SEQ ID NO: 405200 - DNA, 20 bp, Artificial Sequence
  chemically synthesized
aattccattgcatcatttta

SEQ ID NO: 405201 - DNA, 20 bp, Artificial Sequence
  chemically synthesized
gaatctgtaaaatgatgcaa

SEQ ID NO: 405202 - DNA, 20 bp, Artificial Sequence
  chemically synthesized
gcaatggaattgctaacaat

SEQ ID NO: 405203 - DNA, 20 bp, Artificial Sequence
  chemically synthesized
agttgattattgcttattgt

SEQ ID NO: 405204 - DNA, 20 bp, Artificial Sequence
  chemically synthesized
aattgctacattaacatttt

SEQ ID NO: 405205 - DNA, 20 bp, Artificial Sequence
  chemically synthesized
atcaactcaaaatgttaatg

SEQ ID NO: 405206 - DNA, 20 bp, Artificial Sequence
  chemically synthesized
taatttaacattttttataa

SEQ ID NO: 405207 - DNA, 20 bp, Artificial Sequence
  chemically synthesized
ataaaaaatgttaaattaca

SEQ ID NO: 405208 - DNA, 20 bp, Artificial Sequence
  chemically synthesized
aaaaaatgttaaattacaaa

SEQ ID NO: 405209 - DNA, 20 bp, Artificial Sequence
  chemically synthesized
ttaaattacaaagagaataa

SEQ ID NO: 405210 - DNA, 20 bp, Artificial Sequence
  chemically synthesized
ttaaattatgtgtcatttta

SEQ ID NO: 405211 - DNA, 20 bp, Artificial Sequence
  chemically synthesized
tttaaattatgtgtcatttt

SEQ ID NO: 405212 - DNA, 20 bp, Artificial Sequence
  chemically synthesized
acacataatttaaaatacta

SEQ ID NO: 405213 - DNA, 20 bp, Artificial Sequence
  chemically synthesized
ttttccaatattaacatctg

SEQ ID NO: 405214 - DNA, 20 bp, Artificial Sequence
  chemically synthesized
aatactacagatgttaatat

SEQ ID NO: 405215 - DNA, 20 bp, Artificial Sequence
  chemically synthesized
gagtactcaggtgtgaacat

SEQ ID NO: 405216 - DNA, 20 bp, Artificial Sequence
  chemically synthesized
gtttaccaatgttcacacct

SEQ ID NO: 405217 - DNA, 20 bp, Artificial Sequence
  chemically synthesized
catcaaaggattgagtactc

SEQ ID NO: 405218 - DNA, 20 bp, Artificial Sequence
  chemically synthesized
ccatcaaaggattgagtact

SEQ ID NO: 405219 - DNA, 20 bp, Artificial Sequence
  chemically synthesized
ataccttccatcaaaggatt

SEQ ID NO: 405220 - DNA, 20 bp, Artificial Sequence
  chemically synthesized
ctgagtactcaatcctttga

SEQ ID NO: 405221 - DNA, 20 bp, Artificial Sequence
  chemically synthesized
agtactcaatcctttgatgg

SEQ ID NO: 405222 - DNA, 20 bp, Artificial Sequence
  chemically synthesized
agtgtcataccttccatcaa

SEQ ID NO: 405223 - DNA, 20 bp, Artificial Sequence
  chemically synthesized
gtactcaatcctttgatgga

SEQ ID NO: 405224 - DNA, 20 bp, Artificial Sequence
  chemically synthesized
tagtgtcataccttccatca

SEQ ID NO: 405225 - DNA, 20 bp, Artificial Sequence
  chemically synthesized
gtttttataataaatcatta

SEQ ID NO: 405226 - DNA, 20 bp, Artificial Sequence
  chemically synthesized
atttattataaaaactcctt

SEQ ID NO: 405227 - DNA, 20 bp, Artificial Sequence
  chemically synthesized
tattataaaaactccttaag

SEQ ID NO: 405228 - DNA, 20 bp, Artificial Sequence
  chemically synthesized
aggctgcgcggccacttaag

SEQ ID NO: 405229 - DNA, 20 bp, Artificial Sequence
  chemically synthesized
gcaggctgcgcggccactta

SEQ ID NO: 405230 - DNA, 20 bp, Artificial Sequence
  chemically synthesized
cgcaggctgcgcggccactt

SEQ ID NO: 405231 - DNA, 20 bp, Artificial Sequence
  chemically synthesized
aaactccttaagtggccgcg

SEQ ID NO: 405232 - DNA, 20 bp, Artificial Sequence
  chemically synthesized
gcgcgcatgcgcaggctgcg

SEQ ID NO: 405233 - DNA, 20 bp, Artificial Sequence
  chemically synthesized
ggtcgccggcgcgcatgcgc

SEQ ID NO: 405234 - DNA, 20 bp, Artificial Sequence
  chemically synthesized
tggtcgccggcgcgcatgcg

SEQ ID NO: 405235 - DNA, 20 bp, Artificial Sequence
  chemically synthesized
cgcagcctgcgcatgcgcgc

SEQ ID NO: 405236 - DNA, 20 bp, Artificial Sequence
  chemically synthesized
gcgcatgcgcgccggcgacc

SEQ ID NO: 405237 - DNA, 20 bp, Artificial Sequence
  chemically synthesized
agctatttaggcttggtcgc

SEQ ID NO: 405238 - DNA, 20 bp, Artificial Sequence
  chemically synthesized
aggcggtagctatttaggct

SEQ ID NO: 405239 - DNA, 20 bp, Artificial Sequence
  chemically synthesized
cgccggcgaccaagcctaaa

SEQ ID NO: 405240 - DNA, 20 bp, Artificial Sequence
  chemically synthesized
cgcagaggcggtagctattt

SEQ ID NO: 405241 - DNA, 20 bp, Artificial Sequence
  chemically synthesized
gcgcagaggcggtagctatt

SEQ ID NO: 405242 - DNA, 20 bp, Artificial Sequence
  chemically synthesized
agggcgacgcgcagaggcgg

SEQ ID NO: 405243 - DNA, 20 bp, Artificial Sequence
  chemically synthesized
tggagggcgacgcgcagagg

SEQ ID NO: 405244 - DNA, 20 bp, Artificial Sequence
  chemically synthesized
ccgtggagggcgacgcgcag

SEQ ID NO: 405245 - DNA, 20 bp, Artificial Sequence
  chemically synthesized
accgtggagggcgacgcgca

SEQ ID NO: 405246 - DNA, 20 bp, Artificial Sequence
  chemically synthesized
taaccgtggagggcgacgcg

SEQ ID NO: 405247 - DNA, 20 bp, Artificial Sequence
  chemically synthesized
cctctgcgcgtcgccctcca

SEQ ID NO: 405248 - DNA, 20 bp, Artificial Sequence
  chemically synthesized
aaagccggggtaaccgtgga

SEQ ID NO: 405249 - DNA, 20 bp, Artificial Sequence
  chemically synthesized
gaaagccggggtaaccgtgg

SEQ ID NO: 405250 - DNA, 20 bp, Artificial Sequence
  chemically synthesized
ggaaagccggggtaaccgtg

SEQ ID NO: 405251 - DNA, 20 bp, Artificial Sequence
  chemically synthesized
gcggaaagccggggtaaccg

SEQ ID NO: 405252 - DNA, 20 bp, Artificial Sequence
  chemically synthesized
gtcgccctccacggttaccc

SEQ ID NO: 405253 - DNA, 20 bp, Artificial Sequence
  chemically synthesized
gaaggaggggcggaaagccg

SEQ ID NO: 405254 - DNA, 20 bp, Artificial Sequence
  chemically synthesized
agaaggaggggcggaaagcc

SEQ ID NO: 405255 - DNA, 20 bp, Artificial Sequence
  chemically synthesized
gagaaggaggggcggaaagc

SEQ ID NO: 405256 - DNA, 20 bp, Artificial Sequence
  chemically synthesized
ccgcgagaaggaggggcgga

SEQ ID NO: 405257 - DNA, 20 bp, Artificial Sequence
  chemically synthesized
agccccgcgagaaggagggg

SEQ ID NO: 405258 - DNA, 20 bp, Artificial Sequence
  chemically synthesized
tcgagccccgcgagaaggag

SEQ ID NO: 405259 - DNA, 20 bp, Artificial Sequence
  chemically synthesized
ctcgagccccgcgagaagga

SEQ ID NO: 405260 - DNA, 20 bp, Artificial Sequence
  chemically synthesized
cctcgagccccgcgagaagg

SEQ ID NO: 405261 - DNA, 20 bp, Artificial Sequence
  chemically synthesized
ctttccgcccctccttctcg

SEQ ID NO: 405262 - DNA, 20 bp, Artificial Sequence
  chemically synthesized
ccctcgagccccgcgagaag

SEQ ID NO: 405263 - DNA, 20 bp, Artificial Sequence
  chemically synthesized
tttccgcccctccttctcgc

SEQ ID NO: 405264 - DNA, 20 bp, Artificial Sequence
  chemically synthesized
ttccgcccctccttctcgcg

SEQ ID NO: 405265 - DNA, 20 bp, Artificial Sequence
  chemically synthesized
gtccctcgagccccgcgaga

SEQ ID NO: 405266 - DNA, 20 bp, Artificial Sequence
  chemically synthesized
ggtccctcgagccccgcgag

SEQ ID NO: 405267 - DNA, 20 bp, Artificial Sequence
  chemically synthesized
catggtccctcgagccccgc

SEQ ID NO: 405268 - DNA, 20 bp, Artificial Sequence
  chemically synthesized
ccctccttctcgcggggctc

SEQ ID NO: 405269 - DNA, 20 bp, Artificial Sequence
  chemically synthesized
cctccttctcgcggggctcg

SEQ ID NO: 405270 - DNA, 20 bp, Artificial Sequence
  chemically synthesized
ctccttctcgcggggctcga

SEQ ID NO: 405271 - DNA, 20 bp, Artificial Sequence
  chemically synthesized
aggatcggccatggtccctc

SEQ ID NO: 405272 - DNA, 20 bp, Artificial Sequence
  chemically synthesized
tcgcggggctcgagggacca

SEQ ID NO: 405273 - DNA, 20 bp, Artificial Sequence
  chemically synthesized
tctcacgcgaggatcggcca

SEQ ID NO: 405274 - DNA, 20 bp, Artificial Sequence
  chemically synthesized
gatctgtctcacgcgaggat

SEQ ID NO: 405275 - DNA, 20 bp, Artificial Sequence
  chemically synthesized
accatggccgatcctcgcgt

SEQ ID NO: 405276 - DNA, 20 bp, Artificial Sequence
  chemically synthesized
atcttgatctgtctcacgcg

SEQ ID NO: 405277 - DNA, 20 bp, Artificial Sequence
  chemically synthesized
gatcttgatctgtctcacgc

SEQ ID NO: 405278 - DNA, 20 bp, Artificial Sequence
  chemically synthesized
tggccgatcctcgcgtgaga

SEQ ID NO: 405279 - DNA, 20 bp, Artificial Sequence
  chemically synthesized
atcctcgcgtgagacagatc

SEQ ID NO: 405280 - DNA, 20 bp, Artificial Sequence
  chemically synthesized
gcgtgagacagatcaagatc

SEQ ID NO: 405281 - DNA, 20 bp, Artificial Sequence
  chemically synthesized
agacagatcaagatcaagac

SEQ ID NO: 405282 - DNA, 20 bp, Artificial Sequence
  chemically synthesized
gatcaagatcaagaccggtg

SEQ ID NO: 405283 - DNA, 20 bp, Artificial Sequence
  chemically synthesized
gaccaaccgcttcaccacac

SEQ ID NO: 405284 - DNA, 20 bp, Artificial Sequence
  chemically synthesized
agatcaagaccggtgtggtg

SEQ ID NO: 405285 - DNA, 20 bp, Artificial Sequence
  chemically synthesized
tcaagaccggtgtggtgaag

SEQ ID NO: 405286 - DNA, 20 bp, Artificial Sequence
  chemically synthesized
gaccggtgtggtgaagcggt

SEQ ID NO: 405287 - DNA, 20 bp, Artificial Sequence
  chemically synthesized
gaagcggttggtcaaataaa

SEQ ID NO: 405288 - DNA, 20 bp, Artificial Sequence
  chemically synthesized
ataaaaagtgatgtatgaaa

SEQ ID NO: 405289 - DNA, 20 bp, Artificial Sequence
  chemically synthesized
aaaaagtgatgtatgaaaaa

SEQ ID NO: 405290 - DNA, 20 bp, Artificial Sequence
  chemically synthesized
aaaagtgatgtatgaaaaag

SEQ ID NO: 405291 - DNA, 20 bp, Artificial Sequence
  chemically synthesized
tgaaaaagaggcaaaacaac

SEQ ID NO: 405292 - DNA, 20 bp, Artificial Sequence
  chemically synthesized
aaaagaggcaaaacaacaag

SEQ ID NO: 405293 - DNA, 20 bp, Artificial Sequence
  chemically synthesized
aggcaaaacaacaagaagaa

SEQ ID NO: 405294 - DNA, 20 bp, Artificial Sequence
  chemically synthesized
gaagaaaagattgaaaaaat

SEQ ID NO: 405295 - DNA, 20 bp, Artificial Sequence
  chemically synthesized
agaaaagattgaaaaaatga

SEQ ID NO: 405296 - DNA, 20 bp, Artificial Sequence
  chemically synthesized
gattgaaaaaatgagagctg

SEQ ID NO: 405297 - DNA, 20 bp, Artificial Sequence
  chemically synthesized
gaaaaaatgagagctgaaga

SEQ ID NO: 405298 - DNA, 20 bp, Artificial Sequence
  chemically synthesized
gtcataattttcaccatctt

SEQ ID NO: 405299 - DNA, 20 bp, Artificial Sequence
  chemically synthesized
gtgaaaattatgacatcaaa

SEQ ID NO: 405300 - DNA, 20 bp, Artificial Sequence
  chemically synthesized
aaaattatgacatcaaaaag

SEQ ID NO: 405301 - DNA, 20 bp, Artificial Sequence
  chemically synthesized
aaattatgacatcaaaaagc

SEQ ID NO: 405302 - DNA, 20 bp, Artificial Sequence
  chemically synthesized
ttatgacatcaaaaagcagg

SEQ ID NO: 405303 - DNA, 20 bp, Artificial Sequence
  chemically synthesized
atgacatcaaaaagcaggca

SEQ ID NO: 405304 - DNA, 20 bp, Artificial Sequence
  chemically synthesized
aaagcaggcagagatcctac

SEQ ID NO: 405305 - DNA, 20 bp, Artificial Sequence
  chemically synthesized
tcatcatccgggattcttgt

SEQ ID NO: 405306 - DNA, 20 bp, Artificial Sequence
  chemically synthesized
atcatcatccgggattcttg

SEQ ID NO: 405307 - DNA, 20 bp, Artificial Sequence
  chemically synthesized
cagagatcctacaagaatcc

SEQ ID NO: 405308 - DNA, 20 bp, Artificial Sequence
  chemically synthesized
gcaatctgggatcatcatcc

SEQ ID NO: 405309 - DNA, 20 bp, Artificial Sequence
  chemically synthesized
ggcaatctgggatcatcatc

SEQ ID NO: 405310 - DNA, 20 bp, Artificial Sequence
  chemically synthesized
agaatcccggatgatgatcc

SEQ ID NO: 405311 - DNA, 20 bp, Artificial Sequence
  chemically synthesized
ggatgatgatcccagattgc

SEQ ID NO: 405312 - DNA, 20 bp, Artificial Sequence
  chemically synthesized
ccaacctgcgctggcaatct

SEQ ID NO: 405313 - DNA, 20 bp, Artificial Sequence
  chemically synthesized
tccaacctgcgctggcaatc

SEQ ID NO: 405314 - DNA, 20 bp, Artificial Sequence
  chemically synthesized
atgatcccagattgccagcg

SEQ ID NO: 405315 - DNA, 20 bp, Artificial Sequence
  chemically synthesized
tgatcccagattgccagcgc

SEQ ID NO: 405316 - DNA, 20 bp, Artificial Sequence
  chemically synthesized
atgcggcttccaacctgcgc

SEQ ID NO: 405317 - DNA, 20 bp, Artificial Sequence
  chemically synthesized
cccagattgccagcgcaggt

SEQ ID NO: 405318 - DNA, 20 bp, Artificial Sequence
  chemically synthesized
agattgccagcgcaggttgg

SEQ ID NO: 405319 - DNA, 20 bp, Artificial Sequence
  chemically synthesized
caggttggaagccgcatatt

SEQ ID NO: 405320 - DNA, 20 bp, Artificial Sequence
  chemically synthesized
ctgttgaagatccaaatatg

SEQ ID NO: 405321 - DNA, 20 bp, Artificial Sequence
  chemically synthesized
ccgcatatttggatcttcaa

SEQ ID NO: 405322 - DNA, 20 bp, Artificial Sequence
  chemically synthesized
tcactttctaatatctgttg

SEQ ID NO: 405323 - DNA, 20 bp, Artificial Sequence
  chemically synthesized
tttggatcttcaacagatat

SEQ ID NO: 405324 - DNA, 20 bp, Artificial Sequence
  chemically synthesized
gatcttcaacagatattaga

SEQ ID NO: 405325 - DNA, 20 bp, Artificial Sequence
  chemically synthesized
acagatattagaaagtgaaa

SEQ ID NO: 405326 - DNA, 20 bp, Artificial Sequence
  chemically synthesized
attagaaagtgaaaaagact

SEQ ID NO: 405327 - DNA, 20 bp, Artificial Sequence
  chemically synthesized
agaaagtgaaaaagacttgg

SEQ ID NO: 405328 - DNA, 20 bp, Artificial Sequence
  chemically synthesized
aagtgaaaaagacttggaag

SEQ ID NO: 405329 - DNA, 20 bp, Artificial Sequence
  chemically synthesized
tatattcctcagcttcttcc

SEQ ID NO: 405330 - DNA, 20 bp, Artificial Sequence
  chemically synthesized
aaaaagacttggaagaagct

SEQ ID NO: 405331 - DNA, 20 bp, Artificial Sequence
  chemically synthesized
aaaagacttggaagaagctg

SEQ ID NO: 405332 - DNA, 20 bp, Artificial Sequence
  chemically synthesized
acgtgcttctttatattcct

SEQ ID NO: 405333 - DNA, 20 bp, Artificial Sequence
  chemically synthesized
ggaagaagctgaggaatata

SEQ ID NO: 405334 - DNA, 20 bp, Artificial Sequence
  chemically synthesized
agaagctgaggaatataaag

SEQ ID NO: 405335 - DNA, 20 bp, Artificial Sequence
  chemically synthesized
ggaatataaagaagcacgtt

SEQ ID NO: 405336 - DNA, 20 bp, Artificial Sequence
  chemically synthesized
taaagaagcacgtttagtac

SEQ ID NO: 405337 - DNA, 20 bp, Artificial Sequence
  chemically synthesized
agcacgtttagtactggatt

SEQ ID NO: 405338 - DNA, 20 bp, Artificial Sequence
  chemically synthesized
gcttctaacttcactgaatc

SEQ ID NO: 405339 - DNA, 20 bp, Artificial Sequence
  chemically synthesized
gtttagtactggattcagtg

SEQ ID NO: 405340 - DNA, 20 bp, Artificial Sequence
  chemically synthesized
agtactggattcagtgaagt

SEQ ID NO: 405341 - DNA, 20 bp, Artificial Sequence
  chemically synthesized
actggattcagtgaagttag

SEQ ID NO: 405342 - DNA, 20 bp, Artificial Sequence
  chemically synthesized
ccccatacgagaaaagtttc

SEQ ID NO: 405343 - DNA, 20 bp, Artificial Sequence
  chemically synthesized
accccatacgagaaaagttt

SEQ ID NO: 405344 - DNA, 20 bp, Artificial Sequence
  chemically synthesized
aaaaccaccccatacgagaa

SEQ ID NO: 405345 - DNA, 20 bp, Artificial Sequence
  chemically synthesized
agcctgaaacttttctcgta

SEQ ID NO: 405346 - DNA, 20 bp, Artificial Sequence
  chemically synthesized
gcctgaaacttttctcgtat

SEQ ID NO: 405347 - DNA, 20 bp, Artificial Sequence
  chemically synthesized
cctgaaacttttctcgtatg

SEQ ID NO: 405348 - DNA, 20 bp, Artificial Sequence
  chemically synthesized
atgcaaaaaccaccccatac

SEQ ID NO: 405349 - DNA, 20 bp, Artificial Sequence
  chemically synthesized
gaaacttttctcgtatgggg

SEQ ID NO: 405350 - DNA, 20 bp, Artificial Sequence
  chemically synthesized
gtggtttttgcattaaatcc

SEQ ID NO: 405351 - DNA, 20 bp, Artificial Sequence
  chemically synthesized
tggtttttgcattaaatcct

SEQ ID NO: 405352 - DNA, 20 bp, Artificial Sequence
  chemically synthesized
ggtttttgcattaaatcctg

SEQ ID NO: 405353 - DNA, 20 bp, Artificial Sequence
  chemically synthesized
tggattgtaaaatggacccc

SEQ ID NO: 405354 - DNA, 20 bp, Artificial Sequence
  chemically synthesized
atggattgtaaaatggaccc

SEQ ID NO: 405355 - DNA, 20 bp, Artificial Sequence
  chemically synthesized
aaaaataatggattgtaaaa

SEQ ID NO: 405356 - DNA, 20 bp, Artificial Sequence
  chemically synthesized
accgcagtggtcaaaaataa

SEQ ID NO: 405357 - DNA, 20 bp, Artificial Sequence
  chemically synthesized
tccattatttttgaccactg

SEQ ID NO: 405358 - DNA, 20 bp, Artificial Sequence
  chemically synthesized
actacttgaacacaccgcag

SEQ ID NO: 405359 - DNA, 20 bp, Artificial Sequence
  chemically synthesized
catactacttgaacacaccg

SEQ ID NO: 405360 - DNA, 20 bp, Artificial Sequence
  chemically synthesized
ttgaccactgcggtgtgttc

SEQ ID NO: 405361 - DNA, 20 bp, Artificial Sequence
  chemically synthesized
accactgcggtgtgttcaag

SEQ ID NO: 405362 - DNA, 20 bp, Artificial Sequence
  chemically synthesized
gcggtgtgttcaagtagtat

SEQ ID NO: 405363 - DNA, 20 bp, Artificial Sequence
  chemically synthesized
agaatgtgattgtttttatc

SEQ ID NO: 405364 - DNA, 20 bp, Artificial Sequence
  chemically synthesized
caaagaaatatatatgtaac

SEQ ID NO: 405365 - DNA, 20 bp, Artificial Sequence
  chemically synthesized
ttgacatattaaattagaca

SEQ ID NO: 405366 - DNA, 20 bp, Artificial Sequence
  chemically synthesized
atttatttgacatattaaat

SEQ ID NO: 405367 - DNA, 20 bp, Artificial Sequence
  chemically synthesized
atttaatatgtcaaataaat

SEQ ID NO: 405368 - DNA, 20 bp, Artificial Sequence
  chemically synthesized
tcacgtatggattttttttt

SEQ ID NO: 405369 - DNA, 20 bp, Artificial Sequence
  chemically synthesized
tataaaccacacatcacgta

SEQ ID NO: 405370 - DNA, 20 bp, Artificial Sequence
  chemically synthesized
aaaaatccatacgtgatgtg

SEQ ID NO: 405371 - DNA, 20 bp, Artificial Sequence
  chemically synthesized
aagaatatatatcatatagg

SEQ ID NO: 405372 - DNA, 20 bp, Artificial Sequence
  chemically synthesized
ggtaagaatatatatcatat

SEQ ID NO: 405373 - DNA, 20 bp, Artificial Sequence
  chemically synthesized
gggtaagaatatatatcata

SEQ ID NO: 405374 - DNA, 20 bp, Artificial Sequence
  chemically synthesized
tgatgggatggggttggggt

SEQ ID NO: 405375 - DNA, 20 bp, Artificial Sequence
  chemically synthesized
tatatgatgggatggggttg

SEQ ID NO: 405376 - DNA, 20 bp, Artificial Sequence
  chemically synthesized
ctatatgatgggatggggtt

SEQ ID NO: 405377 - DNA, 20 bp, Artificial Sequence
  chemically synthesized
tctatatgatgggatggggt

SEQ ID NO: 405378 - DNA, 20 bp, Artificial Sequence
  chemically synthesized
cttatctatatgatgggatg

SEQ ID NO: 405379 - DNA, 20 bp, Artificial Sequence
  chemically synthesized
tcttatctatatgatgggat

SEQ ID NO: 405380 - DNA, 20 bp, Artificial Sequence
  chemically synthesized
ttcttatctatatgatggga

SEQ ID NO: 405381 - DNA, 20 bp, Artificial Sequence
  chemically synthesized
cccaaccccatcccatcata

SEQ ID NO: 405382 - DNA, 20 bp, Artificial Sequence
  chemically synthesized
cattttcttatctatatgat

SEQ ID NO: 405383 - DNA, 20 bp, Artificial Sequence
  chemically synthesized
gcattttcttatctatatga

SEQ ID NO: 405384 - DNA, 20 bp, Artificial Sequence
  chemically synthesized
ccccatcccatcatatagat

SEQ ID NO: 405385 - DNA, 20 bp, Artificial Sequence
  chemically synthesized
tgtaaacctgagcacataag

SEQ ID NO: 405386 - DNA, 20 bp, Artificial Sequence
  chemically synthesized
gaaaatgctacttatgtgct

SEQ ID NO: 405387 - DNA, 20 bp, Artificial Sequence
  chemically synthesized
ttgtgtaaacctgagcacat

SEQ ID NO: 405388 - DNA, 20 bp, Artificial Sequence
  chemically synthesized
aaaatgctacttatgtgctc

SEQ ID NO: 405389 - DNA, 20 bp, Artificial Sequence
  chemically synthesized
tctaagagttgtgtaaacct

SEQ ID NO: 405390 - DNA, 20 bp, Artificial Sequence
  chemically synthesized
gctcaggtttacacaactct

SEQ ID NO: 405391 - DNA, 20 bp, Artificial Sequence
  chemically synthesized
ttgtagtcagagacatctaa

SEQ ID NO: 405392 - DNA, 20 bp, Artificial Sequence
  chemically synthesized
ctttgtagtcagagacatct

SEQ ID NO: 405393 - DNA, 20 bp, Artificial Sequence
  chemically synthesized
gaacaaagactttgtagtca

SEQ ID NO: 405394 - DNA, 20 bp, Artificial Sequence
  chemically synthesized
cttagatgtctctgactaca

SEQ ID NO: 405395 - DNA, 20 bp, Artificial Sequence
  chemically synthesized
aagaacaaagactttgtagt

SEQ ID NO: 405396 - DNA, 20 bp, Artificial Sequence
  chemically synthesized
taaaaagaacaaagactttg

SEQ ID NO: 405397 - DNA, 20 bp, Artificial Sequence
  chemically synthesized
gaggtacattaaaaagaaca

SEQ ID NO: 405398 - DNA, 20 bp, Artificial Sequence
  chemically synthesized
aggcatagaggtacattaaa

SEQ ID NO: 405399 - DNA, 20 bp, Artificial Sequence
  chemically synthesized
ttaaagtatgagaggcatag

SEQ ID NO: 405400 - DNA, 20 bp, Artificial Sequence
  chemically synthesized
tttaaagtatgagaggcata

SEQ ID NO: 405401 - DNA, 20 bp, Artificial Sequence
  chemically synthesized
attttaaagtatgagaggca

SEQ ID NO: 405402 - DNA, 20 bp, Artificial Sequence
  chemically synthesized
tttcaattttaaagtatgag

SEQ ID NO: 405403 - DNA, 20 bp, Artificial Sequence
  chemically synthesized
atttcaattttaaagtatga

SEQ ID NO: 405404 - DNA, 20 bp, Artificial Sequence
  chemically synthesized
ttatttcaattttaaagtat

SEQ ID NO: 405405 - DNA, 20 bp, Artificial Sequence
  chemically synthesized
attaatttatttcaatttta

SEQ ID NO: 405406 - DNA, 20 bp, Artificial Sequence
  chemically synthesized
aaattgatcatttggagcag

SEQ ID NO: 405407 - DNA, 20 bp, Artificial Sequence
  chemically synthesized
ggaaaattgatcatttggag

SEQ ID NO: 405408 - DNA, 20 bp, Artificial Sequence
  chemically synthesized
catggaaaattgatcatttg

SEQ ID NO: 405409 - DNA, 20 bp, Artificial Sequence
  chemically synthesized
tccatggaaaattgatcatt

SEQ ID NO: 405410 - DNA, 20 bp, Artificial Sequence
  chemically synthesized
tccaaatgatcaattttcca

SEQ ID NO: 405411 - DNA, 20 bp, Artificial Sequence
  chemically synthesized
aaagttctcttttttttcca

SEQ ID NO: 405412 - DNA, 20 bp, Artificial Sequence
  chemically synthesized
tcaattttccatggaaaaaa

SEQ ID NO: 405413 - DNA, 20 bp, Artificial Sequence
  chemically synthesized
aattttccatggaaaaaaaa

SEQ ID NO: 405414 - DNA, 20 bp, Artificial Sequence
  chemically synthesized
agaggttgttacaattacaa

SEQ ID NO: 405415 - DNA, 20 bp, Artificial Sequence
  chemically synthesized
agtgtttagtcatatagcag

SEQ ID NO: 405416 - DNA, 20 bp, Artificial Sequence
  chemically synthesized
cagtgtttagtcatatagca

SEQ ID NO: 405417 - DNA, 20 bp, Artificial Sequence
  chemically synthesized
ctcagtgtttagtcatatag

SEQ ID NO: 405418 - DNA, 20 bp, Artificial Sequence
  chemically synthesized
tggctcagtgtttagtcata

SEQ ID NO: 405419 - DNA, 20 bp, Artificial Sequence
  chemically synthesized
ctgctatatgactaaacact

SEQ ID NO: 405420 - DNA, 20 bp, Artificial Sequence
  chemically synthesized
ccacctcatggctcagtgtt

SEQ ID NO: 405421 - DNA, 20 bp, Artificial Sequence
  chemically synthesized
atgactaaacactgagccat

SEQ ID NO: 405422 - DNA, 20 bp, Artificial Sequence
  chemically synthesized
tgactaaacactgagccatg

SEQ ID NO: 405423 - DNA, 20 bp, Artificial Sequence
  chemically synthesized
tggcagcccacctcatggct

SEQ ID NO: 405424 - DNA, 20 bp, Artificial Sequence
  chemically synthesized
ctaaacactgagccatgagg

SEQ ID NO: 405425 - DNA, 20 bp, Artificial Sequence
  chemically synthesized
taaacactgagccatgaggt

SEQ ID NO: 405426 - DNA, 20 bp, Artificial Sequence
  chemically synthesized
ttacctggcagcccacctca

SEQ ID NO: 405427 - DNA, 20 bp, Artificial Sequence
  chemically synthesized
tgagccatgaggtgggctgc

SEQ ID NO: 405428 - DNA, 20 bp, Artificial Sequence
  chemically synthesized
gagccatgaggtgggctgcc

SEQ ID NO: 405429 - DNA, 20 bp, Artificial Sequence
  chemically synthesized
aagccttccaatttacctgg

SEQ ID NO: 405430 - DNA, 20 bp, Artificial Sequence
  chemically synthesized
aggtgggctgccaggtaaat

SEQ ID NO: 405431 - DNA, 20 bp, Artificial Sequence
  chemically synthesized
atgaagccttccaatttacc

SEQ ID NO: 405432 - DNA, 20 bp, Artificial Sequence
  chemically synthesized
tgggctgccaggtaaattgg

SEQ ID NO: 405433 - DNA, 20 bp, Artificial Sequence
  chemically synthesized
gggctgccaggtaaattgga

SEQ ID NO: 405434 - DNA, 20 bp, Artificial Sequence
  chemically synthesized
agtcttgtactttttagatg

SEQ ID NO: 405435 - DNA, 20 bp, Artificial Sequence
  chemically synthesized
attggaaggcttcatctaaa

SEQ ID NO: 405436 - DNA, 20 bp, Artificial Sequence
  chemically synthesized
cctcacagtcttgtactttt

SEQ ID NO: 405437 - DNA, 20 bp, Artificial Sequence
  chemically synthesized
aggcttcatctaaaaagtac

SEQ ID NO: 405438 - DNA, 20 bp, Artificial Sequence
  chemically synthesized
tctaaaaagtacaagactgt

SEQ ID NO: 405439 - DNA, 20 bp, Artificial Sequence
  chemically synthesized
ctaaaaagtacaagactgtg

SEQ ID NO: 405440 - DNA, 20 bp, Artificial Sequence
  chemically synthesized
tgagaagggaatatgcctca

SEQ ID NO: 405441 - DNA, 20 bp, Artificial Sequence
  chemically synthesized
gaggcatattcccttctcaa

SEQ ID NO: 405442 - DNA, 20 bp, Artificial Sequence
  chemically synthesized
tcatcctaggctgttgagaa

SEQ ID NO: 405443 - DNA, 20 bp, Artificial Sequence
  chemically synthesized
atcatcctaggctgttgaga

SEQ ID NO: 405444 - DNA, 20 bp, Artificial Sequence
  chemically synthesized
aatcatcctaggctgttgag

SEQ ID NO: 405445 - DNA, 20 bp, Artificial Sequence
  chemically synthesized
atattcccttctcaacagcc

SEQ ID NO: 405446 - DNA, 20 bp, Artificial Sequence
  chemically synthesized
tccaatcatcctaggctgtt

SEQ ID NO: 405447 - DNA, 20 bp, Artificial Sequence
  chemically synthesized
tattcccttctcaacagcct

SEQ ID NO: 405448 - DNA, 20 bp, Artificial Sequence
  chemically synthesized
tgggtagatccaatcatcct

SEQ ID NO: 405449 - DNA, 20 bp, Artificial Sequence
  chemically synthesized
tctcaacagcctaggatgat

SEQ ID NO: 405450 - DNA, 20 bp, Artificial Sequence
  chemically synthesized
atgggtagatccaatcatcc

SEQ ID NO: 405451 - DNA, 20 bp, Artificial Sequence
  chemically synthesized
tgaaaatgtgacagaatggg

SEQ ID NO: 405452 - DNA, 20 bp, Artificial Sequence
  chemically synthesized
tattgaaaatgtgacagaat

SEQ ID NO: 405453 - DNA, 20 bp, Artificial Sequence
  chemically synthesized
atattgaaaatgtgacagaa

SEQ ID NO: 405454 - DNA, 20 bp, Artificial Sequence
  chemically synthesized
attatatattgaaaatgtga

SEQ ID NO: 405455 - DNA, 20 bp, Artificial Sequence
  chemically synthesized
tattaatagaaagtttgaac

SEQ ID NO: 405456 - DNA, 20 bp, Artificial Sequence
  chemically synthesized
atattaatagaaagtttgaa

SEQ ID NO: 405457 - DNA, 20 bp, Artificial Sequence
  chemically synthesized
tgaaatgatatattaataga

SEQ ID NO: 405458 - DNA, 20 bp, Artificial Sequence
  chemically synthesized
aacttgaaatgatatattaa

SEQ ID NO: 405459 - DNA, 20 bp, Artificial Sequence
  chemically synthesized
ttctattaatatatcatttc

SEQ ID NO: 405460 - DNA, 20 bp, Artificial Sequence
  chemically synthesized
atcatttcaagtttcattga

SEQ ID NO: 405461 - DNA, 20 bp, Artificial Sequence
  chemically synthesized
cgtcttttgtgttgcatttt

SEQ ID NO: 405462 - DNA, 20 bp, Artificial Sequence
  chemically synthesized
tcgtcttttgtgttgcattt

SEQ ID NO: 405463 - DNA, 20 bp, Artificial Sequence
  chemically synthesized
agtcctaaaatgcaacacaa

SEQ ID NO: 405464 - DNA, 20 bp, Artificial Sequence
  chemically synthesized
taaaatgcaacacaaaagac

SEQ ID NO: 405465 - DNA, 20 bp, Artificial Sequence
  chemically synthesized
aatgcaacacaaaagacgag

SEQ ID NO: 405466 - DNA, 20 bp, Artificial Sequence
  chemically synthesized
aaaagacgagcagatgattt

SEQ ID NO: 405467 - DNA, 20 bp, Artificial Sequence
  chemically synthesized
caaaaggctgcaaattggaa

SEQ ID NO: 405468 - DNA, 20 bp, Artificial Sequence
  chemically synthesized
atttcagccattccaatttg

SEQ ID NO: 405469 - DNA, 20 bp, Artificial Sequence
  chemically synthesized
ctctacaaaaggctgcaaat

SEQ ID NO: 405470 - DNA, 20 bp, Artificial Sequence
  chemically synthesized
ttccaatttgcagccttttg

SEQ ID NO: 405471 - DNA, 20 bp, Artificial Sequence
  chemically synthesized
ccaatttgcagccttttgta

SEQ ID NO: 405472 - DNA, 20 bp, Artificial Sequence
  chemically synthesized
caatttgcagccttttgtag

SEQ ID NO: 405473 - DNA, 20 bp, Artificial Sequence
  chemically synthesized
tattgatgcccctctacaaa

SEQ ID NO: 405474 - DNA, 20 bp, Artificial Sequence
  chemically synthesized
aatttgcagccttttgtaga

SEQ ID NO: 405475 - DNA, 20 bp, Artificial Sequence
  chemically synthesized
ctattgatgcccctctacaa

SEQ ID NO: 405476 - DNA, 20 bp, Artificial Sequence
  chemically synthesized
atttgcagccttttgtagag

SEQ ID NO: 405477 - DNA, 20 bp, Artificial Sequence
  chemically synthesized
cttttgtagaggggcatcaa

SEQ ID NO: 405478 - DNA, 20 bp, Artificial Sequence
  chemically synthesized
actagggctttatgcaagta

SEQ ID NO: 405479 - DNA, 20 bp, Artificial Sequence
  chemically synthesized
gattttactgtacttgcata

SEQ ID NO: 405480 - DNA, 20 bp, Artificial Sequence
  chemically synthesized
gaacaactagggctttatgc

SEQ ID NO: 405481 - DNA, 20 bp, Artificial Sequence
  chemically synthesized
actgtacttgcataaagccc

SEQ ID NO: 405482 - DNA, 20 bp, Artificial Sequence
  chemically synthesized
gaataggaaaagaacaacta

SEQ ID NO: 405483 - DNA, 20 bp, Artificial Sequence
  chemically synthesized
agaataggaaaagaacaact

SEQ ID NO: 405484 - DNA, 20 bp, Artificial Sequence
  chemically synthesized
tagaataggaaaagaacaac

SEQ ID NO: 405485 - DNA, 20 bp, Artificial Sequence
  chemically synthesized
cagaaatgatagaataggaa

SEQ ID NO: 405486 - DNA, 20 bp, Artificial Sequence
  chemically synthesized
caatccagaaatgatagaat

SEQ ID NO: 405487 - DNA, 20 bp, Artificial Sequence
  chemically synthesized
ccaatccagaaatgatagaa

SEQ ID NO: 405488 - DNA, 20 bp, Artificial Sequence
  chemically synthesized
ttttcctattctatcatttc

SEQ ID NO: 405489 - DNA, 20 bp, Artificial Sequence
  chemically synthesized
attcgccaatccagaaatga

SEQ ID NO: 405490 - DNA, 20 bp, Artificial Sequence
  chemically synthesized
ctattctatcatttctggat

SEQ ID NO: 405491 - DNA, 20 bp, Artificial Sequence
  chemically synthesized
ttttatcccattcgccaatc

SEQ ID NO: 405492 - DNA, 20 bp, Artificial Sequence
  chemically synthesized
atcatttctggattggcgaa

SEQ ID NO: 405493 - DNA, 20 bp, Artificial Sequence
  chemically synthesized
tcatttctggattggcgaat

SEQ ID NO: 405494 - DNA, 20 bp, Artificial Sequence
  chemically synthesized
ggcgaatgggataaaatgtt

SEQ ID NO: 405495 - DNA, 20 bp, Artificial Sequence
  chemically synthesized
gcgaatgggataaaatgttc

SEQ ID NO: 405496 - DNA, 20 bp, Artificial Sequence
  chemically synthesized
atgggataaaatgttcagga

SEQ ID NO: 405497 - DNA, 20 bp, Artificial Sequence
  chemically synthesized
atgacattcacgtttgtgtt

SEQ ID NO: 405498 - DNA, 20 bp, Artificial Sequence
  chemically synthesized
acaaacgtgaatgtcattga

SEQ ID NO: 405499 - DNA, 20 bp, Artificial Sequence
  chemically synthesized
aatgtcattgaaagctaaaa

SEQ ID NO: 405500 - DNA, 20 bp, Artificial Sequence
  chemically synthesized
attaactttgtttacttttt

SEQ ID NO: 405501 - DNA, 20 bp, Artificial Sequence
  chemically synthesized
gaaagctaaaaaagtaaaca

SEQ ID NO: 405502 - DNA, 20 bp, Artificial Sequence
  chemically synthesized
aagttaatgatcacacccgt

SEQ ID NO: 405503 - DNA, 20 bp, Artificial Sequence
  chemically synthesized
gaaaaatcagtagcacttac

SEQ ID NO: 405504 - DNA, 20 bp, Artificial Sequence
  chemically synthesized
tgaaaaatcagtagcactta

SEQ ID NO: 405505 - DNA, 20 bp, Artificial Sequence
  chemically synthesized
tgagttcaatgaaaaatcag

SEQ ID NO: 405506 - DNA, 20 bp, Artificial Sequence
  chemically synthesized
ctctgagttcaatgaaaaat

SEQ ID NO: 405507 - DNA, 20 bp, Artificial Sequence
  chemically synthesized
tactgatttttcattgaact

SEQ ID NO: 405508 - DNA, 20 bp, Artificial Sequence
  chemically synthesized
ctgatttttcattgaactca

SEQ ID NO: 405509 - DNA, 20 bp, Artificial Sequence
  chemically synthesized
tgatttttcattgaactcag

SEQ ID NO: 405510 - DNA, 20 bp, Artificial Sequence
  chemically synthesized
atttttcattgaactcagag

SEQ ID NO: 405511 - DNA, 20 bp, Artificial Sequence
  chemically synthesized
atccagtaactttctcctct

SEQ ID NO: 405512 - DNA, 20 bp, Artificial Sequence
  chemically synthesized
ttcattgaactcagaggaga

SEQ ID NO: 405513 - DNA, 20 bp, Artificial Sequence
  chemically synthesized
aactcagaggagaaagttac

SEQ ID NO: 405514 - DNA, 20 bp, Artificial Sequence
  chemically synthesized
ttcacttacttttgggaatc

SEQ ID NO: 405515 - DNA, 20 bp, Artificial Sequence
  chemically synthesized
gaaagttactggattcccaa

SEQ ID NO: 405516 - DNA, 20 bp, Artificial Sequence
  chemically synthesized
gttactggattcccaaaagt

SEQ ID NO: 405517 - DNA, 20 bp, Artificial Sequence
  chemically synthesized
tatacccttcacttactttt

SEQ ID NO: 405518 - DNA, 20 bp, Artificial Sequence
  chemically synthesized
atatacccttcacttacttt

SEQ ID NO: 405519 - DNA, 20 bp, Artificial Sequence
  chemically synthesized
tggattcccaaaagtaagtg

SEQ ID NO: 405520 - DNA, 20 bp, Artificial Sequence
  chemically synthesized
ggattcccaaaagtaagtga

SEQ ID NO: 405521 - DNA, 20 bp, Artificial Sequence
  chemically synthesized
gattcccaaaagtaagtgaa

SEQ ID NO: 405522 - DNA, 20 bp, Artificial Sequence
  chemically synthesized
caacaggctgtgaatgcatt

SEQ ID NO: 405523 - DNA, 20 bp, Artificial Sequence
  chemically synthesized
atgtttgctaaatgcattca

SEQ ID NO: 405524 - DNA, 20 bp, Artificial Sequence
  chemically synthesized
cctcaaataattagagcaac

SEQ ID NO: 405525 - DNA, 20 bp, Artificial Sequence
  chemically synthesized
acctcaaataattagagcaa

SEQ ID NO: 405526 - DNA, 20 bp, Artificial Sequence
  chemically synthesized
taaaaaacctcaaataatta

SEQ ID NO: 405527 - DNA, 20 bp, Artificial Sequence
  chemically synthesized
gcctgttgctctaattattt

SEQ ID NO: 405528 - DNA, 20 bp, Artificial Sequence
  chemically synthesized
cataaaaaacctcaaataat

SEQ ID NO: 405529 - DNA, 20 bp, Artificial Sequence
  chemically synthesized
cctgttgctctaattatttg

SEQ ID NO: 405530 - DNA, 20 bp, Artificial Sequence
  chemically synthesized
ttttttatgtgttgttgttt

SEQ ID NO: 405531 - DNA, 20 bp, Artificial Sequence
  chemically synthesized
agaataaaaaacacaaacaa

SEQ ID NO: 405532 - DNA, 20 bp, Artificial Sequence
  chemically synthesized
cagtagaagaaaaatgcaga

SEQ ID NO: 405533 - DNA, 20 bp, Artificial Sequence
  chemically synthesized
tgtacagtagaagaaaaatg

SEQ ID NO: 405534 - DNA, 20 bp, Artificial Sequence
  chemically synthesized
gaataacaactgtacagtag

SEQ ID NO: 405535 - DNA, 20 bp, Artificial Sequence
  chemically synthesized
tgcatttttcttctactgta

SEQ ID NO: 405536 - DNA, 20 bp, Artificial Sequence
  chemically synthesized
catgaataacaactgtacag

SEQ ID NO: 405537 - DNA, 20 bp, Artificial Sequence
  chemically synthesized
tagcatgaataacaactgta

SEQ ID NO: 405538 - DNA, 20 bp, Artificial Sequence
  chemically synthesized
acagttgttattcatgctat

SEQ ID NO: 405539 - DNA, 20 bp, Artificial Sequence
  chemically synthesized
tgtaaactttagataactca

SEQ ID NO: 405540 - DNA, 20 bp, Artificial Sequence
  chemically synthesized
ttcatgctatgagttatcta

SEQ ID NO: 405541 - DNA, 20 bp, Artificial Sequence
  chemically synthesized
ttgattattaatgtaaactt

SEQ ID NO: 405542 - DNA, 20 bp, Artificial Sequence
  chemically synthesized
ttcagagttgggatggtgca

SEQ ID NO: 405543 - DNA, 20 bp, Artificial Sequence
  chemically synthesized
tttcagagttgggatggtgc

SEQ ID NO: 405544 - DNA, 20 bp, Artificial Sequence
  chemically synthesized
tgtgtgtttcagagttggga

SEQ ID NO: 405545 - DNA, 20 bp, Artificial Sequence
  chemically synthesized
aagttgtgtgtttcagagtt

SEQ ID NO: 405546 - DNA, 20 bp, Artificial Sequence
  chemically synthesized
caagttgtgtgtttcagagt

SEQ ID NO: 405547 - DNA, 20 bp, Artificial Sequence
  chemically synthesized
catccaagttgtgtgtttca

SEQ ID NO: 405548 - DNA, 20 bp, Artificial Sequence
  chemically synthesized
tccatccaagttgtgtgttt

SEQ ID NO: 405549 - DNA, 20 bp, Artificial Sequence
  chemically synthesized
caactctgaaacacacaact

SEQ ID NO: 405550 - DNA, 20 bp, Artificial Sequence
  chemically synthesized
tctgaaacacacaacttgga

SEQ ID NO: 405551 - DNA, 20 bp, Artificial Sequence
  chemically synthesized
tgaaacacacaacttggatg

SEQ ID NO: 405552 - DNA, 20 bp, Artificial Sequence
  chemically synthesized
atgagtcttaatctccatcc

SEQ ID NO: 405553 - DNA, 20 bp, Artificial Sequence
  chemically synthesized
acacaacttggatggagatt

SEQ ID NO: 405554 - DNA, 20 bp, Artificial Sequence
  chemically synthesized
gatggagattaagactcatt

SEQ ID NO: 405555 - DNA, 20 bp, Artificial Sequence
  chemically synthesized
atggagattaagactcattc

SEQ ID NO: 405556 - DNA, 20 bp, Artificial Sequence
  chemically synthesized
tgtctgcctgagtcctgaat

SEQ ID NO: 405557 - DNA, 20 bp, Artificial Sequence
  chemically synthesized
attaagactcattcaggact

SEQ ID NO: 405558 - DNA, 20 bp, Artificial Sequence
  chemically synthesized
ttaagactcattcaggactc

SEQ ID NO: 405559 - DNA, 20 bp, Artificial Sequence
  chemically synthesized
agactcattcaggactcagg

SEQ ID NO: 405560 - DNA, 20 bp, Artificial Sequence
  chemically synthesized
ggtactaaggatgtctgcct

SEQ ID NO: 405561 - DNA, 20 bp, Artificial Sequence
  chemically synthesized
aggactcaggcagacatcct

SEQ ID NO: 405562 - DNA, 20 bp, Artificial Sequence
  chemically synthesized
aggcagacatccttagtacc

SEQ ID NO: 405563 - DNA, 20 bp, Artificial Sequence
  chemically synthesized
tgttgtggttctgggtacta

SEQ ID NO: 405564 - DNA, 20 bp, Artificial Sequence
  chemically synthesized
gtgttgtggttctgggtact

SEQ ID NO: 405565 - DNA, 20 bp, Artificial Sequence
  chemically synthesized
gtgtgctgtgttgtggttct

SEQ ID NO: 405566 - DNA, 20 bp, Artificial Sequence
  chemically synthesized
tgtgtgctgtgttgtggttc

SEQ ID NO: 405567 - DNA, 20 bp, Artificial Sequence
  chemically synthesized
tagtacccagaaccacaaca

SEQ ID NO: 405568 - DNA, 20 bp, Artificial Sequence
  chemically synthesized
cattcgtgtgtgctgtgttg

SEQ ID NO: 405569 - DNA, 20 bp, Artificial Sequence
  chemically synthesized
acacagcacacacgaatgca

SEQ ID NO: 405570 - DNA, 20 bp, Artificial Sequence
  chemically synthesized
gatgctccataaaataatta

SEQ ID NO: 405571 - DNA, 20 bp, Artificial Sequence
  chemically synthesized
atggttctataattatttta

SEQ ID NO: 405572 - DNA, 20 bp, Artificial Sequence
  chemically synthesized
ggttctataattattttatg

SEQ ID NO: 405573 - DNA, 20 bp, Artificial Sequence
  chemically synthesized
tccggtgcatagcaaattca

SEQ ID NO: 405574 - DNA, 20 bp, Artificial Sequence
  chemically synthesized
tctatgaatttgctatgcac

SEQ ID NO: 405575 - DNA, 20 bp, Artificial Sequence
  chemically synthesized
acttcccagggtccggtgca

SEQ ID NO: 405576 - DNA, 20 bp, Artificial Sequence
  chemically synthesized
atttgctatgcaccggaccc

SEQ ID NO: 405577 - DNA, 20 bp, Artificial Sequence
  chemically synthesized
tttgctatgcaccggaccct

SEQ ID NO: 405578 - DNA, 20 bp, Artificial Sequence
  chemically synthesized
tacattgacttcccagggtc

SEQ ID NO: 405579 - DNA, 20 bp, Artificial Sequence
  chemically synthesized
gctatgcaccggaccctggg

SEQ ID NO: 405580 - DNA, 20 bp, Artificial Sequence
  chemically synthesized
cactgtacattgacttccca

SEQ ID NO: 405581 - DNA, 20 bp, Artificial Sequence
  chemically synthesized
ccactgtacattgacttccc

SEQ ID NO: 405582 - DNA, 20 bp, Artificial Sequence
  chemically synthesized
accactgtacattgacttcc

SEQ ID NO: 405583 - DNA, 20 bp, Artificial Sequence
  chemically synthesized
gaccctgggaagtcaatgta

SEQ ID NO: 405584 - DNA, 20 bp, Artificial Sequence
  chemically synthesized
cctgggaagtcaatgtacag

SEQ ID NO: 405585 - DNA, 20 bp, Artificial Sequence
  chemically synthesized
aattcaattgtattaatatt

SEQ ID NO: 405586 - DNA, 20 bp, Artificial Sequence
  chemically synthesized
tcaattgtattaatatttag

SEQ ID NO: 405587 - DNA, 20 bp, Artificial Sequence
  chemically synthesized
aagaatatatttgcattttg

SEQ ID NO: 405588 - DNA, 20 bp, Artificial Sequence
  chemically synthesized
taacaagcttcaaattaaaa

SEQ ID NO: 405589 - DNA, 20 bp, Artificial Sequence
  chemically synthesized
atatattcttttttaatttg

SEQ ID NO: 405590 - DNA, 20 bp, Artificial Sequence
  chemically synthesized
agattgtgcagaagaataac

SEQ ID NO: 405591 - DNA, 20 bp, Artificial Sequence
  chemically synthesized
aggagctatagattgtgcag

SEQ ID NO: 405592 - DNA, 20 bp, Artificial Sequence
  chemically synthesized
aataggagctatagattgtg

SEQ ID NO: 405593 - DNA, 20 bp, Artificial Sequence
  chemically synthesized
ttattcttctgcacaatcta

SEQ ID NO: 405594 - DNA, 20 bp, Artificial Sequence
  chemically synthesized
aatgattctaataggagcta

SEQ ID NO: 405595 - DNA, 20 bp, Artificial Sequence
  chemically synthesized
gcacaatctatagctcctat

SEQ ID NO: 405596 - DNA, 20 bp, Artificial Sequence
  chemically synthesized
tactttaatgattctaatag

SEQ ID NO: 405597 - DNA, 20 bp, Artificial Sequence
  chemically synthesized
tgtactttaatgattctaat

SEQ ID NO: 405598 - DNA, 20 bp, Artificial Sequence
  chemically synthesized
atgtactttaatgattctaa

SEQ ID NO: 405599 - DNA, 20 bp, Artificial Sequence
  chemically synthesized
agctcctattagaatcatta

SEQ ID NO: 405600 - DNA, 20 bp, Artificial Sequence
  chemically synthesized
tagaatcattaaagtacatt

SEQ ID NO: 405601 - DNA, 20 bp, Artificial Sequence
  chemically synthesized
aatcattaaagtacattcag

SEQ ID NO: 405602 - DNA, 20 bp, Artificial Sequence
  chemically synthesized
cattaaagtacattcagcag

SEQ ID NO: 405603 - DNA, 20 bp, Artificial Sequence
  chemically synthesized
cagcagcagtaacaaacgaa

SEQ ID NO: 405604 - DNA, 20 bp, Artificial Sequence
  chemically synthesized
agcagcagtaacaaacgaac

SEQ ID NO: 405605 - DNA, 20 bp, Artificial Sequence
  chemically synthesized
gcagcagtaacaaacgaaca

SEQ ID NO: 405606 - DNA, 20 bp, Artificial Sequence
  chemically synthesized
ggaaaatgtgaacatgacaa

SEQ ID NO: 405607 - DNA, 20 bp, Artificial Sequence
  chemically synthesized
gaaaatgtgaacatgacaaa

SEQ ID NO: 405608 - DNA, 20 bp, Artificial Sequence
  chemically synthesized
tgaacatgacaaaaggctgc

SEQ ID NO: 405609 - DNA, 20 bp, Artificial Sequence
  chemically synthesized
aacatgacaaaaggctgcca

SEQ ID NO: 405610 - DNA, 20 bp, Artificial Sequence
  chemically synthesized
tgtcacccgtgttactctgg

SEQ ID NO: 405611 - DNA, 20 bp, Artificial Sequence
  chemically synthesized
atttgtcacccgtgttactc

SEQ ID NO: 405612 - DNA, 20 bp, Artificial Sequence
  chemically synthesized
aaaaggctgccagagtaaca

SEQ ID NO: 405613 - DNA, 20 bp, Artificial Sequence
  chemically synthesized
aaaggctgccagagtaacac

SEQ ID NO: 405614 - DNA, 20 bp, Artificial Sequence
  chemically synthesized
agtaacacgggtgacaaatg

SEQ ID NO: 405615 - DNA, 20 bp, Artificial Sequence
  chemically synthesized
gtaacacgggtgacaaatgt

SEQ ID NO: 405616 - DNA, 20 bp, Artificial Sequence
  chemically synthesized
tgacaaatgtgggaacattt

SEQ ID NO: 405617 - DNA, 20 bp, Artificial Sequence
  chemically synthesized
ttttattagagtgggaaatt

SEQ ID NO: 405618 - DNA, 20 bp, Artificial Sequence
  chemically synthesized
attttattagagtgggaaat

SEQ ID NO: 405619 - DNA, 20 bp, Artificial Sequence
  chemically synthesized
tcatattattttattagagt

SEQ ID NO: 405620 - DNA, 20 bp, Artificial Sequence
  chemically synthesized
ttcatattattttattagag

SEQ ID NO: 405621 - DNA, 20 bp, Artificial Sequence
  chemically synthesized
ttgttcatattattttatta

SEQ ID NO: 405622 - DNA, 20 bp, Artificial Sequence
  chemically synthesized
ttttgttcatattattttat

SEQ ID NO: 405623 - DNA, 20 bp, Artificial Sequence
  chemically synthesized
aataaaataatatgaacaaa

SEQ ID NO: 405624 - DNA, 20 bp, Artificial Sequence
  chemically synthesized
ataaaataatatgaacaaaa

SEQ ID NO: 405625 - DNA, 20 bp, Artificial Sequence
  chemically synthesized
atgaacaaaaaggctttttt

SEQ ID NO: 405626 - DNA, 20 bp, Artificial Sequence
  chemically synthesized
aacaaaaaggctttttttag

SEQ ID NO: 405627 - DNA, 20 bp, Artificial Sequence
  chemically synthesized
tcagttgaagctactaaaaa

SEQ ID NO: 405628 - DNA, 20 bp, Artificial Sequence
  chemically synthesized
tcaggtgatagtttcagttg

SEQ ID NO: 405629 - DNA, 20 bp, Artificial Sequence
  chemically synthesized
aatagatcaggtgatagttt

SEQ ID NO: 405630 - DNA, 20 bp, Artificial Sequence
  chemically synthesized
ttaagaaatagatcaggtga

SEQ ID NO: 405631 - DNA, 20 bp, Artificial Sequence
  chemically synthesized
aggattttaagaaatagatc

SEQ ID NO: 405632 - DNA, 20 bp, Artificial Sequence
  chemically synthesized
gaggattttaagaaatagat

SEQ ID NO: 405633 - DNA, 20 bp, Artificial Sequence
  chemically synthesized
ttcgtgaggattttaagaaa

SEQ ID NO: 405634 - DNA, 20 bp, Artificial Sequence
  chemically synthesized
gaaaccttcgtgaggatttt

SEQ ID NO: 405635 - DNA, 20 bp, Artificial Sequence
  chemically synthesized
tatttcttaaaatcctcacg

SEQ ID NO: 405636 - DNA, 20 bp, Artificial Sequence
  chemically synthesized
atttcttaaaatcctcacga

SEQ ID NO: 405637 - DNA, 20 bp, Artificial Sequence
  chemically synthesized
ggttcagtgaaaccttcgtg

SEQ ID NO: 405638 - DNA, 20 bp, Artificial Sequence
  chemically synthesized
tggttcagtgaaaccttcgt

SEQ ID NO: 405639 - DNA, 20 bp, Artificial Sequence
  chemically synthesized
cgaaggtttcactgaaccat

SEQ ID NO: 405640 - DNA, 20 bp, Artificial Sequence
  chemically synthesized
tgcccaaacctctaatggtt

SEQ ID NO: 405641 - DNA, 20 bp, Artificial Sequence
  chemically synthesized
aaggtttcactgaaccatta

SEQ ID NO: 405642 - DNA, 20 bp, Artificial Sequence
  chemically synthesized
aggtttcactgaaccattag

SEQ ID NO: 405643 - DNA, 20 bp, Artificial Sequence
  chemically synthesized
ttgactgcccaaacctctaa

SEQ ID NO: 405644 - DNA, 20 bp, Artificial Sequence
  chemically synthesized
tcactgaaccattagaggtt

SEQ ID NO: 405645 - DNA, 20 bp, Artificial Sequence
  chemically synthesized
cactgaaccattagaggttt

SEQ ID NO: 405646 - DNA, 20 bp, Artificial Sequence
  chemically synthesized
tgaaccattagaggtttggg

SEQ ID NO: 405647 - DNA, 20 bp, Artificial Sequence
  chemically synthesized
taaacatgaaccaatctttt

SEQ ID NO: 405648 - DNA, 20 bp, Artificial Sequence
  chemically synthesized
agtagtcattctaaaaagat

SEQ ID NO: 405649 - DNA, 20 bp, Artificial Sequence
  chemically synthesized
acttcagtagtcattctaaa

SEQ ID NO: 405650 - DNA, 20 bp, Artificial Sequence
  chemically synthesized
tctttttagaatgactactg

SEQ ID NO: 405651 - DNA, 20 bp, Artificial Sequence
  chemically synthesized
ggaaatactgagcacttcag

SEQ ID NO: 405652 - DNA, 20 bp, Artificial Sequence
  chemically synthesized
agaatgactactgaagtgct

SEQ ID NO: 405653 - DNA, 20 bp, Artificial Sequence
  chemically synthesized
gctggaaatactgagcactt

SEQ ID NO: 405654 - DNA, 20 bp, Artificial Sequence
  chemically synthesized
actggaaggctggaaatact

SEQ ID NO: 405655 - DNA, 20 bp, Artificial Sequence
  chemically synthesized
actgaagtgctcagtatttc

SEQ ID NO: 405656 - DNA, 20 bp, Artificial Sequence
  chemically synthesized
gctcagtatttccagccttc

SEQ ID NO: 405657 - DNA, 20 bp, Artificial Sequence
  chemically synthesized
cactgtggtaactggaaggc

SEQ ID NO: 405658 - DNA, 20 bp, Artificial Sequence
  chemically synthesized
ctttcactgtggtaactgga

SEQ ID NO: 405659 - DNA, 20 bp, Artificial Sequence
  chemically synthesized
tctttcactgtggtaactgg

SEQ ID NO: 405660 - DNA, 20 bp, Artificial Sequence
  chemically synthesized
ttccagccttccagttacca

SEQ ID NO: 405661 - DNA, 20 bp, Artificial Sequence
  chemically synthesized
gtttctttcactgtggtaac

SEQ ID NO: 405662 - DNA, 20 bp, Artificial Sequence
  chemically synthesized
ccttccagttaccacagtga

SEQ ID NO: 405663 - DNA, 20 bp, Artificial Sequence
  chemically synthesized
cctgtttgtttctttcactg

SEQ ID NO: 405664 - DNA, 20 bp, Artificial Sequence
  chemically synthesized
accacagtgaaagaaacaaa

SEQ ID NO: 405665 - DNA, 20 bp, Artificial Sequence
  chemically synthesized
ccacagtgaaagaaacaaac

SEQ ID NO: 405666 - DNA, 20 bp, Artificial Sequence
  chemically synthesized
agaaacaaacaggtacttgt

SEQ ID NO: 405667 - DNA, 20 bp, Artificial Sequence
  chemically synthesized
gaaacaaacaggtacttgtc

SEQ ID NO: 405668 - DNA, 20 bp, Artificial Sequence
  chemically synthesized
cattcccttataaacctgac

SEQ ID NO: 405669 - DNA, 20 bp, Artificial Sequence
  chemically synthesized
caggtacttgtcaggtttat

SEQ ID NO: 405670 - DNA, 20 bp, Artificial Sequence
  chemically synthesized
aggtacttgtcaggtttata

SEQ ID NO: 405671 - DNA, 20 bp, Artificial Sequence
  chemically synthesized
ggtacttgtcaggtttataa

SEQ ID NO: 405672 - DNA, 20 bp, Artificial Sequence
  chemically synthesized
aggcaaaaaagggcagaaaa

SEQ ID NO: 405673 - DNA, 20 bp, Artificial Sequence
  chemically synthesized
aaagagtaggcaaaaaaggg

SEQ ID NO: 405674 - DNA, 20 bp, Artificial Sequence
  chemically synthesized
cttaaagagtaggcaaaaaa

SEQ ID NO: 405675 - DNA, 20 bp, Artificial Sequence
  chemically synthesized
ccttaaagagtaggcaaaaa

SEQ ID NO: 405676 - DNA, 20 bp, Artificial Sequence
  chemically synthesized
tccttaaagagtaggcaaaa

SEQ ID NO: 405677 - DNA, 20 bp, Artificial Sequence
  chemically synthesized
cccttttttgcctactcttt

SEQ ID NO: 405678 - DNA, 20 bp, Artificial Sequence
  chemically synthesized
gtgtgttttccttaaagagt

SEQ ID NO: 405679 - DNA, 20 bp, Artificial Sequence
  chemically synthesized
ccttttttgcctactcttta

SEQ ID NO: 405680 - DNA, 20 bp, Artificial Sequence
  chemically synthesized
tgtgtgttttccttaaagag

SEQ ID NO: 405681 - DNA, 20 bp, Artificial Sequence
  chemically synthesized
gtgtgtgtgttttccttaaa

SEQ ID NO: 405682 - DNA, 20 bp, Artificial Sequence
  chemically synthesized
atgtgtgtgtgttttcctta

SEQ ID NO: 405683 - DNA, 20 bp, Artificial Sequence
  chemically synthesized
acacacacacatatgcatgc

SEQ ID NO: 405684 - DNA, 20 bp, Artificial Sequence
  chemically synthesized
gcaagcatacacgcatgcac

SEQ ID NO: 405685 - DNA, 20 bp, Artificial Sequence
  chemically synthesized
agcatacacgcatgcacaag

SEQ ID NO: 405686 - DNA, 20 bp, Artificial Sequence
  chemically synthesized
gcacaagcagaacacaaatt

SEQ ID NO: 405687 - DNA, 20 bp, Artificial Sequence
  chemically synthesized
caagcagaacacaaatttag

SEQ ID NO: 405688 - DNA, 20 bp, Artificial Sequence
  chemically synthesized
gaacacaaatttagaagcta

SEQ ID NO: 405689 - DNA, 20 bp, Artificial Sequence
  chemically synthesized
acacaaatttagaagctata

SEQ ID NO: 405690 - DNA, 20 bp, Artificial Sequence
  chemically synthesized
ttttctatttattttctcta

SEQ ID NO: 405691 - DNA, 20 bp, Artificial Sequence
  chemically synthesized
gaagctatagagaaaataaa

SEQ ID NO: 405692 - DNA, 20 bp, Artificial Sequence
  chemically synthesized
gagaaaataaatagaaaaca

SEQ ID NO: 405693 - DNA, 20 bp, Artificial Sequence
  chemically synthesized
aaaataaatagaaaacaaag

SEQ ID NO: 405694 - DNA, 20 bp, Artificial Sequence
  chemically synthesized
atctaaaagtaaagacagtt

SEQ ID NO: 405695 - DNA, 20 bp, Artificial Sequence
  chemically synthesized
ttataatctaaaagtaaaga

SEQ ID NO: 405696 - DNA, 20 bp, Artificial Sequence
  chemically synthesized
aaccaaactgtctttacttt

SEQ ID NO: 405697 - DNA, 20 bp, Artificial Sequence
  chemically synthesized
gtttttataatctaaaagta

SEQ ID NO: 405698 - DNA, 20 bp, Artificial Sequence
  chemically synthesized
tgattgtttttataatctaa

SEQ ID NO: 405699 - DNA, 20 bp, Artificial Sequence
  chemically synthesized
aagtataataataaaaaaaa

SEQ ID NO: 405700 - DNA, 20 bp, Artificial Sequence
  chemically synthesized
taaagtataataataaaaaa

SEQ ID NO: 405701 - DNA, 20 bp, Artificial Sequence
  chemically synthesized
ttttttttattattatactt

SEQ ID NO: 405702 - DNA, 20 bp, Artificial Sequence
  chemically synthesized
tttttttattattatacttt

SEQ ID NO: 405703 - DNA, 20 bp, Artificial Sequence
  chemically synthesized
tattattatactttaggttt

SEQ ID NO: 405704 - DNA, 20 bp, Artificial Sequence
  chemically synthesized
cacatgtaccctaaaaccta

SEQ ID NO: 405705 - DNA, 20 bp, Artificial Sequence
  chemically synthesized
attattatactttaggtttt

SEQ ID NO: 405706 - DNA, 20 bp, Artificial Sequence
  chemically synthesized
ttattatactttaggtttta

SEQ ID NO: 405707 - DNA, 20 bp, Artificial Sequence
  chemically synthesized
gggtacatgtgcacaacgtg

SEQ ID NO: 405708 - DNA, 20 bp, Artificial Sequence
  chemically synthesized
ggtacatgtgcacaacgtgc

SEQ ID NO: 405709 - DNA, 20 bp, Artificial Sequence
  chemically synthesized
tatgtatacatgtgccatgt

SEQ ID NO: 405710 - DNA, 20 bp, Artificial Sequence
  chemically synthesized
atgggtgcagcacaccaaca

SEQ ID NO: 405711 - DNA, 20 bp, Artificial Sequence
  chemically synthesized
aaatgacgagttaatgggtg

SEQ ID NO: 405712 - DNA, 20 bp, Artificial Sequence
  chemically synthesized
atgttaaatgacgagttaat

SEQ ID NO: 405713 - DNA, 20 bp, Artificial Sequence
  chemically synthesized
aatgttaaatgacgagttaa

SEQ ID NO: 405714 - DNA, 20 bp, Artificial Sequence
  chemically synthesized
tatacctaatgttaaatgac

SEQ ID NO: 405715 - DNA, 20 bp, Artificial Sequence
  chemically synthesized
attaactcgtcatttaacat

SEQ ID NO: 405716 - DNA, 20 bp, Artificial Sequence
  chemically synthesized
ttaactcgtcatttaacatt

SEQ ID NO: 405717 - DNA, 20 bp, Artificial Sequence
  chemically synthesized
ggggggagggatagcattag

SEQ ID NO: 405718 - DNA, 20 bp, Artificial Sequence
  chemically synthesized
gaggggggagggatagcatt

SEQ ID NO: 405719 - DNA, 20 bp, Artificial Sequence
  chemically synthesized
ggaggggggagggatagcat

SEQ ID NO: 405720 - DNA, 20 bp, Artificial Sequence
  chemically synthesized
gtggggggaggggggaggga

SEQ ID NO: 405721 - DNA, 20 bp, Artificial Sequence
  chemically synthesized
tggggtggggggagggggga

SEQ ID NO: 405722 - DNA, 20 bp, Artificial Sequence
  chemically synthesized
gtggggtggggggagggggg

SEQ ID NO: 405723 - DNA, 20 bp, Artificial Sequence
  chemically synthesized
tgtggggtggggggaggggg

SEQ ID NO: 405724 - DNA, 20 bp, Artificial Sequence
  chemically synthesized
gttgtggggtggggggaggg

SEQ ID NO: 405725 - DNA, 20 bp, Artificial Sequence
  chemically synthesized
tgttgtggggtggggggagg

SEQ ID NO: 405726 - DNA, 20 bp, Artificial Sequence
  chemically synthesized
ctgttgtggggtggggggag

SEQ ID NO: 405727 - DNA, 20 bp, Artificial Sequence
  chemically synthesized
cctgttgtggggtgggggga

SEQ ID NO: 405728 - DNA, 20 bp, Artificial Sequence
  chemically synthesized
gcctgttgtggggtgggggg

SEQ ID NO: 405729 - DNA, 20 bp, Artificial Sequence
  chemically synthesized
ggcctgttgtggggtggggg

SEQ ID NO: 405730 - DNA, 20 bp, Artificial Sequence
  chemically synthesized
ggggcctgttgtggggtggg

SEQ ID NO: 405731 - DNA, 20 bp, Artificial Sequence
  chemically synthesized
cggggcctgttgtggggtgg

SEQ ID NO: 405732 - DNA, 20 bp, Artificial Sequence
  chemically synthesized
ccggggcctgttgtggggtg

SEQ ID NO: 405733 - DNA, 20 bp, Artificial Sequence
  chemically synthesized
accggggcctgttgtggggt

SEQ ID NO: 405734 - DNA, 20 bp, Artificial Sequence
  chemically synthesized
caccggggcctgttgtgggg

SEQ ID NO: 405735 - DNA, 20 bp, Artificial Sequence
  chemically synthesized
cccctccccccaccccacaa

SEQ ID NO: 405736 - DNA, 20 bp, Artificial Sequence
  chemically synthesized
ccctccccccaccccacaac

SEQ ID NO: 405737 - DNA, 20 bp, Artificial Sequence
  chemically synthesized
acacaccggggcctgttgtg

SEQ ID NO: 405738 - DNA, 20 bp, Artificial Sequence
  chemically synthesized
cacacaccggggcctgttgt

SEQ ID NO: 405739 - DNA, 20 bp, Artificial Sequence
  chemically synthesized
tcacacaccggggcctgttg

SEQ ID NO: 405740 - DNA, 20 bp, Artificial Sequence
  chemically synthesized
ccccaccccacaacaggccc

SEQ ID NO: 405741 - DNA, 20 bp, Artificial Sequence
  chemically synthesized
tctaattccctcacacaccg

SEQ ID NO: 405742 - DNA, 20 bp, Artificial Sequence
  chemically synthesized
cacaacaggccccggtgtgt

SEQ ID NO: 405743 - DNA, 20 bp, Artificial Sequence
  chemically synthesized
ttctaattccctcacacacc

SEQ ID NO: 405744 - DNA, 20 bp, Artificial Sequence
  chemically synthesized
acaacaggccccggtgtgtg

SEQ ID NO: 405745 - DNA, 20 bp, Artificial Sequence
  chemically synthesized
attctaattccctcacacac

SEQ ID NO: 405746 - DNA, 20 bp, Artificial Sequence
  chemically synthesized
caacaggccccggtgtgtga

SEQ ID NO: 405747 - DNA, 20 bp, Artificial Sequence
  chemically synthesized
gccccggtgtgtgagggaat

SEQ ID NO: 405748 - DNA, 20 bp, Artificial Sequence
  chemically synthesized
ttagaattttgtaattcatt

SEQ ID NO: 405749 - DNA, 20 bp, Artificial Sequence
  chemically synthesized
tagaattttgtaattcattt

SEQ ID NO: 405750 - DNA, 20 bp, Artificial Sequence
  chemically synthesized
aattttgtaattcatttggg

SEQ ID NO: 405751 - DNA, 20 bp, Artificial Sequence
  chemically synthesized
ttttgtaattcatttgggta

SEQ ID NO: 405752 - DNA, 20 bp, Artificial Sequence
  chemically synthesized
tttgtaattcatttgggtag

SEQ ID NO: 405753 - DNA, 20 bp, Artificial Sequence
  chemically synthesized
tgtaattcatttgggtagag

SEQ ID NO: 405754 - DNA, 20 bp, Artificial Sequence
  chemically synthesized
tcatttgggtagaggagcaa

SEQ ID NO: 405755 - DNA, 20 bp, Artificial Sequence
  chemically synthesized
catttgggtagaggagcaaa

SEQ ID NO: 405756 - DNA, 20 bp, Artificial Sequence
  chemically synthesized
gaggagcaaaaggtatatat

SEQ ID NO: 405757 - DNA, 20 bp, Artificial Sequence
  chemically synthesized
aggagcaaaaggtatatatt

SEQ ID NO: 405758 - DNA, 20 bp, Artificial Sequence
  chemically synthesized
atatattaggctcaactttt

SEQ ID NO: 405759 - DNA, 20 bp, Artificial Sequence
  chemically synthesized
tcatcaccgactgaaaagtt

SEQ ID NO: 405760 - DNA, 20 bp, Artificial Sequence
  chemically synthesized
attaggctcaacttttcagt

SEQ ID NO: 405761 - DNA, 20 bp, Artificial Sequence
  chemically synthesized
gtctctcatcaccgactgaa

SEQ ID NO: 405762 - DNA, 20 bp, Artificial Sequence
  chemically synthesized
tcaacttttcagtcggtgat

SEQ ID NO: 405763 - DNA, 20 bp, Artificial Sequence
  chemically synthesized
aacttttcagtcggtgatga

SEQ ID NO: 405764 - DNA, 20 bp, Artificial Sequence
  chemically synthesized
agtcggtgatgagagacaaa

SEQ ID NO: 405765 - DNA, 20 bp, Artificial Sequence
  chemically synthesized
tgagagagggcagggatggc

SEQ ID NO: 405766 - DNA, 20 bp, Artificial Sequence
  chemically synthesized
gtgagagagggcagggatgg

SEQ ID NO: 405767 - DNA, 20 bp, Artificial Sequence
  chemically synthesized
taggtgagagagggcaggga

SEQ ID NO: 405768 - DNA, 20 bp, Artificial Sequence
  chemically synthesized
ggggtaggtgagagagggca

SEQ ID NO: 405769 - DNA, 20 bp, Artificial Sequence
  chemically synthesized
tggggtaggtgagagagggc

SEQ ID NO: 405770 - DNA, 20 bp, Artificial Sequence
  chemically synthesized
ctggggtaggtgagagaggg

SEQ ID NO: 405771 - DNA, 20 bp, Artificial Sequence
  chemically synthesized
taactggggtaggtgagaga

SEQ ID NO: 405772 - DNA, 20 bp, Artificial Sequence
  chemically synthesized
ttaactggggtaggtgagag

SEQ ID NO: 405773 - DNA, 20 bp, Artificial Sequence
  chemically synthesized
attaactggggtaggtgaga

SEQ ID NO: 405774 - DNA, 20 bp, Artificial Sequence
  chemically synthesized
agattaactggggtaggtga

SEQ ID NO: 405775 - DNA, 20 bp, Artificial Sequence
  chemically synthesized
ttagattaactggggtaggt

SEQ ID NO: 405776 - DNA, 20 bp, Artificial Sequence
  chemically synthesized
ctgccctctctcacctaccc

SEQ ID NO: 405777 - DNA, 20 bp, Artificial Sequence
  chemically synthesized
agatttagattaactggggt

SEQ ID NO: 405778 - DNA, 20 bp, Artificial Sequence
  chemically synthesized
cagatttagattaactgggg

SEQ ID NO: 405779 - DNA, 20 bp, Artificial Sequence
  chemically synthesized
ttgcagatttagattaactg

SEQ ID NO: 405780 - DNA, 20 bp, Artificial Sequence
  chemically synthesized
tttgcagatttagattaact

SEQ ID NO: 405781 - DNA, 20 bp, Artificial Sequence
  chemically synthesized
ttttgcagatttagattaac

SEQ ID NO: 405782 - DNA, 20 bp, Artificial Sequence
  chemically synthesized
ctcctttcgttttgcagatt

SEQ ID NO: 405783 - DNA, 20 bp, Artificial Sequence
  chemically synthesized
tggaagctcctttcgttttg

SEQ ID NO: 405784 - DNA, 20 bp, Artificial Sequence
  chemically synthesized
aatctaaatctgcaaaacga

SEQ ID NO: 405785 - DNA, 20 bp, Artificial Sequence
  chemically synthesized
atctaaatctgcaaaacgaa

SEQ ID NO: 405786 - DNA, 20 bp, Artificial Sequence
  chemically synthesized
ctaaatctgcaaaacgaaag

SEQ ID NO: 405787 - DNA, 20 bp, Artificial Sequence
  chemically synthesized
aaaacgaaaggagcttccac

SEQ ID NO: 405788 - DNA, 20 bp, Artificial Sequence
  chemically synthesized
aaacgaaaggagcttccact

SEQ ID NO: 405789 - DNA, 20 bp, Artificial Sequence
  chemically synthesized
cagcccctctggcctagtgg

SEQ ID NO: 405790 - DNA, 20 bp, Artificial Sequence
  chemically synthesized
gaaaggagcttccactaggc

SEQ ID NO: 405791 - DNA, 20 bp, Artificial Sequence
  chemically synthesized
ctgcagcccctctggcctag

SEQ ID NO: 405792 - DNA, 20 bp, Artificial Sequence
  chemically synthesized
aaggagcttccactaggcca

SEQ ID NO: 405793 - DNA, 20 bp, Artificial Sequence
  chemically synthesized
aggagcttccactaggccag

SEQ ID NO: 405794 - DNA, 20 bp, Artificial Sequence
  chemically synthesized
ggagcttccactaggccaga

SEQ ID NO: 405795 - DNA, 20 bp, Artificial Sequence
  chemically synthesized
atcctgcagcccctctggcc

SEQ ID NO: 405796 - DNA, 20 bp, Artificial Sequence
  chemically synthesized
gagcttccactaggccagag

SEQ ID NO: 405797 - DNA, 20 bp, Artificial Sequence
  chemically synthesized
ttcccatcctgcagcccctc

SEQ ID NO: 405798 - DNA, 20 bp, Artificial Sequence
  chemically synthesized
ccactaggccagaggggctg

SEQ ID NO: 405799 - DNA, 20 bp, Artificial Sequence
  chemically synthesized
cactaggccagaggggctgc

SEQ ID NO: 405800 - DNA, 20 bp, Artificial Sequence
  chemically synthesized
aggccagaggggctgcagga

SEQ ID NO: 405801 - DNA, 20 bp, Artificial Sequence
  chemically synthesized
ggccagaggggctgcaggat

SEQ ID NO: 405802 - DNA, 20 bp, Artificial Sequence
  chemically synthesized
ctgattgttttcccatcctg

SEQ ID NO: 405803 - DNA, 20 bp, Artificial Sequence
  chemically synthesized
ctgcaggatgggaaaacaat

SEQ ID NO: 405804 - DNA, 20 bp, Artificial Sequence
  chemically synthesized
ggatgggaaaacaatcagaa

SEQ ID NO: 405805 - DNA, 20 bp, Artificial Sequence
  chemically synthesized
atcagaatggaacactttca

SEQ ID NO: 405806 - DNA, 20 bp, Artificial Sequence
  chemically synthesized
tcagaatggaacactttcat

SEQ ID NO: 405807 - DNA, 20 bp, Artificial Sequence
  chemically synthesized
gtctgtaggaacgcccatga

SEQ ID NO: 405808 - DNA, 20 bp, Artificial Sequence
  chemically synthesized
cactttcatgggcgttccta

SEQ ID NO: 405809 - DNA, 20 bp, Artificial Sequence
  chemically synthesized
ctggaagcaaattggtctgt

SEQ ID NO: 405810 - DNA, 20 bp, Artificial Sequence
  chemically synthesized
actggaagcaaattggtctg

SEQ ID NO: 405811 - DNA, 20 bp, Artificial Sequence
  chemically synthesized
tgggctgactggaagcaaat

SEQ ID NO: 405812 - DNA, 20 bp, Artificial Sequence
  chemically synthesized
cctacagaccaatttgcttc

SEQ ID NO: 405813 - DNA, 20 bp, Artificial Sequence
  chemically synthesized
cagaccaatttgcttccagt

SEQ ID NO: 405814 - DNA, 20 bp, Artificial Sequence
  chemically synthesized
aaattaaatgggctgactgg

SEQ ID NO: 405815 - DNA, 20 bp, Artificial Sequence
  chemically synthesized
atgaaattaaatgggctgac

SEQ ID NO: 405816 - DNA, 20 bp, Artificial Sequence
  chemically synthesized
tcataaatatgaaattaaat

SEQ ID NO: 405817 - DNA, 20 bp, Artificial Sequence
  chemically synthesized
atcataaatatgaaattaaa

SEQ ID NO: 405818 - DNA, 20 bp, Artificial Sequence
  chemically synthesized
tcatatttatgattgtttaa

SEQ ID NO: 405819 - DNA, 20 bp, Artificial Sequence
  chemically synthesized
atatttatgattgtttaaaa

SEQ ID NO: 405820 - DNA, 20 bp, Artificial Sequence
  chemically synthesized
atttatgattgtttaaaaga

SEQ ID NO: 405821 - DNA, 20 bp, Artificial Sequence
  chemically synthesized
ttatgattgtttaaaagaga

SEQ ID NO: 405822 - DNA, 20 bp, Artificial Sequence
  chemically synthesized
attgtttaaaagagagagcc

SEQ ID NO: 405823 - DNA, 20 bp, Artificial Sequence
  chemically synthesized
ttgtttaaaagagagagccc

SEQ ID NO: 405824 - DNA, 20 bp, Artificial Sequence
  chemically synthesized
taaaagagagagcccaggcg

SEQ ID NO: 405825 - DNA, 20 bp, Artificial Sequence
  chemically synthesized
aggcatgagccactgcgcct

SEQ ID NO: 405826 - DNA, 20 bp, Artificial Sequence
  chemically synthesized
aagagagagcccaggcgcag

SEQ ID NO: 405827 - DNA, 20 bp, Artificial Sequence
  chemically synthesized
caggcatgagccactgcgcc

SEQ ID NO: 405828 - DNA, 20 bp, Artificial Sequence
  chemically synthesized
agtactgggattacaggcat

SEQ ID NO: 405829 - DNA, 20 bp, Artificial Sequence
  chemically synthesized
gtggctcatgcctgtaatcc

SEQ ID NO: 405830 - DNA, 20 bp, Artificial Sequence
  chemically synthesized
tcccaaagtactgggattac

SEQ ID NO: 405831 - DNA, 20 bp, Artificial Sequence
  chemically synthesized
ttcccaaagtactgggatta

SEQ ID NO: 405832 - DNA, 20 bp, Artificial Sequence
  chemically synthesized
tgcctgtaatcccagtactt

SEQ ID NO: 405833 - DNA, 20 bp, Artificial Sequence
  chemically synthesized
cctcggcttcccaaagtact

SEQ ID NO: 405834 - DNA, 20 bp, Artificial Sequence
  chemically synthesized
gcctgtaatcccagtacttt

SEQ ID NO: 405835 - DNA, 20 bp, Artificial Sequence
  chemically synthesized
gcctcggcttcccaaagtac

SEQ ID NO: 405836 - DNA, 20 bp, Artificial Sequence
  chemically synthesized
tgtaatcccagtactttggg

SEQ ID NO: 405837 - DNA, 20 bp, Artificial Sequence
  chemically synthesized
ccacctgcctcggcttccca

SEQ ID NO: 405838 - DNA, 20 bp, Artificial Sequence
  chemically synthesized
tcccagtactttgggaagcc

SEQ ID NO: 405839 - DNA, 20 bp, Artificial Sequence
  chemically synthesized
cccagtactttgggaagccg

SEQ ID NO: 405840 - DNA, 20 bp, Artificial Sequence
  chemically synthesized
agtactttgggaagccgagg

SEQ ID NO: 405841 - DNA, 20 bp, Artificial Sequence
  chemically synthesized
gtactttgggaagccgaggc

SEQ ID NO: 405842 - DNA, 20 bp, Artificial Sequence
  chemically synthesized
ctttgggaagccgaggcagg

SEQ ID NO: 405843 - DNA, 20 bp, Artificial Sequence
  chemically synthesized
ctcaagtgatccacctgcct

SEQ ID NO: 405844 - DNA, 20 bp, Artificial Sequence
  chemically synthesized
ccgaggcaggtggatcactt

SEQ ID NO: 405845 - DNA, 20 bp, Artificial Sequence
  chemically synthesized
cgaggcaggtggatcacttg

SEQ ID NO: 405846 - DNA, 20 bp, Artificial Sequence
  chemically synthesized
gcaggtggatcacttgaggt

SEQ ID NO: 405847 - DNA, 20 bp, Artificial Sequence
  chemically synthesized
caggtggatcacttgaggtc

SEQ ID NO: 405848 - DNA, 20 bp, Artificial Sequence
  chemically synthesized
ggtcttgaactcctgacctc

SEQ ID NO: 405849 - DNA, 20 bp, Artificial Sequence
  chemically synthesized
ggtggatcacttgaggtcag

SEQ ID NO: 405850 - DNA, 20 bp, Artificial Sequence
  chemically synthesized
tcacttgaggtcaggagttc

SEQ ID NO: 405851 - DNA, 20 bp, Artificial Sequence
  chemically synthesized
tgaggtcaggagttcaagac

SEQ ID NO: 405852 - DNA, 20 bp, Artificial Sequence
  chemically synthesized
tcaggagttcaagaccagcc

SEQ ID NO: 405853 - DNA, 20 bp, Artificial Sequence
  chemically synthesized
tttcaccacgttggccaggc

SEQ ID NO: 405854 - DNA, 20 bp, Artificial Sequence
  chemically synthesized
ggggtttcaccacgttggcc

SEQ ID NO: 405855 - DNA, 20 bp, Artificial Sequence
  chemically synthesized
caagaccagcctggccaacg

SEQ ID NO: 405856 - DNA, 20 bp, Artificial Sequence
  chemically synthesized
cggggtttcaccacgttggc

SEQ ID NO: 405857 - DNA, 20 bp, Artificial Sequence
  chemically synthesized
gagacggggtttcaccacgt

SEQ ID NO: 405858 - DNA, 20 bp, Artificial Sequence
  chemically synthesized
ttgtatttttagtagagacg

SEQ ID NO: 405859 - DNA, 20 bp, Artificial Sequence
  chemically synthesized
tttgtatttttagtagagac

SEQ ID NO: 405860 - DNA, 20 bp, Artificial Sequence
  chemically synthesized
ttttgtatttttagtagaga

SEQ ID NO: 405861 - DNA, 20 bp, Artificial Sequence
  chemically synthesized
taatttttgtatttttagta

SEQ ID NO: 405862 - DNA, 20 bp, Artificial Sequence
  chemically synthesized
gctaatttttgtatttttag

SEQ ID NO: 405863 - DNA, 20 bp, Artificial Sequence
  chemically synthesized
ccggctaatttttgtatttt

SEQ ID NO: 405864 - DNA, 20 bp, Artificial Sequence
  chemically synthesized
tctactaaaaatacaaaaat

SEQ ID NO: 405865 - DNA, 20 bp, Artificial Sequence
  chemically synthesized
ctaaaaatacaaaaattagc

SEQ ID NO: 405866 - DNA, 20 bp, Artificial Sequence
  chemically synthesized
taaaaatacaaaaattagcc

SEQ ID NO: 405867 - DNA, 20 bp, Artificial Sequence
  chemically synthesized
atacaaaaattagccgggcg

SEQ ID NO: 405868 - DNA, 20 bp, Artificial Sequence
  chemically synthesized
caaaaattagccgggcgtgg

SEQ ID NO: 405869 - DNA, 20 bp, Artificial Sequence
  chemically synthesized
caggcatgcaccaccacgcc

SEQ ID NO: 405870 - DNA, 20 bp, Artificial Sequence
  chemically synthesized
gtggtgcatgcctgtaatcc

SEQ ID NO: 405871 - DNA, 20 bp, Artificial Sequence
  chemically synthesized
tccctagtagctgggattac

SEQ ID NO: 405872 - DNA, 20 bp, Artificial Sequence
  chemically synthesized
ctccctagtagctgggatta

SEQ ID NO: 405873 - DNA, 20 bp, Artificial Sequence
  chemically synthesized
atgcctgtaatcccagctac

SEQ ID NO: 405874 - DNA, 20 bp, Artificial Sequence
  chemically synthesized
tgcctgtaatcccagctact

SEQ ID NO: 405875 - DNA, 20 bp, Artificial Sequence
  chemically synthesized
cctaagcctccctagtagct

SEQ ID NO: 405876 - DNA, 20 bp, Artificial Sequence
  chemically synthesized
gcctgtaatcccagctacta

SEQ ID NO: 405877 - DNA, 20 bp, Artificial Sequence
  chemically synthesized
gcctaagcctccctagtagc

SEQ ID NO: 405878 - DNA, 20 bp, Artificial Sequence
  chemically synthesized
ctgtaatcccagctactagg

SEQ ID NO: 405879 - DNA, 20 bp, Artificial Sequence
  chemically synthesized
tgtaatcccagctactaggg

SEQ ID NO: 405880 - DNA, 20 bp, Artificial Sequence
  chemically synthesized
tcctgcctaagcctccctag

SEQ ID NO: 405881 - DNA, 20 bp, Artificial Sequence
  chemically synthesized
ttctcctgcctaagcctccc

SEQ ID NO: 405882 - DNA, 20 bp, Artificial Sequence
  chemically synthesized
tcccagctactagggaggct

SEQ ID NO: 405883 - DNA, 20 bp, Artificial Sequence
  chemically synthesized
cccagctactagggaggctt

SEQ ID NO: 405884 - DNA, 20 bp, Artificial Sequence
  chemically synthesized
agctactagggaggcttagg

SEQ ID NO: 405885 - DNA, 20 bp, Artificial Sequence
  chemically synthesized
gctactagggaggcttaggc

SEQ ID NO: 405886 - DNA, 20 bp, Artificial Sequence
  chemically synthesized
tactagggaggcttaggcag

SEQ ID NO: 405887 - DNA, 20 bp, Artificial Sequence
  chemically synthesized
ttcaagtgattctcctgcct

SEQ ID NO: 405888 - DNA, 20 bp, Artificial Sequence
  chemically synthesized
gcaggagaatcacttgaacc

SEQ ID NO: 405889 - DNA, 20 bp, Artificial Sequence
  chemically synthesized
caggagaatcacttgaaccc

SEQ ID NO: 405890 - DNA, 20 bp, Artificial Sequence
  chemically synthesized
aacctcctcctcccgggttc

SEQ ID NO: 405891 - DNA, 20 bp, Artificial Sequence
  chemically synthesized
ggagaatcacttgaacccgg

SEQ ID NO: 405892 - DNA, 20 bp, Artificial Sequence
  chemically synthesized
gagaatcacttgaacccggg

SEQ ID NO: 405893 - DNA, 20 bp, Artificial Sequence
  chemically synthesized
gaatcacttgaacccgggag

SEQ ID NO: 405894 - DNA, 20 bp, Artificial Sequence
  chemically synthesized
aatcacttgaacccgggagg

SEQ ID NO: 405895 - DNA, 20 bp, Artificial Sequence
  chemically synthesized
cactgcaacctcctcctccc

SEQ ID NO: 405896 - DNA, 20 bp, Artificial Sequence
  chemically synthesized
tcacttgaacccgggaggag

SEQ ID NO: 405897 - DNA, 20 bp, Artificial Sequence
  chemically synthesized
tcactgcaacctcctcctcc

SEQ ID NO: 405898 - DNA, 20 bp, Artificial Sequence
  chemically synthesized
cacttgaacccgggaggagg

SEQ ID NO: 405899 - DNA, 20 bp, Artificial Sequence
  chemically synthesized
aacccgggaggaggaggttg

SEQ ID NO: 405900 - DNA, 20 bp, Artificial Sequence
  chemically synthesized
cgggaggaggaggttgcagt

SEQ ID NO: 405901 - DNA, 20 bp, Artificial Sequence
  chemically synthesized
ggaggaggttgcagtgagct

SEQ ID NO: 405902 - DNA, 20 bp, Artificial Sequence
  chemically synthesized
ggagtacagtggtgcgatct

SEQ ID NO: 405903 - DNA, 20 bp, Artificial Sequence
  chemically synthesized
tcacccaggctggagtacag

SEQ ID NO: 405904 - DNA, 20 bp, Artificial Sequence
  chemically synthesized
gagatcgcaccactgtactc

SEQ ID NO: 405905 - DNA, 20 bp, Artificial Sequence
  chemically synthesized
ctgtcacccaggctggagta

SEQ ID NO: 405906 - DNA, 20 bp, Artificial Sequence
  chemically synthesized
cgcaccactgtactccagcc

SEQ ID NO: 405907 - DNA, 20 bp, Artificial Sequence
  chemically synthesized
gcaccactgtactccagcct

SEQ ID NO: 405908 - DNA, 20 bp, Artificial Sequence
  chemically synthesized
ttgctctgtcacccaggctg

SEQ ID NO: 405909 - DNA, 20 bp, Artificial Sequence
  chemically synthesized
tcttgctctgtcacccaggc

SEQ ID NO: 405910 - DNA, 20 bp, Artificial Sequence
  chemically synthesized
ctgtactccagcctgggtga

SEQ ID NO: 405911 - DNA, 20 bp, Artificial Sequence
  chemically synthesized
tgactcttgctctgtcaccc

SEQ ID NO: 405912 - DNA, 20 bp, Artificial Sequence
  chemically synthesized
gtactccagcctgggtgaca

SEQ ID NO: 405913 - DNA, 20 bp, Artificial Sequence
  chemically synthesized
ctgactcttgctctgtcacc

SEQ ID NO: 405914 - DNA, 20 bp, Artificial Sequence
  chemically synthesized
tccagcctgggtgacagagc

SEQ ID NO: 405915 - DNA, 20 bp, Artificial Sequence
  chemically synthesized
cagcctgggtgacagagcaa

SEQ ID NO: 405916 - DNA, 20 bp, Artificial Sequence
  chemically synthesized
ctgggtgacagagcaagagt

SEQ ID NO: 405917 - DNA, 20 bp, Artificial Sequence
  chemically synthesized
gagcaagagtcagtctcaaa

SEQ ID NO: 405918 - DNA, 20 bp, Artificial Sequence
  chemically synthesized
aagagtcagtctcaaaaaga

SEQ ID NO: 405919 - DNA, 20 bp, Artificial Sequence
  chemically synthesized
tccctccttgctttcttttt

SEQ ID NO: 405920 - DNA, 20 bp, Artificial Sequence
  chemically synthesized
gtcagtctcaaaaagaaagc

SEQ ID NO: 405921 - DNA, 20 bp, Artificial Sequence
  chemically synthesized
tcagtctcaaaaagaaagca

SEQ ID NO: 405922 - DNA, 20 bp, Artificial Sequence
  chemically synthesized
agtctcaaaaagaaagcaag

SEQ ID NO: 405923 - DNA, 20 bp, Artificial Sequence
  chemically synthesized
gtctcaaaaagaaagcaagg

SEQ ID NO: 405924 - DNA, 20 bp, Artificial Sequence
  chemically synthesized
tctcaaaaagaaagcaagga

SEQ ID NO: 405925 - DNA, 20 bp, Artificial Sequence
  chemically synthesized
aaaagaaagcaaggagggaa

SEQ ID NO: 405926 - DNA, 20 bp, Artificial Sequence
  chemically synthesized
aaagaaagcaaggagggaat

SEQ ID NO: 405927 - DNA, 20 bp, Artificial Sequence
  chemically synthesized
gggaatgggacaattcataa

SEQ ID NO: 405928 - DNA, 20 bp, Artificial Sequence
  chemically synthesized
atgggacaattcataaaagc

SEQ ID NO: 405929 - DNA, 20 bp, Artificial Sequence
  chemically synthesized
caattcataaaagcaagccc

SEQ ID NO: 405930 - DNA, 20 bp, Artificial Sequence
  chemically synthesized
ttcataaaagcaagccccag

SEQ ID NO: 405931 - DNA, 20 bp, Artificial Sequence
  chemically synthesized
acagttaactagaactgctg

SEQ ID NO: 405932 - DNA, 20 bp, Artificial Sequence
  chemically synthesized
cacagttaactagaactgct

SEQ ID NO: 405933 - DNA, 20 bp, Artificial Sequence
  chemically synthesized
aaagcaagccccagcagttc

SEQ ID NO: 405934 - DNA, 20 bp, Artificial Sequence
  chemically synthesized
tcacagttaactagaactgc

SEQ ID NO: 405935 - DNA, 20 bp, Artificial Sequence
  chemically synthesized
tggttcagttcacagttaac

SEQ ID NO: 405936 - DNA, 20 bp, Artificial Sequence
  chemically synthesized
catcttactggttcagttca

SEQ ID NO: 405937 - DNA, 20 bp, Artificial Sequence
  chemically synthesized
tagttaactgtgaactgaac

SEQ ID NO: 405938 - DNA, 20 bp, Artificial Sequence
  chemically synthesized
taactgtgaactgaaccagt

SEQ ID NO: 405939 - DNA, 20 bp, Artificial Sequence
  chemically synthesized
caatgtgcatcttactggtt

SEQ ID NO: 405940 - DNA, 20 bp, Artificial Sequence
  chemically synthesized
taaatcaatgtgcatcttac

SEQ ID NO: 405941 - DNA, 20 bp, Artificial Sequence
  chemically synthesized
gatgcacattgatttaactt

SEQ ID NO: 405942 - DNA, 20 bp, Artificial Sequence
  chemically synthesized
cagcacataaattatttccg

SEQ ID NO: 405943 - DNA, 20 bp, Artificial Sequence
  chemically synthesized
ttcggaaataatttatgtgc

SEQ ID NO: 405944 - DNA, 20 bp, Artificial Sequence
  chemically synthesized
gtagcagtcatttaagaaac

SEQ ID NO: 405945 - DNA, 20 bp, Artificial Sequence
  chemically synthesized
gcaatatgtagcagtcattt

SEQ ID NO: 405946 - DNA, 20 bp, Artificial Sequence
  chemically synthesized
ggtaagaaggcaatatgtag

SEQ ID NO: 405947 - DNA, 20 bp, Artificial Sequence
  chemically synthesized
tcaggtaagaaggcaatatg

SEQ ID NO: 405948 - DNA, 20 bp, Artificial Sequence
  chemically synthesized
cactccatcgtcaggtaaga

SEQ ID NO: 405949 - DNA, 20 bp, Artificial Sequence
  chemically synthesized
gcactccatcgtcaggtaag

SEQ ID NO: 405950 - DNA, 20 bp, Artificial Sequence
  chemically synthesized
tctgcactccatcgtcaggt

SEQ ID NO: 405951 - DNA, 20 bp, Artificial Sequence
  chemically synthesized
attgccttcttacctgacga

SEQ ID NO: 405952 - DNA, 20 bp, Artificial Sequence
  chemically synthesized
tgccttcttacctgacgatg

SEQ ID NO: 405953 - DNA, 20 bp, Artificial Sequence
  chemically synthesized
atattctgcactccatcgtc

SEQ ID NO: 405954 - DNA, 20 bp, Artificial Sequence
  chemically synthesized
catattctgcactccatcgt

SEQ ID NO: 405955 - DNA, 20 bp, Artificial Sequence
  chemically synthesized
tcttacctgacgatggagtg

SEQ ID NO: 405956 - DNA, 20 bp, Artificial Sequence
  chemically synthesized
tgacgatggagtgcagaata

SEQ ID NO: 405957 - DNA, 20 bp, Artificial Sequence
  chemically synthesized
gacgatggagtgcagaatat

SEQ ID NO: 405958 - DNA, 20 bp, Artificial Sequence
  chemically synthesized
acgatggagtgcagaatatg

SEQ ID NO: 405959 - DNA, 20 bp, Artificial Sequence
  chemically synthesized
cagaatatggggacaaaaat

SEQ ID NO: 405960 - DNA, 20 bp, Artificial Sequence
  chemically synthesized
gaatatggggacaaaaataa

SEQ ID NO: 405961 - DNA, 20 bp, Artificial Sequence
  chemically synthesized
acaaaaataagagcaattcc

SEQ ID NO: 405962 - DNA, 20 bp, Artificial Sequence
  chemically synthesized
caaaaataagagcaattcca

SEQ ID NO: 405963 - DNA, 20 bp, Artificial Sequence
  chemically synthesized
tcgggcataaagcatttcct

SEQ ID NO: 405964 - DNA, 20 bp, Artificial Sequence
  chemically synthesized
caaggaaatgctttatgccc

SEQ ID NO: 405965 - DNA, 20 bp, Artificial Sequence
  chemically synthesized
tgaattagcactcgggcata

SEQ ID NO: 405966 - DNA, 20 bp, Artificial Sequence
  chemically synthesized
atggttctgaattagcactc

SEQ ID NO: 405967 - DNA, 20 bp, Artificial Sequence
  chemically synthesized
tatggttctgaattagcact

SEQ ID NO: 405968 - DNA, 20 bp, Artificial Sequence
  chemically synthesized
tttatgcccgagtgctaatt

SEQ ID NO: 405969 - DNA, 20 bp, Artificial Sequence
  chemically synthesized
ttttcagtatggttctgaat

SEQ ID NO: 405970 - DNA, 20 bp, Artificial Sequence
  chemically synthesized
ttgcatctcctttttcagta

SEQ ID NO: 405971 - DNA, 20 bp, Artificial Sequence
  chemically synthesized
aattcagaaccatactgaaa

SEQ ID NO: 405972 - DNA, 20 bp, Artificial Sequence
  chemically synthesized
attcagaaccatactgaaaa

SEQ ID NO: 405973 - DNA, 20 bp, Artificial Sequence
  chemically synthesized
tcagaaccatactgaaaaag

SEQ ID NO: 405974 - DNA, 20 bp, Artificial Sequence
  chemically synthesized
ttctcttgcatctccttttt

SEQ ID NO: 405975 - DNA, 20 bp, Artificial Sequence
  chemically synthesized
catactgaaaaaggagatgc

SEQ ID NO: 405976 - DNA, 20 bp, Artificial Sequence
  chemically synthesized
tactgaaaaaggagatgcaa

SEQ ID NO: 405977 - DNA, 20 bp, Artificial Sequence
  chemically synthesized
aggagatgcaagagaatgct

SEQ ID NO: 405978 - DNA, 20 bp, Artificial Sequence
  chemically synthesized
atgcaagagaatgctcagcg

SEQ ID NO: 405979 - DNA, 20 bp, Artificial Sequence
  chemically synthesized
gatggcctagaatctacgct

SEQ ID NO: 405980 - DNA, 20 bp, Artificial Sequence
  chemically synthesized
agaatgctcagcgtagattc

SEQ ID NO: 405981 - DNA, 20 bp, Artificial Sequence
  chemically synthesized
gaatgctcagcgtagattct

SEQ ID NO: 405982 - DNA, 20 bp, Artificial Sequence
  chemically synthesized
tggattgtttaaggatggcc

SEQ ID NO: 405983 - DNA, 20 bp, Artificial Sequence
  chemically synthesized
agctctggattgtttaagga

SEQ ID NO: 405984 - DNA, 20 bp, Artificial Sequence
  chemically synthesized
cttcagctctggattgttta

SEQ ID NO: 405985 - DNA, 20 bp, Artificial Sequence
  chemically synthesized
tcttcagctctggattgttt

SEQ ID NO: 405986 - DNA, 20 bp, Artificial Sequence
  chemically synthesized
taggccatccttaaacaatc

SEQ ID NO: 405987 - DNA, 20 bp, Artificial Sequence
  chemically synthesized
ggccatccttaaacaatcca

SEQ ID NO: 405988 - DNA, 20 bp, Artificial Sequence
  chemically synthesized
ccttaaacaatccagagctg

SEQ ID NO: 405989 - DNA, 20 bp, Artificial Sequence
  chemically synthesized
tgaatacggctcttcagctc

SEQ ID NO: 405990 - DNA, 20 bp, Artificial Sequence
  chemically synthesized
ttaaacaatccagagctgaa

SEQ ID NO: 405991 - DNA, 20 bp, Artificial Sequence
  chemically synthesized
tatctctgaatacggctctt

SEQ ID NO: 405992 - DNA, 20 bp, Artificial Sequence
  chemically synthesized
cagagctgaagagccgtatt

SEQ ID NO: 405993 - DNA, 20 bp, Artificial Sequence
  chemically synthesized
gagctgaagagccgtattca

SEQ ID NO: 405994 - DNA, 20 bp, Artificial Sequence
  chemically synthesized
aataaatttatctctgaata

SEQ ID NO: 405995 - DNA, 20 bp, Artificial Sequence
  chemically synthesized
aggtcaagaaacattgaacg

SEQ ID NO: 405996 - DNA, 20 bp, Artificial Sequence
  chemically synthesized
ttccttacgagaagtaggtc

SEQ ID NO: 405997 - DNA, 20 bp, Artificial Sequence
  chemically synthesized
gaattttccttacgagaagt

SEQ ID NO: 405998 - DNA, 20 bp, Artificial Sequence
  chemically synthesized
agaattttccttacgagaag

SEQ ID NO: 405999 - DNA, 20 bp, Artificial Sequence
  chemically synthesized
tttcttgacctacttctcgt

SEQ ID NO: 406000 - DNA, 20 bp, Artificial Sequence
  chemically synthesized
ttcttgacctacttctcgta

SEQ ID NO: 406001 - DNA, 20 bp, Artificial Sequence
  chemically synthesized
ggcagaattttccttacgag

SEQ ID NO: 406002 - DNA, 20 bp, Artificial Sequence
  chemically synthesized
tcaggcagaattttccttac

SEQ ID NO: 406003 - DNA, 20 bp, Artificial Sequence
  chemically synthesized
aattccttctggtattcagg

SEQ ID NO: 406004 - DNA, 20 bp, Artificial Sequence
  chemically synthesized
ggaaaattctgcctgaatac

SEQ ID NO: 406005 - DNA, 20 bp, Artificial Sequence
  chemically synthesized
atgaattccttctggtattc

SEQ ID NO: 406006 - DNA, 20 bp, Artificial Sequence
  chemically synthesized
aatgaattccttctggtatt

SEQ ID NO: 406007 - DNA, 20 bp, Artificial Sequence
  chemically synthesized
aaattctgcctgaataccag

SEQ ID NO: 406008 - DNA, 20 bp, Artificial Sequence
  chemically synthesized
aattctgcctgaataccaga

SEQ ID NO: 406009 - DNA, 20 bp, Artificial Sequence
  chemically synthesized
agtgaaaaatgaattccttc

SEQ ID NO: 406010 - DNA, 20 bp, Artificial Sequence
  chemically synthesized
aaggaattcatttttcactt

SEQ ID NO: 406011 - DNA, 20 bp, Artificial Sequence
  chemically synthesized
ttaaggtaaatttcaagcta

SEQ ID NO: 406012 - DNA, 20 bp, Artificial Sequence
  chemically synthesized
tttatcttaaggtaaatttc

SEQ ID NO: 406013 - DNA, 20 bp, Artificial Sequence
  chemically synthesized
tttagcttgaaatttacctt

SEQ ID NO: 406014 - DNA, 20 bp, Artificial Sequence
  chemically synthesized
aactattgtgttttatctta

SEQ ID NO: 406015 - DNA, 20 bp, Artificial Sequence
  chemically synthesized
caactattgtgttttatctt

SEQ ID NO: 406016 - DNA, 20 bp, Artificial Sequence
  chemically synthesized
taccttaagataaaacacaa

SEQ ID NO: 406017 - DNA, 20 bp, Artificial Sequence
  chemically synthesized
gtataaaaatatgccttatt

SEQ ID NO: 406018 - DNA, 20 bp, Artificial Sequence
  chemically synthesized
tttatatgcataaccaaata

SEQ ID NO: 406019 - DNA, 20 bp, Artificial Sequence
  chemically synthesized
ctttatatgcataaccaaat

SEQ ID NO: 406020 - DNA, 20 bp, Artificial Sequence
  chemically synthesized
cttatttggttatgcatata

SEQ ID NO: 406021 - DNA, 20 bp, Artificial Sequence
  chemically synthesized
atttggttatgcatataaag

SEQ ID NO: 406022 - DNA, 20 bp, Artificial Sequence
  chemically synthesized
tatgcatataaagcagaccc

SEQ ID NO: 406023 - DNA, 20 bp, Artificial Sequence
  chemically synthesized
tgcatataaagcagacccaa

SEQ ID NO: 406024 - DNA, 20 bp, Artificial Sequence
  chemically synthesized
gcatataaagcagacccaag

SEQ ID NO: 406025 - DNA, 20 bp, Artificial Sequence
  chemically synthesized
attttaccccaaatcctctt

SEQ ID NO: 406026 - DNA, 20 bp, Artificial Sequence
  chemically synthesized
tattttaccccaaatcctct

SEQ ID NO: 406027 - DNA, 20 bp, Artificial Sequence
  chemically synthesized
aaagcagacccaagaggatt

SEQ ID NO: 406028 - DNA, 20 bp, Artificial Sequence
  chemically synthesized
aagcagacccaagaggattt

SEQ ID NO: 406029 - DNA, 20 bp, Artificial Sequence
  chemically synthesized
agcagacccaagaggatttg

SEQ ID NO: 406030 - DNA, 20 bp, Artificial Sequence
  chemically synthesized
tttggggtaaaatatttcat

SEQ ID NO: 406031 - DNA, 20 bp, Artificial Sequence
  chemically synthesized
tcattttttatattcatgca

SEQ ID NO: 406032 - DNA, 20 bp, Artificial Sequence
  chemically synthesized
tatgcatgaatataaaaaat

SEQ ID NO: 406033 - DNA, 20 bp, Artificial Sequence
  chemically synthesized
atataaaaaatgagaaacaa

SEQ ID NO: 406034 - DNA, 20 bp, Artificial Sequence
  chemically synthesized
tataaaaaatgagaaacaaa

SEQ ID NO: 406035 - DNA, 20 bp, Artificial Sequence
  chemically synthesized
aaaaatgagaaacaaaagga

SEQ ID NO: 406036 - DNA, 20 bp, Artificial Sequence
  chemically synthesized
atgagaaacaaaaggatagt

SEQ ID NO: 406037 - DNA, 20 bp, Artificial Sequence
  chemically synthesized
aacaaaaggatagttagtaa

SEQ ID NO: 406038 - DNA, 20 bp, Artificial Sequence
  chemically synthesized
acaaaaggatagttagtaaa

SEQ ID NO: 406039 - DNA, 20 bp, Artificial Sequence
  chemically synthesized
atagttagtaaaaggctgtt

SEQ ID NO: 406040 - DNA, 20 bp, Artificial Sequence
  chemically synthesized
ctcctttatttgggactgaa

SEQ ID NO: 406041 - DNA, 20 bp, Artificial Sequence
  chemically synthesized
aggctgttcagtcccaaata

SEQ ID NO: 406042 - DNA, 20 bp, Artificial Sequence
  chemically synthesized
ggctgttcagtcccaaataa

SEQ ID NO: 406043 - DNA, 20 bp, Artificial Sequence
  chemically synthesized
caacaattactcctttattt

SEQ ID NO: 406044 - DNA, 20 bp, Artificial Sequence
  chemically synthesized
ctgttcagtcccaaataaag

SEQ ID NO: 406045 - DNA, 20 bp, Artificial Sequence
  chemically synthesized
tcaacaattactcctttatt

SEQ ID NO: 406046 - DNA, 20 bp, Artificial Sequence
  chemically synthesized
attgttgatatgctaaataa

SEQ ID NO: 406047 - DNA, 20 bp, Artificial Sequence
  chemically synthesized
ttgttgatatgctaaataaa

SEQ ID NO: 406048 - DNA, 20 bp, Artificial Sequence
  chemically synthesized
tgttgatatgctaaataaaa

SEQ ID NO: 406049 - DNA, 20 bp, Artificial Sequence
  chemically synthesized
ttccccaccccccttttatt

SEQ ID NO: 406050 - DNA, 20 bp, Artificial Sequence
  chemically synthesized
gttgatatgctaaataaaag

SEQ ID NO: 406051 - DNA, 20 bp, Artificial Sequence
  chemically synthesized
ttgatatgctaaataaaagg

SEQ ID NO: 406052 - DNA, 20 bp, Artificial Sequence
  chemically synthesized
tgatatgctaaataaaaggg

SEQ ID NO: 406053 - DNA, 20 bp, Artificial Sequence
  chemically synthesized
tatgctaaataaaagggggg

SEQ ID NO: 406054 - DNA, 20 bp, Artificial Sequence
  chemically synthesized
atgctaaataaaaggggggt

SEQ ID NO: 406055 - DNA, 20 bp, Artificial Sequence
  chemically synthesized
tgctaaataaaaggggggtg

SEQ ID NO: 406056 - DNA, 20 bp, Artificial Sequence
  chemically synthesized
aaataaaaggggggtgggga

SEQ ID NO: 406057 - DNA, 20 bp, Artificial Sequence
  chemically synthesized
tcacattcccttgtaaaaaa

SEQ ID NO: 406058 - DNA, 20 bp, Artificial Sequence
  chemically synthesized
ggggaaagtcctttttttac

SEQ ID NO: 406059 - DNA, 20 bp, Artificial Sequence
  chemically synthesized
ctcacattcccttgtaaaaa

SEQ ID NO: 406060 - DNA, 20 bp, Artificial Sequence
  chemically synthesized
gggaaagtcctttttttaca

SEQ ID NO: 406061 - DNA, 20 bp, Artificial Sequence
  chemically synthesized
ggaaagtcctttttttacaa

SEQ ID NO: 406062 - DNA, 20 bp, Artificial Sequence
  chemically synthesized
ctttttttacaagggaatgt

SEQ ID NO: 406063 - DNA, 20 bp, Artificial Sequence
  chemically synthesized
tttttttacaagggaatgtg

SEQ ID NO: 406064 - DNA, 20 bp, Artificial Sequence
  chemically synthesized
ttttacaagggaatgtgagg

SEQ ID NO: 406065 - DNA, 20 bp, Artificial Sequence
  chemically synthesized
tttacaagggaatgtgagga

SEQ ID NO: 406066 - DNA, 20 bp, Artificial Sequence
  chemically synthesized
ttacaagggaatgtgaggaa

SEQ ID NO: 406067 - DNA, 20 bp, Artificial Sequence
  chemically synthesized
aatacagcctcaacaaatgt

SEQ ID NO: 406068 - DNA, 20 bp, Artificial Sequence
  chemically synthesized
gaagggaactcacatttgtt

SEQ ID NO: 406069 - DNA, 20 bp, Artificial Sequence
  chemically synthesized
aagggaactcacatttgttg

SEQ ID NO: 406070 - DNA, 20 bp, Artificial Sequence
  chemically synthesized
tgaggattaaatgcaaaata

SEQ ID NO: 406071 - DNA, 20 bp, Artificial Sequence
  chemically synthesized
ttgcatttaatcctcacaac

SEQ ID NO: 406072 - DNA, 20 bp, Artificial Sequence
  chemically synthesized
tgcatttaatcctcacaact

SEQ ID NO: 406073 - DNA, 20 bp, Artificial Sequence
  chemically synthesized
ttgttctcagcctagttgtg

SEQ ID NO: 406074 - DNA, 20 bp, Artificial Sequence
  chemically synthesized
tttgttctcagcctagttgt

SEQ ID NO: 406075 - DNA, 20 bp, Artificial Sequence
  chemically synthesized
ttaatcctcacaactaggct

SEQ ID NO: 406076 - DNA, 20 bp, Artificial Sequence
  chemically synthesized
cctaatgtttgttctcagcc

SEQ ID NO: 406077 - DNA, 20 bp, Artificial Sequence
  chemically synthesized
aaatgcctaatgtttgttct

SEQ ID NO: 406078 - DNA, 20 bp, Artificial Sequence
  chemically synthesized
actaggctgagaacaaacat

SEQ ID NO: 406079 - DNA, 20 bp, Artificial Sequence
  chemically synthesized
ctaggctgagaacaaacatt

SEQ ID NO: 406080 - DNA, 20 bp, Artificial Sequence
  chemically synthesized
ggcattttatttcccattta

SEQ ID NO: 406081 - DNA, 20 bp, Artificial Sequence
  chemically synthesized
caggtttacaatctgtaaat

SEQ ID NO: 406082 - DNA, 20 bp, Artificial Sequence
  chemically synthesized
tcaggtttacaatctgtaaa

SEQ ID NO: 406083 - DNA, 20 bp, Artificial Sequence
  chemically synthesized
catttacagattgtaaacct

SEQ ID NO: 406084 - DNA, 20 bp, Artificial Sequence
  chemically synthesized
atttacagattgtaaacctg

SEQ ID NO: 406085 - DNA, 20 bp, Artificial Sequence
  chemically synthesized
agattgtaaacctgaggcaa

SEQ ID NO: 406086 - DNA, 20 bp, Artificial Sequence
  chemically synthesized
gcaactaatcctattgcctc

SEQ ID NO: 406087 - DNA, 20 bp, Artificial Sequence
  chemically synthesized
gattgtaaacctgaggcaat

SEQ ID NO: 406088 - DNA, 20 bp, Artificial Sequence
  chemically synthesized
ggcaactaatcctattgcct

SEQ ID NO: 406089 - DNA, 20 bp, Artificial Sequence
  chemically synthesized
taaacctgaggcaataggat

SEQ ID NO: 406090 - DNA, 20 bp, Artificial Sequence
  chemically synthesized
aacatgtgaattgttatcac

SEQ ID NO: 406091 - DNA, 20 bp, Artificial Sequence
  chemically synthesized
caacatgtgaattgttatca

SEQ ID NO: 406092 - DNA, 20 bp, Artificial Sequence
  chemically synthesized
gtgataacaattcacatgtt

SEQ ID NO: 406093 - DNA, 20 bp, Artificial Sequence
  chemically synthesized
tgttgagaatcataatatta

SEQ ID NO: 406094 - DNA, 20 bp, Artificial Sequence
  chemically synthesized
gttgagaatcataatattat

SEQ ID NO: 406095 - DNA, 20 bp, Artificial Sequence
  chemically synthesized
atggcattgttaggtggtgg

SEQ ID NO: 406096 - DNA, 20 bp, Artificial Sequence
  chemically synthesized
gatggcattgttaggtggtg

SEQ ID NO: 406097 - DNA, 20 bp, Artificial Sequence
  chemically synthesized
aagatggcattgttaggtgg

SEQ ID NO: 406098 - DNA, 20 bp, Artificial Sequence
  chemically synthesized
ctgaagatggcattgttagg

SEQ ID NO: 406099 - DNA, 20 bp, Artificial Sequence
  chemically synthesized
gttctgaagatggcattgtt

SEQ ID NO: 406100 - DNA, 20 bp, Artificial Sequence
  chemically synthesized
agttctgaagatggcattgt

SEQ ID NO: 406101 - DNA, 20 bp, Artificial Sequence
  chemically synthesized
ccacctaacaatgccatctt

SEQ ID NO: 406102 - DNA, 20 bp, Artificial Sequence
  chemically synthesized
tgtgtgtgtagttctgaaga

SEQ ID NO: 406103 - DNA, 20 bp, Artificial Sequence
  chemically synthesized
cctgtgtgtgtgtagttctg

SEQ ID NO: 406104 - DNA, 20 bp, Artificial Sequence
  chemically synthesized
tgtacgcacctgtgtgtgtg

SEQ ID NO: 406105 - DNA, 20 bp, Artificial Sequence
  chemically synthesized
tcttcagaactacacacaca

SEQ ID NO: 406106 - DNA, 20 bp, Artificial Sequence
  chemically synthesized
cttcagaactacacacacac

SEQ ID NO: 406107 - DNA, 20 bp, Artificial Sequence
  chemically synthesized
acacacacacacacacacac

SEQ ID NO: 406108 - DNA, 20 bp, Artificial Sequence
  chemically synthesized
cacacacacaagtatttcgt

SEQ ID NO: 406109 - DNA, 20 bp, Artificial Sequence
  chemically synthesized
gagattgtaaccacattctt

SEQ ID NO: 406110 - DNA, 20 bp, Artificial Sequence
  chemically synthesized
aaggatggaacttaagaatg

SEQ ID NO: 406111 - DNA, 20 bp, Artificial Sequence
  chemically synthesized
acttgcaaaggatggaactt

SEQ ID NO: 406112 - DNA, 20 bp, Artificial Sequence
  chemically synthesized
cttaccttacttgcaaagga

SEQ ID NO: 406113 - DNA, 20 bp, Artificial Sequence
  chemically synthesized
tcttaagttccatcctttgc

SEQ ID NO: 406114 - DNA, 20 bp, Artificial Sequence
  chemically synthesized
ctaacttaccttacttgcaa

SEQ ID NO: 406115 - DNA, 20 bp, Artificial Sequence
  chemically synthesized
aagttccatcctttgcaagt

SEQ ID NO: 406116 - DNA, 20 bp, Artificial Sequence
  chemically synthesized
cctaacttaccttacttgca

SEQ ID NO: 406117 - DNA, 20 bp, Artificial Sequence
  chemically synthesized
agttccatcctttgcaagta

SEQ ID NO: 406118 - DNA, 20 bp, Artificial Sequence
  chemically synthesized
ccatcctttgcaagtaaggt

SEQ ID NO: 406119 - DNA, 20 bp, Artificial Sequence
  chemically synthesized
cctttgcaagtaaggtaagt

SEQ ID NO: 406120 - DNA, 20 bp, Artificial Sequence
  chemically synthesized
ctttgcaagtaaggtaagtt

SEQ ID NO: 406121 - DNA, 20 bp, Artificial Sequence
  chemically synthesized
accctaaggcagtgaggaaa

SEQ ID NO: 406122 - DNA, 20 bp, Artificial Sequence
  chemically synthesized
taaacaaccctaaggcagtg

SEQ ID NO: 406123 - DNA, 20 bp, Artificial Sequence
  chemically synthesized
gcactgtttcctcactgcct

SEQ ID NO: 406124 - DNA, 20 bp, Artificial Sequence
  chemically synthesized
ataaacaaccctaaggcagt

SEQ ID NO: 406125 - DNA, 20 bp, Artificial Sequence
  chemically synthesized
cactgtttcctcactgcctt

SEQ ID NO: 406126 - DNA, 20 bp, Artificial Sequence
  chemically synthesized
actgtttcctcactgcctta

SEQ ID NO: 406127 - DNA, 20 bp, Artificial Sequence
  chemically synthesized
atttataaacaaccctaagg

SEQ ID NO: 406128 - DNA, 20 bp, Artificial Sequence
  chemically synthesized
tgtatttataaacaacccta

SEQ ID NO: 406129 - DNA, 20 bp, Artificial Sequence
  chemically synthesized
ctgtatttataaacaaccct

SEQ ID NO: 406130 - DNA, 20 bp, Artificial Sequence
  chemically synthesized
cttagggttgtttataaata

SEQ ID NO: 406131 - DNA, 20 bp, Artificial Sequence
  chemically synthesized
tagggttgtttataaataca

SEQ ID NO: 406132 - DNA, 20 bp, Artificial Sequence
  chemically synthesized
gagttgattttgtaattcaa

SEQ ID NO: 406133 - DNA, 20 bp, Artificial Sequence
  chemically synthesized
aagagttgattttgtaattc

SEQ ID NO: 406134 - DNA, 20 bp, Artificial Sequence
  chemically synthesized
acctctgtcagtgaaatcaa

SEQ ID NO: 406135 - DNA, 20 bp, Artificial Sequence
  chemically synthesized
tgacctctgtcagtgaaatc

SEQ ID NO: 406136 - DNA, 20 bp, Artificial Sequence
  chemically synthesized
tcaactcttgatttcactga

SEQ ID NO: 406137 - DNA, 20 bp, Artificial Sequence
  chemically synthesized
aactcttgatttcactgaca

SEQ ID NO: 406138 - DNA, 20 bp, Artificial Sequence
  chemically synthesized
actcttgatttcactgacag

SEQ ID NO: 406139 - DNA, 20 bp, Artificial Sequence
  chemically synthesized
taaaagcagttgacctctgt

SEQ ID NO: 406140 - DNA, 20 bp, Artificial Sequence
  chemically synthesized
tgacagaggtcaactgcttt

SEQ ID NO: 406141 - DNA, 20 bp, Artificial Sequence
  chemically synthesized
tggttcacttacactaaaag

SEQ ID NO: 406142 - DNA, 20 bp, Artificial Sequence
  chemically synthesized
aggtcaactgcttttagtgt

SEQ ID NO: 406143 - DNA, 20 bp, Artificial Sequence
  chemically synthesized
tcatggttcacttacactaa

SEQ ID NO: 406144 - DNA, 20 bp, Artificial Sequence
  chemically synthesized
gtgtaagtgaaccatgattc

SEQ ID NO: 406145 - DNA, 20 bp, Artificial Sequence
  chemically synthesized
atctgtttatgccagaatca

SEQ ID NO: 406146 - DNA, 20 bp, Artificial Sequence
  chemically synthesized
aaccatgattctggcataaa

SEQ ID NO: 406147 - DNA, 20 bp, Artificial Sequence
  chemically synthesized
tcttctatatctgtttatgc

SEQ ID NO: 406148 - DNA, 20 bp, Artificial Sequence
  chemically synthesized
gattctggcataaacagata

SEQ ID NO: 406149 - DNA, 20 bp, Artificial Sequence
  chemically synthesized
tctggcataaacagatatag

SEQ ID NO: 406150 - DNA, 20 bp, Artificial Sequence
  chemically synthesized
tatagaagaatcctgtttaa

SEQ ID NO: 406151 - DNA, 20 bp, Artificial Sequence
  chemically synthesized
gcaggtaaaaacttttaaac

SEQ ID NO: 406152 - DNA, 20 bp, Artificial Sequence
  chemically synthesized
agcaggtaaaaacttttaaa

SEQ ID NO: 406153 - DNA, 20 bp, Artificial Sequence
  chemically synthesized
ttaaaagtttttacctgctc

SEQ ID NO: 406154 - DNA, 20 bp, Artificial Sequence
  chemically synthesized
taaaagtttttacctgctct

SEQ ID NO: 406155 - DNA, 20 bp, Artificial Sequence
  chemically synthesized
tcttggtaggcacctagagc

SEQ ID NO: 406156 - DNA, 20 bp, Artificial Sequence
  chemically synthesized
ctcttggtaggcacctagag

SEQ ID NO: 406157 - DNA, 20 bp, Artificial Sequence
  chemically synthesized
cttctcttggtaggcaccta

SEQ ID NO: 406158 - DNA, 20 bp, Artificial Sequence
  chemically synthesized
ttcttctcttggtaggcacc

SEQ ID NO: 406159 - DNA, 20 bp, Artificial Sequence
  chemically synthesized
acctgctctaggtgcctacc

SEQ ID NO: 406160 - DNA, 20 bp, Artificial Sequence
  chemically synthesized
ctgctctaggtgcctaccaa

SEQ ID NO: 406161 - DNA, 20 bp, Artificial Sequence
  chemically synthesized
ccccctcttcttctcttggt

SEQ ID NO: 406162 - DNA, 20 bp, Artificial Sequence
  chemically synthesized
ctctaggtgcctaccaagag

SEQ ID NO: 406163 - DNA, 20 bp, Artificial Sequence
  chemically synthesized
tccccctcttcttctcttgg

SEQ ID NO: 406164 - DNA, 20 bp, Artificial Sequence
  chemically synthesized
taggtgcctaccaagagaag

SEQ ID NO: 406165 - DNA, 20 bp, Artificial Sequence
  chemically synthesized
acttccccctcttcttctct

SEQ ID NO: 406166 - DNA, 20 bp, Artificial Sequence
  chemically synthesized
ggtgcctaccaagagaagaa

SEQ ID NO: 406167 - DNA, 20 bp, Artificial Sequence
  chemically synthesized
gtgcctaccaagagaagaag

SEQ ID NO: 406168 - DNA, 20 bp, Artificial Sequence
  chemically synthesized
tgcctaccaagagaagaaga

SEQ ID NO: 406169 - DNA, 20 bp, Artificial Sequence
  chemically synthesized
gcctaccaagagaagaagag

SEQ ID NO: 406170 - DNA, 20 bp, Artificial Sequence
  chemically synthesized
cctaccaagagaagaagagg

SEQ ID NO: 406171 - DNA, 20 bp, Artificial Sequence
  chemically synthesized
accaagagaagaagaggggg

SEQ ID NO: 406172 - DNA, 20 bp, Artificial Sequence
  chemically synthesized
gagaagaagagggggaagtt

SEQ ID NO: 406173 - DNA, 20 bp, Artificial Sequence
  chemically synthesized
gaagaagagggggaagttga

SEQ ID NO: 406174 - DNA, 20 bp, Artificial Sequence
  chemically synthesized
agaagagggggaagttgaga

SEQ ID NO: 406175 - DNA, 20 bp, Artificial Sequence
  chemically synthesized
gggggaagttgagagagtta

SEQ ID NO: 406176 - DNA, 20 bp, Artificial Sequence
  chemically synthesized
aagttgagagagttacagat

SEQ ID NO: 406177 - DNA, 20 bp, Artificial Sequence
  chemically synthesized
tgagagagttacagataagt

SEQ ID NO: 406178 - DNA, 20 bp, Artificial Sequence
  chemically synthesized
agagagttacagataagtga

SEQ ID NO: 406179 - DNA, 20 bp, Artificial Sequence
  chemically synthesized
agttacagataagtgagagc

SEQ ID NO: 406180 - DNA, 20 bp, Artificial Sequence
  chemically synthesized
tacagataagtgagagctag

SEQ ID NO: 406181 - DNA, 20 bp, Artificial Sequence
  chemically synthesized
ccacacccccacacggcttc

SEQ ID NO: 406182 - DNA, 20 bp, Artificial Sequence
  chemically synthesized
agtgagagctagaagccgtg

SEQ ID NO: 406183 - DNA, 20 bp, Artificial Sequence
  chemically synthesized
gtgagagctagaagccgtgt

SEQ ID NO: 406184 - DNA, 20 bp, Artificial Sequence
  chemically synthesized
tgagagctagaagccgtgtg

SEQ ID NO: 406185 - DNA, 20 bp, Artificial Sequence
  chemically synthesized
gagagctagaagccgtgtgg

SEQ ID NO: 406186 - DNA, 20 bp, Artificial Sequence
  chemically synthesized
accctccccacacccccaca

SEQ ID NO: 406187 - DNA, 20 bp, Artificial Sequence
  chemically synthesized
ctagaagccgtgtgggggtg

SEQ ID NO: 406188 - DNA, 20 bp, Artificial Sequence
  chemically synthesized
tagaagccgtgtgggggtgt

SEQ ID NO: 406189 - DNA, 20 bp, Artificial Sequence
  chemically synthesized
agaagccgtgtgggggtgtg

SEQ ID NO: 406190 - DNA, 20 bp, Artificial Sequence
  chemically synthesized
aagccgtgtgggggtgtggg

SEQ ID NO: 406191 - DNA, 20 bp, Artificial Sequence
  chemically synthesized
agccgtgtgggggtgtgggg

SEQ ID NO: 406192 - DNA, 20 bp, Artificial Sequence
  chemically synthesized
gccgtgtgggggtgtgggga

SEQ ID NO: 406193 - DNA, 20 bp, Artificial Sequence
  chemically synthesized
tgtgtgtgtgtcagagggtc

SEQ ID NO: 406194 - DNA, 20 bp, Artificial Sequence
  chemically synthesized
gtgtgtgtgtgtcagagggt

SEQ ID NO: 406195 - DNA, 20 bp, Artificial Sequence
  chemically synthesized
gtgtgtgtgtgtgtgtcaga

SEQ ID NO: 406196 - DNA, 20 bp, Artificial Sequence
  chemically synthesized
ggtgtgtgtgtgtgtgtcag

SEQ ID NO: 406197 - DNA, 20 bp, Artificial Sequence
  chemically synthesized
aggtgtgtgtgtgtgtgtca

SEQ ID NO: 406198 - DNA, 20 bp, Artificial Sequence
  chemically synthesized
aaaggtgtgtgtgtgtgtgt

SEQ ID NO: 406199 - DNA, 20 bp, Artificial Sequence
  chemically synthesized
aatgttcctcttatttgaaa

SEQ ID NO: 406200 - DNA, 20 bp, Artificial Sequence
  chemically synthesized
acacacacaccttttcaaat

SEQ ID NO: 406201 - DNA, 20 bp, Artificial Sequence
  chemically synthesized
taatgttcctcttatttgaa

SEQ ID NO: 406202 - DNA, 20 bp, Artificial Sequence
  chemically synthesized
acacacaccttttcaaataa

SEQ ID NO: 406203 - DNA, 20 bp, Artificial Sequence
  chemically synthesized
cacacaccttttcaaataag

SEQ ID NO: 406204 - DNA, 20 bp, Artificial Sequence
  chemically synthesized
ggaacattataatgtcctct

SEQ ID NO: 406205 - DNA, 20 bp, Artificial Sequence
  chemically synthesized
gaacattataatgtcctctt

SEQ ID NO: 406206 - DNA, 20 bp, Artificial Sequence
  chemically synthesized
aacattataatgtcctctta

SEQ ID NO: 406207 - DNA, 20 bp, Artificial Sequence
  chemically synthesized
taggactttggttccctaag

SEQ ID NO: 406208 - DNA, 20 bp, Artificial Sequence
  chemically synthesized
ttaggactttggttccctaa

SEQ ID NO: 406209 - DNA, 20 bp, Artificial Sequence
  chemically synthesized
ctttaggactttggttccct

SEQ ID NO: 406210 - DNA, 20 bp, Artificial Sequence
  chemically synthesized
aatgtcctcttagggaacca

SEQ ID NO: 406211 - DNA, 20 bp, Artificial Sequence
  chemically synthesized
ccttctcttctttaggactt

SEQ ID NO: 406212 - DNA, 20 bp, Artificial Sequence
  chemically synthesized
cttagggaaccaaagtccta

SEQ ID NO: 406213 - DNA, 20 bp, Artificial Sequence
  chemically synthesized
agggaaccaaagtcctaaag

SEQ ID NO: 406214 - DNA, 20 bp, Artificial Sequence
  chemically synthesized
ggaaccaaagtcctaaagaa

SEQ ID NO: 406215 - DNA, 20 bp, Artificial Sequence
  chemically synthesized
agaacctccttctcttcttt

SEQ ID NO: 406216 - DNA, 20 bp, Artificial Sequence
  chemically synthesized
cagaacctccttctcttctt

SEQ ID NO: 406217 - DNA, 20 bp, Artificial Sequence
  chemically synthesized
accaaagtcctaaagaagag

SEQ ID NO: 406218 - DNA, 20 bp, Artificial Sequence
  chemically synthesized
ccaaagtcctaaagaagaga

SEQ ID NO: 406219 - DNA, 20 bp, Artificial Sequence
  chemically synthesized
aaagtcctaaagaagagaag

SEQ ID NO: 406220 - DNA, 20 bp, Artificial Sequence
  chemically synthesized
aagtcctaaagaagagaagg

SEQ ID NO: 406221 - DNA, 20 bp, Artificial Sequence
  chemically synthesized
taaagaagagaaggaggttc

SEQ ID NO: 406222 - DNA, 20 bp, Artificial Sequence
  chemically synthesized
aagaagagaaggaggttctg

SEQ ID NO: 406223 - DNA, 20 bp, Artificial Sequence
  chemically synthesized
gcactatttttcagcagctc

SEQ ID NO: 406224 - DNA, 20 bp, Artificial Sequence
  chemically synthesized
ggttgggcactatttttcag

SEQ ID NO: 406225 - DNA, 20 bp, Artificial Sequence
  chemically synthesized
gttctggagctgctgaaaaa

SEQ ID NO: 406226 - DNA, 20 bp, Artificial Sequence
  chemically synthesized
tctggttgggcactattttt

SEQ ID NO: 406227 - DNA, 20 bp, Artificial Sequence
  chemically synthesized
gctgaaaaatagtgcccaac

SEQ ID NO: 406228 - DNA, 20 bp, Artificial Sequence
  chemically synthesized
tgaaaaatagtgcccaacca

SEQ ID NO: 406229 - DNA, 20 bp, Artificial Sequence
  chemically synthesized
ccagtccctttgctctggtt

SEQ ID NO: 406230 - DNA, 20 bp, Artificial Sequence
  chemically synthesized
cccagtccctttgctctggt

SEQ ID NO: 406231 - DNA, 20 bp, Artificial Sequence
  chemically synthesized
aatagtgcccaaccagagca

SEQ ID NO: 406232 - DNA, 20 bp, Artificial Sequence
  chemically synthesized
atagtgcccaaccagagcaa

SEQ ID NO: 406233 - DNA, 20 bp, Artificial Sequence
  chemically synthesized
tagtgcccaaccagagcaaa

SEQ ID NO: 406234 - DNA, 20 bp, Artificial Sequence
  chemically synthesized
catgcccagtccctttgctc

SEQ ID NO: 406235 - DNA, 20 bp, Artificial Sequence
  chemically synthesized
cccaaccagagcaaagggac

SEQ ID NO: 406236 - DNA, 20 bp, Artificial Sequence
  chemically synthesized
ccaaccagagcaaagggact

SEQ ID NO: 406237 - DNA, 20 bp, Artificial Sequence
  chemically synthesized
gagcaaagggactgggcatg

SEQ ID NO: 406238 - DNA, 20 bp, Artificial Sequence
  chemically synthesized
gtgaggctaatctacatgcc

SEQ ID NO: 406239 - DNA, 20 bp, Artificial Sequence
  chemically synthesized
aagggactgggcatgtagat

SEQ ID NO: 406240 - DNA, 20 bp, Artificial Sequence
  chemically synthesized
gggcatgtagattagcctca

SEQ ID NO: 406241 - DNA, 20 bp, Artificial Sequence
  chemically synthesized
ggcatgtagattagcctcac

SEQ ID NO: 406242 - DNA, 20 bp, Artificial Sequence
  chemically synthesized
gcatgtagattagcctcaca

SEQ ID NO: 406243 - DNA, 20 bp, Artificial Sequence
  chemically synthesized
catgtagattagcctcacag

SEQ ID NO: 406244 - DNA, 20 bp, Artificial Sequence
  chemically synthesized
gagatgctcagacccctgtg

SEQ ID NO: 406245 - DNA, 20 bp, Artificial Sequence
  chemically synthesized
tgagatgctcagacccctgt

SEQ ID NO: 406246 - DNA, 20 bp, Artificial Sequence
  chemically synthesized
gattagcctcacaggggtct

SEQ ID NO: 406247 - DNA, 20 bp, Artificial Sequence
  chemically synthesized
cacaaacctgatgagatgct

SEQ ID NO: 406248 - DNA, 20 bp, Artificial Sequence
  chemically synthesized
caggggtctgagcatctcat

SEQ ID NO: 406249 - DNA, 20 bp, Artificial Sequence
  chemically synthesized
aggggtctgagcatctcatc

SEQ ID NO: 406250 - DNA, 20 bp, Artificial Sequence
  chemically synthesized
ctgcttatcacaaacctgat

SEQ ID NO: 406251 - DNA, 20 bp, Artificial Sequence
  chemically synthesized
catctcatcaggtttgtgat

SEQ ID NO: 406252 - DNA, 20 bp, Artificial Sequence
  chemically synthesized
ctcatcaggtttgtgataag

SEQ ID NO: 406253 - DNA, 20 bp, Artificial Sequence
  chemically synthesized
tctcaagcaccgacacatgt

SEQ ID NO: 406254 - DNA, 20 bp, Artificial Sequence
  chemically synthesized
gataagcagctaacatgtgt

SEQ ID NO: 406255 - DNA, 20 bp, Artificial Sequence
  chemically synthesized
gctaacatgtgtcggtgctt

SEQ ID NO: 406256 - DNA, 20 bp, Artificial Sequence
  chemically synthesized
aacatgtgtcggtgcttgag

SEQ ID NO: 406257 - DNA, 20 bp, Artificial Sequence
  chemically synthesized
acatgtgtcggtgcttgaga

SEQ ID NO: 406258 - DNA, 20 bp, Artificial Sequence
  chemically synthesized
ctaacttccatgaccttctc

SEQ ID NO: 406259 - DNA, 20 bp, Artificial Sequence
  chemically synthesized
gtcggtgcttgagaaggtca

SEQ ID NO: 406260 - DNA, 20 bp, Artificial Sequence
  chemically synthesized
ggtgcttgagaaggtcatgg

SEQ ID NO: 406261 - DNA, 20 bp, Artificial Sequence
  chemically synthesized
cttgagaaggtcatggaagt

SEQ ID NO: 406262 - DNA, 20 bp, Artificial Sequence
  chemically synthesized
ttgagaaggtcatggaagtt

SEQ ID NO: 406263 - DNA, 20 bp, Artificial Sequence
  chemically synthesized
gagaaggtcatggaagttag

SEQ ID NO: 406264 - DNA, 20 bp, Artificial Sequence
  chemically synthesized
agaaggtcatggaagttagg

SEQ ID NO: 406265 - DNA, 20 bp, Artificial Sequence
  chemically synthesized
aaggtcatggaagttaggag

SEQ ID NO: 406266 - DNA, 20 bp, Artificial Sequence
  chemically synthesized
tcatggaagttaggaggagc

SEQ ID NO: 406267 - DNA, 20 bp, Artificial Sequence
  chemically synthesized
ggaagttaggaggagcaagc

SEQ ID NO: 406268 - DNA, 20 bp, Artificial Sequence
  chemically synthesized
agttaggaggagcaagctgg

SEQ ID NO: 406269 - DNA, 20 bp, Artificial Sequence
  chemically synthesized
ccacacccttgaaagactgc

SEQ ID NO: 406270 - DNA, 20 bp, Artificial Sequence
  chemically synthesized
gagcaagctggcagtctttc

SEQ ID NO: 406271 - DNA, 20 bp, Artificial Sequence
  chemically synthesized
agcaagctggcagtctttca

SEQ ID NO: 406272 - DNA, 20 bp, Artificial Sequence
  chemically synthesized
gcaagctggcagtctttcaa

SEQ ID NO: 406273 - DNA, 20 bp, Artificial Sequence
  chemically synthesized
cctgattaccacacccttga

SEQ ID NO: 406274 - DNA, 20 bp, Artificial Sequence
  chemically synthesized
ctggcagtctttcaagggtg

SEQ ID NO: 406275 - DNA, 20 bp, Artificial Sequence
  chemically synthesized
tctttcaagggtgtggtaat

SEQ ID NO: 406276 - DNA, 20 bp, Artificial Sequence
  chemically synthesized
ctttcaagggtgtggtaatc

SEQ ID NO: 406277 - DNA, 20 bp, Artificial Sequence
  chemically synthesized
agggtgtggtaatcaggaca

SEQ ID NO: 406278 - DNA, 20 bp, Artificial Sequence
  chemically synthesized
gacacagacaccccaaatcc

SEQ ID NO: 406279 - DNA, 20 bp, Artificial Sequence
  chemically synthesized
tattctgcctccaggatttg

SEQ ID NO: 406280 - DNA, 20 bp, Artificial Sequence
  chemically synthesized
ctattctgcctccaggattt

SEQ ID NO: 406281 - DNA, 20 bp, Artificial Sequence
  chemically synthesized
cacagacaccccaaatcctg

SEQ ID NO: 406282 - DNA, 20 bp, Artificial Sequence
  chemically synthesized
cctattctgcctccaggatt

SEQ ID NO: 406283 - DNA, 20 bp, Artificial Sequence
  chemically synthesized
acagacaccccaaatcctgg

SEQ ID NO: 406284 - DNA, 20 bp, Artificial Sequence
  chemically synthesized
gacaccccaaatcctggagg

SEQ ID NO: 406285 - DNA, 20 bp, Artificial Sequence
  chemically synthesized
gaactgcctattctgcctcc

SEQ ID NO: 406286 - DNA, 20 bp, Artificial Sequence
  chemically synthesized
tgaactgcctattctgcctc

SEQ ID NO: 406287 - DNA, 20 bp, Artificial Sequence
  chemically synthesized
cccaaatcctggaggcagaa

SEQ ID NO: 406288 - DNA, 20 bp, Artificial Sequence
  chemically synthesized
ccaaatcctggaggcagaat

SEQ ID NO: 406289 - DNA, 20 bp, Artificial Sequence
  chemically synthesized
aatcctggaggcagaatagg

SEQ ID NO: 406290 - DNA, 20 bp, Artificial Sequence
  chemically synthesized
gcagaataggcagttcaact

SEQ ID NO: 406291 - DNA, 20 bp, Artificial Sequence
  chemically synthesized
cagaataggcagttcaacta

SEQ ID NO: 406292 - DNA, 20 bp, Artificial Sequence
  chemically synthesized
agaataggcagttcaactaa

SEQ ID NO: 406293 - DNA, 20 bp, Artificial Sequence
  chemically synthesized
ataggcagttcaactaaggg

SEQ ID NO: 406294 - DNA, 20 bp, Artificial Sequence
  chemically synthesized
taggcagttcaactaagggc

SEQ ID NO: 406295 - DNA, 20 bp, Artificial Sequence
  chemically synthesized
cagtacctgcatcccgccct

SEQ ID NO: 406296 - DNA, 20 bp, Artificial Sequence
  chemically synthesized
gttcaactaagggcgggatg

SEQ ID NO: 406297 - DNA, 20 bp, Artificial Sequence
  chemically synthesized
ttcaactaagggcgggatgc

SEQ ID NO: 406298 - DNA, 20 bp, Artificial Sequence
  chemically synthesized
taagggcgggatgcaggtac

SEQ ID NO: 406299 - DNA, 20 bp, Artificial Sequence
  chemically synthesized
aggcattggctgaagtgaac

SEQ ID NO: 406300 - DNA, 20 bp, Artificial Sequence
  chemically synthesized
atgcaggtactggttcactt

SEQ ID NO: 406301 - DNA, 20 bp, Artificial Sequence
  chemically synthesized
ttgcatgcaggcattggctg

SEQ ID NO: 406302 - DNA, 20 bp, Artificial Sequence
  chemically synthesized
agatctttgcatgcaggcat

SEQ ID NO: 406303 - DNA, 20 bp, Artificial Sequence
  chemically synthesized
tcagccaatgcctgcatgca

SEQ ID NO: 406304 - DNA, 20 bp, Artificial Sequence
  chemically synthesized
ggaagaagatctttgcatgc

SEQ ID NO: 406305 - DNA, 20 bp, Artificial Sequence
  chemically synthesized
gggaagaagatctttgcatg

SEQ ID NO: 406306 - DNA, 20 bp, Artificial Sequence
  chemically synthesized
caatgtggtctgtggggaag

SEQ ID NO: 406307 - DNA, 20 bp, Artificial Sequence
  chemically synthesized
tgcaaagatcttcttcccca

SEQ ID NO: 406308 - DNA, 20 bp, Artificial Sequence
  chemically synthesized
atccaatgtggtctgtgggg

SEQ ID NO: 406309 - DNA, 20 bp, Artificial Sequence
  chemically synthesized
gacatccaatgtggtctgtg

SEQ ID NO: 406310 - DNA, 20 bp, Artificial Sequence
  chemically synthesized
tgacatccaatgtggtctgt

SEQ ID NO: 406311 - DNA, 20 bp, Artificial Sequence
  chemically synthesized
gtgacatccaatgtggtctg

SEQ ID NO: 406312 - DNA, 20 bp, Artificial Sequence
  chemically synthesized
ttcttccccacagaccacat

SEQ ID NO: 406313 - DNA, 20 bp, Artificial Sequence
  chemically synthesized
cagagatgtgacatccaatg

SEQ ID NO: 406314 - DNA, 20 bp, Artificial Sequence
  chemically synthesized
ttctaggtcaaggacacaca

SEQ ID NO: 406315 - DNA, 20 bp, Artificial Sequence
  chemically synthesized
gattctaggtcaaggacaca

SEQ ID NO: 406316 - DNA, 20 bp, Artificial Sequence
  chemically synthesized
atctctgtgtgtccttgacc

SEQ ID NO: 406317 - DNA, 20 bp, Artificial Sequence
  chemically synthesized
caacttctgattctaggtca

SEQ ID NO: 406318 - DNA, 20 bp, Artificial Sequence
  chemically synthesized
ccaacttctgattctaggtc

SEQ ID NO: 406319 - DNA, 20 bp, Artificial Sequence
  chemically synthesized
gtgtgtccttgacctagaat

SEQ ID NO: 406320 - DNA, 20 bp, Artificial Sequence
  chemically synthesized
cagggccaacttctgattct

SEQ ID NO: 406321 - DNA, 20 bp, Artificial Sequence
  chemically synthesized
tgtccttgacctagaatcag

SEQ ID NO: 406322 - DNA, 20 bp, Artificial Sequence
  chemically synthesized
tcagggccaacttctgattc

SEQ ID NO: 406323 - DNA, 20 bp, Artificial Sequence
  chemically synthesized
cttgacctagaatcagaagt

SEQ ID NO: 406324 - DNA, 20 bp, Artificial Sequence
  chemically synthesized
tacttagcttcatggcatca

SEQ ID NO: 406325 - DNA, 20 bp, Artificial Sequence
  chemically synthesized
ttacttagcttcatggcatc

SEQ ID NO: 406326 - DNA, 20 bp, Artificial Sequence
  chemically synthesized
attacttagcttcatggcat

SEQ ID NO: 406327 - DNA, 20 bp, Artificial Sequence
  chemically synthesized
aagttggccctgatgccatg

SEQ ID NO: 406328 - DNA, 20 bp, Artificial Sequence
  chemically synthesized
ggccctgatgccatgaagct

SEQ ID NO: 406329 - DNA, 20 bp, Artificial Sequence
  chemically synthesized
aggagtattacttagcttca

SEQ ID NO: 406330 - DNA, 20 bp, Artificial Sequence
  chemically synthesized
aataacacaggagtattact

SEQ ID NO: 406331 - DNA, 20 bp, Artificial Sequence
  chemically synthesized
ctaggattggaataacacag

SEQ ID NO: 406332 - DNA, 20 bp, Artificial Sequence
  chemically synthesized
ctctaggattggaataacac

SEQ ID NO: 406333 - DNA, 20 bp, Artificial Sequence
  chemically synthesized
actctaggattggaataaca

SEQ ID NO: 406334 - DNA, 20 bp, Artificial Sequence
  chemically synthesized
ctcctgtgttattccaatcc

SEQ ID NO: 406335 - DNA, 20 bp, Artificial Sequence
  chemically synthesized
cctgtgttattccaatccta

SEQ ID NO: 406336 - DNA, 20 bp, Artificial Sequence
  chemically synthesized
tctagcctccactctaggat

SEQ ID NO: 406337 - DNA, 20 bp, Artificial Sequence
  chemically synthesized
gtgttattccaatcctagag

SEQ ID NO: 406338 - DNA, 20 bp, Artificial Sequence
  chemically synthesized
gttattccaatcctagagtg

SEQ ID NO: 406339 - DNA, 20 bp, Artificial Sequence
  chemically synthesized
ttattccaatcctagagtgg

SEQ ID NO: 406340 - DNA, 20 bp, Artificial Sequence
  chemically synthesized
aggactctagcctccactct

SEQ ID NO: 406341 - DNA, 20 bp, Artificial Sequence
  chemically synthesized
taggactctagcctccactc

SEQ ID NO: 406342 - DNA, 20 bp, Artificial Sequence
  chemically synthesized
tccaatcctagagtggaggc

SEQ ID NO: 406343 - DNA, 20 bp, Artificial Sequence
  chemically synthesized
caatcctagagtggaggcta

SEQ ID NO: 406344 - DNA, 20 bp, Artificial Sequence
  chemically synthesized
ttcaggagttgttaggactc

SEQ ID NO: 406345 - DNA, 20 bp, Artificial Sequence
  chemically synthesized
ggtcacattcaggagttgtt

SEQ ID NO: 406346 - DNA, 20 bp, Artificial Sequence
  chemically synthesized
cggtcacattcaggagttgt

SEQ ID NO: 406347 - DNA, 20 bp, Artificial Sequence
  chemically synthesized
ggtctaccggtcacattcag

SEQ ID NO: 406348 - DNA, 20 bp, Artificial Sequence
  chemically synthesized
caggtctaccggtcacattc

SEQ ID NO: 406349 - DNA, 20 bp, Artificial Sequence
  chemically synthesized
tcaggtctaccggtcacatt

SEQ ID NO: 406350 - DNA, 20 bp, Artificial Sequence
  chemically synthesized
taacaactcctgaatgtgac

SEQ ID NO: 406351 - DNA, 20 bp, Artificial Sequence
  chemically synthesized
caactcctgaatgtgaccgg

SEQ ID NO: 406352 - DNA, 20 bp, Artificial Sequence
  chemically synthesized
cagtgacttttcaggtctac

SEQ ID NO: 406353 - DNA, 20 bp, Artificial Sequence
  chemically synthesized
atgtgaccggtagacctgaa

SEQ ID NO: 406354 - DNA, 20 bp, Artificial Sequence
  chemically synthesized
ataaaattcagtgacttttc

SEQ ID NO: 406355 - DNA, 20 bp, Artificial Sequence
  chemically synthesized
aataaaattcagtgactttt

SEQ ID NO: 406356 - DNA, 20 bp, Artificial Sequence
  chemically synthesized
caggaaatcttaataaaatt

SEQ ID NO: 406357 - DNA, 20 bp, Artificial Sequence
  chemically synthesized
aaaagtcactgaattttatt

SEQ ID NO: 406358 - DNA, 20 bp, Artificial Sequence
  chemically synthesized
gaattttattaagatttcct

SEQ ID NO: 406359 - DNA, 20 bp, Artificial Sequence
  chemically synthesized
ttattaagatttcctgagaa

SEQ ID NO: 406360 - DNA, 20 bp, Artificial Sequence
  chemically synthesized
tttcttaatataccattctc

SEQ ID NO: 406361 - DNA, 20 bp, Artificial Sequence
  chemically synthesized
gtttcttaatataccattct

SEQ ID NO: 406362 - DNA, 20 bp, Artificial Sequence
  chemically synthesized
tttcctgagaatggtatatt

SEQ ID NO: 406363 - DNA, 20 bp, Artificial Sequence
  chemically synthesized
ggttcctcttttaatttaac

SEQ ID NO: 406364 - DNA, 20 bp, Artificial Sequence
  chemically synthesized
tggttcctcttttaatttaa

SEQ ID NO: 406365 - DNA, 20 bp, Artificial Sequence
  chemically synthesized
taagaaacctgttaaattaa

SEQ ID NO: 406366 - DNA, 20 bp, Artificial Sequence
  chemically synthesized
agaaacctgttaaattaaaa

SEQ ID NO: 406367 - DNA, 20 bp, Artificial Sequence
  chemically synthesized
gaaacctgttaaattaaaag

SEQ ID NO: 406368 - DNA, 20 bp, Artificial Sequence
  chemically synthesized
aattaaaagaggaaccaaaa

SEQ ID NO: 406369 - DNA, 20 bp, Artificial Sequence
  chemically synthesized
gctaaattaaatttctattt

SEQ ID NO: 406370 - DNA, 20 bp, Artificial Sequence
  chemically synthesized
accaaaatagaaatttaatt

SEQ ID NO: 406371 - DNA, 20 bp, Artificial Sequence
  chemically synthesized
atagaaatttaatttagcta

SEQ ID NO: 406372 - DNA, 20 bp, Artificial Sequence
  chemically synthesized
gtattttattaatttttcta

SEQ ID NO: 406373 - DNA, 20 bp, Artificial Sequence
  chemically synthesized
aattaataaaataccatttt

SEQ ID NO: 406374 - DNA, 20 bp, Artificial Sequence
  chemically synthesized
aaatttaagtgggctaaaaa

SEQ ID NO: 406375 - DNA, 20 bp, Artificial Sequence
  chemically synthesized
agtatcacacaaatttaagt

SEQ ID NO: 406376 - DNA, 20 bp, Artificial Sequence
  chemically synthesized
cagtatcacacaaatttaag

SEQ ID NO: 406377 - DNA, 20 bp, Artificial Sequence
  chemically synthesized
tttcagtatcacacaaattt

SEQ ID NO: 406378 - DNA, 20 bp, Artificial Sequence
  chemically synthesized
gtagcaggaaaaaaaaattt

SEQ ID NO: 406379 - DNA, 20 bp, Artificial Sequence
  chemically synthesized
gaaatttttttttcctgcta

SEQ ID NO: 406380 - DNA, 20 bp, Artificial Sequence
  chemically synthesized
ctaaattatacatctgtagc

SEQ ID NO: 406381 - DNA, 20 bp, Artificial Sequence
  chemically synthesized
actaaattatacatctgtag

SEQ ID NO: 406382 - DNA, 20 bp, Artificial Sequence
  chemically synthesized
tgcactaaattatacatctg

SEQ ID NO: 406383 - DNA, 20 bp, Artificial Sequence
  chemically synthesized
cctgctacagatgtataatt

SEQ ID NO: 406384 - DNA, 20 bp, Artificial Sequence
  chemically synthesized
cagatgtataatttagtgca

SEQ ID NO: 406385 - DNA, 20 bp, Artificial Sequence
  chemically synthesized
agatgtataatttagtgcaa

SEQ ID NO: 406386 - DNA, 20 bp, Artificial Sequence
  chemically synthesized
tataatttagtgcaaaggtg

SEQ ID NO: 406387 - DNA, 20 bp, Artificial Sequence
  chemically synthesized
ataatttagtgcaaaggtgt

SEQ ID NO: 406388 - DNA, 20 bp, Artificial Sequence
  chemically synthesized
taatttagtgcaaaggtgta

SEQ ID NO: 406389 - DNA, 20 bp, Artificial Sequence
  chemically synthesized
agtgcaaaggtgtagggccc

SEQ ID NO: 406390 - DNA, 20 bp, Artificial Sequence
  chemically synthesized
gtgcaaaggtgtagggccca

SEQ ID NO: 406391 - DNA, 20 bp, Artificial Sequence
  chemically synthesized
attcctcacagtgaagcctt

SEQ ID NO: 406392 - DNA, 20 bp, Artificial Sequence
  chemically synthesized
cattcctcacagtgaagcct

SEQ ID NO: 406393 - DNA, 20 bp, Artificial Sequence
  chemically synthesized
agggcccaaggcttcactgt

SEQ ID NO: 406394 - DNA, 20 bp, Artificial Sequence
  chemically synthesized
gggcccaaggcttcactgtg

SEQ ID NO: 406395 - DNA, 20 bp, Artificial Sequence
  chemically synthesized
catttacattcctcacagtg

SEQ ID NO: 406396 - DNA, 20 bp, Artificial Sequence
  chemically synthesized
gagcacatttacattcctca

SEQ ID NO: 406397 - DNA, 20 bp, Artificial Sequence
  chemically synthesized
aaatcataaattattttggg

SEQ ID NO: 406398 - DNA, 20 bp, Artificial Sequence
  chemically synthesized
caaaatcataaattattttg

SEQ ID NO: 406399 - DNA, 20 bp, Artificial Sequence
  chemically synthesized
tcaaaatcataaattatttt

SEQ ID NO: 406400 - DNA, 20 bp, Artificial Sequence
  chemically synthesized
gtcaaaatcataaattattt

SEQ ID NO: 406401 - DNA, 20 bp, Artificial Sequence
  chemically synthesized
atagtattttgtgcagacat

SEQ ID NO: 406402 - DNA, 20 bp, Artificial Sequence
  chemically synthesized
atggactatagtattttgtg

SEQ ID NO: 406403 - DNA, 20 bp, Artificial Sequence
  chemically synthesized
aatgtctgcacaaaatacta

SEQ ID NO: 406404 - DNA, 20 bp, Artificial Sequence
  chemically synthesized
ttgaaacctgttatggacta

SEQ ID NO: 406405 - DNA, 20 bp, Artificial Sequence
  chemically synthesized
caaaatactatagtccataa

SEQ ID NO: 406406 - DNA, 20 bp, Artificial Sequence
  chemically synthesized
aaaatactatagtccataac

SEQ ID NO: 406407 - DNA, 20 bp, Artificial Sequence
  chemically synthesized
ataagatttgaaacctgtta

SEQ ID NO: 406408 - DNA, 20 bp, Artificial Sequence
  chemically synthesized
atagtattaatagttgttat

SEQ ID NO: 406409 - DNA, 20 bp, Artificial Sequence
  chemically synthesized
ctacatgttgatagtattaa

SEQ ID NO: 406410 - DNA, 20 bp, Artificial Sequence
  chemically synthesized
ttcttatttctacatgttga

SEQ ID NO: 406411 - DNA, 20 bp, Artificial Sequence
  chemically synthesized
ctattaatactatcaacatg

SEQ ID NO: 406412 - DNA, 20 bp, Artificial Sequence
  chemically synthesized
tactatcaacatgtagaaat

SEQ ID NO: 406413 - DNA, 20 bp, Artificial Sequence
  chemically synthesized
catgtagaaataagaaaact

SEQ ID NO: 406414 - DNA, 20 bp, Artificial Sequence
  chemically synthesized
atgtagaaataagaaaactg

SEQ ID NO: 406415 - DNA, 20 bp, Artificial Sequence
  chemically synthesized
gaaataagaaaactgaggct

SEQ ID NO: 406416 - DNA, 20 bp, Artificial Sequence
  chemically synthesized
aataagaaaactgaggctta

SEQ ID NO: 406417 - DNA, 20 bp, Artificial Sequence
  chemically synthesized
agtccaaccactctaagcct

SEQ ID NO: 406418 - DNA, 20 bp, Artificial Sequence
  chemically synthesized
aagaaaactgaggcttagag

SEQ ID NO: 406419 - DNA, 20 bp, Artificial Sequence
  chemically synthesized
ggatagagtccaaccactct

SEQ ID NO: 406420 - DNA, 20 bp, Artificial Sequence
  chemically synthesized
aaactgaggcttagagtggt

SEQ ID NO: 406421 - DNA, 20 bp, Artificial Sequence
  chemically synthesized
tcctgggcaatcaatggata

SEQ ID NO: 406422 - DNA, 20 bp, Artificial Sequence
  chemically synthesized
tatcctgggcaatcaatgga

SEQ ID NO: 406423 - DNA, 20 bp, Artificial Sequence
  chemically synthesized
atgttatcctgggcaatcaa

SEQ ID NO: 406424 - DNA, 20 bp, Artificial Sequence
  chemically synthesized
gactctatccattgattgcc

SEQ ID NO: 406425 - DNA, 20 bp, Artificial Sequence
  chemically synthesized
actctatccattgattgccc

SEQ ID NO: 406426 - DNA, 20 bp, Artificial Sequence
  chemically synthesized
cagtcacttgatgttatcct

SEQ ID NO: 406427 - DNA, 20 bp, Artificial Sequence
  chemically synthesized
tcagtcacttgatgttatcc

SEQ ID NO: 406428 - DNA, 20 bp, Artificial Sequence
  chemically synthesized
tgattgcccaggataacatc

SEQ ID NO: 406429 - DNA, 20 bp, Artificial Sequence
  chemically synthesized
gataacatcaagtgactgac

SEQ ID NO: 406430 - DNA, 20 bp, Artificial Sequence
  chemically synthesized
ataacatcaagtgactgact

SEQ ID NO: 406431 - DNA, 20 bp, Artificial Sequence
  chemically synthesized
taacatcaagtgactgactg

SEQ ID NO: 406432 - DNA, 20 bp, Artificial Sequence
  chemically synthesized
aacatcaagtgactgactgg

SEQ ID NO: 406433 - DNA, 20 bp, Artificial Sequence
  chemically synthesized
aacaattttgagcccccagt

SEQ ID NO: 406434 - DNA, 20 bp, Artificial Sequence
  chemically synthesized
ggagaacaattttgagcccc

SEQ ID NO: 406435 - DNA, 20 bp, Artificial Sequence
  chemically synthesized
acaatcaggagaacaatttt

SEQ ID NO: 406436 - DNA, 20 bp, Artificial Sequence
  chemically synthesized
ggattgatatttacaatcag

SEQ ID NO: 406437 - DNA, 20 bp, Artificial Sequence
  chemically synthesized
caggattgatatttacaatc

SEQ ID NO: 406438 - DNA, 20 bp, Artificial Sequence
  chemically synthesized
acaggattgatatttacaat

SEQ ID NO: 406439 - DNA, 20 bp, Artificial Sequence
  chemically synthesized
tatggacaagtataggaaac

SEQ ID NO: 406440 - DNA, 20 bp, Artificial Sequence
  chemically synthesized
atatggacaagtataggaaa

SEQ ID NO: 406441 - DNA, 20 bp, Artificial Sequence
  chemically synthesized
ggaagtatatggacaagtat

SEQ ID NO: 406442 - DNA, 20 bp, Artificial Sequence
  chemically synthesized
aggaagtatatggacaagta

SEQ ID NO: 406443 - DNA, 20 bp, Artificial Sequence
  chemically synthesized
gcatcaggaagtatatggac

SEQ ID NO: 406444 - DNA, 20 bp, Artificial Sequence
  chemically synthesized
aataggcatcaggaagtata

SEQ ID NO: 406445 - DNA, 20 bp, Artificial Sequence
  chemically synthesized
agcaccaaataggcatcagg

SEQ ID NO: 406446 - DNA, 20 bp, Artificial Sequence
  chemically synthesized
ttgagcaccaaataggcatc

SEQ ID NO: 406447 - DNA, 20 bp, Artificial Sequence
  chemically synthesized
attgagcaccaaataggcat

SEQ ID NO: 406448 - DNA, 20 bp, Artificial Sequence
  chemically synthesized
tatacttcctgatgcctatt

SEQ ID NO: 406449 - DNA, 20 bp, Artificial Sequence
  chemically synthesized
aaagttattgagcaccaaat

SEQ ID NO: 406450 - DNA, 20 bp, Artificial Sequence
  chemically synthesized
aaaagttattgagcaccaaa

SEQ ID NO: 406451 - DNA, 20 bp, Artificial Sequence
  chemically synthesized
tactcaatctaaaagttatt

SEQ ID NO: 406452 - DNA, 20 bp, Artificial Sequence
  chemically synthesized
atttggtgctcaataacttt

SEQ ID NO: 406453 - DNA, 20 bp, Artificial Sequence
  chemically synthesized
tgctcaataacttttagatt

SEQ ID NO: 406454 - DNA, 20 bp, Artificial Sequence
  chemically synthesized
cattcttttactcaatctaa

SEQ ID NO: 406455 - DNA, 20 bp, Artificial Sequence
  chemically synthesized
ataacttttagattgagtaa

SEQ ID NO: 406456 - DNA, 20 bp, Artificial Sequence
  chemically synthesized
aacaaaaacatgtatttatt

SEQ ID NO: 406457 - DNA, 20 bp, Artificial Sequence
  chemically synthesized
acatgtatttatttagtgcc

SEQ ID NO: 406458 - DNA, 20 bp, Artificial Sequence
  chemically synthesized
tgtatttatttagtgcccgg

SEQ ID NO: 406459 - DNA, 20 bp, Artificial Sequence
  chemically synthesized
gtatttatttagtgcccgga

SEQ ID NO: 406460 - DNA, 20 bp, Artificial Sequence
  chemically synthesized
tatttatttagtgcccggaa

SEQ ID NO: 406461 - DNA, 20 bp, Artificial Sequence
  chemically synthesized
atttatttagtgcccggaag

SEQ ID NO: 406462 - DNA, 20 bp, Artificial Sequence
  chemically synthesized
ttatttgctatgccccttcc

SEQ ID NO: 406463 - DNA, 20 bp, Artificial Sequence
  chemically synthesized
attatttgctatgccccttc

SEQ ID NO: 406464 - DNA, 20 bp, Artificial Sequence
  chemically synthesized
tttagtgcccggaaggggca

SEQ ID NO: 406465 - DNA, 20 bp, Artificial Sequence
  chemically synthesized
aatgctatgtgagataggaa

SEQ ID NO: 406466 - DNA, 20 bp, Artificial Sequence
  chemically synthesized
gaatgctatgtgagatagga

SEQ ID NO: 406467 - DNA, 20 bp, Artificial Sequence
  chemically synthesized
tactgaatgctatgtgagat

SEQ ID NO: 406468 - DNA, 20 bp, Artificial Sequence
  chemically synthesized
atatcctttcctatctcaca

SEQ ID NO: 406469 - DNA, 20 bp, Artificial Sequence
  chemically synthesized
gtactgaatgctatgtgaga

SEQ ID NO: 406470 - DNA, 20 bp, Artificial Sequence
  chemically synthesized
tgctgtactgaatgctatgt

SEQ ID NO: 406471 - DNA, 20 bp, Artificial Sequence
  chemically synthesized
ttcctatctcacatagcatt

SEQ ID NO: 406472 - DNA, 20 bp, Artificial Sequence
  chemically synthesized
atctcacatagcattcagta

SEQ ID NO: 406473 - DNA, 20 bp, Artificial Sequence
  chemically synthesized
acatagcattcagtacagca

SEQ ID NO: 406474 - DNA, 20 bp, Artificial Sequence
  chemically synthesized
agcattcagtacagcaaagt

SEQ ID NO: 406475 - DNA, 20 bp, Artificial Sequence
  chemically synthesized
acagcaaagtaagcaaaatt

SEQ ID NO: 406476 - DNA, 20 bp, Artificial Sequence
  chemically synthesized
cagcaaagtaagcaaaattg

SEQ ID NO: 406477 - DNA, 20 bp, Artificial Sequence
  chemically synthesized
gcaaagtaagcaaaattgag

SEQ ID NO: 406478 - DNA, 20 bp, Artificial Sequence
  chemically synthesized
caaagtaagcaaaattgagg

SEQ ID NO: 406479 - DNA, 20 bp, Artificial Sequence
  chemically synthesized
aaagtaagcaaaattgagga

SEQ ID NO: 406480 - DNA, 20 bp, Artificial Sequence
  chemically synthesized
tctcagtgtctagcaatttg

SEQ ID NO: 406481 - DNA, 20 bp, Artificial Sequence
  chemically synthesized
gttgaacatctacaaattgc

SEQ ID NO: 406482 - DNA, 20 bp, Artificial Sequence
  chemically synthesized
tctacaaattgctagacact

SEQ ID NO: 406483 - DNA, 20 bp, Artificial Sequence
  chemically synthesized
tgcataaaaatctcagtgtc

SEQ ID NO: 406484 - DNA, 20 bp, Artificial Sequence
  chemically synthesized
taaaaagtgcataaaaatct

SEQ ID NO: 406485 - DNA, 20 bp, Artificial Sequence
  chemically synthesized
gagatttttatgcacttttt

SEQ ID NO: 406486 - DNA, 20 bp, Artificial Sequence
  chemically synthesized
acacgaagattaaacttaaa

SEQ ID NO: 406487 - DNA, 20 bp, Artificial Sequence
  chemically synthesized
atgtaatgtggattaacacg

SEQ ID NO: 406488 - DNA, 20 bp, Artificial Sequence
  chemically synthesized
ccatttcctcatatgtaatg

SEQ ID NO: 406489 - DNA, 20 bp, Artificial Sequence
  chemically synthesized
tgttaatccacattacatat

SEQ ID NO: 406490 - DNA, 20 bp, Artificial Sequence
  chemically synthesized
gttaatccacattacatatg

SEQ ID NO: 406491 - DNA, 20 bp, Artificial Sequence
  chemically synthesized
ccacattacatatgaggaaa

SEQ ID NO: 406492 - DNA, 20 bp, Artificial Sequence
  chemically synthesized
acattacatatgaggaaatg

SEQ ID NO: 406493 - DNA, 20 bp, Artificial Sequence
  chemically synthesized
attacatatgaggaaatgga

SEQ ID NO: 406494 - DNA, 20 bp, Artificial Sequence
  chemically synthesized
tacatatgaggaaatggaga

SEQ ID NO: 406495 - DNA, 20 bp, Artificial Sequence
  chemically synthesized
gaggaaatggagagagaata

SEQ ID NO: 406496 - DNA, 20 bp, Artificial Sequence
  chemically synthesized
gagagagaatatagtttgtc

SEQ ID NO: 406497 - DNA, 20 bp, Artificial Sequence
  chemically synthesized
agagagaatatagtttgtca

SEQ ID NO: 406498 - DNA, 20 bp, Artificial Sequence
  chemically synthesized
aatatagtttgtcaaggtaa

SEQ ID NO: 406499 - DNA, 20 bp, Artificial Sequence
  chemically synthesized
gtttgtcaaggtaatggcca

SEQ ID NO: 406500 - DNA, 20 bp, Artificial Sequence
  chemically synthesized
cactcaaattatatggacta

SEQ ID NO: 406501 - DNA, 20 bp, Artificial Sequence
  chemically synthesized
tagtaagcactcaaattata

SEQ ID NO: 406502 - DNA, 20 bp, Artificial Sequence
  chemically synthesized
ggccatagtccatataattt

SEQ ID NO: 406503 - DNA, 20 bp, Artificial Sequence
  chemically synthesized
tttagtaggtggcacatagt

SEQ ID NO: 406504 - DNA, 20 bp, Artificial Sequence
  chemically synthesized
agtgtttagtaggtggcaca

SEQ ID NO: 406505 - DNA, 20 bp, Artificial Sequence
  chemically synthesized
tgtttaaagtgtttagtagg

SEQ ID NO: 406506 - DNA, 20 bp, Artificial Sequence
  chemically synthesized
atgtgtttaaagtgtttagt

SEQ ID NO: 406507 - DNA, 20 bp, Artificial Sequence
  chemically synthesized
catgtgtttaaagtgtttag

SEQ ID NO: 406508 - DNA, 20 bp, Artificial Sequence
  chemically synthesized
gttcatgtgtttaaagtgtt

SEQ ID NO: 406509 - DNA, 20 bp, Artificial Sequence
  chemically synthesized
gaagtatgttcatgtgttta

SEQ ID NO: 406510 - DNA, 20 bp, Artificial Sequence
  chemically synthesized
ttacaaggtctgtgaaaatg

SEQ ID NO: 406511 - DNA, 20 bp, Artificial Sequence
  chemically synthesized
atgaacatacttcattttca

SEQ ID NO: 406512 - DNA, 20 bp, Artificial Sequence
  chemically synthesized
ttcattttcacagaccttgt

SEQ ID NO: 406513 - DNA, 20 bp, Artificial Sequence
  chemically synthesized
cattttcacagaccttgtaa

SEQ ID NO: 406514 - DNA, 20 bp, Artificial Sequence
  chemically synthesized
ttttcacagaccttgtaaga

SEQ ID NO: 406515 - DNA, 20 bp, Artificial Sequence
  chemically synthesized
agagaagtacctctcttaca

SEQ ID NO: 406516 - DNA, 20 bp, Artificial Sequence
  chemically synthesized
tttcacagaccttgtaagag

SEQ ID NO: 406517 - DNA, 20 bp, Artificial Sequence
  chemically synthesized
aagagaagtacctctcttac

SEQ ID NO: 406518 - DNA, 20 bp, Artificial Sequence
  chemically synthesized
ccatacaatagggtcaagag

SEQ ID NO: 406519 - DNA, 20 bp, Artificial Sequence
  chemically synthesized
tatccatacaatagggtcaa

SEQ ID NO: 406520 - DNA, 20 bp, Artificial Sequence
  chemically synthesized
cctatccatacaatagggtc

SEQ ID NO: 406521 - DNA, 20 bp, Artificial Sequence
  chemically synthesized
cttctcttgaccctattgta

SEQ ID NO: 406522 - DNA, 20 bp, Artificial Sequence
  chemically synthesized
tgtttcctatccatacaata

SEQ ID NO: 406523 - DNA, 20 bp, Artificial Sequence
  chemically synthesized
ttgtttcctatccatacaat

SEQ ID NO: 406524 - DNA, 20 bp, Artificial Sequence
  chemically synthesized
tttgtttcctatccatacaa

SEQ ID NO: 406525 - DNA, 20 bp, Artificial Sequence
  chemically synthesized
tcttgaccctattgtatgga

SEQ ID NO: 406526 - DNA, 20 bp, Artificial Sequence
  chemically synthesized
cttgaccctattgtatggat

SEQ ID NO: 406527 - DNA, 20 bp, Artificial Sequence
  chemically synthesized
tattgtatggataggaaaca

SEQ ID NO: 406528 - DNA, 20 bp, Artificial Sequence
  chemically synthesized
tatggataggaaacaaagct

SEQ ID NO: 406529 - DNA, 20 bp, Artificial Sequence
  chemically synthesized
gataggaaacaaagcttagc

SEQ ID NO: 406530 - DNA, 20 bp, Artificial Sequence
  chemically synthesized
ataggaaacaaagcttagcg

SEQ ID NO: 406531 - DNA, 20 bp, Artificial Sequence
  chemically synthesized
ggcagttacttaacctcgct

SEQ ID NO: 406532 - DNA, 20 bp, Artificial Sequence
  chemically synthesized
aaacaaagcttagcgaggtt

SEQ ID NO: 406533 - DNA, 20 bp, Artificial Sequence
  chemically synthesized
gcgaggttaagtaactgccc

SEQ ID NO: 406534 - DNA, 20 bp, Artificial Sequence
  chemically synthesized
agtagctatatgaacttggg

SEQ ID NO: 406535 - DNA, 20 bp, Artificial Sequence
  chemically synthesized
caaagtagctatatgaactt

SEQ ID NO: 406536 - DNA, 20 bp, Artificial Sequence
  chemically synthesized
gcaaagtagctatatgaact

SEQ ID NO: 406537 - DNA, 20 bp, Artificial Sequence
  chemically synthesized
agtaactgcccaagttcata

SEQ ID NO: 406538 - DNA, 20 bp, Artificial Sequence
  chemically synthesized
aagttcatatagctactttg

SEQ ID NO: 406539 - DNA, 20 bp, Artificial Sequence
  chemically synthesized
tgtgctcatctactgcaaag

SEQ ID NO: 406540 - DNA, 20 bp, Artificial Sequence
  chemically synthesized
ttcatatagctactttgcag

SEQ ID NO: 406541 - DNA, 20 bp, Artificial Sequence
  chemically synthesized
atttgtgctcatctactgca

SEQ ID NO: 406542 - DNA, 20 bp, Artificial Sequence
  chemically synthesized
atagctactttgcagtagat

SEQ ID NO: 406543 - DNA, 20 bp, Artificial Sequence
  chemically synthesized
taatggagttagagaagcat

SEQ ID NO: 406544 - DNA, 20 bp, Artificial Sequence
  chemically synthesized
ggttaataatggagttagag

SEQ ID NO: 406545 - DNA, 20 bp, Artificial Sequence
  chemically synthesized
ttgggttaataatggagtta

SEQ ID NO: 406546 - DNA, 20 bp, Artificial Sequence
  chemically synthesized
tattgggttaataatggagt

SEQ ID NO: 406547 - DNA, 20 bp, Artificial Sequence
  chemically synthesized
ctgctattgggttaataatg

SEQ ID NO: 406548 - DNA, 20 bp, Artificial Sequence
  chemically synthesized
acctgctattgggttaataa

SEQ ID NO: 406549 - DNA, 20 bp, Artificial Sequence
  chemically synthesized
taactccattattaacccaa

SEQ ID NO: 406550 - DNA, 20 bp, Artificial Sequence
  chemically synthesized
ctccattattaacccaatag

SEQ ID NO: 406551 - DNA, 20 bp, Artificial Sequence
  chemically synthesized
tccattattaacccaatagc

SEQ ID NO: 406552 - DNA, 20 bp, Artificial Sequence
  chemically synthesized
gattttcagcacctgctatt

SEQ ID NO: 406553 - DNA, 20 bp, Artificial Sequence
  chemically synthesized
tgattttcagcacctgctat

SEQ ID NO: 406554 - DNA, 20 bp, Artificial Sequence
  chemically synthesized
gcaacacgatcagtgatttt

SEQ ID NO: 406555 - DNA, 20 bp, Artificial Sequence
  chemically synthesized
tcctttgtcagcaacacgat

SEQ ID NO: 406556 - DNA, 20 bp, Artificial Sequence
  chemically synthesized
cactgatcgtgttgctgaca

SEQ ID NO: 406557 - DNA, 20 bp, Artificial Sequence
  chemically synthesized
actgatcgtgttgctgacaa

SEQ ID NO: 406558 - DNA, 20 bp, Artificial Sequence
  chemically synthesized
tgatcgtgttgctgacaaag

SEQ ID NO: 406559 - DNA, 20 bp, Artificial Sequence
  chemically synthesized
tattgtttactctcctttgt

SEQ ID NO: 406560 - DNA, 20 bp, Artificial Sequence
  chemically synthesized
atcgtgttgctgacaaagga

SEQ ID NO: 406561 - DNA, 20 bp, Artificial Sequence
  chemically synthesized
tgacaaaggagagtaaacaa

SEQ ID NO: 406562 - DNA, 20 bp, Artificial Sequence
  chemically synthesized
ccttagatagtattattatg

SEQ ID NO: 406563 - DNA, 20 bp, Artificial Sequence
  chemically synthesized
gccacataataatactatct

SEQ ID NO: 406564 - DNA, 20 bp, Artificial Sequence
  chemically synthesized
ccacataataatactatcta

SEQ ID NO: 406565 - DNA, 20 bp, Artificial Sequence
  chemically synthesized
cacataataatactatctaa

SEQ ID NO: 406566 - DNA, 20 bp, Artificial Sequence
  chemically synthesized
atcagtaatgttcccttaga

SEQ ID NO: 406567 - DNA, 20 bp, Artificial Sequence
  chemically synthesized
gtacatcagtaatgttccct

SEQ ID NO: 406568 - DNA, 20 bp, Artificial Sequence
  chemically synthesized
gggaacattactgatgtacc

SEQ ID NO: 406569 - DNA, 20 bp, Artificial Sequence
  chemically synthesized
tttaaaaaatctaggtacat

SEQ ID NO: 406570 - DNA, 20 bp, Artificial Sequence
  chemically synthesized
aaagaaagtttaaaaaatct

SEQ ID NO: 406571 - DNA, 20 bp, Artificial Sequence
  chemically synthesized
aaaagaaagtttaaaaaatc

SEQ ID NO: 406572 - DNA, 20 bp, Artificial Sequence
  chemically synthesized
ttattttcataaataaaaga

SEQ ID NO: 406573 - DNA, 20 bp, Artificial Sequence
  chemically synthesized
atttttattttcataaataa

SEQ ID NO: 406574 - DNA, 20 bp, Artificial Sequence
  chemically synthesized
aaagtggcacaaacagaggg

SEQ ID NO: 406575 - DNA, 20 bp, Artificial Sequence
  chemically synthesized
tttaaagtggcacaaacaga

SEQ ID NO: 406576 - DNA, 20 bp, Artificial Sequence
  chemically synthesized
gtttaaagtggcacaaacag

SEQ ID NO: 406577 - DNA, 20 bp, Artificial Sequence
  chemically synthesized
tgtttaaagtggcacaaaca

SEQ ID NO: 406578 - DNA, 20 bp, Artificial Sequence
  chemically synthesized
agtgtttaaagtggcacaaa

SEQ ID NO: 406579 - DNA, 20 bp, Artificial Sequence
  chemically synthesized
ggaggcaccagtgtttaaag

SEQ ID NO: 406580 - DNA, 20 bp, Artificial Sequence
  chemically synthesized
gtttgtgccactttaaacac

SEQ ID NO: 406581 - DNA, 20 bp, Artificial Sequence
  chemically synthesized
aagggaggcaccagtgttta

SEQ ID NO: 406582 - DNA, 20 bp, Artificial Sequence
  chemically synthesized
gtcaaagagaagggaggcac

SEQ ID NO: 406583 - DNA, 20 bp, Artificial Sequence
  chemically synthesized
atttgggtcaaagagaaggg

SEQ ID NO: 406584 - DNA, 20 bp, Artificial Sequence
  chemically synthesized
tatttgggtcaaagagaagg

SEQ ID NO: 406585 - DNA, 20 bp, Artificial Sequence
  chemically synthesized
agtatttgggtcaaagagaa

SEQ ID NO: 406586 - DNA, 20 bp, Artificial Sequence
  chemically synthesized
gagtatttgggtcaaagaga

SEQ ID NO: 406587 - DNA, 20 bp, Artificial Sequence
  chemically synthesized
tgagtatttgggtcaaagag

SEQ ID NO: 406588 - DNA, 20 bp, Artificial Sequence
  chemically synthesized
ttttgagtatttgggtcaaa

SEQ ID NO: 406589 - DNA, 20 bp, Artificial Sequence
  chemically synthesized
tgttttgagtatttgggtca

SEQ ID NO: 406590 - DNA, 20 bp, Artificial Sequence
  chemically synthesized
gtgacctgttttgagtattt

SEQ ID NO: 406591 - DNA, 20 bp, Artificial Sequence
  chemically synthesized
tgtgacctgttttgagtatt

SEQ ID NO: 406592 - DNA, 20 bp, Artificial Sequence
  chemically synthesized
tttgacccaaatactcaaaa

SEQ ID NO: 406593 - DNA, 20 bp, Artificial Sequence
  chemically synthesized
ttgacccaaatactcaaaac

SEQ ID NO: 406594 - DNA, 20 bp, Artificial Sequence
  chemically synthesized
ttaaatgtgtgacctgtttt

SEQ ID NO: 406595 - DNA, 20 bp, Artificial Sequence
  chemically synthesized
acaggtcacacatttaaata

SEQ ID NO: 406596 - DNA, 20 bp, Artificial Sequence
  chemically synthesized
gtcacacatttaaatatggc

SEQ ID NO: 406597 - DNA, 20 bp, Artificial Sequence
  chemically synthesized
tttaaatatggcaagccctc

SEQ ID NO: 406598 - DNA, 20 bp, Artificial Sequence
  chemically synthesized
ccatcatttgcagggctgga

SEQ ID NO: 406599 - DNA, 20 bp, Artificial Sequence
  chemically synthesized
tccatcatttgcagggctgg

SEQ ID NO: 406600 - DNA, 20 bp, Artificial Sequence
  chemically synthesized
gtccatcatttgcagggctg

SEQ ID NO: 406601 - DNA, 20 bp, Artificial Sequence
  chemically synthesized
tagtccatcatttgcagggc

SEQ ID NO: 406602 - DNA, 20 bp, Artificial Sequence
  chemically synthesized
tttatagtccatcatttgca

SEQ ID NO: 406603 - DNA, 20 bp, Artificial Sequence
  chemically synthesized
ttttatagtccatcatttgc

SEQ ID NO: 406604 - DNA, 20 bp, Artificial Sequence
  chemically synthesized
ccctccagccctgcaaatga

SEQ ID NO: 406605 - DNA, 20 bp, Artificial Sequence
  chemically synthesized
attttatagtccatcatttg

SEQ ID NO: 406606 - DNA, 20 bp, Artificial Sequence
  chemically synthesized
agtagtacaaacaaatttta

SEQ ID NO: 406607 - DNA, 20 bp, Artificial Sequence
  chemically synthesized
ataaaatttgtttgtactac

SEQ ID NO: 406608 - DNA, 20 bp, Artificial Sequence
  chemically synthesized
ttttaaaaaaaaatcgccag

SEQ ID NO: 406609 - DNA, 20 bp, Artificial Sequence
  chemically synthesized
cttttttaaaaaaaaatcgc

SEQ ID NO: 406610 - DNA, 20 bp, Artificial Sequence
  chemically synthesized
ctggcgatttttttttaaaa

SEQ ID NO: 406611 - DNA, 20 bp, Artificial Sequence
  chemically synthesized
atatgaaagtaggtgtgcat

SEQ ID NO: 406612 - DNA, 20 bp, Artificial Sequence
  chemically synthesized
caacctaaaaatatgaaagt

SEQ ID NO: 406613 - DNA, 20 bp, Artificial Sequence
  chemically synthesized
ccaacctaaaaatatgaaag

SEQ ID NO: 406614 - DNA, 20 bp, Artificial Sequence
  chemically synthesized
tgtccaacctaaaaatatga

SEQ ID NO: 406615 - DNA, 20 bp, Artificial Sequence
  chemically synthesized
cacacctactttcatatttt

SEQ ID NO: 406616 - DNA, 20 bp, Artificial Sequence
  chemically synthesized
acacctactttcatattttt

SEQ ID NO: 406617 - DNA, 20 bp, Artificial Sequence
  chemically synthesized
ctactttcatatttttaggt

SEQ ID NO: 406618 - DNA, 20 bp, Artificial Sequence
  chemically synthesized
tttcatatttttaggttgga

SEQ ID NO: 406619 - DNA, 20 bp, Artificial Sequence
  chemically synthesized
ttttaggttggacagtacct

SEQ ID NO: 406620 - DNA, 20 bp, Artificial Sequence
  chemically synthesized
aatttttgtttttatttcta

SEQ ID NO: 406621 - DNA, 20 bp, Artificial Sequence
  chemically synthesized
taatttttgtttttatttct

SEQ ID NO: 406622 - DNA, 20 bp, Artificial Sequence
  chemically synthesized
aataaaaacaaaaattaaaa

SEQ ID NO: 406623 - DNA, 20 bp, Artificial Sequence
  chemically synthesized
aatagattttttaaaagata

SEQ ID NO: 406624 - DNA, 20 bp, Artificial Sequence
  chemically synthesized
ttggaaaatagattttttaa

SEQ ID NO: 406625 - DNA, 20 bp, Artificial Sequence
  chemically synthesized
atttgtttccttttggaaaa

SEQ ID NO: 406626 - DNA, 20 bp, Artificial Sequence
  chemically synthesized
ttaaaaaatctattttccaa

SEQ ID NO: 406627 - DNA, 20 bp, Artificial Sequence
  chemically synthesized
taaaaaatctattttccaaa

SEQ ID NO: 406628 - DNA, 20 bp, Artificial Sequence
  chemically synthesized
ataattcatttgtttccttt

SEQ ID NO: 406629 - DNA, 20 bp, Artificial Sequence
  chemically synthesized
ttaagctatatggtaataat

SEQ ID NO: 406630 - DNA, 20 bp, Artificial Sequence
  chemically synthesized
tttgtcttattattaccata

SEQ ID NO: 406631 - DNA, 20 bp, Artificial Sequence
  chemically synthesized
taattgatttttaagctata

SEQ ID NO: 406632 - DNA, 20 bp, Artificial Sequence
  chemically synthesized
atttcaggtaattgattttt

SEQ ID NO: 406633 - DNA, 20 bp, Artificial Sequence
  chemically synthesized
atttgaatgataatgatttc

SEQ ID NO: 406634 - DNA, 20 bp, Artificial Sequence
  chemically synthesized
gatttgaatgataatgattt

SEQ ID NO: 406635 - DNA, 20 bp, Artificial Sequence
  chemically synthesized
atcattcaaatctttaaaac

SEQ ID NO: 406636 - DNA, 20 bp, Artificial Sequence
  chemically synthesized
tcattcaaatctttaaaaca

SEQ ID NO: 406637 - DNA, 20 bp, Artificial Sequence
  chemically synthesized
catttaagtgccttgtttta

SEQ ID NO: 406638 - DNA, 20 bp, Artificial Sequence
  chemically synthesized
ttaaaaaagattaaacattt

SEQ ID NO: 406639 - DNA, 20 bp, Artificial Sequence
  chemically synthesized
cattggctaagtttttaaaa

SEQ ID NO: 406640 - DNA, 20 bp, Artificial Sequence
  chemically synthesized
tttaatcttttttaaaaact

SEQ ID NO: 406641 - DNA, 20 bp, Artificial Sequence
  chemically synthesized
aaagcagttttgcattggct

SEQ ID NO: 406642 - DNA, 20 bp, Artificial Sequence
  chemically synthesized
ggaggaaagcagttttgcat

SEQ ID NO: 406643 - DNA, 20 bp, Artificial Sequence
  chemically synthesized
gagggcgttttggaggaaag

SEQ ID NO: 406644 - DNA, 20 bp, Artificial Sequence
  chemically synthesized
tctgagggcgttttggagga

SEQ ID NO: 406645 - DNA, 20 bp, Artificial Sequence
  chemically synthesized
taattctgagggcgttttgg

SEQ ID NO: 406646 - DNA, 20 bp, Artificial Sequence
  chemically synthesized
gtaattctgagggcgttttg

SEQ ID NO: 406647 - DNA, 20 bp, Artificial Sequence
  chemically synthesized
aggtaattctgagggcgttt

SEQ ID NO: 406648 - DNA, 20 bp, Artificial Sequence
  chemically synthesized
gctttcctccaaaacgccct

SEQ ID NO: 406649 - DNA, 20 bp, Artificial Sequence
  chemically synthesized
ggagaagcaggtaattctga

SEQ ID NO: 406650 - DNA, 20 bp, Artificial Sequence
  chemically synthesized
aggagaagcaggtaattctg

SEQ ID NO: 406651 - DNA, 20 bp, Artificial Sequence
  chemically synthesized
caggagaagcaggtaattct

SEQ ID NO: 406652 - DNA, 20 bp, Artificial Sequence
  chemically synthesized
actaagagtgcaggagaagc

SEQ ID NO: 406653 - DNA, 20 bp, Artificial Sequence
  chemically synthesized
tactaagagtgcaggagaag

SEQ ID NO: 406654 - DNA, 20 bp, Artificial Sequence
  chemically synthesized
ggatactaagagtgcaggag

SEQ ID NO: 406655 - DNA, 20 bp, Artificial Sequence
  chemically synthesized
tggggatactaagagtgcag

SEQ ID NO: 406656 - DNA, 20 bp, Artificial Sequence
  chemically synthesized
acctgcttctcctgcactct

SEQ ID NO: 406657 - DNA, 20 bp, Artificial Sequence
  chemically synthesized
cttggggatactaagagtgc

SEQ ID NO: 406658 - DNA, 20 bp, Artificial Sequence
  chemically synthesized
acttggggatactaagagtg

SEQ ID NO: 406659 - DNA, 20 bp, Artificial Sequence
  chemically synthesized
caataacttggggatactaa

SEQ ID NO: 406660 - DNA, 20 bp, Artificial Sequence
  chemically synthesized
gccaataacttggggatact

SEQ ID NO: 406661 - DNA, 20 bp, Artificial Sequence
  chemically synthesized
cctgcactcttagtatcccc

SEQ ID NO: 406662 - DNA, 20 bp, Artificial Sequence
  chemically synthesized
tattcactgccaataacttg

SEQ ID NO: 406663 - DNA, 20 bp, Artificial Sequence
  chemically synthesized
tcttagtatccccaagttat

SEQ ID NO: 406664 - DNA, 20 bp, Artificial Sequence
  chemically synthesized
ttattcactgccaataactt

SEQ ID NO: 406665 - DNA, 20 bp, Artificial Sequence
  chemically synthesized
tttattcactgccaataact

SEQ ID NO: 406666 - DNA, 20 bp, Artificial Sequence
  chemically synthesized
tagtatccccaagttattgg

SEQ ID NO: 406667 - DNA, 20 bp, Artificial Sequence
  chemically synthesized
aagttattggcagtgaataa

SEQ ID NO: 406668 - DNA, 20 bp, Artificial Sequence
  chemically synthesized
tggcagtgaataaaagtgta

SEQ ID NO: 406669 - DNA, 20 bp, Artificial Sequence
  chemically synthesized
ggcagtgaataaaagtgtaa

SEQ ID NO: 406670 - DNA, 20 bp, Artificial Sequence
  chemically synthesized
tgaaattcacagagaattgc

SEQ ID NO: 406671 - DNA, 20 bp, Artificial Sequence
  chemically synthesized
tttttggaatgaaattcaca

SEQ ID NO: 406672 - DNA, 20 bp, Artificial Sequence
  chemically synthesized
cttttttggaatgaaattca

SEQ ID NO: 406673 - DNA, 20 bp, Artificial Sequence
  chemically synthesized
ctgtgaatttcattccaaaa

SEQ ID NO: 406674 - DNA, 20 bp, Artificial Sequence
  chemically synthesized
aaatgcctaaaattcttttt

SEQ ID NO: 406675 - DNA, 20 bp, Artificial Sequence
  chemically synthesized
ttcattccaaaaaagaattt

SEQ ID NO: 406676 - DNA, 20 bp, Artificial Sequence
  chemically synthesized
tcattccaaaaaagaatttt

SEQ ID NO: 406677 - DNA, 20 bp, Artificial Sequence
  chemically synthesized
gaattttaggcattttgatg

SEQ ID NO: 406678 - DNA, 20 bp, Artificial Sequence
  chemically synthesized
ggcattttgatgaagcgatg

SEQ ID NO: 406679 - DNA, 20 bp, Artificial Sequence
  chemically synthesized
gcattttgatgaagcgatgt

SEQ ID NO: 406680 - DNA, 20 bp, Artificial Sequence
  chemically synthesized
cattttgatgaagcgatgta

SEQ ID NO: 406681 - DNA, 20 bp, Artificial Sequence
  chemically synthesized
tgatgaagcgatgtagggat

SEQ ID NO: 406682 - DNA, 20 bp, Artificial Sequence
  chemically synthesized
atgtagggattagttttaaa

SEQ ID NO: 406683 - DNA, 20 bp, Artificial Sequence
  chemically synthesized
tgtagggattagttttaaat

SEQ ID NO: 406684 - DNA, 20 bp, Artificial Sequence
  chemically synthesized
gtagggattagttttaaata

SEQ ID NO: 406685 - DNA, 20 bp, Artificial Sequence
  chemically synthesized
tgaaaataatacacaaatca

SEQ ID NO: 406686 - DNA, 20 bp, Artificial Sequence
  chemically synthesized
tgtgaaaataatacacaaat

SEQ ID NO: 406687 - DNA, 20 bp, Artificial Sequence
  chemically synthesized
aatcacttttggaagaaagt

SEQ ID NO: 406688 - DNA, 20 bp, Artificial Sequence
  chemically synthesized
ttcaaatcacttttggaaga

SEQ ID NO: 406689 - DNA, 20 bp, Artificial Sequence
  chemically synthesized
gtaaacttactttcttccaa

SEQ ID NO: 406690 - DNA, 20 bp, Artificial Sequence
  chemically synthesized
ttatttcaaatcacttttgg

SEQ ID NO: 406691 - DNA, 20 bp, Artificial Sequence
  chemically synthesized
tatttatttcaaatcacttt

SEQ ID NO: 406692 - DNA, 20 bp, Artificial Sequence
  chemically synthesized
tccattgatcttcagtgttt

SEQ ID NO: 406693 - DNA, 20 bp, Artificial Sequence
  chemically synthesized
ataaatattctgaaacactg

SEQ ID NO: 406694 - DNA, 20 bp, Artificial Sequence
  chemically synthesized
tcttagcttccattgatctt

SEQ ID NO: 406695 - DNA, 20 bp, Artificial Sequence
  chemically synthesized
tctgaaacactgaagatcaa

SEQ ID NO: 406696 - DNA, 20 bp, Artificial Sequence
  chemically synthesized
gaaacactgaagatcaatgg

SEQ ID NO: 406697 - DNA, 20 bp, Artificial Sequence
  chemically synthesized
actgaagatcaatggaagct

SEQ ID NO: 406698 - DNA, 20 bp, Artificial Sequence
  chemically synthesized
gatcaatggaagctaagaat

SEQ ID NO: 406699 - DNA, 20 bp, Artificial Sequence
  chemically synthesized
gtataagcatttctaattct

SEQ ID NO: 406700 - DNA, 20 bp, Artificial Sequence
  chemically synthesized
taggtttaatagatttgtat

SEQ ID NO: 406701 - DNA, 20 bp, Artificial Sequence
  chemically synthesized
atatatacagttaggtttaa

SEQ ID NO: 406702 - DNA, 20 bp, Artificial Sequence
  chemically synthesized
ttatatgcatatatacagtt

SEQ ID NO: 406703 - DNA, 20 bp, Artificial Sequence
  chemically synthesized
attatatgcatatatacagt

SEQ ID NO: 406704 - DNA, 20 bp, Artificial Sequence
  chemically synthesized
aaatattatatgcatatata

SEQ ID NO: 406705 - DNA, 20 bp, Artificial Sequence
  chemically synthesized
atgcatataatatttttgtt

SEQ ID NO: 406706 - DNA, 20 bp, Artificial Sequence
  chemically synthesized
aatatttttgttaagaaaca

SEQ ID NO: 406707 - DNA, 20 bp, Artificial Sequence
  chemically synthesized
ttaagaaacatagaattctt

SEQ ID NO: 406708 - DNA, 20 bp, Artificial Sequence
  chemically synthesized
tataaaattgaattattcta

SEQ ID NO: 406709 - DNA, 20 bp, Artificial Sequence
  chemically synthesized
aattcaattttatataatta

SEQ ID NO: 406710 - DNA, 20 bp, Artificial Sequence
  chemically synthesized
attttatataattatggata

SEQ ID NO: 406711 - DNA, 20 bp, Artificial Sequence
  chemically synthesized
taattatggatacagacaca

SEQ ID NO: 406712 - DNA, 20 bp, Artificial Sequence
  chemically synthesized
ttcacattgtaatgtttatt

SEQ ID NO: 406713 - DNA, 20 bp, Artificial Sequence
  chemically synthesized
gtgtttatttgttgattgtt

SEQ ID NO: 406714 - DNA, 20 bp, Artificial Sequence
  chemically synthesized
tgtttatttgttgattgttc

SEQ ID NO: 406715 - DNA, 20 bp, Artificial Sequence
  chemically synthesized
ttgttgattgttcaggcaaa

SEQ ID NO: 406716 - DNA, 20 bp, Artificial Sequence
  chemically synthesized
aggcaaacggaaactgcatt

SEQ ID NO: 406717 - DNA, 20 bp, Artificial Sequence
  chemically synthesized
gcaactgttgacaccaaatg

SEQ ID NO: 406718 - DNA, 20 bp, Artificial Sequence
  chemically synthesized
gaaactgcatttggtgtcaa

SEQ ID NO: 406719 - DNA, 20 bp, Artificial Sequence
  chemically synthesized
aaccagctaatataaatata

SEQ ID NO: 406720 - DNA, 20 bp, Artificial Sequence
  chemically synthesized
gcatttctttatatttatat

SEQ ID NO: 406721 - DNA, 20 bp, Artificial Sequence
  chemically synthesized
ttctttatatttatattagc

SEQ ID NO: 406722 - DNA, 20 bp, Artificial Sequence
  chemically synthesized
ttatatttatattagctggt

SEQ ID NO: 406723 - DNA, 20 bp, Artificial Sequence
  chemically synthesized
gttctgccagcacagctaac

SEQ ID NO: 406724 - DNA, 20 bp, Artificial Sequence
  chemically synthesized
tattagctggttagctgtgc

SEQ ID NO: 406725 - DNA, 20 bp, Artificial Sequence
  chemically synthesized
tagctggttagctgtgctgg

SEQ ID NO: 406726 - DNA, 20 bp, Artificial Sequence
  chemically synthesized
ttcctttagttctgccagca

SEQ ID NO: 406727 - DNA, 20 bp, Artificial Sequence
  chemically synthesized
caggtttcctttagttctgc

SEQ ID NO: 406728 - DNA, 20 bp, Artificial Sequence
  chemically synthesized
tagctgtgctggcagaacta

SEQ ID NO: 406729 - DNA, 20 bp, Artificial Sequence
  chemically synthesized
agctgtgctggcagaactaa

SEQ ID NO: 406730 - DNA, 20 bp, Artificial Sequence
  chemically synthesized
ctctatggacaggtttcctt

SEQ ID NO: 406731 - DNA, 20 bp, Artificial Sequence
  chemically synthesized
aactaaaggaaacctgtcca

SEQ ID NO: 406732 - DNA, 20 bp, Artificial Sequence
  chemically synthesized
ctaaaggaaacctgtccata

SEQ ID NO: 406733 - DNA, 20 bp, Artificial Sequence
  chemically synthesized
ctacgtaaggctctatggac

SEQ ID NO: 406734 - DNA, 20 bp, Artificial Sequence
  chemically synthesized
actacgtaaggctctatgga

SEQ ID NO: 406735 - DNA, 20 bp, Artificial Sequence
  chemically synthesized
tacgactacgtaaggctcta

SEQ ID NO: 406736 - DNA, 20 bp, Artificial Sequence
  chemically synthesized
cctgtccatagagccttacg

SEQ ID NO: 406737 - DNA, 20 bp, Artificial Sequence
  chemically synthesized
gttgtagttacgactacgta

SEQ ID NO: 406738 - DNA, 20 bp, Artificial Sequence
  chemically synthesized
tgttgtagttacgactacgt

SEQ ID NO: 406739 - DNA, 20 bp, Artificial Sequence
  chemically synthesized
tgtgacacatgattgtgttg

SEQ ID NO: 406740 - DNA, 20 bp, Artificial Sequence
  chemically synthesized
aatcatgtgtcacaaattta

SEQ ID NO: 406741 - DNA, 20 bp, Artificial Sequence
  chemically synthesized
tgtgtcacaaatttatagca

SEQ ID NO: 406742 - DNA, 20 bp, Artificial Sequence
  chemically synthesized
gtcacaaatttatagcacag

SEQ ID NO: 406743 - DNA, 20 bp, Artificial Sequence
  chemically synthesized
ctaaacaattttcagtgtaa

SEQ ID NO: 406744 - DNA, 20 bp, Artificial Sequence
  chemically synthesized
tctaaacaattttcagtgta

SEQ ID NO: 406745 - DNA, 20 bp, Artificial Sequence
  chemically synthesized
ttctttctctaaacaatttt

SEQ ID NO: 406746 - DNA, 20 bp, Artificial Sequence
  chemically synthesized
cctttacactgaaaattgtt

SEQ ID NO: 406747 - DNA, 20 bp, Artificial Sequence
  chemically synthesized
tttacactgaaaattgttta

SEQ ID NO: 406748 - DNA, 20 bp, Artificial Sequence
  chemically synthesized
cactgaaaattgtttagaga

SEQ ID NO: 406749 - DNA, 20 bp, Artificial Sequence
  chemically synthesized
tagagaaagaaaaattcgac

SEQ ID NO: 406750 - DNA, 20 bp, Artificial Sequence
  chemically synthesized
agagaaagaaaaattcgact

SEQ ID NO: 406751 - DNA, 20 bp, Artificial Sequence
  chemically synthesized
agaaagaaaaattcgactgg

SEQ ID NO: 406752 - DNA, 20 bp, Artificial Sequence
  chemically synthesized
aagaaaaattcgactgggag

SEQ ID NO: 406753 - DNA, 20 bp, Artificial Sequence
  chemically synthesized
aaaaattcgactgggagcgg

SEQ ID NO: 406754 - DNA, 20 bp, Artificial Sequence
  chemically synthesized
caagtgtgagccaccgctcc

SEQ ID NO: 406755 - DNA, 20 bp, Artificial Sequence
  chemically synthesized
agtgctgggattacaagtgt

SEQ ID NO: 406756 - DNA, 20 bp, Artificial Sequence
  chemically synthesized
gtggctcacacttgtaatcc

SEQ ID NO: 406757 - DNA, 20 bp, Artificial Sequence
  chemically synthesized
tcccaaagtgctgggattac

SEQ ID NO: 406758 - DNA, 20 bp, Artificial Sequence
  chemically synthesized
cacttgtaatcccagcactt

SEQ ID NO: 406759 - DNA, 20 bp, Artificial Sequence
  chemically synthesized
cctcggcctcccaaagtgct

SEQ ID NO: 406760 - DNA, 20 bp, Artificial Sequence
  chemically synthesized
acttgtaatcccagcacttt

SEQ ID NO: 406761 - DNA, 20 bp, Artificial Sequence
  chemically synthesized
gcctcggcctcccaaagtgc

SEQ ID NO: 406762 - DNA, 20 bp, Artificial Sequence
  chemically synthesized
ttgtaatcccagcactttgg

SEQ ID NO: 406763 - DNA, 20 bp, Artificial Sequence
  chemically synthesized
tgtaatcccagcactttggg

SEQ ID NO: 406764 - DNA, 20 bp, Artificial Sequence
  chemically synthesized
ccacccgcctcggcctccca

SEQ ID NO: 406765 - DNA, 20 bp, Artificial Sequence
  chemically synthesized
tcccagcactttgggaggcc

SEQ ID NO: 406766 - DNA, 20 bp, Artificial Sequence
  chemically synthesized
cccagcactttgggaggccg

SEQ ID NO: 406767 - DNA, 20 bp, Artificial Sequence
  chemically synthesized
agcactttgggaggccgagg

SEQ ID NO: 406768 - DNA, 20 bp, Artificial Sequence
  chemically synthesized
gcactttgggaggccgaggc

SEQ ID NO: 406769 - DNA, 20 bp, Artificial Sequence
  chemically synthesized
ctttgggaggccgaggcggg

SEQ ID NO: 406770 - DNA, 20 bp, Artificial Sequence
  chemically synthesized
ctcaggtgatccacccgcct

SEQ ID NO: 406771 - DNA, 20 bp, Artificial Sequence
  chemically synthesized
ccgaggcgggtggatcacct

SEQ ID NO: 406772 - DNA, 20 bp, Artificial Sequence
  chemically synthesized
cgaggcgggtggatcacctg

SEQ ID NO: 406773 - DNA, 20 bp, Artificial Sequence
  chemically synthesized
gcgggtggatcacctgaggt

SEQ ID NO: 406774 - DNA, 20 bp, Artificial Sequence
  chemically synthesized
cgggtggatcacctgaggtc

SEQ ID NO: 406775 - DNA, 20 bp, Artificial Sequence
  chemically synthesized
ggtcttgaactcctgacctc

SEQ ID NO: 406776 - DNA, 20 bp, Artificial Sequence
  chemically synthesized
ggtggatcacctgaggtcag

SEQ ID NO: 406777 - DNA, 20 bp, Artificial Sequence
  chemically synthesized
tggtcttgaactcctgacct

SEQ ID NO: 406778 - DNA, 20 bp, Artificial Sequence
  chemically synthesized
tcacctgaggtcaggagttc

SEQ ID NO: 406779 - DNA, 20 bp, Artificial Sequence
  chemically synthesized
tgaggtcaggagttcaagac

SEQ ID NO: 406780 - DNA, 20 bp, Artificial Sequence
  chemically synthesized
tttcaccatgttgggcacgc

SEQ ID NO: 406781 - DNA, 20 bp, Artificial Sequence
  chemically synthesized
caagaccagcgtgcccaaca

SEQ ID NO: 406782 - DNA, 20 bp, Artificial Sequence
  chemically synthesized
agacgggatttcaccatgtt

SEQ ID NO: 406783 - DNA, 20 bp, Artificial Sequence
  chemically synthesized
gagacgggatttcaccatgt

SEQ ID NO: 406784 - DNA, 20 bp, Artificial Sequence
  chemically synthesized
cttgtatttttagtagagac

SEQ ID NO: 406785 - DNA, 20 bp, Artificial Sequence
  chemically synthesized
tcttgtatttttagtagaga

SEQ ID NO: 406786 - DNA, 20 bp, Artificial Sequence
  chemically synthesized
tttttcttgtatttttagta

SEQ ID NO: 406787 - DNA, 20 bp, Artificial Sequence
  chemically synthesized
aatttttcttgtatttttag

SEQ ID NO: 406788 - DNA, 20 bp, Artificial Sequence
  chemically synthesized
cccgtctctactaaaaatac

SEQ ID NO: 406789 - DNA, 20 bp, Artificial Sequence
  chemically synthesized
gctaatttttcttgtatttt

SEQ ID NO: 406790 - DNA, 20 bp, Artificial Sequence
  chemically synthesized
actaaaaatacaagaaaaat

SEQ ID NO: 406791 - DNA, 20 bp, Artificial Sequence
  chemically synthesized
aaaatacaagaaaaattagc

SEQ ID NO: 406792 - DNA, 20 bp, Artificial Sequence
  chemically synthesized
aaatacaagaaaaattagct

SEQ ID NO: 406793 - DNA, 20 bp, Artificial Sequence
  chemically synthesized
caagaaaaattagctgggca

SEQ ID NO: 406794 - DNA, 20 bp, Artificial Sequence
  chemically synthesized
gaaaaattagctgggcatgg

SEQ ID NO: 406795 - DNA, 20 bp, Artificial Sequence
  chemically synthesized
caggtgcatgccaccatgcc

SEQ ID NO: 406796 - DNA, 20 bp, Artificial Sequence
  chemically synthesized
ggcatggtggcatgcacctg

SEQ ID NO: 406797 - DNA, 20 bp, Artificial Sequence
  chemically synthesized
gtggcatgcacctgtagtcc

SEQ ID NO: 406798 - DNA, 20 bp, Artificial Sequence
  chemically synthesized
tcccgaatagctaggactac

SEQ ID NO: 406799 - DNA, 20 bp, Artificial Sequence
  chemically synthesized
ctcccgaatagctaggacta

SEQ ID NO: 406800 - DNA, 20 bp, Artificial Sequence
  chemically synthesized
cacctgtagtcctagctatt

SEQ ID NO: 406801 - DNA, 20 bp, Artificial Sequence
  chemically synthesized
cctcagcctcccgaatagct

SEQ ID NO: 406802 - DNA, 20 bp, Artificial Sequence
  chemically synthesized
acctgtagtcctagctattc

SEQ ID NO: 406803 - DNA, 20 bp, Artificial Sequence
  chemically synthesized
ccctcagcctcccgaatagc

SEQ ID NO: 406804 - DNA, 20 bp, Artificial Sequence
  chemically synthesized
ctgtagtcctagctattcgg

SEQ ID NO: 406805 - DNA, 20 bp, Artificial Sequence
  chemically synthesized
tgtagtcctagctattcggg

SEQ ID NO: 406806 - DNA, 20 bp, Artificial Sequence
  chemically synthesized
cctgccctcagcctcccgaa

SEQ ID NO: 406807 - DNA, 20 bp, Artificial Sequence
  chemically synthesized
tcctagctattcgggaggct

SEQ ID NO: 406808 - DNA, 20 bp, Artificial Sequence
  chemically synthesized
cctagctattcgggaggctg

SEQ ID NO: 406809 - DNA, 20 bp, Artificial Sequence
  chemically synthesized
ctagctattcgggaggctga

SEQ ID NO: 406810 - DNA, 20 bp, Artificial Sequence
  chemically synthesized
gctattcgggaggctgaggg

SEQ ID NO: 406811 - DNA, 20 bp, Artificial Sequence
  chemically synthesized
ctattcgggaggctgagggc

SEQ ID NO: 406812 - DNA, 20 bp, Artificial Sequence
  chemically synthesized
attcgggaggctgagggcag

SEQ ID NO: 406813 - DNA, 20 bp, Artificial Sequence
  chemically synthesized
tcaagcgattctcctgccct

SEQ ID NO: 406814 - DNA, 20 bp, Artificial Sequence
  chemically synthesized
gcaggagaatcgcttgaacc

SEQ ID NO: 406815 - DNA, 20 bp, Artificial Sequence
  chemically synthesized
caggagaatcgcttgaaccc

SEQ ID NO: 406816 - DNA, 20 bp, Artificial Sequence
  chemically synthesized
aacctccacctcccgggttc

SEQ ID NO: 406817 - DNA, 20 bp, Artificial Sequence
  chemically synthesized
ggagaatcgcttgaacccgg

SEQ ID NO: 406818 - DNA, 20 bp, Artificial Sequence
  chemically synthesized
gagaatcgcttgaacccggg

SEQ ID NO: 406819 - DNA, 20 bp, Artificial Sequence
  chemically synthesized
aatcgcttgaacccgggagg

SEQ ID NO: 406820 - DNA, 20 bp, Artificial Sequence
  chemically synthesized
cactgcaacctccacctccc

SEQ ID NO: 406821 - DNA, 20 bp, Artificial Sequence
  chemically synthesized
tcgcttgaacccgggaggtg

SEQ ID NO: 406822 - DNA, 20 bp, Artificial Sequence
  chemically synthesized
tcactgcaacctccacctcc

SEQ ID NO: 406823 - DNA, 20 bp, Artificial Sequence
  chemically synthesized
cgcttgaacccgggaggtgg

SEQ ID NO: 406824 - DNA, 20 bp, Artificial Sequence
  chemically synthesized
aacccgggaggtggaggttg

SEQ ID NO: 406825 - DNA, 20 bp, Artificial Sequence
  chemically synthesized
cgggaggtggaggttgcagt

SEQ ID NO: 406826 - DNA, 20 bp, Artificial Sequence
  chemically synthesized
ggtggaggttgcagtgagcc

SEQ ID NO: 406827 - DNA, 20 bp, Artificial Sequence
  chemically synthesized
ggagtgcagtagcatgatct

SEQ ID NO: 406828 - DNA, 20 bp, Artificial Sequence
  chemically synthesized
tcagccaggctggagtgcag

SEQ ID NO: 406829 - DNA, 20 bp, Artificial Sequence
  chemically synthesized
gagatcatgctactgcactc

SEQ ID NO: 406830 - DNA, 20 bp, Artificial Sequence
  chemically synthesized
ctgtcagccaggctggagtg

SEQ ID NO: 406831 - DNA, 20 bp, Artificial Sequence
  chemically synthesized
catgctactgcactccagcc

SEQ ID NO: 406832 - DNA, 20 bp, Artificial Sequence
  chemically synthesized
tcgctctgtcagccaggctg

SEQ ID NO: 406833 - DNA, 20 bp, Artificial Sequence
  chemically synthesized
tctcgctctgtcagccaggc

SEQ ID NO: 406834 - DNA, 20 bp, Artificial Sequence
  chemically synthesized
ctgcactccagcctggctga

SEQ ID NO: 406835 - DNA, 20 bp, Artificial Sequence
  chemically synthesized
ggagtctcgctctgtcagcc

SEQ ID NO: 406836 - DNA, 20 bp, Artificial Sequence
  chemically synthesized
gcactccagcctggctgaca

SEQ ID NO: 406837 - DNA, 20 bp, Artificial Sequence
  chemically synthesized
gggagtctcgctctgtcagc

SEQ ID NO: 406838 - DNA, 20 bp, Artificial Sequence
  chemically synthesized
tccagcctggctgacagagc

SEQ ID NO: 406839 - DNA, 20 bp, Artificial Sequence
  chemically synthesized
gatggggagtctcgctctgt

SEQ ID NO: 406840 - DNA, 20 bp, Artificial Sequence
  chemically synthesized
tttttttttttttagatggg

SEQ ID NO: 406841 - DNA, 20 bp, Artificial Sequence
  chemically synthesized
tttttttttttttttagatg

SEQ ID NO: 406842 - DNA, 20 bp, Artificial Sequence
  chemically synthesized
ttttttttttttttttagat

SEQ ID NO: 406843 - DNA, 20 bp, Artificial Sequence
  chemically synthesized
tttttttttttttttttaga

SEQ ID NO: 406844 - DNA, 20 bp, Artificial Sequence
  chemically synthesized
tttttttttttttttttttt

SEQ ID NO: 406845 - DNA, 20 bp, Artificial Sequence
  chemically synthesized
aaaaaaaaaaaaaaaaaaaa

SEQ ID NO: 406846 - DNA, 20 bp, Artificial Sequence
  chemically synthesized
aaaaaaaaaaaaaaaaaaaa

SEQ ID NO: 406847 - DNA, 20 bp, Artificial Sequence
  chemically synthesized
aaaaaaaaaaaaaaaaaaag

SEQ ID NO: 406848 - DNA, 20 bp, Artificial Sequence
  chemically synthesized
aaaaaaaaaaaaaaaaagga

SEQ ID NO: 406849 - DNA, 20 bp, Artificial Sequence
  chemically synthesized
aaaaaaaaaaaaaaaggaga

SEQ ID NO: 406850 - DNA, 20 bp, Artificial Sequence
  chemically synthesized
aaaaaaaaaaaaaggagaga

SEQ ID NO: 406851 - DNA, 20 bp, Artificial Sequence
  chemically synthesized
aaaaaaaaaaaggagagaga

SEQ ID NO: 406852 - DNA, 20 bp, Artificial Sequence
  chemically synthesized
aaaaaaaggagagagagaga

SEQ ID NO: 406853 - DNA, 20 bp, Artificial Sequence
  chemically synthesized
aaaaaaggagagagagagaa

SEQ ID NO: 406854 - DNA, 20 bp, Artificial Sequence
  chemically synthesized
ccagttctcattcatttttc

SEQ ID NO: 406855 - DNA, 20 bp, Artificial Sequence
  chemically synthesized
ggaaaacttgaaaaatgaat

SEQ ID NO: 406856 - DNA, 20 bp, Artificial Sequence
  chemically synthesized
cttgaaaaatgaatgagaac

SEQ ID NO: 406857 - DNA, 20 bp, Artificial Sequence
  chemically synthesized
ctttccctgcagttgtttac

SEQ ID NO: 406858 - DNA, 20 bp, Artificial Sequence
  chemically synthesized
tgagaactggtaaacaactg

SEQ ID NO: 406859 - DNA, 20 bp, Artificial Sequence
  chemically synthesized
gagaactggtaaacaactgc

SEQ ID NO: 406860 - DNA, 20 bp, Artificial Sequence
  chemically synthesized
agaactggtaaacaactgca

SEQ ID NO: 406861 - DNA, 20 bp, Artificial Sequence
  chemically synthesized
ctggtaaacaactgcaggga

SEQ ID NO: 406862 - DNA, 20 bp, Artificial Sequence
  chemically synthesized
tgtggtaattactttccctg

SEQ ID NO: 406863 - DNA, 20 bp, Artificial Sequence
  chemically synthesized
agtttgccatatgaagagtg

SEQ ID NO: 406864 - DNA, 20 bp, Artificial Sequence
  chemically synthesized
taattaccacactcttcata

SEQ ID NO: 406865 - DNA, 20 bp, Artificial Sequence
  chemically synthesized
tctttagtttgccatatgaa

SEQ ID NO: 406866 - DNA, 20 bp, Artificial Sequence
  chemically synthesized
tttctttagtttgccatatg

SEQ ID NO: 406867 - DNA, 20 bp, Artificial Sequence
  chemically synthesized
actcttcatatggcaaacta

SEQ ID NO: 406868 - DNA, 20 bp, Artificial Sequence
  chemically synthesized
ttcatatggcaaactaaaga

SEQ ID NO: 406869 - DNA, 20 bp, Artificial Sequence
  chemically synthesized
tcatatggcaaactaaagaa

SEQ ID NO: 406870 - DNA, 20 bp, Artificial Sequence
  chemically synthesized
catatggcaaactaaagaaa

SEQ ID NO: 406871 - DNA, 20 bp, Artificial Sequence
  chemically synthesized
atatggcaaactaaagaaag

SEQ ID NO: 406872 - DNA, 20 bp, Artificial Sequence
  chemically synthesized
cttgcggtgccccctttctt

SEQ ID NO: 406873 - DNA, 20 bp, Artificial Sequence
  chemically synthesized
tatggcaaactaaagaaagg

SEQ ID NO: 406874 - DNA, 20 bp, Artificial Sequence
  chemically synthesized
ctaaagaaagggggcaccgc

SEQ ID NO: 406875 - DNA, 20 bp, Artificial Sequence
  chemically synthesized
gaaagggggcaccgcaagaa

SEQ ID NO: 406876 - DNA, 20 bp, Artificial Sequence
  chemically synthesized
ctctggcaatacttttcttg

SEQ ID NO: 406877 - DNA, 20 bp, Artificial Sequence
  chemically synthesized
caccgcaagaaaagtattgc

SEQ ID NO: 406878 - DNA, 20 bp, Artificial Sequence
  chemically synthesized
ccgcaagaaaagtattgcca

SEQ ID NO: 406879 - DNA, 20 bp, Artificial Sequence
  chemically synthesized
aaaagtattgccagagcttg

SEQ ID NO: 406880 - DNA, 20 bp, Artificial Sequence
  chemically synthesized
acattctgcccttcaagctc

SEQ ID NO: 406881 - DNA, 20 bp, Artificial Sequence
  chemically synthesized
aaagtattgccagagcttga

SEQ ID NO: 406882 - DNA, 20 bp, Artificial Sequence
  chemically synthesized
aagtattgccagagcttgaa

SEQ ID NO: 406883 - DNA, 20 bp, Artificial Sequence
  chemically synthesized
tattgccagagcttgaaggg

SEQ ID NO: 406884 - DNA, 20 bp, Artificial Sequence
  chemically synthesized
aattacacattctgcccttc

SEQ ID NO: 406885 - DNA, 20 bp, Artificial Sequence
  chemically synthesized
tgaagggcagaatgtgtaat

SEQ ID NO: 406886 - DNA, 20 bp, Artificial Sequence
  chemically synthesized
gaagggcagaatgtgtaatt

SEQ ID NO: 406887 - DNA, 20 bp, Artificial Sequence
  chemically synthesized
tgtaattaggatgtgatatc

SEQ ID NO: 406888 - DNA, 20 bp, Artificial Sequence
  chemically synthesized
aattaggatgtgatatctgg

SEQ ID NO: 406889 - DNA, 20 bp, Artificial Sequence
  chemically synthesized
taggatgtgatatctggcag

SEQ ID NO: 406890 - DNA, 20 bp, Artificial Sequence
  chemically synthesized
atgattggaatcaccactgc

SEQ ID NO: 406891 - DNA, 20 bp, Artificial Sequence
  chemically synthesized
gcagtggtgattccaatcat

SEQ ID NO: 406892 - DNA, 20 bp, Artificial Sequence
  chemically synthesized
cagtggtgattccaatcatt

SEQ ID NO: 406893 - DNA, 20 bp, Artificial Sequence
  chemically synthesized
agtggtgattccaatcattg

SEQ ID NO: 406894 - DNA, 20 bp, Artificial Sequence
  chemically synthesized
cagttttaatccccaatgat

SEQ ID NO: 406895 - DNA, 20 bp, Artificial Sequence
  chemically synthesized
aaagagcacaagttgagata

SEQ ID NO: 406896 - DNA, 20 bp, Artificial Sequence
  chemically synthesized
caacagaaagagcacaagtt

SEQ ID NO: 406897 - DNA, 20 bp, Artificial Sequence
  chemically synthesized
taaagcaacagaaagagcac

SEQ ID NO: 406898 - DNA, 20 bp, Artificial Sequence
  chemically synthesized
tggccctaaagcaacagaaa

SEQ ID NO: 406899 - DNA, 20 bp, Artificial Sequence
  chemically synthesized
actggccctaaagcaacaga

SEQ ID NO: 406900 - DNA, 20 bp, Artificial Sequence
  chemically synthesized
ttgtgctctttctgttgctt

SEQ ID NO: 406901 - DNA, 20 bp, Artificial Sequence
  chemically synthesized
tgtgctctttctgttgcttt

SEQ ID NO: 406902 - DNA, 20 bp, Artificial Sequence
  chemically synthesized
atacactggccctaaagcaa

SEQ ID NO: 406903 - DNA, 20 bp, Artificial Sequence
  chemically synthesized
gtgctctttctgttgcttta

SEQ ID NO: 406904 - DNA, 20 bp, Artificial Sequence
  chemically synthesized
tctttctgttgctttagggc

SEQ ID NO: 406905 - DNA, 20 bp, Artificial Sequence
  chemically synthesized
gagtgaatacactggcccta

SEQ ID NO: 406906 - DNA, 20 bp, Artificial Sequence
  chemically synthesized
ggaagattgagtgaatacac

SEQ ID NO: 406907 - DNA, 20 bp, Artificial Sequence
  chemically synthesized
tatagatatcatggaagatt

SEQ ID NO: 406908 - DNA, 20 bp, Artificial Sequence
  chemically synthesized
agtccatatagatatcatgg

SEQ ID NO: 406909 - DNA, 20 bp, Artificial Sequence
  chemically synthesized
gtgagtccatatagatatca

SEQ ID NO: 406910 - DNA, 20 bp, Artificial Sequence
  chemically synthesized
aatcttccatgatatctata

SEQ ID NO: 406911 - DNA, 20 bp, Artificial Sequence
  chemically synthesized
tgaggttcagtgagtccata

SEQ ID NO: 406912 - DNA, 20 bp, Artificial Sequence
  chemically synthesized
gttaagatctgaggttcagt

SEQ ID NO: 406913 - DNA, 20 bp, Artificial Sequence
  chemically synthesized
tatatggactcactgaacct

SEQ ID NO: 406914 - DNA, 20 bp, Artificial Sequence
  chemically synthesized
tgaagttaagatctgaggtt

SEQ ID NO: 406915 - DNA, 20 bp, Artificial Sequence
  chemically synthesized
tcaactgaagttaagatctg

SEQ ID NO: 406916 - DNA, 20 bp, Artificial Sequence
  chemically synthesized
ctcaactgaagttaagatct

SEQ ID NO: 406917 - DNA, 20 bp, Artificial Sequence
  chemically synthesized
tgaacctcagatcttaactt

SEQ ID NO: 406918 - DNA, 20 bp, Artificial Sequence
  chemically synthesized
agttctgctcaactgaagtt

SEQ ID NO: 406919 - DNA, 20 bp, Artificial Sequence
  chemically synthesized
ctcagatcttaacttcagtt

SEQ ID NO: 406920 - DNA, 20 bp, Artificial Sequence
  chemically synthesized
agactagttctgctcaactg

SEQ ID NO: 406921 - DNA, 20 bp, Artificial Sequence
  chemically synthesized
agatcttaacttcagttgag

SEQ ID NO: 406922 - DNA, 20 bp, Artificial Sequence
  chemically synthesized
taacttcagttgagcagaac

SEQ ID NO: 406923 - DNA, 20 bp, Artificial Sequence
  chemically synthesized
tggtctgagagagagaagac

SEQ ID NO: 406924 - DNA, 20 bp, Artificial Sequence
  chemically synthesized
ttccttggtctgagagagag

SEQ ID NO: 406925 - DNA, 20 bp, Artificial Sequence
  chemically synthesized
agaactagtcttctctctct

SEQ ID NO: 406926 - DNA, 20 bp, Artificial Sequence
  chemically synthesized
gccttccttggtctgagaga

SEQ ID NO: 406927 - DNA, 20 bp, Artificial Sequence
  chemically synthesized
atgccttccttggtctgaga

SEQ ID NO: 406928 - DNA, 20 bp, Artificial Sequence
  chemically synthesized
agtcttctctctctcagacc

SEQ ID NO: 406929 - DNA, 20 bp, Artificial Sequence
  chemically synthesized
ttatgccttccttggtctga

SEQ ID NO: 406930 - DNA, 20 bp, Artificial Sequence
  chemically synthesized
gtcttctctctctcagacca

SEQ ID NO: 406931 - DNA, 20 bp, Artificial Sequence
  chemically synthesized
agttatgccttccttggtct

SEQ ID NO: 406932 - DNA, 20 bp, Artificial Sequence
  chemically synthesized
ttctctctctcagaccaagg

SEQ ID NO: 406933 - DNA, 20 bp, Artificial Sequence
  chemically synthesized
tctctctctcagaccaagga

SEQ ID NO: 406934 - DNA, 20 bp, Artificial Sequence
  chemically synthesized
aacacaagttatgccttcct

SEQ ID NO: 406935 - DNA, 20 bp, Artificial Sequence
  chemically synthesized
cagtaggcttcatggaacac

SEQ ID NO: 406936 - DNA, 20 bp, Artificial Sequence
  chemically synthesized
ggcataacttgtgttccatg

SEQ ID NO: 406937 - DNA, 20 bp, Artificial Sequence
  chemically synthesized
acttgacacagtaggcttca

SEQ ID NO: 406938 - DNA, 20 bp, Artificial Sequence
  chemically synthesized
tttggcagacttgacacagt

SEQ ID NO: 406939 - DNA, 20 bp, Artificial Sequence
  chemically synthesized
tccatgaagcctactgtgtc

SEQ ID NO: 406940 - DNA, 20 bp, Artificial Sequence
  chemically synthesized
atttggcagacttgacacag

SEQ ID NO: 406941 - DNA, 20 bp, Artificial Sequence
  chemically synthesized
ttcatttggcagacttgaca

SEQ ID NO: 406942 - DNA, 20 bp, Artificial Sequence
  chemically synthesized
atatttaaagtttcatttgg

SEQ ID NO: 406943 - DNA, 20 bp, Artificial Sequence
  chemically synthesized
tacatatttaaagtttcatt

SEQ ID NO: 406944 - DNA, 20 bp, Artificial Sequence
  chemically synthesized
agacaatgcctacatattta

SEQ ID NO: 406945 - DNA, 20 bp, Artificial Sequence
  chemically synthesized
caaatgaaactttaaatatg

SEQ ID NO: 406946 - DNA, 20 bp, Artificial Sequence
  chemically synthesized
aaatgaaactttaaatatgt

SEQ ID NO: 406947 - DNA, 20 bp, Artificial Sequence
  chemically synthesized
atatgtaggcattgtctact

SEQ ID NO: 406948 - DNA, 20 bp, Artificial Sequence
  chemically synthesized
tttttagtgttcaggctaag

SEQ ID NO: 406949 - DNA, 20 bp, Artificial Sequence
  chemically synthesized
ctctttttagtgttcaggct

SEQ ID NO: 406950 - DNA, 20 bp, Artificial Sequence
  chemically synthesized
aaggactctttttagtgttc

SEQ ID NO: 406951 - DNA, 20 bp, Artificial Sequence
  chemically synthesized
aaaggactctttttagtgtt

SEQ ID NO: 406952 - DNA, 20 bp, Artificial Sequence
  chemically synthesized
tacttagcctgaacactaaa

SEQ ID NO: 406953 - DNA, 20 bp, Artificial Sequence
  chemically synthesized
cttagcctgaacactaaaaa

SEQ ID NO: 406954 - DNA, 20 bp, Artificial Sequence
  chemically synthesized
actgtagaaaggactctttt

SEQ ID NO: 406955 - DNA, 20 bp, Artificial Sequence
  chemically synthesized
actaaaaagagtcctttcta

SEQ ID NO: 406956 - DNA, 20 bp, Artificial Sequence
  chemically synthesized
aatccttgggaactgtagaa

SEQ ID NO: 406957 - DNA, 20 bp, Artificial Sequence
  chemically synthesized
aaatccttgggaactgtaga

SEQ ID NO: 406958 - DNA, 20 bp, Artificial Sequence
  chemically synthesized
aaacaaatccttgggaactg

SEQ ID NO: 406959 - DNA, 20 bp, Artificial Sequence
  chemically synthesized
gagtcctttctacagttccc

SEQ ID NO: 406960 - DNA, 20 bp, Artificial Sequence
  chemically synthesized
agtcctttctacagttccca

SEQ ID NO: 406961 - DNA, 20 bp, Artificial Sequence
  chemically synthesized
ttgcaaccaaacaaatcctt

SEQ ID NO: 406962 - DNA, 20 bp, Artificial Sequence
  chemically synthesized
attgcaaccaaacaaatcct

SEQ ID NO: 406963 - DNA, 20 bp, Artificial Sequence
  chemically synthesized
acagttcccaaggatttgtt

SEQ ID NO: 406964 - DNA, 20 bp, Artificial Sequence
  chemically synthesized
gtttggttgcaatgtttcta

SEQ ID NO: 406965 - DNA, 20 bp, Artificial Sequence
  chemically synthesized
ggttgcaatgtttctaaagt

SEQ ID NO: 406966 - DNA, 20 bp, Artificial Sequence
  chemically synthesized
ggaagtttctgtactgactt

SEQ ID NO: 406967 - DNA, 20 bp, Artificial Sequence
  chemically synthesized
caatgtttctaaagtcagta

SEQ ID NO: 406968 - DNA, 20 bp, Artificial Sequence
  chemically synthesized
ttggagctccattttcaggg

SEQ ID NO: 406969 - DNA, 20 bp, Artificial Sequence
  chemically synthesized
tacagaaacttccctgaaaa

SEQ ID NO: 406970 - DNA, 20 bp, Artificial Sequence
  chemically synthesized
agtttggagctccattttca

SEQ ID NO: 406971 - DNA, 20 bp, Artificial Sequence
  chemically synthesized
cagaaacttccctgaaaatg

SEQ ID NO: 406972 - DNA, 20 bp, Artificial Sequence
  chemically synthesized
aagtttggagctccattttc

SEQ ID NO: 406973 - DNA, 20 bp, Artificial Sequence
  chemically synthesized
taagtttggagctccatttt

SEQ ID NO: 406974 - DNA, 20 bp, Artificial Sequence
  chemically synthesized
tgaaaatcgtgataagtttg

SEQ ID NO: 406975 - DNA, 20 bp, Artificial Sequence
  chemically synthesized
gatgaaaatcgtgataagtt

SEQ ID NO: 406976 - DNA, 20 bp, Artificial Sequence
  chemically synthesized
tccaggatgaaaatcgtgat

SEQ ID NO: 406977 - DNA, 20 bp, Artificial Sequence
  chemically synthesized
acttatcacgattttcatcc

SEQ ID NO: 406978 - DNA, 20 bp, Artificial Sequence
  chemically synthesized
tacaaacctaaatacattcc

SEQ ID NO: 406979 - DNA, 20 bp, Artificial Sequence
  chemically synthesized
atacaaacctaaatacattc

SEQ ID NO: 406980 - DNA, 20 bp, Artificial Sequence
  chemically synthesized
ttttcatcctggaatgtatt

SEQ ID NO: 406981 - DNA, 20 bp, Artificial Sequence
  chemically synthesized
tttcatcctggaatgtattt

SEQ ID NO: 406982 - DNA, 20 bp, Artificial Sequence
  chemically synthesized
aattgagtggtgcacgtcga

SEQ ID NO: 406983 - DNA, 20 bp, Artificial Sequence
  chemically synthesized
caattgagtggtgcacgtcg

SEQ ID NO: 406984 - DNA, 20 bp, Artificial Sequence
  chemically synthesized
tcaattgagtggtgcacgtc

SEQ ID NO: 406985 - DNA, 20 bp, Artificial Sequence
  chemically synthesized
agtatgtgacgtcaattgag

SEQ ID NO: 406986 - DNA, 20 bp, Artificial Sequence
  chemically synthesized
aaaagtatgtgacgtcaatt

SEQ ID NO: 406987 - DNA, 20 bp, Artificial Sequence
  chemically synthesized
tgaaataaatttcaggtaaa

SEQ ID NO: 406988 - DNA, 20 bp, Artificial Sequence
  chemically synthesized
gagaaactgaaataaatttc

SEQ ID NO: 406989 - DNA, 20 bp, Artificial Sequence
  chemically synthesized
tgagaaactgaaataaattt

SEQ ID NO: 406990 - DNA, 20 bp, Artificial Sequence
  chemically synthesized
tttttacctgaaatttattt

SEQ ID NO: 406991 - DNA, 20 bp, Artificial Sequence
  chemically synthesized
tgaaatttatttcagtttct

SEQ ID NO: 406992 - DNA, 20 bp, Artificial Sequence
  chemically synthesized
aatttatttcagtttctcag

SEQ ID NO: 406993 - DNA, 20 bp, Artificial Sequence
  chemically synthesized
ggggaaatatacagtcttct

SEQ ID NO: 406994 - DNA, 20 bp, Artificial Sequence
  chemically synthesized
tctgtaactggggaaatata

SEQ ID NO: 406995 - DNA, 20 bp, Artificial Sequence
  chemically synthesized
cagaagactgtatatttccc

SEQ ID NO: 406996 - DNA, 20 bp, Artificial Sequence
  chemically synthesized
actgtatatttccccagtta

SEQ ID NO: 406997 - DNA, 20 bp, Artificial Sequence
  chemically synthesized
aatagtaaaatctgtaactg

SEQ ID NO: 406998 - DNA, 20 bp, Artificial Sequence
  chemically synthesized
gaatagtaaaatctgtaact

SEQ ID NO: 406999 - DNA, 20 bp, Artificial Sequence
  chemically synthesized
ggaatagtaaaatctgtaac

SEQ ID NO: 407000 - DNA, 20 bp, Artificial Sequence
  chemically synthesized
cagccaccatatttaaggaa

SEQ ID NO: 407001 - DNA, 20 bp, Artificial Sequence
  chemically synthesized
attttactattccttaaata

SEQ ID NO: 407002 - DNA, 20 bp, Artificial Sequence
  chemically synthesized
agtggcagccaccatattta

SEQ ID NO: 407003 - DNA, 20 bp, Artificial Sequence
  chemically synthesized
aagtggcagccaccatattt

SEQ ID NO: 407004 - DNA, 20 bp, Artificial Sequence
  chemically synthesized
ttactattccttaaatatgg

SEQ ID NO: 407005 - DNA, 20 bp, Artificial Sequence
  chemically synthesized
actgtaggttaagaaagtgg

SEQ ID NO: 407006 - DNA, 20 bp, Artificial Sequence
  chemically synthesized
aatactgtaggttaagaaag

SEQ ID NO: 407007 - DNA, 20 bp, Artificial Sequence
  chemically synthesized
attaatactgtaggttaaga

SEQ ID NO: 407008 - DNA, 20 bp, Artificial Sequence
  chemically synthesized
gctgccactttcttaaccta

SEQ ID NO: 407009 - DNA, 20 bp, Artificial Sequence
  chemically synthesized
tgccattaatactgtaggtt

SEQ ID NO: 407010 - DNA, 20 bp, Artificial Sequence
  chemically synthesized
atttctgccattaatactgt

SEQ ID NO: 407011 - DNA, 20 bp, Artificial Sequence
  chemically synthesized
catttctgccattaatactg

SEQ ID NO: 407012 - DNA, 20 bp, Artificial Sequence
  chemically synthesized
ttcttaacctacagtattaa

SEQ ID NO: 407013 - DNA, 20 bp, Artificial Sequence
  chemically synthesized
ttaacctacagtattaatgg

SEQ ID NO: 407014 - DNA, 20 bp, Artificial Sequence
  chemically synthesized
gtattaatggcagaaatgct

SEQ ID NO: 407015 - DNA, 20 bp, Artificial Sequence
  chemically synthesized
tgtttgccttttataaatct

SEQ ID NO: 407016 - DNA, 20 bp, Artificial Sequence
  chemically synthesized
agaaatgcttagatttataa

SEQ ID NO: 407017 - DNA, 20 bp, Artificial Sequence
  chemically synthesized
gaaatgcttagatttataaa

SEQ ID NO: 407018 - DNA, 20 bp, Artificial Sequence
  chemically synthesized
agatttataaaaggcaaaca

SEQ ID NO: 407019 - DNA, 20 bp, Artificial Sequence
  chemically synthesized
gatttataaaaggcaaacat

SEQ ID NO: 407020 - DNA, 20 bp, Artificial Sequence
  chemically synthesized
atttataaaaggcaaacatg

SEQ ID NO: 407021 - DNA, 20 bp, Artificial Sequence
  chemically synthesized
taaaaggcaaacatggggaa

SEQ ID NO: 407022 - DNA, 20 bp, Artificial Sequence
  chemically synthesized
aaaggcaaacatggggaaaa

SEQ ID NO: 407023 - DNA, 20 bp, Artificial Sequence
  chemically synthesized
aggcaaacatggggaaaaga

SEQ ID NO: 407024 - DNA, 20 bp, Artificial Sequence
  chemically synthesized
agagagacaatattaaattc

SEQ ID NO: 407025 - DNA, 20 bp, Artificial Sequence
  chemically synthesized
attaaattcaagtctctcga

SEQ ID NO: 407026 - DNA, 20 bp, Artificial Sequence
  chemically synthesized
ttaaattcaagtctctcgaa

SEQ ID NO: 407027 - DNA, 20 bp, Artificial Sequence
  chemically synthesized
atcttttcctttcctttcga

SEQ ID NO: 407028 - DNA, 20 bp, Artificial Sequence
  chemically synthesized
attcaagtctctcgaaagga

SEQ ID NO: 407029 - DNA, 20 bp, Artificial Sequence
  chemically synthesized
ttatcttttcctttcctttc

SEQ ID NO: 407030 - DNA, 20 bp, Artificial Sequence
  chemically synthesized
ttcaagtctctcgaaaggaa

SEQ ID NO: 407031 - DNA, 20 bp, Artificial Sequence
  chemically synthesized
gtctctcgaaaggaaaggaa

SEQ ID NO: 407032 - DNA, 20 bp, Artificial Sequence
  chemically synthesized
gaaaggaaaagataatgaaa

SEQ ID NO: 407033 - DNA, 20 bp, Artificial Sequence
  chemically synthesized
gaaaaagcaatgtaaaaaat

SEQ ID NO: 407034 - DNA, 20 bp, Artificial Sequence
  chemically synthesized
aaaagcaatgtaaaaaatga

SEQ ID NO: 407035 - DNA, 20 bp, Artificial Sequence
  chemically synthesized
gcaatgtaaaaaatgagaga

SEQ ID NO: 407036 - DNA, 20 bp, Artificial Sequence
  chemically synthesized
caatgtaaaaaatgagagat

SEQ ID NO: 407037 - DNA, 20 bp, Artificial Sequence
  chemically synthesized
tgtaaaaaatgagagatagg

SEQ ID NO: 407038 - DNA, 20 bp, Artificial Sequence
  chemically synthesized
gtaaaaaatgagagataggt

SEQ ID NO: 407039 - DNA, 20 bp, Artificial Sequence
  chemically synthesized
taaaaaatgagagataggtg

SEQ ID NO: 407040 - DNA, 20 bp, Artificial Sequence
  chemically synthesized
aaaatgagagataggtgggg

SEQ ID NO: 407041 - DNA, 20 bp, Artificial Sequence
  chemically synthesized
aaatgagagataggtggggc

SEQ ID NO: 407042 - DNA, 20 bp, Artificial Sequence
  chemically synthesized
gagataggtggggcaggttt

SEQ ID NO: 407043 - DNA, 20 bp, Artificial Sequence
  chemically synthesized
cagtctatgcagagattcaa

SEQ ID NO: 407044 - DNA, 20 bp, Artificial Sequence
  chemically synthesized
gatgccattgaatctctgca

SEQ ID NO: 407045 - DNA, 20 bp, Artificial Sequence
  chemically synthesized
aaaaaaaggcagtctatgca

SEQ ID NO: 407046 - DNA, 20 bp, Artificial Sequence
  chemically synthesized
aaaaaaaaaggcagtctatg

SEQ ID NO: 407047 - DNA, 20 bp, Artificial Sequence
  chemically synthesized
atttagagcaaaaaaaaagg

SEQ ID NO: 407048 - DNA, 20 bp, Artificial Sequence
  chemically synthesized
agtatttagagcaaaaaaaa

SEQ ID NO: 407049 - DNA, 20 bp, Artificial Sequence
  chemically synthesized
tagtatttagagcaaaaaaa

SEQ ID NO: 407050 - DNA, 20 bp, Artificial Sequence
  chemically synthesized
ttaggcaagtttagtattta

SEQ ID NO: 407051 - DNA, 20 bp, Artificial Sequence
  chemically synthesized
atttaggcaagtttagtatt

SEQ ID NO: 407052 - DNA, 20 bp, Artificial Sequence
  chemically synthesized
tggcctaatttaggcaagtt

SEQ ID NO: 407053 - DNA, 20 bp, Artificial Sequence
  chemically synthesized
ggaggtggcctaatttaggc

SEQ ID NO: 407054 - DNA, 20 bp, Artificial Sequence
  chemically synthesized
aatactaaacttgcctaaat

SEQ ID NO: 407055 - DNA, 20 bp, Artificial Sequence
  chemically synthesized
atactaaacttgcctaaatt

SEQ ID NO: 407056 - DNA, 20 bp, Artificial Sequence
  chemically synthesized
ggagggaggtggcctaattt

SEQ ID NO: 407057 - DNA, 20 bp, Artificial Sequence
  chemically synthesized
tggagggaggtggcctaatt

SEQ ID NO: 407058 - DNA, 20 bp, Artificial Sequence
  chemically synthesized
ttttgttctctggagggagg

SEQ ID NO: 407059 - DNA, 20 bp, Artificial Sequence
  chemically synthesized
taaattaggccacctccctc

SEQ ID NO: 407060 - DNA, 20 bp, Artificial Sequence
  chemically synthesized
aattaggccacctccctcca

SEQ ID NO: 407061 - DNA, 20 bp, Artificial Sequence
  chemically synthesized
tccttttgttctctggaggg

SEQ ID NO: 407062 - DNA, 20 bp, Artificial Sequence
  chemically synthesized
ttccttttgttctctggagg

SEQ ID NO: 407063 - DNA, 20 bp, Artificial Sequence
  chemically synthesized
gtttccttttgttctctgga

SEQ ID NO: 407064 - DNA, 20 bp, Artificial Sequence
  chemically synthesized
agtttccttttgttctctgg

SEQ ID NO: 407065 - DNA, 20 bp, Artificial Sequence
  chemically synthesized
aagtttccttttgttctctg

SEQ ID NO: 407066 - DNA, 20 bp, Artificial Sequence
  chemically synthesized
ccaagtttccttttgttctc

SEQ ID NO: 407067 - DNA, 20 bp, Artificial Sequence
  chemically synthesized
cacctccctccagagaacaa

SEQ ID NO: 407068 - DNA, 20 bp, Artificial Sequence
  chemically synthesized
acctccctccagagaacaaa

SEQ ID NO: 407069 - DNA, 20 bp, Artificial Sequence
  chemically synthesized
ccagagaacaaaaggaaact

SEQ ID NO: 407070 - DNA, 20 bp, Artificial Sequence
  chemically synthesized
ggtactattccatagtggcc

SEQ ID NO: 407071 - DNA, 20 bp, Artificial Sequence
  chemically synthesized
aaaaggaaacttggccacta

SEQ ID NO: 407072 - DNA, 20 bp, Artificial Sequence
  chemically synthesized
actttggtactattccatag

SEQ ID NO: 407073 - DNA, 20 bp, Artificial Sequence
  chemically synthesized
gaaacttggccactatggaa

SEQ ID NO: 407074 - DNA, 20 bp, Artificial Sequence
  chemically synthesized
ttcactttggtactattcca

SEQ ID NO: 407075 - DNA, 20 bp, Artificial Sequence
  chemically synthesized
gccactatggaatagtacca

SEQ ID NO: 407076 - DNA, 20 bp, Artificial Sequence
  chemically synthesized
tagcttctaaaaattcactt

SEQ ID NO: 407077 - DNA, 20 bp, Artificial Sequence
  chemically synthesized
atagtaccaaagtgaatttt

SEQ ID NO: 407078 - DNA, 20 bp, Artificial Sequence
  chemically synthesized
gtaccaaagtgaatttttag

SEQ ID NO: 407079 - DNA, 20 bp, Artificial Sequence
  chemically synthesized
agattatgagtgggtaataa

SEQ ID NO: 407080 - DNA, 20 bp, Artificial Sequence
  chemically synthesized
caaaaatatagattatgagt

SEQ ID NO: 407081 - DNA, 20 bp, Artificial Sequence
  chemically synthesized
tcaaaaatatagattatgag

SEQ ID NO: 407082 - DNA, 20 bp, Artificial Sequence
  chemically synthesized
ttttcaaaaatatagattat

SEQ ID NO: 407083 - DNA, 20 bp, Artificial Sequence
  chemically synthesized
tatattaattttcaaaaata

SEQ ID NO: 407084 - DNA, 20 bp, Artificial Sequence
  chemically synthesized
taattatcaatattaatacg

SEQ ID NO: 407085 - DNA, 20 bp, Artificial Sequence
  chemically synthesized
tcaatattaatacgaagcaa

SEQ ID NO: 407086 - DNA, 20 bp, Artificial Sequence
  chemically synthesized
caatattaatacgaagcaat

SEQ ID NO: 407087 - DNA, 20 bp, Artificial Sequence
  chemically synthesized
aatattaatacgaagcaata

SEQ ID NO: 407088 - DNA, 20 bp, Artificial Sequence
  chemically synthesized
caatagggtcaacatgaact

SEQ ID NO: 407089 - DNA, 20 bp, Artificial Sequence
  chemically synthesized
tgaacttaacagaagtatcc

SEQ ID NO: 407090 - DNA, 20 bp, Artificial Sequence
  chemically synthesized
tgaacttggatacttctgtt

SEQ ID NO: 407091 - DNA, 20 bp, Artificial Sequence
  chemically synthesized
tatttaagtgaacttaacag

SEQ ID NO: 407092 - DNA, 20 bp, Artificial Sequence
  chemically synthesized
caatatttaagtgaacttaa

SEQ ID NO: 407093 - DNA, 20 bp, Artificial Sequence
  chemically synthesized
attagattagttcaatattt

SEQ ID NO: 407094 - DNA, 20 bp, Artificial Sequence
  chemically synthesized
aaaatgagaagtgattagat

SEQ ID NO: 407095 - DNA, 20 bp, Artificial Sequence
  chemically synthesized
aagaaaaaatgagaagtgat

SEQ ID NO: 407096 - DNA, 20 bp, Artificial Sequence
  chemically synthesized
ttggttaaagaaaaaatgag

SEQ ID NO: 407097 - DNA, 20 bp, Artificial Sequence
  chemically synthesized
tatttggttaaagaaaaaat

SEQ ID NO: 407098 - DNA, 20 bp, Artificial Sequence
  chemically synthesized
tgaatttacatatttggtta

SEQ ID NO: 407099 - DNA, 20 bp, Artificial Sequence
  chemically synthesized
ttatattgaatttacatatt

SEQ ID NO: 407100 - DNA, 20 bp, Artificial Sequence
  chemically synthesized
taaattcaatataattgact

SEQ ID NO: 407101 - DNA, 20 bp, Artificial Sequence
  chemically synthesized
attgaaccaatttgagaact

SEQ ID NO: 407102 - DNA, 20 bp, Artificial Sequence
  chemically synthesized
aattgacttagttctcaaat

SEQ ID NO: 407103 - DNA, 20 bp, Artificial Sequence
  chemically synthesized
acactttattgaaccaattt

SEQ ID NO: 407104 - DNA, 20 bp, Artificial Sequence
  chemically synthesized
gttctcaaattggttcaata

SEQ ID NO: 407105 - DNA, 20 bp, Artificial Sequence
  chemically synthesized
ggttcaataaagtgttccca

SEQ ID NO: 407106 - DNA, 20 bp, Artificial Sequence
  chemically synthesized
aatatatttgcaaatactgt

SEQ ID NO: 407107 - DNA, 20 bp, Artificial Sequence
  chemically synthesized
gaatatatttgcaaatactg

SEQ ID NO: 407108 - DNA, 20 bp, Artificial Sequence
  chemically synthesized
tttgcaaatatattcgtctt

SEQ ID NO: 407109 - DNA, 20 bp, Artificial Sequence
  chemically synthesized
ggttaaggaggaatattcta

SEQ ID NO: 407110 - DNA, 20 bp, Artificial Sequence
  chemically synthesized
tctacttaaaaaggttaagg

SEQ ID NO: 407111 - DNA, 20 bp, Artificial Sequence
  chemically synthesized
ttctacttaaaaaggttaag

SEQ ID NO: 407112 - DNA, 20 bp, Artificial Sequence
  chemically synthesized
atttctacttaaaaaggtta

SEQ ID NO: 407113 - DNA, 20 bp, Artificial Sequence
  chemically synthesized
aatttctacttaaaaaggtt

SEQ ID NO: 407114 - DNA, 20 bp, Artificial Sequence
  chemically synthesized
tattcctccttaaccttttt

SEQ ID NO: 407115 - DNA, 20 bp, Artificial Sequence
  chemically synthesized
tcctccttaacctttttaag

SEQ ID NO: 407116 - DNA, 20 bp, Artificial Sequence
  chemically synthesized
attttaatttctacttaaaa

SEQ ID NO: 407117 - DNA, 20 bp, Artificial Sequence
  chemically synthesized
tattttaatttctacttaaa

SEQ ID NO: 407118 - DNA, 20 bp, Artificial Sequence
  chemically synthesized
tttttaagtagaaattaaaa

SEQ ID NO: 407119 - DNA, 20 bp, Artificial Sequence
  chemically synthesized
atattaaaacgtgtatttaa

SEQ ID NO: 407120 - DNA, 20 bp, Artificial Sequence
  chemically synthesized
ttaaaacgtgtatttaaaag

SEQ ID NO: 407121 - DNA, 20 bp, Artificial Sequence
  chemically synthesized
gtaaatgtctgttaagagaa

SEQ ID NO: 407122 - DNA, 20 bp, Artificial Sequence
  chemically synthesized
aaagtggtcttttctcttaa

SEQ ID NO: 407123 - DNA, 20 bp, Artificial Sequence
  chemically synthesized
aaaaagtaaatgtctgttaa

SEQ ID NO: 407124 - DNA, 20 bp, Artificial Sequence
  chemically synthesized
agaaaaagtaaatgtctgtt

SEQ ID NO: 407125 - DNA, 20 bp, Artificial Sequence
  chemically synthesized
aaaccaattcatgtaagaaa

SEQ ID NO: 407126 - DNA, 20 bp, Artificial Sequence
  chemically synthesized
aaaactaaaccaattcatgt

SEQ ID NO: 407127 - DNA, 20 bp, Artificial Sequence
  chemically synthesized
ttactttttcttacatgaat

SEQ ID NO: 407128 - DNA, 20 bp, Artificial Sequence
  chemically synthesized
ttttcttacatgaattggtt

SEQ ID NO: 407129 - DNA, 20 bp, Artificial Sequence
  chemically synthesized
attggtttagtttttttttc

SEQ ID NO: 407130 - DNA, 20 bp, Artificial Sequence
  chemically synthesized
ttttggaatggtttcagtgc

SEQ ID NO: 407131 - DNA, 20 bp, Artificial Sequence
  chemically synthesized
agttttttttggaatggttt

SEQ ID NO: 407132 - DNA, 20 bp, Artificial Sequence
  chemically synthesized
ttctacagttttttttggaa

SEQ ID NO: 407133 - DNA, 20 bp, Artificial Sequence
  chemically synthesized
ctcttttctacagttttttt

SEQ ID NO: 407134 - DNA, 20 bp, Artificial Sequence
  chemically synthesized
aaccattccaaaaaaaactg

SEQ ID NO: 407135 - DNA, 20 bp, Artificial Sequence
  chemically synthesized
ttccaaaaaaaactgtagaa

SEQ ID NO: 407136 - DNA, 20 bp, Artificial Sequence
  chemically synthesized
ccaaaaaaaactgtagaaaa

SEQ ID NO: 407137 - DNA, 20 bp, Artificial Sequence
  chemically synthesized
taaatattcactcttttcta

SEQ ID NO: 407138 - DNA, 20 bp, Artificial Sequence
  chemically synthesized
agagtgaatatttattctat

SEQ ID NO: 407139 - DNA, 20 bp, Artificial Sequence
  chemically synthesized
caaacataacaaacatccaa

SEQ ID NO: 407140 - DNA, 20 bp, Artificial Sequence
  chemically synthesized
atgtttgcataataactaat

SEQ ID NO: 407141 - DNA, 20 bp, Artificial Sequence
  chemically synthesized
gttggcctcaattcactaat

SEQ ID NO: 407142 - DNA, 20 bp, Artificial Sequence
  chemically synthesized
taataactaattagtgaatt

SEQ ID NO: 407143 - DNA, 20 bp, Artificial Sequence
  chemically synthesized
aataactaattagtgaattg

SEQ ID NO: 407144 - DNA, 20 bp, Artificial Sequence
  chemically synthesized
gcaaacattttgatcaaagt

SEQ ID NO: 407145 - DNA, 20 bp, Artificial Sequence
  chemically synthesized
cagagcaaacattttgatca

SEQ ID NO: 407146 - DNA, 20 bp, Artificial Sequence
  chemically synthesized
atcaaaatgtttgctctgaa

SEQ ID NO: 407147 - DNA, 20 bp, Artificial Sequence
  chemically synthesized
tattagcaaatatctattca

SEQ ID NO: 407148 - DNA, 20 bp, Artificial Sequence
  chemically synthesized
tttattagcaaatatctatt

SEQ ID NO: 407149 - DNA, 20 bp, Artificial Sequence
  chemically synthesized
cacatgaaaaaattatttat

SEQ ID NO: 407150 - DNA, 20 bp, Artificial Sequence
  chemically synthesized
aaataattttttcatgtgat

SEQ ID NO: 407151 - DNA, 20 bp, Artificial Sequence
  chemically synthesized
tgtgataagtgtgtaataat

SEQ ID NO: 407152 - DNA, 20 bp, Artificial Sequence
  chemically synthesized
tatcaaagcaaggcagcata

SEQ ID NO: 407153 - DNA, 20 bp, Artificial Sequence
  chemically synthesized
tctatcaaagcaaggcagca

SEQ ID NO: 407154 - DNA, 20 bp, Artificial Sequence
  chemically synthesized
aatattctatcaaagcaagg

SEQ ID NO: 407155 - DNA, 20 bp, Artificial Sequence
  chemically synthesized
ctgaatattctatcaaagca

SEQ ID NO: 407156 - DNA, 20 bp, Artificial Sequence
  chemically synthesized
tctatgctgccttgctttga

SEQ ID NO: 407157 - DNA, 20 bp, Artificial Sequence
  chemically synthesized
tctgaatattctatcaaagc

SEQ ID NO: 407158 - DNA, 20 bp, Artificial Sequence
  chemically synthesized
gttgtctgaatattctatca

SEQ ID NO: 407159 - DNA, 20 bp, Artificial Sequence
  chemically synthesized
ccttgctttgatagaatatt

SEQ ID NO: 407160 - DNA, 20 bp, Artificial Sequence
  chemically synthesized
catttataaatgactaattc

SEQ ID NO: 407161 - DNA, 20 bp, Artificial Sequence
  chemically synthesized
atttataaatgactaattca

SEQ ID NO: 407162 - DNA, 20 bp, Artificial Sequence
  chemically synthesized
gaccttttaattccttgaat

SEQ ID NO: 407163 - DNA, 20 bp, Artificial Sequence
  chemically synthesized
tgactaattcaaggaattaa

SEQ ID NO: 407164 - DNA, 20 bp, Artificial Sequence
  chemically synthesized
gactaattcaaggaattaaa

SEQ ID NO: 407165 - DNA, 20 bp, Artificial Sequence
  chemically synthesized
tcaaggaattaaaaggtctt

SEQ ID NO: 407166 - DNA, 20 bp, Artificial Sequence
  chemically synthesized
ttctacattctggggcactt

SEQ ID NO: 407167 - DNA, 20 bp, Artificial Sequence
  chemically synthesized
ttaaaaggtcttaagtgccc

SEQ ID NO: 407168 - DNA, 20 bp, Artificial Sequence
  chemically synthesized
gtcttaagtgccccagaatg

SEQ ID NO: 407169 - DNA, 20 bp, Artificial Sequence
  chemically synthesized
tattccatttctacattctg

SEQ ID NO: 407170 - DNA, 20 bp, Artificial Sequence
  chemically synthesized
ttattccatttctacattct

SEQ ID NO: 407171 - DNA, 20 bp, Artificial Sequence
  chemically synthesized
tttattccatttctacattc

SEQ ID NO: 407172 - DNA, 20 bp, Artificial Sequence
  chemically synthesized
agtgccccagaatgtagaaa

SEQ ID NO: 407173 - DNA, 20 bp, Artificial Sequence
  chemically synthesized
gtagaaatggaataaacatg

SEQ ID NO: 407174 - DNA, 20 bp, Artificial Sequence
  chemically synthesized
gaaatggaataaacatgtgg

SEQ ID NO: 407175 - DNA, 20 bp, Artificial Sequence
  chemically synthesized
atggaataaacatgtggtag

SEQ ID NO: 407176 - DNA, 20 bp, Artificial Sequence
  chemically synthesized
aataaacatgtggtagtggt

SEQ ID NO: 407177 - DNA, 20 bp, Artificial Sequence
  chemically synthesized
ataaacatgtggtagtggtg

SEQ ID NO: 407178 - DNA, 20 bp, Artificial Sequence
  chemically synthesized
taaacatgtggtagtggtga

SEQ ID NO: 407179 - DNA, 20 bp, Artificial Sequence
  chemically synthesized
acatgtggtagtggtgaggg

SEQ ID NO: 407180 - DNA, 20 bp, Artificial Sequence
  chemically synthesized
catgtggtagtggtgagggt

SEQ ID NO: 407181 - DNA, 20 bp, Artificial Sequence
  chemically synthesized
tggtagtggtgagggtgggc

SEQ ID NO: 407182 - DNA, 20 bp, Artificial Sequence
  chemically synthesized
aaatctagtttaatcatttc

SEQ ID NO: 407183 - DNA, 20 bp, Artificial Sequence
  chemically synthesized
tgggctagaaatgattaaac

SEQ ID NO: 407184 - DNA, 20 bp, Artificial Sequence
  chemically synthesized
ttctttttttaaaaaaaatc

SEQ ID NO: 407185 - DNA, 20 bp, Artificial Sequence
  chemically synthesized
aactagattttttttaaaaa

SEQ ID NO: 407186 - DNA, 20 bp, Artificial Sequence
  chemically synthesized
tagattttttttaaaaaaag

SEQ ID NO: 407187 - DNA, 20 bp, Artificial Sequence
  chemically synthesized
aaaagaagcaaaaataccgc

SEQ ID NO: 407188 - DNA, 20 bp, Artificial Sequence
  chemically synthesized
tctgcgtgcattttttccag

SEQ ID NO: 407189 - DNA, 20 bp, Artificial Sequence
  chemically synthesized
tattctgcgtgcattttttc

SEQ ID NO: 407190 - DNA, 20 bp, Artificial Sequence
  chemically synthesized
accgctggaaaaaatgcacg

SEQ ID NO: 407191 - DNA, 20 bp, Artificial Sequence
  chemically synthesized
gaaaatcaagtacacacgtt

SEQ ID NO: 407192 - DNA, 20 bp, Artificial Sequence
  chemically synthesized
agccgtgatgaaggaaaatc

SEQ ID NO: 407193 - DNA, 20 bp, Artificial Sequence
  chemically synthesized
tacttgattttccttcatca

SEQ ID NO: 407194 - DNA, 20 bp, Artificial Sequence
  chemically synthesized
tcaaaatgaagccgtgatga

SEQ ID NO: 407195 - DNA, 20 bp, Artificial Sequence
  chemically synthesized
ctcaaaatgaagccgtgatg

SEQ ID NO: 407196 - DNA, 20 bp, Artificial Sequence
  chemically synthesized
cttcatcacggcttcatttt

SEQ ID NO: 407197 - DNA, 20 bp, Artificial Sequence
  chemically synthesized
gacctggacgtctcaaaatg

SEQ ID NO: 407198 - DNA, 20 bp, Artificial Sequence
  chemically synthesized
cggcttcattttgagacgtc

SEQ ID NO: 407199 - DNA, 20 bp, Artificial Sequence
  chemically synthesized
ggcttcattttgagacgtcc

SEQ ID NO: 407200 - DNA, 20 bp, Artificial Sequence
  chemically synthesized
ttggttgacagtggttgacc

SEQ ID NO: 407201 - DNA, 20 bp, Artificial Sequence
  chemically synthesized
agagattgattggttgacag

SEQ ID NO: 407202 - DNA, 20 bp, Artificial Sequence
  chemically synthesized
gctagagattgattggttga

SEQ ID NO: 407203 - DNA, 20 bp, Artificial Sequence
  chemically synthesized
caaagaggctagagattgat

SEQ ID NO: 407204 - DNA, 20 bp, Artificial Sequence
  chemically synthesized
actgtcaaccaatcaatctc

SEQ ID NO: 407205 - DNA, 20 bp, Artificial Sequence
  chemically synthesized
atctctgctcaaagaggcta

SEQ ID NO: 407206 - DNA, 20 bp, Artificial Sequence
  chemically synthesized
tgatctctgctcaaagaggc

SEQ ID NO: 407207 - DNA, 20 bp, Artificial Sequence
  chemically synthesized
aatcaatctctagcctcttt

SEQ ID NO: 407208 - DNA, 20 bp, Artificial Sequence
  chemically synthesized
caatctctagcctctttgag

SEQ ID NO: 407209 - DNA, 20 bp, Artificial Sequence
  chemically synthesized
cccttgatctctgctcaaag

SEQ ID NO: 407210 - DNA, 20 bp, Artificial Sequence
  chemically synthesized
gcccttgatctctgctcaaa

SEQ ID NO: 407211 - DNA, 20 bp, Artificial Sequence
  chemically synthesized
atctctagcctctttgagca

SEQ ID NO: 407212 - DNA, 20 bp, Artificial Sequence
  chemically synthesized
ttgcccttgatctctgctca

SEQ ID NO: 407213 - DNA, 20 bp, Artificial Sequence
  chemically synthesized
agcctctttgagcagagatc

SEQ ID NO: 407214 - DNA, 20 bp, Artificial Sequence
  chemically synthesized
gcctctttgagcagagatca

SEQ ID NO: 407215 - DNA, 20 bp, Artificial Sequence
  chemically synthesized
cctctttgagcagagatcaa

SEQ ID NO: 407216 - DNA, 20 bp, Artificial Sequence
  chemically synthesized
tgagcagagatcaagggcaa

SEQ ID NO: 407217 - DNA, 20 bp, Artificial Sequence
  chemically synthesized
gcagagatcaagggcaacag

SEQ ID NO: 407218 - DNA, 20 bp, Artificial Sequence
  chemically synthesized
agagatcaagggcaacagca

SEQ ID NO: 407219 - DNA, 20 bp, Artificial Sequence
  chemically synthesized
gctagaggttgaaatcatta

SEQ ID NO: 407220 - DNA, 20 bp, Artificial Sequence
  chemically synthesized
ggctagaggttgaaatcatt

SEQ ID NO: 407221 - DNA, 20 bp, Artificial Sequence
  chemically synthesized
gccttaatgatttcaacctc

SEQ ID NO: 407222 - DNA, 20 bp, Artificial Sequence
  chemically synthesized
tctgtgcccttgaaggctag

SEQ ID NO: 407223 - DNA, 20 bp, Artificial Sequence
  chemically synthesized
atctgtgcccttgaaggcta

SEQ ID NO: 407224 - DNA, 20 bp, Artificial Sequence
  chemically synthesized
gatttcaacctctagccttc

SEQ ID NO: 407225 - DNA, 20 bp, Artificial Sequence
  chemically synthesized
atttcaacctctagccttca

SEQ ID NO: 407226 - DNA, 20 bp, Artificial Sequence
  chemically synthesized
taatctgtgcccttgaaggc

SEQ ID NO: 407227 - DNA, 20 bp, Artificial Sequence
  chemically synthesized
tttcaacctctagccttcaa

SEQ ID NO: 407228 - DNA, 20 bp, Artificial Sequence
  chemically synthesized
cctgtaatctgtgcccttga

SEQ ID NO: 407229 - DNA, 20 bp, Artificial Sequence
  chemically synthesized
ccctgtaatctgtgcccttg

SEQ ID NO: 407230 - DNA, 20 bp, Artificial Sequence
  chemically synthesized
acctctagccttcaagggca

SEQ ID NO: 407231 - DNA, 20 bp, Artificial Sequence
  chemically synthesized
gccttcaagggcacagatta

SEQ ID NO: 407232 - DNA, 20 bp, Artificial Sequence
  chemically synthesized
ccttcaagggcacagattac

SEQ ID NO: 407233 - DNA, 20 bp, Artificial Sequence
  chemically synthesized
cttcaagggcacagattaca

SEQ ID NO: 407234 - DNA, 20 bp, Artificial Sequence
  chemically synthesized
gcacagattacagggactga

SEQ ID NO: 407235 - DNA, 20 bp, Artificial Sequence
  chemically synthesized
gtgatggactgatttacttt

SEQ ID NO: 407236 - DNA, 20 bp, Artificial Sequence
  chemically synthesized
tacagggactgaaagtaaat

SEQ ID NO: 407237 - DNA, 20 bp, Artificial Sequence
  chemically synthesized
aaagtaaatcagtccatcac

SEQ ID NO: 407238 - DNA, 20 bp, Artificial Sequence
  chemically synthesized
aagtaaatcagtccatcaca

SEQ ID NO: 407239 - DNA, 20 bp, Artificial Sequence
  chemically synthesized
tgggctgaagtgccttgtga

SEQ ID NO: 407240 - DNA, 20 bp, Artificial Sequence
  chemically synthesized
cagtccatcacaaggcactt

SEQ ID NO: 407241 - DNA, 20 bp, Artificial Sequence
  chemically synthesized
tcacaaggcacttcagccca

SEQ ID NO: 407242 - DNA, 20 bp, Artificial Sequence
  chemically synthesized
ttgtcatgggctatgggctg

SEQ ID NO: 407243 - DNA, 20 bp, Artificial Sequence
  chemically synthesized
caagctttgtcatgggctat

SEQ ID NO: 407244 - DNA, 20 bp, Artificial Sequence
  chemically synthesized
tcaagctttgtcatgggcta

SEQ ID NO: 407245 - DNA, 20 bp, Artificial Sequence
  chemically synthesized
tcagcccatagcccatgaca

SEQ ID NO: 407246 - DNA, 20 bp, Artificial Sequence
  chemically synthesized
ttctaatcaagctttgtcat

SEQ ID NO: 407247 - DNA, 20 bp, Artificial Sequence
  chemically synthesized
attctaatcaagctttgtca

SEQ ID NO: 407248 - DNA, 20 bp, Artificial Sequence
  chemically synthesized
agcccatgacaaagcttgat

SEQ ID NO: 407249 - DNA, 20 bp, Artificial Sequence
  chemically synthesized
aacacttttccattctaatc

SEQ ID NO: 407250 - DNA, 20 bp, Artificial Sequence
  chemically synthesized
atgacaaagcttgattagaa

SEQ ID NO: 407251 - DNA, 20 bp, Artificial Sequence
  chemically synthesized
aaagcttgattagaatggaa

SEQ ID NO: 407252 - DNA, 20 bp, Artificial Sequence
  chemically synthesized
gattagaatggaaaagtgtt

SEQ ID NO: 407253 - DNA, 20 bp, Artificial Sequence
  chemically synthesized
tagctgtgtcttgtttttga

SEQ ID NO: 407254 - DNA, 20 bp, Artificial Sequence
  chemically synthesized
agtgttaagccatcaaaaac

SEQ ID NO: 407255 - DNA, 20 bp, Artificial Sequence
  chemically synthesized
aagccatcaaaaacaagaca

SEQ ID NO: 407256 - DNA, 20 bp, Artificial Sequence
  chemically synthesized
caaaaacaagacacagctat

SEQ ID NO: 407257 - DNA, 20 bp, Artificial Sequence
  chemically synthesized
aaaaacaagacacagctata

SEQ ID NO: 407258 - DNA, 20 bp, Artificial Sequence
  chemically synthesized
acaagacacagctataagga

SEQ ID NO: 407259 - DNA, 20 bp, Artificial Sequence
  chemically synthesized
ttatatttcctctttcctta

SEQ ID NO: 407260 - DNA, 20 bp, Artificial Sequence
  chemically synthesized
aagacacagctataaggaaa

SEQ ID NO: 407261 - DNA, 20 bp, Artificial Sequence
  chemically synthesized
agacacagctataaggaaag

SEQ ID NO: 407262 - DNA, 20 bp, Artificial Sequence
  chemically synthesized
tataaggaaagaggaaatat

SEQ ID NO: 407263 - DNA, 20 bp, Artificial Sequence
  chemically synthesized
ataaggaaagaggaaatata

SEQ ID NO: 407264 - DNA, 20 bp, Artificial Sequence
  chemically synthesized
ttatgaacactaaaattcat

SEQ ID NO: 407265 - DNA, 20 bp, Artificial Sequence
  chemically synthesized
aatataaggctaatgaattt

SEQ ID NO: 407266 - DNA, 20 bp, Artificial Sequence
  chemically synthesized
tgaattttagtgttcataac

SEQ ID NO: 407267 - DNA, 20 bp, Artificial Sequence
  chemically synthesized
taaatggctacacaggtatt

SEQ ID NO: 407268 - DNA, 20 bp, Artificial Sequence
  chemically synthesized
tgtgtttctcaatacctgtg

SEQ ID NO: 407269 - DNA, 20 bp, Artificial Sequence
  chemically synthesized
agatttctaaatggctacac

SEQ ID NO: 407270 - DNA, 20 bp, Artificial Sequence
  chemically synthesized
tagatttctaaatggctaca

SEQ ID NO: 407271 - DNA, 20 bp, Artificial Sequence
  chemically synthesized
tcaatacctgtgtagccatt

SEQ ID NO: 407272 - DNA, 20 bp, Artificial Sequence
  chemically synthesized
ttgctctttagatttctaaa

SEQ ID NO: 407273 - DNA, 20 bp, Artificial Sequence
  chemically synthesized
tgtagccatttagaaatcta

SEQ ID NO: 407274 - DNA, 20 bp, Artificial Sequence
  chemically synthesized
tagccatttagaaatctaaa

SEQ ID NO: 407275 - DNA, 20 bp, Artificial Sequence
  chemically synthesized
catttagaaatctaaagagc

SEQ ID NO: 407276 - DNA, 20 bp, Artificial Sequence
  chemically synthesized
ataattttcttcttgctctt

SEQ ID NO: 407277 - DNA, 20 bp, Artificial Sequence
  chemically synthesized
ttagaaatctaaagagcaag

SEQ ID NO: 407278 - DNA, 20 bp, Artificial Sequence
  chemically synthesized
gagcaagaagaaaattatga

SEQ ID NO: 407279 - DNA, 20 bp, Artificial Sequence
  chemically synthesized
aaattatgatagaacattct

SEQ ID NO: 407280 - DNA, 20 bp, Artificial Sequence
  chemically synthesized
gaaaagaggaagaaattgct

SEQ ID NO: 407281 - DNA, 20 bp, Artificial Sequence
  chemically synthesized
tctgctcttgagaaaagagg

SEQ ID NO: 407282 - DNA, 20 bp, Artificial Sequence
  chemically synthesized
aattctgctcttgagaaaag

SEQ ID NO: 407283 - DNA, 20 bp, Artificial Sequence
  chemically synthesized
caatttcttcctcttttctc

SEQ ID NO: 407284 - DNA, 20 bp, Artificial Sequence
  chemically synthesized
caattctgctcttgagaaaa

SEQ ID NO: 407285 - DNA, 20 bp, Artificial Sequence
  chemically synthesized
atttcttcctcttttctcaa

SEQ ID NO: 407286 - DNA, 20 bp, Artificial Sequence
  chemically synthesized
ctcaattctgctcttgagaa

SEQ ID NO: 407287 - DNA, 20 bp, Artificial Sequence
  chemically synthesized
tcttcctcttttctcaagag

SEQ ID NO: 407288 - DNA, 20 bp, Artificial Sequence
  chemically synthesized
tctatctcaattctgctctt

SEQ ID NO: 407289 - DNA, 20 bp, Artificial Sequence
  chemically synthesized
cttttctcaagagcagaatt

SEQ ID NO: 407290 - DNA, 20 bp, Artificial Sequence
  chemically synthesized
tctcaagagcagaattgaga

SEQ ID NO: 407291 - DNA, 20 bp, Artificial Sequence
  chemically synthesized
gagcagaattgagatagact

SEQ ID NO: 407292 - DNA, 20 bp, Artificial Sequence
  chemically synthesized
ttgagatagacttagatgtc

SEQ ID NO: 407293 - DNA, 20 bp, Artificial Sequence
  chemically synthesized
aatgggtagacttgacatct

SEQ ID NO: 407294 - DNA, 20 bp, Artificial Sequence
  chemically synthesized
gaacggcctagaagaatggg

SEQ ID NO: 407295 - DNA, 20 bp, Artificial Sequence
  chemically synthesized
gtcaagtctacccattcttc

SEQ ID NO: 407296 - DNA, 20 bp, Artificial Sequence
  chemically synthesized
tgagaacggcctagaagaat

SEQ ID NO: 407297 - DNA, 20 bp, Artificial Sequence
  chemically synthesized
tcaagtctacccattcttct

SEQ ID NO: 407298 - DNA, 20 bp, Artificial Sequence
  chemically synthesized
ctgagaacggcctagaagaa

SEQ ID NO: 407299 - DNA, 20 bp, Artificial Sequence
  chemically synthesized
tgggtctgagaacggcctag

SEQ ID NO: 407300 - DNA, 20 bp, Artificial Sequence
  chemically synthesized
aaatgggtctgagaacggcc

SEQ ID NO: 407301 - DNA, 20 bp, Artificial Sequence
  chemically synthesized
ccattcttctaggccgttct

SEQ ID NO: 407302 - DNA, 20 bp, Artificial Sequence
  chemically synthesized
tttgaaaatgggtctgagaa

SEQ ID NO: 407303 - DNA, 20 bp, Artificial Sequence
  chemically synthesized
gtttttttgaaaatgggtct

SEQ ID NO: 407304 - DNA, 20 bp, Artificial Sequence
  chemically synthesized
tttattgtttttttgaaaat

SEQ ID NO: 407305 - DNA, 20 bp, Artificial Sequence
  chemically synthesized
atttattgtttttttgaaaa

SEQ ID NO: 407306 - DNA, 20 bp, Artificial Sequence
  chemically synthesized
caaaaaaacaataaatccaa

SEQ ID NO: 407307 - DNA, 20 bp, Artificial Sequence
  chemically synthesized
agtttattgcttttggcttt

SEQ ID NO: 407308 - DNA, 20 bp, Artificial Sequence
  chemically synthesized
acaataaatccaaaagccaa

SEQ ID NO: 407309 - DNA, 20 bp, Artificial Sequence
  chemically synthesized
ttaaacaagtttattgcttt

SEQ ID NO: 407310 - DNA, 20 bp, Artificial Sequence
  chemically synthesized
gtgaacttcagtatttaaac

SEQ ID NO: 407311 - DNA, 20 bp, Artificial Sequence
  chemically synthesized
ataaacttgtttaaatactg

SEQ ID NO: 407312 - DNA, 20 bp, Artificial Sequence
  chemically synthesized
catgagcaccatgtgaactt

SEQ ID NO: 407313 - DNA, 20 bp, Artificial Sequence
  chemically synthesized
tttaaatactgaagttcaca

SEQ ID NO: 407314 - DNA, 20 bp, Artificial Sequence
  chemically synthesized
tcacatggtgctcatgtttt

SEQ ID NO: 407315 - DNA, 20 bp, Artificial Sequence
  chemically synthesized
aagtggatttctgaaaacat

SEQ ID NO: 407316 - DNA, 20 bp, Artificial Sequence
  chemically synthesized
ttatgggtgtaaagtgtaag

SEQ ID NO: 407317 - DNA, 20 bp, Artificial Sequence
  chemically synthesized
acattatgggtgtaaagtgt

SEQ ID NO: 407318 - DNA, 20 bp, Artificial Sequence
  chemically synthesized
ttacttacattatgggtgta

SEQ ID NO: 407319 - DNA, 20 bp, Artificial Sequence
  chemically synthesized
acactttacacccataatgt

SEQ ID NO: 407320 - DNA, 20 bp, Artificial Sequence
  chemically synthesized
gggtacgttacttacattat

SEQ ID NO: 407321 - DNA, 20 bp, Artificial Sequence
  chemically synthesized
agggtacgttacttacatta

SEQ ID NO: 407322 - DNA, 20 bp, Artificial Sequence
  chemically synthesized
tgagcagttaaatatttaaa

SEQ ID NO: 407323 - DNA, 20 bp, Artificial Sequence
  chemically synthesized
gtgagcagttaaatatttaa

SEQ ID NO: 407324 - DNA, 20 bp, Artificial Sequence
  chemically synthesized
agtgagcagttaaatattta

SEQ ID NO: 407325 - DNA, 20 bp, Artificial Sequence
  chemically synthesized
caaataaaaacattagtgag

SEQ ID NO: 407326 - DNA, 20 bp, Artificial Sequence
  chemically synthesized
atgcaaataaaaacattagt

SEQ ID NO: 407327 - DNA, 20 bp, Artificial Sequence
  chemically synthesized
tgatatgcaaataaaaacat

SEQ ID NO: 407328 - DNA, 20 bp, Artificial Sequence
  chemically synthesized
gtgtgttatctagttttaaa

SEQ ID NO: 407329 - DNA, 20 bp, Artificial Sequence
  chemically synthesized
atatcatttctttttaaaac

SEQ ID NO: 407330 - DNA, 20 bp, Artificial Sequence
  chemically synthesized
ctaaaaaagtgtgtgttatc

SEQ ID NO: 407331 - DNA, 20 bp, Artificial Sequence
  chemically synthesized
ctagataacacacacttttt

SEQ ID NO: 407332 - DNA, 20 bp, Artificial Sequence
  chemically synthesized
gataacacacacttttttag

SEQ ID NO: 407333 - DNA, 20 bp, Artificial Sequence
  chemically synthesized
tccaaagatatctgctaaaa

SEQ ID NO: 407334 - DNA, 20 bp, Artificial Sequence
  chemically synthesized
acttttttagcagatatctt

SEQ ID NO: 407335 - DNA, 20 bp, Artificial Sequence
  chemically synthesized
gttgagatagtgaagatcca

SEQ ID NO: 407336 - DNA, 20 bp, Artificial Sequence
  chemically synthesized
aaaagtcagttgagatagtg

SEQ ID NO: 407337 - DNA, 20 bp, Artificial Sequence
  chemically synthesized
aaaagaaaagtcagttgaga

SEQ ID NO: 407338 - DNA, 20 bp, Artificial Sequence
  chemically synthesized
aaaaaaaagaaaagtcagtt

SEQ ID NO: 407339 - DNA, 20 bp, Artificial Sequence
  chemically synthesized
aaaaaaaaaaaaagaaaagt

SEQ ID NO: 407340 - DNA, 20 bp, Artificial Sequence
  chemically synthesized
aaaaaaaaaaaaaaaaagaa

SEQ ID NO: 407341 - DNA, 20 bp, Artificial Sequence
  chemically synthesized
gtctcaaaaaaaaaaaaaaa

SEQ ID NO: 407342 - DNA, 20 bp, Artificial Sequence
  chemically synthesized
ttcttttttttttttttttt

SEQ ID NO: 407343 - DNA, 20 bp, Artificial Sequence
  chemically synthesized
ctgggcgatagagggagatt

SEQ ID NO: 407344 - DNA, 20 bp, Artificial Sequence
  chemically synthesized
tccagcctgggcgatagagg

SEQ ID NO: 407345 - DNA, 20 bp, Artificial Sequence
  chemically synthesized
actccagcctgggcgataga

SEQ ID NO: 407346 - DNA, 20 bp, Artificial Sequence
  chemically synthesized
cactccagcctgggcgatag

SEQ ID NO: 407347 - DNA, 20 bp, Artificial Sequence
  chemically synthesized
ctgaatctccctctatcgcc

SEQ ID NO: 407348 - DNA, 20 bp, Artificial Sequence
  chemically synthesized
gcactccagcctgggcgata

SEQ ID NO: 407349 - DNA, 20 bp, Artificial Sequence
  chemically synthesized
tgaatctccctctatcgccc

SEQ ID NO: 407350 - DNA, 20 bp, Artificial Sequence
  chemically synthesized
ctgcactccagcctgggcga

SEQ ID NO: 407351 - DNA, 20 bp, Artificial Sequence
  chemically synthesized
tctccctctatcgcccaggc

SEQ ID NO: 407352 - DNA, 20 bp, Artificial Sequence
  chemically synthesized
tccctctatcgcccaggctg

SEQ ID NO: 407353 - DNA, 20 bp, Artificial Sequence
  chemically synthesized
gaaacactgcactccagcct

SEQ ID NO: 407354 - DNA, 20 bp, Artificial Sequence
  chemically synthesized
tgaaacactgcactccagcc

SEQ ID NO: 407355 - DNA, 20 bp, Artificial Sequence
  chemically synthesized
ctatcgcccaggctggagtg

SEQ ID NO: 407356 - DNA, 20 bp, Artificial Sequence
  chemically synthesized
gagattgaaacactgcactc

SEQ ID NO: 407357 - DNA, 20 bp, Artificial Sequence
  chemically synthesized
ggagtgcagtgtttcaatct

SEQ ID NO: 407358 - DNA, 20 bp, Artificial Sequence
  chemically synthesized
ggaggaggttgcagtgagcc

SEQ ID NO: 407359 - DNA, 20 bp, Artificial Sequence
  chemically synthesized
caggaggaggaggttgcagt

SEQ ID NO: 407360 - DNA, 20 bp, Artificial Sequence
  chemically synthesized
gacccaggaggaggaggttg

SEQ ID NO: 407361 - DNA, 20 bp, Artificial Sequence
  chemically synthesized
cgcttggacccaggaggagg

SEQ ID NO: 407362 - DNA, 20 bp, Artificial Sequence
  chemically synthesized
tcactgcaacctcctcctcc

SEQ ID NO: 407363 - DNA, 20 bp, Artificial Sequence
  chemically synthesized
tcgcttggacccaggaggag

SEQ ID NO: 407364 - DNA, 20 bp, Artificial Sequence
  chemically synthesized
cactgcaacctcctcctcct

SEQ ID NO: 407365 - DNA, 20 bp, Artificial Sequence
  chemically synthesized
aatcgcttggacccaggagg

SEQ ID NO: 407366 - DNA, 20 bp, Artificial Sequence
  chemically synthesized
gaatcgcttggacccaggag

SEQ ID NO: 407367 - DNA, 20 bp, Artificial Sequence
  chemically synthesized
aagaatcgcttggacccagg

SEQ ID NO: 407368 - DNA, 20 bp, Artificial Sequence
  chemically synthesized
gaagaatcgcttggacccag

SEQ ID NO: 407369 - DNA, 20 bp, Artificial Sequence
  chemically synthesized
aacctcctcctcctgggtcc

SEQ ID NO: 407370 - DNA, 20 bp, Artificial Sequence
  chemically synthesized
cagaagaatcgcttggaccc

SEQ ID NO: 407371 - DNA, 20 bp, Artificial Sequence
  chemically synthesized
gcagaagaatcgcttggacc

SEQ ID NO: 407372 - DNA, 20 bp, Artificial Sequence
  chemically synthesized
gctgaggcagaagaatcgct

SEQ ID NO: 407373 - DNA, 20 bp, Artificial Sequence
  chemically synthesized
tccaagcgattcttctgcct

SEQ ID NO: 407374 - DNA, 20 bp, Artificial Sequence
  chemically synthesized
tacttaggaggctgaggcag

SEQ ID NO: 407375 - DNA, 20 bp, Artificial Sequence
  chemically synthesized
agctacttaggaggctgagg

SEQ ID NO: 407376 - DNA, 20 bp, Artificial Sequence
  chemically synthesized
cccagctacttaggaggctg

SEQ ID NO: 407377 - DNA, 20 bp, Artificial Sequence
  chemically synthesized
tcccagctacttaggaggct

SEQ ID NO: 407378 - DNA, 20 bp, Artificial Sequence
  chemically synthesized
ttcttctgcctcagcctcct

SEQ ID NO: 407379 - DNA, 20 bp, Artificial Sequence
  chemically synthesized
ttctgcctcagcctcctaag

SEQ ID NO: 407380 - DNA, 20 bp, Artificial Sequence
  chemically synthesized
tctaatcccagctacttagg

SEQ ID NO: 407381 - DNA, 20 bp, Artificial Sequence
  chemically synthesized
ctctaatcccagctacttag

SEQ ID NO: 407382 - DNA, 20 bp, Artificial Sequence
  chemically synthesized
gcctcagcctcctaagtagc

SEQ ID NO: 407383 - DNA, 20 bp, Artificial Sequence
  chemically synthesized
gcctctaatcccagctactt

SEQ ID NO: 407384 - DNA, 20 bp, Artificial Sequence
  chemically synthesized
cctcagcctcctaagtagct

SEQ ID NO: 407385 - DNA, 20 bp, Artificial Sequence
  chemically synthesized
tgcctctaatcccagctact

SEQ ID NO: 407386 - DNA, 20 bp, Artificial Sequence
  chemically synthesized
gcctcctaagtagctgggat

SEQ ID NO: 407387 - DNA, 20 bp, Artificial Sequence
  chemically synthesized
ctcctaagtagctgggatta

SEQ ID NO: 407388 - DNA, 20 bp, Artificial Sequence
  chemically synthesized
tcctaagtagctgggattag

SEQ ID NO: 407389 - DNA, 20 bp, Artificial Sequence
  chemically synthesized
gtggtgggtgcctctaatcc

SEQ ID NO: 407390 - DNA, 20 bp, Artificial Sequence
  chemically synthesized
aattagccaggcgtggtggt

SEQ ID NO: 407391 - DNA, 20 bp, Artificial Sequence
  chemically synthesized
caattagccaggcgtggtgg

SEQ ID NO: 407392 - DNA, 20 bp, Artificial Sequence
  chemically synthesized
gaggcacccaccaccacgcc

SEQ ID NO: 407393 - DNA, 20 bp, Artificial Sequence
  chemically synthesized
caacaattagccaggcgtgg

SEQ ID NO: 407394 - DNA, 20 bp, Artificial Sequence
  chemically synthesized
atacaacaattagccaggcg

SEQ ID NO: 407395 - DNA, 20 bp, Artificial Sequence
  chemically synthesized
taaaaatacaacaattagcc

SEQ ID NO: 407396 - DNA, 20 bp, Artificial Sequence
  chemically synthesized
ctaaaaatacaacaattagc

SEQ ID NO: 407397 - DNA, 20 bp, Artificial Sequence
  chemically synthesized
tctactaaaaatacaacaat

SEQ ID NO: 407398 - DNA, 20 bp, Artificial Sequence
  chemically synthesized
ctggctaattgttgtatttt

SEQ ID NO: 407399 - DNA, 20 bp, Artificial Sequence
  chemically synthesized
gctaattgttgtatttttag

SEQ ID NO: 407400 - DNA, 20 bp, Artificial Sequence
  chemically synthesized
taattgttgtatttttagta

SEQ ID NO: 407401 - DNA, 20 bp, Artificial Sequence
  chemically synthesized
ttgttgtatttttagtagag

SEQ ID NO: 407402 - DNA, 20 bp, Artificial Sequence
  chemically synthesized
tgttgtatttttagtagaga

SEQ ID NO: 407403 - DNA, 20 bp, Artificial Sequence
  chemically synthesized
gttgtatttttagtagagaa

SEQ ID NO: 407404 - DNA, 20 bp, Artificial Sequence
  chemically synthesized
ttgtatttttagtagagaag

SEQ ID NO: 407405 - DNA, 20 bp, Artificial Sequence
  chemically synthesized
gagaaggggtttcatcacgt

SEQ ID NO: 407406 - DNA, 20 bp, Artificial Sequence
  chemically synthesized
aggggtttcatcacgttggc

SEQ ID NO: 407407 - DNA, 20 bp, Artificial Sequence
  chemically synthesized
ggggtttcatcacgttggct

SEQ ID NO: 407408 - DNA, 20 bp, Artificial Sequence
  chemically synthesized
tttcatcacgttggctaggc

SEQ ID NO: 407409 - DNA, 20 bp, Artificial Sequence
  chemically synthesized
acaggagtttgagaccagcc

SEQ ID NO: 407410 - DNA, 20 bp, Artificial Sequence
  chemically synthesized
tgaagacaggagtttgagac

SEQ ID NO: 407411 - DNA, 20 bp, Artificial Sequence
  chemically synthesized
tcacttgaagacaggagttt

SEQ ID NO: 407412 - DNA, 20 bp, Artificial Sequence
  chemically synthesized
agtggatcacttgaagacag

SEQ ID NO: 407413 - DNA, 20 bp, Artificial Sequence
  chemically synthesized
ggtctcaaactcctgtcttc

SEQ ID NO: 407414 - DNA, 20 bp, Artificial Sequence
  chemically synthesized
ccagtggatcacttgaagac

SEQ ID NO: 407415 - DNA, 20 bp, Artificial Sequence
  chemically synthesized
gccagtggatcacttgaaga

SEQ ID NO: 407416 - DNA, 20 bp, Artificial Sequence
  chemically synthesized
agaggccagtggatcacttg

SEQ ID NO: 407417 - DNA, 20 bp, Artificial Sequence
  chemically synthesized
cctgtcttcaagtgatccac

SEQ ID NO: 407418 - DNA, 20 bp, Artificial Sequence
  chemically synthesized
cttcgggagttagaggccag

SEQ ID NO: 407419 - DNA, 20 bp, Artificial Sequence
  chemically synthesized
gcacttcgggagttagaggc

SEQ ID NO: 407420 - DNA, 20 bp, Artificial Sequence
  chemically synthesized
cccagcacttcgggagttag

SEQ ID NO: 407421 - DNA, 20 bp, Artificial Sequence
  chemically synthesized
tcccagcacttcgggagtta

SEQ ID NO: 407422 - DNA, 20 bp, Artificial Sequence
  chemically synthesized
ccactggcctctaactcccg

SEQ ID NO: 407423 - DNA, 20 bp, Artificial Sequence
  chemically synthesized
aatcccagcacttcgggagt

SEQ ID NO: 407424 - DNA, 20 bp, Artificial Sequence
  chemically synthesized
ctgtaatcccagcacttcgg

SEQ ID NO: 407425 - DNA, 20 bp, Artificial Sequence
  chemically synthesized
gcctctaactcccgaagtgc

SEQ ID NO: 407426 - DNA, 20 bp, Artificial Sequence
  chemically synthesized
tcctgtaatcccagcacttc

SEQ ID NO: 407427 - DNA, 20 bp, Artificial Sequence
  chemically synthesized
cctctaactcccgaagtgct

SEQ ID NO: 407428 - DNA, 20 bp, Artificial Sequence
  chemically synthesized
ctcctgtaatcccagcactt

SEQ ID NO: 407429 - DNA, 20 bp, Artificial Sequence
  chemically synthesized
ctcccgaagtgctgggatta

SEQ ID NO: 407430 - DNA, 20 bp, Artificial Sequence
  chemically synthesized
tcccgaagtgctgggattac

SEQ ID NO: 407431 - DNA, 20 bp, Artificial Sequence
  chemically synthesized
ggggctcactcctgtaatcc

SEQ ID NO: 407432 - DNA, 20 bp, Artificial Sequence
  chemically synthesized
ccgaagtgctgggattacag

SEQ ID NO: 407433 - DNA, 20 bp, Artificial Sequence
  chemically synthesized
agtgctgggattacaggagt

SEQ ID NO: 407434 - DNA, 20 bp, Artificial Sequence
  chemically synthesized
caggagtgagcccctgcgcc

SEQ ID NO: 407435 - DNA, 20 bp, Artificial Sequence
  chemically synthesized
tcggttgaggccaggcgcag

SEQ ID NO: 407436 - DNA, 20 bp, Artificial Sequence
  chemically synthesized
gtcggttgaggccaggcgca

SEQ ID NO: 407437 - DNA, 20 bp, Artificial Sequence
  chemically synthesized
agtcggttgaggccaggcgc

SEQ ID NO: 407438 - DNA, 20 bp, Artificial Sequence
  chemically synthesized
aagtcggttgaggccaggcg

SEQ ID NO: 407439 - DNA, 20 bp, Artificial Sequence
  chemically synthesized
taaaaaagtcggttgaggcc

SEQ ID NO: 407440 - DNA, 20 bp, Artificial Sequence
  chemically synthesized
ctaaaaaagtcggttgaggc

SEQ ID NO: 407441 - DNA, 20 bp, Artificial Sequence
  chemically synthesized
tggtctaaaaaagtcggttg

SEQ ID NO: 407442 - DNA, 20 bp, Artificial Sequence
  chemically synthesized
gtggtctaaaaaagtcggtt

SEQ ID NO: 407443 - DNA, 20 bp, Artificial Sequence
  chemically synthesized
ctggcctcaaccgacttttt

SEQ ID NO: 407444 - DNA, 20 bp, Artificial Sequence
  chemically synthesized
tacctgtggtctaaaaaagt

SEQ ID NO: 407445 - DNA, 20 bp, Artificial Sequence
  chemically synthesized
catttacctgtggtctaaaa

SEQ ID NO: 407446 - DNA, 20 bp, Artificial Sequence
  chemically synthesized
caaccgacttttttagacca

SEQ ID NO: 407447 - DNA, 20 bp, Artificial Sequence
  chemically synthesized
aaccgacttttttagaccac

SEQ ID NO: 407448 - DNA, 20 bp, Artificial Sequence
  chemically synthesized
gtaaaactaacatttacctg

SEQ ID NO: 407449 - DNA, 20 bp, Artificial Sequence
  chemically synthesized
tttagaccacaggtaaatgt

SEQ ID NO: 407450 - DNA, 20 bp, Artificial Sequence
  chemically synthesized
tcaaaataattacaatcatt

SEQ ID NO: 407451 - DNA, 20 bp, Artificial Sequence
  chemically synthesized
ttattttgatatactctata

SEQ ID NO: 407452 - DNA, 20 bp, Artificial Sequence
  chemically synthesized
ctttccttattttccatata

SEQ ID NO: 407453 - DNA, 20 bp, Artificial Sequence
  chemically synthesized
tactttccttattttccata

SEQ ID NO: 407454 - DNA, 20 bp, Artificial Sequence
  chemically synthesized
atatactctatatggaaaat

SEQ ID NO: 407455 - DNA, 20 bp, Artificial Sequence
  chemically synthesized
tatactctatatggaaaata

SEQ ID NO: 407456 - DNA, 20 bp, Artificial Sequence
  chemically synthesized
ctctatatggaaaataagga

SEQ ID NO: 407457 - DNA, 20 bp, Artificial Sequence
  chemically synthesized
atattttccttattttaaaa

SEQ ID NO: 407458 - DNA, 20 bp, Artificial Sequence
  chemically synthesized
tatattttccttattttaaa

SEQ ID NO: 407459 - DNA, 20 bp, Artificial Sequence
  chemically synthesized
tattttttcccttttaaaat

SEQ ID NO: 407460 - DNA, 20 bp, Artificial Sequence
  chemically synthesized
atatattttccttattttaa

SEQ ID NO: 407461 - DNA, 20 bp, Artificial Sequence
  chemically synthesized
attttttcccttttaaaata

SEQ ID NO: 407462 - DNA, 20 bp, Artificial Sequence
  chemically synthesized
aaaaaaaaaaaaaaaaaata

SEQ ID NO: 407463 - DNA, 20 bp, Artificial Sequence
  chemically synthesized
caaaaaaaaaaaaaaaaaaa

SEQ ID NO: 407464 - DNA, 20 bp, Artificial Sequence
  chemically synthesized
attttttttttttttttttt

SEQ ID NO: 407465 - DNA, 20 bp, Artificial Sequence
  chemically synthesized
ttttttttttttttttgaga

SEQ ID NO: 407466 - DNA, 20 bp, Artificial Sequence
  chemically synthesized
ttttttttttttttgagacg

SEQ ID NO: 407467 - DNA, 20 bp, Artificial Sequence
  chemically synthesized
tttttttttgagacggagac

SEQ ID NO: 407468 - DNA, 20 bp, Artificial Sequence
  chemically synthesized
tccagcctggggaacagagc

SEQ ID NO: 407469 - DNA, 20 bp, Artificial Sequence
  chemically synthesized
cggagaccggctctgttccc

SEQ ID NO: 407470 - DNA, 20 bp, Artificial Sequence
  chemically synthesized
aacttccagcctggggaaca

SEQ ID NO: 407471 - DNA, 20 bp, Artificial Sequence
  chemically synthesized
ggagaccggctctgttcccc

SEQ ID NO: 407472 - DNA, 20 bp, Artificial Sequence
  chemically synthesized
tgaacttccagcctggggaa

SEQ ID NO: 407473 - DNA, 20 bp, Artificial Sequence
  chemically synthesized
accggctctgttccccaggc

SEQ ID NO: 407474 - DNA, 20 bp, Artificial Sequence
  chemically synthesized
gccactgaacttccagcctg

SEQ ID NO: 407475 - DNA, 20 bp, Artificial Sequence
  chemically synthesized
ggctctgttccccaggctgg

SEQ ID NO: 407476 - DNA, 20 bp, Artificial Sequence
  chemically synthesized
tgccactgaacttccagcct

SEQ ID NO: 407477 - DNA, 20 bp, Artificial Sequence
  chemically synthesized
gtgccactgaacttccagcc

SEQ ID NO: 407478 - DNA, 20 bp, Artificial Sequence
  chemically synthesized
tgttccccaggctggaagtt

SEQ ID NO: 407479 - DNA, 20 bp, Artificial Sequence
  chemically synthesized
agatcgtgccactgaacttc

SEQ ID NO: 407480 - DNA, 20 bp, Artificial Sequence
  chemically synthesized
tccccaggctggaagttcag

SEQ ID NO: 407481 - DNA, 20 bp, Artificial Sequence
  chemically synthesized
agcggaggttgcagtgagtt

SEQ ID NO: 407482 - DNA, 20 bp, Artificial Sequence
  chemically synthesized
caggaagcggaggttgcagt

SEQ ID NO: 407483 - DNA, 20 bp, Artificial Sequence
  chemically synthesized
aacccaggaagcggaggttg

SEQ ID NO: 407484 - DNA, 20 bp, Artificial Sequence
  chemically synthesized
tgcttgaacccaggaagcgg

SEQ ID NO: 407485 - DNA, 20 bp, Artificial Sequence
  chemically synthesized
tcactgcaacctccgcttcc

SEQ ID NO: 407486 - DNA, 20 bp, Artificial Sequence
  chemically synthesized
ttgcttgaacccaggaagcg

SEQ ID NO: 407487 - DNA, 20 bp, Artificial Sequence
  chemically synthesized
cactgcaacctccgcttcct

SEQ ID NO: 407488 - DNA, 20 bp, Artificial Sequence
  chemically synthesized
agttgcttgaacccaggaag

SEQ ID NO: 407489 - DNA, 20 bp, Artificial Sequence
  chemically synthesized
gagagttgcttgaacccagg

SEQ ID NO: 407490 - DNA, 20 bp, Artificial Sequence
  chemically synthesized
aacctccgcttcctgggttc

SEQ ID NO: 407491 - DNA, 20 bp, Artificial Sequence
  chemically synthesized
caggagagttgcttgaaccc

SEQ ID NO: 407492 - DNA, 20 bp, Artificial Sequence
  chemically synthesized
gcaggagagttgcttgaacc

SEQ ID NO: 407493 - DNA, 20 bp, Artificial Sequence
  chemically synthesized
cttgggaggctgaggcagga

SEQ ID NO: 407494 - DNA, 20 bp, Artificial Sequence
  chemically synthesized
ttcaagcaactctcctgcct

SEQ ID NO: 407495 - DNA, 20 bp, Artificial Sequence
  chemically synthesized
ttcttgggaggctgaggcag

SEQ ID NO: 407496 - DNA, 20 bp, Artificial Sequence
  chemically synthesized
acttcttgggaggctgaggc

SEQ ID NO: 407497 - DNA, 20 bp, Artificial Sequence
  chemically synthesized
aacttcttgggaggctgagg

SEQ ID NO: 407498 - DNA, 20 bp, Artificial Sequence
  chemically synthesized
cccaacttcttgggaggctg

SEQ ID NO: 407499 - DNA, 20 bp, Artificial Sequence
  chemically synthesized
tcccaacttcttgggaggct

SEQ ID NO: 407500 - DNA, 20 bp, Artificial Sequence
  chemically synthesized
ctctcctgcctcagcctccc

SEQ ID NO: 407501 - DNA, 20 bp, Artificial Sequence
  chemically synthesized
tcctgcctcagcctcccaag

SEQ ID NO: 407502 - DNA, 20 bp, Artificial Sequence
  chemically synthesized
tgtagtcccaacttcttggg

SEQ ID NO: 407503 - DNA, 20 bp, Artificial Sequence
  chemically synthesized
ctgtagtcccaacttcttgg

SEQ ID NO: 407504 - DNA, 20 bp, Artificial Sequence
  chemically synthesized
gcctcagcctcccaagaagt

SEQ ID NO: 407505 - DNA, 20 bp, Artificial Sequence
  chemically synthesized
gcctgtagtcccaacttctt

SEQ ID NO: 407506 - DNA, 20 bp, Artificial Sequence
  chemically synthesized
cctcagcctcccaagaagtt

SEQ ID NO: 407507 - DNA, 20 bp, Artificial Sequence
  chemically synthesized
tgcctgtagtcccaacttct

SEQ ID NO: 407508 - DNA, 20 bp, Artificial Sequence
  chemically synthesized
ctcccaagaagttgggacta

SEQ ID NO: 407509 - DNA, 20 bp, Artificial Sequence
  chemically synthesized
tcccaagaagttgggactac

SEQ ID NO: 407510 - DNA, 20 bp, Artificial Sequence
  chemically synthesized
aagaagttgggactacaggc

SEQ ID NO: 407511 - DNA, 20 bp, Artificial Sequence
  chemically synthesized
ggcgtggtggcacttgcctg

SEQ ID NO: 407512 - DNA, 20 bp, Artificial Sequence
  chemically synthesized
caggcaagtgccaccacgcc

SEQ ID NO: 407513 - DNA, 20 bp, Artificial Sequence
  chemically synthesized
caaaaattagctgggcgtgg

SEQ ID NO: 407514 - DNA, 20 bp, Artificial Sequence
  chemically synthesized
atacaaaaattagctgggcg

SEQ ID NO: 407515 - DNA, 20 bp, Artificial Sequence
  chemically synthesized
taaaaatacaaaaattagct

SEQ ID NO: 407516 - DNA, 20 bp, Artificial Sequence
  chemically synthesized
ctaaaaatacaaaaattagc

SEQ ID NO: 407517 - DNA, 20 bp, Artificial Sequence
  chemically synthesized
tctactaaaaatacaaaaat

SEQ ID NO: 407518 - DNA, 20 bp, Artificial Sequence
  chemically synthesized
ccagctaatttttgtatttt

SEQ ID NO: 407519 - DNA, 20 bp, Artificial Sequence
  chemically synthesized
gctaatttttgtatttttag

SEQ ID NO: 407520 - DNA, 20 bp, Artificial Sequence
  chemically synthesized
taatttttgtatttttagta

SEQ ID NO: 407521 - DNA, 20 bp, Artificial Sequence
  chemically synthesized
ttttgtatttttagtagaga

SEQ ID NO: 407522 - DNA, 20 bp, Artificial Sequence
  chemically synthesized
tttgtatttttagtagagac

SEQ ID NO: 407523 - DNA, 20 bp, Artificial Sequence
  chemically synthesized
ttgtatttttagtagagacg

SEQ ID NO: 407524 - DNA, 20 bp, Artificial Sequence
  chemically synthesized
gagacggggttttaccatgt

SEQ ID NO: 407525 - DNA, 20 bp, Artificial Sequence
  chemically synthesized
cggggttttaccatgttggc

SEQ ID NO: 407526 - DNA, 20 bp, Artificial Sequence
  chemically synthesized
cgagactggcctggccaaca

SEQ ID NO: 407527 - DNA, 20 bp, Artificial Sequence
  chemically synthesized
ggggttttaccatgttggcc

SEQ ID NO: 407528 - DNA, 20 bp, Artificial Sequence
  chemically synthesized
ttttaccatgttggccaggc

SEQ ID NO: 407529 - DNA, 20 bp, Artificial Sequence
  chemically synthesized
tcaggagttcgagactggcc

SEQ ID NO: 407530 - DNA, 20 bp, Artificial Sequence
  chemically synthesized
tgaggtcaggagttcgagac

SEQ ID NO: 407531 - DNA, 20 bp, Artificial Sequence
  chemically synthesized
tcacctgaggtcaggagttc

SEQ ID NO: 407532 - DNA, 20 bp, Artificial Sequence
  chemically synthesized
cagtctcgaactcctgacct

SEQ ID NO: 407533 - DNA, 20 bp, Artificial Sequence
  chemically synthesized
ggcagatcacctgaggtcag

SEQ ID NO: 407534 - DNA, 20 bp, Artificial Sequence
  chemically synthesized
agtctcgaactcctgacctc

SEQ ID NO: 407535 - DNA, 20 bp, Artificial Sequence
  chemically synthesized
cgggcagatcacctgaggtc

SEQ ID NO: 407536 - DNA, 20 bp, Artificial Sequence
  chemically synthesized
gcgggcagatcacctgaggt

SEQ ID NO: 407537 - DNA, 20 bp, Artificial Sequence
  chemically synthesized
cgaggcgggcagatcacctg

SEQ ID NO: 407538 - DNA, 20 bp, Artificial Sequence
  chemically synthesized
ccgaggcgggcagatcacct

SEQ ID NO: 407539 - DNA, 20 bp, Artificial Sequence
  chemically synthesized
ctcaggtgatctgcccgcct

SEQ ID NO: 407540 - DNA, 20 bp, Artificial Sequence
  chemically synthesized
ctttgggaggccgaggcggg

SEQ ID NO: 407541 - DNA, 20 bp, Artificial Sequence
  chemically synthesized
gcactttgggaggccgaggc

SEQ ID NO: 407542 - DNA, 20 bp, Artificial Sequence
  chemically synthesized
agcactttgggaggccgagg

SEQ ID NO: 407543 - DNA, 20 bp, Artificial Sequence
  chemically synthesized
cccagcactttgggaggccg

SEQ ID NO: 407544 - DNA, 20 bp, Artificial Sequence
  chemically synthesized
tcccagcactttgggaggcc

SEQ ID NO: 407545 - DNA, 20 bp, Artificial Sequence
  chemically synthesized
ctgcccgcctcggcctccca

SEQ ID NO: 407546 - DNA, 20 bp, Artificial Sequence
  chemically synthesized
tgtaatcccagcactttggg

SEQ ID NO: 407547 - DNA, 20 bp, Artificial Sequence
  chemically synthesized
ttgtaatcccagcactttgg

SEQ ID NO: 407548 - DNA, 20 bp, Artificial Sequence
  chemically synthesized
gcctcggcctcccaaagtgc

SEQ ID NO: 407549 - DNA, 20 bp, Artificial Sequence
  chemically synthesized
acttgtaatcccagcacttt

SEQ ID NO: 407550 - DNA, 20 bp, Artificial Sequence
  chemically synthesized
cctcggcctcccaaagtgct

SEQ ID NO: 407551 - DNA, 20 bp, Artificial Sequence
  chemically synthesized
cacttgtaatcccagcactt

SEQ ID NO: 407552 - DNA, 20 bp, Artificial Sequence
  chemically synthesized
tcccaaagtgctgggattac

SEQ ID NO: 407553 - DNA, 20 bp, Artificial Sequence
  chemically synthesized
gtgactcacacttgtaatcc

SEQ ID NO: 407554 - DNA, 20 bp, Artificial Sequence
  chemically synthesized
agtgctgggattacaagtgt

SEQ ID NO: 407555 - DNA, 20 bp, Artificial Sequence
  chemically synthesized
aaggatatttaggtcgggcg

SEQ ID NO: 407556 - DNA, 20 bp, Artificial Sequence
  chemically synthesized
atttaaaggatatttaggtc

SEQ ID NO: 407557 - DNA, 20 bp, Artificial Sequence
  chemically synthesized
gatttaaaggatatttaggt

SEQ ID NO: 407558 - DNA, 20 bp, Artificial Sequence
  chemically synthesized
actagatttaaaggatattt

SEQ ID NO: 407559 - DNA, 20 bp, Artificial Sequence
  chemically synthesized
cactagatttaaaggatatt

SEQ ID NO: 407560 - DNA, 20 bp, Artificial Sequence
  chemically synthesized
acctaaatatcctttaaatc

SEQ ID NO: 407561 - DNA, 20 bp, Artificial Sequence
  chemically synthesized
catagatacactagatttaa

SEQ ID NO: 407562 - DNA, 20 bp, Artificial Sequence
  chemically synthesized
acatagatacactagattta

SEQ ID NO: 407563 - DNA, 20 bp, Artificial Sequence
  chemically synthesized
ttatagtcacatagatacac

SEQ ID NO: 407564 - DNA, 20 bp, Artificial Sequence
  chemically synthesized
ttctcatcattatagtcaca

SEQ ID NO: 407565 - DNA, 20 bp, Artificial Sequence
  chemically synthesized
atctatgtgactataatgat

SEQ ID NO: 407566 - DNA, 20 bp, Artificial Sequence
  chemically synthesized
atcctgacttctcatcatta

SEQ ID NO: 407567 - DNA, 20 bp, Artificial Sequence
  chemically synthesized
tatgtgactataatgatgag

SEQ ID NO: 407568 - DNA, 20 bp, Artificial Sequence
  chemically synthesized
tgactataatgatgagaagt

SEQ ID NO: 407569 - DNA, 20 bp, Artificial Sequence
  chemically synthesized
gactataatgatgagaagtc

SEQ ID NO: 407570 - DNA, 20 bp, Artificial Sequence
  chemically synthesized
aagtcaggatgccttcccta

SEQ ID NO: 407571 - DNA, 20 bp, Artificial Sequence
  chemically synthesized
tctttgtttagctgtaggga

SEQ ID NO: 407572 - DNA, 20 bp, Artificial Sequence
  chemically synthesized
gtctttgtttagctgtaggg

SEQ ID NO: 407573 - DNA, 20 bp, Artificial Sequence
  chemically synthesized
aaagtctttgtttagctgta

SEQ ID NO: 407574 - DNA, 20 bp, Artificial Sequence
  chemically synthesized
aaaagtctttgtttagctgt

SEQ ID NO: 407575 - DNA, 20 bp, Artificial Sequence
  chemically synthesized
gaaaagtctttgtttagctg

SEQ ID NO: 407576 - DNA, 20 bp, Artificial Sequence
  chemically synthesized
gccttccctacagctaaaca

SEQ ID NO: 407577 - DNA, 20 bp, Artificial Sequence
  chemically synthesized
atttcagaaaagtctttgtt

SEQ ID NO: 407578 - DNA, 20 bp, Artificial Sequence
  chemically synthesized
tccaaatatacatttcagaa

SEQ ID NO: 407579 - DNA, 20 bp, Artificial Sequence
  chemically synthesized
gggtctccaaatatacattt

SEQ ID NO: 407580 - DNA, 20 bp, Artificial Sequence
  chemically synthesized
acttttctgaaatgtatatt

SEQ ID NO: 407581 - DNA, 20 bp, Artificial Sequence
  chemically synthesized
ttttctgaaatgtatatttg

SEQ ID NO: 407582 - DNA, 20 bp, Artificial Sequence
  chemically synthesized
gaaatgtatatttggagacc

SEQ ID NO: 407583 - DNA, 20 bp, Artificial Sequence
  chemically synthesized
ttcaaataaggtgaaattct

SEQ ID NO: 407584 - DNA, 20 bp, Artificial Sequence
  chemically synthesized
attcaaataaggtgaaattc

SEQ ID NO: 407585 - DNA, 20 bp, Artificial Sequence
  chemically synthesized
aagtgttttgcattcaaata

SEQ ID NO: 407586 - DNA, 20 bp, Artificial Sequence
  chemically synthesized
taagtgttttgcattcaaat

SEQ ID NO: 407587 - DNA, 20 bp, Artificial Sequence
  chemically synthesized
ttatttgaatgcaaaacact

SEQ ID NO: 407588 - DNA, 20 bp, Artificial Sequence
  chemically synthesized
atttgaatgcaaaacactta

SEQ ID NO: 407589 - DNA, 20 bp, Artificial Sequence
  chemically synthesized
tttgaatgcaaaacacttag

SEQ ID NO: 407590 - DNA, 20 bp, Artificial Sequence
  chemically synthesized
tattaagatttatttcctct

SEQ ID NO: 407591 - DNA, 20 bp, Artificial Sequence
  chemically synthesized
ttagaggaaataaatcttaa

SEQ ID NO: 407592 - DNA, 20 bp, Artificial Sequence
  chemically synthesized
ctgtaaaaatcatttctatt

SEQ ID NO: 407593 - DNA, 20 bp, Artificial Sequence
  chemically synthesized
cttaatagaaatgattttta

SEQ ID NO: 407594 - DNA, 20 bp, Artificial Sequence
  chemically synthesized
ttttacagcatttcgaacac

SEQ ID NO: 407595 - DNA, 20 bp, Artificial Sequence
  chemically synthesized
catttcgaacacaagaattg

SEQ ID NO: 407596 - DNA, 20 bp, Artificial Sequence
  chemically synthesized
gtttaaaatattgttcttta

SEQ ID NO: 407597 - DNA, 20 bp, Artificial Sequence
  chemically synthesized
ttggtttacttatagcttta

SEQ ID NO: 407598 - DNA, 20 bp, Artificial Sequence
  chemically synthesized
atattgttctttaaagctat

SEQ ID NO: 407599 - DNA, 20 bp, Artificial Sequence
  chemically synthesized
tggaaacattggtttactta

SEQ ID NO: 407600 - DNA, 20 bp, Artificial Sequence
  chemically synthesized
aaaaaacagtttggaaacat

SEQ ID NO: 407601 - DNA, 20 bp, Artificial Sequence
  chemically synthesized
ttgctctagaaaaaacagtt

SEQ ID NO: 407602 - DNA, 20 bp, Artificial Sequence
  chemically synthesized
tgtttccaaactgttttttc

SEQ ID NO: 407603 - DNA, 20 bp, Artificial Sequence
  chemically synthesized
aaattttgctctagaaaaaa

SEQ ID NO: 407604 - DNA, 20 bp, Artificial Sequence
  chemically synthesized
tttccaaactgttttttcta

SEQ ID NO: 407605 - DNA, 20 bp, Artificial Sequence
  chemically synthesized
ggttctaggaaattttgctc

SEQ ID NO: 407606 - DNA, 20 bp, Artificial Sequence
  chemically synthesized
ttttctagagcaaaatttcc

SEQ ID NO: 407607 - DNA, 20 bp, Artificial Sequence
  chemically synthesized
ttcaagattattttggttct

SEQ ID NO: 407608 - DNA, 20 bp, Artificial Sequence
  chemically synthesized
tttcaagattattttggttc

SEQ ID NO: 407609 - DNA, 20 bp, Artificial Sequence
  chemically synthesized
ctaaaatttcaagattattt

SEQ ID NO: 407610 - DNA, 20 bp, Artificial Sequence
  chemically synthesized
ccaaaataatcttgaaattt

SEQ ID NO: 407611 - DNA, 20 bp, Artificial Sequence
  chemically synthesized
tttgtttaatctaaaatttc

SEQ ID NO: 407612 - DNA, 20 bp, Artificial Sequence
  chemically synthesized
ttgaaattttagattaaaca

SEQ ID NO: 407613 - DNA, 20 bp, Artificial Sequence
  chemically synthesized
ttagattaaacaaagcaaaa

SEQ ID NO: 407614 - DNA, 20 bp, Artificial Sequence
  chemically synthesized
aaacagattaaatcacctcc

SEQ ID NO: 407615 - DNA, 20 bp, Artificial Sequence
  chemically synthesized
gaagattctgagaaacttgg

SEQ ID NO: 407616 - DNA, 20 bp, Artificial Sequence
  chemically synthesized
tgaagattctgagaaacttg

SEQ ID NO: 407617 - DNA, 20 bp, Artificial Sequence
  chemically synthesized
taaatcacctccaagtttct

SEQ ID NO: 407618 - DNA, 20 bp, Artificial Sequence
  chemically synthesized
gttgaagattctgagaaact

SEQ ID NO: 407619 - DNA, 20 bp, Artificial Sequence
  chemically synthesized
atttgtatgttgaagattct

SEQ ID NO: 407620 - DNA, 20 bp, Artificial Sequence
  chemically synthesized
taacagccatttgtatgttg

SEQ ID NO: 407621 - DNA, 20 bp, Artificial Sequence
  chemically synthesized
cagaatcttcaacatacaaa

SEQ ID NO: 407622 - DNA, 20 bp, Artificial Sequence
  chemically synthesized
attcctttttgagatattaa

SEQ ID NO: 407623 - DNA, 20 bp, Artificial Sequence
  chemically synthesized
atggctgttaatatctcaaa

SEQ ID NO: 407624 - DNA, 20 bp, Artificial Sequence
  chemically synthesized
tggctgttaatatctcaaaa

SEQ ID NO: 407625 - DNA, 20 bp, Artificial Sequence
  chemically synthesized
aacagtttttattccttttt

SEQ ID NO: 407626 - DNA, 20 bp, Artificial Sequence
  chemically synthesized
ctcgtatatatttggaaaaa

SEQ ID NO: 407627 - DNA, 20 bp, Artificial Sequence
  chemically synthesized
aagtcattctcgtatatatt

SEQ ID NO: 407628 - DNA, 20 bp, Artificial Sequence
  chemically synthesized
ctgtttttccaaatatatac

SEQ ID NO: 407629 - DNA, 20 bp, Artificial Sequence
  chemically synthesized
ctaattctaggggagaaaaa

SEQ ID NO: 407630 - DNA, 20 bp, Artificial Sequence
  chemically synthesized
gaatgactttttttctcccc

SEQ ID NO: 407631 - DNA, 20 bp, Artificial Sequence
  chemically synthesized
atcaatagctaattctaggg

SEQ ID NO: 407632 - DNA, 20 bp, Artificial Sequence
  chemically synthesized
ctttttttctcccctagaat

SEQ ID NO: 407633 - DNA, 20 bp, Artificial Sequence
  chemically synthesized
gcatcaatagctaattctag

SEQ ID NO: 407634 - DNA, 20 bp, Artificial Sequence
  chemically synthesized
ggcatcaatagctaattcta

SEQ ID NO: 407635 - DNA, 20 bp, Artificial Sequence
  chemically synthesized
tggcatcaatagctaattct

SEQ ID NO: 407636 - DNA, 20 bp, Artificial Sequence
  chemically synthesized
ttggcatcaatagctaattc

SEQ ID NO: 407637 - DNA, 20 bp, Artificial Sequence
  chemically synthesized
aacactgagcttggcatcaa

SEQ ID NO: 407638 - DNA, 20 bp, Artificial Sequence
  chemically synthesized
tagaattagctattgatgcc

SEQ ID NO: 407639 - DNA, 20 bp, Artificial Sequence
  chemically synthesized
ttagctattgatgccaagct

SEQ ID NO: 407640 - DNA, 20 bp, Artificial Sequence
  chemically synthesized
tatatgagaaacactgagct

SEQ ID NO: 407641 - DNA, 20 bp, Artificial Sequence
  chemically synthesized
taaactatatgagaaacact

SEQ ID NO: 407642 - DNA, 20 bp, Artificial Sequence
  chemically synthesized
caagctcagtgtttctcata

SEQ ID NO: 407643 - DNA, 20 bp, Artificial Sequence
  chemically synthesized
ccgtgtgttttaaactatat

SEQ ID NO: 407644 - DNA, 20 bp, Artificial Sequence
  chemically synthesized
ctcatatagtttaaaacaca

SEQ ID NO: 407645 - DNA, 20 bp, Artificial Sequence
  chemically synthesized
atatagtttaaaacacacgg

SEQ ID NO: 407646 - DNA, 20 bp, Artificial Sequence
  chemically synthesized
aggatatgtttataagggaa

SEQ ID NO: 407647 - DNA, 20 bp, Artificial Sequence
  chemically synthesized
ttatcaggatatgtttataa

SEQ ID NO: 407648 - DNA, 20 bp, Artificial Sequence
  chemically synthesized
attatcaggatatgtttata

SEQ ID NO: 407649 - DNA, 20 bp, Artificial Sequence
  chemically synthesized
tattatcaggatatgtttat

SEQ ID NO: 407650 - DNA, 20 bp, Artificial Sequence
  chemically synthesized
ataaacatatcctgataata

SEQ ID NO: 407651 - DNA, 20 bp, Artificial Sequence
  chemically synthesized
ataaatgtttccatattatc

SEQ ID NO: 407652 - DNA, 20 bp, Artificial Sequence
  chemically synthesized
aataaatgtttccatattat

SEQ ID NO: 407653 - DNA, 20 bp, Artificial Sequence
  chemically synthesized
ttgcctgttttgttattagt

SEQ ID NO: 407654 - DNA, 20 bp, Artificial Sequence
  chemically synthesized
tttgttgcctgttttgttat

SEQ ID NO: 407655 - DNA, 20 bp, Artificial Sequence
  chemically synthesized
tcaactaactaataacaaaa

SEQ ID NO: 407656 - DNA, 20 bp, Artificial Sequence
  chemically synthesized
caactaactaataacaaaac

SEQ ID NO: 407657 - DNA, 20 bp, Artificial Sequence
  chemically synthesized
aacaaattaaaactgattca

SEQ ID NO: 407658 - DNA, 20 bp, Artificial Sequence
  chemically synthesized
acaaattaaaactgattcaa

SEQ ID NO: 407659 - DNA, 20 bp, Artificial Sequence
  chemically synthesized
caaattaaaactgattcaaa

SEQ ID NO: 407660 - DNA, 20 bp, Artificial Sequence
  chemically synthesized
ccttgaattcccctttgaat

SEQ ID NO: 407661 - DNA, 20 bp, Artificial Sequence
  chemically synthesized
aaattaaaactgattcaaag

SEQ ID NO: 407662 - DNA, 20 bp, Artificial Sequence
  chemically synthesized
actgattcaaaggggaattc

SEQ ID NO: 407663 - DNA, 20 bp, Artificial Sequence
  chemically synthesized
ctgattcaaaggggaattca

SEQ ID NO: 407664 - DNA, 20 bp, Artificial Sequence
  chemically synthesized
tgattcaaaggggaattcaa

SEQ ID NO: 407665 - DNA, 20 bp, Artificial Sequence
  chemically synthesized
tttctgtgactatgtgtgtt

SEQ ID NO: 407666 - DNA, 20 bp, Artificial Sequence
  chemically synthesized
ttcaagggactgaacacaca

SEQ ID NO: 407667 - DNA, 20 bp, Artificial Sequence
  chemically synthesized
ggactgaacacacatagtca

SEQ ID NO: 407668 - DNA, 20 bp, Artificial Sequence
  chemically synthesized
tgaacacacatagtcacaga

SEQ ID NO: 407669 - DNA, 20 bp, Artificial Sequence
  chemically synthesized
cacatagtcacagaaagaaa

SEQ ID NO: 407670 - DNA, 20 bp, Artificial Sequence
  chemically synthesized
atagtcacagaaagaaaaag

SEQ ID NO: 407671 - DNA, 20 bp, Artificial Sequence
  chemically synthesized
tcacagaaagaaaaagaagc

SEQ ID NO: 407672 - DNA, 20 bp, Artificial Sequence
  chemically synthesized
aaagaaaaagaagctagaac

SEQ ID NO: 407673 - DNA, 20 bp, Artificial Sequence
  chemically synthesized
ctaacttagcaatcttgttc

SEQ ID NO: 407674 - DNA, 20 bp, Artificial Sequence
  chemically synthesized
gaagctagaacaagattgct

SEQ ID NO: 407675 - DNA, 20 bp, Artificial Sequence
  chemically synthesized
ctagaacaagattgctaagt

SEQ ID NO: 407676 - DNA, 20 bp, Artificial Sequence
  chemically synthesized
aatctgttttgtttctaact

SEQ ID NO: 407677 - DNA, 20 bp, Artificial Sequence
  chemically synthesized
ttgctaagttagaaacaaaa

SEQ ID NO: 407678 - DNA, 20 bp, Artificial Sequence
  chemically synthesized
caaaacagattaacatcaaa

SEQ ID NO: 407679 - DNA, 20 bp, Artificial Sequence
  chemically synthesized
gcaataaaattatatatttt

SEQ ID NO: 407680 - DNA, 20 bp, Artificial Sequence
  chemically synthesized
caataaaattatatattttg

SEQ ID NO: 407681 - DNA, 20 bp, Artificial Sequence
  chemically synthesized
aataaaattatatattttga

SEQ ID NO: 407682 - DNA, 20 bp, Artificial Sequence
  chemically synthesized
attatatattttgagggtgc

SEQ ID NO: 407683 - DNA, 20 bp, Artificial Sequence
  chemically synthesized
tatattttgagggtgccaga

SEQ ID NO: 407684 - DNA, 20 bp, Artificial Sequence
  chemically synthesized
agagacaagtaatatctttc

SEQ ID NO: 407685 - DNA, 20 bp, Artificial Sequence
  chemically synthesized
tttttgttcagtagagagac

SEQ ID NO: 407686 - DNA, 20 bp, Artificial Sequence
  chemically synthesized
acacatttttgttcagtaga

SEQ ID NO: 407687 - DNA, 20 bp, Artificial Sequence
  chemically synthesized
gtacacatttttgttcagta

SEQ ID NO: 407688 - DNA, 20 bp, Artificial Sequence
  chemically synthesized
atgtacacatttttgttcag

SEQ ID NO: 407689 - DNA, 20 bp, Artificial Sequence
  chemically synthesized
taaatgtacacatttttgtt

SEQ ID NO: 407690 - DNA, 20 bp, Artificial Sequence
  chemically synthesized
tacatttatgtaaaatttct

SEQ ID NO: 407691 - DNA, 20 bp, Artificial Sequence
  chemically synthesized
tgtaaaatttctcagaatct

SEQ ID NO: 407692 - DNA, 20 bp, Artificial Sequence
  chemically synthesized
ttgattagggcttagattct

SEQ ID NO: 407693 - DNA, 20 bp, Artificial Sequence
  chemically synthesized
atttactattgattagggct

SEQ ID NO: 407694 - DNA, 20 bp, Artificial Sequence
  chemically synthesized
agaatctaagccctaatcaa

SEQ ID NO: 407695 - DNA, 20 bp, Artificial Sequence
  chemically synthesized
atagtatttactattgatta

SEQ ID NO: 407696 - DNA, 20 bp, Artificial Sequence
  chemically synthesized
tatagtatttactattgatt

SEQ ID NO: 407697 - DNA, 20 bp, Artificial Sequence
  chemically synthesized
ctatagtatttactattgat

SEQ ID NO: 407698 - DNA, 20 bp, Artificial Sequence
  chemically synthesized
ctaatcaatagtaaatacta

SEQ ID NO: 407699 - DNA, 20 bp, Artificial Sequence
  chemically synthesized
taatcaatagtaaatactat

SEQ ID NO: 407700 - DNA, 20 bp, Artificial Sequence
  chemically synthesized
aatcaatagtaaatactata

SEQ ID NO: 407701 - DNA, 20 bp, Artificial Sequence
  chemically synthesized
tattgactatagtcacccta

SEQ ID NO: 407702 - DNA, 20 bp, Artificial Sequence
  chemically synthesized
taaatactatagggtgacta

SEQ ID NO: 407703 - DNA, 20 bp, Artificial Sequence
  chemically synthesized
aagtaagttattattgacta

SEQ ID NO: 407704 - DNA, 20 bp, Artificial Sequence
  chemically synthesized
ttatttaaaaatgtacaagt

SEQ ID NO: 407705 - DNA, 20 bp, Artificial Sequence
  chemically synthesized
ttagttatttaaaaatgtac

SEQ ID NO: 407706 - DNA, 20 bp, Artificial Sequence
  chemically synthesized
ttgtacatttttaaataact

SEQ ID NO: 407707 - DNA, 20 bp, Artificial Sequence
  chemically synthesized
gtacatttttaaataactaa

SEQ ID NO: 407708 - DNA, 20 bp, Artificial Sequence
  chemically synthesized
aaacaatccagttatactct

SEQ ID NO: 407709 - DNA, 20 bp, Artificial Sequence
  chemically synthesized
taaataactaagagtataac

SEQ ID NO: 407710 - DNA, 20 bp, Artificial Sequence
  chemically synthesized
cctttgtgttacaaacaatc

SEQ ID NO: 407711 - DNA, 20 bp, Artificial Sequence
  chemically synthesized
actggattgtttgtaacaca

SEQ ID NO: 407712 - DNA, 20 bp, Artificial Sequence
  chemically synthesized
ctggattgtttgtaacacaa

SEQ ID NO: 407713 - DNA, 20 bp, Artificial Sequence
  chemically synthesized
aacacaaaggataaatgctt

SEQ ID NO: 407714 - DNA, 20 bp, Artificial Sequence
  chemically synthesized
acacaaaggataaatgctta

SEQ ID NO: 407715 - DNA, 20 bp, Artificial Sequence
  chemically synthesized
aggataaatgcttaaggtaa

SEQ ID NO: 407716 - DNA, 20 bp, Artificial Sequence
  chemically synthesized
aatggggcatctattacctt

SEQ ID NO: 407717 - DNA, 20 bp, Artificial Sequence
  chemically synthesized
ttatcacatcagaataaatg

SEQ ID NO: 407718 - DNA, 20 bp, Artificial Sequence
  chemically synthesized
gttatcacatcagaataaat

SEQ ID NO: 407719 - DNA, 20 bp, Artificial Sequence
  chemically synthesized
agttatcacatcagaataaa

SEQ ID NO: 407720 - DNA, 20 bp, Artificial Sequence
  chemically synthesized
acaatgcatagttatcacat

SEQ ID NO: 407721 - DNA, 20 bp, Artificial Sequence
  chemically synthesized
tgatacagacatacaatgca

SEQ ID NO: 407722 - DNA, 20 bp, Artificial Sequence
  chemically synthesized
gcacatgagatattttgata

SEQ ID NO: 407723 - DNA, 20 bp, Artificial Sequence
  chemically synthesized
catataatttggaagcacat

SEQ ID NO: 407724 - DNA, 20 bp, Artificial Sequence
  chemically synthesized
agtaggtgcatataatttgg

SEQ ID NO: 407725 - DNA, 20 bp, Artificial Sequence
  chemically synthesized
catagtaggtgcatataatt

SEQ ID NO: 407726 - DNA, 20 bp, Artificial Sequence
  chemically synthesized
tttttttgtgggtacatagt

SEQ ID NO: 407727 - DNA, 20 bp, Artificial Sequence
  chemically synthesized
atttttttgtgggtacatag

SEQ ID NO: 407728 - DNA, 20 bp, Artificial Sequence
  chemically synthesized
ataatttttttgtgggtaca

SEQ ID NO: 407729 - DNA, 20 bp, Artificial Sequence
  chemically synthesized
ttaaaagataatttttttgt

SEQ ID NO: 407730 - DNA, 20 bp, Artificial Sequence
  chemically synthesized
cttaaaagataatttttttg

SEQ ID NO: 407731 - DNA, 20 bp, Artificial Sequence
  chemically synthesized
ccacaaaaaaattatctttt

SEQ ID NO: 407732 - DNA, 20 bp, Artificial Sequence
  chemically synthesized
aaaaaaattatcttttaagt

SEQ ID NO: 407733 - DNA, 20 bp, Artificial Sequence
  chemically synthesized
ataacttagtactaacttaa

SEQ ID NO: 407734 - DNA, 20 bp, Artificial Sequence
  chemically synthesized
ttatcttttaagttagtact

SEQ ID NO: 407735 - DNA, 20 bp, Artificial Sequence
  chemically synthesized
acatgcgtctttgtataact

SEQ ID NO: 407736 - DNA, 20 bp, Artificial Sequence
  chemically synthesized
agttagtactaagttataca

SEQ ID NO: 407737 - DNA, 20 bp, Artificial Sequence
  chemically synthesized
acagatagtttaatttgtta

SEQ ID NO: 407738 - DNA, 20 bp, Artificial Sequence
  chemically synthesized
gacagatagtttaatttgtt

SEQ ID NO: 407739 - DNA, 20 bp, Artificial Sequence
  chemically synthesized
cgacagatagtttaatttgt

SEQ ID NO: 407740 - DNA, 20 bp, Artificial Sequence
  chemically synthesized
taacaaattaaactatctgt

SEQ ID NO: 407741 - DNA, 20 bp, Artificial Sequence
  chemically synthesized
ctaaaagatctaccgacaga

SEQ ID NO: 407742 - DNA, 20 bp, Artificial Sequence
  chemically synthesized
caaattaaactatctgtcgg

SEQ ID NO: 407743 - DNA, 20 bp, Artificial Sequence
  chemically synthesized
ttgtctaaaagatctaccga

SEQ ID NO: 407744 - DNA, 20 bp, Artificial Sequence
  chemically synthesized
ctatctgtcggtagatcttt

SEQ ID NO: 407745 - DNA, 20 bp, Artificial Sequence
  chemically synthesized
tactaaaaagtattgtctaa

SEQ ID NO: 407746 - DNA, 20 bp, Artificial Sequence
  chemically synthesized
atcttttagacaatactttt

SEQ ID NO: 407747 - DNA, 20 bp, Artificial Sequence
  chemically synthesized
tcttttattatcatactaaa

SEQ ID NO: 407748 - DNA, 20 bp, Artificial Sequence
  chemically synthesized
actttttagtatgataataa

SEQ ID NO: 407749 - DNA, 20 bp, Artificial Sequence
  chemically synthesized
aaataaggcaaaagaacaag

SEQ ID NO: 407750 - DNA, 20 bp, Artificial Sequence
  chemically synthesized
tggaaataaggcaaaagaac

SEQ ID NO: 407751 - DNA, 20 bp, Artificial Sequence
  chemically synthesized
aaaacttggaaataaggcaa

SEQ ID NO: 407752 - DNA, 20 bp, Artificial Sequence
  chemically synthesized
tgttcttttgccttatttcc

SEQ ID NO: 407753 - DNA, 20 bp, Artificial Sequence
  chemically synthesized
aactctaaaacttggaaata

SEQ ID NO: 407754 - DNA, 20 bp, Artificial Sequence
  chemically synthesized
aaactctaaaacttggaaat

SEQ ID NO: 407755 - DNA, 20 bp, Artificial Sequence
  chemically synthesized
tttgccttatttccaagttt

SEQ ID NO: 407756 - DNA, 20 bp, Artificial Sequence
  chemically synthesized
tgccttatttccaagtttta

SEQ ID NO: 407757 - DNA, 20 bp, Artificial Sequence
  chemically synthesized
gcttgttaaactctaaaact

SEQ ID NO: 407758 - DNA, 20 bp, Artificial Sequence
  chemically synthesized
tccaagttttagagtttaac

SEQ ID NO: 407759 - DNA, 20 bp, Artificial Sequence
  chemically synthesized
tgagtaattatgacacattc

SEQ ID NO: 407760 - DNA, 20 bp, Artificial Sequence
  chemically synthesized
aattacgtgagtaattaaat

SEQ ID NO: 407761 - DNA, 20 bp, Artificial Sequence
  chemically synthesized
tgacacttaagtaattacgt

SEQ ID NO: 407762 - DNA, 20 bp, Artificial Sequence
  chemically synthesized
aattactcacgtaattactt

SEQ ID NO: 407763 - DNA, 20 bp, Artificial Sequence
  chemically synthesized
tcacgtaattacttaagtgt

SEQ ID NO: 407764 - DNA, 20 bp, Artificial Sequence
  chemically synthesized
cacgtaattacttaagtgtc

SEQ ID NO: 407765 - DNA, 20 bp, Artificial Sequence
  chemically synthesized
cagcacaatgcctgacactt

SEQ ID NO: 407766 - DNA, 20 bp, Artificial Sequence
  chemically synthesized
ttaagtgtcaggcattgtgc

SEQ ID NO: 407767 - DNA, 20 bp, Artificial Sequence
  chemically synthesized
taagtgtcaggcattgtgct

SEQ ID NO: 407768 - DNA, 20 bp, Artificial Sequence
  chemically synthesized
aagtgtcaggcattgtgctg

SEQ ID NO: 407769 - DNA, 20 bp, Artificial Sequence
  chemically synthesized
tcaggcattgtgctggggac

SEQ ID NO: 407770 - DNA, 20 bp, Artificial Sequence
  chemically synthesized
caggcattgtgctggggact

SEQ ID NO: 407771 - DNA, 20 bp, Artificial Sequence
  chemically synthesized
aggcattgtgctggggacta

SEQ ID NO: 407772 - DNA, 20 bp, Artificial Sequence
  chemically synthesized
cctatcatctccctagtccc

SEQ ID NO: 407773 - DNA, 20 bp, Artificial Sequence
  chemically synthesized
gcattgtgctggggactagg

SEQ ID NO: 407774 - DNA, 20 bp, Artificial Sequence
  chemically synthesized
ccagttccctatcatctccc

SEQ ID NO: 407775 - DNA, 20 bp, Artificial Sequence
  chemically synthesized
gctggggactagggagatga

SEQ ID NO: 407776 - DNA, 20 bp, Artificial Sequence
  chemically synthesized
ctggggactagggagatgat

SEQ ID NO: 407777 - DNA, 20 bp, Artificial Sequence
  chemically synthesized
tggggactagggagatgata

SEQ ID NO: 407778 - DNA, 20 bp, Artificial Sequence
  chemically synthesized
ctagggagatgatagggaac

SEQ ID NO: 407779 - DNA, 20 bp, Artificial Sequence
  chemically synthesized
aaaaagtatgggcatttatc

SEQ ID NO: 407780 - DNA, 20 bp, Artificial Sequence
  chemically synthesized
agtaagcttctaaaaagtat

SEQ ID NO: 407781 - DNA, 20 bp, Artificial Sequence
  chemically synthesized
ggataaatgcccatactttt

SEQ ID NO: 407782 - DNA, 20 bp, Artificial Sequence
  chemically synthesized
tagtaagcttctaaaaagta

SEQ ID NO: 407783 - DNA, 20 bp, Artificial Sequence
  chemically synthesized
taaatgcccatactttttag

SEQ ID NO: 407784 - DNA, 20 bp, Artificial Sequence
  chemically synthesized
ctcattagtaagcttctaaa

SEQ ID NO: 407785 - DNA, 20 bp, Artificial Sequence
  chemically synthesized
ctttttagaagcttactaat

SEQ ID NO: 407786 - DNA, 20 bp, Artificial Sequence
  chemically synthesized
tttttagaagcttactaatg

SEQ ID NO: 407787 - DNA, 20 bp, Artificial Sequence
  chemically synthesized
tgtcattatccctcattagt

SEQ ID NO: 407788 - DNA, 20 bp, Artificial Sequence
  chemically synthesized
ttttagaagcttactaatga

SEQ ID NO: 407789 - DNA, 20 bp, Artificial Sequence
  chemically synthesized
tacatgtcattatccctcat

SEQ ID NO: 407790 - DNA, 20 bp, Artificial Sequence
  chemically synthesized
gagggataatgacatgtaaa

SEQ ID NO: 407791 - DNA, 20 bp, Artificial Sequence
  chemically synthesized
agggataatgacatgtaaac

SEQ ID NO: 407792 - DNA, 20 bp, Artificial Sequence
  chemically synthesized
catgtaaacaggaaattgca

SEQ ID NO: 407793 - DNA, 20 bp, Artificial Sequence
  chemically synthesized
gtaaacaggaaattgcaaag

SEQ ID NO: 407794 - DNA, 20 bp, Artificial Sequence
  chemically synthesized
gtttgatgtatgttaaaaca

SEQ ID NO: 407795 - DNA, 20 bp, Artificial Sequence
  chemically synthesized
atgttaaaacatagttactg

SEQ ID NO: 407796 - DNA, 20 bp, Artificial Sequence
  chemically synthesized
tgttaaaacatagttactgt

SEQ ID NO: 407797 - DNA, 20 bp, Artificial Sequence
  chemically synthesized
aaaacatagttactgtgggc

SEQ ID NO: 407798 - DNA, 20 bp, Artificial Sequence
  chemically synthesized
aaacatagttactgtgggcc

SEQ ID NO: 407799 - DNA, 20 bp, Artificial Sequence
  chemically synthesized
gagccaccgcgcccggccca

SEQ ID NO: 407800 - DNA, 20 bp, Artificial Sequence
  chemically synthesized
tagttactgtgggccgggcg

SEQ ID NO: 407801 - DNA, 20 bp, Artificial Sequence
  chemically synthesized
ttactgtgggccgggcgcgg

SEQ ID NO: 407802 - DNA, 20 bp, Artificial Sequence
  chemically synthesized
caggcatgagccaccgcgcc

SEQ ID NO: 407803 - DNA, 20 bp, Artificial Sequence
  chemically synthesized
agttatgggattacaggcat

SEQ ID NO: 407804 - DNA, 20 bp, Artificial Sequence
  chemically synthesized
tcccaaagttatgggattac

SEQ ID NO: 407805 - DNA, 20 bp, Artificial Sequence
  chemically synthesized
ctcccaaagttatgggatta

SEQ ID NO: 407806 - DNA, 20 bp, Artificial Sequence
  chemically synthesized
tgcctgtaatcccataactt

SEQ ID NO: 407807 - DNA, 20 bp, Artificial Sequence
  chemically synthesized
cctcagcctcccaaagttat

SEQ ID NO: 407808 - DNA, 20 bp, Artificial Sequence
  chemically synthesized
gcctgtaatcccataacttt

SEQ ID NO: 407809 - DNA, 20 bp, Artificial Sequence
  chemically synthesized
gcctcagcctcccaaagtta

SEQ ID NO: 407810 - DNA, 20 bp, Artificial Sequence
  chemically synthesized
ctgtaatcccataactttgg

SEQ ID NO: 407811 - DNA, 20 bp, Artificial Sequence
  chemically synthesized
tgtaatcccataactttggg

SEQ ID NO: 407812 - DNA, 20 bp, Artificial Sequence
  chemically synthesized
ccgcccgcctcagcctccca

SEQ ID NO: 407813 - DNA, 20 bp, Artificial Sequence
  chemically synthesized
tcccataactttgggaggct

SEQ ID NO: 407814 - DNA, 20 bp, Artificial Sequence
  chemically synthesized
cccataactttgggaggctg

SEQ ID NO: 407815 - DNA, 20 bp, Artificial Sequence
  chemically synthesized
ataactttgggaggctgagg

SEQ ID NO: 407816 - DNA, 20 bp, Artificial Sequence
  chemically synthesized
taactttgggaggctgaggc

SEQ ID NO: 407817 - DNA, 20 bp, Artificial Sequence
  chemically synthesized
ctttgggaggctgaggcggg

SEQ ID NO: 407818 - DNA, 20 bp, Artificial Sequence
  chemically synthesized
acctcgtgatccgcccgcct

SEQ ID NO: 407819 - DNA, 20 bp, Artificial Sequence
  chemically synthesized
ggctgaggcgggcggatcac

SEQ ID NO: 407820 - DNA, 20 bp, Artificial Sequence
  chemically synthesized
gctgaggcgggcggatcacg

SEQ ID NO: 407821 - DNA, 20 bp, Artificial Sequence
  chemically synthesized
aggcgggcggatcacgaggt

SEQ ID NO: 407822 - DNA, 20 bp, Artificial Sequence
  chemically synthesized
ggcgggcggatcacgaggtc

SEQ ID NO: 407823 - DNA, 20 bp, Artificial Sequence
  chemically synthesized
cgggcggatcacgaggtcag

SEQ ID NO: 407824 - DNA, 20 bp, Artificial Sequence
  chemically synthesized
gatcacgaggtcaggagttc

SEQ ID NO: 407825 - DNA, 20 bp, Artificial Sequence
  chemically synthesized
cgaggtcaggagttcgagac

SEQ ID NO: 407826 - DNA, 20 bp, Artificial Sequence
  chemically synthesized
tcaggagttcgagaccagcc

SEQ ID NO: 407827 - DNA, 20 bp, Artificial Sequence
  chemically synthesized
tttcaccatattggccaggc

SEQ ID NO: 407828 - DNA, 20 bp, Artificial Sequence
  chemically synthesized
ggagtttcaccatattggcc

SEQ ID NO: 407829 - DNA, 20 bp, Artificial Sequence
  chemically synthesized
cgagaccagcctggccaata

SEQ ID NO: 407830 - DNA, 20 bp, Artificial Sequence
  chemically synthesized
cggagtttcaccatattggc

SEQ ID NO: 407831 - DNA, 20 bp, Artificial Sequence
  chemically synthesized
gagacggagtttcaccatat

SEQ ID NO: 407832 - DNA, 20 bp, Artificial Sequence
  chemically synthesized
gtatttttttagtagagacg

SEQ ID NO: 407833 - DNA, 20 bp, Artificial Sequence
  chemically synthesized
ttgtatttttttagtagaga

SEQ ID NO: 407834 - DNA, 20 bp, Artificial Sequence
  chemically synthesized
atttttgtatttttttagta

SEQ ID NO: 407835 - DNA, 20 bp, Artificial Sequence
  chemically synthesized
taatttttgtatttttttag

SEQ ID NO: 407836 - DNA, 20 bp, Artificial Sequence
  chemically synthesized
ggctaatttttgtatttttt

SEQ ID NO: 407837 - DNA, 20 bp, Artificial Sequence
  chemically synthesized
tactaaaaaaatacaaaaat

SEQ ID NO: 407838 - DNA, 20 bp, Artificial Sequence
  chemically synthesized
aaaaaaatacaaaaattagc

SEQ ID NO: 407839 - DNA, 20 bp, Artificial Sequence
  chemically synthesized
aaaaaatacaaaaattagcc

SEQ ID NO: 407840 - DNA, 20 bp, Artificial Sequence
  chemically synthesized
atacaaaaattagccgggca

SEQ ID NO: 407841 - DNA, 20 bp, Artificial Sequence
  chemically synthesized
caaaaattagccgggcatgg

SEQ ID NO: 407842 - DNA, 20 bp, Artificial Sequence
  chemically synthesized
caggtgcgtgccaccatgcc

SEQ ID NO: 407843 - DNA, 20 bp, Artificial Sequence
  chemically synthesized
ggcatggtggcacgcacctg

SEQ ID NO: 407844 - DNA, 20 bp, Artificial Sequence
  chemically synthesized
gtggcacgcacctgtagtcc

SEQ ID NO: 407845 - DNA, 20 bp, Artificial Sequence
  chemically synthesized
tcccgagtagctgggactac

SEQ ID NO: 407846 - DNA, 20 bp, Artificial Sequence
  chemically synthesized
ctcccgagtagctgggacta

SEQ ID NO: 407847 - DNA, 20 bp, Artificial Sequence
  chemically synthesized
cacctgtagtcccagctact

SEQ ID NO: 407848 - DNA, 20 bp, Artificial Sequence
  chemically synthesized
tctcagcctcccgagtagct

SEQ ID NO: 407849 - DNA, 20 bp, Artificial Sequence
  chemically synthesized
acctgtagtcccagctactc

SEQ ID NO: 407850 - DNA, 20 bp, Artificial Sequence
  chemically synthesized
gtctcagcctcccgagtagc

SEQ ID NO: 407851 - DNA, 20 bp, Artificial Sequence
  chemically synthesized
ctgtagtcccagctactcgg

SEQ ID NO: 407852 - DNA, 20 bp, Artificial Sequence
  chemically synthesized
tgtagtcccagctactcggg

SEQ ID NO: 407853 - DNA, 20 bp, Artificial Sequence
  chemically synthesized
ttctgtctcagcctcccgag

SEQ ID NO: 407854 - DNA, 20 bp, Artificial Sequence
  chemically synthesized
ttcttctgtctcagcctccc

SEQ ID NO: 407855 - DNA, 20 bp, Artificial Sequence
  chemically synthesized
tcccagctactcgggaggct

SEQ ID NO: 407856 - DNA, 20 bp, Artificial Sequence
  chemically synthesized
agctactcgggaggctgaga

SEQ ID NO: 407857 - DNA, 20 bp, Artificial Sequence
  chemically synthesized
tactcgggaggctgagacag

SEQ ID NO: 407858 - DNA, 20 bp, Artificial Sequence
  chemically synthesized
ttcaagcgattcttctgtct

SEQ ID NO: 407859 - DNA, 20 bp, Artificial Sequence
  chemically synthesized
acagaagaatcgcttgaact

SEQ ID NO: 407860 - DNA, 20 bp, Artificial Sequence
  chemically synthesized
cagaagaatcgcttgaactc

SEQ ID NO: 407861 - DNA, 20 bp, Artificial Sequence
  chemically synthesized
aacctccgcctcccgagttc

SEQ ID NO: 407862 - DNA, 20 bp, Artificial Sequence
  chemically synthesized
gaagaatcgcttgaactcgg

SEQ ID NO: 407863 - DNA, 20 bp, Artificial Sequence
  chemically synthesized
aagaatcgcttgaactcggg

SEQ ID NO: 407864 - DNA, 20 bp, Artificial Sequence
  chemically synthesized
aatcgcttgaactcgggagg

SEQ ID NO: 407865 - DNA, 20 bp, Artificial Sequence
  chemically synthesized
cactgcaacctccgcctccc

SEQ ID NO: 407866 - DNA, 20 bp, Artificial Sequence
  chemically synthesized
tcgcttgaactcgggaggcg

SEQ ID NO: 407867 - DNA, 20 bp, Artificial Sequence
  chemically synthesized
cgcttgaactcgggaggcgg

SEQ ID NO: 407868 - DNA, 20 bp, Artificial Sequence
  chemically synthesized
aactcgggaggcggaggttg

SEQ ID NO: 407869 - DNA, 20 bp, Artificial Sequence
  chemically synthesized
cgggaggcggaggttgcagt

SEQ ID NO: 407870 - DNA, 20 bp, Artificial Sequence
  chemically synthesized
ggcggaggttgcagtgagcc

SEQ ID NO: 407871 - DNA, 20 bp, Artificial Sequence
  chemically synthesized
ggagtgcagtggtgtgatct

SEQ ID NO: 407872 - DNA, 20 bp, Artificial Sequence
  chemically synthesized
tcacccaggctggagtgcag

SEQ ID NO: 407873 - DNA, 20 bp, Artificial Sequence
  chemically synthesized
gagatcacaccactgcactc

SEQ ID NO: 407874 - DNA, 20 bp, Artificial Sequence
  chemically synthesized
ctgtcacccaggctggagtg

SEQ ID NO: 407875 - DNA, 20 bp, Artificial Sequence
  chemically synthesized
cacaccactgcactccagcc

SEQ ID NO: 407876 - DNA, 20 bp, Artificial Sequence
  chemically synthesized
acaccactgcactccagcct

SEQ ID NO: 407877 - DNA, 20 bp, Artificial Sequence
  chemically synthesized
ttgctctgtcacccaggctg

SEQ ID NO: 407878 - DNA, 20 bp, Artificial Sequence
  chemically synthesized
tcttgctctgtcacccaggc

SEQ ID NO: 407879 - DNA, 20 bp, Artificial Sequence
  chemically synthesized
ctgcactccagcctgggtga

SEQ ID NO: 407880 - DNA, 20 bp, Artificial Sequence
  chemically synthesized
ggagtcttgctctgtcaccc

SEQ ID NO: 407881 - DNA, 20 bp, Artificial Sequence
  chemically synthesized
gcactccagcctgggtgaca

SEQ ID NO: 407882 - DNA, 20 bp, Artificial Sequence
  chemically synthesized
tggagtcttgctctgtcacc

SEQ ID NO: 407883 - DNA, 20 bp, Artificial Sequence
  chemically synthesized
tccagcctgggtgacagagc

SEQ ID NO: 407884 - DNA, 20 bp, Artificial Sequence
  chemically synthesized
tcttttctttttttgagatg

SEQ ID NO: 407885 - DNA, 20 bp, Artificial Sequence
  chemically synthesized
tttcttttctttttttgaga

SEQ ID NO: 407886 - DNA, 20 bp, Artificial Sequence
  chemically synthesized
gcaagactccatctcaaaaa

SEQ ID NO: 407887 - DNA, 20 bp, Artificial Sequence
  chemically synthesized
tttctttcttttcttttttt

SEQ ID NO: 407888 - DNA, 20 bp, Artificial Sequence
  chemically synthesized
actccatctcaaaaaaagaa

SEQ ID NO: 407889 - DNA, 20 bp, Artificial Sequence
  chemically synthesized
catctcaaaaaaagaaaaga

SEQ ID NO: 407890 - DNA, 20 bp, Artificial Sequence
  chemically synthesized
tcaaaaaaagaaaagaaaga

SEQ ID NO: 407891 - DNA, 20 bp, Artificial Sequence
  chemically synthesized
aaagaaagaaagaaaacaaa

SEQ ID NO: 407892 - DNA, 20 bp, Artificial Sequence
  chemically synthesized
aaaacaaaaagaaaaaaaaa

SEQ ID NO: 407893 - DNA, 20 bp, Artificial Sequence
  chemically synthesized
agaaaaaaaaatagttactg

SEQ ID NO: 407894 - DNA, 20 bp, Artificial Sequence
  chemically synthesized
gaaaaaaaaatagttactgt

SEQ ID NO: 407895 - DNA, 20 bp, Artificial Sequence
  chemically synthesized
tgtgtcatctcaacatccca

SEQ ID NO: 407896 - DNA, 20 bp, Artificial Sequence
  chemically synthesized
aatagttactgtgggatgtt

SEQ ID NO: 407897 - DNA, 20 bp, Artificial Sequence
  chemically synthesized
gggatgttgagatgacacac

SEQ ID NO: 407898 - DNA, 20 bp, Artificial Sequence
  chemically synthesized
gatgttgagatgacacacaa

SEQ ID NO: 407899 - DNA, 20 bp, Artificial Sequence
  chemically synthesized
cctagaattgacgttacagg

SEQ ID NO: 407900 - DNA, 20 bp, Artificial Sequence
  chemically synthesized
acctagaattgacgttacag

SEQ ID NO: 407901 - DNA, 20 bp, Artificial Sequence
  chemically synthesized
atacctagaattgacgttac

SEQ ID NO: 407902 - DNA, 20 bp, Artificial Sequence
  chemically synthesized
catacctagaattgacgtta

SEQ ID NO: 407903 - DNA, 20 bp, Artificial Sequence
  chemically synthesized
tcctcctgtaacgtcaattc

SEQ ID NO: 407904 - DNA, 20 bp, Artificial Sequence
  chemically synthesized
cctcctgtaacgtcaattct

SEQ ID NO: 407905 - DNA, 20 bp, Artificial Sequence
  chemically synthesized
tctcctttttggaacatacc

SEQ ID NO: 407906 - DNA, 20 bp, Artificial Sequence
  chemically synthesized
aattctaggtatgttccaaa

SEQ ID NO: 407907 - DNA, 20 bp, Artificial Sequence
  chemically synthesized
attctaggtatgttccaaaa

SEQ ID NO: 407908 - DNA, 20 bp, Artificial Sequence
  chemically synthesized
tctaggtatgttccaaaaag

SEQ ID NO: 407909 - DNA, 20 bp, Artificial Sequence
  chemically synthesized
tttaggtgatgtctcctttt

SEQ ID NO: 407910 - DNA, 20 bp, Artificial Sequence
  chemically synthesized
ctaactccagtttatcattt

SEQ ID NO: 407911 - DNA, 20 bp, Artificial Sequence
  chemically synthesized
gctaactccagtttatcatt

SEQ ID NO: 407912 - DNA, 20 bp, Artificial Sequence
  chemically synthesized
acatcacctaaatgataaac

SEQ ID NO: 407913 - DNA, 20 bp, Artificial Sequence
  chemically synthesized
atcacctaaatgataaactg

SEQ ID NO: 407914 - DNA, 20 bp, Artificial Sequence
  chemically synthesized
cctaaatgataaactggagt

SEQ ID NO: 407915 - DNA, 20 bp, Artificial Sequence
  chemically synthesized
actttttacccagctaactc

SEQ ID NO: 407916 - DNA, 20 bp, Artificial Sequence
  chemically synthesized
aatgataaactggagttagc

SEQ ID NO: 407917 - DNA, 20 bp, Artificial Sequence
  chemically synthesized
atgataaactggagttagct

SEQ ID NO: 407918 - DNA, 20 bp, Artificial Sequence
  chemically synthesized
actggagttagctgggtaaa

SEQ ID NO: 407919 - DNA, 20 bp, Artificial Sequence
  chemically synthesized
tcccacctcaactttttacc

SEQ ID NO: 407920 - DNA, 20 bp, Artificial Sequence
  chemically synthesized
agttagctgggtaaaaagtt

SEQ ID NO: 407921 - DNA, 20 bp, Artificial Sequence
  chemically synthesized
gttagctgggtaaaaagttg

SEQ ID NO: 407922 - DNA, 20 bp, Artificial Sequence
  chemically synthesized
agctgggtaaaaagttgagg

SEQ ID NO: 407923 - DNA, 20 bp, Artificial Sequence
  chemically synthesized
gctgggtaaaaagttgaggt

SEQ ID NO: 407924 - DNA, 20 bp, Artificial Sequence
  chemically synthesized
tgggtaaaaagttgaggtgg

SEQ ID NO: 407925 - DNA, 20 bp, Artificial Sequence
  chemically synthesized
gaggtgggagatgacatttc

SEQ ID NO: 407926 - DNA, 20 bp, Artificial Sequence
  chemically synthesized
gtgggagatgacatttccag

SEQ ID NO: 407927 - DNA, 20 bp, Artificial Sequence
  chemically synthesized
tctagcttctgttattcttc

SEQ ID NO: 407928 - DNA, 20 bp, Artificial Sequence
  chemically synthesized
tgacatttccagaagaataa

SEQ ID NO: 407929 - DNA, 20 bp, Artificial Sequence
  chemically synthesized
catttccagaagaataacag

SEQ ID NO: 407930 - DNA, 20 bp, Artificial Sequence
  chemically synthesized
tccagaagaataacagaagc

SEQ ID NO: 407931 - DNA, 20 bp, Artificial Sequence
  chemically synthesized
aagaataacagaagctagaa

SEQ ID NO: 407932 - DNA, 20 bp, Artificial Sequence
  chemically synthesized
tgtcatacaagtcactattc

SEQ ID NO: 407933 - DNA, 20 bp, Artificial Sequence
  chemically synthesized
acgtactaatcatgtcatac

SEQ ID NO: 407934 - DNA, 20 bp, Artificial Sequence
  chemically synthesized
agtgacttgtatgacatgat

SEQ ID NO: 407935 - DNA, 20 bp, Artificial Sequence
  chemically synthesized
gtacgtacaatgtcgttctt

SEQ ID NO: 407936 - DNA, 20 bp, Artificial Sequence
  chemically synthesized
tacgtacaatgtcgttcttg

SEQ ID NO: 407937 - DNA, 20 bp, Artificial Sequence
  chemically synthesized
acgtacaatgtcgttcttga

SEQ ID NO: 407938 - DNA, 20 bp, Artificial Sequence
  chemically synthesized
acaatgtcgttcttgaggga

SEQ ID NO: 407939 - DNA, 20 bp, Artificial Sequence
  chemically synthesized
caatgtcgttcttgagggat

SEQ ID NO: 407940 - DNA, 20 bp, Artificial Sequence
  chemically synthesized
accgaacccacccatccctc

SEQ ID NO: 407941 - DNA, 20 bp, Artificial Sequence
  chemically synthesized
tgtcgttcttgagggatggg

SEQ ID NO: 407942 - DNA, 20 bp, Artificial Sequence
  chemically synthesized
gtcgttcttgagggatgggt

SEQ ID NO: 407943 - DNA, 20 bp, Artificial Sequence
  chemically synthesized
tcttgagggatgggtgggtt

SEQ ID NO: 407944 - DNA, 20 bp, Artificial Sequence
  chemically synthesized
tgagggatgggtgggttcgg

SEQ ID NO: 407945 - DNA, 20 bp, Artificial Sequence
  chemically synthesized
gagggatgggtgggttcggt

SEQ ID NO: 407946 - DNA, 20 bp, Artificial Sequence
  chemically synthesized
ggatgggtgggttcggtggg

SEQ ID NO: 407947 - DNA, 20 bp, Artificial Sequence
  chemically synthesized
gatgggtgggttcggtgggt

SEQ ID NO: 407948 - DNA, 20 bp, Artificial Sequence
  chemically synthesized
gggtgggttcggtgggtggg

SEQ ID NO: 407949 - DNA, 20 bp, Artificial Sequence
  chemically synthesized
ggtgggttcggtgggtggga

SEQ ID NO: 407950 - DNA, 20 bp, Artificial Sequence
  chemically synthesized
gtgggttcggtgggtgggaa

SEQ ID NO: 407951 - DNA, 20 bp, Artificial Sequence
  chemically synthesized
tgggttcggtgggtgggaag

SEQ ID NO: 407952 - DNA, 20 bp, Artificial Sequence
  chemically synthesized
ggtgggaaggggtgaatgta

SEQ ID NO: 407953 - DNA, 20 bp, Artificial Sequence
  chemically synthesized
tgggaaggggtgaatgtaaa

SEQ ID NO: 407954 - DNA, 20 bp, Artificial Sequence
  chemically synthesized
aaggggtgaatgtaaagaga

SEQ ID NO: 407955 - DNA, 20 bp, Artificial Sequence
  chemically synthesized
gtgaatgtaaagagatagtg

SEQ ID NO: 407956 - DNA, 20 bp, Artificial Sequence
  chemically synthesized
gaatgtaaagagatagtgca

SEQ ID NO: 407957 - DNA, 20 bp, Artificial Sequence
  chemically synthesized
aatgtaaagagatagtgcag

SEQ ID NO: 407958 - DNA, 20 bp, Artificial Sequence
  chemically synthesized
atagtgcagaggccaattaa

SEQ ID NO: 407959 - DNA, 20 bp, Artificial Sequence
  chemically synthesized
agtgcagaggccaattaatg

SEQ ID NO: 407960 - DNA, 20 bp, Artificial Sequence
  chemically synthesized
ctaccaatctctccattaat

SEQ ID NO: 407961 - DNA, 20 bp, Artificial Sequence
  chemically synthesized
tgcagaggccaattaatgga

SEQ ID NO: 407962 - DNA, 20 bp, Artificial Sequence
  chemically synthesized
aggccaattaatggagagat

SEQ ID NO: 407963 - DNA, 20 bp, Artificial Sequence
  chemically synthesized
ccaattaatggagagattgg

SEQ ID NO: 407964 - DNA, 20 bp, Artificial Sequence
  chemically synthesized
aattaatggagagattggta

SEQ ID NO: 407965 - DNA, 20 bp, Artificial Sequence
  chemically synthesized
gagattggtagagcatctta

SEQ ID NO: 407966 - DNA, 20 bp, Artificial Sequence
  chemically synthesized
aagtgaaatctgaattctat

SEQ ID NO: 407967 - DNA, 20 bp, Artificial Sequence
  chemically synthesized
gtagagcatcttatagaatt

SEQ ID NO: 407968 - DNA, 20 bp, Artificial Sequence
  chemically synthesized
tagaattcagatttcacttt

SEQ ID NO: 407969 - DNA, 20 bp, Artificial Sequence
  chemically synthesized
agaattcagatttcactttt

SEQ ID NO: 407970 - DNA, 20 bp, Artificial Sequence
  chemically synthesized
gaattcagatttcacttttg

SEQ ID NO: 407971 - DNA, 20 bp, Artificial Sequence
  chemically synthesized
ccaaattctcattgccccaa

SEQ ID NO: 407972 - DNA, 20 bp, Artificial Sequence
  chemically synthesized
gatttcacttttggggcaat

SEQ ID NO: 407973 - DNA, 20 bp, Artificial Sequence
  chemically synthesized
cttttggggcaatgagaatt

SEQ ID NO: 407974 - DNA, 20 bp, Artificial Sequence
  chemically synthesized
caatgagaatttggcataat

SEQ ID NO: 407975 - DNA, 20 bp, Artificial Sequence
  chemically synthesized
tgagaatttggcataatgag

SEQ ID NO: 407976 - DNA, 20 bp, Artificial Sequence
  chemically synthesized
agttttcctaaaatgtaagt

SEQ ID NO: 407977 - DNA, 20 bp, Artificial Sequence
  chemically synthesized
gcattatctgacttacattt

SEQ ID NO: 407978 - DNA, 20 bp, Artificial Sequence
  chemically synthesized
cattatctgacttacatttt

SEQ ID NO: 407979 - DNA, 20 bp, Artificial Sequence
  chemically synthesized
aaagagttttcctaaaatgt

SEQ ID NO: 407980 - DNA, 20 bp, Artificial Sequence
  chemically synthesized
ttcccaattgttatcaaaaa

SEQ ID NO: 407981 - DNA, 20 bp, Artificial Sequence
  chemically synthesized
ctttcccaattgttatcaaa

SEQ ID NO: 407982 - DNA, 20 bp, Artificial Sequence
  chemically synthesized
aaactctttttgataacaat

SEQ ID NO: 407983 - DNA, 20 bp, Artificial Sequence
  chemically synthesized
aactctttttgataacaatt

SEQ ID NO: 407984 - DNA, 20 bp, Artificial Sequence
  chemically synthesized
ctttttgataacaattggga

SEQ ID NO: 407985 - DNA, 20 bp, Artificial Sequence
  chemically synthesized
tttgataacaattgggaaag

SEQ ID NO: 407986 - DNA, 20 bp, Artificial Sequence
  chemically synthesized
aacaattgggaaagtggatt

SEQ ID NO: 407987 - DNA, 20 bp, Artificial Sequence
  chemically synthesized
acaattgggaaagtggattt

SEQ ID NO: 407988 - DNA, 20 bp, Artificial Sequence
  chemically synthesized
attgggaaagtggatttggg

SEQ ID NO: 407989 - DNA, 20 bp, Artificial Sequence
  chemically synthesized
aagtggatttgggaagtttg

SEQ ID NO: 407990 - DNA, 20 bp, Artificial Sequence
  chemically synthesized
tggatttgggaagtttgaag

SEQ ID NO: 407991 - DNA, 20 bp, Artificial Sequence
  chemically synthesized
ggatttgggaagtttgaaga

SEQ ID NO: 407992 - DNA, 20 bp, Artificial Sequence
  chemically synthesized
gatttgggaagtttgaagaa

SEQ ID NO: 407993 - DNA, 20 bp, Artificial Sequence
  chemically synthesized
gaagtttgaagaagggaacg

SEQ ID NO: 407994 - DNA, 20 bp, Artificial Sequence
  chemically synthesized
agaagggaacgtggcaaata

SEQ ID NO: 407995 - DNA, 20 bp, Artificial Sequence
  chemically synthesized
aagggaacgtggcaaataaa

SEQ ID NO: 407996 - DNA, 20 bp, Artificial Sequence
  chemically synthesized
aacgtggcaaataaagagac

SEQ ID NO: 407997 - DNA, 20 bp, Artificial Sequence
  chemically synthesized
acgtggcaaataaagagaca

SEQ ID NO: 407998 - DNA, 20 bp, Artificial Sequence
  chemically synthesized
caaataaagagacaaggaat

SEQ ID NO: 407999 - DNA, 20 bp, Artificial Sequence
  chemically synthesized
aaataaagagacaaggaatc

SEQ ID NO: 408000 - DNA, 20 bp, Artificial Sequence
  chemically synthesized
ataaagagacaaggaatcag

SEQ ID NO: 408001 - DNA, 20 bp, Artificial Sequence
  chemically synthesized
taaagagacaaggaatcagg

SEQ ID NO: 408002 - DNA, 20 bp, Artificial Sequence
  chemically synthesized
tttcacctgagtgattacaa

SEQ ID NO: 408003 - DNA, 20 bp, Artificial Sequence
  chemically synthesized
aggaggctattgtaatcact

SEQ ID NO: 408004 - DNA, 20 bp, Artificial Sequence
  chemically synthesized
ggaggctattgtaatcactc

SEQ ID NO: 408005 - DNA, 20 bp, Artificial Sequence
  chemically synthesized
attgtaatcactcaggtgaa

SEQ ID NO: 408006 - DNA, 20 bp, Artificial Sequence
  chemically synthesized
tttataccaccttttcacct

SEQ ID NO: 408007 - DNA, 20 bp, Artificial Sequence
  chemically synthesized
ttgtaatcactcaggtgaaa

SEQ ID NO: 408008 - DNA, 20 bp, Artificial Sequence
  chemically synthesized
taatcactcaggtgaaaagg

SEQ ID NO: 408009 - DNA, 20 bp, Artificial Sequence
  chemically synthesized
gtgaaaaggtggtataaact

SEQ ID NO: 408010 - DNA, 20 bp, Artificial Sequence
  chemically synthesized
tgaaaaggtggtataaacta

SEQ ID NO: 408011 - DNA, 20 bp, Artificial Sequence
  chemically synthesized
ggtggtataaactaaggtaa

SEQ ID NO: 408012 - DNA, 20 bp, Artificial Sequence
  chemically synthesized
tgtttccatggctgttacct

SEQ ID NO: 408013 - DNA, 20 bp, Artificial Sequence
  chemically synthesized
ataaactaaggtaacagcca

SEQ ID NO: 408014 - DNA, 20 bp, Artificial Sequence
  chemically synthesized
taaggtaacagccatggaaa

SEQ ID NO: 408015 - DNA, 20 bp, Artificial Sequence
  chemically synthesized
atgtgatcattctgtttcca

SEQ ID NO: 408016 - DNA, 20 bp, Artificial Sequence
  chemically synthesized
tggaaacagaatgatcacat

SEQ ID NO: 408017 - DNA, 20 bp, Artificial Sequence
  chemically synthesized
tggatttgtggtttgtatgt

SEQ ID NO: 408018 - DNA, 20 bp, Artificial Sequence
  chemically synthesized
atattagttgattggatttg

SEQ ID NO: 408019 - DNA, 20 bp, Artificial Sequence
  chemically synthesized
cgtttgaaatattagttgat

SEQ ID NO: 408020 - DNA, 20 bp, Artificial Sequence
  chemically synthesized
attttgcacgtttgaaatat

SEQ ID NO: 408021 - DNA, 20 bp, Artificial Sequence
  chemically synthesized
tcaaacgtgcaaaatatgtt

SEQ ID NO: 408022 - DNA, 20 bp, Artificial Sequence
  chemically synthesized
aacgtgcaaaatatgtttgg

SEQ ID NO: 408023 - DNA, 20 bp, Artificial Sequence
  chemically synthesized
acgtgcaaaatatgtttggc

SEQ ID NO: 408024 - DNA, 20 bp, Artificial Sequence
  chemically synthesized
cgtgcaaaatatgtttggca

SEQ ID NO: 408025 - DNA, 20 bp, Artificial Sequence
  chemically synthesized
gtgcaaaatatgtttggcag

SEQ ID NO: 408026 - DNA, 20 bp, Artificial Sequence
  chemically synthesized
gtgtatagagacataattta

SEQ ID NO: 408027 - DNA, 20 bp, Artificial Sequence
  chemically synthesized
tatgtatagatatgtgtata

SEQ ID NO: 408028 - DNA, 20 bp, Artificial Sequence
  chemically synthesized
tatatgtatagatatgtgta

SEQ ID NO: 408029 - DNA, 20 bp, Artificial Sequence
  chemically synthesized
tgtgtatgtatatatatgta

SEQ ID NO: 408030 - DNA, 20 bp, Artificial Sequence
  chemically synthesized
gaatatatatataggcatat

SEQ ID NO: 408031 - DNA, 20 bp, Artificial Sequence
  chemically synthesized
ggaatatatatataggcata

SEQ ID NO: 408032 - DNA, 20 bp, Artificial Sequence
  chemically synthesized
aaactatggaatatatatat

SEQ ID NO: 408033 - DNA, 20 bp, Artificial Sequence
  chemically synthesized
aaaactatggaatatatata

SEQ ID NO: 408034 - DNA, 20 bp, Artificial Sequence
  chemically synthesized
atgcctatatatatattcca

SEQ ID NO: 408035 - DNA, 20 bp, Artificial Sequence
  chemically synthesized
ccatcactttcacaaaacta

SEQ ID NO: 408036 - DNA, 20 bp, Artificial Sequence
  chemically synthesized
tatattccatagttttgtga

SEQ ID NO: 408037 - DNA, 20 bp, Artificial Sequence
  chemically synthesized
ccatagttttgtgaaagtga

SEQ ID NO: 408038 - DNA, 20 bp, Artificial Sequence
  chemically synthesized
attgtgatcagtggatatga

SEQ ID NO: 408039 - DNA, 20 bp, Artificial Sequence
  chemically synthesized
acaaagtctattgtgatcag

SEQ ID NO: 408040 - DNA, 20 bp, Artificial Sequence
  chemically synthesized
gtcatatccactgatcacaa

SEQ ID NO: 408041 - DNA, 20 bp, Artificial Sequence
  chemically synthesized
ggcacaaagtctattgtgat

SEQ ID NO: 408042 - DNA, 20 bp, Artificial Sequence
  chemically synthesized
gcaaaataaccagaggcaca

SEQ ID NO: 408043 - DNA, 20 bp, Artificial Sequence
  chemically synthesized
cacaatagactttgtgcctc

SEQ ID NO: 408044 - DNA, 20 bp, Artificial Sequence
  chemically synthesized
atgatttgcaaaataaccag

SEQ ID NO: 408045 - DNA, 20 bp, Artificial Sequence
  chemically synthesized
aatgatttgcaaaataacca

SEQ ID NO: 408046 - DNA, 20 bp, Artificial Sequence
  chemically synthesized
taaatgatttgcaaaataac

SEQ ID NO: 408047 - DNA, 20 bp, Artificial Sequence
  chemically synthesized
tttgcaaatcatttaacaat

SEQ ID NO: 408048 - DNA, 20 bp, Artificial Sequence
  chemically synthesized
taacaattagttttcattta

SEQ ID NO: 408049 - DNA, 20 bp, Artificial Sequence
  chemically synthesized
aacaattagttttcatttaa

SEQ ID NO: 408050 - DNA, 20 bp, Artificial Sequence
  chemically synthesized
aattagttttcatttaaagg

SEQ ID NO: 408051 - DNA, 20 bp, Artificial Sequence
  chemically synthesized
ttcatttaaaggaagtttat

SEQ ID NO: 408052 - DNA, 20 bp, Artificial Sequence
  chemically synthesized
taaaggaagtttataagtta

SEQ ID NO: 408053 - DNA, 20 bp, Artificial Sequence
  chemically synthesized
ttataagttaaagtaaacat

SEQ ID NO: 408054 - DNA, 20 bp, Artificial Sequence
  chemically synthesized
caaatttattcttgaatgtt

SEQ ID NO: 408055 - DNA, 20 bp, Artificial Sequence
  chemically synthesized
atgctgagggcttaacattc

SEQ ID NO: 408056 - DNA, 20 bp, Artificial Sequence
  chemically synthesized
attcttgaatgttaagccct

SEQ ID NO: 408057 - DNA, 20 bp, Artificial Sequence
  chemically synthesized
ttcatggtcctcgatgctga

SEQ ID NO: 408058 - DNA, 20 bp, Artificial Sequence
  chemically synthesized
aatgttaagccctcagcatc

SEQ ID NO: 408059 - DNA, 20 bp, Artificial Sequence
  chemically synthesized
tttcatggtcctcgatgctg

SEQ ID NO: 408060 - DNA, 20 bp, Artificial Sequence
  chemically synthesized
atgttaagccctcagcatcg

SEQ ID NO: 408061 - DNA, 20 bp, Artificial Sequence
  chemically synthesized
ttttcatggtcctcgatgct

SEQ ID NO: 408062 - DNA, 20 bp, Artificial Sequence
  chemically synthesized
ctaattaatcagtattttca

SEQ ID NO: 408063 - DNA, 20 bp, Artificial Sequence
  chemically synthesized
ccatgaaaatactgattaat

SEQ ID NO: 408064 - DNA, 20 bp, Artificial Sequence
  chemically synthesized
ccttcgtcacactaattaat

SEQ ID NO: 408065 - DNA, 20 bp, Artificial Sequence
  chemically synthesized
actgattaattagtgtgacg

SEQ ID NO: 408066 - DNA, 20 bp, Artificial Sequence
  chemically synthesized
ctgattaattagtgtgacga

SEQ ID NO: 408067 - DNA, 20 bp, Artificial Sequence
  chemically synthesized
acgaaggaaaacattgaatt

SEQ ID NO: 408068 - DNA, 20 bp, Artificial Sequence
  chemically synthesized
aaacattgaattaagtcaac

SEQ ID NO: 408069 - DNA, 20 bp, Artificial Sequence
  chemically synthesized
aattaagtcaactagttatt

SEQ ID NO: 408070 - DNA, 20 bp, Artificial Sequence
  chemically synthesized
aataaatttaactgaataac

SEQ ID NO: 408071 - DNA, 20 bp, Artificial Sequence
  chemically synthesized
attcagttaaatttattttg

SEQ ID NO: 408072 - DNA, 20 bp, Artificial Sequence
  chemically synthesized
aatttattttgaagaaaccg

SEQ ID NO: 408073 - DNA, 20 bp, Artificial Sequence
  chemically synthesized
ttattttgaagaaaccgcag

SEQ ID NO: 408074 - DNA, 20 bp, Artificial Sequence
  chemically synthesized
tattttgaagaaaccgcaga

SEQ ID NO: 408075 - DNA, 20 bp, Artificial Sequence
  chemically synthesized
tccccctagaaaaccttctg

SEQ ID NO: 408076 - DNA, 20 bp, Artificial Sequence
  chemically synthesized
agaaaccgcagaaggttttc

SEQ ID NO: 408077 - DNA, 20 bp, Artificial Sequence
  chemically synthesized
gaaaccgcagaaggttttct

SEQ ID NO: 408078 - DNA, 20 bp, Artificial Sequence
  chemically synthesized
aaaccgcagaaggttttcta

SEQ ID NO: 408079 - DNA, 20 bp, Artificial Sequence
  chemically synthesized
aaccgcagaaggttttctag

SEQ ID NO: 408080 - DNA, 20 bp, Artificial Sequence
  chemically synthesized
accgcagaaggttttctagg

SEQ ID NO: 408081 - DNA, 20 bp, Artificial Sequence
  chemically synthesized
gcagaaggttttctaggggg

SEQ ID NO: 408082 - DNA, 20 bp, Artificial Sequence
  chemically synthesized
cgattgtgtcatcttccccc

SEQ ID NO: 408083 - DNA, 20 bp, Artificial Sequence
  chemically synthesized
tgcagccagaatgttttaaa

SEQ ID NO: 408084 - DNA, 20 bp, Artificial Sequence
  chemically synthesized
atatgctttttaaaacattc

SEQ ID NO: 408085 - DNA, 20 bp, Artificial Sequence
  chemically synthesized
ttcagttttccacatgcagc

SEQ ID NO: 408086 - DNA, 20 bp, Artificial Sequence
  chemically synthesized
taaaacattctggctgcatg

SEQ ID NO: 408087 - DNA, 20 bp, Artificial Sequence
  chemically synthesized
gtgattcagttttccacatg

SEQ ID NO: 408088 - DNA, 20 bp, Artificial Sequence
  chemically synthesized
gcatgtggaaaactgaatca

SEQ ID NO: 408089 - DNA, 20 bp, Artificial Sequence
  chemically synthesized
catgtggaaaactgaatcac

SEQ ID NO: 408090 - DNA, 20 bp, Artificial Sequence
  chemically synthesized
atgtggaaaactgaatcaca

SEQ ID NO: 408091 - DNA, 20 bp, Artificial Sequence
  chemically synthesized
tttcccccacccctgtgatt

SEQ ID NO: 408092 - DNA, 20 bp, Artificial Sequence
  chemically synthesized
tgtggaaaactgaatcacag

SEQ ID NO: 408093 - DNA, 20 bp, Artificial Sequence
  chemically synthesized
ggaaaactgaatcacagggg

SEQ ID NO: 408094 - DNA, 20 bp, Artificial Sequence
  chemically synthesized
gaaaactgaatcacaggggt

SEQ ID NO: 408095 - DNA, 20 bp, Artificial Sequence
  chemically synthesized
aaaactgaatcacaggggtg

SEQ ID NO: 408096 - DNA, 20 bp, Artificial Sequence
  chemically synthesized
aaactgaatcacaggggtgg

SEQ ID NO: 408097 - DNA, 20 bp, Artificial Sequence
  chemically synthesized
gggaaattgaacatctgttt

SEQ ID NO: 408098 - DNA, 20 bp, Artificial Sequence
  chemically synthesized
ggaaattgaacatctgtttt

SEQ ID NO: 408099 - DNA, 20 bp, Artificial Sequence
  chemically synthesized
gaaattgaacatctgtttta

SEQ ID NO: 408100 - DNA, 20 bp, Artificial Sequence
  chemically synthesized
aaattgaacatctgttttag

SEQ ID NO: 408101 - DNA, 20 bp, Artificial Sequence
  chemically synthesized
ttgttgcagttcccctaaaa

SEQ ID NO: 408102 - DNA, 20 bp, Artificial Sequence
  chemically synthesized
atgttttgccaggattgttg

SEQ ID NO: 408103 - DNA, 20 bp, Artificial Sequence
  chemically synthesized
taggggaactgcaacaatcc

SEQ ID NO: 408104 - DNA, 20 bp, Artificial Sequence
  chemically synthesized
atcagccatcatgttttgcc

SEQ ID NO: 408105 - DNA, 20 bp, Artificial Sequence
  chemically synthesized
catcagccatcatgttttgc

SEQ ID NO: 408106 - DNA, 20 bp, Artificial Sequence
  chemically synthesized
acaatcctggcaaaacatga

SEQ ID NO: 408107 - DNA, 20 bp, Artificial Sequence
  chemically synthesized
aaaacatgatggctgatgcc

SEQ ID NO: 408108 - DNA, 20 bp, Artificial Sequence
  chemically synthesized
aaacatgatggctgatgcca

SEQ ID NO: 408109 - DNA, 20 bp, Artificial Sequence
  chemically synthesized
ttctaacattaccttggcat

SEQ ID NO: 408110 - DNA, 20 bp, Artificial Sequence
  chemically synthesized
tcactgttctaacattacct

SEQ ID NO: 408111 - DNA, 20 bp, Artificial Sequence
  chemically synthesized
ggctgatgccaaggtaatgt

SEQ ID NO: 408112 - DNA, 20 bp, Artificial Sequence
  chemically synthesized
atgccaaggtaatgttagaa

SEQ ID NO: 408113 - DNA, 20 bp, Artificial Sequence
  chemically synthesized
aatgttagaacagtgatctc

SEQ ID NO: 408114 - DNA, 20 bp, Artificial Sequence
  chemically synthesized
atgttagaacagtgatctcg

SEQ ID NO: 408115 - DNA, 20 bp, Artificial Sequence
  chemically synthesized
tgttagaacagtgatctcga

SEQ ID NO: 408116 - DNA, 20 bp, Artificial Sequence
  chemically synthesized
ttagaacagtgatctcgagg

SEQ ID NO: 408117 - DNA, 20 bp, Artificial Sequence
  chemically synthesized
tcattcttgcattctccctc

SEQ ID NO: 408118 - DNA, 20 bp, Artificial Sequence
  chemically synthesized
gtgatctcgagggagaatgc

SEQ ID NO: 408119 - DNA, 20 bp, Artificial Sequence
  chemically synthesized
gccaaacttctcaggtttgg

SEQ ID NO: 408120 - DNA, 20 bp, Artificial Sequence
  chemically synthesized
agaatgatacccccaaacct

SEQ ID NO: 408121 - DNA, 20 bp, Artificial Sequence
  chemically synthesized
tgccaaacttctcaggtttg

SEQ ID NO: 408122 - DNA, 20 bp, Artificial Sequence
  chemically synthesized
gtgccaaacttctcaggttt

SEQ ID NO: 408123 - DNA, 20 bp, Artificial Sequence
  chemically synthesized
tgtgccaaacttctcaggtt

SEQ ID NO: 408124 - DNA, 20 bp, Artificial Sequence
  chemically synthesized
atgatacccccaaacctgag

SEQ ID NO: 408125 - DNA, 20 bp, Artificial Sequence
  chemically synthesized
catcatgtgccaaacttctc

SEQ ID NO: 408126 - DNA, 20 bp, Artificial Sequence
  chemically synthesized
acccccaaacctgagaagtt

SEQ ID NO: 408127 - DNA, 20 bp, Artificial Sequence
  chemically synthesized
acatcatgtgccaaacttct

SEQ ID NO: 408128 - DNA, 20 bp, Artificial Sequence
  chemically synthesized
ggcacatgatgtctttcaat

SEQ ID NO: 408129 - DNA, 20 bp, Artificial Sequence
  chemically synthesized
ctccttctctagctcattga

SEQ ID NO: 408130 - DNA, 20 bp, Artificial Sequence
  chemically synthesized
catgatgtctttcaatgagc

SEQ ID NO: 408131 - DNA, 20 bp, Artificial Sequence
  chemically synthesized
tgatgtctttcaatgagcta

SEQ ID NO: 408132 - DNA, 20 bp, Artificial Sequence
  chemically synthesized
tgtctttcaatgagctagag

SEQ ID NO: 408133 - DNA, 20 bp, Artificial Sequence
  chemically synthesized
gtctttcaatgagctagaga

SEQ ID NO: 408134 - DNA, 20 bp, Artificial Sequence
  chemically synthesized
ctttcaatgagctagagaag

SEQ ID NO: 408135 - DNA, 20 bp, Artificial Sequence
  chemically synthesized
tttcaatgagctagagaagg

SEQ ID NO: 408136 - DNA, 20 bp, Artificial Sequence
  chemically synthesized
agcaattcttcctccttctc

SEQ ID NO: 408137 - DNA, 20 bp, Artificial Sequence
  chemically synthesized
caatgagctagagaaggagg

SEQ ID NO: 408138 - DNA, 20 bp, Artificial Sequence
  chemically synthesized
gagaaggaggaagaattgct

SEQ ID NO: 408139 - DNA, 20 bp, Artificial Sequence
  chemically synthesized
aaggaggaagaattgcttag

SEQ ID NO: 408140 - DNA, 20 bp, Artificial Sequence
  chemically synthesized
aggaggaagaattgcttaga

SEQ ID NO: 408141 - DNA, 20 bp, Artificial Sequence
  chemically synthesized
aggaagaattgcttagaagg

SEQ ID NO: 408142 - DNA, 20 bp, Artificial Sequence
  chemically synthesized
gagatcaaaaactgccttct

SEQ ID NO: 408143 - DNA, 20 bp, Artificial Sequence
  chemically synthesized
aattcaaaatcagtatatat

SEQ ID NO: 408144 - DNA, 20 bp, Artificial Sequence
  chemically synthesized
tcacatagttaattcaaaat

SEQ ID NO: 408145 - DNA, 20 bp, Artificial Sequence
  chemically synthesized
ttatgctcatgtatgtcaca

SEQ ID NO: 408146 - DNA, 20 bp, Artificial Sequence
  chemically synthesized
attaactatgtgacatacat

SEQ ID NO: 408147 - DNA, 20 bp, Artificial Sequence
  chemically synthesized
acatacatgagcataactga

SEQ ID NO: 408148 - DNA, 20 bp, Artificial Sequence
  chemically synthesized
catacatgagcataactgat

SEQ ID NO: 408149 - DNA, 20 bp, Artificial Sequence
  chemically synthesized
acatgagcataactgatggg

SEQ ID NO: 408150 - DNA, 20 bp, Artificial Sequence
  chemically synthesized
catgagcataactgatgggc

SEQ ID NO: 408151 - DNA, 20 bp, Artificial Sequence
  chemically synthesized
atgagcataactgatgggca

SEQ ID NO: 408152 - DNA, 20 bp, Artificial Sequence
  chemically synthesized
agacctatccccctgcccat

SEQ ID NO: 408153 - DNA, 20 bp, Artificial Sequence
  chemically synthesized
tgagcataactgatgggcag

SEQ ID NO: 408154 - DNA, 20 bp, Artificial Sequence
  chemically synthesized
gagcataactgatgggcagg

SEQ ID NO: 408155 - DNA, 20 bp, Artificial Sequence
  chemically synthesized
ataactgatgggcaggggga

SEQ ID NO: 408156 - DNA, 20 bp, Artificial Sequence
  chemically synthesized
taactgatgggcagggggat

SEQ ID NO: 408157 - DNA, 20 bp, Artificial Sequence
  chemically synthesized
tgggcagggggataggtctc

SEQ ID NO: 408158 - DNA, 20 bp, Artificial Sequence
  chemically synthesized
aaaatcattcttttgagcta

SEQ ID NO: 408159 - DNA, 20 bp, Artificial Sequence
  chemically synthesized
gggataggtctctagctcaa

SEQ ID NO: 408160 - DNA, 20 bp, Artificial Sequence
  chemically synthesized
ccaaaatcattcttttgagc

SEQ ID NO: 408161 - DNA, 20 bp, Artificial Sequence
  chemically synthesized
ccaaccaaaatcattctttt

SEQ ID NO: 408162 - DNA, 20 bp, Artificial Sequence
  chemically synthesized
ctagctcaaaagaatgattt

SEQ ID NO: 408163 - DNA, 20 bp, Artificial Sequence
  chemically synthesized
ctcaaaagaatgattttggt

SEQ ID NO: 408164 - DNA, 20 bp, Artificial Sequence
  chemically synthesized
ttggttggatataaaaatct

SEQ ID NO: 408165 - DNA, 20 bp, Artificial Sequence
  chemically synthesized
tggttggatataaaaatctg

SEQ ID NO: 408166 - DNA, 20 bp, Artificial Sequence
  chemically synthesized
ggttggatataaaaatctga

SEQ ID NO: 408167 - DNA, 20 bp, Artificial Sequence
  chemically synthesized
atataaaaatctgagggtca

SEQ ID NO: 408168 - DNA, 20 bp, Artificial Sequence
  chemically synthesized
caactcttaaccatgaccct

SEQ ID NO: 408169 - DNA, 20 bp, Artificial Sequence
  chemically synthesized
aaaatctgagggtcatggtt

SEQ ID NO: 408170 - DNA, 20 bp, Artificial Sequence
  chemically synthesized
aatctgagggtcatggttaa

SEQ ID NO: 408171 - DNA, 20 bp, Artificial Sequence
  chemically synthesized
gttaagagttgttattgcta

SEQ ID NO: 408172 - DNA, 20 bp, Artificial Sequence
  chemically synthesized
cttgatctcatcaaaatcca

SEQ ID NO: 408173 - DNA, 20 bp, Artificial Sequence
  chemically synthesized
ttattgctatggattttgat

SEQ ID NO: 408174 - DNA, 20 bp, Artificial Sequence
  chemically synthesized
ctatggattttgatgagatc

SEQ ID NO: 408175 - DNA, 20 bp, Artificial Sequence
  chemically synthesized
tcaagaaaaatatgttgatt

SEQ ID NO: 408176 - DNA, 20 bp, Artificial Sequence
  chemically synthesized
aaatatgttgattgagcatt

SEQ ID NO: 408177 - DNA, 20 bp, Artificial Sequence
  chemically synthesized
ttgattgagcattaagattg

SEQ ID NO: 408178 - DNA, 20 bp, Artificial Sequence
  chemically synthesized
cgtaaatctcttttaacgtt

SEQ ID NO: 408179 - DNA, 20 bp, Artificial Sequence
  chemically synthesized
agattgaagctcaacgttaa

SEQ ID NO: 408180 - DNA, 20 bp, Artificial Sequence
  chemically synthesized
attgaagctcaacgttaaaa

SEQ ID NO: 408181 - DNA, 20 bp, Artificial Sequence
  chemically synthesized
acgttaaaagagatttacga

SEQ ID NO: 408182 - DNA, 20 bp, Artificial Sequence
  chemically synthesized
cgttaaaagagatttacgat

SEQ ID NO: 408183 - DNA, 20 bp, Artificial Sequence
  chemically synthesized
ttaaaagagatttacgatag

SEQ ID NO: 408184 - DNA, 20 bp, Artificial Sequence
  chemically synthesized
aaaagagatttacgatagga

SEQ ID NO: 408185 - DNA, 20 bp, Artificial Sequence
  chemically synthesized
cgataggagagcaaccctcc

SEQ ID NO: 408186 - DNA, 20 bp, Artificial Sequence
  chemically synthesized
aactttatcattttcttgga

SEQ ID NO: 408187 - DNA, 20 bp, Artificial Sequence
  chemically synthesized
caactttatcattttcttgg

SEQ ID NO: 408188 - DNA, 20 bp, Artificial Sequence
  chemically synthesized
gcaactttatcattttcttg

SEQ ID NO: 408189 - DNA, 20 bp, Artificial Sequence
  chemically synthesized
gggcaactttatcattttct

SEQ ID NO: 408190 - DNA, 20 bp, Artificial Sequence
  chemically synthesized
aaccctccaagaaaatgata

SEQ ID NO: 408191 - DNA, 20 bp, Artificial Sequence
  chemically synthesized
gaaaatgataaagttgccct

SEQ ID NO: 408192 - DNA, 20 bp, Artificial Sequence
  chemically synthesized
atgataaagttgccctgaga

SEQ ID NO: 408193 - DNA, 20 bp, Artificial Sequence
  chemically synthesized
tgataaagttgccctgagac

SEQ ID NO: 408194 - DNA, 20 bp, Artificial Sequence
  chemically synthesized
attctagttttcctgtctca

SEQ ID NO: 408195 - DNA, 20 bp, Artificial Sequence
  chemically synthesized
tattctagttttcctgtctc

SEQ ID NO: 408196 - DNA, 20 bp, Artificial Sequence
  chemically synthesized
ctattctagttttcctgtct

SEQ ID NO: 408197 - DNA, 20 bp, Artificial Sequence
  chemically synthesized
ttgccctgagacaggaaaac

SEQ ID NO: 408198 - DNA, 20 bp, Artificial Sequence
  chemically synthesized
ctgagacaggaaaactagaa

SEQ ID NO: 408199 - DNA, 20 bp, Artificial Sequence
  chemically synthesized
agacaggaaaactagaatag

SEQ ID NO: 408200 - DNA, 20 bp, Artificial Sequence
  chemically synthesized
tctaagatattccactattc

SEQ ID NO: 408201 - DNA, 20 bp, Artificial Sequence
  chemically synthesized
actagaatagtggaatatct

SEQ ID NO: 408202 - DNA, 20 bp, Artificial Sequence
  chemically synthesized
agaatagtggaatatcttag

SEQ ID NO: 408203 - DNA, 20 bp, Artificial Sequence
  chemically synthesized
tagtggaatatcttagaagc

SEQ ID NO: 408204 - DNA, 20 bp, Artificial Sequence
  chemically synthesized
agtggaatatcttagaagcc

SEQ ID NO: 408205 - DNA, 20 bp, Artificial Sequence
  chemically synthesized
actcttcttccctggcttct

SEQ ID NO: 408206 - DNA, 20 bp, Artificial Sequence
  chemically synthesized
gtggaatatcttagaagcca

SEQ ID NO: 408207 - DNA, 20 bp, Artificial Sequence
  chemically synthesized
gaatatcttagaagccaggg

SEQ ID NO: 408208 - DNA, 20 bp, Artificial Sequence
  chemically synthesized
tatcttagaagccagggaag

SEQ ID NO: 408209 - DNA, 20 bp, Artificial Sequence
  chemically synthesized
ttggaaaaactcttcttccc

SEQ ID NO: 408210 - DNA, 20 bp, Artificial Sequence
  chemically synthesized
tcttagaagccagggaagaa

SEQ ID NO: 408211 - DNA, 20 bp, Artificial Sequence
  chemically synthesized
gggaagaagagtttttccaa

SEQ ID NO: 408212 - DNA, 20 bp, Artificial Sequence
  chemically synthesized
ggaagaagagtttttccaat

SEQ ID NO: 408213 - DNA, 20 bp, Artificial Sequence
  chemically synthesized
agaagagtttttccaatagg

SEQ ID NO: 408214 - DNA, 20 bp, Artificial Sequence
  chemically synthesized
gaagagtttttccaatagga

SEQ ID NO: 408215 - DNA, 20 bp, Artificial Sequence
  chemically synthesized
tgttgatcggtccttcctat

SEQ ID NO: 408216 - DNA, 20 bp, Artificial Sequence
  chemically synthesized
ctgtagtattgattgttgat

SEQ ID NO: 408217 - DNA, 20 bp, Artificial Sequence
  chemically synthesized
ccgatcaacaatcaatacta

SEQ ID NO: 408218 - DNA, 20 bp, Artificial Sequence
  chemically synthesized
gatcaacaatcaatactaca

SEQ ID NO: 408219 - DNA, 20 bp, Artificial Sequence
  chemically synthesized
caacaatcaatactacagag

SEQ ID NO: 408220 - DNA, 20 bp, Artificial Sequence
  chemically synthesized
ggcctcatcttaccactctg

SEQ ID NO: 408221 - DNA, 20 bp, Artificial Sequence
  chemically synthesized
aatcaatactacagagtggt

SEQ ID NO: 408222 - DNA, 20 bp, Artificial Sequence
  chemically synthesized
atactacagagtggtaagat

SEQ ID NO: 408223 - DNA, 20 bp, Artificial Sequence
  chemically synthesized
tactacagagtggtaagatg

SEQ ID NO: 408224 - DNA, 20 bp, Artificial Sequence
  chemically synthesized
gtcacggcccaagtcacatc

SEQ ID NO: 408225 - DNA, 20 bp, Artificial Sequence
  chemically synthesized
tgtcacggcccaagtcacat

SEQ ID NO: 408226 - DNA, 20 bp, Artificial Sequence
  chemically synthesized
agatgaggcctgatgtgact

SEQ ID NO: 408227 - DNA, 20 bp, Artificial Sequence
  chemically synthesized
gatgaggcctgatgtgactt

SEQ ID NO: 408228 - DNA, 20 bp, Artificial Sequence
  chemically synthesized
aattgattttgtcacggccc

SEQ ID NO: 408229 - DNA, 20 bp, Artificial Sequence
  chemically synthesized
aactgaaattgattttgtca

SEQ ID NO: 408230 - DNA, 20 bp, Artificial Sequence
  chemically synthesized
ggccgtgacaaaatcaattt

SEQ ID NO: 408231 - DNA, 20 bp, Artificial Sequence
  chemically synthesized
gacaaaatcaatttcagttg

SEQ ID NO: 408232 - DNA, 20 bp, Artificial Sequence
  chemically synthesized
acaaaatcaatttcagttga

SEQ ID NO: 408233 - DNA, 20 bp, Artificial Sequence
  chemically synthesized
tcaatttcagttgaaggatg

SEQ ID NO: 408234 - DNA, 20 bp, Artificial Sequence
  chemically synthesized
atttcagttgaaggatgtgg

SEQ ID NO: 408235 - DNA, 20 bp, Artificial Sequence
  chemically synthesized
tcagttgaaggatgtggaag

SEQ ID NO: 408236 - DNA, 20 bp, Artificial Sequence
  chemically synthesized
ttgaaggatgtggaagcagc

SEQ ID NO: 408237 - DNA, 20 bp, Artificial Sequence
  chemically synthesized
tgtggaagcagccggattat

SEQ ID NO: 408238 - DNA, 20 bp, Artificial Sequence
  chemically synthesized
tacctcaaacaccaataatc

SEQ ID NO: 408239 - DNA, 20 bp, Artificial Sequence
  chemically synthesized
cagccggattattggtgttt

SEQ ID NO: 408240 - DNA, 20 bp, Artificial Sequence
  chemically synthesized
agccggattattggtgtttg

SEQ ID NO: 408241 - DNA, 20 bp, Artificial Sequence
  chemically synthesized
cggattattggtgtttgagg

SEQ ID NO: 408242 - DNA, 20 bp, Artificial Sequence
  chemically synthesized
ggtgtttgaggtagctacgt

SEQ ID NO: 408243 - DNA, 20 bp, Artificial Sequence
  chemically synthesized
tttgaggtagctacgtgagt

SEQ ID NO: 408244 - DNA, 20 bp, Artificial Sequence
  chemically synthesized
tatctacttccttactcacg

SEQ ID NO: 408245 - DNA, 20 bp, Artificial Sequence
  chemically synthesized
ttgaggtagctacgtgagta

SEQ ID NO: 408246 - DNA, 20 bp, Artificial Sequence
  chemically synthesized
aggtagctacgtgagtaagg

SEQ ID NO: 408247 - DNA, 20 bp, Artificial Sequence
  chemically synthesized
tagctacgtgagtaaggaag

SEQ ID NO: 408248 - DNA, 20 bp, Artificial Sequence
  chemically synthesized
agtaaggaagtagatacaat

SEQ ID NO: 408249 - DNA, 20 bp, Artificial Sequence
  chemically synthesized
ggaagtagatacaatgagca

SEQ ID NO: 408250 - DNA, 20 bp, Artificial Sequence
  chemically synthesized
aatgagcatagaaattgtta

SEQ ID NO: 408251 - DNA, 20 bp, Artificial Sequence
  chemically synthesized
gagcatagaaattgttaaag

SEQ ID NO: 408252 - DNA, 20 bp, Artificial Sequence
  chemically synthesized
tagaaattgttaaagaagtt

SEQ ID NO: 408253 - DNA, 20 bp, Artificial Sequence
  chemically synthesized
ttgttaaagaagtttagctt

SEQ ID NO: 408254 - DNA, 20 bp, Artificial Sequence
  chemically synthesized
tgttaaagaagtttagcttc

SEQ ID NO: 408255 - DNA, 20 bp, Artificial Sequence
  chemically synthesized
ttaaagaagtttagcttcag

SEQ ID NO: 408256 - DNA, 20 bp, Artificial Sequence
  chemically synthesized
aagaagtttagcttcaggag

SEQ ID NO: 408257 - DNA, 20 bp, Artificial Sequence
  chemically synthesized
cttgttattttccactcctg

SEQ ID NO: 408258 - DNA, 20 bp, Artificial Sequence
  chemically synthesized
cttcaggagtggaaaataac

SEQ ID NO: 408259 - DNA, 20 bp, Artificial Sequence
  chemically synthesized
aggagtggaaaataacaagt

SEQ ID NO: 408260 - DNA, 20 bp, Artificial Sequence
  chemically synthesized
agtggaaaataacaagtcgg

SEQ ID NO: 408261 - DNA, 20 bp, Artificial Sequence
  chemically synthesized
gtggaaaataacaagtcggt

SEQ ID NO: 408262 - DNA, 20 bp, Artificial Sequence
  chemically synthesized
ggaaaataacaagtcggtag

SEQ ID NO: 408263 - DNA, 20 bp, Artificial Sequence
  chemically synthesized
ggtaggagattaaaaactaa

SEQ ID NO: 408264 - DNA, 20 bp, Artificial Sequence
  chemically synthesized
aggagattaaaaactaatag

SEQ ID NO: 408265 - DNA, 20 bp, Artificial Sequence
  chemically synthesized
caaataggacattctgctat

SEQ ID NO: 408266 - DNA, 20 bp, Artificial Sequence
  chemically synthesized
tgttgcctgtagtaacaaat

SEQ ID NO: 408267 - DNA, 20 bp, Artificial Sequence
  chemically synthesized
gtgttgcctgtagtaacaaa

SEQ ID NO: 408268 - DNA, 20 bp, Artificial Sequence
  chemically synthesized
gaatgtcctatttgttacta

SEQ ID NO: 408269 - DNA, 20 bp, Artificial Sequence
  chemically synthesized
aatgtcctatttgttactac

SEQ ID NO: 408270 - DNA, 20 bp, Artificial Sequence
  chemically synthesized
ttgcaatacagtgttgcctg

SEQ ID NO: 408271 - DNA, 20 bp, Artificial Sequence
  chemically synthesized
tacaggcaacactgtattgc

SEQ ID NO: 408272 - DNA, 20 bp, Artificial Sequence
  chemically synthesized
atttattttaacttgcaata

SEQ ID NO: 408273 - DNA, 20 bp, Artificial Sequence
  chemically synthesized
tattgcaagttaaaataaat

SEQ ID NO: 408274 - DNA, 20 bp, Artificial Sequence
  chemically synthesized
tgcgttcaggcatttgtgtc

SEQ ID NO: 408275 - DNA, 20 bp, Artificial Sequence
  chemically synthesized
ttgcgttcaggcatttgtgt

SEQ ID NO: 408276 - DNA, 20 bp, Artificial Sequence
  chemically synthesized
tgacacaaatgcctgaacgc

SEQ ID NO: 408277 - DNA, 20 bp, Artificial Sequence
  chemically synthesized
taattttttttcttgcgttc

SEQ ID NO: 408278 - DNA, 20 bp, Artificial Sequence
  chemically synthesized
ttaattttttttcttgcgtt

SEQ ID NO: 408279 - DNA, 20 bp, Artificial Sequence
  chemically synthesized
gaacgcaagaaaaaaaatta

SEQ ID NO: 408280 - DNA, 20 bp, Artificial Sequence
  chemically synthesized
aacgcaagaaaaaaaattaa

SEQ ID NO: 408281 - DNA, 20 bp, Artificial Sequence
  chemically synthesized
acgcaagaaaaaaaattaaa

SEQ ID NO: 408282 - DNA, 20 bp, Artificial Sequence
  chemically synthesized
aattaaagggtttcttcaac

SEQ ID NO: 408283 - DNA, 20 bp, Artificial Sequence
  chemically synthesized
aaaatacaaatgtctggttg

SEQ ID NO: 408284 - DNA, 20 bp, Artificial Sequence
  chemically synthesized
atgcttaaaatacaaatgtc

SEQ ID NO: 408285 - DNA, 20 bp, Artificial Sequence
  chemically synthesized
caaccagacatttgtatttt

SEQ ID NO: 408286 - DNA, 20 bp, Artificial Sequence
  chemically synthesized
gtattttaagcattttattt

SEQ ID NO: 408287 - DNA, 20 bp, Artificial Sequence
  chemically synthesized
attttattttggcaatcaat

SEQ ID NO: 408288 - DNA, 20 bp, Artificial Sequence
  chemically synthesized
ttttattttggcaatcaatt

SEQ ID NO: 408289 - DNA, 20 bp, Artificial Sequence
  chemically synthesized
tttattttggcaatcaattg

SEQ ID NO: 408290 - DNA, 20 bp, Artificial Sequence
  chemically synthesized
tggcaatcaattggggaaat

SEQ ID NO: 408291 - DNA, 20 bp, Artificial Sequence
  chemically synthesized
aatgagatattttctcctca

SEQ ID NO: 408292 - DNA, 20 bp, Artificial Sequence
  chemically synthesized
atgagatattttctcctcaa

SEQ ID NO: 408293 - DNA, 20 bp, Artificial Sequence
  chemically synthesized
gctacagcattacctttgag

SEQ ID NO: 408294 - DNA, 20 bp, Artificial Sequence
  chemically synthesized
ctgctacagcattacctttg

SEQ ID NO: 408295 - DNA, 20 bp, Artificial Sequence
  chemically synthesized
actgctacagcattaccttt

SEQ ID NO: 408296 - DNA, 20 bp, Artificial Sequence
  chemically synthesized
tctcctcaaaggtaatgctg

SEQ ID NO: 408297 - DNA, 20 bp, Artificial Sequence
  chemically synthesized
cctcaaaggtaatgctgtag

SEQ ID NO: 408298 - DNA, 20 bp, Artificial Sequence
  chemically synthesized
gaatacaattataactgcta

SEQ ID NO: 408299 - DNA, 20 bp, Artificial Sequence
  chemically synthesized
tagcagttataattgtattc

SEQ ID NO: 408300 - DNA, 20 bp, Artificial Sequence
  chemically synthesized
agcagttataattgtattcc

SEQ ID NO: 408301 - DNA, 20 bp, Artificial Sequence
  chemically synthesized
taattgtattccaggacttg

SEQ ID NO: 408302 - DNA, 20 bp, Artificial Sequence
  chemically synthesized
taatagtagcccgcaagtcc

SEQ ID NO: 408303 - DNA, 20 bp, Artificial Sequence
  chemically synthesized
aattgtattccaggacttgc

SEQ ID NO: 408304 - DNA, 20 bp, Artificial Sequence
  chemically synthesized
tatttgtaatagtagcccgc

SEQ ID NO: 408305 - DNA, 20 bp, Artificial Sequence
  chemically synthesized
tccatgagtatttgtaatag

SEQ ID NO: 408306 - DNA, 20 bp, Artificial Sequence
  chemically synthesized
atttccatgagtatttgtaa

SEQ ID NO: 408307 - DNA, 20 bp, Artificial Sequence
  chemically synthesized
gctactattacaaatactca

SEQ ID NO: 408308 - DNA, 20 bp, Artificial Sequence
  chemically synthesized
aaaaattcattaatttccat

SEQ ID NO: 408309 - DNA, 20 bp, Artificial Sequence
  chemically synthesized
ttaatgaatttttatccccc

SEQ ID NO: 408310 - DNA, 20 bp, Artificial Sequence
  chemically synthesized
gccactcctccagagccagg

SEQ ID NO: 408311 - DNA, 20 bp, Artificial Sequence
  chemically synthesized
aatttttatccccctggctc

SEQ ID NO: 408312 - DNA, 20 bp, Artificial Sequence
  chemically synthesized
agccactcctccagagccag

SEQ ID NO: 408313 - DNA, 20 bp, Artificial Sequence
  chemically synthesized
cagccactcctccagagcca

SEQ ID NO: 408314 - DNA, 20 bp, Artificial Sequence
  chemically synthesized
tttttatccccctggctctg

SEQ ID NO: 408315 - DNA, 20 bp, Artificial Sequence
  chemically synthesized
tcagccactcctccagagcc

SEQ ID NO: 408316 - DNA, 20 bp, Artificial Sequence
  chemically synthesized
ttttatccccctggctctgg

SEQ ID NO: 408317 - DNA, 20 bp, Artificial Sequence
  chemically synthesized
ttcagccactcctccagagc

SEQ ID NO: 408318 - DNA, 20 bp, Artificial Sequence
  chemically synthesized
ttatccccctggctctggag

SEQ ID NO: 408319 - DNA, 20 bp, Artificial Sequence
  chemically synthesized
tgctttcagccactcctcca

SEQ ID NO: 408320 - DNA, 20 bp, Artificial Sequence
  chemically synthesized
tccccctggctctggaggag

SEQ ID NO: 408321 - DNA, 20 bp, Artificial Sequence
  chemically synthesized
ggtgctttcagccactcctc

SEQ ID NO: 408322 - DNA, 20 bp, Artificial Sequence
  chemically synthesized
ggctctggaggagtggctga

SEQ ID NO: 408323 - DNA, 20 bp, Artificial Sequence
  chemically synthesized
actataaaacacggtgcttt

SEQ ID NO: 408324 - DNA, 20 bp, Artificial Sequence
  chemically synthesized
gctgaaagcaccgtgtttta

SEQ ID NO: 408325 - DNA, 20 bp, Artificial Sequence
  chemically synthesized
atttgtcagactataaaaca

SEQ ID NO: 408326 - DNA, 20 bp, Artificial Sequence
  chemically synthesized
gttttatagtctgacaaatt

SEQ ID NO: 408327 - DNA, 20 bp, Artificial Sequence
  chemically synthesized
ggaatagaacccaaatttgt

SEQ ID NO: 408328 - DNA, 20 bp, Artificial Sequence
  chemically synthesized
ttttatagtctgacaaattt

SEQ ID NO: 408329 - DNA, 20 bp, Artificial Sequence
  chemically synthesized
acaaatttgggttctattcc

SEQ ID NO: 408330 - DNA, 20 bp, Artificial Sequence
  chemically synthesized
gtatccagagatactgggaa

SEQ ID NO: 408331 - DNA, 20 bp, Artificial Sequence
  chemically synthesized
agctggtatccagagatact

SEQ ID NO: 408332 - DNA, 20 bp, Artificial Sequence
  chemically synthesized
ggttctattcccagtatctc

SEQ ID NO: 408333 - DNA, 20 bp, Artificial Sequence
  chemically synthesized
tagctggtatccagagatac

SEQ ID NO: 408334 - DNA, 20 bp, Artificial Sequence
  chemically synthesized
ttcccagtatctctggatac

SEQ ID NO: 408335 - DNA, 20 bp, Artificial Sequence
  chemically synthesized
ggtcatatagctggtatcca

SEQ ID NO: 408336 - DNA, 20 bp, Artificial Sequence
  chemically synthesized
aaggtcatatagctggtatc

SEQ ID NO: 408337 - DNA, 20 bp, Artificial Sequence
  chemically synthesized
tttgttcaaggtcatatagc

SEQ ID NO: 408338 - DNA, 20 bp, Artificial Sequence
  chemically synthesized
gtattttgttcaaggtcata

SEQ ID NO: 408339 - DNA, 20 bp, Artificial Sequence
  chemically synthesized
gaggctcagtattttgttca

SEQ ID NO: 408340 - DNA, 20 bp, Artificial Sequence
  chemically synthesized
agaggctcagtattttgttc

SEQ ID NO: 408341 - DNA, 20 bp, Artificial Sequence
  chemically synthesized
atgaccttgaacaaaatact

SEQ ID NO: 408342 - DNA, 20 bp, Artificial Sequence
  chemically synthesized
ctgaggctttgaaagaggct

SEQ ID NO: 408343 - DNA, 20 bp, Artificial Sequence
  chemically synthesized
aaaatactgagcctctttca

SEQ ID NO: 408344 - DNA, 20 bp, Artificial Sequence
  chemically synthesized
gaaaactgaggctttgaaag

SEQ ID NO: 408345 - DNA, 20 bp, Artificial Sequence
  chemically synthesized
agaaaactgaggctttgaaa

SEQ ID NO: 408346 - DNA, 20 bp, Artificial Sequence
  chemically synthesized
tgagaaaactgaggctttga

SEQ ID NO: 408347 - DNA, 20 bp, Artificial Sequence
  chemically synthesized
ctgagcctctttcaaagcct

SEQ ID NO: 408348 - DNA, 20 bp, Artificial Sequence
  chemically synthesized
gtttacaaatgagaaaactg

SEQ ID NO: 408349 - DNA, 20 bp, Artificial Sequence
  chemically synthesized
tgtttacaaatgagaaaact

SEQ ID NO: 408350 - DNA, 20 bp, Artificial Sequence
  chemically synthesized
ttactgctttgtttacaaat

SEQ ID NO: 408351 - DNA, 20 bp, Artificial Sequence
  chemically synthesized
agttttctcatttgtaaaca

SEQ ID NO: 408352 - DNA, 20 bp, Artificial Sequence
  chemically synthesized
tttctcatttgtaaacaaag

SEQ ID NO: 408353 - DNA, 20 bp, Artificial Sequence
  chemically synthesized
tgtaaacaaagcagtaacaa

SEQ ID NO: 408354 - DNA, 20 bp, Artificial Sequence
  chemically synthesized
cagtaacaatagctctttta

SEQ ID NO: 408355 - DNA, 20 bp, Artificial Sequence
  chemically synthesized
ttctccatgattctataaaa

SEQ ID NO: 408356 - DNA, 20 bp, Artificial Sequence
  chemically synthesized
tcttctccatgattctataa

SEQ ID NO: 408357 - DNA, 20 bp, Artificial Sequence
  chemically synthesized
atagctcttttatagaatca

SEQ ID NO: 408358 - DNA, 20 bp, Artificial Sequence
  chemically synthesized
agctcttttatagaatcatg

SEQ ID NO: 408359 - DNA, 20 bp, Artificial Sequence
  chemically synthesized
tcttttatagaatcatggag

SEQ ID NO: 408360 - DNA, 20 bp, Artificial Sequence
  chemically synthesized
atcatggagaagaataaata

SEQ ID NO: 408361 - DNA, 20 bp, Artificial Sequence
  chemically synthesized
taggttgagagacagtgtag

SEQ ID NO: 408362 - DNA, 20 bp, Artificial Sequence
  chemically synthesized
ctctaggttgagagacagtg

SEQ ID NO: 408363 - DNA, 20 bp, Artificial Sequence
  chemically synthesized
atagtctctaggttgagaga

SEQ ID NO: 408364 - DNA, 20 bp, Artificial Sequence
  chemically synthesized
tactacactgtctctcaacc

SEQ ID NO: 408365 - DNA, 20 bp, Artificial Sequence
  chemically synthesized
tgatatagtctctaggttga

SEQ ID NO: 408366 - DNA, 20 bp, Artificial Sequence
  chemically synthesized
ctacactgtctctcaaccta

SEQ ID NO: 408367 - DNA, 20 bp, Artificial Sequence
  chemically synthesized
tttgatatagtctctaggtt

SEQ ID NO: 408368 - DNA, 20 bp, Artificial Sequence
  chemically synthesized
gggattttgatatagtctct

SEQ ID NO: 408369 - DNA, 20 bp, Artificial Sequence
  chemically synthesized
ggggattttgatatagtctc

SEQ ID NO: 408370 - DNA, 20 bp, Artificial Sequence
  chemically synthesized
ttcttcaggggattttgata

SEQ ID NO: 408371 - DNA, 20 bp, Artificial Sequence
  chemically synthesized
gactatatcaaaatcccctg

SEQ ID NO: 408372 - DNA, 20 bp, Artificial Sequence
  chemically synthesized
tattataagaagttcttcag

SEQ ID NO: 408373 - DNA, 20 bp, Artificial Sequence
  chemically synthesized
gtattataagaagttcttca

SEQ ID NO: 408374 - DNA, 20 bp, Artificial Sequence
  chemically synthesized
ggtattataagaagttcttc

SEQ ID NO: 408375 - DNA, 20 bp, Artificial Sequence
  chemically synthesized
aggtattataagaagttctt

SEQ ID NO: 408376 - DNA, 20 bp, Artificial Sequence
  chemically synthesized
tctgggagaggtattataag

SEQ ID NO: 408377 - DNA, 20 bp, Artificial Sequence
  chemically synthesized
aattctgggagaggtattat

SEQ ID NO: 408378 - DNA, 20 bp, Artificial Sequence
  chemically synthesized
acttcttataatacctctcc

SEQ ID NO: 408379 - DNA, 20 bp, Artificial Sequence
  chemically synthesized
tagataatgaattctgggag

SEQ ID NO: 408380 - DNA, 20 bp, Artificial Sequence
  chemically synthesized
ctagataatgaattctggga

SEQ ID NO: 408381 - DNA, 20 bp, Artificial Sequence
  chemically synthesized
tactagataatgaattctgg

SEQ ID NO: 408382 - DNA, 20 bp, Artificial Sequence
  chemically synthesized
cctactagataatgaattct

SEQ ID NO: 408383 - DNA, 20 bp, Artificial Sequence
  chemically synthesized
acctactagataatgaattc

SEQ ID NO: 408384 - DNA, 20 bp, Artificial Sequence
  chemically synthesized
ctctcccagaattcattatc

SEQ ID NO: 408385 - DNA, 20 bp, Artificial Sequence
  chemically synthesized
tcccagaattcattatctag

SEQ ID NO: 408386 - DNA, 20 bp, Artificial Sequence
  chemically synthesized
cccagaattcattatctagt

SEQ ID NO: 408387 - DNA, 20 bp, Artificial Sequence
  chemically synthesized
cgggctgtgcggagacctac

SEQ ID NO: 408388 - DNA, 20 bp, Artificial Sequence
  chemically synthesized
ttatctagtaggtctccgca

SEQ ID NO: 408389 - DNA, 20 bp, Artificial Sequence
  chemically synthesized
gtaaattctcgggctgtgcg

SEQ ID NO: 408390 - DNA, 20 bp, Artificial Sequence
  chemically synthesized
atgtaaattctcgggctgtg

SEQ ID NO: 408391 - DNA, 20 bp, Artificial Sequence
  chemically synthesized
agtaggtctccgcacagccc

SEQ ID NO: 408392 - DNA, 20 bp, Artificial Sequence
  chemically synthesized
tgtaagaaatgtaaattctc

SEQ ID NO: 408393 - DNA, 20 bp, Artificial Sequence
  chemically synthesized
ttgtaagaaatgtaaattct

SEQ ID NO: 408394 - DNA, 20 bp, Artificial Sequence
  chemically synthesized
aatatcacctggaaatttgt

SEQ ID NO: 408395 - DNA, 20 bp, Artificial Sequence
  chemically synthesized
ttacatttcttacaaatttc

SEQ ID NO: 408396 - DNA, 20 bp, Artificial Sequence
  chemically synthesized
tacatttcttacaaatttcc

SEQ ID NO: 408397 - DNA, 20 bp, Artificial Sequence
  chemically synthesized
ttcagacccgcaatatcacc

SEQ ID NO: 408398 - DNA, 20 bp, Artificial Sequence
  chemically synthesized
caaatttccaggtgatattg

SEQ ID NO: 408399 - DNA, 20 bp, Artificial Sequence
  chemically synthesized
aaatttccaggtgatattgc

SEQ ID NO: 408400 - DNA, 20 bp, Artificial Sequence
  chemically synthesized
gtggttctcaaagtatgttt

SEQ ID NO: 408401 - DNA, 20 bp, Artificial Sequence
  chemically synthesized
gcgggtctgaaacatacttt

SEQ ID NO: 408402 - DNA, 20 bp, Artificial Sequence
  chemically synthesized
tgctaaagctgtggttctca

SEQ ID NO: 408403 - DNA, 20 bp, Artificial Sequence
  chemically synthesized
gaaacatactttgagaacca

SEQ ID NO: 408404 - DNA, 20 bp, Artificial Sequence
  chemically synthesized
tactttgagaaccacagctt

SEQ ID NO: 408405 - DNA, 20 bp, Artificial Sequence
  chemically synthesized
ctgtctatgtgctaaagctg

SEQ ID NO: 408406 - DNA, 20 bp, Artificial Sequence
  chemically synthesized
agaaccacagctttagcaca

SEQ ID NO: 408407 - DNA, 20 bp, Artificial Sequence
  chemically synthesized
atgtgactgtctatgtgcta

SEQ ID NO: 408408 - DNA, 20 bp, Artificial Sequence
  chemically synthesized
ccacagctttagcacataga

SEQ ID NO: 408409 - DNA, 20 bp, Artificial Sequence
  chemically synthesized
atgctaatatttacattcat

SEQ ID NO: 408410 - DNA, 20 bp, Artificial Sequence
  chemically synthesized
aaaccaatgaatgtaaatat

SEQ ID NO: 408411 - DNA, 20 bp, Artificial Sequence
  chemically synthesized
aaatattagcatttctttga

SEQ ID NO: 408412 - DNA, 20 bp, Artificial Sequence
  chemically synthesized
atattagcatttctttgatg

SEQ ID NO: 408413 - DNA, 20 bp, Artificial Sequence
  chemically synthesized
gcctggggctgtctccatca

SEQ ID NO: 408414 - DNA, 20 bp, Artificial Sequence
  chemically synthesized
tagcatttctttgatggaga

SEQ ID NO: 408415 - DNA, 20 bp, Artificial Sequence
  chemically synthesized
ttctttgatggagacagccc

SEQ ID NO: 408416 - DNA, 20 bp, Artificial Sequence
  chemically synthesized
tctttgatggagacagcccc

SEQ ID NO: 408417 - DNA, 20 bp, Artificial Sequence
  chemically synthesized
atcttgctgtaggcagcctg

SEQ ID NO: 408418 - DNA, 20 bp, Artificial Sequence
  chemically synthesized
catcttgctgtaggcagcct

SEQ ID NO: 408419 - DNA, 20 bp, Artificial Sequence
  chemically synthesized
acatcttgctgtaggcagcc

SEQ ID NO: 408420 - DNA, 20 bp, Artificial Sequence
  chemically synthesized
agacagccccaggctgccta

SEQ ID NO: 408421 - DNA, 20 bp, Artificial Sequence
  chemically synthesized
agggaacatcttgctgtagg

SEQ ID NO: 408422 - DNA, 20 bp, Artificial Sequence
  chemically synthesized
agccccaggctgcctacagc

SEQ ID NO: 408423 - DNA, 20 bp, Artificial Sequence
  chemically synthesized
ctaagggaacatcttgctgt

SEQ ID NO: 408424 - DNA, 20 bp, Artificial Sequence
  chemically synthesized
cctaagggaacatcttgctg

SEQ ID NO: 408425 - DNA, 20 bp, Artificial Sequence
  chemically synthesized
cctacagcaagatgttccct

SEQ ID NO: 408426 - DNA, 20 bp, Artificial Sequence
  chemically synthesized
ctacagcaagatgttccctt

SEQ ID NO: 408427 - DNA, 20 bp, Artificial Sequence
  chemically synthesized
ttctattttcaggaacctaa

SEQ ID NO: 408428 - DNA, 20 bp, Artificial Sequence
  chemically synthesized
tttctattttcaggaaccta

SEQ ID NO: 408429 - DNA, 20 bp, Artificial Sequence
  chemically synthesized
ctttctattttcaggaacct

SEQ ID NO: 408430 - DNA, 20 bp, Artificial Sequence
  chemically synthesized
ttcccttaggttcctgaaaa

SEQ ID NO: 408431 - DNA, 20 bp, Artificial Sequence
  chemically synthesized
atgcgggactttctattttc

SEQ ID NO: 408432 - DNA, 20 bp, Artificial Sequence
  chemically synthesized
catgcgggactttctatttt

SEQ ID NO: 408433 - DNA, 20 bp, Artificial Sequence
  chemically synthesized
cttaggttcctgaaaataga

SEQ ID NO: 408434 - DNA, 20 bp, Artificial Sequence
  chemically synthesized
tgaaaatagaaagtcccgca

SEQ ID NO: 408435 - DNA, 20 bp, Artificial Sequence
  chemically synthesized
gactttgatgaggaccatgc

SEQ ID NO: 408436 - DNA, 20 bp, Artificial Sequence
  chemically synthesized
ggactttgatgaggaccatg

SEQ ID NO: 408437 - DNA, 20 bp, Artificial Sequence
  chemically synthesized
gtcccgcatggtcctcatca

SEQ ID NO: 408438 - DNA, 20 bp, Artificial Sequence
  chemically synthesized
gaatccagcggactttgatg

SEQ ID NO: 408439 - DNA, 20 bp, Artificial Sequence
  chemically synthesized
ggaatccagcggactttgat

SEQ ID NO: 408440 - DNA, 20 bp, Artificial Sequence
  chemically synthesized
tggtcctcatcaaagtccgc

SEQ ID NO: 408441 - DNA, 20 bp, Artificial Sequence
  chemically synthesized
gaggtattgaaggaatccag

SEQ ID NO: 408442 - DNA, 20 bp, Artificial Sequence
  chemically synthesized
gaagaggtattgaaggaatc

SEQ ID NO: 408443 - DNA, 20 bp, Artificial Sequence
  chemically synthesized
aaaagaggaagaggtattga

SEQ ID NO: 408444 - DNA, 20 bp, Artificial Sequence
  chemically synthesized
gaaaagaggaagaggtattg

SEQ ID NO: 408445 - DNA, 20 bp, Artificial Sequence
  chemically synthesized
ccatgtgagaaaagaggaag

SEQ ID NO: 408446 - DNA, 20 bp, Artificial Sequence
  chemically synthesized
cccatgtgagaaaagaggaa

SEQ ID NO: 408447 - DNA, 20 bp, Artificial Sequence
  chemically synthesized
tgcccatgtgagaaaagagg

SEQ ID NO: 408448 - DNA, 20 bp, Artificial Sequence
  chemically synthesized
taatgcccatgtgagaaaag

SEQ ID NO: 408449 - DNA, 20 bp, Artificial Sequence
  chemically synthesized
ttaatgcccatgtgagaaaa

SEQ ID NO: 408450 - DNA, 20 bp, Artificial Sequence
  chemically synthesized
tgttaatgcccatgtgagaa

SEQ ID NO: 408451 - DNA, 20 bp, Artificial Sequence
  chemically synthesized
cctcttcctcttttctcaca

SEQ ID NO: 408452 - DNA, 20 bp, Artificial Sequence
  chemically synthesized
ctcttcctcttttctcacat

SEQ ID NO: 408453 - DNA, 20 bp, Artificial Sequence
  chemically synthesized
ggggatgttaatgcccatgt

SEQ ID NO: 408454 - DNA, 20 bp, Artificial Sequence
  chemically synthesized
agttagaaggtagaggagtg

SEQ ID NO: 408455 - DNA, 20 bp, Artificial Sequence
  chemically synthesized
gagttagaaggtagaggagt

SEQ ID NO: 408456 - DNA, 20 bp, Artificial Sequence
  chemically synthesized
tgagttagaaggtagaggag

SEQ ID NO: 408457 - DNA, 20 bp, Artificial Sequence
  chemically synthesized
aattgagttagaaggtagag

SEQ ID NO: 408458 - DNA, 20 bp, Artificial Sequence
  chemically synthesized
ataattgagttagaaggtag

SEQ ID NO: 408459 - DNA, 20 bp, Artificial Sequence
  chemically synthesized
gataattgagttagaaggta

SEQ ID NO: 408460 - DNA, 20 bp, Artificial Sequence
  chemically synthesized
cagataattgagttagaagg

SEQ ID NO: 408461 - DNA, 20 bp, Artificial Sequence
  chemically synthesized
ggtcagataattgagttaga

SEQ ID NO: 408462 - DNA, 20 bp, Artificial Sequence
  chemically synthesized
gggtcagataattgagttag

SEQ ID NO: 408463 - DNA, 20 bp, Artificial Sequence
  chemically synthesized
caggggtcagataattgagt

SEQ ID NO: 408464 - DNA, 20 bp, Artificial Sequence
  chemically synthesized
agcgcaggggtcagataatt

SEQ ID NO: 408465 - DNA, 20 bp, Artificial Sequence
  chemically synthesized
aaaaaaaagagcgcaggggt

SEQ ID NO: 408466 - DNA, 20 bp, Artificial Sequence
  chemically synthesized
agaaaaaaaaaagagcgcag

SEQ ID NO: 408467 - DNA, 20 bp, Artificial Sequence
  chemically synthesized
aagaaaaaaaaaagagcgca

SEQ ID NO: 408468 - DNA, 20 bp, Artificial Sequence
  chemically synthesized
aaagaaaaaaaaaagagcgc

SEQ ID NO: 408469 - DNA, 20 bp, Artificial Sequence
  chemically synthesized
aaaagaaaaaaaaaagagcg

SEQ ID NO: 408470 - DNA, 20 bp, Artificial Sequence
  chemically synthesized
aaagaaaaagaaaaaaaaaa

SEQ ID NO: 408471 - DNA, 20 bp, Artificial Sequence
  chemically synthesized
gaaaagaaaaagaaaaaaaa

SEQ ID NO: 408472 - DNA, 20 bp, Artificial Sequence
  chemically synthesized
aaaagaaaaaagaaaagaaa

SEQ ID NO: 408473 - DNA, 20 bp, Artificial Sequence
  chemically synthesized
gaaaagaaaagaaaaaagaa

SEQ ID NO: 408474 - DNA, 20 bp, Artificial Sequence
  chemically synthesized
gtctcgaaaagaaaagaaaa

SEQ ID NO: 408475 - DNA, 20 bp, Artificial Sequence
  chemically synthesized
aaactccgtctcgaaaagaa

SEQ ID NO: 408476 - DNA, 20 bp, Artificial Sequence
  chemically synthesized
ttcttttttcttttcttttc

SEQ ID NO: 408477 - DNA, 20 bp, Artificial Sequence
  chemically synthesized
tttttcttttcttttcgaga

SEQ ID NO: 408478 - DNA, 20 bp, Artificial Sequence
  chemically synthesized
gagcaaaactccgtctcgaa

SEQ ID NO: 408479 - DNA, 20 bp, Artificial Sequence
  chemically synthesized
tttcttttcttttcgagacg

SEQ ID NO: 408480 - DNA, 20 bp, Artificial Sequence
  chemically synthesized
cactccagcctgggcaaaga

SEQ ID NO: 408481 - DNA, 20 bp, Artificial Sequence
  chemically synthesized
ggagttttgctctctttgcc

SEQ ID NO: 408482 - DNA, 20 bp, Artificial Sequence
  chemically synthesized
gagttttgctctctttgccc

SEQ ID NO: 408483 - DNA, 20 bp, Artificial Sequence
  chemically synthesized
tacactccagcctgggcaaa

SEQ ID NO: 408484 - DNA, 20 bp, Artificial Sequence
  chemically synthesized
actacactccagcctgggca

SEQ ID NO: 408485 - DNA, 20 bp, Artificial Sequence
  chemically synthesized
tttgctctctttgcccaggc

SEQ ID NO: 408486 - DNA, 20 bp, Artificial Sequence
  chemically synthesized
tgctctctttgcccaggctg

SEQ ID NO: 408487 - DNA, 20 bp, Artificial Sequence
  chemically synthesized
gtgccactacactccagcct

SEQ ID NO: 408488 - DNA, 20 bp, Artificial Sequence
  chemically synthesized
cgtgccactacactccagcc

SEQ ID NO: 408489 - DNA, 20 bp, Artificial Sequence
  chemically synthesized
tctttgcccaggctggagtg

SEQ ID NO: 408490 - DNA, 20 bp, Artificial Sequence
  chemically synthesized
gagatcgtgccactacactc

SEQ ID NO: 408491 - DNA, 20 bp, Artificial Sequence
  chemically synthesized
ttgcccaggctggagtgtag

SEQ ID NO: 408492 - DNA, 20 bp, Artificial Sequence
  chemically synthesized
ggagtgtagtggcacgatct

SEQ ID NO: 408493 - DNA, 20 bp, Artificial Sequence
  chemically synthesized
gacagtggttgcagtgagcc

SEQ ID NO: 408494 - DNA, 20 bp, Artificial Sequence
  chemically synthesized
ctggagacagtggttgcagt

SEQ ID NO: 408495 - DNA, 20 bp, Artificial Sequence
  chemically synthesized
aaccctggagacagtggttg

SEQ ID NO: 408496 - DNA, 20 bp, Artificial Sequence
  chemically synthesized
ctcactgcaaccactgtctc

SEQ ID NO: 408497 - DNA, 20 bp, Artificial Sequence
  chemically synthesized
cgcttgaaccctggagacag

SEQ ID NO: 408498 - DNA, 20 bp, Artificial Sequence
  chemically synthesized
tcactgcaaccactgtctcc

SEQ ID NO: 408499 - DNA, 20 bp, Artificial Sequence
  chemically synthesized
cactgcaaccactgtctcca

SEQ ID NO: 408500 - DNA, 20 bp, Artificial Sequence
  chemically synthesized
aatcgcttgaaccctggaga

SEQ ID NO: 408501 - DNA, 20 bp, Artificial Sequence
  chemically synthesized
ggagaatcgcttgaaccctg

SEQ ID NO: 408502 - DNA, 20 bp, Artificial Sequence
  chemically synthesized
aaccactgtctccagggttc

SEQ ID NO: 408503 - DNA, 20 bp, Artificial Sequence
  chemically synthesized
caggagaatcgcttgaaccc

SEQ ID NO: 408504 - DNA, 20 bp, Artificial Sequence
  chemically synthesized
ttcaagcgattctcctgcct

SEQ ID NO: 408505 - DNA, 20 bp, Artificial Sequence
  chemically synthesized
tacttgggaggctgaggcag

SEQ ID NO: 408506 - DNA, 20 bp, Artificial Sequence
  chemically synthesized
gctacttgggaggctgaggc

SEQ ID NO: 408507 - DNA, 20 bp, Artificial Sequence
  chemically synthesized
agctacttgggaggctgagg

SEQ ID NO: 408508 - DNA, 20 bp, Artificial Sequence
  chemically synthesized
cccagctacttgggaggctg

SEQ ID NO: 408509 - DNA, 20 bp, Artificial Sequence
  chemically synthesized
tcccagctacttgggaggct

SEQ ID NO: 408510 - DNA, 20 bp, Artificial Sequence
  chemically synthesized
ttctcctgcctcagcctccc

SEQ ID NO: 408511 - DNA, 20 bp, Artificial Sequence
  chemically synthesized
tcctgcctcagcctcccaag

SEQ ID NO: 408512 - DNA, 20 bp, Artificial Sequence
  chemically synthesized
tgtagtcccagctacttggg

SEQ ID NO: 408513 - DNA, 20 bp, Artificial Sequence
  chemically synthesized
ctgtagtcccagctacttgg

SEQ ID NO: 408514 - DNA, 20 bp, Artificial Sequence
  chemically synthesized
gcctcagcctcccaagtagc

SEQ ID NO: 408515 - DNA, 20 bp, Artificial Sequence
  chemically synthesized
gcctgtagtcccagctactt

SEQ ID NO: 408516 - DNA, 20 bp, Artificial Sequence
  chemically synthesized
cctcagcctcccaagtagct

SEQ ID NO: 408517 - DNA, 20 bp, Artificial Sequence
  chemically synthesized
tgcctgtagtcccagctact

SEQ ID NO: 408518 - DNA, 20 bp, Artificial Sequence
  chemically synthesized
ctcccaagtagctgggacta

SEQ ID NO: 408519 - DNA, 20 bp, Artificial Sequence
  chemically synthesized
tcccaagtagctgggactac

SEQ ID NO: 408520 - DNA, 20 bp, Artificial Sequence
  chemically synthesized
gtggcgcatgcctgtagtcc

SEQ ID NO: 408521 - DNA, 20 bp, Artificial Sequence
  chemically synthesized
ggcatggtggcgcatgcctg

SEQ ID NO: 408522 - DNA, 20 bp, Artificial Sequence
  chemically synthesized
caggcatgcgccaccatgcc

SEQ ID NO: 408523 - DNA, 20 bp, Artificial Sequence
  chemically synthesized
aaaaaattagccgggcatgg

SEQ ID NO: 408524 - DNA, 20 bp, Artificial Sequence
  chemically synthesized
tacaaaaaattagccgggca

SEQ ID NO: 408525 - DNA, 20 bp, Artificial Sequence
  chemically synthesized
aaaaatacaaaaaattagcc

SEQ ID NO: 408526 - DNA, 20 bp, Artificial Sequence
  chemically synthesized
taaaaatacaaaaaattagc

SEQ ID NO: 408527 - DNA, 20 bp, Artificial Sequence
  chemically synthesized
ctactaaaaatacaaaaaat

SEQ ID NO: 408528 - DNA, 20 bp, Artificial Sequence
  chemically synthesized
cggctaattttttgtatttt

SEQ ID NO: 408529 - DNA, 20 bp, Artificial Sequence
  chemically synthesized
ctaattttttgtatttttag

SEQ ID NO: 408530 - DNA, 20 bp, Artificial Sequence
  chemically synthesized
aattttttgtatttttagta

SEQ ID NO: 408531 - DNA, 20 bp, Artificial Sequence
  chemically synthesized
ttttgtatttttagtagaga

SEQ ID NO: 408532 - DNA, 20 bp, Artificial Sequence
  chemically synthesized
tttgtatttttagtagagac

SEQ ID NO: 408533 - DNA, 20 bp, Artificial Sequence
  chemically synthesized
ttgtatttttagtagagacg

SEQ ID NO: 408534 - DNA, 20 bp, Artificial Sequence
  chemically synthesized
cggggttttaccatgtttgc

SEQ ID NO: 408535 - DNA, 20 bp, Artificial Sequence
  chemically synthesized
agagaccagcctggcaaaca

SEQ ID NO: 408536 - DNA, 20 bp, Artificial Sequence
  chemically synthesized
ggggttttaccatgtttgcc

SEQ ID NO: 408537 - DNA, 20 bp, Artificial Sequence
  chemically synthesized
ttttaccatgtttgccaggc

SEQ ID NO: 408538 - DNA, 20 bp, Artificial Sequence
  chemically synthesized
tcaggagttagagaccagcc

SEQ ID NO: 408539 - DNA, 20 bp, Artificial Sequence
  chemically synthesized
tgaggtcaggagttagagac

SEQ ID NO: 408540 - DNA, 20 bp, Artificial Sequence
  chemically synthesized
tcatctgaggtcaggagtta

SEQ ID NO: 408541 - DNA, 20 bp, Artificial Sequence
  chemically synthesized
gatcatctgaggtcaggagt

SEQ ID NO: 408542 - DNA, 20 bp, Artificial Sequence
  chemically synthesized
tggtctctaactcctgacct

SEQ ID NO: 408543 - DNA, 20 bp, Artificial Sequence
  chemically synthesized
gacggatcatctgaggtcag

SEQ ID NO: 408544 - DNA, 20 bp, Artificial Sequence
  chemically synthesized
cagacggatcatctgaggtc

SEQ ID NO: 408545 - DNA, 20 bp, Artificial Sequence
  chemically synthesized
gcagacggatcatctgaggt

SEQ ID NO: 408546 - DNA, 20 bp, Artificial Sequence
  chemically synthesized
tgaggcagacggatcatctg

SEQ ID NO: 408547 - DNA, 20 bp, Artificial Sequence
  chemically synthesized
ctgaggcagacggatcatct

SEQ ID NO: 408548 - DNA, 20 bp, Artificial Sequence
  chemically synthesized
ctcagatgatccgtctgcct

SEQ ID NO: 408549 - DNA, 20 bp, Artificial Sequence
  chemically synthesized
ctttgggaggctgaggcaga

SEQ ID NO: 408550 - DNA, 20 bp, Artificial Sequence
  chemically synthesized
agcactttgggaggctgagg

SEQ ID NO: 408551 - DNA, 20 bp, Artificial Sequence
  chemically synthesized
cccagcactttgggaggctg

SEQ ID NO: 408552 - DNA, 20 bp, Artificial Sequence
  chemically synthesized
tcccagcactttgggaggct

SEQ ID NO: 408553 - DNA, 20 bp, Artificial Sequence
  chemically synthesized
ccgtctgcctcagcctccca

SEQ ID NO: 408554 - DNA, 20 bp, Artificial Sequence
  chemically synthesized
tgtaatcccagcactttggg

SEQ ID NO: 408555 - DNA, 20 bp, Artificial Sequence
  chemically synthesized
ctgtaatcccagcactttgg

SEQ ID NO: 408556 - DNA, 20 bp, Artificial Sequence
  chemically synthesized
gcctcagcctcccaaagtgc

SEQ ID NO: 408557 - DNA, 20 bp, Artificial Sequence
  chemically synthesized
acctgtaatcccagcacttt

SEQ ID NO: 408558 - DNA, 20 bp, Artificial Sequence
  chemically synthesized
cctcagcctcccaaagtgct

SEQ ID NO: 408559 - DNA, 20 bp, Artificial Sequence
  chemically synthesized
cacctgtaatcccagcactt

SEQ ID NO: 408560 - DNA, 20 bp, Artificial Sequence
  chemically synthesized
ctcccaaagtgctgggatta

SEQ ID NO: 408561 - DNA, 20 bp, Artificial Sequence
  chemically synthesized
tcccaaagtgctgggattac

SEQ ID NO: 408562 - DNA, 20 bp, Artificial Sequence
  chemically synthesized
gtggctcacacctgtaatcc

SEQ ID NO: 408563 - DNA, 20 bp, Artificial Sequence
  chemically synthesized
agtgctgggattacaggtgt

SEQ ID NO: 408564 - DNA, 20 bp, Artificial Sequence
  chemically synthesized
gcaggggggccggggcgcgg

SEQ ID NO: 408565 - DNA, 20 bp, Artificial Sequence
  chemically synthesized
aggtgtgagccaccgcgccc

SEQ ID NO: 408566 - DNA, 20 bp, Artificial Sequence
  chemically synthesized
agcgcaggggggccggggcg

SEQ ID NO: 408567 - DNA, 20 bp, Artificial Sequence
  chemically synthesized
taaaaagcgcaggggggccg

SEQ ID NO: 408568 - DNA, 20 bp, Artificial Sequence
  chemically synthesized
ataaaaagcgcaggggggcc

SEQ ID NO: 408569 - DNA, 20 bp, Artificial Sequence
  chemically synthesized
tataaaaagcgcaggggggc

SEQ ID NO: 408570 - DNA, 20 bp, Artificial Sequence
  chemically synthesized
aatttataaaaagcgcaggg

SEQ ID NO: 408571 - DNA, 20 bp, Artificial Sequence
  chemically synthesized
gaatttataaaaagcgcagg

SEQ ID NO: 408572 - DNA, 20 bp, Artificial Sequence
  chemically synthesized
tgaatttataaaaagcgcag

SEQ ID NO: 408573 - DNA, 20 bp, Artificial Sequence
  chemically synthesized
atgaatttataaaaagcgca

SEQ ID NO: 408574 - DNA, 20 bp, Artificial Sequence
  chemically synthesized
aatgaatttataaaaagcgc

SEQ ID NO: 408575 - DNA, 20 bp, Artificial Sequence
  chemically synthesized
gaatgaatttataaaaagcg

SEQ ID NO: 408576 - DNA, 20 bp, Artificial Sequence
  chemically synthesized
tgaatgaatgaatttataaa

SEQ ID NO: 408577 - DNA, 20 bp, Artificial Sequence
  chemically synthesized
tcattcaataaactctgcta

SEQ ID NO: 408578 - DNA, 20 bp, Artificial Sequence
  chemically synthesized
agtctctgaatactgtagca

SEQ ID NO: 408579 - DNA, 20 bp, Artificial Sequence
  chemically synthesized
agagtctctgaatactgtag

SEQ ID NO: 408580 - DNA, 20 bp, Artificial Sequence
  chemically synthesized
ataaactctgctacagtatt

SEQ ID NO: 408581 - DNA, 20 bp, Artificial Sequence
  chemically synthesized
aaaagagtctctgaatactg

SEQ ID NO: 408582 - DNA, 20 bp, Artificial Sequence
  chemically synthesized
aaactctgctacagtattca

SEQ ID NO: 408583 - DNA, 20 bp, Artificial Sequence
  chemically synthesized
aaagcaaatatggcagaaaa

SEQ ID NO: 408584 - DNA, 20 bp, Artificial Sequence
  chemically synthesized
tcaaagcaaatatggcagaa

SEQ ID NO: 408585 - DNA, 20 bp, Artificial Sequence
  chemically synthesized
ctagatcaaagcaaatatgg

SEQ ID NO: 408586 - DNA, 20 bp, Artificial Sequence
  chemically synthesized
taactagatcaaagcaaata

SEQ ID NO: 408587 - DNA, 20 bp, Artificial Sequence
  chemically synthesized
ctgccatatttgctttgatc

SEQ ID NO: 408588 - DNA, 20 bp, Artificial Sequence
  chemically synthesized
attaagtgttaactagatca

SEQ ID NO: 408589 - DNA, 20 bp, Artificial Sequence
  chemically synthesized
taaactcattaagtgttaac

SEQ ID NO: 408590 - DNA, 20 bp, Artificial Sequence
  chemically synthesized
tgatctagttaacacttaat

SEQ ID NO: 408591 - DNA, 20 bp, Artificial Sequence
  chemically synthesized
ttatggtatataaactcatt

SEQ ID NO: 408592 - DNA, 20 bp, Artificial Sequence
  chemically synthesized
atactgtaaaagggatatta

SEQ ID NO: 408593 - DNA, 20 bp, Artificial Sequence
  chemically synthesized
ataccataatatccctttta

SEQ ID NO: 408594 - DNA, 20 bp, Artificial Sequence
  chemically synthesized
cgttacaggatactgtaaaa

SEQ ID NO: 408595 - DNA, 20 bp, Artificial Sequence
  chemically synthesized
tcgttacaggatactgtaaa

SEQ ID NO: 408596 - DNA, 20 bp, Artificial Sequence
  chemically synthesized
ttcgttacaggatactgtaa

SEQ ID NO: 408597 - DNA, 20 bp, Artificial Sequence
  chemically synthesized
atgataaagagattcgttac

SEQ ID NO: 408598 - DNA, 20 bp, Artificial Sequence
  chemically synthesized
aatgataaagagattcgtta

SEQ ID NO: 408599 - DNA, 20 bp, Artificial Sequence
  chemically synthesized
tataagctagaaatgataaa

SEQ ID NO: 408600 - DNA, 20 bp, Artificial Sequence
  chemically synthesized
gatataagctagaaatgata

SEQ ID NO: 408601 - DNA, 20 bp, Artificial Sequence
  chemically synthesized
acgaatctctttatcatttc

SEQ ID NO: 408602 - DNA, 20 bp, Artificial Sequence
  chemically synthesized
acagactccatgatataagc

SEQ ID NO: 408603 - DNA, 20 bp, Artificial Sequence
  chemically synthesized
atcatttctagcttatatca

SEQ ID NO: 408604 - DNA, 20 bp, Artificial Sequence
  chemically synthesized
tgtcacagactccatgatat

SEQ ID NO: 408605 - DNA, 20 bp, Artificial Sequence
  chemically synthesized
catttctagcttatatcatg

SEQ ID NO: 408606 - DNA, 20 bp, Artificial Sequence
  chemically synthesized
ttatatcatggagtctgtga

SEQ ID NO: 408607 - DNA, 20 bp, Artificial Sequence
  chemically synthesized
ggcaatcttgttgtctgtca

SEQ ID NO: 408608 - DNA, 20 bp, Artificial Sequence
  chemically synthesized
tggagtctgtgacagacaac

SEQ ID NO: 408609 - DNA, 20 bp, Artificial Sequence
  chemically synthesized
cagtagagggcatggttcag

SEQ ID NO: 408610 - DNA, 20 bp, Artificial Sequence
  chemically synthesized
tcagtagagggcatggttca

SEQ ID NO: 408611 - DNA, 20 bp, Artificial Sequence
  chemically synthesized
catcagtagagggcatggtt

SEQ ID NO: 408612 - DNA, 20 bp, Artificial Sequence
  chemically synthesized
acccacatcagtagagggca

SEQ ID NO: 408613 - DNA, 20 bp, Artificial Sequence
  chemically synthesized
ataatacccacatcagtaga

SEQ ID NO: 408614 - DNA, 20 bp, Artificial Sequence
  chemically synthesized
aataatacccacatcagtag

SEQ ID NO: 408615 - DNA, 20 bp, Artificial Sequence
  chemically synthesized
taataatacccacatcagta

SEQ ID NO: 408616 - DNA, 20 bp, Artificial Sequence
  chemically synthesized
aaccatgccctctactgatg

SEQ ID NO: 408617 - DNA, 20 bp, Artificial Sequence
  chemically synthesized
accatgccctctactgatgt

SEQ ID NO: 408618 - DNA, 20 bp, Artificial Sequence
  chemically synthesized
tataataatacccacatcag

SEQ ID NO: 408619 - DNA, 20 bp, Artificial Sequence
  chemically synthesized
cagtataataatacccacat

SEQ ID NO: 408620 - DNA, 20 bp, Artificial Sequence
  chemically synthesized
gtgggtattattatactgat

SEQ ID NO: 408621 - DNA, 20 bp, Artificial Sequence
  chemically synthesized
cgagaaagaagaaatctcat

SEQ ID NO: 408622 - DNA, 20 bp, Artificial Sequence
  chemically synthesized
cataacagagaacgagaaag

SEQ ID NO: 408623 - DNA, 20 bp, Artificial Sequence
  chemically synthesized
tttcataacagagaacgaga

SEQ ID NO: 408624 - DNA, 20 bp, Artificial Sequence
  chemically synthesized
gctttttcataacagagaac

SEQ ID NO: 408625 - DNA, 20 bp, Artificial Sequence
  chemically synthesized
gagcttgctttttcataaca

SEQ ID NO: 408626 - DNA, 20 bp, Artificial Sequence
  chemically synthesized
atgagcttgctttttcataa

SEQ ID NO: 408627 - DNA, 20 bp, Artificial Sequence
  chemically synthesized
tctcgttctctgttatgaaa

SEQ ID NO: 408628 - DNA, 20 bp, Artificial Sequence
  chemically synthesized
gttctctgttatgaaaaagc

SEQ ID NO: 408629 - DNA, 20 bp, Artificial Sequence
  chemically synthesized
gttatgaaaaagcaagctca

SEQ ID NO: 408630 - DNA, 20 bp, Artificial Sequence
  chemically synthesized
ttatgagccccgtgggccat

SEQ ID NO: 408631 - DNA, 20 bp, Artificial Sequence
  chemically synthesized
aaaagcaagctcatggccca

SEQ ID NO: 408632 - DNA, 20 bp, Artificial Sequence
  chemically synthesized
aaagcaagctcatggcccac

SEQ ID NO: 408633 - DNA, 20 bp, Artificial Sequence
  chemically synthesized
aagcaagctcatggcccacg

SEQ ID NO: 408634 - DNA, 20 bp, Artificial Sequence
  chemically synthesized
acattttttatgagccccgt

SEQ ID NO: 408635 - DNA, 20 bp, Artificial Sequence
  chemically synthesized
tacattttttatgagccccg

SEQ ID NO: 408636 - DNA, 20 bp, Artificial Sequence
  chemically synthesized
gcctttagtacattttttat

SEQ ID NO: 408637 - DNA, 20 bp, Artificial Sequence
  chemically synthesized
ggctcataaaaaatgtacta

SEQ ID NO: 408638 - DNA, 20 bp, Artificial Sequence
  chemically synthesized
gctcataaaaaatgtactaa

SEQ ID NO: 408639 - DNA, 20 bp, Artificial Sequence
  chemically synthesized
taaaaaatgtactaaaggct

SEQ ID NO: 408640 - DNA, 20 bp, Artificial Sequence
  chemically synthesized
ttgccattgctctcagcctt

SEQ ID NO: 408641 - DNA, 20 bp, Artificial Sequence
  chemically synthesized
aaaaatgtactaaaggctga

SEQ ID NO: 408642 - DNA, 20 bp, Artificial Sequence
  chemically synthesized
gtactaaaggctgagagcaa

SEQ ID NO: 408643 - DNA, 20 bp, Artificial Sequence
  chemically synthesized
tcattagttgccattgctct

SEQ ID NO: 408644 - DNA, 20 bp, Artificial Sequence
  chemically synthesized
tgtacttacacgtatatcat

SEQ ID NO: 408645 - DNA, 20 bp, Artificial Sequence
  chemically synthesized
gcaactaatgatatacgtgt

SEQ ID NO: 408646 - DNA, 20 bp, Artificial Sequence
  chemically synthesized
taagtacatattgatcaaat

SEQ ID NO: 408647 - DNA, 20 bp, Artificial Sequence
  chemically synthesized
agtacatattgatcaaatta

SEQ ID NO: 408648 - DNA, 20 bp, Artificial Sequence
  chemically synthesized
agagatgattttttttttca

SEQ ID NO: 408649 - DNA, 20 bp, Artificial Sequence
  chemically synthesized
tgattttttttttcacagct

SEQ ID NO: 408650 - DNA, 20 bp, Artificial Sequence
  chemically synthesized
ctattgttagacacatcact

SEQ ID NO: 408651 - DNA, 20 bp, Artificial Sequence
  chemically synthesized
ctcagtgatgtgtctaacaa

SEQ ID NO: 408652 - DNA, 20 bp, Artificial Sequence
  chemically synthesized
atttcccagaatactattgt

SEQ ID NO: 408653 - DNA, 20 bp, Artificial Sequence
  chemically synthesized
tgtgtctaacaatagtattc

SEQ ID NO: 408654 - DNA, 20 bp, Artificial Sequence
  chemically synthesized
gtgtctaacaatagtattct

SEQ ID NO: 408655 - DNA, 20 bp, Artificial Sequence
  chemically synthesized
tatgtatatatggaatttcc

SEQ ID NO: 408656 - DNA, 20 bp, Artificial Sequence
  chemically synthesized
tggcttatattatgtatata

SEQ ID NO: 408657 - DNA, 20 bp, Artificial Sequence
  chemically synthesized
attccatatatacataatat

SEQ ID NO: 408658 - DNA, 20 bp, Artificial Sequence
  chemically synthesized
tatatacataatataagcca

SEQ ID NO: 408659 - DNA, 20 bp, Artificial Sequence
  chemically synthesized
gttctatctgaataaagcca

SEQ ID NO: 408660 - DNA, 20 bp, Artificial Sequence
  chemically synthesized
atataagccatggctttatt

SEQ ID NO: 408661 - DNA, 20 bp, Artificial Sequence
  chemically synthesized
gcatttgttctatctgaata

SEQ ID NO: 408662 - DNA, 20 bp, Artificial Sequence
  chemically synthesized
aagccatggctttattcaga

SEQ ID NO: 408663 - DNA, 20 bp, Artificial Sequence
  chemically synthesized
tattcagatagaacaaatgc

SEQ ID NO: 408664 - DNA, 20 bp, Artificial Sequence
  chemically synthesized
aagctcctaacaatattatc

SEQ ID NO: 408665 - DNA, 20 bp, Artificial Sequence
  chemically synthesized
caaatgccagataatattgt

SEQ ID NO: 408666 - DNA, 20 bp, Artificial Sequence
  chemically synthesized
aaatgccagataatattgtt

SEQ ID NO: 408667 - DNA, 20 bp, Artificial Sequence
  chemically synthesized
atgccagataatattgttag

SEQ ID NO: 408668 - DNA, 20 bp, Artificial Sequence
  chemically synthesized
attgttaggagcttctacaa

SEQ ID NO: 408669 - DNA, 20 bp, Artificial Sequence
  chemically synthesized
tttgaattttgctattgtag

SEQ ID NO: 408670 - DNA, 20 bp, Artificial Sequence
  chemically synthesized
gattttgaattttgctattg

SEQ ID NO: 408671 - DNA, 20 bp, Artificial Sequence
  chemically synthesized
tcattttaaaacacataaaa

SEQ ID NO: 408672 - DNA, 20 bp, Artificial Sequence
  chemically synthesized
gcactgaagaaaaaaaaagt

SEQ ID NO: 408673 - DNA, 20 bp, Artificial Sequence
  chemically synthesized
acaggcactgaagaaaaaaa

SEQ ID NO: 408674 - DNA, 20 bp, Artificial Sequence
  chemically synthesized
tggctcactttttttttctt

SEQ ID NO: 408675 - DNA, 20 bp, Artificial Sequence
  chemically synthesized
aacaagatggacaggcactg

SEQ ID NO: 408676 - DNA, 20 bp, Artificial Sequence
  chemically synthesized
cttttctaaacaagatggac

SEQ ID NO: 408677 - DNA, 20 bp, Artificial Sequence
  chemically synthesized
tcttttctaaacaagatgga

SEQ ID NO: 408678 - DNA, 20 bp, Artificial Sequence
  chemically synthesized
cagtgcctgtccatcttgtt

SEQ ID NO: 408679 - DNA, 20 bp, Artificial Sequence
  chemically synthesized
caagtcttttctaaacaaga

SEQ ID NO: 408680 - DNA, 20 bp, Artificial Sequence
  chemically synthesized
taatcaagtcttttctaaac

SEQ ID NO: 408681 - DNA, 20 bp, Artificial Sequence
  chemically synthesized
cctgtccatcttgtttagaa

SEQ ID NO: 408682 - DNA, 20 bp, Artificial Sequence
  chemically synthesized
gtttagaaaagacttgatta

SEQ ID NO: 408683 - DNA, 20 bp, Artificial Sequence
  chemically synthesized
cagtggatgtggctttaatc

SEQ ID NO: 408684 - DNA, 20 bp, Artificial Sequence
  chemically synthesized
ccattgcctatcagtggatg

SEQ ID NO: 408685 - DNA, 20 bp, Artificial Sequence
  chemically synthesized
attaaagccacatccactga

SEQ ID NO: 408686 - DNA, 20 bp, Artificial Sequence
  chemically synthesized
ttaaagccacatccactgat

SEQ ID NO: 408687 - DNA, 20 bp, Artificial Sequence
  chemically synthesized
taacttccattgcctatcag

SEQ ID NO: 408688 - DNA, 20 bp, Artificial Sequence
  chemically synthesized
atctaacttccattgcctat

SEQ ID NO: 408689 - DNA, 20 bp, Artificial Sequence
  chemically synthesized
ccacatccactgataggcaa

SEQ ID NO: 408690 - DNA, 20 bp, Artificial Sequence
  chemically synthesized
catccactgataggcaatgg

SEQ ID NO: 408691 - DNA, 20 bp, Artificial Sequence
  chemically synthesized
cactgataggcaatggaagt

SEQ ID NO: 408692 - DNA, 20 bp, Artificial Sequence
  chemically synthesized
ataggcaatggaagttagat

SEQ ID NO: 408693 - DNA, 20 bp, Artificial Sequence
  chemically synthesized
ttaaacagtatcggatacac

SEQ ID NO: 408694 - DNA, 20 bp, Artificial Sequence
  chemically synthesized
accagtcttttaaacagtat

SEQ ID NO: 408695 - DNA, 20 bp, Artificial Sequence
  chemically synthesized
gtgtatccgatactgtttaa

SEQ ID NO: 408696 - DNA, 20 bp, Artificial Sequence
  chemically synthesized
aacagaaccagtcttttaaa

SEQ ID NO: 408697 - DNA, 20 bp, Artificial Sequence
  chemically synthesized
tccgatactgtttaaaagac

SEQ ID NO: 408698 - DNA, 20 bp, Artificial Sequence
  chemically synthesized
ttcaaattataaaacagaac

SEQ ID NO: 408699 - DNA, 20 bp, Artificial Sequence
  chemically synthesized
atttaattcaaattataaaa

SEQ ID NO: 408700 - DNA, 20 bp, Artificial Sequence
  chemically synthesized
gttttataatttgaattaaa

SEQ ID NO: 408701 - DNA, 20 bp, Artificial Sequence
  chemically synthesized
gctcctacaaaaaaaaagat

SEQ ID NO: 408702 - DNA, 20 bp, Artificial Sequence
  chemically synthesized
cccaagctcctacaaaaaaa

SEQ ID NO: 408703 - DNA, 20 bp, Artificial Sequence
  chemically synthesized
gtaactaatctttttttttg

SEQ ID NO: 408704 - DNA, 20 bp, Artificial Sequence
  chemically synthesized
taactaatctttttttttgt

SEQ ID NO: 408705 - DNA, 20 bp, Artificial Sequence
  chemically synthesized
actaatctttttttttgtag

SEQ ID NO: 408706 - DNA, 20 bp, Artificial Sequence
  chemically synthesized
tctttttttttgtaggagct

SEQ ID NO: 408707 - DNA, 20 bp, Artificial Sequence
  chemically synthesized
ctttttttttgtaggagctt

SEQ ID NO: 408708 - DNA, 20 bp, Artificial Sequence
  chemically synthesized
ttttttgtaggagcttgggc

SEQ ID NO: 408709 - DNA, 20 bp, Artificial Sequence
  chemically synthesized
tttttgtaggagcttgggct

SEQ ID NO: 408710 - DNA, 20 bp, Artificial Sequence
  chemically synthesized
ttccttactttgcctagccc

SEQ ID NO: 408711 - DNA, 20 bp, Artificial Sequence
  chemically synthesized
gtaggagcttgggctaggca

SEQ ID NO: 408712 - DNA, 20 bp, Artificial Sequence
  chemically synthesized
tctttattccttactttgcc

SEQ ID NO: 408713 - DNA, 20 bp, Artificial Sequence
  chemically synthesized
gagcttgggctaggcaaagt

SEQ ID NO: 408714 - DNA, 20 bp, Artificial Sequence
  chemically synthesized
agcttgggctaggcaaagta

SEQ ID NO: 408715 - DNA, 20 bp, Artificial Sequence
  chemically synthesized
gctaggcaaagtaaggaata

SEQ ID NO: 408716 - DNA, 20 bp, Artificial Sequence
  chemically synthesized
aagtaaggaataaagaaata

SEQ ID NO: 408717 - DNA, 20 bp, Artificial Sequence
  chemically synthesized
aaagttacattttctatgac

SEQ ID NO: 408718 - DNA, 20 bp, Artificial Sequence
  chemically synthesized
agttacattttctatgacta

SEQ ID NO: 408719 - DNA, 20 bp, Artificial Sequence
  chemically synthesized
gttacattttctatgactag

SEQ ID NO: 408720 - DNA, 20 bp, Artificial Sequence
  chemically synthesized
ttctaaaatacctctagtca

SEQ ID NO: 408721 - DNA, 20 bp, Artificial Sequence
  chemically synthesized
aacttcttctaaaatacctc

SEQ ID NO: 408722 - DNA, 20 bp, Artificial Sequence
  chemically synthesized
ttctatgactagaggtattt

SEQ ID NO: 408723 - DNA, 20 bp, Artificial Sequence
  chemically synthesized
tatgactagaggtattttag

SEQ ID NO: 408724 - DNA, 20 bp, Artificial Sequence
  chemically synthesized
gactagaggtattttagaag

SEQ ID NO: 408725 - DNA, 20 bp, Artificial Sequence
  chemically synthesized
catagaacacacattttatt

SEQ ID NO: 408726 - DNA, 20 bp, Artificial Sequence
  chemically synthesized
ttaataaaatgtgtgttcta

SEQ ID NO: 408727 - DNA, 20 bp, Artificial Sequence
  chemically synthesized
aataaaatgtgtgttctatg

SEQ ID NO: 408728 - DNA, 20 bp, Artificial Sequence
  chemically synthesized
atgcatgcgtagaatctcca

SEQ ID NO: 408729 - DNA, 20 bp, Artificial Sequence
  chemically synthesized
cctagttttctatgcatgcg

SEQ ID NO: 408730 - DNA, 20 bp, Artificial Sequence
  chemically synthesized
atggagattctacgcatgca

SEQ ID NO: 408731 - DNA, 20 bp, Artificial Sequence
  chemically synthesized
tctacgcatgcatagaaaac

SEQ ID NO: 408732 - DNA, 20 bp, Artificial Sequence
  chemically synthesized
ctacgcatgcatagaaaact

SEQ ID NO: 408733 - DNA, 20 bp, Artificial Sequence
  chemically synthesized
tgcagaatttttatttcacc

SEQ ID NO: 408734 - DNA, 20 bp, Artificial Sequence
  chemically synthesized
tacttgcttacagaaatgtg

SEQ ID NO: 408735 - DNA, 20 bp, Artificial Sequence
  chemically synthesized
aaaattctgcacatttctgt

SEQ ID NO: 408736 - DNA, 20 bp, Artificial Sequence
  chemically synthesized
ttctgcacatttctgtaagc

SEQ ID NO: 408737 - DNA, 20 bp, Artificial Sequence
  chemically synthesized
ttttccttgatacttgctta

SEQ ID NO: 408738 - DNA, 20 bp, Artificial Sequence
  chemically synthesized
catttctgtaagcaagtatc

SEQ ID NO: 408739 - DNA, 20 bp, Artificial Sequence
  chemically synthesized
atttctgtaagcaagtatca

SEQ ID NO: 408740 - DNA, 20 bp, Artificial Sequence
  chemically synthesized
gtaagcaagtatcaaggaaa

SEQ ID NO: 408741 - DNA, 20 bp, Artificial Sequence
  chemically synthesized
aagcaagtatcaaggaaaaa

SEQ ID NO: 408742 - DNA, 20 bp, Artificial Sequence
  chemically synthesized
tacagggtgctgcaattgtt

SEQ ID NO: 408743 - DNA, 20 bp, Artificial Sequence
  chemically synthesized
aaaagagttctgaacaattg

SEQ ID NO: 408744 - DNA, 20 bp, Artificial Sequence
  chemically synthesized
gaacaattgcagcaccctgt

SEQ ID NO: 408745 - DNA, 20 bp, Artificial Sequence
  chemically synthesized
gagcatgaaggagacttaca

SEQ ID NO: 408746 - DNA, 20 bp, Artificial Sequence
  chemically synthesized
agagcatgaaggagacttac

SEQ ID NO: 408747 - DNA, 20 bp, Artificial Sequence
  chemically synthesized
aagagcatgaaggagactta

SEQ ID NO: 408748 - DNA, 20 bp, Artificial Sequence
  chemically synthesized
aattgggaaagagcatgaag

SEQ ID NO: 408749 - DNA, 20 bp, Artificial Sequence
  chemically synthesized
tgaattgggaaagagcatga

SEQ ID NO: 408750 - DNA, 20 bp, Artificial Sequence
  chemically synthesized
gtgaattgggaaagagcatg

SEQ ID NO: 408751 - DNA, 20 bp, Artificial Sequence
  chemically synthesized
atatagtgtgaattgggaaa

SEQ ID NO: 408752 - DNA, 20 bp, Artificial Sequence
  chemically synthesized
gaatatagtgtgaattggga

SEQ ID NO: 408753 - DNA, 20 bp, Artificial Sequence
  chemically synthesized
gtgggaatatagtgtgaatt

SEQ ID NO: 408754 - DNA, 20 bp, Artificial Sequence
  chemically synthesized
ggtgggaatatagtgtgaat

SEQ ID NO: 408755 - DNA, 20 bp, Artificial Sequence
  chemically synthesized
ctgagaggctggtgggaata

SEQ ID NO: 408756 - DNA, 20 bp, Artificial Sequence
  chemically synthesized
aattcacactatattcccac

SEQ ID NO: 408757 - DNA, 20 bp, Artificial Sequence
  chemically synthesized
tttcttcctgagaggctggt

SEQ ID NO: 408758 - DNA, 20 bp, Artificial Sequence
  chemically synthesized
gtttcttcctgagaggctgg

SEQ ID NO: 408759 - DNA, 20 bp, Artificial Sequence
  chemically synthesized
ctatattcccaccagcctct

SEQ ID NO: 408760 - DNA, 20 bp, Artificial Sequence
  chemically synthesized
tatattcccaccagcctctc

SEQ ID NO: 408761 - DNA, 20 bp, Artificial Sequence
  chemically synthesized
gcagtttcttcctgagaggc

SEQ ID NO: 408762 - DNA, 20 bp, Artificial Sequence
  chemically synthesized
attcccaccagcctctcagg

SEQ ID NO: 408763 - DNA, 20 bp, Artificial Sequence
  chemically synthesized
cagagcagtttcttcctgag

SEQ ID NO: 408764 - DNA, 20 bp, Artificial Sequence
  chemically synthesized
gcagagcagtttcttcctga

SEQ ID NO: 408765 - DNA, 20 bp, Artificial Sequence
  chemically synthesized
cagcagagcagtttcttcct

SEQ ID NO: 408766 - DNA, 20 bp, Artificial Sequence
  chemically synthesized
aatgattcaggtcagcagag

SEQ ID NO: 408767 - DNA, 20 bp, Artificial Sequence
  chemically synthesized
tataatgattcaggtcagca

SEQ ID NO: 408768 - DNA, 20 bp, Artificial Sequence
  chemically synthesized
tctataatgattcaggtcag

SEQ ID NO: 408769 - DNA, 20 bp, Artificial Sequence
  chemically synthesized
ttatctataatgattcaggt

SEQ ID NO: 408770 - DNA, 20 bp, Artificial Sequence
  chemically synthesized
aaagttatctataatgattc

SEQ ID NO: 408771 - DNA, 20 bp, Artificial Sequence
  chemically synthesized
caaagttatctataatgatt

SEQ ID NO: 408772 - DNA, 20 bp, Artificial Sequence
  chemically synthesized
tctgctgacctgaatcatta

SEQ ID NO: 408773 - DNA, 20 bp, Artificial Sequence
  chemically synthesized
tgaatcattatagataactt

SEQ ID NO: 408774 - DNA, 20 bp, Artificial Sequence
  chemically synthesized
tcattatagataactttggc

SEQ ID NO: 408775 - DNA, 20 bp, Artificial Sequence
  chemically synthesized
tgaagtttgagaactggcca

SEQ ID NO: 408776 - DNA, 20 bp, Artificial Sequence
  chemically synthesized
tctatatgaagtttgagaac

SEQ ID NO: 408777 - DNA, 20 bp, Artificial Sequence
  chemically synthesized
attccatctatatgaagttt

SEQ ID NO: 408778 - DNA, 20 bp, Artificial Sequence
  chemically synthesized
gccagttctcaaacttcata

SEQ ID NO: 408779 - DNA, 20 bp, Artificial Sequence
  chemically synthesized
tgtgtgattccatctatatg

SEQ ID NO: 408780 - DNA, 20 bp, Artificial Sequence
  chemically synthesized
gttctcaaacttcatataga

SEQ ID NO: 408781 - DNA, 20 bp, Artificial Sequence
  chemically synthesized
ttcatatagatggaatcaca

SEQ ID NO: 408782 - DNA, 20 bp, Artificial Sequence
  chemically synthesized
cacagtaaatgttcatcttc

SEQ ID NO: 408783 - DNA, 20 bp, Artificial Sequence
  chemically synthesized
ataaacacaatgttgactag

SEQ ID NO: 408784 - DNA, 20 bp, Artificial Sequence
  chemically synthesized
ttcataaacacaatgttgac

SEQ ID NO: 408785 - DNA, 20 bp, Artificial Sequence
  chemically synthesized
tagtcaacattgtgtttatg

SEQ ID NO: 408786 - DNA, 20 bp, Artificial Sequence
  chemically synthesized
aagttcgttcatattcttcc

SEQ ID NO: 408787 - DNA, 20 bp, Artificial Sequence
  chemically synthesized
ttcgttcatattcttccaag

SEQ ID NO: 408788 - DNA, 20 bp, Artificial Sequence
  chemically synthesized
aataaaaacctgctacttgg

SEQ ID NO: 408789 - DNA, 20 bp, Artificial Sequence
  chemically synthesized
gttcatattcttccaagtag

SEQ ID NO: 408790 - DNA, 20 bp, Artificial Sequence
  chemically synthesized
ttcatattcttccaagtagc

SEQ ID NO: 408791 - DNA, 20 bp, Artificial Sequence
  chemically synthesized
agtaataaaaacctgctact

SEQ ID NO: 408792 - DNA, 20 bp, Artificial Sequence
  chemically synthesized
tatatccgtggaatattata

SEQ ID NO: 408793 - DNA, 20 bp, Artificial Sequence
  chemically synthesized
tattactatataatattcca

SEQ ID NO: 408794 - DNA, 20 bp, Artificial Sequence
  chemically synthesized
acaaaaattgggtatatccg

SEQ ID NO: 408795 - DNA, 20 bp, Artificial Sequence
  chemically synthesized
acaaacaaaaaacaaaaatt

SEQ ID NO: 408796 - DNA, 20 bp, Artificial Sequence
  chemically synthesized
aacaaacaaaaaacaaaaat

SEQ ID NO: 408797 - DNA, 20 bp, Artificial Sequence
  chemically synthesized
tgttttttgtttttgttttt

SEQ ID NO: 408798 - DNA, 20 bp, Artificial Sequence
  chemically synthesized
ttgtttttgtttttgagaca

SEQ ID NO: 408799 - DNA, 20 bp, Artificial Sequence
  chemically synthesized
ttcagcctgggtgacagagc

SEQ ID NO: 408800 - DNA, 20 bp, Artificial Sequence
  chemically synthesized
caaagtctcgctctgtcacc

SEQ ID NO: 408801 - DNA, 20 bp, Artificial Sequence
  chemically synthesized
gcacttcagcctgggtgaca

SEQ ID NO: 408802 - DNA, 20 bp, Artificial Sequence
  chemically synthesized
aaagtctcgctctgtcaccc

SEQ ID NO: 408803 - DNA, 20 bp, Artificial Sequence
  chemically synthesized
ctgcacttcagcctgggtga

SEQ ID NO: 408804 - DNA, 20 bp, Artificial Sequence
  chemically synthesized
tcgctctgtcacccaggctg

SEQ ID NO: 408805 - DNA, 20 bp, Artificial Sequence
  chemically synthesized
atgccactgcacttcagcct

SEQ ID NO: 408806 - DNA, 20 bp, Artificial Sequence
  chemically synthesized
catgccactgcacttcagcc

SEQ ID NO: 408807 - DNA, 20 bp, Artificial Sequence
  chemically synthesized
ctgtcacccaggctgaagtg

SEQ ID NO: 408808 - DNA, 20 bp, Artificial Sequence
  chemically synthesized
gagatcatgccactgcactt

SEQ ID NO: 408809 - DNA, 20 bp, Artificial Sequence
  chemically synthesized
tcacccaggctgaagtgcag

SEQ ID NO: 408810 - DNA, 20 bp, Artificial Sequence
  chemically synthesized
gaagtgcagtggcatgatct

SEQ ID NO: 408811 - DNA, 20 bp, Artificial Sequence
  chemically synthesized
ggcagaggttgtagtgagct

SEQ ID NO: 408812 - DNA, 20 bp, Artificial Sequence
  chemically synthesized
caggaggcagaggttgtagt

SEQ ID NO: 408813 - DNA, 20 bp, Artificial Sequence
  chemically synthesized
aacccaggaggcagaggttg

SEQ ID NO: 408814 - DNA, 20 bp, Artificial Sequence
  chemically synthesized
cgcttgaacccaggaggcag

SEQ ID NO: 408815 - DNA, 20 bp, Artificial Sequence
  chemically synthesized
tcactacaacctctgcctcc

SEQ ID NO: 408816 - DNA, 20 bp, Artificial Sequence
  chemically synthesized
tcgcttgaacccaggaggca

SEQ ID NO: 408817 - DNA, 20 bp, Artificial Sequence
  chemically synthesized
cactacaacctctgcctcct

SEQ ID NO: 408818 - DNA, 20 bp, Artificial Sequence
  chemically synthesized
aatcgcttgaacccaggagg

SEQ ID NO: 408819 - DNA, 20 bp, Artificial Sequence
  chemically synthesized
gagaatcgcttgaacccagg

SEQ ID NO: 408820 - DNA, 20 bp, Artificial Sequence
  chemically synthesized
ggagaatcgcttgaacccag

SEQ ID NO: 408821 - DNA, 20 bp, Artificial Sequence
  chemically synthesized
aacctctgcctcctgggttc

SEQ ID NO: 408822 - DNA, 20 bp, Artificial Sequence
  chemically synthesized
caggagaatcgcttgaaccc

SEQ ID NO: 408823 - DNA, 20 bp, Artificial Sequence
  chemically synthesized
gcaggagaatcgcttgaacc

SEQ ID NO: 408824 - DNA, 20 bp, Artificial Sequence
  chemically synthesized
ttcaagcgattctcctgcct

SEQ ID NO: 408825 - DNA, 20 bp, Artificial Sequence
  chemically synthesized
tactcaggaggctaaggcag

SEQ ID NO: 408826 - DNA, 20 bp, Artificial Sequence
  chemically synthesized
gctactcaggaggctaaggc

SEQ ID NO: 408827 - DNA, 20 bp, Artificial Sequence
  chemically synthesized
agctactcaggaggctaagg

SEQ ID NO: 408828 - DNA, 20 bp, Artificial Sequence
  chemically synthesized
cccagctactcaggaggcta

SEQ ID NO: 408829 - DNA, 20 bp, Artificial Sequence
  chemically synthesized
tcccagctactcaggaggct

SEQ ID NO: 408830 - DNA, 20 bp, Artificial Sequence
  chemically synthesized
ttctcctgccttagcctcct

SEQ ID NO: 408831 - DNA, 20 bp, Artificial Sequence
  chemically synthesized
tcctgccttagcctcctgag

SEQ ID NO: 408832 - DNA, 20 bp, Artificial Sequence
  chemically synthesized
tgtaatcccagctactcagg

SEQ ID NO: 408833 - DNA, 20 bp, Artificial Sequence
  chemically synthesized
ctgtaatcccagctactcag

SEQ ID NO: 408834 - DNA, 20 bp, Artificial Sequence
  chemically synthesized
gccttagcctcctgagtagc

SEQ ID NO: 408835 - DNA, 20 bp, Artificial Sequence
  chemically synthesized
gcctgtaatcccagctactc

SEQ ID NO: 408836 - DNA, 20 bp, Artificial Sequence
  chemically synthesized
ccttagcctcctgagtagct

SEQ ID NO: 408837 - DNA, 20 bp, Artificial Sequence
  chemically synthesized
cgcctgtaatcccagctact

SEQ ID NO: 408838 - DNA, 20 bp, Artificial Sequence
  chemically synthesized
ctcctgagtagctgggatta

SEQ ID NO: 408839 - DNA, 20 bp, Artificial Sequence
  chemically synthesized
tcctgagtagctgggattac

SEQ ID NO: 408840 - DNA, 20 bp, Artificial Sequence
  chemically synthesized
gtggcaggcgcctgtaatcc

SEQ ID NO: 408841 - DNA, 20 bp, Artificial Sequence
  chemically synthesized
aattagccgtgtgtggtggc

SEQ ID NO: 408842 - DNA, 20 bp, Artificial Sequence
  chemically synthesized
aaattagccgtgtgtggtgg

SEQ ID NO: 408843 - DNA, 20 bp, Artificial Sequence
  chemically synthesized
caggcgcctgccaccacaca

SEQ ID NO: 408844 - DNA, 20 bp, Artificial Sequence
  chemically synthesized
aaaaaattagccgtgtgtgg

SEQ ID NO: 408845 - DNA, 20 bp, Artificial Sequence
  chemically synthesized
tacaaaaaattagccgtgtg

SEQ ID NO: 408846 - DNA, 20 bp, Artificial Sequence
  chemically synthesized
ctactaaaaatacaaaaaat

SEQ ID NO: 408847 - DNA, 20 bp, Artificial Sequence
  chemically synthesized
cggctaattttttgtatttt

SEQ ID NO: 408848 - DNA, 20 bp, Artificial Sequence
  chemically synthesized
ctaattttttgtatttttag

SEQ ID NO: 408849 - DNA, 20 bp, Artificial Sequence
  chemically synthesized
aattttttgtatttttagta

SEQ ID NO: 408850 - DNA, 20 bp, Artificial Sequence
  chemically synthesized
ttttgtatttttagtagaga

SEQ ID NO: 408851 - DNA, 20 bp, Artificial Sequence
  chemically synthesized
tttgtatttttagtagagac

SEQ ID NO: 408852 - DNA, 20 bp, Artificial Sequence
  chemically synthesized
ttgtatttttagtagagaca

SEQ ID NO: 408853 - DNA, 20 bp, Artificial Sequence
  chemically synthesized
cagggtttcactatgttgac

SEQ ID NO: 408854 - DNA, 20 bp, Artificial Sequence
  chemically synthesized
agagaccagcctggtcaaca

SEQ ID NO: 408855 - DNA, 20 bp, Artificial Sequence
  chemically synthesized
agggtttcactatgttgacc

SEQ ID NO: 408856 - DNA, 20 bp, Artificial Sequence
  chemically synthesized
tttcactatgttgaccaggc

SEQ ID NO: 408857 - DNA, 20 bp, Artificial Sequence
  chemically synthesized
tcaggagtcagagaccagcc

SEQ ID NO: 408858 - DNA, 20 bp, Artificial Sequence
  chemically synthesized
tgagatcaggagtcagagac

SEQ ID NO: 408859 - DNA, 20 bp, Artificial Sequence
  chemically synthesized
tcacttgagatcaggagtca

SEQ ID NO: 408860 - DNA, 20 bp, Artificial Sequence
  chemically synthesized
gatcacttgagatcaggagt

SEQ ID NO: 408861 - DNA, 20 bp, Artificial Sequence
  chemically synthesized
ggcggatcacttgagatcag

SEQ ID NO: 408862 - DNA, 20 bp, Artificial Sequence
  chemically synthesized
ggtctctgactcctgatctc

SEQ ID NO: 408863 - DNA, 20 bp, Artificial Sequence
  chemically synthesized
agggcggatcacttgagatc

SEQ ID NO: 408864 - DNA, 20 bp, Artificial Sequence
  chemically synthesized
gagggcggatcacttgagat

SEQ ID NO: 408865 - DNA, 20 bp, Artificial Sequence
  chemically synthesized
cccaggagggcggatcactt

SEQ ID NO: 408866 - DNA, 20 bp, Artificial Sequence
  chemically synthesized
tctcaagtgatccgccctcc

SEQ ID NO: 408867 - DNA, 20 bp, Artificial Sequence
  chemically synthesized
ctcaagtgatccgccctcct

SEQ ID NO: 408868 - DNA, 20 bp, Artificial Sequence
  chemically synthesized
ctttgggaggcccaggaggg

SEQ ID NO: 408869 - DNA, 20 bp, Artificial Sequence
  chemically synthesized
gcactttgggaggcccagga

SEQ ID NO: 408870 - DNA, 20 bp, Artificial Sequence
  chemically synthesized
agcactttgggaggcccagg

SEQ ID NO: 408871 - DNA, 20 bp, Artificial Sequence
  chemically synthesized
tagcactttgggaggcccag

SEQ ID NO: 408872 - DNA, 20 bp, Artificial Sequence
  chemically synthesized
cctagcactttgggaggccc

SEQ ID NO: 408873 - DNA, 20 bp, Artificial Sequence
  chemically synthesized
tcctagcactttgggaggcc

SEQ ID NO: 408874 - DNA, 20 bp, Artificial Sequence
  chemically synthesized
ccgccctcctgggcctccca

SEQ ID NO: 408875 - DNA, 20 bp, Artificial Sequence
  chemically synthesized
tgtaatcctagcactttggg

SEQ ID NO: 408876 - DNA, 20 bp, Artificial Sequence
  chemically synthesized
ctgtaatcctagcactttgg

SEQ ID NO: 408877 - DNA, 20 bp, Artificial Sequence
  chemically synthesized
tcctgggcctcccaaagtgc

SEQ ID NO: 408878 - DNA, 20 bp, Artificial Sequence
  chemically synthesized
gcctgtaatcctagcacttt

SEQ ID NO: 408879 - DNA, 20 bp, Artificial Sequence
  chemically synthesized
cctgggcctcccaaagtgct

SEQ ID NO: 408880 - DNA, 20 bp, Artificial Sequence
  chemically synthesized
cgcctgtaatcctagcactt

SEQ ID NO: 408881 - DNA, 20 bp, Artificial Sequence
  chemically synthesized
ctcccaaagtgctaggatta

SEQ ID NO: 408882 - DNA, 20 bp, Artificial Sequence
  chemically synthesized
tcccaaagtgctaggattac

SEQ ID NO: 408883 - DNA, 20 bp, Artificial Sequence
  chemically synthesized
gtggctcacgcctgtaatcc

SEQ ID NO: 408884 - DNA, 20 bp, Artificial Sequence
  chemically synthesized
agtgctaggattacaggcgt

SEQ ID NO: 408885 - DNA, 20 bp, Artificial Sequence
  chemically synthesized
caggcgtgagccacctcgcc

SEQ ID NO: 408886 - DNA, 20 bp, Artificial Sequence
  chemically synthesized
gcggtatagactgggcgagg

SEQ ID NO: 408887 - DNA, 20 bp, Artificial Sequence
  chemically synthesized
aatgcggtatagactgggcg

SEQ ID NO: 408888 - DNA, 20 bp, Artificial Sequence
  chemically synthesized
aaatgcggtatagactgggc

SEQ ID NO: 408889 - DNA, 20 bp, Artificial Sequence
  chemically synthesized
ttaaaaatgcggtatagact

SEQ ID NO: 408890 - DNA, 20 bp, Artificial Sequence
  chemically synthesized
attaaaaatgcggtatagac

SEQ ID NO: 408891 - DNA, 20 bp, Artificial Sequence
  chemically synthesized
ttagaattaaaaatgcggta

SEQ ID NO: 408892 - DNA, 20 bp, Artificial Sequence
  chemically synthesized
cagaattagaattaaaaatg

SEQ ID NO: 408893 - DNA, 20 bp, Artificial Sequence
  chemically synthesized
gcatttttaattctaattct

SEQ ID NO: 408894 - DNA, 20 bp, Artificial Sequence
  chemically synthesized
catttttaattctaattctg

SEQ ID NO: 408895 - DNA, 20 bp, Artificial Sequence
  chemically synthesized
atttttaattctaattctga

SEQ ID NO: 408896 - DNA, 20 bp, Artificial Sequence
  chemically synthesized
taacttgtgtccctcagaat

SEQ ID NO: 408897 - DNA, 20 bp, Artificial Sequence
  chemically synthesized
ctgatataacttgtgtccct

SEQ ID NO: 408898 - DNA, 20 bp, Artificial Sequence
  chemically synthesized
attctaattctgagggacac

SEQ ID NO: 408899 - DNA, 20 bp, Artificial Sequence
  chemically synthesized
ctgagggacacaagttatat

SEQ ID NO: 408900 - DNA, 20 bp, Artificial Sequence
  chemically synthesized
tgagggacacaagttatatc

SEQ ID NO: 408901 - DNA, 20 bp, Artificial Sequence
  chemically synthesized
agcaacattttgcataatag

SEQ ID NO: 408902 - DNA, 20 bp, Artificial Sequence
  chemically synthesized
aatagcaacattttgcataa

SEQ ID NO: 408903 - DNA, 20 bp, Artificial Sequence
  chemically synthesized
agcatgcacaaggtagttaa

SEQ ID NO: 408904 - DNA, 20 bp, Artificial Sequence
  chemically synthesized
ccaaaatagcatgcacaagg

SEQ ID NO: 408905 - DNA, 20 bp, Artificial Sequence
  chemically synthesized
ccaccaaaatagcatgcaca

SEQ ID NO: 408906 - DNA, 20 bp, Artificial Sequence
  chemically synthesized
tccaccaaaatagcatgcac

SEQ ID NO: 408907 - DNA, 20 bp, Artificial Sequence
  chemically synthesized
ctaccttgtgcatgctattt

SEQ ID NO: 408908 - DNA, 20 bp, Artificial Sequence
  chemically synthesized
ccttgtgcatgctattttgg

SEQ ID NO: 408909 - DNA, 20 bp, Artificial Sequence
  chemically synthesized
agaaattaagtccaccaaaa

SEQ ID NO: 408910 - DNA, 20 bp, Artificial Sequence
  chemically synthesized
ctcaaaaaaggggagaaatt

SEQ ID NO: 408911 - DNA, 20 bp, Artificial Sequence
  chemically synthesized
gaccctgtctcaaaaaaggg

SEQ ID NO: 408912 - DNA, 20 bp, Artificial Sequence
  chemically synthesized
cttaatttctcccctttttt

SEQ ID NO: 408913 - DNA, 20 bp, Artificial Sequence
  chemically synthesized
cagaccctgtctcaaaaaag

SEQ ID NO: 408914 - DNA, 20 bp, Artificial Sequence
  chemically synthesized
tcagaccctgtctcaaaaaa

SEQ ID NO: 408915 - DNA, 20 bp, Artificial Sequence
  chemically synthesized
gtcagaccctgtctcaaaaa

SEQ ID NO: 408916 - DNA, 20 bp, Artificial Sequence
  chemically synthesized
agtcagaccctgtctcaaaa

SEQ ID NO: 408917 - DNA, 20 bp, Artificial Sequence
  chemically synthesized
atttctccccttttttgaga

SEQ ID NO: 408918 - DNA, 20 bp, Artificial Sequence
  chemically synthesized
tttctccccttttttgagac

SEQ ID NO: 408919 - DNA, 20 bp, Artificial Sequence
  chemically synthesized
ttctccccttttttgagaca

SEQ ID NO: 408920 - DNA, 20 bp, Artificial Sequence
  chemically synthesized
actcctgcctgggacagagt

SEQ ID NO: 408921 - DNA, 20 bp, Artificial Sequence
  chemically synthesized
gacagggtctgactctgtcc

SEQ ID NO: 408922 - DNA, 20 bp, Artificial Sequence
  chemically synthesized
acagggtctgactctgtccc

SEQ ID NO: 408923 - DNA, 20 bp, Artificial Sequence
  chemically synthesized
ctacactcctgcctgggaca

SEQ ID NO: 408924 - DNA, 20 bp, Artificial Sequence
  chemically synthesized
gggtctgactctgtcccagg

SEQ ID NO: 408925 - DNA, 20 bp, Artificial Sequence
  chemically synthesized
cactacactcctgcctggga

SEQ ID NO: 408926 - DNA, 20 bp, Artificial Sequence
  chemically synthesized
ggtctgactctgtcccaggc

SEQ ID NO: 408927 - DNA, 20 bp, Artificial Sequence
  chemically synthesized
tctgactctgtcccaggcag

SEQ ID NO: 408928 - DNA, 20 bp, Artificial Sequence
  chemically synthesized
gcaccactacactcctgcct

SEQ ID NO: 408929 - DNA, 20 bp, Artificial Sequence
  chemically synthesized
tgcaccactacactcctgcc

SEQ ID NO: 408930 - DNA, 20 bp, Artificial Sequence
  chemically synthesized
ctctgtcccaggcaggagtg

SEQ ID NO: 408931 - DNA, 20 bp, Artificial Sequence
  chemically synthesized
tgtcccaggcaggagtgtag

SEQ ID NO: 408932 - DNA, 20 bp, Artificial Sequence
  chemically synthesized
ggagtgtagtggtgcaatca

SEQ ID NO: 408933 - DNA, 20 bp, Artificial Sequence
  chemically synthesized
ggtgcaatcacggctccctg

SEQ ID NO: 408934 - DNA, 20 bp, Artificial Sequence
  chemically synthesized
caggaagttgaggctgcagg

SEQ ID NO: 408935 - DNA, 20 bp, Artificial Sequence
  chemically synthesized
cccaggaagttgaggctgca

SEQ ID NO: 408936 - DNA, 20 bp, Artificial Sequence
  chemically synthesized
gcccaggaagttgaggctgc

SEQ ID NO: 408937 - DNA, 20 bp, Artificial Sequence
  chemically synthesized
agcccaggaagttgaggctg

SEQ ID NO: 408938 - DNA, 20 bp, Artificial Sequence
  chemically synthesized
ggcttgagcccaggaagttg

SEQ ID NO: 408939 - DNA, 20 bp, Artificial Sequence
  chemically synthesized
tccctgcagcctcaacttcc

SEQ ID NO: 408940 - DNA, 20 bp, Artificial Sequence
  chemically synthesized
tggcttgagcccaggaagtt

SEQ ID NO: 408941 - DNA, 20 bp, Artificial Sequence
  chemically synthesized
ccctgcagcctcaacttcct

SEQ ID NO: 408942 - DNA, 20 bp, Artificial Sequence
  chemically synthesized
gagaatggcttgagcccagg

SEQ ID NO: 408943 - DNA, 20 bp, Artificial Sequence
  chemically synthesized
agcctcaacttcctgggctc

SEQ ID NO: 408944 - DNA, 20 bp, Artificial Sequence
  chemically synthesized
tgagagaatggcttgagccc

SEQ ID NO: 408945 - DNA, 20 bp, Artificial Sequence
  chemically synthesized
atgagagaatggcttgagcc

SEQ ID NO: 408946 - DNA, 20 bp, Artificial Sequence
  chemically synthesized
ctgagatgagagaatggctt

SEQ ID NO: 408947 - DNA, 20 bp, Artificial Sequence
  chemically synthesized
cagaggctgagatgagagaa

SEQ ID NO: 408948 - DNA, 20 bp, Artificial Sequence
  chemically synthesized
ctcaagccattctctcatct

SEQ ID NO: 408949 - DNA, 20 bp, Artificial Sequence
  chemically synthesized
tactccagaggctgagatga

SEQ ID NO: 408950 - DNA, 20 bp, Artificial Sequence
  chemically synthesized
gctactccagaggctgagat

SEQ ID NO: 408951 - DNA, 20 bp, Artificial Sequence
  chemically synthesized
cattctctcatctcagcctc

SEQ ID NO: 408952 - DNA, 20 bp, Artificial Sequence
  chemically synthesized
tcccagctactccagaggct

SEQ ID NO: 408953 - DNA, 20 bp, Artificial Sequence
  chemically synthesized
ttctctcatctcagcctctg

SEQ ID NO: 408954 - DNA, 20 bp, Artificial Sequence
  chemically synthesized
tctcatctcagcctctggag

SEQ ID NO: 408955 - DNA, 20 bp, Artificial Sequence
  chemically synthesized
tgtagtcccagctactccag

SEQ ID NO: 408956 - DNA, 20 bp, Artificial Sequence
  chemically synthesized
ctgtagtcccagctactcca

SEQ ID NO: 408957 - DNA, 20 bp, Artificial Sequence
  chemically synthesized
atctcagcctctggagtagc

SEQ ID NO: 408958 - DNA, 20 bp, Artificial Sequence
  chemically synthesized
acctgtagtcccagctactc

SEQ ID NO: 408959 - DNA, 20 bp, Artificial Sequence
  chemically synthesized
tctcagcctctggagtagct

SEQ ID NO: 408960 - DNA, 20 bp, Artificial Sequence
  chemically synthesized
ctctggagtagctgggacta

SEQ ID NO: 408961 - DNA, 20 bp, Artificial Sequence
  chemically synthesized
tctggagtagctgggactac

SEQ ID NO: 408962 - DNA, 20 bp, Artificial Sequence
  chemically synthesized
gtggcatgcacctgtagtcc

SEQ ID NO: 408963 - DNA, 20 bp, Artificial Sequence
  chemically synthesized
gacatggtggcatgcacctg

SEQ ID NO: 408964 - DNA, 20 bp, Artificial Sequence
  chemically synthesized
acaggtgcatgccaccatgt

SEQ ID NO: 408965 - DNA, 20 bp, Artificial Sequence
  chemically synthesized
caggtgcatgccaccatgtc

SEQ ID NO: 408966 - DNA, 20 bp, Artificial Sequence
  chemically synthesized
tcaaaattagcctgacatgg

SEQ ID NO: 408967 - DNA, 20 bp, Artificial Sequence
  chemically synthesized
taatcaaaattagcctgaca

SEQ ID NO: 408968 - DNA, 20 bp, Artificial Sequence
  chemically synthesized
aaaataataataatcaaaat

SEQ ID NO: 408969 - DNA, 20 bp, Artificial Sequence
  chemically synthesized
tattttattttttttttttg

SEQ ID NO: 408970 - DNA, 20 bp, Artificial Sequence
  chemically synthesized
ttttattttttttttttgta

SEQ ID NO: 408971 - DNA, 20 bp, Artificial Sequence
  chemically synthesized
ttttttttttttgtagagat

SEQ ID NO: 408972 - DNA, 20 bp, Artificial Sequence
  chemically synthesized
tttttttttttgtagagatg

SEQ ID NO: 408973 - DNA, 20 bp, Artificial Sequence
  chemically synthesized
tgaggtcaaactatgttgcc

SEQ ID NO: 408974 - DNA, 20 bp, Artificial Sequence
  chemically synthesized
ttagactatcctgggcaaca

SEQ ID NO: 408975 - DNA, 20 bp, Artificial Sequence
  chemically synthesized
gaggtcaaactatgttgccc

SEQ ID NO: 408976 - DNA, 20 bp, Artificial Sequence
  chemically synthesized
tcaaactatgttgcccagga

SEQ ID NO: 408977 - DNA, 20 bp, Artificial Sequence
  chemically synthesized
caggagttttagactatcct

SEQ ID NO: 408978 - DNA, 20 bp, Artificial Sequence
  chemically synthesized
ccaggagttttagactatcc

SEQ ID NO: 408979 - DNA, 20 bp, Artificial Sequence
  chemically synthesized
ccaggatagtctaaaactcc

SEQ ID NO: 408980 - DNA, 20 bp, Artificial Sequence
  chemically synthesized
tcacttgaagccaggagttt

SEQ ID NO: 408981 - DNA, 20 bp, Artificial Sequence
  chemically synthesized
ggagggtcacttgaagccag

SEQ ID NO: 408982 - DNA, 20 bp, Artificial Sequence
  chemically synthesized
agtctaaaactcctggcttc

SEQ ID NO: 408983 - DNA, 20 bp, Artificial Sequence
  chemically synthesized
tgggagggtcacttgaagcc

SEQ ID NO: 408984 - DNA, 20 bp, Artificial Sequence
  chemically synthesized
gtgggagggtcacttgaagc

SEQ ID NO: 408985 - DNA, 20 bp, Artificial Sequence
  chemically synthesized
caaagtgggagggtcacttg

SEQ ID NO: 408986 - DNA, 20 bp, Artificial Sequence
  chemically synthesized
tttgggaggccaaagtggga

SEQ ID NO: 408987 - DNA, 20 bp, Artificial Sequence
  chemically synthesized
ttcaagtgaccctcccactt

SEQ ID NO: 408988 - DNA, 20 bp, Artificial Sequence
  chemically synthesized
ctttgggaggccaaagtggg

SEQ ID NO: 408989 - DNA, 20 bp, Artificial Sequence
  chemically synthesized
actttgggaggccaaagtgg

SEQ ID NO: 408990 - DNA, 20 bp, Artificial Sequence
  chemically synthesized
gcactttgggaggccaaagt

SEQ ID NO: 408991 - DNA, 20 bp, Artificial Sequence
  chemically synthesized
agcactttgggaggccaaag

SEQ ID NO: 408992 - DNA, 20 bp, Artificial Sequence
  chemically synthesized
cccagcactttgggaggcca

SEQ ID NO: 408993 - DNA, 20 bp, Artificial Sequence
  chemically synthesized
cctcccactttggcctccca

SEQ ID NO: 408994 - DNA, 20 bp, Artificial Sequence
  chemically synthesized
tgtaatcccagcactttggg

SEQ ID NO: 408995 - DNA, 20 bp, Artificial Sequence
  chemically synthesized
ctgtaatcccagcactttgg

SEQ ID NO: 408996 - DNA, 20 bp, Artificial Sequence
  chemically synthesized
actttggcctcccaaagtgc

SEQ ID NO: 408997 - DNA, 20 bp, Artificial Sequence
  chemically synthesized
gcctgtaatcccagcacttt

SEQ ID NO: 408998 - DNA, 20 bp, Artificial Sequence
  chemically synthesized
ctttggcctcccaaagtgct

SEQ ID NO: 408999 - DNA, 20 bp, Artificial Sequence
  chemically synthesized
tgcctgtaatcccagcactt

SEQ ID NO: 409000 - DNA, 20 bp, Artificial Sequence
  chemically synthesized
ctcccaaagtgctgggatta

SEQ ID NO: 409001 - DNA, 20 bp, Artificial Sequence
  chemically synthesized
tcccaaagtgctgggattac

SEQ ID NO: 409002 - DNA, 20 bp, Artificial Sequence
  chemically synthesized
gtggatcatgcctgtaatcc

SEQ ID NO: 409003 - DNA, 20 bp, Artificial Sequence
  chemically synthesized
caggcatgatccactacacc

SEQ ID NO: 409004 - DNA, 20 bp, Artificial Sequence
  chemically synthesized
aattagtaggccaggtgtag

SEQ ID NO: 409005 - DNA, 20 bp, Artificial Sequence
  chemically synthesized
agaaattagtaggccaggtg

SEQ ID NO: 409006 - DNA, 20 bp, Artificial Sequence
  chemically synthesized
tcaaaagaaattagtaggcc

SEQ ID NO: 409007 - DNA, 20 bp, Artificial Sequence
  chemically synthesized
ttcaaaagaaattagtaggc

SEQ ID NO: 409008 - DNA, 20 bp, Artificial Sequence
  chemically synthesized
tgtgttcaaaagaaattagt

SEQ ID NO: 409009 - DNA, 20 bp, Artificial Sequence
  chemically synthesized
atgtgttcaaaagaaattag

SEQ ID NO: 409010 - DNA, 20 bp, Artificial Sequence
  chemically synthesized
tgtatgtgttcaaaagaaat

SEQ ID NO: 409011 - DNA, 20 bp, Artificial Sequence
  chemically synthesized
tctcatatgtatgtgttcaa

SEQ ID NO: 409012 - DNA, 20 bp, Artificial Sequence
  chemically synthesized
tcttttgaacacatacatat

SEQ ID NO: 409013 - DNA, 20 bp, Artificial Sequence
  chemically synthesized
ttttgaacacatacatatga

SEQ ID NO: 409014 - DNA, 20 bp, Artificial Sequence
  chemically synthesized
tttgaacacatacatatgag

SEQ ID NO: 409015 - DNA, 20 bp, Artificial Sequence
  chemically synthesized
atacatatgagaggaattgc

SEQ ID NO: 409016 - DNA, 20 bp, Artificial Sequence
  chemically synthesized
gagaggaattgctggctcat

SEQ ID NO: 409017 - DNA, 20 bp, Artificial Sequence
  chemically synthesized
agaggaattgctggctcata

SEQ ID NO: 409018 - DNA, 20 bp, Artificial Sequence
  chemically synthesized
tttatgccttccttatgagc

SEQ ID NO: 409019 - DNA, 20 bp, Artificial Sequence
  chemically synthesized
ggaattgctggctcataagg

SEQ ID NO: 409020 - DNA, 20 bp, Artificial Sequence
  chemically synthesized
gaattgctggctcataagga

SEQ ID NO: 409021 - DNA, 20 bp, Artificial Sequence
  chemically synthesized
taaatttatgccttccttat

SEQ ID NO: 409022 - DNA, 20 bp, Artificial Sequence
  chemically synthesized
tcataaggaaggcataaatt

SEQ ID NO: 409023 - DNA, 20 bp, Artificial Sequence
  chemically synthesized
ggaaggcataaatttagatt

SEQ ID NO: 409024 - DNA, 20 bp, Artificial Sequence
  chemically synthesized
aggcataaatttagatttag

SEQ ID NO: 409025 - DNA, 20 bp, Artificial Sequence
  chemically synthesized
aatttagatttagtagatat

SEQ ID NO: 409026 - DNA, 20 bp, Artificial Sequence
  chemically synthesized
atattaatttacacttaaac

SEQ ID NO: 409027 - DNA, 20 bp, Artificial Sequence
  chemically synthesized
ctctcaaatattgctggttt

SEQ ID NO: 409028 - DNA, 20 bp, Artificial Sequence
  chemically synthesized
ctggagctctcaaatattgc

SEQ ID NO: 409029 - DNA, 20 bp, Artificial Sequence
  chemically synthesized
cacttaaaccagcaatattt

SEQ ID NO: 409030 - DNA, 20 bp, Artificial Sequence
  chemically synthesized
cttaaaccagcaatatttga

SEQ ID NO: 409031 - DNA, 20 bp, Artificial Sequence
  chemically synthesized
ccagcaatatttgagagctc

SEQ ID NO: 409032 - DNA, 20 bp, Artificial Sequence
  chemically synthesized
aatatttgagagctccagct

SEQ ID NO: 409033 - DNA, 20 bp, Artificial Sequence
  chemically synthesized
atatttgagagctccagctg

SEQ ID NO: 409034 - DNA, 20 bp, Artificial Sequence
  chemically synthesized
gagaattggtgcctcagctg

SEQ ID NO: 409035 - DNA, 20 bp, Artificial Sequence
  chemically synthesized
gggagaattggtgcctcagc

SEQ ID NO: 409036 - DNA, 20 bp, Artificial Sequence
  chemically synthesized
attggggagaattggtgcct

SEQ ID NO: 409037 - DNA, 20 bp, Artificial Sequence
  chemically synthesized
tatcaagtattggggagaat

SEQ ID NO: 409038 - DNA, 20 bp, Artificial Sequence
  chemically synthesized
agacaatatcaagtattggg

SEQ ID NO: 409039 - DNA, 20 bp, Artificial Sequence
  chemically synthesized
taagacaatatcaagtattg

SEQ ID NO: 409040 - DNA, 20 bp, Artificial Sequence
  chemically synthesized
ataagacaatatcaagtatt

SEQ ID NO: 409041 - DNA, 20 bp, Artificial Sequence
  chemically synthesized
aataagacaatatcaagtat

SEQ ID NO: 409042 - DNA, 20 bp, Artificial Sequence
  chemically synthesized
aaatataataagacaatatc

SEQ ID NO: 409043 - DNA, 20 bp, Artificial Sequence
  chemically synthesized
ccgaatggttaaaatataat

SEQ ID NO: 409044 - DNA, 20 bp, Artificial Sequence
  chemically synthesized
cttattatattttaaccatt

SEQ ID NO: 409045 - DNA, 20 bp, Artificial Sequence
  chemically synthesized
cccctatatatgcatccgaa

SEQ ID NO: 409046 - DNA, 20 bp, Artificial Sequence
  chemically synthesized
taaccattcggatgcatata

SEQ ID NO: 409047 - DNA, 20 bp, Artificial Sequence
  chemically synthesized
aaccattcggatgcatatat

SEQ ID NO: 409048 - DNA, 20 bp, Artificial Sequence
  chemically synthesized
accattcggatgcatatata

SEQ ID NO: 409049 - DNA, 20 bp, Artificial Sequence
  chemically synthesized
ccattcggatgcatatatag

SEQ ID NO: 409050 - DNA, 20 bp, Artificial Sequence
  chemically synthesized
cctaacttcattagtaatca

SEQ ID NO: 409051 - DNA, 20 bp, Artificial Sequence
  chemically synthesized
aaattctttgattactaatg

SEQ ID NO: 409052 - DNA, 20 bp, Artificial Sequence
  chemically synthesized
tctttgattactaatgaagt

SEQ ID NO: 409053 - DNA, 20 bp, Artificial Sequence
  chemically synthesized
gaataggtgcctaacttcat

SEQ ID NO: 409054 - DNA, 20 bp, Artificial Sequence
  chemically synthesized
ctttgattactaatgaagtt

SEQ ID NO: 409055 - DNA, 20 bp, Artificial Sequence
  chemically synthesized
atggtaaaaaacatttgaat

SEQ ID NO: 409056 - DNA, 20 bp, Artificial Sequence
  chemically synthesized
gatggtaaaaaacatttgaa

SEQ ID NO: 409057 - DNA, 20 bp, Artificial Sequence
  chemically synthesized
ttcataaaagaggacaaaga

SEQ ID NO: 409058 - DNA, 20 bp, Artificial Sequence
  chemically synthesized
gcacttcataaaagaggaca

SEQ ID NO: 409059 - DNA, 20 bp, Artificial Sequence
  chemically synthesized
gaacaggcacttcataaaag

SEQ ID NO: 409060 - DNA, 20 bp, Artificial Sequence
  chemically synthesized
catctttgtcctcttttatg

SEQ ID NO: 409061 - DNA, 20 bp, Artificial Sequence
  chemically synthesized
tgaacaggcacttcataaaa

SEQ ID NO: 409062 - DNA, 20 bp, Artificial Sequence
  chemically synthesized
tttgaacaggcacttcataa

SEQ ID NO: 409063 - DNA, 20 bp, Artificial Sequence
  chemically synthesized
agttggcaaaatatttgaac

SEQ ID NO: 409064 - DNA, 20 bp, Artificial Sequence
  chemically synthesized
aagttggcaaaatatttgaa

SEQ ID NO: 409065 - DNA, 20 bp, Artificial Sequence
  chemically synthesized
acaacccattttttaaaagt

SEQ ID NO: 409066 - DNA, 20 bp, Artificial Sequence
  chemically synthesized
aaagacaacccattttttaa

SEQ ID NO: 409067 - DNA, 20 bp, Artificial Sequence
  chemically synthesized
ttttgccaacttttaaaaaa

SEQ ID NO: 409068 - DNA, 20 bp, Artificial Sequence
  chemically synthesized
tttgccaacttttaaaaaat

SEQ ID NO: 409069 - DNA, 20 bp, Artificial Sequence
  chemically synthesized
aactcatacatatcaataaa

SEQ ID NO: 409070 - DNA, 20 bp, Artificial Sequence
  chemically synthesized
gtctttttattgatatgtat

SEQ ID NO: 409071 - DNA, 20 bp, Artificial Sequence
  chemically synthesized
tatgagtttattatatatta

SEQ ID NO: 409072 - DNA, 20 bp, Artificial Sequence
  chemically synthesized
ttattatatattatggatac

SEQ ID NO: 409073 - DNA, 20 bp, Artificial Sequence
  chemically synthesized
atggatacaagttttctaat

SEQ ID NO: 409074 - DNA, 20 bp, Artificial Sequence
  chemically synthesized
tcacaagacgtatatctgat

SEQ ID NO: 409075 - DNA, 20 bp, Artificial Sequence
  chemically synthesized
actgggagaaaaatattcac

SEQ ID NO: 409076 - DNA, 20 bp, Artificial Sequence
  chemically synthesized
tcttgtgaatatttttctcc

SEQ ID NO: 409077 - DNA, 20 bp, Artificial Sequence
  chemically synthesized
aaagaaaagtcatggactgg

SEQ ID NO: 409078 - DNA, 20 bp, Artificial Sequence
  chemically synthesized
gaaaagaaaagtcatggact

SEQ ID NO: 409079 - DNA, 20 bp, Artificial Sequence
  chemically synthesized
tgaaaagaaaagtcatggac

SEQ ID NO: 409080 - DNA, 20 bp, Artificial Sequence
  chemically synthesized
aacagtgaaaagaaaagtca

SEQ ID NO: 409081 - DNA, 20 bp, Artificial Sequence
  chemically synthesized
actaataacagtgaaaagaa

SEQ ID NO: 409082 - DNA, 20 bp, Artificial Sequence
  chemically synthesized
aatacactaataacagtgaa

SEQ ID NO: 409083 - DNA, 20 bp, Artificial Sequence
  chemically synthesized
acttttcttttcactgttat

SEQ ID NO: 409084 - DNA, 20 bp, Artificial Sequence
  chemically synthesized
ctattataatacactaataa

SEQ ID NO: 409085 - DNA, 20 bp, Artificial Sequence
  chemically synthesized
ctgttattagtgtattataa

SEQ ID NO: 409086 - DNA, 20 bp, Artificial Sequence
  chemically synthesized
tattagtgtattataataga

SEQ ID NO: 409087 - DNA, 20 bp, Artificial Sequence
  chemically synthesized
attataatagatagaattct

SEQ ID NO: 409088 - DNA, 20 bp, Artificial Sequence
  chemically synthesized
aattgagcttcattaaaact

SEQ ID NO: 409089 - DNA, 20 bp, Artificial Sequence
  chemically synthesized
tagaattcttagttttaatg

SEQ ID NO: 409090 - DNA, 20 bp, Artificial Sequence
  chemically synthesized
tttaatgaagctcaatttat

SEQ ID NO: 409091 - DNA, 20 bp, Artificial Sequence
  chemically synthesized
aagtcaaacactgataaatt

SEQ ID NO: 409092 - DNA, 20 bp, Artificial Sequence
  chemically synthesized
tcagtgtttgactttgtact

SEQ ID NO: 409093 - DNA, 20 bp, Artificial Sequence
  chemically synthesized
ccgaacaagcactaagtaca

SEQ ID NO: 409094 - DNA, 20 bp, Artificial Sequence
  chemically synthesized
attaggaccgaacaagcact

SEQ ID NO: 409095 - DNA, 20 bp, Artificial Sequence
  chemically synthesized
ctttgtacttagtgcttgtt

SEQ ID NO: 409096 - DNA, 20 bp, Artificial Sequence
  chemically synthesized
tttcataattaggaccgaac

SEQ ID NO: 409097 - DNA, 20 bp, Artificial Sequence
  chemically synthesized
taagcaaagatttcataatt

SEQ ID NO: 409098 - DNA, 20 bp, Artificial Sequence
  chemically synthesized
ctaagcaaagatttcataat

SEQ ID NO: 409099 - DNA, 20 bp, Artificial Sequence
  chemically synthesized
ctaattatgaaatctttgct

SEQ ID NO: 409100 - DNA, 20 bp, Artificial Sequence
  chemically synthesized
agtgagatacaggctaagca

SEQ ID NO: 409101 - DNA, 20 bp, Artificial Sequence
  chemically synthesized
ctacgagtgagatacaggct

SEQ ID NO: 409102 - DNA, 20 bp, Artificial Sequence
  chemically synthesized
ataatctacgagtgagatac

SEQ ID NO: 409103 - DNA, 20 bp, Artificial Sequence
  chemically synthesized
aataatctacgagtgagata

SEQ ID NO: 409104 - DNA, 20 bp, Artificial Sequence
  chemically synthesized
cttagcctgtatctcactcg

SEQ ID NO: 409105 - DNA, 20 bp, Artificial Sequence
  chemically synthesized
aagtaaaataatctacgagt

SEQ ID NO: 409106 - DNA, 20 bp, Artificial Sequence
  chemically synthesized
tcataagtaaaataatctac

SEQ ID NO: 409107 - DNA, 20 bp, Artificial Sequence
  chemically synthesized
tagattattttacttatgac

SEQ ID NO: 409108 - DNA, 20 bp, Artificial Sequence
  chemically synthesized
gattattttacttatgactg

SEQ ID NO: 409109 - DNA, 20 bp, Artificial Sequence
  chemically synthesized
ggtgggcaatctccagtcat

SEQ ID NO: 409110 - DNA, 20 bp, Artificial Sequence
  chemically synthesized
tacatctggtgggcaatctc

SEQ ID NO: 409111 - DNA, 20 bp, Artificial Sequence
  chemically synthesized
tatgactggagattgcccac

SEQ ID NO: 409112 - DNA, 20 bp, Artificial Sequence
  chemically synthesized
tgtaagtggttacatctggt

SEQ ID NO: 409113 - DNA, 20 bp, Artificial Sequence
  chemically synthesized
gtgtaagtggttacatctgg

SEQ ID NO: 409114 - DNA, 20 bp, Artificial Sequence
  chemically synthesized
agtgtgtaagtggttacatc

SEQ ID NO: 409115 - DNA, 20 bp, Artificial Sequence
  chemically synthesized
tgtgaccattagtgtgtaag

SEQ ID NO: 409116 - DNA, 20 bp, Artificial Sequence
  chemically synthesized
ggctgtgaccattagtgtgt

SEQ ID NO: 409117 - DNA, 20 bp, Artificial Sequence
  chemically synthesized
tgtaaccacttacacactaa

SEQ ID NO: 409118 - DNA, 20 bp, Artificial Sequence
  chemically synthesized
cacttacacactaatggtca

SEQ ID NO: 409119 - DNA, 20 bp, Artificial Sequence
  chemically synthesized
gagaatatggctgtgaccat

SEQ ID NO: 409120 - DNA, 20 bp, Artificial Sequence
  chemically synthesized
aaacatagtcaaggagaata

SEQ ID NO: 409121 - DNA, 20 bp, Artificial Sequence
  chemically synthesized
attaagtaaacatagtcaag

SEQ ID NO: 409122 - DNA, 20 bp, Artificial Sequence
  chemically synthesized
tgattaagtaaacatagtca

SEQ ID NO: 409123 - DNA, 20 bp, Artificial Sequence
  chemically synthesized
gtgattaagtaaacatagtc

SEQ ID NO: 409124 - DNA, 20 bp, Artificial Sequence
  chemically synthesized
caatggtgattaagtaaaca

SEQ ID NO: 409125 - DNA, 20 bp, Artificial Sequence
  chemically synthesized
agtctctgccaatggtgatt

SEQ ID NO: 409126 - DNA, 20 bp, Artificial Sequence
  chemically synthesized
tatgtttacttaatcaccat

SEQ ID NO: 409127 - DNA, 20 bp, Artificial Sequence
  chemically synthesized
gtttacttaatcaccattgg

SEQ ID NO: 409128 - DNA, 20 bp, Artificial Sequence
  chemically synthesized
ttacttaatcaccattggca

SEQ ID NO: 409129 - DNA, 20 bp, Artificial Sequence
  chemically synthesized
cgagacatagtctctgccaa

SEQ ID NO: 409130 - DNA, 20 bp, Artificial Sequence
  chemically synthesized
aaagaatattagacgagaca

SEQ ID NO: 409131 - DNA, 20 bp, Artificial Sequence
  chemically synthesized
gggataaaagaatattagac

SEQ ID NO: 409132 - DNA, 20 bp, Artificial Sequence
  chemically synthesized
aataagggataaaagaatat

SEQ ID NO: 409133 - DNA, 20 bp, Artificial Sequence
  chemically synthesized
agtctctgaataagggataa

SEQ ID NO: 409134 - DNA, 20 bp, Artificial Sequence
  chemically synthesized
atattcttttatcccttatt

SEQ ID NO: 409135 - DNA, 20 bp, Artificial Sequence
  chemically synthesized
attcttttatcccttattca

SEQ ID NO: 409136 - DNA, 20 bp, Artificial Sequence
  chemically synthesized
atatgagagtctctgaataa

SEQ ID NO: 409137 - DNA, 20 bp, Artificial Sequence
  chemically synthesized
aatatgagagtctctgaata

SEQ ID NO: 409138 - DNA, 20 bp, Artificial Sequence
  chemically synthesized
taatatgagagtctctgaat

SEQ ID NO: 409139 - DNA, 20 bp, Artificial Sequence
  chemically synthesized
ttacagtcacaataatatga

SEQ ID NO: 409140 - DNA, 20 bp, Artificial Sequence
  chemically synthesized
atttacagtcacaataatat

SEQ ID NO: 409141 - DNA, 20 bp, Artificial Sequence
  chemically synthesized
attttagctaagaaaattta

SEQ ID NO: 409142 - DNA, 20 bp, Artificial Sequence
  chemically synthesized
attgtgactgtaaattttct

SEQ ID NO: 409143 - DNA, 20 bp, Artificial Sequence
  chemically synthesized
agagggaaattattttagct

SEQ ID NO: 409144 - DNA, 20 bp, Artificial Sequence
  chemically synthesized
gagatagagggaaattattt

SEQ ID NO: 409145 - DNA, 20 bp, Artificial Sequence
  chemically synthesized
gtgagacagagagagataga

SEQ ID NO: 409146 - DNA, 20 bp, Artificial Sequence
  chemically synthesized
agtgagacagagagagatag

SEQ ID NO: 409147 - DNA, 20 bp, Artificial Sequence
  chemically synthesized
aagtgagacagagagagata

SEQ ID NO: 409148 - DNA, 20 bp, Artificial Sequence
  chemically synthesized
gaaagtgagacagagagaga

SEQ ID NO: 409149 - DNA, 20 bp, Artificial Sequence
  chemically synthesized
gaaagaaagtgagacagaga

SEQ ID NO: 409150 - DNA, 20 bp, Artificial Sequence
  chemically synthesized
gagaaagaaagtgagacaga

SEQ ID NO: 409151 - DNA, 20 bp, Artificial Sequence
  chemically synthesized
gagagaaagaaagtgagaca

SEQ ID NO: 409152 - DNA, 20 bp, Artificial Sequence
  chemically synthesized
gagagagaaagaaagtgaga

SEQ ID NO: 409153 - DNA, 20 bp, Artificial Sequence
  chemically synthesized
gagagagagagaaagaaagt

SEQ ID NO: 409154 - DNA, 20 bp, Artificial Sequence
  chemically synthesized
gagagagagagagagaaaga

SEQ ID NO: 409155 - DNA, 20 bp, Artificial Sequence
  chemically synthesized
gagagagagagagagagaga

SEQ ID NO: 409156 - DNA, 20 bp, Artificial Sequence
  chemically synthesized
tggagagagagagagagaga

SEQ ID NO: 409157 - DNA, 20 bp, Artificial Sequence
  chemically synthesized
gttggagagagagagagaga

SEQ ID NO: 409158 - DNA, 20 bp, Artificial Sequence
  chemically synthesized
gagttggagagagagagaga

SEQ ID NO: 409159 - DNA, 20 bp, Artificial Sequence
  chemically synthesized
gggagttggagagagagaga

SEQ ID NO: 409160 - DNA, 20 bp, Artificial Sequence
  chemically synthesized
ttgggagttggagagagaga

SEQ ID NO: 409161 - DNA, 20 bp, Artificial Sequence
  chemically synthesized
ctttgggagttggagagaga

SEQ ID NO: 409162 - DNA, 20 bp, Artificial Sequence
  chemically synthesized
atctttgggagttggagaga

SEQ ID NO: 409163 - DNA, 20 bp, Artificial Sequence
  chemically synthesized
atatctttgggagttggaga

SEQ ID NO: 409164 - DNA, 20 bp, Artificial Sequence
  chemically synthesized
atatatctttgggagttgga

SEQ ID NO: 409165 - DNA, 20 bp, Artificial Sequence
  chemically synthesized
ttatatatctttgggagttg

SEQ ID NO: 409166 - DNA, 20 bp, Artificial Sequence
  chemically synthesized
ctctctctctccaactccca

SEQ ID NO: 409167 - DNA, 20 bp, Artificial Sequence
  chemically synthesized
acttatatatctttgggagt

SEQ ID NO: 409168 - DNA, 20 bp, Artificial Sequence
  chemically synthesized
tccgacttatatatctttgg

SEQ ID NO: 409169 - DNA, 20 bp, Artificial Sequence
  chemically synthesized
aatccgacttatatatcttt

SEQ ID NO: 409170 - DNA, 20 bp, Artificial Sequence
  chemically synthesized
aaatccgacttatatatctt

SEQ ID NO: 409171 - DNA, 20 bp, Artificial Sequence
  chemically synthesized
tccaactcccaaagatatat

SEQ ID NO: 409172 - DNA, 20 bp, Artificial Sequence
  chemically synthesized
actcccaaagatatataagt

SEQ ID NO: 409173 - DNA, 20 bp, Artificial Sequence
  chemically synthesized
gatatataagtcggatttat

SEQ ID NO: 409174 - DNA, 20 bp, Artificial Sequence
  chemically synthesized
atatataagtcggatttatt

SEQ ID NO: 409175 - DNA, 20 bp, Artificial Sequence
  chemically synthesized
taagtcggatttattgggca

SEQ ID NO: 409176 - DNA, 20 bp, Artificial Sequence
  chemically synthesized
gatttattgggcacagctac

SEQ ID NO: 409177 - DNA, 20 bp, Artificial Sequence
  chemically synthesized
atttattgggcacagctacc

SEQ ID NO: 409178 - DNA, 20 bp, Artificial Sequence
  chemically synthesized
ttgggcacagctaccaggaa

SEQ ID NO: 409179 - DNA, 20 bp, Artificial Sequence
  chemically synthesized
tcttgaaccccttttcctgg

SEQ ID NO: 409180 - DNA, 20 bp, Artificial Sequence
  chemically synthesized
tgggcacagctaccaggaaa

SEQ ID NO: 409181 - DNA, 20 bp, Artificial Sequence
  chemically synthesized
gggcacagctaccaggaaaa

SEQ ID NO: 409182 - DNA, 20 bp, Artificial Sequence
  chemically synthesized
ggcacagctaccaggaaaag

SEQ ID NO: 409183 - DNA, 20 bp, Artificial Sequence
  chemically synthesized
ccttcttgaaccccttttcc

SEQ ID NO: 409184 - DNA, 20 bp, Artificial Sequence
  chemically synthesized
gctaccaggaaaaggggttc

SEQ ID NO: 409185 - DNA, 20 bp, Artificial Sequence
  chemically synthesized
accaggaaaaggggttcaag

SEQ ID NO: 409186 - DNA, 20 bp, Artificial Sequence
  chemically synthesized
ccaggaaaaggggttcaaga

SEQ ID NO: 409187 - DNA, 20 bp, Artificial Sequence
  chemically synthesized
caggaaaaggggttcaagaa

SEQ ID NO: 409188 - DNA, 20 bp, Artificial Sequence
  chemically synthesized
aaggggttcaagaagggtta

SEQ ID NO: 409189 - DNA, 20 bp, Artificial Sequence
  chemically synthesized
ggggttcaagaagggttaca

SEQ ID NO: 409190 - DNA, 20 bp, Artificial Sequence
  chemically synthesized
gcaaatgaataatcttttgc

SEQ ID NO: 409191 - DNA, 20 bp, Artificial Sequence
  chemically synthesized
caaatgaataatcttttgct

SEQ ID NO: 409192 - DNA, 20 bp, Artificial Sequence
  chemically synthesized
aaatgaataatcttttgcta

SEQ ID NO: 409193 - DNA, 20 bp, Artificial Sequence
  chemically synthesized
ggactcctcagccctagcaa

SEQ ID NO: 409194 - DNA, 20 bp, Artificial Sequence
  chemically synthesized
aataatcttttgctagggct

SEQ ID NO: 409195 - DNA, 20 bp, Artificial Sequence
  chemically synthesized
ataatcttttgctagggctg

SEQ ID NO: 409196 - DNA, 20 bp, Artificial Sequence
  chemically synthesized
tgagttggactcctcagccc

SEQ ID NO: 409197 - DNA, 20 bp, Artificial Sequence
  chemically synthesized
aatcttttgctagggctgag

SEQ ID NO: 409198 - DNA, 20 bp, Artificial Sequence
  chemically synthesized
aggccatgagttggactcct

SEQ ID NO: 409199 - DNA, 20 bp, Artificial Sequence
  chemically synthesized
gggctgaggagtccaactca

SEQ ID NO: 409200 - DNA, 20 bp, Artificial Sequence
  chemically synthesized
attatatcgaggccatgagt

SEQ ID NO: 409201 - DNA, 20 bp, Artificial Sequence
  chemically synthesized
aaaaattatatcgaggccat

SEQ ID NO: 409202 - DNA, 20 bp, Artificial Sequence
  chemically synthesized
cattctcaaaaattatatcg

SEQ ID NO: 409203 - DNA, 20 bp, Artificial Sequence
  chemically synthesized
ccattctcaaaaattatatc

SEQ ID NO: 409204 - DNA, 20 bp, Artificial Sequence
  chemically synthesized
atggcctcgatataattttt

SEQ ID NO: 409205 - DNA, 20 bp, Artificial Sequence
  chemically synthesized
ctcgatataatttttgagaa

SEQ ID NO: 409206 - DNA, 20 bp, Artificial Sequence
  chemically synthesized
gatataatttttgagaatgg

SEQ ID NO: 409207 - DNA, 20 bp, Artificial Sequence
  chemically synthesized
taatttttgagaatggaagc

SEQ ID NO: 409208 - DNA, 20 bp, Artificial Sequence
  chemically synthesized
aatttttgagaatggaagct

SEQ ID NO: 409209 - DNA, 20 bp, Artificial Sequence
  chemically synthesized
ttgagaatggaagctgggaa

SEQ ID NO: 409210 - DNA, 20 bp, Artificial Sequence
  chemically synthesized
agaatggaagctgggaatag

SEQ ID NO: 409211 - DNA, 20 bp, Artificial Sequence
  chemically synthesized
tccctgacatcttctattcc

SEQ ID NO: 409212 - DNA, 20 bp, Artificial Sequence
  chemically synthesized
aagctgggaatagaagatgt

SEQ ID NO: 409213 - DNA, 20 bp, Artificial Sequence
  chemically synthesized
agctgggaatagaagatgtc

SEQ ID NO: 409214 - DNA, 20 bp, Artificial Sequence
  chemically synthesized
gctgggaatagaagatgtca

SEQ ID NO: 409215 - DNA, 20 bp, Artificial Sequence
  chemically synthesized
tagaagatgtcagggaaccc

SEQ ID NO: 409216 - DNA, 20 bp, Artificial Sequence
  chemically synthesized
agaagatgtcagggaaccct

SEQ ID NO: 409217 - DNA, 20 bp, Artificial Sequence
  chemically synthesized
gaagatgtcagggaaccctg

SEQ ID NO: 409218 - DNA, 20 bp, Artificial Sequence
  chemically synthesized
caatactattaacaacccca

SEQ ID NO: 409219 - DNA, 20 bp, Artificial Sequence
  chemically synthesized
tcaatactattaacaacccc

SEQ ID NO: 409220 - DNA, 20 bp, Artificial Sequence
  chemically synthesized
ttcaatactattaacaaccc

SEQ ID NO: 409221 - DNA, 20 bp, Artificial Sequence
  chemically synthesized
gggaaccctggggttgttaa

SEQ ID NO: 409222 - DNA, 20 bp, Artificial Sequence
  chemically synthesized
tattgaaacaacctaccttg

SEQ ID NO: 409223 - DNA, 20 bp, Artificial Sequence
  chemically synthesized
tctcaaaagtactgcaaggt

SEQ ID NO: 409224 - DNA, 20 bp, Artificial Sequence
  chemically synthesized
ctctcaaaagtactgcaagg

SEQ ID NO: 409225 - DNA, 20 bp, Artificial Sequence
  chemically synthesized
tctctctcaaaagtactgca

SEQ ID NO: 409226 - DNA, 20 bp, Artificial Sequence
  chemically synthesized
atctctctcaaaagtactgc

SEQ ID NO: 409227 - DNA, 20 bp, Artificial Sequence
  chemically synthesized
acctaccttgcagtactttt

SEQ ID NO: 409228 - DNA, 20 bp, Artificial Sequence
  chemically synthesized
ctaccttgcagtacttttga

SEQ ID NO: 409229 - DNA, 20 bp, Artificial Sequence
  chemically synthesized
accttgcagtacttttgaga

SEQ ID NO: 409230 - DNA, 20 bp, Artificial Sequence
  chemically synthesized
tggttttatatctctctcaa

SEQ ID NO: 409231 - DNA, 20 bp, Artificial Sequence
  chemically synthesized
cgagcttcagaacagggtga

SEQ ID NO: 409232 - DNA, 20 bp, Artificial Sequence
  chemically synthesized
aaaaccatcaccctgttctg

SEQ ID NO: 409233 - DNA, 20 bp, Artificial Sequence
  chemically synthesized
agggctcgagcttcagaaca

SEQ ID NO: 409234 - DNA, 20 bp, Artificial Sequence
  chemically synthesized
tagggctcgagcttcagaac

SEQ ID NO: 409235 - DNA, 20 bp, Artificial Sequence
  chemically synthesized
ctagggctcgagcttcagaa

SEQ ID NO: 409236 - DNA, 20 bp, Artificial Sequence
  chemically synthesized
atcaccctgttctgaagctc

SEQ ID NO: 409237 - DNA, 20 bp, Artificial Sequence
  chemically synthesized
ataagctagggctcgagctt

SEQ ID NO: 409238 - DNA, 20 bp, Artificial Sequence
  chemically synthesized
ctgttctgaagctcgagccc

SEQ ID NO: 409239 - DNA, 20 bp, Artificial Sequence
  chemically synthesized
aaaataataagctagggctc

SEQ ID NO: 409240 - DNA, 20 bp, Artificial Sequence
  chemically synthesized
aaagggaaaataataagcta

SEQ ID NO: 409241 - DNA, 20 bp, Artificial Sequence
  chemically synthesized
taaagggaaaataataagct

SEQ ID NO: 409242 - DNA, 20 bp, Artificial Sequence
  chemically synthesized
ataaagggaaaataataagc

SEQ ID NO: 409243 - DNA, 20 bp, Artificial Sequence
  chemically synthesized
attgataaagggaaaataat

SEQ ID NO: 409244 - DNA, 20 bp, Artificial Sequence
  chemically synthesized
tttatttgtgaattgataaa

SEQ ID NO: 409245 - DNA, 20 bp, Artificial Sequence
  chemically synthesized
ttttatttgtgaattgataa

SEQ ID NO: 409246 - DNA, 20 bp, Artificial Sequence
  chemically synthesized
cttttatttgtgaattgata

SEQ ID NO: 409247 - DNA, 20 bp, Artificial Sequence
  chemically synthesized
ctttatcaattcacaaataa

SEQ ID NO: 409248 - DNA, 20 bp, Artificial Sequence
  chemically synthesized
aaccaagaagaagtatttgt

SEQ ID NO: 409249 - DNA, 20 bp, Artificial Sequence
  chemically synthesized
aaaccaagaagaagtatttg

SEQ ID NO: 409250 - DNA, 20 bp, Artificial Sequence
  chemically synthesized
ttcctacaaatacttcttct

SEQ ID NO: 409251 - DNA, 20 bp, Artificial Sequence
  chemically synthesized
ataccttcaaaaccaagaag

SEQ ID NO: 409252 - DNA, 20 bp, Artificial Sequence
  chemically synthesized
aacataccttcaaaaccaag

SEQ ID NO: 409253 - DNA, 20 bp, Artificial Sequence
  chemically synthesized
aatacttcttcttggttttg

SEQ ID NO: 409254 - DNA, 20 bp, Artificial Sequence
  chemically synthesized
tataacataccttcaaaacc

SEQ ID NO: 409255 - DNA, 20 bp, Artificial Sequence
  chemically synthesized
atacttcttcttggttttga

SEQ ID NO: 409256 - DNA, 20 bp, Artificial Sequence
  chemically synthesized
ttggttttgaaggtatgtta

SEQ ID NO: 409257 - DNA, 20 bp, Artificial Sequence
  chemically synthesized
tttgaaggtatgttatagaa

SEQ ID NO: 409258 - DNA, 20 bp, Artificial Sequence
  chemically synthesized
ggtatgttatagaatagaaa

SEQ ID NO: 409259 - DNA, 20 bp, Artificial Sequence
  chemically synthesized
agaatagaaaaagtcttaca

SEQ ID NO: 409260 - DNA, 20 bp, Artificial Sequence
  chemically synthesized
gaatagaaaaagtcttacaa

SEQ ID NO: 409261 - DNA, 20 bp, Artificial Sequence
  chemically synthesized
atgtgaaaatacacctttgt

SEQ ID NO: 409262 - DNA, 20 bp, Artificial Sequence
  chemically synthesized
tacaaaggtgtattttcaca

SEQ ID NO: 409263 - DNA, 20 bp, Artificial Sequence
  chemically synthesized
aaaggtgtattttcacatag

SEQ ID NO: 409264 - DNA, 20 bp, Artificial Sequence
  chemically synthesized
gtgtattttcacatagtggt

SEQ ID NO: 409265 - DNA, 20 bp, Artificial Sequence
  chemically synthesized
tttcacatagtggttggtga

SEQ ID NO: 409266 - DNA, 20 bp, Artificial Sequence
  chemically synthesized
cacatagtggttggtgatgg

SEQ ID NO: 409267 - DNA, 20 bp, Artificial Sequence
  chemically synthesized
tagtggttggtgatggtgga

SEQ ID NO: 409268 - DNA, 20 bp, Artificial Sequence
  chemically synthesized
ttataaaaatatgaaatgaa

SEQ ID NO: 409269 - DNA, 20 bp, Artificial Sequence
  chemically synthesized
gttataaaaatatgaaatga

SEQ ID NO: 409270 - DNA, 20 bp, Artificial Sequence
  chemically synthesized
tgttataaaaatatgaaatg

SEQ ID NO: 409271 - DNA, 20 bp, Artificial Sequence
  chemically synthesized
tcaatgtattaaattttcaa

SEQ ID NO: 409272 - DNA, 20 bp, Artificial Sequence
  chemically synthesized
atgcaaatatctgttctaca

SEQ ID NO: 409273 - DNA, 20 bp, Artificial Sequence
  chemically synthesized
ggtcttcaatctatgtagaa

SEQ ID NO: 409274 - DNA, 20 bp, Artificial Sequence
  chemically synthesized
ttcttggtcttcaatctatg

SEQ ID NO: 409275 - DNA, 20 bp, Artificial Sequence
  chemically synthesized
tatctgttctacatagattg

SEQ ID NO: 409276 - DNA, 20 bp, Artificial Sequence
  chemically synthesized
ttctacatagattgaagacc

SEQ ID NO: 409277 - DNA, 20 bp, Artificial Sequence
  chemically synthesized
gtatcactggcagaaattct

SEQ ID NO: 409278 - DNA, 20 bp, Artificial Sequence
  chemically synthesized
tgaagaccaagaatttctgc

SEQ ID NO: 409279 - DNA, 20 bp, Artificial Sequence
  chemically synthesized
tcttggctgggtatcactgg

SEQ ID NO: 409280 - DNA, 20 bp, Artificial Sequence
  chemically synthesized
taatcttggctgggtatcac

SEQ ID NO: 409281 - DNA, 20 bp, Artificial Sequence
  chemically synthesized
gaatttctgccagtgatacc

SEQ ID NO: 409282 - DNA, 20 bp, Artificial Sequence
  chemically synthesized
tctgccagtgatacccagcc

SEQ ID NO: 409283 - DNA, 20 bp, Artificial Sequence
  chemically synthesized
actgaaaactaatcttggct

SEQ ID NO: 409284 - DNA, 20 bp, Artificial Sequence
  chemically synthesized
aactgaaaactaatcttggc

SEQ ID NO: 409285 - DNA, 20 bp, Artificial Sequence
  chemically synthesized
cagtgatacccagccaagat

SEQ ID NO: 409286 - DNA, 20 bp, Artificial Sequence
  chemically synthesized
gactaactgaaaactaatct

SEQ ID NO: 409287 - DNA, 20 bp, Artificial Sequence
  chemically synthesized
acccagccaagattagtttt

SEQ ID NO: 409288 - DNA, 20 bp, Artificial Sequence
  chemically synthesized
agccaagattagttttcagt

SEQ ID NO: 409289 - DNA, 20 bp, Artificial Sequence
  chemically synthesized
gttttgaaagatggtataaa

SEQ ID NO: 409290 - DNA, 20 bp, Artificial Sequence
  chemically synthesized
ttaccatttgttttgaaaga

SEQ ID NO: 409291 - DNA, 20 bp, Artificial Sequence
  chemically synthesized
cacattaccatttgttttga

SEQ ID NO: 409292 - DNA, 20 bp, Artificial Sequence
  chemically synthesized
ataccatctttcaaaacaaa

SEQ ID NO: 409293 - DNA, 20 bp, Artificial Sequence
  chemically synthesized
attttttctttaacagtata

SEQ ID NO: 409294 - DNA, 20 bp, Artificial Sequence
  chemically synthesized
aattttttctttaacagtat

SEQ ID NO: 409295 - DNA, 20 bp, Artificial Sequence
  chemically synthesized
gtgcgatccttatactgtta

SEQ ID NO: 409296 - DNA, 20 bp, Artificial Sequence
  chemically synthesized
ttgaataattttttctttaa

SEQ ID NO: 409297 - DNA, 20 bp, Artificial Sequence
  chemically synthesized
ctgccttaccgtgattcagc

SEQ ID NO: 409298 - DNA, 20 bp, Artificial Sequence
  chemically synthesized
caatgtcacttgctgaatca

SEQ ID NO: 409299 - DNA, 20 bp, Artificial Sequence
  chemically synthesized
aagcctgccttaccgtgatt

SEQ ID NO: 409300 - DNA, 20 bp, Artificial Sequence
  chemically synthesized
gtcacttgctgaatcacggt

SEQ ID NO: 409301 - DNA, 20 bp, Artificial Sequence
  chemically synthesized
tcacttgctgaatcacggta

SEQ ID NO: 409302 - DNA, 20 bp, Artificial Sequence
  chemically synthesized
cttgctgaatcacggtaagg

SEQ ID NO: 409303 - DNA, 20 bp, Artificial Sequence
  chemically synthesized
ttgctgaatcacggtaaggc

SEQ ID NO: 409304 - DNA, 20 bp, Artificial Sequence
  chemically synthesized
cggtaaggcaggctttattc

SEQ ID NO: 409305 - DNA, 20 bp, Artificial Sequence
  chemically synthesized
tattgagatggtcttgaata

SEQ ID NO: 409306 - DNA, 20 bp, Artificial Sequence
  chemically synthesized
tttattcaagaccatctcaa

SEQ ID NO: 409307 - DNA, 20 bp, Artificial Sequence
  chemically synthesized
ttattcaagaccatctcaat

SEQ ID NO: 409308 - DNA, 20 bp, Artificial Sequence
  chemically synthesized
ggtccctatacctattgaga

SEQ ID NO: 409309 - DNA, 20 bp, Artificial Sequence
  chemically synthesized
tcacggtccctatacctatt

SEQ ID NO: 409310 - DNA, 20 bp, Artificial Sequence
  chemically synthesized
caagaccatctcaataggta

SEQ ID NO: 409311 - DNA, 20 bp, Artificial Sequence
  chemically synthesized
aagaccatctcaataggtat

SEQ ID NO: 409312 - DNA, 20 bp, Artificial Sequence
  chemically synthesized
agaccatctcaataggtata

SEQ ID NO: 409313 - DNA, 20 bp, Artificial Sequence
  chemically synthesized
aggtatagggaccgtgaaaa

SEQ ID NO: 409314 - DNA, 20 bp, Artificial Sequence
  chemically synthesized
ggtatagggaccgtgaaaat

SEQ ID NO: 409315 - DNA, 20 bp, Artificial Sequence
  chemically synthesized
actgcaagaccctattttca

SEQ ID NO: 409316 - DNA, 20 bp, Artificial Sequence
  chemically synthesized
gtatagggaccgtgaaaata

SEQ ID NO: 409317 - DNA, 20 bp, Artificial Sequence
  chemically synthesized
accgtgaaaatagggtcttg

SEQ ID NO: 409318 - DNA, 20 bp, Artificial Sequence
  chemically synthesized
gtgaaaatagggtcttgcag

SEQ ID NO: 409319 - DNA, 20 bp, Artificial Sequence
  chemically synthesized
tgaaaatagggtcttgcagt

SEQ ID NO: 409320 - DNA, 20 bp, Artificial Sequence
  chemically synthesized
gaaaatagggtcttgcagta

SEQ ID NO: 409321 - DNA, 20 bp, Artificial Sequence
  chemically synthesized
aaaatagggtcttgcagtag

SEQ ID NO: 409322 - DNA, 20 bp, Artificial Sequence
  chemically synthesized
caatctctctcccctactgc

SEQ ID NO: 409323 - DNA, 20 bp, Artificial Sequence
  chemically synthesized
aatagggtcttgcagtaggg

SEQ ID NO: 409324 - DNA, 20 bp, Artificial Sequence
  chemically synthesized
tagggtcttgcagtagggga

SEQ ID NO: 409325 - DNA, 20 bp, Artificial Sequence
  chemically synthesized
gggtcttgcagtaggggaga

SEQ ID NO: 409326 - DNA, 20 bp, Artificial Sequence
  chemically synthesized
tgcagtaggggagagagatt

SEQ ID NO: 409327 - DNA, 20 bp, Artificial Sequence
  chemically synthesized
gcctgtgctgtattcaaatt

SEQ ID NO: 409328 - DNA, 20 bp, Artificial Sequence
  chemically synthesized
gattgagctcaatttgaata

SEQ ID NO: 409329 - DNA, 20 bp, Artificial Sequence
  chemically synthesized
agctcaatttgaatacagca

SEQ ID NO: 409330 - DNA, 20 bp, Artificial Sequence
  chemically synthesized
gctcaatttgaatacagcac

SEQ ID NO: 409331 - DNA, 20 bp, Artificial Sequence
  chemically synthesized
ttgaatacagcacaggcaaa

SEQ ID NO: 409332 - DNA, 20 bp, Artificial Sequence
  chemically synthesized
tgaatacagcacaggcaaat

SEQ ID NO: 409333 - DNA, 20 bp, Artificial Sequence
  chemically synthesized
caaatgggaattttataacc

SEQ ID NO: 409334 - DNA, 20 bp, Artificial Sequence
  chemically synthesized
aaatgggaattttataacca

SEQ ID NO: 409335 - DNA, 20 bp, Artificial Sequence
  chemically synthesized
ggaattttataaccaaggaa

SEQ ID NO: 409336 - DNA, 20 bp, Artificial Sequence
  chemically synthesized
gaattttataaccaaggaac

SEQ ID NO: 409337 - DNA, 20 bp, Artificial Sequence
  chemically synthesized
aattttataaccaaggaaca

SEQ ID NO: 409338 - DNA, 20 bp, Artificial Sequence
  chemically synthesized
ctgacccctaccctgttcct

SEQ ID NO: 409339 - DNA, 20 bp, Artificial Sequence
  chemically synthesized
tttataaccaaggaacaggg

SEQ ID NO: 409340 - DNA, 20 bp, Artificial Sequence
  chemically synthesized
ttataaccaaggaacagggt

SEQ ID NO: 409341 - DNA, 20 bp, Artificial Sequence
  chemically synthesized
tataaccaaggaacagggta

SEQ ID NO: 409342 - DNA, 20 bp, Artificial Sequence
  chemically synthesized
ataaccaaggaacagggtag

SEQ ID NO: 409343 - DNA, 20 bp, Artificial Sequence
  chemically synthesized
ccaaggaacagggtaggggt

SEQ ID NO: 409344 - DNA, 20 bp, Artificial Sequence
  chemically synthesized
aggaacagggtaggggtcag

SEQ ID NO: 409345 - DNA, 20 bp, Artificial Sequence
  chemically synthesized
acagggtaggggtcagtgga

SEQ ID NO: 409346 - DNA, 20 bp, Artificial Sequence
  chemically synthesized
tcagtggatggaaaattatt

SEQ ID NO: 409347 - DNA, 20 bp, Artificial Sequence
  chemically synthesized
agtggatggaaaattattaa

SEQ ID NO: 409348 - DNA, 20 bp, Artificial Sequence
  chemically synthesized
gtggatggaaaattattaag

SEQ ID NO: 409349 - DNA, 20 bp, Artificial Sequence
  chemically synthesized
gatggaaaattattaagagg

SEQ ID NO: 409350 - DNA, 20 bp, Artificial Sequence
  chemically synthesized
attattaagaggaagcatca

SEQ ID NO: 409351 - DNA, 20 bp, Artificial Sequence
  chemically synthesized
ttattaagaggaagcatcat

SEQ ID NO: 409352 - DNA, 20 bp, Artificial Sequence
  chemically synthesized
taagaggaagcatcatgggt

SEQ ID NO: 409353 - DNA, 20 bp, Artificial Sequence
  chemically synthesized
aagaggaagcatcatgggta

SEQ ID NO: 409354 - DNA, 20 bp, Artificial Sequence
  chemically synthesized
agaggaagcatcatgggtaa

SEQ ID NO: 409355 - DNA, 20 bp, Artificial Sequence
  chemically synthesized
aggaagcatcatgggtaagg

SEQ ID NO: 409356 - DNA, 20 bp, Artificial Sequence
  chemically synthesized
gactggactattttcagcag

SEQ ID NO: 409357 - DNA, 20 bp, Artificial Sequence
  chemically synthesized
atgactggactattttcagc

SEQ ID NO: 409358 - DNA, 20 bp, Artificial Sequence
  chemically synthesized
agggagactcctgctgaaaa

SEQ ID NO: 409359 - DNA, 20 bp, Artificial Sequence
  chemically synthesized
gatgactggactattttcag

SEQ ID NO: 409360 - DNA, 20 bp, Artificial Sequence
  chemically synthesized
ggggatgactggactatttt

SEQ ID NO: 409361 - DNA, 20 bp, Artificial Sequence
  chemically synthesized
gactcctgctgaaaatagtc

SEQ ID NO: 409362 - DNA, 20 bp, Artificial Sequence
  chemically synthesized
accatcctccaggggatgac

SEQ ID NO: 409363 - DNA, 20 bp, Artificial Sequence
  chemically synthesized
aaaatagtccagtcatcccc

SEQ ID NO: 409364 - DNA, 20 bp, Artificial Sequence
  chemically synthesized
aatagtccagtcatcccctg

SEQ ID NO: 409365 - DNA, 20 bp, Artificial Sequence
  chemically synthesized
atagtccagtcatcccctgg

SEQ ID NO: 409366 - DNA, 20 bp, Artificial Sequence
  chemically synthesized
catcatccaccatcctccag

SEQ ID NO: 409367 - DNA, 20 bp, Artificial Sequence
  chemically synthesized
tccagtcatcccctggagga

SEQ ID NO: 409368 - DNA, 20 bp, Artificial Sequence
  chemically synthesized
tcatcatccaccatcctcca

SEQ ID NO: 409369 - DNA, 20 bp, Artificial Sequence
  chemically synthesized
ctcatcatccaccatcctcc

SEQ ID NO: 409370 - DNA, 20 bp, Artificial Sequence
  chemically synthesized
cctcatcatccaccatcctc

SEQ ID NO: 409371 - DNA, 20 bp, Artificial Sequence
  chemically synthesized
agtcatcccctggaggatgg

SEQ ID NO: 409372 - DNA, 20 bp, Artificial Sequence
  chemically synthesized
cctggaggatggtggatgat

SEQ ID NO: 409373 - DNA, 20 bp, Artificial Sequence
  chemically synthesized
ctggaggatggtggatgatg

SEQ ID NO: 409374 - DNA, 20 bp, Artificial Sequence
  chemically synthesized
tggatgatgaggaacatgat

SEQ ID NO: 409375 - DNA, 20 bp, Artificial Sequence
  chemically synthesized
gaggaacatgatcagatatc

SEQ ID NO: 409376 - DNA, 20 bp, Artificial Sequence
  chemically synthesized
aggaacatgatcagatatcc

SEQ ID NO: 409377 - DNA, 20 bp, Artificial Sequence
  chemically synthesized
tccttggtatttgattatcc

SEQ ID NO: 409378 - DNA, 20 bp, Artificial Sequence
  chemically synthesized
atccaggataatcaaatacc

SEQ ID NO: 409379 - DNA, 20 bp, Artificial Sequence
  chemically synthesized
tccaggataatcaaatacca

SEQ ID NO: 409380 - DNA, 20 bp, Artificial Sequence
  chemically synthesized
gataatcaaataccaaggat

SEQ ID NO: 409381 - DNA, 20 bp, Artificial Sequence
  chemically synthesized
agccagaaaacactcatcct

SEQ ID NO: 409382 - DNA, 20 bp, Artificial Sequence
  chemically synthesized
taccaaggatgagtgttttc

SEQ ID NO: 409383 - DNA, 20 bp, Artificial Sequence
  chemically synthesized
gcaggccagatcagtttagc

SEQ ID NO: 409384 - DNA, 20 bp, Artificial Sequence
  chemically synthesized
tttagcaggccagatcagtt

SEQ ID NO: 409385 - DNA, 20 bp, Artificial Sequence
  chemically synthesized
gttttctggctaaactgatc

SEQ ID NO: 409386 - DNA, 20 bp, Artificial Sequence
  chemically synthesized
ttagttttagcaggccagat

SEQ ID NO: 409387 - DNA, 20 bp, Artificial Sequence
  chemically synthesized
aaaatttagttttagcaggc

SEQ ID NO: 409388 - DNA, 20 bp, Artificial Sequence
  chemically synthesized
tcctaaaatttagttttagc

SEQ ID NO: 409389 - DNA, 20 bp, Artificial Sequence
  chemically synthesized
ctcctaaaatttagttttag

SEQ ID NO: 409390 - DNA, 20 bp, Artificial Sequence
  chemically synthesized
attctcctaaaatttagttt

SEQ ID NO: 409391 - DNA, 20 bp, Artificial Sequence
  chemically synthesized
ggcctgctaaaactaaattt

SEQ ID NO: 409392 - DNA, 20 bp, Artificial Sequence
  chemically synthesized
gcctgctaaaactaaatttt

SEQ ID NO: 409393 - DNA, 20 bp, Artificial Sequence
  chemically synthesized
gtgcacattctcctaaaatt

SEQ ID NO: 409394 - DNA, 20 bp, Artificial Sequence
  chemically synthesized
ctgctaaaactaaattttag

SEQ ID NO: 409395 - DNA, 20 bp, Artificial Sequence
  chemically synthesized
aaattttaggagaatgtgca

SEQ ID NO: 409396 - DNA, 20 bp, Artificial Sequence
  chemically synthesized
ttaggagaatgtgcacagac

SEQ ID NO: 409397 - DNA, 20 bp, Artificial Sequence
  chemically synthesized
taggagaatgtgcacagact

SEQ ID NO: 409398 - DNA, 20 bp, Artificial Sequence
  chemically synthesized
atgtgcacagactgggctat

SEQ ID NO: 409399 - DNA, 20 bp, Artificial Sequence
  chemically synthesized
ttcccaaccttctcatagcc

SEQ ID NO: 409400 - DNA, 20 bp, Artificial Sequence
  chemically synthesized
tgcacagactgggctatgag

SEQ ID NO: 409401 - DNA, 20 bp, Artificial Sequence
  chemically synthesized
gcacagactgggctatgaga

SEQ ID NO: 409402 - DNA, 20 bp, Artificial Sequence
  chemically synthesized
caggcttcccaaccttctca

SEQ ID NO: 409403 - DNA, 20 bp, Artificial Sequence
  chemically synthesized
agactgggctatgagaaggt

SEQ ID NO: 409404 - DNA, 20 bp, Artificial Sequence
  chemically synthesized
gactgggctatgagaaggtt

SEQ ID NO: 409405 - DNA, 20 bp, Artificial Sequence
  chemically synthesized
tgggctatgagaaggttggg

SEQ ID NO: 409406 - DNA, 20 bp, Artificial Sequence
  chemically synthesized
tgctcggccaaaatttattc

SEQ ID NO: 409407 - DNA, 20 bp, Artificial Sequence
  chemically synthesized
ttgctcggccaaaatttatt

SEQ ID NO: 409408 - DNA, 20 bp, Artificial Sequence
  chemically synthesized
tgggaagcctgaataaattt

SEQ ID NO: 409409 - DNA, 20 bp, Artificial Sequence
  chemically synthesized
agcctgaataaattttggcc

SEQ ID NO: 409410 - DNA, 20 bp, Artificial Sequence
  chemically synthesized
actgacaaagattatttgct

SEQ ID NO: 409411 - DNA, 20 bp, Artificial Sequence
  chemically synthesized
gccgagcaaataatctttgt

SEQ ID NO: 409412 - DNA, 20 bp, Artificial Sequence
  chemically synthesized
taactatgttagtactgaca

SEQ ID NO: 409413 - DNA, 20 bp, Artificial Sequence
  chemically synthesized
aatctttgtcagtactaaca

SEQ ID NO: 409414 - DNA, 20 bp, Artificial Sequence
  chemically synthesized
tctctgtttattaactatgt

SEQ ID NO: 409415 - DNA, 20 bp, Artificial Sequence
  chemically synthesized
gtactaacatagttaataaa

SEQ ID NO: 409416 - DNA, 20 bp, Artificial Sequence
  chemically synthesized
actaacatagttaataaaca

SEQ ID NO: 409417 - DNA, 20 bp, Artificial Sequence
  chemically synthesized
taacatagttaataaacaga

SEQ ID NO: 409418 - DNA, 20 bp, Artificial Sequence
  chemically synthesized
ttaataaacagagagtaccc

SEQ ID NO: 409419 - DNA, 20 bp, Artificial Sequence
  chemically synthesized
ttttcataaatgaattactg

SEQ ID NO: 409420 - DNA, 20 bp, Artificial Sequence
  chemically synthesized
attttcataaatgaattact

SEQ ID NO: 409421 - DNA, 20 bp, Artificial Sequence
  chemically synthesized
cattttcataaatgaattac

SEQ ID NO: 409422 - DNA, 20 bp, Artificial Sequence
  chemically synthesized
aaatgtgtttcaaaaaattc

SEQ ID NO: 409423 - DNA, 20 bp, Artificial Sequence
  chemically synthesized
ccaccacgcctggtcgagac

SEQ ID NO: 409424 - DNA, 20 bp, Artificial Sequence
  chemically synthesized
caaaaaattccagtctcgac

SEQ ID NO: 409425 - DNA, 20 bp, Artificial Sequence
  chemically synthesized
aaaaaattccagtctcgacc

SEQ ID NO: 409426 - DNA, 20 bp, Artificial Sequence
  chemically synthesized
gtgagccaccacgcctggtc

SEQ ID NO: 409427 - DNA, 20 bp, Artificial Sequence
  chemically synthesized
attccagtctcgaccaggcg

SEQ ID NO: 409428 - DNA, 20 bp, Artificial Sequence
  chemically synthesized
ccagtctcgaccaggcgtgg

SEQ ID NO: 409429 - DNA, 20 bp, Artificial Sequence
  chemically synthesized
caggcgtgagccaccacgcc

SEQ ID NO: 409430 - DNA, 20 bp, Artificial Sequence
  chemically synthesized
agtgcagcgattacaggcgt

SEQ ID NO: 409431 - DNA, 20 bp, Artificial Sequence
  chemically synthesized
tcctaaagtgcagcgattac

SEQ ID NO: 409432 - DNA, 20 bp, Artificial Sequence
  chemically synthesized
ctcctaaagtgcagcgatta

SEQ ID NO: 409433 - DNA, 20 bp, Artificial Sequence
  chemically synthesized
cgcctgtaatcgctgcactt

SEQ ID NO: 409434 - DNA, 20 bp, Artificial Sequence
  chemically synthesized
gcctgtaatcgctgcacttt

SEQ ID NO: 409435 - DNA, 20 bp, Artificial Sequence
  chemically synthesized
tgcctctgcctcctaaagtg

SEQ ID NO: 409436 - DNA, 20 bp, Artificial Sequence
  chemically synthesized
ctgtaatcgctgcactttag

SEQ ID NO: 409437 - DNA, 20 bp, Artificial Sequence
  chemically synthesized
tgtaatcgctgcactttagg

SEQ ID NO: 409438 - DNA, 20 bp, Artificial Sequence
  chemically synthesized
aatcgctgcactttaggagg

SEQ ID NO: 409439 - DNA, 20 bp, Artificial Sequence
  chemically synthesized
ccacctgcctctgcctccta

SEQ ID NO: 409440 - DNA, 20 bp, Artificial Sequence
  chemically synthesized
tcgctgcactttaggaggca

SEQ ID NO: 409441 - DNA, 20 bp, Artificial Sequence
  chemically synthesized
cgctgcactttaggaggcag

SEQ ID NO: 409442 - DNA, 20 bp, Artificial Sequence
  chemically synthesized
tgcactttaggaggcagagg

SEQ ID NO: 409443 - DNA, 20 bp, Artificial Sequence
  chemically synthesized
gcactttaggaggcagaggc

SEQ ID NO: 409444 - DNA, 20 bp, Artificial Sequence
  chemically synthesized
ctttaggaggcagaggcagg

SEQ ID NO: 409445 - DNA, 20 bp, Artificial Sequence
  chemically synthesized
cagaggcaggtggatcacct

SEQ ID NO: 409446 - DNA, 20 bp, Artificial Sequence
  chemically synthesized
agaggcaggtggatcacctg

SEQ ID NO: 409447 - DNA, 20 bp, Artificial Sequence
  chemically synthesized
caggtggatcacctgaggtc

SEQ ID NO: 409448 - DNA, 20 bp, Artificial Sequence
  chemically synthesized
ggtctcgaactctagacctc

SEQ ID NO: 409449 - DNA, 20 bp, Artificial Sequence
  chemically synthesized
ggtggatcacctgaggtcta

SEQ ID NO: 409450 - DNA, 20 bp, Artificial Sequence
  chemically synthesized
tggtctcgaactctagacct

SEQ ID NO: 409451 - DNA, 20 bp, Artificial Sequence
  chemically synthesized
tcacctgaggtctagagttc

SEQ ID NO: 409452 - DNA, 20 bp, Artificial Sequence
  chemically synthesized
gtcaggctggtctcgaactc

SEQ ID NO: 409453 - DNA, 20 bp, Artificial Sequence
  chemically synthesized
tgaggtctagagttcgagac

SEQ ID NO: 409454 - DNA, 20 bp, Artificial Sequence
  chemically synthesized
tttcactatgttggtcaggc

SEQ ID NO: 409455 - DNA, 20 bp, Artificial Sequence
  chemically synthesized
ggggtttcactatgttggtc

SEQ ID NO: 409456 - DNA, 20 bp, Artificial Sequence
  chemically synthesized
cgagaccagcctgaccaaca

SEQ ID NO: 409457 - DNA, 20 bp, Artificial Sequence
  chemically synthesized
aggggtttcactatgttggt

SEQ ID NO: 409458 - DNA, 20 bp, Artificial Sequence
  chemically synthesized
agaaaggggtttcactatgt

SEQ ID NO: 409459 - DNA, 20 bp, Artificial Sequence
  chemically synthesized
tgtatttttagtagagaaag

SEQ ID NO: 409460 - DNA, 20 bp, Artificial Sequence
  chemically synthesized
ttgtatttttagtagagaaa

SEQ ID NO: 409461 - DNA, 20 bp, Artificial Sequence
  chemically synthesized
tttgtatttttagtagagaa

SEQ ID NO: 409462 - DNA, 20 bp, Artificial Sequence
  chemically synthesized
ttttgtatttttagtagaga

SEQ ID NO: 409463 - DNA, 20 bp, Artificial Sequence
  chemically synthesized
ttttttttgtatttttagta

SEQ ID NO: 409464 - DNA, 20 bp, Artificial Sequence
  chemically synthesized
aattttttttgtatttttag

SEQ ID NO: 409465 - DNA, 20 bp, Artificial Sequence
  chemically synthesized
gctaattttttttgtatttt

SEQ ID NO: 409466 - DNA, 20 bp, Artificial Sequence
  chemically synthesized
actaaaaatacaaaaaaaat

SEQ ID NO: 409467 - DNA, 20 bp, Artificial Sequence
  chemically synthesized
aaaatacaaaaaaaattagc

SEQ ID NO: 409468 - DNA, 20 bp, Artificial Sequence
  chemically synthesized
aaatacaaaaaaaattagcc

SEQ ID NO: 409469 - DNA, 20 bp, Artificial Sequence
  chemically synthesized
caaaaaaaattagccgggcg

SEQ ID NO: 409470 - DNA, 20 bp, Artificial Sequence
  chemically synthesized
aaaaaattagccgggcgtgg

SEQ ID NO: 409471 - DNA, 20 bp, Artificial Sequence
  chemically synthesized
caagtgcatgccaccacgcc

SEQ ID NO: 409472 - DNA, 20 bp, Artificial Sequence
  chemically synthesized
gtggcatgcacttgtaatcc

SEQ ID NO: 409473 - DNA, 20 bp, Artificial Sequence
  chemically synthesized
tcccggttagctgggattac

SEQ ID NO: 409474 - DNA, 20 bp, Artificial Sequence
  chemically synthesized
cacttgtaatcccagctaac

SEQ ID NO: 409475 - DNA, 20 bp, Artificial Sequence
  chemically synthesized
cttcagcctcccggttagct

SEQ ID NO: 409476 - DNA, 20 bp, Artificial Sequence
  chemically synthesized
acttgtaatcccagctaacc

SEQ ID NO: 409477 - DNA, 20 bp, Artificial Sequence
  chemically synthesized
gcttcagcctcccggttagc

SEQ ID NO: 409478 - DNA, 20 bp, Artificial Sequence
  chemically synthesized
ttgtaatcccagctaaccgg

SEQ ID NO: 409479 - DNA, 20 bp, Artificial Sequence
  chemically synthesized
tgtaatcccagctaaccggg

SEQ ID NO: 409480 - DNA, 20 bp, Artificial Sequence
  chemically synthesized
tcctgcttcagcctcccggt

SEQ ID NO: 409481 - DNA, 20 bp, Artificial Sequence
  chemically synthesized
attctcctgcttcagcctcc

SEQ ID NO: 409482 - DNA, 20 bp, Artificial Sequence
  chemically synthesized
cccagctaaccgggaggctg

SEQ ID NO: 409483 - DNA, 20 bp, Artificial Sequence
  chemically synthesized
agctaaccgggaggctgaag

SEQ ID NO: 409484 - DNA, 20 bp, Artificial Sequence
  chemically synthesized
gctaaccgggaggctgaagc

SEQ ID NO: 409485 - DNA, 20 bp, Artificial Sequence
  chemically synthesized
taaccgggaggctgaagcag

SEQ ID NO: 409486 - DNA, 20 bp, Artificial Sequence
  chemically synthesized
ttcaagcgattctcctgctt

SEQ ID NO: 409487 - DNA, 20 bp, Artificial Sequence
  chemically synthesized
gcaggagaatcgcttgaacc

SEQ ID NO: 409488 - DNA, 20 bp, Artificial Sequence
  chemically synthesized
caggagaatcgcttgaacct

SEQ ID NO: 409489 - DNA, 20 bp, Artificial Sequence
  chemically synthesized
aacctctgcctcccaggttc

SEQ ID NO: 409490 - DNA, 20 bp, Artificial Sequence
  chemically synthesized
ggagaatcgcttgaacctgg

SEQ ID NO: 409491 - DNA, 20 bp, Artificial Sequence
  chemically synthesized
gagaatcgcttgaacctggg

SEQ ID NO: 409492 - DNA, 20 bp, Artificial Sequence
  chemically synthesized
aatcgcttgaacctgggagg

SEQ ID NO: 409493 - DNA, 20 bp, Artificial Sequence
  chemically synthesized
cactgcaacctctgcctccc

SEQ ID NO: 409494 - DNA, 20 bp, Artificial Sequence
  chemically synthesized
tcgcttgaacctgggaggca

SEQ ID NO: 409495 - DNA, 20 bp, Artificial Sequence
  chemically synthesized
tcactgcaacctctgcctcc

SEQ ID NO: 409496 - DNA, 20 bp, Artificial Sequence
  chemically synthesized
cgcttgaacctgggaggcag

SEQ ID NO: 409497 - DNA, 20 bp, Artificial Sequence
  chemically synthesized
aacctgggaggcagaggttg

SEQ ID NO: 409498 - DNA, 20 bp, Artificial Sequence
  chemically synthesized
tgggaggcagaggttgcagt

SEQ ID NO: 409499 - DNA, 20 bp, Artificial Sequence
  chemically synthesized
ggcagaggttgcagtgagcc

SEQ ID NO: 409500 - DNA, 20 bp, Artificial Sequence
  chemically synthesized
ggaatgcagtggcatgatct

SEQ ID NO: 409501 - DNA, 20 bp, Artificial Sequence
  chemically synthesized
ttgcccaggctggaatgcag

SEQ ID NO: 409502 - DNA, 20 bp, Artificial Sequence
  chemically synthesized
aagatcatgccactgcattc

SEQ ID NO: 409503 - DNA, 20 bp, Artificial Sequence
  chemically synthesized
ttattgcccaggctggaatg

SEQ ID NO: 409504 - DNA, 20 bp, Artificial Sequence
  chemically synthesized
catgccactgcattccagcc

SEQ ID NO: 409505 - DNA, 20 bp, Artificial Sequence
  chemically synthesized
atgccactgcattccagcct

SEQ ID NO: 409506 - DNA, 20 bp, Artificial Sequence
  chemically synthesized
ttcactcttattgcccaggc

SEQ ID NO: 409507 - DNA, 20 bp, Artificial Sequence
  chemically synthesized
tgcattccagcctgggcaat

SEQ ID NO: 409508 - DNA, 20 bp, Artificial Sequence
  chemically synthesized
aagtttcactcttattgccc

SEQ ID NO: 409509 - DNA, 20 bp, Artificial Sequence
  chemically synthesized
gaagtttcactcttattgcc

SEQ ID NO: 409510 - DNA, 20 bp, Artificial Sequence
  chemically synthesized
cattccagcctgggcaataa

SEQ ID NO: 409511 - DNA, 20 bp, Artificial Sequence
  chemically synthesized
ttttttttttttttgaaatg

SEQ ID NO: 409512 - DNA, 20 bp, Artificial Sequence
  chemically synthesized
tacataactttcaaagagat

SEQ ID NO: 409513 - DNA, 20 bp, Artificial Sequence
  chemically synthesized
aaaaaatccaatctctttga

SEQ ID NO: 409514 - DNA, 20 bp, Artificial Sequence
  chemically synthesized
agtgatacataactttcaaa

SEQ ID NO: 409515 - DNA, 20 bp, Artificial Sequence
  chemically synthesized
caagtgatacataactttca

SEQ ID NO: 409516 - DNA, 20 bp, Artificial Sequence
  chemically synthesized
acaaaggaaatgtttttgtc

SEQ ID NO: 409517 - DNA, 20 bp, Artificial Sequence
  chemically synthesized
tttctgaacctacgtcacaa

SEQ ID NO: 409518 - DNA, 20 bp, Artificial Sequence
  chemically synthesized
aaaacatttcctttgtgacg

SEQ ID NO: 409519 - DNA, 20 bp, Artificial Sequence
  chemically synthesized
gtttctgaacctacgtcaca

SEQ ID NO: 409520 - DNA, 20 bp, Artificial Sequence
  chemically synthesized
aaacatttcctttgtgacgt

SEQ ID NO: 409521 - DNA, 20 bp, Artificial Sequence
  chemically synthesized
tttcctttgtgacgtaggtt

SEQ ID NO: 409522 - DNA, 20 bp, Artificial Sequence
  chemically synthesized
tgacgtaggttcagaaacat

SEQ ID NO: 409523 - DNA, 20 bp, Artificial Sequence
  chemically synthesized
gacgtaggttcagaaacatt

SEQ ID NO: 409524 - DNA, 20 bp, Artificial Sequence
  chemically synthesized
cagaaacattgggttaaact

SEQ ID NO: 409525 - DNA, 20 bp, Artificial Sequence
  chemically synthesized
gttaaaaaaattgtttaact

SEQ ID NO: 409526 - DNA, 20 bp, Artificial Sequence
  chemically synthesized
ctcaaccctgaaatgttttg

SEQ ID NO: 409527 - DNA, 20 bp, Artificial Sequence
  chemically synthesized
tttttaactacaaaacattt

SEQ ID NO: 409528 - DNA, 20 bp, Artificial Sequence
  chemically synthesized
ttttaactacaaaacatttc

SEQ ID NO: 409529 - DNA, 20 bp, Artificial Sequence
  chemically synthesized
tttaactacaaaacatttca

SEQ ID NO: 409530 - DNA, 20 bp, Artificial Sequence
  chemically synthesized
ctacaaaacatttcagggtt

SEQ ID NO: 409531 - DNA, 20 bp, Artificial Sequence
  chemically synthesized
ggttgagttgtgactcgcta

SEQ ID NO: 409532 - DNA, 20 bp, Artificial Sequence
  chemically synthesized
tgagttgtgactcgctaaag

SEQ ID NO: 409533 - DNA, 20 bp, Artificial Sequence
  chemically synthesized
atttcatttccttctttagc

SEQ ID NO: 409534 - DNA, 20 bp, Artificial Sequence
  chemically synthesized
gagttgtgactcgctaaaga

SEQ ID NO: 409535 - DNA, 20 bp, Artificial Sequence
  chemically synthesized
gataatttcatttccttctt

SEQ ID NO: 409536 - DNA, 20 bp, Artificial Sequence
  chemically synthesized
gtttttcattcaacatctta

SEQ ID NO: 409537 - DNA, 20 bp, Artificial Sequence
  chemically synthesized
tttttcattcaacatcttac

SEQ ID NO: 409538 - DNA, 20 bp, Artificial Sequence
  chemically synthesized
gtaaagaacattgatcccgt

SEQ ID NO: 409539 - DNA, 20 bp, Artificial Sequence
  chemically synthesized
atttccaaatggaaattgta

SEQ ID NO: 409540 - DNA, 20 bp, Artificial Sequence
  chemically synthesized
tgttctttacaatttccatt

SEQ ID NO: 409541 - DNA, 20 bp, Artificial Sequence
  chemically synthesized
tctagaacagcatttccaaa

SEQ ID NO: 409542 - DNA, 20 bp, Artificial Sequence
  chemically synthesized
tccatttggaaatgctgttc

SEQ ID NO: 409543 - DNA, 20 bp, Artificial Sequence
  chemically synthesized
tataacggatgagtctagaa

SEQ ID NO: 409544 - DNA, 20 bp, Artificial Sequence
  chemically synthesized
atttatataacggatgagtc

SEQ ID NO: 409545 - DNA, 20 bp, Artificial Sequence
  chemically synthesized
gtataatttatataacggat

SEQ ID NO: 409546 - DNA, 20 bp, Artificial Sequence
  chemically synthesized
taaatgtataatttatataa

SEQ ID NO: 409547 - DNA, 20 bp, Artificial Sequence
  chemically synthesized
gttatataaattatacattt

SEQ ID NO: 409548 - DNA, 20 bp, Artificial Sequence
  chemically synthesized
tatataaattatacatttaa

SEQ ID NO: 409549 - DNA, 20 bp, Artificial Sequence
  chemically synthesized
atataaattatacatttaag

SEQ ID NO: 409550 - DNA, 20 bp, Artificial Sequence
  chemically synthesized
ttatacatttaagaggatgt

SEQ ID NO: 409551 - DNA, 20 bp, Artificial Sequence
  chemically synthesized
tgatagcaagttaaagtatt

SEQ ID NO: 409552 - DNA, 20 bp, Artificial Sequence
  chemically synthesized
tctgccttgatagcaagtta

SEQ ID NO: 409553 - DNA, 20 bp, Artificial Sequence
  chemically synthesized
aaatactttaacttgctatc

SEQ ID NO: 409554 - DNA, 20 bp, Artificial Sequence
  chemically synthesized
aatactttaacttgctatca

SEQ ID NO: 409555 - DNA, 20 bp, Artificial Sequence
  chemically synthesized
taaatttctgccttgatagc

SEQ ID NO: 409556 - DNA, 20 bp, Artificial Sequence
  chemically synthesized
actttaacttgctatcaagg

SEQ ID NO: 409557 - DNA, 20 bp, Artificial Sequence
  chemically synthesized
cttttaaatttctgccttga

SEQ ID NO: 409558 - DNA, 20 bp, Artificial Sequence
  chemically synthesized
ctatcaaggcagaaatttaa

SEQ ID NO: 409559 - DNA, 20 bp, Artificial Sequence
  chemically synthesized
aaaagagaataacgtaacaa

SEQ ID NO: 409560 - DNA, 20 bp, Artificial Sequence
  chemically synthesized
ataaaagagaataacgtaac

SEQ ID NO: 409561 - DNA, 20 bp, Artificial Sequence
  chemically synthesized
tttttctcttggatataaaa

SEQ ID NO: 409562 - DNA, 20 bp, Artificial Sequence
  chemically synthesized
tctttttctcttggatataa

SEQ ID NO: 409563 - DNA, 20 bp, Artificial Sequence
  chemically synthesized
cgttattctcttttatatcc

SEQ ID NO: 409564 - DNA, 20 bp, Artificial Sequence
  chemically synthesized
ttattctcttttatatccaa

SEQ ID NO: 409565 - DNA, 20 bp, Artificial Sequence
  chemically synthesized
tcttttatatccaagagaaa

SEQ ID NO: 409566 - DNA, 20 bp, Artificial Sequence
  chemically synthesized
acttaacattctttttctct

SEQ ID NO: 409567 - DNA, 20 bp, Artificial Sequence
  chemically synthesized
tccaagagaaaaagaatgtt

SEQ ID NO: 409568 - DNA, 20 bp, Artificial Sequence
  chemically synthesized
gaaaaagaatgttaagttga

SEQ ID NO: 409569 - DNA, 20 bp, Artificial Sequence
  chemically synthesized
aagttgaaagttattttgct

SEQ ID NO: 409570 - DNA, 20 bp, Artificial Sequence
  chemically synthesized
agttgaaagttattttgctc

SEQ ID NO: 409571 - DNA, 20 bp, Artificial Sequence
  chemically synthesized
gttgaaagttattttgctca

SEQ ID NO: 409572 - DNA, 20 bp, Artificial Sequence
  chemically synthesized
atatctttgtaagtgtccct

SEQ ID NO: 409573 - DNA, 20 bp, Artificial Sequence
  chemically synthesized
tttgctcagggacacttaca

SEQ ID NO: 409574 - DNA, 20 bp, Artificial Sequence
  chemically synthesized
gaatgtgtatatatctttgt

SEQ ID NO: 409575 - DNA, 20 bp, Artificial Sequence
  chemically synthesized
tacaaagatatatacacatt

SEQ ID NO: 409576 - DNA, 20 bp, Artificial Sequence
  chemically synthesized
aaagatatatacacattcag

SEQ ID NO: 409577 - DNA, 20 bp, Artificial Sequence
  chemically synthesized
tttcaaatgtaatgtcatgc

SEQ ID NO: 409578 - DNA, 20 bp, Artificial Sequence
  chemically synthesized
catgacattacatttgaaat

SEQ ID NO: 409579 - DNA, 20 bp, Artificial Sequence
  chemically synthesized
ttgaaattggatatatcttt

SEQ ID NO: 409580 - DNA, 20 bp, Artificial Sequence
  chemically synthesized
atctgtgtataaaaagctaa

SEQ ID NO: 409581 - DNA, 20 bp, Artificial Sequence
  chemically synthesized
tactatgatctgtgtataaa

SEQ ID NO: 409582 - DNA, 20 bp, Artificial Sequence
  chemically synthesized
atcttttagctttttataca

SEQ ID NO: 409583 - DNA, 20 bp, Artificial Sequence
  chemically synthesized
agctttttatacacagatca

SEQ ID NO: 409584 - DNA, 20 bp, Artificial Sequence
  chemically synthesized
tatacacagatcatagtatg

SEQ ID NO: 409585 - DNA, 20 bp, Artificial Sequence
  chemically synthesized
gatcatagtatgcagatttt

SEQ ID NO: 409586 - DNA, 20 bp, Artificial Sequence
  chemically synthesized
catagtatgcagattttaag

SEQ ID NO: 409587 - DNA, 20 bp, Artificial Sequence
  chemically synthesized
agtatgcagattttaagtgg

SEQ ID NO: 409588 - DNA, 20 bp, Artificial Sequence
  chemically synthesized
ctcatcactttgaatgttaa

SEQ ID NO: 409589 - DNA, 20 bp, Artificial Sequence
  chemically synthesized
aatgaatcttttaacattca

SEQ ID NO: 409590 - DNA, 20 bp, Artificial Sequence
  chemically synthesized
cttttaacattcaaagtgat

SEQ ID NO: 409591 - DNA, 20 bp, Artificial Sequence
  chemically synthesized
acattcaaagtgatgagctt

SEQ ID NO: 409592 - DNA, 20 bp, Artificial Sequence
  chemically synthesized
attcaaagtgatgagctttg

SEQ ID NO: 409593 - DNA, 20 bp, Artificial Sequence
  chemically synthesized
caaagtgatgagctttggag

SEQ ID NO: 409594 - DNA, 20 bp, Artificial Sequence
  chemically synthesized
aaagtgatgagctttggaga

SEQ ID NO: 409595 - DNA, 20 bp, Artificial Sequence
  chemically synthesized
gattaaaacagccttctcca

SEQ ID NO: 409596 - DNA, 20 bp, Artificial Sequence
  chemically synthesized
tgcagtataacagattaaaa

SEQ ID NO: 409597 - DNA, 20 bp, Artificial Sequence
  chemically synthesized
gagttacacctgcagtataa

SEQ ID NO: 409598 - DNA, 20 bp, Artificial Sequence
  chemically synthesized
tgttttaatctgttatactg

SEQ ID NO: 409599 - DNA, 20 bp, Artificial Sequence
  chemically synthesized
gttttaatctgttatactgc

SEQ ID NO: 409600 - DNA, 20 bp, Artificial Sequence
  chemically synthesized
tgtaccaggagttacacctg

SEQ ID NO: 409601 - DNA, 20 bp, Artificial Sequence
  chemically synthesized
tatactgcaggtgtaactcc

SEQ ID NO: 409602 - DNA, 20 bp, Artificial Sequence
  chemically synthesized
ctaacctacaagtgtaccag

SEQ ID NO: 409603 - DNA, 20 bp, Artificial Sequence
  chemically synthesized
tactaacctacaagtgtacc

SEQ ID NO: 409604 - DNA, 20 bp, Artificial Sequence
  chemically synthesized
ctactaacctacaagtgtac

SEQ ID NO: 409605 - DNA, 20 bp, Artificial Sequence
  chemically synthesized
tgtaactcctggtacacttg

SEQ ID NO: 409606 - DNA, 20 bp, Artificial Sequence
  chemically synthesized
gtaactcctggtacacttgt

SEQ ID NO: 409607 - DNA, 20 bp, Artificial Sequence
  chemically synthesized
ctcctggtacacttgtaggt

SEQ ID NO: 409608 - DNA, 20 bp, Artificial Sequence
  chemically synthesized
caatatcactactaacctac

SEQ ID NO: 409609 - DNA, 20 bp, Artificial Sequence
  chemically synthesized
ctggtacacttgtaggttag

SEQ ID NO: 409610 - DNA, 20 bp, Artificial Sequence
  chemically synthesized
gtaggttagtagtgatattg

SEQ ID NO: 409611 - DNA, 20 bp, Artificial Sequence
  chemically synthesized
taggttagtagtgatattgt

SEQ ID NO: 409612 - DNA, 20 bp, Artificial Sequence
  chemically synthesized
gatattgtaggcatattcga

SEQ ID NO: 409613 - DNA, 20 bp, Artificial Sequence
  chemically synthesized
attcgatggatcaatatata

SEQ ID NO: 409614 - DNA, 20 bp, Artificial Sequence
  chemically synthesized
tcgatggatcaatatatatg

SEQ ID NO: 409615 - DNA, 20 bp, Artificial Sequence
  chemically synthesized
tatatggagtacttgatatt

SEQ ID NO: 409616 - DNA, 20 bp, Artificial Sequence
  chemically synthesized
gaactgaatatctgaatatc

SEQ ID NO: 409617 - DNA, 20 bp, Artificial Sequence
  chemically synthesized
gtacttgatattcagatatt

SEQ ID NO: 409618 - DNA, 20 bp, Artificial Sequence
  chemically synthesized
acccagattaaggcatcggg

SEQ ID NO: 409619 - DNA, 20 bp, Artificial Sequence
  chemically synthesized
acacccagattaaggcatcg

SEQ ID NO: 409620 - DNA, 20 bp, Artificial Sequence
  chemically synthesized
aacacccagattaaggcatc

SEQ ID NO: 409621 - DNA, 20 bp, Artificial Sequence
  chemically synthesized
caacacccagattaaggcat

SEQ ID NO: 409622 - DNA, 20 bp, Artificial Sequence
  chemically synthesized
ttctccccgatgccttaatc

SEQ ID NO: 409623 - DNA, 20 bp, Artificial Sequence
  chemically synthesized
tctccccgatgccttaatct

SEQ ID NO: 409624 - DNA, 20 bp, Artificial Sequence
  chemically synthesized
caaaaacaacacccagatta

SEQ ID NO: 409625 - DNA, 20 bp, Artificial Sequence
  chemically synthesized
gcaaaaacaacacccagatt

SEQ ID NO: 409626 - DNA, 20 bp, Artificial Sequence
  chemically synthesized
accactgcaaaaacaacacc

SEQ ID NO: 409627 - DNA, 20 bp, Artificial Sequence
  chemically synthesized
taatctgggtgttgtttttg

SEQ ID NO: 409628 - DNA, 20 bp, Artificial Sequence
  chemically synthesized
tctgggtgttgtttttgcag

SEQ ID NO: 409629 - DNA, 20 bp, Artificial Sequence
  chemically synthesized
ggtgttgtttttgcagtggt

SEQ ID NO: 409630 - DNA, 20 bp, Artificial Sequence
  chemically synthesized
gtgttgtttttgcagtggtt

SEQ ID NO: 409631 - DNA, 20 bp, Artificial Sequence
  chemically synthesized
gttgtttttgcagtggttag

SEQ ID NO: 409632 - DNA, 20 bp, Artificial Sequence
  chemically synthesized
ttgtttttgcagtggttagg

SEQ ID NO: 409633 - DNA, 20 bp, Artificial Sequence
  chemically synthesized
tttttgcagtggttaggagg

SEQ ID NO: 409634 - DNA, 20 bp, Artificial Sequence
  chemically synthesized
ttttgcagtggttaggagga

SEQ ID NO: 409635 - DNA, 20 bp, Artificial Sequence
  chemically synthesized
ttgcagtggttaggaggaag

SEQ ID NO: 409636 - DNA, 20 bp, Artificial Sequence
  chemically synthesized
gcagtggttaggaggaagga

SEQ ID NO: 409637 - DNA, 20 bp, Artificial Sequence
  chemically synthesized
cagtggttaggaggaaggag

SEQ ID NO: 409638 - DNA, 20 bp, Artificial Sequence
  chemically synthesized
gtggttaggaggaaggagag

SEQ ID NO: 409639 - DNA, 20 bp, Artificial Sequence
  chemically synthesized
tggttaggaggaaggagagg

SEQ ID NO: 409640 - DNA, 20 bp, Artificial Sequence
  chemically synthesized
gaggaaggagaggaggtgcc

SEQ ID NO: 409641 - DNA, 20 bp, Artificial Sequence
  chemically synthesized
ggagaggaggtgccaagatt

SEQ ID NO: 409642 - DNA, 20 bp, Artificial Sequence
  chemically synthesized
cttctgcagtgtctgaatct

SEQ ID NO: 409643 - DNA, 20 bp, Artificial Sequence
  chemically synthesized
gtgccaagattcagacactg

SEQ ID NO: 409644 - DNA, 20 bp, Artificial Sequence
  chemically synthesized
ccaagattcagacactgcag

SEQ ID NO: 409645 - DNA, 20 bp, Artificial Sequence
  chemically synthesized
aagattcagacactgcagaa

SEQ ID NO: 409646 - DNA, 20 bp, Artificial Sequence
  chemically synthesized
agattcagacactgcagaag

SEQ ID NO: 409647 - DNA, 20 bp, Artificial Sequence
  chemically synthesized
gcttatataatcctcttctg

SEQ ID NO: 409648 - DNA, 20 bp, Artificial Sequence
  chemically synthesized
actgcagaagaggattatat

SEQ ID NO: 409649 - DNA, 20 bp, Artificial Sequence
  chemically synthesized
gcagaagaggattatataag

SEQ ID NO: 409650 - DNA, 20 bp, Artificial Sequence
  chemically synthesized
gcagaaataattccatgatg

SEQ ID NO: 409651 - DNA, 20 bp, Artificial Sequence
  chemically synthesized
acaggtacaaaaccgcatca

SEQ ID NO: 409652 - DNA, 20 bp, Artificial Sequence
  chemically synthesized
acctttgatttgtagtaaac

SEQ ID NO: 409653 - DNA, 20 bp, Artificial Sequence
  chemically synthesized
cacctttgatttgtagtaaa

SEQ ID NO: 409654 - DNA, 20 bp, Artificial Sequence
  chemically synthesized
tacctgtttactacaaatca

SEQ ID NO: 409655 - DNA, 20 bp, Artificial Sequence
  chemically synthesized
tgtcagccacctttgatttg

SEQ ID NO: 409656 - DNA, 20 bp, Artificial Sequence
  chemically synthesized
acctgtttactacaaatcaa

SEQ ID NO: 409657 - DNA, 20 bp, Artificial Sequence
  chemically synthesized
tgtttactacaaatcaaagg

SEQ ID NO: 409658 - DNA, 20 bp, Artificial Sequence
  chemically synthesized
tcctggggacaaagttgtgt

SEQ ID NO: 409659 - DNA, 20 bp, Artificial Sequence
  chemically synthesized
ggctgacacaactttgtccc

SEQ ID NO: 409660 - DNA, 20 bp, Artificial Sequence
  chemically synthesized
gctgacacaactttgtcccc

SEQ ID NO: 409661 - DNA, 20 bp, Artificial Sequence
  chemically synthesized
ttatagaattcctggggaca

SEQ ID NO: 409662 - DNA, 20 bp, Artificial Sequence
  chemically synthesized
taaccattatagaattcctg

SEQ ID NO: 409663 - DNA, 20 bp, Artificial Sequence
  chemically synthesized
ctaaccattatagaattcct

SEQ ID NO: 409664 - DNA, 20 bp, Artificial Sequence
  chemically synthesized
tctaaccattatagaattcc

SEQ ID NO: 409665 - DNA, 20 bp, Artificial Sequence
  chemically synthesized
tgtccccaggaattctataa

SEQ ID NO: 409666 - DNA, 20 bp, Artificial Sequence
  chemically synthesized
cccaggaattctataatggt

SEQ ID NO: 409667 - DNA, 20 bp, Artificial Sequence
  chemically synthesized
cagctatcgtctaaccatta

SEQ ID NO: 409668 - DNA, 20 bp, Artificial Sequence
  chemically synthesized
attctataatggttagacga

SEQ ID NO: 409669 - DNA, 20 bp, Artificial Sequence
  chemically synthesized
ggaacacaggagcgtattta

SEQ ID NO: 409670 - DNA, 20 bp, Artificial Sequence
  chemically synthesized
cacctctggaaggaacacag

SEQ ID NO: 409671 - DNA, 20 bp, Artificial Sequence
  chemically synthesized
cacacctctggaaggaacac

SEQ ID NO: 409672 - DNA, 20 bp, Artificial Sequence
  chemically synthesized
acacacctctggaaggaaca

SEQ ID NO: 409673 - DNA, 20 bp, Artificial Sequence
  chemically synthesized
atacgctcctgtgttccttc

SEQ ID NO: 409674 - DNA, 20 bp, Artificial Sequence
  chemically synthesized
acgctcctgtgttccttcca

SEQ ID NO: 409675 - DNA, 20 bp, Artificial Sequence
  chemically synthesized
cgctcctgtgttccttccag

SEQ ID NO: 409676 - DNA, 20 bp, Artificial Sequence
  chemically synthesized
gtttcccacacacctctgga

SEQ ID NO: 409677 - DNA, 20 bp, Artificial Sequence
  chemically synthesized
ggtttcccacacacctctgg

SEQ ID NO: 409678 - DNA, 20 bp, Artificial Sequence
  chemically synthesized
cagggtttcccacacacctc

SEQ ID NO: 409679 - DNA, 20 bp, Artificial Sequence
  chemically synthesized
gtgttccttccagaggtgtg

SEQ ID NO: 409680 - DNA, 20 bp, Artificial Sequence
  chemically synthesized
tgttccttccagaggtgtgt

SEQ ID NO: 409681 - DNA, 20 bp, Artificial Sequence
  chemically synthesized
agaggtgtgtgggaaaccct

SEQ ID NO: 409682 - DNA, 20 bp, Artificial Sequence
  chemically synthesized
tgtgtgggaaaccctgagaa

SEQ ID NO: 409683 - DNA, 20 bp, Artificial Sequence
  chemically synthesized
gtgtgggaaaccctgagaat

SEQ ID NO: 409684 - DNA, 20 bp, Artificial Sequence
  chemically synthesized
aaatgcacaccccattctca

SEQ ID NO: 409685 - DNA, 20 bp, Artificial Sequence
  chemically synthesized
tgtgggaaaccctgagaatg

SEQ ID NO: 409686 - DNA, 20 bp, Artificial Sequence
  chemically synthesized
caaatgcacaccccattctc

SEQ ID NO: 409687 - DNA, 20 bp, Artificial Sequence
  chemically synthesized
gcaaatgcacaccccattct

SEQ ID NO: 409688 - DNA, 20 bp, Artificial Sequence
  chemically synthesized
atggggtgtgcatttgcccc

SEQ ID NO: 409689 - DNA, 20 bp, Artificial Sequence
  chemically synthesized
gtgtgcatttgcccctagtt

SEQ ID NO: 409690 - DNA, 20 bp, Artificial Sequence
  chemically synthesized
tgtgcatttgcccctagtta

SEQ ID NO: 409691 - DNA, 20 bp, Artificial Sequence
  chemically synthesized
tttcgttgacccttaactag

SEQ ID NO: 409692 - DNA, 20 bp, Artificial Sequence
  chemically synthesized
gtgcatttgcccctagttaa

SEQ ID NO: 409693 - DNA, 20 bp, Artificial Sequence
  chemically synthesized
atttcgttgacccttaacta

SEQ ID NO: 409694 - DNA, 20 bp, Artificial Sequence
  chemically synthesized
gatttcgttgacccttaact

SEQ ID NO: 409695 - DNA, 20 bp, Artificial Sequence
  chemically synthesized
agatttcgttgacccttaac

SEQ ID NO: 409696 - DNA, 20 bp, Artificial Sequence
  chemically synthesized
gttaagggtcaacgaaatct

SEQ ID NO: 409697 - DNA, 20 bp, Artificial Sequence
  chemically synthesized
ttaagggtcaacgaaatcta

SEQ ID NO: 409698 - DNA, 20 bp, Artificial Sequence
  chemically synthesized
agggtcaacgaaatctaagg

SEQ ID NO: 409699 - DNA, 20 bp, Artificial Sequence
  chemically synthesized
cctgtagctgaattctgcct

SEQ ID NO: 409700 - DNA, 20 bp, Artificial Sequence
  chemically synthesized
acgaaatctaaggcagaatt

SEQ ID NO: 409701 - DNA, 20 bp, Artificial Sequence
  chemically synthesized
tctaaggcagaattcagcta

SEQ ID NO: 409702 - DNA, 20 bp, Artificial Sequence
  chemically synthesized
ctaaggcagaattcagctac

SEQ ID NO: 409703 - DNA, 20 bp, Artificial Sequence
  chemically synthesized
gcagaattcagctacaggtt

SEQ ID NO: 409704 - DNA, 20 bp, Artificial Sequence
  chemically synthesized
agactatagctctaaacctg

SEQ ID NO: 409705 - DNA, 20 bp, Artificial Sequence
  chemically synthesized
agaattcagctacaggttta

SEQ ID NO: 409706 - DNA, 20 bp, Artificial Sequence
  chemically synthesized
cagctacaggtttagagcta

SEQ ID NO: 409707 - DNA, 20 bp, Artificial Sequence
  chemically synthesized
ctggaactctaaagagacta

SEQ ID NO: 409708 - DNA, 20 bp, Artificial Sequence
  chemically synthesized
gtttagagctatagtctctt

SEQ ID NO: 409709 - DNA, 20 bp, Artificial Sequence
  chemically synthesized
ttagagctatagtctcttta

SEQ ID NO: 409710 - DNA, 20 bp, Artificial Sequence
  chemically synthesized
gggacacctggaactctaaa

SEQ ID NO: 409711 - DNA, 20 bp, Artificial Sequence
  chemically synthesized
aagggacacctggaactcta

SEQ ID NO: 409712 - DNA, 20 bp, Artificial Sequence
  chemically synthesized
ctatagtctctttagagttc

SEQ ID NO: 409713 - DNA, 20 bp, Artificial Sequence
  chemically synthesized
tatagtctctttagagttcc

SEQ ID NO: 409714 - DNA, 20 bp, Artificial Sequence
  chemically synthesized
ttttaagtaaaagggacacc

SEQ ID NO: 409715 - DNA, 20 bp, Artificial Sequence
  chemically synthesized
aaaaagagttttaagtaaaa

SEQ ID NO: 409716 - DNA, 20 bp, Artificial Sequence
  chemically synthesized
aaaaaagagttttaagtaaa

SEQ ID NO: 409717 - DNA, 20 bp, Artificial Sequence
  chemically synthesized
aaaaaaagagttttaagtaa

SEQ ID NO: 409718 - DNA, 20 bp, Artificial Sequence
  chemically synthesized
tcagggaaaaaaagagtttt

SEQ ID NO: 409719 - DNA, 20 bp, Artificial Sequence
  chemically synthesized
taaaatgtcagggaaaaaaa

SEQ ID NO: 409720 - DNA, 20 bp, Artificial Sequence
  chemically synthesized
tttaaaatgtcagggaaaaa

SEQ ID NO: 409721 - DNA, 20 bp, Artificial Sequence
  chemically synthesized
aacttatatttaaaatgtca

SEQ ID NO: 409722 - DNA, 20 bp, Artificial Sequence
  chemically synthesized
aaacttatatttaaaatgtc

SEQ ID NO: 409723 - DNA, 20 bp, Artificial Sequence
  chemically synthesized
gaaacttatatttaaaatgt

SEQ ID NO: 409724 - DNA, 20 bp, Artificial Sequence
  chemically synthesized
ttccctgacattttaaatat

SEQ ID NO: 409725 - DNA, 20 bp, Artificial Sequence
  chemically synthesized
taagctttgcaaagtgaata

SEQ ID NO: 409726 - DNA, 20 bp, Artificial Sequence
  chemically synthesized
ctaagctttgcaaagtgaat

SEQ ID NO: 409727 - DNA, 20 bp, Artificial Sequence
  chemically synthesized
actaagctttgcaaagtgaa

SEQ ID NO: 409728 - DNA, 20 bp, Artificial Sequence
  chemically synthesized
gtttccctattcactttgca

SEQ ID NO: 409729 - DNA, 20 bp, Artificial Sequence
  chemically synthesized
agtattaactaagctttgca

SEQ ID NO: 409730 - DNA, 20 bp, Artificial Sequence
  chemically synthesized
cctattcactttgcaaagct

SEQ ID NO: 409731 - DNA, 20 bp, Artificial Sequence
  chemically synthesized
gttacatatcagtattaact

SEQ ID NO: 409732 - DNA, 20 bp, Artificial Sequence
  chemically synthesized
gaataatttttgttacatat

SEQ ID NO: 409733 - DNA, 20 bp, Artificial Sequence
  chemically synthesized
aaaaattattcgctacactt

SEQ ID NO: 409734 - DNA, 20 bp, Artificial Sequence
  chemically synthesized
agaagagacatgctcaagtg

SEQ ID NO: 409735 - DNA, 20 bp, Artificial Sequence
  chemically synthesized
tatggagaagagacatgctc

SEQ ID NO: 409736 - DNA, 20 bp, Artificial Sequence
  chemically synthesized
agctggatctttatggagaa

SEQ ID NO: 409737 - DNA, 20 bp, Artificial Sequence
  chemically synthesized
gagcatgtctcttctccata

SEQ ID NO: 409738 - DNA, 20 bp, Artificial Sequence
  chemically synthesized
aaagctggatctttatggag

SEQ ID NO: 409739 - DNA, 20 bp, Artificial Sequence
  chemically synthesized
tctaaagctggatctttatg

SEQ ID NO: 409740 - DNA, 20 bp, Artificial Sequence
  chemically synthesized
tatctaaagctggatcttta

SEQ ID NO: 409741 - DNA, 20 bp, Artificial Sequence
  chemically synthesized
gtctcttctccataaagatc

SEQ ID NO: 409742 - DNA, 20 bp, Artificial Sequence
  chemically synthesized
tctccataaagatccagctt

SEQ ID NO: 409743 - DNA, 20 bp, Artificial Sequence
  chemically synthesized
gaagagttgctatctaaagc

SEQ ID NO: 409744 - DNA, 20 bp, Artificial Sequence
  chemically synthesized
cataaagatccagctttaga

SEQ ID NO: 409745 - DNA, 20 bp, Artificial Sequence
  chemically synthesized
atgagaagagttgctatcta

SEQ ID NO: 409746 - DNA, 20 bp, Artificial Sequence
  chemically synthesized
ttagatagcaactcttctca

SEQ ID NO: 409747 - DNA, 20 bp, Artificial Sequence
  chemically synthesized
tacttacagatctatgagaa

SEQ ID NO: 409748 - DNA, 20 bp, Artificial Sequence
  chemically synthesized
aatacttacagatctatgag

SEQ ID NO: 409749 - DNA, 20 bp, Artificial Sequence
  chemically synthesized
cacaatacttacagatctat

SEQ ID NO: 409750 - DNA, 20 bp, Artificial Sequence
  chemically synthesized
aactcttctcatagatctgt

SEQ ID NO: 409751 - DNA, 20 bp, Artificial Sequence
  chemically synthesized
ttatcttctcacaatactta

SEQ ID NO: 409752 - DNA, 20 bp, Artificial Sequence
  chemically synthesized
catagatctgtaagtattgt

SEQ ID NO: 409753 - DNA, 20 bp, Artificial Sequence
  chemically synthesized
agatctgtaagtattgtgag

SEQ ID NO: 409754 - DNA, 20 bp, Artificial Sequence
  chemically synthesized
tattgtgagaagataattaa

SEQ ID NO: 409755 - DNA, 20 bp, Artificial Sequence
  chemically synthesized
ttgattattgtccatataaa

SEQ ID NO: 409756 - DNA, 20 bp, Artificial Sequence
  chemically synthesized
tttcttaccgtctatttata

SEQ ID NO: 409757 - DNA, 20 bp, Artificial Sequence
  chemically synthesized
ttattgtccatataaataga

SEQ ID NO: 409758 - DNA, 20 bp, Artificial Sequence
  chemically synthesized
tgtccatataaatagacggt

SEQ ID NO: 409759 - DNA, 20 bp, Artificial Sequence
  chemically synthesized
ggtaagaaaatacacatttt

SEQ ID NO: 409760 - DNA, 20 bp, Artificial Sequence
  chemically synthesized
cacattttcagtattgaata

SEQ ID NO: 409761 - DNA, 20 bp, Artificial Sequence
  chemically synthesized
acttctgctgagaagaagga

SEQ ID NO: 409762 - DNA, 20 bp, Artificial Sequence
  chemically synthesized
ataaagactttccttcttct

SEQ ID NO: 409763 - DNA, 20 bp, Artificial Sequence
  chemically synthesized
atcaacttctgctgagaaga

SEQ ID NO: 409764 - DNA, 20 bp, Artificial Sequence
  chemically synthesized
aatcaacttctgctgagaag

SEQ ID NO: 409765 - DNA, 20 bp, Artificial Sequence
  chemically synthesized
aagactttccttcttctcag

SEQ ID NO: 409766 - DNA, 20 bp, Artificial Sequence
  chemically synthesized
tacaatcaacttctgctgag

SEQ ID NO: 409767 - DNA, 20 bp, Artificial Sequence
  chemically synthesized
actttccttcttctcagcag

SEQ ID NO: 409768 - DNA, 20 bp, Artificial Sequence
  chemically synthesized
gaatacaatcaacttctgct

SEQ ID NO: 409769 - DNA, 20 bp, Artificial Sequence
  chemically synthesized
agcagaagttgattgtattc

SEQ ID NO: 409770 - DNA, 20 bp, Artificial Sequence
  chemically synthesized
aagttgattgtattccagaa

SEQ ID NO: 409771 - DNA, 20 bp, Artificial Sequence
  chemically synthesized
agttgattgtattccagaaa

SEQ ID NO: 409772 - DNA, 20 bp, Artificial Sequence
  chemically synthesized
ggaaggattctttccttttc

SEQ ID NO: 409773 - DNA, 20 bp, Artificial Sequence
  chemically synthesized
gattgtattccagaaaagga

SEQ ID NO: 409774 - DNA, 20 bp, Artificial Sequence
  chemically synthesized
aatttgcccttatgaaagga

SEQ ID NO: 409775 - DNA, 20 bp, Artificial Sequence
  chemically synthesized
taatttgcccttatgaaagg

SEQ ID NO: 409776 - DNA, 20 bp, Artificial Sequence
  chemically synthesized
gaaagaatccttcctttcat

SEQ ID NO: 409777 - DNA, 20 bp, Artificial Sequence
  chemically synthesized
aaagaatccttcctttcata

SEQ ID NO: 409778 - DNA, 20 bp, Artificial Sequence
  chemically synthesized
aagaatccttcctttcataa

SEQ ID NO: 409779 - DNA, 20 bp, Artificial Sequence
  chemically synthesized
ttttaatttgcccttatgaa

SEQ ID NO: 409780 - DNA, 20 bp, Artificial Sequence
  chemically synthesized
attttaatttgcccttatga

SEQ ID NO: 409781 - DNA, 20 bp, Artificial Sequence
  chemically synthesized
cataagggcaaattaaaatg

SEQ ID NO: 409782 - DNA, 20 bp, Artificial Sequence
  chemically synthesized
ataagggcaaattaaaatgc

SEQ ID NO: 409783 - DNA, 20 bp, Artificial Sequence
  chemically synthesized
aaatgcaggaactctgaatt

SEQ ID NO: 409784 - DNA, 20 bp, Artificial Sequence
  chemically synthesized
aatgcaggaactctgaattt

SEQ ID NO: 409785 - DNA, 20 bp, Artificial Sequence
  chemically synthesized
aaaacagactcccaaattca

SEQ ID NO: 409786 - DNA, 20 bp, Artificial Sequence
  chemically synthesized
tgcaggaactctgaatttgg

SEQ ID NO: 409787 - DNA, 20 bp, Artificial Sequence
  chemically synthesized
gaaaaacagactcccaaatt

SEQ ID NO: 409788 - DNA, 20 bp, Artificial Sequence
  chemically synthesized
aatttgggagtctgtttttc

SEQ ID NO: 409789 - DNA, 20 bp, Artificial Sequence
  chemically synthesized
tgattattcatcttgaaaaa

SEQ ID NO: 409790 - DNA, 20 bp, Artificial Sequence
  chemically synthesized
tcaagatgaataatcatctt

SEQ ID NO: 409791 - DNA, 20 bp, Artificial Sequence
  chemically synthesized
tgaataatcatctttggcaa

SEQ ID NO: 409792 - DNA, 20 bp, Artificial Sequence
  chemically synthesized
gaataatcatctttggcaat

SEQ ID NO: 409793 - DNA, 20 bp, Artificial Sequence
  chemically synthesized
ccatttgaatcctattgcca

SEQ ID NO: 409794 - DNA, 20 bp, Artificial Sequence
  chemically synthesized
ctttggcaataggattcaaa

SEQ ID NO: 409795 - DNA, 20 bp, Artificial Sequence
  chemically synthesized
ataggattcaaatggcacaa

SEQ ID NO: 409796 - DNA, 20 bp, Artificial Sequence
  chemically synthesized
ggattcaaatggcacaacag

SEQ ID NO: 409797 - DNA, 20 bp, Artificial Sequence
  chemically synthesized
gattcaaatggcacaacaga

SEQ ID NO: 409798 - DNA, 20 bp, Artificial Sequence
  chemically synthesized
tagaggttggatcaagaatt

SEQ ID NO: 409799 - DNA, 20 bp, Artificial Sequence
  chemically synthesized
tcaaaaatagaggttggatc

SEQ ID NO: 409800 - DNA, 20 bp, Artificial Sequence
  chemically synthesized
acatattcaaaaatagaggt

SEQ ID NO: 409801 - DNA, 20 bp, Artificial Sequence
  chemically synthesized
atgtacatattcaaaaatag

SEQ ID NO: 409802 - DNA, 20 bp, Artificial Sequence
  chemically synthesized
aatgtacatattcaaaaata

SEQ ID NO: 409803 - DNA, 20 bp, Artificial Sequence
  chemically synthesized
taaatgtacatattcaaaaa

SEQ ID NO: 409804 - DNA, 20 bp, Artificial Sequence
  chemically synthesized
atttttgaatatgtacattt

SEQ ID NO: 409805 - DNA, 20 bp, Artificial Sequence
  chemically synthesized
taatgagagttaaatgcaca

SEQ ID NO: 409806 - DNA, 20 bp, Artificial Sequence
  chemically synthesized
tatgcaattatgcataatga

SEQ ID NO: 409807 - DNA, 20 bp, Artificial Sequence
  chemically synthesized
gttatgcaattatgcataat

SEQ ID NO: 409808 - DNA, 20 bp, Artificial Sequence
  chemically synthesized
attatgcataattgcataac

SEQ ID NO: 409809 - DNA, 20 bp, Artificial Sequence
  chemically synthesized
aagaaacaaatattgttgtc

SEQ ID NO: 409810 - DNA, 20 bp, Artificial Sequence
  chemically synthesized
caacaatatttgtttcttcc

SEQ ID NO: 409811 - DNA, 20 bp, Artificial Sequence
  chemically synthesized
taaactccttgaattccagg

SEQ ID NO: 409812 - DNA, 20 bp, Artificial Sequence
  chemically synthesized
tttgtttcttcctggaattc

SEQ ID NO: 409813 - DNA, 20 bp, Artificial Sequence
  chemically synthesized
gaataaactccttgaattcc

SEQ ID NO: 409814 - DNA, 20 bp, Artificial Sequence
  chemically synthesized
ttgtttcttcctggaattca

SEQ ID NO: 409815 - DNA, 20 bp, Artificial Sequence
  chemically synthesized
agaataaactccttgaattc

SEQ ID NO: 409816 - DNA, 20 bp, Artificial Sequence
  chemically synthesized
gtttcttcctggaattcaag

SEQ ID NO: 409817 - DNA, 20 bp, Artificial Sequence
  chemically synthesized
ataaataaaaacaaaaattg

SEQ ID NO: 409818 - DNA, 20 bp, Artificial Sequence
  chemically synthesized
ctccatctttcaaaaataaa

SEQ ID NO: 409819 - DNA, 20 bp, Artificial Sequence
  chemically synthesized
atttatctatttatttttga

SEQ ID NO: 409820 - DNA, 20 bp, Artificial Sequence
  chemically synthesized
atctatttatttttgaaaga

SEQ ID NO: 409821 - DNA, 20 bp, Artificial Sequence
  chemically synthesized
ctatttatttttgaaagatg

SEQ ID NO: 409822 - DNA, 20 bp, Artificial Sequence
  chemically synthesized
tccagcctgggcaacagaac

SEQ ID NO: 409823 - DNA, 20 bp, Artificial Sequence
  chemically synthesized
tggagtctcgttctgttgcc

SEQ ID NO: 409824 - DNA, 20 bp, Artificial Sequence
  chemically synthesized
ggagtctcgttctgttgccc

SEQ ID NO: 409825 - DNA, 20 bp, Artificial Sequence
  chemically synthesized
ctgcactccagcctgggcaa

SEQ ID NO: 409826 - DNA, 20 bp, Artificial Sequence
  chemically synthesized
tctcgttctgttgcccaggc

SEQ ID NO: 409827 - DNA, 20 bp, Artificial Sequence
  chemically synthesized
tcgttctgttgcccaggctg

SEQ ID NO: 409828 - DNA, 20 bp, Artificial Sequence
  chemically synthesized
acaccactgcactccagcct

SEQ ID NO: 409829 - DNA, 20 bp, Artificial Sequence
  chemically synthesized
cacaccactgcactccagcc

SEQ ID NO: 409830 - DNA, 20 bp, Artificial Sequence
  chemically synthesized
ctgttgcccaggctggagtg

SEQ ID NO: 409831 - DNA, 20 bp, Artificial Sequence
  chemically synthesized
aagatcacaccactgcactc

SEQ ID NO: 409832 - DNA, 20 bp, Artificial Sequence
  chemically synthesized
ttgcccaggctggagtgcag

SEQ ID NO: 409833 - DNA, 20 bp, Artificial Sequence
  chemically synthesized
ggagtgcagtggtgtgatct

SEQ ID NO: 409834 - DNA, 20 bp, Artificial Sequence
  chemically synthesized
ggtggaggttgcagtgagcc

SEQ ID NO: 409835 - DNA, 20 bp, Artificial Sequence
  chemically synthesized
cgggaggtggaggttgcagt

SEQ ID NO: 409836 - DNA, 20 bp, Artificial Sequence
  chemically synthesized
aactcgggaggtggaggttg

SEQ ID NO: 409837 - DNA, 20 bp, Artificial Sequence
  chemically synthesized
tgcttgaactcgggaggtgg

SEQ ID NO: 409838 - DNA, 20 bp, Artificial Sequence
  chemically synthesized
ttgcttgaactcgggaggtg

SEQ ID NO: 409839 - DNA, 20 bp, Artificial Sequence
  chemically synthesized
cactgcaacctccacctccc

SEQ ID NO: 409840 - DNA, 20 bp, Artificial Sequence
  chemically synthesized
aattgcttgaactcgggagg

SEQ ID NO: 409841 - DNA, 20 bp, Artificial Sequence
  chemically synthesized
gagaattgcttgaactcggg

SEQ ID NO: 409842 - DNA, 20 bp, Artificial Sequence
  chemically synthesized
ggagaattgcttgaactcgg

SEQ ID NO: 409843 - DNA, 20 bp, Artificial Sequence
  chemically synthesized
aacctccacctcccgagttc

SEQ ID NO: 409844 - DNA, 20 bp, Artificial Sequence
  chemically synthesized
caggagaattgcttgaactc

SEQ ID NO: 409845 - DNA, 20 bp, Artificial Sequence
  chemically synthesized
gcaggagaattgcttgaact

SEQ ID NO: 409846 - DNA, 20 bp, Artificial Sequence
  chemically synthesized
ttcaagcaattctcctgcct

SEQ ID NO: 409847 - DNA, 20 bp, Artificial Sequence
  chemically synthesized
tactcgggaggctgaggcag

SEQ ID NO: 409848 - DNA, 20 bp, Artificial Sequence
  chemically synthesized
gctactcgggaggctgaggc

SEQ ID NO: 409849 - DNA, 20 bp, Artificial Sequence
  chemically synthesized
agctactcgggaggctgagg

SEQ ID NO: 409850 - DNA, 20 bp, Artificial Sequence
  chemically synthesized
cccagctactcgggaggctg

SEQ ID NO: 409851 - DNA, 20 bp, Artificial Sequence
  chemically synthesized
tcccagctactcgggaggct

SEQ ID NO: 409852 - DNA, 20 bp, Artificial Sequence
  chemically synthesized
ttctcctgcctcagcctccc

SEQ ID NO: 409853 - DNA, 20 bp, Artificial Sequence
  chemically synthesized
tcctgcctcagcctcccgag

SEQ ID NO: 409854 - DNA, 20 bp, Artificial Sequence
  chemically synthesized
tgtgatcccagctactcggg

SEQ ID NO: 409855 - DNA, 20 bp, Artificial Sequence
  chemically synthesized
ctgtgatcccagctactcgg

SEQ ID NO: 409856 - DNA, 20 bp, Artificial Sequence
  chemically synthesized
gcctcagcctcccgagtagc

SEQ ID NO: 409857 - DNA, 20 bp, Artificial Sequence
  chemically synthesized
gcctgtgatcccagctactc

SEQ ID NO: 409858 - DNA, 20 bp, Artificial Sequence
  chemically synthesized
cctcagcctcccgagtagct

SEQ ID NO: 409859 - DNA, 20 bp, Artificial Sequence
  chemically synthesized
cgcctgtgatcccagctact

SEQ ID NO: 409860 - DNA, 20 bp, Artificial Sequence
  chemically synthesized
ctcccgagtagctgggatca

SEQ ID NO: 409861 - DNA, 20 bp, Artificial Sequence
  chemically synthesized
tcccgagtagctgggatcac

SEQ ID NO: 409862 - DNA, 20 bp, Artificial Sequence
  chemically synthesized
gtggcgcacgcctgtgatcc

SEQ ID NO: 409863 - DNA, 20 bp, Artificial Sequence
  chemically synthesized
caggcgtgcgccactacgcc

SEQ ID NO: 409864 - DNA, 20 bp, Artificial Sequence
  chemically synthesized
caaaaaccagccaggcgtag

SEQ ID NO: 409865 - DNA, 20 bp, Artificial Sequence
  chemically synthesized
atacaaaaaccagccaggcg

SEQ ID NO: 409866 - DNA, 20 bp, Artificial Sequence
  chemically synthesized
cgtgcgccactacgcctggc

SEQ ID NO: 409867 - DNA, 20 bp, Artificial Sequence
  chemically synthesized
taaaaatacaaaaaccagcc

SEQ ID NO: 409868 - DNA, 20 bp, Artificial Sequence
  chemically synthesized
ctaaaaatacaaaaaccagc

SEQ ID NO: 409869 - DNA, 20 bp, Artificial Sequence
  chemically synthesized
tctactaaaaatacaaaaac

SEQ ID NO: 409870 - DNA, 20 bp, Artificial Sequence
  chemically synthesized
ctggctggtttttgtatttt

SEQ ID NO: 409871 - DNA, 20 bp, Artificial Sequence
  chemically synthesized
gctggtttttgtatttttag

SEQ ID NO: 409872 - DNA, 20 bp, Artificial Sequence
  chemically synthesized
tggtttttgtatttttagta

SEQ ID NO: 409873 - DNA, 20 bp, Artificial Sequence
  chemically synthesized
ttttgtatttttagtagaga

SEQ ID NO: 409874 - DNA, 20 bp, Artificial Sequence
  chemically synthesized
tttgtatttttagtagagat

SEQ ID NO: 409875 - DNA, 20 bp, Artificial Sequence
  chemically synthesized
ttgtatttttagtagagatg

SEQ ID NO: 409876 - DNA, 20 bp, Artificial Sequence
  chemically synthesized
gagatggggtttcaccacgt

SEQ ID NO: 409877 - DNA, 20 bp, Artificial Sequence
  chemically synthesized
tggggtttcaccacgttggc

SEQ ID NO: 409878 - DNA, 20 bp, Artificial Sequence
  chemically synthesized
caagaccagcctggccaacg

SEQ ID NO: 409879 - DNA, 20 bp, Artificial Sequence
  chemically synthesized
ggggtttcaccacgttggcc

SEQ ID NO: 409880 - DNA, 20 bp, Artificial Sequence
  chemically synthesized
tttcaccacgttggccaggc

SEQ ID NO: 409881 - DNA, 20 bp, Artificial Sequence
  chemically synthesized
ccaggagttcaagaccagcc

SEQ ID NO: 409882 - DNA, 20 bp, Artificial Sequence
  chemically synthesized
ggaggccaggagttcaagac

SEQ ID NO: 409883 - DNA, 20 bp, Artificial Sequence
  chemically synthesized
ccaggctggtcttgaactcc

SEQ ID NO: 409884 - DNA, 20 bp, Artificial Sequence
  chemically synthesized
tcaccggaggccaggagttc

SEQ ID NO: 409885 - DNA, 20 bp, Artificial Sequence
  chemically synthesized
ggtggatcaccggaggccag

SEQ ID NO: 409886 - DNA, 20 bp, Artificial Sequence
  chemically synthesized
ggtcttgaactcctggcctc

SEQ ID NO: 409887 - DNA, 20 bp, Artificial Sequence
  chemically synthesized
cgggtggatcaccggaggcc

SEQ ID NO: 409888 - DNA, 20 bp, Artificial Sequence
  chemically synthesized
gcgggtggatcaccggaggc

SEQ ID NO: 409889 - DNA, 20 bp, Artificial Sequence
  chemically synthesized
cgaggcgggtggatcaccgg

SEQ ID NO: 409890 - DNA, 20 bp, Artificial Sequence
  chemically synthesized
ccgaggcgggtggatcaccg

SEQ ID NO: 409891 - DNA, 20 bp, Artificial Sequence
  chemically synthesized
ggccgaggcgggtggatcac

SEQ ID NO: 409892 - DNA, 20 bp, Artificial Sequence
  chemically synthesized
ctccggtgatccacccgcct

SEQ ID NO: 409893 - DNA, 20 bp, Artificial Sequence
  chemically synthesized
ctttgggaggccgaggcggg

SEQ ID NO: 409894 - DNA, 20 bp, Artificial Sequence
  chemically synthesized
gcactttgggaggccgaggc

SEQ ID NO: 409895 - DNA, 20 bp, Artificial Sequence
  chemically synthesized
agcactttgggaggccgagg

SEQ ID NO: 409896 - DNA, 20 bp, Artificial Sequence
  chemically synthesized
cccagcactttgggaggccg

SEQ ID NO: 409897 - DNA, 20 bp, Artificial Sequence
  chemically synthesized
tcccagcactttgggaggcc

SEQ ID NO: 409898 - DNA, 20 bp, Artificial Sequence
  chemically synthesized
ccacccgcctcggcctccca

SEQ ID NO: 409899 - DNA, 20 bp, Artificial Sequence
  chemically synthesized
tgttatcccagcactttggg

SEQ ID NO: 409900 - DNA, 20 bp, Artificial Sequence
  chemically synthesized
ctgttatcccagcactttgg

SEQ ID NO: 409901 - DNA, 20 bp, Artificial Sequence
  chemically synthesized
gcctcggcctcccaaagtgc

SEQ ID NO: 409902 - DNA, 20 bp, Artificial Sequence
  chemically synthesized
gcctgttatcccagcacttt

SEQ ID NO: 409903 - DNA, 20 bp, Artificial Sequence
  chemically synthesized
cctcggcctcccaaagtgct

SEQ ID NO: 409904 - DNA, 20 bp, Artificial Sequence
  chemically synthesized
cgcctgttatcccagcactt

SEQ ID NO: 409905 - DNA, 20 bp, Artificial Sequence
  chemically synthesized
ctcccaaagtgctgggataa

SEQ ID NO: 409906 - DNA, 20 bp, Artificial Sequence
  chemically synthesized
tcccaaagtgctgggataac

SEQ ID NO: 409907 - DNA, 20 bp, Artificial Sequence
  chemically synthesized
atggcgcacgcctgttatcc

SEQ ID NO: 409908 - DNA, 20 bp, Artificial Sequence
  chemically synthesized
gataacaggcgtgcgccatt

SEQ ID NO: 409909 - DNA, 20 bp, Artificial Sequence
  chemically synthesized
caggcgtgcgccattgagcc

SEQ ID NO: 409910 - DNA, 20 bp, Artificial Sequence
  chemically synthesized
tgtagaatagccaggctcaa

SEQ ID NO: 409911 - DNA, 20 bp, Artificial Sequence
  chemically synthesized
ctaaaaattgtagaatagcc

SEQ ID NO: 409912 - DNA, 20 bp, Artificial Sequence
  chemically synthesized
tctaaaaattgtagaatagc

SEQ ID NO: 409913 - DNA, 20 bp, Artificial Sequence
  chemically synthesized
cctttctaaaaattgtagaa

SEQ ID NO: 409914 - DNA, 20 bp, Artificial Sequence
  chemically synthesized
cctggctattctacaatttt

SEQ ID NO: 409915 - DNA, 20 bp, Artificial Sequence
  chemically synthesized
tgctacctttctaaaaattg

SEQ ID NO: 409916 - DNA, 20 bp, Artificial Sequence
  chemically synthesized
gctattctacaatttttaga

SEQ ID NO: 409917 - DNA, 20 bp, Artificial Sequence
  chemically synthesized
ctattctacaatttttagaa

SEQ ID NO: 409918 - DNA, 20 bp, Artificial Sequence
  chemically synthesized
ttctacaatttttagaaagg

SEQ ID NO: 409919 - DNA, 20 bp, Artificial Sequence
  chemically synthesized
ttaatgtcatgtggggaaag

SEQ ID NO: 409920 - DNA, 20 bp, Artificial Sequence
  chemically synthesized
aacttaatgtcatgtgggga

SEQ ID NO: 409921 - DNA, 20 bp, Artificial Sequence
  chemically synthesized
aaaaaacttaatgtcatgtg

SEQ ID NO: 409922 - DNA, 20 bp, Artificial Sequence
  chemically synthesized
taaaaaacttaatgtcatgt

SEQ ID NO: 409923 - DNA, 20 bp, Artificial Sequence
  chemically synthesized
ataaaaaacttaatgtcatg

SEQ ID NO: 409924 - DNA, 20 bp, Artificial Sequence
  chemically synthesized
ttctttccccacatgacatt

SEQ ID NO: 409925 - DNA, 20 bp, Artificial Sequence
  chemically synthesized
tttttataatactaaatatg

SEQ ID NO: 409926 - DNA, 20 bp, Artificial Sequence
  chemically synthesized
gtgcattaaagcttcatatt

SEQ ID NO: 409927 - DNA, 20 bp, Artificial Sequence
  chemically synthesized
caagtatgtttggtgcatta

SEQ ID NO: 409928 - DNA, 20 bp, Artificial Sequence
  chemically synthesized
ttgatgattgcaagtatgtt

SEQ ID NO: 409929 - DNA, 20 bp, Artificial Sequence
  chemically synthesized
atatgtttattgatgattgc

SEQ ID NO: 409930 - DNA, 20 bp, Artificial Sequence
  chemically synthesized
tatgacatatctctactaac

SEQ ID NO: 409931 - DNA, 20 bp, Artificial Sequence
  chemically synthesized
ttccaatctgcttgttagta

SEQ ID NO: 409932 - DNA, 20 bp, Artificial Sequence
  chemically synthesized
atttccaatctgcttgttag

SEQ ID NO: 409933 - DNA, 20 bp, Artificial Sequence
  chemically synthesized
gacatatctctactaacaag

SEQ ID NO: 409934 - DNA, 20 bp, Artificial Sequence
  chemically synthesized
ataatttccaatctgcttgt

SEQ ID NO: 409935 - DNA, 20 bp, Artificial Sequence
  chemically synthesized
atctctactaacaagcagat

SEQ ID NO: 409936 - DNA, 20 bp, Artificial Sequence
  chemically synthesized
aacaagcagattggaaatta

SEQ ID NO: 409937 - DNA, 20 bp, Artificial Sequence
  chemically synthesized
tagagtctgtgtggcacaga

SEQ ID NO: 409938 - DNA, 20 bp, Artificial Sequence
  chemically synthesized
aattcaccatctgtgccaca

SEQ ID NO: 409939 - DNA, 20 bp, Artificial Sequence
  chemically synthesized
aaactagagtctgtgtggca

SEQ ID NO: 409940 - DNA, 20 bp, Artificial Sequence
  chemically synthesized
tttcaaaactagagtctgtg

SEQ ID NO: 409941 - DNA, 20 bp, Artificial Sequence
  chemically synthesized
catctgtgccacacagactc

SEQ ID NO: 409942 - DNA, 20 bp, Artificial Sequence
  chemically synthesized
aaataagagtttcaaaacta

SEQ ID NO: 409943 - DNA, 20 bp, Artificial Sequence
  chemically synthesized
tcaaataagagtttcaaaac

SEQ ID NO: 409944 - DNA, 20 bp, Artificial Sequence
  chemically synthesized
taactttctgtttcaaataa

SEQ ID NO: 409945 - DNA, 20 bp, Artificial Sequence
  chemically synthesized
tataactttctgtttcaaat

SEQ ID NO: 409946 - DNA, 20 bp, Artificial Sequence
  chemically synthesized
tttgaaactcttatttgaaa

SEQ ID NO: 409947 - DNA, 20 bp, Artificial Sequence
  chemically synthesized
aaactcttatttgaaacaga

SEQ ID NO: 409948 - DNA, 20 bp, Artificial Sequence
  chemically synthesized
tgaaacagaaagttatatat

SEQ ID NO: 409949 - DNA, 20 bp, Artificial Sequence
  chemically synthesized
agaaagttatatatgagcat

SEQ ID NO: 409950 - DNA, 20 bp, Artificial Sequence
  chemically synthesized
aaagttatatatgagcataa

SEQ ID NO: 409951 - DNA, 20 bp, Artificial Sequence
  chemically synthesized
aagttatatatgagcataag

SEQ ID NO: 409952 - DNA, 20 bp, Artificial Sequence
  chemically synthesized
gcataagaggacactgcaca

SEQ ID NO: 409953 - DNA, 20 bp, Artificial Sequence
  chemically synthesized
ataagaggacactgcacatg

SEQ ID NO: 409954 - DNA, 20 bp, Artificial Sequence
  chemically synthesized
agttagaagaactccatgtg

SEQ ID NO: 409955 - DNA, 20 bp, Artificial Sequence
  chemically synthesized
aaatttacacataaagttag

SEQ ID NO: 409956 - DNA, 20 bp, Artificial Sequence
  chemically synthesized
tagaaatttacacataaagt

SEQ ID NO: 409957 - DNA, 20 bp, Artificial Sequence
  chemically synthesized
taagtagaaatttacacata

SEQ ID NO: 409958 - DNA, 20 bp, Artificial Sequence
  chemically synthesized
atgtgtaaatttctacttaa

SEQ ID NO: 409959 - DNA, 20 bp, Artificial Sequence
  chemically synthesized
acagtatatattctattaag

SEQ ID NO: 409960 - DNA, 20 bp, Artificial Sequence
  chemically synthesized
ataacagtatatattctatt

SEQ ID NO: 409961 - DNA, 20 bp, Artificial Sequence
  chemically synthesized
aatagaatatatactgttat

SEQ ID NO: 409962 - DNA, 20 bp, Artificial Sequence
  chemically synthesized
ataagtgaagcagcttataa

SEQ ID NO: 409963 - DNA, 20 bp, Artificial Sequence
  chemically synthesized
aggtttaacaataagtgaag

SEQ ID NO: 409964 - DNA, 20 bp, Artificial Sequence
  chemically synthesized
tataggtttaacaataagtg

SEQ ID NO: 409965 - DNA, 20 bp, Artificial Sequence
  chemically synthesized
atgtatataggtttaacaat

SEQ ID NO: 409966 - DNA, 20 bp, Artificial Sequence
  chemically synthesized
ttattaatgtatatgtatat

SEQ ID NO: 409967 - DNA, 20 bp, Artificial Sequence
  chemically synthesized
tttattaatgtatatgtata

SEQ ID NO: 409968 - DNA, 20 bp, Artificial Sequence
  chemically synthesized
tatacatatacattaataaa

SEQ ID NO: 409969 - DNA, 20 bp, Artificial Sequence
  chemically synthesized
ttaaaactcaaattatttgt

SEQ ID NO: 409970 - DNA, 20 bp, Artificial Sequence
  chemically synthesized
tttaaaactcaaattatttg

SEQ ID NO: 409971 - DNA, 20 bp, Artificial Sequence
  chemically synthesized
tattgacctacaaataattt

SEQ ID NO: 409972 - DNA, 20 bp, Artificial Sequence
  chemically synthesized
cctgttccaaaaatgaagta

SEQ ID NO: 409973 - DNA, 20 bp, Artificial Sequence
  chemically synthesized
ttattactgtacttcatttt

SEQ ID NO: 409974 - DNA, 20 bp, Artificial Sequence
  chemically synthesized
tgattcctgttccaaaaatg

SEQ ID NO: 409975 - DNA, 20 bp, Artificial Sequence
  chemically synthesized
actgtacttcatttttggaa

SEQ ID NO: 409976 - DNA, 20 bp, Artificial Sequence
  chemically synthesized
ctgtacttcatttttggaac

SEQ ID NO: 409977 - DNA, 20 bp, Artificial Sequence
  chemically synthesized
gaatcaaattataataaaac

SEQ ID NO: 409978 - DNA, 20 bp, Artificial Sequence
  chemically synthesized
tcaaattataataaaactag

SEQ ID NO: 409979 - DNA, 20 bp, Artificial Sequence
  chemically synthesized
ttataataaaactagtagca

SEQ ID NO: 409980 - DNA, 20 bp, Artificial Sequence
  chemically synthesized
cttgtctgtttctgtgctac

SEQ ID NO: 409981 - DNA, 20 bp, Artificial Sequence
  chemically synthesized
taaaactagtagcacagaaa

SEQ ID NO: 409982 - DNA, 20 bp, Artificial Sequence
  chemically synthesized
ctagtagcacagaaacagac

SEQ ID NO: 409983 - DNA, 20 bp, Artificial Sequence
  chemically synthesized
agaaacagacaagattactt

SEQ ID NO: 409984 - DNA, 20 bp, Artificial Sequence
  chemically synthesized
gacaagattactttggttac

SEQ ID NO: 409985 - DNA, 20 bp, Artificial Sequence
  chemically synthesized
ggcagagtctctggtaacca

SEQ ID NO: 409986 - DNA, 20 bp, Artificial Sequence
  chemically synthesized
caagattactttggttacca

SEQ ID NO: 409987 - DNA, 20 bp, Artificial Sequence
  chemically synthesized
tgaaaatttggcagagtctc

SEQ ID NO: 409988 - DNA, 20 bp, Artificial Sequence
  chemically synthesized
ttatcattgaaaatttggca

SEQ ID NO: 409989 - DNA, 20 bp, Artificial Sequence
  chemically synthesized
aattatcattgaaaatttgg

SEQ ID NO: 409990 - DNA, 20 bp, Artificial Sequence
  chemically synthesized
gtaaattatcattgaaaatt

SEQ ID NO: 409991 - DNA, 20 bp, Artificial Sequence
  chemically synthesized
taatttacatatgaaaaaaa

SEQ ID NO: 409992 - DNA, 20 bp, Artificial Sequence
  chemically synthesized
tttacatatgaaaaaaatag

SEQ ID NO: 409993 - DNA, 20 bp, Artificial Sequence
  chemically synthesized
tatgaaaaaaatagaagaaa

SEQ ID NO: 409994 - DNA, 20 bp, Artificial Sequence
  chemically synthesized
gaaaaaaatagaagaaaaag

SEQ ID NO: 409995 - DNA, 20 bp, Artificial Sequence
  chemically synthesized
aaaagtagaaaatgttacca

SEQ ID NO: 409996 - DNA, 20 bp, Artificial Sequence
  chemically synthesized
agtagaaaatgttaccatgg

SEQ ID NO: 409997 - DNA, 20 bp, Artificial Sequence
  chemically synthesized
acatgcatattttactgcca

SEQ ID NO: 409998 - DNA, 20 bp, Artificial Sequence
  chemically synthesized
agtaaaatatgcatgtattt

SEQ ID NO: 409999 - DNA, 20 bp, Artificial Sequence
  chemically synthesized
gtaaaatatgcatgtatttg

SEQ ID NO: 410000 - DNA, 20 bp, Artificial Sequence
  chemically synthesized
tatttgaggatgatattcaa

SEQ ID NO: 410001 - DNA, 20 bp, Artificial Sequence
  chemically synthesized
atttgaggatgatattcaac

SEQ ID NO: 410002 - DNA, 20 bp, Artificial Sequence
  chemically synthesized
tttttatatttgttgcaggt

SEQ ID NO: 410003 - DNA, 20 bp, Artificial Sequence
  chemically synthesized
tccctttttatatttgttgc

SEQ ID NO: 410004 - DNA, 20 bp, Artificial Sequence
  chemically synthesized
ttccctttttatatttgttg

SEQ ID NO: 410005 - DNA, 20 bp, Artificial Sequence
  chemically synthesized
ttacctgcaacaaatataaa

SEQ ID NO: 410006 - DNA, 20 bp, Artificial Sequence
  chemically synthesized
tacctgcaacaaatataaaa

SEQ ID NO: 410007 - DNA, 20 bp, Artificial Sequence
  chemically synthesized
acctgcaacaaatataaaaa

SEQ ID NO: 410008 - DNA, 20 bp, Artificial Sequence
  chemically synthesized
tgcaacaaatataaaaaggg

SEQ ID NO: 410009 - DNA, 20 bp, Artificial Sequence
  chemically synthesized
aacaaatataaaaagggaag

SEQ ID NO: 410010 - DNA, 20 bp, Artificial Sequence
  chemically synthesized
acttaacattttaagggatt

SEQ ID NO: 410011 - DNA, 20 bp, Artificial Sequence
  chemically synthesized
ctcagtacttaacattttaa

SEQ ID NO: 410012 - DNA, 20 bp, Artificial Sequence
  chemically synthesized
cctcagtacttaacatttta

SEQ ID NO: 410013 - DNA, 20 bp, Artificial Sequence
  chemically synthesized
ccctcagtacttaacatttt

SEQ ID NO: 410014 - DNA, 20 bp, Artificial Sequence
  chemically synthesized
actaaatcccttaaaatgtt

SEQ ID NO: 410015 - DNA, 20 bp, Artificial Sequence
  chemically synthesized
cccttaaaatgttaagtact

SEQ ID NO: 410016 - DNA, 20 bp, Artificial Sequence
  chemically synthesized
ccttaaaatgttaagtactg

SEQ ID NO: 410017 - DNA, 20 bp, Artificial Sequence
  chemically synthesized
cttaaaatgttaagtactga

SEQ ID NO: 410018 - DNA, 20 bp, Artificial Sequence
  chemically synthesized
aaaatgttaagtactgaggg

SEQ ID NO: 410019 - DNA, 20 bp, Artificial Sequence
  chemically synthesized
tctatcttactttccaccct

SEQ ID NO: 410020 - DNA, 20 bp, Artificial Sequence
  chemically synthesized
tgttaagtactgagggtgga

SEQ ID NO: 410021 - DNA, 20 bp, Artificial Sequence
  chemically synthesized
aagtactgagggtggaaagt

SEQ ID NO: 410022 - DNA, 20 bp, Artificial Sequence
  chemically synthesized
actgagggtggaaagtaaga

SEQ ID NO: 410023 - DNA, 20 bp, Artificial Sequence
  chemically synthesized
ataataattataatttttcc

SEQ ID NO: 410024 - DNA, 20 bp, Artificial Sequence
  chemically synthesized
attataatttttcctagaat

SEQ ID NO: 410025 - DNA, 20 bp, Artificial Sequence
  chemically synthesized
ttataatttttcctagaatg

SEQ ID NO: 410026 - DNA, 20 bp, Artificial Sequence
  chemically synthesized
tataatttttcctagaatga

SEQ ID NO: 410027 - DNA, 20 bp, Artificial Sequence
  chemically synthesized
tcgagccttaccctcattct

SEQ ID NO: 410028 - DNA, 20 bp, Artificial Sequence
  chemically synthesized
ctcgagccttaccctcattc

SEQ ID NO: 410029 - DNA, 20 bp, Artificial Sequence
  chemically synthesized
atttttcctagaatgagggt

SEQ ID NO: 410030 - DNA, 20 bp, Artificial Sequence
  chemically synthesized
tttttcctagaatgagggta

SEQ ID NO: 410031 - DNA, 20 bp, Artificial Sequence
  chemically synthesized
ctagaatgagggtaaggctc

SEQ ID NO: 410032 - DNA, 20 bp, Artificial Sequence
  chemically synthesized
tgttagtgttttcataactc

SEQ ID NO: 410033 - DNA, 20 bp, Artificial Sequence
  chemically synthesized
tatgaaaacactaacaccgt

SEQ ID NO: 410034 - DNA, 20 bp, Artificial Sequence
  chemically synthesized
aagacttactctgacggtgt

SEQ ID NO: 410035 - DNA, 20 bp, Artificial Sequence
  chemically synthesized
tgaaaacactaacaccgtca

SEQ ID NO: 410036 - DNA, 20 bp, Artificial Sequence
  chemically synthesized
aacactaacaccgtcagagt

SEQ ID NO: 410037 - DNA, 20 bp, Artificial Sequence
  chemically synthesized
tcccttaagacttactctga

SEQ ID NO: 410038 - DNA, 20 bp, Artificial Sequence
  chemically synthesized
acaccgtcagagtaagtctt

SEQ ID NO: 410039 - DNA, 20 bp, Artificial Sequence
  chemically synthesized
caccgtcagagtaagtctta

SEQ ID NO: 410040 - DNA, 20 bp, Artificial Sequence
  chemically synthesized
accgtcagagtaagtcttaa

SEQ ID NO: 410041 - DNA, 20 bp, Artificial Sequence
  chemically synthesized
cgtcagagtaagtcttaagg

SEQ ID NO: 410042 - DNA, 20 bp, Artificial Sequence
  chemically synthesized
tccagaagtggttctccctt

SEQ ID NO: 410043 - DNA, 20 bp, Artificial Sequence
  chemically synthesized
tcttaagggagaaccacttc

SEQ ID NO: 410044 - DNA, 20 bp, Artificial Sequence
  chemically synthesized
aaaccagggaattccagaag

SEQ ID NO: 410045 - DNA, 20 bp, Artificial Sequence
  chemically synthesized
gcaaaaccagggaattccag

SEQ ID NO: 410046 - DNA, 20 bp, Artificial Sequence
  chemically synthesized
ggagcaaaaccagggaattc

SEQ ID NO: 410047 - DNA, 20 bp, Artificial Sequence
  chemically synthesized
gaaccacttctggaattccc

SEQ ID NO: 410048 - DNA, 20 bp, Artificial Sequence
  chemically synthesized
tcagccggggagcaaaacca

SEQ ID NO: 410049 - DNA, 20 bp, Artificial Sequence
  chemically synthesized
atcagccggggagcaaaacc

SEQ ID NO: 410050 - DNA, 20 bp, Artificial Sequence
  chemically synthesized
catcagccggggagcaaaac

SEQ ID NO: 410051 - DNA, 20 bp, Artificial Sequence
  chemically synthesized
aattccctggttttgctccc

SEQ ID NO: 410052 - DNA, 20 bp, Artificial Sequence
  chemically synthesized
tgttctgtacatcagccggg

SEQ ID NO: 410053 - DNA, 20 bp, Artificial Sequence
  chemically synthesized
tatgttctgtacatcagccg

SEQ ID NO: 410054 - DNA, 20 bp, Artificial Sequence
  chemically synthesized
atatgttctgtacatcagcc

SEQ ID NO: 410055 - DNA, 20 bp, Artificial Sequence
  chemically synthesized
catatgttctgtacatcagc

SEQ ID NO: 410056 - DNA, 20 bp, Artificial Sequence
  chemically synthesized
tttgctccccggctgatgta

SEQ ID NO: 410057 - DNA, 20 bp, Artificial Sequence
  chemically synthesized
gagacatatgttctgtacat

SEQ ID NO: 410058 - DNA, 20 bp, Artificial Sequence
  chemically synthesized
atgtacagaacatatgtctc

SEQ ID NO: 410059 - DNA, 20 bp, Artificial Sequence
  chemically synthesized
tacagaacatatgtctctag

SEQ ID NO: 410060 - DNA, 20 bp, Artificial Sequence
  chemically synthesized
tgcctttgattattcttcta

SEQ ID NO: 410061 - DNA, 20 bp, Artificial Sequence
  chemically synthesized
aatgcctttgattattcttc

SEQ ID NO: 410062 - DNA, 20 bp, Artificial Sequence
  chemically synthesized
tgtctctagaagaataatca

SEQ ID NO: 410063 - DNA, 20 bp, Artificial Sequence
  chemically synthesized
gtctctagaagaataatcaa

SEQ ID NO: 410064 - DNA, 20 bp, Artificial Sequence
  chemically synthesized
gaataatcaaaggcattaca

SEQ ID NO: 410065 - DNA, 20 bp, Artificial Sequence
  chemically synthesized
actatcagcaattagtgaga

SEQ ID NO: 410066 - DNA, 20 bp, Artificial Sequence
  chemically synthesized
aactatcagcaattagtgag

SEQ ID NO: 410067 - DNA, 20 bp, Artificial Sequence
  chemically synthesized
taactatcagcaattagtga

SEQ ID NO: 410068 - DNA, 20 bp, Artificial Sequence
  chemically synthesized
tgtaactatcagcaattagt

SEQ ID NO: 410069 - DNA, 20 bp, Artificial Sequence
  chemically synthesized
gtactgtaactatcagcaat

SEQ ID NO: 410070 - DNA, 20 bp, Artificial Sequence
  chemically synthesized
accctctcactaattgctga

SEQ ID NO: 410071 - DNA, 20 bp, Artificial Sequence
  chemically synthesized
tcactaattgctgatagtta

SEQ ID NO: 410072 - DNA, 20 bp, Artificial Sequence
  chemically synthesized
taggactgtactgtaactat

SEQ ID NO: 410073 - DNA, 20 bp, Artificial Sequence
  chemically synthesized
aattgctgatagttacagta

SEQ ID NO: 410074 - DNA, 20 bp, Artificial Sequence
  chemically synthesized
tgatagttacagtacagtcc

SEQ ID NO: 410075 - DNA, 20 bp, Artificial Sequence
  chemically synthesized
aactgcctctatgggtgtct

SEQ ID NO: 410076 - DNA, 20 bp, Artificial Sequence
  chemically synthesized
gaactgcctctatgggtgtc

SEQ ID NO: 410077 - DNA, 20 bp, Artificial Sequence
  chemically synthesized
agtacagtcctagacaccca

SEQ ID NO: 410078 - DNA, 20 bp, Artificial Sequence
  chemically synthesized
tacagtcctagacacccata

SEQ ID NO: 410079 - DNA, 20 bp, Artificial Sequence
  chemically synthesized
acagtcctagacacccatag

SEQ ID NO: 410080 - DNA, 20 bp, Artificial Sequence
  chemically synthesized
gtcctagacacccatagagg

SEQ ID NO: 410081 - DNA, 20 bp, Artificial Sequence
  chemically synthesized
gggcaaagaactgcctctat

SEQ ID NO: 410082 - DNA, 20 bp, Artificial Sequence
  chemically synthesized
ggggcaaagaactgcctcta

SEQ ID NO: 410083 - DNA, 20 bp, Artificial Sequence
  chemically synthesized
tctgatgtgtagtaggggca

SEQ ID NO: 410084 - DNA, 20 bp, Artificial Sequence
  chemically synthesized
gtggttctgatgtgtagtag

SEQ ID NO: 410085 - DNA, 20 bp, Artificial Sequence
  chemically synthesized
ggtggttctgatgtgtagta

SEQ ID NO: 410086 - DNA, 20 bp, Artificial Sequence
  chemically synthesized
aggtggttctgatgtgtagt

SEQ ID NO: 410087 - DNA, 20 bp, Artificial Sequence
  chemically synthesized
taggtggttctgatgtgtag

SEQ ID NO: 410088 - DNA, 20 bp, Artificial Sequence
  chemically synthesized
tctttgcccctactacacat

SEQ ID NO: 410089 - DNA, 20 bp, Artificial Sequence
  chemically synthesized
ctctaggtggttctgatgtg

SEQ ID NO: 410090 - DNA, 20 bp, Artificial Sequence
  chemically synthesized
tactacacatcagaaccacc

SEQ ID NO: 410091 - DNA, 20 bp, Artificial Sequence
  chemically synthesized
ctacacatcagaaccaccta

SEQ ID NO: 410092 - DNA, 20 bp, Artificial Sequence
  chemically synthesized
acacatcagaaccacctaga

SEQ ID NO: 410093 - DNA, 20 bp, Artificial Sequence
  chemically synthesized
atattttatggctctctagg

SEQ ID NO: 410094 - DNA, 20 bp, Artificial Sequence
  chemically synthesized
gtaatattttatggctctct

SEQ ID NO: 410095 - DNA, 20 bp, Artificial Sequence
  chemically synthesized
ggtaatattttatggctctc

SEQ ID NO: 410096 - DNA, 20 bp, Artificial Sequence
  chemically synthesized
tgggcttaggtaatatttta

SEQ ID NO: 410097 - DNA, 20 bp, Artificial Sequence
  chemically synthesized
agagccataaaatattacct

SEQ ID NO: 410098 - DNA, 20 bp, Artificial Sequence
  chemically synthesized
ctggggtggggtatgggctt

SEQ ID NO: 410099 - DNA, 20 bp, Artificial Sequence
  chemically synthesized
tctggggtggggtatgggct

SEQ ID NO: 410100 - DNA, 20 bp, Artificial Sequence
  chemically synthesized
gttggtctggggtggggtat

SEQ ID NO: 410101 - DNA, 20 bp, Artificial Sequence
  chemically synthesized
agttggtctggggtggggta

SEQ ID NO: 410102 - DNA, 20 bp, Artificial Sequence
  chemically synthesized
cctaagcccataccccaccc

SEQ ID NO: 410103 - DNA, 20 bp, Artificial Sequence
  chemically synthesized
gattcagttggtctggggtg

SEQ ID NO: 410104 - DNA, 20 bp, Artificial Sequence
  chemically synthesized
tgattcagttggtctggggt

SEQ ID NO: 410105 - DNA, 20 bp, Artificial Sequence
  chemically synthesized
gtgattcagttggtctgggg

SEQ ID NO: 410106 - DNA, 20 bp, Artificial Sequence
  chemically synthesized
atagtgattcagttggtctg

SEQ ID NO: 410107 - DNA, 20 bp, Artificial Sequence
  chemically synthesized
gatagtgattcagttggtct

SEQ ID NO: 410108 - DNA, 20 bp, Artificial Sequence
  chemically synthesized
agatagtgattcagttggtc

SEQ ID NO: 410109 - DNA, 20 bp, Artificial Sequence
  chemically synthesized
catagagatagtgattcagt

SEQ ID NO: 410110 - DNA, 20 bp, Artificial Sequence
  chemically synthesized
ccggcatagagatagtgatt

SEQ ID NO: 410111 - DNA, 20 bp, Artificial Sequence
  chemically synthesized
cccaagccccggcatagaga

SEQ ID NO: 410112 - DNA, 20 bp, Artificial Sequence
  chemically synthesized
ctgaatcactatctctatgc

SEQ ID NO: 410113 - DNA, 20 bp, Artificial Sequence
  chemically synthesized
tgaatcactatctctatgcc

SEQ ID NO: 410114 - DNA, 20 bp, Artificial Sequence
  chemically synthesized
gaatcactatctctatgccg

SEQ ID NO: 410115 - DNA, 20 bp, Artificial Sequence
  chemically synthesized
tatgcccaagccccggcata

SEQ ID NO: 410116 - DNA, 20 bp, Artificial Sequence
  chemically synthesized
catatgcccaagccccggca

SEQ ID NO: 410117 - DNA, 20 bp, Artificial Sequence
  chemically synthesized
actatctctatgccggggct

SEQ ID NO: 410118 - DNA, 20 bp, Artificial Sequence
  chemically synthesized
ctatctctatgccggggctt

SEQ ID NO: 410119 - DNA, 20 bp, Artificial Sequence
  chemically synthesized
tcaaccatatgcccaagccc

SEQ ID NO: 410120 - DNA, 20 bp, Artificial Sequence
  chemically synthesized
tatgccggggcttgggcata

SEQ ID NO: 410121 - DNA, 20 bp, Artificial Sequence
  chemically synthesized
caattttcaaccatatgccc

SEQ ID NO: 410122 - DNA, 20 bp, Artificial Sequence
  chemically synthesized
gggcatatggttgaaaattg

SEQ ID NO: 410123 - DNA, 20 bp, Artificial Sequence
  chemically synthesized
atggttgaaaattgcagtcc

SEQ ID NO: 410124 - DNA, 20 bp, Artificial Sequence
  chemically synthesized
tgtattgtagcaggtcatct

SEQ ID NO: 410125 - DNA, 20 bp, Artificial Sequence
  chemically synthesized
gtgtattgtagcaggtcatc

SEQ ID NO: 410126 - DNA, 20 bp, Artificial Sequence
  chemically synthesized
gtgtgtgtgtgtattgtagc

SEQ ID NO: 410127 - DNA, 20 bp, Artificial Sequence
  chemically synthesized
tgtgtgtgtgtgtattgtag

SEQ ID NO: 410128 - DNA, 20 bp, Artificial Sequence
  chemically synthesized
gtttgtgtgtgtgtgtattg

SEQ ID NO: 410129 - DNA, 20 bp, Artificial Sequence
  chemically synthesized
ggaaagtatgagagtacatg

SEQ ID NO: 410130 - DNA, 20 bp, Artificial Sequence
  chemically synthesized
gcgtgaagtggaaagtatga

SEQ ID NO: 410131 - DNA, 20 bp, Artificial Sequence
  chemically synthesized
gtgcgtgaagtggaaagtat

SEQ ID NO: 410132 - DNA, 20 bp, Artificial Sequence
  chemically synthesized
gtgctagtgcgtgaagtgga

SEQ ID NO: 410133 - DNA, 20 bp, Artificial Sequence
  chemically synthesized
acaagtgctagtgcgtgaag

SEQ ID NO: 410134 - DNA, 20 bp, Artificial Sequence
  chemically synthesized
atactttccacttcacgcac

SEQ ID NO: 410135 - DNA, 20 bp, Artificial Sequence
  chemically synthesized
ggaacaagtgctagtgcgtg

SEQ ID NO: 410136 - DNA, 20 bp, Artificial Sequence
  chemically synthesized
aaggtacagggaacaagtgc

SEQ ID NO: 410137 - DNA, 20 bp, Artificial Sequence
  chemically synthesized
cttaggaaggtacagggaac

SEQ ID NO: 410138 - DNA, 20 bp, Artificial Sequence
  chemically synthesized
agtggacttaggaaggtaca

SEQ ID NO: 410139 - DNA, 20 bp, Artificial Sequence
  chemically synthesized
aagtggacttaggaaggtac

SEQ ID NO: 410140 - DNA, 20 bp, Artificial Sequence
  chemically synthesized
taagtggacttaggaaggta

SEQ ID NO: 410141 - DNA, 20 bp, Artificial Sequence
  chemically synthesized
cttgttccctgtaccttcct

SEQ ID NO: 410142 - DNA, 20 bp, Artificial Sequence
  chemically synthesized
ttttctaagtggacttagga

SEQ ID NO: 410143 - DNA, 20 bp, Artificial Sequence
  chemically synthesized
attttctaagtggacttagg

SEQ ID NO: 410144 - DNA, 20 bp, Artificial Sequence
  chemically synthesized
ctgattttctaagtggactt

SEQ ID NO: 410145 - DNA, 20 bp, Artificial Sequence
  chemically synthesized
tctgattttctaagtggact

SEQ ID NO: 410146 - DNA, 20 bp, Artificial Sequence
  chemically synthesized
tgtaccttcctaagtccact

SEQ ID NO: 410147 - DNA, 20 bp, Artificial Sequence
  chemically synthesized
gtaaaatctgattttctaag

SEQ ID NO: 410148 - DNA, 20 bp, Artificial Sequence
  chemically synthesized
cctaagtccacttagaaaat

SEQ ID NO: 410149 - DNA, 20 bp, Artificial Sequence
  chemically synthesized
aatgtaaaatctgattttct

SEQ ID NO: 410150 - DNA, 20 bp, Artificial Sequence
  chemically synthesized
tcgtgtgtgcattttaatga

SEQ ID NO: 410151 - DNA, 20 bp, Artificial Sequence
  chemically synthesized
gtgtgtgcattttaatgaaa

SEQ ID NO: 410152 - DNA, 20 bp, Artificial Sequence
  chemically synthesized
tttaatgaaagagtatcact

SEQ ID NO: 410153 - DNA, 20 bp, Artificial Sequence
  chemically synthesized
cctactgtcacattttatct

SEQ ID NO: 410154 - DNA, 20 bp, Artificial Sequence
  chemically synthesized
atcactaagataaaatgtga

SEQ ID NO: 410155 - DNA, 20 bp, Artificial Sequence
  chemically synthesized
actaagataaaatgtgacag

SEQ ID NO: 410156 - DNA, 20 bp, Artificial Sequence
  chemically synthesized
ctaagataaaatgtgacagt

SEQ ID NO: 410157 - DNA, 20 bp, Artificial Sequence
  chemically synthesized
tgctctgtgaagaaagaaat

SEQ ID NO: 410158 - DNA, 20 bp, Artificial Sequence
  chemically synthesized
gcaaccaatttctttcttca

SEQ ID NO: 410159 - DNA, 20 bp, Artificial Sequence
  chemically synthesized
ttttcaatgctctgtgaaga

SEQ ID NO: 410160 - DNA, 20 bp, Artificial Sequence
  chemically synthesized
aaccaatttctttcttcaca

SEQ ID NO: 410161 - DNA, 20 bp, Artificial Sequence
  chemically synthesized
tctattttcaatgctctgtg

SEQ ID NO: 410162 - DNA, 20 bp, Artificial Sequence
  chemically synthesized
tcttcacagagcattgaaaa

SEQ ID NO: 410163 - DNA, 20 bp, Artificial Sequence
  chemically synthesized
atagacataattgattgcct

SEQ ID NO: 410164 - DNA, 20 bp, Artificial Sequence
  chemically synthesized
tatatatgggcatgaatcta

SEQ ID NO: 410165 - DNA, 20 bp, Artificial Sequence
  chemically synthesized
gtatatatgggcatgaatct

SEQ ID NO: 410166 - DNA, 20 bp, Artificial Sequence
  chemically synthesized
gtgcatatatatgtatatat

SEQ ID NO: 410167 - DNA, 20 bp, Artificial Sequence
  chemically synthesized
tgtgcatatatatgtatata

SEQ ID NO: 410168 - DNA, 20 bp, Artificial Sequence
  chemically synthesized
gccctatcaaaatgagtttg

SEQ ID NO: 410169 - DNA, 20 bp, Artificial Sequence
  chemically synthesized
atacttcaaactcattttga

SEQ ID NO: 410170 - DNA, 20 bp, Artificial Sequence
  chemically synthesized
ctactgtgccctatcaaaat

SEQ ID NO: 410171 - DNA, 20 bp, Artificial Sequence
  chemically synthesized
tacttcaaactcattttgat

SEQ ID NO: 410172 - DNA, 20 bp, Artificial Sequence
  chemically synthesized
acttcaaactcattttgata

SEQ ID NO: 410173 - DNA, 20 bp, Artificial Sequence
  chemically synthesized
aaactcattttgatagggca

SEQ ID NO: 410174 - DNA, 20 bp, Artificial Sequence
  chemically synthesized
ctcattttgatagggcacag

SEQ ID NO: 410175 - DNA, 20 bp, Artificial Sequence
  chemically synthesized
agggcacagtagtgatttcc

SEQ ID NO: 410176 - DNA, 20 bp, Artificial Sequence
  chemically synthesized
gaacggattgttattacacc

SEQ ID NO: 410177 - DNA, 20 bp, Artificial Sequence
  chemically synthesized
tgaacggattgttattacac

SEQ ID NO: 410178 - DNA, 20 bp, Artificial Sequence
  chemically synthesized
aatgttacatgaaaaatgaa

SEQ ID NO: 410179 - DNA, 20 bp, Artificial Sequence
  chemically synthesized
aaaagtataataaaatcata

SEQ ID NO: 410180 - DNA, 20 bp, Artificial Sequence
  chemically synthesized
tatttcattctatgtataaa

SEQ ID NO: 410181 - DNA, 20 bp, Artificial Sequence
  chemically synthesized
tttattatactttttataca

SEQ ID NO: 410182 - DNA, 20 bp, Artificial Sequence
  chemically synthesized
gaaatatttgttaataaatg

SEQ ID NO: 410183 - DNA, 20 bp, Artificial Sequence
  chemically synthesized
ttgttaataaatgaagaact

SEQ ID NO: 410184 - DNA, 20 bp, Artificial Sequence
  chemically synthesized
tgttaataaatgaagaacta

SEQ ID NO: 410185 - DNA, 20 bp, Artificial Sequence
  chemically synthesized
gttaataaatgaagaactaa

SEQ ID NO: 410186 - DNA, 20 bp, Artificial Sequence
  chemically synthesized
tgctatagagtgagtgccct

SEQ ID NO: 410187 - DNA, 20 bp, Artificial Sequence
  chemically synthesized
aactaagggcactcactcta

SEQ ID NO: 410188 - DNA, 20 bp, Artificial Sequence
  chemically synthesized
tggcatttttgctatagagt

SEQ ID NO: 410189 - DNA, 20 bp, Artificial Sequence
  chemically synthesized
gaggtggcatttttgctata

SEQ ID NO: 410190 - DNA, 20 bp, Artificial Sequence
  chemically synthesized
tagaggtggcatttttgcta

SEQ ID NO: 410191 - DNA, 20 bp, Artificial Sequence
  chemically synthesized
agcaaaaatgccacctctac

SEQ ID NO: 410192 - DNA, 20 bp, Artificial Sequence
  chemically synthesized
ctttttcttactagtagagg

SEQ ID NO: 410193 - DNA, 20 bp, Artificial Sequence
  chemically synthesized
tttctttttcttactagtag

SEQ ID NO: 410194 - DNA, 20 bp, Artificial Sequence
  chemically synthesized
aaaatgccacctctactagt

SEQ ID NO: 410195 - DNA, 20 bp, Artificial Sequence
  chemically synthesized
atttctttttcttactagta

SEQ ID NO: 410196 - DNA, 20 bp, Artificial Sequence
  chemically synthesized
ttatttctttttcttactag

SEQ ID NO: 410197 - DNA, 20 bp, Artificial Sequence
  chemically synthesized
tgtttatttctttttcttac

SEQ ID NO: 410198 - DNA, 20 bp, Artificial Sequence
  chemically synthesized
ccacctctactagtaagaaa

SEQ ID NO: 410199 - DNA, 20 bp, Artificial Sequence
  chemically synthesized
ataaacattttctattattg

SEQ ID NO: 410200 - DNA, 20 bp, Artificial Sequence
  chemically synthesized
ttagaaagttgccgcaataa

SEQ ID NO: 410201 - DNA, 20 bp, Artificial Sequence
  chemically synthesized
ttattgcggcaactttctaa

SEQ ID NO: 410202 - DNA, 20 bp, Artificial Sequence
  chemically synthesized
tattgcggcaactttctaaa

SEQ ID NO: 410203 - DNA, 20 bp, Artificial Sequence
  chemically synthesized
tgtttttttttccttttaga

SEQ ID NO: 410204 - DNA, 20 bp, Artificial Sequence
  chemically synthesized
cctgtgtttttttttccttt

SEQ ID NO: 410205 - DNA, 20 bp, Artificial Sequence
  chemically synthesized
tctaaaaggaaaaaaaaaca

SEQ ID NO: 410206 - DNA, 20 bp, Artificial Sequence
  chemically synthesized
ctaaaaggaaaaaaaaacac

SEQ ID NO: 410207 - DNA, 20 bp, Artificial Sequence
  chemically synthesized
aaaggaaaaaaaaacacagg

SEQ ID NO: 410208 - DNA, 20 bp, Artificial Sequence
  chemically synthesized
taaaggatttcattatgtga

SEQ ID NO: 410209 - DNA, 20 bp, Artificial Sequence
  chemically synthesized
gagaaagaagtaacaattaa

SEQ ID NO: 410210 - DNA, 20 bp, Artificial Sequence
  chemically synthesized
agagaaagaagtaacaatta

SEQ ID NO: 410211 - DNA, 20 bp, Artificial Sequence
  chemically synthesized
agagagtgagatagagaaag

SEQ ID NO: 410212 - DNA, 20 bp, Artificial Sequence
  chemically synthesized
aaaagagagtgagatagaga

SEQ ID NO: 410213 - DNA, 20 bp, Artificial Sequence
  chemically synthesized
aaacaaaagagagtgagata

SEQ ID NO: 410214 - DNA, 20 bp, Artificial Sequence
  chemically synthesized
tgaaacaaaagagagtgaga

SEQ ID NO: 410215 - DNA, 20 bp, Artificial Sequence
  chemically synthesized
tggatgaaacaaaagagagt

SEQ ID NO: 410216 - DNA, 20 bp, Artificial Sequence
  chemically synthesized
ttcttggatgaaacaaaaga

SEQ ID NO: 410217 - DNA, 20 bp, Artificial Sequence
  chemically synthesized
ttttcttggatgaaacaaaa

SEQ ID NO: 410218 - DNA, 20 bp, Artificial Sequence
  chemically synthesized
agttttcttggatgaaacaa

SEQ ID NO: 410219 - DNA, 20 bp, Artificial Sequence
  chemically synthesized
cactctcttttgtttcatcc

SEQ ID NO: 410220 - DNA, 20 bp, Artificial Sequence
  chemically synthesized
taatagttaaatagttttct

SEQ ID NO: 410221 - DNA, 20 bp, Artificial Sequence
  chemically synthesized
atcactatataatagttaaa

SEQ ID NO: 410222 - DNA, 20 bp, Artificial Sequence
  chemically synthesized
aaaactatttaactattata

SEQ ID NO: 410223 - DNA, 20 bp, Artificial Sequence
  chemically synthesized
aattacatatcactatataa

SEQ ID NO: 410224 - DNA, 20 bp, Artificial Sequence
  chemically synthesized
attatatagtgatatgtaat

SEQ ID NO: 410225 - DNA, 20 bp, Artificial Sequence
  chemically synthesized
tatatagtgatatgtaatta

SEQ ID NO: 410226 - DNA, 20 bp, Artificial Sequence
  chemically synthesized
agcttaacaattttaattga

SEQ ID NO: 410227 - DNA, 20 bp, Artificial Sequence
  chemically synthesized
gtctttcaattaaaattgtt

SEQ ID NO: 410228 - DNA, 20 bp, Artificial Sequence
  chemically synthesized
caattaaaattgttaagcta

SEQ ID NO: 410229 - DNA, 20 bp, Artificial Sequence
  chemically synthesized
tcggtggtgtcaacaatctg

SEQ ID NO: 410230 - DNA, 20 bp, Artificial Sequence
  chemically synthesized
ttttaatcaagtatattcgg

SEQ ID NO: 410231 - DNA, 20 bp, Artificial Sequence
  chemically synthesized
ttattttaatcaagtatatt

SEQ ID NO: 410232 - DNA, 20 bp, Artificial Sequence
  chemically synthesized
catctatacttattttaatc

SEQ ID NO: 410233 - DNA, 20 bp, Artificial Sequence
  chemically synthesized
cgaatatacttgattaaaat

SEQ ID NO: 410234 - DNA, 20 bp, Artificial Sequence
  chemically synthesized
atacttgattaaaataagta

SEQ ID NO: 410235 - DNA, 20 bp, Artificial Sequence
  chemically synthesized
tagatgtaaacaaatgtaaa

SEQ ID NO: 410236 - DNA, 20 bp, Artificial Sequence
  chemically synthesized
ctaaataatgaatatcattt

SEQ ID NO: 410237 - DNA, 20 bp, Artificial Sequence
  chemically synthesized
cttaaatgatattcattatt

SEQ ID NO: 410238 - DNA, 20 bp, Artificial Sequence
  chemically synthesized
atttatttaaaatgcattga

SEQ ID NO: 410239 - DNA, 20 bp, Artificial Sequence
  chemically synthesized
atttaaaatgcattgatggc

SEQ ID NO: 410240 - DNA, 20 bp, Artificial Sequence
  chemically synthesized
aatgcattgatggccagacg

SEQ ID NO: 410241 - DNA, 20 bp, Artificial Sequence
  chemically synthesized
gcattgatggccagacgcgg

SEQ ID NO: 410242 - DNA, 20 bp, Artificial Sequence
  chemically synthesized
caggcatgagccaccgcgtc

SEQ ID NO: 410243 - DNA, 20 bp, Artificial Sequence
  chemically synthesized
agtgttgggattacaggcat

SEQ ID NO: 410244 - DNA, 20 bp, Artificial Sequence
  chemically synthesized
tcccaaagtgttgggattac

SEQ ID NO: 410245 - DNA, 20 bp, Artificial Sequence
  chemically synthesized
ctcccaaagtgttgggatta

SEQ ID NO: 410246 - DNA, 20 bp, Artificial Sequence
  chemically synthesized
tgcctgtaatcccaacactt

SEQ ID NO: 410247 - DNA, 20 bp, Artificial Sequence
  chemically synthesized
cctcagcctcccaaagtgtt

SEQ ID NO: 410248 - DNA, 20 bp, Artificial Sequence
  chemically synthesized
gcctgtaatcccaacacttt

SEQ ID NO: 410249 - DNA, 20 bp, Artificial Sequence
  chemically synthesized
acctcagcctcccaaagtgt

SEQ ID NO: 410250 - DNA, 20 bp, Artificial Sequence
  chemically synthesized
ctgtaatcccaacactttgg

SEQ ID NO: 410251 - DNA, 20 bp, Artificial Sequence
  chemically synthesized
tgtaatcccaacactttggg

SEQ ID NO: 410252 - DNA, 20 bp, Artificial Sequence
  chemically synthesized
ccacccacctcagcctccca

SEQ ID NO: 410253 - DNA, 20 bp, Artificial Sequence
  chemically synthesized
tcccaacactttgggaggct

SEQ ID NO: 410254 - DNA, 20 bp, Artificial Sequence
  chemically synthesized
cccaacactttgggaggctg

SEQ ID NO: 410255 - DNA, 20 bp, Artificial Sequence
  chemically synthesized
aacactttgggaggctgagg

SEQ ID NO: 410256 - DNA, 20 bp, Artificial Sequence
  chemically synthesized
acactttgggaggctgaggt

SEQ ID NO: 410257 - DNA, 20 bp, Artificial Sequence
  chemically synthesized
ctttgggaggctgaggtggg

SEQ ID NO: 410258 - DNA, 20 bp, Artificial Sequence
  chemically synthesized
ttcaggtgatccacccacct

SEQ ID NO: 410259 - DNA, 20 bp, Artificial Sequence
  chemically synthesized
tgaggtgggtggatcacctg

SEQ ID NO: 410260 - DNA, 20 bp, Artificial Sequence
  chemically synthesized
gtgggtggatcacctgaagt

SEQ ID NO: 410261 - DNA, 20 bp, Artificial Sequence
  chemically synthesized
tgggtggatcacctgaagtc

SEQ ID NO: 410262 - DNA, 20 bp, Artificial Sequence
  chemically synthesized
ggtcttgaactcctgacttc

SEQ ID NO: 410263 - DNA, 20 bp, Artificial Sequence
  chemically synthesized
ggtggatcacctgaagtcag

SEQ ID NO: 410264 - DNA, 20 bp, Artificial Sequence
  chemically synthesized
tggtcttgaactcctgactt

SEQ ID NO: 410265 - DNA, 20 bp, Artificial Sequence
  chemically synthesized
tcacctgaagtcaggagttc

SEQ ID NO: 410266 - DNA, 20 bp, Artificial Sequence
  chemically synthesized
tgaagtcaggagttcaagac

SEQ ID NO: 410267 - DNA, 20 bp, Artificial Sequence
  chemically synthesized
tcaggagttcaagaccagtc

SEQ ID NO: 410268 - DNA, 20 bp, Artificial Sequence
  chemically synthesized
ttttgccatgttggccagac

SEQ ID NO: 410269 - DNA, 20 bp, Artificial Sequence
  chemically synthesized
caagaccagtctggccaaca

SEQ ID NO: 410270 - DNA, 20 bp, Artificial Sequence
  chemically synthesized
tggggttttgccatgttggc

SEQ ID NO: 410271 - DNA, 20 bp, Artificial Sequence
  chemically synthesized
gagatggggttttgccatgt

SEQ ID NO: 410272 - DNA, 20 bp, Artificial Sequence
  chemically synthesized
ttgtgtttttagtagagatg

SEQ ID NO: 410273 - DNA, 20 bp, Artificial Sequence
  chemically synthesized
tttgtgtttttagtagagat

SEQ ID NO: 410274 - DNA, 20 bp, Artificial Sequence
  chemically synthesized
ttttgtgtttttagtagaga

SEQ ID NO: 410275 - DNA, 20 bp, Artificial Sequence
  chemically synthesized
taatttttgtgtttttagta

SEQ ID NO: 410276 - DNA, 20 bp, Artificial Sequence
  chemically synthesized
gctaatttttgtgtttttag

SEQ ID NO: 410277 - DNA, 20 bp, Artificial Sequence
  chemically synthesized
ccggctaatttttgtgtttt

SEQ ID NO: 410278 - DNA, 20 bp, Artificial Sequence
  chemically synthesized
tctactaaaaacacaaaaat

SEQ ID NO: 410279 - DNA, 20 bp, Artificial Sequence
  chemically synthesized
ctaaaaacacaaaaattagc

SEQ ID NO: 410280 - DNA, 20 bp, Artificial Sequence
  chemically synthesized
taaaaacacaaaaattagcc

SEQ ID NO: 410281 - DNA, 20 bp, Artificial Sequence
  chemically synthesized
acacaaaaattagccgggca

SEQ ID NO: 410282 - DNA, 20 bp, Artificial Sequence
  chemically synthesized
caaaaattagccgggcatgg

SEQ ID NO: 410283 - DNA, 20 bp, Artificial Sequence
  chemically synthesized
caggcacttgccaccatgcc

SEQ ID NO: 410284 - DNA, 20 bp, Artificial Sequence
  chemically synthesized
aattagccgggcatggtggc

SEQ ID NO: 410285 - DNA, 20 bp, Artificial Sequence
  chemically synthesized
ggcatggtggcaagtgcctg

SEQ ID NO: 410286 - DNA, 20 bp, Artificial Sequence
  chemically synthesized
gtggcaagtgcctgtagtcc

SEQ ID NO: 410287 - DNA, 20 bp, Artificial Sequence
  chemically synthesized
tcccaagtagctgggactac

SEQ ID NO: 410288 - DNA, 20 bp, Artificial Sequence
  chemically synthesized
ctcccaagtagctgggacta

SEQ ID NO: 410289 - DNA, 20 bp, Artificial Sequence
  chemically synthesized
tgcctgtagtcccagctact

SEQ ID NO: 410290 - DNA, 20 bp, Artificial Sequence
  chemically synthesized
cctcagtctcccaagtagct

SEQ ID NO: 410291 - DNA, 20 bp, Artificial Sequence
  chemically synthesized
gcctgtagtcccagctactt

SEQ ID NO: 410292 - DNA, 20 bp, Artificial Sequence
  chemically synthesized
acctcagtctcccaagtagc

SEQ ID NO: 410293 - DNA, 20 bp, Artificial Sequence
  chemically synthesized
ctgtagtcccagctacttgg

SEQ ID NO: 410294 - DNA, 20 bp, Artificial Sequence
  chemically synthesized
tcccacctcagtctcccaag

SEQ ID NO: 410295 - DNA, 20 bp, Artificial Sequence
  chemically synthesized
ttctcccacctcagtctccc

SEQ ID NO: 410296 - DNA, 20 bp, Artificial Sequence
  chemically synthesized
tcccagctacttgggagact

SEQ ID NO: 410297 - DNA, 20 bp, Artificial Sequence
  chemically synthesized
cccagctacttgggagactg

SEQ ID NO: 410298 - DNA, 20 bp, Artificial Sequence
  chemically synthesized
agctacttgggagactgagg

SEQ ID NO: 410299 - DNA, 20 bp, Artificial Sequence
  chemically synthesized
gctacttgggagactgaggt

SEQ ID NO: 410300 - DNA, 20 bp, Artificial Sequence
  chemically synthesized
tacttgggagactgaggtgg

SEQ ID NO: 410301 - DNA, 20 bp, Artificial Sequence
  chemically synthesized
ttcaagcaattctcccacct

SEQ ID NO: 410302 - DNA, 20 bp, Artificial Sequence
  chemically synthesized
tgggagaattgcttgaactt

SEQ ID NO: 410303 - DNA, 20 bp, Artificial Sequence
  chemically synthesized
aacctccgcctctgaagttc

SEQ ID NO: 410304 - DNA, 20 bp, Artificial Sequence
  chemically synthesized
ggagaattgcttgaacttca

SEQ ID NO: 410305 - DNA, 20 bp, Artificial Sequence
  chemically synthesized
gagaattgcttgaacttcag

SEQ ID NO: 410306 - DNA, 20 bp, Artificial Sequence
  chemically synthesized
aattgcttgaacttcagagg

SEQ ID NO: 410307 - DNA, 20 bp, Artificial Sequence
  chemically synthesized
cactgcaacctccgcctctg

SEQ ID NO: 410308 - DNA, 20 bp, Artificial Sequence
  chemically synthesized
ttgcttgaacttcagaggcg

SEQ ID NO: 410309 - DNA, 20 bp, Artificial Sequence
  chemically synthesized
tgcttgaacttcagaggcgg

SEQ ID NO: 410310 - DNA, 20 bp, Artificial Sequence
  chemically synthesized
aacttcagaggcggaggttg

SEQ ID NO: 410311 - DNA, 20 bp, Artificial Sequence
  chemically synthesized
tcagaggcggaggttgcagt

SEQ ID NO: 410312 - DNA, 20 bp, Artificial Sequence
  chemically synthesized
ggcggaggttgcagtgagcc

SEQ ID NO: 410313 - DNA, 20 bp, Artificial Sequence
  chemically synthesized
gaagtgcagtggcgcgatct

SEQ ID NO: 410314 - DNA, 20 bp, Artificial Sequence
  chemically synthesized
accccgaggctgaagtgcag

SEQ ID NO: 410315 - DNA, 20 bp, Artificial Sequence
  chemically synthesized
aagatcgcgccactgcactt

SEQ ID NO: 410316 - DNA, 20 bp, Artificial Sequence
  chemically synthesized
ctgaccccgaggctgaagtg

SEQ ID NO: 410317 - DNA, 20 bp, Artificial Sequence
  chemically synthesized
gcgccactgcacttcagcct

SEQ ID NO: 410318 - DNA, 20 bp, Artificial Sequence
  chemically synthesized
cgccactgcacttcagcctc

SEQ ID NO: 410319 - DNA, 20 bp, Artificial Sequence
  chemically synthesized
tctctctgaccccgaggctg

SEQ ID NO: 410320 - DNA, 20 bp, Artificial Sequence
  chemically synthesized
gccactgcacttcagcctcg

SEQ ID NO: 410321 - DNA, 20 bp, Artificial Sequence
  chemically synthesized
ctgcacttcagcctcggggt

SEQ ID NO: 410322 - DNA, 20 bp, Artificial Sequence
  chemically synthesized
gaagtctctctctgaccccg

SEQ ID NO: 410323 - DNA, 20 bp, Artificial Sequence
  chemically synthesized
gcacttcagcctcggggtca

SEQ ID NO: 410324 - DNA, 20 bp, Artificial Sequence
  chemically synthesized
tgaagtctctctctgacccc

SEQ ID NO: 410325 - DNA, 20 bp, Artificial Sequence
  chemically synthesized
acttcagcctcggggtcaga

SEQ ID NO: 410326 - DNA, 20 bp, Artificial Sequence
  chemically synthesized
ttcagcctcggggtcagaga

SEQ ID NO: 410327 - DNA, 20 bp, Artificial Sequence
  chemically synthesized
gtcagagagagacttcatct

SEQ ID NO: 410328 - DNA, 20 bp, Artificial Sequence
  chemically synthesized
tattatttttttctgagatg

SEQ ID NO: 410329 - DNA, 20 bp, Artificial Sequence
  chemically synthesized
ttttattattatttttttct

SEQ ID NO: 410330 - DNA, 20 bp, Artificial Sequence
  chemically synthesized
ataaaataaaataaaatgta

SEQ ID NO: 410331 - DNA, 20 bp, Artificial Sequence
  chemically synthesized
ataaaataaaatgtatggaa

SEQ ID NO: 410332 - DNA, 20 bp, Artificial Sequence
  chemically synthesized
ttacttcgtagaatggtggt

SEQ ID NO: 410333 - DNA, 20 bp, Artificial Sequence
  chemically synthesized
gttcttacttcgtagaatgg

SEQ ID NO: 410334 - DNA, 20 bp, Artificial Sequence
  chemically synthesized
tggccaaccaccattctacg

SEQ ID NO: 410335 - DNA, 20 bp, Artificial Sequence
  chemically synthesized
tcagttcttacttcgtagaa

SEQ ID NO: 410336 - DNA, 20 bp, Artificial Sequence
  chemically synthesized
caaccaccattctacgaagt

SEQ ID NO: 410337 - DNA, 20 bp, Artificial Sequence
  chemically synthesized
gactttcagttcttacttcg

SEQ ID NO: 410338 - DNA, 20 bp, Artificial Sequence
  chemically synthesized
ttctacgaagtaagaactga

SEQ ID NO: 410339 - DNA, 20 bp, Artificial Sequence
  chemically synthesized
acctttgcttattagacttt

SEQ ID NO: 410340 - DNA, 20 bp, Artificial Sequence
  chemically synthesized
gtaagaactgaaagtctaat

SEQ ID NO: 410341 - DNA, 20 bp, Artificial Sequence
  chemically synthesized
aactgaaagtctaataagca

SEQ ID NO: 410342 - DNA, 20 bp, Artificial Sequence
  chemically synthesized
aagtagagacctttgcttat

SEQ ID NO: 410343 - DNA, 20 bp, Artificial Sequence
  chemically synthesized
actgaaagtctaataagcaa

SEQ ID NO: 410344 - DNA, 20 bp, Artificial Sequence
  chemically synthesized
aagcaaaggtctctacttct

SEQ ID NO: 410345 - DNA, 20 bp, Artificial Sequence
  chemically synthesized
aacagagcttctgagaagta

SEQ ID NO: 410346 - DNA, 20 bp, Artificial Sequence
  chemically synthesized
ccaacagagcttctgagaag

SEQ ID NO: 410347 - DNA, 20 bp, Artificial Sequence
  chemically synthesized
caaaggtctctacttctcag

SEQ ID NO: 410348 - DNA, 20 bp, Artificial Sequence
  chemically synthesized
catccaacagagcttctgag

SEQ ID NO: 410349 - DNA, 20 bp, Artificial Sequence
  chemically synthesized
tatcatccaacagagcttct

SEQ ID NO: 410350 - DNA, 20 bp, Artificial Sequence
  chemically synthesized
ctacttctcagaagctctgt

SEQ ID NO: 410351 - DNA, 20 bp, Artificial Sequence
  chemically synthesized
caaacctgtatcatccaaca

SEQ ID NO: 410352 - DNA, 20 bp, Artificial Sequence
  chemically synthesized
cacaaacctgtatcatccaa

SEQ ID NO: 410353 - DNA, 20 bp, Artificial Sequence
  chemically synthesized
agaagctctgttggatgata

SEQ ID NO: 410354 - DNA, 20 bp, Artificial Sequence
  chemically synthesized
gaagctctgttggatgatac

SEQ ID NO: 410355 - DNA, 20 bp, Artificial Sequence
  chemically synthesized
gtacaaatattacattaaca

SEQ ID NO: 410356 - DNA, 20 bp, Artificial Sequence
  chemically synthesized
atattacattaacatggaaa

SEQ ID NO: 410357 - DNA, 20 bp, Artificial Sequence
  chemically synthesized
atggaaaaagtgctaacatg

SEQ ID NO: 410358 - DNA, 20 bp, Artificial Sequence
  chemically synthesized
atgcctcctctactgcatgt

SEQ ID NO: 410359 - DNA, 20 bp, Artificial Sequence
  chemically synthesized
gaaaaagtgctaacatgcag

SEQ ID NO: 410360 - DNA, 20 bp, Artificial Sequence
  chemically synthesized
aaaagtgctaacatgcagta

SEQ ID NO: 410361 - DNA, 20 bp, Artificial Sequence
  chemically synthesized
aaagtgctaacatgcagtag

SEQ ID NO: 410362 - DNA, 20 bp, Artificial Sequence
  chemically synthesized
agtgctaacatgcagtagag

SEQ ID NO: 410363 - DNA, 20 bp, Artificial Sequence
  chemically synthesized
gtgctaacatgcagtagagg

SEQ ID NO: 410364 - DNA, 20 bp, Artificial Sequence
  chemically synthesized
gaggcataaacttgctcgat

SEQ ID NO: 410365 - DNA, 20 bp, Artificial Sequence
  chemically synthesized
accaccaaacctaatcgagc

SEQ ID NO: 410366 - DNA, 20 bp, Artificial Sequence
  chemically synthesized
aggcataaacttgctcgatt

SEQ ID NO: 410367 - DNA, 20 bp, Artificial Sequence
  chemically synthesized
tccaaccaccaaacctaatc

SEQ ID NO: 410368 - DNA, 20 bp, Artificial Sequence
  chemically synthesized
taaacttgctcgattaggtt

SEQ ID NO: 410369 - DNA, 20 bp, Artificial Sequence
  chemically synthesized
acttgctcgattaggtttgg

SEQ ID NO: 410370 - DNA, 20 bp, Artificial Sequence
  chemically synthesized
gctcgattaggtttggtggt

SEQ ID NO: 410371 - DNA, 20 bp, Artificial Sequence
  chemically synthesized
tcgattaggtttggtggttg

SEQ ID NO: 410372 - DNA, 20 bp, Artificial Sequence
  chemically synthesized
cgattaggtttggtggttgg

SEQ ID NO: 410373 - DNA, 20 bp, Artificial Sequence
  chemically synthesized
ggtggttggaggttttacaa

SEQ ID NO: 410374 - DNA, 20 bp, Artificial Sequence
  chemically synthesized
tggttggaggttttacaaaa

SEQ ID NO: 410375 - DNA, 20 bp, Artificial Sequence
  chemically synthesized
ggttttacaaaagagatgat

SEQ ID NO: 410376 - DNA, 20 bp, Artificial Sequence
  chemically synthesized
gttttacaaaagagatgatg

SEQ ID NO: 410377 - DNA, 20 bp, Artificial Sequence
  chemically synthesized
aaagagatgatgaggcaaat

SEQ ID NO: 410378 - DNA, 20 bp, Artificial Sequence
  chemically synthesized
gggtgggggctgtcaagtgt

SEQ ID NO: 410379 - DNA, 20 bp, Artificial Sequence
  chemically synthesized
tggtgtttacctacacttga

SEQ ID NO: 410380 - DNA, 20 bp, Artificial Sequence
  chemically synthesized
tgggtgggggctgtcaagtg

SEQ ID NO: 410381 - DNA, 20 bp, Artificial Sequence
  chemically synthesized
aactatgggtgggggctgtc

SEQ ID NO: 410382 - DNA, 20 bp, Artificial Sequence
  chemically synthesized
cacttgacagcccccaccca

SEQ ID NO: 410383 - DNA, 20 bp, Artificial Sequence
  chemically synthesized
tttatactaactatgggtgg

SEQ ID NO: 410384 - DNA, 20 bp, Artificial Sequence
  chemically synthesized
ttttatactaactatgggtg

SEQ ID NO: 410385 - DNA, 20 bp, Artificial Sequence
  chemically synthesized
attttatactaactatgggt

SEQ ID NO: 410386 - DNA, 20 bp, Artificial Sequence
  chemically synthesized
cattttatactaactatggg

SEQ ID NO: 410387 - DNA, 20 bp, Artificial Sequence
  chemically synthesized
tgacagcccccacccatagt

SEQ ID NO: 410388 - DNA, 20 bp, Artificial Sequence
  chemically synthesized
ttacattttatactaactat

SEQ ID NO: 410389 - DNA, 20 bp, Artificial Sequence
  chemically synthesized
attacattttatactaacta

SEQ ID NO: 410390 - DNA, 20 bp, Artificial Sequence
  chemically synthesized
taattataattttgtgtata

SEQ ID NO: 410391 - DNA, 20 bp, Artificial Sequence
  chemically synthesized
attggctgtaataatttttc

SEQ ID NO: 410392 - DNA, 20 bp, Artificial Sequence
  chemically synthesized
cagtacttgaaaaattatta

SEQ ID NO: 410393 - DNA, 20 bp, Artificial Sequence
  chemically synthesized
attattacagccaatcacaa

SEQ ID NO: 410394 - DNA, 20 bp, Artificial Sequence
  chemically synthesized
tttatatccactattgtgat

SEQ ID NO: 410395 - DNA, 20 bp, Artificial Sequence
  chemically synthesized
attacagccaatcacaatag

SEQ ID NO: 410396 - DNA, 20 bp, Artificial Sequence
  chemically synthesized
atagtggatataaaaattcc

SEQ ID NO: 410397 - DNA, 20 bp, Artificial Sequence
  chemically synthesized
gttttccttgtaaatagact

SEQ ID NO: 410398 - DNA, 20 bp, Artificial Sequence
  chemically synthesized
aaaattccaagtctatttac

SEQ ID NO: 410399 - DNA, 20 bp, Artificial Sequence
  chemically synthesized
aaattccaagtctatttaca

SEQ ID NO: 410400 - DNA, 20 bp, Artificial Sequence
  chemically synthesized
cagaatgttttccttgtaaa

SEQ ID NO: 410401 - DNA, 20 bp, Artificial Sequence
  chemically synthesized
tatttacaaggaaaacattc

SEQ ID NO: 410402 - DNA, 20 bp, Artificial Sequence
  chemically synthesized
tatttatggtcatatttggc

SEQ ID NO: 410403 - DNA, 20 bp, Artificial Sequence
  chemically synthesized
caaatatttatggtcatatt

SEQ ID NO: 410404 - DNA, 20 bp, Artificial Sequence
  chemically synthesized
attgtaagcacaaatattta

SEQ ID NO: 410405 - DNA, 20 bp, Artificial Sequence
  chemically synthesized
ttgaaatttctaggtattgt

SEQ ID NO: 410406 - DNA, 20 bp, Artificial Sequence
  chemically synthesized
atatttgtgcttacaatacc

SEQ ID NO: 410407 - DNA, 20 bp, Artificial Sequence
  chemically synthesized
atcaaacatttgaaatttct

SEQ ID NO: 410408 - DNA, 20 bp, Artificial Sequence
  chemically synthesized
tatcaaacatttgaaatttc

SEQ ID NO: 410409 - DNA, 20 bp, Artificial Sequence
  chemically synthesized
atgttaaatatttttatttg

SEQ ID NO: 410410 - DNA, 20 bp, Artificial Sequence
  chemically synthesized
gttaaatatttttatttgta

SEQ ID NO: 410411 - DNA, 20 bp, Artificial Sequence
  chemically synthesized
gtaatctatatttgaaagtg

SEQ ID NO: 410412 - DNA, 20 bp, Artificial Sequence
  chemically synthesized
gagttcttcactttcaaata

SEQ ID NO: 410413 - DNA, 20 bp, Artificial Sequence
  chemically synthesized
taaaagtaatctatatttga

SEQ ID NO: 410414 - DNA, 20 bp, Artificial Sequence
  chemically synthesized
aaatatagattacttttaat

SEQ ID NO: 410415 - DNA, 20 bp, Artificial Sequence
  chemically synthesized
aattgtttctatctcattaa

SEQ ID NO: 410416 - DNA, 20 bp, Artificial Sequence
  chemically synthesized
atagattacttttaatgaga

SEQ ID NO: 410417 - DNA, 20 bp, Artificial Sequence
  chemically synthesized
aatgagatagaaacaattat

SEQ ID NO: 410418 - DNA, 20 bp, Artificial Sequence
  chemically synthesized
aattatcagtttgattcatt

SEQ ID NO: 410419 - DNA, 20 bp, Artificial Sequence
  chemically synthesized
attatcagtttgattcatta

SEQ ID NO: 410420 - DNA, 20 bp, Artificial Sequence
  chemically synthesized
ttatcagtttgattcattaa

SEQ ID NO: 410421 - DNA, 20 bp, Artificial Sequence
  chemically synthesized
taagggacaatatcacttta

SEQ ID NO: 410422 - DNA, 20 bp, Artificial Sequence
  chemically synthesized
aatacatgtaaatttctgta

SEQ ID NO: 410423 - DNA, 20 bp, Artificial Sequence
  chemically synthesized
catgtatttattaacatgtg

SEQ ID NO: 410424 - DNA, 20 bp, Artificial Sequence
  chemically synthesized
tattaacatgtgaagcactt

SEQ ID NO: 410425 - DNA, 20 bp, Artificial Sequence
  chemically synthesized
taacatgtgaagcactttag

SEQ ID NO: 410426 - DNA, 20 bp, Artificial Sequence
  chemically synthesized
aatgtcctttttatctacta

SEQ ID NO: 410427 - DNA, 20 bp, Artificial Sequence
  chemically synthesized
gaagcactttagtagataaa

SEQ ID NO: 410428 - DNA, 20 bp, Artificial Sequence
  chemically synthesized
aagcactttagtagataaaa

SEQ ID NO: 410429 - DNA, 20 bp, Artificial Sequence
  chemically synthesized
ttttgtatcacttaaaacat

SEQ ID NO: 410430 - DNA, 20 bp, Artificial Sequence
  chemically synthesized
taatttcatcctaatgtttt

SEQ ID NO: 410431 - DNA, 20 bp, Artificial Sequence
  chemically synthesized
tttgtatcacttaaaacatt

SEQ ID NO: 410432 - DNA, 20 bp, Artificial Sequence
  chemically synthesized
gaaatgtacatgctgcctac

SEQ ID NO: 410433 - DNA, 20 bp, Artificial Sequence
  chemically synthesized
taatctttggtgccagtagg

SEQ ID NO: 410434 - DNA, 20 bp, Artificial Sequence
  chemically synthesized
ttataatctttggtgccagt

SEQ ID NO: 410435 - DNA, 20 bp, Artificial Sequence
  chemically synthesized
cttataatctttggtgccag

SEQ ID NO: 410436 - DNA, 20 bp, Artificial Sequence
  chemically synthesized
catgctgcctactggcacca

SEQ ID NO: 410437 - DNA, 20 bp, Artificial Sequence
  chemically synthesized
cggcttataatctttggtgc

SEQ ID NO: 410438 - DNA, 20 bp, Artificial Sequence
  chemically synthesized
tgagaccggcttataatctt

SEQ ID NO: 410439 - DNA, 20 bp, Artificial Sequence
  chemically synthesized
ctactggcaccaaagattat

SEQ ID NO: 410440 - DNA, 20 bp, Artificial Sequence
  chemically synthesized
tggcaccaaagattataagc

SEQ ID NO: 410441 - DNA, 20 bp, Artificial Sequence
  chemically synthesized
tgaaaagccaattgtgagac

SEQ ID NO: 410442 - DNA, 20 bp, Artificial Sequence
  chemically synthesized
ttataagccggtctcacaat

SEQ ID NO: 410443 - DNA, 20 bp, Artificial Sequence
  chemically synthesized
tataatgaaaagccaattgt

SEQ ID NO: 410444 - DNA, 20 bp, Artificial Sequence
  chemically synthesized
ggtgttctttatataatgaa

SEQ ID NO: 410445 - DNA, 20 bp, Artificial Sequence
  chemically synthesized
aattggcttttcattatata

SEQ ID NO: 410446 - DNA, 20 bp, Artificial Sequence
  chemically synthesized
aggaattccaagcatataat

SEQ ID NO: 410447 - DNA, 20 bp, Artificial Sequence
  chemically synthesized
taggaattccaagcatataa

SEQ ID NO: 410448 - DNA, 20 bp, Artificial Sequence
  chemically synthesized
aagaacacccattatatgct

SEQ ID NO: 410449 - DNA, 20 bp, Artificial Sequence
  chemically synthesized
cctgctggcataggaattcc

SEQ ID NO: 410450 - DNA, 20 bp, Artificial Sequence
  chemically synthesized
tatgcttggaattcctatgc

SEQ ID NO: 410451 - DNA, 20 bp, Artificial Sequence
  chemically synthesized
gcttggaattcctatgccag

SEQ ID NO: 410452 - DNA, 20 bp, Artificial Sequence
  chemically synthesized
tgctgtatgcctgctggcat

SEQ ID NO: 410453 - DNA, 20 bp, Artificial Sequence
  chemically synthesized
cttggaattcctatgccagc

SEQ ID NO: 410454 - DNA, 20 bp, Artificial Sequence
  chemically synthesized
ttgctgtatgcctgctggca

SEQ ID NO: 410455 - DNA, 20 bp, Artificial Sequence
  chemically synthesized
agcatttgctgtatgcctgc

SEQ ID NO: 410456 - DNA, 20 bp, Artificial Sequence
  chemically synthesized
ttcctatgccagcaggcata

SEQ ID NO: 410457 - DNA, 20 bp, Artificial Sequence
  chemically synthesized
agcaggcatacagcaaatgc

SEQ ID NO: 410458 - DNA, 20 bp, Artificial Sequence
  chemically synthesized
aggcatacagcaaatgctgg

SEQ ID NO: 410459 - DNA, 20 bp, Artificial Sequence
  chemically synthesized
agttatgaacaatgggcttc

SEQ ID NO: 410460 - DNA, 20 bp, Artificial Sequence
  chemically synthesized
gaagtaaagttatgaacaat

SEQ ID NO: 410461 - DNA, 20 bp, Artificial Sequence
  chemically synthesized
agaagtaaagttatgaacaa

SEQ ID NO: 410462 - DNA, 20 bp, Artificial Sequence
  chemically synthesized
gaaatgcttggcaagaagta

SEQ ID NO: 410463 - DNA, 20 bp, Artificial Sequence
  chemically synthesized
tcataactttacttcttgcc

SEQ ID NO: 410464 - DNA, 20 bp, Artificial Sequence
  chemically synthesized
taactgaaatgcttggcaag

SEQ ID NO: 410465 - DNA, 20 bp, Artificial Sequence
  chemically synthesized
atataactgaaatgcttggc

SEQ ID NO: 410466 - DNA, 20 bp, Artificial Sequence
  chemically synthesized
ttacttcttgccaagcattt

SEQ ID NO: 410467 - DNA, 20 bp, Artificial Sequence
  chemically synthesized
gaaaatataactgaaatgct

SEQ ID NO: 410468 - DNA, 20 bp, Artificial Sequence
  chemically synthesized
catttcagttatattttctt

SEQ ID NO: 410469 - DNA, 20 bp, Artificial Sequence
  chemically synthesized
tctggccctttatataacca

SEQ ID NO: 410470 - DNA, 20 bp, Artificial Sequence
  chemically synthesized
atattttctttggttatata

SEQ ID NO: 410471 - DNA, 20 bp, Artificial Sequence
  chemically synthesized
tattttctttggttatataa

SEQ ID NO: 410472 - DNA, 20 bp, Artificial Sequence
  chemically synthesized
attttctttggttatataaa

SEQ ID NO: 410473 - DNA, 20 bp, Artificial Sequence
  chemically synthesized
tctttggttatataaagggc

SEQ ID NO: 410474 - DNA, 20 bp, Artificial Sequence
  chemically synthesized
tttggttatataaagggcca

SEQ ID NO: 410475 - DNA, 20 bp, Artificial Sequence
  chemically synthesized
tctttcacttaaaatagctc

SEQ ID NO: 410476 - DNA, 20 bp, Artificial Sequence
  chemically synthesized
taaagggccagagctatttt

SEQ ID NO: 410477 - DNA, 20 bp, Artificial Sequence
  chemically synthesized
gctacctctttcacttaaaa

SEQ ID NO: 410478 - DNA, 20 bp, Artificial Sequence
  chemically synthesized
gccagagctattttaagtga

SEQ ID NO: 410479 - DNA, 20 bp, Artificial Sequence
  chemically synthesized
cagagctattttaagtgaaa

SEQ ID NO: 410480 - DNA, 20 bp, Artificial Sequence
  chemically synthesized
agagctattttaagtgaaag

SEQ ID NO: 410481 - DNA, 20 bp, Artificial Sequence
  chemically synthesized
gctattttaagtgaaagagg

SEQ ID NO: 410482 - DNA, 20 bp, Artificial Sequence
  chemically synthesized
gtcatatagtgagatgagga

SEQ ID NO: 410483 - DNA, 20 bp, Artificial Sequence
  chemically synthesized
atctgtcatatagtgagatg

SEQ ID NO: 410484 - DNA, 20 bp, Artificial Sequence
  chemically synthesized
catctgtcatatagtgagat

SEQ ID NO: 410485 - DNA, 20 bp, Artificial Sequence
  chemically synthesized
tatgacatctgtcatatagt

SEQ ID NO: 410486 - DNA, 20 bp, Artificial Sequence
  chemically synthesized
atcctcatctcactatatga

SEQ ID NO: 410487 - DNA, 20 bp, Artificial Sequence
  chemically synthesized
gtaatatgacatctgtcata

SEQ ID NO: 410488 - DNA, 20 bp, Artificial Sequence
  chemically synthesized
tattacaatgccctacataa

SEQ ID NO: 410489 - DNA, 20 bp, Artificial Sequence
  chemically synthesized
cccttgcatactattatgta

SEQ ID NO: 410490 - DNA, 20 bp, Artificial Sequence
  chemically synthesized
gcccttgcatactattatgt

SEQ ID NO: 410491 - DNA, 20 bp, Artificial Sequence
  chemically synthesized
tgcccttgcatactattatg

SEQ ID NO: 410492 - DNA, 20 bp, Artificial Sequence
  chemically synthesized
tgccctacataatagtatgc

SEQ ID NO: 410493 - DNA, 20 bp, Artificial Sequence
  chemically synthesized
gccctacataatagtatgca

SEQ ID NO: 410494 - DNA, 20 bp, Artificial Sequence
  chemically synthesized
ccctacataatagtatgcaa

SEQ ID NO: 410495 - DNA, 20 bp, Artificial Sequence
  chemically synthesized
ttacaccaggtcgaaggagg

SEQ ID NO: 410496 - DNA, 20 bp, Artificial Sequence
  chemically synthesized
attttacaccaggtcgaagg

SEQ ID NO: 410497 - DNA, 20 bp, Artificial Sequence
  chemically synthesized
aattttacaccaggtcgaag

SEQ ID NO: 410498 - DNA, 20 bp, Artificial Sequence
  chemically synthesized
caatgctacctccttcgacc

SEQ ID NO: 410499 - DNA, 20 bp, Artificial Sequence
  chemically synthesized
ggaattttacaccaggtcga

SEQ ID NO: 410500 - DNA, 20 bp, Artificial Sequence
  chemically synthesized
aggaattttacaccaggtcg

SEQ ID NO: 410501 - DNA, 20 bp, Artificial Sequence
  chemically synthesized
attctaaggaattttacacc

SEQ ID NO: 410502 - DNA, 20 bp, Artificial Sequence
  chemically synthesized
aattctaaggaattttacac

SEQ ID NO: 410503 - DNA, 20 bp, Artificial Sequence
  chemically synthesized
cgacctggtgtaaaattcct

SEQ ID NO: 410504 - DNA, 20 bp, Artificial Sequence
  chemically synthesized
aacacacagttgtaattcta

SEQ ID NO: 410505 - DNA, 20 bp, Artificial Sequence
  chemically synthesized
aaacacacagttgtaattct

SEQ ID NO: 410506 - DNA, 20 bp, Artificial Sequence
  chemically synthesized
tagaattacaactgtgtgtt

SEQ ID NO: 410507 - DNA, 20 bp, Artificial Sequence
  chemically synthesized
ggttttattgtctaaacaca

SEQ ID NO: 410508 - DNA, 20 bp, Artificial Sequence
  chemically synthesized
gtgtttagacaataaaaccg

SEQ ID NO: 410509 - DNA, 20 bp, Artificial Sequence
  chemically synthesized
tgtttagacaataaaaccga

SEQ ID NO: 410510 - DNA, 20 bp, Artificial Sequence
  chemically synthesized
gatatttgaggcaaatcctt

SEQ ID NO: 410511 - DNA, 20 bp, Artificial Sequence
  chemically synthesized
gcacttagttttgatatttg

SEQ ID NO: 410512 - DNA, 20 bp, Artificial Sequence
  chemically synthesized
tgcacttagttttgatattt

SEQ ID NO: 410513 - DNA, 20 bp, Artificial Sequence
  chemically synthesized
ttgcctcaaatatcaaaact

SEQ ID NO: 410514 - DNA, 20 bp, Artificial Sequence
  chemically synthesized
tagcattgcccatttgcact

SEQ ID NO: 410515 - DNA, 20 bp, Artificial Sequence
  chemically synthesized
atatcaaaactaagtgcaaa

SEQ ID NO: 410516 - DNA, 20 bp, Artificial Sequence
  chemically synthesized
tatcaaaactaagtgcaaat

SEQ ID NO: 410517 - DNA, 20 bp, Artificial Sequence
  chemically synthesized
tgcaaatgggcaatgctata

SEQ ID NO: 410518 - DNA, 20 bp, Artificial Sequence
  chemically synthesized
atgggcaatgctatatagat

SEQ ID NO: 410519 - DNA, 20 bp, Artificial Sequence
  chemically synthesized
atgtttcctgctcatctata

SEQ ID NO: 410520 - DNA, 20 bp, Artificial Sequence
  chemically synthesized
ggcaatgctatatagatgag

SEQ ID NO: 410521 - DNA, 20 bp, Artificial Sequence
  chemically synthesized
gcaatgctatatagatgagc

SEQ ID NO: 410522 - DNA, 20 bp, Artificial Sequence
  chemically synthesized
gcattcacttagaggagagt

SEQ ID NO: 410523 - DNA, 20 bp, Artificial Sequence
  chemically synthesized
aacatttctcactctcctct

SEQ ID NO: 410524 - DNA, 20 bp, Artificial Sequence
  chemically synthesized
attagcattcacttagagga

SEQ ID NO: 410525 - DNA, 20 bp, Artificial Sequence
  chemically synthesized
atattagcattcacttagag

SEQ ID NO: 410526 - DNA, 20 bp, Artificial Sequence
  chemically synthesized
tcatattagcattcacttag

SEQ ID NO: 410527 - DNA, 20 bp, Artificial Sequence
  chemically synthesized
atcatattagcattcactta

SEQ ID NO: 410528 - DNA, 20 bp, Artificial Sequence
  chemically synthesized
aaatcatattagcattcact

SEQ ID NO: 410529 - DNA, 20 bp, Artificial Sequence
  chemically synthesized
gtcaattcatgaaatcatat

SEQ ID NO: 410530 - DNA, 20 bp, Artificial Sequence
  chemically synthesized
tgttcttataaagcaaaatt

SEQ ID NO: 410531 - DNA, 20 bp, Artificial Sequence
  chemically synthesized
acaactaaattttgctttat

SEQ ID NO: 410532 - DNA, 20 bp, Artificial Sequence
  chemically synthesized
tggctatgtatgttcttata

SEQ ID NO: 410533 - DNA, 20 bp, Artificial Sequence
  chemically synthesized
ttgctttataagaacataca

SEQ ID NO: 410534 - DNA, 20 bp, Artificial Sequence
  chemically synthesized
tataagaacatacatagcca

SEQ ID NO: 410535 - DNA, 20 bp, Artificial Sequence
  chemically synthesized
ataagaacatacatagccaa

SEQ ID NO: 410536 - DNA, 20 bp, Artificial Sequence
  chemically synthesized
ttttttttttttaaatcctt

SEQ ID NO: 410537 - DNA, 20 bp, Artificial Sequence
  chemically synthesized
ctctgtaacttgttttaagg

SEQ ID NO: 410538 - DNA, 20 bp, Artificial Sequence
  chemically synthesized
aaaaaaaaccaccttaaaac

SEQ ID NO: 410539 - DNA, 20 bp, Artificial Sequence
  chemically synthesized
accctctgtaacttgtttta

SEQ ID NO: 410540 - DNA, 20 bp, Artificial Sequence
  chemically synthesized
aaccctctgtaacttgtttt

SEQ ID NO: 410541 - DNA, 20 bp, Artificial Sequence
  chemically synthesized
aaccaccttaaaacaagtta

SEQ ID NO: 410542 - DNA, 20 bp, Artificial Sequence
  chemically synthesized
ccaccttaaaacaagttaca

SEQ ID NO: 410543 - DNA, 20 bp, Artificial Sequence
  chemically synthesized
caccttaaaacaagttacag

SEQ ID NO: 410544 - DNA, 20 bp, Artificial Sequence
  chemically synthesized
accttaaaacaagttacaga

SEQ ID NO: 410545 - DNA, 20 bp, Artificial Sequence
  chemically synthesized
acaagttacagagggttaaa

SEQ ID NO: 410546 - DNA, 20 bp, Artificial Sequence
  chemically synthesized
agttacagagggttaaacgg

SEQ ID NO: 410547 - DNA, 20 bp, Artificial Sequence
  chemically synthesized
agagggttaaacggaagcaa

SEQ ID NO: 410548 - DNA, 20 bp, Artificial Sequence
  chemically synthesized
gggttaaacggaagcaaaag

SEQ ID NO: 410549 - DNA, 20 bp, Artificial Sequence
  chemically synthesized
ggttaaacggaagcaaaagt

SEQ ID NO: 410550 - DNA, 20 bp, Artificial Sequence
  chemically synthesized
taaacggaagcaaaagtagg

SEQ ID NO: 410551 - DNA, 20 bp, Artificial Sequence
  chemically synthesized
ggaagcaaaagtaggtagct

SEQ ID NO: 410552 - DNA, 20 bp, Artificial Sequence
  chemically synthesized
aaaagtaggtagctaagtat

SEQ ID NO: 410553 - DNA, 20 bp, Artificial Sequence
  chemically synthesized
aaagtaggtagctaagtatt

SEQ ID NO: 410554 - DNA, 20 bp, Artificial Sequence
  chemically synthesized
attccacccttcctaatact

SEQ ID NO: 410555 - DNA, 20 bp, Artificial Sequence
  chemically synthesized
gtaggtagctaagtattagg

SEQ ID NO: 410556 - DNA, 20 bp, Artificial Sequence
  chemically synthesized
taggtagctaagtattagga

SEQ ID NO: 410557 - DNA, 20 bp, Artificial Sequence
  chemically synthesized
aggtagctaagtattaggaa

SEQ ID NO: 410558 - DNA, 20 bp, Artificial Sequence
  chemically synthesized
tagctaagtattaggaaggg

SEQ ID NO: 410559 - DNA, 20 bp, Artificial Sequence
  chemically synthesized
aggaagggtggaataatgtc

SEQ ID NO: 410560 - DNA, 20 bp, Artificial Sequence
  chemically synthesized
ggaagggtggaataatgtct

SEQ ID NO: 410561 - DNA, 20 bp, Artificial Sequence
  chemically synthesized
tggaataatgtctaggaaac

SEQ ID NO: 410562 - DNA, 20 bp, Artificial Sequence
  chemically synthesized
gccttattactctcgtttcc

SEQ ID NO: 410563 - DNA, 20 bp, Artificial Sequence
  chemically synthesized
gaataatgtctaggaaacga

SEQ ID NO: 410564 - DNA, 20 bp, Artificial Sequence
  chemically synthesized
gtctaggaaacgagagtaat

SEQ ID NO: 410565 - DNA, 20 bp, Artificial Sequence
  chemically synthesized
tctaggaaacgagagtaata

SEQ ID NO: 410566 - DNA, 20 bp, Artificial Sequence
  chemically synthesized
ggaaacgagagtaataaggc

SEQ ID NO: 410567 - DNA, 20 bp, Artificial Sequence
  chemically synthesized
gaaacgagagtaataaggcc

SEQ ID NO: 410568 - DNA, 20 bp, Artificial Sequence
  chemically synthesized
gagagtaataaggccaggtg

SEQ ID NO: 410569 - DNA, 20 bp, Artificial Sequence
  chemically synthesized
agtaataaggccaggtgcag

SEQ ID NO: 410570 - DNA, 20 bp, Artificial Sequence
  chemically synthesized
taggcatgagccactgcacc

SEQ ID NO: 410571 - DNA, 20 bp, Artificial Sequence
  chemically synthesized
agtgctaggattataggcat

SEQ ID NO: 410572 - DNA, 20 bp, Artificial Sequence
  chemically synthesized
gtggctcatgcctataatcc

SEQ ID NO: 410573 - DNA, 20 bp, Artificial Sequence
  chemically synthesized
tcccaaagtgctaggattat

SEQ ID NO: 410574 - DNA, 20 bp, Artificial Sequence
  chemically synthesized
ctcccaaagtgctaggatta

SEQ ID NO: 410575 - DNA, 20 bp, Artificial Sequence
  chemically synthesized
tgcctataatcctagcactt

SEQ ID NO: 410576 - DNA, 20 bp, Artificial Sequence
  chemically synthesized
cctcggcctcccaaagtgct

SEQ ID NO: 410577 - DNA, 20 bp, Artificial Sequence
  chemically synthesized
gcctataatcctagcacttt

SEQ ID NO: 410578 - DNA, 20 bp, Artificial Sequence
  chemically synthesized
gcctcggcctcccaaagtgc

SEQ ID NO: 410579 - DNA, 20 bp, Artificial Sequence
  chemically synthesized
ctataatcctagcactttgg

SEQ ID NO: 410580 - DNA, 20 bp, Artificial Sequence
  chemically synthesized
tataatcctagcactttggg

SEQ ID NO: 410581 - DNA, 20 bp, Artificial Sequence
  chemically synthesized
ctgcccgcctcggcctccca

SEQ ID NO: 410582 - DNA, 20 bp, Artificial Sequence
  chemically synthesized
tcctagcactttgggaggcc

SEQ ID NO: 410583 - DNA, 20 bp, Artificial Sequence
  chemically synthesized
cctagcactttgggaggccg

SEQ ID NO: 410584 - DNA, 20 bp, Artificial Sequence
  chemically synthesized
agcactttgggaggccgagg

SEQ ID NO: 410585 - DNA, 20 bp, Artificial Sequence
  chemically synthesized
gcactttgggaggccgaggc

SEQ ID NO: 410586 - DNA, 20 bp, Artificial Sequence
  chemically synthesized
ctttgggaggccgaggcggg

SEQ ID NO: 410587 - DNA, 20 bp, Artificial Sequence
  chemically synthesized
ctcaagtgatctgcccgcct

SEQ ID NO: 410588 - DNA, 20 bp, Artificial Sequence
  chemically synthesized
ccgaggcgggcagatcactt

SEQ ID NO: 410589 - DNA, 20 bp, Artificial Sequence
  chemically synthesized
cgaggcgggcagatcacttg

SEQ ID NO: 410590 - DNA, 20 bp, Artificial Sequence
  chemically synthesized
gcgggcagatcacttgaggt

SEQ ID NO: 410591 - DNA, 20 bp, Artificial Sequence
  chemically synthesized
cgggcagatcacttgaggtc

SEQ ID NO: 410592 - DNA, 20 bp, Artificial Sequence
  chemically synthesized
ggttttgaactcctgacctc

SEQ ID NO: 410593 - DNA, 20 bp, Artificial Sequence
  chemically synthesized
ggcagatcacttgaggtcag

SEQ ID NO: 410594 - DNA, 20 bp, Artificial Sequence
  chemically synthesized
tcaggagttcaaaaccaacc

SEQ ID NO: 410595 - DNA, 20 bp, Artificial Sequence
  chemically synthesized
tttcatcacattggccaggt

SEQ ID NO: 410596 - DNA, 20 bp, Artificial Sequence
  chemically synthesized
gcggtttcatcacattggcc

SEQ ID NO: 410597 - DNA, 20 bp, Artificial Sequence
  chemically synthesized
cgcggtttcatcacattggc

SEQ ID NO: 410598 - DNA, 20 bp, Artificial Sequence
  chemically synthesized
gagacgcggtttcatcacat

SEQ ID NO: 410599 - DNA, 20 bp, Artificial Sequence
  chemically synthesized
tttttattttagtagagacg

SEQ ID NO: 410600 - DNA, 20 bp, Artificial Sequence
  chemically synthesized
ggctaatttttattttagta

SEQ ID NO: 410601 - DNA, 20 bp, Artificial Sequence
  chemically synthesized
ctggctaatttttattttag

SEQ ID NO: 410602 - DNA, 20 bp, Artificial Sequence
  chemically synthesized
ggcctggctaatttttattt

SEQ ID NO: 410603 - DNA, 20 bp, Artificial Sequence
  chemically synthesized
gtctctactaaaataaaaat

SEQ ID NO: 410604 - DNA, 20 bp, Artificial Sequence
  chemically synthesized
ctactaaaataaaaattagc

SEQ ID NO: 410605 - DNA, 20 bp, Artificial Sequence
  chemically synthesized
tactaaaataaaaattagcc

SEQ ID NO: 410606 - DNA, 20 bp, Artificial Sequence
  chemically synthesized
aaataaaaattagccaggcc

SEQ ID NO: 410607 - DNA, 20 bp, Artificial Sequence
  chemically synthesized
taaaaattagccaggcctgg

SEQ ID NO: 410608 - DNA, 20 bp, Artificial Sequence
  chemically synthesized
caggcgcgcaccaccaggcc

SEQ ID NO: 410609 - DNA, 20 bp, Artificial Sequence
  chemically synthesized
gattacaggcgcgcaccacc

SEQ ID NO: 410610 - DNA, 20 bp, Artificial Sequence
  chemically synthesized
ggattacaggcgcgcaccac

SEQ ID NO: 410611 - DNA, 20 bp, Artificial Sequence
  chemically synthesized
gtggtgcgcgcctgtaatcc

SEQ ID NO: 410612 - DNA, 20 bp, Artificial Sequence
  chemically synthesized
tcctgagtagctgggattac

SEQ ID NO: 410613 - DNA, 20 bp, Artificial Sequence
  chemically synthesized
ctcctgagtagctgggatta

SEQ ID NO: 410614 - DNA, 20 bp, Artificial Sequence
  chemically synthesized
cgcctgtaatcccagctact

SEQ ID NO: 410615 - DNA, 20 bp, Artificial Sequence
  chemically synthesized
cctcaccctcctgagtagct

SEQ ID NO: 410616 - DNA, 20 bp, Artificial Sequence
  chemically synthesized
gcctgtaatcccagctactc

SEQ ID NO: 410617 - DNA, 20 bp, Artificial Sequence
  chemically synthesized
gcctcaccctcctgagtagc

SEQ ID NO: 410618 - DNA, 20 bp, Artificial Sequence
  chemically synthesized
ctgtaatcccagctactcag

SEQ ID NO: 410619 - DNA, 20 bp, Artificial Sequence
  chemically synthesized
tgtaatcccagctactcagg

SEQ ID NO: 410620 - DNA, 20 bp, Artificial Sequence
  chemically synthesized
gtaatcccagctactcagga

SEQ ID NO: 410621 - DNA, 20 bp, Artificial Sequence
  chemically synthesized
tcatgcctcaccctcctgag

SEQ ID NO: 410622 - DNA, 20 bp, Artificial Sequence
  chemically synthesized
ttctcatgcctcaccctcct

SEQ ID NO: 410623 - DNA, 20 bp, Artificial Sequence
  chemically synthesized
tcccagctactcaggagggt

SEQ ID NO: 410624 - DNA, 20 bp, Artificial Sequence
  chemically synthesized
cccagctactcaggagggtg

SEQ ID NO: 410625 - DNA, 20 bp, Artificial Sequence
  chemically synthesized
tactcaggagggtgaggcat

SEQ ID NO: 410626 - DNA, 20 bp, Artificial Sequence
  chemically synthesized
gcatgagaatcgcttgaacc

SEQ ID NO: 410627 - DNA, 20 bp, Artificial Sequence
  chemically synthesized
catgagaatcgcttgaacct

SEQ ID NO: 410628 - DNA, 20 bp, Artificial Sequence
  chemically synthesized
aacctctgcctcccaggttc

SEQ ID NO: 410629 - DNA, 20 bp, Artificial Sequence
  chemically synthesized
tgagaatcgcttgaacctgg

SEQ ID NO: 410630 - DNA, 20 bp, Artificial Sequence
  chemically synthesized
gagaatcgcttgaacctggg

SEQ ID NO: 410631 - DNA, 20 bp, Artificial Sequence
  chemically synthesized
aatcgcttgaacctgggagg

SEQ ID NO: 410632 - DNA, 20 bp, Artificial Sequence
  chemically synthesized
cactgcaacctctgcctccc

SEQ ID NO: 410633 - DNA, 20 bp, Artificial Sequence
  chemically synthesized
tcgcttgaacctgggaggca

SEQ ID NO: 410634 - DNA, 20 bp, Artificial Sequence
  chemically synthesized
tcactgcaacctctgcctcc

SEQ ID NO: 410635 - DNA, 20 bp, Artificial Sequence
  chemically synthesized
cgcttgaacctgggaggcag

SEQ ID NO: 410636 - DNA, 20 bp, Artificial Sequence
  chemically synthesized
aacctgggaggcagaggttg

SEQ ID NO: 410637 - DNA, 20 bp, Artificial Sequence
  chemically synthesized
tgggaggcagaggttgcagt

SEQ ID NO: 410638 - DNA, 20 bp, Artificial Sequence
  chemically synthesized
ggcagaggttgcagtgagac

SEQ ID NO: 410639 - DNA, 20 bp, Artificial Sequence
  chemically synthesized
ttgtccaggctggagtgcag

SEQ ID NO: 410640 - DNA, 20 bp, Artificial Sequence
  chemically synthesized
gagatcacaccactgcactc

SEQ ID NO: 410641 - DNA, 20 bp, Artificial Sequence
  chemically synthesized
gttttgtccaggctggagtg

SEQ ID NO: 410642 - DNA, 20 bp, Artificial Sequence
  chemically synthesized
cacaccactgcactccagcc

SEQ ID NO: 410643 - DNA, 20 bp, Artificial Sequence
  chemically synthesized
tcactgttttgtccaggctg

SEQ ID NO: 410644 - DNA, 20 bp, Artificial Sequence
  chemically synthesized
tctcactgttttgtccaggc

SEQ ID NO: 410645 - DNA, 20 bp, Artificial Sequence
  chemically synthesized
agagtctcactgttttgtcc

SEQ ID NO: 410646 - DNA, 20 bp, Artificial Sequence
  chemically synthesized
gcactccagcctggacaaaa

SEQ ID NO: 410647 - DNA, 20 bp, Artificial Sequence
  chemically synthesized
cagagtctcactgttttgtc

SEQ ID NO: 410648 - DNA, 20 bp, Artificial Sequence
  chemically synthesized
tccagcctggacaaaacagt

SEQ ID NO: 410649 - DNA, 20 bp, Artificial Sequence
  chemically synthesized
ttttttttttttttttgaca

SEQ ID NO: 410650 - DNA, 20 bp, Artificial Sequence
  chemically synthesized
ctttttttttttttttttga

SEQ ID NO: 410651 - DNA, 20 bp, Artificial Sequence
  chemically synthesized
ctgtcaaaaaaaaaaaaaaa

SEQ ID NO: 410652 - DNA, 20 bp, Artificial Sequence
  chemically synthesized
tgtcaaaaaaaaaaaaaaaa

SEQ ID NO: 410653 - DNA, 20 bp, Artificial Sequence
  chemically synthesized
caaaaaaaaaaaaaaaaagg

SEQ ID NO: 410654 - DNA, 20 bp, Artificial Sequence
  chemically synthesized
aaaaaaaaaaaaaaaaagga

SEQ ID NO: 410655 - DNA, 20 bp, Artificial Sequence
  chemically synthesized
aaaaaaaaaaaaaaggaagg

SEQ ID NO: 410656 - DNA, 20 bp, Artificial Sequence
  chemically synthesized
aaaaaaaaaaaaaggaagga

SEQ ID NO: 410657 - DNA, 20 bp, Artificial Sequence
  chemically synthesized
aaaaaaaaaaggaaggaagg

SEQ ID NO: 410658 - DNA, 20 bp, Artificial Sequence
  chemically synthesized
aaaaaaaaaggaaggaagga

SEQ ID NO: 410659 - DNA, 20 bp, Artificial Sequence
  chemically synthesized
aaaggaaggaaggaaggaaa

SEQ ID NO: 410660 - DNA, 20 bp, Artificial Sequence
  chemically synthesized
aaggaaggaaggaaaaagaa

SEQ ID NO: 410661 - DNA, 20 bp, Artificial Sequence
  chemically synthesized
aaggaaaaagaaaagaaaaa

SEQ ID NO: 410662 - DNA, 20 bp, Artificial Sequence
  chemically synthesized
aggaaaaagaaaagaaaaaa

SEQ ID NO: 410663 - DNA, 20 bp, Artificial Sequence
  chemically synthesized
aaaagaaaaaaaggaaacaa

SEQ ID NO: 410664 - DNA, 20 bp, Artificial Sequence
  chemically synthesized
aaaaaaggaaacaaaagtaa

SEQ ID NO: 410665 - DNA, 20 bp, Artificial Sequence
  chemically synthesized
caaaagtaatagactaatct

SEQ ID NO: 410666 - DNA, 20 bp, Artificial Sequence
  chemically synthesized
aaaagtaatagactaatctt

SEQ ID NO: 410667 - DNA, 20 bp, Artificial Sequence
  chemically synthesized
tccagccagcttcctaagat

SEQ ID NO: 410668 - DNA, 20 bp, Artificial Sequence
  chemically synthesized
agtaatagactaatcttagg

SEQ ID NO: 410669 - DNA, 20 bp, Artificial Sequence
  chemically synthesized
atagactaatcttaggaagc

SEQ ID NO: 410670 - DNA, 20 bp, Artificial Sequence
  chemically synthesized
tctactccagccagcttcct

SEQ ID NO: 410671 - DNA, 20 bp, Artificial Sequence
  chemically synthesized
actaatcttaggaagctggc

SEQ ID NO: 410672 - DNA, 20 bp, Artificial Sequence
  chemically synthesized
taatcttaggaagctggctg

SEQ ID NO: 410673 - DNA, 20 bp, Artificial Sequence
  chemically synthesized
tcttaggaagctggctggag

SEQ ID NO: 410674 - DNA, 20 bp, Artificial Sequence
  chemically synthesized
ctatgccattctactccagc

SEQ ID NO: 410675 - DNA, 20 bp, Artificial Sequence
  chemically synthesized
ggctctatgccattctactc

SEQ ID NO: 410676 - DNA, 20 bp, Artificial Sequence
  chemically synthesized
ggaagctggctggagtagaa

SEQ ID NO: 410677 - DNA, 20 bp, Artificial Sequence
  chemically synthesized
ctggctggagtagaatggca

SEQ ID NO: 410678 - DNA, 20 bp, Artificial Sequence
  chemically synthesized
ggctggagtagaatggcata

SEQ ID NO: 410679 - DNA, 20 bp, Artificial Sequence
  chemically synthesized
gaatggcatagagcccccaa

SEQ ID NO: 410680 - DNA, 20 bp, Artificial Sequence
  chemically synthesized
cacattgctggtaccgttgg

SEQ ID NO: 410681 - DNA, 20 bp, Artificial Sequence
  chemically synthesized
ccacattgctggtaccgttg

SEQ ID NO: 410682 - DNA, 20 bp, Artificial Sequence
  chemically synthesized
cccacattgctggtaccgtt

SEQ ID NO: 410683 - DNA, 20 bp, Artificial Sequence
  chemically synthesized
catagagcccccaacggtac

SEQ ID NO: 410684 - DNA, 20 bp, Artificial Sequence
  chemically synthesized
ccccacattgctggtaccgt

SEQ ID NO: 410685 - DNA, 20 bp, Artificial Sequence
  chemically synthesized
ccccaacggtaccagcaatg

SEQ ID NO: 410686 - DNA, 20 bp, Artificial Sequence
  chemically synthesized
cccaacggtaccagcaatgt

SEQ ID NO: 410687 - DNA, 20 bp, Artificial Sequence
  chemically synthesized
tcctacctaccccacattgc

SEQ ID NO: 410688 - DNA, 20 bp, Artificial Sequence
  chemically synthesized
ccaacggtaccagcaatgtg

SEQ ID NO: 410689 - DNA, 20 bp, Artificial Sequence
  chemically synthesized
acggtaccagcaatgtgggg

SEQ ID NO: 410690 - DNA, 20 bp, Artificial Sequence
  chemically synthesized
cggtaccagcaatgtggggt

SEQ ID NO: 410691 - DNA, 20 bp, Artificial Sequence
  chemically synthesized
taccagcaatgtggggtagg

SEQ ID NO: 410692 - DNA, 20 bp, Artificial Sequence
  chemically synthesized
accagcaatgtggggtaggt

SEQ ID NO: 410693 - DNA, 20 bp, Artificial Sequence
  chemically synthesized
aatgtggggtaggtaggact

SEQ ID NO: 410694 - DNA, 20 bp, Artificial Sequence
  chemically synthesized
ggtaggtaggactcagctcc

SEQ ID NO: 410695 - DNA, 20 bp, Artificial Sequence
  chemically synthesized
cataagaagatctaggagct

SEQ ID NO: 410696 - DNA, 20 bp, Artificial Sequence
  chemically synthesized
aggaccataagaagatctag

SEQ ID NO: 410697 - DNA, 20 bp, Artificial Sequence
  chemically synthesized
tgaggaccataagaagatct

SEQ ID NO: 410698 - DNA, 20 bp, Artificial Sequence
  chemically synthesized
ctgaggaccataagaagatc

SEQ ID NO: 410699 - DNA, 20 bp, Artificial Sequence
  chemically synthesized
tcagctcctagatcttctta

SEQ ID NO: 410700 - DNA, 20 bp, Artificial Sequence
  chemically synthesized
tatgtcctgaggaccataag

SEQ ID NO: 410701 - DNA, 20 bp, Artificial Sequence
  chemically synthesized
tcttatgtcctgaggaccat

SEQ ID NO: 410702 - DNA, 20 bp, Artificial Sequence
  chemically synthesized
ctagatcttcttatggtcct

SEQ ID NO: 410703 - DNA, 20 bp, Artificial Sequence
  chemically synthesized
tagatcttcttatggtcctc

SEQ ID NO: 410704 - DNA, 20 bp, Artificial Sequence
  chemically synthesized
agtgtgcttcttatgtcctg

SEQ ID NO: 410705 - DNA, 20 bp, Artificial Sequence
  chemically synthesized
tcttatggtcctcaggacat

SEQ ID NO: 410706 - DNA, 20 bp, Artificial Sequence
  chemically synthesized
tagtgtgcttcttatgtcct

SEQ ID NO: 410707 - DNA, 20 bp, Artificial Sequence
  chemically synthesized
tatggtcctcaggacataag

SEQ ID NO: 410708 - DNA, 20 bp, Artificial Sequence
  chemically synthesized
ggacataagaagcacactaa

SEQ ID NO: 410709 - DNA, 20 bp, Artificial Sequence
  chemically synthesized
gacataagaagcacactaaa

SEQ ID NO: 410710 - DNA, 20 bp, Artificial Sequence
  chemically synthesized
tctatcctctataggccttt

SEQ ID NO: 410711 - DNA, 20 bp, Artificial Sequence
  chemically synthesized
gaagcacactaaaaggccta

SEQ ID NO: 410712 - DNA, 20 bp, Artificial Sequence
  chemically synthesized
agcacactaaaaggcctata

SEQ ID NO: 410713 - DNA, 20 bp, Artificial Sequence
  chemically synthesized
gcacactaaaaggcctatag

SEQ ID NO: 410714 - DNA, 20 bp, Artificial Sequence
  chemically synthesized
gggcatcatctatcctctat

SEQ ID NO: 410715 - DNA, 20 bp, Artificial Sequence
  chemically synthesized
actaaaaggcctatagagga

SEQ ID NO: 410716 - DNA, 20 bp, Artificial Sequence
  chemically synthesized
tgggcatcatctatcctcta

SEQ ID NO: 410717 - DNA, 20 bp, Artificial Sequence
  chemically synthesized
gcagaattaaaggtttaaat

SEQ ID NO: 410718 - DNA, 20 bp, Artificial Sequence
  chemically synthesized
ggcagaattaaaggtttaaa

SEQ ID NO: 410719 - DNA, 20 bp, Artificial Sequence
  chemically synthesized
agaactttaggcagaattaa

SEQ ID NO: 410720 - DNA, 20 bp, Artificial Sequence
  chemically synthesized
cagaactttaggcagaatta

SEQ ID NO: 410721 - DNA, 20 bp, Artificial Sequence
  chemically synthesized
taaacctttaattctgccta

SEQ ID NO: 410722 - DNA, 20 bp, Artificial Sequence
  chemically synthesized
aaacctggcagaactttagg

SEQ ID NO: 410723 - DNA, 20 bp, Artificial Sequence
  chemically synthesized
cataaacctggcagaacttt

SEQ ID NO: 410724 - DNA, 20 bp, Artificial Sequence
  chemically synthesized
acataaacctggcagaactt

SEQ ID NO: 410725 - DNA, 20 bp, Artificial Sequence
  chemically synthesized
aattctgcctaaagttctgc

SEQ ID NO: 410726 - DNA, 20 bp, Artificial Sequence
  chemically synthesized
attctgcctaaagttctgcc

SEQ ID NO: 410727 - DNA, 20 bp, Artificial Sequence
  chemically synthesized
atgcccgtacataaacctgg

SEQ ID NO: 410728 - DNA, 20 bp, Artificial Sequence
  chemically synthesized
actatgcccgtacataaacc

SEQ ID NO: 410729 - DNA, 20 bp, Artificial Sequence
  chemically synthesized
agttctgccaggtttatgta

SEQ ID NO: 410730 - DNA, 20 bp, Artificial Sequence
  chemically synthesized
gttctgccaggtttatgtac

SEQ ID NO: 410731 - DNA, 20 bp, Artificial Sequence
  chemically synthesized
gccaggtttatgtacgggca

SEQ ID NO: 410732 - DNA, 20 bp, Artificial Sequence
  chemically synthesized
gtacgggcatagtgcacata

SEQ ID NO: 410733 - DNA, 20 bp, Artificial Sequence
  chemically synthesized
agtgcacataaagcatgcat

SEQ ID NO: 410734 - DNA, 20 bp, Artificial Sequence
  chemically synthesized
catattttttgccttgcctt

SEQ ID NO: 410735 - DNA, 20 bp, Artificial Sequence
  chemically synthesized
acctggaaaaactaaaggca

SEQ ID NO: 410736 - DNA, 20 bp, Artificial Sequence
  chemically synthesized
aacctggaaaaactaaaggc

SEQ ID NO: 410737 - DNA, 20 bp, Artificial Sequence
  chemically synthesized
tgaaaacctggaaaaactaa

SEQ ID NO: 410738 - DNA, 20 bp, Artificial Sequence
  chemically synthesized
atgaaaacctggaaaaacta

SEQ ID NO: 410739 - DNA, 20 bp, Artificial Sequence
  chemically synthesized
tgccttgcctttagtttttc

SEQ ID NO: 410740 - DNA, 20 bp, Artificial Sequence
  chemically synthesized
gccttgcctttagtttttcc

SEQ ID NO: 410741 - DNA, 20 bp, Artificial Sequence
  chemically synthesized
gtgttaatatcatgaaaacc

SEQ ID NO: 410742 - DNA, 20 bp, Artificial Sequence
  chemically synthesized
cataactctgacataatcgt

SEQ ID NO: 410743 - DNA, 20 bp, Artificial Sequence
  chemically synthesized
attaacaccaacgattatgt

SEQ ID NO: 410744 - DNA, 20 bp, Artificial Sequence
  chemically synthesized
taacaccaacgattatgtca

SEQ ID NO: 410745 - DNA, 20 bp, Artificial Sequence
  chemically synthesized
tctcccattgagaaaaaaca

SEQ ID NO: 410746 - DNA, 20 bp, Artificial Sequence
  chemically synthesized
tatgctttgttttttctcaa

SEQ ID NO: 410747 - DNA, 20 bp, Artificial Sequence
  chemically synthesized
atgctttgttttttctcaat

SEQ ID NO: 410748 - DNA, 20 bp, Artificial Sequence
  chemically synthesized
gctttgttttttctcaatgg

SEQ ID NO: 410749 - DNA, 20 bp, Artificial Sequence
  chemically synthesized
atgcttggatttctcccatt

SEQ ID NO: 410750 - DNA, 20 bp, Artificial Sequence
  chemically synthesized
tttctcaatgggagaaatcc

SEQ ID NO: 410751 - DNA, 20 bp, Artificial Sequence
  chemically synthesized
caatgggagaaatccaagca

SEQ ID NO: 410752 - DNA, 20 bp, Artificial Sequence
  chemically synthesized
aatgggagaaatccaagcat

SEQ ID NO: 410753 - DNA, 20 bp, Artificial Sequence
  chemically synthesized
ttctttagggggcctatgct

SEQ ID NO: 410754 - DNA, 20 bp, Artificial Sequence
  chemically synthesized
atccaagcataggcccccta

SEQ ID NO: 410755 - DNA, 20 bp, Artificial Sequence
  chemically synthesized
tttacatttcattctttagg

SEQ ID NO: 410756 - DNA, 20 bp, Artificial Sequence
  chemically synthesized
ttttacatttcattctttag

SEQ ID NO: 410757 - DNA, 20 bp, Artificial Sequence
  chemically synthesized
gttttacatttcattcttta

SEQ ID NO: 410758 - DNA, 20 bp, Artificial Sequence
  chemically synthesized
tgttttacatttcattcttt

SEQ ID NO: 410759 - DNA, 20 bp, Artificial Sequence
  chemically synthesized
ttgttttacatttcattctt

SEQ ID NO: 410760 - DNA, 20 bp, Artificial Sequence
  chemically synthesized
cttctggttgtatcaggcag

SEQ ID NO: 410761 - DNA, 20 bp, Artificial Sequence
  chemically synthesized
tccttctggttgtatcaggc

SEQ ID NO: 410762 - DNA, 20 bp, Artificial Sequence
  chemically synthesized
ttccttctggttgtatcagg

SEQ ID NO: 410763 - DNA, 20 bp, Artificial Sequence
  chemically synthesized
atcttccttctggttgtatc

SEQ ID NO: 410764 - DNA, 20 bp, Artificial Sequence
  chemically synthesized
tgactcctgcctgatacaac

SEQ ID NO: 410765 - DNA, 20 bp, Artificial Sequence
  chemically synthesized
aatcttccttctggttgtat

SEQ ID NO: 410766 - DNA, 20 bp, Artificial Sequence
  chemically synthesized
ctcctgcctgatacaaccag

SEQ ID NO: 410767 - DNA, 20 bp, Artificial Sequence
  chemically synthesized
tcctgcctgatacaaccaga

SEQ ID NO: 410768 - DNA, 20 bp, Artificial Sequence
  chemically synthesized
tgcctgatacaaccagaagg

SEQ ID NO: 410769 - DNA, 20 bp, Artificial Sequence
  chemically synthesized
tgtattgtcaatcttccttc

SEQ ID NO: 410770 - DNA, 20 bp, Artificial Sequence
  chemically synthesized
gattgacaatacaacatgaa

SEQ ID NO: 410771 - DNA, 20 bp, Artificial Sequence
  chemically synthesized
caatacaacatgaaaagtca

SEQ ID NO: 410772 - DNA, 20 bp, Artificial Sequence
  chemically synthesized
atacaacatgaaaagtcacg

SEQ ID NO: 410773 - DNA, 20 bp, Artificial Sequence
  chemically synthesized
ggagtaaattattttcatac

SEQ ID NO: 410774 - DNA, 20 bp, Artificial Sequence
  chemically synthesized
gtaaattattttcatacaag

SEQ ID NO: 410775 - DNA, 20 bp, Artificial Sequence
  chemically synthesized
aaattattttcatacaagtg

SEQ ID NO: 410776 - DNA, 20 bp, Artificial Sequence
  chemically synthesized
acaagtggagaaattatttt

SEQ ID NO: 410777 - DNA, 20 bp, Artificial Sequence
  chemically synthesized
caagtggagaaattattttc

SEQ ID NO: 410778 - DNA, 20 bp, Artificial Sequence
  chemically synthesized
aagtggagaaattattttca

SEQ ID NO: 410779 - DNA, 20 bp, Artificial Sequence
  chemically synthesized
aattattttcagggaattcg

SEQ ID NO: 410780 - DNA, 20 bp, Artificial Sequence
  chemically synthesized
tcagggaattcgtagaccga

SEQ ID NO: 410781 - DNA, 20 bp, Artificial Sequence
  chemically synthesized
gatggcctgtgaatagctgt

SEQ ID NO: 410782 - DNA, 20 bp, Artificial Sequence
  chemically synthesized
cgtagaccgacagctattca

SEQ ID NO: 410783 - DNA, 20 bp, Artificial Sequence
  chemically synthesized
gtagaccgacagctattcac

SEQ ID NO: 410784 - DNA, 20 bp, Artificial Sequence
  chemically synthesized
ggtgtttgatggcctgtgaa

SEQ ID NO: 410785 - DNA, 20 bp, Artificial Sequence
  chemically synthesized
aggtccttatgggtgtttga

SEQ ID NO: 410786 - DNA, 20 bp, Artificial Sequence
  chemically synthesized
acaggccatcaaacacccat

SEQ ID NO: 410787 - DNA, 20 bp, Artificial Sequence
  chemically synthesized
caggccatcaaacacccata

SEQ ID NO: 410788 - DNA, 20 bp, Artificial Sequence
  chemically synthesized
aggatgacaaaggtccttat

SEQ ID NO: 410789 - DNA, 20 bp, Artificial Sequence
  chemically synthesized
aaggatgacaaaggtcctta

SEQ ID NO: 410790 - DNA, 20 bp, Artificial Sequence
  chemically synthesized
aagtgattgaaggatgacaa

SEQ ID NO: 410791 - DNA, 20 bp, Artificial Sequence
  chemically synthesized
gaagtgattgaaggatgaca

SEQ ID NO: 410792 - DNA, 20 bp, Artificial Sequence
  chemically synthesized
ctctctactgaagtgattga

SEQ ID NO: 410793 - DNA, 20 bp, Artificial Sequence
  chemically synthesized
tctctctactgaagtgattg

SEQ ID NO: 410794 - DNA, 20 bp, Artificial Sequence
  chemically synthesized
ttgtcatccttcaatcactt

SEQ ID NO: 410795 - DNA, 20 bp, Artificial Sequence
  chemically synthesized
tcatccttcaatcacttcag

SEQ ID NO: 410796 - DNA, 20 bp, Artificial Sequence
  chemically synthesized
atccttcaatcacttcagta

SEQ ID NO: 410797 - DNA, 20 bp, Artificial Sequence
  chemically synthesized
ccttcaatcacttcagtaga

SEQ ID NO: 410798 - DNA, 20 bp, Artificial Sequence
  chemically synthesized
tacatgttctctctctactg

SEQ ID NO: 410799 - DNA, 20 bp, Artificial Sequence
  chemically synthesized
ttcaatcacttcagtagaga

SEQ ID NO: 410800 - DNA, 20 bp, Artificial Sequence
  chemically synthesized
tagagagagaacatgtatga

SEQ ID NO: 410801 - DNA, 20 bp, Artificial Sequence
  chemically synthesized
gagagagaacatgtatgaaa

SEQ ID NO: 410802 - DNA, 20 bp, Artificial Sequence
  chemically synthesized
gagaacatgtatgaaagaga

SEQ ID NO: 410803 - DNA, 20 bp, Artificial Sequence
  chemically synthesized
tatgaaagagacagaaaaca

SEQ ID NO: 410804 - DNA, 20 bp, Artificial Sequence
  chemically synthesized
gacagaaaacacagttaaat

SEQ ID NO: 410805 - DNA, 20 bp, Artificial Sequence
  chemically synthesized
ttaaataagcaattcctgtt

SEQ ID NO: 410806 - DNA, 20 bp, Artificial Sequence
  chemically synthesized
ataagcaattcctgttcagt

SEQ ID NO: 410807 - DNA, 20 bp, Artificial Sequence
  chemically synthesized
cctgcagacacttactgaac

SEQ ID NO: 410808 - DNA, 20 bp, Artificial Sequence
  chemically synthesized
ccctgcagacacttactgaa

SEQ ID NO: 410809 - DNA, 20 bp, Artificial Sequence
  chemically synthesized
tcctgttcagtaagtgtctg

SEQ ID NO: 410810 - DNA, 20 bp, Artificial Sequence
  chemically synthesized
cctgttcagtaagtgtctgc

SEQ ID NO: 410811 - DNA, 20 bp, Artificial Sequence
  chemically synthesized
ctgttcagtaagtgtctgca

SEQ ID NO: 410812 - DNA, 20 bp, Artificial Sequence
  chemically synthesized
gttcagtaagtgtctgcagg

SEQ ID NO: 410813 - DNA, 20 bp, Artificial Sequence
  chemically synthesized
acactctgaaaaactccctg

SEQ ID NO: 410814 - DNA, 20 bp, Artificial Sequence
  chemically synthesized
agtgtctgcagggagttttt

SEQ ID NO: 410815 - DNA, 20 bp, Artificial Sequence
  chemically synthesized
tgtctgcagggagtttttca

SEQ ID NO: 410816 - DNA, 20 bp, Artificial Sequence
  chemically synthesized
ggagtttttcagagtgtgta

SEQ ID NO: 410817 - DNA, 20 bp, Artificial Sequence
  chemically synthesized
acgcacttgtaggatcgagt

SEQ ID NO: 410818 - DNA, 20 bp, Artificial Sequence
  chemically synthesized
cacgcacttgtaggatcgag

SEQ ID NO: 410819 - DNA, 20 bp, Artificial Sequence
  chemically synthesized
aaccacgcacttgtaggatc

SEQ ID NO: 410820 - DNA, 20 bp, Artificial Sequence
  chemically synthesized
gtatacctactcgatcctac

SEQ ID NO: 410821 - DNA, 20 bp, Artificial Sequence
  chemically synthesized
gttcagaaccacgcacttgt

SEQ ID NO: 410822 - DNA, 20 bp, Artificial Sequence
  chemically synthesized
tgttcagaaccacgcacttg

SEQ ID NO: 410823 - DNA, 20 bp, Artificial Sequence
  chemically synthesized
tactcgatcctacaagtgcg

SEQ ID NO: 410824 - DNA, 20 bp, Artificial Sequence
  chemically synthesized
tacaagtgcgtggttctgaa

SEQ ID NO: 410825 - DNA, 20 bp, Artificial Sequence
  chemically synthesized
aagtgcgtggttctgaacag

SEQ ID NO: 410826 - DNA, 20 bp, Artificial Sequence
  chemically synthesized
acttcaaatttgcttctgtt

SEQ ID NO: 410827 - DNA, 20 bp, Artificial Sequence
  chemically synthesized
tctgaacagaagcaaatttg

SEQ ID NO: 410828 - DNA, 20 bp, Artificial Sequence
  chemically synthesized
ttgaagtattaataacaatg

SEQ ID NO: 410829 - DNA, 20 bp, Artificial Sequence
  chemically synthesized
agtattaataacaatgaaga

SEQ ID NO: 410830 - DNA, 20 bp, Artificial Sequence
  chemically synthesized
aataacaatgaagatggaaa
